United States Patent 11,421,016 (CANCER NEOEPITOPES) - sequence listing, part 18

SEQ ID NO: 787127 - protein, 9 aa, Homo Sapiens
GPAVIPGPS

SEQ ID NO: 787128 - protein, 9 aa, Homo Sapiens
VQDALVLLL

SEQ ID NO: 787129 - protein, 9 aa, Homo Sapiens
DSGHFNIDN

SEQ ID NO: 787130 - protein, 9 aa, Homo Sapiens
KFYPEAVSE

SEQ ID NO: 787131 - protein, 9 aa, Homo Sapiens
IIPAYFEAK

SEQ ID NO: 787132 - protein, 9 aa, Homo Sapiens
SSVRVVGLG

SEQ ID NO: 787133 - protein, 9 aa, Homo Sapiens
PARFFSSQI

SEQ ID NO: 787134 - protein, 9 aa, Homo Sapiens
ALKATDKMY

SEQ ID NO: 787135 - protein, 9 aa, Homo Sapiens
RDVGLPPDN

SEQ ID NO: 787136 - protein, 9 aa, Homo Sapiens
VFFKNRKPR

SEQ ID NO: 787137 - protein, 9 aa, Homo Sapiens
GWNNDIPIC

SEQ ID NO: 787138 - protein, 9 aa, Homo Sapiens
PTPGAIDSN

SEQ ID NO: 787139 - protein, 9 aa, Homo Sapiens
VPAARRDGL

SEQ ID NO: 787140 - protein, 9 aa, Homo Sapiens
HRYSAVLDA

SEQ ID NO: 787141 - protein, 9 aa, Homo Sapiens
SGILHCTAN

SEQ ID NO: 787142 - protein, 9 aa, Homo Sapiens
VPEGLLAAV

SEQ ID NO: 787143 - protein, 9 aa, Homo Sapiens
YGNPGVANA

SEQ ID NO: 787144 - protein, 9 aa, Homo Sapiens
HGLALRLHL

SEQ ID NO: 787145 - protein, 9 aa, Homo Sapiens
GTPCWMGPE

SEQ ID NO: 787146 - protein, 9 aa, Homo Sapiens
GVGLHGGLG

SEQ ID NO: 787147 - protein, 9 aa, Homo Sapiens
EAVSEELIQ

SEQ ID NO: 787148 - protein, 9 aa, Homo Sapiens
STNKEEKDE

SEQ ID NO: 787149 - protein, 9 aa, Homo Sapiens
YLTEALKAT

SEQ ID NO: 787150 - protein, 9 aa, Homo Sapiens
GYPKKPHTP

SEQ ID NO: 787151 - protein, 9 aa, Homo Sapiens
FRKSHRSLN

SEQ ID NO: 787152 - protein, 9 aa, Homo Sapiens
AGEQYRGMV

SEQ ID NO: 787153 - protein, 9 aa, Homo Sapiens
RVISRIFDS

SEQ ID NO: 787154 - protein, 9 aa, Homo Sapiens
VNPFMWTWN

SEQ ID NO: 787155 - protein, 9 aa, Homo Sapiens
LQRPGQVLD

SEQ ID NO: 787156 - protein, 9 aa, Homo Sapiens
RKSNSMVDV

SEQ ID NO: 787157 - protein, 9 aa, Homo Sapiens
WSARSESAQ

SEQ ID NO: 787158 - protein, 9 aa, Homo Sapiens
YVSQSIPCS

SEQ ID NO: 787159 - protein, 9 aa, Homo Sapiens
YHIGDRVLI

SEQ ID NO: 787160 - protein, 9 aa, Homo Sapiens
IFQTFDLFL

SEQ ID NO: 787161 - protein, 9 aa, Homo Sapiens
TLQRKSSNM

SEQ ID NO: 787162 - protein, 9 aa, Homo Sapiens
GENQRGHSF

SEQ ID NO: 787163 - protein, 9 aa, Homo Sapiens
DSKRLRRSR

SEQ ID NO: 787164 - protein, 9 aa, Homo Sapiens
SGADGLVGQ

SEQ ID NO: 787165 - protein, 9 aa, Homo Sapiens
GSAAKLQHY

SEQ ID NO: 787166 - protein, 9 aa, Homo Sapiens
LLLAHELDV

SEQ ID NO: 787167 - protein, 9 aa, Homo Sapiens
RSCGQQGHE

SEQ ID NO: 787168 - protein, 9 aa, Homo Sapiens
EQGLCDLVL

SEQ ID NO: 787169 - protein, 9 aa, Homo Sapiens
SPRGENQRG

SEQ ID NO: 787170 - protein, 9 aa, Homo Sapiens
SPASASSAG

SEQ ID NO: 787171 - protein, 9 aa, Homo Sapiens
LVRARSAAS

SEQ ID NO: 787172 - protein, 9 aa, Homo Sapiens
LCDLVLCEA

SEQ ID NO: 787173 - protein, 9 aa, Homo Sapiens
AAKLQHYYC

SEQ ID NO: 787174 - protein, 9 aa, Homo Sapiens
MVSKTRKGV

SEQ ID NO: 787175 - protein, 9 aa, Homo Sapiens
LLRLAQRLL

SEQ ID NO: 787176 - protein, 9 aa, Homo Sapiens
LAFERVYIA

SEQ ID NO: 787177 - protein, 9 aa, Homo Sapiens
VRLLLAHEL

SEQ ID NO: 787178 - protein, 9 aa, Homo Sapiens
HLSNLIFQT

SEQ ID NO: 787179 - protein, 9 aa, Homo Sapiens
SAPYQHLLE

SEQ ID NO: 787180 - protein, 9 aa, Homo Sapiens
MSCQKSSSL

SEQ ID NO: 787181 - protein, 9 aa, Homo Sapiens
CKCIRPFLP

SEQ ID NO: 787182 - protein, 9 aa, Homo Sapiens
SWRATSEED

SEQ ID NO: 787183 - protein, 9 aa, Homo Sapiens
DNMLIQMKT

SEQ ID NO: 787184 - protein, 9 aa, Homo Sapiens
LQTSGPIFN

SEQ ID NO: 787185 - protein, 9 aa, Homo Sapiens
RAKFYPEAV

SEQ ID NO: 787186 - protein, 9 aa, Homo Sapiens
LGVGLHGGL

SEQ ID NO: 787187 - protein, 9 aa, Homo Sapiens
EFEGSESLS

SEQ ID NO: 787188 - protein, 9 aa, Homo Sapiens
LLLLLDAVL

SEQ ID NO: 787189 - protein, 9 aa, Homo Sapiens
GAPEHVYSP

SEQ ID NO: 787190 - protein, 9 aa, Homo Sapiens
QVCGAGLAA

SEQ ID NO: 787191 - protein, 9 aa, Homo Sapiens
CINAISPGE

SEQ ID NO: 787192 - protein, 9 aa, Homo Sapiens
LQATLWGEA

SEQ ID NO: 787193 - protein, 9 aa, Homo Sapiens
PWSVVWGQE

SEQ ID NO: 787194 - protein, 9 aa, Homo Sapiens
GVLGAGFAI

SEQ ID NO: 787195 - protein, 9 aa, Homo Sapiens
LCDVCSFMS

SEQ ID NO: 787196 - protein, 9 aa, Homo Sapiens
EGSESLSSG

SEQ ID NO: 787197 - protein, 9 aa, Homo Sapiens
KVLAETEPK

SEQ ID NO: 787198 - protein, 9 aa, Homo Sapiens
QLSTALGGV

SEQ ID NO: 787199 - protein, 9 aa, Homo Sapiens
PEEKEDPKE

SEQ ID NO: 787200 - protein, 9 aa, Homo Sapiens
TLETIYNEE

SEQ ID NO: 787201 - protein, 9 aa, Homo Sapiens
VLALKVALL

SEQ ID NO: 787202 - protein, 9 aa, Homo Sapiens
CSDSGLGDQ

SEQ ID NO: 787203 - protein, 9 aa, Homo Sapiens
AFERVYIAN

SEQ ID NO: 787204 - protein, 9 aa, Homo Sapiens
GLYSSIYCS

SEQ ID NO: 787205 - protein, 9 aa, Homo Sapiens
AATPCINAI

SEQ ID NO: 787206 - protein, 9 aa, Homo Sapiens
GCGRGYIAH

SEQ ID NO: 787207 - protein, 9 aa, Homo Sapiens
AVTVCLTLT

SEQ ID NO: 787208 - protein, 9 aa, Homo Sapiens
RPGQVLDDG

SEQ ID NO: 787209 - protein, 9 aa, Homo Sapiens
RGKIIPAYF

SEQ ID NO: 787210 - protein, 9 aa, Homo Sapiens
SKENLESIV

SEQ ID NO: 787211 - protein, 9 aa, Homo Sapiens
NVDHRRKSN

SEQ ID NO: 787212 - protein, 9 aa, Homo Sapiens
FLKLAWWTS

SEQ ID NO: 787213 - protein, 9 aa, Homo Sapiens
HVYSPMSGG

SEQ ID NO: 787214 - protein, 9 aa, Homo Sapiens
LGLGLALLL

SEQ ID NO: 787215 - protein, 9 aa, Homo Sapiens
CETHRYSAV

SEQ ID NO: 787216 - protein, 9 aa, Homo Sapiens
RHLASIFDF

SEQ ID NO: 787217 - protein, 9 aa, Homo Sapiens
RLECLQRIL

SEQ ID NO: 787218 - protein, 9 aa, Homo Sapiens
IPAYFEAKI

SEQ ID NO: 787219 - protein, 9 aa, Homo Sapiens
VDPDDIITN

SEQ ID NO: 787220 - protein, 9 aa, Homo Sapiens
AVLVSDALA

SEQ ID NO: 787221 - protein, 9 aa, Homo Sapiens
TALLSFGFS

SEQ ID NO: 787222 - protein, 9 aa, Homo Sapiens
IIGGDVQIT

SEQ ID NO: 787223 - protein, 9 aa, Homo Sapiens
GGVWVLLLV

SEQ ID NO: 787224 - protein, 9 aa, Homo Sapiens
NQVMDGYRM

SEQ ID NO: 787225 - protein, 9 aa, Homo Sapiens
LTEALKATD

SEQ ID NO: 787226 - protein, 9 aa, Homo Sapiens
SHSFPNFHY

SEQ ID NO: 787227 - protein, 9 aa, Homo Sapiens
SDALAHGLA

SEQ ID NO: 787228 - protein, 9 aa, Homo Sapiens
DTDGWNNDI

SEQ ID NO: 787229 - protein, 9 aa, Homo Sapiens
PPGPPGPAV

SEQ ID NO: 787230 - protein, 9 aa, Homo Sapiens
WSVVWGQEG

SEQ ID NO: 787231 - protein, 9 aa, Homo Sapiens
AGTKHIRYL

SEQ ID NO: 787232 - protein, 9 aa, Homo Sapiens
PLPLVTARL

SEQ ID NO: 787233 - protein, 9 aa, Homo Sapiens
ADGLVGQDG

SEQ ID NO: 787234 - protein, 9 aa, Homo Sapiens
QAQQQQQHP

SEQ ID NO: 787235 - protein, 9 aa, Homo Sapiens
CEMLPLLKL

SEQ ID NO: 787236 - protein, 9 aa, Homo Sapiens
LLRAALGVG

SEQ ID NO: 787237 - protein, 9 aa, Homo Sapiens
RESLTLESS

SEQ ID NO: 787238 - protein, 9 aa, Homo Sapiens
GRGYIAHYL

SEQ ID NO: 787239 - protein, 9 aa, Homo Sapiens
LVTARLRGV

SEQ ID NO: 787240 - protein, 9 aa, Homo Sapiens
EKEDPKEVP

SEQ ID NO: 787241 - protein, 9 aa, Homo Sapiens
LVLLEAQAD

SEQ ID NO: 787242 - protein, 9 aa, Homo Sapiens
SRDSKRLRR

SEQ ID NO: 787243 - protein, 9 aa, Homo Sapiens
ELAKGACPR

SEQ ID NO: 787244 - protein, 9 aa, Homo Sapiens
EEKEDPKEV

SEQ ID NO: 787245 - protein, 9 aa, Homo Sapiens
PMRGGPGAG

SEQ ID NO: 787246 - protein, 9 aa, Homo Sapiens
QTRPEHPVY

SEQ ID NO: 787247 - protein, 9 aa, Homo Sapiens
KASGSQNEG

SEQ ID NO: 787248 - protein, 9 aa, Homo Sapiens
APWVPAIPH

SEQ ID NO: 787249 - protein, 9 aa, Homo Sapiens
LTKLQMEAG

SEQ ID NO: 787250 - protein, 9 aa, Homo Sapiens
HGAIMAGLI

SEQ ID NO: 787251 - protein, 9 aa, Homo Sapiens
PEHVYSPMS

SEQ ID NO: 787252 - protein, 9 aa, Homo Sapiens
GLEAQAACS

SEQ ID NO: 787253 - protein, 9 aa, Homo Sapiens
VADFLKLAW

SEQ ID NO: 787254 - protein, 9 aa, Homo Sapiens
HGQSEKHLP

SEQ ID NO: 787255 - protein, 9 aa, Homo Sapiens
TVLLTRGLK

SEQ ID NO: 787256 - protein, 9 aa, Homo Sapiens
HGGLGLGLA

SEQ ID NO: 787257 - protein, 9 aa, Homo Sapiens
PGPAVIPGP

SEQ ID NO: 787258 - protein, 9 aa, Homo Sapiens
MLAPSIPRD

SEQ ID NO: 787259 - protein, 9 aa, Homo Sapiens
QHLPHVLGG

SEQ ID NO: 787260 - protein, 9 aa, Homo Sapiens
YETFSDDPT

SEQ ID NO: 787261 - protein, 9 aa, Homo Sapiens
PAYFEAKIL

SEQ ID NO: 787262 - protein, 9 aa, Homo Sapiens
VSSVRVVGL

SEQ ID NO: 787263 - protein, 9 aa, Homo Sapiens
CGRGYIAHY

SEQ ID NO: 787264 - protein, 9 aa, Homo Sapiens
SPPARFFSS

SEQ ID NO: 787265 - protein, 9 aa, Homo Sapiens
LRLKGQITI

SEQ ID NO: 787266 - protein, 9 aa, Homo Sapiens
LHLGVLGLA

SEQ ID NO: 787267 - protein, 9 aa, Homo Sapiens
LIFQTFDLF

SEQ ID NO: 787268 - protein, 9 aa, Homo Sapiens
LKGKLLRGI

SEQ ID NO: 787269 - protein, 9 aa, Homo Sapiens
LVCETHRYS

SEQ ID NO: 787270 - protein, 9 aa, Homo Sapiens
PGEEEDKEC

SEQ ID NO: 787271 - protein, 9 aa, Homo Sapiens
VQEVQAVHL

SEQ ID NO: 787272 - protein, 9 aa, Homo Sapiens
LGVLGLALL

SEQ ID NO: 787273 - protein, 9 aa, Homo Sapiens
KQLCYECST

SEQ ID NO: 787274 - protein, 9 aa, Homo Sapiens
LPLLLLLGG

SEQ ID NO: 787275 - protein, 9 aa, Homo Sapiens
VIITIQVPQ

SEQ ID NO: 787276 - protein, 9 aa, Homo Sapiens
QRGHSFLIN

SEQ ID NO: 787277 - protein, 9 aa, Homo Sapiens
LGDQEPVGS

SEQ ID NO: 787278 - protein, 9 aa, Homo Sapiens
YRMPIGQFW

SEQ ID NO: 787279 - protein, 9 aa, Homo Sapiens
RVYIANQNC

SEQ ID NO: 787280 - protein, 9 aa, Homo Sapiens
HLVPAARRD

SEQ ID NO: 787281 - protein, 9 aa, Homo Sapiens
VFRKSHRSL

SEQ ID NO: 787282 - protein, 9 aa, Homo Sapiens
PLRKPRNAQ

SEQ ID NO: 787283 - protein, 9 aa, Homo Sapiens
GPPGPAVIP

SEQ ID NO: 787284 - protein, 9 aa, Homo Sapiens
QAEAPEDAP

SEQ ID NO: 787285 - protein, 9 aa, Homo Sapiens
VICWILSIG

SEQ ID NO: 787286 - protein, 9 aa, Homo Sapiens
HLPHVLGGP

SEQ ID NO: 787287 - protein, 9 aa, Homo Sapiens
LGVGRDVIV

SEQ ID NO: 787288 - protein, 9 aa, Homo Sapiens
NVPEGLLAA

SEQ ID NO: 787289 - protein, 9 aa, Homo Sapiens
SCGQQGHED

SEQ ID NO: 787290 - protein, 9 aa, Homo Sapiens
LLHLVPAAR

SEQ ID NO: 787291 - protein, 9 aa, Homo Sapiens
VCETHRYSA

SEQ ID NO: 787292 - protein, 9 aa, Homo Sapiens
CLQRILTKL

SEQ ID NO: 787293 - protein, 9 aa, Homo Sapiens
VEWSARSES

SEQ ID NO: 787294 - protein, 9 aa, Homo Sapiens
LEDMTVHLL

SEQ ID NO: 787295 - protein, 9 aa, Homo Sapiens
FKQLCYECS

SEQ ID NO: 787296 - protein, 9 aa, Homo Sapiens
GPEVMEQVR

SEQ ID NO: 787297 - protein, 9 aa, Homo Sapiens
RKSHRSLNS

SEQ ID NO: 787298 - protein, 9 aa, Homo Sapiens
DSPLRTLQR

SEQ ID NO: 787299 - protein, 9 aa, Homo Sapiens
DCMEATPEE

SEQ ID NO: 787300 - protein, 9 aa, Homo Sapiens
RVFRKSHRS

SEQ ID NO: 787301 - protein, 9 aa, Homo Sapiens
LLLRLAQRL

SEQ ID NO: 787302 - protein, 9 aa, Homo Sapiens
GILHCTANI

SEQ ID NO: 787303 - protein, 9 aa, Homo Sapiens
LPPQPRKAA

SEQ ID NO: 787304 - protein, 9 aa, Homo Sapiens
DQRPGQSLS

SEQ ID NO: 787305 - protein, 9 aa, Homo Sapiens
LPLVTARLR

SEQ ID NO: 787306 - protein, 9 aa, Homo Sapiens
TCHPSPEKL

SEQ ID NO: 787307 - protein, 9 aa, Homo Sapiens
SGLGDQEPV

SEQ ID NO: 787308 - protein, 9 aa, Homo Sapiens
ALLSFGFSL

SEQ ID NO: 787309 - protein, 9 aa, Homo Sapiens
VDHRRKSNS

SEQ ID NO: 787310 - protein, 9 aa, Homo Sapiens
DVQITKHLF

SEQ ID NO: 787311 - protein, 9 aa, Homo Sapiens
LSKKSVIKT

SEQ ID NO: 787312 - protein, 9 aa, Homo Sapiens
GLPPDNAST

SEQ ID NO: 787313 - protein, 9 aa, Homo Sapiens
PRKEHLYHL

SEQ ID NO: 787314 - protein, 9 aa, Homo Sapiens
PLGLEAQAA

SEQ ID NO: 787315 - protein, 9 aa, Homo Sapiens
TSPLTVEWS

SEQ ID NO: 787316 - protein, 9 aa, Homo Sapiens
VERLYGMVQ

SEQ ID NO: 787317 - protein, 9 aa, Homo Sapiens
PPRPDLPLR

SEQ ID NO: 787318 - protein, 9 aa, Homo Sapiens
KLQHYYCWP

SEQ ID NO: 787319 - protein, 9 aa, Homo Sapiens
DSGLGDQEP

SEQ ID NO: 787320 - protein, 9 aa, Homo Sapiens
RATDQRPGQ

SEQ ID NO: 787321 - protein, 9 aa, Homo Sapiens
VIKTERING

SEQ ID NO: 787322 - protein, 9 aa, Homo Sapiens
VYLRLKGQI

SEQ ID NO: 787323 - protein, 9 aa, Homo Sapiens
QTCSTQTHN

SEQ ID NO: 787324 - protein, 9 aa, Homo Sapiens
PLRTLQRKS

SEQ ID NO: 787325 - protein, 9 aa, Homo Sapiens
STTFCSSPR

SEQ ID NO: 787326 - protein, 9 aa, Homo Sapiens
KEQRKIPLV

SEQ ID NO: 787327 - protein, 9 aa, Homo Sapiens
PRLLSPTYA

SEQ ID NO: 787328 - protein, 9 aa, Homo Sapiens
LYALVCETH

SEQ ID NO: 787329 - protein, 9 aa, Homo Sapiens
EASIYVCRV

SEQ ID NO: 787330 - protein, 9 aa, Homo Sapiens
KFASLQPVS

SEQ ID NO: 787331 - protein, 9 aa, Homo Sapiens
TDKMYLSNN

SEQ ID NO: 787332 - protein, 9 aa, Homo Sapiens
PFMWTWNTA

SEQ ID NO: 787333 - protein, 9 aa, Homo Sapiens
ACEVKFTKM

SEQ ID NO: 787334 - protein, 9 aa, Homo Sapiens
TGGGRVISR

SEQ ID NO: 787335 - protein, 9 aa, Homo Sapiens
HPVYLCLDS

SEQ ID NO: 787336 - protein, 9 aa, Homo Sapiens
LWGEADCYV

SEQ ID NO: 787337 - protein, 9 aa, Homo Sapiens
IITIQVPQS

SEQ ID NO: 787338 - protein, 9 aa, Homo Sapiens
TPCINAISP

SEQ ID NO: 787339 - protein, 9 aa, Homo Sapiens
GKPTLEFVM

SEQ ID NO: 787340 - protein, 9 aa, Homo Sapiens
RPGQSLSSL

SEQ ID NO: 787341 - protein, 9 aa, Homo Sapiens
HQLPLGLEA

SEQ ID NO: 787342 - protein, 9 aa, Homo Sapiens
PEAVSEELI

SEQ ID NO: 787343 - protein, 9 aa, Homo Sapiens
LEAQAACSQ

SEQ ID NO: 787344 - protein, 9 aa, Homo Sapiens
QADTGFVID

SEQ ID NO: 787345 - protein, 9 aa, Homo Sapiens
YSPMSGGGP

SEQ ID NO: 787346 - protein, 9 aa, Homo Sapiens
AEDVIITIQ

SEQ ID NO: 787347 - protein, 9 aa, Homo Sapiens
CSFMSHEKC

SEQ ID NO: 787348 - protein, 9 aa, Homo Sapiens
RPDSKFASL

SEQ ID NO: 787349 - protein, 9 aa, Homo Sapiens
HYLNKETIG

SEQ ID NO: 787350 - protein, 9 aa, Homo Sapiens
LGLALLLRL

SEQ ID NO: 787351 - protein, 9 aa, Homo Sapiens
DPKKYVGRS

SEQ ID NO: 787352 - protein, 9 aa, Homo Sapiens
TNKEEKDEC

SEQ ID NO: 787353 - protein, 9 aa, Homo Sapiens
CTSYVSQSI

SEQ ID NO: 787354 - protein, 9 aa, Homo Sapiens
VSRRAAQVC

SEQ ID NO: 787355 - protein, 9 aa, Homo Sapiens
RLYGMVQAE

SEQ ID NO: 787356 - protein, 9 aa, Homo Sapiens
EAATPCINA

SEQ ID NO: 787357 - protein, 9 aa, Homo Sapiens
GKPAGTKHI

SEQ ID NO: 787358 - protein, 9 aa, Homo Sapiens
PDSGHFNID

SEQ ID NO: 787359 - protein, 9 aa, Homo Sapiens
RPSSAPYQH

SEQ ID NO: 787360 - protein, 9 aa, Homo Sapiens
LLSFGFSLE

SEQ ID NO: 787361 - protein, 9 aa, Homo Sapiens
APLGVGLHG

SEQ ID NO: 787362 - protein, 9 aa, Homo Sapiens
LIIEIRIVE

SEQ ID NO: 787363 - protein, 9 aa, Homo Sapiens
EVKFTKMIP

SEQ ID NO: 787364 - protein, 9 aa, Homo Sapiens
SHKHCKCIR

SEQ ID NO: 787365 - protein, 9 aa, Homo Sapiens
CPIRTYLVR

SEQ ID NO: 787366 - protein, 9 aa, Homo Sapiens
LLAHELDVD

SEQ ID NO: 787367 - protein, 9 aa, Homo Sapiens
QNEGDYNPG

SEQ ID NO: 787368 - protein, 9 aa, Homo Sapiens
VLVSDALAH

SEQ ID NO: 787369 - protein, 9 aa, Homo Sapiens
PEFEGSESL

SEQ ID NO: 787370 - protein, 9 aa, Homo Sapiens
IDLQTSGPI

SEQ ID NO: 787371 - protein, 9 aa, Homo Sapiens
SARVFFKNR

SEQ ID NO: 787372 - protein, 9 aa, Homo Sapiens
QRSTCHPSP

SEQ ID NO: 787373 - protein, 9 aa, Homo Sapiens
SGSQNEGDY

SEQ ID NO: 787374 - protein, 9 aa, Homo Sapiens
EMDNMLIQM

SEQ ID NO: 787375 - protein, 9 aa, Homo Sapiens
WQCLRGFAL

SEQ ID NO: 787376 - protein, 9 aa, Homo Sapiens
FFKNRKPRP

SEQ ID NO: 787377 - protein, 9 aa, Homo Sapiens
WNNDIPICE

SEQ ID NO: 787378 - protein, 9 aa, Homo Sapiens
GGPGAGPGP

SEQ ID NO: 787379 - protein, 9 aa, Homo Sapiens
FLRESLTLE

SEQ ID NO: 787380 - protein, 9 aa, Homo Sapiens
FGFSLEDPQ

SEQ ID NO: 787381 - protein, 9 aa, Homo Sapiens
EYFCCGYPK

SEQ ID NO: 787382 - protein, 9 aa, Homo Sapiens
LAPSIPRDE

SEQ ID NO: 787383 - protein, 9 aa, Homo Sapiens
NKEEKDECA

SEQ ID NO: 787384 - protein, 9 aa, Homo Sapiens
PTYAVHVWN

SEQ ID NO: 787385 - protein, 9 aa, Homo Sapiens
TLWGEADCY

SEQ ID NO: 787386 - protein, 9 aa, Homo Sapiens
CWILSIGLK

SEQ ID NO: 787387 - protein, 9 aa, Homo Sapiens
VWSNDRVIC

SEQ ID NO: 787388 - protein, 9 aa, Homo Sapiens
SERAFLRES

SEQ ID NO: 787389 - protein, 9 aa, Homo Sapiens
FVSTLGIDF

SEQ ID NO: 787390 - protein, 9 aa, Homo Sapiens
MPFPFPSRS

SEQ ID NO: 787391 - protein, 9 aa, Homo Sapiens
KKSVIKTER

SEQ ID NO: 787392 - protein, 9 aa, Homo Sapiens
TERINGGKK

SEQ ID NO: 787393 - protein, 9 aa, Homo Sapiens
SVRVVGLGT

SEQ ID NO: 787394 - protein, 9 aa, Homo Sapiens
AKGACPRKE

SEQ ID NO: 787395 - protein, 9 aa, Homo Sapiens
GSADGESKP

SEQ ID NO: 787396 - protein, 9 aa, Homo Sapiens
NQRGHSFLI

SEQ ID NO: 787397 - protein, 9 aa, Homo Sapiens
KRESMSCQK

SEQ ID NO: 787398 - protein, 9 aa, Homo Sapiens
LYSSIYCST

SEQ ID NO: 787399 - protein, 9 aa, Homo Sapiens
LKLAWWTSA

SEQ ID NO: 787400 - protein, 9 aa, Homo Sapiens
LFDYHIGDR

SEQ ID NO: 787401 - protein, 9 aa, Homo Sapiens
SQRSTCHPS

SEQ ID NO: 787402 - protein, 9 aa, Homo Sapiens
PDNASTALS

SEQ ID NO: 787403 - protein, 9 aa, Homo Sapiens
EIDLQTSGP

SEQ ID NO: 787404 - protein, 9 aa, Homo Sapiens
SPLRTLQRK

SEQ ID NO: 787405 - protein, 9 aa, Homo Sapiens
GAGEQYRGM

SEQ ID NO: 787406 - protein, 9 aa, Homo Sapiens
LLVTPQHLP

SEQ ID NO: 787407 - protein, 9 aa, Homo Sapiens
DTGFVIDPV

SEQ ID NO: 787408 - protein, 9 aa, Homo Sapiens
LSKENLESI

SEQ ID NO: 787409 - protein, 9 aa, Homo Sapiens
QKSSSLREM

SEQ ID NO: 787410 - protein, 9 aa, Homo Sapiens
DISPPARFF

SEQ ID NO: 787411 - protein, 9 aa, Homo Sapiens
TFCSSPRSP

SEQ ID NO: 787412 - protein, 9 aa, Homo Sapiens
GVQDALVLL

SEQ ID NO: 787413 - protein, 9 aa, Homo Sapiens
QRPGQSLSS

SEQ ID NO: 787414 - protein, 9 aa, Homo Sapiens
ICWILSIGL

SEQ ID NO: 787415 - protein, 9 aa, Homo Sapiens
CCGYPKKPH

SEQ ID NO: 787416 - protein, 9 aa, Homo Sapiens
VYLCLDSVL

SEQ ID NO: 787417 - protein, 9 aa, Homo Sapiens
ALLLRLAQR

SEQ ID NO: 787418 - protein, 9 aa, Homo Sapiens
GISAVNPFM

SEQ ID NO: 787419 - protein, 9 aa, Homo Sapiens
GPRQAPLGV

SEQ ID NO: 787420 - protein, 9 aa, Homo Sapiens
ASGSQNEGD

SEQ ID NO: 787421 - protein, 9 aa, Homo Sapiens
ATGLYAHGA

SEQ ID NO: 787422 - protein, 9 aa, Homo Sapiens
RGMVSKTRK

SEQ ID NO: 787423 - protein, 9 aa, Homo Sapiens
LLLHLVPAA

SEQ ID NO: 787424 - protein, 9 aa, Homo Sapiens
RRPSSAPYQ

SEQ ID NO: 787425 - protein, 9 aa, Homo Sapiens
RRAAQVCGA

SEQ ID NO: 787426 - protein, 9 aa, Homo Sapiens
RLKGQITIE

SEQ ID NO: 787427 - protein, 9 aa, Homo Sapiens
ALDPKKYVG

SEQ ID NO: 787428 - protein, 9 aa, Homo Sapiens
APLQATLWG

SEQ ID NO: 787429 - protein, 9 aa, Homo Sapiens
GLHGGLGLG

SEQ ID NO: 787430 - protein, 9 aa, Homo Sapiens
WVPAIPHEG

SEQ ID NO: 787431 - protein, 9 aa, Homo Sapiens
GSQNEGDYN

SEQ ID NO: 787432 - protein, 9 aa, Homo Sapiens
VKFTKMIPR

SEQ ID NO: 787433 - protein, 9 aa, Homo Sapiens
GQSEKHLPP

SEQ ID NO: 787434 - protein, 9 aa, Homo Sapiens
VLLEAQADT

SEQ ID NO: 787435 - protein, 9 aa, Homo Sapiens
RESMSCQKS

SEQ ID NO: 787436 - protein, 9 aa, Homo Sapiens
ADFLKLAWW

SEQ ID NO: 787437 - protein, 9 aa, Homo Sapiens
SEDYERWSG

SEQ ID NO: 787438 - protein, 9 aa, Homo Sapiens
DNASTALSS

SEQ ID NO: 787439 - protein, 9 aa, Homo Sapiens
EKEKDFLWS

SEQ ID NO: 787440 - protein, 9 aa, Homo Sapiens
GLALLLRLA

SEQ ID NO: 787441 - protein, 9 aa, Homo Sapiens
DSKFASLQP

SEQ ID NO: 787442 - protein, 9 aa, Homo Sapiens
ILKFEIGGQ

SEQ ID NO: 787443 - protein, 9 aa, Homo Sapiens
KQKVLAETE

SEQ ID NO: 787444 - protein, 9 aa, Homo Sapiens
GQITIENPL

SEQ ID NO: 787445 - protein, 9 aa, Homo Sapiens
CMEATPEEK

SEQ ID NO: 787446 - protein, 9 aa, Homo Sapiens
ETMSHKHCK

SEQ ID NO: 787447 - protein, 9 aa, Homo Sapiens
KYVGRSYEE

SEQ ID NO: 787448 - protein, 9 aa, Homo Sapiens
GLAPLQATL

SEQ ID NO: 787449 - protein, 9 aa, Homo Sapiens
GNPGVANAT

SEQ ID NO: 787450 - protein, 9 aa, Homo Sapiens
DALAHGLAL

SEQ ID NO: 787451 - protein, 9 aa, Homo Sapiens
DSEGHSEDY

SEQ ID NO: 787452 - protein, 9 aa, Homo Sapiens
SMSCQKSSS

SEQ ID NO: 787453 - protein, 9 aa, Homo Sapiens
GGVLGAGFA

SEQ ID NO: 787454 - protein, 9 aa, Homo Sapiens
ETLETIYNE

SEQ ID NO: 787455 - protein, 9 aa, Homo Sapiens
LVSDALAHG

SEQ ID NO: 787456 - protein, 9 aa, Homo Sapiens
TYLVRARSA

SEQ ID NO: 787457 - protein, 9 aa, Homo Sapiens
RAALGVGRD

SEQ ID NO: 787458 - protein, 9 aa, Homo Sapiens
PEGSADGES

SEQ ID NO: 787459 - protein, 9 aa, Homo Sapiens
IPHEGNTGD

SEQ ID NO: 787460 - protein, 9 aa, Homo Sapiens
SNLIFQTFD

SEQ ID NO: 787461 - protein, 9 aa, Homo Sapiens
GADGLVGQD

SEQ ID NO: 787462 - protein, 9 aa, Homo Sapiens
ECDTDGWNN

SEQ ID NO: 787463 - protein, 9 aa, Homo Sapiens
AHGLALRLH

SEQ ID NO: 787464 - protein, 9 aa, Homo Sapiens
VRATDQRPG

SEQ ID NO: 787465 - protein, 9 aa, Homo Sapiens
VGLPPDNAS

SEQ ID NO: 787466 - protein, 9 aa, Homo Sapiens
ALVCETHRY

SEQ ID NO: 787467 - protein, 9 aa, Homo Sapiens
LRKPRNAQP

SEQ ID NO: 787468 - protein, 9 aa, Homo Sapiens
VGQDGAADA

SEQ ID NO: 787469 - protein, 9 aa, Homo Sapiens
SPLASTNKE

SEQ ID NO: 787470 - protein, 9 aa, Homo Sapiens
CGYPKKPHT

SEQ ID NO: 787471 - protein, 9 aa, Homo Sapiens
HIRDVRGHE

SEQ ID NO: 787472 - protein, 9 aa, Homo Sapiens
LAPLQATLW

SEQ ID NO: 787473 - protein, 9 aa, Homo Sapiens
GMGSQRSTC

SEQ ID NO: 787474 - protein, 9 aa, Homo Sapiens
ARVFFKNRK

SEQ ID NO: 787475 - protein, 9 aa, Homo Sapiens
EASTTFCSS

SEQ ID NO: 787476 - protein, 9 aa, Homo Sapiens
PFDNYSFIC

SEQ ID NO: 787477 - protein, 9 aa, Homo Sapiens
SAAKLQHYY

SEQ ID NO: 787478 - protein, 9 aa, Homo Sapiens
RPDLPLRKP

SEQ ID NO: 787479 - protein, 9 aa, Homo Sapiens
HYVHSTPFD

SEQ ID NO: 787480 - protein, 9 aa, Homo Sapiens
NRKPRPTIN

SEQ ID NO: 787481 - protein, 9 aa, Homo Sapiens
KVALLGLGQ

SEQ ID NO: 787482 - protein, 9 aa, Homo Sapiens
DVIITIQVP

SEQ ID NO: 787483 - protein, 9 aa, Homo Sapiens
KATDKMYLS

SEQ ID NO: 787484 - protein, 9 aa, Homo Sapiens
QEPVGSGTL

SEQ ID NO: 787485 - protein, 9 aa, Homo Sapiens
YMRSELTAS

SEQ ID NO: 787486 - protein, 9 aa, Homo Sapiens
VVQEVQAVH

SEQ ID NO: 787487 - protein, 9 aa, Homo Sapiens
PWVPAIPHE

SEQ ID NO: 787488 - protein, 9 aa, Homo Sapiens
MAVKVPHQV

SEQ ID NO: 787489 - protein, 9 aa, Homo Sapiens
KHIRYLSYP

SEQ ID NO: 787490 - protein, 9 aa, Homo Sapiens
FRAKFYPEA

SEQ ID NO: 787491 - protein, 9 aa, Homo Sapiens
LLLEHVLQR

SEQ ID NO: 787492 - protein, 9 aa, Homo Sapiens
LRLHLGVLG

SEQ ID NO: 787493 - protein, 9 aa, Homo Sapiens
ENKYFEDIM

SEQ ID NO: 787494 - protein, 9 aa, Homo Sapiens
MAVQVVQEV

SEQ ID NO: 787495 - protein, 9 aa, Homo Sapiens
TGKPTLEFV

SEQ ID NO: 787496 - protein, 9 aa, Homo Sapiens
GEQYRGMVS

SEQ ID NO: 787497 - protein, 9 aa, Homo Sapiens
NAISPGEGW

SEQ ID NO: 787498 - protein, 9 aa, Homo Sapiens
QATLWGEAD

SEQ ID NO: 787499 - protein, 9 aa, Homo Sapiens
WSTNRHLAS

SEQ ID NO: 787500 - protein, 9 aa, Homo Sapiens
PDLPLRKPR

SEQ ID NO: 787501 - protein, 9 aa, Homo Sapiens
RPVSSVRVV

SEQ ID NO: 787502 - protein, 9 aa, Homo Sapiens
AKFYPEAVS

SEQ ID NO: 787503 - protein, 9 aa, Homo Sapiens
PSPRGENQR

SEQ ID NO: 787504 - protein, 9 aa, Homo Sapiens
PGPPGPAVI

SEQ ID NO: 787505 - protein, 9 aa, Homo Sapiens
KKRKASGSQ

SEQ ID NO: 787506 - protein, 9 aa, Homo Sapiens
KLLRGIDSL

SEQ ID NO: 787507 - protein, 9 aa, Homo Sapiens
NMLIQMKTQ

SEQ ID NO: 787508 - protein, 9 aa, Homo Sapiens
SNPIEIDLQ

SEQ ID NO: 787509 - protein, 9 aa, Homo Sapiens
LVLLLHLVP

SEQ ID NO: 787510 - protein, 9 aa, Homo Sapiens
MGPEVMEQV

SEQ ID NO: 787511 - protein, 9 aa, Homo Sapiens
VHSTPFDNY

SEQ ID NO: 787512 - protein, 9 aa, Homo Sapiens
FNIDNIRVC

SEQ ID NO: 787513 - protein, 9 aa, Homo Sapiens
RRKSNSMVD

SEQ ID NO: 787514 - protein, 9 aa, Homo Sapiens
AEKEQRKIP

SEQ ID NO: 787515 - protein, 9 aa, Homo Sapiens
HYIIEQGLC

SEQ ID NO: 787516 - protein, 9 aa, Homo Sapiens
ETFSDDPTP

SEQ ID NO: 787517 - protein, 9 aa, Homo Sapiens
FTSAWSTNR

SEQ ID NO: 787518 - protein, 9 aa, Homo Sapiens
YLVLALKVA

SEQ ID NO: 787519 - protein, 9 aa, Homo Sapiens
ASSAGAGAA

SEQ ID NO: 787520 - protein, 9 aa, Homo Sapiens
RKASGSQNE

SEQ ID NO: 787521 - protein, 9 aa, Homo Sapiens
EHVLQRPGQ

SEQ ID NO: 787522 - protein, 9 aa, Homo Sapiens
PWQCLRGFA

SEQ ID NO: 787523 - protein, 9 aa, Homo Sapiens
MWTWNTAFV

SEQ ID NO: 787524 - protein, 9 aa, Homo Sapiens
VQITKHLFE

SEQ ID NO: 787525 - protein, 9 aa, Homo Sapiens
AFVSTLGID

SEQ ID NO: 787526 - protein, 9 aa, Homo Sapiens
RGFALAWWE

SEQ ID NO: 787527 - protein, 9 aa, Homo Sapiens
KVPHQVPVQ

SEQ ID NO: 787528 - protein, 9 aa, Homo Sapiens
PRPDLPLRK

SEQ ID NO: 787529 - protein, 9 aa, Homo Sapiens
LSNPIEIDL

SEQ ID NO: 787530 - protein, 9 aa, Homo Sapiens
KIEEKQKVL

SEQ ID NO: 787531 - protein, 9 aa, Homo Sapiens
AAQVCGAGL

SEQ ID NO: 787532 - protein, 9 aa, Homo Sapiens
LLLVTPQHL

SEQ ID NO: 787533 - protein, 9 aa, Homo Sapiens
LAHGLALRL

SEQ ID NO: 787534 - protein, 9 aa, Homo Sapiens
RQAPLGVGL

SEQ ID NO: 787535 - protein, 9 aa, Homo Sapiens
QTHNIMENK

SEQ ID NO: 787536 - protein, 9 aa, Homo Sapiens
SVIKTERIN

SEQ ID NO: 787537 - protein, 9 aa, Homo Sapiens
PAFVSTLGI

SEQ ID NO: 787538 - protein, 9 aa, Homo Sapiens
RMACEVKFT

SEQ ID NO: 787539 - protein, 9 aa, Homo Sapiens
LRESLTLES

SEQ ID NO: 787540 - protein, 9 aa, Homo Sapiens
SRSRDSKRL

SEQ ID NO: 787541 - protein, 9 aa, Homo Sapiens
TVEWSARSE

SEQ ID NO: 787542 - protein, 9 aa, Homo Sapiens
MNPPWSVVW

SEQ ID NO: 787543 - protein, 9 aa, Homo Sapiens
PAARRDGLL

SEQ ID NO: 787544 - protein, 9 aa, Homo Sapiens
AIPHEGNTG

SEQ ID NO: 787545 - protein, 9 aa, Homo Sapiens
PNFHYPGVQ

SEQ ID NO: 787546 - protein, 9 aa, Homo Sapiens
LGIDFKVKT

SEQ ID NO: 787547 - protein, 9 aa, Homo Sapiens
GLGDQEPVG

SEQ ID NO: 787548 - protein, 9 aa, Homo Sapiens
GVWVLLLVT

SEQ ID NO: 787549 - protein, 9 aa, Homo Sapiens
ESLTLESST

SEQ ID NO: 787550 - protein, 9 aa, Homo Sapiens
GQQGHEDGQ

SEQ ID NO: 787551 - protein, 9 aa, Homo Sapiens
LLDAVLVSD

SEQ ID NO: 787552 - protein, 9 aa, Homo Sapiens
RGENQRGHS

SEQ ID NO: 787553 - protein, 9 aa, Homo Sapiens
RLAQRLLPL

SEQ ID NO: 787554 - protein, 9 aa, Homo Sapiens
AALGVGRDV

SEQ ID NO: 787555 - protein, 9 aa, Homo Sapiens
LLLLLGGVW

SEQ ID NO: 787556 - protein, 9 aa, Homo Sapiens
VRVVHVWFQ

SEQ ID NO: 787557 - protein, 9 aa, Homo Sapiens
ADELFDYHI

SEQ ID NO: 787558 - protein, 9 aa, Homo Sapiens
IETMSHKHC

SEQ ID NO: 787559 - protein, 9 aa, Homo Sapiens
FCCGYPKKP

SEQ ID NO: 787560 - protein, 9 aa, Homo Sapiens
GDQEPVGSG

SEQ ID NO: 787561 - protein, 9 aa, Homo Sapiens
DGVQDALVL

SEQ ID NO: 787562 - protein, 9 aa, Homo Sapiens
FDYHIGDRV

SEQ ID NO: 787563 - protein, 9 aa, Homo Sapiens
CSGSSLFLK

SEQ ID NO: 787564 - protein, 9 aa, Homo Sapiens
TLAFERVYI

SEQ ID NO: 787565 - protein, 9 aa, Homo Sapiens
LRAALGVGR

SEQ ID NO: 787566 - protein, 9 aa, Homo Sapiens
DELFDYHIG

SEQ ID NO: 787567 - protein, 9 aa, Homo Sapiens
EKEQRKIPL

SEQ ID NO: 787568 - protein, 9 aa, Homo Sapiens
HVWFQNQRA

SEQ ID NO: 787569 - protein, 9 aa, Homo Sapiens
KIIPAYFEA

SEQ ID NO: 787570 - protein, 9 aa, Homo Sapiens
KGQITIENP

SEQ ID NO: 787571 - protein, 9 aa, Homo Sapiens
AGAGAAVGT

SEQ ID NO: 787572 - protein, 9 aa, Homo Sapiens
DNLLESYMG

SEQ ID NO: 787573 - protein, 9 aa, Homo Sapiens
STNRHLASI

SEQ ID NO: 787574 - protein, 9 aa, Homo Sapiens
IYNEEQTPL

SEQ ID NO: 787575 - protein, 9 aa, Homo Sapiens
MILKEKNAE

SEQ ID NO: 787576 - protein, 9 aa, Homo Sapiens
SAVNPFMWT

SEQ ID NO: 787577 - protein, 9 aa, Homo Sapiens
GLCDLVLCE

SEQ ID NO: 787578 - protein, 9 aa, Homo Sapiens
TDGWNNDIP

SEQ ID NO: 787579 - protein, 9 aa, Homo Sapiens
IANQNCVDA

SEQ ID NO: 787580 - protein, 9 aa, Homo Sapiens
ITIQVPQSK

SEQ ID NO: 787581 - protein, 9 aa, Homo Sapiens
YFEAKILEA

SEQ ID NO: 787582 - protein, 9 aa, Homo Sapiens
ATPEEKEDP

SEQ ID NO: 787583 - protein, 9 aa, Homo Sapiens
QVVQEVQAV

SEQ ID NO: 787584 - protein, 9 aa, Homo Sapiens
EDVIITIQV

SEQ ID NO: 787585 - protein, 9 aa, Homo Sapiens
PTADELFDY

SEQ ID NO: 787586 - protein, 9 aa, Homo Sapiens
QGEYFCCGY

SEQ ID NO: 787587 - protein, 9 aa, Homo Sapiens
IDNIRVCKI

SEQ ID NO: 787588 - protein, 9 aa, Homo Sapiens
SEAATPCIN

SEQ ID NO: 787589 - protein, 9 aa, Homo Sapiens
WMGPEVMEQ

SEQ ID NO: 787590 - protein, 9 aa, Homo Sapiens
VRVFRKSHR

SEQ ID NO: 787591 - protein, 9 aa, Homo Sapiens
DVGLPPDNA

SEQ ID NO: 787592 - protein, 9 aa, Homo Sapiens
RVVGLGTMG

SEQ ID NO: 787593 - protein, 9 aa, Homo Sapiens
NHFFCEMLP

SEQ ID NO: 787594 - protein, 9 aa, Homo Sapiens
RGGPGAGPG

SEQ ID NO: 787595 - protein, 9 aa, Homo Sapiens
ANATPPWSS

SEQ ID NO: 787596 - protein, 9 aa, Homo Sapiens
VHLLIIEIR

SEQ ID NO: 787597 - protein, 9 aa, Homo Sapiens
KSHRSLNSQ

SEQ ID NO: 787598 - protein, 9 aa, Homo Sapiens
GLGLGLALL

SEQ ID NO: 787599 - protein, 9 aa, Homo Sapiens
ALKVALLGL

SEQ ID NO: 787600 - protein, 9 aa, Homo Sapiens
YRGMVSKTR

SEQ ID NO: 787601 - protein, 9 aa, Homo Sapiens
LCYECSTAR

SEQ ID NO: 787602 - protein, 9 aa, Homo Sapiens
NPIEIDLQT

SEQ ID NO: 787603 - protein, 9 aa, Homo Sapiens
LKVALLGLG

SEQ ID NO: 787604 - protein, 9 aa, Homo Sapiens
DVRGHEASI

SEQ ID NO: 787605 - protein, 9 aa, Homo Sapiens
VPTVADFLK

SEQ ID NO: 787606 - protein, 9 aa, Homo Sapiens
SPLTVEWSA

SEQ ID NO: 787607 - protein, 9 aa, Homo Sapiens
PYQHLLETA

SEQ ID NO: 787608 - protein, 9 aa, Homo Sapiens
DGWNNDIPI

SEQ ID NO: 787609 - protein, 9 aa, Homo Sapiens
LECLQRILT

SEQ ID NO: 787610 - protein, 9 aa, Homo Sapiens
SRLFLKGKL

SEQ ID NO: 787611 - protein, 9 aa, Homo Sapiens
QRLLPLLLL

SEQ ID NO: 787612 - protein, 9 aa, Homo Sapiens
VLGAGFAIC

SEQ ID NO: 787613 - protein, 9 aa, Homo Sapiens
GEYFCCGYP

SEQ ID NO: 787614 - protein, 9 aa, Homo Sapiens
AAVTVCLTL

SEQ ID NO: 787615 - protein, 9 aa, Homo Sapiens
LKFEIGGQS

SEQ ID NO: 787616 - protein, 9 aa, Homo Sapiens
LGLEAQAAC

SEQ ID NO: 787617 - protein, 9 aa, Homo Sapiens
GLGLALLLL

SEQ ID NO: 787618 - protein, 9 aa, Homo Sapiens
SCQKSSSLR

SEQ ID NO: 787619 - protein, 9 aa, Homo Sapiens
VCSFMSHEK

SEQ ID NO: 787620 - protein, 9 aa, Homo Sapiens
GPGAGPGPY

SEQ ID NO: 787621 - protein, 9 aa, Homo Sapiens
LQCSGSSLF

SEQ ID NO: 787622 - protein, 9 aa, Homo Sapiens
SYLVLALKV

SEQ ID NO: 787623 - protein, 9 aa, Homo Sapiens
PAEDVIITI

SEQ ID NO: 787624 - protein, 9 aa, Homo Sapiens
LRLAQRLLP

SEQ ID NO: 787625 - protein, 9 aa, Homo Sapiens
YIAHYLNKE

SEQ ID NO: 787626 - protein, 9 aa, Homo Sapiens
GPTGKPTLE

SEQ ID NO: 787627 - protein, 9 aa, Homo Sapiens
AHYLNKETI

SEQ ID NO: 787628 - protein, 9 aa, Homo Sapiens
LLIIEIRIV

SEQ ID NO: 787629 - protein, 9 aa, Homo Sapiens
QCSGSSLFL

SEQ ID NO: 787630 - protein, 9 aa, Homo Sapiens
GYIAHYLNK

SEQ ID NO: 787631 - protein, 9 aa, Homo Sapiens
IEQGLCDLV

SEQ ID NO: 787632 - protein, 9 aa, Homo Sapiens
RRDGLLGPR

SEQ ID NO: 787633 - protein, 9 aa, Homo Sapiens
VGLHGGLGL

SEQ ID NO: 787634 - protein, 9 aa, Homo Sapiens
TLEFVMAEW

SEQ ID NO: 787635 - protein, 9 aa, Homo Sapiens
PPEFEGSES

SEQ ID NO: 787636 - protein, 9 aa, Homo Sapiens
WVLLLVTPQ

SEQ ID NO: 787637 - protein, 9 aa, Homo Sapiens
GSESLSSGN

SEQ ID NO: 787638 - protein, 9 aa, Homo Sapiens
YVRVFRKSH

SEQ ID NO: 787639 - protein, 9 aa, Homo Sapiens
VWVLLLVTP

SEQ ID NO: 787640 - protein, 9 aa, Homo Sapiens
CSTRRNMLA

SEQ ID NO: 787641 - protein, 9 aa, Homo Sapiens
GFLCDVCSF

SEQ ID NO: 787642 - protein, 9 aa, Homo Sapiens
ARPVSSVRV

SEQ ID NO: 787643 - protein, 9 aa, Homo Sapiens
QEVQAVHLE

SEQ ID NO: 787644 - protein, 9 aa, Homo Sapiens
EKHLPPQPR

SEQ ID NO: 787645 - protein, 9 aa, Homo Sapiens
NDRVICWIL

SEQ ID NO: 787646 - protein, 9 aa, Homo Sapiens
ALGVGRDVI

SEQ ID NO: 787647 - protein, 9 aa, Homo Sapiens
PLGVGLHGG

SEQ ID NO: 787648 - protein, 9 aa, Homo Sapiens
AVQVVQEVQ

SEQ ID NO: 787649 - protein, 9 aa, Homo Sapiens
ESMSCQKSS

SEQ ID NO: 787650 - protein, 9 aa, Homo Sapiens
GMVSKTRKG

SEQ ID NO: 787651 - protein, 9 aa, Homo Sapiens
FSDDPTPGA

SEQ ID NO: 787652 - protein, 9 aa, Homo Sapiens
KRNVDHRRK

SEQ ID NO: 787653 - protein, 9 aa, Homo Sapiens
HLLIIEIRI

SEQ ID NO: 787654 - protein, 9 aa, Homo Sapiens
FLSTTGGGR

SEQ ID NO: 787655 - protein, 9 aa, Homo Sapiens
EGLLAAVTV

SEQ ID NO: 787656 - protein, 9 aa, Homo Sapiens
GELQCSGSS

SEQ ID NO: 787657 - protein, 9 aa, Homo Sapiens
SKKSVIKTE

SEQ ID NO: 787658 - protein, 9 aa, Homo Sapiens
PSSAPYQHL

SEQ ID NO: 787659 - protein, 9 aa, Homo Sapiens
CSSPRSPTT

SEQ ID NO: 787660 - protein, 9 aa, Homo Sapiens
GGDVQITKH

SEQ ID NO: 787661 - protein, 9 aa, Homo Sapiens
DGLLGPRQA

SEQ ID NO: 787662 - protein, 9 aa, Homo Sapiens
FFCEMLPLL

SEQ ID NO: 787663 - protein, 9 aa, Homo Sapiens
QVMDGYRMP

SEQ ID NO: 787664 - protein, 9 aa, Homo Sapiens
DEISVDPDD

SEQ ID NO: 787665 - protein, 9 aa, Homo Sapiens
PASASSAGA

SEQ ID NO: 787666 - protein, 9 aa, Homo Sapiens
LSEITEKEK

SEQ ID NO: 787667 - protein, 9 aa, Homo Sapiens
LRGFALAWW

SEQ ID NO: 787668 - protein, 9 aa, Homo Sapiens
PTGKPTLEF

SEQ ID NO: 787669 - protein, 9 aa, Homo Sapiens
TMSHKHCKC

SEQ ID NO: 787670 - protein, 9 aa, Homo Sapiens
ATDKMYLSN

SEQ ID NO: 787671 - protein, 9 aa, Homo Sapiens
ESKPKKQRQ

SEQ ID NO: 787672 - protein, 9 aa, Homo Sapiens
MAKGELQCS

SEQ ID NO: 787673 - protein, 9 aa, Homo Sapiens
GGASSFPVY

SEQ ID NO: 787674 - protein, 9 aa, Homo Sapiens
GGAGIDCEE

SEQ ID NO: 787675 - protein, 9 aa, Homo Sapiens
LLCIREFTL

SEQ ID NO: 787676 - protein, 9 aa, Homo Sapiens
MDAEAAGLR

SEQ ID NO: 787677 - protein, 9 aa, Homo Sapiens
RAMDAEAAG

SEQ ID NO: 787678 - protein, 9 aa, Homo Sapiens
TINPSGTTI

SEQ ID NO: 787679 - protein, 9 aa, Homo Sapiens
MGGARTQAE

SEQ ID NO: 787680 - protein, 9 aa, Homo Sapiens
YGPDIGQPR

SEQ ID NO: 787681 - protein, 9 aa, Homo Sapiens
GPAGYLWRA

SEQ ID NO: 787682 - protein, 9 aa, Homo Sapiens
DSRRSSAFR

SEQ ID NO: 787683 - protein, 9 aa, Homo Sapiens
NVTFNSLTD

SEQ ID NO: 787684 - protein, 9 aa, Homo Sapiens
GLAFRQGGK

SEQ ID NO: 787685 - protein, 9 aa, Homo Sapiens
FENPDEAKK

SEQ ID NO: 787686 - protein, 9 aa, Homo Sapiens
DSWCTAVGT

SEQ ID NO: 787687 - protein, 9 aa, Homo Sapiens
FRDHLMKLN

SEQ ID NO: 787688 - protein, 9 aa, Homo Sapiens
KTLEDRNTL

SEQ ID NO: 787689 - protein, 9 aa, Homo Sapiens
GNMTLQCGS

SEQ ID NO: 787690 - protein, 9 aa, Homo Sapiens
LGRKIFLGE

SEQ ID NO: 787691 - protein, 9 aa, Homo Sapiens
MCAVCLLPG

SEQ ID NO: 787692 - protein, 9 aa, Homo Sapiens
SFRSAAPIT

SEQ ID NO: 787693 - protein, 9 aa, Homo Sapiens
FDALISKSY

SEQ ID NO: 787694 - protein, 9 aa, Homo Sapiens
NASLFNGKM

SEQ ID NO: 787695 - protein, 9 aa, Homo Sapiens
KHRFDRRIS

SEQ ID NO: 787696 - protein, 9 aa, Homo Sapiens
KYGDTKVHH

SEQ ID NO: 787697 - protein, 9 aa, Homo Sapiens
TLQCGSQKG

SEQ ID NO: 787698 - protein, 9 aa, Homo Sapiens
WDTFVALYH

SEQ ID NO: 787699 - protein, 9 aa, Homo Sapiens
KALICCTYL

SEQ ID NO: 787700 - protein, 9 aa, Homo Sapiens
KKEELPLWD

SEQ ID NO: 787701 - protein, 9 aa, Homo Sapiens
PPITEFSNC

SEQ ID NO: 787702 - protein, 9 aa, Homo Sapiens
IYWPAAKEQ

SEQ ID NO: 787703 - protein, 9 aa, Homo Sapiens
GKALICCTY

SEQ ID NO: 787704 - protein, 9 aa, Homo Sapiens
AQLRAARTQ

SEQ ID NO: 787705 - protein, 9 aa, Homo Sapiens
PITEFSNCS

SEQ ID NO: 787706 - protein, 9 aa, Homo Sapiens
IFDYEDIPS

SEQ ID NO: 787707 - protein, 9 aa, Homo Sapiens
SSIFDYEDI

SEQ ID NO: 787708 - protein, 9 aa, Homo Sapiens
PRVSCNTGL

SEQ ID NO: 787709 - protein, 9 aa, Homo Sapiens
RMGGARTQA

SEQ ID NO: 787710 - protein, 9 aa, Homo Sapiens
ISHNPAVVD

SEQ ID NO: 787711 - protein, 9 aa, Homo Sapiens
RTVSSDYLH

SEQ ID NO: 787712 - protein, 9 aa, Homo Sapiens
LCYPGWSQT

SEQ ID NO: 787713 - protein, 9 aa, Homo Sapiens
KKIMATLIK

SEQ ID NO: 787714 - protein, 9 aa, Homo Sapiens
DIGQPRRKT

SEQ ID NO: 787715 - protein, 9 aa, Homo Sapiens
SANASLFNG

SEQ ID NO: 787716 - protein, 9 aa, Homo Sapiens
DDDIASLVF

SEQ ID NO: 787717 - protein, 9 aa, Homo Sapiens
RWALMGYND

SEQ ID NO: 787718 - protein, 9 aa, Homo Sapiens
RDHLMKLNL

SEQ ID NO: 787719 - protein, 9 aa, Homo Sapiens
ETLSLDVNT

SEQ ID NO: 787720 - protein, 9 aa, Homo Sapiens
SSKIVCRVG

SEQ ID NO: 787721 - protein, 9 aa, Homo Sapiens
DRCTIDWKK

SEQ ID NO: 787722 - protein, 9 aa, Homo Sapiens
SRRSSAFRS

SEQ ID NO: 787723 - protein, 9 aa, Homo Sapiens
NTTMHVMKH

SEQ ID NO: 787724 - protein, 9 aa, Homo Sapiens
NVLPEYKLQ

SEQ ID NO: 787725 - protein, 9 aa, Homo Sapiens
NPFRDHLMK

SEQ ID NO: 787726 - protein, 9 aa, Homo Sapiens
AALSAYAPQ

SEQ ID NO: 787727 - protein, 9 aa, Homo Sapiens
SVNDFYSSL

SEQ ID NO: 787728 - protein, 9 aa, Homo Sapiens
AFRDVYHLS

SEQ ID NO: 787729 - protein, 9 aa, Homo Sapiens
CTINPSGTT

SEQ ID NO: 787730 - protein, 9 aa, Homo Sapiens
LLKKIMATL

SEQ ID NO: 787731 - protein, 9 aa, Homo Sapiens
GIVAAGITN

SEQ ID NO: 787732 - protein, 9 aa, Homo Sapiens
ALICCTYLQ

SEQ ID NO: 787733 - protein, 9 aa, Homo Sapiens
IVELLEKEI

SEQ ID NO: 787734 - protein, 9 aa, Homo Sapiens
PAHTCPRGV

SEQ ID NO: 787735 - protein, 9 aa, Homo Sapiens
YPQANQTYG

SEQ ID NO: 787736 - protein, 9 aa, Homo Sapiens
LAPPRCTIN

SEQ ID NO: 787737 - protein, 9 aa, Homo Sapiens
DGGSLCYPG

SEQ ID NO: 787738 - protein, 9 aa, Homo Sapiens
GRVHYHLDS

SEQ ID NO: 787739 - protein, 9 aa, Homo Sapiens
ARGAPVTAA

SEQ ID NO: 787740 - protein, 9 aa, Homo Sapiens
GYLWRASVA

SEQ ID NO: 787741 - protein, 9 aa, Homo Sapiens
IFIEKLADN

SEQ ID NO: 787742 - protein, 9 aa, Homo Sapiens
LRLLHGRLE

SEQ ID NO: 787743 - protein, 9 aa, Homo Sapiens
HNLIVQMYD

SEQ ID NO: 787744 - protein, 9 aa, Homo Sapiens
RMTIAACQT

SEQ ID NO: 787745 - protein, 9 aa, Homo Sapiens
SSDYLHPQY

SEQ ID NO: 787746 - protein, 9 aa, Homo Sapiens
PVITDEILP

SEQ ID NO: 787747 - protein, 9 aa, Homo Sapiens
STNLEEPCK

SEQ ID NO: 787748 - protein, 9 aa, Homo Sapiens
EAKKALKHM

SEQ ID NO: 787749 - protein, 9 aa, Homo Sapiens
HWNGKKMLS

SEQ ID NO: 787750 - protein, 9 aa, Homo Sapiens
QRGREHGLP

SEQ ID NO: 787751 - protein, 9 aa, Homo Sapiens
AACQTLYES

SEQ ID NO: 787752 - protein, 9 aa, Homo Sapiens
KTVQDYLKK

SEQ ID NO: 787753 - protein, 9 aa, Homo Sapiens
EWMSSSKIV

SEQ ID NO: 787754 - protein, 9 aa, Homo Sapiens
KKKYSNHSI

SEQ ID NO: 787755 - protein, 9 aa, Homo Sapiens
RKQPVGCIF

SEQ ID NO: 787756 - protein, 9 aa, Homo Sapiens
SFPVYSLWK

SEQ ID NO: 787757 - protein, 9 aa, Homo Sapiens
APKKGSKEA

SEQ ID NO: 787758 - protein, 9 aa, Homo Sapiens
SLTHLFLVF

SEQ ID NO: 787759 - protein, 9 aa, Homo Sapiens
LQEASTEGR

SEQ ID NO: 787760 - protein, 9 aa, Homo Sapiens
GGSLCYPGW

SEQ ID NO: 787761 - protein, 9 aa, Homo Sapiens
HRAPGPDGP

SEQ ID NO: 787762 - protein, 9 aa, Homo Sapiens
VLKKASTNL

SEQ ID NO: 787763 - protein, 9 aa, Homo Sapiens
RFVLDNGIL

SEQ ID NO: 787764 - protein, 9 aa, Homo Sapiens
FFSLHAGHP

SEQ ID NO: 787765 - protein, 9 aa, Homo Sapiens
PRMSASSEV

SEQ ID NO: 787766 - protein, 9 aa, Homo Sapiens
TKVHHMHMR

SEQ ID NO: 787767 - protein, 9 aa, Homo Sapiens
LIKSKKGIN

SEQ ID NO: 787768 - protein, 9 aa, Homo Sapiens
ISDLGGGTF

SEQ ID NO: 787769 - protein, 9 aa, Homo Sapiens
PALRGPPAP

SEQ ID NO: 787770 - protein, 9 aa, Homo Sapiens
GRLRHQENI

SEQ ID NO: 787771 - protein, 9 aa, Homo Sapiens
PQEGPEDKH

SEQ ID NO: 787772 - protein, 9 aa, Homo Sapiens
IVQCLALLT

SEQ ID NO: 787773 - protein, 9 aa, Homo Sapiens
GDGSEKALA

SEQ ID NO: 787774 - protein, 9 aa, Homo Sapiens
FEALLPPLP

SEQ ID NO: 787775 - protein, 9 aa, Homo Sapiens
GIWVFLLKL

SEQ ID NO: 787776 - protein, 9 aa, Homo Sapiens
SAHEARRYS

SEQ ID NO: 787777 - protein, 9 aa, Homo Sapiens
NLEGTDFLR

SEQ ID NO: 787778 - protein, 9 aa, Homo Sapiens
HDVLKKAST

SEQ ID NO: 787779 - protein, 9 aa, Homo Sapiens
GYRYWASIG

SEQ ID NO: 787780 - protein, 9 aa, Homo Sapiens
TTGFDSVDD

SEQ ID NO: 787781 - protein, 9 aa, Homo Sapiens
AVETAEEAE

SEQ ID NO: 787782 - protein, 9 aa, Homo Sapiens
DGSEKALAP

SEQ ID NO: 787783 - protein, 9 aa, Homo Sapiens
ATLIKRFHH

SEQ ID NO: 787784 - protein, 9 aa, Homo Sapiens
LNVTFNSLT

SEQ ID NO: 787785 - protein, 9 aa, Homo Sapiens
RVALGNRKR

SEQ ID NO: 787786 - protein, 9 aa, Homo Sapiens
QVELCKLAG

SEQ ID NO: 787787 - protein, 9 aa, Homo Sapiens
AFLQVFVQS

SEQ ID NO: 787788 - protein, 9 aa, Homo Sapiens
WKMYQEMCW

SEQ ID NO: 787789 - protein, 9 aa, Homo Sapiens
TGAVPLIKA

SEQ ID NO: 787790 - protein, 9 aa, Homo Sapiens
KKALKHMDG

SEQ ID NO: 787791 - protein, 9 aa, Homo Sapiens
TMHVMKHLL

SEQ ID NO: 787792 - protein, 9 aa, Homo Sapiens
GTNTAREGR

SEQ ID NO: 787793 - protein, 9 aa, Homo Sapiens
AFRQGGKTT

SEQ ID NO: 787794 - protein, 9 aa, Homo Sapiens
KKFYQLPSN

SEQ ID NO: 787795 - protein, 9 aa, Homo Sapiens
LGADRQEVQ

SEQ ID NO: 787796 - protein, 9 aa, Homo Sapiens
VMKHLLPET

SEQ ID NO: 787797 - protein, 9 aa, Homo Sapiens
QDSWCTAVG

SEQ ID NO: 787798 - protein, 9 aa, Homo Sapiens
EPVLPDSSS

SEQ ID NO: 787799 - protein, 9 aa, Homo Sapiens
CPRGVPACS

SEQ ID NO: 787800 - protein, 9 aa, Homo Sapiens
TDEILPSKK

SEQ ID NO: 787801 - protein, 9 aa, Homo Sapiens
ALFMAEMLL

SEQ ID NO: 787802 - protein, 9 aa, Homo Sapiens
SSAFRSIRG

SEQ ID NO: 787803 - protein, 9 aa, Homo Sapiens
GGFYNIESG

SEQ ID NO: 787804 - protein, 9 aa, Homo Sapiens
RTQRARAQT

SEQ ID NO: 787805 - protein, 9 aa, Homo Sapiens
HLTVTSSDH

SEQ ID NO: 787806 - protein, 9 aa, Homo Sapiens
LKHTTGFDS

SEQ ID NO: 787807 - protein, 9 aa, Homo Sapiens
VMLRSMLIS

SEQ ID NO: 787808 - protein, 9 aa, Homo Sapiens
LAPAPPPSG

SEQ ID NO: 787809 - protein, 9 aa, Homo Sapiens
DRQEVQPEA

SEQ ID NO: 787810 - protein, 9 aa, Homo Sapiens
ESLGRKIFL

SEQ ID NO: 787811 - protein, 9 aa, Homo Sapiens
VSCNTGLSL

SEQ ID NO: 787812 - protein, 9 aa, Homo Sapiens
DTKVHHMHM

SEQ ID NO: 787813 - protein, 9 aa, Homo Sapiens
APRVSCNTG

SEQ ID NO: 787814 - protein, 9 aa, Homo Sapiens
LGANVLPEY

SEQ ID NO: 787815 - protein, 9 aa, Homo Sapiens
GMTKSKMLA

SEQ ID NO: 787816 - protein, 9 aa, Homo Sapiens
QKATPQVPA

SEQ ID NO: 787817 - protein, 9 aa, Homo Sapiens
NPWWVLIGM

SEQ ID NO: 787818 - protein, 9 aa, Homo Sapiens
HEGNPPITE

SEQ ID NO: 787819 - protein, 9 aa, Homo Sapiens
ASLFNGKMQ

SEQ ID NO: 787820 - protein, 9 aa, Homo Sapiens
RGREHGLPG

SEQ ID NO: 787821 - protein, 9 aa, Homo Sapiens
EARRYSPPG

SEQ ID NO: 787822 - protein, 9 aa, Homo Sapiens
RLRHQENIE

SEQ ID NO: 787823 - protein, 9 aa, Homo Sapiens
FLLRLLHGR

SEQ ID NO: 787824 - protein, 9 aa, Homo Sapiens
LAFRQGGKT

SEQ ID NO: 787825 - protein, 9 aa, Homo Sapiens
RESLGRKIF

SEQ ID NO: 787826 - protein, 9 aa, Homo Sapiens
WVFLLKLLI

SEQ ID NO: 787827 - protein, 9 aa, Homo Sapiens
DTNAPRVSC

SEQ ID NO: 787828 - protein, 9 aa, Homo Sapiens
SRWALMGYN

SEQ ID NO: 787829 - protein, 9 aa, Homo Sapiens
PPEPVLPDS

SEQ ID NO: 787830 - protein, 9 aa, Homo Sapiens
VMCAVCLLP

SEQ ID NO: 787831 - protein, 9 aa, Homo Sapiens
FRHRVVVPY

SEQ ID NO: 787832 - protein, 9 aa, Homo Sapiens
YPGWSQTPG

SEQ ID NO: 787833 - protein, 9 aa, Homo Sapiens
RRFVLDNGI

SEQ ID NO: 787834 - protein, 9 aa, Homo Sapiens
QPKYGDTKV

SEQ ID NO: 787835 - protein, 9 aa, Homo Sapiens
LDVNTIHWS

SEQ ID NO: 787836 - protein, 9 aa, Homo Sapiens
ALGNRKREC

SEQ ID NO: 787837 - protein, 9 aa, Homo Sapiens
HVIGTQLNT

SEQ ID NO: 787838 - protein, 9 aa, Homo Sapiens
AVGTSRIDQ

SEQ ID NO: 787839 - protein, 9 aa, Homo Sapiens
ADNILVKTT

SEQ ID NO: 787840 - protein, 9 aa, Homo Sapiens
QENLEGTDF

SEQ ID NO: 787841 - protein, 9 aa, Homo Sapiens
PRRFVLDNG

SEQ ID NO: 787842 - protein, 9 aa, Homo Sapiens
HGRLEVDLD

SEQ ID NO: 787843 - protein, 9 aa, Homo Sapiens
EAEEPAEAD

SEQ ID NO: 787844 - protein, 9 aa, Homo Sapiens
DLLSKSGNT

SEQ ID NO: 787845 - protein, 9 aa, Homo Sapiens
LRAARTQRA

SEQ ID NO: 787846 - protein, 9 aa, Homo Sapiens
CDRCTIDWK

SEQ ID NO: 787847 - protein, 9 aa, Homo Sapiens
AGGASSFPV

SEQ ID NO: 787848 - protein, 9 aa, Homo Sapiens
QELNVTFNS

SEQ ID NO: 787849 - protein, 9 aa, Homo Sapiens
KYSNHSIFS

SEQ ID NO: 787850 - protein, 9 aa, Homo Sapiens
ASRLQTMTA

SEQ ID NO: 787851 - protein, 9 aa, Homo Sapiens
RVLDIAGFE

SEQ ID NO: 787852 - protein, 9 aa, Homo Sapiens
AGKRNVLIS

SEQ ID NO: 787853 - protein, 9 aa, Homo Sapiens
PAPKKGSKE

SEQ ID NO: 787854 - protein, 9 aa, Homo Sapiens
PVCLSWVRD

SEQ ID NO: 787855 - protein, 9 aa, Homo Sapiens
LLGADRQEV

SEQ ID NO: 787856 - protein, 9 aa, Homo Sapiens
AKKALKHMD

SEQ ID NO: 787857 - protein, 9 aa, Homo Sapiens
FSGRHSLLC

SEQ ID NO: 787858 - protein, 9 aa, Homo Sapiens
RKIFLGEVE

SEQ ID NO: 787859 - protein, 9 aa, Homo Sapiens
LSVEVSVET

SEQ ID NO: 787860 - protein, 9 aa, Homo Sapiens
GASSFPVYS

SEQ ID NO: 787861 - protein, 9 aa, Homo Sapiens
IEGRMGGAR

SEQ ID NO: 787862 - protein, 9 aa, Homo Sapiens
KNLESLDLF

SEQ ID NO: 787863 - protein, 9 aa, Homo Sapiens
QENGERTGA

SEQ ID NO: 787864 - protein, 9 aa, Homo Sapiens
DVRFPLAMP

SEQ ID NO: 787865 - protein, 9 aa, Homo Sapiens
NLAEHFKIN

SEQ ID NO: 787866 - protein, 9 aa, Homo Sapiens
GAVPLIKAP

SEQ ID NO: 787867 - protein, 9 aa, Homo Sapiens
VFERLWDGL

SEQ ID NO: 787868 - protein, 9 aa, Homo Sapiens
TQRARAQTP

SEQ ID NO: 787869 - protein, 9 aa, Homo Sapiens
NTAREGRAA

SEQ ID NO: 787870 - protein, 9 aa, Homo Sapiens
PSFCSKRGC

SEQ ID NO: 787871 - protein, 9 aa, Homo Sapiens
YFFFFGSSE

SEQ ID NO: 787872 - protein, 9 aa, Homo Sapiens
TLSLDVNTI

SEQ ID NO: 787873 - protein, 9 aa, Homo Sapiens
PKQENLEGT

SEQ ID NO: 787874 - protein, 9 aa, Homo Sapiens
NLQRGREHG

SEQ ID NO: 787875 - protein, 9 aa, Homo Sapiens
NFDALISKS

SEQ ID NO: 787876 - protein, 9 aa, Homo Sapiens
GQRVFGPAG

SEQ ID NO: 787877 - protein, 9 aa, Homo Sapiens
YAPQRPPAP

SEQ ID NO: 787878 - protein, 9 aa, Homo Sapiens
SINLQRGRE

SEQ ID NO: 787879 - protein, 9 aa, Homo Sapiens
TKTVQDYLK

SEQ ID NO: 787880 - protein, 9 aa, Homo Sapiens
MTLQCGSQK

SEQ ID NO: 787881 - protein, 9 aa, Homo Sapiens
RQPKYGDTK

SEQ ID NO: 787882 - protein, 9 aa, Homo Sapiens
RGRLALHRA

SEQ ID NO: 787883 - protein, 9 aa, Homo Sapiens
QLISHNPAV

SEQ ID NO: 787884 - protein, 9 aa, Homo Sapiens
RVFGPAGKV

SEQ ID NO: 787885 - protein, 9 aa, Homo Sapiens
FLKFNYSWP

SEQ ID NO: 787886 - protein, 9 aa, Homo Sapiens
VNTIHWSRN

SEQ ID NO: 787887 - protein, 9 aa, Homo Sapiens
EDRNTLRLW

SEQ ID NO: 787888 - protein, 9 aa, Homo Sapiens
PKKGSKEAV

SEQ ID NO: 787889 - protein, 9 aa, Homo Sapiens
STGPSNTDL

SEQ ID NO: 787890 - protein, 9 aa, Homo Sapiens
KLYGPDIGQ

SEQ ID NO: 787891 - protein, 9 aa, Homo Sapiens
KIFLGEVEV

SEQ ID NO: 787892 - protein, 9 aa, Homo Sapiens
ASTEGRRFR

SEQ ID NO: 787893 - protein, 9 aa, Homo Sapiens
VFLKHTTGF

SEQ ID NO: 787894 - protein, 9 aa, Homo Sapiens
HTTSGTDLG

SEQ ID NO: 787895 - protein, 9 aa, Homo Sapiens
PRGVPACSH

SEQ ID NO: 787896 - protein, 9 aa, Homo Sapiens
MLSLTHLFL

SEQ ID NO: 787897 - protein, 9 aa, Homo Sapiens
LFMAEMLLK

SEQ ID NO: 787898 - protein, 9 aa, Homo Sapiens
IMATLIKRF

SEQ ID NO: 787899 - protein, 9 aa, Homo Sapiens
TCPRGVPAC

SEQ ID NO: 787900 - protein, 9 aa, Homo Sapiens
SSFPVYSLW

SEQ ID NO: 787901 - protein, 9 aa, Homo Sapiens
LQRGREHGL

SEQ ID NO: 787902 - protein, 9 aa, Homo Sapiens
WPYSDLVLD

SEQ ID NO: 787903 - protein, 9 aa, Homo Sapiens
YLTGWQPRR

SEQ ID NO: 787904 - protein, 9 aa, Homo Sapiens
TKSKMLAVS

SEQ ID NO: 787905 - protein, 9 aa, Homo Sapiens
FIRVLDIAG

SEQ ID NO: 787906 - protein, 9 aa, Homo Sapiens
AHEARRYSP

SEQ ID NO: 787907 - protein, 9 aa, Homo Sapiens
SDLGGGTFD

SEQ ID NO: 787908 - protein, 9 aa, Homo Sapiens
TTSGTDLGI

SEQ ID NO: 787909 - protein, 9 aa, Homo Sapiens
KKYSNHSIF

SEQ ID NO: 787910 - protein, 9 aa, Homo Sapiens
EPLKKNLES

SEQ ID NO: 787911 - protein, 9 aa, Homo Sapiens
NTFRHRVVV

SEQ ID NO: 787912 - protein, 9 aa, Homo Sapiens
SWTNPWWVL

SEQ ID NO: 787913 - protein, 9 aa, Homo Sapiens
NTIHWSRNS

SEQ ID NO: 787914 - protein, 9 aa, Homo Sapiens
MLAVSLWTG

SEQ ID NO: 787915 - protein, 9 aa, Homo Sapiens
GCCHIQASG

SEQ ID NO: 787916 - protein, 9 aa, Homo Sapiens
KLIKSKKGI

SEQ ID NO: 787917 - protein, 9 aa, Homo Sapiens
LREIVELLE

SEQ ID NO: 787918 - protein, 9 aa, Homo Sapiens
PRTVSSDYL

SEQ ID NO: 787919 - protein, 9 aa, Homo Sapiens
HLREIVELL

SEQ ID NO: 787920 - protein, 9 aa, Homo Sapiens
EKPRTVSSD

SEQ ID NO: 787921 - protein, 9 aa, Homo Sapiens
MLRALKLKA

SEQ ID NO: 787922 - protein, 9 aa, Homo Sapiens
KRCATPVIT

SEQ ID NO: 787923 - protein, 9 aa, Homo Sapiens
NKYHLSGRP

SEQ ID NO: 787924 - protein, 9 aa, Homo Sapiens
TAVGTSRID

SEQ ID NO: 787925 - protein, 9 aa, Homo Sapiens
TNAPRVSCN

SEQ ID NO: 787926 - protein, 9 aa, Homo Sapiens
QSHIIQLKN

SEQ ID NO: 787927 - protein, 9 aa, Homo Sapiens
RCATPVITD

SEQ ID NO: 787928 - protein, 9 aa, Homo Sapiens
MNKYHLSGR

SEQ ID NO: 787929 - protein, 9 aa, Homo Sapiens
LEDRNTLRL

SEQ ID NO: 787930 - protein, 9 aa, Homo Sapiens
RHQENIEGA

SEQ ID NO: 787931 - protein, 9 aa, Homo Sapiens
SGDGSEKAL

SEQ ID NO: 787932 - protein, 9 aa, Homo Sapiens
HVYEAVKEA

SEQ ID NO: 787933 - protein, 9 aa, Homo Sapiens
LCIREFTLG

SEQ ID NO: 787934 - protein, 9 aa, Homo Sapiens
EGTYLFHLT

SEQ ID NO: 787935 - protein, 9 aa, Homo Sapiens
LKKIMATLI

SEQ ID NO: 787936 - protein, 9 aa, Homo Sapiens
NGERTGAVP

SEQ ID NO: 787937 - protein, 9 aa, Homo Sapiens
SSLESSGWL

SEQ ID NO: 787938 - protein, 9 aa, Homo Sapiens
SAFRSIRGS

SEQ ID NO: 787939 - protein, 9 aa, Homo Sapiens
VTFNSLTDL

SEQ ID NO: 787940 - protein, 9 aa, Homo Sapiens
EQLGQRVFG

SEQ ID NO: 787941 - protein, 9 aa, Homo Sapiens
RKLRPAWVA

SEQ ID NO: 787942 - protein, 9 aa, Homo Sapiens
LRALKLKAY

SEQ ID NO: 787943 - protein, 9 aa, Homo Sapiens
TGWQPRRFV

SEQ ID NO: 787944 - protein, 9 aa, Homo Sapiens
VQDYLKKFY

SEQ ID NO: 787945 - protein, 9 aa, Homo Sapiens
GPEIVDCDR

SEQ ID NO: 787946 - protein, 9 aa, Homo Sapiens
PGRVHYHLD

SEQ ID NO: 787947 - protein, 9 aa, Homo Sapiens
PVTAAALAR

SEQ ID NO: 787948 - protein, 9 aa, Homo Sapiens
ALQELNVTF

SEQ ID NO: 787949 - protein, 9 aa, Homo Sapiens
PKYGDTKVH

SEQ ID NO: 787950 - protein, 9 aa, Homo Sapiens
SGRHSLLCI

SEQ ID NO: 787951 - protein, 9 aa, Homo Sapiens
RRHLREIVE

SEQ ID NO: 787952 - protein, 9 aa, Homo Sapiens
RSMLISGQS

SEQ ID NO: 787953 - protein, 9 aa, Homo Sapiens
RYWASIGVL

SEQ ID NO: 787954 - protein, 9 aa, Homo Sapiens
ENGERTGAV

SEQ ID NO: 787955 - protein, 9 aa, Homo Sapiens
MAEMLLKMY

SEQ ID NO: 787956 - protein, 9 aa, Homo Sapiens
QVFVQSHII

SEQ ID NO: 787957 - protein, 9 aa, Homo Sapiens
KFNYSWPYS

SEQ ID NO: 787958 - protein, 9 aa, Homo Sapiens
AEKPRTVSS

SEQ ID NO: 787959 - protein, 9 aa, Homo Sapiens
FMAEMLLKM

SEQ ID NO: 787960 - protein, 9 aa, Homo Sapiens
LWDGLWMNC

SEQ ID NO: 787961 - protein, 9 aa, Homo Sapiens
DVYHLSRHK

SEQ ID NO: 787962 - protein, 9 aa, Homo Sapiens
QDYLKKFYQ

SEQ ID NO: 787963 - protein, 9 aa, Homo Sapiens
ENLEGTDFL

SEQ ID NO: 787964 - protein, 9 aa, Homo Sapiens
PLAMPLGAR

SEQ ID NO: 787965 - protein, 9 aa, Homo Sapiens
TDLEPEERM

SEQ ID NO: 787966 - protein, 9 aa, Homo Sapiens
IAACQTLYE

SEQ ID NO: 787967 - protein, 9 aa, Homo Sapiens
RQGGKTTHL

SEQ ID NO: 787968 - protein, 9 aa, Homo Sapiens
ALPLEREDS

SEQ ID NO: 787969 - protein, 9 aa, Homo Sapiens
PSNTDLEPE

SEQ ID NO: 787970 - protein, 9 aa, Homo Sapiens
SRDGGSLCY

SEQ ID NO: 787971 - protein, 9 aa, Homo Sapiens
AEHFKINRT

SEQ ID NO: 787972 - protein, 9 aa, Homo Sapiens
SKMLAVSLW

SEQ ID NO: 787973 - protein, 9 aa, Homo Sapiens
PEDKHTRFS

SEQ ID NO: 787974 - protein, 9 aa, Homo Sapiens
WTNPWWVLI

SEQ ID NO: 787975 - protein, 9 aa, Homo Sapiens
LGIWSSHCH

SEQ ID NO: 787976 - protein, 9 aa, Homo Sapiens
SNITSKSFN

SEQ ID NO: 787977 - protein, 9 aa, Homo Sapiens
RGQLLGADR

SEQ ID NO: 787978 - protein, 9 aa, Homo Sapiens
SRILQEAST

SEQ ID NO: 787979 - protein, 9 aa, Homo Sapiens
TFNSLTDLP

SEQ ID NO: 787980 - protein, 9 aa, Homo Sapiens
LQLQEGFGW

SEQ ID NO: 787981 - protein, 9 aa, Homo Sapiens
GAPVTAAAL

SEQ ID NO: 787982 - protein, 9 aa, Homo Sapiens
TVQDYLKKF

SEQ ID NO: 787983 - protein, 9 aa, Homo Sapiens
VRFPLAMPL

SEQ ID NO: 787984 - protein, 9 aa, Homo Sapiens
DDFFSLHAG

SEQ ID NO: 787985 - protein, 9 aa, Homo Sapiens
TCHWNGKKM

SEQ ID NO: 787986 - protein, 9 aa, Homo Sapiens
SKSYPSREE

SEQ ID NO: 787987 - protein, 9 aa, Homo Sapiens
QANQTYGLP

SEQ ID NO: 787988 - protein, 9 aa, Homo Sapiens
SLLCIREFT

SEQ ID NO: 787989 - protein, 9 aa, Homo Sapiens
SWPYSDLVL

SEQ ID NO: 787990 - protein, 9 aa, Homo Sapiens
KEAVTKAQK

SEQ ID NO: 787991 - protein, 9 aa, Homo Sapiens
GRTLSVEVS

SEQ ID NO: 787992 - protein, 9 aa, Homo Sapiens
FDSRRSSAF

SEQ ID NO: 787993 - protein, 9 aa, Homo Sapiens
IAQKDFEAL

SEQ ID NO: 787994 - protein, 9 aa, Homo Sapiens
NTDLEPEER

SEQ ID NO: 787995 - protein, 9 aa, Homo Sapiens
GFYNIESGA

SEQ ID NO: 787996 - protein, 9 aa, Homo Sapiens
KGINRERQK

SEQ ID NO: 787997 - protein, 9 aa, Homo Sapiens
ARGRCPREL

SEQ ID NO: 787998 - protein, 9 aa, Homo Sapiens
LDSPAKGAQ

SEQ ID NO: 787999 - protein, 9 aa, Homo Sapiens
PPAHTCPRG

SEQ ID NO: 788000 - protein, 9 aa, Homo Sapiens
FLLKLLILQ

SEQ ID NO: 788001 - protein, 9 aa, Homo Sapiens
AVYPQANQT

SEQ ID NO: 788002 - protein, 9 aa, Homo Sapiens
EFSNCSYGD

SEQ ID NO: 788003 - protein, 9 aa, Homo Sapiens
VRAMDAEAA

SEQ ID NO: 788004 - protein, 9 aa, Homo Sapiens
LGYRYWASI

SEQ ID NO: 788005 - protein, 9 aa, Homo Sapiens
ISKSYPSRE

SEQ ID NO: 788006 - protein, 9 aa, Homo Sapiens
DDRNTFRHR

SEQ ID NO: 788007 - protein, 9 aa, Homo Sapiens
FLKHRFDRR

SEQ ID NO: 788008 - protein, 9 aa, Homo Sapiens
ITMCRTDLE

SEQ ID NO: 788009 - protein, 9 aa, Homo Sapiens
RTGAVPLIK

SEQ ID NO: 788010 - protein, 9 aa, Homo Sapiens
KYHLSGRPL

SEQ ID NO: 788011 - protein, 9 aa, Homo Sapiens
HTRFSYKGR

SEQ ID NO: 788012 - protein, 9 aa, Homo Sapiens
HRVVVPYEP

SEQ ID NO: 788013 - protein, 9 aa, Homo Sapiens
NDFYSSLES

SEQ ID NO: 788014 - protein, 9 aa, Homo Sapiens
IMHNLIVQM

SEQ ID NO: 788015 - protein, 9 aa, Homo Sapiens
QGGKTTHLF

SEQ ID NO: 788016 - protein, 9 aa, Homo Sapiens
KPRTVSSDY

SEQ ID NO: 788017 - protein, 9 aa, Homo Sapiens
LKKASTNLE

SEQ ID NO: 788018 - protein, 9 aa, Homo Sapiens
SSSKIVCRV

SEQ ID NO: 788019 - protein, 9 aa, Homo Sapiens
ADRQEVQPE

SEQ ID NO: 788020 - protein, 9 aa, Homo Sapiens
GWQPRRFVL

SEQ ID NO: 788021 - protein, 9 aa, Homo Sapiens
VLDEITMCR

SEQ ID NO: 788022 - protein, 9 aa, Homo Sapiens
GSKEAVTKA

SEQ ID NO: 788023 - protein, 9 aa, Homo Sapiens
EASTEGRRF

SEQ ID NO: 788024 - protein, 9 aa, Homo Sapiens
TPGRVHYHL

SEQ ID NO: 788025 - protein, 9 aa, Homo Sapiens
CATPVITDE

SEQ ID NO: 788026 - protein, 9 aa, Homo Sapiens
YNIESGAVW

SEQ ID NO: 788027 - protein, 9 aa, Homo Sapiens
TLSVEVSVE

SEQ ID NO: 788028 - protein, 9 aa, Homo Sapiens
KNSRWALMG

SEQ ID NO: 788029 - protein, 9 aa, Homo Sapiens
QEGFGWEPF

SEQ ID NO: 788030 - protein, 9 aa, Homo Sapiens
ERRHLREIV

SEQ ID NO: 788031 - protein, 9 aa, Homo Sapiens
QTMTAQVKM

SEQ ID NO: 788032 - protein, 9 aa, Homo Sapiens
LFNGKMQDG

SEQ ID NO: 788033 - protein, 9 aa, Homo Sapiens
YLQLQEGFG

SEQ ID NO: 788034 - protein, 9 aa, Homo Sapiens
GPSNTDLEP

SEQ ID NO: 788035 - protein, 9 aa, Homo Sapiens
PGGPAGYLW

SEQ ID NO: 788036 - protein, 9 aa, Homo Sapiens
VDVRFPLAM

SEQ ID NO: 788037 - protein, 9 aa, Homo Sapiens
KNLAEHFKI

SEQ ID NO: 788038 - protein, 9 aa, Homo Sapiens
KVDVRFPLA

SEQ ID NO: 788039 - protein, 9 aa, Homo Sapiens
IVQMYDEGE

SEQ ID NO: 788040 - protein, 9 aa, Homo Sapiens
FRQGGKTTH

SEQ ID NO: 788041 - protein, 9 aa, Homo Sapiens
ITSKSFNMS

SEQ ID NO: 788042 - protein, 9 aa, Homo Sapiens
YWASIGVLQ

SEQ ID NO: 788043 - protein, 9 aa, Homo Sapiens
HQENIEGAT

SEQ ID NO: 788044 - protein, 9 aa, Homo Sapiens
EGTDFLRTC

SEQ ID NO: 788045 - protein, 9 aa, Homo Sapiens
KKGSKEAVT

SEQ ID NO: 788046 - protein, 9 aa, Homo Sapiens
TARGRCPRE

SEQ ID NO: 788047 - protein, 9 aa, Homo Sapiens
EELPLWDTF

SEQ ID NO: 788048 - protein, 9 aa, Homo Sapiens
QEASTEGRR

SEQ ID NO: 788049 - protein, 9 aa, Homo Sapiens
QTAGHRKAV

SEQ ID NO: 788050 - protein, 9 aa, Homo Sapiens
QRARAQTPQ

SEQ ID NO: 788051 - protein, 9 aa, Homo Sapiens
SGTDLGIWS

SEQ ID NO: 788052 - protein, 9 aa, Homo Sapiens
PAAKEQVEL

SEQ ID NO: 788053 - protein, 9 aa, Homo Sapiens
RMSASSEVA

SEQ ID NO: 788054 - protein, 9 aa, Homo Sapiens
NGKKMLSLT

SEQ ID NO: 788055 - protein, 9 aa, Homo Sapiens
AQSKTLEDR

SEQ ID NO: 788056 - protein, 9 aa, Homo Sapiens
LVHKLGGFY

SEQ ID NO: 788057 - protein, 9 aa, Homo Sapiens
SGVMLRSML

SEQ ID NO: 788058 - protein, 9 aa, Homo Sapiens
EIRMTIAAC

SEQ ID NO: 788059 - protein, 9 aa, Homo Sapiens
ENPDEAKKA

SEQ ID NO: 788060 - protein, 9 aa, Homo Sapiens
IFPEGIVAA

SEQ ID NO: 788061 - protein, 9 aa, Homo Sapiens
SRHRAEALP

SEQ ID NO: 788062 - protein, 9 aa, Homo Sapiens
SYPHHVIGT

SEQ ID NO: 788063 - protein, 9 aa, Homo Sapiens
KNIANPHTT

SEQ ID NO: 788064 - protein, 9 aa, Homo Sapiens
QRVFGPAGK

SEQ ID NO: 788065 - protein, 9 aa, Homo Sapiens
PICPIEGRM

SEQ ID NO: 788066 - protein, 9 aa, Homo Sapiens
ELSVFLKHT

SEQ ID NO: 788067 - protein, 9 aa, Homo Sapiens
CNTGLSLLE

SEQ ID NO: 788068 - protein, 9 aa, Homo Sapiens
KASTNLEEP

SEQ ID NO: 788069 - protein, 9 aa, Homo Sapiens
WHRESLGRK

SEQ ID NO: 788070 - protein, 9 aa, Homo Sapiens
KCKQCGKAL

SEQ ID NO: 788071 - protein, 9 aa, Homo Sapiens
SAYAPQRPP

SEQ ID NO: 788072 - protein, 9 aa, Homo Sapiens
IEKLADNIL

SEQ ID NO: 788073 - protein, 9 aa, Homo Sapiens
QPRRFVLDN

SEQ ID NO: 788074 - protein, 9 aa, Homo Sapiens
TSGTDLGIW

SEQ ID NO: 788075 - protein, 9 aa, Homo Sapiens
WMSSSKIVC

SEQ ID NO: 788076 - protein, 9 aa, Homo Sapiens
KHLLPETTY

SEQ ID NO: 788077 - protein, 9 aa, Homo Sapiens
WPAAKEQVE

SEQ ID NO: 788078 - protein, 9 aa, Homo Sapiens
SDQEPSRVS

SEQ ID NO: 788079 - protein, 9 aa, Homo Sapiens
ATPVITDEI

SEQ ID NO: 788080 - protein, 9 aa, Homo Sapiens
QMYFFFFGS

SEQ ID NO: 788081 - protein, 9 aa, Homo Sapiens
LISKSYPSR

SEQ ID NO: 788082 - protein, 9 aa, Homo Sapiens
PKNSRWALM

SEQ ID NO: 788083 - protein, 9 aa, Homo Sapiens
EGRMGGART

SEQ ID NO: 788084 - protein, 9 aa, Homo Sapiens
FRDVYHLSR

SEQ ID NO: 788085 - protein, 9 aa, Homo Sapiens
EIVDCDRCT

SEQ ID NO: 788086 - protein, 9 aa, Homo Sapiens
IVDCDRCTI

SEQ ID NO: 788087 - protein, 9 aa, Homo Sapiens
MYFFFFGSS

SEQ ID NO: 788088 - protein, 9 aa, Homo Sapiens
ADDDIASLV

SEQ ID NO: 788089 - protein, 9 aa, Homo Sapiens
VALIVQCLA

SEQ ID NO: 788090 - protein, 9 aa, Homo Sapiens
GKKMLSLTH

SEQ ID NO: 788091 - protein, 9 aa, Homo Sapiens
DFYSSLESS

SEQ ID NO: 788092 - protein, 9 aa, Homo Sapiens
IASLVFHST

SEQ ID NO: 788093 - protein, 9 aa, Homo Sapiens
NPPITEFSN

SEQ ID NO: 788094 - protein, 9 aa, Homo Sapiens
DEAKKALKH

SEQ ID NO: 788095 - protein, 9 aa, Homo Sapiens
KRNVLISDL

SEQ ID NO: 788096 - protein, 9 aa, Homo Sapiens
GRLALHRAP

SEQ ID NO: 788097 - protein, 9 aa, Homo Sapiens
MPRKQPVGC

SEQ ID NO: 788098 - protein, 9 aa, Homo Sapiens
VYEAVKEAL

SEQ ID NO: 788099 - protein, 9 aa, Homo Sapiens
KMLSLTHLF

SEQ ID NO: 788100 - protein, 9 aa, Homo Sapiens
ELNVTFNSL

SEQ ID NO: 788101 - protein, 9 aa, Homo Sapiens
VFLLKLLIL

SEQ ID NO: 788102 - protein, 9 aa, Homo Sapiens
TYGNDSHQR

SEQ ID NO: 788103 - protein, 9 aa, Homo Sapiens
PRQYFIRVL

SEQ ID NO: 788104 - protein, 9 aa, Homo Sapiens
DAGGAGIDC

SEQ ID NO: 788105 - protein, 9 aa, Homo Sapiens
KEDDFFSLH

SEQ ID NO: 788106 - protein, 9 aa, Homo Sapiens
PAGYLWRAS

SEQ ID NO: 788107 - protein, 9 aa, Homo Sapiens
HNPAVVDDA

SEQ ID NO: 788108 - protein, 9 aa, Homo Sapiens
VHYHLDSPA

SEQ ID NO: 788109 - protein, 9 aa, Homo Sapiens
MWGRTARGR

SEQ ID NO: 788110 - protein, 9 aa, Homo Sapiens
RHRAEALPL

SEQ ID NO: 788111 - protein, 9 aa, Homo Sapiens
RGVPACSHV

SEQ ID NO: 788112 - protein, 9 aa, Homo Sapiens
EALLPPLPD

SEQ ID NO: 788113 - protein, 9 aa, Homo Sapiens
GAGIDCEEP

SEQ ID NO: 788114 - protein, 9 aa, Homo Sapiens
TATAALSFR

SEQ ID NO: 788115 - protein, 9 aa, Homo Sapiens
LKAYRFSIS

SEQ ID NO: 788116 - protein, 9 aa, Homo Sapiens
NAKLYGPDI

SEQ ID NO: 788117 - protein, 9 aa, Homo Sapiens
SHQRCQCQN

SEQ ID NO: 788118 - protein, 9 aa, Homo Sapiens
AGITNPIMP

SEQ ID NO: 788119 - protein, 9 aa, Homo Sapiens
RLWDGLWMN

SEQ ID NO: 788120 - protein, 9 aa, Homo Sapiens
GNTPSNEHA

SEQ ID NO: 788121 - protein, 9 aa, Homo Sapiens
MKLNLKVEI

SEQ ID NO: 788122 - protein, 9 aa, Homo Sapiens
GTDFLRTCS

SEQ ID NO: 788123 - protein, 9 aa, Homo Sapiens
DIASLVFHS

SEQ ID NO: 788124 - protein, 9 aa, Homo Sapiens
ADSANASLF

SEQ ID NO: 788125 - protein, 9 aa, Homo Sapiens
RRVLDEITM

SEQ ID NO: 788126 - protein, 9 aa, Homo Sapiens
AHTCPRGVP

SEQ ID NO: 788127 - protein, 9 aa, Homo Sapiens
LICCTYLQI

SEQ ID NO: 788128 - protein, 9 aa, Homo Sapiens
WKNLAEHFK

SEQ ID NO: 788129 - protein, 9 aa, Homo Sapiens
QLGQRVFGP

SEQ ID NO: 788130 - protein, 9 aa, Homo Sapiens
ARRYSPPGS

SEQ ID NO: 788131 - protein, 9 aa, Homo Sapiens
ANVLPEYKL

SEQ ID NO: 788132 - protein, 9 aa, Homo Sapiens
ALHRAPGPD

SEQ ID NO: 788133 - protein, 9 aa, Homo Sapiens
LKHRFDRRI

SEQ ID NO: 788134 - protein, 9 aa, Homo Sapiens
TPVITDEIL

SEQ ID NO: 788135 - protein, 9 aa, Homo Sapiens
GTYLFHLTV

SEQ ID NO: 788136 - protein, 9 aa, Homo Sapiens
RGRCPRELR

SEQ ID NO: 788137 - protein, 9 aa, Homo Sapiens
AEALPLERE

SEQ ID NO: 788138 - protein, 9 aa, Homo Sapiens
VLISDLGGG

SEQ ID NO: 788139 - protein, 9 aa, Homo Sapiens
LTAEWMSSS

SEQ ID NO: 788140 - protein, 9 aa, Homo Sapiens
PDEAKKALK

SEQ ID NO: 788141 - protein, 9 aa, Homo Sapiens
PIEGRMGGA

SEQ ID NO: 788142 - protein, 9 aa, Homo Sapiens
IRVLDIAGF

SEQ ID NO: 788143 - protein, 9 aa, Homo Sapiens
ALLPPLPDN

SEQ ID NO: 788144 - protein, 9 aa, Homo Sapiens
KSKKGINRE

SEQ ID NO: 788145 - protein, 9 aa, Homo Sapiens
QLLGADRQE

SEQ ID NO: 788146 - protein, 9 aa, Homo Sapiens
AARTQRARA

SEQ ID NO: 788147 - protein, 9 aa, Homo Sapiens
TQVLSLGAN

SEQ ID NO: 788148 - protein, 9 aa, Homo Sapiens
HLSRHKLSH

SEQ ID NO: 788149 - protein, 9 aa, Homo Sapiens
MATLIKRFH

SEQ ID NO: 788150 - protein, 9 aa, Homo Sapiens
ASIGVLQSC

SEQ ID NO: 788151 - protein, 9 aa, Homo Sapiens
AVPLIKAPK

SEQ ID NO: 788152 - protein, 9 aa, Homo Sapiens
PQANQTYGL

SEQ ID NO: 788153 - protein, 9 aa, Homo Sapiens
FDYEDIPSV

SEQ ID NO: 788154 - protein, 9 aa, Homo Sapiens
LMGRTLSVE

SEQ ID NO: 788155 - protein, 9 aa, Homo Sapiens
LKPIVVLHV

SEQ ID NO: 788156 - protein, 9 aa, Homo Sapiens
LMKLNLKVE

SEQ ID NO: 788157 - protein, 9 aa, Homo Sapiens
PHTTSGTDL

SEQ ID NO: 788158 - protein, 9 aa, Homo Sapiens
EKALAPAPP

SEQ ID NO: 788159 - protein, 9 aa, Homo Sapiens
AEEAEEPAE

SEQ ID NO: 788160 - protein, 9 aa, Homo Sapiens
GNPPITEFS

SEQ ID NO: 788161 - protein, 9 aa, Homo Sapiens
DKHTRFSYK

SEQ ID NO: 788162 - protein, 9 aa, Homo Sapiens
SINNKKKYS

SEQ ID NO: 788163 - protein, 9 aa, Homo Sapiens
SWCTAVGTS

SEQ ID NO: 788164 - protein, 9 aa, Homo Sapiens
GPKNSRWAL

SEQ ID NO: 788165 - protein, 9 aa, Homo Sapiens
SEKALAPAP

SEQ ID NO: 788166 - protein, 9 aa, Homo Sapiens
GADRQEVQP

SEQ ID NO: 788167 - protein, 9 aa, Homo Sapiens
HLLPETTYR

SEQ ID NO: 788168 - protein, 9 aa, Homo Sapiens
GDTKVHHMH

SEQ ID NO: 788169 - protein, 9 aa, Homo Sapiens
SKRGCCHIQ

SEQ ID NO: 788170 - protein, 9 aa, Homo Sapiens
TIAACQTLY

SEQ ID NO: 788171 - protein, 9 aa, Homo Sapiens
QSKTLEDRN

SEQ ID NO: 788172 - protein, 9 aa, Homo Sapiens
REIVELLEK

SEQ ID NO: 788173 - protein, 9 aa, Homo Sapiens
GSEKALAPA

SEQ ID NO: 788174 - protein, 9 aa, Homo Sapiens
EITMCRTDL

SEQ ID NO: 788175 - protein, 9 aa, Homo Sapiens
RRISITRVT

SEQ ID NO: 788176 - protein, 9 aa, Homo Sapiens
GREHGLPGY

SEQ ID NO: 788177 - protein, 9 aa, Homo Sapiens
VQMYDEGER

SEQ ID NO: 788178 - protein, 9 aa, Homo Sapiens
INNKKKYSN

SEQ ID NO: 788179 - protein, 9 aa, Homo Sapiens
KKASTNLEE

SEQ ID NO: 788180 - protein, 9 aa, Homo Sapiens
RLQTMTAQV

SEQ ID NO: 788181 - protein, 9 aa, Homo Sapiens
AEGCSVGAQ

SEQ ID NO: 788182 - protein, 9 aa, Homo Sapiens
NNKKKYSNH

SEQ ID NO: 788183 - protein, 9 aa, Homo Sapiens
VDCDRCTID

SEQ ID NO: 788184 - protein, 9 aa, Homo Sapiens
PVLPDSSSI

SEQ ID NO: 788185 - protein, 9 aa, Homo Sapiens
HRESLGRKI

SEQ ID NO: 788186 - protein, 9 aa, Homo Sapiens
GAVALIVQC

SEQ ID NO: 788187 - protein, 9 aa, Homo Sapiens
IVAAGITNP

SEQ ID NO: 788188 - protein, 9 aa, Homo Sapiens
RCTINPSGT

SEQ ID NO: 788189 - protein, 9 aa, Homo Sapiens
MRLTVMCAV

SEQ ID NO: 788190 - protein, 9 aa, Homo Sapiens
AYAPQRPPA

SEQ ID NO: 788191 - protein, 9 aa, Homo Sapiens
QKDFEALLP

SEQ ID NO: 788192 - protein, 9 aa, Homo Sapiens
RVVVPYEPP

SEQ ID NO: 788193 - protein, 9 aa, Homo Sapiens
HAGHPSSCN

SEQ ID NO: 788194 - protein, 9 aa, Homo Sapiens
ICPIEGRMG

SEQ ID NO: 788195 - protein, 9 aa, Homo Sapiens
VSSDYLHPQ

SEQ ID NO: 788196 - protein, 9 aa, Homo Sapiens
HKLGGFYNI

SEQ ID NO: 788197 - protein, 9 aa, Homo Sapiens
KALLALFMA

SEQ ID NO: 788198 - protein, 9 aa, Homo Sapiens
EQGTYGNDS

SEQ ID NO: 788199 - protein, 9 aa, Homo Sapiens
SPPGSIFLS

SEQ ID NO: 788200 - protein, 9 aa, Homo Sapiens
RVLDEITMC

SEQ ID NO: 788201 - protein, 9 aa, Homo Sapiens
LALFMAEML

SEQ ID NO: 788202 - protein, 9 aa, Homo Sapiens
YFIRVLDIA

SEQ ID NO: 788203 - protein, 9 aa, Homo Sapiens
QENIEGATA

SEQ ID NO: 788204 - protein, 9 aa, Homo Sapiens
EHFKINRTV

SEQ ID NO: 788205 - protein, 9 aa, Homo Sapiens
KEQVELCKL

SEQ ID NO: 788206 - protein, 9 aa, Homo Sapiens
LADNILVKT

SEQ ID NO: 788207 - protein, 9 aa, Homo Sapiens
ALAPAPPPS

SEQ ID NO: 788208 - protein, 9 aa, Homo Sapiens
RLLHGRLEV

SEQ ID NO: 788209 - protein, 9 aa, Homo Sapiens
LGQRVFGPA

SEQ ID NO: 788210 - protein, 9 aa, Homo Sapiens
SENHIAGHA

SEQ ID NO: 788211 - protein, 9 aa, Homo Sapiens
DSENHIAGH

SEQ ID NO: 788212 - protein, 9 aa, Homo Sapiens
DYLKKFYQL

SEQ ID NO: 788213 - protein, 9 aa, Homo Sapiens
ESSIFDYED

SEQ ID NO: 788214 - protein, 9 aa, Homo Sapiens
SSDQEPSRV

SEQ ID NO: 788215 - protein, 9 aa, Homo Sapiens
TASRLQTMT

SEQ ID NO: 788216 - protein, 9 aa, Homo Sapiens
AGHRKAVKT

SEQ ID NO: 788217 - protein, 9 aa, Homo Sapiens
MTIAACQTL

SEQ ID NO: 788218 - protein, 9 aa, Homo Sapiens
NTPSNEHAA

SEQ ID NO: 788219 - protein, 9 aa, Homo Sapiens
LLSKSGNTP

SEQ ID NO: 788220 - protein, 9 aa, Homo Sapiens
LHGRLEVDL

SEQ ID NO: 788221 - protein, 9 aa, Homo Sapiens
YLKKFYQLP

SEQ ID NO: 788222 - protein, 9 aa, Homo Sapiens
LTVMCAVCL

SEQ ID NO: 788223 - protein, 9 aa, Homo Sapiens
STIEPLKKN

SEQ ID NO: 788224 - protein, 9 aa, Homo Sapiens
CQWKNLAEH

SEQ ID NO: 788225 - protein, 9 aa, Homo Sapiens
KHTRFSYKG

SEQ ID NO: 788226 - protein, 9 aa, Homo Sapiens
YHLSRHKLS

SEQ ID NO: 788227 - protein, 9 aa, Homo Sapiens
REGRAAPAF

SEQ ID NO: 788228 - protein, 9 aa, Homo Sapiens
MYQEMCWEF

SEQ ID NO: 788229 - protein, 9 aa, Homo Sapiens
IDCEEPRHK

SEQ ID NO: 788230 - protein, 9 aa, Homo Sapiens
GPDIGQPRR

SEQ ID NO: 788231 - protein, 9 aa, Homo Sapiens
SGPPEPVLP

SEQ ID NO: 788232 - protein, 9 aa, Homo Sapiens
YGDTKVHHM

SEQ ID NO: 788233 - protein, 9 aa, Homo Sapiens
AAGGASSFP

SEQ ID NO: 788234 - protein, 9 aa, Homo Sapiens
LQTMTAQVK

SEQ ID NO: 788235 - protein, 9 aa, Homo Sapiens
VIGTQLNTV

SEQ ID NO: 788236 - protein, 9 aa, Homo Sapiens
GGNMTLQCG

SEQ ID NO: 788237 - protein, 9 aa, Homo Sapiens
ASGGNMTLQ

SEQ ID NO: 788238 - protein, 9 aa, Homo Sapiens
VITDEILPS

SEQ ID NO: 788239 - protein, 9 aa, Homo Sapiens
FNGKMQDGN

SEQ ID NO: 788240 - protein, 9 aa, Homo Sapiens
RAEALPLER

SEQ ID NO: 788241 - protein, 9 aa, Homo Sapiens
SHIIQLKNE

SEQ ID NO: 788242 - protein, 9 aa, Homo Sapiens
SDAGGAGID

SEQ ID NO: 788243 - protein, 9 aa, Homo Sapiens
NPSGTTISV

SEQ ID NO: 788244 - protein, 9 aa, Homo Sapiens
EGPEDKHTR

SEQ ID NO: 788245 - protein, 9 aa, Homo Sapiens
VETAEEAEE

SEQ ID NO: 788246 - protein, 9 aa, Homo Sapiens
GNDSHQRCQ

SEQ ID NO: 788247 - protein, 9 aa, Homo Sapiens
QVPALRGPP

SEQ ID NO: 788248 - protein, 9 aa, Homo Sapiens
THDVLKKAS

SEQ ID NO: 788249 - protein, 9 aa, Homo Sapiens
LQDSWCTAV

SEQ ID NO: 788250 - protein, 9 aa, Homo Sapiens
SIGVLQSCE

SEQ ID NO: 788251 - protein, 9 aa, Homo Sapiens
HLSGRPLNI

SEQ ID NO: 788252 - protein, 9 aa, Homo Sapiens
RNTFRHRVV

SEQ ID NO: 788253 - protein, 9 aa, Homo Sapiens
VYPQANQTY

SEQ ID NO: 788254 - protein, 9 aa, Homo Sapiens
MASWTNPWW

SEQ ID NO: 788255 - protein, 9 aa, Homo Sapiens
TMNKYHLSG

SEQ ID NO: 788256 - protein, 9 aa, Homo Sapiens
LSDAGGAGI

SEQ ID NO: 788257 - protein, 9 aa, Homo Sapiens
NIANPHTTS

SEQ ID NO: 788258 - protein, 9 aa, Homo Sapiens
LGSRVRAMD

SEQ ID NO: 788259 - protein, 9 aa, Homo Sapiens
FLQVFVQSH

SEQ ID NO: 788260 - protein, 9 aa, Homo Sapiens
LPLWDTFVA

SEQ ID NO: 788261 - protein, 9 aa, Homo Sapiens
SRLQTMTAQ

SEQ ID NO: 788262 - protein, 9 aa, Homo Sapiens
YGTNTAREG

SEQ ID NO: 788263 - protein, 9 aa, Homo Sapiens
YWPAAKEQV

SEQ ID NO: 788264 - protein, 9 aa, Homo Sapiens
APQRPPAPP

SEQ ID NO: 788265 - protein, 9 aa, Homo Sapiens
DRRISITRV

SEQ ID NO: 788266 - protein, 9 aa, Homo Sapiens
SLESSGWLR

SEQ ID NO: 788267 - protein, 9 aa, Homo Sapiens
ASSFPVYSL

SEQ ID NO: 788268 - protein, 9 aa, Homo Sapiens
HEARRYSPP

SEQ ID NO: 788269 - protein, 9 aa, Homo Sapiens
LETMNKYHL

SEQ ID NO: 788270 - protein, 9 aa, Homo Sapiens
NDSHQRCQC

SEQ ID NO: 788271 - protein, 9 aa, Homo Sapiens
CQTLYESSV

SEQ ID NO: 788272 - protein, 9 aa, Homo Sapiens
VLSLGANVL

SEQ ID NO: 788273 - protein, 9 aa, Homo Sapiens
DDIASLVFH

SEQ ID NO: 788274 - protein, 9 aa, Homo Sapiens
DSYPHHVIG

SEQ ID NO: 788275 - protein, 9 aa, Homo Sapiens
VNDFYSSLE

SEQ ID NO: 788276 - protein, 9 aa, Homo Sapiens
TVSSDYLHP

SEQ ID NO: 788277 - protein, 9 aa, Homo Sapiens
KLADNILVK

SEQ ID NO: 788278 - protein, 9 aa, Homo Sapiens
SKSGNTPSN

SEQ ID NO: 788279 - protein, 9 aa, Homo Sapiens
RVSCNTGLS

SEQ ID NO: 788280 - protein, 9 aa, Homo Sapiens
AGIDCEEPR

SEQ ID NO: 788281 - protein, 9 aa, Homo Sapiens
AAEKPRTVS

SEQ ID NO: 788282 - protein, 9 aa, Homo Sapiens
NLIVQMYDE

SEQ ID NO: 788283 - protein, 9 aa, Homo Sapiens
EFENPDEAK

SEQ ID NO: 788284 - protein, 9 aa, Homo Sapiens
LQELNVTFN

SEQ ID NO: 788285 - protein, 9 aa, Homo Sapiens
VWKMYQEMC

SEQ ID NO: 788286 - protein, 9 aa, Homo Sapiens
RVHYHLDSP

SEQ ID NO: 788287 - protein, 9 aa, Homo Sapiens
VHKLGGFYN

SEQ ID NO: 788288 - protein, 9 aa, Homo Sapiens
GPPEPVLPD

SEQ ID NO: 788289 - protein, 9 aa, Homo Sapiens
ASWTNPWWV

SEQ ID NO: 788290 - protein, 9 aa, Homo Sapiens
LKKNLESLD

SEQ ID NO: 788291 - protein, 9 aa, Homo Sapiens
NPAVVDDAQ

SEQ ID NO: 788292 - protein, 9 aa, Homo Sapiens
RAARTQRAR

SEQ ID NO: 788293 - protein, 9 aa, Homo Sapiens
LALHRAPGP

SEQ ID NO: 788294 - protein, 9 aa, Homo Sapiens
QSTGPSNTD

SEQ ID NO: 788295 - protein, 9 aa, Homo Sapiens
IIVFERLWD

SEQ ID NO: 788296 - protein, 9 aa, Homo Sapiens
PRQTAGHRK

SEQ ID NO: 788297 - protein, 9 aa, Homo Sapiens
EPSRVSHEQ

SEQ ID NO: 788298 - protein, 9 aa, Homo Sapiens
HRRKLRPAW

SEQ ID NO: 788299 - protein, 9 aa, Homo Sapiens
ALKLKAYRF

SEQ ID NO: 788300 - protein, 9 aa, Homo Sapiens
GGPAGYLWR

SEQ ID NO: 788301 - protein, 9 aa, Homo Sapiens
DFLKHRFDR

SEQ ID NO: 788302 - protein, 9 aa, Homo Sapiens
AQLISHNPA

SEQ ID NO: 788303 - protein, 9 aa, Homo Sapiens
PEPVLPDSS

SEQ ID NO: 788304 - protein, 9 aa, Homo Sapiens
EQVELCKLA

SEQ ID NO: 788305 - protein, 9 aa, Homo Sapiens
FPVYSLWKT

SEQ ID NO: 788306 - protein, 9 aa, Homo Sapiens
LSFRSAAPI

SEQ ID NO: 788307 - protein, 9 aa, Homo Sapiens
VALGNRKRE

SEQ ID NO: 788308 - protein, 9 aa, Homo Sapiens
GRTARGRCP

SEQ ID NO: 788309 - protein, 9 aa, Homo Sapiens
STEGRRFRV

SEQ ID NO: 788310 - protein, 9 aa, Homo Sapiens
LLTAEWMSS

SEQ ID NO: 788311 - protein, 9 aa, Homo Sapiens
FNYSWPYSD

SEQ ID NO: 788312 - protein, 9 aa, Homo Sapiens
ANPHTTSGT

SEQ ID NO: 788313 - protein, 9 aa, Homo Sapiens
GIWSSHCHR

SEQ ID NO: 788314 - protein, 9 aa, Homo Sapiens
SADDDIASL

SEQ ID NO: 788315 - protein, 9 aa, Homo Sapiens
RHRVVVPYE

SEQ ID NO: 788316 - protein, 9 aa, Homo Sapiens
LSLGANVLP

SEQ ID NO: 788317 - protein, 9 aa, Homo Sapiens
KKGINRERQ

SEQ ID NO: 788318 - protein, 9 aa, Homo Sapiens
FERLWDGLW

SEQ ID NO: 788319 - protein, 9 aa, Homo Sapiens
FPLAMPLGA

SEQ ID NO: 788320 - protein, 9 aa, Homo Sapiens
QWKNLAEHF

SEQ ID NO: 788321 - protein, 9 aa, Homo Sapiens
YGAVALIVQ

SEQ ID NO: 788322 - protein, 9 aa, Homo Sapiens
PPFPVCLSW

SEQ ID NO: 788323 - protein, 9 aa, Homo Sapiens
WCTAVGTSR

SEQ ID NO: 788324 - protein, 9 aa, Homo Sapiens
THRRKLRPA

SEQ ID NO: 788325 - protein, 9 aa, Homo Sapiens
QGTYGNDSH

SEQ ID NO: 788326 - protein, 9 aa, Homo Sapiens
KKMLSLTHL

SEQ ID NO: 788327 - protein, 9 aa, Homo Sapiens
DALISKSYP

SEQ ID NO: 788328 - protein, 9 aa, Homo Sapiens
VFGPAGKVV

SEQ ID NO: 788329 - protein, 9 aa, Homo Sapiens
ALLALFMAE

SEQ ID NO: 788330 - protein, 9 aa, Homo Sapiens
DVLKKASTN

SEQ ID NO: 788331 - protein, 9 aa, Homo Sapiens
VKFLLRLLH

SEQ ID NO: 788332 - protein, 9 aa, Homo Sapiens
SGGNMTLQC

SEQ ID NO: 788333 - protein, 9 aa, Homo Sapiens
VGAQEPPRA

SEQ ID NO: 788334 - protein, 9 aa, Homo Sapiens
PVGCIFLLT

SEQ ID NO: 788335 - protein, 9 aa, Homo Sapiens
ALRGPPAPA

SEQ ID NO: 788336 - protein, 9 aa, Homo Sapiens
QCGKALICC

SEQ ID NO: 788337 - protein, 9 aa, Homo Sapiens
YLWRASVAQ

SEQ ID NO: 788338 - protein, 9 aa, Homo Sapiens
WALMGYNDQ

SEQ ID NO: 788339 - protein, 9 aa, Homo Sapiens
SYPSREEYE

SEQ ID NO: 788340 - protein, 9 aa, Homo Sapiens
FDRRISITR

SEQ ID NO: 788341 - protein, 9 aa, Homo Sapiens
RHSLLCIRE

SEQ ID NO: 788342 - protein, 9 aa, Homo Sapiens
DSHQRCQCQ

SEQ ID NO: 788343 - protein, 9 aa, Homo Sapiens
LISDLGGGT

SEQ ID NO: 788344 - protein, 9 aa, Homo Sapiens
CYPGWSQTP

SEQ ID NO: 788345 - protein, 9 aa, Homo Sapiens
QRGRLALHR

SEQ ID NO: 788346 - protein, 9 aa, Homo Sapiens
ASINNKKKY

SEQ ID NO: 788347 - protein, 9 aa, Homo Sapiens
QYFIRVLDI

SEQ ID NO: 788348 - protein, 9 aa, Homo Sapiens
IEPLKKNLE

SEQ ID NO: 788349 - protein, 9 aa, Homo Sapiens
TQMYFFFFG

SEQ ID NO: 788350 - protein, 9 aa, Homo Sapiens
TNTAREGRA

SEQ ID NO: 788351 - protein, 9 aa, Homo Sapiens
GQERVALGN

SEQ ID NO: 788352 - protein, 9 aa, Homo Sapiens
RRSSAFRSI

SEQ ID NO: 788353 - protein, 9 aa, Homo Sapiens
DSANASLFN

SEQ ID NO: 788354 - protein, 9 aa, Homo Sapiens
NIEGATATL

SEQ ID NO: 788355 - protein, 9 aa, Homo Sapiens
DLEPEERMA

SEQ ID NO: 788356 - protein, 9 aa, Homo Sapiens
DGSPPFPVC

SEQ ID NO: 788357 - protein, 9 aa, Homo Sapiens
MSSSKIVCR

SEQ ID NO: 788358 - protein, 9 aa, Homo Sapiens
LLKLLILQY

SEQ ID NO: 788359 - protein, 9 aa, Homo Sapiens
AEWMSSSKI

SEQ ID NO: 788360 - protein, 9 aa, Homo Sapiens
GRCPRELRR

SEQ ID NO: 788361 - protein, 9 aa, Homo Sapiens
VTGLAFRQG

SEQ ID NO: 788362 - protein, 9 aa, Homo Sapiens
FCSKRGCCH

SEQ ID NO: 788363 - protein, 9 aa, Homo Sapiens
SLFNGKMQD

SEQ ID NO: 788364 - protein, 9 aa, Homo Sapiens
LHRAPGPDG

SEQ ID NO: 788365 - protein, 9 aa, Homo Sapiens
SFCSKRGCC

SEQ ID NO: 788366 - protein, 9 aa, Homo Sapiens
GAEGCSVGA

SEQ ID NO: 788367 - protein, 9 aa, Homo Sapiens
VGTSRIDQD

SEQ ID NO: 788368 - protein, 9 aa, Homo Sapiens
GFGWEPFTQ

SEQ ID NO: 788369 - protein, 9 aa, Homo Sapiens
LHVYEAVKE

SEQ ID NO: 788370 - protein, 9 aa, Homo Sapiens
CSKRGCCHI

SEQ ID NO: 788371 - protein, 9 aa, Homo Sapiens
NMLRALKLK

SEQ ID NO: 788372 - protein, 9 aa, Homo Sapiens
NILVKTTFG

SEQ ID NO: 788373 - protein, 9 aa, Homo Sapiens
SLCYPGWSQ

SEQ ID NO: 788374 - protein, 9 aa, Homo Sapiens
ALGLGQISH

SEQ ID NO: 788375 - protein, 9 aa, Homo Sapiens
ERLWDGLWM

SEQ ID NO: 788376 - protein, 9 aa, Homo Sapiens
IVVLHVYEA

SEQ ID NO: 788377 - protein, 9 aa, Homo Sapiens
TPPPPGKPQ

SEQ ID NO: 788378 - protein, 9 aa, Homo Sapiens
ACQTLYESS

SEQ ID NO: 788379 - protein, 9 aa, Homo Sapiens
TPQVPALRG

SEQ ID NO: 788380 - protein, 9 aa, Homo Sapiens
GSPPFPVCL

SEQ ID NO: 788381 - protein, 9 aa, Homo Sapiens
FRSAAPITF

SEQ ID NO: 788382 - protein, 9 aa, Homo Sapiens
INLQRGREH

SEQ ID NO: 788383 - protein, 9 aa, Homo Sapiens
DRNTLRLWK

SEQ ID NO: 788384 - protein, 9 aa, Homo Sapiens
GPEDKHTRF

SEQ ID NO: 788385 - protein, 9 aa, Homo Sapiens
EYLAIMNGD

SEQ ID NO: 788386 - protein, 9 aa, Homo Sapiens
LGGFYNIES

SEQ ID NO: 788387 - protein, 9 aa, Homo Sapiens
KLRPAWVAG

SEQ ID NO: 788388 - protein, 9 aa, Homo Sapiens
RFDRRISIT

SEQ ID NO: 788389 - protein, 9 aa, Homo Sapiens
LASINNKKK

SEQ ID NO: 788390 - protein, 9 aa, Homo Sapiens
ILQEASTEG

SEQ ID NO: 788391 - protein, 9 aa, Homo Sapiens
SLGANVLPE

SEQ ID NO: 788392 - protein, 9 aa, Homo Sapiens
AAGITNPIM

SEQ ID NO: 788393 - protein, 9 aa, Homo Sapiens
LSRHKLSHS

SEQ ID NO: 788394 - protein, 9 aa, Homo Sapiens
MCWEFFPAG

SEQ ID NO: 788395 - protein, 9 aa, Homo Sapiens
SVEVSVETI

SEQ ID NO: 788396 - protein, 9 aa, Homo Sapiens
CTAVGTSRI

SEQ ID NO: 788397 - protein, 9 aa, Homo Sapiens
KPIVVLHVY

SEQ ID NO: 788398 - protein, 9 aa, Homo Sapiens
VLPDSSSIL

SEQ ID NO: 788399 - protein, 9 aa, Homo Sapiens
SIFDYEDIP

SEQ ID NO: 788400 - protein, 9 aa, Homo Sapiens
DYEDIPSVT

SEQ ID NO: 788401 - protein, 9 aa, Homo Sapiens
YSWPYSDLV

SEQ ID NO: 788402 - protein, 9 aa, Homo Sapiens
SKKGINRER

SEQ ID NO: 788403 - protein, 9 aa, Homo Sapiens
IRMTIAACQ

SEQ ID NO: 788404 - protein, 9 aa, Homo Sapiens
LFHLTVTSS

SEQ ID NO: 788405 - protein, 9 aa, Homo Sapiens
IGRLRHQEN

SEQ ID NO: 788406 - protein, 9 aa, Homo Sapiens
GCSVGAQEP

SEQ ID NO: 788407 - protein, 9 aa, Homo Sapiens
KGSKEAVTK

SEQ ID NO: 788408 - protein, 9 aa, Homo Sapiens
DTSADDDIA

SEQ ID NO: 788409 - protein, 9 aa, Homo Sapiens
TGLAFRQGG

SEQ ID NO: 788410 - protein, 9 aa, Homo Sapiens
MTAQVKMCL

SEQ ID NO: 788411 - protein, 9 aa, Homo Sapiens
LIFSNITSK

SEQ ID NO: 788412 - protein, 9 aa, Homo Sapiens
LTASRLQTM

SEQ ID NO: 788413 - protein, 9 aa, Homo Sapiens
AREGRAAPA

SEQ ID NO: 788414 - protein, 9 aa, Homo Sapiens
VQCLALLTL

SEQ ID NO: 788415 - protein, 9 aa, Homo Sapiens
LPLEREDSG

SEQ ID NO: 788416 - protein, 9 aa, Homo Sapiens
LSVNDFYSS

SEQ ID NO: 788417 - protein, 9 aa, Homo Sapiens
RQYFIRVLD

SEQ ID NO: 788418 - protein, 9 aa, Homo Sapiens
GRHSLLCIR

SEQ ID NO: 788419 - protein, 9 aa, Homo Sapiens
EDDFFSLHA

SEQ ID NO: 788420 - protein, 9 aa, Homo Sapiens
QCGSQKGYH

SEQ ID NO: 788421 - protein, 9 aa, Homo Sapiens
PDSSSILAD

SEQ ID NO: 788422 - protein, 9 aa, Homo Sapiens
YPHHVIGTQ

SEQ ID NO: 788423 - protein, 9 aa, Homo Sapiens
AKLYGPDIG

SEQ ID NO: 788424 - protein, 9 aa, Homo Sapiens
SFDSRRSSA

SEQ ID NO: 788425 - protein, 9 aa, Homo Sapiens
VGCIFLLTF

SEQ ID NO: 788426 - protein, 9 aa, Homo Sapiens
WGSSSDQEP

SEQ ID NO: 788427 - protein, 9 aa, Homo Sapiens
YVWKMYQEM

SEQ ID NO: 788428 - protein, 9 aa, Homo Sapiens
VAAGITNPI

SEQ ID NO: 788429 - protein, 9 aa, Homo Sapiens
DCDRCTIDW

SEQ ID NO: 788430 - protein, 9 aa, Homo Sapiens
LQEGFGWEP

SEQ ID NO: 788431 - protein, 9 aa, Homo Sapiens
RRKLRPAWV

SEQ ID NO: 788432 - protein, 9 aa, Homo Sapiens
GPRQTAGHR

SEQ ID NO: 788433 - protein, 9 aa, Homo Sapiens
HTCPRGVPA

SEQ ID NO: 788434 - protein, 9 aa, Homo Sapiens
KGAEGCSVG

SEQ ID NO: 788435 - protein, 9 aa, Homo Sapiens
FPEGIVAAG

SEQ ID NO: 788436 - protein, 9 aa, Homo Sapiens
RDVYHLSRH

SEQ ID NO: 788437 - protein, 9 aa, Homo Sapiens
TESGVMLRS

SEQ ID NO: 788438 - protein, 9 aa, Homo Sapiens
YSPPGSIFL

SEQ ID NO: 788439 - protein, 9 aa, Homo Sapiens
SGNTPSNEH

SEQ ID NO: 788440 - protein, 9 aa, Homo Sapiens
ATPQVPALR

SEQ ID NO: 788441 - protein, 9 aa, Homo Sapiens
ATAALSFRS

SEQ ID NO: 788442 - protein, 9 aa, Homo Sapiens
CIREFTLGR

SEQ ID NO: 788443 - protein, 9 aa, Homo Sapiens
MSASSEVAF

SEQ ID NO: 788444 - protein, 9 aa, Homo Sapiens
SRVRAMDAE

SEQ ID NO: 788445 - protein, 9 aa, Homo Sapiens
SVFLKHTTG

SEQ ID NO: 788446 - protein, 9 aa, Homo Sapiens
KATPQVPAL

SEQ ID NO: 788447 - protein, 9 aa, Homo Sapiens
TEFSNCSYG

SEQ ID NO: 788448 - protein, 9 aa, Homo Sapiens
HSLLCIREF

SEQ ID NO: 788449 - protein, 9 aa, Homo Sapiens
SYDSYPHHV

SEQ ID NO: 788450 - protein, 9 aa, Homo Sapiens
RTARGRCPR

SEQ ID NO: 788451 - protein, 9 aa, Homo Sapiens
LIVQMYDEG

SEQ ID NO: 788452 - protein, 9 aa, Homo Sapiens
QPVGCIFLL

SEQ ID NO: 788453 - protein, 9 aa, Homo Sapiens
TGQERVALG

SEQ ID NO: 788454 - protein, 9 aa, Homo Sapiens
FTLPRMSAS

SEQ ID NO: 788455 - protein, 9 aa, Homo Sapiens
EEAEEPAEA

SEQ ID NO: 788456 - protein, 9 aa, Homo Sapiens
CPIEGRMGG

SEQ ID NO: 788457 - protein, 9 aa, Homo Sapiens
FHLTVTSSD

SEQ ID NO: 788458 - protein, 9 aa, Homo Sapiens
WASIGVLQS

SEQ ID NO: 788459 - protein, 9 aa, Homo Sapiens
AMDAEAAGL

SEQ ID NO: 788460 - protein, 9 aa, Homo Sapiens
RNVLISDLG

SEQ ID NO: 788461 - protein, 9 aa, Homo Sapiens
QCLALLTLN

SEQ ID NO: 788462 - protein, 9 aa, Homo Sapiens
LPDSSSILA

SEQ ID NO: 788463 - protein, 9 aa, Homo Sapiens
FYNIESGAV

SEQ ID NO: 788464 - protein, 9 aa, Homo Sapiens
PLWDTFVAL

SEQ ID NO: 788465 - protein, 9 aa, Homo Sapiens
RLALHRAPG

SEQ ID NO: 788466 - protein, 9 aa, Homo Sapiens
AYEQLGQRV

SEQ ID NO: 788467 - protein, 9 aa, Homo Sapiens
AARGAPVTA

SEQ ID NO: 788468 - protein, 9 aa, Homo Sapiens
DKGAEGCSV

SEQ ID NO: 788469 - protein, 9 aa, Homo Sapiens
RKLIKSKKG

SEQ ID NO: 788470 - protein, 9 aa, Homo Sapiens
ALETMNKYH

SEQ ID NO: 788471 - protein, 9 aa, Homo Sapiens
AMPLGARDL

SEQ ID NO: 788472 - protein, 9 aa, Homo Sapiens
FIEKLADNI

SEQ ID NO: 788473 - protein, 9 aa, Homo Sapiens
WNGKKMLSL

SEQ ID NO: 788474 - protein, 9 aa, Homo Sapiens
ETESGVMLR

SEQ ID NO: 788475 - protein, 9 aa, Homo Sapiens
LTHRRKLRP

SEQ ID NO: 788476 - protein, 9 aa, Homo Sapiens
TYLFHLTVT

SEQ ID NO: 788477 - protein, 9 aa, Homo Sapiens
GGKTTHLFV

SEQ ID NO: 788478 - protein, 9 aa, Homo Sapiens
RYSPPGSIF

SEQ ID NO: 788479 - protein, 9 aa, Homo Sapiens
TTMHVMKHL

SEQ ID NO: 788480 - protein, 9 aa, Homo Sapiens
TAREGRAAP

SEQ ID NO: 788481 - protein, 9 aa, Homo Sapiens
TSADDDIAS

SEQ ID NO: 788482 - protein, 9 aa, Homo Sapiens
NPDEAKKAL

SEQ ID NO: 788483 - protein, 9 aa, Homo Sapiens
KKALGLGQI

SEQ ID NO: 788484 - protein, 9 aa, Homo Sapiens
NAPRVSCNT

SEQ ID NO: 788485 - protein, 9 aa, Homo Sapiens
VGMTKSKML

SEQ ID NO: 788486 - protein, 9 aa, Homo Sapiens
LQCGSQKGY

SEQ ID NO: 788487 - protein, 9 aa, Homo Sapiens
VVLHVYEAV

SEQ ID NO: 788488 - protein, 9 aa, Homo Sapiens
ENHIAGHAN

SEQ ID NO: 788489 - protein, 9 aa, Homo Sapiens
RDGGSLCYP

SEQ ID NO: 788490 - protein, 9 aa, Homo Sapiens
GTDLGIWSS

SEQ ID NO: 788491 - protein, 9 aa, Homo Sapiens
KIMATLIKR

SEQ ID NO: 788492 - protein, 9 aa, Homo Sapiens
LNMLRALKL

SEQ ID NO: 788493 - protein, 9 aa, Homo Sapiens
ISKNIANPH

SEQ ID NO: 788494 - protein, 9 aa, Homo Sapiens
IVFERLWDG

SEQ ID NO: 788495 - protein, 9 aa, Homo Sapiens
PIVVLHVYE

SEQ ID NO: 788496 - protein, 9 aa, Homo Sapiens
PAWVAGGAL

SEQ ID NO: 788497 - protein, 9 aa, Homo Sapiens
RALKLKAYR

SEQ ID NO: 788498 - protein, 9 aa, Homo Sapiens
KDFEALLPP

SEQ ID NO: 788499 - protein, 9 aa, Homo Sapiens
VQSHIIQLK

SEQ ID NO: 788500 - protein, 9 aa, Homo Sapiens
APVTAAALA

SEQ ID NO: 788501 - protein, 9 aa, Homo Sapiens
LLRLLHGRL

SEQ ID NO: 788502 - protein, 9 aa, Homo Sapiens
REHGLPGYN

SEQ ID NO: 788503 - protein, 9 aa, Homo Sapiens
RFPLAMPLG

SEQ ID NO: 788504 - protein, 9 aa, Homo Sapiens
PFPVCLSWV

SEQ ID NO: 788505 - protein, 9 aa, Homo Sapiens
EALPLERED

SEQ ID NO: 788506 - protein, 9 aa, Homo Sapiens
DNILVKTTF

SEQ ID NO: 788507 - protein, 9 aa, Homo Sapiens
EGFGWEPFT

SEQ ID NO: 788508 - protein, 9 aa, Homo Sapiens
AAKEQVELC

SEQ ID NO: 788509 - protein, 9 aa, Homo Sapiens
RHLREIVEL

SEQ ID NO: 788510 - protein, 9 aa, Homo Sapiens
VLGYRYWAS

SEQ ID NO: 788511 - protein, 9 aa, Homo Sapiens
MAALSAYAP

SEQ ID NO: 788512 - protein, 9 aa, Homo Sapiens
PRCTINPSG

SEQ ID NO: 788513 - protein, 9 aa, Homo Sapiens
RILQEASTE

SEQ ID NO: 788514 - protein, 9 aa, Homo Sapiens
VLHVYEAVK

SEQ ID NO: 788515 - protein, 9 aa, Homo Sapiens
DRNTFRHRV

SEQ ID NO: 788516 - protein, 9 aa, Homo Sapiens
LLLKKIMAT

SEQ ID NO: 788517 - protein, 9 aa, Homo Sapiens
NKKKYSNHS

SEQ ID NO: 788518 - protein, 9 aa, Homo Sapiens
SKEAVTKAQ

SEQ ID NO: 788519 - protein, 9 aa, Homo Sapiens
EALQELNVT

SEQ ID NO: 788520 - protein, 9 aa, Homo Sapiens
KEGTYLFHL

SEQ ID NO: 788521 - protein, 9 aa, Homo Sapiens
MCRTDLEIQ

SEQ ID NO: 788522 - protein, 9 aa, Homo Sapiens
IWVFLLKLL

SEQ ID NO: 788523 - protein, 9 aa, Homo Sapiens
YEDIPSVTR

SEQ ID NO: 788524 - protein, 9 aa, Homo Sapiens
NITSKSFNM

SEQ ID NO: 788525 - protein, 9 aa, Homo Sapiens
VVGMTKSKM

SEQ ID NO: 788526 - protein, 9 aa, Homo Sapiens
GERTGAVPL

SEQ ID NO: 788527 - protein, 9 aa, Homo Sapiens
DFFSLHAGH

SEQ ID NO: 788528 - protein, 9 aa, Homo Sapiens
SSSDQEPSR

SEQ ID NO: 788529 - protein, 9 aa, Homo Sapiens
KQPRQYFIR

SEQ ID NO: 788530 - protein, 9 aa, Homo Sapiens
VCLSWVRDG

SEQ ID NO: 788531 - protein, 9 aa, Homo Sapiens
TYLQLQEGF

SEQ ID NO: 788532 - protein, 9 aa, Homo Sapiens
WQPRRFVLD

SEQ ID NO: 788533 - protein, 9 aa, Homo Sapiens
TIEPLKKNL

SEQ ID NO: 788534 - protein, 9 aa, Homo Sapiens
IAQLISHNP

SEQ ID NO: 788535 - protein, 9 aa, Homo Sapiens
GSLCYPGWS

SEQ ID NO: 788536 - protein, 9 aa, Homo Sapiens
RCTIDWKKG

SEQ ID NO: 788537 - protein, 9 aa, Homo Sapiens
GKRNVLISD

SEQ ID NO: 788538 - protein, 9 aa, Homo Sapiens
TDFLRTCSS

SEQ ID NO: 788539 - protein, 9 aa, Homo Sapiens
WGRTARGRC

SEQ ID NO: 788540 - protein, 9 aa, Homo Sapiens
TIHWSRNSV

SEQ ID NO: 788541 - protein, 9 aa, Homo Sapiens
SWGSSSDQE

SEQ ID NO: 788542 - protein, 9 aa, Homo Sapiens
KSYPSREEY

SEQ ID NO: 788543 - protein, 9 aa, Homo Sapiens
HYHLDSPAK

SEQ ID NO: 788544 - protein, 9 aa, Homo Sapiens
FPVCLSWVR

SEQ ID NO: 788545 - protein, 9 aa, Homo Sapiens
DLGIWSSHC

SEQ ID NO: 788546 - protein, 9 aa, Homo Sapiens
YHLDSPAKG

SEQ ID NO: 788547 - protein, 9 aa, Homo Sapiens
LIVQCLALL

SEQ ID NO: 788548 - protein, 9 aa, Homo Sapiens
ANASLFNGK

SEQ ID NO: 788549 - protein, 9 aa, Homo Sapiens
DIMHNLIVQ

SEQ ID NO: 788550 - protein, 9 aa, Homo Sapiens
LSKSGNTPS

SEQ ID NO: 788551 - protein, 9 aa, Homo Sapiens
PRKQPVGCI

SEQ ID NO: 788552 - protein, 9 aa, Homo Sapiens
TAEWMSSSK

SEQ ID NO: 788553 - protein, 9 aa, Homo Sapiens
NPHTTSGTD

SEQ ID NO: 788554 - protein, 9 aa, Homo Sapiens
MHVMKHLLP

SEQ ID NO: 788555 - protein, 9 aa, Homo Sapiens
EAVTKAQKK

SEQ ID NO: 788556 - protein, 9 aa, Homo Sapiens
AGYLWRASV

SEQ ID NO: 788557 - protein, 9 aa, Homo Sapiens
PPRCTINPS

SEQ ID NO: 788558 - protein, 9 aa, Homo Sapiens
WQRGRLALH

SEQ ID NO: 788559 - protein, 9 aa, Homo Sapiens
SKTLEDRNT

SEQ ID NO: 788560 - protein, 9 aa, Homo Sapiens
NKALLALFM

SEQ ID NO: 788561 - protein, 9 aa, Homo Sapiens
PAVVDDAQL

SEQ ID NO: 788562 - protein, 9 aa, Homo Sapiens
RISKNIANP

SEQ ID NO: 788563 - protein, 9 aa, Homo Sapiens
LWRASVAQL

SEQ ID NO: 788564 - protein, 9 aa, Homo Sapiens
PYAVYPQAN

SEQ ID NO: 788565 - protein, 9 aa, Homo Sapiens
RKSGEAAVY

SEQ ID NO: 788566 - protein, 9 aa, Homo Sapiens
EHGLPGYNE

SEQ ID NO: 788567 - protein, 9 aa, Homo Sapiens
INPSGTTIS

SEQ ID NO: 788568 - protein, 9 aa, Homo Sapiens
LYGPDIGQP

SEQ ID NO: 788569 - protein, 9 aa, Homo Sapiens
TCQWKNLAE

SEQ ID NO: 788570 - protein, 9 aa, Homo Sapiens
CPPAHTCPR

SEQ ID NO: 788571 - protein, 9 aa, Homo Sapiens
RKAVKTFWT

SEQ ID NO: 788572 - protein, 9 aa, Homo Sapiens
KQPVGCIFL

SEQ ID NO: 788573 - protein, 9 aa, Homo Sapiens
QTGIWVFLL

SEQ ID NO: 788574 - protein, 9 aa, Homo Sapiens
VSRILQEAS

SEQ ID NO: 788575 - protein, 9 aa, Homo Sapiens
PHHVIGTQL

SEQ ID NO: 788576 - protein, 9 aa, Homo Sapiens
KALAPAPPP

SEQ ID NO: 788577 - protein, 9 aa, Homo Sapiens
ELPLWDTFV

SEQ ID NO: 788578 - protein, 9 aa, Homo Sapiens
TAAALARAA

SEQ ID NO: 788579 - protein, 9 aa, Homo Sapiens
LHAGHPSSC

SEQ ID NO: 788580 - protein, 9 aa, Homo Sapiens
ETAEEAEEP

SEQ ID NO: 788581 - protein, 9 aa, Homo Sapiens
TLEDRNTLR

SEQ ID NO: 788582 - protein, 9 aa, Homo Sapiens
KMLAVSLWT

SEQ ID NO: 788583 - protein, 9 aa, Homo Sapiens
NYSWPYSDL

SEQ ID NO: 788584 - protein, 9 aa, Homo Sapiens
AYGTNTARE

SEQ ID NO: 788585 - protein, 9 aa, Homo Sapiens
MGRTLSVEV

SEQ ID NO: 788586 - protein, 9 aa, Homo Sapiens
MHNLIVQMY

SEQ ID NO: 788587 - protein, 9 aa, Homo Sapiens
YDSYPHHVI

SEQ ID NO: 788588 - protein, 9 aa, Homo Sapiens
ARTQRARAQ

SEQ ID NO: 788589 - protein, 9 aa, Homo Sapiens
FLKHTTGFD

SEQ ID NO: 788590 - protein, 9 aa, Homo Sapiens
PEGIVAAGI

SEQ ID NO: 788591 - protein, 9 aa, Homo Sapiens
CSVGAQEPP

SEQ ID NO: 788592 - protein, 9 aa, Homo Sapiens
IKSKKGINR

SEQ ID NO: 788593 - protein, 9 aa, Homo Sapiens
RGAPVTAAA

SEQ ID NO: 788594 - protein, 9 aa, Homo Sapiens
LRKSGEAAV

SEQ ID NO: 788595 - protein, 9 aa, Homo Sapiens
LGPKNSRWA

SEQ ID NO: 788596 - protein, 9 aa, Homo Sapiens
SLGRKIFLG

SEQ ID NO: 788597 - protein, 9 aa, Homo Sapiens
YSSLESSGW

SEQ ID NO: 788598 - protein, 9 aa, Homo Sapiens
GTYGNDSHQ

SEQ ID NO: 788599 - protein, 9 aa, Homo Sapiens
HFLKFNYSW

SEQ ID NO: 788600 - protein, 9 aa, Homo Sapiens
QEGPEDKHT

SEQ ID NO: 788601 - protein, 9 aa, Homo Sapiens
IFSNITSKS

SEQ ID NO: 788602 - protein, 9 aa, Homo Sapiens
GANVLPEYK

SEQ ID NO: 788603 - protein, 9 aa, Homo Sapiens
LQVFVQSHI

SEQ ID NO: 788604 - protein, 9 aa, Homo Sapiens
LRPAWVAGG

SEQ ID NO: 788605 - protein, 9 aa, Homo Sapiens
LEGTDFLRT

SEQ ID NO: 788606 - protein, 9 aa, Homo Sapiens
GNRKRECGN

SEQ ID NO: 788607 - protein, 9 aa, Homo Sapiens
VPALRGPPA

SEQ ID NO: 788608 - protein, 9 aa, Homo Sapiens
ALSFRSAAP

SEQ ID NO: 788609 - protein, 9 aa, Homo Sapiens
KQCGKALIC

SEQ ID NO: 788610 - protein, 9 aa, Homo Sapiens
DGLWMNCIR

SEQ ID NO: 788611 - protein, 9 aa, Homo Sapiens
NSRWALMGY

SEQ ID NO: 788612 - protein, 9 aa, Homo Sapiens
VTAAALARA

SEQ ID NO: 788613 - protein, 9 aa, Homo Sapiens
FLGPKNSRW

SEQ ID NO: 788614 - protein, 9 aa, Homo Sapiens
RQEVQPEAL

SEQ ID NO: 788615 - protein, 9 aa, Homo Sapiens
SCNTGLSLL

SEQ ID NO: 788616 - protein, 9 aa, Homo Sapiens
AAARGAPVT

SEQ ID NO: 788617 - protein, 9 aa, Homo Sapiens
SRHKLSHSD

SEQ ID NO: 788618 - protein, 9 aa, Homo Sapiens
NRLMGRTLS

SEQ ID NO: 788619 - protein, 9 aa, Homo Sapiens
FVQSHIIQL

SEQ ID NO: 788620 - protein, 9 aa, Homo Sapiens
IGQPRRKTA

SEQ ID NO: 788621 - protein, 9 aa, Homo Sapiens
CGKALICCT

SEQ ID NO: 788622 - protein, 9 aa, Homo Sapiens
AKEQVELCK

SEQ ID NO: 788623 - protein, 9 aa, Homo Sapiens
SAQSKTLED

SEQ ID NO: 788624 - protein, 9 aa, Homo Sapiens
LGNRKRECG

SEQ ID NO: 788625 - protein, 9 aa, Homo Sapiens
HTTGFDSVD

SEQ ID NO: 788626 - protein, 9 aa, Homo Sapiens
SKSFNMSWT

SEQ ID NO: 788627 - protein, 9 aa, Homo Sapiens
HRKAVKTFW

SEQ ID NO: 788628 - protein, 9 aa, Homo Sapiens
GHRKAVKTF

SEQ ID NO: 788629 - protein, 9 aa, Homo Sapiens
PQRPPAPPG

SEQ ID NO: 788630 - protein, 9 aa, Homo Sapiens
SFTLPRMSA

SEQ ID NO: 788631 - protein, 9 aa, Homo Sapiens
MTKSKMLAV

SEQ ID NO: 788632 - protein, 9 aa, Homo Sapiens
LSAYAPQRP

SEQ ID NO: 788633 - protein, 9 aa, Homo Sapiens
QPRQYFIRV

SEQ ID NO: 788634 - protein, 9 aa, Homo Sapiens
KRGCCHIQA

SEQ ID NO: 788635 - protein, 9 aa, Homo Sapiens
QVLSLGANV

SEQ ID NO: 788636 - protein, 9 aa, Homo Sapiens
CHWNGKKML

SEQ ID NO: 788637 - protein, 9 aa, Homo Sapiens
VSFTLPRMS

SEQ ID NO: 788638 - protein, 9 aa, Homo Sapiens
FYSSLESSG

SEQ ID NO: 788639 - protein, 9 aa, Homo Sapiens
PQVPALRGP

SEQ ID NO: 788640 - protein, 9 aa, Homo Sapiens
RGCCHIQAS

SEQ ID NO: 788641 - protein, 9 aa, Homo Sapiens
GIDCEEPRH

SEQ ID NO: 788642 - protein, 9 aa, Homo Sapiens
EGIVAAGIT

SEQ ID NO: 788643 - protein, 9 aa, Homo Sapiens
GVMLRSMLI

SEQ ID NO: 788644 - protein, 9 aa, Homo Sapiens
DEITMCRTD

SEQ ID NO: 788645 - protein, 9 aa, Homo Sapiens
TAGHRKAVK

SEQ ID NO: 788646 - protein, 9 aa, Homo Sapiens
GSSSDQEPS

SEQ ID NO: 788647 - protein, 9 aa, Homo Sapiens
VYHLSRHKL

SEQ ID NO: 788648 - protein, 9 aa, Homo Sapiens
EEPAEADIT

SEQ ID NO: 788649 - protein, 9 aa, Homo Sapiens
TDLLSKSGN

SEQ ID NO: 788650 - protein, 9 aa, Homo Sapiens
TMCRTDLEI

SEQ ID NO: 788651 - protein, 9 aa, Homo Sapiens
LRSMLISGQ

SEQ ID NO: 788652 - protein, 9 aa, Homo Sapiens
LWDTFVALY

SEQ ID NO: 788653 - protein, 9 aa, Homo Sapiens
RLTVMCAVC

SEQ ID NO: 788654 - protein, 9 aa, Homo Sapiens
KSKMLAVSL

SEQ ID NO: 788655 - protein, 9 aa, Homo Sapiens
LKKFYQLPS

SEQ ID NO: 788656 - protein, 9 aa, Homo Sapiens
HHVIGTQLN

SEQ ID NO: 788657 - protein, 9 aa, Homo Sapiens
RLMGRTLSV

SEQ ID NO: 788658 - protein, 9 aa, Homo Sapiens
SLDVNTIHW

SEQ ID NO: 788659 - protein, 9 aa, Homo Sapiens
LISHNPAVV

SEQ ID NO: 788660 - protein, 9 aa, Homo Sapiens
WDGLWMNCI

SEQ ID NO: 788661 - protein, 9 aa, Homo Sapiens
TGIWVFLLK

SEQ ID NO: 788662 - protein, 9 aa, Homo Sapiens
VRISKNIAN

SEQ ID NO: 788663 - protein, 9 aa, Homo Sapiens
ERTGAVPLI

SEQ ID NO: 788664 - protein, 9 aa, Homo Sapiens
KEYLAIMNG

SEQ ID NO: 788665 - protein, 9 aa, Homo Sapiens
TLIKRFHHT

SEQ ID NO: 788666 - protein, 9 aa, Homo Sapiens
KMYQEMCWE

SEQ ID NO: 788667 - protein, 9 aa, Homo Sapiens
ENIEGATAT

SEQ ID NO: 788668 - protein, 9 aa, Homo Sapiens
IRQPKYGDT

SEQ ID NO: 788669 - protein, 9 aa, Homo Sapiens
EGRAAPAFK

SEQ ID NO: 788670 - protein, 9 aa, Homo Sapiens
QEPSRVSHE

SEQ ID NO: 788671 - protein, 9 aa, Homo Sapiens
RPAWVAGGA

SEQ ID NO: 788672 - protein, 9 aa, Homo Sapiens
RVRAMDAEA

SEQ ID NO: 788673 - protein, 9 aa, Homo Sapiens
PFRDHLMKL

SEQ ID NO: 788674 - protein, 9 aa, Homo Sapiens
HRFDRRISI

SEQ ID NO: 788675 - protein, 9 aa, Homo Sapiens
TAALSFRSA

SEQ ID NO: 788676 - protein, 9 aa, Homo Sapiens
SKNIANPHT

SEQ ID NO: 788677 - protein, 9 aa, Homo Sapiens
CCHIQASGR

SEQ ID NO: 788678 - protein, 9 aa, Homo Sapiens
TNPWWVLIG

SEQ ID NO: 788679 - protein, 9 aa, Homo Sapiens
AFRSIRGSP

SEQ ID NO: 788680 - protein, 9 aa, Homo Sapiens
EGNPPITEF

SEQ ID NO: 788681 - protein, 9 aa, Homo Sapiens
RTLSVEVSV

SEQ ID NO: 788682 - protein, 9 aa, Homo Sapiens
GRKIFLGEV

SEQ ID NO: 788683 - protein, 9 aa, Homo Sapiens
EMCWEFFPA

SEQ ID NO: 788684 - protein, 9 aa, Homo Sapiens
LKEGTYLFH

SEQ ID NO: 788685 - protein, 9 aa, Homo Sapiens
CLSWVRDGI

SEQ ID NO: 788686 - protein, 9 aa, Homo Sapiens
TDLGIWSSH

SEQ ID NO: 788687 - protein, 9 aa, Homo Sapiens
LAMPLGARD

SEQ ID NO: 788688 - protein, 9 aa, Homo Sapiens
LSLTHLFLV

SEQ ID NO: 788689 - protein, 9 aa, Homo Sapiens
KSGNTPSNE

SEQ ID NO: 788690 - protein, 9 aa, Homo Sapiens
SVGAQEPPR

SEQ ID NO: 788691 - protein, 9 aa, Homo Sapiens
RSAAPITFP

SEQ ID NO: 788692 - protein, 9 aa, Homo Sapiens
ANQTYGLPP

SEQ ID NO: 788693 - protein, 9 aa, Homo Sapiens
YLFHLTVTS

SEQ ID NO: 788694 - protein, 9 aa, Homo Sapiens
QSRHRAEAL

SEQ ID NO: 788695 - protein, 9 aa, Homo Sapiens
ITEFSNCSY

SEQ ID NO: 788696 - protein, 9 aa, Homo Sapiens
MLRSMLISG

SEQ ID NO: 788697 - protein, 9 aa, Homo Sapiens
QERVALGNR

SEQ ID NO: 788698 - protein, 9 aa, Homo Sapiens
LKFNYSWPY

SEQ ID NO: 788699 - protein, 9 aa, Homo Sapiens
NVLISDLGG

SEQ ID NO: 788700 - protein, 9 aa, Homo Sapiens
FSLHAGHPS

SEQ ID NO: 788701 - protein, 9 aa, Homo Sapiens
WRASVAQLT

SEQ ID NO: 788702 - protein, 9 aa, Homo Sapiens
YDTSADDDI

SEQ ID NO: 788703 - protein, 9 aa, Homo Sapiens
YRYWASIGV

SEQ ID NO: 788704 - protein, 9 aa, Homo Sapiens
PVYSLWKTD

SEQ ID NO: 788705 - protein, 9 aa, Homo Sapiens
LLALFMAEM

SEQ ID NO: 788706 - protein, 9 aa, Homo Sapiens
VFVQSHIIQ

SEQ ID NO: 788707 - protein, 9 aa, Homo Sapiens
QLQEGFGWE

SEQ ID NO: 788708 - protein, 9 aa, Homo Sapiens
LKLLILQYL

SEQ ID NO: 788709 - protein, 9 aa, Homo Sapiens
PEIVDCDRC

SEQ ID NO: 788710 - protein, 9 aa, Homo Sapiens
YQEMCWEFF

SEQ ID NO: 788711 - protein, 9 aa, Homo Sapiens
YEQLGQRVF

SEQ ID NO: 788712 - protein, 9 aa, Homo Sapiens
TLIFSNITS

SEQ ID NO: 788713 - protein, 9 aa, Homo Sapiens
ALSAYAPQR

SEQ ID NO: 788714 - protein, 9 aa, Homo Sapiens
KQENLEGTD

SEQ ID NO: 788715 - protein, 9 aa, Homo Sapiens
FSNITSKSF

SEQ ID NO: 788716 - protein, 9 aa, Homo Sapiens
DHLMKLNLK

SEQ ID NO: 788717 - protein, 9 aa, Homo Sapiens
SLHAGHPSS

SEQ ID NO: 788718 - protein, 9 aa, Homo Sapiens
GSRVRAMDA

SEQ ID NO: 788719 - protein, 9 aa, Homo Sapiens
RRYSPPGSI

SEQ ID NO: 788720 - protein, 9 aa, Homo Sapiens
ETYLQLQEG

SEQ ID NO: 788721 - protein, 9 aa, Homo Sapiens
APPRCTINP

SEQ ID NO: 788722 - protein, 9 aa, Homo Sapiens
LAEHFKINR

SEQ ID NO: 788723 - protein, 9 aa, Homo Sapiens
YAVYPQANQ

SEQ ID NO: 788724 - protein, 9 aa, Homo Sapiens
CVSFTLPRM

SEQ ID NO: 788725 - protein, 9 aa, Homo Sapiens
TIAQKDFEA

SEQ ID NO: 788726 - protein, 9 aa, Homo Sapiens
AQKDFEALL

SEQ ID NO: 788727 - protein, 9 aa, Homo Sapiens
QEMCWEFFP

SEQ ID NO: 788728 - protein, 9 aa, Homo Sapiens
IANPHTTSG

SEQ ID NO: 788729 - protein, 9 aa, Homo Sapiens
KKNLESLDL

SEQ ID NO: 788730 - protein, 9 aa, Homo Sapiens
LSVFLKHTT

SEQ ID NO: 788731 - protein, 9 aa, Homo Sapiens
HLDSPAKGA

SEQ ID NO: 788732 - protein, 9 aa, Homo Sapiens
PLKKNLESL

SEQ ID NO: 788733 - protein, 9 aa, Homo Sapiens
KHTTGFDSV

SEQ ID NO: 788734 - protein, 9 aa, Homo Sapiens
GINRERQKS

SEQ ID NO: 788735 - protein, 9 aa, Homo Sapiens
DFEALLPPL

SEQ ID NO: 788736 - protein, 9 aa, Homo Sapiens
AEEPAEADI

SEQ ID NO: 788737 - protein, 9 aa, Homo Sapiens
GRMGGARTQ

SEQ ID NO: 788738 - protein, 9 aa, Homo Sapiens
ERVALGNRK

SEQ ID NO: 788739 - protein, 9 aa, Homo Sapiens
ESGVMLRSM

SEQ ID NO: 788740 - protein, 9 aa, Homo Sapiens
RSSAFRSIR

SEQ ID NO: 788741 - protein, 9 aa, Homo Sapiens
GNPFRDHLM

SEQ ID NO: 788742 - protein, 9 aa, Homo Sapiens
SNTDLEPEE

SEQ ID NO: 788743 - protein, 9 aa, Homo Sapiens
LTGWQPRRF

SEQ ID NO: 788744 - protein, 9 aa, Homo Sapiens
SPPFPVCLS

SEQ ID NO: 788745 - protein, 9 aa, Homo Sapiens
LRHQENIEG

SEQ ID NO: 788746 - protein, 9 aa, Homo Sapiens
EDKHTRFSY

SEQ ID NO: 788747 - protein, 9 aa, Homo Sapiens
LDEITMCRT

SEQ ID NO: 788748 - protein, 9 aa, Homo Sapiens
TFRHRVVVP

SEQ ID NO: 788749 - protein, 9 aa, Homo Sapiens
TLPRMSASS

SEQ ID NO: 788750 - protein, 9 aa, Homo Sapiens
DTFVALYHV

SEQ ID NO: 788751 - protein, 9 aa, Homo Sapiens
LPRMSASSE

SEQ ID NO: 788752 - protein, 9 aa, Homo Sapiens
ETMNKYHLS

SEQ ID NO: 788753 - protein, 9 aa, Homo Sapiens
KALGLGQIS

SEQ ID NO: 788754 - protein, 9 aa, Homo Sapiens
ALISKSYPS

SEQ ID NO: 788755 - protein, 9 aa, Homo Sapiens
YGNDSHQRC

SEQ ID NO: 788756 - protein, 9 aa, Homo Sapiens
EKLADNILV

SEQ ID NO: 788757 - protein, 9 aa, Homo Sapiens
TSKSFNMSW

SEQ ID NO: 788758 - protein, 9 aa, Homo Sapiens
TVMCAVCLL

SEQ ID NO: 788759 - protein, 9 aa, Homo Sapiens
MKHLLPETT

SEQ ID NO: 788760 - protein, 9 aa, Homo Sapiens
SHNPAVVDD

SEQ ID NO: 788761 - protein, 9 aa, Homo Sapiens
YHLSGRPLN

SEQ ID NO: 788762 - protein, 9 aa, Homo Sapiens
TAEEAEEPA

SEQ ID NO: 788763 - protein, 9 aa, Homo Sapiens
NQTYGLPPF

SEQ ID NO: 788764 - protein, 9 aa, Homo Sapiens
EIVELLEKE

SEQ ID NO: 788765 - protein, 9 aa, Homo Sapiens
ASTNLEEPC

SEQ ID NO: 788766 - protein, 9 aa, Homo Sapiens
KLGGFYNIE

SEQ ID NO: 788767 - protein, 9 aa, Homo Sapiens
NMTLQCGSQ

SEQ ID NO: 788768 - protein, 9 aa, Homo Sapiens
AALSFRSAA

SEQ ID NO: 788769 - protein, 9 aa, Homo Sapiens
HVMKHLLPE

SEQ ID NO: 788770 - protein, 9 aa, Homo Sapiens
CKQCGKALI

SEQ ID NO: 788771 - protein, 9 aa, Homo Sapiens
AGGAGIDCE

SEQ ID NO: 788772 - protein, 9 aa, Homo Sapiens
HLMKLNLKV

SEQ ID NO: 788773 - protein, 9 aa, Homo Sapiens
DQEPSRVSH

SEQ ID NO: 788774 - protein, 9 aa, Homo Sapiens
TERRHLREI

SEQ ID NO: 788775 - protein, 9 aa, Homo Sapiens
KFLLRLLHG

SEQ ID NO: 788776 - protein, 9 aa, Homo Sapiens
ITDEILPSK

SEQ ID NO: 788777 - protein, 9 aa, Homo Sapiens
AVALIVQCL

SEQ ID NO: 788778 - protein, 9 aa, Homo Sapiens
KLKAYRFSI

SEQ ID NO: 788779 - protein, 9 aa, Homo Sapiens
ALIVQCLAL

SEQ ID NO: 788780 - protein, 9 aa, Homo Sapiens
QLRAARTQR

SEQ ID NO: 788781 - protein, 9 aa, Homo Sapiens
LKLKAYRFS

SEQ ID NO: 788782 - protein, 9 aa, Homo Sapiens
TMTAQVKMC

SEQ ID NO: 788783 - protein, 9 aa, Homo Sapiens
LSLDVNTIH

SEQ ID NO: 788784 - protein, 9 aa, Homo Sapiens
GDIMHNLIV

SEQ ID NO: 788785 - protein, 9 aa, Homo Sapiens
TGPSNTDLE

SEQ ID NO: 788786 - protein, 9 aa, Homo Sapiens
KEELPLWDT

SEQ ID NO: 788787 - protein, 9 aa, Homo Sapiens
RQTAGHRKA

SEQ ID NO: 788788 - protein, 9 aa, Homo Sapiens
PDIGQPRRK

SEQ ID NO: 788789 - protein, 9 aa, Homo Sapiens
DVNTIHWSR

SEQ ID NO: 788790 - protein, 9 aa, Homo Sapiens
LLHGRLEVD

SEQ ID NO: 788791 - protein, 9 aa, Homo Sapiens
HRAEALPLE

SEQ ID NO: 788792 - protein, 9 aa, Homo Sapiens
EGCSVGAQE

SEQ ID NO: 788793 - protein, 9 aa, Homo Sapiens
GQLLGADRQ

SEQ ID NO: 788794 - protein, 9 aa, Homo Sapiens
FQGYWSYVL

SEQ ID NO: 788795 - protein, 9 aa, Homo Sapiens
NITCVQFIW

SEQ ID NO: 788796 - protein, 9 aa, Homo Sapiens
VSYTDCATS

SEQ ID NO: 788797 - protein, 9 aa, Homo Sapiens
FFDKTTGHF

SEQ ID NO: 788798 - protein, 9 aa, Homo Sapiens
LLPDLLAQG

SEQ ID NO: 788799 - protein, 9 aa, Homo Sapiens
LYAELIWRQ

SEQ ID NO: 788800 - protein, 9 aa, Homo Sapiens
SQRPADGHE

SEQ ID NO: 788801 - protein, 9 aa, Homo Sapiens
PRFYEACEE

SEQ ID NO: 788802 - protein, 9 aa, Homo Sapiens
WLQWKCTPK

SEQ ID NO: 788803 - protein, 9 aa, Homo Sapiens
VLSRRTDIG

SEQ ID NO: 788804 - protein, 9 aa, Homo Sapiens
LLQSQALPA

SEQ ID NO: 788805 - protein, 9 aa, Homo Sapiens
EALLCSKSL

SEQ ID NO: 788806 - protein, 9 aa, Homo Sapiens
KQYVYSAVM

SEQ ID NO: 788807 - protein, 9 aa, Homo Sapiens
PVATLARRH

SEQ ID NO: 788808 - protein, 9 aa, Homo Sapiens
VVNAGMGNS

SEQ ID NO: 788809 - protein, 9 aa, Homo Sapiens
EGETVQVSN

SEQ ID NO: 788810 - protein, 9 aa, Homo Sapiens
GKRGPSPSG

SEQ ID NO: 788811 - protein, 9 aa, Homo Sapiens
LAQGLSLAA

SEQ ID NO: 788812 - protein, 9 aa, Homo Sapiens
LFFRFGFSQ

SEQ ID NO: 788813 - protein, 9 aa, Homo Sapiens
DDAKQYVYS

SEQ ID NO: 788814 - protein, 9 aa, Homo Sapiens
TQEGQLRRA

SEQ ID NO: 788815 - protein, 9 aa, Homo Sapiens
NFLLCAGQN

SEQ ID NO: 788816 - protein, 9 aa, Homo Sapiens
SQNVSNADN

SEQ ID NO: 788817 - protein, 9 aa, Homo Sapiens
LGDVNGDQL

SEQ ID NO: 788818 - protein, 9 aa, Homo Sapiens
DLQAALEDV

SEQ ID NO: 788819 - protein, 9 aa, Homo Sapiens
FLKTIFRSR

SEQ ID NO: 788820 - protein, 9 aa, Homo Sapiens
GCGPQSDMI

SEQ ID NO: 788821 - protein, 9 aa, Homo Sapiens
TIDWGLLQR

SEQ ID NO: 788822 - protein, 9 aa, Homo Sapiens
LPGPLPASH

SEQ ID NO: 788823 - protein, 9 aa, Homo Sapiens
FSQSVVGYA

SEQ ID NO: 788824 - protein, 9 aa, Homo Sapiens
SWAVFSVGP

SEQ ID NO: 788825 - protein, 9 aa, Homo Sapiens
RLLQSQALP

SEQ ID NO: 788826 - protein, 9 aa, Homo Sapiens
RYGGFMRGV

SEQ ID NO: 788827 - protein, 9 aa, Homo Sapiens
ARRHFTEQW

SEQ ID NO: 788828 - protein, 9 aa, Homo Sapiens
RQFISELNT

SEQ ID NO: 788829 - protein, 9 aa, Homo Sapiens
SLNNTSLNP

SEQ ID NO: 788830 - protein, 9 aa, Homo Sapiens
AVLLSSVFW

SEQ ID NO: 788831 - protein, 9 aa, Homo Sapiens
KICPCGWLQ

SEQ ID NO: 788832 - protein, 9 aa, Homo Sapiens
TIITTTQAG

SEQ ID NO: 788833 - protein, 9 aa, Homo Sapiens
SEDGAEPGS

SEQ ID NO: 788834 - protein, 9 aa, Homo Sapiens
SHDTTISNS

SEQ ID NO: 788835 - protein, 9 aa, Homo Sapiens
LECEAGFYV

SEQ ID NO: 788836 - protein, 9 aa, Homo Sapiens
TAVLLSSVF

SEQ ID NO: 788837 - protein, 9 aa, Homo Sapiens
MNLRYNSTS

SEQ ID NO: 788838 - protein, 9 aa, Homo Sapiens
KDRAFAVLA

SEQ ID NO: 788839 - protein, 9 aa, Homo Sapiens
TKNRTNDVV

SEQ ID NO: 788840 - protein, 9 aa, Homo Sapiens
LLQFNILIS

SEQ ID NO: 788841 - protein, 9 aa, Homo Sapiens
LLAQGLSLA

SEQ ID NO: 788842 - protein, 9 aa, Homo Sapiens
KVAKCSTLF

SEQ ID NO: 788843 - protein, 9 aa, Homo Sapiens
ATYDAFVHV

SEQ ID NO: 788844 - protein, 9 aa, Homo Sapiens
YMIHIIEKW

SEQ ID NO: 788845 - protein, 9 aa, Homo Sapiens
NLRYNSTSY

SEQ ID NO: 788846 - protein, 9 aa, Homo Sapiens
NERLDRQFI

SEQ ID NO: 788847 - protein, 9 aa, Homo Sapiens
YWIWQVCGQ

SEQ ID NO: 788848 - protein, 9 aa, Homo Sapiens
EEAQLSADQ

SEQ ID NO: 788849 - protein, 9 aa, Homo Sapiens
NVGNITCVQ

SEQ ID NO: 788850 - protein, 9 aa, Homo Sapiens
GLLQRAPGA

SEQ ID NO: 788851 - protein, 9 aa, Homo Sapiens
LCMNLRYNS

SEQ ID NO: 788852 - protein, 9 aa, Homo Sapiens
KAFNKAHYP

SEQ ID NO: 788853 - protein, 9 aa, Homo Sapiens
NQILRHRLL

SEQ ID NO: 788854 - protein, 9 aa, Homo Sapiens
HYWIWQVCG

SEQ ID NO: 788855 - protein, 9 aa, Homo Sapiens
AFNKAHYPD

SEQ ID NO: 788856 - protein, 9 aa, Homo Sapiens
QEDAAPHNL

SEQ ID NO: 788857 - protein, 9 aa, Homo Sapiens
NIMIRTGET

SEQ ID NO: 788858 - protein, 9 aa, Homo Sapiens
VSNADNRQQ

SEQ ID NO: 788859 - protein, 9 aa, Homo Sapiens
GFMRGVGRP

SEQ ID NO: 788860 - protein, 9 aa, Homo Sapiens
MDFSNSMSE

SEQ ID NO: 788861 - protein, 9 aa, Homo Sapiens
EDYMIHIIE

SEQ ID NO: 788862 - protein, 9 aa, Homo Sapiens
VPLWLECEA

SEQ ID NO: 788863 - protein, 9 aa, Homo Sapiens
GEPRKGFVP

SEQ ID NO: 788864 - protein, 9 aa, Homo Sapiens
PSKEEGDTV

SEQ ID NO: 788865 - protein, 9 aa, Homo Sapiens
QRLHYWIWQ

SEQ ID NO: 788866 - protein, 9 aa, Homo Sapiens
QSQRPADGH

SEQ ID NO: 788867 - protein, 9 aa, Homo Sapiens
PLWLECEAG

SEQ ID NO: 788868 - protein, 9 aa, Homo Sapiens
FTLLDNLLI

SEQ ID NO: 788869 - protein, 9 aa, Homo Sapiens
LFLPMSAKR

SEQ ID NO: 788870 - protein, 9 aa, Homo Sapiens
NSQNVSNAD

SEQ ID NO: 788871 - protein, 9 aa, Homo Sapiens
RGVGRPEWW

SEQ ID NO: 788872 - protein, 9 aa, Homo Sapiens
EDGAEPGSG

SEQ ID NO: 788873 - protein, 9 aa, Homo Sapiens
KRLSQYAYR

SEQ ID NO: 788874 - protein, 9 aa, Homo Sapiens
FDAVKSGTM

SEQ ID NO: 788875 - protein, 9 aa, Homo Sapiens
NRNHMKDNS

SEQ ID NO: 788876 - protein, 9 aa, Homo Sapiens
KPLYSWEES

SEQ ID NO: 788877 - protein, 9 aa, Homo Sapiens
LYHLYGASI

SEQ ID NO: 788878 - protein, 9 aa, Homo Sapiens
ASCSPAQPA

SEQ ID NO: 788879 - protein, 9 aa, Homo Sapiens
LYLFFRFGF

SEQ ID NO: 788880 - protein, 9 aa, Homo Sapiens
SLDSGLLFL

SEQ ID NO: 788881 - protein, 9 aa, Homo Sapiens
EGRSKSFNN

SEQ ID NO: 788882 - protein, 9 aa, Homo Sapiens
RYNERLDRQ

SEQ ID NO: 788883 - protein, 9 aa, Homo Sapiens
LEISGGRAG

SEQ ID NO: 788884 - protein, 9 aa, Homo Sapiens
ATEDANQEM

SEQ ID NO: 788885 - protein, 9 aa, Homo Sapiens
VGNITCVQF

SEQ ID NO: 788886 - protein, 9 aa, Homo Sapiens
AALFQGYWS

SEQ ID NO: 788887 - protein, 9 aa, Homo Sapiens
SVEQPEMAP

SEQ ID NO: 788888 - protein, 9 aa, Homo Sapiens
ELIWRQALD

SEQ ID NO: 788889 - protein, 9 aa, Homo Sapiens
TNQEKTPEK

SEQ ID NO: 788890 - protein, 9 aa, Homo Sapiens
AIVSISALS

SEQ ID NO: 788891 - protein, 9 aa, Homo Sapiens
AAGSKSGPR

SEQ ID NO: 788892 - protein, 9 aa, Homo Sapiens
FVLLLSAIV

SEQ ID NO: 788893 - protein, 9 aa, Homo Sapiens
VLLSSVFWI

SEQ ID NO: 788894 - protein, 9 aa, Homo Sapiens
QNVSNADNR

SEQ ID NO: 788895 - protein, 9 aa, Homo Sapiens
QAGGAGTKP

SEQ ID NO: 788896 - protein, 9 aa, Homo Sapiens
DPWVYILLH

SEQ ID NO: 788897 - protein, 9 aa, Homo Sapiens
QIRKTATEG

SEQ ID NO: 788898 - protein, 9 aa, Homo Sapiens
LASADDSGS

SEQ ID NO: 788899 - protein, 9 aa, Homo Sapiens
ASDLTRSHD

SEQ ID NO: 788900 - protein, 9 aa, Homo Sapiens
IQKDRAFAV

SEQ ID NO: 788901 - protein, 9 aa, Homo Sapiens
SGSIKILDL

SEQ ID NO: 788902 - protein, 9 aa, Homo Sapiens
SYVLRLVPK

SEQ ID NO: 788903 - protein, 9 aa, Homo Sapiens
IITTTQAGG

SEQ ID NO: 788904 - protein, 9 aa, Homo Sapiens
GGFMRGVGR

SEQ ID NO: 788905 - protein, 9 aa, Homo Sapiens
EESKQKTVE

SEQ ID NO: 788906 - protein, 9 aa, Homo Sapiens
KTIFRSRNG

SEQ ID NO: 788907 - protein, 9 aa, Homo Sapiens
RSRNGHDGS

SEQ ID NO: 788908 - protein, 9 aa, Homo Sapiens
GGQQPLEIS

SEQ ID NO: 788909 - protein, 9 aa, Homo Sapiens
RRHFTEQWY

SEQ ID NO: 788910 - protein, 9 aa, Homo Sapiens
YDAFVHVDD

SEQ ID NO: 788911 - protein, 9 aa, Homo Sapiens
GDQLTDVVI

SEQ ID NO: 788912 - protein, 9 aa, Homo Sapiens
GWSWAVFSV

SEQ ID NO: 788913 - protein, 9 aa, Homo Sapiens
FGFSQSVVG

SEQ ID NO: 788914 - protein, 9 aa, Homo Sapiens
YSWEESKQK

SEQ ID NO: 788915 - protein, 9 aa, Homo Sapiens
WSWAVFSVG

SEQ ID NO: 788916 - protein, 9 aa, Homo Sapiens
RKTATEGRS

SEQ ID NO: 788917 - protein, 9 aa, Homo Sapiens
LLAYLEQTG

SEQ ID NO: 788918 - protein, 9 aa, Homo Sapiens
TYDAFVHVD

SEQ ID NO: 788919 - protein, 9 aa, Homo Sapiens
KAHYPDVYA

SEQ ID NO: 788920 - protein, 9 aa, Homo Sapiens
WKTHLACHH

SEQ ID NO: 788921 - protein, 9 aa, Homo Sapiens
YFFYRDPDI

SEQ ID NO: 788922 - protein, 9 aa, Homo Sapiens
GTAANIEVW

SEQ ID NO: 788923 - protein, 9 aa, Homo Sapiens
AQGLSLAAL

SEQ ID NO: 788924 - protein, 9 aa, Homo Sapiens
NLLGSVVGT

SEQ ID NO: 788925 - protein, 9 aa, Homo Sapiens
PLAMDTEVF

SEQ ID NO: 788926 - protein, 9 aa, Homo Sapiens
ARGWSWAVF

SEQ ID NO: 788927 - protein, 9 aa, Homo Sapiens
CPCGWLQWK

SEQ ID NO: 788928 - protein, 9 aa, Homo Sapiens
RAPGANHIV

SEQ ID NO: 788929 - protein, 9 aa, Homo Sapiens
SISEALLCS

SEQ ID NO: 788930 - protein, 9 aa, Homo Sapiens
LRYNSTSYP

SEQ ID NO: 788931 - protein, 9 aa, Homo Sapiens
SGCIDSMVI

SEQ ID NO: 788932 - protein, 9 aa, Homo Sapiens
KGFVPSWPD

SEQ ID NO: 788933 - protein, 9 aa, Homo Sapiens
ETQQYFFYR

SEQ ID NO: 788934 - protein, 9 aa, Homo Sapiens
FSETGRNWK

SEQ ID NO: 788935 - protein, 9 aa, Homo Sapiens
GWLQWKCTP

SEQ ID NO: 788936 - protein, 9 aa, Homo Sapiens
AMDTEVFNT

SEQ ID NO: 788937 - protein, 9 aa, Homo Sapiens
EACEELTGP

SEQ ID NO: 788938 - protein, 9 aa, Homo Sapiens
AVFSVGPVS

SEQ ID NO: 788939 - protein, 9 aa, Homo Sapiens
EEGLKLLCD

SEQ ID NO: 788940 - protein, 9 aa, Homo Sapiens
CGPQSDMIE

SEQ ID NO: 788941 - protein, 9 aa, Homo Sapiens
AGCGPQSDM

SEQ ID NO: 788942 - protein, 9 aa, Homo Sapiens
SMSEDGAEP

SEQ ID NO: 788943 - protein, 9 aa, Homo Sapiens
INRVGMFVS

SEQ ID NO: 788944 - protein, 9 aa, Homo Sapiens
LTTDLPPQL

SEQ ID NO: 788945 - protein, 9 aa, Homo Sapiens
EAPMLLPDL

SEQ ID NO: 788946 - protein, 9 aa, Homo Sapiens
IAESQVSKL

SEQ ID NO: 788947 - protein, 9 aa, Homo Sapiens
WVDSTSPPG

SEQ ID NO: 788948 - protein, 9 aa, Homo Sapiens
RVPTEDYMI

SEQ ID NO: 788949 - protein, 9 aa, Homo Sapiens
HRLLTTDLP

SEQ ID NO: 788950 - protein, 9 aa, Homo Sapiens
RNHMKDNSS

SEQ ID NO: 788951 - protein, 9 aa, Homo Sapiens
GNFINRVGM

SEQ ID NO: 788952 - protein, 9 aa, Homo Sapiens
STIKKINKE

SEQ ID NO: 788953 - protein, 9 aa, Homo Sapiens
NTSLNPMTY

SEQ ID NO: 788954 - protein, 9 aa, Homo Sapiens
AALLYVNAA

SEQ ID NO: 788955 - protein, 9 aa, Homo Sapiens
IVCEKMENA

SEQ ID NO: 788956 - protein, 9 aa, Homo Sapiens
ESKQKTVEW

SEQ ID NO: 788957 - protein, 9 aa, Homo Sapiens
VQPPPAEET

SEQ ID NO: 788958 - protein, 9 aa, Homo Sapiens
DAAPHNLLG

SEQ ID NO: 788959 - protein, 9 aa, Homo Sapiens
GEGETVQVS

SEQ ID NO: 788960 - protein, 9 aa, Homo Sapiens
SIKILDLEN

SEQ ID NO: 788961 - protein, 9 aa, Homo Sapiens
SVETTNQEK

SEQ ID NO: 788962 - protein, 9 aa, Homo Sapiens
PQIRKTATE

SEQ ID NO: 788963 - protein, 9 aa, Homo Sapiens
ICPCGWLQW

SEQ ID NO: 788964 - protein, 9 aa, Homo Sapiens
GDVNGDQLT

SEQ ID NO: 788965 - protein, 9 aa, Homo Sapiens
RPPRFYEAC

SEQ ID NO: 788966 - protein, 9 aa, Homo Sapiens
NLVYLPTAV

SEQ ID NO: 788967 - protein, 9 aa, Homo Sapiens
EVFNTAILT

SEQ ID NO: 788968 - protein, 9 aa, Homo Sapiens
TATEGRSKS

SEQ ID NO: 788969 - protein, 9 aa, Homo Sapiens
LCAGQNGSK

SEQ ID NO: 788970 - protein, 9 aa, Homo Sapiens
LELCMNLRY

SEQ ID NO: 788971 - protein, 9 aa, Homo Sapiens
SAGCGPQSD

SEQ ID NO: 788972 - protein, 9 aa, Homo Sapiens
PPRATYDAF

SEQ ID NO: 788973 - protein, 9 aa, Homo Sapiens
CGWLQWKCT

SEQ ID NO: 788974 - protein, 9 aa, Homo Sapiens
AGQNGSKHH

SEQ ID NO: 788975 - protein, 9 aa, Homo Sapiens
SGPRNLDRN

SEQ ID NO: 788976 - protein, 9 aa, Homo Sapiens
TLLDNLLIM

SEQ ID NO: 788977 - protein, 9 aa, Homo Sapiens
WSYVLRLVP

SEQ ID NO: 788978 - protein, 9 aa, Homo Sapiens
SKQKTVEWV

SEQ ID NO: 788979 - protein, 9 aa, Homo Sapiens
TGASPHRVH

SEQ ID NO: 788980 - protein, 9 aa, Homo Sapiens
FFILGLQTW

SEQ ID NO: 788981 - protein, 9 aa, Homo Sapiens
SCDSISEAL

SEQ ID NO: 788982 - protein, 9 aa, Homo Sapiens
GGLYAELIW

SEQ ID NO: 788983 - protein, 9 aa, Homo Sapiens
EPAHQRLHY

SEQ ID NO: 788984 - protein, 9 aa, Homo Sapiens
LRFDAVKSG

SEQ ID NO: 788985 - protein, 9 aa, Homo Sapiens
LIWRQALDA

SEQ ID NO: 788986 - protein, 9 aa, Homo Sapiens
NILISLVEP

SEQ ID NO: 788987 - protein, 9 aa, Homo Sapiens
PWVYILLHQ

SEQ ID NO: 788988 - protein, 9 aa, Homo Sapiens
GLQTWDTPT

SEQ ID NO: 788989 - protein, 9 aa, Homo Sapiens
SWEESKQKT

SEQ ID NO: 788990 - protein, 9 aa, Homo Sapiens
LTRSHDTTI

SEQ ID NO: 788991 - protein, 9 aa, Homo Sapiens
YLLVGTAAN

SEQ ID NO: 788992 - protein, 9 aa, Homo Sapiens
LSRRTDIGV

SEQ ID NO: 788993 - protein, 9 aa, Homo Sapiens
LREINIMIR

SEQ ID NO: 788994 - protein, 9 aa, Homo Sapiens
RKQYVGAAL

SEQ ID NO: 788995 - protein, 9 aa, Homo Sapiens
LSDCLVKIY

SEQ ID NO: 788996 - protein, 9 aa, Homo Sapiens
RRTDIGVYG

SEQ ID NO: 788997 - protein, 9 aa, Homo Sapiens
FLRFDAVKS

SEQ ID NO: 788998 - protein, 9 aa, Homo Sapiens
IQACTTTPC

SEQ ID NO: 788999 - protein, 9 aa, Homo Sapiens
LFQGYWSYV

SEQ ID NO: 789000 - protein, 9 aa, Homo Sapiens
RLHYWIWQV

SEQ ID NO: 789001 - protein, 9 aa, Homo Sapiens
CGKGFNWKT

SEQ ID NO: 789002 - protein, 9 aa, Homo Sapiens
QGLSLAALF

SEQ ID NO: 789003 - protein, 9 aa, Homo Sapiens
ILGLQTWDT

SEQ ID NO: 789004 - protein, 9 aa, Homo Sapiens
QYFFYRDPD

SEQ ID NO: 789005 - protein, 9 aa, Homo Sapiens
TSPATEDAN

SEQ ID NO: 789006 - protein, 9 aa, Homo Sapiens
LEKAFNKAH

SEQ ID NO: 789007 - protein, 9 aa, Homo Sapiens
RLDRQFISE

SEQ ID NO: 789008 - protein, 9 aa, Homo Sapiens
LSLAALFQG

SEQ ID NO: 789009 - protein, 9 aa, Homo Sapiens
TSLNPMTYK

SEQ ID NO: 789010 - protein, 9 aa, Homo Sapiens
TSFSLFFDK

SEQ ID NO: 789011 - protein, 9 aa, Homo Sapiens
SRRTDIGVY

SEQ ID NO: 789012 - protein, 9 aa, Homo Sapiens
DCATSPVGC

SEQ ID NO: 789013 - protein, 9 aa, Homo Sapiens
TSPVGCSVV

SEQ ID NO: 789014 - protein, 9 aa, Homo Sapiens
VAAVQADLE

SEQ ID NO: 789015 - protein, 9 aa, Homo Sapiens
NSLDSGLLF

SEQ ID NO: 789016 - protein, 9 aa, Homo Sapiens
PAHQRLHYW

SEQ ID NO: 789017 - protein, 9 aa, Homo Sapiens
KCSTLFISN

SEQ ID NO: 789018 - protein, 9 aa, Homo Sapiens
FNTAILTGK

SEQ ID NO: 789019 - protein, 9 aa, Homo Sapiens
TQAGGAGTK

SEQ ID NO: 789020 - protein, 9 aa, Homo Sapiens
FDKTTGHFL

SEQ ID NO: 789021 - protein, 9 aa, Homo Sapiens
EEGDTVNWY

SEQ ID NO: 789022 - protein, 9 aa, Homo Sapiens
VKSGTMSTY

SEQ ID NO: 789023 - protein, 9 aa, Homo Sapiens
KTATEGRSK

SEQ ID NO: 789024 - protein, 9 aa, Homo Sapiens
CAGQNGSKH

SEQ ID NO: 789025 - protein, 9 aa, Homo Sapiens
DDSGSIKIL

SEQ ID NO: 789026 - protein, 9 aa, Homo Sapiens
WLECEAGFY

SEQ ID NO: 789027 - protein, 9 aa, Homo Sapiens
AALEDVASS

SEQ ID NO: 789028 - protein, 9 aa, Homo Sapiens
ALEDVASSD

SEQ ID NO: 789029 - protein, 9 aa, Homo Sapiens
QLLQFNILI

SEQ ID NO: 789030 - protein, 9 aa, Homo Sapiens
KVSDKHLEE

SEQ ID NO: 789031 - protein, 9 aa, Homo Sapiens
FFYRDPDIF

SEQ ID NO: 789032 - protein, 9 aa, Homo Sapiens
MFSETGRNW

SEQ ID NO: 789033 - protein, 9 aa, Homo Sapiens
MLLPDLLAQ

SEQ ID NO: 789034 - protein, 9 aa, Homo Sapiens
WQVCGQSQR

SEQ ID NO: 789035 - protein, 9 aa, Homo Sapiens
FYEACEELT

SEQ ID NO: 789036 - protein, 9 aa, Homo Sapiens
LLLSAIVSI

SEQ ID NO: 789037 - protein, 9 aa, Homo Sapiens
VGTAANIEV

SEQ ID NO: 789038 - protein, 9 aa, Homo Sapiens
FKICPCGWL

SEQ ID NO: 789039 - protein, 9 aa, Homo Sapiens
YLFFRFGFS

SEQ ID NO: 789040 - protein, 9 aa, Homo Sapiens
GLYAELIWR

SEQ ID NO: 789041 - protein, 9 aa, Homo Sapiens
QYAYRRNSV

SEQ ID NO: 789042 - protein, 9 aa, Homo Sapiens
YVNAAGSKS

SEQ ID NO: 789043 - protein, 9 aa, Homo Sapiens
ETGRNWKQY

SEQ ID NO: 789044 - protein, 9 aa, Homo Sapiens
DVNVGNITC

SEQ ID NO: 789045 - protein, 9 aa, Homo Sapiens
RKRLSQYAY

SEQ ID NO: 789046 - protein, 9 aa, Homo Sapiens
EDRAQLYIV

SEQ ID NO: 789047 - protein, 9 aa, Homo Sapiens
FNILISLVE

SEQ ID NO: 789048 - protein, 9 aa, Homo Sapiens
ASADDSGSI

SEQ ID NO: 789049 - protein, 9 aa, Homo Sapiens
LPASHPLFG

SEQ ID NO: 789050 - protein, 9 aa, Homo Sapiens
KINKEKSMG

SEQ ID NO: 789051 - protein, 9 aa, Homo Sapiens
LFRNPVTNV

SEQ ID NO: 789052 - protein, 9 aa, Homo Sapiens
QVSKLRAKS

SEQ ID NO: 789053 - protein, 9 aa, Homo Sapiens
STSPPGTRV

SEQ ID NO: 789054 - protein, 9 aa, Homo Sapiens
DVNGDQLTD

SEQ ID NO: 789055 - protein, 9 aa, Homo Sapiens
VSNAEAPML

SEQ ID NO: 789056 - protein, 9 aa, Homo Sapiens
AGEGETVQV

SEQ ID NO: 789057 - protein, 9 aa, Homo Sapiens
PHNLLGSVV

SEQ ID NO: 789058 - protein, 9 aa, Homo Sapiens
HIQACTTTP

SEQ ID NO: 789059 - protein, 9 aa, Homo Sapiens
FILGLQTWD

SEQ ID NO: 789060 - protein, 9 aa, Homo Sapiens
VETTNQEKT

SEQ ID NO: 789061 - protein, 9 aa, Homo Sapiens
DSGSIKILD

SEQ ID NO: 789062 - protein, 9 aa, Homo Sapiens
DRAFAVLAY

SEQ ID NO: 789063 - protein, 9 aa, Homo Sapiens
ALLYVNAAG

SEQ ID NO: 789064 - protein, 9 aa, Homo Sapiens
RLVPKDPCR

SEQ ID NO: 789065 - protein, 9 aa, Homo Sapiens
NECGKGFNW

SEQ ID NO: 789066 - protein, 9 aa, Homo Sapiens
CIDSMVIAT

SEQ ID NO: 789067 - protein, 9 aa, Homo Sapiens
HNLLGSVVG

SEQ ID NO: 789068 - protein, 9 aa, Homo Sapiens
ILFSGCIDS

SEQ ID NO: 789069 - protein, 9 aa, Homo Sapiens
LSADQLPFV

SEQ ID NO: 789070 - protein, 9 aa, Homo Sapiens
PRNLDRNGE

SEQ ID NO: 789071 - protein, 9 aa, Homo Sapiens
TTSFSLFFD

SEQ ID NO: 789072 - protein, 9 aa, Homo Sapiens
QKVSDKHLE

SEQ ID NO: 789073 - protein, 9 aa, Homo Sapiens
CATSPVGCS

SEQ ID NO: 789074 - protein, 9 aa, Homo Sapiens
AHIHRLFNW

SEQ ID NO: 789075 - protein, 9 aa, Homo Sapiens
YVGAALLYV

SEQ ID NO: 789076 - protein, 9 aa, Homo Sapiens
TEMARQPKK

SEQ ID NO: 789077 - protein, 9 aa, Homo Sapiens
NNTSLNPMT

SEQ ID NO: 789078 - protein, 9 aa, Homo Sapiens
ATPASCSPA

SEQ ID NO: 789079 - protein, 9 aa, Homo Sapiens
YGASIQNRW

SEQ ID NO: 789080 - protein, 9 aa, Homo Sapiens
QKDRAFAVL

SEQ ID NO: 789081 - protein, 9 aa, Homo Sapiens
DVASSDSDT

SEQ ID NO: 789082 - protein, 9 aa, Homo Sapiens
EPSVETTNQ

SEQ ID NO: 789083 - protein, 9 aa, Homo Sapiens
KGGTSPATE

SEQ ID NO: 789084 - protein, 9 aa, Homo Sapiens
NRTNDVVNA

SEQ ID NO: 789085 - protein, 9 aa, Homo Sapiens
EISGGRAGP

SEQ ID NO: 789086 - protein, 9 aa, Homo Sapiens
LQAALEDVA

SEQ ID NO: 789087 - protein, 9 aa, Homo Sapiens
LYGASIQNR

SEQ ID NO: 789088 - protein, 9 aa, Homo Sapiens
QRAPGANHI

SEQ ID NO: 789089 - protein, 9 aa, Homo Sapiens
TEGRSKSFN

SEQ ID NO: 789090 - protein, 9 aa, Homo Sapiens
GQSQRPADG

SEQ ID NO: 789091 - protein, 9 aa, Homo Sapiens
GSGPEPAHQ

SEQ ID NO: 789092 - protein, 9 aa, Homo Sapiens
KPRLLQSQA

SEQ ID NO: 789093 - protein, 9 aa, Homo Sapiens
LRLVPKDPC

SEQ ID NO: 789094 - protein, 9 aa, Homo Sapiens
RNPVTNVRH

SEQ ID NO: 789095 - protein, 9 aa, Homo Sapiens
QEPWGTQEG

SEQ ID NO: 789096 - protein, 9 aa, Homo Sapiens
TAEVIAQKV

SEQ ID NO: 789097 - protein, 9 aa, Homo Sapiens
GDISSRIGL

SEQ ID NO: 789098 - protein, 9 aa, Homo Sapiens
GQQPLEISG

SEQ ID NO: 789099 - protein, 9 aa, Homo Sapiens
VRHGFVSTH

SEQ ID NO: 789100 - protein, 9 aa, Homo Sapiens
CNSAGCGPQ

SEQ ID NO: 789101 - protein, 9 aa, Homo Sapiens
VPTEDYMIH

SEQ ID NO: 789102 - protein, 9 aa, Homo Sapiens
ASMKLDENF

SEQ ID NO: 789103 - protein, 9 aa, Homo Sapiens
QTGASPHRV

SEQ ID NO: 789104 - protein, 9 aa, Homo Sapiens
EFRGLSDCL

SEQ ID NO: 789105 - protein, 9 aa, Homo Sapiens
ALLCSKSLS

SEQ ID NO: 789106 - protein, 9 aa, Homo Sapiens
CSPAQPAGA

SEQ ID NO: 789107 - protein, 9 aa, Homo Sapiens
TIFRSRNGH

SEQ ID NO: 789108 - protein, 9 aa, Homo Sapiens
SDCLVKIYK

SEQ ID NO: 789109 - protein, 9 aa, Homo Sapiens
TTTQAGGAG

SEQ ID NO: 789110 - protein, 9 aa, Homo Sapiens
PVTNVRHGF

SEQ ID NO: 789111 - protein, 9 aa, Homo Sapiens
LLVGTAANI

SEQ ID NO: 789112 - protein, 9 aa, Homo Sapiens
REFRGLSDC

SEQ ID NO: 789113 - protein, 9 aa, Homo Sapiens
EETPAEVQP

SEQ ID NO: 789114 - protein, 9 aa, Homo Sapiens
QILRHRLLT

SEQ ID NO: 789115 - protein, 9 aa, Homo Sapiens
RHPERVKVY

SEQ ID NO: 789116 - protein, 9 aa, Homo Sapiens
RFDAVKSGT

SEQ ID NO: 789117 - protein, 9 aa, Homo Sapiens
YLFTLLDNL

SEQ ID NO: 789118 - protein, 9 aa, Homo Sapiens
LQWKCTPKK

SEQ ID NO: 789119 - protein, 9 aa, Homo Sapiens
GGTSPATED

SEQ ID NO: 789120 - protein, 9 aa, Homo Sapiens
PPAEETPAE

SEQ ID NO: 789121 - protein, 9 aa, Homo Sapiens
TNVRHGFVS

SEQ ID NO: 789122 - protein, 9 aa, Homo Sapiens
YWSYVLRLV

SEQ ID NO: 789123 - protein, 9 aa, Homo Sapiens
IKKINKEKS

SEQ ID NO: 789124 - protein, 9 aa, Homo Sapiens
LGPPRATYD

SEQ ID NO: 789125 - protein, 9 aa, Homo Sapiens
FMRGVGRPE

SEQ ID NO: 789126 - protein, 9 aa, Homo Sapiens
VQVSNAEAP

SEQ ID NO: 789127 - protein, 9 aa, Homo Sapiens
QFNILISLV

SEQ ID NO: 789128 - protein, 9 aa, Homo Sapiens
SLMFSETGR

SEQ ID NO: 789129 - protein, 9 aa, Homo Sapiens
SCSPAQPAG

SEQ ID NO: 789130 - protein, 9 aa, Homo Sapiens
FYRDPDIFR

SEQ ID NO: 789131 - protein, 9 aa, Homo Sapiens
KDPCRWGKR

SEQ ID NO: 789132 - protein, 9 aa, Homo Sapiens
AGSKSGPRN

SEQ ID NO: 789133 - protein, 9 aa, Homo Sapiens
RSRKRLSQY

SEQ ID NO: 789134 - protein, 9 aa, Homo Sapiens
LNNTSLNPM

SEQ ID NO: 789135 - protein, 9 aa, Homo Sapiens
GCIDSMVIA

SEQ ID NO: 789136 - protein, 9 aa, Homo Sapiens
VATLARRHF

SEQ ID NO: 789137 - protein, 9 aa, Homo Sapiens
NKEKSMGQK

SEQ ID NO: 789138 - protein, 9 aa, Homo Sapiens
NWKTHLACH

SEQ ID NO: 789139 - protein, 9 aa, Homo Sapiens
TLARRHFTE

SEQ ID NO: 789140 - protein, 9 aa, Homo Sapiens
NQEYKSPTW

SEQ ID NO: 789141 - protein, 9 aa, Homo Sapiens
EQTGASPHR

SEQ ID NO: 789142 - protein, 9 aa, Homo Sapiens
SNADNRQQH

SEQ ID NO: 789143 - protein, 9 aa, Homo Sapiens
SLGFSVEQP

SEQ ID NO: 789144 - protein, 9 aa, Homo Sapiens
ELEKAFNKA

SEQ ID NO: 789145 - protein, 9 aa, Homo Sapiens
LFLPCPSSH

SEQ ID NO: 789146 - protein, 9 aa, Homo Sapiens
PASCSPAQP

SEQ ID NO: 789147 - protein, 9 aa, Homo Sapiens
EGDTVNWYS

SEQ ID NO: 789148 - protein, 9 aa, Homo Sapiens
AILFSGCID

SEQ ID NO: 789149 - protein, 9 aa, Homo Sapiens
IASDLTRSH

SEQ ID NO: 789150 - protein, 9 aa, Homo Sapiens
QLTDVVIGA

SEQ ID NO: 789151 - protein, 9 aa, Homo Sapiens
GEGRHPERV

SEQ ID NO: 789152 - protein, 9 aa, Homo Sapiens
TQQYFFYRD

SEQ ID NO: 789153 - protein, 9 aa, Homo Sapiens
EKSMGQKWE

SEQ ID NO: 789154 - protein, 9 aa, Homo Sapiens
QLYIVCEKM

SEQ ID NO: 789155 - protein, 9 aa, Homo Sapiens
SPATEDANQ

SEQ ID NO: 789156 - protein, 9 aa, Homo Sapiens
QRPADGHEA

SEQ ID NO: 789157 - protein, 9 aa, Homo Sapiens
APSKEEGDT

SEQ ID NO: 789158 - protein, 9 aa, Homo Sapiens
WAVFSVGPV

SEQ ID NO: 789159 - protein, 9 aa, Homo Sapiens
ENFQRKKGD

SEQ ID NO: 789160 - protein, 9 aa, Homo Sapiens
AATPASCSP

SEQ ID NO: 789161 - protein, 9 aa, Homo Sapiens
SFSLFFDKT

SEQ ID NO: 789162 - protein, 9 aa, Homo Sapiens
YGGFMRGVG

SEQ ID NO: 789163 - protein, 9 aa, Homo Sapiens
PATEDANQE

SEQ ID NO: 789164 - protein, 9 aa, Homo Sapiens
RATYDAFVH

SEQ ID NO: 789165 - protein, 9 aa, Homo Sapiens
ETPAEVQPP

SEQ ID NO: 789166 - protein, 9 aa, Homo Sapiens
GLSLAALFQ

SEQ ID NO: 789167 - protein, 9 aa, Homo Sapiens
PKDPCRWGK

SEQ ID NO: 789168 - protein, 9 aa, Homo Sapiens
ILYHLYGAS

SEQ ID NO: 789169 - protein, 9 aa, Homo Sapiens
VEEEGLKLL

SEQ ID NO: 789170 - protein, 9 aa, Homo Sapiens
TLELCMNLR

SEQ ID NO: 789171 - protein, 9 aa, Homo Sapiens
HARGWSWAV

SEQ ID NO: 789172 - protein, 9 aa, Homo Sapiens
LLFLPCPSS

SEQ ID NO: 789173 - protein, 9 aa, Homo Sapiens
TTQAGGAGT

SEQ ID NO: 789174 - protein, 9 aa, Homo Sapiens
LQTWDTPTI

SEQ ID NO: 789175 - protein, 9 aa, Homo Sapiens
NSAGCGPQS

SEQ ID NO: 789176 - protein, 9 aa, Homo Sapiens
PLYSWEESK

SEQ ID NO: 789177 - protein, 9 aa, Homo Sapiens
RGWSWAVFS

SEQ ID NO: 789178 - protein, 9 aa, Homo Sapiens
KSGPRNLDR

SEQ ID NO: 789179 - protein, 9 aa, Homo Sapiens
VPKDPCRWG

SEQ ID NO: 789180 - protein, 9 aa, Homo Sapiens
YVPLWLECE

SEQ ID NO: 789181 - protein, 9 aa, Homo Sapiens
RSNSVAAVQ

SEQ ID NO: 789182 - protein, 9 aa, Homo Sapiens
GTQEGQLRR

SEQ ID NO: 789183 - protein, 9 aa, Homo Sapiens
VNGDQLTDV

SEQ ID NO: 789184 - protein, 9 aa, Homo Sapiens
LAMDTEVFN

SEQ ID NO: 789185 - protein, 9 aa, Homo Sapiens
EGRHPERVK

SEQ ID NO: 789186 - protein, 9 aa, Homo Sapiens
LVYLPTAVL

SEQ ID NO: 789187 - protein, 9 aa, Homo Sapiens
LLHQAVLRQ

SEQ ID NO: 789188 - protein, 9 aa, Homo Sapiens
QYVGAALLY

SEQ ID NO: 789189 - protein, 9 aa, Homo Sapiens
LLTTDLPPQ

SEQ ID NO: 789190 - protein, 9 aa, Homo Sapiens
TLFISNRAV

SEQ ID NO: 789191 - protein, 9 aa, Homo Sapiens
LSQYAYRRN

SEQ ID NO: 789192 - protein, 9 aa, Homo Sapiens
TEVFNTAIL

SEQ ID NO: 789193 - protein, 9 aa, Homo Sapiens
VQEDAAPHN

SEQ ID NO: 789194 - protein, 9 aa, Homo Sapiens
YLPTAVLLS

SEQ ID NO: 789195 - protein, 9 aa, Homo Sapiens
GNITCVQFI

SEQ ID NO: 789196 - protein, 9 aa, Homo Sapiens
FRSRNGHDG

SEQ ID NO: 789197 - protein, 9 aa, Homo Sapiens
HRAPSKEEG

SEQ ID NO: 789198 - protein, 9 aa, Homo Sapiens
GIAHIHRLF

SEQ ID NO: 789199 - protein, 9 aa, Homo Sapiens
YILLHQAVL

SEQ ID NO: 789200 - protein, 9 aa, Homo Sapiens
DSTSPPGTR

SEQ ID NO: 789201 - protein, 9 aa, Homo Sapiens
ILISLVEPG

SEQ ID NO: 789202 - protein, 9 aa, Homo Sapiens
RNLIQKDRA

SEQ ID NO: 789203 - protein, 9 aa, Homo Sapiens
GRHPERVKV

SEQ ID NO: 789204 - protein, 9 aa, Homo Sapiens
SLNPMTYKL

SEQ ID NO: 789205 - protein, 9 aa, Homo Sapiens
KYHIQACTT

SEQ ID NO: 789206 - protein, 9 aa, Homo Sapiens
TNDVVNAGM

SEQ ID NO: 789207 - protein, 9 aa, Homo Sapiens
PGSGPEPAH

SEQ ID NO: 789208 - protein, 9 aa, Homo Sapiens
LGLQTWDTP

SEQ ID NO: 789209 - protein, 9 aa, Homo Sapiens
AGGAGTKPT

SEQ ID NO: 789210 - protein, 9 aa, Homo Sapiens
RSHDTTISN

SEQ ID NO: 789211 - protein, 9 aa, Homo Sapiens
GPEPAHQRL

SEQ ID NO: 789212 - protein, 9 aa, Homo Sapiens
EGLKLLCDI

SEQ ID NO: 789213 - protein, 9 aa, Homo Sapiens
KQYVGAALL

SEQ ID NO: 789214 - protein, 9 aa, Homo Sapiens
EDVASSDSD

SEQ ID NO: 789215 - protein, 9 aa, Homo Sapiens
VYILLHQAV

SEQ ID NO: 789216 - protein, 9 aa, Homo Sapiens
RFGFSQSVV

SEQ ID NO: 789217 - protein, 9 aa, Homo Sapiens
NSGIAHIHR

SEQ ID NO: 789218 - protein, 9 aa, Homo Sapiens
PCRWGKRGP

SEQ ID NO: 789219 - protein, 9 aa, Homo Sapiens
PQSDMIEAF

SEQ ID NO: 789220 - protein, 9 aa, Homo Sapiens
SAIVSISAL

SEQ ID NO: 789221 - protein, 9 aa, Homo Sapiens
VLLLSAIVS

SEQ ID NO: 789222 - protein, 9 aa, Homo Sapiens
LFTLLDNLL

SEQ ID NO: 789223 - protein, 9 aa, Homo Sapiens
MARQPKKFQ

SEQ ID NO: 789224 - protein, 9 aa, Homo Sapiens
TPASCSPAQ

SEQ ID NO: 789225 - protein, 9 aa, Homo Sapiens
RVGMFVSKF

SEQ ID NO: 789226 - protein, 9 aa, Homo Sapiens
YKSPTWGEP

SEQ ID NO: 789227 - protein, 9 aa, Homo Sapiens
LVGTAANIE

SEQ ID NO: 789228 - protein, 9 aa, Homo Sapiens
IIFVLLLSA

SEQ ID NO: 789229 - protein, 9 aa, Homo Sapiens
QTWDTPTIV

SEQ ID NO: 789230 - protein, 9 aa, Homo Sapiens
RLSQYAYRR

SEQ ID NO: 789231 - protein, 9 aa, Homo Sapiens
LYSWEESKQ

SEQ ID NO: 789232 - protein, 9 aa, Homo Sapiens
GPLPASHPL

SEQ ID NO: 789233 - protein, 9 aa, Homo Sapiens
KKINKEKSM

SEQ ID NO: 789234 - protein, 9 aa, Homo Sapiens
ACTTTPCML

SEQ ID NO: 789235 - protein, 9 aa, Homo Sapiens
CSTLFISNR

SEQ ID NO: 789236 - protein, 9 aa, Homo Sapiens
VSFLKTIFR

SEQ ID NO: 789237 - protein, 9 aa, Homo Sapiens
RGEEAQLSA

SEQ ID NO: 789238 - protein, 9 aa, Homo Sapiens
IEPSVETTN

SEQ ID NO: 789239 - protein, 9 aa, Homo Sapiens
PASHPLFGR

SEQ ID NO: 789240 - protein, 9 aa, Homo Sapiens
DVVNAGMGN

SEQ ID NO: 789241 - protein, 9 aa, Homo Sapiens
TEDANQEMS

SEQ ID NO: 789242 - protein, 9 aa, Homo Sapiens
FSVEQPEMA

SEQ ID NO: 789243 - protein, 9 aa, Homo Sapiens
NINTEMARQ

SEQ ID NO: 789244 - protein, 9 aa, Homo Sapiens
TIKKINKEK

SEQ ID NO: 789245 - protein, 9 aa, Homo Sapiens
AEVIAQKVS

SEQ ID NO: 789246 - protein, 9 aa, Homo Sapiens
LDRNGETQY

SEQ ID NO: 789247 - protein, 9 aa, Homo Sapiens
VGKYHIQAC

SEQ ID NO: 789248 - protein, 9 aa, Homo Sapiens
LFSGCIDSM

SEQ ID NO: 789249 - protein, 9 aa, Homo Sapiens
YAELIWRQA

SEQ ID NO: 789250 - protein, 9 aa, Homo Sapiens
CMNLRYNST

SEQ ID NO: 789251 - protein, 9 aa, Homo Sapiens
PLPASHPLF

SEQ ID NO: 789252 - protein, 9 aa, Homo Sapiens
FFRFGFSQS

SEQ ID NO: 789253 - protein, 9 aa, Homo Sapiens
FNKAHYPDV

SEQ ID NO: 789254 - protein, 9 aa, Homo Sapiens
RAPSKEEGD

SEQ ID NO: 789255 - protein, 9 aa, Homo Sapiens
GPRNLDRNG

SEQ ID NO: 789256 - protein, 9 aa, Homo Sapiens
AQKVSDKHL

SEQ ID NO: 789257 - protein, 9 aa, Homo Sapiens
SGIAHIHRL

SEQ ID NO: 789258 - protein, 9 aa, Homo Sapiens
LLQVLSRRT

SEQ ID NO: 789259 - protein, 9 aa, Homo Sapiens
DGAEPGSGP

SEQ ID NO: 789260 - protein, 9 aa, Homo Sapiens
TPAEVQPPP

SEQ ID NO: 789261 - protein, 9 aa, Homo Sapiens
EREFRGLSD

SEQ ID NO: 789262 - protein, 9 aa, Homo Sapiens
INTEMARQP

SEQ ID NO: 789263 - protein, 9 aa, Homo Sapiens
EAQLSADQL

SEQ ID NO: 789264 - protein, 9 aa, Homo Sapiens
QSQALPAAH

SEQ ID NO: 789265 - protein, 9 aa, Homo Sapiens
QPLEISGGR

SEQ ID NO: 789266 - protein, 9 aa, Homo Sapiens
LPTAVLLSS

SEQ ID NO: 789267 - protein, 9 aa, Homo Sapiens
RWGKRGPSP

SEQ ID NO: 789268 - protein, 9 aa, Homo Sapiens
SRIGLRHKL

SEQ ID NO: 789269 - protein, 9 aa, Homo Sapiens
LGFSVEQPE

SEQ ID NO: 789270 - protein, 9 aa, Homo Sapiens
VAILFSGCI

SEQ ID NO: 789271 - protein, 9 aa, Homo Sapiens
GFSQSVVGY

SEQ ID NO: 789272 - protein, 9 aa, Homo Sapiens
GSKSGPRNL

SEQ ID NO: 789273 - protein, 9 aa, Homo Sapiens
ISGGRAGPG

SEQ ID NO: 789274 - protein, 9 aa, Homo Sapiens
DNINTEMAR

SEQ ID NO: 789275 - protein, 9 aa, Homo Sapiens
SNSMSEDGA

SEQ ID NO: 789276 - protein, 9 aa, Homo Sapiens
SKLRAKSRD

SEQ ID NO: 789277 - protein, 9 aa, Homo Sapiens
GTSPATEDA

SEQ ID NO: 789278 - protein, 9 aa, Homo Sapiens
KLLCDIQEH

SEQ ID NO: 789279 - protein, 9 aa, Homo Sapiens
GLSDCLVKI

SEQ ID NO: 789280 - protein, 9 aa, Homo Sapiens
AESQVSKLR

SEQ ID NO: 789281 - protein, 9 aa, Homo Sapiens
LQRAPGANH

SEQ ID NO: 789282 - protein, 9 aa, Homo Sapiens
ISSRIGLRH

SEQ ID NO: 789283 - protein, 9 aa, Homo Sapiens
SQALPAAHI

SEQ ID NO: 789284 - protein, 9 aa, Homo Sapiens
DYGDISSRI

SEQ ID NO: 789285 - protein, 9 aa, Homo Sapiens
YHLYGASIQ

SEQ ID NO: 789286 - protein, 9 aa, Homo Sapiens
ERLDRQFIS

SEQ ID NO: 789287 - protein, 9 aa, Homo Sapiens
EVIAQKVSD

SEQ ID NO: 789288 - protein, 9 aa, Homo Sapiens
TSPPGTRVR

SEQ ID NO: 789289 - protein, 9 aa, Homo Sapiens
HIHRLFNWL

SEQ ID NO: 789290 - protein, 9 aa, Homo Sapiens
GFVPSWPDR

SEQ ID NO: 789291 - protein, 9 aa, Homo Sapiens
EPRKGFVPS

SEQ ID NO: 789292 - protein, 9 aa, Homo Sapiens
QEYKSPTWG

SEQ ID NO: 789293 - protein, 9 aa, Homo Sapiens
WEESKQKTV

SEQ ID NO: 789294 - protein, 9 aa, Homo Sapiens
SLLAYLEQT

SEQ ID NO: 789295 - protein, 9 aa, Homo Sapiens
CGQSQRPAD

SEQ ID NO: 789296 - protein, 9 aa, Homo Sapiens
TCVQFIWKK

SEQ ID NO: 789297 - protein, 9 aa, Homo Sapiens
FVPSWPDRS

SEQ ID NO: 789298 - protein, 9 aa, Homo Sapiens
KEEGDTVNW

SEQ ID NO: 789299 - protein, 9 aa, Homo Sapiens
EKAFNKAHY

SEQ ID NO: 789300 - protein, 9 aa, Homo Sapiens
DAKQYVYSA

SEQ ID NO: 789301 - protein, 9 aa, Homo Sapiens
LQSQALPAA

SEQ ID NO: 789302 - protein, 9 aa, Homo Sapiens
FKRSNSVAA

SEQ ID NO: 789303 - protein, 9 aa, Homo Sapiens
FRGLSDCLV

SEQ ID NO: 789304 - protein, 9 aa, Homo Sapiens
DSGLLFLPC

SEQ ID NO: 789305 - protein, 9 aa, Homo Sapiens
ADIAESQVS

SEQ ID NO: 789306 - protein, 9 aa, Homo Sapiens
EELEKAFNK

SEQ ID NO: 789307 - protein, 9 aa, Homo Sapiens
FRVNVGEGR

SEQ ID NO: 789308 - protein, 9 aa, Homo Sapiens
NRVGMFVSK

SEQ ID NO: 789309 - protein, 9 aa, Homo Sapiens
PMLLPDLLA

SEQ ID NO: 789310 - protein, 9 aa, Homo Sapiens
SKRLREINI

SEQ ID NO: 789311 - protein, 9 aa, Homo Sapiens
PVSYTDCAT

SEQ ID NO: 789312 - protein, 9 aa, Homo Sapiens
ARQPKKFQK

SEQ ID NO: 789313 - protein, 9 aa, Homo Sapiens
RLREINIMI

SEQ ID NO: 789314 - protein, 9 aa, Homo Sapiens
LFLRFDAVK

SEQ ID NO: 789315 - protein, 9 aa, Homo Sapiens
QLWVDSTSP

SEQ ID NO: 789316 - protein, 9 aa, Homo Sapiens
SAVMDYLPI

SEQ ID NO: 789317 - protein, 9 aa, Homo Sapiens
HLYGASIQN

SEQ ID NO: 789318 - protein, 9 aa, Homo Sapiens
VKGGTSPAT

SEQ ID NO: 789319 - protein, 9 aa, Homo Sapiens
LVEEEGLKL

SEQ ID NO: 789320 - protein, 9 aa, Homo Sapiens
QVSNAEAPM

SEQ ID NO: 789321 - protein, 9 aa, Homo Sapiens
AFAVLAYSN

SEQ ID NO: 789322 - protein, 9 aa, Homo Sapiens
APMLLPDLL

SEQ ID NO: 789323 - protein, 9 aa, Homo Sapiens
GEEAQLSAD

SEQ ID NO: 789324 - protein, 9 aa, Homo Sapiens
ECGKGFNWK

SEQ ID NO: 789325 - protein, 9 aa, Homo Sapiens
AEETPAEVQ

SEQ ID NO: 789326 - protein, 9 aa, Homo Sapiens
MSEDGAEPG

SEQ ID NO: 789327 - protein, 9 aa, Homo Sapiens
ILRHRLLTT

SEQ ID NO: 789328 - protein, 9 aa, Homo Sapiens
WGLLQRAPG

SEQ ID NO: 789329 - protein, 9 aa, Homo Sapiens
LQEPWGTQE

SEQ ID NO: 789330 - protein, 9 aa, Homo Sapiens
VYLPTAVLL

SEQ ID NO: 789331 - protein, 9 aa, Homo Sapiens
PRATYDAFV

SEQ ID NO: 789332 - protein, 9 aa, Homo Sapiens
LAYLEQTGA

SEQ ID NO: 789333 - protein, 9 aa, Homo Sapiens
SYTDCATSP

SEQ ID NO: 789334 - protein, 9 aa, Homo Sapiens
GPPRATYDA

SEQ ID NO: 789335 - protein, 9 aa, Homo Sapiens
DAVKSGTMS

SEQ ID NO: 789336 - protein, 9 aa, Homo Sapiens
SADDSGSIK

SEQ ID NO: 789337 - protein, 9 aa, Homo Sapiens
RAFAVLAYS

SEQ ID NO: 789338 - protein, 9 aa, Homo Sapiens
QQYFFYRDP

SEQ ID NO: 789339 - protein, 9 aa, Homo Sapiens
ISEALLCSK

SEQ ID NO: 789340 - protein, 9 aa, Homo Sapiens
PYVPLWLEC

SEQ ID NO: 789341 - protein, 9 aa, Homo Sapiens
ALFQGYWSY

SEQ ID NO: 789342 - protein, 9 aa, Homo Sapiens
WSGAANQEY

SEQ ID NO: 789343 - protein, 9 aa, Homo Sapiens
ATLARRHFT

SEQ ID NO: 789344 - protein, 9 aa, Homo Sapiens
LEQTGASPH

SEQ ID NO: 789345 - protein, 9 aa, Homo Sapiens
GASIQNRWL

SEQ ID NO: 789346 - protein, 9 aa, Homo Sapiens
LPDLLAQGL

SEQ ID NO: 789347 - protein, 9 aa, Homo Sapiens
NADNRQQHS

SEQ ID NO: 789348 - protein, 9 aa, Homo Sapiens
ITCVQFIWK

SEQ ID NO: 789349 - protein, 9 aa, Homo Sapiens
VTNVRHGFV

SEQ ID NO: 789350 - protein, 9 aa, Homo Sapiens
MYLFTLLDN

SEQ ID NO: 789351 - protein, 9 aa, Homo Sapiens
IWQVCGQSQ

SEQ ID NO: 789352 - protein, 9 aa, Homo Sapiens
ASHPLFGRL

SEQ ID NO: 789353 - protein, 9 aa, Homo Sapiens
SGAANQEYK

SEQ ID NO: 789354 - protein, 9 aa, Homo Sapiens
HTLLQVLSR

SEQ ID NO: 789355 - protein, 9 aa, Homo Sapiens
RLLTTDLPP

SEQ ID NO: 789356 - protein, 9 aa, Homo Sapiens
AQLSADQLP

SEQ ID NO: 789357 - protein, 9 aa, Homo Sapiens
QALPAAHIP

SEQ ID NO: 789358 - protein, 9 aa, Homo Sapiens
FSGCIDSMV

SEQ ID NO: 789359 - protein, 9 aa, Homo Sapiens
NLDRNGETQ

SEQ ID NO: 789360 - protein, 9 aa, Homo Sapiens
DSISEALLC

SEQ ID NO: 789361 - protein, 9 aa, Homo Sapiens
VYSAVMDYL

SEQ ID NO: 789362 - protein, 9 aa, Homo Sapiens
ITTTQAGGA

SEQ ID NO: 789363 - protein, 9 aa, Homo Sapiens
NVRHGFVST

SEQ ID NO: 789364 - protein, 9 aa, Homo Sapiens
TRSHDTTIS

SEQ ID NO: 789365 - protein, 9 aa, Homo Sapiens
CDSISEALL

SEQ ID NO: 789366 - protein, 9 aa, Homo Sapiens
IDWGLLQRA

SEQ ID NO: 789367 - protein, 9 aa, Homo Sapiens
LSSLGFSVE

SEQ ID NO: 789368 - protein, 9 aa, Homo Sapiens
QSDMIEAFT

SEQ ID NO: 789369 - protein, 9 aa, Homo Sapiens
TVQVSNAEA

SEQ ID NO: 789370 - protein, 9 aa, Homo Sapiens
NLIQKDRAF

SEQ ID NO: 789371 - protein, 9 aa, Homo Sapiens
ANQEYKSPT

SEQ ID NO: 789372 - protein, 9 aa, Homo Sapiens
WAATPASCS

SEQ ID NO: 789373 - protein, 9 aa, Homo Sapiens
SGLLFLPCP

SEQ ID NO: 789374 - protein, 9 aa, Homo Sapiens
DENFQRKKG

SEQ ID NO: 789375 - protein, 9 aa, Homo Sapiens
PLEISGGRA

SEQ ID NO: 789376 - protein, 9 aa, Homo Sapiens
GPYVPLWLE

SEQ ID NO: 789377 - protein, 9 aa, Homo Sapiens
GQNGSKHHP

SEQ ID NO: 789378 - protein, 9 aa, Homo Sapiens
QAALEDVAS

SEQ ID NO: 789379 - protein, 9 aa, Homo Sapiens
DTEVFNTAI

SEQ ID NO: 789380 - protein, 9 aa, Homo Sapiens
DNLLIMATV

SEQ ID NO: 789381 - protein, 9 aa, Homo Sapiens
SNAEAPMLL

SEQ ID NO: 789382 - protein, 9 aa, Homo Sapiens
CNSGIAHIH

SEQ ID NO: 789383 - protein, 9 aa, Homo Sapiens
PTAVLLSSV

SEQ ID NO: 789384 - protein, 9 aa, Homo Sapiens
SHPLFGRLV

SEQ ID NO: 789385 - protein, 9 aa, Homo Sapiens
NSMSEDGAE

SEQ ID NO: 789386 - protein, 9 aa, Homo Sapiens
SADQLPFVM

SEQ ID NO: 789387 - protein, 9 aa, Homo Sapiens
DWGLLQRAP

SEQ ID NO: 789388 - protein, 9 aa, Homo Sapiens
TWDTPTIVS

SEQ ID NO: 789389 - protein, 9 aa, Homo Sapiens
TDCATSPVG

SEQ ID NO: 789390 - protein, 9 aa, Homo Sapiens
DYMIHIIEK

SEQ ID NO: 789391 - protein, 9 aa, Homo Sapiens
PPPAEETPA

SEQ ID NO: 789392 - protein, 9 aa, Homo Sapiens
ETVQVSNAE

SEQ ID NO: 789393 - protein, 9 aa, Homo Sapiens
DRQFISELN

SEQ ID NO: 789394 - protein, 9 aa, Homo Sapiens
EYKSPTWGE

SEQ ID NO: 789395 - protein, 9 aa, Homo Sapiens
NLFLRFDAV

SEQ ID NO: 789396 - protein, 9 aa, Homo Sapiens
WGKRGPSPS

SEQ ID NO: 789397 - protein, 9 aa, Homo Sapiens
SSRIGLRHK

SEQ ID NO: 789398 - protein, 9 aa, Homo Sapiens
RNLDRNGET

SEQ ID NO: 789399 - protein, 9 aa, Homo Sapiens
QQPLEISGG

SEQ ID NO: 789400 - protein, 9 aa, Homo Sapiens
SSLGFSVEQ

SEQ ID NO: 789401 - protein, 9 aa, Homo Sapiens
RIGLRHKLQ

SEQ ID NO: 789402 - protein, 9 aa, Homo Sapiens
SMKLDENFQ

SEQ ID NO: 789403 - protein, 9 aa, Homo Sapiens
AANQEYKSP

SEQ ID NO: 789404 - protein, 9 aa, Homo Sapiens
LFFDKTTGH

SEQ ID NO: 789405 - protein, 9 aa, Homo Sapiens
PCGWLQWKC

SEQ ID NO: 789406 - protein, 9 aa, Homo Sapiens
PPRFYEACE

SEQ ID NO: 789407 - protein, 9 aa, Homo Sapiens
TTNQEKTPE

SEQ ID NO: 789408 - protein, 9 aa, Homo Sapiens
DFSNSMSED

SEQ ID NO: 789409 - protein, 9 aa, Homo Sapiens
SLAALFQGY

SEQ ID NO: 789410 - protein, 9 aa, Homo Sapiens
NQEKTPEKQ

SEQ ID NO: 789411 - protein, 9 aa, Homo Sapiens
NAAGSKSGP

SEQ ID NO: 789412 - protein, 9 aa, Homo Sapiens
NPVTNVRHG

SEQ ID NO: 789413 - protein, 9 aa, Homo Sapiens
VTTSFSLFF

SEQ ID NO: 789414 - protein, 9 aa, Homo Sapiens
KRSNSVAAV

SEQ ID NO: 789415 - protein, 9 aa, Homo Sapiens
RGGQQPLEI

SEQ ID NO: 789416 - protein, 9 aa, Homo Sapiens
IRKTATEGR

SEQ ID NO: 789417 - protein, 9 aa, Homo Sapiens
WRQALDAPR

SEQ ID NO: 789418 - protein, 9 aa, Homo Sapiens
GAEPGSGPE

SEQ ID NO: 789419 - protein, 9 aa, Homo Sapiens
NGDQLTDVV

SEQ ID NO: 789420 - protein, 9 aa, Homo Sapiens
NPMTYKLRI

SEQ ID NO: 789421 - protein, 9 aa, Homo Sapiens
YHIQACTTT

SEQ ID NO: 789422 - protein, 9 aa, Homo Sapiens
NTEMARQPK

SEQ ID NO: 789423 - protein, 9 aa, Homo Sapiens
ECEAGFYVD

SEQ ID NO: 789424 - protein, 9 aa, Homo Sapiens
GLLFLPCPS

SEQ ID NO: 789425 - protein, 9 aa, Homo Sapiens
MRGVGRPEW

SEQ ID NO: 789426 - protein, 9 aa, Homo Sapiens
ACEELTGPG

SEQ ID NO: 789427 - protein, 9 aa, Homo Sapiens
ADLQAALED

SEQ ID NO: 789428 - protein, 9 aa, Homo Sapiens
LLSAIVSIS

SEQ ID NO: 789429 - protein, 9 aa, Homo Sapiens
PTEDYMIHI

SEQ ID NO: 789430 - protein, 9 aa, Homo Sapiens
LFISNRAVL

SEQ ID NO: 789431 - protein, 9 aa, Homo Sapiens
LWVDSTSPP

SEQ ID NO: 789432 - protein, 9 aa, Homo Sapiens
KLDENFQRK

SEQ ID NO: 789433 - protein, 9 aa, Homo Sapiens
VCEKMENAE

SEQ ID NO: 789434 - protein, 9 aa, Homo Sapiens
NVGEGRHPE

SEQ ID NO: 789435 - protein, 9 aa, Homo Sapiens
RKGFVPSWP

SEQ ID NO: 789436 - protein, 9 aa, Homo Sapiens
EPWGTQEGQ

SEQ ID NO: 789437 - protein, 9 aa, Homo Sapiens
FINRVGMFV

SEQ ID NO: 789438 - protein, 9 aa, Homo Sapiens
CSLNNTSLN

SEQ ID NO: 789439 - protein, 9 aa, Homo Sapiens
VGEPRKGFV

SEQ ID NO: 789440 - protein, 9 aa, Homo Sapiens
GKLQEPWGT

SEQ ID NO: 789441 - protein, 9 aa, Homo Sapiens
VFSVGPVSP

SEQ ID NO: 789442 - protein, 9 aa, Homo Sapiens
MDTEVFNTA

SEQ ID NO: 789443 - protein, 9 aa, Homo Sapiens
LDNLLIMAT

SEQ ID NO: 789444 - protein, 9 aa, Homo Sapiens
MLVEEEGLK

SEQ ID NO: 789445 - protein, 9 aa, Homo Sapiens
CVQFIWKKH

SEQ ID NO: 789446 - protein, 9 aa, Homo Sapiens
EPGSGPEPA

SEQ ID NO: 789447 - protein, 9 aa, Homo Sapiens
GYWSYVLRL

SEQ ID NO: 789448 - protein, 9 aa, Homo Sapiens
LAALFQGYW

SEQ ID NO: 789449 - protein, 9 aa, Homo Sapiens
CASMKLDEN

SEQ ID NO: 789450 - protein, 9 aa, Homo Sapiens
QLSADQLPF

SEQ ID NO: 789451 - protein, 9 aa, Homo Sapiens
LDENFQRKK

SEQ ID NO: 789452 - protein, 9 aa, Homo Sapiens
LLYVNAAGS

SEQ ID NO: 789453 - protein, 9 aa, Homo Sapiens
SVAAVQADL

SEQ ID NO: 789454 - protein, 9 aa, Homo Sapiens
RVNVGEGRH

SEQ ID NO: 789455 - protein, 9 aa, Homo Sapiens
LYVNAAGSK

SEQ ID NO: 789456 - protein, 9 aa, Homo Sapiens
YSAVMDYLP

SEQ ID NO: 789457 - protein, 9 aa, Homo Sapiens
LKLLCDIQE

SEQ ID NO: 789458 - protein, 9 aa, Homo Sapiens
SDLTRSHDT

SEQ ID NO: 789459 - protein, 9 aa, Homo Sapiens
VAKCSTLFI

SEQ ID NO: 789460 - protein, 9 aa, Homo Sapiens
NFINRVGMF

SEQ ID NO: 789461 - protein, 9 aa, Homo Sapiens
YAYRRNSVR

SEQ ID NO: 789462 - protein, 9 aa, Homo Sapiens
SQYAYRRNS

SEQ ID NO: 789463 - protein, 9 aa, Homo Sapiens
IFRSRNGHD

SEQ ID NO: 789464 - protein, 9 aa, Homo Sapiens
INKEKSMGQ

SEQ ID NO: 789465 - protein, 9 aa, Homo Sapiens
YSLMFSETG

SEQ ID NO: 789466 - protein, 9 aa, Homo Sapiens
AFFILGLQT

SEQ ID NO: 789467 - protein, 9 aa, Homo Sapiens
LRHRLLTTD

SEQ ID NO: 789468 - protein, 9 aa, Homo Sapiens
PRKGFVPSW

SEQ ID NO: 789469 - protein, 9 aa, Homo Sapiens
NVAILFSGC

SEQ ID NO: 789470 - protein, 9 aa, Homo Sapiens
DRAQLYIVC

SEQ ID NO: 789471 - protein, 9 aa, Homo Sapiens
SNSVAAVQA

SEQ ID NO: 789472 - protein, 9 aa, Homo Sapiens
WVYILLHQA

SEQ ID NO: 789473 - protein, 9 aa, Homo Sapiens
GAANQEYKS

SEQ ID NO: 789474 - protein, 9 aa, Homo Sapiens
CEELTGPGA

SEQ ID NO: 789475 - protein, 9 aa, Homo Sapiens
AELIWRQAL

SEQ ID NO: 789476 - protein, 9 aa, Homo Sapiens
TEDYMIHII

SEQ ID NO: 789477 - protein, 9 aa, Homo Sapiens
AEREFRGLS

SEQ ID NO: 789478 - protein, 9 aa, Homo Sapiens
LDRQFISEL

SEQ ID NO: 789479 - protein, 9 aa, Homo Sapiens
RGLSDCLVK

SEQ ID NO: 789480 - protein, 9 aa, Homo Sapiens
KRLREINIM

SEQ ID NO: 789481 - protein, 9 aa, Homo Sapiens
SGYLLVGTA

SEQ ID NO: 789482 - protein, 9 aa, Homo Sapiens
PVGKYHIQA

SEQ ID NO: 789483 - protein, 9 aa, Homo Sapiens
QGYWSYVLR

SEQ ID NO: 789484 - protein, 9 aa, Homo Sapiens
YLEQTGASP

SEQ ID NO: 789485 - protein, 9 aa, Homo Sapiens
FSNSMSEDG

SEQ ID NO: 789486 - protein, 9 aa, Homo Sapiens
ADDSGSIKI

SEQ ID NO: 789487 - protein, 9 aa, Homo Sapiens
GSIKILDLE

SEQ ID NO: 789488 - protein, 9 aa, Homo Sapiens
HQRLHYWIW

SEQ ID NO: 789489 - protein, 9 aa, Homo Sapiens
RYNSTSYPN

SEQ ID NO: 789490 - protein, 9 aa, Homo Sapiens
SFLKTIFRS

SEQ ID NO: 789491 - protein, 9 aa, Homo Sapiens
SQVSKLRAK

SEQ ID NO: 789492 - protein, 9 aa, Homo Sapiens
DQLTDVVIG

SEQ ID NO: 789493 - protein, 9 aa, Homo Sapiens
DISSRIGLR

SEQ ID NO: 789494 - protein, 9 aa, Homo Sapiens
IGLRHKLQC

SEQ ID NO: 789495 - protein, 9 aa, Homo Sapiens
YVYSAVMDY

SEQ ID NO: 789496 - protein, 9 aa, Homo Sapiens
DIAESQVSK

SEQ ID NO: 789497 - protein, 9 aa, Homo Sapiens
PETQQYFFY

SEQ ID NO: 789498 - protein, 9 aa, Homo Sapiens
SPPGTRVRA

SEQ ID NO: 789499 - protein, 9 aa, Homo Sapiens
YVLRLVPKD

SEQ ID NO: 789500 - protein, 9 aa, Homo Sapiens
EMARQPKKF

SEQ ID NO: 789501 - protein, 9 aa, Homo Sapiens
YRDPDIFRH

SEQ ID NO: 789502 - protein, 9 aa, Homo Sapiens
NVSNADNRQ

SEQ ID NO: 789503 - protein, 9 aa, Homo Sapiens
AAPHNLLGS

SEQ ID NO: 789504 - protein, 9 aa, Homo Sapiens
TLLQVLSRR

SEQ ID NO: 789505 - protein, 9 aa, Homo Sapiens
MKLDENFQR

SEQ ID NO: 789506 - protein, 9 aa, Homo Sapiens
CRWGKRGPS

SEQ ID NO: 789507 - protein, 9 aa, Homo Sapiens
ELCMNLRYN

SEQ ID NO: 789508 - protein, 9 aa, Homo Sapiens
KRGPSPSGA

SEQ ID NO: 789509 - protein, 9 aa, Homo Sapiens
FSLFFDKTT

SEQ ID NO: 789510 - protein, 9 aa, Homo Sapiens
LLDNLLIMA

SEQ ID NO: 789511 - protein, 9 aa, Homo Sapiens
IAQKVSDKH

SEQ ID NO: 789512 - protein, 9 aa, Homo Sapiens
SETGRNWKQ

SEQ ID NO: 789513 - protein, 9 aa, Homo Sapiens
QVCGQSQRP

SEQ ID NO: 789514 - protein, 9 aa, Homo Sapiens
LYIVCEKME

SEQ ID NO: 789515 - protein, 9 aa, Homo Sapiens
AKQYVYSAV

SEQ ID NO: 789516 - protein, 9 aa, Homo Sapiens
PDLLAQGLS

SEQ ID NO: 789517 - protein, 9 aa, Homo Sapiens
KEKSMGQKW

SEQ ID NO: 789518 - protein, 9 aa, Homo Sapiens
NLGNFINRV

SEQ ID NO: 789519 - protein, 9 aa, Homo Sapiens
SIQNRWLVH

SEQ ID NO: 789520 - protein, 9 aa, Homo Sapiens
LGNFINRVG

SEQ ID NO: 789521 - protein, 9 aa, Homo Sapiens
RFKRSNSVA

SEQ ID NO: 789522 - protein, 9 aa, Homo Sapiens
EEEGLKLLC

SEQ ID NO: 789523 - protein, 9 aa, Homo Sapiens
RAQLYIVCE

SEQ ID NO: 789524 - protein, 9 aa, Homo Sapiens
AEAPMLLPD

SEQ ID NO: 789525 - protein, 9 aa, Homo Sapiens
LEDVASSDS

SEQ ID NO: 789526 - protein, 9 aa, Homo Sapiens
PGPLPASHP

SEQ ID NO: 789527 - protein, 9 aa, Homo Sapiens
QACTTTPCM

SEQ ID NO: 789528 - protein, 9 aa, Homo Sapiens
LIQKDRAFA

SEQ ID NO: 789529 - protein, 9 aa, Homo Sapiens
PAEETPAEV

SEQ ID NO: 789530 - protein, 9 aa, Homo Sapiens
SYSLMFSET

SEQ ID NO: 789531 - protein, 9 aa, Homo Sapiens
LQVLSRRTD

SEQ ID NO: 789532 - protein, 9 aa, Homo Sapiens
PSVETTNQE

SEQ ID NO: 789533 - protein, 9 aa, Homo Sapiens
YGDISSRIG

SEQ ID NO: 789534 - protein, 9 aa, Homo Sapiens
HDTTISNSQ

SEQ ID NO: 789535 - protein, 9 aa, Homo Sapiens
VLGDVNGDQ

SEQ ID NO: 789536 - protein, 9 aa, Homo Sapiens
RKPRLLQSQ

SEQ ID NO: 789537 - protein, 9 aa, Homo Sapiens
KCASMKLDE

SEQ ID NO: 789538 - protein, 9 aa, Homo Sapiens
SPAQPAGAT

SEQ ID NO: 789539 - protein, 9 aa, Homo Sapiens
VFNTAILTG

SEQ ID NO: 789540 - protein, 9 aa, Homo Sapiens
FLPCPSSHC

SEQ ID NO: 789541 - protein, 9 aa, Homo Sapiens
VCGQSQRPA

SEQ ID NO: 789542 - protein, 9 aa, Homo Sapiens
VGEGRHPER

SEQ ID NO: 789543 - protein, 9 aa, Homo Sapiens
LISLVEPGP

SEQ ID NO: 789544 - protein, 9 aa, Homo Sapiens
AYLEQTGAS

SEQ ID NO: 789545 - protein, 9 aa, Homo Sapiens
SKSGPRNLD

SEQ ID NO: 789546 - protein, 9 aa, Homo Sapiens
PEPAHQRLH

SEQ ID NO: 789547 - protein, 9 aa, Homo Sapiens
GPQSDMIEA

SEQ ID NO: 789548 - protein, 9 aa, Homo Sapiens
GGAGTKPTI

SEQ ID NO: 789549 - protein, 9 aa, Homo Sapiens
VQLWVDSTS

SEQ ID NO: 789550 - protein, 9 aa, Homo Sapiens
PWGTQEGQL

SEQ ID NO: 789551 - protein, 9 aa, Homo Sapiens
INIMIRTGE

SEQ ID NO: 789552 - protein, 9 aa, Homo Sapiens
DTCNSGIAH

SEQ ID NO: 789553 - protein, 9 aa, Homo Sapiens
LHYWIWQVC

SEQ ID NO: 789554 - protein, 9 aa, Homo Sapiens
RTNDVVNAG

SEQ ID NO: 789555 - protein, 9 aa, Homo Sapiens
SRKRLSQYA

SEQ ID NO: 789556 - protein, 9 aa, Homo Sapiens
KNRTNDVVN

SEQ ID NO: 789557 - protein, 9 aa, Homo Sapiens
TCNSGIAHI

SEQ ID NO: 789558 - protein, 9 aa, Homo Sapiens
LSAIVSISA

SEQ ID NO: 789559 - protein, 9 aa, Homo Sapiens
DLTRSHDTT

SEQ ID NO: 789560 - protein, 9 aa, Homo Sapiens
VPVATLARR

SEQ ID NO: 789561 - protein, 9 aa, Homo Sapiens
GYLLVGTAA

SEQ ID NO: 789562 - protein, 9 aa, Homo Sapiens
VGAALLYVN

SEQ ID NO: 789563 - protein, 9 aa, Homo Sapiens
AHQRLHYWI

SEQ ID NO: 789564 - protein, 9 aa, Homo Sapiens
KGFNWKTHL

SEQ ID NO: 789565 - protein, 9 aa, Homo Sapiens
KNRNHMKDN

SEQ ID NO: 789566 - protein, 9 aa, Homo Sapiens
DLLAQGLSL

SEQ ID NO: 789567 - protein, 9 aa, Homo Sapiens
YNERLDRQF

SEQ ID NO: 789568 - protein, 9 aa, Homo Sapiens
GVGRPEWWM

SEQ ID NO: 789569 - protein, 9 aa, Homo Sapiens
LLCAGQNGS

SEQ ID NO: 789570 - protein, 9 aa, Homo Sapiens
QYVYSAVMD

SEQ ID NO: 789571 - protein, 9 aa, Homo Sapiens
GFSVEQPEM

SEQ ID NO: 789572 - protein, 9 aa, Homo Sapiens
GVGEPRKGF

SEQ ID NO: 789573 - protein, 9 aa, Homo Sapiens
NDVVNAGMG

SEQ ID NO: 789574 - protein, 9 aa, Homo Sapiens
APHNLLGSV

SEQ ID NO: 789575 - protein, 9 aa, Homo Sapiens
AKCSTLFIS

SEQ ID NO: 789576 - protein, 9 aa, Homo Sapiens
TTAEVIAQK

SEQ ID NO: 789577 - protein, 9 aa, Homo Sapiens
YEACEELTG

SEQ ID NO: 789578 - protein, 9 aa, Homo Sapiens
GKGFNWKTH

SEQ ID NO: 789579 - protein, 9 aa, Homo Sapiens
ADQLPFVME

SEQ ID NO: 789580 - protein, 9 aa, Homo Sapiens
VSCDSISEA

SEQ ID NO: 789581 - protein, 9 aa, Homo Sapiens
LDSGLLFLP

SEQ ID NO: 789582 - protein, 9 aa, Homo Sapiens
NSVAAVQAD

SEQ ID NO: 789583 - protein, 9 aa, Homo Sapiens
VNVGNITCV

SEQ ID NO: 789584 - protein, 9 aa, Homo Sapiens
VGMFVSKFF

SEQ ID NO: 789585 - protein, 9 aa, Homo Sapiens
GAALLYVNA

SEQ ID NO: 789586 - protein, 9 aa, Homo Sapiens
LLQRAPGAN

SEQ ID NO: 789587 - protein, 9 aa, Homo Sapiens
SLFFDKTTG

SEQ ID NO: 789588 - protein, 9 aa, Homo Sapiens
VNAAGSKSG

SEQ ID NO: 789589 - protein, 9 aa, Homo Sapiens
VDSTSPPGT

SEQ ID NO: 789590 - protein, 9 aa, Homo Sapiens
AQLYIVCEK

SEQ ID NO: 789591 - protein, 9 aa, Homo Sapiens
TNFLLCAGQ

SEQ ID NO: 789592 - protein, 9 aa, Homo Sapiens
EQPEMAPQS

SEQ ID NO: 789593 - protein, 9 aa, Homo Sapiens
RFYEACEEL

SEQ ID NO: 789594 - protein, 9 aa, Homo Sapiens
FNWKTHLAC

SEQ ID NO: 789595 - protein, 9 aa, Homo Sapiens
IQLLQFNIL

SEQ ID NO: 789596 - protein, 9 aa, Homo Sapiens
SKEEGDTVN

SEQ ID NO: 789597 - protein, 9 aa, Homo Sapiens
FISNRAVLQ

SEQ ID NO: 789598 - protein, 9 aa, Homo Sapiens
GETVQVSNA

SEQ ID NO: 789599 - protein, 9 aa, Homo Sapiens
YIVCEKMEN

SEQ ID NO: 789600 - protein, 9 aa, Homo Sapiens
LQFNILISL

SEQ ID NO: 789601 - protein, 9 aa, Homo Sapiens
FLLCAGQNG

SEQ ID NO: 789602 - protein, 9 aa, Homo Sapiens
NAEAPMLLP

SEQ ID NO: 789603 - protein, 9 aa, Homo Sapiens
QNGSKHHPL

SEQ ID NO: 789604 - protein, 9 aa, Homo Sapiens
LKTIFRSRN

SEQ ID NO: 789605 - protein, 9 aa, Homo Sapiens
LWLECEAGF

SEQ ID NO: 789606 - protein, 9 aa, Homo Sapiens
REINIMIRT

SEQ ID NO: 789607 - protein, 9 aa, Homo Sapiens
ETTNQEKTP

SEQ ID NO: 789608 - protein, 9 aa, Homo Sapiens
QDSREETQH

SEQ ID NO: 789609 - protein, 9 aa, Homo Sapiens
LARRHFTEQ

SEQ ID NO: 789610 - protein, 9 aa, Homo Sapiens
SEALLCSKS

SEQ ID NO: 789611 - protein, 9 aa, Homo Sapiens
AANIEVWSY

SEQ ID NO: 789612 - protein, 9 aa, Homo Sapiens
HNSQNVSNA

SEQ ID NO: 789613 - protein, 9 aa, Homo Sapiens
LLPGPLPAS

SEQ ID NO: 789614 - protein, 9 aa, Homo Sapiens
QFISELNTQ

SEQ ID NO: 789615 - protein, 9 aa, Homo Sapiens
IFVLLLSAI

SEQ ID NO: 789616 - protein, 9 aa, Homo Sapiens
IWRQALDAP

SEQ ID NO: 789617 - protein, 9 aa, Homo Sapiens
AEPGSGPEP

SEQ ID NO: 789618 - protein, 9 aa, Homo Sapiens
GLKLLCDIQ

SEQ ID NO: 789619 - protein, 9 aa, Homo Sapiens
VLRLVPKDP

SEQ ID NO: 789620 - protein, 9 aa, Homo Sapiens
VIAQKVSDK

SEQ ID NO: 789621 - protein, 9 aa, Homo Sapiens
LMYLFTLLD

SEQ ID NO: 789622 - protein, 9 aa, Homo Sapiens
IMIRTGETP

SEQ ID NO: 789623 - protein, 9 aa, Homo Sapiens
ILLHQAVLR

SEQ ID NO: 789624 - protein, 9 aa, Homo Sapiens
VSKLRAKSR

SEQ ID NO: 789625 - protein, 9 aa, Homo Sapiens
QVLSRRTDI

SEQ ID NO: 789626 - protein, 9 aa, Homo Sapiens
ASIQNRWLV

SEQ ID NO: 789627 - protein, 9 aa, Homo Sapiens
KLQEPWGTQ

SEQ ID NO: 789628 - protein, 9 aa, Homo Sapiens
EDAAPHNLL

SEQ ID NO: 789629 - protein, 9 aa, Homo Sapiens
WIWQVCGQS

SEQ ID NO: 789630 - protein, 9 aa, Homo Sapiens
FRFGFSQSV

SEQ ID NO: 789631 - protein, 9 aa, Homo Sapiens
VEQPEMAPQ

SEQ ID NO: 789632 - protein, 9 aa, Homo Sapiens
DPCRWGKRG

SEQ ID NO: 789633 - protein, 9 aa, Homo Sapiens
RHRLLTTDL

SEQ ID NO: 789634 - protein, 9 aa, Homo Sapiens
HQAVLRQLL

SEQ ID NO: 789635 - protein, 9 aa, Homo Sapiens
AVKSGTMST

SEQ ID NO: 789636 - protein, 9 aa, Homo Sapiens
ATEGRSKSF

SEQ ID NO: 789637 - protein, 9 aa, Homo Sapiens
GKYHIQACT

SEQ ID NO: 789638 - protein, 9 aa, Homo Sapiens
ATSPVGCSV

SEQ ID NO: 789639 - protein, 9 aa, Homo Sapiens
SGPEPAHQR

SEQ ID NO: 789640 - protein, 9 aa, Homo Sapiens
WGTQEGQLR

SEQ ID NO: 789641 - protein, 9 aa, Homo Sapiens
EINIMIRTG

SEQ ID NO: 789642 - protein, 9 aa, Homo Sapiens
TAANIEVWS

SEQ ID NO: 789643 - protein, 9 aa, Homo Sapiens
GDTVNWYSS

SEQ ID NO: 789644 - protein, 9 aa, Homo Sapiens
NKAHYPDVY

SEQ ID NO: 789645 - protein, 9 aa, Homo Sapiens
LNPMTYKLR

SEQ ID NO: 789646 - protein, 9 aa, Homo Sapiens
LMFSETGRN

SEQ ID NO: 789647 - protein, 9 aa, Homo Sapiens
TSYSLMFSE

SEQ ID NO: 789648 - protein, 9 aa, Homo Sapiens
NDNINTEMA

SEQ ID NO: 789649 - protein, 9 aa, Homo Sapiens
PRLLQSQAL

SEQ ID NO: 789650 - protein, 9 aa, Homo Sapiens
ESQVSKLRA

SEQ ID NO: 789651 - protein, 9 aa, Homo Sapiens
STLFISNRA

SEQ ID NO: 789652 - protein, 9 aa, Homo Sapiens
IKNRNHMKD

SEQ ID NO: 789653 - protein, 9 aa, Homo Sapiens
VNVGEGRHP

SEQ ID NO: 789654 - protein, 9 aa, Homo Sapiens
GFNWKTHLA

SEQ ID NO: 789655 - protein, 9 aa, Homo Sapiens
LHQAVLRQL

SEQ ID NO: 789656 - protein, 9 aa, Homo Sapiens
TVPVATLAR

SEQ ID NO: 789657 - protein, 9 aa, Homo Sapiens
FHNSQNVSN

SEQ ID NO: 789658 - protein, 9 aa, Homo Sapiens
YTDCATSPV

SEQ ID NO: 789659 - protein, 9 aa, Homo Sapiens
FRNPVTNVR

SEQ ID NO: 789660 - protein, 9 aa, Homo Sapiens
LVPKDPCRW

SEQ ID NO: 789661 - protein, 9 aa, Homo Sapiens
QPPPAEETP

SEQ ID NO: 789662 - protein, 9 aa, Homo Sapiens
IAHIHRLFN

SEQ ID NO: 789663 - protein, 9 aa, Homo Sapiens
IVYQPDGSV

SEQ ID NO: 789664 - protein, 9 aa, Homo Sapiens
NMNGLAATP

SEQ ID NO: 789665 - protein, 9 aa, Homo Sapiens
PAAPSPAPG

SEQ ID NO: 789666 - protein, 9 aa, Homo Sapiens
LSMGMIMMC

SEQ ID NO: 789667 - protein, 9 aa, Homo Sapiens
AQGQVATTG

SEQ ID NO: 789668 - protein, 9 aa, Homo Sapiens
REYRNLLRQ

SEQ ID NO: 789669 - protein, 9 aa, Homo Sapiens
TTTAQKSRP

SEQ ID NO: 789670 - protein, 9 aa, Homo Sapiens
DYLRVASRP

SEQ ID NO: 789671 - protein, 9 aa, Homo Sapiens
YKASKFRVG

SEQ ID NO: 789672 - protein, 9 aa, Homo Sapiens
AVITASAVA

SEQ ID NO: 789673 - protein, 9 aa, Homo Sapiens
PALLLLLAG

SEQ ID NO: 789674 - protein, 9 aa, Homo Sapiens
RQPLESDSV

SEQ ID NO: 789675 - protein, 9 aa, Homo Sapiens
EFVCHIIYV

SEQ ID NO: 789676 - protein, 9 aa, Homo Sapiens
DPDSSENSR

SEQ ID NO: 789677 - protein, 9 aa, Homo Sapiens
PAGQRRGSR

SEQ ID NO: 789678 - protein, 9 aa, Homo Sapiens
TISHFLYTL

SEQ ID NO: 789679 - protein, 9 aa, Homo Sapiens
SSVPPELTA

SEQ ID NO: 789680 - protein, 9 aa, Homo Sapiens
SSENSRVIY

SEQ ID NO: 789681 - protein, 9 aa, Homo Sapiens
LECLCRELQ

SEQ ID NO: 789682 - protein, 9 aa, Homo Sapiens
PSRTRTRMP

SEQ ID NO: 789683 - protein, 9 aa, Homo Sapiens
VRHCLAPAR

SEQ ID NO: 789684 - protein, 9 aa, Homo Sapiens
DIKCNRKIS

SEQ ID NO: 789685 - protein, 9 aa, Homo Sapiens
WNRMEWNRI

SEQ ID NO: 789686 - protein, 9 aa, Homo Sapiens
RQLRPFPST

SEQ ID NO: 789687 - protein, 9 aa, Homo Sapiens
PRRTNHVSR

SEQ ID NO: 789688 - protein, 9 aa, Homo Sapiens
TLGGCQVSP

SEQ ID NO: 789689 - protein, 9 aa, Homo Sapiens
ATPMTPTSG

SEQ ID NO: 789690 - protein, 9 aa, Homo Sapiens
VEETCSFEE

SEQ ID NO: 789691 - protein, 9 aa, Homo Sapiens
AFRHSLFFA

SEQ ID NO: 789692 - protein, 9 aa, Homo Sapiens
LSPGDWNGE

SEQ ID NO: 789693 - protein, 9 aa, Homo Sapiens
APEGCSPRP

SEQ ID NO: 789694 - protein, 9 aa, Homo Sapiens
MGMIMMCVA

SEQ ID NO: 789695 - protein, 9 aa, Homo Sapiens
TAGTVVVAV

SEQ ID NO: 789696 - protein, 9 aa, Homo Sapiens
KLKTPLNSA

SEQ ID NO: 789697 - protein, 9 aa, Homo Sapiens
KRTFLHCWE

SEQ ID NO: 789698 - protein, 9 aa, Homo Sapiens
RKRGSLPSR

SEQ ID NO: 789699 - protein, 9 aa, Homo Sapiens
GGQCEAGRY

SEQ ID NO: 789700 - protein, 9 aa, Homo Sapiens
PFPSTSRWS

SEQ ID NO: 789701 - protein, 9 aa, Homo Sapiens
GGFLARKMS

SEQ ID NO: 789702 - protein, 9 aa, Homo Sapiens
IILQNVIHF

SEQ ID NO: 789703 - protein, 9 aa, Homo Sapiens
TRRRTRDFL

SEQ ID NO: 789704 - protein, 9 aa, Homo Sapiens
RTTRRRTRD

SEQ ID NO: 789705 - protein, 9 aa, Homo Sapiens
QPCKRTFLH

SEQ ID NO: 789706 - protein, 9 aa, Homo Sapiens
PPPPGPADP

SEQ ID NO: 789707 - protein, 9 aa, Homo Sapiens
QPRTTRRRT

SEQ ID NO: 789708 - protein, 9 aa, Homo Sapiens
RHCLAPARG

SEQ ID NO: 789709 - protein, 9 aa, Homo Sapiens
GPCPPSPSS

SEQ ID NO: 789710 - protein, 9 aa, Homo Sapiens
SAKPGSSWI

SEQ ID NO: 789711 - protein, 9 aa, Homo Sapiens
VVAVITASA

SEQ ID NO: 789712 - protein, 9 aa, Homo Sapiens
HLRKAARLE

SEQ ID NO: 789713 - protein, 9 aa, Homo Sapiens
RRAGECGGK

SEQ ID NO: 789714 - protein, 9 aa, Homo Sapiens
SRSQPRTTR

SEQ ID NO: 789715 - protein, 9 aa, Homo Sapiens
EWNRMEWNR

SEQ ID NO: 789716 - protein, 9 aa, Homo Sapiens
RQGLVAAVL

SEQ ID NO: 789717 - protein, 9 aa, Homo Sapiens
AQKSRPRMC

SEQ ID NO: 789718 - protein, 9 aa, Homo Sapiens
ILINPMRKE

SEQ ID NO: 789719 - protein, 9 aa, Homo Sapiens
MTEVVRRFP

SEQ ID NO: 789720 - protein, 9 aa, Homo Sapiens
PAVDTVSGM

SEQ ID NO: 789721 - protein, 9 aa, Homo Sapiens
RTNHVSRED

SEQ ID NO: 789722 - protein, 9 aa, Homo Sapiens
FYPKPVRVC

SEQ ID NO: 789723 - protein, 9 aa, Homo Sapiens
AYTVKKIID

SEQ ID NO: 789724 - protein, 9 aa, Homo Sapiens
EQEEEEEVE

SEQ ID NO: 789725 - protein, 9 aa, Homo Sapiens
AVAAAPPAR

SEQ ID NO: 789726 - protein, 9 aa, Homo Sapiens
TPMTPTSGG

SEQ ID NO: 789727 - protein, 9 aa, Homo Sapiens
PPPGPADPA

SEQ ID NO: 789728 - protein, 9 aa, Homo Sapiens
ALDKNEGEQ

SEQ ID NO: 789729 - protein, 9 aa, Homo Sapiens
YWKIYKASK

SEQ ID NO: 789730 - protein, 9 aa, Homo Sapiens
FDIKCNRKI

SEQ ID NO: 789731 - protein, 9 aa, Homo Sapiens
EVCGRGFSQ

SEQ ID NO: 789732 - protein, 9 aa, Homo Sapiens
AQLFMDHLY

SEQ ID NO: 789733 - protein, 9 aa, Homo Sapiens
LEPRGARRW

SEQ ID NO: 789734 - protein, 9 aa, Homo Sapiens
ANQAHLIVN

SEQ ID NO: 789735 - protein, 9 aa, Homo Sapiens
TRMPRAATT

SEQ ID NO: 789736 - protein, 9 aa, Homo Sapiens
FSKGSQYQP

SEQ ID NO: 789737 - protein, 9 aa, Homo Sapiens
LCQSGPLPP

SEQ ID NO: 789738 - protein, 9 aa, Homo Sapiens
AAPTAAPPA

SEQ ID NO: 789739 - protein, 9 aa, Homo Sapiens
TTRRRTRDF

SEQ ID NO: 789740 - protein, 9 aa, Homo Sapiens
NADNAHLFA

SEQ ID NO: 789741 - protein, 9 aa, Homo Sapiens
ADPAAPSPA

SEQ ID NO: 789742 - protein, 9 aa, Homo Sapiens
LARSKLECL

SEQ ID NO: 789743 - protein, 9 aa, Homo Sapiens
LRYANQAHL

SEQ ID NO: 789744 - protein, 9 aa, Homo Sapiens
VAVITASAV

SEQ ID NO: 789745 - protein, 9 aa, Homo Sapiens
FEEAFEALE

SEQ ID NO: 789746 - protein, 9 aa, Homo Sapiens
IKCNRKISA

SEQ ID NO: 789747 - protein, 9 aa, Homo Sapiens
IGSWNFFER

SEQ ID NO: 789748 - protein, 9 aa, Homo Sapiens
VCFLCASKG

SEQ ID NO: 789749 - protein, 9 aa, Homo Sapiens
FDAARGDTL

SEQ ID NO: 789750 - protein, 9 aa, Homo Sapiens
LAAECSEQL

SEQ ID NO: 789751 - protein, 9 aa, Homo Sapiens
TVIIQPMNV

SEQ ID NO: 789752 - protein, 9 aa, Homo Sapiens
PRRAGECGG

SEQ ID NO: 789753 - protein, 9 aa, Homo Sapiens
EPPRRTNHV

SEQ ID NO: 789754 - protein, 9 aa, Homo Sapiens
VYIVESLSQ

SEQ ID NO: 789755 - protein, 9 aa, Homo Sapiens
RRRTRDFLK

SEQ ID NO: 789756 - protein, 9 aa, Homo Sapiens
GTAFRHSLF

SEQ ID NO: 789757 - protein, 9 aa, Homo Sapiens
GSWNFFERD

SEQ ID NO: 789758 - protein, 9 aa, Homo Sapiens
VTYAQVKHS

SEQ ID NO: 789759 - protein, 9 aa, Homo Sapiens
IQPMNVEDR

SEQ ID NO: 789760 - protein, 9 aa, Homo Sapiens
AYGEHLAAA

SEQ ID NO: 789761 - protein, 9 aa, Homo Sapiens
TAPAAPTAA

SEQ ID NO: 789762 - protein, 9 aa, Homo Sapiens
CHIIYVFYQ

SEQ ID NO: 789763 - protein, 9 aa, Homo Sapiens
TSRWSLPQA

SEQ ID NO: 789764 - protein, 9 aa, Homo Sapiens
DVDKRNKAL

SEQ ID NO: 789765 - protein, 9 aa, Homo Sapiens
TAFRHSLFF

SEQ ID NO: 789766 - protein, 9 aa, Homo Sapiens
GMIMMCVAF

SEQ ID NO: 789767 - protein, 9 aa, Homo Sapiens
LKTPLNSAK

SEQ ID NO: 789768 - protein, 9 aa, Homo Sapiens
SLSMGMIMM

SEQ ID NO: 789769 - protein, 9 aa, Homo Sapiens
LDLHEAGVE

SEQ ID NO: 789770 - protein, 9 aa, Homo Sapiens
GEQEEEEEV

SEQ ID NO: 789771 - protein, 9 aa, Homo Sapiens
EREYRNLLR

SEQ ID NO: 789772 - protein, 9 aa, Homo Sapiens
KTPLNSAKP

SEQ ID NO: 789773 - protein, 9 aa, Homo Sapiens
PLVRHCLAP

SEQ ID NO: 789774 - protein, 9 aa, Homo Sapiens
VRDLSSVPP

SEQ ID NO: 789775 - protein, 9 aa, Homo Sapiens
SKFRVGSRK

SEQ ID NO: 789776 - protein, 9 aa, Homo Sapiens
AAECSEQLG

SEQ ID NO: 789777 - protein, 9 aa, Homo Sapiens
VTRLFSFTS

SEQ ID NO: 789778 - protein, 9 aa, Homo Sapiens
AATPMTPTS

SEQ ID NO: 789779 - protein, 9 aa, Homo Sapiens
DKRNKALEE

SEQ ID NO: 789780 - protein, 9 aa, Homo Sapiens
GLLSPGDWN

SEQ ID NO: 789781 - protein, 9 aa, Homo Sapiens
LSPDPIILQ

SEQ ID NO: 789782 - protein, 9 aa, Homo Sapiens
WILINPMRK

SEQ ID NO: 789783 - protein, 9 aa, Homo Sapiens
HGRLALRRA

SEQ ID NO: 789784 - protein, 9 aa, Homo Sapiens
KVADEVLKV

SEQ ID NO: 789785 - protein, 9 aa, Homo Sapiens
HEPLCSMLA

SEQ ID NO: 789786 - protein, 9 aa, Homo Sapiens
LSLFDIKCN

SEQ ID NO: 789787 - protein, 9 aa, Homo Sapiens
CQEEIGSWN

SEQ ID NO: 789788 - protein, 9 aa, Homo Sapiens
AAVLEKLEK

SEQ ID NO: 789789 - protein, 9 aa, Homo Sapiens
ALSQTGFSY

SEQ ID NO: 789790 - protein, 9 aa, Homo Sapiens
RFHTFPRRA

SEQ ID NO: 789791 - protein, 9 aa, Homo Sapiens
ENNKLIVCR

SEQ ID NO: 789792 - protein, 9 aa, Homo Sapiens
GLVAAVLEK

SEQ ID NO: 789793 - protein, 9 aa, Homo Sapiens
IPVLQFAML

SEQ ID NO: 789794 - protein, 9 aa, Homo Sapiens
ASQIWNLNP

SEQ ID NO: 789795 - protein, 9 aa, Homo Sapiens
VADEVLKVD

SEQ ID NO: 789796 - protein, 9 aa, Homo Sapiens
FVFQRWYQK

SEQ ID NO: 789797 - protein, 9 aa, Homo Sapiens
AAAEAALSQ

SEQ ID NO: 789798 - protein, 9 aa, Homo Sapiens
RMEWNRIES

SEQ ID NO: 789799 - protein, 9 aa, Homo Sapiens
CKRTFLHCW

SEQ ID NO: 789800 - protein, 9 aa, Homo Sapiens
FLKAGKKTF

SEQ ID NO: 789801 - protein, 9 aa, Homo Sapiens
RGHQTYTRY

SEQ ID NO: 789802 - protein, 9 aa, Homo Sapiens
SETAPAAPT

SEQ ID NO: 789803 - protein, 9 aa, Homo Sapiens
PSGPCPPSP

SEQ ID NO: 789804 - protein, 9 aa, Homo Sapiens
CSMLAASTP

SEQ ID NO: 789805 - protein, 9 aa, Homo Sapiens
KELRELEPR

SEQ ID NO: 789806 - protein, 9 aa, Homo Sapiens
PCKRTFLHC

SEQ ID NO: 789807 - protein, 9 aa, Homo Sapiens
SFEEAFEAL

SEQ ID NO: 789808 - protein, 9 aa, Homo Sapiens
LPGAAKTPM

SEQ ID NO: 789809 - protein, 9 aa, Homo Sapiens
KDGLLSPGD

SEQ ID NO: 789810 - protein, 9 aa, Homo Sapiens
MNVEDRGFA

SEQ ID NO: 789811 - protein, 9 aa, Homo Sapiens
NPMRKEDEG

SEQ ID NO: 789812 - protein, 9 aa, Homo Sapiens
SDYLRVASR

SEQ ID NO: 789813 - protein, 9 aa, Homo Sapiens
SHEPLCSML

SEQ ID NO: 789814 - protein, 9 aa, Homo Sapiens
ELEPRGARR

SEQ ID NO: 789815 - protein, 9 aa, Homo Sapiens
CGRGFSQRA

SEQ ID NO: 789816 - protein, 9 aa, Homo Sapiens
RARQPLESD

SEQ ID NO: 789817 - protein, 9 aa, Homo Sapiens
KCNRKISAD

SEQ ID NO: 789818 - protein, 9 aa, Homo Sapiens
MIMMCVAFS

SEQ ID NO: 789819 - protein, 9 aa, Homo Sapiens
RSPSQPRPG

SEQ ID NO: 789820 - protein, 9 aa, Homo Sapiens
EGGQCEAGR

SEQ ID NO: 789821 - protein, 9 aa, Homo Sapiens
DSSENSRVI

SEQ ID NO: 789822 - protein, 9 aa, Homo Sapiens
YLRTAVIVS

SEQ ID NO: 789823 - protein, 9 aa, Homo Sapiens
GFDAARGDT

SEQ ID NO: 789824 - protein, 9 aa, Homo Sapiens
KVRARQPLE

SEQ ID NO: 789825 - protein, 9 aa, Homo Sapiens
GDTLGGCQV

SEQ ID NO: 789826 - protein, 9 aa, Homo Sapiens
SDFQVPQAL

SEQ ID NO: 789827 - protein, 9 aa, Homo Sapiens
VAAAPPARA

SEQ ID NO: 789828 - protein, 9 aa, Homo Sapiens
TAAPPAEKA

SEQ ID NO: 789829 - protein, 9 aa, Homo Sapiens
VEDRGFAYR

SEQ ID NO: 789830 - protein, 9 aa, Homo Sapiens
GQCEAGRYF

SEQ ID NO: 789831 - protein, 9 aa, Homo Sapiens
ERSREDVDK

SEQ ID NO: 789832 - protein, 9 aa, Homo Sapiens
LQFAMLFSK

SEQ ID NO: 789833 - protein, 9 aa, Homo Sapiens
EVLKVDDCD

SEQ ID NO: 789834 - protein, 9 aa, Homo Sapiens
ALLLLLAGA

SEQ ID NO: 789835 - protein, 9 aa, Homo Sapiens
EGCSPRPSR

SEQ ID NO: 789836 - protein, 9 aa, Homo Sapiens
ALAAECSEQ

SEQ ID NO: 789837 - protein, 9 aa, Homo Sapiens
PPGPADPAA

SEQ ID NO: 789838 - protein, 9 aa, Homo Sapiens
MGASPRKRG

SEQ ID NO: 789839 - protein, 9 aa, Homo Sapiens
VCGRGFSQR

SEQ ID NO: 789840 - protein, 9 aa, Homo Sapiens
EGRETLRTI

SEQ ID NO: 789841 - protein, 9 aa, Homo Sapiens
VSINADNAH

SEQ ID NO: 789842 - protein, 9 aa, Homo Sapiens
PVLQFAMLF

SEQ ID NO: 789843 - protein, 9 aa, Homo Sapiens
PEPQSPRDC

SEQ ID NO: 789844 - protein, 9 aa, Homo Sapiens
DDAYTVKKI

SEQ ID NO: 789845 - protein, 9 aa, Homo Sapiens
SMGMIMMCV

SEQ ID NO: 789846 - protein, 9 aa, Homo Sapiens
LPPLPGAAK

SEQ ID NO: 789847 - protein, 9 aa, Homo Sapiens
KEGRETLRT

SEQ ID NO: 789848 - protein, 9 aa, Homo Sapiens
KKMEWDLNE

SEQ ID NO: 789849 - protein, 9 aa, Homo Sapiens
MPRAATTTT

SEQ ID NO: 789850 - protein, 9 aa, Homo Sapiens
DLHEAGVED

SEQ ID NO: 789851 - protein, 9 aa, Homo Sapiens
RTIEEGGAK

SEQ ID NO: 789852 - protein, 9 aa, Homo Sapiens
RLESLGLYR

SEQ ID NO: 789853 - protein, 9 aa, Homo Sapiens
TTAQKSRPR

SEQ ID NO: 789854 - protein, 9 aa, Homo Sapiens
SRPSQGGTS

SEQ ID NO: 789855 - protein, 9 aa, Homo Sapiens
DEVLKVDDC

SEQ ID NO: 789856 - protein, 9 aa, Homo Sapiens
LQRSRPSQG

SEQ ID NO: 789857 - protein, 9 aa, Homo Sapiens
RRAAPTPPR

SEQ ID NO: 789858 - protein, 9 aa, Homo Sapiens
TFPRRAGEC

SEQ ID NO: 789859 - protein, 9 aa, Homo Sapiens
LEDDAYTVK

SEQ ID NO: 789860 - protein, 9 aa, Homo Sapiens
MMRRAGTIR

SEQ ID NO: 789861 - protein, 9 aa, Homo Sapiens
AARLESLGL

SEQ ID NO: 789862 - protein, 9 aa, Homo Sapiens
DAARGDTLG

SEQ ID NO: 789863 - protein, 9 aa, Homo Sapiens
RDCLRKAIS

SEQ ID NO: 789864 - protein, 9 aa, Homo Sapiens
LRPFPSTSR

SEQ ID NO: 789865 - protein, 9 aa, Homo Sapiens
QAVTYAQVK

SEQ ID NO: 789866 - protein, 9 aa, Homo Sapiens
YANQAHLIV

SEQ ID NO: 789867 - protein, 9 aa, Homo Sapiens
QPRPGGPAP

SEQ ID NO: 789868 - protein, 9 aa, Homo Sapiens
GDWNGEPSG

SEQ ID NO: 789869 - protein, 9 aa, Homo Sapiens
TLRYANQAH

SEQ ID NO: 789870 - protein, 9 aa, Homo Sapiens
AEHGGFLAR

SEQ ID NO: 789871 - protein, 9 aa, Homo Sapiens
WNFFERDGQ

SEQ ID NO: 789872 - protein, 9 aa, Homo Sapiens
SQPRTTRRR

SEQ ID NO: 789873 - protein, 9 aa, Homo Sapiens
RYLRTAVIV

SEQ ID NO: 789874 - protein, 9 aa, Homo Sapiens
TRRAPEGCS

SEQ ID NO: 789875 - protein, 9 aa, Homo Sapiens
RWQHGRLAL

SEQ ID NO: 789876 - protein, 9 aa, Homo Sapiens
SGFGEDLDG

SEQ ID NO: 789877 - protein, 9 aa, Homo Sapiens
AVDTVSGMV

SEQ ID NO: 789878 - protein, 9 aa, Homo Sapiens
ADMRPPPPG

SEQ ID NO: 789879 - protein, 9 aa, Homo Sapiens
ECVEETCSF

SEQ ID NO: 789880 - protein, 9 aa, Homo Sapiens
QIWNLNPVF

SEQ ID NO: 789881 - protein, 9 aa, Homo Sapiens
RLFSFTSPA

SEQ ID NO: 789882 - protein, 9 aa, Homo Sapiens
EDDAYTVKK

SEQ ID NO: 789883 - protein, 9 aa, Homo Sapiens
STAGALDKN

SEQ ID NO: 789884 - protein, 9 aa, Homo Sapiens
CEVCGRGFS

SEQ ID NO: 789885 - protein, 9 aa, Homo Sapiens
MEWNRMEWN

SEQ ID NO: 789886 - protein, 9 aa, Homo Sapiens
GMEWNRMEW

SEQ ID NO: 789887 - protein, 9 aa, Homo Sapiens
DMRPPPPGP

SEQ ID NO: 789888 - protein, 9 aa, Homo Sapiens
PSQPRPGGP

SEQ ID NO: 789889 - protein, 9 aa, Homo Sapiens
RRTNHVSRE

SEQ ID NO: 789890 - protein, 9 aa, Homo Sapiens
SWNFFERDG

SEQ ID NO: 789891 - protein, 9 aa, Homo Sapiens
ATTGPSADM

SEQ ID NO: 789892 - protein, 9 aa, Homo Sapiens
PIILQNVIH

SEQ ID NO: 789893 - protein, 9 aa, Homo Sapiens
DEFVCHIIY

SEQ ID NO: 789894 - protein, 9 aa, Homo Sapiens
ECLCRELQR

SEQ ID NO: 789895 - protein, 9 aa, Homo Sapiens
LLPSGPCPP

SEQ ID NO: 789896 - protein, 9 aa, Homo Sapiens
LGFQIKKKN

SEQ ID NO: 789897 - protein, 9 aa, Homo Sapiens
QGLVAAVLE

SEQ ID NO: 789898 - protein, 9 aa, Homo Sapiens
GHIFYPKPV

SEQ ID NO: 789899 - protein, 9 aa, Homo Sapiens
WQHGRLALR

SEQ ID NO: 789900 - protein, 9 aa, Homo Sapiens
PQAQGQVAT

SEQ ID NO: 789901 - protein, 9 aa, Homo Sapiens
YPAGQRRGS

SEQ ID NO: 789902 - protein, 9 aa, Homo Sapiens
ILARSKLEC

SEQ ID NO: 789903 - protein, 9 aa, Homo Sapiens
IWNLNPVFG

SEQ ID NO: 789904 - protein, 9 aa, Homo Sapiens
QKMMRRAGT

SEQ ID NO: 789905 - protein, 9 aa, Homo Sapiens
SLFDIKCNR

SEQ ID NO: 789906 - protein, 9 aa, Homo Sapiens
PLAEGAWLL

SEQ ID NO: 789907 - protein, 9 aa, Homo Sapiens
CNRKISADF

SEQ ID NO: 789908 - protein, 9 aa, Homo Sapiens
FRHSLFFAE

SEQ ID NO: 789909 - protein, 9 aa, Homo Sapiens
PGAAKTPMG

SEQ ID NO: 789910 - protein, 9 aa, Homo Sapiens
AAPSPAPGY

SEQ ID NO: 789911 - protein, 9 aa, Homo Sapiens
RTRMPRAAT

SEQ ID NO: 789912 - protein, 9 aa, Homo Sapiens
LLDAYGEHL

SEQ ID NO: 789913 - protein, 9 aa, Homo Sapiens
RHSLFFAEQ

SEQ ID NO: 789914 - protein, 9 aa, Homo Sapiens
SGMVGTYRT

SEQ ID NO: 789915 - protein, 9 aa, Homo Sapiens
SINADNAHL

SEQ ID NO: 789916 - protein, 9 aa, Homo Sapiens
FPHHERCSD

SEQ ID NO: 789917 - protein, 9 aa, Homo Sapiens
TAGALDKNE

SEQ ID NO: 789918 - protein, 9 aa, Homo Sapiens
LPSGPCPPS

SEQ ID NO: 789919 - protein, 9 aa, Homo Sapiens
AATTTTAQK

SEQ ID NO: 789920 - protein, 9 aa, Homo Sapiens
IRLKKKMEW

SEQ ID NO: 789921 - protein, 9 aa, Homo Sapiens
RDLSSVPPE

SEQ ID NO: 789922 - protein, 9 aa, Homo Sapiens
GFGEDLDGY

SEQ ID NO: 789923 - protein, 9 aa, Homo Sapiens
GEHLAAALC

SEQ ID NO: 789924 - protein, 9 aa, Homo Sapiens
FFRYLRTAV

SEQ ID NO: 789925 - protein, 9 aa, Homo Sapiens
QFAMLFSKG

SEQ ID NO: 789926 - protein, 9 aa, Homo Sapiens
VYQPDGSVY

SEQ ID NO: 789927 - protein, 9 aa, Homo Sapiens
PSPSSRSQP

SEQ ID NO: 789928 - protein, 9 aa, Homo Sapiens
LPSRLPLAE

SEQ ID NO: 789929 - protein, 9 aa, Homo Sapiens
SENSRVIYS

SEQ ID NO: 789930 - protein, 9 aa, Homo Sapiens
GLAATPMTP

SEQ ID NO: 789931 - protein, 9 aa, Homo Sapiens
PRPGGPAPR

SEQ ID NO: 789932 - protein, 9 aa, Homo Sapiens
PSQGGTSAW

SEQ ID NO: 789933 - protein, 9 aa, Homo Sapiens
DLSSVPPEL

SEQ ID NO: 789934 - protein, 9 aa, Homo Sapiens
LSSVPPELT

SEQ ID NO: 789935 - protein, 9 aa, Homo Sapiens
SPRPSRTRT

SEQ ID NO: 789936 - protein, 9 aa, Homo Sapiens
CLCRELQRH

SEQ ID NO: 789937 - protein, 9 aa, Homo Sapiens
TFCLPLCQS

SEQ ID NO: 789938 - protein, 9 aa, Homo Sapiens
CLPLCQSGP

SEQ ID NO: 789939 - protein, 9 aa, Homo Sapiens
IVCRGQSFY

SEQ ID NO: 789940 - protein, 9 aa, Homo Sapiens
LIVCRGQSF

SEQ ID NO: 789941 - protein, 9 aa, Homo Sapiens
CGPPRTPRA

SEQ ID NO: 789942 - protein, 9 aa, Homo Sapiens
MSLSMGMIM

SEQ ID NO: 789943 - protein, 9 aa, Homo Sapiens
DWNGEPSGE

SEQ ID NO: 789944 - protein, 9 aa, Homo Sapiens
PSDFQVPQA

SEQ ID NO: 789945 - protein, 9 aa, Homo Sapiens
VSGMVGTYR

SEQ ID NO: 789946 - protein, 9 aa, Homo Sapiens
ATTTTAQKS

SEQ ID NO: 789947 - protein, 9 aa, Homo Sapiens
GPPMVCFLC

SEQ ID NO: 789948 - protein, 9 aa, Homo Sapiens
NNKLIVCRG

SEQ ID NO: 789949 - protein, 9 aa, Homo Sapiens
AKTPMGASP

SEQ ID NO: 789950 - protein, 9 aa, Homo Sapiens
RAPRRQLRP

SEQ ID NO: 789951 - protein, 9 aa, Homo Sapiens
ACEGGQCEA

SEQ ID NO: 789952 - protein, 9 aa, Homo Sapiens
PRTPRAPRR

SEQ ID NO: 789953 - protein, 9 aa, Homo Sapiens
HMTEVVRRF

SEQ ID NO: 789954 - protein, 9 aa, Homo Sapiens
VAAVLEKLE

SEQ ID NO: 789955 - protein, 9 aa, Homo Sapiens
EEIGSWNFF

SEQ ID NO: 789956 - protein, 9 aa, Homo Sapiens
SHGRRGHQT

SEQ ID NO: 789957 - protein, 9 aa, Homo Sapiens
GFLARKMSL

SEQ ID NO: 789958 - protein, 9 aa, Homo Sapiens
KMEWDLNEI

SEQ ID NO: 789959 - protein, 9 aa, Homo Sapiens
VLDLHEAGV

SEQ ID NO: 789960 - protein, 9 aa, Homo Sapiens
TTGPSADMR

SEQ ID NO: 789961 - protein, 9 aa, Homo Sapiens
PLPPLPGAA

SEQ ID NO: 789962 - protein, 9 aa, Homo Sapiens
QRSRPSQGG

SEQ ID NO: 789963 - protein, 9 aa, Homo Sapiens
LLQRSRPSQ

SEQ ID NO: 789964 - protein, 9 aa, Homo Sapiens
CGHIFYPKP

SEQ ID NO: 789965 - protein, 9 aa, Homo Sapiens
KKTFCLPLC

SEQ ID NO: 789966 - protein, 9 aa, Homo Sapiens
LPLAEGAWL

SEQ ID NO: 789967 - protein, 9 aa, Homo Sapiens
RDFLKAGKK

SEQ ID NO: 789968 - protein, 9 aa, Homo Sapiens
VVVAVITAS

SEQ ID NO: 789969 - protein, 9 aa, Homo Sapiens
PSPAPGYPA

SEQ ID NO: 789970 - protein, 9 aa, Homo Sapiens
QRRGSRSLL

SEQ ID NO: 789971 - protein, 9 aa, Homo Sapiens
QGKGLSYLS

SEQ ID NO: 789972 - protein, 9 aa, Homo Sapiens
GRGFSQRAY

SEQ ID NO: 789973 - protein, 9 aa, Homo Sapiens
KNTISHFLY

SEQ ID NO: 789974 - protein, 9 aa, Homo Sapiens
CEGGQCEAG

SEQ ID NO: 789975 - protein, 9 aa, Homo Sapiens
PADPAAPSP

SEQ ID NO: 789976 - protein, 9 aa, Homo Sapiens
PLCQSGPLP

SEQ ID NO: 789977 - protein, 9 aa, Homo Sapiens
PGPADPAAP

SEQ ID NO: 789978 - protein, 9 aa, Homo Sapiens
NKLIVCRGQ

SEQ ID NO: 789979 - protein, 9 aa, Homo Sapiens
SHFLYTLLL

SEQ ID NO: 789980 - protein, 9 aa, Homo Sapiens
VDTVSGMVG

SEQ ID NO: 789981 - protein, 9 aa, Homo Sapiens
HTQACEGGQ

SEQ ID NO: 789982 - protein, 9 aa, Homo Sapiens
PRAATTTTA

SEQ ID NO: 789983 - protein, 9 aa, Homo Sapiens
PRKRGSLPS

SEQ ID NO: 789984 - protein, 9 aa, Homo Sapiens
RRQLRPFPS

SEQ ID NO: 789985 - protein, 9 aa, Homo Sapiens
RNLLRQTLE

SEQ ID NO: 789986 - protein, 9 aa, Homo Sapiens
HGENLPSDF

SEQ ID NO: 789987 - protein, 9 aa, Homo Sapiens
DRFHTFPRR

SEQ ID NO: 789988 - protein, 9 aa, Homo Sapiens
RPFPSTSRW

SEQ ID NO: 789989 - protein, 9 aa, Homo Sapiens
ICEVCGRGF

SEQ ID NO: 789990 - protein, 9 aa, Homo Sapiens
NGLAATPMT

SEQ ID NO: 789991 - protein, 9 aa, Homo Sapiens
GENLPSDFQ

SEQ ID NO: 789992 - protein, 9 aa, Homo Sapiens
TAWILINPM

SEQ ID NO: 789993 - protein, 9 aa, Homo Sapiens
KFFHKVRAR

SEQ ID NO: 789994 - protein, 9 aa, Homo Sapiens
SASQIWNLN

SEQ ID NO: 789995 - protein, 9 aa, Homo Sapiens
ADNAHLFAL

SEQ ID NO: 789996 - protein, 9 aa, Homo Sapiens
RNCGHIFYP

SEQ ID NO: 789997 - protein, 9 aa, Homo Sapiens
PDSSENSRV

SEQ ID NO: 789998 - protein, 9 aa, Homo Sapiens
GPSADMRPP

SEQ ID NO: 789999 - protein, 9 aa, Homo Sapiens
FLARKMSLG

SEQ ID NO: 790000 - protein, 9 aa, Homo Sapiens
SIHYDLVFL

SEQ ID NO: 790001 - protein, 9 aa, Homo Sapiens
KTFCLPLCQ

SEQ ID NO: 790002 - protein, 9 aa, Homo Sapiens
VCHIIYVFY

SEQ ID NO: 790003 - protein, 9 aa, Homo Sapiens
SPGDWNGEP

SEQ ID NO: 790004 - protein, 9 aa, Homo Sapiens
VDKRNKALE

SEQ ID NO: 790005 - protein, 9 aa, Homo Sapiens
NEGEQAKAL

SEQ ID NO: 790006 - protein, 9 aa, Homo Sapiens
PPRRTNHVS

SEQ ID NO: 790007 - protein, 9 aa, Homo Sapiens
QVKHSRPRR

SEQ ID NO: 790008 - protein, 9 aa, Homo Sapiens
MVCFLCASK

SEQ ID NO: 790009 - protein, 9 aa, Homo Sapiens
LPALLLLLA

SEQ ID NO: 790010 - protein, 9 aa, Homo Sapiens
SLPQAQGQV

SEQ ID NO: 790011 - protein, 9 aa, Homo Sapiens
LKKKMEWDL

SEQ ID NO: 790012 - protein, 9 aa, Homo Sapiens
HCLAPARGL

SEQ ID NO: 790013 - protein, 9 aa, Homo Sapiens
WNGMEWNRM

SEQ ID NO: 790014 - protein, 9 aa, Homo Sapiens
GPAPRRRAA

SEQ ID NO: 790015 - protein, 9 aa, Homo Sapiens
LPSDFQVPQ

SEQ ID NO: 790016 - protein, 9 aa, Homo Sapiens
TLSLFDIKC

SEQ ID NO: 790017 - protein, 9 aa, Homo Sapiens
HLYAGAEVI

SEQ ID NO: 790018 - protein, 9 aa, Homo Sapiens
KNEGEQAKA

SEQ ID NO: 790019 - protein, 9 aa, Homo Sapiens
PPVRDLSSV

SEQ ID NO: 790020 - protein, 9 aa, Homo Sapiens
HTFPRRAGE

SEQ ID NO: 790021 - protein, 9 aa, Homo Sapiens
ASKFRVGSR

SEQ ID NO: 790022 - protein, 9 aa, Homo Sapiens
YGSHGRRGH

SEQ ID NO: 790023 - protein, 9 aa, Homo Sapiens
RLPLAEGAW

SEQ ID NO: 790024 - protein, 9 aa, Homo Sapiens
TTTTAQKSR

SEQ ID NO: 790025 - protein, 9 aa, Homo Sapiens
CKNTISHFL

SEQ ID NO: 790026 - protein, 9 aa, Homo Sapiens
AARGDTLGG

SEQ ID NO: 790027 - protein, 9 aa, Homo Sapiens
VDIPVLQFA

SEQ ID NO: 790028 - protein, 9 aa, Homo Sapiens
SRPRMCGPP

SEQ ID NO: 790029 - protein, 9 aa, Homo Sapiens
VLEKLEKGP

SEQ ID NO: 790030 - protein, 9 aa, Homo Sapiens
VLKVDDCDC

SEQ ID NO: 790031 - protein, 9 aa, Homo Sapiens
TPLNSAKPG

SEQ ID NO: 790032 - protein, 9 aa, Homo Sapiens
KWNGMEWNR

SEQ ID NO: 790033 - protein, 9 aa, Homo Sapiens
AHLIVNIAK

SEQ ID NO: 790034 - protein, 9 aa, Homo Sapiens
PRTLTRRAP

SEQ ID NO: 790035 - protein, 9 aa, Homo Sapiens
GVEDFAMDE

SEQ ID NO: 790036 - protein, 9 aa, Homo Sapiens
YPLVRHCLA

SEQ ID NO: 790037 - protein, 9 aa, Homo Sapiens
ETLRTIEEG

SEQ ID NO: 790038 - protein, 9 aa, Homo Sapiens
PPRTLTRRA

SEQ ID NO: 790039 - protein, 9 aa, Homo Sapiens
TVLLDAYGE

SEQ ID NO: 790040 - protein, 9 aa, Homo Sapiens
RSREDVDKR

SEQ ID NO: 790041 - protein, 9 aa, Homo Sapiens
QLFMDHLYA

SEQ ID NO: 790042 - protein, 9 aa, Homo Sapiens
PGGPPMVCF

SEQ ID NO: 790043 - protein, 9 aa, Homo Sapiens
AMLFSKGSQ

SEQ ID NO: 790044 - protein, 9 aa, Homo Sapiens
QVATTGPSA

SEQ ID NO: 790045 - protein, 9 aa, Homo Sapiens
PPARAAAST

SEQ ID NO: 790046 - protein, 9 aa, Homo Sapiens
CKSIHYDLV

SEQ ID NO: 790047 - protein, 9 aa, Homo Sapiens
LVAAVLEKL

SEQ ID NO: 790048 - protein, 9 aa, Homo Sapiens
GRETLRTIE

SEQ ID NO: 790049 - protein, 9 aa, Homo Sapiens
RGSLPSRLP

SEQ ID NO: 790050 - protein, 9 aa, Homo Sapiens
ESLGLYRDR

SEQ ID NO: 790051 - protein, 9 aa, Homo Sapiens
CPPSPSSRS

SEQ ID NO: 790052 - protein, 9 aa, Homo Sapiens
HFLYTLLLP

SEQ ID NO: 790053 - protein, 9 aa, Homo Sapiens
PAAPTAAPP

SEQ ID NO: 790054 - protein, 9 aa, Homo Sapiens
RPRMCGPPR

SEQ ID NO: 790055 - protein, 9 aa, Homo Sapiens
DSRFFRYLR

SEQ ID NO: 790056 - protein, 9 aa, Homo Sapiens
AAEAALSQT

SEQ ID NO: 790057 - protein, 9 aa, Homo Sapiens
TRTRMPRAA

SEQ ID NO: 790058 - protein, 9 aa, Homo Sapiens
GARWQHGRL

SEQ ID NO: 790059 - protein, 9 aa, Homo Sapiens
AYDPDSSEN

SEQ ID NO: 790060 - protein, 9 aa, Homo Sapiens
GPPRTPRAP

SEQ ID NO: 790061 - protein, 9 aa, Homo Sapiens
SFVFQRWYQ

SEQ ID NO: 790062 - protein, 9 aa, Homo Sapiens
PTAAPPAEK

SEQ ID NO: 790063 - protein, 9 aa, Homo Sapiens
HGRRGHQTY

SEQ ID NO: 790064 - protein, 9 aa, Homo Sapiens
ASGFGEDLD

SEQ ID NO: 790065 - protein, 9 aa, Homo Sapiens
DEEPPRRTN

SEQ ID NO: 790066 - protein, 9 aa, Homo Sapiens
HEAGVEDFA

SEQ ID NO: 790067 - protein, 9 aa, Homo Sapiens
DCLRKAISK

SEQ ID NO: 790068 - protein, 9 aa, Homo Sapiens
GRRGHQTYT

SEQ ID NO: 790069 - protein, 9 aa, Homo Sapiens
AAKTPMGAS

SEQ ID NO: 790070 - protein, 9 aa, Homo Sapiens
LHEAGVEDF

SEQ ID NO: 790071 - protein, 9 aa, Homo Sapiens
SREDVDKRN

SEQ ID NO: 790072 - protein, 9 aa, Homo Sapiens
ALSPDPIIL

SEQ ID NO: 790073 - protein, 9 aa, Homo Sapiens
MLAASTPSP

SEQ ID NO: 790074 - protein, 9 aa, Homo Sapiens
VLQFAMLFS

SEQ ID NO: 790075 - protein, 9 aa, Homo Sapiens
AEAALSQTG

SEQ ID NO: 790076 - protein, 9 aa, Homo Sapiens
SQIWNLNPV

SEQ ID NO: 790077 - protein, 9 aa, Homo Sapiens
QPDGSVYIV

SEQ ID NO: 790078 - protein, 9 aa, Homo Sapiens
WNLNPVFGG

SEQ ID NO: 790079 - protein, 9 aa, Homo Sapiens
FLYTLLLPL

SEQ ID NO: 790080 - protein, 9 aa, Homo Sapiens
RMPRAATTT

SEQ ID NO: 790081 - protein, 9 aa, Homo Sapiens
LNMNGLAAT

SEQ ID NO: 790082 - protein, 9 aa, Homo Sapiens
GMVGTYRTL

SEQ ID NO: 790083 - protein, 9 aa, Homo Sapiens
GSQYQPCKR

SEQ ID NO: 790084 - protein, 9 aa, Homo Sapiens
LAATPMTPT

SEQ ID NO: 790085 - protein, 9 aa, Homo Sapiens
ARWQHGRLA

SEQ ID NO: 790086 - protein, 9 aa, Homo Sapiens
RTAVIVSGT

SEQ ID NO: 790087 - protein, 9 aa, Homo Sapiens
AGVEDFAMD

SEQ ID NO: 790088 - protein, 9 aa, Homo Sapiens
IYKASKFRV

SEQ ID NO: 790089 - protein, 9 aa, Homo Sapiens
APAAPTAAP

SEQ ID NO: 790090 - protein, 9 aa, Homo Sapiens
RPSQGGTSA

SEQ ID NO: 790091 - protein, 9 aa, Homo Sapiens
RAGECGGKN

SEQ ID NO: 790092 - protein, 9 aa, Homo Sapiens
ECLLRQKMM

SEQ ID NO: 790093 - protein, 9 aa, Homo Sapiens
QSGPLPPLP

SEQ ID NO: 790094 - protein, 9 aa, Homo Sapiens
RSLLPSGPC

SEQ ID NO: 790095 - protein, 9 aa, Homo Sapiens
FRYLRTAVI

SEQ ID NO: 790096 - protein, 9 aa, Homo Sapiens
RTPRAPRRQ

SEQ ID NO: 790097 - protein, 9 aa, Homo Sapiens
PRRRAAPTP

SEQ ID NO: 790098 - protein, 9 aa, Homo Sapiens
APSPAPGYP

SEQ ID NO: 790099 - protein, 9 aa, Homo Sapiens
SMLAASTPS

SEQ ID NO: 790100 - protein, 9 aa, Homo Sapiens
SRLSASQIW

SEQ ID NO: 790101 - protein, 9 aa, Homo Sapiens
LDAYGEHLA

SEQ ID NO: 790102 - protein, 9 aa, Homo Sapiens
SRTRTRMPR

SEQ ID NO: 790103 - protein, 9 aa, Homo Sapiens
PTPPRTLTR

SEQ ID NO: 790104 - protein, 9 aa, Homo Sapiens
PAPRRRAAP

SEQ ID NO: 790105 - protein, 9 aa, Homo Sapiens
HKVRARQPL

SEQ ID NO: 790106 - protein, 9 aa, Homo Sapiens
APGYPAGQR

SEQ ID NO: 790107 - protein, 9 aa, Homo Sapiens
NGMEWNRME

SEQ ID NO: 790108 - protein, 9 aa, Homo Sapiens
PPRTPRAPR

SEQ ID NO: 790109 - protein, 9 aa, Homo Sapiens
SPAPGYPAG

SEQ ID NO: 790110 - protein, 9 aa, Homo Sapiens
PARAAASTV

SEQ ID NO: 790111 - protein, 9 aa, Homo Sapiens
PMNVEDRGF

SEQ ID NO: 790112 - protein, 9 aa, Homo Sapiens
CRGQSFYVQ

SEQ ID NO: 790113 - protein, 9 aa, Homo Sapiens
SPRDCLRKA

SEQ ID NO: 790114 - protein, 9 aa, Homo Sapiens
GCSPRPSRT

SEQ ID NO: 790115 - protein, 9 aa, Homo Sapiens
RRRAAPTPP

SEQ ID NO: 790116 - protein, 9 aa, Homo Sapiens
VEDFAMDED

SEQ ID NO: 790117 - protein, 9 aa, Homo Sapiens
DAYTVKKII

SEQ ID NO: 790118 - protein, 9 aa, Homo Sapiens
FMDHLYAGA

SEQ ID NO: 790119 - protein, 9 aa, Homo Sapiens
ILNLQGKGL

SEQ ID NO: 790120 - protein, 9 aa, Homo Sapiens
PRPSRTRTR

SEQ ID NO: 790121 - protein, 9 aa, Homo Sapiens
EDDEFVCHI

SEQ ID NO: 790122 - protein, 9 aa, Homo Sapiens
MSFVFQRWY

SEQ ID NO: 790123 - protein, 9 aa, Homo Sapiens
PCPPSPSSR

SEQ ID NO: 790124 - protein, 9 aa, Homo Sapiens
SPRKRGSLP

SEQ ID NO: 790125 - protein, 9 aa, Homo Sapiens
RTRTRMPRA

SEQ ID NO: 790126 - protein, 9 aa, Homo Sapiens
LRKAARLES

SEQ ID NO: 790127 - protein, 9 aa, Homo Sapiens
GGPPMVCFL

SEQ ID NO: 790128 - protein, 9 aa, Homo Sapiens
VIAYDPDSS

SEQ ID NO: 790129 - protein, 9 aa, Homo Sapiens
CSPRPSRTR

SEQ ID NO: 790130 - protein, 9 aa, Homo Sapiens
ILQNVIHFI

SEQ ID NO: 790131 - protein, 9 aa, Homo Sapiens
YICEVCGRG

SEQ ID NO: 790132 - protein, 9 aa, Homo Sapiens
WDLNEIEIQ

SEQ ID NO: 790133 - protein, 9 aa, Homo Sapiens
CLLRQKMMR

SEQ ID NO: 790134 - protein, 9 aa, Homo Sapiens
HIFYPKPVR

SEQ ID NO: 790135 - protein, 9 aa, Homo Sapiens
RRGSRSLLP

SEQ ID NO: 790136 - protein, 9 aa, Homo Sapiens
FLEDDAYTV

SEQ ID NO: 790137 - protein, 9 aa, Homo Sapiens
TPMGASPRK

SEQ ID NO: 790138 - protein, 9 aa, Homo Sapiens
KTPMGASPR

SEQ ID NO: 790139 - protein, 9 aa, Homo Sapiens
QEEEEEVEE

SEQ ID NO: 790140 - protein, 9 aa, Homo Sapiens
EDEEPPRRT

SEQ ID NO: 790141 - protein, 9 aa, Homo Sapiens
TCSFEEAFE

SEQ ID NO: 790142 - protein, 9 aa, Homo Sapiens
GGPAPRRRA

SEQ ID NO: 790143 - protein, 9 aa, Homo Sapiens
FAMLFSKGS

SEQ ID NO: 790144 - protein, 9 aa, Homo Sapiens
RRFPHHERC

SEQ ID NO: 790145 - protein, 9 aa, Homo Sapiens
QAQGQVATT

SEQ ID NO: 790146 - protein, 9 aa, Homo Sapiens
SRLPLAEGA

SEQ ID NO: 790147 - protein, 9 aa, Homo Sapiens
EHGGFLARK

SEQ ID NO: 790148 - protein, 9 aa, Homo Sapiens
LSASQIWNL

SEQ ID NO: 790149 - protein, 9 aa, Homo Sapiens
TVKKIIDER

SEQ ID NO: 790150 - protein, 9 aa, Homo Sapiens
APRRQLRPF

SEQ ID NO: 790151 - protein, 9 aa, Homo Sapiens
DIPVLQFAM

SEQ ID NO: 790152 - protein, 9 aa, Homo Sapiens
VYPLVRHCL

SEQ ID NO: 790153 - protein, 9 aa, Homo Sapiens
QPMNVEDRG

SEQ ID NO: 790154 - protein, 9 aa, Homo Sapiens
QRQGLVAAV

SEQ ID NO: 790155 - protein, 9 aa, Homo Sapiens
KAGKKTFCL

SEQ ID NO: 790156 - protein, 9 aa, Homo Sapiens
PGDWNGEPS

SEQ ID NO: 790157 - protein, 9 aa, Homo Sapiens
RGDTLGGCQ

SEQ ID NO: 790158 - protein, 9 aa, Homo Sapiens
TQACEGGQC

SEQ ID NO: 790159 - protein, 9 aa, Homo Sapiens
LVSINADNA

SEQ ID NO: 790160 - protein, 9 aa, Homo Sapiens
RTFLHCWEY

SEQ ID NO: 790161 - protein, 9 aa, Homo Sapiens
NSHEPLCSM

SEQ ID NO: 790162 - protein, 9 aa, Homo Sapiens
EPQSPRDCL

SEQ ID NO: 790163 - protein, 9 aa, Homo Sapiens
SPDPIILQN

SEQ ID NO: 790164 - protein, 9 aa, Homo Sapiens
LTRRAPEGC

SEQ ID NO: 790165 - protein, 9 aa, Homo Sapiens
PLNSAKPGS

SEQ ID NO: 790166 - protein, 9 aa, Homo Sapiens
SPSSRSQPR

SEQ ID NO: 790167 - protein, 9 aa, Homo Sapiens
ENLPSDFQV

SEQ ID NO: 790168 - protein, 9 aa, Homo Sapiens
QEDDEFVCH

SEQ ID NO: 790169 - protein, 9 aa, Homo Sapiens
CLRKAISKM

SEQ ID NO: 790170 - protein, 9 aa, Homo Sapiens
LNLQGKGLS

SEQ ID NO: 790171 - protein, 9 aa, Homo Sapiens
PLCSMLAAS

SEQ ID NO: 790172 - protein, 9 aa, Homo Sapiens
KKKMEWDLN

SEQ ID NO: 790173 - protein, 9 aa, Homo Sapiens
SLLPSGPCP

SEQ ID NO: 790174 - protein, 9 aa, Homo Sapiens
KAARLESLG

SEQ ID NO: 790175 - protein, 9 aa, Homo Sapiens
QKSRPRMCG

SEQ ID NO: 790176 - protein, 9 aa, Homo Sapiens
ALMSLSMGM

SEQ ID NO: 790177 - protein, 9 aa, Homo Sapiens
SSRSQPRTT

SEQ ID NO: 790178 - protein, 9 aa, Homo Sapiens
ARQPLESDS

SEQ ID NO: 790179 - protein, 9 aa, Homo Sapiens
GHQTYTRYQ

SEQ ID NO: 790180 - protein, 9 aa, Homo Sapiens
SKLECLCRE

SEQ ID NO: 790181 - protein, 9 aa, Homo Sapiens
ASPRKRGSL

SEQ ID NO: 790182 - protein, 9 aa, Homo Sapiens
KLECLCREL

SEQ ID NO: 790183 - protein, 9 aa, Homo Sapiens
NLPSDFQVP

SEQ ID NO: 790184 - protein, 9 aa, Homo Sapiens
TAQKSRPRM

SEQ ID NO: 790185 - protein, 9 aa, Homo Sapiens
VKKIIDERS

SEQ ID NO: 790186 - protein, 9 aa, Homo Sapiens
FCLPLCQSG

SEQ ID NO: 790187 - protein, 9 aa, Homo Sapiens
GCKSIHYDL

SEQ ID NO: 790188 - protein, 9 aa, Homo Sapiens
PPMVCFLCA

SEQ ID NO: 790189 - protein, 9 aa, Homo Sapiens
SVYIVESLS

SEQ ID NO: 790190 - protein, 9 aa, Homo Sapiens
RLSASQIWN

SEQ ID NO: 790191 - protein, 9 aa, Homo Sapiens
NNILNLQGK

SEQ ID NO: 790192 - protein, 9 aa, Homo Sapiens
RPHGENLPS

SEQ ID NO: 790193 - protein, 9 aa, Homo Sapiens
RLKKKMEWD

SEQ ID NO: 790194 - protein, 9 aa, Homo Sapiens
FPRRAGECG

SEQ ID NO: 790195 - protein, 9 aa, Homo Sapiens
LCSMLAAST

SEQ ID NO: 790196 - protein, 9 aa, Homo Sapiens
DAYGEHLAA

SEQ ID NO: 790197 - protein, 9 aa, Homo Sapiens
MVGTYRTLD

SEQ ID NO: 790198 - protein, 9 aa, Homo Sapiens
RTLTRRAPE

SEQ ID NO: 790199 - protein, 9 aa, Homo Sapiens
YGEHLAAAL

SEQ ID NO: 790200 - protein, 9 aa, Homo Sapiens
SQGGTSAWG

SEQ ID NO: 790201 - protein, 9 aa, Homo Sapiens
FGEDLDGYC

SEQ ID NO: 790202 - protein, 9 aa, Homo Sapiens
EYRNLLRQT

SEQ ID NO: 790203 - protein, 9 aa, Homo Sapiens
YRNLLRQTL

SEQ ID NO: 790204 - protein, 9 aa, Homo Sapiens
RRGHQTYTR

SEQ ID NO: 790205 - protein, 9 aa, Homo Sapiens
DPIILQNVI

SEQ ID NO: 790206 - protein, 9 aa, Homo Sapiens
EKLKTPLNS

SEQ ID NO: 790207 - protein, 9 aa, Homo Sapiens
FPSTSRWSL

SEQ ID NO: 790208 - protein, 9 aa, Homo Sapiens
HGGFLARKM

SEQ ID NO: 790209 - protein, 9 aa, Homo Sapiens
LASGFGEDL

SEQ ID NO: 790210 - protein, 9 aa, Homo Sapiens
LFMDHLYAG

SEQ ID NO: 790211 - protein, 9 aa, Homo Sapiens
KMMRRAGTI

SEQ ID NO: 790212 - protein, 9 aa, Homo Sapiens
EEPPRRTNH

SEQ ID NO: 790213 - protein, 9 aa, Homo Sapiens
LLSPGDWNG

SEQ ID NO: 790214 - protein, 9 aa, Homo Sapiens
TRLFSFTSP

SEQ ID NO: 790215 - protein, 9 aa, Homo Sapiens
GSLPSRLPL

SEQ ID NO: 790216 - protein, 9 aa, Homo Sapiens
EDLDGYCDT

SEQ ID NO: 790217 - protein, 9 aa, Homo Sapiens
KRGSLPSRL

SEQ ID NO: 790218 - protein, 9 aa, Homo Sapiens
DHLYAGAEV

SEQ ID NO: 790219 - protein, 9 aa, Homo Sapiens
AAPPARAAA

SEQ ID NO: 790220 - protein, 9 aa, Homo Sapiens
FLCASKGLH

SEQ ID NO: 790221 - protein, 9 aa, Homo Sapiens
EGTAFRHSL

SEQ ID NO: 790222 - protein, 9 aa, Homo Sapiens
NLKVADEVL

SEQ ID NO: 790223 - protein, 9 aa, Homo Sapiens
NSAKPGSSW

SEQ ID NO: 790224 - protein, 9 aa, Homo Sapiens
ARSKLECLC

SEQ ID NO: 790225 - protein, 9 aa, Homo Sapiens
LVEKEREYR

SEQ ID NO: 790226 - protein, 9 aa, Homo Sapiens
RGSRSLLPS

SEQ ID NO: 790227 - protein, 9 aa, Homo Sapiens
EVVRRFPHH

SEQ ID NO: 790228 - protein, 9 aa, Homo Sapiens
LVRHCLAPA

SEQ ID NO: 790229 - protein, 9 aa, Homo Sapiens
VATTGPSAD

SEQ ID NO: 790230 - protein, 9 aa, Homo Sapiens
MRPPPPGPA

SEQ ID NO: 790231 - protein, 9 aa, Homo Sapiens
NCGHIFYPK

SEQ ID NO: 790232 - protein, 9 aa, Homo Sapiens
TYAQVKHSR

SEQ ID NO: 790233 - protein, 9 aa, Homo Sapiens
SGPCPPSPS

SEQ ID NO: 790234 - protein, 9 aa, Homo Sapiens
YAGAEVILL

SEQ ID NO: 790235 - protein, 9 aa, Homo Sapiens
PSADMRPPP

SEQ ID NO: 790236 - protein, 9 aa, Homo Sapiens
GAPPVRDLS

SEQ ID NO: 790237 - protein, 9 aa, Homo Sapiens
GSHGRRGHQ

SEQ ID NO: 790238 - protein, 9 aa, Homo Sapiens
NILNLQGKG

SEQ ID NO: 790239 - protein, 9 aa, Homo Sapiens
GTVVVAVIT

SEQ ID NO: 790240 - protein, 9 aa, Homo Sapiens
LKVADEVLK

SEQ ID NO: 790241 - protein, 9 aa, Homo Sapiens
FFHKVRARQ

SEQ ID NO: 790242 - protein, 9 aa, Homo Sapiens
ECSEQLGQL

SEQ ID NO: 790243 - protein, 9 aa, Homo Sapiens
PRGARRWEE

SEQ ID NO: 790244 - protein, 9 aa, Homo Sapiens
DNAHLFALR

SEQ ID NO: 790245 - protein, 9 aa, Homo Sapiens
TNHVSREDE

SEQ ID NO: 790246 - protein, 9 aa, Homo Sapiens
KNNILNLQG

SEQ ID NO: 790247 - protein, 9 aa, Homo Sapiens
IHYDLVFLL

SEQ ID NO: 790248 - protein, 9 aa, Homo Sapiens
TVSGMVGTY

SEQ ID NO: 790249 - protein, 9 aa, Homo Sapiens
RAAPTPPRT

SEQ ID NO: 790250 - protein, 9 aa, Homo Sapiens
RTVLLDAYG

SEQ ID NO: 790251 - protein, 9 aa, Homo Sapiens
IAYDPDSSE

SEQ ID NO: 790252 - protein, 9 aa, Homo Sapiens
AGCKSIHYD

SEQ ID NO: 790253 - protein, 9 aa, Homo Sapiens
AQRAGCKSI

SEQ ID NO: 790254 - protein, 9 aa, Homo Sapiens
DGSVYIVES

SEQ ID NO: 790255 - protein, 9 aa, Homo Sapiens
GKKTFCLPL

SEQ ID NO: 790256 - protein, 9 aa, Homo Sapiens
RAAAEAALS

SEQ ID NO: 790257 - protein, 9 aa, Homo Sapiens
RPSRTRTRM

SEQ ID NO: 790258 - protein, 9 aa, Homo Sapiens
MLFSKGSQY

SEQ ID NO: 790259 - protein, 9 aa, Homo Sapiens
TVVVAVITA

SEQ ID NO: 790260 - protein, 9 aa, Homo Sapiens
QSPRDCLRK

SEQ ID NO: 790261 - protein, 9 aa, Homo Sapiens
SQPRPGGPA

SEQ ID NO: 790262 - protein, 9 aa, Homo Sapiens
RMCGPPRTP

SEQ ID NO: 790263 - protein, 9 aa, Homo Sapiens
YLRVASRPM

SEQ ID NO: 790264 - protein, 9 aa, Homo Sapiens
CQSGPLPPL

SEQ ID NO: 790265 - protein, 9 aa, Homo Sapiens
YQPCKRTFL

SEQ ID NO: 790266 - protein, 9 aa, Homo Sapiens
MCGPPRTPR

SEQ ID NO: 790267 - protein, 9 aa, Homo Sapiens
SRWSLPQAQ

SEQ ID NO: 790268 - protein, 9 aa, Homo Sapiens
LRTAVIVSG

SEQ ID NO: 790269 - protein, 9 aa, Homo Sapiens
ARAAASTVD

SEQ ID NO: 790270 - protein, 9 aa, Homo Sapiens
LQGKGLSYL

SEQ ID NO: 790271 - protein, 9 aa, Homo Sapiens
LLRQKMMRR

SEQ ID NO: 790272 - protein, 9 aa, Homo Sapiens
LMSLSMGMI

SEQ ID NO: 790273 - protein, 9 aa, Homo Sapiens
RPPPPGPAD

SEQ ID NO: 790274 - protein, 9 aa, Homo Sapiens
RAAASTVDT

SEQ ID NO: 790275 - protein, 9 aa, Homo Sapiens
PRAPRRQLR

SEQ ID NO: 790276 - protein, 9 aa, Homo Sapiens
KLIVCRGQS

SEQ ID NO: 790277 - protein, 9 aa, Homo Sapiens
QGQVATTGP

SEQ ID NO: 790278 - protein, 9 aa, Homo Sapiens
DPAAPSPAP

SEQ ID NO: 790279 - protein, 9 aa, Homo Sapiens
YENNKLIVC

SEQ ID NO: 790280 - protein, 9 aa, Homo Sapiens
EIGSWNFFE

SEQ ID NO: 790281 - protein, 9 aa, Homo Sapiens
KVYPLVRHC

SEQ ID NO: 790282 - protein, 9 aa, Homo Sapiens
HKVYPLVRH

SEQ ID NO: 790283 - protein, 9 aa, Homo Sapiens
PVRDLSSVP

SEQ ID NO: 790284 - protein, 9 aa, Homo Sapiens
TPRAPRRQL

SEQ ID NO: 790285 - protein, 9 aa, Homo Sapiens
APTAAPPAE

SEQ ID NO: 790286 - protein, 9 aa, Homo Sapiens
GRSPSQPRP

SEQ ID NO: 790287 - protein, 9 aa, Homo Sapiens
RAATTTTAQ

SEQ ID NO: 790288 - protein, 9 aa, Homo Sapiens
EPRGARRWE

SEQ ID NO: 790289 - protein, 9 aa, Homo Sapiens
HLIVNIAKV

SEQ ID NO: 790290 - protein, 9 aa, Homo Sapiens
RYANQAHLI

SEQ ID NO: 790291 - protein, 9 aa, Homo Sapiens
AHAEHGGFL

SEQ ID NO: 790292 - protein, 9 aa, Homo Sapiens
TEVVRRFPH

SEQ ID NO: 790293 - protein, 9 aa, Homo Sapiens
HAEHGGFLA

SEQ ID NO: 790294 - protein, 9 aa, Homo Sapiens
RTRDFLKAG

SEQ ID NO: 790295 - protein, 9 aa, Homo Sapiens
RGFSQRAYL

SEQ ID NO: 790296 - protein, 9 aa, Homo Sapiens
PPSPSSRSQ

SEQ ID NO: 790297 - protein, 9 aa, Homo Sapiens
DPQAVTYAQ

SEQ ID NO: 790298 - protein, 9 aa, Homo Sapiens
VRARQPLES

SEQ ID NO: 790299 - protein, 9 aa, Homo Sapiens
WKIYKASKF

SEQ ID NO: 790300 - protein, 9 aa, Homo Sapiens
AGQRRGSRS

SEQ ID NO: 790301 - protein, 9 aa, Homo Sapiens
PGGPAPRRR

SEQ ID NO: 790302 - protein, 9 aa, Homo Sapiens
APPVRDLSS

SEQ ID NO: 790303 - protein, 9 aa, Homo Sapiens
PSTSRWSLP

SEQ ID NO: 790304 - protein, 9 aa, Homo Sapiens
PLPGAAKTP

SEQ ID NO: 790305 - protein, 9 aa, Homo Sapiens
FALAAECSE

SEQ ID NO: 790306 - protein, 9 aa, Homo Sapiens
QACEGGQCE

SEQ ID NO: 790307 - protein, 9 aa, Homo Sapiens
PYICEVCGR

SEQ ID NO: 790308 - protein, 9 aa, Homo Sapiens
LKAGKKTFC

SEQ ID NO: 790309 - protein, 9 aa, Homo Sapiens
LESLGLYRD

SEQ ID NO: 790310 - protein, 9 aa, Homo Sapiens
EAGVEDFAM

SEQ ID NO: 790311 - protein, 9 aa, Homo Sapiens
KSRPRMCGP

SEQ ID NO: 790312 - protein, 9 aa, Homo Sapiens
RSKLECLCR

SEQ ID NO: 790313 - protein, 9 aa, Homo Sapiens
PHGENLPSD

SEQ ID NO: 790314 - protein, 9 aa, Homo Sapiens
LRAAAEAAL

SEQ ID NO: 790315 - protein, 9 aa, Homo Sapiens
LDKNEGEQA

SEQ ID NO: 790316 - protein, 9 aa, Homo Sapiens
ISHFLYTLL

SEQ ID NO: 790317 - protein, 9 aa, Homo Sapiens
GPADPAAPS

SEQ ID NO: 790318 - protein, 9 aa, Homo Sapiens
GALDKNEGE

SEQ ID NO: 790319 - protein, 9 aa, Homo Sapiens
RELEPRGAR

SEQ ID NO: 790320 - protein, 9 aa, Homo Sapiens
QCEAGRYFL

SEQ ID NO: 790321 - protein, 9 aa, Homo Sapiens
QHGRLALRR

SEQ ID NO: 790322 - protein, 9 aa, Homo Sapiens
PSRLPLAEG

SEQ ID NO: 790323 - protein, 9 aa, Homo Sapiens
RPGGPAPRR

SEQ ID NO: 790324 - protein, 9 aa, Homo Sapiens
LQNVIHFIL

SEQ ID NO: 790325 - protein, 9 aa, Homo Sapiens
RETLRTIEE

SEQ ID NO: 790326 - protein, 9 aa, Homo Sapiens
VECLLRQKM

SEQ ID NO: 790327 - protein, 9 aa, Homo Sapiens
GYPAGQRRG

SEQ ID NO: 790328 - protein, 9 aa, Homo Sapiens
PRTTRRRTR

SEQ ID NO: 790329 - protein, 9 aa, Homo Sapiens
NAHLFALRS

SEQ ID NO: 790330 - protein, 9 aa, Homo Sapiens
HQTYTRYQT

SEQ ID NO: 790331 - protein, 9 aa, Homo Sapiens
ETAPAAPTA

SEQ ID NO: 790332 - protein, 9 aa, Homo Sapiens
AAPTPPRTL

SEQ ID NO: 790333 - protein, 9 aa, Homo Sapiens
PSSRSQPRT

SEQ ID NO: 790334 - protein, 9 aa, Homo Sapiens
AHLFALRSL

SEQ ID NO: 790335 - protein, 9 aa, Homo Sapiens
AWILINPMR

SEQ ID NO: 790336 - protein, 9 aa, Homo Sapiens
APRRRAAPT

SEQ ID NO: 790337 - protein, 9 aa, Homo Sapiens
TGPSADMRP

SEQ ID NO: 790338 - protein, 9 aa, Homo Sapiens
PRMCGPPRT

SEQ ID NO: 790339 - protein, 9 aa, Homo Sapiens
TPPRTLTRR

SEQ ID NO: 790340 - protein, 9 aa, Homo Sapiens
PRRQLRPFP

SEQ ID NO: 790341 - protein, 9 aa, Homo Sapiens
LPQAQGQVA

SEQ ID NO: 790342 - protein, 9 aa, Homo Sapiens
TLTRRAPEG

SEQ ID NO: 790343 - protein, 9 aa, Homo Sapiens
EETCSFEEA

SEQ ID NO: 790344 - protein, 9 aa, Homo Sapiens
KGSQYQPCK

SEQ ID NO: 790345 - protein, 9 aa, Homo Sapiens
RWSLPQAQG

SEQ ID NO: 790346 - protein, 9 aa, Homo Sapiens
GAAKTPMGA

SEQ ID NO: 790347 - protein, 9 aa, Homo Sapiens
MEWDLNEIE

SEQ ID NO: 790348 - protein, 9 aa, Homo Sapiens
RRTRDFLKA

SEQ ID NO: 790349 - protein, 9 aa, Homo Sapiens
MNGLAATPM

SEQ ID NO: 790350 - protein, 9 aa, Homo Sapiens
RQKMMRRAG

SEQ ID NO: 790351 - protein, 9 aa, Homo Sapiens
YQPDGSVYI

SEQ ID NO: 790352 - protein, 9 aa, Homo Sapiens
DDEFVCHII

SEQ ID NO: 790353 - protein, 9 aa, Homo Sapiens
SADMRPPPP

SEQ ID NO: 790354 - protein, 9 aa, Homo Sapiens
AECSEQLGQ

SEQ ID NO: 790355 - protein, 9 aa, Homo Sapiens
PDGSVYIVE

SEQ ID NO: 790356 - protein, 9 aa, Homo Sapiens
PRDCLRKAI

SEQ ID NO: 790357 - protein, 9 aa, Homo Sapiens
TRDFLKAGK

SEQ ID NO: 790358 - protein, 9 aa, Homo Sapiens
QAHLIVNIA

SEQ ID NO: 790359 - protein, 9 aa, Homo Sapiens
ELRELEPRG

SEQ ID NO: 790360 - protein, 9 aa, Homo Sapiens
VEKEREYRN

SEQ ID NO: 790361 - protein, 9 aa, Homo Sapiens
EAALSQTGF

SEQ ID NO: 790362 - protein, 9 aa, Homo Sapiens
KSIHYDLVF

SEQ ID NO: 790363 - protein, 9 aa, Homo Sapiens
HCQEEIGSW

SEQ ID NO: 790364 - protein, 9 aa, Homo Sapiens
YDPDSSENS

SEQ ID NO: 790365 - protein, 9 aa, Homo Sapiens
ETCSFEEAF

SEQ ID NO: 790366 - protein, 9 aa, Homo Sapiens
SRSLLPSGP

SEQ ID NO: 790367 - protein, 9 aa, Homo Sapiens
LRQKMMRRA

SEQ ID NO: 790368 - protein, 9 aa, Homo Sapiens
PDPIILQNV

SEQ ID NO: 790369 - protein, 9 aa, Homo Sapiens
DTVSGMVGT

SEQ ID NO: 790370 - protein, 9 aa, Homo Sapiens
LRTIEEGGA

SEQ ID NO: 790371 - protein, 9 aa, Homo Sapiens
NVEDRGFAY

SEQ ID NO: 790372 - protein, 9 aa, Homo Sapiens
PGYPAGQRR

SEQ ID NO: 790373 - protein, 9 aa, Homo Sapiens
MDSGARWQH

SEQ ID NO: 790374 - protein, 9 aa, Homo Sapiens
SPSQPRPGG

SEQ ID NO: 790375 - protein, 9 aa, Homo Sapiens
MDHLYAGAE

SEQ ID NO: 790376 - protein, 9 aa, Homo Sapiens
KKEGRETLR

SEQ ID NO: 790377 - protein, 9 aa, Homo Sapiens
SKGSQYQPC

SEQ ID NO: 790378 - protein, 9 aa, Homo Sapiens
CRNCGHIFY

SEQ ID NO: 790379 - protein, 9 aa, Homo Sapiens
KASKFRVGS

SEQ ID NO: 790380 - protein, 9 aa, Homo Sapiens
GASPRKRGS

SEQ ID NO: 790381 - protein, 9 aa, Homo Sapiens
LDGYCDTIV

SEQ ID NO: 790382 - protein, 9 aa, Homo Sapiens
SRFFRYLRT

SEQ ID NO: 790383 - protein, 9 aa, Homo Sapiens
PAHAEHGGF

SEQ ID NO: 790384 - protein, 9 aa, Homo Sapiens
GSVYIVESL

SEQ ID NO: 790385 - protein, 9 aa, Homo Sapiens
SGARWQHGR

SEQ ID NO: 790386 - protein, 9 aa, Homo Sapiens
LSQTGFSYD

SEQ ID NO: 790387 - protein, 9 aa, Homo Sapiens
HIIYVFYQM

SEQ ID NO: 790388 - protein, 9 aa, Homo Sapiens
RKAARLESL

SEQ ID NO: 790389 - protein, 9 aa, Homo Sapiens
GEDLDGYCD

SEQ ID NO: 790390 - protein, 9 aa, Homo Sapiens
PQAVTYAQV

SEQ ID NO: 790391 - protein, 9 aa, Homo Sapiens
WSLPQAQGQ

SEQ ID NO: 790392 - protein, 9 aa, Homo Sapiens
VVRRFPHHE

SEQ ID NO: 790393 - protein, 9 aa, Homo Sapiens
YTVKKIIDE

SEQ ID NO: 790394 - protein, 9 aa, Homo Sapiens
NRMEWNRIE

SEQ ID NO: 790395 - protein, 9 aa, Homo Sapiens
NLQGKGLSY

SEQ ID NO: 790396 - protein, 9 aa, Homo Sapiens
RRAPEGCSP

SEQ ID NO: 790397 - protein, 9 aa, Homo Sapiens
LFSKGSQYQ

SEQ ID NO: 790398 - protein, 9 aa, Homo Sapiens
VCRGQSFYV

SEQ ID NO: 790399 - protein, 9 aa, Homo Sapiens
DGLLSPGDW

SEQ ID NO: 790400 - protein, 9 aa, Homo Sapiens
MRKEDEGVY

SEQ ID NO: 790401 - protein, 9 aa, Homo Sapiens
SQYQPCKRT

SEQ ID NO: 790402 - protein, 9 aa, Homo Sapiens
GQRRGSRSL

SEQ ID NO: 790403 - protein, 9 aa, Homo Sapiens
SLFFAEQLT

SEQ ID NO: 790404 - protein, 9 aa, Homo Sapiens
RFPHHERCS

SEQ ID NO: 790405 - protein, 9 aa, Homo Sapiens
AVLEKLEKG

SEQ ID NO: 790406 - protein, 9 aa, Homo Sapiens
INADNAHLF

SEQ ID NO: 790407 - protein, 9 aa, Homo Sapiens
PPLPGAAKT

SEQ ID NO: 790408 - protein, 9 aa, Homo Sapiens
DSGARWQHG

SEQ ID NO: 790409 - protein, 9 aa, Homo Sapiens
PQSPRDCLR

SEQ ID NO: 790410 - protein, 9 aa, Homo Sapiens
FVCHIIYVF

SEQ ID NO: 790411 - protein, 9 aa, Homo Sapiens
LFDIKCNRK

SEQ ID NO: 790412 - protein, 9 aa, Homo Sapiens
SEQLGQLHP

SEQ ID NO: 790413 - protein, 9 aa, Homo Sapiens
APPARAAAS

SEQ ID NO: 790414 - protein, 9 aa, Homo Sapiens
TLRTIEEGG

SEQ ID NO: 790415 - protein, 9 aa, Homo Sapiens
PMRKEDEGV

SEQ ID NO: 790416 - protein, 9 aa, Homo Sapiens
LINPMRKED

SEQ ID NO: 790417 - protein, 9 aa, Homo Sapiens
RAPEGCSPR

SEQ ID NO: 790418 - protein, 9 aa, Homo Sapiens
CSEQLGQLH

SEQ ID NO: 790419 - protein, 9 aa, Homo Sapiens
DFLKAGKKT

SEQ ID NO: 790420 - protein, 9 aa, Homo Sapiens
AALSQTGFS

SEQ ID NO: 790421 - protein, 9 aa, Homo Sapiens
EFALAAECS

SEQ ID NO: 790422 - protein, 9 aa, Homo Sapiens
LPLCQSGPL

SEQ ID NO: 790423 - protein, 9 aa, Homo Sapiens
SGPLPPLPG

SEQ ID NO: 790424 - protein, 9 aa, Homo Sapiens
DLDGYCDTI

SEQ ID NO: 790425 - protein, 9 aa, Homo Sapiens
DTLGGCQVS

SEQ ID NO: 790426 - protein, 9 aa, Homo Sapiens
ADEVLKVDD

SEQ ID NO: 790427 - protein, 9 aa, Homo Sapiens
AQVKHSRPR

SEQ ID NO: 790428 - protein, 9 aa, Homo Sapiens
VYWKIYKAS

SEQ ID NO: 790429 - protein, 9 aa, Homo Sapiens
QLRPFPSTS

SEQ ID NO: 790430 - protein, 9 aa, Homo Sapiens
AVTYAQVKH

SEQ ID NO: 790431 - protein, 9 aa, Homo Sapiens
LFFAEQLTA

SEQ ID NO: 790432 - protein, 9 aa, Homo Sapiens
INPMRKEDE

SEQ ID NO: 790433 - protein, 9 aa, Homo Sapiens
PMGASPRKR

SEQ ID NO: 790434 - protein, 9 aa, Homo Sapiens
REDVDKRNK

SEQ ID NO: 790435 - protein, 9 aa, Homo Sapiens
APTPPRTLT

SEQ ID NO: 790436 - protein, 9 aa, Homo Sapiens
AGALDKNEG

SEQ ID NO: 790437 - protein, 9 aa, Homo Sapiens
STSRWSLPQ

SEQ ID NO: 790438 - protein, 9 aa, Homo Sapiens
CSFEEAFEA

SEQ ID NO: 790439 - protein, 9 aa, Homo Sapiens
GKGLSYLSQ

SEQ ID NO: 790440 - protein, 9 aa, Homo Sapiens
CFLCASKGL

SEQ ID NO: 790441 - protein, 9 aa, Homo Sapiens
NTAGTVVVA

SEQ ID NO: 790442 - protein, 9 aa, Homo Sapiens
VRRFPHHER

SEQ ID NO: 790443 - protein, 9 aa, Homo Sapiens
KIYKASKFR

SEQ ID NO: 790444 - protein, 9 aa, Homo Sapiens
EDVDKRNKA

SEQ ID NO: 790445 - protein, 9 aa, Homo Sapiens
EKEREYRNL

SEQ ID NO: 790446 - protein, 9 aa, Homo Sapiens
PEGCSPRPS

SEQ ID NO: 790447 - protein, 9 aa, Homo Sapiens
FHTFPRRAG

SEQ ID NO: 790448 - protein, 9 aa, Homo Sapiens
GQVATTGPS

SEQ ID NO: 790449 - protein, 9 aa, Homo Sapiens
DKNEGEQAK

SEQ ID NO: 790450 - protein, 9 aa, Homo Sapiens
PMVCFLCAS

SEQ ID NO: 790451 - protein, 9 aa, Homo Sapiens
NVTRLFSFT

SEQ ID NO: 790452 - protein, 9 aa, Homo Sapiens
LYAGAEVIL

SEQ ID NO: 790453 - protein, 9 aa, Homo Sapiens
SLPSRLPLA

SEQ ID NO: 790454 - protein, 9 aa, Homo Sapiens
AAAPPARAA

SEQ ID NO: 790455 - protein, 9 aa, Homo Sapiens
ARGDTLGGC

SEQ ID NO: 790456 - protein, 9 aa, Homo Sapiens
GSRSLLPSG

SEQ ID NO: 790457 - protein, 9 aa, Homo Sapiens
RSRPSQGGT

SEQ ID NO: 790458 - protein, 9 aa, Homo Sapiens
FHKVRARQP

SEQ ID NO: 790459 - protein, 9 aa, Homo Sapiens
QRAGCKSIH

SEQ ID NO: 790460 - protein, 9 aa, Homo Sapiens
KEREYRNLL

SEQ ID NO: 790461 - protein, 9 aa, Homo Sapiens
VLLDAYGEH

SEQ ID NO: 790462 - protein, 9 aa, Homo Sapiens
PAPGYPAGQ

SEQ ID NO: 790463 - protein, 9 aa, Homo Sapiens
ARLESLGLY

SEQ ID NO: 790464 - protein, 9 aa, Homo Sapiens
YAQVKHSRP

SEQ ID NO: 790465 - protein, 9 aa, Homo Sapiens
EPLCSMLAA

SEQ ID NO: 790466 - protein, 9 aa, Homo Sapiens
NQAHLIVNI

SEQ ID NO: 790467 - protein, 9 aa, Homo Sapiens
AGKKTFCLP

SEQ ID NO: 790468 - protein, 9 aa, Homo Sapiens
EWDLNEIEI

SEQ ID NO: 790469 - protein, 9 aa, Homo Sapiens
NTISHFLYT

SEQ ID NO: 790470 - protein, 9 aa, Homo Sapiens
AGTVVVAVI

SEQ ID NO: 790471 - protein, 9 aa, Homo Sapiens
RFFRYLRTA

SEQ ID NO: 790472 - protein, 9 aa, Homo Sapiens
QYQPCKRTF

SEQ ID NO: 790473 - protein, 9 aa, Homo Sapiens
IIQPMNVED

SEQ ID NO: 790474 - protein, 9 aa, Homo Sapiens
RSQPRTTRR

SEQ ID NO: 790475 - protein, 9 aa, Homo Sapiens
MERSREDVD

SEQ ID NO: 790476 - protein, 9 aa, Homo Sapiens
IFYPKPVRV

SEQ ID NO: 790477 - protein, 9 aa, Homo Sapiens
LNSAKPGSS

SEQ ID NO: 790478 - protein, 9 aa, Homo Sapiens
RAGCKSIHY

SEQ ID NO: 790479 - protein, 9 aa, Homo Sapiens
QEEIGSWNF

SEQ ID NO: 790480 - protein, 9 aa, Homo Sapiens
LRELEPRGA

SEQ ID NO: 790481 - protein, 9 aa, Homo Sapiens
VIIQPMNVE

SEQ ID NO: 790482 - protein, 9 aa, Homo Sapiens
GPLPPLPGA

SEQ ID NO: 790483 - protein, 9 aa, Homo Sapiens
HSLFFAEQL

SEQ ID NO: 790484 - protein, 9 aa, Homo Sapiens
QNLKVADEV

SEQ ID NO: 790485 - protein, 9 aa, Homo Sapiens
MNVTRLFSF

SEQ ID NO: 790486 - protein, 9 aa, Homo Sapiens
EKELRELEP

SEQ ID NO: 790487 - protein, 9 aa, Homo Sapiens
CVEETCSFE

SEQ ID NO: 790488 - protein, 9 aa, Homo Sapiens
QGGTSAWGK

SEQ ID NO: 790489 - protein, 9 aa, Homo Sapiens
NTSGGGDET

SEQ ID NO: 790490 - protein, 9 aa, Homo Sapiens
DGSNHSITD

SEQ ID NO: 790491 - protein, 9 aa, Homo Sapiens
GARKTQYDI

SEQ ID NO: 790492 - protein, 9 aa, Homo Sapiens
RMLHLERLQ

SEQ ID NO: 790493 - protein, 9 aa, Homo Sapiens
VQLEQDEYA

SEQ ID NO: 790494 - protein, 9 aa, Homo Sapiens
GALNQKIWG

SEQ ID NO: 790495 - protein, 9 aa, Homo Sapiens
GEWADTPWD

SEQ ID NO: 790496 - protein, 9 aa, Homo Sapiens
FKQHGNPDL

SEQ ID NO: 790497 - protein, 9 aa, Homo Sapiens
RVWAGERVH

SEQ ID NO: 790498 - protein, 9 aa, Homo Sapiens
PKGNWIEEA

SEQ ID NO: 790499 - protein, 9 aa, Homo Sapiens
LSGKLEECP

SEQ ID NO: 790500 - protein, 9 aa, Homo Sapiens
CLCFNSLGG

SEQ ID NO: 790501 - protein, 9 aa, Homo Sapiens
MACDACTSR

SEQ ID NO: 790502 - protein, 9 aa, Homo Sapiens
DGGTKSDSS

SEQ ID NO: 790503 - protein, 9 aa, Homo Sapiens
PTTERVTFT

SEQ ID NO: 790504 - protein, 9 aa, Homo Sapiens
SEEEEVFGI

SEQ ID NO: 790505 - protein, 9 aa, Homo Sapiens
LAWEGPLYN

SEQ ID NO: 790506 - protein, 9 aa, Homo Sapiens
DLYHSQGKG

SEQ ID NO: 790507 - protein, 9 aa, Homo Sapiens
LVVSGLMER

SEQ ID NO: 790508 - protein, 9 aa, Homo Sapiens
MLMRVYRAL

SEQ ID NO: 790509 - protein, 9 aa, Homo Sapiens
LLNRPLIDL

SEQ ID NO: 790510 - protein, 9 aa, Homo Sapiens
NWIEEAPYK

SEQ ID NO: 790511 - protein, 9 aa, Homo Sapiens
RPNNLVIVR

SEQ ID NO: 790512 - protein, 9 aa, Homo Sapiens
KQHGNPDLY

SEQ ID NO: 790513 - protein, 9 aa, Homo Sapiens
REPSIDRSR

SEQ ID NO: 790514 - protein, 9 aa, Homo Sapiens
QKIWGKKYP

SEQ ID NO: 790515 - protein, 9 aa, Homo Sapiens
DQPDLRMLH

SEQ ID NO: 790516 - protein, 9 aa, Homo Sapiens
RAFTYTWFN

SEQ ID NO: 790517 - protein, 9 aa, Homo Sapiens
PSYCQPITT

SEQ ID NO: 790518 - protein, 9 aa, Homo Sapiens
ERVTFTRCF

SEQ ID NO: 790519 - protein, 9 aa, Homo Sapiens
KTNESHVTL

SEQ ID NO: 790520 - protein, 9 aa, Homo Sapiens
EWLDSVQRN

SEQ ID NO: 790521 - protein, 9 aa, Homo Sapiens
GSLDGGTKS

SEQ ID NO: 790522 - protein, 9 aa, Homo Sapiens
KLILLGVFT

SEQ ID NO: 790523 - protein, 9 aa, Homo Sapiens
GFKQHGNPD

SEQ ID NO: 790524 - protein, 9 aa, Homo Sapiens
LTYLLRVNG

SEQ ID NO: 790525 - protein, 9 aa, Homo Sapiens
AFTYTWFNL

SEQ ID NO: 790526 - protein, 9 aa, Homo Sapiens
QDSQILCFK

SEQ ID NO: 790527 - protein, 9 aa, Homo Sapiens
FTYTWFNLQ

SEQ ID NO: 790528 - protein, 9 aa, Homo Sapiens
NRPLIDLIS

SEQ ID NO: 790529 - protein, 9 aa, Homo Sapiens
LVIVRMYDY

SEQ ID NO: 790530 - protein, 9 aa, Homo Sapiens
RAAREPSID

SEQ ID NO: 790531 - protein, 9 aa, Homo Sapiens
RKTQYDIWG

SEQ ID NO: 790532 - protein, 9 aa, Homo Sapiens
LMRVYRALF

SEQ ID NO: 790533 - protein, 9 aa, Homo Sapiens
QRKMRVTCV

SEQ ID NO: 790534 - protein, 9 aa, Homo Sapiens
KQEEEGTTD

SEQ ID NO: 790535 - protein, 9 aa, Homo Sapiens
RFRLCKCIM

SEQ ID NO: 790536 - protein, 9 aa, Homo Sapiens
LKGEAKPKR

SEQ ID NO: 790537 - protein, 9 aa, Homo Sapiens
DACTSRSGV

SEQ ID NO: 790538 - protein, 9 aa, Homo Sapiens
SLKQVQLEQ

SEQ ID NO: 790539 - protein, 9 aa, Homo Sapiens
APSVESYPV

SEQ ID NO: 790540 - protein, 9 aa, Homo Sapiens
FNSLGGLPG

SEQ ID NO: 790541 - protein, 9 aa, Homo Sapiens
PEWLDSVQR

SEQ ID NO: 790542 - protein, 9 aa, Homo Sapiens
FKALSEGLH

SEQ ID NO: 790543 - protein, 9 aa, Homo Sapiens
PDGAVVSKP

SEQ ID NO: 790544 - protein, 9 aa, Homo Sapiens
EQMTNRKMV

SEQ ID NO: 790545 - protein, 9 aa, Homo Sapiens
YGVKIKTNE

SEQ ID NO: 790546 - protein, 9 aa, Homo Sapiens
CQDSQILCF

SEQ ID NO: 790547 - protein, 9 aa, Homo Sapiens
NQKIWGKKY

SEQ ID NO: 790548 - protein, 9 aa, Homo Sapiens
NLVIVRMYD

SEQ ID NO: 790549 - protein, 9 aa, Homo Sapiens
KEEEWFKAL

SEQ ID NO: 790550 - protein, 9 aa, Homo Sapiens
LQRKMRVTC

SEQ ID NO: 790551 - protein, 9 aa, Homo Sapiens
SNRLKLILL

SEQ ID NO: 790552 - protein, 9 aa, Homo Sapiens
NRLKLILLG

SEQ ID NO: 790553 - protein, 9 aa, Homo Sapiens
TPRVCEELL

SEQ ID NO: 790554 - protein, 9 aa, Homo Sapiens
SYPVLEKLK

SEQ ID NO: 790555 - protein, 9 aa, Homo Sapiens
SQILCFKPD

SEQ ID NO: 790556 - protein, 9 aa, Homo Sapiens
WAGERVHRV

SEQ ID NO: 790557 - protein, 9 aa, Homo Sapiens
SRKNFLEGE

SEQ ID NO: 790558 - protein, 9 aa, Homo Sapiens
SCSFPHNFV

SEQ ID NO: 790559 - protein, 9 aa, Homo Sapiens
PHPATRVRP

SEQ ID NO: 790560 - protein, 9 aa, Homo Sapiens
QLEQDEYAK

SEQ ID NO: 790561 - protein, 9 aa, Homo Sapiens
LCFNSLGGL

SEQ ID NO: 790562 - protein, 9 aa, Homo Sapiens
LLADAQQGH

SEQ ID NO: 790563 - protein, 9 aa, Homo Sapiens
VIAIQKDSG

SEQ ID NO: 790564 - protein, 9 aa, Homo Sapiens
SSVPSYCQP

SEQ ID NO: 790565 - protein, 9 aa, Homo Sapiens
INPQKDTTA

SEQ ID NO: 790566 - protein, 9 aa, Homo Sapiens
NPQKDTTAD

SEQ ID NO: 790567 - protein, 9 aa, Homo Sapiens
AGVIGARKT

SEQ ID NO: 790568 - protein, 9 aa, Homo Sapiens
ALNQKIWGK

SEQ ID NO: 790569 - protein, 9 aa, Homo Sapiens
VTFTRCFYL

SEQ ID NO: 790570 - protein, 9 aa, Homo Sapiens
DTCLCFNSL

SEQ ID NO: 790571 - protein, 9 aa, Homo Sapiens
NAGIALRKL

SEQ ID NO: 790572 - protein, 9 aa, Homo Sapiens
THYKLTPHP

SEQ ID NO: 790573 - protein, 9 aa, Homo Sapiens
MIQTYIPCF

SEQ ID NO: 790574 - protein, 9 aa, Homo Sapiens
VWAGERVHR

SEQ ID NO: 790575 - protein, 9 aa, Homo Sapiens
ERFMTPRVC

SEQ ID NO: 790576 - protein, 9 aa, Homo Sapiens
QPKNTSGGG

SEQ ID NO: 790577 - protein, 9 aa, Homo Sapiens
IQKAISEGY

SEQ ID NO: 790578 - protein, 9 aa, Homo Sapiens
QILCFKPDS

SEQ ID NO: 790579 - protein, 9 aa, Homo Sapiens
KGFFKRTLQ

SEQ ID NO: 790580 - protein, 9 aa, Homo Sapiens
RSQSEEEEV

SEQ ID NO: 790581 - protein, 9 aa, Homo Sapiens
YPVLEKLKA

SEQ ID NO: 790582 - protein, 9 aa, Homo Sapiens
LEECPVKDG

SEQ ID NO: 790583 - protein, 9 aa, Homo Sapiens
TLSGKLEEC

SEQ ID NO: 790584 - protein, 9 aa, Homo Sapiens
RLTYLLRVN

SEQ ID NO: 790585 - protein, 9 aa, Homo Sapiens
PNFIIRVWA

SEQ ID NO: 790586 - protein, 9 aa, Homo Sapiens
IAIVYVPCG

SEQ ID NO: 790587 - protein, 9 aa, Homo Sapiens
GPDGAVVSK

SEQ ID NO: 790588 - protein, 9 aa, Homo Sapiens
TAMGSSVPS

SEQ ID NO: 790589 - protein, 9 aa, Homo Sapiens
FIGPTLCPS

SEQ ID NO: 790590 - protein, 9 aa, Homo Sapiens
PRVCEELLR

SEQ ID NO: 790591 - protein, 9 aa, Homo Sapiens
EDDIRGILT

SEQ ID NO: 790592 - protein, 9 aa, Homo Sapiens
ELEEMHVSI

SEQ ID NO: 790593 - protein, 9 aa, Homo Sapiens
TYIPCFMTV

SEQ ID NO: 790594 - protein, 9 aa, Homo Sapiens
VGQLGCARA

SEQ ID NO: 790595 - protein, 9 aa, Homo Sapiens
HIPLIPAAQ

SEQ ID NO: 790596 - protein, 9 aa, Homo Sapiens
EECGKALKQ

SEQ ID NO: 790597 - protein, 9 aa, Homo Sapiens
LKLILLGVF

SEQ ID NO: 790598 - protein, 9 aa, Homo Sapiens
SAILLAWEG

SEQ ID NO: 790599 - protein, 9 aa, Homo Sapiens
WVNDIVYLN

SEQ ID NO: 790600 - protein, 9 aa, Homo Sapiens
VPSYCQPIT

SEQ ID NO: 790601 - protein, 9 aa, Homo Sapiens
LDGGTKSDS

SEQ ID NO: 790602 - protein, 9 aa, Homo Sapiens
IDLISLLIP

SEQ ID NO: 790603 - protein, 9 aa, Homo Sapiens
LEEMHVSIT

SEQ ID NO: 790604 - protein, 9 aa, Homo Sapiens
LTPHPATRV

SEQ ID NO: 790605 - protein, 9 aa, Homo Sapiens
TYTWFNLQA

SEQ ID NO: 790606 - protein, 9 aa, Homo Sapiens
GVKIKTNES

SEQ ID NO: 790607 - protein, 9 aa, Homo Sapiens
CFNSLGGLP

SEQ ID NO: 790608 - protein, 9 aa, Homo Sapiens
IYYGVKIKT

SEQ ID NO: 790609 - protein, 9 aa, Homo Sapiens
LCPSCGSSP

SEQ ID NO: 790610 - protein, 9 aa, Homo Sapiens
IGSLDGGTK

SEQ ID NO: 790611 - protein, 9 aa, Homo Sapiens
AAREPSIDR

SEQ ID NO: 790612 - protein, 9 aa, Homo Sapiens
EEAPYKVGV

SEQ ID NO: 790613 - protein, 9 aa, Homo Sapiens
PTLCPSCGS

SEQ ID NO: 790614 - protein, 9 aa, Homo Sapiens
RVCEELLRH

SEQ ID NO: 790615 - protein, 9 aa, Homo Sapiens
WLDSVQRNG

SEQ ID NO: 790616 - protein, 9 aa, Homo Sapiens
GCARAETEE

SEQ ID NO: 790617 - protein, 9 aa, Homo Sapiens
KCEECGKAL

SEQ ID NO: 790618 - protein, 9 aa, Homo Sapiens
SLAINGSNR

SEQ ID NO: 790619 - protein, 9 aa, Homo Sapiens
DSSRKNFLE

SEQ ID NO: 790620 - protein, 9 aa, Homo Sapiens
FFKRTLQNN

SEQ ID NO: 790621 - protein, 9 aa, Homo Sapiens
NRPRSKIAQ

SEQ ID NO: 790622 - protein, 9 aa, Homo Sapiens
GQLGCARAE

SEQ ID NO: 790623 - protein, 9 aa, Homo Sapiens
DIVYLNYTK

SEQ ID NO: 790624 - protein, 9 aa, Homo Sapiens
MHVSITQEK

SEQ ID NO: 790625 - protein, 9 aa, Homo Sapiens
LILLGVFTG

SEQ ID NO: 790626 - protein, 9 aa, Homo Sapiens
DGAVVSKPA

SEQ ID NO: 790627 - protein, 9 aa, Homo Sapiens
FLEALARLT

SEQ ID NO: 790628 - protein, 9 aa, Homo Sapiens
SGEWADTPW

SEQ ID NO: 790629 - protein, 9 aa, Homo Sapiens
FRLCKCIMT

SEQ ID NO: 790630 - protein, 9 aa, Homo Sapiens
CSFPHNFVL

SEQ ID NO: 790631 - protein, 9 aa, Homo Sapiens
KIKTNESHV

SEQ ID NO: 790632 - protein, 9 aa, Homo Sapiens
AILLAWEGP

SEQ ID NO: 790633 - protein, 9 aa, Homo Sapiens
TTERVTFTR

SEQ ID NO: 790634 - protein, 9 aa, Homo Sapiens
PHVRAFTYT

SEQ ID NO: 790635 - protein, 9 aa, Homo Sapiens
EGPLYNSDK

SEQ ID NO: 790636 - protein, 9 aa, Homo Sapiens
VLKGEAKPK

SEQ ID NO: 790637 - protein, 9 aa, Homo Sapiens
THPQGVRFR

SEQ ID NO: 790638 - protein, 9 aa, Homo Sapiens
TPHPATRVR

SEQ ID NO: 790639 - protein, 9 aa, Homo Sapiens
QLGCARAET

SEQ ID NO: 790640 - protein, 9 aa, Homo Sapiens
YRALFWSLA

SEQ ID NO: 790641 - protein, 9 aa, Homo Sapiens
GPSCSFPHN

SEQ ID NO: 790642 - protein, 9 aa, Homo Sapiens
IWGKKYPTC

SEQ ID NO: 790643 - protein, 9 aa, Homo Sapiens
YVIAIQKDS

SEQ ID NO: 790644 - protein, 9 aa, Homo Sapiens
ANSCQDSQI

SEQ ID NO: 790645 - protein, 9 aa, Homo Sapiens
EQDEYAKHI

SEQ ID NO: 790646 - protein, 9 aa, Homo Sapiens
GVIGARKTQ

SEQ ID NO: 790647 - protein, 9 aa, Homo Sapiens
RTLQNNKHY

SEQ ID NO: 790648 - protein, 9 aa, Homo Sapiens
LGCARAETE

SEQ ID NO: 790649 - protein, 9 aa, Homo Sapiens
VRMYDYHVL

SEQ ID NO: 790650 - protein, 9 aa, Homo Sapiens
ERTAIQKAI

SEQ ID NO: 790651 - protein, 9 aa, Homo Sapiens
LLLNRPLID

SEQ ID NO: 790652 - protein, 9 aa, Homo Sapiens
CKGFFKRTL

SEQ ID NO: 790653 - protein, 9 aa, Homo Sapiens
SCQDSQILC

SEQ ID NO: 790654 - protein, 9 aa, Homo Sapiens
KQVQLEQDE

SEQ ID NO: 790655 - protein, 9 aa, Homo Sapiens
STVLKGEAK

SEQ ID NO: 790656 - protein, 9 aa, Homo Sapiens
GTKSDSSSP

SEQ ID NO: 790657 - protein, 9 aa, Homo Sapiens
FALKPVSDM

SEQ ID NO: 790658 - protein, 9 aa, Homo Sapiens
VSGLMERNG

SEQ ID NO: 790659 - protein, 9 aa, Homo Sapiens
HVRAFTYTW

SEQ ID NO: 790660 - protein, 9 aa, Homo Sapiens
RYIAICPPL

SEQ ID NO: 790661 - protein, 9 aa, Homo Sapiens
IVYLNYTKV

SEQ ID NO: 790662 - protein, 9 aa, Homo Sapiens
KTIEEQMTN

SEQ ID NO: 790663 - protein, 9 aa, Homo Sapiens
LNQKIWGKK

SEQ ID NO: 790664 - protein, 9 aa, Homo Sapiens
FKRTLQNNK

SEQ ID NO: 790665 - protein, 9 aa, Homo Sapiens
LIDLISLLI

SEQ ID NO: 790666 - protein, 9 aa, Homo Sapiens
VGDVNCLVM

SEQ ID NO: 790667 - protein, 9 aa, Homo Sapiens
ALARLTYLL

SEQ ID NO: 790668 - protein, 9 aa, Homo Sapiens
RTAIQKAIS

SEQ ID NO: 790669 - protein, 9 aa, Homo Sapiens
IKTNESHVT

SEQ ID NO: 790670 - protein, 9 aa, Homo Sapiens
RNIAIVYVP

SEQ ID NO: 790671 - protein, 9 aa, Homo Sapiens
HSITDACTL

SEQ ID NO: 790672 - protein, 9 aa, Homo Sapiens
TTADPSEPS

SEQ ID NO: 790673 - protein, 9 aa, Homo Sapiens
PSIDRSRLP

SEQ ID NO: 790674 - protein, 9 aa, Homo Sapiens
SIYYGVKIK

SEQ ID NO: 790675 - protein, 9 aa, Homo Sapiens
GSSVPSYCQ

SEQ ID NO: 790676 - protein, 9 aa, Homo Sapiens
LARLTYLLR

SEQ ID NO: 790677 - protein, 9 aa, Homo Sapiens
AIQKAISEG

SEQ ID NO: 790678 - protein, 9 aa, Homo Sapiens
LADAQQGHR

SEQ ID NO: 790679 - protein, 9 aa, Homo Sapiens
ITDACTLVL

SEQ ID NO: 790680 - protein, 9 aa, Homo Sapiens
LPLSADCFA

SEQ ID NO: 790681 - protein, 9 aa, Homo Sapiens
MPSLVVSGL

SEQ ID NO: 790682 - protein, 9 aa, Homo Sapiens
PNNLVIVRM

SEQ ID NO: 790683 - protein, 9 aa, Homo Sapiens
KRQELEEMH

SEQ ID NO: 790684 - protein, 9 aa, Homo Sapiens
RPRSKIAQP

SEQ ID NO: 790685 - protein, 9 aa, Homo Sapiens
EEEWFKALS

SEQ ID NO: 790686 - protein, 9 aa, Homo Sapiens
MRVYRALFW

SEQ ID NO: 790687 - protein, 9 aa, Homo Sapiens
SNHSITDAC

SEQ ID NO: 790688 - protein, 9 aa, Homo Sapiens
YIAICPPLH

SEQ ID NO: 790689 - protein, 9 aa, Homo Sapiens
ALSEGLHPD

SEQ ID NO: 790690 - protein, 9 aa, Homo Sapiens
RIFIGPTLC

SEQ ID NO: 790691 - protein, 9 aa, Homo Sapiens
AIVYVPCGH

SEQ ID NO: 790692 - protein, 9 aa, Homo Sapiens
HYKLTPHPA

SEQ ID NO: 790693 - protein, 9 aa, Homo Sapiens
ECPVKDGLL

SEQ ID NO: 790694 - protein, 9 aa, Homo Sapiens
EEWFKALSE

SEQ ID NO: 790695 - protein, 9 aa, Homo Sapiens
IFIGPTLCP

SEQ ID NO: 790696 - protein, 9 aa, Homo Sapiens
LDSVQRNGE

SEQ ID NO: 790697 - protein, 9 aa, Homo Sapiens
GNWIEEAPY

SEQ ID NO: 790698 - protein, 9 aa, Homo Sapiens
SSRKNFLEG

SEQ ID NO: 790699 - protein, 9 aa, Homo Sapiens
AVVSKPAHA

SEQ ID NO: 790700 - protein, 9 aa, Homo Sapiens
CLSHIPLIP

SEQ ID NO: 790701 - protein, 9 aa, Homo Sapiens
PQKDTTADP

SEQ ID NO: 790702 - protein, 9 aa, Homo Sapiens
FKEDDIRGI

SEQ ID NO: 790703 - protein, 9 aa, Homo Sapiens
KGNWIEEAP

SEQ ID NO: 790704 - protein, 9 aa, Homo Sapiens
QMLMRVYRA

SEQ ID NO: 790705 - protein, 9 aa, Homo Sapiens
HPATRVRPK

SEQ ID NO: 790706 - protein, 9 aa, Homo Sapiens
VVSGLMERN

SEQ ID NO: 790707 - protein, 9 aa, Homo Sapiens
DDIRGILTP

SEQ ID NO: 790708 - protein, 9 aa, Homo Sapiens
FPHNFVLLV

SEQ ID NO: 790709 - protein, 9 aa, Homo Sapiens
PCFMTVILS

SEQ ID NO: 790710 - protein, 9 aa, Homo Sapiens
PDLYHSQGK

SEQ ID NO: 790711 - protein, 9 aa, Homo Sapiens
LGIQPKNTS

SEQ ID NO: 790712 - protein, 9 aa, Homo Sapiens
TGALNQKIW

SEQ ID NO: 790713 - protein, 9 aa, Homo Sapiens
ICPPLHCST

SEQ ID NO: 790714 - protein, 9 aa, Homo Sapiens
KLKFKEDDI

SEQ ID NO: 790715 - protein, 9 aa, Homo Sapiens
SDANLDSSR

SEQ ID NO: 790716 - protein, 9 aa, Homo Sapiens
SYCQPITTV

SEQ ID NO: 790717 - protein, 9 aa, Homo Sapiens
NIAIVYVPC

SEQ ID NO: 790718 - protein, 9 aa, Homo Sapiens
IEEAPYKVG

SEQ ID NO: 790719 - protein, 9 aa, Homo Sapiens
LKFKEDDIR

SEQ ID NO: 790720 - protein, 9 aa, Homo Sapiens
INGSNRPRS

SEQ ID NO: 790721 - protein, 9 aa, Homo Sapiens
TYLLRVNGS

SEQ ID NO: 790722 - protein, 9 aa, Homo Sapiens
VVSKPAHAP

SEQ ID NO: 790723 - protein, 9 aa, Homo Sapiens
LSHIPLIPA

SEQ ID NO: 790724 - protein, 9 aa, Homo Sapiens
IRGILTPSD

SEQ ID NO: 790725 - protein, 9 aa, Homo Sapiens
ACDACTSRS

SEQ ID NO: 790726 - protein, 9 aa, Homo Sapiens
ILLGVFTGL

SEQ ID NO: 790727 - protein, 9 aa, Homo Sapiens
RNGELFYLE

SEQ ID NO: 790728 - protein, 9 aa, Homo Sapiens
RKLCTAEPR

SEQ ID NO: 790729 - protein, 9 aa, Homo Sapiens
LEALARLTY

SEQ ID NO: 790730 - protein, 9 aa, Homo Sapiens
KNTSGGGDE

SEQ ID NO: 790731 - protein, 9 aa, Homo Sapiens
GIQPKNTSG

SEQ ID NO: 790732 - protein, 9 aa, Homo Sapiens
QVNAGIALR

SEQ ID NO: 790733 - protein, 9 aa, Homo Sapiens
LRKLCTAEP

SEQ ID NO: 790734 - protein, 9 aa, Homo Sapiens
IPLIPAAQG

SEQ ID NO: 790735 - protein, 9 aa, Homo Sapiens
GSNRPRSKI

SEQ ID NO: 790736 - protein, 9 aa, Homo Sapiens
DANLDSSRK

SEQ ID NO: 790737 - protein, 9 aa, Homo Sapiens
DSQILCFKP

SEQ ID NO: 790738 - protein, 9 aa, Homo Sapiens
GIALRKLCT

SEQ ID NO: 790739 - protein, 9 aa, Homo Sapiens
EDTCLCFNS

SEQ ID NO: 790740 - protein, 9 aa, Homo Sapiens
RFMTPRVCE

SEQ ID NO: 790741 - protein, 9 aa, Homo Sapiens
CGKALKQSS

SEQ ID NO: 790742 - protein, 9 aa, Homo Sapiens
VNDIVYLNY

SEQ ID NO: 790743 - protein, 9 aa, Homo Sapiens
ADCFALKPV

SEQ ID NO: 790744 - protein, 9 aa, Homo Sapiens
TLCPSCGSS

SEQ ID NO: 790745 - protein, 9 aa, Homo Sapiens
HAAVGQLGC

SEQ ID NO: 790746 - protein, 9 aa, Homo Sapiens
KVFASTGYV

SEQ ID NO: 790747 - protein, 9 aa, Homo Sapiens
NSCQDSQIL

SEQ ID NO: 790748 - protein, 9 aa, Homo Sapiens
PSVESYPVL

SEQ ID NO: 790749 - protein, 9 aa, Homo Sapiens
GLMERNGGF

SEQ ID NO: 790750 - protein, 9 aa, Homo Sapiens
NSLGGLPGP

SEQ ID NO: 790751 - protein, 9 aa, Homo Sapiens
STGYVIAIQ

SEQ ID NO: 790752 - protein, 9 aa, Homo Sapiens
KCLSHIPLI

SEQ ID NO: 790753 - protein, 9 aa, Homo Sapiens
SKPAHAPHM

SEQ ID NO: 790754 - protein, 9 aa, Homo Sapiens
QKAISEGYK

SEQ ID NO: 790755 - protein, 9 aa, Homo Sapiens
SAPSVESYP

SEQ ID NO: 790756 - protein, 9 aa, Homo Sapiens
SLVVSGLME

SEQ ID NO: 790757 - protein, 9 aa, Homo Sapiens
DIRGILTPS

SEQ ID NO: 790758 - protein, 9 aa, Homo Sapiens
LSEGLHPDA

SEQ ID NO: 790759 - protein, 9 aa, Homo Sapiens
VRAFTYTWF

SEQ ID NO: 790760 - protein, 9 aa, Homo Sapiens
SAYAVGDVN

SEQ ID NO: 790761 - protein, 9 aa, Homo Sapiens
APRAAREPS

SEQ ID NO: 790762 - protein, 9 aa, Homo Sapiens
LIGSLDGGT

SEQ ID NO: 790763 - protein, 9 aa, Homo Sapiens
ARLTYLLRV

SEQ ID NO: 790764 - protein, 9 aa, Homo Sapiens
KFKEDDIRG

SEQ ID NO: 790765 - protein, 9 aa, Homo Sapiens
SLDGGTKSD

SEQ ID NO: 790766 - protein, 9 aa, Homo Sapiens
IPAAQGRGG

SEQ ID NO: 790767 - protein, 9 aa, Homo Sapiens
IQPKNTSGG

SEQ ID NO: 790768 - protein, 9 aa, Homo Sapiens
DTTADPSEP

SEQ ID NO: 790769 - protein, 9 aa, Homo Sapiens
SGLMERNGG

SEQ ID NO: 790770 - protein, 9 aa, Homo Sapiens
AYAVGDVNC

SEQ ID NO: 790771 - protein, 9 aa, Homo Sapiens
GPDQPDLRM

SEQ ID NO: 790772 - protein, 9 aa, Homo Sapiens
NCLVMDVQA

SEQ ID NO: 790773 - protein, 9 aa, Homo Sapiens
RKMRVTCVI

SEQ ID NO: 790774 - protein, 9 aa, Homo Sapiens
VQRNGELFY

SEQ ID NO: 790775 - protein, 9 aa, Homo Sapiens
NDIVYLNYT

SEQ ID NO: 790776 - protein, 9 aa, Homo Sapiens
SLGGLPGPY

SEQ ID NO: 790777 - protein, 9 aa, Homo Sapiens
KALSEGLHP

SEQ ID NO: 790778 - protein, 9 aa, Homo Sapiens
MRVTCVITQ

SEQ ID NO: 790779 - protein, 9 aa, Homo Sapiens
LLPHVRAFT

SEQ ID NO: 790780 - protein, 9 aa, Homo Sapiens
PTHYKLTPH

SEQ ID NO: 790781 - protein, 9 aa, Homo Sapiens
YLNYTKVEQ

SEQ ID NO: 790782 - protein, 9 aa, Homo Sapiens
NRKMVLFQE

SEQ ID NO: 790783 - protein, 9 aa, Homo Sapiens
PLIPAAQGR

SEQ ID NO: 790784 - protein, 9 aa, Homo Sapiens
CEELLRHQL

SEQ ID NO: 790785 - protein, 9 aa, Homo Sapiens
MLHLERLQR

SEQ ID NO: 790786 - protein, 9 aa, Homo Sapiens
ILGIQPKNT

SEQ ID NO: 790787 - protein, 9 aa, Homo Sapiens
PKNTSGGGD

SEQ ID NO: 790788 - protein, 9 aa, Homo Sapiens
AAVGQLGCA

SEQ ID NO: 790789 - protein, 9 aa, Homo Sapiens
GDVNCLVMD

SEQ ID NO: 790790 - protein, 9 aa, Homo Sapiens
GPLYNSDKV

SEQ ID NO: 790791 - protein, 9 aa, Homo Sapiens
NSAPSVESY

SEQ ID NO: 790792 - protein, 9 aa, Homo Sapiens
LLAWEGPLY

SEQ ID NO: 790793 - protein, 9 aa, Homo Sapiens
TIEEQMTNR

SEQ ID NO: 790794 - protein, 9 aa, Homo Sapiens
IIRVWAGER

SEQ ID NO: 790795 - protein, 9 aa, Homo Sapiens
TCLCFNSLG

SEQ ID NO: 790796 - protein, 9 aa, Homo Sapiens
DLRMLHLER

SEQ ID NO: 790797 - protein, 9 aa, Homo Sapiens
RVTFTRCFY

SEQ ID NO: 790798 - protein, 9 aa, Homo Sapiens
ADTPWDPCP

SEQ ID NO: 790799 - protein, 9 aa, Homo Sapiens
LHSGEWADT

SEQ ID NO: 790800 - protein, 9 aa, Homo Sapiens
WFKALSEGL

SEQ ID NO: 790801 - protein, 9 aa, Homo Sapiens
TQYDIWGNT

SEQ ID NO: 790802 - protein, 9 aa, Homo Sapiens
KRPNNLVIV

SEQ ID NO: 790803 - protein, 9 aa, Homo Sapiens
IAICPPLHC

SEQ ID NO: 790804 - protein, 9 aa, Homo Sapiens
LKQVQLEQD

SEQ ID NO: 790805 - protein, 9 aa, Homo Sapiens
DAQQGHRQS

SEQ ID NO: 790806 - protein, 9 aa, Homo Sapiens
IVRMYDYHV

SEQ ID NO: 790807 - protein, 9 aa, Homo Sapiens
KALKQSSTL

SEQ ID NO: 790808 - protein, 9 aa, Homo Sapiens
KDTTADPSE

SEQ ID NO: 790809 - protein, 9 aa, Homo Sapiens
CFMTVILSQ

SEQ ID NO: 790810 - protein, 9 aa, Homo Sapiens
AWVNDIVYL

SEQ ID NO: 790811 - protein, 9 aa, Homo Sapiens
KRTLQNNKH

SEQ ID NO: 790812 - protein, 9 aa, Homo Sapiens
EPSIDRSRL

SEQ ID NO: 790813 - protein, 9 aa, Homo Sapiens
VKIKTNESH

SEQ ID NO: 790814 - protein, 9 aa, Homo Sapiens
PRAAREPSI

SEQ ID NO: 790815 - protein, 9 aa, Homo Sapiens
AISEGYKDF

SEQ ID NO: 790816 - protein, 9 aa, Homo Sapiens
EEMHVSITQ

SEQ ID NO: 790817 - protein, 9 aa, Homo Sapiens
KEDDIRGIL

SEQ ID NO: 790818 - protein, 9 aa, Homo Sapiens
LEQDEYAKH

SEQ ID NO: 790819 - protein, 9 aa, Homo Sapiens
DVNCLVMDV

SEQ ID NO: 790820 - protein, 9 aa, Homo Sapiens
AMGSSVPSY

SEQ ID NO: 790821 - protein, 9 aa, Homo Sapiens
LNRPLIDLI

SEQ ID NO: 790822 - protein, 9 aa, Homo Sapiens
VESYPVLEK

SEQ ID NO: 790823 - protein, 9 aa, Homo Sapiens
CARAETEEL

SEQ ID NO: 790824 - protein, 9 aa, Homo Sapiens
ESYPVLEKL

SEQ ID NO: 790825 - protein, 9 aa, Homo Sapiens
RSNRLKLIL

SEQ ID NO: 790826 - protein, 9 aa, Homo Sapiens
SQSEEEEVF

SEQ ID NO: 790827 - protein, 9 aa, Homo Sapiens
CFALKPVSD

SEQ ID NO: 790828 - protein, 9 aa, Homo Sapiens
LMERNGGFG

SEQ ID NO: 790829 - protein, 9 aa, Homo Sapiens
AVGDVNCLV

SEQ ID NO: 790830 - protein, 9 aa, Homo Sapiens
TDACTLVLV

SEQ ID NO: 790831 - protein, 9 aa, Homo Sapiens
MTPRVCEEL

SEQ ID NO: 790832 - protein, 9 aa, Homo Sapiens
KIWGKKYPT

SEQ ID NO: 790833 - protein, 9 aa, Homo Sapiens
QMTNRKMVL

SEQ ID NO: 790834 - protein, 9 aa, Homo Sapiens
GSNHSITDA

SEQ ID NO: 790835 - protein, 9 aa, Homo Sapiens
TAIQKAISE

SEQ ID NO: 790836 - protein, 9 aa, Homo Sapiens
NNLVIVRMY

SEQ ID NO: 790837 - protein, 9 aa, Homo Sapiens
IPCFMTVIL

SEQ ID NO: 790838 - protein, 9 aa, Homo Sapiens
PQGVRFRLC

SEQ ID NO: 790839 - protein, 9 aa, Homo Sapiens
TKSDSSSPN

SEQ ID NO: 790840 - protein, 9 aa, Homo Sapiens
PDLRMLHLE

SEQ ID NO: 790841 - protein, 9 aa, Homo Sapiens
PLIDLISLL

SEQ ID NO: 790842 - protein, 9 aa, Homo Sapiens
RPLIDLISL

SEQ ID NO: 790843 - protein, 9 aa, Homo Sapiens
QELEEMHVS

SEQ ID NO: 790844 - protein, 9 aa, Homo Sapiens
TGYVIAIQK

SEQ ID NO: 790845 - protein, 9 aa, Homo Sapiens
CVITQGAKR

SEQ ID NO: 790846 - protein, 9 aa, Homo Sapiens
NSTVLKGEA

SEQ ID NO: 790847 - protein, 9 aa, Homo Sapiens
QTYIPCFMT

SEQ ID NO: 790848 - protein, 9 aa, Homo Sapiens
LQNNKHYTC

SEQ ID NO: 790849 - protein, 9 aa, Homo Sapiens
ISEGYKDFR

SEQ ID NO: 790850 - protein, 9 aa, Homo Sapiens
DTPWDPCPA

SEQ ID NO: 790851 - protein, 9 aa, Homo Sapiens
NFIIRVWAG

SEQ ID NO: 790852 - protein, 9 aa, Homo Sapiens
YYGVKIKTN

SEQ ID NO: 790853 - protein, 9 aa, Homo Sapiens
RQELEEMHV

SEQ ID NO: 790854 - protein, 9 aa, Homo Sapiens
QKDTTADPS

SEQ ID NO: 790855 - protein, 9 aa, Homo Sapiens
RKNFLEGEV

SEQ ID NO: 790856 - protein, 9 aa, Homo Sapiens
GPTLCPSCG

SEQ ID NO: 790857 - protein, 9 aa, Homo Sapiens
ANLDSSRKN

SEQ ID NO: 790858 - protein, 9 aa, Homo Sapiens
QHGNPDLYH

SEQ ID NO: 790859 - protein, 9 aa, Homo Sapiens
MTNRKMVLF

SEQ ID NO: 790860 - protein, 9 aa, Homo Sapiens
AWEGPLYNS

SEQ ID NO: 790861 - protein, 9 aa, Homo Sapiens
CPVKDGLLK

SEQ ID NO: 790862 - protein, 9 aa, Homo Sapiens
AGIALRKLC

SEQ ID NO: 790863 - protein, 9 aa, Homo Sapiens
CPPLHCSTV

SEQ ID NO: 790864 - protein, 9 aa, Homo Sapiens
GFFKRTLQN

SEQ ID NO: 790865 - protein, 9 aa, Homo Sapiens
CEECGKALK

SEQ ID NO: 790866 - protein, 9 aa, Homo Sapiens
LPHVRAFTY

SEQ ID NO: 790867 - protein, 9 aa, Homo Sapiens
VYLNYTKVE

SEQ ID NO: 790868 - protein, 9 aa, Homo Sapiens
GAVVSKPAH

SEQ ID NO: 790869 - protein, 9 aa, Homo Sapiens
FDGSNHSIT

SEQ ID NO: 790870 - protein, 9 aa, Homo Sapiens
QSEEEEVFG

SEQ ID NO: 790871 - protein, 9 aa, Homo Sapiens
EWFKALSEG

SEQ ID NO: 790872 - protein, 9 aa, Homo Sapiens
SFPHNFVLL

SEQ ID NO: 790873 - protein, 9 aa, Homo Sapiens
TCVITQGAK

SEQ ID NO: 790874 - protein, 9 aa, Homo Sapiens
LLGVFTGLS

SEQ ID NO: 790875 - protein, 9 aa, Homo Sapiens
LLLLNRPLI

SEQ ID NO: 790876 - protein, 9 aa, Homo Sapiens
EMHVSITQE

SEQ ID NO: 790877 - protein, 9 aa, Homo Sapiens
RALFWSLAP

SEQ ID NO: 790878 - protein, 9 aa, Homo Sapiens
EALARLTYL

SEQ ID NO: 790879 - protein, 9 aa, Homo Sapiens
LDSSRKNFL

SEQ ID NO: 790880 - protein, 9 aa, Homo Sapiens
NHSITDACT

SEQ ID NO: 790881 - protein, 9 aa, Homo Sapiens
WEGPLYNSD

SEQ ID NO: 790882 - protein, 9 aa, Homo Sapiens
GGTKSDSSS

SEQ ID NO: 790883 - protein, 9 aa, Homo Sapiens
ILLAWEGPL

SEQ ID NO: 790884 - protein, 9 aa, Homo Sapiens
TERVTFTRC

SEQ ID NO: 790885 - protein, 9 aa, Homo Sapiens
QPKKQEEEG

SEQ ID NO: 790886 - protein, 9 aa, Homo Sapiens
KPNSTVLKG

SEQ ID NO: 790887 - protein, 9 aa, Homo Sapiens
PLSADCFAL

SEQ ID NO: 790888 - protein, 9 aa, Homo Sapiens
KKQEEEGTT

SEQ ID NO: 790889 - protein, 9 aa, Homo Sapiens
SKPNSTVLK

SEQ ID NO: 790890 - protein, 9 aa, Homo Sapiens
PKKQEEEGT

SEQ ID NO: 790891 - protein, 9 aa, Homo Sapiens
SITDACTLV

SEQ ID NO: 790892 - protein, 9 aa, Homo Sapiens
SADCFALKP

SEQ ID NO: 790893 - protein, 9 aa, Homo Sapiens
VTCVITQGA

SEQ ID NO: 790894 - protein, 9 aa, Homo Sapiens
TLQNNKHYT

SEQ ID NO: 790895 - protein, 9 aa, Homo Sapiens
ARKTQYDIW

SEQ ID NO: 790896 - protein, 9 aa, Homo Sapiens
ALKQSSTLT

SEQ ID NO: 790897 - protein, 9 aa, Homo Sapiens
TQMLMRVYR

SEQ ID NO: 790898 - protein, 9 aa, Homo Sapiens
LRMLHLERL

SEQ ID NO: 790899 - protein, 9 aa, Homo Sapiens
VRFRLCKCI

SEQ ID NO: 790900 - protein, 9 aa, Homo Sapiens
TILGIQPKN

SEQ ID NO: 790901 - protein, 9 aa, Homo Sapiens
NGSNRPRSK

SEQ ID NO: 790902 - protein, 9 aa, Homo Sapiens
GVRFRLCKC

SEQ ID NO: 790903 - protein, 9 aa, Homo Sapiens
VIVRMYDYH

SEQ ID NO: 790904 - protein, 9 aa, Homo Sapiens
ECGKALKQS

SEQ ID NO: 790905 - protein, 9 aa, Homo Sapiens
KLTPHPATR

SEQ ID NO: 790906 - protein, 9 aa, Homo Sapiens
QPDLRMLHL

SEQ ID NO: 790907 - protein, 9 aa, Homo Sapiens
AREPSIDRS

SEQ ID NO: 790908 - protein, 9 aa, Homo Sapiens
VNCLVMDVQ

SEQ ID NO: 790909 - protein, 9 aa, Homo Sapiens
GKLEECPVK

SEQ ID NO: 790910 - protein, 9 aa, Homo Sapiens
SGKLEECPV

SEQ ID NO: 790911 - protein, 9 aa, Homo Sapiens
AINGSNRPR

SEQ ID NO: 790912 - protein, 9 aa, Homo Sapiens
PHNFVLLVQ

SEQ ID NO: 790913 - protein, 9 aa, Homo Sapiens
ALRKLCTAE

SEQ ID NO: 790914 - protein, 9 aa, Homo Sapiens
VNAGIALRK

SEQ ID NO: 790915 - protein, 9 aa, Homo Sapiens
VSKPAHAPH

SEQ ID NO: 790916 - protein, 9 aa, Homo Sapiens
LIPAAQGRG

SEQ ID NO: 790917 - protein, 9 aa, Homo Sapiens
SHIPLIPAA

SEQ ID NO: 790918 - protein, 9 aa, Homo Sapiens
PDQPDLRML

SEQ ID NO: 790919 - protein, 9 aa, Homo Sapiens
GYVIAIQKD

SEQ ID NO: 790920 - protein, 9 aa, Homo Sapiens
HQGPSCSFP

SEQ ID NO: 790921 - protein, 9 aa, Homo Sapiens
QEEEGTTDT

SEQ ID NO: 790922 - protein, 9 aa, Homo Sapiens
HSGEWADTP

SEQ ID NO: 790923 - protein, 9 aa, Homo Sapiens
YAVGDVNCL

SEQ ID NO: 790924 - protein, 9 aa, Homo Sapiens
MGSSVPSYC

SEQ ID NO: 790925 - protein, 9 aa, Homo Sapiens
PPNFIIRVW

SEQ ID NO: 790926 - protein, 9 aa, Homo Sapiens
IGPTLCPSC

SEQ ID NO: 790927 - protein, 9 aa, Homo Sapiens
SHINPQKDT

SEQ ID NO: 790928 - protein, 9 aa, Homo Sapiens
RVYRALFWS

SEQ ID NO: 790929 - protein, 9 aa, Homo Sapiens
KLEECPVKD

SEQ ID NO: 790930 - protein, 9 aa, Homo Sapiens
WIEEAPYKV

SEQ ID NO: 790931 - protein, 9 aa, Homo Sapiens
FTRCFYLFP

SEQ ID NO: 790932 - protein, 9 aa, Homo Sapiens
ILCFKPDSI

SEQ ID NO: 790933 - protein, 9 aa, Homo Sapiens
ADAQQGHRQ

SEQ ID NO: 790934 - protein, 9 aa, Homo Sapiens
PSCSFPHNF

SEQ ID NO: 790935 - protein, 9 aa, Homo Sapiens
YTGALNQKI

SEQ ID NO: 790936 - protein, 9 aa, Homo Sapiens
PSLVVSGLM

SEQ ID NO: 790937 - protein, 9 aa, Homo Sapiens
FDRYIAICP

SEQ ID NO: 790938 - protein, 9 aa, Homo Sapiens
VYRALFWSL

SEQ ID NO: 790939 - protein, 9 aa, Homo Sapiens
MDRNIAIVY

SEQ ID NO: 790940 - protein, 9 aa, Homo Sapiens
IGARKTQYD

SEQ ID NO: 790941 - protein, 9 aa, Homo Sapiens
DRYIAICPP

SEQ ID NO: 790942 - protein, 9 aa, Homo Sapiens
VYVPCGHLV

SEQ ID NO: 790943 - protein, 9 aa, Homo Sapiens
DRNIAIVYV

SEQ ID NO: 790944 - protein, 9 aa, Homo Sapiens
TNRKMVLFQ

SEQ ID NO: 790945 - protein, 9 aa, Homo Sapiens
ASKPNSTVL

SEQ ID NO: 790946 - protein, 9 aa, Homo Sapiens
AVGQLGCAR

SEQ ID NO: 790947 - protein, 9 aa, Homo Sapiens
QVQLEQDEY

SEQ ID NO: 790948 - protein, 9 aa, Homo Sapiens
ASTGYVIAI

SEQ ID NO: 790949 - protein, 9 aa, Homo Sapiens
KMRVTCVIT

SEQ ID NO: 790950 - protein, 9 aa, Homo Sapiens
SVQRNGELF

SEQ ID NO: 790951 - protein, 9 aa, Homo Sapiens
KPAHAPHMA

SEQ ID NO: 790952 - protein, 9 aa, Homo Sapiens
ACTSRSGVT

SEQ ID NO: 790953 - protein, 9 aa, Homo Sapiens
HPQGVRFRL

SEQ ID NO: 790954 - protein, 9 aa, Homo Sapiens
QGPSCSFPH

SEQ ID NO: 790955 - protein, 9 aa, Homo Sapiens
SVPSYCQPI

SEQ ID NO: 790956 - protein, 9 aa, Homo Sapiens
AQQGHRQSS

SEQ ID NO: 790957 - protein, 9 aa, Homo Sapiens
VFASTGYVI

SEQ ID NO: 790958 - protein, 9 aa, Homo Sapiens
MPTTERVTF

SEQ ID NO: 790959 - protein, 9 aa, Homo Sapiens
QRNGELFYL

SEQ ID NO: 790960 - protein, 9 aa, Homo Sapiens
QGVRFRLCK

SEQ ID NO: 790961 - protein, 9 aa, Homo Sapiens
IQTYIPCFM

SEQ ID NO: 790962 - protein, 9 aa, Homo Sapiens
FMTPRVCEE

SEQ ID NO: 790963 - protein, 9 aa, Homo Sapiens
IVYVPCGHL

SEQ ID NO: 790964 - protein, 9 aa, Homo Sapiens
FMTVILSQV

SEQ ID NO: 790965 - protein, 9 aa, Homo Sapiens
SNRPRSKIA

SEQ ID NO: 790966 - protein, 9 aa, Homo Sapiens
KRIFIGPTL

SEQ ID NO: 790967 - protein, 9 aa, Homo Sapiens
PNSTVLKGE

SEQ ID NO: 790968 - protein, 9 aa, Homo Sapiens
APKGNWIEE

SEQ ID NO: 790969 - protein, 9 aa, Homo Sapiens
YAPKGNWIE

SEQ ID NO: 790970 - protein, 9 aa, Homo Sapiens
NPDLYHSQG

SEQ ID NO: 790971 - protein, 9 aa, Homo Sapiens
GKALKQSST

SEQ ID NO: 790972 - protein, 9 aa, Homo Sapiens
YVPCGHLVT

SEQ ID NO: 790973 - protein, 9 aa, Homo Sapiens
DSVQRNGEL

SEQ ID NO: 790974 - protein, 9 aa, Homo Sapiens
YKLTPHPAT

SEQ ID NO: 790975 - protein, 9 aa, Homo Sapiens
DCFALKPVS

SEQ ID NO: 790976 - protein, 9 aa, Homo Sapiens
VIGARKTQY

SEQ ID NO: 790977 - protein, 9 aa, Homo Sapiens
TPWDPCPAS

SEQ ID NO: 790978 - protein, 9 aa, Homo Sapiens
YIPCFMTVI

SEQ ID NO: 790979 - protein, 9 aa, Homo Sapiens
NLDSSRKNF

SEQ ID NO: 790980 - protein, 9 aa, Homo Sapiens
TVLKGEAKP

SEQ ID NO: 790981 - protein, 9 aa, Homo Sapiens
RVTCVITQG

SEQ ID NO: 790982 - protein, 9 aa, Homo Sapiens
CDACTSRSG

SEQ ID NO: 790983 - protein, 9 aa, Homo Sapiens
SVESYPVLE

SEQ ID NO: 790984 - protein, 9 aa, Homo Sapiens
LAINGSNRP

SEQ ID NO: 790985 - protein, 9 aa, Homo Sapiens
CTSRSGVTC

SEQ ID NO: 790986 - protein, 9 aa, Homo Sapiens
IAWVNDIVY

SEQ ID NO: 790987 - protein, 9 aa, Homo Sapiens
VCEELLRHQ

SEQ ID NO: 790988 - protein, 9 aa, Homo Sapiens
RLKLILLGV

SEQ ID NO: 790989 - protein, 9 aa, Homo Sapiens
VLPLSADCF

SEQ ID NO: 790990 - protein, 9 aa, Homo Sapiens
HINPQKDTT

SEQ ID NO: 790991 - protein, 9 aa, Homo Sapiens
SIDRSRLPK

SEQ ID NO: 790992 - protein, 9 aa, Homo Sapiens
FASTGYVIA

SEQ ID NO: 790993 - protein, 9 aa, Homo Sapiens
AICPPLHCS

SEQ ID NO: 790994 - protein, 9 aa, Homo Sapiens
LSADCFALK

SEQ ID NO: 790995 - protein, 9 aa, Homo Sapiens
AKRQELEEM

SEQ ID NO: 790996 - protein, 9 aa, Homo Sapiens
RLCKCIMTF

SEQ ID NO: 790997 - protein, 9 aa, Homo Sapiens
FIIRVWAGE

SEQ ID NO: 790998 - protein, 9 aa, Homo Sapiens
EWADTPWDP

SEQ ID NO: 790999 - protein, 9 aa, Homo Sapiens
IALRKLCTA

SEQ ID NO: 791000 - protein, 9 aa, Homo Sapiens
KAISEGYKD

SEQ ID NO: 791001 - protein, 9 aa, Homo Sapiens
KTQYDIWGN

SEQ ID NO: 791002 - protein, 9 aa, Homo Sapiens
EECPVKDGL

SEQ ID NO: 791003 - protein, 9 aa, Homo Sapiens
LKQSSTLTT

SEQ ID NO: 791004 - protein, 9 aa, Homo Sapiens
GNPDLYHSQ

SEQ ID NO: 791005 - protein, 9 aa, Homo Sapiens
IRVWAGERV

SEQ ID NO: 791006 - protein, 9 aa, Homo Sapiens
HGNPDLYHS

SEQ ID NO: 791007 - protein, 9 aa, Homo Sapiens
TFTRCFYLF

SEQ ID NO: 791008 - protein, 9 aa, Homo Sapiens
QDEYAKHIK

SEQ ID NO: 791009 - protein, 9 aa, Homo Sapiens
PPLHCSTVM

SEQ ID NO: 791010 - protein, 9 aa, Homo Sapiens
EEQMTNRKM

SEQ ID NO: 791011 - protein, 9 aa, Homo Sapiens
IEEQMTNRK

SEQ ID NO: 791012 - protein, 9 aa, Homo Sapiens
WADTPWDPC

SEQ ID NO: 791013 - protein, 9 aa, Homo Sapiens
GDKQISASP

SEQ ID NO: 791014 - protein, 9 aa, Homo Sapiens
GLVTWDTAL

SEQ ID NO: 791015 - protein, 9 aa, Homo Sapiens
AALGLCVLP

SEQ ID NO: 791016 - protein, 9 aa, Homo Sapiens
FQRYLQCIL

SEQ ID NO: 791017 - protein, 9 aa, Homo Sapiens
TDSHFPYNL

SEQ ID NO: 791018 - protein, 9 aa, Homo Sapiens
GVPYPSSIN

SEQ ID NO: 791019 - protein, 9 aa, Homo Sapiens
GFGMGFQRY

SEQ ID NO: 791020 - protein, 9 aa, Homo Sapiens
DKYVSFARK

SEQ ID NO: 791021 - protein, 9 aa, Homo Sapiens
PTDSHFPYN

SEQ ID NO: 791022 - protein, 9 aa, Homo Sapiens
QGLPFSTED

SEQ ID NO: 791023 - protein, 9 aa, Homo Sapiens
SQESDGKFR

SEQ ID NO: 791024 - protein, 9 aa, Homo Sapiens
HDVLLGSSI

SEQ ID NO: 791025 - protein, 9 aa, Homo Sapiens
NAGVTQRAS

SEQ ID NO: 791026 - protein, 9 aa, Homo Sapiens
TKPTNDRYG

SEQ ID NO: 791027 - protein, 9 aa, Homo Sapiens
DKMPPLWKK

SEQ ID NO: 791028 - protein, 9 aa, Homo Sapiens
TQRASDPAQ

SEQ ID NO: 791029 - protein, 9 aa, Homo Sapiens
VSEEIEFKD

SEQ ID NO: 791030 - protein, 9 aa, Homo Sapiens
KKSDGRGDK

SEQ ID NO: 791031 - protein, 9 aa, Homo Sapiens
RDDLEKKMA

SEQ ID NO: 791032 - protein, 9 aa, Homo Sapiens
AFNDQFIKI

SEQ ID NO: 791033 - protein, 9 aa, Homo Sapiens
ANSAPAPKK

SEQ ID NO: 791034 - protein, 9 aa, Homo Sapiens
WDTALYLAE

SEQ ID NO: 791035 - protein, 9 aa, Homo Sapiens
HGGFGMGFQ

SEQ ID NO: 791036 - protein, 9 aa, Homo Sapiens
SEEIEFKDG

SEQ ID NO: 791037 - protein, 9 aa, Homo Sapiens
VTQRASDPA

SEQ ID NO: 791038 - protein, 9 aa, Homo Sapiens
SPWLGWGRG

SEQ ID NO: 791039 - protein, 9 aa, Homo Sapiens
RWGRATSGY

SEQ ID NO: 791040 - protein, 9 aa, Homo Sapiens
DLRRTEPFL

SEQ ID NO: 791041 - protein, 9 aa, Homo Sapiens
ERISAWQSL

SEQ ID NO: 791042 - protein, 9 aa, Homo Sapiens
GQGREGGPY

SEQ ID NO: 791043 - protein, 9 aa, Homo Sapiens
VEPYNATHS

SEQ ID NO: 791044 - protein, 9 aa, Homo Sapiens
RISAWQSLV

SEQ ID NO: 791045 - protein, 9 aa, Homo Sapiens
RPSEDERVA

SEQ ID NO: 791046 - protein, 9 aa, Homo Sapiens
GITVVKAVR

SEQ ID NO: 791047 - protein, 9 aa, Homo Sapiens
SYMSLTLPA

SEQ ID NO: 791048 - protein, 9 aa, Homo Sapiens
DAKLNTSSS

SEQ ID NO: 791049 - protein, 9 aa, Homo Sapiens
NATHSVHQL

SEQ ID NO: 791050 - protein, 9 aa, Homo Sapiens
DESRLEEWL

SEQ ID NO: 791051 - protein, 9 aa, Homo Sapiens
SLVLDDRSL

SEQ ID NO: 791052 - protein, 9 aa, Homo Sapiens
LPCFVNLAP

SEQ ID NO: 791053 - protein, 9 aa, Homo Sapiens
THRNLQWAH

SEQ ID NO: 791054 - protein, 9 aa, Homo Sapiens
DACSWSTGM

SEQ ID NO: 791055 - protein, 9 aa, Homo Sapiens
THSVHQLIE

SEQ ID NO: 791056 - protein, 9 aa, Homo Sapiens
VRLSTGGEA

SEQ ID NO: 791057 - protein, 9 aa, Homo Sapiens
EPFLESPLQ

SEQ ID NO: 791058 - protein, 9 aa, Homo Sapiens
QEALRPIIS

SEQ ID NO: 791059 - protein, 9 aa, Homo Sapiens
KRYKLRDDL

SEQ ID NO: 791060 - protein, 9 aa, Homo Sapiens
EDDKMPPLW

SEQ ID NO: 791061 - protein, 9 aa, Homo Sapiens
ATHSVHQLI

SEQ ID NO: 791062 - protein, 9 aa, Homo Sapiens
LRRTEPFLE

SEQ ID NO: 791063 - protein, 9 aa, Homo Sapiens
TSSSLAVCA

SEQ ID NO: 791064 - protein, 9 aa, Homo Sapiens
GPTCALSPG

SEQ ID NO: 791065 - protein, 9 aa, Homo Sapiens
WSTKPTNDR

SEQ ID NO: 791066 - protein, 9 aa, Homo Sapiens
TSFHGPTCA

SEQ ID NO: 791067 - protein, 9 aa, Homo Sapiens
PGRWGRATS

SEQ ID NO: 791068 - protein, 9 aa, Homo Sapiens
FDESRLEEW

SEQ ID NO: 791069 - protein, 9 aa, Homo Sapiens
GGPYLGSSG

SEQ ID NO: 791070 - protein, 9 aa, Homo Sapiens
LQWAHDVLL

SEQ ID NO: 791071 - protein, 9 aa, Homo Sapiens
MATVSKTIV

SEQ ID NO: 791072 - protein, 9 aa, Homo Sapiens
SPKTRKKLL

SEQ ID NO: 791073 - protein, 9 aa, Homo Sapiens
MGFQRYLQC

SEQ ID NO: 791074 - protein, 9 aa, Homo Sapiens
EGGPYLGSS

SEQ ID NO: 791075 - protein, 9 aa, Homo Sapiens
NLLLRKDAC

SEQ ID NO: 791076 - protein, 9 aa, Homo Sapiens
YMRHLGVQT

SEQ ID NO: 791077 - protein, 9 aa, Homo Sapiens
ISPCLPNEG

SEQ ID NO: 791078 - protein, 9 aa, Homo Sapiens
YHQGLPFST

SEQ ID NO: 791079 - protein, 9 aa, Homo Sapiens
ITVVKAVRF

SEQ ID NO: 791080 - protein, 9 aa, Homo Sapiens
KPEPVIRRN

SEQ ID NO: 791081 - protein, 9 aa, Homo Sapiens
GDKYVSFAR

SEQ ID NO: 791082 - protein, 9 aa, Homo Sapiens
PTCALSPGR

SEQ ID NO: 791083 - protein, 9 aa, Homo Sapiens
TSYMSLTLP

SEQ ID NO: 791084 - protein, 9 aa, Homo Sapiens
LTLPALDWQ

SEQ ID NO: 791085 - protein, 9 aa, Homo Sapiens
AGVPYPSSI

SEQ ID NO: 791086 - protein, 9 aa, Homo Sapiens
SGVYPEQLR

SEQ ID NO: 791087 - protein, 9 aa, Homo Sapiens
WQSLVLDDR

SEQ ID NO: 791088 - protein, 9 aa, Homo Sapiens
RYGLFAVVM

SEQ ID NO: 791089 - protein, 9 aa, Homo Sapiens
MSLTLPALD

SEQ ID NO: 791090 - protein, 9 aa, Homo Sapiens
ALSPGRWGR

SEQ ID NO: 791091 - protein, 9 aa, Homo Sapiens
LRPSEDERV

SEQ ID NO: 791092 - protein, 9 aa, Homo Sapiens
GFQRYLQCI

SEQ ID NO: 791093 - protein, 9 aa, Homo Sapiens
ACSWSTGMQ

SEQ ID NO: 791094 - protein, 9 aa, Homo Sapiens
CALSPGRWG

SEQ ID NO: 791095 - protein, 9 aa, Homo Sapiens
SDGRGDKQI

SEQ ID NO: 791096 - protein, 9 aa, Homo Sapiens
PWLGWGRGP

SEQ ID NO: 791097 - protein, 9 aa, Homo Sapiens
QTMLAGVPY

SEQ ID NO: 791098 - protein, 9 aa, Homo Sapiens
LSYHQGLPF

SEQ ID NO: 791099 - protein, 9 aa, Homo Sapiens
EKPEPVIRR

SEQ ID NO: 791100 - protein, 9 aa, Homo Sapiens
PTNDRYGLF

SEQ ID NO: 791101 - protein, 9 aa, Homo Sapiens
LLLRKDACS

SEQ ID NO: 791102 - protein, 9 aa, Homo Sapiens
FKDGETQHV

SEQ ID NO: 791103 - protein, 9 aa, Homo Sapiens
PFLESPLQR

SEQ ID NO: 791104 - protein, 9 aa, Homo Sapiens
VLPCFVNLA

SEQ ID NO: 791105 - protein, 9 aa, Homo Sapiens
TNDRYGLFA

SEQ ID NO: 791106 - protein, 9 aa, Homo Sapiens
LWKKQRGLL

SEQ ID NO: 791107 - protein, 9 aa, Homo Sapiens
RHLGVQTKS

SEQ ID NO: 791108 - protein, 9 aa, Homo Sapiens
YARSVVPQL

SEQ ID NO: 791109 - protein, 9 aa, Homo Sapiens
VDVSYARSV

SEQ ID NO: 791110 - protein, 9 aa, Homo Sapiens
VLMATVSKT

SEQ ID NO: 791111 - protein, 9 aa, Homo Sapiens
LVTWDTALY

SEQ ID NO: 791112 - protein, 9 aa, Homo Sapiens
MPPLWKKQR

SEQ ID NO: 791113 - protein, 9 aa, Homo Sapiens
PIISPCLPN

SEQ ID NO: 791114 - protein, 9 aa, Homo Sapiens
RVRLSTGGE

SEQ ID NO: 791115 - protein, 9 aa, Homo Sapiens
TVVKAVRFH

SEQ ID NO: 791116 - protein, 9 aa, Homo Sapiens
QGREGGPYL

SEQ ID NO: 791117 - protein, 9 aa, Homo Sapiens
AHDVLLGSS

SEQ ID NO: 791118 - protein, 9 aa, Homo Sapiens
IKISTRLPS

SEQ ID NO: 791119 - protein, 9 aa, Homo Sapiens
KAVRFHTSF

SEQ ID NO: 791120 - protein, 9 aa, Homo Sapiens
YVSFARKWM

SEQ ID NO: 791121 - protein, 9 aa, Homo Sapiens
TGLVTWDTA

SEQ ID NO: 791122 - protein, 9 aa, Homo Sapiens
VRFHTSFHG

SEQ ID NO: 791123 - protein, 9 aa, Homo Sapiens
ALRPIISPC

SEQ ID NO: 791124 - protein, 9 aa, Homo Sapiens
PYLGSSGPQ

SEQ ID NO: 791125 - protein, 9 aa, Homo Sapiens
VQTKSGDKK

SEQ ID NO: 791126 - protein, 9 aa, Homo Sapiens
GQYLRPSED

SEQ ID NO: 791127 - protein, 9 aa, Homo Sapiens
MPEPANSAP

SEQ ID NO: 791128 - protein, 9 aa, Homo Sapiens
AALASAWGA

SEQ ID NO: 791129 - protein, 9 aa, Homo Sapiens
QAGQAVARE

SEQ ID NO: 791130 - protein, 9 aa, Homo Sapiens
DQFIKISTR

SEQ ID NO: 791131 - protein, 9 aa, Homo Sapiens
AGVTQRASD

SEQ ID NO: 791132 - protein, 9 aa, Homo Sapiens
DSHFPYNLH

SEQ ID NO: 791133 - protein, 9 aa, Homo Sapiens
SSFTHAFDE

SEQ ID NO: 791134 - protein, 9 aa, Homo Sapiens
KDGETQHVV

SEQ ID NO: 791135 - protein, 9 aa, Homo Sapiens
GMGFQRYLQ

SEQ ID NO: 791136 - protein, 9 aa, Homo Sapiens
GVYPEQLRW

SEQ ID NO: 791137 - protein, 9 aa, Homo Sapiens
LASAWGALV

SEQ ID NO: 791138 - protein, 9 aa, Homo Sapiens
PYNATHSVH

SEQ ID NO: 791139 - protein, 9 aa, Homo Sapiens
GGFGMGFQR

SEQ ID NO: 791140 - protein, 9 aa, Homo Sapiens
GVTQRASDP

SEQ ID NO: 791141 - protein, 9 aa, Homo Sapiens
LGLCVLPCF

SEQ ID NO: 791142 - protein, 9 aa, Homo Sapiens
QQAGQAVAR

SEQ ID NO: 791143 - protein, 9 aa, Homo Sapiens
LRSQESDGK

SEQ ID NO: 791144 - protein, 9 aa, Homo Sapiens
ESDGKFREE

SEQ ID NO: 791145 - protein, 9 aa, Homo Sapiens
EFKDGETQH

SEQ ID NO: 791146 - protein, 9 aa, Homo Sapiens
AKLNTSSSL

SEQ ID NO: 791147 - protein, 9 aa, Homo Sapiens
PKTRKKLLP

SEQ ID NO: 791148 - protein, 9 aa, Homo Sapiens
PTSYMSLTL

SEQ ID NO: 791149 - protein, 9 aa, Homo Sapiens
FSSGVYPEQ

SEQ ID NO: 791150 - protein, 9 aa, Homo Sapiens
YNPNAGVTQ

SEQ ID NO: 791151 - protein, 9 aa, Homo Sapiens
PLWKKQRGL

SEQ ID NO: 791152 - protein, 9 aa, Homo Sapiens
AGQAVAREY

SEQ ID NO: 791153 - protein, 9 aa, Homo Sapiens
FLESPLQRT

SEQ ID NO: 791154 - protein, 9 aa, Homo Sapiens
FIKISTRLP

SEQ ID NO: 791155 - protein, 9 aa, Homo Sapiens
NDQFIKIST

SEQ ID NO: 791156 - protein, 9 aa, Homo Sapiens
DGETQHVVE

SEQ ID NO: 791157 - protein, 9 aa, Homo Sapiens
EIEFKDGET

SEQ ID NO: 791158 - protein, 9 aa, Homo Sapiens
DGRGDKQIS

SEQ ID NO: 791159 - protein, 9 aa, Homo Sapiens
PAALASAWG

SEQ ID NO: 791160 - protein, 9 aa, Homo Sapiens
GKFREEEQL

SEQ ID NO: 791161 - protein, 9 aa, Homo Sapiens
GLCVLPCFV

SEQ ID NO: 791162 - protein, 9 aa, Homo Sapiens
NTSSSLAVC

SEQ ID NO: 791163 - protein, 9 aa, Homo Sapiens
ESRLEEWLS

SEQ ID NO: 791164 - protein, 9 aa, Homo Sapiens
QFIKISTRL

SEQ ID NO: 791165 - protein, 9 aa, Homo Sapiens
SPTSYMSLT

SEQ ID NO: 791166 - protein, 9 aa, Homo Sapiens
NLHLRSQSL

SEQ ID NO: 791167 - protein, 9 aa, Homo Sapiens
KMPPLWKKQ

SEQ ID NO: 791168 - protein, 9 aa, Homo Sapiens
HKKSDGRGD

SEQ ID NO: 791169 - protein, 9 aa, Homo Sapiens
EPANSAPAP

SEQ ID NO: 791170 - protein, 9 aa, Homo Sapiens
HSVHQLIEN

SEQ ID NO: 791171 - protein, 9 aa, Homo Sapiens
TEPFLESPL

SEQ ID NO: 791172 - protein, 9 aa, Homo Sapiens
NDRYGLFAV

SEQ ID NO: 791173 - protein, 9 aa, Homo Sapiens
VVKAVRFHT

SEQ ID NO: 791174 - protein, 9 aa, Homo Sapiens
LYMRHLGVQ

SEQ ID NO: 791175 - protein, 9 aa, Homo Sapiens
QRASDPAQA

SEQ ID NO: 791176 - protein, 9 aa, Homo Sapiens
DLSKSPKTR

SEQ ID NO: 791177 - protein, 9 aa, Homo Sapiens
TWDTALYLA

SEQ ID NO: 791178 - protein, 9 aa, Homo Sapiens
DVSYARSVV

SEQ ID NO: 791179 - protein, 9 aa, Homo Sapiens
WAHDVLLGS

SEQ ID NO: 791180 - protein, 9 aa, Homo Sapiens
EAPDLAHGG

SEQ ID NO: 791181 - protein, 9 aa, Homo Sapiens
TRKKLLPKR

SEQ ID NO: 791182 - protein, 9 aa, Homo Sapiens
LNTSSSLAV

SEQ ID NO: 791183 - protein, 9 aa, Homo Sapiens
AFDESRLEE

SEQ ID NO: 791184 - protein, 9 aa, Homo Sapiens
TALYLAEWA

SEQ ID NO: 791185 - protein, 9 aa, Homo Sapiens
PEPANSAPA

SEQ ID NO: 791186 - protein, 9 aa, Homo Sapiens
EEKPEPVIR

SEQ ID NO: 791187 - protein, 9 aa, Homo Sapiens
SKSPKTRKK

SEQ ID NO: 791188 - protein, 9 aa, Homo Sapiens
ARSVVPQLL

SEQ ID NO: 791189 - protein, 9 aa, Homo Sapiens
FPYNLHLRS

SEQ ID NO: 791190 - protein, 9 aa, Homo Sapiens
KDAKLNTSS

SEQ ID NO: 791191 - protein, 9 aa, Homo Sapiens
SFTHAFDES

SEQ ID NO: 791192 - protein, 9 aa, Homo Sapiens
VSFARKWMN

SEQ ID NO: 791193 - protein, 9 aa, Homo Sapiens
AWQSLVLDD

SEQ ID NO: 791194 - protein, 9 aa, Homo Sapiens
LSPTSYMSL

SEQ ID NO: 791195 - protein, 9 aa, Homo Sapiens
GSPWLGWGR

SEQ ID NO: 791196 - protein, 9 aa, Homo Sapiens
LCVLPCFVN

SEQ ID NO: 791197 - protein, 9 aa, Homo Sapiens
QLRSQESDG

SEQ ID NO: 791198 - protein, 9 aa, Homo Sapiens
EALRPIISP

SEQ ID NO: 791199 - protein, 9 aa, Homo Sapiens
LRDDLEKKM

SEQ ID NO: 791200 - protein, 9 aa, Homo Sapiens
HPAALASAW

SEQ ID NO: 791201 - protein, 9 aa, Homo Sapiens
FNDQFIKIS

SEQ ID NO: 791202 - protein, 9 aa, Homo Sapiens
GHPAALASA

SEQ ID NO: 791203 - protein, 9 aa, Homo Sapiens
PCFVNLAPL

SEQ ID NO: 791204 - protein, 9 aa, Homo Sapiens
GEAVCFIPG

SEQ ID NO: 791205 - protein, 9 aa, Homo Sapiens
SPGRWGRAT

SEQ ID NO: 791206 - protein, 9 aa, Homo Sapiens
RFHTSFHGP

SEQ ID NO: 791207 - protein, 9 aa, Homo Sapiens
NPNAGVTQR

SEQ ID NO: 791208 - protein, 9 aa, Homo Sapiens
MRHLGVQTK

SEQ ID NO: 791209 - protein, 9 aa, Homo Sapiens
VVEPYNATH

SEQ ID NO: 791210 - protein, 9 aa, Homo Sapiens
DDKMPPLWK

SEQ ID NO: 791211 - protein, 9 aa, Homo Sapiens
YLRPSEDER

SEQ ID NO: 791212 - protein, 9 aa, Homo Sapiens
KLRDDLEKK

SEQ ID NO: 791213 - protein, 9 aa, Homo Sapiens
LLRKDACSW

SEQ ID NO: 791214 - protein, 9 aa, Homo Sapiens
LHKKSDGRG

SEQ ID NO: 791215 - protein, 9 aa, Homo Sapiens
DGKFREEEQ

SEQ ID NO: 791216 - protein, 9 aa, Homo Sapiens
RRTEPFLES

SEQ ID NO: 791217 - protein, 9 aa, Homo Sapiens
LSTGGEAVC

SEQ ID NO: 791218 - protein, 9 aa, Homo Sapiens
WLGWGRGPQ

SEQ ID NO: 791219 - protein, 9 aa, Homo Sapiens
LVLDDRSLP

SEQ ID NO: 791220 - protein, 9 aa, Homo Sapiens
FGMGFQRYL

SEQ ID NO: 791221 - protein, 9 aa, Homo Sapiens
LGWGRGPQV

SEQ ID NO: 791222 - protein, 9 aa, Homo Sapiens
REYSCEAGS

SEQ ID NO: 791223 - protein, 9 aa, Homo Sapiens
FAFNDQFIK

SEQ ID NO: 791224 - protein, 9 aa, Homo Sapiens
PYNLHLRSQ

SEQ ID NO: 791225 - protein, 9 aa, Homo Sapiens
KIGDKYVSF

SEQ ID NO: 791226 - protein, 9 aa, Homo Sapiens
RSQESDGKF

SEQ ID NO: 791227 - protein, 9 aa, Homo Sapiens
AREYSCEAG

SEQ ID NO: 791228 - protein, 9 aa, Homo Sapiens
IISPCLPNE

SEQ ID NO: 791229 - protein, 9 aa, Homo Sapiens
GPYLGSSGP

SEQ ID NO: 791230 - protein, 9 aa, Homo Sapiens
RGDKQISAS

SEQ ID NO: 791231 - protein, 9 aa, Homo Sapiens
YNLHLRSQS

SEQ ID NO: 791232 - protein, 9 aa, Homo Sapiens
SAWQSLVLD

SEQ ID NO: 791233 - protein, 9 aa, Homo Sapiens
RNLQWAHDV

SEQ ID NO: 791234 - protein, 9 aa, Homo Sapiens
PNAGVTQRA

SEQ ID NO: 791235 - protein, 9 aa, Homo Sapiens
QSLVLDDRS

SEQ ID NO: 791236 - protein, 9 aa, Homo Sapiens
LAGVPYPSS

SEQ ID NO: 791237 - protein, 9 aa, Homo Sapiens
RQKIGDKYV

SEQ ID NO: 791238 - protein, 9 aa, Homo Sapiens
AVRFHTSFH

SEQ ID NO: 791239 - protein, 9 aa, Homo Sapiens
MLAGVPYPS

SEQ ID NO: 791240 - protein, 9 aa, Homo Sapiens
LMATVSKTI

SEQ ID NO: 791241 - protein, 9 aa, Homo Sapiens
IGDKYVSFA

SEQ ID NO: 791242 - protein, 9 aa, Homo Sapiens
SKTIVLIPF

SEQ ID NO: 791243 - protein, 9 aa, Homo Sapiens
SQTMLAGVP

SEQ ID NO: 791244 - protein, 9 aa, Homo Sapiens
FQEALRPII

SEQ ID NO: 791245 - protein, 9 aa, Homo Sapiens
DSLSYHQGL

SEQ ID NO: 791246 - protein, 9 aa, Homo Sapiens
EPYNATHSV

SEQ ID NO: 791247 - protein, 9 aa, Homo Sapiens
GRGDKQISA

SEQ ID NO: 791248 - protein, 9 aa, Homo Sapiens
VPYPSSINL

SEQ ID NO: 791249 - protein, 9 aa, Homo Sapiens
QGSPWLGWG

SEQ ID NO: 791250 - protein, 9 aa, Homo Sapiens
PDLRRTEPF

SEQ ID NO: 791251 - protein, 9 aa, Homo Sapiens
LEKKMADFH

SEQ ID NO: 791252 - protein, 9 aa, Homo Sapiens
SYHQGLPFS

SEQ ID NO: 791253 - protein, 9 aa, Homo Sapiens
VAREYSCEA

SEQ ID NO: 791254 - protein, 9 aa, Homo Sapiens
TGGEAVCFI

SEQ ID NO: 791255 - protein, 9 aa, Homo Sapiens
SGITVVKAV

SEQ ID NO: 791256 - protein, 9 aa, Homo Sapiens
IEFKDGETQ

SEQ ID NO: 791257 - protein, 9 aa, Homo Sapiens
RGHPAALAS

SEQ ID NO: 791258 - protein, 9 aa, Homo Sapiens
YMSLTLPAL

SEQ ID NO: 791259 - protein, 9 aa, Homo Sapiens
GGEAVCFIP

SEQ ID NO: 791260 - protein, 9 aa, Homo Sapiens
KTRKKLLPK

SEQ ID NO: 791261 - protein, 9 aa, Homo Sapiens
LPFSTEDRD

SEQ ID NO: 791262 - protein, 9 aa, Homo Sapiens
THAFDESRL

SEQ ID NO: 791263 - protein, 9 aa, Homo Sapiens
STGGEAVCF

SEQ ID NO: 791264 - protein, 9 aa, Homo Sapiens
HGPTCALSP

SEQ ID NO: 791265 - protein, 9 aa, Homo Sapiens
SAWGALVIS

SEQ ID NO: 791266 - protein, 9 aa, Homo Sapiens
LRPIISPCL

SEQ ID NO: 791267 - protein, 9 aa, Homo Sapiens
FTHAFDESR

SEQ ID NO: 791268 - protein, 9 aa, Homo Sapiens
PYPSSINLT

SEQ ID NO: 791269 - protein, 9 aa, Homo Sapiens
NSAPAPKKG

SEQ ID NO: 791270 - protein, 9 aa, Homo Sapiens
ALASAWGAL

SEQ ID NO: 791271 - protein, 9 aa, Homo Sapiens
VSKTIVLIP

SEQ ID NO: 791272 - protein, 9 aa, Homo Sapiens
HAFDESRLE

SEQ ID NO: 791273 - protein, 9 aa, Homo Sapiens
PEPVIRRNC

SEQ ID NO: 791274 - protein, 9 aa, Homo Sapiens
ATVSKTIVL

SEQ ID NO: 791275 - protein, 9 aa, Homo Sapiens
RPIISPCLP

SEQ ID NO: 791276 - protein, 9 aa, Homo Sapiens
PTSQGSPWL

SEQ ID NO: 791277 - protein, 9 aa, Homo Sapiens
LVDVSYARS

SEQ ID NO: 791278 - protein, 9 aa, Homo Sapiens
LSPGRWGRA

SEQ ID NO: 791279 - protein, 9 aa, Homo Sapiens
KSPKTRKKL

SEQ ID NO: 791280 - protein, 9 aa, Homo Sapiens
YKLRDDLEK

SEQ ID NO: 791281 - protein, 9 aa, Homo Sapiens
CIVLMATVS

SEQ ID NO: 791282 - protein, 9 aa, Homo Sapiens
ASAWGALVI

SEQ ID NO: 791283 - protein, 9 aa, Homo Sapiens
NNLLLRKDA

SEQ ID NO: 791284 - protein, 9 aa, Homo Sapiens
LRKDACSWS

SEQ ID NO: 791285 - protein, 9 aa, Homo Sapiens
QWAHDVLLG

SEQ ID NO: 791286 - protein, 9 aa, Homo Sapiens
KISTRLPSE

SEQ ID NO: 791287 - protein, 9 aa, Homo Sapiens
YLGSSGPQF

SEQ ID NO: 791288 - protein, 9 aa, Homo Sapiens
KLNTSSSLA

SEQ ID NO: 791289 - protein, 9 aa, Homo Sapiens
CVLPCFVNL

SEQ ID NO: 791290 - protein, 9 aa, Homo Sapiens
EGQYLRPSE

SEQ ID NO: 791291 - protein, 9 aa, Homo Sapiens
TCALSPGRW

SEQ ID NO: 791292 - protein, 9 aa, Homo Sapiens
REGGPYLGS

SEQ ID NO: 791293 - protein, 9 aa, Homo Sapiens
SQGSPWLGW

SEQ ID NO: 791294 - protein, 9 aa, Homo Sapiens
SYARSVVPQ

SEQ ID NO: 791295 - protein, 9 aa, Homo Sapiens
QAVAREYSC

SEQ ID NO: 791296 - protein, 9 aa, Homo Sapiens
LGVQTKSGD

SEQ ID NO: 791297 - protein, 9 aa, Homo Sapiens
ISAWQSLVL

SEQ ID NO: 791298 - protein, 9 aa, Homo Sapiens
GQAVAREYS

SEQ ID NO: 791299 - protein, 9 aa, Homo Sapiens
VYPEQLRWL

SEQ ID NO: 791300 - protein, 9 aa, Homo Sapiens
SFHGPTCAL

SEQ ID NO: 791301 - protein, 9 aa, Homo Sapiens
FHTSFHGPT

SEQ ID NO: 791302 - protein, 9 aa, Homo Sapiens
VSYARSVVP

SEQ ID NO: 791303 - protein, 9 aa, Homo Sapiens
RYKLRDDLE

SEQ ID NO: 791304 - protein, 9 aa, Homo Sapiens
KPTNDRYGL

SEQ ID NO: 791305 - protein, 9 aa, Homo Sapiens
QTKSGDKKS

SEQ ID NO: 791306 - protein, 9 aa, Homo Sapiens
ALGLCVLPC

SEQ ID NO: 791307 - protein, 9 aa, Homo Sapiens
DRYGLFAVV

SEQ ID NO: 791308 - protein, 9 aa, Homo Sapiens
QEEKPEPVI

SEQ ID NO: 791309 - protein, 9 aa, Homo Sapiens
HLGVQTKSG

SEQ ID NO: 791310 - protein, 9 aa, Homo Sapiens
WGRATSGYL

SEQ ID NO: 791311 - protein, 9 aa, Homo Sapiens
TMLAGVPYP

SEQ ID NO: 791312 - protein, 9 aa, Homo Sapiens
VKAVRFHTS

SEQ ID NO: 791313 - protein, 9 aa, Homo Sapiens
QRYLQCILG

SEQ ID NO: 791314 - protein, 9 aa, Homo Sapiens
SSSLAVCAD

SEQ ID NO: 791315 - protein, 9 aa, Homo Sapiens
AKDAKLNTS

SEQ ID NO: 791316 - protein, 9 aa, Homo Sapiens
TTGLVTWDT

SEQ ID NO: 791317 - protein, 9 aa, Homo Sapiens
HFPYNLHLR

SEQ ID NO: 791318 - protein, 9 aa, Homo Sapiens
HTSFHGPTC

SEQ ID NO: 791319 - protein, 9 aa, Homo Sapiens
RKDACSWST

SEQ ID NO: 791320 - protein, 9 aa, Homo Sapiens
GRWGRATSG

SEQ ID NO: 791321 - protein, 9 aa, Homo Sapiens
PEGQYLRPS

SEQ ID NO: 791322 - protein, 9 aa, Homo Sapiens
GVQTKSGDK

SEQ ID NO: 791323 - protein, 9 aa, Homo Sapiens
RSVVPQLLA

SEQ ID NO: 791324 - protein, 9 aa, Homo Sapiens
DLEKKMADF

SEQ ID NO: 791325 - protein, 9 aa, Homo Sapiens
NLQWAHDVL

SEQ ID NO: 791326 - protein, 9 aa, Homo Sapiens
LSKSPKTRK

SEQ ID NO: 791327 - protein, 9 aa, Homo Sapiens
GREGGPYLG

SEQ ID NO: 791328 - protein, 9 aa, Homo Sapiens
KYVSFARKW

SEQ ID NO: 791329 - protein, 9 aa, Homo Sapiens
TSQGSPWLG

SEQ ID NO: 791330 - protein, 9 aa, Homo Sapiens
CRVRLSTGG

SEQ ID NO: 791331 - protein, 9 aa, Homo Sapiens
YNATHSVHQ

SEQ ID NO: 791332 - protein, 9 aa, Homo Sapiens
QKIGDKYVS

SEQ ID NO: 791333 - protein, 9 aa, Homo Sapiens
SLVDVSYAR

SEQ ID NO: 791334 - protein, 9 aa, Homo Sapiens
MEAPDLAHG

SEQ ID NO: 791335 - protein, 9 aa, Homo Sapiens
GLPFSTEDR

SEQ ID NO: 791336 - protein, 9 aa, Homo Sapiens
RLSTGGEAV

SEQ ID NO: 791337 - protein, 9 aa, Homo Sapiens
DTALYLAEW

SEQ ID NO: 791338 - protein, 9 aa, Homo Sapiens
EPVIRRNCP

SEQ ID NO: 791339 - protein, 9 aa, Homo Sapiens
QYLRPSEDE

SEQ ID NO: 791340 - protein, 9 aa, Homo Sapiens
TVSKTIVLI

SEQ ID NO: 791341 - protein, 9 aa, Homo Sapiens
RTEPFLESP

SEQ ID NO: 791342 - protein, 9 aa, Homo Sapiens
FHGPTCALS

SEQ ID NO: 791343 - protein, 9 aa, Homo Sapiens
KDACSWSTG

SEQ ID NO: 791344 - protein, 9 aa, Homo Sapiens
STKPTNDRY

SEQ ID NO: 791345 - protein, 9 aa, Homo Sapiens
HRNLQWAHD

SEQ ID NO: 791346 - protein, 9 aa, Homo Sapiens
SHFPYNLHL

SEQ ID NO: 791347 - protein, 9 aa, Homo Sapiens
DDLEKKMAD

SEQ ID NO: 791348 - protein, 9 aa, Homo Sapiens
WKKQRGLLL

SEQ ID NO: 791349 - protein, 9 aa, Homo Sapiens
IVLMATVSK

SEQ ID NO: 791350 - protein, 9 aa, Homo Sapiens
EEIEFKDGE

SEQ ID NO: 791351 - protein, 9 aa, Homo Sapiens
PSEDERVAF

SEQ ID NO: 791352 - protein, 9 aa, Homo Sapiens
PPLWKKQRG

SEQ ID NO: 791353 - protein, 9 aa, Homo Sapiens
RKKLLPKRK

SEQ ID NO: 791354 - protein, 9 aa, Homo Sapiens
SLTLPALDW

SEQ ID NO: 791355 - protein, 9 aa, Homo Sapiens
AVAREYSCE

SEQ ID NO: 791356 - protein, 9 aa, Homo Sapiens
SSGVYPEQL

SEQ ID NO: 791357 - protein, 9 aa, Homo Sapiens
SLSYHQGLP

SEQ ID NO: 791358 - protein, 9 aa, Homo Sapiens
SDGKFREEE

SEQ ID NO: 791359 - protein, 9 aa, Homo Sapiens
QESDGKFRE

SEQ ID NO: 791360 - protein, 9 aa, Homo Sapiens
KSDGRGDKQ

SEQ ID NO: 791361 - protein, 9 aa, Homo Sapiens
HQGLPFSTE

SEQ ID NO: 791362 - protein, 9 aa, Homo Sapiens
PANSAPAPK

SEQ ID NO: 791363 - protein, 9 aa, Homo Sapiens
SEDERVAFC

SEQ ID NO: 791364 - protein, 9 aa, Homo Sapiens
VTWDTALYL

SEQ ID NO: 791365 - protein, 9 aa, Homo Sapiens
HRHTGIHTD

SEQ ID NO: 791366 - protein, 9 aa, Homo Sapiens
ECYKGEKKL

SEQ ID NO: 791367 - protein, 9 aa, Homo Sapiens
DTHRNTQAH

SEQ ID NO: 791368 - protein, 9 aa, Homo Sapiens
DNGYLLEKK

SEQ ID NO: 791369 - protein, 9 aa, Homo Sapiens
TGIHTDTHR

SEQ ID NO: 791370 - protein, 9 aa, Homo Sapiens
RHTHTQAYT

SEQ ID NO: 791371 - protein, 9 aa, Homo Sapiens
HPEVPLNSF

SEQ ID NO: 791372 - protein, 9 aa, Homo Sapiens
DEITGDTAM

SEQ ID NO: 791373 - protein, 9 aa, Homo Sapiens
GILMAKPIP

SEQ ID NO: 791374 - protein, 9 aa, Homo Sapiens
AQIPMISIP

SEQ ID NO: 791375 - protein, 9 aa, Homo Sapiens
LWRGNGTNI

SEQ ID NO: 791376 - protein, 9 aa, Homo Sapiens
WVLFPPAPL

SEQ ID NO: 791377 - protein, 9 aa, Homo Sapiens
GTHTVVVMG

SEQ ID NO: 791378 - protein, 9 aa, Homo Sapiens
KDISICFTK

SEQ ID NO: 791379 - protein, 9 aa, Homo Sapiens
HTQAYTLTY

SEQ ID NO: 791380 - protein, 9 aa, Homo Sapiens
FEVRVCAFP

SEQ ID NO: 791381 - protein, 9 aa, Homo Sapiens
RSGPNTNPS

SEQ ID NO: 791382 - protein, 9 aa, Homo Sapiens
SIYSLLSVF

SEQ ID NO: 791383 - protein, 9 aa, Homo Sapiens
LVREITLGK

SEQ ID NO: 791384 - protein, 9 aa, Homo Sapiens
AYTLTYTGT

SEQ ID NO: 791385 - protein, 9 aa, Homo Sapiens
KWLTTFNPY

SEQ ID NO: 791386 - protein, 9 aa, Homo Sapiens
QTHIQAQTG

SEQ ID NO: 791387 - protein, 9 aa, Homo Sapiens
FSTDELLAE

SEQ ID NO: 791388 - protein, 9 aa, Homo Sapiens
RECLGTHTV

SEQ ID NO: 791389 - protein, 9 aa, Homo Sapiens
RHTGIHTDT

SEQ ID NO: 791390 - protein, 9 aa, Homo Sapiens
AVSHGRLDC

SEQ ID NO: 791391 - protein, 9 aa, Homo Sapiens
DNLAQIPMI

SEQ ID NO: 791392 - protein, 9 aa, Homo Sapiens
YVAEDARNV

SEQ ID NO: 791393 - protein, 9 aa, Homo Sapiens
QAYTLTYTG

SEQ ID NO: 791394 - protein, 9 aa, Homo Sapiens
VSDFCKWLT

SEQ ID NO: 791395 - protein, 9 aa, Homo Sapiens
HRYTHRHTQ

SEQ ID NO: 791396 - protein, 9 aa, Homo Sapiens
KLSIGVKNQ

SEQ ID NO: 791397 - protein, 9 aa, Homo Sapiens
LFTAVSHGR

SEQ ID NO: 791398 - protein, 9 aa, Homo Sapiens
EVVERSGPN

SEQ ID NO: 791399 - protein, 9 aa, Homo Sapiens
FECYKGEKK

SEQ ID NO: 791400 - protein, 9 aa, Homo Sapiens
QAPNIKLSI

SEQ ID NO: 791401 - protein, 9 aa, Homo Sapiens
LVLPSNLPG

SEQ ID NO: 791402 - protein, 9 aa, Homo Sapiens
EITGDTAME

SEQ ID NO: 791403 - protein, 9 aa, Homo Sapiens
AFKDISICF

SEQ ID NO: 791404 - protein, 9 aa, Homo Sapiens
GTHRHTHTH

SEQ ID NO: 791405 - protein, 9 aa, Homo Sapiens
SWFLVNTCA

SEQ ID NO: 791406 - protein, 9 aa, Homo Sapiens
RYTHRHTQA

SEQ ID NO: 791407 - protein, 9 aa, Homo Sapiens
HMDNLAQIP

SEQ ID NO: 791408 - protein, 9 aa, Homo Sapiens
FLVIPVGGL

SEQ ID NO: 791409 - protein, 9 aa, Homo Sapiens
NLAQIPMIS

SEQ ID NO: 791410 - protein, 9 aa, Homo Sapiens
QAQTGTHRH

SEQ ID NO: 791411 - protein, 9 aa, Homo Sapiens
VPLNSFTGS

SEQ ID NO: 791412 - protein, 9 aa, Homo Sapiens
HTDTDTHSH

SEQ ID NO: 791413 - protein, 9 aa, Homo Sapiens
TQAYTQTHI

SEQ ID NO: 791414 - protein, 9 aa, Homo Sapiens
GTNIIKIAP

SEQ ID NO: 791415 - protein, 9 aa, Homo Sapiens
PHSIYSLLS

SEQ ID NO: 791416 - protein, 9 aa, Homo Sapiens
PNIKLSIGV

SEQ ID NO: 791417 - protein, 9 aa, Homo Sapiens
VIPVGGLSF

SEQ ID NO: 791418 - protein, 9 aa, Homo Sapiens
LCWLPHSIY

SEQ ID NO: 791419 - protein, 9 aa, Homo Sapiens
LEDQSDQRI

SEQ ID NO: 791420 - protein, 9 aa, Homo Sapiens
IIKIAPETA

SEQ ID NO: 791421 - protein, 9 aa, Homo Sapiens
HTDTHRNTQ

SEQ ID NO: 791422 - protein, 9 aa, Homo Sapiens
HTHTHRYTH

SEQ ID NO: 791423 - protein, 9 aa, Homo Sapiens
VVERSGPNT

SEQ ID NO: 791424 - protein, 9 aa, Homo Sapiens
NSFTGSQPT

SEQ ID NO: 791425 - protein, 9 aa, Homo Sapiens
DEKLVREIT

SEQ ID NO: 791426 - protein, 9 aa, Homo Sapiens
KVITNSITQ

SEQ ID NO: 791427 - protein, 9 aa, Homo Sapiens
YTGTHRHTH

SEQ ID NO: 791428 - protein, 9 aa, Homo Sapiens
SHPEVPLNS

SEQ ID NO: 791429 - protein, 9 aa, Homo Sapiens
HTVVVMGGK

SEQ ID NO: 791430 - protein, 9 aa, Homo Sapiens
RTHAYTREC

SEQ ID NO: 791431 - protein, 9 aa, Homo Sapiens
HRNTQAHTG

SEQ ID NO: 791432 - protein, 9 aa, Homo Sapiens
EQAPNIKLS

SEQ ID NO: 791433 - protein, 9 aa, Homo Sapiens
AVSDFCKWL

SEQ ID NO: 791434 - protein, 9 aa, Homo Sapiens
QTGTHRHIH

SEQ ID NO: 791435 - protein, 9 aa, Homo Sapiens
TLASLGDTR

SEQ ID NO: 791436 - protein, 9 aa, Homo Sapiens
ERSGPNTNP

SEQ ID NO: 791437 - protein, 9 aa, Homo Sapiens
SDFCKWLTT

SEQ ID NO: 791438 - protein, 9 aa, Homo Sapiens
KEDNGYLLE

SEQ ID NO: 791439 - protein, 9 aa, Homo Sapiens
LGDTRWAGG

SEQ ID NO: 791440 - protein, 9 aa, Homo Sapiens
NAILMFKNT

SEQ ID NO: 791441 - protein, 9 aa, Homo Sapiens
VAEDARNVT

SEQ ID NO: 791442 - protein, 9 aa, Homo Sapiens
PLNSFTGSQ

SEQ ID NO: 791443 - protein, 9 aa, Homo Sapiens
PPPAFECYK

SEQ ID NO: 791444 - protein, 9 aa, Homo Sapiens
LTTGPRQCV

SEQ ID NO: 791445 - protein, 9 aa, Homo Sapiens
YTRECLGTH

SEQ ID NO: 791446 - protein, 9 aa, Homo Sapiens
HSIYSLLSV

SEQ ID NO: 791447 - protein, 9 aa, Homo Sapiens
GIHTDTDTH

SEQ ID NO: 791448 - protein, 9 aa, Homo Sapiens
PSNLPGSPV

SEQ ID NO: 791449 - protein, 9 aa, Homo Sapiens
SLGDTRWAG

SEQ ID NO: 791450 - protein, 9 aa, Homo Sapiens
CKWLTTFNP

SEQ ID NO: 791451 - protein, 9 aa, Homo Sapiens
RVEFLVIPV

SEQ ID NO: 791452 - protein, 9 aa, Homo Sapiens
VSHGRLDCV

SEQ ID NO: 791453 - protein, 9 aa, Homo Sapiens
WMSWFLVNT

SEQ ID NO: 791454 - protein, 9 aa, Homo Sapiens
IHTGDKSYK

SEQ ID NO: 791455 - protein, 9 aa, Homo Sapiens
FLVNTCAHR

SEQ ID NO: 791456 - protein, 9 aa, Homo Sapiens
IQAQTGTHR

SEQ ID NO: 791457 - protein, 9 aa, Homo Sapiens
GQFSTDELL

SEQ ID NO: 791458 - protein, 9 aa, Homo Sapiens
GDKSYKCEE

SEQ ID NO: 791459 - protein, 9 aa, Homo Sapiens
NIKLSIGVK

SEQ ID NO: 791460 - protein, 9 aa, Homo Sapiens
HSRTHAYTR

SEQ ID NO: 791461 - protein, 9 aa, Homo Sapiens
IHTDTHRNT

SEQ ID NO: 791462 - protein, 9 aa, Homo Sapiens
GPGLGLDPW

SEQ ID NO: 791463 - protein, 9 aa, Homo Sapiens
TRECLGTHT

SEQ ID NO: 791464 - protein, 9 aa, Homo Sapiens
HTGMHRHTH

SEQ ID NO: 791465 - protein, 9 aa, Homo Sapiens
QQDKIYVAE

SEQ ID NO: 791466 - protein, 9 aa, Homo Sapiens
TTGRMFTSD

SEQ ID NO: 791467 - protein, 9 aa, Homo Sapiens
GDTAMESHL

SEQ ID NO: 791468 - protein, 9 aa, Homo Sapiens
SQDEKLVRE

SEQ ID NO: 791469 - protein, 9 aa, Homo Sapiens
THRYTHRHT

SEQ ID NO: 791470 - protein, 9 aa, Homo Sapiens
DAFKDISIC

SEQ ID NO: 791471 - protein, 9 aa, Homo Sapiens
LLTTGPRQC

SEQ ID NO: 791472 - protein, 9 aa, Homo Sapiens
GMHRHTHTQ

SEQ ID NO: 791473 - protein, 9 aa, Homo Sapiens
AMESHLPMP

SEQ ID NO: 791474 - protein, 9 aa, Homo Sapiens
TGTHRHTHT

SEQ ID NO: 791475 - protein, 9 aa, Homo Sapiens
WLTTFGISD

SEQ ID NO: 791476 - protein, 9 aa, Homo Sapiens
IHMDNLAQI

SEQ ID NO: 791477 - protein, 9 aa, Homo Sapiens
YLLVLPSNL

SEQ ID NO: 791478 - protein, 9 aa, Homo Sapiens
KWLTTFGIS

SEQ ID NO: 791479 - protein, 9 aa, Homo Sapiens
TDTHRNTQA

SEQ ID NO: 791480 - protein, 9 aa, Homo Sapiens
YTHRHTQAY

SEQ ID NO: 791481 - protein, 9 aa, Homo Sapiens
CFTKEEWAE

SEQ ID NO: 791482 - protein, 9 aa, Homo Sapiens
TRWAGGLGP

SEQ ID NO: 791483 - protein, 9 aa, Homo Sapiens
HRHTGMHRH

SEQ ID NO: 791484 - protein, 9 aa, Homo Sapiens
LPSNLPGSP

SEQ ID NO: 791485 - protein, 9 aa, Homo Sapiens
THRHTGIHT

SEQ ID NO: 791486 - protein, 9 aa, Homo Sapiens
DTRWAGGLG

SEQ ID NO: 791487 - protein, 9 aa, Homo Sapiens
GGKEDNGYL

SEQ ID NO: 791488 - protein, 9 aa, Homo Sapiens
ELLAEVEKR

SEQ ID NO: 791489 - protein, 9 aa, Homo Sapiens
MFTSDSYIC

SEQ ID NO: 791490 - protein, 9 aa, Homo Sapiens
KIYVAEDAR

SEQ ID NO: 791491 - protein, 9 aa, Homo Sapiens
NGYLLEKKI

SEQ ID NO: 791492 - protein, 9 aa, Homo Sapiens
TAMESHLPM

SEQ ID NO: 791493 - protein, 9 aa, Homo Sapiens
QLEGDHQLL

SEQ ID NO: 791494 - protein, 9 aa, Homo Sapiens
DTHSHRHTH

SEQ ID NO: 791495 - protein, 9 aa, Homo Sapiens
VLPSNLPGS

SEQ ID NO: 791496 - protein, 9 aa, Homo Sapiens
TQAHTGIHT

SEQ ID NO: 791497 - protein, 9 aa, Homo Sapiens
HEEEEWTDE

SEQ ID NO: 791498 - protein, 9 aa, Homo Sapiens
VCAFPGRDR

SEQ ID NO: 791499 - protein, 9 aa, Homo Sapiens
HTHTQAYTL

SEQ ID NO: 791500 - protein, 9 aa, Homo Sapiens
DPWVLFPPA

SEQ ID NO: 791501 - protein, 9 aa, Homo Sapiens
TVVVMGGKE

SEQ ID NO: 791502 - protein, 9 aa, Homo Sapiens
SDQRIIIKL

SEQ ID NO: 791503 - protein, 9 aa, Homo Sapiens
IPVGGLSFL

SEQ ID NO: 791504 - protein, 9 aa, Homo Sapiens
VPPPAFECY

SEQ ID NO: 791505 - protein, 9 aa, Homo Sapiens
RIIIKLNIH

SEQ ID NO: 791506 - protein, 9 aa, Homo Sapiens
ASLGDTRWA

SEQ ID NO: 791507 - protein, 9 aa, Homo Sapiens
RHIHSRTHA

SEQ ID NO: 791508 - protein, 9 aa, Homo Sapiens
ILMAKPIPQ

SEQ ID NO: 791509 - protein, 9 aa, Homo Sapiens
EEWTDEDLV

SEQ ID NO: 791510 - protein, 9 aa, Homo Sapiens
VNLDFHTKV

SEQ ID NO: 791511 - protein, 9 aa, Homo Sapiens
RHTHTHRYT

SEQ ID NO: 791512 - protein, 9 aa, Homo Sapiens
THRNTQAHT

SEQ ID NO: 791513 - protein, 9 aa, Homo Sapiens
MSQDEKLVR

SEQ ID NO: 791514 - protein, 9 aa, Homo Sapiens
TQAYTLTYT

SEQ ID NO: 791515 - protein, 9 aa, Homo Sapiens
HSHRHTHTH

SEQ ID NO: 791516 - protein, 9 aa, Homo Sapiens
NIDQLEGDH

SEQ ID NO: 791517 - protein, 9 aa, Homo Sapiens
DISICFTKE

SEQ ID NO: 791518 - protein, 9 aa, Homo Sapiens
HTKVITNSI

SEQ ID NO: 791519 - protein, 9 aa, Homo Sapiens
KTNIDQLEG

SEQ ID NO: 791520 - protein, 9 aa, Homo Sapiens
THTQAYTLT

SEQ ID NO: 791521 - protein, 9 aa, Homo Sapiens
NTQAHTGIH

SEQ ID NO: 791522 - protein, 9 aa, Homo Sapiens
LASLGDTRW

SEQ ID NO: 791523 - protein, 9 aa, Homo Sapiens
LLAEVEKRN

SEQ ID NO: 791524 - protein, 9 aa, Homo Sapiens
QSDQRIIIK

SEQ ID NO: 791525 - protein, 9 aa, Homo Sapiens
LVIPVGGLS

SEQ ID NO: 791526 - protein, 9 aa, Homo Sapiens
CLGTHTVVV

SEQ ID NO: 791527 - protein, 9 aa, Homo Sapiens
EEEWTDEDL

SEQ ID NO: 791528 - protein, 9 aa, Homo Sapiens
GTHRHIHSR

SEQ ID NO: 791529 - protein, 9 aa, Homo Sapiens
TTRCFGILM

SEQ ID NO: 791530 - protein, 9 aa, Homo Sapiens
TFRVEFLVI

SEQ ID NO: 791531 - protein, 9 aa, Homo Sapiens
KVIHTGDKS

SEQ ID NO: 791532 - protein, 9 aa, Homo Sapiens
FKDISICFT

SEQ ID NO: 791533 - protein, 9 aa, Homo Sapiens
MDNLAQIPM

SEQ ID NO: 791534 - protein, 9 aa, Homo Sapiens
SYLLVLPSN

SEQ ID NO: 791535 - protein, 9 aa, Homo Sapiens
HTQAYTQTH

SEQ ID NO: 791536 - protein, 9 aa, Homo Sapiens
SHGRLDCVR

SEQ ID NO: 791537 - protein, 9 aa, Homo Sapiens
QIPMISIPR

SEQ ID NO: 791538 - protein, 9 aa, Homo Sapiens
VSHPEVPLN

SEQ ID NO: 791539 - protein, 9 aa, Homo Sapiens
HLLTTGPRQ

SEQ ID NO: 791540 - protein, 9 aa, Homo Sapiens
DFCKWLTTF

SEQ ID NO: 791541 - protein, 9 aa, Homo Sapiens
APNIKLSIG

SEQ ID NO: 791542 - protein, 9 aa, Homo Sapiens
EVRVCAFPG

SEQ ID NO: 791543 - protein, 9 aa, Homo Sapiens
RHTQAYTQT

SEQ ID NO: 791544 - protein, 9 aa, Homo Sapiens
LNSFTGSQP

SEQ ID NO: 791545 - protein, 9 aa, Homo Sapiens
LMAKPIPQI

SEQ ID NO: 791546 - protein, 9 aa, Homo Sapiens
WRGNGTNII

SEQ ID NO: 791547 - protein, 9 aa, Homo Sapiens
CHTTGRMFT

SEQ ID NO: 791548 - protein, 9 aa, Homo Sapiens
CKWLTTFGI

SEQ ID NO: 791549 - protein, 9 aa, Homo Sapiens
GDTRWAGGL

SEQ ID NO: 791550 - protein, 9 aa, Homo Sapiens
AFPGRDRRT

SEQ ID NO: 791551 - protein, 9 aa, Homo Sapiens
MTSEKHLLT

SEQ ID NO: 791552 - protein, 9 aa, Homo Sapiens
FTAVSHGRL

SEQ ID NO: 791553 - protein, 9 aa, Homo Sapiens
RVCAFPGRD

SEQ ID NO: 791554 - protein, 9 aa, Homo Sapiens
DKSYKCEEC

SEQ ID NO: 791555 - protein, 9 aa, Homo Sapiens
GRLDCVRVL

SEQ ID NO: 791556 - protein, 9 aa, Homo Sapiens
RGNGTNIIK

SEQ ID NO: 791557 - protein, 9 aa, Homo Sapiens
THRHIHSRT

SEQ ID NO: 791558 - protein, 9 aa, Homo Sapiens
QAHTGIHTD

SEQ ID NO: 791559 - protein, 9 aa, Homo Sapiens
THTVVVMGG

SEQ ID NO: 791560 - protein, 9 aa, Homo Sapiens
WFLVNTCAH

SEQ ID NO: 791561 - protein, 9 aa, Homo Sapiens
LGTHTVVVM

SEQ ID NO: 791562 - protein, 9 aa, Homo Sapiens
GTYNWMSWF

SEQ ID NO: 791563 - protein, 9 aa, Homo Sapiens
THRHTHTHR

SEQ ID NO: 791564 - protein, 9 aa, Homo Sapiens
SICFTKEEW

SEQ ID NO: 791565 - protein, 9 aa, Homo Sapiens
THRHTQAYT

SEQ ID NO: 791566 - protein, 9 aa, Homo Sapiens
LDFHTKVIT

SEQ ID NO: 791567 - protein, 9 aa, Homo Sapiens
MAKPIPQIP

SEQ ID NO: 791568 - protein, 9 aa, Homo Sapiens
QRIIIKLNI

SEQ ID NO: 791569 - protein, 9 aa, Homo Sapiens
HRHTQAYTQ

SEQ ID NO: 791570 - protein, 9 aa, Homo Sapiens
SEKHLLTTG

SEQ ID NO: 791571 - protein, 9 aa, Homo Sapiens
TAVSHGRLD

SEQ ID NO: 791572 - protein, 9 aa, Homo Sapiens
WLPHSIYSL

SEQ ID NO: 791573 - protein, 9 aa, Homo Sapiens
MGGKEDNGY

SEQ ID NO: 791574 - protein, 9 aa, Homo Sapiens
HAYTRECLG

SEQ ID NO: 791575 - protein, 9 aa, Homo Sapiens
YTQTHIQAQ

SEQ ID NO: 791576 - protein, 9 aa, Homo Sapiens
NWMSWFLVN

SEQ ID NO: 791577 - protein, 9 aa, Homo Sapiens
QDMSQDEKL

SEQ ID NO: 791578 - protein, 9 aa, Homo Sapiens
PEVPLNSFT

SEQ ID NO: 791579 - protein, 9 aa, Homo Sapiens
IIIKLNIHV

SEQ ID NO: 791580 - protein, 9 aa, Homo Sapiens
VERSGPNTN

SEQ ID NO: 791581 - protein, 9 aa, Homo Sapiens
LTYTGTHRH

SEQ ID NO: 791582 - protein, 9 aa, Homo Sapiens
LAQIPMISI

SEQ ID NO: 791583 - protein, 9 aa, Homo Sapiens
THTHRHTGI

SEQ ID NO: 791584 - protein, 9 aa, Homo Sapiens
GRMFTSDSY

SEQ ID NO: 791585 - protein, 9 aa, Homo Sapiens
QFSTDELLA

SEQ ID NO: 791586 - protein, 9 aa, Homo Sapiens
CAFPGRDRR

SEQ ID NO: 791587 - protein, 9 aa, Homo Sapiens
GIHTDTHRN

SEQ ID NO: 791588 - protein, 9 aa, Homo Sapiens
HKVIHTGDK

SEQ ID NO: 791589 - protein, 9 aa, Homo Sapiens
IHSRTHAYT

SEQ ID NO: 791590 - protein, 9 aa, Homo Sapiens
HTHTHRHTG

SEQ ID NO: 791591 - protein, 9 aa, Homo Sapiens
THTHRYTHR

SEQ ID NO: 791592 - protein, 9 aa, Homo Sapiens
SGPNTNPSE

SEQ ID NO: 791593 - protein, 9 aa, Homo Sapiens
HTHRHTGIH

SEQ ID NO: 791594 - protein, 9 aa, Homo Sapiens
RLDCVRVLL

SEQ ID NO: 791595 - protein, 9 aa, Homo Sapiens
RHTHTHRHT

SEQ ID NO: 791596 - protein, 9 aa, Homo Sapiens
QDEKLVREI

SEQ ID NO: 791597 - protein, 9 aa, Homo Sapiens
DFHTKVITN

SEQ ID NO: 791598 - protein, 9 aa, Homo Sapiens
FKNTDDTLK

SEQ ID NO: 791599 - protein, 9 aa, Homo Sapiens
TYNWMSWFL

SEQ ID NO: 791600 - protein, 9 aa, Homo Sapiens
CFGILMAKP

SEQ ID NO: 791601 - protein, 9 aa, Homo Sapiens
DTDTHSHRH

SEQ ID NO: 791602 - protein, 9 aa, Homo Sapiens
PPAFECYKG

SEQ ID NO: 791603 - protein, 9 aa, Homo Sapiens
SNLPGSPVT

SEQ ID NO: 791604 - protein, 9 aa, Homo Sapiens
HTHRYTHRH

SEQ ID NO: 791605 - protein, 9 aa, Homo Sapiens
SRTHAYTRE

SEQ ID NO: 791606 - protein, 9 aa, Homo Sapiens
SPTEVVERS

SEQ ID NO: 791607 - protein, 9 aa, Homo Sapiens
TRCFGILMA

SEQ ID NO: 791608 - protein, 9 aa, Homo Sapiens
TSEKHLLTT

SEQ ID NO: 791609 - protein, 9 aa, Homo Sapiens
TGIHTDTDT

SEQ ID NO: 791610 - protein, 9 aa, Homo Sapiens
TDEDLVESL

SEQ ID NO: 791611 - protein, 9 aa, Homo Sapiens
LAEVEKRNR

SEQ ID NO: 791612 - protein, 9 aa, Homo Sapiens
GLGLDPWVL

SEQ ID NO: 791613 - protein, 9 aa, Homo Sapiens
HTGIHTDTD

SEQ ID NO: 791614 - protein, 9 aa, Homo Sapiens
RNTQAHTGI

SEQ ID NO: 791615 - protein, 9 aa, Homo Sapiens
HTGIHTDTH

SEQ ID NO: 791616 - protein, 9 aa, Homo Sapiens
DMSQDEKLV

SEQ ID NO: 791617 - protein, 9 aa, Homo Sapiens
YKTNIDQLE

SEQ ID NO: 791618 - protein, 9 aa, Homo Sapiens
YTLTYTGTH

SEQ ID NO: 791619 - protein, 9 aa, Homo Sapiens
ITGDTAMES

SEQ ID NO: 791620 - protein, 9 aa, Homo Sapiens
SLCWLPHSI

SEQ ID NO: 791621 - protein, 9 aa, Homo Sapiens
DTAMESHLP

SEQ ID NO: 791622 - protein, 9 aa, Homo Sapiens
VEFLVIPVG

SEQ ID NO: 791623 - protein, 9 aa, Homo Sapiens
TDTDTHSHR

SEQ ID NO: 791624 - protein, 9 aa, Homo Sapiens
TGMHRHTHT

SEQ ID NO: 791625 - protein, 9 aa, Homo Sapiens
IHTDTDTHS

SEQ ID NO: 791626 - protein, 9 aa, Homo Sapiens
IKLSIGVKN

SEQ ID NO: 791627 - protein, 9 aa, Homo Sapiens
INYKTNIDQ

SEQ ID NO: 791628 - protein, 9 aa, Homo Sapiens
GVPPPAFEC

SEQ ID NO: 791629 - protein, 9 aa, Homo Sapiens
IYSLLSVFS

SEQ ID NO: 791630 - protein, 9 aa, Homo Sapiens
EEEEWTDED

SEQ ID NO: 791631 - protein, 9 aa, Homo Sapiens
LPHSIYSLL

SEQ ID NO: 791632 - protein, 9 aa, Homo Sapiens
GNGTNIIKI

SEQ ID NO: 791633 - protein, 9 aa, Homo Sapiens
GYLLEKKIY

SEQ ID NO: 791634 - protein, 9 aa, Homo Sapiens
STDELLAEV

SEQ ID NO: 791635 - protein, 9 aa, Homo Sapiens
WLTTFNPYK

SEQ ID NO: 791636 - protein, 9 aa, Homo Sapiens
LTTFGISDI

SEQ ID NO: 791637 - protein, 9 aa, Homo Sapiens
LDPWVLFPP

SEQ ID NO: 791638 - protein, 9 aa, Homo Sapiens
GLDPWVLFP

SEQ ID NO: 791639 - protein, 9 aa, Homo Sapiens
TGDTAMESH

SEQ ID NO: 791640 - protein, 9 aa, Homo Sapiens
AEDARNVTV

SEQ ID NO: 791641 - protein, 9 aa, Homo Sapiens
EFLVIPVGG

SEQ ID NO: 791642 - protein, 9 aa, Homo Sapiens
VVMGGKEDN

SEQ ID NO: 791643 - protein, 9 aa, Homo Sapiens
AHTGIHTDT

SEQ ID NO: 791644 - protein, 9 aa, Homo Sapiens
DYEQAPNIK

SEQ ID NO: 791645 - protein, 9 aa, Homo Sapiens
WTDEDLVES

SEQ ID NO: 791646 - protein, 9 aa, Homo Sapiens
DKIYVAEDA

SEQ ID NO: 791647 - protein, 9 aa, Homo Sapiens
AYTRECLGT

SEQ ID NO: 791648 - protein, 9 aa, Homo Sapiens
MFKNTDDTL

SEQ ID NO: 791649 - protein, 9 aa, Homo Sapiens
SHRHTHTHR

SEQ ID NO: 791650 - protein, 9 aa, Homo Sapiens
FRVEFLVIP

SEQ ID NO: 791651 - protein, 9 aa, Homo Sapiens
EDNGYLLEK

SEQ ID NO: 791652 - protein, 9 aa, Homo Sapiens
FPGRDRRTE

SEQ ID NO: 791653 - protein, 9 aa, Homo Sapiens
HRHIHSRTH

SEQ ID NO: 791654 - protein, 9 aa, Homo Sapiens
VIHTGDKSY

SEQ ID NO: 791655 - protein, 9 aa, Homo Sapiens
AYTQTHIQA

SEQ ID NO: 791656 - protein, 9 aa, Homo Sapiens
ECLGTHTVV

SEQ ID NO: 791657 - protein, 9 aa, Homo Sapiens
RCFGILMAK

SEQ ID NO: 791658 - protein, 9 aa, Homo Sapiens
TNIIKIAPE

SEQ ID NO: 791659 - protein, 9 aa, Homo Sapiens
QDKIYVAED

SEQ ID NO: 791660 - protein, 9 aa, Homo Sapiens
AQTGTHRHI

SEQ ID NO: 791661 - protein, 9 aa, Homo Sapiens
TNIDQLEGD

SEQ ID NO: 791662 - protein, 9 aa, Homo Sapiens
TTGPRQCVG

SEQ ID NO: 791663 - protein, 9 aa, Homo Sapiens
EVPLNSFTG

SEQ ID NO: 791664 - protein, 9 aa, Homo Sapiens
LGLDPWVLF

SEQ ID NO: 791665 - protein, 9 aa, Homo Sapiens
NYKTNIDQL

SEQ ID NO: 791666 - protein, 9 aa, Homo Sapiens
TSDSYICFA

SEQ ID NO: 791667 - protein, 9 aa, Homo Sapiens
MHRHTHTQA

SEQ ID NO: 791668 - protein, 9 aa, Homo Sapiens
EKLVREITL

SEQ ID NO: 791669 - protein, 9 aa, Homo Sapiens
RMFTSDSYI

SEQ ID NO: 791670 - protein, 9 aa, Homo Sapiens
EWTDEDLVE

SEQ ID NO: 791671 - protein, 9 aa, Homo Sapiens
TEVVERSGP

SEQ ID NO: 791672 - protein, 9 aa, Homo Sapiens
VMGGKEDNG

SEQ ID NO: 791673 - protein, 9 aa, Homo Sapiens
GKEDNGYLL

SEQ ID NO: 791674 - protein, 9 aa, Homo Sapiens
HTTGRMFTS

SEQ ID NO: 791675 - protein, 9 aa, Homo Sapiens
AFECYKGEK

SEQ ID NO: 791676 - protein, 9 aa, Homo Sapiens
AILMFKNTD

SEQ ID NO: 791677 - protein, 9 aa, Homo Sapiens
DQRIIIKLN

SEQ ID NO: 791678 - protein, 9 aa, Homo Sapiens
HIQAQTGTH

SEQ ID NO: 791679 - protein, 9 aa, Homo Sapiens
PWVLFPPAP

SEQ ID NO: 791680 - protein, 9 aa, Homo Sapiens
NIIKIAPET

SEQ ID NO: 791681 - protein, 9 aa, Homo Sapiens
CWLPHSIYS

SEQ ID NO: 791682 - protein, 9 aa, Homo Sapiens
SFEVRVCAF

SEQ ID NO: 791683 - protein, 9 aa, Homo Sapiens
IPMISIPRV

SEQ ID NO: 791684 - protein, 9 aa, Homo Sapiens
LLVLPSNLP

SEQ ID NO: 791685 - protein, 9 aa, Homo Sapiens
IYVAEDARN

SEQ ID NO: 791686 - protein, 9 aa, Homo Sapiens
ILMFKNTDD

SEQ ID NO: 791687 - protein, 9 aa, Homo Sapiens
ICFTKEEWA

SEQ ID NO: 791688 - protein, 9 aa, Homo Sapiens
PAFECYKGE

SEQ ID NO: 791689 - protein, 9 aa, Homo Sapiens
CYKGEKKLF

SEQ ID NO: 791690 - protein, 9 aa, Homo Sapiens
HRHTHTQAY

SEQ ID NO: 791691 - protein, 9 aa, Homo Sapiens
RHTGMHRHT

SEQ ID NO: 791692 - protein, 9 aa, Homo Sapiens
RWAGGLGPF

SEQ ID NO: 791693 - protein, 9 aa, Homo Sapiens
KLVREITLG

SEQ ID NO: 791694 - protein, 9 aa, Homo Sapiens
QAYTQTHIQ

SEQ ID NO: 791695 - protein, 9 aa, Homo Sapiens
FHTKVITNS

SEQ ID NO: 791696 - protein, 9 aa, Homo Sapiens
HGRLDCVRV

SEQ ID NO: 791697 - protein, 9 aa, Homo Sapiens
LTTFNPYKP

SEQ ID NO: 791698 - protein, 9 aa, Homo Sapiens
TGDKSYKCE

SEQ ID NO: 791699 - protein, 9 aa, Homo Sapiens
KHKVIHTGD

SEQ ID NO: 791700 - protein, 9 aa, Homo Sapiens
PTEVVERSG

SEQ ID NO: 791701 - protein, 9 aa, Homo Sapiens
EDQSDQRII

SEQ ID NO: 791702 - protein, 9 aa, Homo Sapiens
VRVCAFPGR

SEQ ID NO: 791703 - protein, 9 aa, Homo Sapiens
YEQAPNIKL

SEQ ID NO: 791704 - protein, 9 aa, Homo Sapiens
ISICFTKEE

SEQ ID NO: 791705 - protein, 9 aa, Homo Sapiens
THAYTRECL

SEQ ID NO: 791706 - protein, 9 aa, Homo Sapiens
TKVITNSIT

SEQ ID NO: 791707 - protein, 9 aa, Homo Sapiens
TDELLAEVE

SEQ ID NO: 791708 - protein, 9 aa, Homo Sapiens
EKHLLTTGP

SEQ ID NO: 791709 - protein, 9 aa, Homo Sapiens
TYTGTHRHT

SEQ ID NO: 791710 - protein, 9 aa, Homo Sapiens
YNWMSWFLV

SEQ ID NO: 791711 - protein, 9 aa, Homo Sapiens
KHLLTTGPR

SEQ ID NO: 791712 - protein, 9 aa, Homo Sapiens
TLTYTGTHR

SEQ ID NO: 791713 - protein, 9 aa, Homo Sapiens
DDEITGDTA

SEQ ID NO: 791714 - protein, 9 aa, Homo Sapiens
HRHTHTHRY

SEQ ID NO: 791715 - protein, 9 aa, Homo Sapiens
NGTNIIKIA

SEQ ID NO: 791716 - protein, 9 aa, Homo Sapiens
HRHTHTHRH

SEQ ID NO: 791717 - protein, 9 aa, Homo Sapiens
THIQAQTGT

SEQ ID NO: 791718 - protein, 9 aa, Homo Sapiens
DQSDQRIII

SEQ ID NO: 791719 - protein, 9 aa, Homo Sapiens
FTSDSYICF

SEQ ID NO: 791720 - protein, 9 aa, Homo Sapiens
FCKWLTTFG

SEQ ID NO: 791721 - protein, 9 aa, Homo Sapiens
HIHSRTHAY

SEQ ID NO: 791722 - protein, 9 aa, Homo Sapiens
THSHRHTHT

SEQ ID NO: 791723 - protein, 9 aa, Homo Sapiens
FCKWLTTFN

SEQ ID NO: 791724 - protein, 9 aa, Homo Sapiens
TGTHRHIHS

SEQ ID NO: 791725 - protein, 9 aa, Homo Sapiens
NLPGSPVTE

SEQ ID NO: 791726 - protein, 9 aa, Homo Sapiens
RQQDKIYVA

SEQ ID NO: 791727 - protein, 9 aa, Homo Sapiens
TQTHIQAQT

SEQ ID NO: 791728 - protein, 9 aa, Homo Sapiens
TGRMFTSDS

SEQ ID NO: 791729 - protein, 9 aa, Homo Sapiens
PGLGLDPWV

SEQ ID NO: 791730 - protein, 9 aa, Homo Sapiens
FGILMAKPI

SEQ ID NO: 791731 - protein, 9 aa, Homo Sapiens
DELLAEVEK

SEQ ID NO: 791732 - protein, 9 aa, Homo Sapiens
TDTHSHRHT

SEQ ID NO: 791733 - protein, 9 aa, Homo Sapiens
LMFKNTDDT

SEQ ID NO: 791734 - protein, 9 aa, Homo Sapiens
MSWFLVNTC

SEQ ID NO: 791735 - protein, 9 aa, Homo Sapiens
NLDFHTKVI

SEQ ID NO: 791736 - protein, 9 aa, Homo Sapiens
VVVMGGKED

SEQ ID NO: 791737 - protein, 9 aa, Homo Sapiens
GDRGEQSPG

SEQ ID NO: 791738 - protein, 9 aa, Homo Sapiens
LEELDISWS

SEQ ID NO: 791739 - protein, 9 aa, Homo Sapiens
LLKLQRLMH

SEQ ID NO: 791740 - protein, 9 aa, Homo Sapiens
HQEAPHCRV

SEQ ID NO: 791741 - protein, 9 aa, Homo Sapiens
NKAELEHIA

SEQ ID NO: 791742 - protein, 9 aa, Homo Sapiens
RSPRLCSTI

SEQ ID NO: 791743 - protein, 9 aa, Homo Sapiens
PHCRVWRIV

SEQ ID NO: 791744 - protein, 9 aa, Homo Sapiens
GTGQQTRKD

SEQ ID NO: 791745 - protein, 9 aa, Homo Sapiens
PWKRMDKLE

SEQ ID NO: 791746 - protein, 9 aa, Homo Sapiens
ELFAKRQSG

SEQ ID NO: 791747 - protein, 9 aa, Homo Sapiens
QTGDRGEQS

SEQ ID NO: 791748 - protein, 9 aa, Homo Sapiens
ASPHPAAPT

SEQ ID NO: 791749 - protein, 9 aa, Homo Sapiens
HGLVQPGEV

SEQ ID NO: 791750 - protein, 9 aa, Homo Sapiens
LKIVVAAFI

SEQ ID NO: 791751 - protein, 9 aa, Homo Sapiens
GQNFGMTHD

SEQ ID NO: 791752 - protein, 9 aa, Homo Sapiens
PTKISQVES

SEQ ID NO: 791753 - protein, 9 aa, Homo Sapiens
VVIYVLNGR

SEQ ID NO: 791754 - protein, 9 aa, Homo Sapiens
GVLWGTRGS

SEQ ID NO: 791755 - protein, 9 aa, Homo Sapiens
KETGHVYVY

SEQ ID NO: 791756 - protein, 9 aa, Homo Sapiens
PPMDLQLQS

SEQ ID NO: 791757 - protein, 9 aa, Homo Sapiens
QFELYRITE

SEQ ID NO: 791758 - protein, 9 aa, Homo Sapiens
GRPPMDLQL

SEQ ID NO: 791759 - protein, 9 aa, Homo Sapiens
KQKEGGTYP

SEQ ID NO: 791760 - protein, 9 aa, Homo Sapiens
PIAPLPPRS

SEQ ID NO: 791761 - protein, 9 aa, Homo Sapiens
FKRSVRWNL

SEQ ID NO: 791762 - protein, 9 aa, Homo Sapiens
AAFIDSPQY

SEQ ID NO: 791763 - protein, 9 aa, Homo Sapiens
KMGWWSIEH

SEQ ID NO: 791764 - protein, 9 aa, Homo Sapiens
EQSPGTGQQ

SEQ ID NO: 791765 - protein, 9 aa, Homo Sapiens
LCSTISCPG

SEQ ID NO: 791766 - protein, 9 aa, Homo Sapiens
PRSVAVFPS

SEQ ID NO: 791767 - protein, 9 aa, Homo Sapiens
SGTQTAAQL

SEQ ID NO: 791768 - protein, 9 aa, Homo Sapiens
SVPGSHYLY

SEQ ID NO: 791769 - protein, 9 aa, Homo Sapiens
PASPHPAAP

SEQ ID NO: 791770 - protein, 9 aa, Homo Sapiens
STISCPGPS

SEQ ID NO: 791771 - protein, 9 aa, Homo Sapiens
EWGTVVYGK

SEQ ID NO: 791772 - protein, 9 aa, Homo Sapiens
KRQSGADRY

SEQ ID NO: 791773 - protein, 9 aa, Homo Sapiens
GASMEQSRR

SEQ ID NO: 791774 - protein, 9 aa, Homo Sapiens
KENGKMGWW

SEQ ID NO: 791775 - protein, 9 aa, Homo Sapiens
EMDHPKSYK

SEQ ID NO: 791776 - protein, 9 aa, Homo Sapiens
PHARAHGGM

SEQ ID NO: 791777 - protein, 9 aa, Homo Sapiens
AVFPSHSLV

SEQ ID NO: 791778 - protein, 9 aa, Homo Sapiens
SKEKTQHLE

SEQ ID NO: 791779 - protein, 9 aa, Homo Sapiens
NLHMKLYET

SEQ ID NO: 791780 - protein, 9 aa, Homo Sapiens
SPRELLKEK

SEQ ID NO: 791781 - protein, 9 aa, Homo Sapiens
EKSNAACVP

SEQ ID NO: 791782 - protein, 9 aa, Homo Sapiens
GDCPSAEPT

SEQ ID NO: 791783 - protein, 9 aa, Homo Sapiens
QQLLLLKLQ

SEQ ID NO: 791784 - protein, 9 aa, Homo Sapiens
QKEWEAEFQ

SEQ ID NO: 791785 - protein, 9 aa, Homo Sapiens
YPPQDAEII

SEQ ID NO: 791786 - protein, 9 aa, Homo Sapiens
AGASVVVCR

SEQ ID NO: 791787 - protein, 9 aa, Homo Sapiens
QDTKGFHTG

SEQ ID NO: 791788 - protein, 9 aa, Homo Sapiens
ENVWLRPVE

SEQ ID NO: 791789 - protein, 9 aa, Homo Sapiens
GTVVYGKTE

SEQ ID NO: 791790 - protein, 9 aa, Homo Sapiens
NGTPSLVTF

SEQ ID NO: 791791 - protein, 9 aa, Homo Sapiens
HMGIHAARP

SEQ ID NO: 791792 - protein, 9 aa, Homo Sapiens
NYVGKIVGS

SEQ ID NO: 791793 - protein, 9 aa, Homo Sapiens
LHMKLYETS

SEQ ID NO: 791794 - protein, 9 aa, Homo Sapiens
VADHEKVAC

SEQ ID NO: 791795 - protein, 9 aa, Homo Sapiens
TAEGIVMPI

SEQ ID NO: 791796 - protein, 9 aa, Homo Sapiens
GKVLVQATK

SEQ ID NO: 791797 - protein, 9 aa, Homo Sapiens
RPVELGGAP

SEQ ID NO: 791798 - protein, 9 aa, Homo Sapiens
RKPAVLQNL

SEQ ID NO: 791799 - protein, 9 aa, Homo Sapiens
DEFGSCVPH

SEQ ID NO: 791800 - protein, 9 aa, Homo Sapiens
TMAHEMGQN

SEQ ID NO: 791801 - protein, 9 aa, Homo Sapiens
SVLQRVHTG

SEQ ID NO: 791802 - protein, 9 aa, Homo Sapiens
DSGGRLACN

SEQ ID NO: 791803 - protein, 9 aa, Homo Sapiens
GTQTAAQLK

SEQ ID NO: 791804 - protein, 9 aa, Homo Sapiens
TPSLVTFDG

SEQ ID NO: 791805 - protein, 9 aa, Homo Sapiens
PRSRMPPWD

SEQ ID NO: 791806 - protein, 9 aa, Homo Sapiens
LDCGAGKDC

SEQ ID NO: 791807 - protein, 9 aa, Homo Sapiens
AHEMGQNFG

SEQ ID NO: 791808 - protein, 9 aa, Homo Sapiens
VSVACSAVT

SEQ ID NO: 791809 - protein, 9 aa, Homo Sapiens
ESLILGKHG

SEQ ID NO: 791810 - protein, 9 aa, Homo Sapiens
ISEFPDEFG

SEQ ID NO: 791811 - protein, 9 aa, Homo Sapiens
YTFSQAAIL

SEQ ID NO: 791812 - protein, 9 aa, Homo Sapiens
HYPSVGQLA

SEQ ID NO: 791813 - protein, 9 aa, Homo Sapiens
TVVIYVLNG

SEQ ID NO: 791814 - protein, 9 aa, Homo Sapiens
TQTAAQLKL

SEQ ID NO: 791815 - protein, 9 aa, Homo Sapiens
PSLVTFDGR

SEQ ID NO: 791816 - protein, 9 aa, Homo Sapiens
IAMFKEELY

SEQ ID NO: 791817 - protein, 9 aa, Homo Sapiens
PQNKETGHV

SEQ ID NO: 791818 - protein, 9 aa, Homo Sapiens
QLSKNSVHR

SEQ ID NO: 791819 - protein, 9 aa, Homo Sapiens
ANLHMKLYE

SEQ ID NO: 791820 - protein, 9 aa, Homo Sapiens
FEAVPTKVL

SEQ ID NO: 791821 - protein, 9 aa, Homo Sapiens
ASVVVCRRK

SEQ ID NO: 791822 - protein, 9 aa, Homo Sapiens
MNKLAEGAE

SEQ ID NO: 791823 - protein, 9 aa, Homo Sapiens
QLQSSDEQV

SEQ ID NO: 791824 - protein, 9 aa, Homo Sapiens
MQHSRLYLI

SEQ ID NO: 791825 - protein, 9 aa, Homo Sapiens
PPWDLSLPV

SEQ ID NO: 791826 - protein, 9 aa, Homo Sapiens
WSGFVGGTL

SEQ ID NO: 791827 - protein, 9 aa, Homo Sapiens
ALFPHMGIH

SEQ ID NO: 791828 - protein, 9 aa, Homo Sapiens
LKRDIAMFK

SEQ ID NO: 791829 - protein, 9 aa, Homo Sapiens
IHAARPCRY

SEQ ID NO: 791830 - protein, 9 aa, Homo Sapiens
DELISLGLS

SEQ ID NO: 791831 - protein, 9 aa, Homo Sapiens
ILQAVQAVE

SEQ ID NO: 791832 - protein, 9 aa, Homo Sapiens
SFCYLRVLM

SEQ ID NO: 791833 - protein, 9 aa, Homo Sapiens
MCFAMLGFL

SEQ ID NO: 791834 - protein, 9 aa, Homo Sapiens
FEKSNAACV

SEQ ID NO: 791835 - protein, 9 aa, Homo Sapiens
EPTKISQVE

SEQ ID NO: 791836 - protein, 9 aa, Homo Sapiens
IVLFLGAIG

SEQ ID NO: 791837 - protein, 9 aa, Homo Sapiens
PQINLSKRQ

SEQ ID NO: 791838 - protein, 9 aa, Homo Sapiens
CLEKQEESI

SEQ ID NO: 791839 - protein, 9 aa, Homo Sapiens
GSHYLYNQP

SEQ ID NO: 791840 - protein, 9 aa, Homo Sapiens
SHSLGKGLG

SEQ ID NO: 791841 - protein, 9 aa, Homo Sapiens
GTWILGVLW

SEQ ID NO: 791842 - protein, 9 aa, Homo Sapiens
PSHSLVPFL

SEQ ID NO: 791843 - protein, 9 aa, Homo Sapiens
VTFDGRRSI

SEQ ID NO: 791844 - protein, 9 aa, Homo Sapiens
LSWPKPWHK

SEQ ID NO: 791845 - protein, 9 aa, Homo Sapiens
ECLKSTVDS

SEQ ID NO: 791846 - protein, 9 aa, Homo Sapiens
EFPDEFGSC

SEQ ID NO: 791847 - protein, 9 aa, Homo Sapiens
TQTFSRSAA

SEQ ID NO: 791848 - protein, 9 aa, Homo Sapiens
SRPLAPEEP

SEQ ID NO: 791849 - protein, 9 aa, Homo Sapiens
CPAACPVGC

SEQ ID NO: 791850 - protein, 9 aa, Homo Sapiens
NEFHYPSVG

SEQ ID NO: 791851 - protein, 9 aa, Homo Sapiens
HLEMDHPKS

SEQ ID NO: 791852 - protein, 9 aa, Homo Sapiens
PGVDQHGLV

SEQ ID NO: 791853 - protein, 9 aa, Homo Sapiens
VPGSHYLYN

SEQ ID NO: 791854 - protein, 9 aa, Homo Sapiens
DCPSAEPTV

SEQ ID NO: 791855 - protein, 9 aa, Homo Sapiens
MGYIFAAVG

SEQ ID NO: 791856 - protein, 9 aa, Homo Sapiens
LQSSDEQVP

SEQ ID NO: 791857 - protein, 9 aa, Homo Sapiens
RAQQLLLLK

SEQ ID NO: 791858 - protein, 9 aa, Homo Sapiens
PTGTWILGV

SEQ ID NO: 791859 - protein, 9 aa, Homo Sapiens
SNEFHYPSV

SEQ ID NO: 791860 - protein, 9 aa, Homo Sapiens
HEMGQNFGM

SEQ ID NO: 791861 - protein, 9 aa, Homo Sapiens
TASWYCSAP

SEQ ID NO: 791862 - protein, 9 aa, Homo Sapiens
TVRIQVIDV

SEQ ID NO: 791863 - protein, 9 aa, Homo Sapiens
GRTSRKTGA

SEQ ID NO: 791864 - protein, 9 aa, Homo Sapiens
WYCSAPLAA

SEQ ID NO: 791865 - protein, 9 aa, Homo Sapiens
PGPAAPLGA

SEQ ID NO: 791866 - protein, 9 aa, Homo Sapiens
GGMTPLHAA

SEQ ID NO: 791867 - protein, 9 aa, Homo Sapiens
FQLSKNSVH

SEQ ID NO: 791868 - protein, 9 aa, Homo Sapiens
TVPGLPIHQ

SEQ ID NO: 791869 - protein, 9 aa, Homo Sapiens
VQPGEVQRS

SEQ ID NO: 791870 - protein, 9 aa, Homo Sapiens
MLPQINLSK

SEQ ID NO: 791871 - protein, 9 aa, Homo Sapiens
PEVMREVQP

SEQ ID NO: 791872 - protein, 9 aa, Homo Sapiens
RVEQECLLT

SEQ ID NO: 791873 - protein, 9 aa, Homo Sapiens
TRPLYHKYK

SEQ ID NO: 791874 - protein, 9 aa, Homo Sapiens
PWDLSLPVV

SEQ ID NO: 791875 - protein, 9 aa, Homo Sapiens
GPQNKETGH

SEQ ID NO: 791876 - protein, 9 aa, Homo Sapiens
AACVPCDLV

SEQ ID NO: 791877 - protein, 9 aa, Homo Sapiens
SLILGKHGV

SEQ ID NO: 791878 - protein, 9 aa, Homo Sapiens
TANVVAVQR

SEQ ID NO: 791879 - protein, 9 aa, Homo Sapiens
YDKRKRFHR

SEQ ID NO: 791880 - protein, 9 aa, Homo Sapiens
SMEQSRRLC

SEQ ID NO: 791881 - protein, 9 aa, Homo Sapiens
RRGGERPSQ

SEQ ID NO: 791882 - protein, 9 aa, Homo Sapiens
NVYSVPGSH

SEQ ID NO: 791883 - protein, 9 aa, Homo Sapiens
GYLVRLVAD

SEQ ID NO: 791884 - protein, 9 aa, Homo Sapiens
WFKGRTSRK

SEQ ID NO: 791885 - protein, 9 aa, Homo Sapiens
LLSWPKPWH

SEQ ID NO: 791886 - protein, 9 aa, Homo Sapiens
PGTGQQTRK

SEQ ID NO: 791887 - protein, 9 aa, Homo Sapiens
VSEGSEPAL

SEQ ID NO: 791888 - protein, 9 aa, Homo Sapiens
CEWGTVVYG

SEQ ID NO: 791889 - protein, 9 aa, Homo Sapiens
YHTALVTGD

SEQ ID NO: 791890 - protein, 9 aa, Homo Sapiens
QRRGGERPS

SEQ ID NO: 791891 - protein, 9 aa, Homo Sapiens
YIFAAVGGM

SEQ ID NO: 791892 - protein, 9 aa, Homo Sapiens
MEQSRRLCY

SEQ ID NO: 791893 - protein, 9 aa, Homo Sapiens
QANKAELEH

SEQ ID NO: 791894 - protein, 9 aa, Homo Sapiens
KHGVNLAME

SEQ ID NO: 791895 - protein, 9 aa, Homo Sapiens
ALVTGDLDH

SEQ ID NO: 791896 - protein, 9 aa, Homo Sapiens
SRRLCYTAG

SEQ ID NO: 791897 - protein, 9 aa, Homo Sapiens
ILGKHGVNL

SEQ ID NO: 791898 - protein, 9 aa, Homo Sapiens
KSGLMTKNQ

SEQ ID NO: 791899 - protein, 9 aa, Homo Sapiens
ETGHVYVYL

SEQ ID NO: 791900 - protein, 9 aa, Homo Sapiens
FIDFIEVIY

SEQ ID NO: 791901 - protein, 9 aa, Homo Sapiens
GLMTKNQLE

SEQ ID NO: 791902 - protein, 9 aa, Homo Sapiens
PQQQTGDRG

SEQ ID NO: 791903 - protein, 9 aa, Homo Sapiens
ACSAVTKSA

SEQ ID NO: 791904 - protein, 9 aa, Homo Sapiens
YSVPGSHYL

SEQ ID NO: 791905 - protein, 9 aa, Homo Sapiens
IFEKSNAAC

SEQ ID NO: 791906 - protein, 9 aa, Homo Sapiens
FVLKPGIVL

SEQ ID NO: 791907 - protein, 9 aa, Homo Sapiens
RIRYACSSS

SEQ ID NO: 791908 - protein, 9 aa, Homo Sapiens
QYYEILGVK

SEQ ID NO: 791909 - protein, 9 aa, Homo Sapiens
GTPSLVTFD

SEQ ID NO: 791910 - protein, 9 aa, Homo Sapiens
PLYHKYKPG

SEQ ID NO: 791911 - protein, 9 aa, Homo Sapiens
ARLKRELVA

SEQ ID NO: 791912 - protein, 9 aa, Homo Sapiens
QAVQAVEDA

SEQ ID NO: 791913 - protein, 9 aa, Homo Sapiens
APEEPPPAS

SEQ ID NO: 791914 - protein, 9 aa, Homo Sapiens
QTAAQLKLS

SEQ ID NO: 791915 - protein, 9 aa, Homo Sapiens
CCGLPGPAP

SEQ ID NO: 791916 - protein, 9 aa, Homo Sapiens
KTNTGSAIN

SEQ ID NO: 791917 - protein, 9 aa, Homo Sapiens
PGPAPQQQT

SEQ ID NO: 791918 - protein, 9 aa, Homo Sapiens
CASPGPAAP

SEQ ID NO: 791919 - protein, 9 aa, Homo Sapiens
RVLLTGPLH

SEQ ID NO: 791920 - protein, 9 aa, Homo Sapiens
LRVEQECLL

SEQ ID NO: 791921 - protein, 9 aa, Homo Sapiens
RGGAGASVV

SEQ ID NO: 791922 - protein, 9 aa, Homo Sapiens
AHPWETQTV

SEQ ID NO: 791923 - protein, 9 aa, Homo Sapiens
FHYPSVGQL

SEQ ID NO: 791924 - protein, 9 aa, Homo Sapiens
NHVSFCYLR

SEQ ID NO: 791925 - protein, 9 aa, Homo Sapiens
SILEKEAHQ

SEQ ID NO: 791926 - protein, 9 aa, Homo Sapiens
ITQQCLHEP

SEQ ID NO: 791927 - protein, 9 aa, Homo Sapiens
TQQCLHEPM

SEQ ID NO: 791928 - protein, 9 aa, Homo Sapiens
QEPTKISQV

SEQ ID NO: 791929 - protein, 9 aa, Homo Sapiens
ASSVVDLTL

SEQ ID NO: 791930 - protein, 9 aa, Homo Sapiens
HAARPCRYF

SEQ ID NO: 791931 - protein, 9 aa, Homo Sapiens
IRYACSSSE

SEQ ID NO: 791932 - protein, 9 aa, Homo Sapiens
SFQLSKNSV

SEQ ID NO: 791933 - protein, 9 aa, Homo Sapiens
QDVLMQHSR

SEQ ID NO: 791934 - protein, 9 aa, Homo Sapiens
IDFIEVIYR

SEQ ID NO: 791935 - protein, 9 aa, Homo Sapiens
LKPGIVLFL

SEQ ID NO: 791936 - protein, 9 aa, Homo Sapiens
KILAMCFAM

SEQ ID NO: 791937 - protein, 9 aa, Homo Sapiens
EEPPPASPH

SEQ ID NO: 791938 - protein, 9 aa, Homo Sapiens
RLACNKNGL

SEQ ID NO: 791939 - protein, 9 aa, Homo Sapiens
FPVVSEGSE

SEQ ID NO: 791940 - protein, 9 aa, Homo Sapiens
LLDDELISL

SEQ ID NO: 791941 - protein, 9 aa, Homo Sapiens
KAELEHIAF

SEQ ID NO: 791942 - protein, 9 aa, Homo Sapiens
SKNSVHRVL

SEQ ID NO: 791943 - protein, 9 aa, Homo Sapiens
YFPVVSEGS

SEQ ID NO: 791944 - protein, 9 aa, Homo Sapiens
ADPHARAHG

SEQ ID NO: 791945 - protein, 9 aa, Homo Sapiens
ELDISWSGF

SEQ ID NO: 791946 - protein, 9 aa, Homo Sapiens
CSAPLAASS

SEQ ID NO: 791947 - protein, 9 aa, Homo Sapiens
LWGTRGSIL

SEQ ID NO: 791948 - protein, 9 aa, Homo Sapiens
DRGEQSPGT

SEQ ID NO: 791949 - protein, 9 aa, Homo Sapiens
GIVLFLGAI

SEQ ID NO: 791950 - protein, 9 aa, Homo Sapiens
VLQNLAPGT

SEQ ID NO: 791951 - protein, 9 aa, Homo Sapiens
CRVWRIVSR

SEQ ID NO: 791952 - protein, 9 aa, Homo Sapiens
DTKGFHTGE

SEQ ID NO: 791953 - protein, 9 aa, Homo Sapiens
SVVVCRRKA

SEQ ID NO: 791954 - protein, 9 aa, Homo Sapiens
RYGKVLVQA

SEQ ID NO: 791955 - protein, 9 aa, Homo Sapiens
QSNCEWGTV

SEQ ID NO: 791956 - protein, 9 aa, Homo Sapiens
LGAEGGSGS

SEQ ID NO: 791957 - protein, 9 aa, Homo Sapiens
LQDVLMQHS

SEQ ID NO: 791958 - protein, 9 aa, Homo Sapiens
IDSPQYLTK

SEQ ID NO: 791959 - protein, 9 aa, Homo Sapiens
SRRIRYACS

SEQ ID NO: 791960 - protein, 9 aa, Homo Sapiens
GRLACNKNG

SEQ ID NO: 791961 - protein, 9 aa, Homo Sapiens
ISLGLSDPT

SEQ ID NO: 791962 - protein, 9 aa, Homo Sapiens
SPHPAAPTG

SEQ ID NO: 791963 - protein, 9 aa, Homo Sapiens
PKKEGSREC

SEQ ID NO: 791964 - protein, 9 aa, Homo Sapiens
SFFKRSVRW

SEQ ID NO: 791965 - protein, 9 aa, Homo Sapiens
FCYLRVLMR

SEQ ID NO: 791966 - protein, 9 aa, Homo Sapiens
SPGTGQQTR

SEQ ID NO: 791967 - protein, 9 aa, Homo Sapiens
YWFKGRTSR

SEQ ID NO: 791968 - protein, 9 aa, Homo Sapiens
KCWLSSMTM

SEQ ID NO: 791969 - protein, 9 aa, Homo Sapiens
RKTGAPVAT

SEQ ID NO: 791970 - protein, 9 aa, Homo Sapiens
PAACPVGCP

SEQ ID NO: 791971 - protein, 9 aa, Homo Sapiens
EQSRRLCYT

SEQ ID NO: 791972 - protein, 9 aa, Homo Sapiens
HIAFNPSLV

SEQ ID NO: 791973 - protein, 9 aa, Homo Sapiens
NPLILSYDK

SEQ ID NO: 791974 - protein, 9 aa, Homo Sapiens
LEPGASPDY

SEQ ID NO: 791975 - protein, 9 aa, Homo Sapiens
SAPLAASSV

SEQ ID NO: 791976 - protein, 9 aa, Homo Sapiens
EVLRVCVAV

SEQ ID NO: 791977 - protein, 9 aa, Homo Sapiens
MTKNQLEGI

SEQ ID NO: 791978 - protein, 9 aa, Homo Sapiens
PAVLQNLAP

SEQ ID NO: 791979 - protein, 9 aa, Homo Sapiens
VDLTLFILY

SEQ ID NO: 791980 - protein, 9 aa, Homo Sapiens
LRPDVSVAC

SEQ ID NO: 791981 - protein, 9 aa, Homo Sapiens
PTSQKEWEA

SEQ ID NO: 791982 - protein, 9 aa, Homo Sapiens
EVQPMTASW

SEQ ID NO: 791983 - protein, 9 aa, Homo Sapiens
NAACVPCDL

SEQ ID NO: 791984 - protein, 9 aa, Homo Sapiens
KYKPGMEQG

SEQ ID NO: 791985 - protein, 9 aa, Homo Sapiens
VIYVLNGRF

SEQ ID NO: 791986 - protein, 9 aa, Homo Sapiens
QECLLTAFR

SEQ ID NO: 791987 - protein, 9 aa, Homo Sapiens
APLAASSVV

SEQ ID NO: 791988 - protein, 9 aa, Homo Sapiens
LAASSVVDL

SEQ ID NO: 791989 - protein, 9 aa, Homo Sapiens
SESSCKCWL

SEQ ID NO: 791990 - protein, 9 aa, Homo Sapiens
VMPISTASE

SEQ ID NO: 791991 - protein, 9 aa, Homo Sapiens
LSVLQRVHT

SEQ ID NO: 791992 - protein, 9 aa, Homo Sapiens
LVQPGEVQR

SEQ ID NO: 791993 - protein, 9 aa, Homo Sapiens
AGKDCLEKQ

SEQ ID NO: 791994 - protein, 9 aa, Homo Sapiens
VATATVLAN

SEQ ID NO: 791995 - protein, 9 aa, Homo Sapiens
LVSEDVDEP

SEQ ID NO: 791996 - protein, 9 aa, Homo Sapiens
KRDIAMFKE

SEQ ID NO: 791997 - protein, 9 aa, Homo Sapiens
FLYIFFSIV

SEQ ID NO: 791998 - protein, 9 aa, Homo Sapiens
CFGDSGGRL

SEQ ID NO: 791999 - protein, 9 aa, Homo Sapiens
HGGMTPLHA

SEQ ID NO: 792000 - protein, 9 aa, Homo Sapiens
DCGAGKDCL

SEQ ID NO: 792001 - protein, 9 aa, Homo Sapiens
FKGRTSRKT

SEQ ID NO: 792002 - protein, 9 aa, Homo Sapiens
VLEKTKNLH

SEQ ID NO: 792003 - protein, 9 aa, Homo Sapiens
KVLVQATKT

SEQ ID NO: 792004 - protein, 9 aa, Homo Sapiens
RRYLCLCCG

SEQ ID NO: 792005 - protein, 9 aa, Homo Sapiens
RLCSTISCP

SEQ ID NO: 792006 - protein, 9 aa, Homo Sapiens
DIAMFKEEL

SEQ ID NO: 792007 - protein, 9 aa, Homo Sapiens
TTAEGIVMP

SEQ ID NO: 792008 - protein, 9 aa, Homo Sapiens
YREQRRGGE

SEQ ID NO: 792009 - protein, 9 aa, Homo Sapiens
QSGTYFPVV

SEQ ID NO: 792010 - protein, 9 aa, Homo Sapiens
PAPQQQTGD

SEQ ID NO: 792011 - protein, 9 aa, Homo Sapiens
SHSLVPFLA

SEQ ID NO: 792012 - protein, 9 aa, Homo Sapiens
SVRWNLSYT

SEQ ID NO: 792013 - protein, 9 aa, Homo Sapiens
PRLCSTISC

SEQ ID NO: 792014 - protein, 9 aa, Homo Sapiens
EVMREVQPM

SEQ ID NO: 792015 - protein, 9 aa, Homo Sapiens
IVSRRYLCL

SEQ ID NO: 792016 - protein, 9 aa, Homo Sapiens
LPGPAPQQQ

SEQ ID NO: 792017 - protein, 9 aa, Homo Sapiens
KLYETSPLT

SEQ ID NO: 792018 - protein, 9 aa, Homo Sapiens
RPDVSVACS

SEQ ID NO: 792019 - protein, 9 aa, Homo Sapiens
AQQLLLLKL

SEQ ID NO: 792020 - protein, 9 aa, Homo Sapiens
TFSQAAILL

SEQ ID NO: 792021 - protein, 9 aa, Homo Sapiens
PWETQTVPG

SEQ ID NO: 792022 - protein, 9 aa, Homo Sapiens
SLQDVLMQH

SEQ ID NO: 792023 - protein, 9 aa, Homo Sapiens
YYEILGVKP

SEQ ID NO: 792024 - protein, 9 aa, Homo Sapiens
MCSARACPA

SEQ ID NO: 792025 - protein, 9 aa, Homo Sapiens
VSEDVDEPR

SEQ ID NO: 792026 - protein, 9 aa, Homo Sapiens
VVAAFIDSP

SEQ ID NO: 792027 - protein, 9 aa, Homo Sapiens
GEEVLRVCV

SEQ ID NO: 792028 - protein, 9 aa, Homo Sapiens
LYHKYKPGM

SEQ ID NO: 792029 - protein, 9 aa, Homo Sapiens
EQECLLTAF

SEQ ID NO: 792030 - protein, 9 aa, Homo Sapiens
IVVAAFIDS

SEQ ID NO: 792031 - protein, 9 aa, Homo Sapiens
VSGQEPTKI

SEQ ID NO: 792032 - protein, 9 aa, Homo Sapiens
MAHEMGQNF

SEQ ID NO: 792033 - protein, 9 aa, Homo Sapiens
HYLYNQPSC

SEQ ID NO: 792034 - protein, 9 aa, Homo Sapiens
HTALVTGDL

SEQ ID NO: 792035 - protein, 9 aa, Homo Sapiens
VAVQRTCNL

SEQ ID NO: 792036 - protein, 9 aa, Homo Sapiens
PVVSEGSEP

SEQ ID NO: 792037 - protein, 9 aa, Homo Sapiens
RMPPWDLSL

SEQ ID NO: 792038 - protein, 9 aa, Homo Sapiens
GIVMPISTA

SEQ ID NO: 792039 - protein, 9 aa, Homo Sapiens
PHMGIHAAR

SEQ ID NO: 792040 - protein, 9 aa, Homo Sapiens
MPPWDLSLP

SEQ ID NO: 792041 - protein, 9 aa, Homo Sapiens
TLLEPGASP

SEQ ID NO: 792042 - protein, 9 aa, Homo Sapiens
SPGPAAPLG

SEQ ID NO: 792043 - protein, 9 aa, Homo Sapiens
LLEPGASPD

SEQ ID NO: 792044 - protein, 9 aa, Homo Sapiens
NQLEGINQH

SEQ ID NO: 792045 - protein, 9 aa, Homo Sapiens
GSVSDLLSW

SEQ ID NO: 792046 - protein, 9 aa, Homo Sapiens
EDVDEPRAI

SEQ ID NO: 792047 - protein, 9 aa, Homo Sapiens
ILAMCFAML

SEQ ID NO: 792048 - protein, 9 aa, Homo Sapiens
DVRPHYYGK

SEQ ID NO: 792049 - protein, 9 aa, Homo Sapiens
DVSVACSAV

SEQ ID NO: 792050 - protein, 9 aa, Homo Sapiens
SAEPTVKLG

SEQ ID NO: 792051 - protein, 9 aa, Homo Sapiens
FFKRSVRWN

SEQ ID NO: 792052 - protein, 9 aa, Homo Sapiens
VACSAVTKS

SEQ ID NO: 792053 - protein, 9 aa, Homo Sapiens
LCCGLPGPA

SEQ ID NO: 792054 - protein, 9 aa, Homo Sapiens
TWILGVLWG

SEQ ID NO: 792055 - protein, 9 aa, Homo Sapiens
VQPMTASWY

SEQ ID NO: 792056 - protein, 9 aa, Homo Sapiens
LLLKLQRLM

SEQ ID NO: 792057 - protein, 9 aa, Homo Sapiens
ELGASMEQS

SEQ ID NO: 792058 - protein, 9 aa, Homo Sapiens
ASWYCSAPL

SEQ ID NO: 792059 - protein, 9 aa, Homo Sapiens
ACPAACPVG

SEQ ID NO: 792060 - protein, 9 aa, Homo Sapiens
DTQTFSRSA

SEQ ID NO: 792061 - protein, 9 aa, Homo Sapiens
SWYCSAPLA

SEQ ID NO: 792062 - protein, 9 aa, Homo Sapiens
WLRPVELGG

SEQ ID NO: 792063 - protein, 9 aa, Homo Sapiens
KQTANVVAV

SEQ ID NO: 792064 - protein, 9 aa, Homo Sapiens
CLKSTVDSP

SEQ ID NO: 792065 - protein, 9 aa, Homo Sapiens
PSAEPTVKL

SEQ ID NO: 792066 - protein, 9 aa, Homo Sapiens
IVIMVLFVL

SEQ ID NO: 792067 - protein, 9 aa, Homo Sapiens
RLVADHEKV

SEQ ID NO: 792068 - protein, 9 aa, Homo Sapiens
RTGMSKEKT

SEQ ID NO: 792069 - protein, 9 aa, Homo Sapiens
AAPTGTWIL

SEQ ID NO: 792070 - protein, 9 aa, Homo Sapiens
KETQYYEIL

SEQ ID NO: 792071 - protein, 9 aa, Homo Sapiens
FIEVIYRGA

SEQ ID NO: 792072 - protein, 9 aa, Homo Sapiens
ACVPCDLVT

SEQ ID NO: 792073 - protein, 9 aa, Homo Sapiens
MKPPTSQKE

SEQ ID NO: 792074 - protein, 9 aa, Homo Sapiens
NNQFELYRI

SEQ ID NO: 792075 - protein, 9 aa, Homo Sapiens
DSPQYLTKT

SEQ ID NO: 792076 - protein, 9 aa, Homo Sapiens
QSGADRYVV

SEQ ID NO: 792077 - protein, 9 aa, Homo Sapiens
TRGSILEKE

SEQ ID NO: 792078 - protein, 9 aa, Homo Sapiens
AKRQSGADR

SEQ ID NO: 792079 - protein, 9 aa, Homo Sapiens
DHPKSYKLM

SEQ ID NO: 792080 - protein, 9 aa, Homo Sapiens
GPSRPLAPE

SEQ ID NO: 792081 - protein, 9 aa, Homo Sapiens
RVWRIVSRR

SEQ ID NO: 792082 - protein, 9 aa, Homo Sapiens
GTVFPKSPR

SEQ ID NO: 792083 - protein, 9 aa, Homo Sapiens
LHLKIVVAA

SEQ ID NO: 792084 - protein, 9 aa, Homo Sapiens
FPDEFGSCV

SEQ ID NO: 792085 - protein, 9 aa, Homo Sapiens
ESSCKCWLS

SEQ ID NO: 792086 - protein, 9 aa, Homo Sapiens
CSAVTKSAG

SEQ ID NO: 792087 - protein, 9 aa, Homo Sapiens
MLKRDIAMF

SEQ ID NO: 792088 - protein, 9 aa, Homo Sapiens
MKLYETSPL

SEQ ID NO: 792089 - protein, 9 aa, Homo Sapiens
AAQLKLSPY

SEQ ID NO: 792090 - protein, 9 aa, Homo Sapiens
MGIHAARPC

SEQ ID NO: 792091 - protein, 9 aa, Homo Sapiens
IQVIDVNDN

SEQ ID NO: 792092 - protein, 9 aa, Homo Sapiens
RRIRYACSS

SEQ ID NO: 792093 - protein, 9 aa, Homo Sapiens
SVHRVLKAV

SEQ ID NO: 792094 - protein, 9 aa, Homo Sapiens
KEKTQHLEQ

SEQ ID NO: 792095 - protein, 9 aa, Homo Sapiens
RDIAMFKEE

SEQ ID NO: 792096 - protein, 9 aa, Homo Sapiens
CSARACPAA

SEQ ID NO: 792097 - protein, 9 aa, Homo Sapiens
PMDLQLQSS

SEQ ID NO: 792098 - protein, 9 aa, Homo Sapiens
KPAVLQNLA

SEQ ID NO: 792099 - protein, 9 aa, Homo Sapiens
LEHIAFNPS

SEQ ID NO: 792100 - protein, 9 aa, Homo Sapiens
EKENGKMGW

SEQ ID NO: 792101 - protein, 9 aa, Homo Sapiens
RWNLSYTCR

SEQ ID NO: 792102 - protein, 9 aa, Homo Sapiens
QTANVVAVQ

SEQ ID NO: 792103 - protein, 9 aa, Homo Sapiens
RIQVIDVND

SEQ ID NO: 792104 - protein, 9 aa, Homo Sapiens
RECLKSTVD

SEQ ID NO: 792105 - protein, 9 aa, Homo Sapiens
GPPIAPLPP

SEQ ID NO: 792106 - protein, 9 aa, Homo Sapiens
FDGRRSIFS

SEQ ID NO: 792107 - protein, 9 aa, Homo Sapiens
EGSRECLKS

SEQ ID NO: 792108 - protein, 9 aa, Homo Sapiens
QEALVNRPW

SEQ ID NO: 792109 - protein, 9 aa, Homo Sapiens
APLPPGPPI

SEQ ID NO: 792110 - protein, 9 aa, Homo Sapiens
PGCPRVLLT

SEQ ID NO: 792111 - protein, 9 aa, Homo Sapiens
TFSRSAANA

SEQ ID NO: 792112 - protein, 9 aa, Homo Sapiens
DDELISLGL

SEQ ID NO: 792113 - protein, 9 aa, Homo Sapiens
REVQPMTAS

SEQ ID NO: 792114 - protein, 9 aa, Homo Sapiens
RAHGGMTPL

SEQ ID NO: 792115 - protein, 9 aa, Homo Sapiens
KVLEKTKNL

SEQ ID NO: 792116 - protein, 9 aa, Homo Sapiens
TYSRSSRRI

SEQ ID NO: 792117 - protein, 9 aa, Homo Sapiens
RELLKEKPF

SEQ ID NO: 792118 - protein, 9 aa, Homo Sapiens
GNANMMNKL

SEQ ID NO: 792119 - protein, 9 aa, Homo Sapiens
NKETGHVYV

SEQ ID NO: 792120 - protein, 9 aa, Homo Sapiens
PGPPIAPLP

SEQ ID NO: 792121 - protein, 9 aa, Homo Sapiens
SRMPPWDLS

SEQ ID NO: 792122 - protein, 9 aa, Homo Sapiens
KGFHTGEDI

SEQ ID NO: 792123 - protein, 9 aa, Homo Sapiens
KSYKLMEMK

SEQ ID NO: 792124 - protein, 9 aa, Homo Sapiens
RLKRELVAT

SEQ ID NO: 792125 - protein, 9 aa, Homo Sapiens
FGDSGGRLA

SEQ ID NO: 792126 - protein, 9 aa, Homo Sapiens
LSSESSCKC

SEQ ID NO: 792127 - protein, 9 aa, Homo Sapiens
EKTKNLHLK

SEQ ID NO: 792128 - protein, 9 aa, Homo Sapiens
YLRVLMRNR

SEQ ID NO: 792129 - protein, 9 aa, Homo Sapiens
MGDVRPHYY

SEQ ID NO: 792130 - protein, 9 aa, Homo Sapiens
TEVSGTQTA

SEQ ID NO: 792131 - protein, 9 aa, Homo Sapiens
GLVQPGEVQ

SEQ ID NO: 792132 - protein, 9 aa, Homo Sapiens
ASPGPAAPL

SEQ ID NO: 792133 - protein, 9 aa, Homo Sapiens
RANLHMKLY

SEQ ID NO: 792134 - protein, 9 aa, Homo Sapiens
ALTLMGYIF

SEQ ID NO: 792135 - protein, 9 aa, Homo Sapiens
QSRRLCYTA

SEQ ID NO: 792136 - protein, 9 aa, Homo Sapiens
TGDLDHLKP

SEQ ID NO: 792137 - protein, 9 aa, Homo Sapiens
LTGPLHILE

SEQ ID NO: 792138 - protein, 9 aa, Homo Sapiens
GALTLMGYI

SEQ ID NO: 792139 - protein, 9 aa, Homo Sapiens
ATMAHEMGQ

SEQ ID NO: 792140 - protein, 9 aa, Homo Sapiens
GARLKRELV

SEQ ID NO: 792141 - protein, 9 aa, Homo Sapiens
PEEPPPASP

SEQ ID NO: 792142 - protein, 9 aa, Homo Sapiens
GCPRVLLTG

SEQ ID NO: 792143 - protein, 9 aa, Homo Sapiens
NLHLKIVVA

SEQ ID NO: 792144 - protein, 9 aa, Homo Sapiens
TVFPKSPRE

SEQ ID NO: 792145 - protein, 9 aa, Homo Sapiens
HVSFCYLRV

SEQ ID NO: 792146 - protein, 9 aa, Homo Sapiens
NPRSRMPPW

SEQ ID NO: 792147 - protein, 9 aa, Homo Sapiens
TGMSKEKTQ

SEQ ID NO: 792148 - protein, 9 aa, Homo Sapiens
ETRPLYHKY

SEQ ID NO: 792149 - protein, 9 aa, Homo Sapiens
MDHPKSYKL

SEQ ID NO: 792150 - protein, 9 aa, Homo Sapiens
NVWLRPVEL

SEQ ID NO: 792151 - protein, 9 aa, Homo Sapiens
PPASPHPAA

SEQ ID NO: 792152 - protein, 9 aa, Homo Sapiens
WNLSYTCRA

SEQ ID NO: 792153 - protein, 9 aa, Homo Sapiens
CLLTAFRCG

SEQ ID NO: 792154 - protein, 9 aa, Homo Sapiens
CLHEPMYYF

SEQ ID NO: 792155 - protein, 9 aa, Homo Sapiens
DLISEFPDE

SEQ ID NO: 792156 - protein, 9 aa, Homo Sapiens
VLWGTRGSI

SEQ ID NO: 792157 - protein, 9 aa, Homo Sapiens
AVQAVEDAA

SEQ ID NO: 792158 - protein, 9 aa, Homo Sapiens
PDEFGSCVP

SEQ ID NO: 792159 - protein, 9 aa, Homo Sapiens
DVDEPRAIA

SEQ ID NO: 792160 - protein, 9 aa, Homo Sapiens
LVATATVLA

SEQ ID NO: 792161 - protein, 9 aa, Homo Sapiens
IAPLPPRSH

SEQ ID NO: 792162 - protein, 9 aa, Homo Sapiens
VSDLLSWPK

SEQ ID NO: 792163 - protein, 9 aa, Homo Sapiens
VLRVCVAVK

SEQ ID NO: 792164 - protein, 9 aa, Homo Sapiens
HARAHGGMT

SEQ ID NO: 792165 - protein, 9 aa, Homo Sapiens
DGSACSSGI

SEQ ID NO: 792166 - protein, 9 aa, Homo Sapiens
TKGFHTGED

SEQ ID NO: 792167 - protein, 9 aa, Homo Sapiens
KGRTSRKTG

SEQ ID NO: 792168 - protein, 9 aa, Homo Sapiens
KEGSRECLK

SEQ ID NO: 792169 - protein, 9 aa, Homo Sapiens
SRSSRRIRY

SEQ ID NO: 792170 - protein, 9 aa, Homo Sapiens
GVDQHGLVQ

SEQ ID NO: 792171 - protein, 9 aa, Homo Sapiens
VPTKVLEKT

SEQ ID NO: 792172 - protein, 9 aa, Homo Sapiens
LRVCVAVKK

SEQ ID NO: 792173 - protein, 9 aa, Homo Sapiens
NGKMGWWSI

SEQ ID NO: 792174 - protein, 9 aa, Homo Sapiens
TASGNANMM

SEQ ID NO: 792175 - protein, 9 aa, Homo Sapiens
QDFIDFIEV

SEQ ID NO: 792176 - protein, 9 aa, Homo Sapiens
TKQDFIDFI

SEQ ID NO: 792177 - protein, 9 aa, Homo Sapiens
GSILEKEAH

SEQ ID NO: 792178 - protein, 9 aa, Homo Sapiens
EKEAHQEAP

SEQ ID NO: 792179 - protein, 9 aa, Homo Sapiens
HVYVYLVGQ

SEQ ID NO: 792180 - protein, 9 aa, Homo Sapiens
TDTQTFSRS

SEQ ID NO: 792181 - protein, 9 aa, Homo Sapiens
QHSRLYLIF

SEQ ID NO: 792182 - protein, 8 aa, Homo Sapiens
PGLSCRFY

SEQ ID NO: 792183 - protein, 9 aa, Homo Sapiens
QNKETGHVY

SEQ ID NO: 792184 - protein, 9 aa, Homo Sapiens
LTVVIYVLN

SEQ ID NO: 792185 - protein, 9 aa, Homo Sapiens
DHEKVACSG

SEQ ID NO: 792186 - protein, 9 aa, Homo Sapiens
WMYTFSQAA

SEQ ID NO: 792187 - protein, 9 aa, Homo Sapiens
SGADRYVVE

SEQ ID NO: 792188 - protein, 9 aa, Homo Sapiens
RELRVEQEC

SEQ ID NO: 792189 - protein, 9 aa, Homo Sapiens
SEFPDEFGS

SEQ ID NO: 792190 - protein, 9 aa, Homo Sapiens
ALKTLLEPG

SEQ ID NO: 792191 - protein, 9 aa, Homo Sapiens
LPPGPPIAP

SEQ ID NO: 792192 - protein, 9 aa, Homo Sapiens
EAPHCRVWR

SEQ ID NO: 792193 - protein, 9 aa, Homo Sapiens
SAINYVGKI

SEQ ID NO: 792194 - protein, 9 aa, Homo Sapiens
RSNEFHYPS

SEQ ID NO: 792195 - protein, 9 aa, Homo Sapiens
LEMDHPKSY

SEQ ID NO: 792196 - protein, 9 aa, Homo Sapiens
EKTQHLEQC

SEQ ID NO: 792197 - protein, 9 aa, Homo Sapiens
TKNLHLKIV

SEQ ID NO: 792198 - protein, 9 aa, Homo Sapiens
VVVCRRKAE

SEQ ID NO: 792199 - protein, 9 aa, Homo Sapiens
TSRKTGAPV

SEQ ID NO: 792200 - protein, 9 aa, Homo Sapiens
APTGTWILG

SEQ ID NO: 792201 - protein, 9 aa, Homo Sapiens
SSGISGGRG

SEQ ID NO: 792202 - protein, 9 aa, Homo Sapiens
VAVFPSHSL

SEQ ID NO: 792203 - protein, 9 aa, Homo Sapiens
WPKPWHKLS

SEQ ID NO: 792204 - protein, 9 aa, Homo Sapiens
RTFVLKPGI

SEQ ID NO: 792205 - protein, 9 aa, Homo Sapiens
PLILSYDKR

SEQ ID NO: 792206 - protein, 9 aa, Homo Sapiens
IYVLNGRFC

SEQ ID NO: 792207 - protein, 9 aa, Homo Sapiens
EYHTALVTG

SEQ ID NO: 792208 - protein, 9 aa, Homo Sapiens
QVIDVNDNA

SEQ ID NO: 792209 - protein, 9 aa, Homo Sapiens
GGRLACNKN

SEQ ID NO: 792210 - protein, 9 aa, Homo Sapiens
EFHYPSVGQ

SEQ ID NO: 792211 - protein, 9 aa, Homo Sapiens
RSVAVFPSH

SEQ ID NO: 792212 - protein, 9 aa, Homo Sapiens
WRIVSRRYL

SEQ ID NO: 792213 - protein, 9 aa, Homo Sapiens
MREVQPMTA

SEQ ID NO: 792214 - protein, 9 aa, Homo Sapiens
MTASWYCSA

SEQ ID NO: 792215 - protein, 9 aa, Homo Sapiens
TFVLKPGIV

SEQ ID NO: 792216 - protein, 9 aa, Homo Sapiens
QHGLVQPGE

SEQ ID NO: 792217 - protein, 9 aa, Homo Sapiens
TQHLEQCSI

SEQ ID NO: 792218 - protein, 9 aa, Homo Sapiens
LRPVELGGA

SEQ ID NO: 792219 - protein, 9 aa, Homo Sapiens
CWLSSMTMD

SEQ ID NO: 792220 - protein, 9 aa, Homo Sapiens
SRRYLCLCC

SEQ ID NO: 792221 - protein, 9 aa, Homo Sapiens
GEQSPGTGQ

SEQ ID NO: 792222 - protein, 9 aa, Homo Sapiens
VSGTQTAAQ

SEQ ID NO: 792223 - protein, 9 aa, Homo Sapiens
LGKHGVNLA

SEQ ID NO: 792224 - protein, 9 aa, Homo Sapiens
NSVHRVLKA

SEQ ID NO: 792225 - protein, 9 aa, Homo Sapiens
VVSEGSEPA

SEQ ID NO: 792226 - protein, 9 aa, Homo Sapiens
LQLQSSDEQ

SEQ ID NO: 792227 - protein, 9 aa, Homo Sapiens
YEILGVKPS

SEQ ID NO: 792228 - protein, 9 aa, Homo Sapiens
KCGDCPSAE

SEQ ID NO: 792229 - protein, 9 aa, Homo Sapiens
QEAPHCRVW

SEQ ID NO: 792230 - protein, 9 aa, Homo Sapiens
MDLQLQSSD

SEQ ID NO: 792231 - protein, 9 aa, Homo Sapiens
KNLHLKIVV

SEQ ID NO: 792232 - protein, 9 aa, Homo Sapiens
KTKNLHLKI

SEQ ID NO: 792233 - protein, 9 aa, Homo Sapiens
QINLSKRQV

SEQ ID NO: 792234 - protein, 9 aa, Homo Sapiens
PPIAPLPPR

SEQ ID NO: 792235 - protein, 9 aa, Homo Sapiens
MGWWSIEHV

SEQ ID NO: 792236 - protein, 9 aa, Homo Sapiens
EFGSCVPHT

SEQ ID NO: 792237 - protein, 9 aa, Homo Sapiens
GPCASPGPA

SEQ ID NO: 792238 - protein, 9 aa, Homo Sapiens
PKSPRELLK

SEQ ID NO: 792239 - protein, 9 aa, Homo Sapiens
PRVLLTGPL

SEQ ID NO: 792240 - protein, 9 aa, Homo Sapiens
WETQTVPGL

SEQ ID NO: 792241 - protein, 9 aa, Homo Sapiens
LCLCCGLPG

SEQ ID NO: 792242 - protein, 9 aa, Homo Sapiens
VLLTGPLHI

SEQ ID NO: 792243 - protein, 9 aa, Homo Sapiens
HLSVLQRVH

SEQ ID NO: 792244 - protein, 9 aa, Homo Sapiens
THLSVLQRV

SEQ ID NO: 792245 - protein, 9 aa, Homo Sapiens
IVMPISTAS

SEQ ID NO: 792246 - protein, 9 aa, Homo Sapiens
LYIFFSIVI

SEQ ID NO: 792247 - protein, 9 aa, Homo Sapiens
DISWSGFVG

SEQ ID NO: 792248 - protein, 9 aa, Homo Sapiens
RSDGSACSS

SEQ ID NO: 792249 - protein, 9 aa, Homo Sapiens
LDDELISLG

SEQ ID NO: 792250 - protein, 9 aa, Homo Sapiens
LSKNSVHRV

SEQ ID NO: 792251 - protein, 9 aa, Homo Sapiens
PGIVLFLGA

SEQ ID NO: 792252 - protein, 9 aa, Homo Sapiens
TISCPGPSW

SEQ ID NO: 792253 - protein, 9 aa, Homo Sapiens
GGTYPPQDA

SEQ ID NO: 792254 - protein, 9 aa, Homo Sapiens
SQAAILLSI

SEQ ID NO: 792255 - protein, 9 aa, Homo Sapiens
QNFGMTHDS

SEQ ID NO: 792256 - protein, 9 aa, Homo Sapiens
LFVIITQQC

SEQ ID NO: 792257 - protein, 9 aa, Homo Sapiens
GKGLGAEGG

SEQ ID NO: 792258 - protein, 9 aa, Homo Sapiens
KRSNEFHYP

SEQ ID NO: 792259 - protein, 9 aa, Homo Sapiens
QEYHTALVT

SEQ ID NO: 792260 - protein, 9 aa, Homo Sapiens
ELEHIAFNP

SEQ ID NO: 792261 - protein, 9 aa, Homo Sapiens
AMFKEELYA

SEQ ID NO: 792262 - protein, 9 aa, Homo Sapiens
SDGSACSSG

SEQ ID NO: 792263 - protein, 9 aa, Homo Sapiens
ILGVLWGTR

SEQ ID NO: 792264 - protein, 9 aa, Homo Sapiens
VDLKRKPAV

SEQ ID NO: 792265 - protein, 9 aa, Homo Sapiens
LFAKRQSGA

SEQ ID NO: 792266 - protein, 9 aa, Homo Sapiens
KGLGAEGGS

SEQ ID NO: 792267 - protein, 9 aa, Homo Sapiens
RPWKRMDKL

SEQ ID NO: 792268 - protein, 9 aa, Homo Sapiens
SVVDLTLFI

SEQ ID NO: 792269 - protein, 9 aa, Homo Sapiens
NTGSAINYV

SEQ ID NO: 792270 - protein, 9 aa, Homo Sapiens
TGEDIGGLH

SEQ ID NO: 792271 - protein, 9 aa, Homo Sapiens
KNQLEGINQ

SEQ ID NO: 792272 - protein, 9 aa, Homo Sapiens
TAAQLKLSP

SEQ ID NO: 792273 - protein, 9 aa, Homo Sapiens
TFDGRRSIF

SEQ ID NO: 792274 - protein, 9 aa, Homo Sapiens
GWWSIEHVE

SEQ ID NO: 792275 - protein, 9 aa, Homo Sapiens
GTRGSILEK

SEQ ID NO: 792276 - protein, 9 aa, Homo Sapiens
GKMGWWSIE

SEQ ID NO: 792277 - protein, 9 aa, Homo Sapiens
VRPHYYGKH

SEQ ID NO: 792278 - protein, 9 aa, Homo Sapiens
VELGGAPKE

SEQ ID NO: 792279 - protein, 9 aa, Homo Sapiens
RSAANAKLN

SEQ ID NO: 792280 - protein, 9 aa, Homo Sapiens
QSNNQFELY

SEQ ID NO: 792281 - protein, 9 aa, Homo Sapiens
NGRFCGYKS

SEQ ID NO: 792282 - protein, 9 aa, Homo Sapiens
ELYRITEAT

SEQ ID NO: 792283 - protein, 9 aa, Homo Sapiens
SKSGLMTKN

SEQ ID NO: 792284 - protein, 9 aa, Homo Sapiens
GAGKDCLEK

SEQ ID NO: 792285 - protein, 9 aa, Homo Sapiens
SLALFPHMG

SEQ ID NO: 792286 - protein, 9 aa, Homo Sapiens
RPLYHKYKP

SEQ ID NO: 792287 - protein, 9 aa, Homo Sapiens
LLLLKLQRL

SEQ ID NO: 792288 - protein, 9 aa, Homo Sapiens
MCNSFCMGG

SEQ ID NO: 792289 - protein, 9 aa, Homo Sapiens
LGVLWGTRG

SEQ ID NO: 792290 - protein, 9 aa, Homo Sapiens
VVCRRKAEA

SEQ ID NO: 792291 - protein, 9 aa, Homo Sapiens
VSRRYLCLC

SEQ ID NO: 792292 - protein, 9 aa, Homo Sapiens
SGLMTKNQL

SEQ ID NO: 792293 - protein, 9 aa, Homo Sapiens
NLQSNCEWG

SEQ ID NO: 792294 - protein, 9 aa, Homo Sapiens
YGKVLVQAT

SEQ ID NO: 792295 - protein, 9 aa, Homo Sapiens
VEQECLLTA

SEQ ID NO: 792296 - protein, 9 aa, Homo Sapiens
ELVATATVL

SEQ ID NO: 792297 - protein, 9 aa, Homo Sapiens
PRELLKEKP

SEQ ID NO: 792298 - protein, 9 aa, Homo Sapiens
TGPLHILEP

SEQ ID NO: 792299 - protein, 9 aa, Homo Sapiens
CSSGISGGR

SEQ ID NO: 792300 - protein, 9 aa, Homo Sapiens
APHCRVWRI

SEQ ID NO: 792301 - protein, 9 aa, Homo Sapiens
LLTGPLHIL

SEQ ID NO: 792302 - protein, 9 aa, Homo Sapiens
LPQINLSKR

SEQ ID NO: 792303 - protein, 9 aa, Homo Sapiens
IFAAVGGME

SEQ ID NO: 792304 - protein, 9 aa, Homo Sapiens
MPISTASEG

SEQ ID NO: 792305 - protein, 9 aa, Homo Sapiens
LQSNCEWGT

SEQ ID NO: 792306 - protein, 9 aa, Homo Sapiens
SHYLYNQPS

SEQ ID NO: 792307 - protein, 9 aa, Homo Sapiens
RPPMDLQLQ

SEQ ID NO: 792308 - protein, 9 aa, Homo Sapiens
CLCCGLPGP

SEQ ID NO: 792309 - protein, 9 aa, Homo Sapiens
DLTLFILYD

SEQ ID NO: 792310 - protein, 9 aa, Homo Sapiens
VNRPWKRMD

SEQ ID NO: 792311 - protein, 9 aa, Homo Sapiens
NVVAVQRTC

SEQ ID NO: 792312 - protein, 9 aa, Homo Sapiens
SPRLCSTIS

SEQ ID NO: 792313 - protein, 9 aa, Homo Sapiens
EAVPTKVLE

SEQ ID NO: 792314 - protein, 9 aa, Homo Sapiens
LEKEAHQEA

SEQ ID NO: 792315 - protein, 9 aa, Homo Sapiens
TGDRGEQSP

SEQ ID NO: 792316 - protein, 9 aa, Homo Sapiens
FVIITQQCL

SEQ ID NO: 792317 - protein, 9 aa, Homo Sapiens
LALFPHMGI

SEQ ID NO: 792318 - protein, 9 aa, Homo Sapiens
TALVTGDLD

SEQ ID NO: 792319 - protein, 9 aa, Homo Sapiens
YSRSSRRIR

SEQ ID NO: 792320 - protein, 9 aa, Homo Sapiens
EILGVKPSA

SEQ ID NO: 792321 - protein, 9 aa, Homo Sapiens
IFFSIVIMV

SEQ ID NO: 792322 - protein, 9 aa, Homo Sapiens
PMTASWYCS

SEQ ID NO: 792323 - protein, 9 aa, Homo Sapiens
SVSDLLSWP

SEQ ID NO: 792324 - protein, 9 aa, Homo Sapiens
FPKSPRELL

SEQ ID NO: 792325 - protein, 9 aa, Homo Sapiens
ENGKMGWWS

SEQ ID NO: 792326 - protein, 9 aa, Homo Sapiens
KTHLSVLQR

SEQ ID NO: 792327 - protein, 9 aa, Homo Sapiens
QAAILLSIV

SEQ ID NO: 792328 - protein, 9 aa, Homo Sapiens
SVAVFPSHS

SEQ ID NO: 792329 - protein, 9 aa, Homo Sapiens
DWMYTFSQA

SEQ ID NO: 792330 - protein, 9 aa, Homo Sapiens
ETQYYEILG

SEQ ID NO: 792331 - protein, 9 aa, Homo Sapiens
LRYGKVLVQ

SEQ ID NO: 792332 - protein, 9 aa, Homo Sapiens
KRSVRWNLS

SEQ ID NO: 792333 - protein, 9 aa, Homo Sapiens
EVSGTQTAA

SEQ ID NO: 792334 - protein, 9 aa, Homo Sapiens
LGKGLGAEG

SEQ ID NO: 792335 - protein, 9 aa, Homo Sapiens
LYKRSNEFH

SEQ ID NO: 792336 - protein, 9 aa, Homo Sapiens
WILGVLWGT

SEQ ID NO: 792337 - protein, 9 aa, Homo Sapiens
SRSAANAKL

SEQ ID NO: 792338 - protein, 9 aa, Homo Sapiens
TGEEVLRVC

SEQ ID NO: 792339 - protein, 9 aa, Homo Sapiens
GSAINYVGK

SEQ ID NO: 792340 - protein, 9 aa, Homo Sapiens
NQSNNQFEL

SEQ ID NO: 792341 - protein, 9 aa, Homo Sapiens
AVPTKVLEK

SEQ ID NO: 792342 - protein, 9 aa, Homo Sapiens
ELISLGLSD

SEQ ID NO: 792343 - protein, 9 aa, Homo Sapiens
KRKPAVLQN

SEQ ID NO: 792344 - protein, 9 aa, Homo Sapiens
VALKTLLEP

SEQ ID NO: 792345 - protein, 9 aa, Homo Sapiens
TSQKEWEAE

SEQ ID NO: 792346 - protein, 9 aa, Homo Sapiens
LILSYDKRK

SEQ ID NO: 792347 - protein, 9 aa, Homo Sapiens
VIMVLFVLG

SEQ ID NO: 792348 - protein, 9 aa, Homo Sapiens
VSLLDDELI

SEQ ID NO: 792349 - protein, 9 aa, Homo Sapiens
SLLDDELIS

SEQ ID NO: 792350 - protein, 9 aa, Homo Sapiens
SDLLSWPKP

SEQ ID NO: 792351 - protein, 9 aa, Homo Sapiens
EELDISWSG

SEQ ID NO: 792352 - protein, 9 aa, Homo Sapiens
SWSGFVGGT

SEQ ID NO: 792353 - protein, 9 aa, Homo Sapiens
ACSSGISGG

SEQ ID NO: 792354 - protein, 9 aa, Homo Sapiens
EPGASPDYK

SEQ ID NO: 792355 - protein, 9 aa, Homo Sapiens
PGPCASPGP

SEQ ID NO: 792356 - protein, 9 aa, Homo Sapiens
LVTGDLDHL

SEQ ID NO: 792357 - protein, 9 aa, Homo Sapiens
KPPTSQKEW

SEQ ID NO: 792358 - protein, 9 aa, Homo Sapiens
LPGPCASPG

SEQ ID NO: 792359 - protein, 9 aa, Homo Sapiens
QTVPGLPIH

SEQ ID NO: 792360 - protein, 9 aa, Homo Sapiens
ASMEQSRRL

SEQ ID NO: 792361 - protein, 9 aa, Homo Sapiens
VLVQATKTI

SEQ ID NO: 792362 - protein, 9 aa, Homo Sapiens
ACFGDSGGR

SEQ ID NO: 792363 - protein, 9 aa, Homo Sapiens
RSRMPPWDL

SEQ ID NO: 792364 - protein, 9 aa, Homo Sapiens
GTYFPVVSE

SEQ ID NO: 792365 - protein, 9 aa, Homo Sapiens
WGTRGSILE

SEQ ID NO: 792366 - protein, 9 aa, Homo Sapiens
IITQQCLHE

SEQ ID NO: 792367 - protein, 9 aa, Homo Sapiens
SGGRLACNK

SEQ ID NO: 792368 - protein, 9 aa, Homo Sapiens
KSPRELLKE

SEQ ID NO: 792369 - protein, 9 aa, Homo Sapiens
VMFLRYGKV

SEQ ID NO: 792370 - protein, 9 aa, Homo Sapiens
STVRIQVID

SEQ ID NO: 792371 - protein, 9 aa, Homo Sapiens
DLQLQSSDE

SEQ ID NO: 792372 - protein, 9 aa, Homo Sapiens
HPAAPTGTW

SEQ ID NO: 792373 - protein, 9 aa, Homo Sapiens
VLKPGIVLF

SEQ ID NO: 792374 - protein, 9 aa, Homo Sapiens
NQFELYRIT

SEQ ID NO: 792375 - protein, 9 aa, Homo Sapiens
RSTPKILAM

SEQ ID NO: 792376 - protein, 9 aa, Homo Sapiens
TGSAINYVG

SEQ ID NO: 792377 - protein, 9 aa, Homo Sapiens
ANVVAVQRT

SEQ ID NO: 792378 - protein, 9 aa, Homo Sapiens
RGEQSPGTG

SEQ ID NO: 792379 - protein, 9 aa, Homo Sapiens
KEWEAEFQR

SEQ ID NO: 792380 - protein, 9 aa, Homo Sapiens
LFPHMGIHA

SEQ ID NO: 792381 - protein, 9 aa, Homo Sapiens
HKYKPGMEQ

SEQ ID NO: 792382 - protein, 9 aa, Homo Sapiens
SEDVDEPRA

SEQ ID NO: 792383 - protein, 9 aa, Homo Sapiens
MSKEKTQHL

SEQ ID NO: 792384 - protein, 9 aa, Homo Sapiens
FELYRITEA

SEQ ID NO: 792385 - protein, 9 aa, Homo Sapiens
LAMCFAMLG

SEQ ID NO: 792386 - protein, 9 aa, Homo Sapiens
VVAVQRTCN

SEQ ID NO: 792387 - protein, 9 aa, Homo Sapiens
SVACSAVTK

SEQ ID NO: 792388 - protein, 9 aa, Homo Sapiens
VLNGRFCGY

SEQ ID NO: 792389 - protein, 9 aa, Homo Sapiens
PPTSQKEWE

SEQ ID NO: 792390 - protein, 9 aa, Homo Sapiens
LNPLILSYD

SEQ ID NO: 792391 - protein, 9 aa, Homo Sapiens
VQAVEDAAG

SEQ ID NO: 792392 - protein, 9 aa, Homo Sapiens
ADHEKVACS

SEQ ID NO: 792393 - protein, 9 aa, Homo Sapiens
REQRRGGER

SEQ ID NO: 792394 - protein, 9 aa, Homo Sapiens
YIFFSIVIM

SEQ ID NO: 792395 - protein, 9 aa, Homo Sapiens
RACPAACPV

SEQ ID NO: 792396 - protein, 9 aa, Homo Sapiens
SYDKRKRFH

SEQ ID NO: 792397 - protein, 9 aa, Homo Sapiens
RGGERPSQP

SEQ ID NO: 792398 - protein, 9 aa, Homo Sapiens
QTFSRSAAN

SEQ ID NO: 792399 - protein, 9 aa, Homo Sapiens
CNSFCMGGM

SEQ ID NO: 792400 - protein, 9 aa, Homo Sapiens
FPSHSLVPF

SEQ ID NO: 792401 - protein, 9 aa, Homo Sapiens
YKPGMEQGR

SEQ ID NO: 792402 - protein, 9 aa, Homo Sapiens
LVRLVADHE

SEQ ID NO: 792403 - protein, 9 aa, Homo Sapiens
GKDCLEKQE

SEQ ID NO: 792404 - protein, 9 aa, Homo Sapiens
LISLGLSDP

SEQ ID NO: 792405 - protein, 9 aa, Homo Sapiens
GHVYVYLVG

SEQ ID NO: 792406 - protein, 9 aa, Homo Sapiens
YVLNGRFCG

SEQ ID NO: 792407 - protein, 9 aa, Homo Sapiens
KDCLEKQEE

SEQ ID NO: 792408 - protein, 9 aa, Homo Sapiens
GSRECLKST

SEQ ID NO: 792409 - protein, 9 aa, Homo Sapiens
LQAVQAVED

SEQ ID NO: 792410 - protein, 9 aa, Homo Sapiens
APQQQTGDR

SEQ ID NO: 792411 - protein, 9 aa, Homo Sapiens
EALVNRPWK

SEQ ID NO: 792412 - protein, 9 aa, Homo Sapiens
RQSGADRYV

SEQ ID NO: 792413 - protein, 9 aa, Homo Sapiens
KILVSEDVD

SEQ ID NO: 792414 - protein, 9 aa, Homo Sapiens
STPKILAMC

SEQ ID NO: 792415 - protein, 9 aa, Homo Sapiens
GTYPPQDAE

SEQ ID NO: 792416 - protein, 9 aa, Homo Sapiens
FAKRQSGAD

SEQ ID NO: 792417 - protein, 9 aa, Homo Sapiens
SARACPAAC

SEQ ID NO: 792418 - protein, 9 aa, Homo Sapiens
GGAGASVVV

SEQ ID NO: 792419 - protein, 9 aa, Homo Sapiens
HGVNLAMEQ

SEQ ID NO: 792420 - protein, 9 aa, Homo Sapiens
SWPKPWHKL

SEQ ID NO: 792421 - protein, 9 aa, Homo Sapiens
KTKQDFIDF

SEQ ID NO: 792422 - protein, 9 aa, Homo Sapiens
MFKEELYAI

SEQ ID NO: 792423 - protein, 9 aa, Homo Sapiens
HTGEDIGGL

SEQ ID NO: 792424 - protein, 9 aa, Homo Sapiens
VRLVADHEK

SEQ ID NO: 792425 - protein, 9 aa, Homo Sapiens
HKTHLSVLQ

SEQ ID NO: 792426 - protein, 9 aa, Homo Sapiens
QKEGGTYPP

SEQ ID NO: 792427 - protein, 9 aa, Homo Sapiens
LDWMYTFSQ

SEQ ID NO: 792428 - protein, 9 aa, Homo Sapiens
KSTVRIQVI

SEQ ID NO: 792429 - protein, 9 aa, Homo Sapiens
PQYLTKTVS

SEQ ID NO: 792430 - protein, 9 aa, Homo Sapiens
QQQTGDRGE

SEQ ID NO: 792431 - protein, 9 aa, Homo Sapiens
LTLFILYDV

SEQ ID NO: 792432 - protein, 9 aa, Homo Sapiens
FENVWLRPV

SEQ ID NO: 792433 - protein, 9 aa, Homo Sapiens
GFHTGEDIG

SEQ ID NO: 792434 - protein, 9 aa, Homo Sapiens
LQRVHTGEK

SEQ ID NO: 792435 - protein, 9 aa, Homo Sapiens
DYREQRRGG

SEQ ID NO: 792436 - protein, 9 aa, Homo Sapiens
LMQHSRLYL

SEQ ID NO: 792437 - protein, 9 aa, Homo Sapiens
YLCLCCGLP

SEQ ID NO: 792438 - protein, 9 aa, Homo Sapiens
ARACPAACP

SEQ ID NO: 792439 - protein, 9 aa, Homo Sapiens
FIDSPQYLT

SEQ ID NO: 792440 - protein, 9 aa, Homo Sapiens
EMGQNFGMT

SEQ ID NO: 792441 - protein, 9 aa, Homo Sapiens
RGSILEKEA

SEQ ID NO: 792442 - protein, 9 aa, Homo Sapiens
TKVLEKTKN

SEQ ID NO: 792443 - protein, 9 aa, Homo Sapiens
VRIQVIDVN

SEQ ID NO: 792444 - protein, 9 aa, Homo Sapiens
SPQYLTKTV

SEQ ID NO: 792445 - protein, 9 aa, Homo Sapiens
NCEWGTVVY

SEQ ID NO: 792446 - protein, 9 aa, Homo Sapiens
KTQHLEQCS

SEQ ID NO: 792447 - protein, 9 aa, Homo Sapiens
LMGYIFAAV

SEQ ID NO: 792448 - protein, 9 aa, Homo Sapiens
PLAPEEPPP

SEQ ID NO: 792449 - protein, 9 aa, Homo Sapiens
HLKIVVAAF

SEQ ID NO: 792450 - protein, 9 aa, Homo Sapiens
AEGIVMPIS

SEQ ID NO: 792451 - protein, 9 aa, Homo Sapiens
NRPWKRMDK

SEQ ID NO: 792452 - protein, 9 aa, Homo Sapiens
SRKTGAPVA

SEQ ID NO: 792453 - protein, 9 aa, Homo Sapiens
GASVVVCRR

SEQ ID NO: 792454 - protein, 9 aa, Homo Sapiens
PPPASPHPA

SEQ ID NO: 792455 - protein, 9 aa, Homo Sapiens
GTDTQTFSR

SEQ ID NO: 792456 - protein, 9 aa, Homo Sapiens
VEDAAGQAL

SEQ ID NO: 792457 - protein, 9 aa, Homo Sapiens
WDLSLPVVA

SEQ ID NO: 792458 - protein, 9 aa, Homo Sapiens
AHGGMTPLH

SEQ ID NO: 792459 - protein, 9 aa, Homo Sapiens
GPAPQQQTG

SEQ ID NO: 792460 - protein, 9 aa, Homo Sapiens
FLRYGKVLV

SEQ ID NO: 792461 - protein, 9 aa, Homo Sapiens
ETQTVPGLP

SEQ ID NO: 792462 - protein, 9 aa, Homo Sapiens
LILGKHGVN

SEQ ID NO: 792463 - protein, 9 aa, Homo Sapiens
RELVATATV

SEQ ID NO: 792464 - protein, 9 aa, Homo Sapiens
FKEELYAIK

SEQ ID NO: 792465 - protein, 9 aa, Homo Sapiens
CGAGKDCLE

SEQ ID NO: 792466 - protein, 9 aa, Homo Sapiens
YMCNSFCMG

SEQ ID NO: 792467 - protein, 9 aa, Homo Sapiens
PLPPGPPIA

SEQ ID NO: 792468 - protein, 9 aa, Homo Sapiens
LKRKPAVLQ

SEQ ID NO: 792469 - protein, 9 aa, Homo Sapiens
DLKRKPAVL

SEQ ID NO: 792470 - protein, 9 aa, Homo Sapiens
LNGRFCGYK

SEQ ID NO: 792471 - protein, 9 aa, Homo Sapiens
RKILVSEDV

SEQ ID NO: 792472 - protein, 9 aa, Homo Sapiens
PDVSVACSA

SEQ ID NO: 792473 - protein, 9 aa, Homo Sapiens
EEVLRVCVA

SEQ ID NO: 792474 - protein, 9 aa, Homo Sapiens
RTSRKTGAP

SEQ ID NO: 792475 - protein, 9 aa, Homo Sapiens
GADRYVVEG

SEQ ID NO: 792476 - protein, 9 aa, Homo Sapiens
PCASPGPAA

SEQ ID NO: 792477 - protein, 9 aa, Homo Sapiens
ILSYDKRKR

SEQ ID NO: 792478 - protein, 9 aa, Homo Sapiens
QAVEDAAGQ

SEQ ID NO: 792479 - protein, 9 aa, Homo Sapiens
AASSVVDLT

SEQ ID NO: 792480 - protein, 9 aa, Homo Sapiens
CLPGPCASP

SEQ ID NO: 792481 - protein, 9 aa, Homo Sapiens
VDEPRAIAL

SEQ ID NO: 792482 - protein, 9 aa, Homo Sapiens
GLGAEGGSG

SEQ ID NO: 792483 - protein, 9 aa, Homo Sapiens
EPPPASPHP

SEQ ID NO: 792484 - protein, 9 aa, Homo Sapiens
DFIDFIEVI

SEQ ID NO: 792485 - protein, 9 aa, Homo Sapiens
DCLEKQEES

SEQ ID NO: 792486 - protein, 9 aa, Homo Sapiens
EMKPPTSQK

SEQ ID NO: 792487 - protein, 9 aa, Homo Sapiens
AVQRTCNLV

SEQ ID NO: 792488 - protein, 9 aa, Homo Sapiens
CPSAEPTVK

SEQ ID NO: 792489 - protein, 9 aa, Homo Sapiens
DLLSWPKPW

SEQ ID NO: 792490 - protein, 9 aa, Homo Sapiens
HPWETQTVP

SEQ ID NO: 792491 - protein, 9 aa, Homo Sapiens
LISEFPDEF

SEQ ID NO: 792492 - protein, 9 aa, Homo Sapiens
SCKCWLSSM

SEQ ID NO: 792493 - protein, 9 aa, Homo Sapiens
PDYREQRRG

SEQ ID NO: 792494 - protein, 9 aa, Homo Sapiens
RVCVAVKKK

SEQ ID NO: 792495 - protein, 9 aa, Homo Sapiens
EGIVMPIST

SEQ ID NO: 792496 - protein, 9 aa, Homo Sapiens
VCVAVKKKL

SEQ ID NO: 792497 - protein, 9 aa, Homo Sapiens
ARAHGGMTP

SEQ ID NO: 792498 - protein, 9 aa, Homo Sapiens
SQKEWEAEF

SEQ ID NO: 792499 - protein, 9 aa, Homo Sapiens
VKETQYYEI

SEQ ID NO: 792500 - protein, 9 aa, Homo Sapiens
TYPPQDAEI

SEQ ID NO: 792501 - protein, 9 aa, Homo Sapiens
LKLQRLMHR

SEQ ID NO: 792502 - protein, 9 aa, Homo Sapiens
VWLRPVELG

SEQ ID NO: 792503 - protein, 9 aa, Homo Sapiens
HYNYMCNSF

SEQ ID NO: 792504 - protein, 9 aa, Homo Sapiens
PKILAMCFA

SEQ ID NO: 792505 - protein, 9 aa, Homo Sapiens
HPKSYKLME

SEQ ID NO: 792506 - protein, 9 aa, Homo Sapiens
GSACSSGIS

SEQ ID NO: 792507 - protein, 9 aa, Homo Sapiens
ISWSGFVGG

SEQ ID NO: 792508 - protein, 9 aa, Homo Sapiens
PVELGGAPK

SEQ ID NO: 792509 - protein, 9 aa, Homo Sapiens
PPGPPIAPL

SEQ ID NO: 792510 - protein, 9 aa, Homo Sapiens
HMKLYETSP

SEQ ID NO: 792511 - protein, 9 aa, Homo Sapiens
AFIDSPQYL

SEQ ID NO: 792512 - protein, 9 aa, Homo Sapiens
SIVIMVLFV

SEQ ID NO: 792513 - protein, 9 aa, Homo Sapiens
CGDCPSAEP

SEQ ID NO: 792514 - protein, 9 aa, Homo Sapiens
KISQVESPE

SEQ ID NO: 792515 - protein, 9 aa, Homo Sapiens
YNYMCNSFC

SEQ ID NO: 792516 - protein, 9 aa, Homo Sapiens
KNSVHRVLK

SEQ ID NO: 792517 - protein, 9 aa, Homo Sapiens
LAPEEPPPA

SEQ ID NO: 792518 - protein, 9 aa, Homo Sapiens
VDQHGLVQP

SEQ ID NO: 792519 - protein, 9 aa, Homo Sapiens
PPQDAEIID

SEQ ID NO: 792520 - protein, 9 aa, Homo Sapiens
TLMGYIFAA

SEQ ID NO: 792521 - protein, 9 aa, Homo Sapiens
GYIFAAVGG

SEQ ID NO: 792522 - protein, 9 aa, Homo Sapiens
VMREVQPMT

SEQ ID NO: 792523 - protein, 9 aa, Homo Sapiens
DKRKRFHRL

SEQ ID NO: 792524 - protein, 9 aa, Homo Sapiens
GIHAARPCR

SEQ ID NO: 792525 - protein, 9 aa, Homo Sapiens
LDISWSGFV

SEQ ID NO: 792526 - protein, 9 aa, Homo Sapiens
KSFQLSKNS

SEQ ID NO: 792527 - protein, 9 aa, Homo Sapiens
KQDFIDFIE

SEQ ID NO: 792528 - protein, 9 aa, Homo Sapiens
GGERPSQPP

SEQ ID NO: 792529 - protein, 9 aa, Homo Sapiens
FPHMGIHAA

SEQ ID NO: 792530 - protein, 9 aa, Homo Sapiens
LKTLLEPGA

SEQ ID NO: 792531 - protein, 9 aa, Homo Sapiens
FSQAAILLS

SEQ ID NO: 792532 - protein, 9 aa, Homo Sapiens
SNCEWGTVV

SEQ ID NO: 792533 - protein, 9 aa, Homo Sapiens
SSRRIRYAC

SEQ ID NO: 792534 - protein, 9 aa, Homo Sapiens
ILEKEAHQE

SEQ ID NO: 792535 - protein, 9 aa, Homo Sapiens
NYMCNSFCM

SEQ ID NO: 792536 - protein, 9 aa, Homo Sapiens
PHPAAPTGT

SEQ ID NO: 792537 - protein, 9 aa, Homo Sapiens
GQEPTKISQ

SEQ ID NO: 792538 - protein, 9 aa, Homo Sapiens
HSLGKGLGA

SEQ ID NO: 792539 - protein, 9 aa, Homo Sapiens
PTTAEGIVM

SEQ ID NO: 792540 - protein, 9 aa, Homo Sapiens
VVDLTLFIL

SEQ ID NO: 792541 - protein, 9 aa, Homo Sapiens
LRVLMRNRM

SEQ ID NO: 792542 - protein, 9 aa, Homo Sapiens
NSFCMGGMN

SEQ ID NO: 792543 - protein, 9 aa, Homo Sapiens
QNQSNNQFE

SEQ ID NO: 792544 - protein, 9 aa, Homo Sapiens
KKEGSRECL

SEQ ID NO: 792545 - protein, 9 aa, Homo Sapiens
SNAACVPCD

SEQ ID NO: 792546 - protein, 9 aa, Homo Sapiens
VSFCYLRVL

SEQ ID NO: 792547 - protein, 9 aa, Homo Sapiens
EHIAFNPSL

SEQ ID NO: 792548 - protein, 9 aa, Homo Sapiens
PRANLHMKL

SEQ ID NO: 792549 - protein, 9 aa, Homo Sapiens
TGTWILGVL

SEQ ID NO: 792550 - protein, 9 aa, Homo Sapiens
TGHVYVYLV

SEQ ID NO: 792551 - protein, 9 aa, Homo Sapiens
DFIEVIYRG

SEQ ID NO: 792552 - protein, 9 aa, Homo Sapiens
CGLPGPAPQ

SEQ ID NO: 792553 - protein, 9 aa, Homo Sapiens
AINYVGKIV

SEQ ID NO: 792554 - protein, 9 aa, Homo Sapiens
FSRSAANAK

SEQ ID NO: 792555 - protein, 9 aa, Homo Sapiens
LMTKNQLEG

SEQ ID NO: 792556 - protein, 9 aa, Homo Sapiens
EPRANLHMK

SEQ ID NO: 792557 - protein, 9 aa, Homo Sapiens
VAAFIDSPQ

SEQ ID NO: 792558 - protein, 9 aa, Homo Sapiens
AVLQNLAPG

SEQ ID NO: 792559 - protein, 9 aa, Homo Sapiens
EPTVKLGAV

SEQ ID NO: 792560 - protein, 9 aa, Homo Sapiens
LSYDKRKRF

SEQ ID NO: 792561 - protein, 9 aa, Homo Sapiens
FHTGEDIGG

SEQ ID NO: 792562 - protein, 9 aa, Homo Sapiens
INYVGKIVG

SEQ ID NO: 792563 - protein, 9 aa, Homo Sapiens
EAHQEAPHC

SEQ ID NO: 792564 - protein, 9 aa, Homo Sapiens
ALVNRPWKR

SEQ ID NO: 792565 - protein, 9 aa, Homo Sapiens
TYFPVVSEG

SEQ ID NO: 792566 - protein, 9 aa, Homo Sapiens
LTLMGYIFA

SEQ ID NO: 792567 - protein, 9 aa, Homo Sapiens
QSPGTGQQT

SEQ ID NO: 792568 - protein, 9 aa, Homo Sapiens
MVKETQYYE

SEQ ID NO: 792569 - protein, 9 aa, Homo Sapiens
KSNAACVPC

SEQ ID NO: 792570 - protein, 9 aa, Homo Sapiens
LVNRPWKRM

SEQ ID NO: 792571 - protein, 9 aa, Homo Sapiens
YLVRLVADH

SEQ ID NO: 792572 - protein, 9 aa, Homo Sapiens
PAHPWETQT

SEQ ID NO: 792573 - protein, 9 aa, Homo Sapiens
LSHSLGKGL

SEQ ID NO: 792574 - protein, 9 aa, Homo Sapiens
TNTGSAINY

SEQ ID NO: 792575 - protein, 9 aa, Homo Sapiens
HSRLYLIFE

SEQ ID NO: 792576 - protein, 9 aa, Homo Sapiens
RVLMRNRME

SEQ ID NO: 792577 - protein, 9 aa, Homo Sapiens
CSTISCPGP

SEQ ID NO: 792578 - protein, 9 aa, Homo Sapiens
LGASMEQSR

SEQ ID NO: 792579 - protein, 9 aa, Homo Sapiens
KTLLEPGAS

SEQ ID NO: 792580 - protein, 9 aa, Homo Sapiens
SSESSCKCW

SEQ ID NO: 792581 - protein, 9 aa, Homo Sapiens
FFSIVIMVL

SEQ ID NO: 792582 - protein, 9 aa, Homo Sapiens
LVADHEKVA

SEQ ID NO: 792583 - protein, 9 aa, Homo Sapiens
PAAPTGTWI

SEQ ID NO: 792584 - protein, 9 aa, Homo Sapiens
RIVSRRYLC

SEQ ID NO: 792585 - protein, 9 aa, Homo Sapiens
ETGEEVLRV

SEQ ID NO: 792586 - protein, 9 aa, Homo Sapiens
AEPTVKLGA

SEQ ID NO: 792587 - protein, 9 aa, Homo Sapiens
HCRVWRIVS

SEQ ID NO: 792588 - protein, 9 aa, Homo Sapiens
RSSRRIRYA

SEQ ID NO: 792589 - protein, 9 aa, Homo Sapiens
ASGNANMMN

SEQ ID NO: 792590 - protein, 9 aa, Homo Sapiens
QKQTANVVA

SEQ ID NO: 792591 - protein, 9 aa, Homo Sapiens
ANKAELEHI

SEQ ID NO: 792592 - protein, 9 aa, Homo Sapiens
MYTFSQAAI

SEQ ID NO: 792593 - protein, 9 aa, Homo Sapiens
GDVRPHYYG

SEQ ID NO: 792594 - protein, 9 aa, Homo Sapiens
PLAASSVVD

SEQ ID NO: 792595 - protein, 9 aa, Homo Sapiens
KIVVAAFID

SEQ ID NO: 792596 - protein, 9 aa, Homo Sapiens
LVTFDGRRS

SEQ ID NO: 792597 - protein, 9 aa, Homo Sapiens
NANMMNKLA

SEQ ID NO: 792598 - protein, 9 aa, Homo Sapiens
MFLRYGKVL

SEQ ID NO: 792599 - protein, 9 aa, Homo Sapiens
VYSVPGSHY

SEQ ID NO: 792600 - protein, 9 aa, Homo Sapiens
SSVVDLTLF

SEQ ID NO: 792601 - protein, 9 aa, Homo Sapiens
KPGIVLFLG

SEQ ID NO: 792602 - protein, 9 aa, Homo Sapiens
AMCFAMLGF

SEQ ID NO: 792603 - protein, 9 aa, Homo Sapiens
RILQAVQAV

SEQ ID NO: 792604 - protein, 9 aa, Homo Sapiens
SRAQQLLLL

SEQ ID NO: 792605 - protein, 9 aa, Homo Sapiens
CVPCDLVTG

SEQ ID NO: 792606 - protein, 9 aa, Homo Sapiens
SACSSGISG

SEQ ID NO: 792607 - protein, 9 aa, Homo Sapiens
QCLHEPMYY

SEQ ID NO: 792608 - protein, 9 aa, Homo Sapiens
PGSHYLYNQ

SEQ ID NO: 792609 - protein, 9 aa, Homo Sapiens
KEGGTYPPQ

SEQ ID NO: 792610 - protein, 9 aa, Homo Sapiens
QQCLHEPMY

SEQ ID NO: 792611 - protein, 9 aa, Homo Sapiens
DPHARAHGG

SEQ ID NO: 792612 - protein, 9 aa, Homo Sapiens
YHKYKPGME

SEQ ID NO: 792613 - protein, 9 aa, Homo Sapiens
FSIVIMVLF

SEQ ID NO: 792614 - protein, 9 aa, Homo Sapiens
VFPSHSLVP

SEQ ID NO: 792615 - protein, 9 aa, Homo Sapiens
YCSAPLAAS

SEQ ID NO: 792616 - protein, 9 aa, Homo Sapiens
SHKTHLSVL

SEQ ID NO: 792617 - protein, 9 aa, Homo Sapiens
PTKVLEKTK

SEQ ID NO: 792618 - protein, 9 aa, Homo Sapiens
SGFVGGTLL

SEQ ID NO: 792619 - protein, 9 aa, Homo Sapiens
TQTVPGLPI

SEQ ID NO: 792620 - protein, 9 aa, Homo Sapiens
VTGDLDHLK

SEQ ID NO: 792621 - protein, 9 aa, Homo Sapiens
QQTGDRGEQ

SEQ ID NO: 792622 - protein, 9 aa, Homo Sapiens
PKSYKLMEM

SEQ ID NO: 792623 - protein, 9 aa, Homo Sapiens
CYLRVLMRN

SEQ ID NO: 792624 - protein, 9 aa, Homo Sapiens
SGNANMMNK

SEQ ID NO: 792625 - protein, 9 aa, Homo Sapiens
VLQRVHTGE

SEQ ID NO: 792626 - protein, 9 aa, Homo Sapiens
GKHGVNLAM

SEQ ID NO: 792627 - protein, 9 aa, Homo Sapiens
VRWNLSYTC

SEQ ID NO: 792628 - protein, 9 aa, Homo Sapiens
VIITQQCLH

SEQ ID NO: 792629 - protein, 9 aa, Homo Sapiens
VFPKSPREL

SEQ ID NO: 792630 - protein, 9 aa, Homo Sapiens
RPLAPEEPP

SEQ ID NO: 792631 - protein, 9 aa, Homo Sapiens
EQRRGGERP

SEQ ID NO: 792632 - protein, 9 aa, Homo Sapiens
GMSKEKTQH

SEQ ID NO: 792633 - protein, 9 aa, Homo Sapiens
SSCKCWLSS

SEQ ID NO: 792634 - protein, 9 aa, Homo Sapiens
TQYYEILGV

SEQ ID NO: 792635 - protein, 9 aa, Homo Sapiens
AVEDAAGQA

SEQ ID NO: 792636 - protein, 9 aa, Homo Sapiens
EQEALVNRP

SEQ ID NO: 792637 - protein, 9 aa, Homo Sapiens
SLGKGLGAE

SEQ ID NO: 792638 - protein, 9 aa, Homo Sapiens
LESLILGKH

SEQ ID NO: 792639 - protein, 9 aa, Homo Sapiens
SLVTFDGRR

SEQ ID NO: 792640 - protein, 9 aa, Homo Sapiens
SGQEPTKIS

SEQ ID NO: 792641 - protein, 9 aa, Homo Sapiens
LKRELVATA

SEQ ID NO: 792642 - protein, 9 aa, Homo Sapiens
VWRIVSRRY

SEQ ID NO: 792643 - protein, 9 aa, Homo Sapiens
CKCWLSSMT

SEQ ID NO: 792644 - protein, 9 aa, Homo Sapiens
SFCMGGMNR

SEQ ID NO: 792645 - protein, 9 aa, Homo Sapiens
PSRPLAPEE

SEQ ID NO: 792646 - protein, 9 aa, Homo Sapiens
YKRSNEFHY

SEQ ID NO: 792647 - protein, 9 aa, Homo Sapiens
GAGASVVVC

SEQ ID NO: 792648 - protein, 9 aa, Homo Sapiens
ISQVESPEA

SEQ ID NO: 792649 - protein, 9 aa, Homo Sapiens
KEAHQEAPH

SEQ ID NO: 792650 - protein, 9 aa, Homo Sapiens
SGTYFPVVS

SEQ ID NO: 792651 - protein, 9 aa, Homo Sapiens
EGGTYPPQD

SEQ ID NO: 792652 - protein, 9 aa, Homo Sapiens
ELRVEQECL

SEQ ID NO: 792653 - protein, 9 aa, Homo Sapiens
NMMNKLAEG

SEQ ID NO: 792654 - protein, 9 aa, Homo Sapiens
ECLLTAFRC

SEQ ID NO: 792655 - protein, 9 aa, Homo Sapiens
ISCPGPSWH

SEQ ID NO: 792656 - protein, 9 aa, Homo Sapiens
AACPVGCPI

SEQ ID NO: 792657 - protein, 9 aa, Homo Sapiens
AELEHIAFN

SEQ ID NO: 792658 - protein, 9 aa, Homo Sapiens
KRELVATAT

SEQ ID NO: 792659 - protein, 9 aa, Homo Sapiens
DVLMQHSRL

SEQ ID NO: 792660 - protein, 9 aa, Homo Sapiens
SNNQFELYR

SEQ ID NO: 792661 - protein, 9 aa, Homo Sapiens
RSVRWNLSY

SEQ ID NO: 792662 - protein, 9 aa, Homo Sapiens
FCMGGMNRR

SEQ ID NO: 792663 - protein, 9 aa, Homo Sapiens
ILVSEDVDE

SEQ ID NO: 792664 - protein, 9 aa, Homo Sapiens
VLMQHSRLY

SEQ ID NO: 792665 - protein, 9 aa, Homo Sapiens
TPKILAMCF

SEQ ID NO: 792666 - protein, 9 aa, Homo Sapiens
ANMMNKLAE

SEQ ID NO: 792667 - protein, 9 aa, Homo Sapiens
TKNQLEGIN

SEQ ID NO: 792668 - protein, 9 aa, Homo Sapiens
WWSIEHVEQ

SEQ ID NO: 792669 - protein, 9 aa, Homo Sapiens
MGQNFGMTH

SEQ ID NO: 792670 - protein, 9 aa, Homo Sapiens
SRECLKSTV

SEQ ID NO: 792671 - protein, 9 aa, Homo Sapiens
INLSKRQVP

SEQ ID NO: 792672 - protein, 9 aa, Homo Sapiens
WGTVVYGKT

SEQ ID NO: 792673 - protein, 9 aa, Homo Sapiens
TRSDGSACS

SEQ ID NO: 792674 - protein, 9 aa, Homo Sapiens
RYLCLCCGL

SEQ ID NO: 792675 - protein, 9 aa, Homo Sapiens
QLLLLKLQR

SEQ ID NO: 792676 - protein, 9 aa, Homo Sapiens
LEKTKNLHL

SEQ ID NO: 792677 - protein, 9 aa, Homo Sapiens
GLPGPAPQQ

SEQ ID NO: 792678 - protein, 9 aa, Homo Sapiens
CPRVLLTGP

SEQ ID NO: 792679 - protein, 9 aa, Homo Sapiens
QPMTASWYC

SEQ ID NO: 792680 - protein, 9 aa, Homo Sapiens
GEDIGGLHA

SEQ ID NO: 792681 - protein, 9 aa, Homo Sapiens
AHQEAPHCR

SEQ ID NO: 792682 - protein, 9 aa, Homo Sapiens
PGASPDYKD

SEQ ID NO: 792683 - protein, 9 aa, Homo Sapiens
MMNKLAEGA

SEQ ID NO: 792684 - protein, 9 aa, Homo Sapiens
TKISQVESP

SEQ ID NO: 792685 - protein, 9 aa, Homo Sapiens
NPGPDGGKK

SEQ ID NO: 792686 - protein, 9 aa, Homo Sapiens
CASCSPLSY

SEQ ID NO: 792687 - protein, 9 aa, Homo Sapiens
DLTCRNKDM

SEQ ID NO: 792688 - protein, 9 aa, Homo Sapiens
QFVISHRLS

SEQ ID NO: 792689 - protein, 9 aa, Homo Sapiens
GTTLCVCKL

SEQ ID NO: 792690 - protein, 9 aa, Homo Sapiens
SHSIQHISQ

SEQ ID NO: 792691 - protein, 9 aa, Homo Sapiens
MPLRDKTLR

SEQ ID NO: 792692 - protein, 9 aa, Homo Sapiens
TAAHRNSSV

SEQ ID NO: 792693 - protein, 9 aa, Homo Sapiens
YKGEKGLVI

SEQ ID NO: 792694 - protein, 9 aa, Homo Sapiens
AGSPPPYHR

SEQ ID NO: 792695 - protein, 9 aa, Homo Sapiens
LEPEGWGTG

SEQ ID NO: 792696 - protein, 9 aa, Homo Sapiens
EFAKRLPAW

SEQ ID NO: 792697 - protein, 9 aa, Homo Sapiens
KAYDGLVTQ

SEQ ID NO: 792698 - protein, 9 aa, Homo Sapiens
CRNKDMLGN

SEQ ID NO: 792699 - protein, 9 aa, Homo Sapiens
AEGRLPGHP

SEQ ID NO: 792700 - protein, 9 aa, Homo Sapiens
EAPGPMGPR

SEQ ID NO: 792701 - protein, 9 aa, Homo Sapiens
ATIKSLSVE

SEQ ID NO: 792702 - protein, 9 aa, Homo Sapiens
LMDDNTSNT

SEQ ID NO: 792703 - protein, 9 aa, Homo Sapiens
QAQKREEQT

SEQ ID NO: 792704 - protein, 9 aa, Homo Sapiens
CTPLCCQQS

SEQ ID NO: 792705 - protein, 9 aa, Homo Sapiens
EIDESVCGE

SEQ ID NO: 792706 - protein, 9 aa, Homo Sapiens
HVCACPGRD

SEQ ID NO: 792707 - protein, 9 aa, Homo Sapiens
VEAARGASW

SEQ ID NO: 792708 - protein, 9 aa, Homo Sapiens
SAGSTGVEP

SEQ ID NO: 792709 - protein, 9 aa, Homo Sapiens
DVKGMEDEG

SEQ ID NO: 792710 - protein, 9 aa, Homo Sapiens
STSTQSEDR

SEQ ID NO: 792711 - protein, 9 aa, Homo Sapiens
MVMPWKAVA

SEQ ID NO: 792712 - protein, 9 aa, Homo Sapiens
SPSTTQTTP

SEQ ID NO: 792713 - protein, 9 aa, Homo Sapiens
PGTQPLGMG

SEQ ID NO: 792714 - protein, 9 aa, Homo Sapiens
AGSTGVEPP

SEQ ID NO: 792715 - protein, 9 aa, Homo Sapiens
PAWFHWLDH

SEQ ID NO: 792716 - protein, 9 aa, Homo Sapiens
LLLLLLIRA

SEQ ID NO: 792717 - protein, 9 aa, Homo Sapiens
SRKFMRPIA

SEQ ID NO: 792718 - protein, 9 aa, Homo Sapiens
MSRSPSTTQ

SEQ ID NO: 792719 - protein, 9 aa, Homo Sapiens
LVAVMVMPW

SEQ ID NO: 792720 - protein, 9 aa, Homo Sapiens
SKHASPHKW

SEQ ID NO: 792721 - protein, 9 aa, Homo Sapiens
EDLTCRNKD

SEQ ID NO: 792722 - protein, 9 aa, Homo Sapiens
GVLLAPDGS

SEQ ID NO: 792723 - protein, 9 aa, Homo Sapiens
AARGASWTG

SEQ ID NO: 792724 - protein, 9 aa, Homo Sapiens
DEVMLKFEM

SEQ ID NO: 792725 - protein, 9 aa, Homo Sapiens
STGVEPPHP

SEQ ID NO: 792726 - protein, 9 aa, Homo Sapiens
DDNTSNTLN

SEQ ID NO: 792727 - protein, 9 aa, Homo Sapiens
GCTSSCTPL

SEQ ID NO: 792728 - protein, 9 aa, Homo Sapiens
VSPPLRNGY

SEQ ID NO: 792729 - protein, 9 aa, Homo Sapiens
LAKKYKGEK

SEQ ID NO: 792730 - protein, 9 aa, Homo Sapiens
LQILGHNLR

SEQ ID NO: 792731 - protein, 9 aa, Homo Sapiens
SVELLKANE

SEQ ID NO: 792732 - protein, 9 aa, Homo Sapiens
EMERGSKTE

SEQ ID NO: 792733 - protein, 9 aa, Homo Sapiens
TQWLTADRE

SEQ ID NO: 792734 - protein, 9 aa, Homo Sapiens
PHIKPNALL

SEQ ID NO: 792735 - protein, 9 aa, Homo Sapiens
TAQAQKREE

SEQ ID NO: 792736 - protein, 9 aa, Homo Sapiens
TDWQKAEGG

SEQ ID NO: 792737 - protein, 9 aa, Homo Sapiens
EKGLVIAKM

SEQ ID NO: 792738 - protein, 9 aa, Homo Sapiens
VELLKANEI

SEQ ID NO: 792739 - protein, 9 aa, Homo Sapiens
GSTGVEPPH

SEQ ID NO: 792740 - protein, 9 aa, Homo Sapiens
PPPYHRRKR

SEQ ID NO: 792741 - protein, 9 aa, Homo Sapiens
MEEMERGSK

SEQ ID NO: 792742 - protein, 9 aa, Homo Sapiens
RGIVKGDRS

SEQ ID NO: 792743 - protein, 9 aa, Homo Sapiens
EDVKGMEDE

SEQ ID NO: 792744 - protein, 9 aa, Homo Sapiens
LRSNSPLSL

SEQ ID NO: 792745 - protein, 9 aa, Homo Sapiens
GEGRQQICK

SEQ ID NO: 792746 - protein, 9 aa, Homo Sapiens
QKAEGGDIL

SEQ ID NO: 792747 - protein, 9 aa, Homo Sapiens
NLRASMREL

SEQ ID NO: 792748 - protein, 9 aa, Homo Sapiens
GDGTPPFRL

SEQ ID NO: 792749 - protein, 9 aa, Homo Sapiens
RPIAFHSPL

SEQ ID NO: 792750 - protein, 9 aa, Homo Sapiens
NSFEVHVCA

SEQ ID NO: 792751 - protein, 9 aa, Homo Sapiens
TPLNDDKWH

SEQ ID NO: 792752 - protein, 9 aa, Homo Sapiens
KYKGEKGLV

SEQ ID NO: 792753 - protein, 9 aa, Homo Sapiens
QSAGSTGVE

SEQ ID NO: 792754 - protein, 9 aa, Homo Sapiens
KSRKFMRPI

SEQ ID NO: 792755 - protein, 9 aa, Homo Sapiens
CDTSGHFQR

SEQ ID NO: 792756 - protein, 9 aa, Homo Sapiens
VVGDMSKKS

SEQ ID NO: 792757 - protein, 9 aa, Homo Sapiens
VGEGPSRGL

SEQ ID NO: 792758 - protein, 9 aa, Homo Sapiens
DDKWHRVTA

SEQ ID NO: 792759 - protein, 9 aa, Homo Sapiens
CVEIDESVC

SEQ ID NO: 792760 - protein, 9 aa, Homo Sapiens
DRSYVKDRW

SEQ ID NO: 792761 - protein, 9 aa, Homo Sapiens
VGMRNDVSP

SEQ ID NO: 792762 - protein, 9 aa, Homo Sapiens
RLLRAKLRE

SEQ ID NO: 792763 - protein, 9 aa, Homo Sapiens
VCLKILLDR

SEQ ID NO: 792764 - protein, 9 aa, Homo Sapiens
DNTSNTLNS

SEQ ID NO: 792765 - protein, 9 aa, Homo Sapiens
ENGLPGENE

SEQ ID NO: 792766 - protein, 9 aa, Homo Sapiens
RTVGFNHPT

SEQ ID NO: 792767 - protein, 9 aa, Homo Sapiens
SDCNSRYKC

SEQ ID NO: 792768 - protein, 9 aa, Homo Sapiens
CETSSCQPS

SEQ ID NO: 792769 - protein, 9 aa, Homo Sapiens
LRPLLLERT

SEQ ID NO: 792770 - protein, 9 aa, Homo Sapiens
EREFEASKL

SEQ ID NO: 792771 - protein, 9 aa, Homo Sapiens
HKWNDKPKN

SEQ ID NO: 792772 - protein, 9 aa, Homo Sapiens
TADEKAPDH

SEQ ID NO: 792773 - protein, 9 aa, Homo Sapiens
DLPPLYPSA

SEQ ID NO: 792774 - protein, 9 aa, Homo Sapiens
GSPPPYHRR

SEQ ID NO: 792775 - protein, 9 aa, Homo Sapiens
ALDEVMLKF

SEQ ID NO: 792776 - protein, 9 aa, Homo Sapiens
ATNAFTESK

SEQ ID NO: 792777 - protein, 9 aa, Homo Sapiens
LFPRLSSAS

SEQ ID NO: 792778 - protein, 9 aa, Homo Sapiens
ERGLGWLMQ

SEQ ID NO: 792779 - protein, 9 aa, Homo Sapiens
SASQSAGST

SEQ ID NO: 792780 - protein, 9 aa, Homo Sapiens
PQIQEPTGH

SEQ ID NO: 792781 - protein, 9 aa, Homo Sapiens
RFDYIWLRD

SEQ ID NO: 792782 - protein, 9 aa, Homo Sapiens
RYKCSETKW

SEQ ID NO: 792783 - protein, 9 aa, Homo Sapiens
KFKFKFLRS

SEQ ID NO: 792784 - protein, 9 aa, Homo Sapiens
RQQICKQQP

SEQ ID NO: 792785 - protein, 9 aa, Homo Sapiens
LIRASCCLW

SEQ ID NO: 792786 - protein, 9 aa, Homo Sapiens
FSKLLQPYR

SEQ ID NO: 792787 - protein, 9 aa, Homo Sapiens
FNHPTLGHN

SEQ ID NO: 792788 - protein, 9 aa, Homo Sapiens
SFDTSGDEL

SEQ ID NO: 792789 - protein, 9 aa, Homo Sapiens
EFFPQIQEP

SEQ ID NO: 792790 - protein, 9 aa, Homo Sapiens
NAFTESKFT

SEQ ID NO: 792791 - protein, 9 aa, Homo Sapiens
YKCSETKWE

SEQ ID NO: 792792 - protein, 9 aa, Homo Sapiens
QLDVAGGVM

SEQ ID NO: 792793 - protein, 9 aa, Homo Sapiens
DKTLREVWA

SEQ ID NO: 792794 - protein, 9 aa, Homo Sapiens
QWLTADRET

SEQ ID NO: 792795 - protein, 9 aa, Homo Sapiens
AAAEAALSQ

SEQ ID NO: 792796 - protein, 9 aa, Homo Sapiens
SCKDIVVGD

SEQ ID NO: 792797 - protein, 9 aa, Homo Sapiens
GLGWLMQIK

SEQ ID NO: 792798 - protein, 9 aa, Homo Sapiens
REGKEYGVL

SEQ ID NO: 792799 - protein, 9 aa, Homo Sapiens
NTEDQDVKT

SEQ ID NO: 792800 - protein, 9 aa, Homo Sapiens
PPFRLLRAK

SEQ ID NO: 792801 - protein, 9 aa, Homo Sapiens
DIVVGDMSK

SEQ ID NO: 792802 - protein, 9 aa, Homo Sapiens
LPGENEAPG

SEQ ID NO: 792803 - protein, 9 aa, Homo Sapiens
VLTVGMRND

SEQ ID NO: 792804 - protein, 9 aa, Homo Sapiens
AHLRQQAVQ

SEQ ID NO: 792805 - protein, 9 aa, Homo Sapiens
KGLQILGHN

SEQ ID NO: 792806 - protein, 9 aa, Homo Sapiens
DALEPEGWG

SEQ ID NO: 792807 - protein, 9 aa, Homo Sapiens
LGDGTPPFR

SEQ ID NO: 792808 - protein, 9 aa, Homo Sapiens
LQEREFEAS

SEQ ID NO: 792809 - protein, 9 aa, Homo Sapiens
LAITICIIL

SEQ ID NO: 792810 - protein, 9 aa, Homo Sapiens
IGVAQVINK

SEQ ID NO: 792811 - protein, 9 aa, Homo Sapiens
LEELRPLLL

SEQ ID NO: 792812 - protein, 9 aa, Homo Sapiens
DGGKKDGEA

SEQ ID NO: 792813 - protein, 9 aa, Homo Sapiens
KYEEINNIK

SEQ ID NO: 792814 - protein, 9 aa, Homo Sapiens
AVTSLPRVK

SEQ ID NO: 792815 - protein, 9 aa, Homo Sapiens
VINKIPEGA

SEQ ID NO: 792816 - protein, 9 aa, Homo Sapiens
GNTCGLEQI

SEQ ID NO: 792817 - protein, 9 aa, Homo Sapiens
LLWHQLLEK

SEQ ID NO: 792818 - protein, 9 aa, Homo Sapiens
VMVMPWKAV

SEQ ID NO: 792819 - protein, 9 aa, Homo Sapiens
RRPNYPAEG

SEQ ID NO: 792820 - protein, 9 aa, Homo Sapiens
ALELPTAAH

SEQ ID NO: 792821 - protein, 9 aa, Homo Sapiens
HQFVISHRL

SEQ ID NO: 792822 - protein, 9 aa, Homo Sapiens
GHNLRASMR

SEQ ID NO: 792823 - protein, 9 aa, Homo Sapiens
NYPAEGRLP

SEQ ID NO: 792824 - protein, 9 aa, Homo Sapiens
DYIWLRDHC

SEQ ID NO: 792825 - protein, 9 aa, Homo Sapiens
EDNTEDQDV

SEQ ID NO: 792826 - protein, 9 aa, Homo Sapiens
AVEAARGAS

SEQ ID NO: 792827 - protein, 9 aa, Homo Sapiens
PTGHQFVIS

SEQ ID NO: 792828 - protein, 9 aa, Homo Sapiens
GHQFVISHR

SEQ ID NO: 792829 - protein, 9 aa, Homo Sapiens
KRKKKWNLD

SEQ ID NO: 792830 - protein, 9 aa, Homo Sapiens
LITAGRLVL

SEQ ID NO: 792831 - protein, 9 aa, Homo Sapiens
RCDTSGHFQ

SEQ ID NO: 792832 - protein, 9 aa, Homo Sapiens
FLRSNSPLS

SEQ ID NO: 792833 - protein, 9 aa, Homo Sapiens
DKWHRVTAE

SEQ ID NO: 792834 - protein, 9 aa, Homo Sapiens
EGKEYGVLL

SEQ ID NO: 792835 - protein, 9 aa, Homo Sapiens
VLKSFIEKL

SEQ ID NO: 792836 - protein, 9 aa, Homo Sapiens
KAPDHSCYA

SEQ ID NO: 792837 - protein, 9 aa, Homo Sapiens
LSLKPFAPE

SEQ ID NO: 792838 - protein, 9 aa, Homo Sapiens
PQPRTAQAQ

SEQ ID NO: 792839 - protein, 9 aa, Homo Sapiens
LNDDKWHRV

SEQ ID NO: 792840 - protein, 9 aa, Homo Sapiens
GPSTSTQSE

SEQ ID NO: 792841 - protein, 9 aa, Homo Sapiens
EVHVCACPG

SEQ ID NO: 792842 - protein, 9 aa, Homo Sapiens
PVPDPNSHS

SEQ ID NO: 792843 - protein, 9 aa, Homo Sapiens
DTSGDELDV

SEQ ID NO: 792844 - protein, 9 aa, Homo Sapiens
KTLREVWAS

SEQ ID NO: 792845 - protein, 9 aa, Homo Sapiens
LQGKYTDLP

SEQ ID NO: 792846 - protein, 9 aa, Homo Sapiens
ATQKNLFNA

SEQ ID NO: 792847 - protein, 9 aa, Homo Sapiens
FIEKLQEEE

SEQ ID NO: 792848 - protein, 9 aa, Homo Sapiens
IGILQGKYT

SEQ ID NO: 792849 - protein, 9 aa, Homo Sapiens
VGDMSKKSL

SEQ ID NO: 792850 - protein, 9 aa, Homo Sapiens
AGGVMQYVN

SEQ ID NO: 792851 - protein, 9 aa, Homo Sapiens
LKPFAPELK

SEQ ID NO: 792852 - protein, 9 aa, Homo Sapiens
DLLVAVMVM

SEQ ID NO: 792853 - protein, 9 aa, Homo Sapiens
SRSPSTTQT

SEQ ID NO: 792854 - protein, 9 aa, Homo Sapiens
CLKILLDRL

SEQ ID NO: 792855 - protein, 9 aa, Homo Sapiens
LGRNSFEVH

SEQ ID NO: 792856 - protein, 9 aa, Homo Sapiens
RPTTDMSAG

SEQ ID NO: 792857 - protein, 9 aa, Homo Sapiens
SQSAGSTGV

SEQ ID NO: 792858 - protein, 9 aa, Homo Sapiens
GILQGKYTD

SEQ ID NO: 792859 - protein, 9 aa, Homo Sapiens
LRTVGFNHP

SEQ ID NO: 792860 - protein, 9 aa, Homo Sapiens
ICKSVYQED

SEQ ID NO: 792861 - protein, 9 aa, Homo Sapiens
ASKLQGMQQ

SEQ ID NO: 792862 - protein, 9 aa, Homo Sapiens
HSAHLRQQA

SEQ ID NO: 792863 - protein, 9 aa, Homo Sapiens
KFMRPIAFH

SEQ ID NO: 792864 - protein, 9 aa, Homo Sapiens
QVINKIPEG

SEQ ID NO: 792865 - protein, 9 aa, Homo Sapiens
GKYTDLPVV

SEQ ID NO: 792866 - protein, 9 aa, Homo Sapiens
NSVGNTCGL

SEQ ID NO: 792867 - protein, 9 aa, Homo Sapiens
QSEDRHGPS

SEQ ID NO: 792868 - protein, 9 aa, Homo Sapiens
PLTLEFFPQ

SEQ ID NO: 792869 - protein, 9 aa, Homo Sapiens
YSYPTKYEE

SEQ ID NO: 792870 - protein, 9 aa, Homo Sapiens
GGAERALVP

SEQ ID NO: 792871 - protein, 9 aa, Homo Sapiens
TSNTLNSLD

SEQ ID NO: 792872 - protein, 9 aa, Homo Sapiens
YTDLPVVLY

SEQ ID NO: 792873 - protein, 9 aa, Homo Sapiens
NLDISLDSG

SEQ ID NO: 792874 - protein, 9 aa, Homo Sapiens
TSTQSEDRH

SEQ ID NO: 792875 - protein, 9 aa, Homo Sapiens
SEDNTEDQD

SEQ ID NO: 792876 - protein, 9 aa, Homo Sapiens
QPVPDPNSH

SEQ ID NO: 792877 - protein, 9 aa, Homo Sapiens
LRAKLREFP

SEQ ID NO: 792878 - protein, 9 aa, Homo Sapiens
DESVCGEDV

SEQ ID NO: 792879 - protein, 9 aa, Homo Sapiens
LERNVTIPI

SEQ ID NO: 792880 - protein, 9 aa, Homo Sapiens
ASPHKWNDK

SEQ ID NO: 792881 - protein, 9 aa, Homo Sapiens
DEKAPDHSC

SEQ ID NO: 792882 - protein, 9 aa, Homo Sapiens
FPILGDGTP

SEQ ID NO: 792883 - protein, 9 aa, Homo Sapiens
KSVYQEDER

SEQ ID NO: 792884 - protein, 9 aa, Homo Sapiens
GWGTGGVVT

SEQ ID NO: 792885 - protein, 9 aa, Homo Sapiens
GAERALVPR

SEQ ID NO: 792886 - protein, 9 aa, Homo Sapiens
KPFAPELKQ

SEQ ID NO: 792887 - protein, 9 aa, Homo Sapiens
APDHSCYAN

SEQ ID NO: 792888 - protein, 9 aa, Homo Sapiens
VTQNASDIA

SEQ ID NO: 792889 - protein, 9 aa, Homo Sapiens
GFNHPTLGH

SEQ ID NO: 792890 - protein, 9 aa, Homo Sapiens
RKKKWNLDI

SEQ ID NO: 792891 - protein, 9 aa, Homo Sapiens
QNGLDLPPL

SEQ ID NO: 792892 - protein, 9 aa, Homo Sapiens
LLQPYREGA

SEQ ID NO: 792893 - protein, 9 aa, Homo Sapiens
SEQLDVAGG

SEQ ID NO: 792894 - protein, 9 aa, Homo Sapiens
HARENSTNV

SEQ ID NO: 792895 - protein, 9 aa, Homo Sapiens
MRFDYIWLR

SEQ ID NO: 792896 - protein, 9 aa, Homo Sapiens
GMRNDVSPT

SEQ ID NO: 792897 - protein, 9 aa, Homo Sapiens
SSCQPSCCE

SEQ ID NO: 792898 - protein, 9 aa, Homo Sapiens
VGPSTSTQS

SEQ ID NO: 792899 - protein, 9 aa, Homo Sapiens
LRQQAVQKL

SEQ ID NO: 792900 - protein, 9 aa, Homo Sapiens
QAVQKLYEH

SEQ ID NO: 792901 - protein, 9 aa, Homo Sapiens
EEMERGSKT

SEQ ID NO: 792902 - protein, 9 aa, Homo Sapiens
GVAQVINKI

SEQ ID NO: 792903 - protein, 9 aa, Homo Sapiens
QILGHNLRA

SEQ ID NO: 792904 - protein, 9 aa, Homo Sapiens
MERGSKTEA

SEQ ID NO: 792905 - protein, 9 aa, Homo Sapiens
KLREFPLTL

SEQ ID NO: 792906 - protein, 9 aa, Homo Sapiens
SLSVELLKA

SEQ ID NO: 792907 - protein, 9 aa, Homo Sapiens
EKAVTSLPR

SEQ ID NO: 792908 - protein, 9 aa, Homo Sapiens
AKLREFPLT

SEQ ID NO: 792909 - protein, 9 aa, Homo Sapiens
HRRKRPSSA

SEQ ID NO: 792910 - protein, 9 aa, Homo Sapiens
EPTGHQFVI

SEQ ID NO: 792911 - protein, 9 aa, Homo Sapiens
FHWLDHRRP

SEQ ID NO: 792912 - protein, 9 aa, Homo Sapiens
EELLWHQLL

SEQ ID NO: 792913 - protein, 9 aa, Homo Sapiens
TQPLGMGEA

SEQ ID NO: 792914 - protein, 9 aa, Homo Sapiens
WHQLLEKRS

SEQ ID NO: 792915 - protein, 9 aa, Homo Sapiens
PRLSSASVS

SEQ ID NO: 792916 - protein, 9 aa, Homo Sapiens
FSDCNSRYK

SEQ ID NO: 792917 - protein, 9 aa, Homo Sapiens
NDDKWHRVT

SEQ ID NO: 792918 - protein, 9 aa, Homo Sapiens
MRNDVSPTI

SEQ ID NO: 792919 - protein, 9 aa, Homo Sapiens
SPHKWNDKP

SEQ ID NO: 792920 - protein, 9 aa, Homo Sapiens
HPTLGHNQR

SEQ ID NO: 792921 - protein, 9 aa, Homo Sapiens
STTQTTPSP

SEQ ID NO: 792922 - protein, 9 aa, Homo Sapiens
SFIEKLQEE

SEQ ID NO: 792923 - protein, 9 aa, Homo Sapiens
NGLPGENEA

SEQ ID NO: 792924 - protein, 9 aa, Homo Sapiens
LNSVGNTCG

SEQ ID NO: 792925 - protein, 9 aa, Homo Sapiens
ADRETWASI

SEQ ID NO: 792926 - protein, 9 aa, Homo Sapiens
VTSLPRVKS

SEQ ID NO: 792927 - protein, 9 aa, Homo Sapiens
PEGWGTGGV

SEQ ID NO: 792928 - protein, 9 aa, Homo Sapiens
FKFKFLRSN

SEQ ID NO: 792929 - protein, 9 aa, Homo Sapiens
PLGMGEALL

SEQ ID NO: 792930 - protein, 9 aa, Homo Sapiens
RNKDMLGNI

SEQ ID NO: 792931 - protein, 9 aa, Homo Sapiens
WLDHRRPNY

SEQ ID NO: 792932 - protein, 9 aa, Homo Sapiens
DGSSSEDNT

SEQ ID NO: 792933 - protein, 9 aa, Homo Sapiens
NHLNSVGNT

SEQ ID NO: 792934 - protein, 9 aa, Homo Sapiens
TSKHASPHK

SEQ ID NO: 792935 - protein, 9 aa, Homo Sapiens
AKKYKGEKG

SEQ ID NO: 792936 - protein, 9 aa, Homo Sapiens
PGENEAPGP

SEQ ID NO: 792937 - protein, 9 aa, Homo Sapiens
QIQEPTGHQ

SEQ ID NO: 792938 - protein, 9 aa, Homo Sapiens
ENEAPGPMG

SEQ ID NO: 792939 - protein, 9 aa, Homo Sapiens
WALSYTRVS

SEQ ID NO: 792940 - protein, 9 aa, Homo Sapiens
TAGRLVLAQ

SEQ ID NO: 792941 - protein, 9 aa, Homo Sapiens
EIEDLTCRN

SEQ ID NO: 792942 - protein, 9 aa, Homo Sapiens
KSLSVELLK

SEQ ID NO: 792943 - protein, 9 aa, Homo Sapiens
FTESKFTCT

SEQ ID NO: 792944 - protein, 9 aa, Homo Sapiens
NSRYKCSET

SEQ ID NO: 792945 - protein, 9 aa, Homo Sapiens
LPLGTTLCV

SEQ ID NO: 792946 - protein, 9 aa, Homo Sapiens
GEIEDLTCR

SEQ ID NO: 792947 - protein, 9 aa, Homo Sapiens
TCRNKDMLG

SEQ ID NO: 792948 - protein, 9 aa, Homo Sapiens
AQAQKREEQ

SEQ ID NO: 792949 - protein, 9 aa, Homo Sapiens
LLLLIRASC

SEQ ID NO: 792950 - protein, 9 aa, Homo Sapiens
WQKAEGGDI

SEQ ID NO: 792951 - protein, 9 aa, Homo Sapiens
ICKQQPPCS

SEQ ID NO: 792952 - protein, 9 aa, Homo Sapiens
EGRQQICKQ

SEQ ID NO: 792953 - protein, 9 aa, Homo Sapiens
KEDVKGMED

SEQ ID NO: 792954 - protein, 9 aa, Homo Sapiens
PLRNGYFGV

SEQ ID NO: 792955 - protein, 9 aa, Homo Sapiens
GKKDGEAPP

SEQ ID NO: 792956 - protein, 9 aa, Homo Sapiens
TTLCVCKLA

SEQ ID NO: 792957 - protein, 9 aa, Homo Sapiens
EAIRCDTSG

SEQ ID NO: 792958 - protein, 9 aa, Homo Sapiens
KGEKGLVIA

SEQ ID NO: 792959 - protein, 9 aa, Homo Sapiens
KHASPHKWN

SEQ ID NO: 792960 - protein, 9 aa, Homo Sapiens
FEVHVCACP

SEQ ID NO: 792961 - protein, 9 aa, Homo Sapiens
FAPELKQGR

SEQ ID NO: 792962 - protein, 9 aa, Homo Sapiens
TPPFRLLRA

SEQ ID NO: 792963 - protein, 9 aa, Homo Sapiens
KAEGGDILL

SEQ ID NO: 792964 - protein, 9 aa, Homo Sapiens
ARGASWTGH

SEQ ID NO: 792965 - protein, 9 aa, Homo Sapiens
PSTSTQSED

SEQ ID NO: 792966 - protein, 9 aa, Homo Sapiens
RSLEELRPL

SEQ ID NO: 792967 - protein, 9 aa, Homo Sapiens
LDISLDSGH

SEQ ID NO: 792968 - protein, 9 aa, Homo Sapiens
PPYHRRKRP

SEQ ID NO: 792969 - protein, 9 aa, Homo Sapiens
AQVINKIPE

SEQ ID NO: 792970 - protein, 9 aa, Homo Sapiens
VVWEWLSDY

SEQ ID NO: 792971 - protein, 9 aa, Homo Sapiens
PHKWNDKPK

SEQ ID NO: 792972 - protein, 9 aa, Homo Sapiens
AITICIILN

SEQ ID NO: 792973 - protein, 9 aa, Homo Sapiens
FDTSGDELD

SEQ ID NO: 792974 - protein, 9 aa, Homo Sapiens
TICKSVYQE

SEQ ID NO: 792975 - protein, 9 aa, Homo Sapiens
RTAQAQKRE

SEQ ID NO: 792976 - protein, 9 aa, Homo Sapiens
LPAWFHWLD

SEQ ID NO: 792977 - protein, 9 aa, Homo Sapiens
GIMEEMERG

SEQ ID NO: 792978 - protein, 9 aa, Homo Sapiens
GVGEGPSRG

SEQ ID NO: 792979 - protein, 9 aa, Homo Sapiens
GAGSPPPYH

SEQ ID NO: 792980 - protein, 9 aa, Homo Sapiens
LEFFPQIQE

SEQ ID NO: 792981 - protein, 9 aa, Homo Sapiens
VGFNHPTLG

SEQ ID NO: 792982 - protein, 9 aa, Homo Sapiens
EYGVLLAPD

SEQ ID NO: 792983 - protein, 9 aa, Homo Sapiens
PVCLKILLD

SEQ ID NO: 792984 - protein, 9 aa, Homo Sapiens
TRVSPPLRN

SEQ ID NO: 792985 - protein, 9 aa, Homo Sapiens
QQAVQKLYE

SEQ ID NO: 792986 - protein, 9 aa, Homo Sapiens
KRPHIKPNA

SEQ ID NO: 792987 - protein, 9 aa, Homo Sapiens
EGRLPGHPD

SEQ ID NO: 792988 - protein, 9 aa, Homo Sapiens
LDHRRPNYP

SEQ ID NO: 792989 - protein, 9 aa, Homo Sapiens
CGEDVYIVQ

SEQ ID NO: 792990 - protein, 9 aa, Homo Sapiens
DMSAGENGG

SEQ ID NO: 792991 - protein, 9 aa, Homo Sapiens
RCASCSPLS

SEQ ID NO: 792992 - protein, 9 aa, Homo Sapiens
VISHRLSAW

SEQ ID NO: 792993 - protein, 9 aa, Homo Sapiens
SIWTILRKC

SEQ ID NO: 792994 - protein, 9 aa, Homo Sapiens
LGHNLRASM

SEQ ID NO: 792995 - protein, 9 aa, Homo Sapiens
RLPAWFHWL

SEQ ID NO: 792996 - protein, 9 aa, Homo Sapiens
GASWTGHVA

SEQ ID NO: 792997 - protein, 9 aa, Homo Sapiens
QKNLFNAES

SEQ ID NO: 792998 - protein, 9 aa, Homo Sapiens
VPRPSLESL

SEQ ID NO: 792999 - protein, 9 aa, Homo Sapiens
FKFLRSNSP

SEQ ID NO: 793000 - protein, 9 aa, Homo Sapiens
LKDRKEDVK

SEQ ID NO: 793001 - protein, 9 aa, Homo Sapiens
QEDERTADE

SEQ ID NO: 793002 - protein, 9 aa, Homo Sapiens
FMRPIAFHS

SEQ ID NO: 793003 - protein, 9 aa, Homo Sapiens
MSAGENGGF

SEQ ID NO: 793004 - protein, 9 aa, Homo Sapiens
GGVMQYVNG

SEQ ID NO: 793005 - protein, 9 aa, Homo Sapiens
SLKPFAPEL

SEQ ID NO: 793006 - protein, 9 aa, Homo Sapiens
NGLDLPPLY

SEQ ID NO: 793007 - protein, 9 aa, Homo Sapiens
SSSEDNTED

SEQ ID NO: 793008 - protein, 9 aa, Homo Sapiens
GPTSKRPHI

SEQ ID NO: 793009 - protein, 9 aa, Homo Sapiens
HRLSAWALS

SEQ ID NO: 793010 - protein, 9 aa, Homo Sapiens
PTSKRPHIK

SEQ ID NO: 793011 - protein, 9 aa, Homo Sapiens
RSPSTTQTT

SEQ ID NO: 793012 - protein, 9 aa, Homo Sapiens
HLNSVGNTC

SEQ ID NO: 793013 - protein, 9 aa, Homo Sapiens
SPLSLKPFA

SEQ ID NO: 793014 - protein, 9 aa, Homo Sapiens
STQSEDRHG

SEQ ID NO: 793015 - protein, 9 aa, Homo Sapiens
LPRVKSPEP

SEQ ID NO: 793016 - protein, 9 aa, Homo Sapiens
LSAWALSYT

SEQ ID NO: 793017 - protein, 9 aa, Homo Sapiens
SVCGEDVYI

SEQ ID NO: 793018 - protein, 9 aa, Homo Sapiens
EGGDILLSS

SEQ ID NO: 793019 - protein, 9 aa, Homo Sapiens
FAKRLPAWF

SEQ ID NO: 793020 - protein, 9 aa, Homo Sapiens
KDIVVGDMS

SEQ ID NO: 793021 - protein, 9 aa, Homo Sapiens
YPAEGRLPG

SEQ ID NO: 793022 - protein, 9 aa, Homo Sapiens
KYTDLPVVL

SEQ ID NO: 793023 - protein, 9 aa, Homo Sapiens
EAARGASWT

SEQ ID NO: 793024 - protein, 9 aa, Homo Sapiens
PTICKSVYQ

SEQ ID NO: 793025 - protein, 9 aa, Homo Sapiens
MPVLKSFIE

SEQ ID NO: 793026 - protein, 9 aa, Homo Sapiens
SRYKCSETK

SEQ ID NO: 793027 - protein, 9 aa, Homo Sapiens
GRNSFEVHV

SEQ ID NO: 793028 - protein, 9 aa, Homo Sapiens
REFPLTLEF

SEQ ID NO: 793029 - protein, 9 aa, Homo Sapiens
LGTTLCVCK

SEQ ID NO: 793030 - protein, 9 aa, Homo Sapiens
TSKRPHIKP

SEQ ID NO: 793031 - protein, 9 aa, Homo Sapiens
DGTPPFRLL

SEQ ID NO: 793032 - protein, 9 aa, Homo Sapiens
IVKGDRSYV

SEQ ID NO: 793033 - protein, 9 aa, Homo Sapiens
DVAGGVMQY

SEQ ID NO: 793034 - protein, 9 aa, Homo Sapiens
GLPGENEAP

SEQ ID NO: 793035 - protein, 9 aa, Homo Sapiens
RVREELLWH

SEQ ID NO: 793036 - protein, 9 aa, Homo Sapiens
LREFPLTLE

SEQ ID NO: 793037 - protein, 9 aa, Homo Sapiens
FLMDDNTSN

SEQ ID NO: 793038 - protein, 9 aa, Homo Sapiens
SAHLRQQAV

SEQ ID NO: 793039 - protein, 9 aa, Homo Sapiens
IEDLTCRNK

SEQ ID NO: 793040 - protein, 9 aa, Homo Sapiens
GSFLMDDNT

SEQ ID NO: 793041 - protein, 9 aa, Homo Sapiens
LSSASVSGS

SEQ ID NO: 793042 - protein, 9 aa, Homo Sapiens
TTDMSAGEN

SEQ ID NO: 793043 - protein, 9 aa, Homo Sapiens
TDLPVVLYT

SEQ ID NO: 793044 - protein, 9 aa, Homo Sapiens
ARENSTNVV

SEQ ID NO: 793045 - protein, 9 aa, Homo Sapiens
PVLKSFIEK

SEQ ID NO: 793046 - protein, 9 aa, Homo Sapiens
PELKQGRRL

SEQ ID NO: 793047 - protein, 9 aa, Homo Sapiens
PVGPSTSTQ

SEQ ID NO: 793048 - protein, 9 aa, Homo Sapiens
DISLDSGHE

SEQ ID NO: 793049 - protein, 9 aa, Homo Sapiens
GWLMQIKNQ

SEQ ID NO: 793050 - protein, 9 aa, Homo Sapiens
KKFKFKFLR

SEQ ID NO: 793051 - protein, 9 aa, Homo Sapiens
PTAAHRNSS

SEQ ID NO: 793052 - protein, 9 aa, Homo Sapiens
GGDILLSSL

SEQ ID NO: 793053 - protein, 9 aa, Homo Sapiens
GNSFDTSGD

SEQ ID NO: 793054 - protein, 9 aa, Homo Sapiens
KEYGVLLAP

SEQ ID NO: 793055 - protein, 9 aa, Homo Sapiens
VYQEDERTA

SEQ ID NO: 793056 - protein, 9 aa, Homo Sapiens
QQICKQQPP

SEQ ID NO: 793057 - protein, 9 aa, Homo Sapiens
TEKAVTSLP

SEQ ID NO: 793058 - protein, 9 aa, Homo Sapiens
GGKKDGEAP

SEQ ID NO: 793059 - protein, 9 aa, Homo Sapiens
TSGDELDVH

SEQ ID NO: 793060 - protein, 9 aa, Homo Sapiens
EWLSDYGSW

SEQ ID NO: 793061 - protein, 9 aa, Homo Sapiens
YPTKYEEIN

SEQ ID NO: 793062 - protein, 9 aa, Homo Sapiens
TNVVFLITD

SEQ ID NO: 793063 - protein, 9 aa, Homo Sapiens
RETWASISS

SEQ ID NO: 793064 - protein, 9 aa, Homo Sapiens
SCYANLPDG

SEQ ID NO: 793065 - protein, 9 aa, Homo Sapiens
KGDRSYVKD

SEQ ID NO: 793066 - protein, 9 aa, Homo Sapiens
IRCDTSGHF

SEQ ID NO: 793067 - protein, 9 aa, Homo Sapiens
CTSSCTPLC

SEQ ID NO: 793068 - protein, 9 aa, Homo Sapiens
TLCVCKLAC

SEQ ID NO: 793069 - protein, 9 aa, Homo Sapiens
PPQPRTAQA

SEQ ID NO: 793070 - protein, 9 aa, Homo Sapiens
WLMQIKNQI

SEQ ID NO: 793071 - protein, 9 aa, Homo Sapiens
EDERTADEK

SEQ ID NO: 793072 - protein, 9 aa, Homo Sapiens
TQKNLFNAE

SEQ ID NO: 793073 - protein, 9 aa, Homo Sapiens
EGPTSKRPH

SEQ ID NO: 793074 - protein, 9 aa, Homo Sapiens
PSTTQTTPS

SEQ ID NO: 793075 - protein, 9 aa, Homo Sapiens
SKRPHIKPN

SEQ ID NO: 793076 - protein, 9 aa, Homo Sapiens
TSSCTPLCC

SEQ ID NO: 793077 - protein, 9 aa, Homo Sapiens
KWNLDISLD

SEQ ID NO: 793078 - protein, 9 aa, Homo Sapiens
QATNAFTES

SEQ ID NO: 793079 - protein, 9 aa, Homo Sapiens
RGSKTEARL

SEQ ID NO: 793080 - protein, 9 aa, Homo Sapiens
AAEAALSQT

SEQ ID NO: 793081 - protein, 9 aa, Homo Sapiens
TICIILNTL

SEQ ID NO: 793082 - protein, 9 aa, Homo Sapiens
SNSPLSLKP

SEQ ID NO: 793083 - protein, 9 aa, Homo Sapiens
SSCTPLCCQ

SEQ ID NO: 793084 - protein, 9 aa, Homo Sapiens
KRLPAWFHW

SEQ ID NO: 793085 - protein, 9 aa, Homo Sapiens
ERTADEKAP

SEQ ID NO: 793086 - protein, 9 aa, Homo Sapiens
NSFDTSGDE

SEQ ID NO: 793087 - protein, 9 aa, Homo Sapiens
LRNGYFGVG

SEQ ID NO: 793088 - protein, 9 aa, Homo Sapiens
GGPGTQPLG

SEQ ID NO: 793089 - protein, 9 aa, Homo Sapiens
TVGMRNDVS

SEQ ID NO: 793090 - protein, 9 aa, Homo Sapiens
TQSEDRHGP

SEQ ID NO: 793091 - protein, 9 aa, Homo Sapiens
PTPLNDDKW

SEQ ID NO: 793092 - protein, 9 aa, Homo Sapiens
AEAALSQTG

SEQ ID NO: 793093 - protein, 9 aa, Homo Sapiens
ELRPLLLER

SEQ ID NO: 793094 - protein, 9 aa, Homo Sapiens
IFELERNVT

SEQ ID NO: 793095 - protein, 9 aa, Homo Sapiens
NAESRPLDS

SEQ ID NO: 793096 - protein, 9 aa, Homo Sapiens
TLEEAIRCD

SEQ ID NO: 793097 - protein, 9 aa, Homo Sapiens
IEKLQEEED

SEQ ID NO: 793098 - protein, 9 aa, Homo Sapiens
HASPHKWND

SEQ ID NO: 793099 - protein, 9 aa, Homo Sapiens
MRPIAFHSP

SEQ ID NO: 793100 - protein, 9 aa, Homo Sapiens
LDGALDEVM

SEQ ID NO: 793101 - protein, 9 aa, Homo Sapiens
PNYPAEGRL

SEQ ID NO: 793102 - protein, 9 aa, Homo Sapiens
ADEKAPDHS

SEQ ID NO: 793103 - protein, 9 aa, Homo Sapiens
IRASCCLWR

SEQ ID NO: 793104 - protein, 9 aa, Homo Sapiens
SHRLSAWAL

SEQ ID NO: 793105 - protein, 9 aa, Homo Sapiens
VSDLLVAVM

SEQ ID NO: 793106 - protein, 9 aa, Homo Sapiens
LSYTRVSPP

SEQ ID NO: 793107 - protein, 9 aa, Homo Sapiens
TVMRFDYIW

SEQ ID NO: 793108 - protein, 9 aa, Homo Sapiens
TADRETWAS

SEQ ID NO: 793109 - protein, 9 aa, Homo Sapiens
SKFTCTSGK

SEQ ID NO: 793110 - protein, 9 aa, Homo Sapiens
ELKDRKEDV

SEQ ID NO: 793111 - protein, 9 aa, Homo Sapiens
FDYIWLRDH

SEQ ID NO: 793112 - protein, 9 aa, Homo Sapiens
TDMSAGENG

SEQ ID NO: 793113 - protein, 9 aa, Homo Sapiens
TRPTTDMSA

SEQ ID NO: 793114 - protein, 9 aa, Homo Sapiens
PFRLLRAKL

SEQ ID NO: 793115 - protein, 9 aa, Homo Sapiens
SRNDFSIWT

SEQ ID NO: 793116 - protein, 9 aa, Homo Sapiens
ILQGKYTDL

SEQ ID NO: 793117 - protein, 9 aa, Homo Sapiens
LCVCKLACI

SEQ ID NO: 793118 - protein, 9 aa, Homo Sapiens
VMLKFEMGH

SEQ ID NO: 793119 - protein, 9 aa, Homo Sapiens
VSPTICKSV

SEQ ID NO: 793120 - protein, 9 aa, Homo Sapiens
KTLEEAIRC

SEQ ID NO: 793121 - protein, 9 aa, Homo Sapiens
VLAQFPIDH

SEQ ID NO: 793122 - protein, 9 aa, Homo Sapiens
GSKTEARLA

SEQ ID NO: 793123 - protein, 9 aa, Homo Sapiens
AIPVCLKIL

SEQ ID NO: 793124 - protein, 9 aa, Homo Sapiens
EPEGWGTGG

SEQ ID NO: 793125 - protein, 9 aa, Homo Sapiens
TILRKCIGM

SEQ ID NO: 793126 - protein, 9 aa, Homo Sapiens
RLVLAQFPI

SEQ ID NO: 793127 - protein, 9 aa, Homo Sapiens
AYDGLVTQN

SEQ ID NO: 793128 - protein, 9 aa, Homo Sapiens
KQGRRLCKW

SEQ ID NO: 793129 - protein, 9 aa, Homo Sapiens
PDGGKKDGE

SEQ ID NO: 793130 - protein, 9 aa, Homo Sapiens
FGVGEGPSR

SEQ ID NO: 793131 - protein, 9 aa, Homo Sapiens
AVMVMPWKA

SEQ ID NO: 793132 - protein, 9 aa, Homo Sapiens
CKSVYQEDE

SEQ ID NO: 793133 - protein, 9 aa, Homo Sapiens
ELPTAAHRN

SEQ ID NO: 793134 - protein, 9 aa, Homo Sapiens
ASQSAGSTG

SEQ ID NO: 793135 - protein, 9 aa, Homo Sapiens
SKLQGMQQS

SEQ ID NO: 793136 - protein, 9 aa, Homo Sapiens
IKSLSVELL

SEQ ID NO: 793137 - protein, 9 aa, Homo Sapiens
GRQQICKQQ

SEQ ID NO: 793138 - protein, 9 aa, Homo Sapiens
AHRNSSVRS

SEQ ID NO: 793139 - protein, 9 aa, Homo Sapiens
DCNSRYKCS

SEQ ID NO: 793140 - protein, 9 aa, Homo Sapiens
PRTAQAQKR

SEQ ID NO: 793141 - protein, 9 aa, Homo Sapiens
GVMQYVNGA

SEQ ID NO: 793142 - protein, 9 aa, Homo Sapiens
ILNTLFMAM

SEQ ID NO: 793143 - protein, 9 aa, Homo Sapiens
WLTADRETW

SEQ ID NO: 793144 - protein, 9 aa, Homo Sapiens
DFSIWTILR

SEQ ID NO: 793145 - protein, 9 aa, Homo Sapiens
AALSQTGFS

SEQ ID NO: 793146 - protein, 9 aa, Homo Sapiens
FPLTLEFFP

SEQ ID NO: 793147 - protein, 9 aa, Homo Sapiens
RLSSASVSG

SEQ ID NO: 793148 - protein, 9 aa, Homo Sapiens
AERALVPRP

SEQ ID NO: 793149 - protein, 9 aa, Homo Sapiens
PPLRNGYFG

SEQ ID NO: 793150 - protein, 9 aa, Homo Sapiens
DLAITICII

SEQ ID NO: 793151 - protein, 9 aa, Homo Sapiens
SFEVHVCAC

SEQ ID NO: 793152 - protein, 9 aa, Homo Sapiens
KKKWNLDIS

SEQ ID NO: 793153 - protein, 9 aa, Homo Sapiens
PGPDGGKKD

SEQ ID NO: 793154 - protein, 9 aa, Homo Sapiens
PNSHSIQHI

SEQ ID NO: 793155 - protein, 9 aa, Homo Sapiens
ARTRPTTDM

SEQ ID NO: 793156 - protein, 9 aa, Homo Sapiens
NVVFLITDG

SEQ ID NO: 793157 - protein, 9 aa, Homo Sapiens
VKGMEDEGQ

SEQ ID NO: 793158 - protein, 9 aa, Homo Sapiens
GPGTQPLGM

SEQ ID NO: 793159 - protein, 9 aa, Homo Sapiens
EGWGTGGVV

SEQ ID NO: 793160 - protein, 9 aa, Homo Sapiens
TQAIPVCLK

SEQ ID NO: 793161 - protein, 9 aa, Homo Sapiens
YFGVGEGPS

SEQ ID NO: 793162 - protein, 9 aa, Homo Sapiens
RGASWTGHV

SEQ ID NO: 793163 - protein, 9 aa, Homo Sapiens
DRETWASIS

SEQ ID NO: 793164 - protein, 9 aa, Homo Sapiens
DGLVTQNAS

SEQ ID NO: 793165 - protein, 9 aa, Homo Sapiens
QICKQQPPC

SEQ ID NO: 793166 - protein, 9 aa, Homo Sapiens
TIPIGWSYF

SEQ ID NO: 793167 - protein, 9 aa, Homo Sapiens
TSLPRVKSP

SEQ ID NO: 793168 - protein, 9 aa, Homo Sapiens
FNAESRPLD

SEQ ID NO: 793169 - protein, 9 aa, Homo Sapiens
GKEYGVLLA

SEQ ID NO: 793170 - protein, 9 aa, Homo Sapiens
IQEPTGHQF

SEQ ID NO: 793171 - protein, 9 aa, Homo Sapiens
VTEKAVTSL

SEQ ID NO: 793172 - protein, 9 aa, Homo Sapiens
ILGDGTPPF

SEQ ID NO: 793173 - protein, 9 aa, Homo Sapiens
ESKFTCTSG

SEQ ID NO: 793174 - protein, 9 aa, Homo Sapiens
AAHRNSSVR

SEQ ID NO: 793175 - protein, 9 aa, Homo Sapiens
PAEGRLPGH

SEQ ID NO: 793176 - protein, 9 aa, Homo Sapiens
LLAPDGSTV

SEQ ID NO: 793177 - protein, 9 aa, Homo Sapiens
HFPILGDGT

SEQ ID NO: 793178 - protein, 9 aa, Homo Sapiens
SSFSKLLQP

SEQ ID NO: 793179 - protein, 9 aa, Homo Sapiens
KDRKEDVKG

SEQ ID NO: 793180 - protein, 9 aa, Homo Sapiens
PTKYEEINN

SEQ ID NO: 793181 - protein, 9 aa, Homo Sapiens
NTSNTLNSL

SEQ ID NO: 793182 - protein, 9 aa, Homo Sapiens
LLLLLIRAS

SEQ ID NO: 793183 - protein, 9 aa, Homo Sapiens
KKKFKFKFL

SEQ ID NO: 793184 - protein, 9 aa, Homo Sapiens
RAKLREFPL

SEQ ID NO: 793185 - protein, 9 aa, Homo Sapiens
NHPTLGHNQ

SEQ ID NO: 793186 - protein, 9 aa, Homo Sapiens
ALEPEGWGT

SEQ ID NO: 793187 - protein, 9 aa, Homo Sapiens
GPDGGKKDG

SEQ ID NO: 793188 - protein, 9 aa, Homo Sapiens
QGKYTDLPV

SEQ ID NO: 793189 - protein, 9 aa, Homo Sapiens
GTPPFRLLR

SEQ ID NO: 793190 - protein, 9 aa, Homo Sapiens
AWFHWLDHR

SEQ ID NO: 793191 - protein, 9 aa, Homo Sapiens
QPLGMGEAL

SEQ ID NO: 793192 - protein, 9 aa, Homo Sapiens
NSTNVVFLI

SEQ ID NO: 793193 - protein, 9 aa, Homo Sapiens
QAIPVCLKI

SEQ ID NO: 793194 - protein, 9 aa, Homo Sapiens
APELKQGRR

SEQ ID NO: 793195 - protein, 9 aa, Homo Sapiens
LTCRNKDML

SEQ ID NO: 793196 - protein, 9 aa, Homo Sapiens
VAGGVMQYV

SEQ ID NO: 793197 - protein, 9 aa, Homo Sapiens
VPDPNSHSI

SEQ ID NO: 793198 - protein, 9 aa, Homo Sapiens
VKGDRSYVK

SEQ ID NO: 793199 - protein, 9 aa, Homo Sapiens
VAQVINKIP

SEQ ID NO: 793200 - protein, 9 aa, Homo Sapiens
LELPTAAHR

SEQ ID NO: 793201 - protein, 9 aa, Homo Sapiens
LGWLMQIKN

SEQ ID NO: 793202 - protein, 9 aa, Homo Sapiens
KNLFNAESR

SEQ ID NO: 793203 - protein, 9 aa, Homo Sapiens
LTVGMRNDV

SEQ ID NO: 793204 - protein, 9 aa, Homo Sapiens
SDCLFPRLS

SEQ ID NO: 793205 - protein, 9 aa, Homo Sapiens
AQKREEQTK

SEQ ID NO: 793206 - protein, 9 aa, Homo Sapiens
ILGHNLRAS

SEQ ID NO: 793207 - protein, 9 aa, Homo Sapiens
LPTAAHRNS

SEQ ID NO: 793208 - protein, 9 aa, Homo Sapiens
VREELLWHQ

SEQ ID NO: 793209 - protein, 9 aa, Homo Sapiens
EKAPDHSCY

SEQ ID NO: 793210 - protein, 9 aa, Homo Sapiens
LGMGEALLG

SEQ ID NO: 793211 - protein, 9 aa, Homo Sapiens
NDFSIWTIL

SEQ ID NO: 793212 - protein, 9 aa, Homo Sapiens
HWLDHRRPN

SEQ ID NO: 793213 - protein, 9 aa, Homo Sapiens
ERGSKTEAR

SEQ ID NO: 793214 - protein, 9 aa, Homo Sapiens
WLSDYGSWT

SEQ ID NO: 793215 - protein, 9 aa, Homo Sapiens
TEGPTSKRP

SEQ ID NO: 793216 - protein, 9 aa, Homo Sapiens
RDKTLREVW

SEQ ID NO: 793217 - protein, 9 aa, Homo Sapiens
GEKGLVIAK

SEQ ID NO: 793218 - protein, 9 aa, Homo Sapiens
DERTADEKA

SEQ ID NO: 793219 - protein, 9 aa, Homo Sapiens
CTDWQKAEG

SEQ ID NO: 793220 - protein, 9 aa, Homo Sapiens
EVMLKFEMG

SEQ ID NO: 793221 - protein, 9 aa, Homo Sapiens
LQPYREGAA

SEQ ID NO: 793222 - protein, 9 aa, Homo Sapiens
QRCASCSPL

SEQ ID NO: 793223 - protein, 9 aa, Homo Sapiens
ALVPRPSLE

SEQ ID NO: 793224 - protein, 9 aa, Homo Sapiens
NLYSYPTKY

SEQ ID NO: 793225 - protein, 9 aa, Homo Sapiens
ELKQGRRLC

SEQ ID NO: 793226 - protein, 9 aa, Homo Sapiens
LEEAIRCDT

SEQ ID NO: 793227 - protein, 9 aa, Homo Sapiens
FRLLRAKLR

SEQ ID NO: 793228 - protein, 9 aa, Homo Sapiens
LHARENSTN

SEQ ID NO: 793229 - protein, 9 aa, Homo Sapiens
ITSKHASPH

SEQ ID NO: 793230 - protein, 9 aa, Homo Sapiens
KQQPPCSRL

SEQ ID NO: 793231 - protein, 9 aa, Homo Sapiens
DWQKAEGGD

SEQ ID NO: 793232 - protein, 9 aa, Homo Sapiens
ALSYTRVSP

SEQ ID NO: 793233 - protein, 9 aa, Homo Sapiens
AFTESKFTC

SEQ ID NO: 793234 - protein, 9 aa, Homo Sapiens
GTQPLGMGE

SEQ ID NO: 793235 - protein, 9 aa, Homo Sapiens
LFNAESRPL

SEQ ID NO: 793236 - protein, 9 aa, Homo Sapiens
PMSRSPSTT

SEQ ID NO: 793237 - protein, 9 aa, Homo Sapiens
HQNGLDLPP

SEQ ID NO: 793238 - protein, 9 aa, Homo Sapiens
DNTEDQDVK

SEQ ID NO: 793239 - protein, 9 aa, Homo Sapiens
WGTGGVVTD

SEQ ID NO: 793240 - protein, 9 aa, Homo Sapiens
EFPLTLEFF

SEQ ID NO: 793241 - protein, 9 aa, Homo Sapiens
DYGSWTAYE

SEQ ID NO: 793242 - protein, 9 aa, Homo Sapiens
GLDLPPLYP

SEQ ID NO: 793243 - protein, 9 aa, Homo Sapiens
SPTICKSVY

SEQ ID NO: 793244 - protein, 9 aa, Homo Sapiens
VTIPIGWSY

SEQ ID NO: 793245 - protein, 9 aa, Homo Sapiens
GDALEPEGW

SEQ ID NO: 793246 - protein, 9 aa, Homo Sapiens
LVTQNASDI

SEQ ID NO: 793247 - protein, 9 aa, Homo Sapiens
TTQTTPSPQ

SEQ ID NO: 793248 - protein, 9 aa, Homo Sapiens
KFLRSNSPL

SEQ ID NO: 793249 - protein, 9 aa, Homo Sapiens
RVSPPLRNG

SEQ ID NO: 793250 - protein, 9 aa, Homo Sapiens
NEAPGPMGP

SEQ ID NO: 793251 - protein, 9 aa, Homo Sapiens
LLIRASCCL

SEQ ID NO: 793252 - protein, 9 aa, Homo Sapiens
NDVSPTICK

SEQ ID NO: 793253 - protein, 9 aa, Homo Sapiens
SSEDNTEDQ

SEQ ID NO: 793254 - protein, 9 aa, Homo Sapiens
ICIILNTLF

SEQ ID NO: 793255 - protein, 9 aa, Homo Sapiens
LLRAKLREF

SEQ ID NO: 793256 - protein, 9 aa, Homo Sapiens
LTADRETWA

SEQ ID NO: 793257 - protein, 9 aa, Homo Sapiens
SKLLQPYRE

SEQ ID NO: 793258 - protein, 9 aa, Homo Sapiens
STNVVFLIT

SEQ ID NO: 793259 - protein, 9 aa, Homo Sapiens
KFKFLRSNS

SEQ ID NO: 793260 - protein, 9 aa, Homo Sapiens
RPHIKPNAL

SEQ ID NO: 793261 - protein, 9 aa, Homo Sapiens
GENEAPGPM

SEQ ID NO: 793262 - protein, 9 aa, Homo Sapiens
NLFNAESRP

SEQ ID NO: 793263 - protein, 9 aa, Homo Sapiens
VEFAKRLPA

SEQ ID NO: 793264 - protein, 9 aa, Homo Sapiens
EFEASKLQG

SEQ ID NO: 793265 - protein, 9 aa, Homo Sapiens
CKDIVVGDM

SEQ ID NO: 793266 - protein, 9 aa, Homo Sapiens
PFAPELKQG

SEQ ID NO: 793267 - protein, 9 aa, Homo Sapiens
SCQPSCCET

SEQ ID NO: 793268 - protein, 9 aa, Homo Sapiens
TIVERGLGW

SEQ ID NO: 793269 - protein, 9 aa, Homo Sapiens
MLKFEMGHV

SEQ ID NO: 793270 - protein, 9 aa, Homo Sapiens
MNHLNSVGN

SEQ ID NO: 793271 - protein, 9 aa, Homo Sapiens
RAAAEAALS

SEQ ID NO: 793272 - protein, 9 aa, Homo Sapiens
REELLWHQL

SEQ ID NO: 793273 - protein, 9 aa, Homo Sapiens
RNGYFGVGE

SEQ ID NO: 793274 - protein, 9 aa, Homo Sapiens
PLLLERTRD

SEQ ID NO: 793275 - protein, 9 aa, Homo Sapiens
KKDGEAPPA

SEQ ID NO: 793276 - protein, 9 aa, Homo Sapiens
YDGLVTQNA

SEQ ID NO: 793277 - protein, 9 aa, Homo Sapiens
YTRVSPPLR

SEQ ID NO: 793278 - protein, 9 aa, Homo Sapiens
RTADEKAPD

SEQ ID NO: 793279 - protein, 9 aa, Homo Sapiens
AWALSYTRV

SEQ ID NO: 793280 - protein, 9 aa, Homo Sapiens
GDRSYVKDR

SEQ ID NO: 793281 - protein, 9 aa, Homo Sapiens
YHRRKRPSS

SEQ ID NO: 793282 - protein, 9 aa, Homo Sapiens
TNAFTESKF

SEQ ID NO: 793283 - protein, 9 aa, Homo Sapiens
NGHQNGLDL

SEQ ID NO: 793284 - protein, 9 aa, Homo Sapiens
LALELPTAA

SEQ ID NO: 793285 - protein, 9 aa, Homo Sapiens
DCLFPRLSS

SEQ ID NO: 793286 - protein, 9 aa, Homo Sapiens
PTLGHNQRM

SEQ ID NO: 793287 - protein, 9 aa, Homo Sapiens
IIGVAQVIN

SEQ ID NO: 793288 - protein, 9 aa, Homo Sapiens
FELERNVTI

SEQ ID NO: 793289 - protein, 9 aa, Homo Sapiens
QEREFEASK

SEQ ID NO: 793290 - protein, 9 aa, Homo Sapiens
SVGNTCGLE

SEQ ID NO: 793291 - protein, 9 aa, Homo Sapiens
GEIIGVAQV

SEQ ID NO: 793292 - protein, 9 aa, Homo Sapiens
LTLEFFPQI

SEQ ID NO: 793293 - protein, 9 aa, Homo Sapiens
PRVREELLW

SEQ ID NO: 793294 - protein, 9 aa, Homo Sapiens
LSDYGSWTA

SEQ ID NO: 793295 - protein, 9 aa, Homo Sapiens
WNLDISLDS

SEQ ID NO: 793296 - protein, 9 aa, Homo Sapiens
QPYREGAAG

SEQ ID NO: 793297 - protein, 9 aa, Homo Sapiens
RENSTNVVF

SEQ ID NO: 793298 - protein, 9 aa, Homo Sapiens
GRLPGHPDS

SEQ ID NO: 793299 - protein, 9 aa, Homo Sapiens
HHSAHLRQQ

SEQ ID NO: 793300 - protein, 9 aa, Homo Sapiens
PRPSLESLL

SEQ ID NO: 793301 - protein, 9 aa, Homo Sapiens
LAQFPIDHF

SEQ ID NO: 793302 - protein, 9 aa, Homo Sapiens
RKFMRPIAF

SEQ ID NO: 793303 - protein, 9 aa, Homo Sapiens
RNDVSPTIC

SEQ ID NO: 793304 - protein, 9 aa, Homo Sapiens
KKYKGEKGL

SEQ ID NO: 793305 - protein, 9 aa, Homo Sapiens
ELLWHQLLE

SEQ ID NO: 793306 - protein, 9 aa, Homo Sapiens
TIKSLSVEL

SEQ ID NO: 793307 - protein, 9 aa, Homo Sapiens
LDLPPLYPS

SEQ ID NO: 793308 - protein, 9 aa, Homo Sapiens
ITAGRLVLA

SEQ ID NO: 793309 - protein, 9 aa, Homo Sapiens
GLPLGTTLC

SEQ ID NO: 793310 - protein, 9 aa, Homo Sapiens
LYSYPTKYE

SEQ ID NO: 793311 - protein, 9 aa, Homo Sapiens
SLPRVKSPE

SEQ ID NO: 793312 - protein, 9 aa, Homo Sapiens
EQLDVAGGV

SEQ ID NO: 793313 - protein, 9 aa, Homo Sapiens
GIVKGDRSY

SEQ ID NO: 793314 - protein, 9 aa, Homo Sapiens
TSDCLFPRL

SEQ ID NO: 793315 - protein, 9 aa, Homo Sapiens
RNVTIPIGW

SEQ ID NO: 793316 - protein, 9 aa, Homo Sapiens
VAVMVMPWK

SEQ ID NO: 793317 - protein, 9 aa, Homo Sapiens
GLVTQNASD

SEQ ID NO: 793318 - protein, 9 aa, Homo Sapiens
NSHSIQHIS

SEQ ID NO: 793319 - protein, 9 aa, Homo Sapiens
NSPLSLKPF

SEQ ID NO: 793320 - protein, 9 aa, Homo Sapiens
PDPNSHSIQ

SEQ ID NO: 793321 - protein, 9 aa, Homo Sapiens
ASWTGHVAG

SEQ ID NO: 793322 - protein, 9 aa, Homo Sapiens
SPPPYHRRK

SEQ ID NO: 793323 - protein, 9 aa, Homo Sapiens
TKYEEINNI

SEQ ID NO: 793324 - protein, 9 aa, Homo Sapiens
ITICIILNT

SEQ ID NO: 793325 - protein, 9 aa, Homo Sapiens
HRRPNYPAE

SEQ ID NO: 793326 - protein, 9 aa, Homo Sapiens
RPNYPAEGR

SEQ ID NO: 793327 - protein, 9 aa, Homo Sapiens
DRKEDVKGM

SEQ ID NO: 793328 - protein, 9 aa, Homo Sapiens
PILGDGTPP

SEQ ID NO: 793329 - protein, 9 aa, Homo Sapiens
LFSDCNSRY

SEQ ID NO: 793330 - protein, 9 aa, Homo Sapiens
ERALVPRPS

SEQ ID NO: 793331 - protein, 9 aa, Homo Sapiens
IAFHSPLDA

SEQ ID NO: 793332 - protein, 9 aa, Homo Sapiens
MDDNTSNTL

SEQ ID NO: 793333 - protein, 9 aa, Homo Sapiens
YQEDERTAD

SEQ ID NO: 793334 - protein, 9 aa, Homo Sapiens
LRAAAEAAL

SEQ ID NO: 793335 - protein, 9 aa, Homo Sapiens
NTVMRFDYI

SEQ ID NO: 793336 - protein, 9 aa, Homo Sapiens
KDGEAPPAG

SEQ ID NO: 793337 - protein, 9 aa, Homo Sapiens
GALDEVMLK

SEQ ID NO: 793338 - protein, 9 aa, Homo Sapiens
GSSFSKLLQ

SEQ ID NO: 793339 - protein, 9 aa, Homo Sapiens
FEASKLQGM

SEQ ID NO: 793340 - protein, 9 aa, Homo Sapiens
PTTDMSAGE

SEQ ID NO: 793341 - protein, 9 aa, Homo Sapiens
YGVLLAPDG

SEQ ID NO: 793342 - protein, 9 aa, Homo Sapiens
RQQAVQKLY

SEQ ID NO: 793343 - protein, 9 aa, Homo Sapiens
IDESVCGED

SEQ ID NO: 793344 - protein, 9 aa, Homo Sapiens
PATQKNLFN

SEQ ID NO: 793345 - protein, 9 aa, Homo Sapiens
GRLVLAQFP

SEQ ID NO: 793346 - protein, 9 aa, Homo Sapiens
ENSTNVVFL

SEQ ID NO: 793347 - protein, 9 aa, Homo Sapiens
TEDQDVKTK

SEQ ID NO: 793348 - protein, 9 aa, Homo Sapiens
EEAIRCDTS

SEQ ID NO: 793349 - protein, 9 aa, Homo Sapiens
LKQGRRLCK

SEQ ID NO: 793350 - protein, 9 aa, Homo Sapiens
ISHRLSAWA

SEQ ID NO: 793351 - protein, 9 aa, Homo Sapiens
VLLAPDGST

SEQ ID NO: 793352 - protein, 9 aa, Homo Sapiens
DHRRPNYPA

SEQ ID NO: 793353 - protein, 9 aa, Homo Sapiens
ETWASISSV

SEQ ID NO: 793354 - protein, 9 aa, Homo Sapiens
LWHQLLEKR

SEQ ID NO: 793355 - protein, 9 aa, Homo Sapiens
FFPQIQEPT

SEQ ID NO: 793356 - protein, 9 aa, Homo Sapiens
VMRFDYIWL

SEQ ID NO: 793357 - protein, 9 aa, Homo Sapiens
GLQILGHNL

SEQ ID NO: 793358 - protein, 9 aa, Homo Sapiens
VERGLGWLM

SEQ ID NO: 793359 - protein, 9 aa, Homo Sapiens
NGYFGVGEG

SEQ ID NO: 793360 - protein, 9 aa, Homo Sapiens
RPLLLERTR

SEQ ID NO: 793361 - protein, 9 aa, Homo Sapiens
RNDFSIWTI

SEQ ID NO: 793362 - protein, 9 aa, Homo Sapiens
IWLRDHCRS

SEQ ID NO: 793363 - protein, 9 aa, Homo Sapiens
FPQIQEPTG

SEQ ID NO: 793364 - protein, 9 aa, Homo Sapiens
FPRLSSASV

SEQ ID NO: 793365 - protein, 9 aa, Homo Sapiens
PLRDKTLRE

SEQ ID NO: 793366 - protein, 9 aa, Homo Sapiens
AGRLVLAQF

SEQ ID NO: 793367 - protein, 9 aa, Homo Sapiens
EIIGVAQVI

SEQ ID NO: 793368 - protein, 9 aa, Homo Sapiens
SPTPLNDDK

SEQ ID NO: 793369 - protein, 9 aa, Homo Sapiens
IVERGLGWL

SEQ ID NO: 793370 - protein, 9 aa, Homo Sapiens
VEIDESVCG

SEQ ID NO: 793371 - protein, 9 aa, Homo Sapiens
RNSFEVHVC

SEQ ID NO: 793372 - protein, 9 aa, Homo Sapiens
ASASQSAGS

SEQ ID NO: 793373 - protein, 9 aa, Homo Sapiens
LSVELLKAN

SEQ ID NO: 793374 - protein, 9 aa, Homo Sapiens
NRSLEELRP

SEQ ID NO: 793375 - protein, 9 aa, Homo Sapiens
VWEWLSDYG

SEQ ID NO: 793376 - protein, 9 aa, Homo Sapiens
SFSKLLQPY

SEQ ID NO: 793377 - protein, 9 aa, Homo Sapiens
IWTILRKCI

SEQ ID NO: 793378 - protein, 9 aa, Homo Sapiens
LLLIRASCC

SEQ ID NO: 793379 - protein, 9 aa, Homo Sapiens
VGNTCGLEQ

SEQ ID NO: 793380 - protein, 9 aa, Homo Sapiens
DVSPTICKS

SEQ ID NO: 793381 - protein, 9 aa, Homo Sapiens
SFLMDDNTS

SEQ ID NO: 793382 - protein, 9 aa, Homo Sapiens
PLSLKPFAP

SEQ ID NO: 793383 - protein, 9 aa, Homo Sapiens
EAALSQTGF

SEQ ID NO: 793384 - protein, 9 aa, Homo Sapiens
CIILNTLFM

SEQ ID NO: 793385 - protein, 9 aa, Homo Sapiens
EASKLQGMQ

SEQ ID NO: 793386 - protein, 9 aa, Homo Sapiens
LVLAQFPID

SEQ ID NO: 793387 - protein, 9 aa, Homo Sapiens
RSYVKDRWC

SEQ ID NO: 793388 - protein, 9 aa, Homo Sapiens
TPLCCQQSS

SEQ ID NO: 793389 - protein, 9 aa, Homo Sapiens
GLLLLLLIR

SEQ ID NO: 793390 - protein, 9 aa, Homo Sapiens
DPNSHSIQH

SEQ ID NO: 793391 - protein, 9 aa, Homo Sapiens
HNLRASMRE

SEQ ID NO: 793392 - protein, 9 aa, Homo Sapiens
LKSFIEKLQ

SEQ ID NO: 793393 - protein, 9 aa, Homo Sapiens
SPPLRNGYF

SEQ ID NO: 793394 - protein, 9 aa, Homo Sapiens
VHVCACPGR

SEQ ID NO: 793395 - protein, 9 aa, Homo Sapiens
TQTTPSPQG

SEQ ID NO: 793396 - protein, 9 aa, Homo Sapiens
AIRCDTSGH

SEQ ID NO: 793397 - protein, 9 aa, Homo Sapiens
KAVTSLPRV

SEQ ID NO: 793398 - protein, 9 aa, Homo Sapiens
IILNTLFMA

SEQ ID NO: 793399 - protein, 9 aa, Homo Sapiens
SDLLVAVMV

SEQ ID NO: 793400 - protein, 9 aa, Homo Sapiens
SVYQEDERT

SEQ ID NO: 793401 - protein, 9 aa, Homo Sapiens
KWHRVTAER

SEQ ID NO: 793402 - protein, 9 aa, Homo Sapiens
LLVAVMVMP

SEQ ID NO: 793403 - protein, 9 aa, Homo Sapiens
LRDKTLREV

SEQ ID NO: 793404 - protein, 9 aa, Homo Sapiens
LSQTGFSYD

SEQ ID NO: 793405 - protein, 9 aa, Homo Sapiens
ENGNSFDTS

SEQ ID NO: 793406 - protein, 9 aa, Homo Sapiens
CVCKLACIN

SEQ ID NO: 793407 - protein, 9 aa, Homo Sapiens
PDHSCYANL

SEQ ID NO: 793408 - protein, 9 aa, Homo Sapiens
ESVCGEDVY

SEQ ID NO: 793409 - protein, 9 aa, Homo Sapiens
SLAKKYKGE

SEQ ID NO: 793410 - protein, 9 aa, Homo Sapiens
NGNSFDTSG

SEQ ID NO: 793411 - protein, 9 aa, Homo Sapiens
SDYGSWTAY

SEQ ID NO: 793412 - protein, 9 aa, Homo Sapiens
YGTQAIPVC

SEQ ID NO: 793413 - protein, 9 aa, Homo Sapiens
REFEASKLQ

SEQ ID NO: 793414 - protein, 9 aa, Homo Sapiens
PIAFHSPLD

SEQ ID NO: 793415 - protein, 9 aa, Homo Sapiens
GTQAIPVCL

SEQ ID NO: 793416 - protein, 9 aa, Homo Sapiens
LDEVMLKFE

SEQ ID NO: 793417 - protein, 9 aa, Homo Sapiens
HSIQHISQT

SEQ ID NO: 793418 - protein, 9 aa, Homo Sapiens
TLEFFPQIQ

SEQ ID NO: 793419 - protein, 9 aa, Homo Sapiens
IENGNSFDT

SEQ ID NO: 793420 - protein, 9 aa, Homo Sapiens
YIWLRDHCR

SEQ ID NO: 793421 - protein, 9 aa, Homo Sapiens
LDVAGGVMQ

SEQ ID NO: 793422 - protein, 9 aa, Homo Sapiens
RGGPGTQPL

SEQ ID NO: 793423 - protein, 9 aa, Homo Sapiens
SLEELRPLL

SEQ ID NO: 793424 - protein, 9 aa, Homo Sapiens
TVGFNHPTL

SEQ ID NO: 793425 - protein, 9 aa, Homo Sapiens
RGLGWLMQI

SEQ ID NO: 793426 - protein, 9 aa, Homo Sapiens
RASCCLWRR

SEQ ID NO: 793427 - protein, 9 aa, Homo Sapiens
SAWALSYTR

SEQ ID NO: 793428 - protein, 9 aa, Homo Sapiens
QPRTAQAQK

SEQ ID NO: 793429 - protein, 9 aa, Homo Sapiens
YEEINNIKK

SEQ ID NO: 793430 - protein, 9 aa, Homo Sapiens
YGSWTAYEA

SEQ ID NO: 793431 - protein, 9 aa, Homo Sapiens
PLCCQQSSC

SEQ ID NO: 793432 - protein, 9 aa, Homo Sapiens
PYHRRKRPS

SEQ ID NO: 793433 - protein, 9 aa, Homo Sapiens
AEGGDILLS

SEQ ID NO: 793434 - protein, 9 aa, Homo Sapiens
MKAYDGLVT

SEQ ID NO: 793435 - protein, 9 aa, Homo Sapiens
WFHWLDHRR

SEQ ID NO: 793436 - protein, 9 aa, Homo Sapiens
SYPTKYEEI

SEQ ID NO: 793437 - protein, 9 aa, Homo Sapiens
KKWNLDISL

SEQ ID NO: 793438 - protein, 9 aa, Homo Sapiens
GYFGVGEGP

SEQ ID NO: 793439 - protein, 9 aa, Homo Sapiens
ALSQTGFSY

SEQ ID NO: 793440 - protein, 9 aa, Homo Sapiens
VCGEDVYIV

SEQ ID NO: 793441 - protein, 9 aa, Homo Sapiens
TESKFTCTS

SEQ ID NO: 793442 - protein, 9 aa, Homo Sapiens
ETSSCQPSC

SEQ ID NO: 793443 - protein, 9 aa, Homo Sapiens
RALVPRPSL

SEQ ID NO: 793444 - protein, 9 aa, Homo Sapiens
AKRLPAWFH

SEQ ID NO: 793445 - protein, 9 aa, Homo Sapiens
SCTPLCCQQ

SEQ ID NO: 793446 - protein, 9 aa, Homo Sapiens
TGHQFVISH

SEQ ID NO: 793447 - protein, 9 aa, Homo Sapiens
RKEDVKGME

SEQ ID NO: 793448 - protein, 9 aa, Homo Sapiens
HSCYANLPD

SEQ ID NO: 793449 - protein, 9 aa, Homo Sapiens
FSIWTILRK

SEQ ID NO: 793450 - protein, 9 aa, Homo Sapiens
LPPLYPSAP

SEQ ID NO: 793451 - protein, 9 aa, Homo Sapiens
NTCGLEQID

SEQ ID NO: 793452 - protein, 9 aa, Homo Sapiens
RLSAWALSY

SEQ ID NO: 793453 - protein, 9 aa, Homo Sapiens
KLLQPYREG

SEQ ID NO: 793454 - protein, 9 aa, Homo Sapiens
DGALDEVML

SEQ ID NO: 793455 - protein, 9 aa, Homo Sapiens
GSSSEDNTE

SEQ ID NO: 793456 - protein, 9 aa, Homo Sapiens
TPSCKDIVV

SEQ ID NO: 793457 - protein, 9 aa, Homo Sapiens
TQNASDIAR

SEQ ID NO: 793458 - protein, 9 aa, Homo Sapiens
PLGTTLCVC

SEQ ID NO: 793459 - protein, 9 aa, Homo Sapiens
WEWLSDYGS

SEQ ID NO: 793460 - protein, 9 aa, Homo Sapiens
SYTRVSPPL

SEQ ID NO: 793461 - protein, 9 aa, Homo Sapiens
RSNSPLSLK

SEQ ID NO: 793462 - protein, 9 aa, Homo Sapiens
IMEEMERGS

SEQ ID NO: 793463 - protein, 9 aa, Homo Sapiens
IPVCLKILL

SEQ ID NO: 793464 - protein, 9 aa, Homo Sapiens
NVTIPIGWS

SEQ ID NO: 793465 - protein, 9 aa, Homo Sapiens
HLRQQAVQK

SEQ ID NO: 793466 - protein, 9 aa, Homo Sapiens
CLFPRLSSA

SEQ ID NO: 793467 - protein, 9 aa, Homo Sapiens
GHQNGLDLP

SEQ ID NO: 793468 - protein, 9 aa, Homo Sapiens
IRGIVKGDR

SEQ ID NO: 793469 - protein, 9 aa, Homo Sapiens
CKQQPPCSR

SEQ ID NO: 793470 - protein, 9 aa, Homo Sapiens
ELERNVTIP

SEQ ID NO: 793471 - protein, 9 aa, Homo Sapiens
WTILRKCIG

SEQ ID NO: 793472 - protein, 9 aa, Homo Sapiens
CNSRYKCSE

SEQ ID NO: 793473 - protein, 9 aa, Homo Sapiens
LVPRPSLES

SEQ ID NO: 793474 - protein, 9 aa, Homo Sapiens
QEPTGHQFV

SEQ ID NO: 793475 - protein, 9 aa, Homo Sapiens
ERNVTIPIG

SEQ ID NO: 793476 - protein, 9 aa, Homo Sapiens
FVISHRLSA

SEQ ID NO: 793477 - protein, 9 aa, Homo Sapiens
RTRPTTDMS

SEQ ID NO: 793478 - protein, 9 aa, Homo Sapiens
EKLQEEEDR

SEQ ID NO: 793479 - protein, 9 aa, Homo Sapiens
SWTGHVAGT

SEQ ID NO: 793480 - protein, 9 aa, Homo Sapiens
PSCKDIVVG

SEQ ID NO: 793481 - protein, 9 aa, Homo Sapiens
EELRPLLLE

SEQ ID NO: 793482 - protein, 9 aa, Homo Sapiens
EATIKSLSV

SEQ ID NO: 793483 - protein, 9 aa, Homo Sapiens
KSFIEKLQE

SEQ ID NO: 793484 - protein, 9 aa, Homo Sapiens
PLNDDKWHR

SEQ ID NO: 793485 - protein, 9 aa, Homo Sapiens
DHSCYANLP

SEQ ID NO: 793486 - protein, 9 aa, Homo Sapiens
IVVGDMSKK

SEQ ID NO: 793487 - protein, 9 aa, Homo Sapiens
NMESIDPQF

SEQ ID NO: 793488 - protein, 9 aa, Homo Sapiens
VYRAKYKKT

SEQ ID NO: 793489 - protein, 9 aa, Homo Sapiens
WKKKSLIQQ

SEQ ID NO: 793490 - protein, 9 aa, Homo Sapiens
IDDHNIPTL

SEQ ID NO: 793491 - protein, 9 aa, Homo Sapiens
FWIFALAIL

SEQ ID NO: 793492 - protein, 9 aa, Homo Sapiens
FRTSHGFGL

SEQ ID NO: 793493 - protein, 9 aa, Homo Sapiens
GHFVNPSGQ

SEQ ID NO: 793494 - protein, 9 aa, Homo Sapiens
KLGLDKAVV

SEQ ID NO: 793495 - protein, 9 aa, Homo Sapiens
DKAVVQSMS

SEQ ID NO: 793496 - protein, 9 aa, Homo Sapiens
WAGTVNAGV

SEQ ID NO: 793497 - protein, 9 aa, Homo Sapiens
KYKKTDEIV

SEQ ID NO: 793498 - protein, 9 aa, Homo Sapiens
GGSCCPSLH

SEQ ID NO: 793499 - protein, 9 aa, Homo Sapiens
PMGQDNFQN

SEQ ID NO: 793500 - protein, 9 aa, Homo Sapiens
HMNLHTGEK

SEQ ID NO: 793501 - protein, 9 aa, Homo Sapiens
LESFNVSKT

SEQ ID NO: 793502 - protein, 9 aa, Homo Sapiens
FLSRLARGL

SEQ ID NO: 793503 - protein, 9 aa, Homo Sapiens
TSTTGRLTS

SEQ ID NO: 793504 - protein, 9 aa, Homo Sapiens
SHAASGAMD

SEQ ID NO: 793505 - protein, 9 aa, Homo Sapiens
SFNVSKTNA

SEQ ID NO: 793506 - protein, 9 aa, Homo Sapiens
EWRLVAFRT

SEQ ID NO: 793507 - protein, 9 aa, Homo Sapiens
RAKYKKTDE

SEQ ID NO: 793508 - protein, 9 aa, Homo Sapiens
YNMCISLLG

SEQ ID NO: 793509 - protein, 9 aa, Homo Sapiens
PAFKYYNMC

SEQ ID NO: 793510 - protein, 9 aa, Homo Sapiens
IASQYKELK

SEQ ID NO: 793511 - protein, 9 aa, Homo Sapiens
KRYCFPCWA

SEQ ID NO: 793512 - protein, 9 aa, Homo Sapiens
VRVYACPGR

SEQ ID NO: 793513 - protein, 9 aa, Homo Sapiens
SAECECKIK

SEQ ID NO: 793514 - protein, 9 aa, Homo Sapiens
GQFCHQCYN

SEQ ID NO: 793515 - protein, 9 aa, Homo Sapiens
DGIFQKWAA

SEQ ID NO: 793516 - protein, 9 aa, Homo Sapiens
YCMRGEVPV

SEQ ID NO: 793517 - protein, 9 aa, Homo Sapiens
VVQSMSGRD

SEQ ID NO: 793518 - protein, 9 aa, Homo Sapiens
TRPAGDGIF

SEQ ID NO: 793519 - protein, 9 aa, Homo Sapiens
DSNLNGTVT

SEQ ID NO: 793520 - protein, 9 aa, Homo Sapiens
SPCVNGGSC

SEQ ID NO: 793521 - protein, 9 aa, Homo Sapiens
GLDKAVVQS

SEQ ID NO: 793522 - protein, 9 aa, Homo Sapiens
LQTKGFAES

SEQ ID NO: 793523 - protein, 9 aa, Homo Sapiens
NPSLYFQKT

SEQ ID NO: 793524 - protein, 9 aa, Homo Sapiens
NVSKTNALN

SEQ ID NO: 793525 - protein, 9 aa, Homo Sapiens
FNVSKTNAL

SEQ ID NO: 793526 - protein, 9 aa, Homo Sapiens
KSLIQQLIL

SEQ ID NO: 793527 - protein, 9 aa, Homo Sapiens
RLYCMRGEV

SEQ ID NO: 793528 - protein, 9 aa, Homo Sapiens
LDDEQPLWL

SEQ ID NO: 793529 - protein, 9 aa, Homo Sapiens
FAESLDPRR

SEQ ID NO: 793530 - protein, 9 aa, Homo Sapiens
LVAFRTSHG

SEQ ID NO: 793531 - protein, 9 aa, Homo Sapiens
YACPGRDRR

SEQ ID NO: 793532 - protein, 9 aa, Homo Sapiens
FEVRVYACP

SEQ ID NO: 793533 - protein, 9 aa, Homo Sapiens
IGNPSLYFQ

SEQ ID NO: 793534 - protein, 9 aa, Homo Sapiens
LSHAASGAM

SEQ ID NO: 793535 - protein, 9 aa, Homo Sapiens
THLSHAASG

SEQ ID NO: 793536 - protein, 9 aa, Homo Sapiens
GLTHLSHAA

SEQ ID NO: 793537 - protein, 9 aa, Homo Sapiens
AECECKIKI

SEQ ID NO: 793538 - protein, 9 aa, Homo Sapiens
VEKRAVLAT

SEQ ID NO: 793539 - protein, 9 aa, Homo Sapiens
LFGLTHLSH

SEQ ID NO: 793540 - protein, 9 aa, Homo Sapiens
CHGLSHIHG

SEQ ID NO: 793541 - protein, 9 aa, Homo Sapiens
DDEQPLWLR

SEQ ID NO: 793542 - protein, 9 aa, Homo Sapiens
GFAESLDPR

SEQ ID NO: 793543 - protein, 9 aa, Homo Sapiens
DSLATYAYK

SEQ ID NO: 793544 - protein, 9 aa, Homo Sapiens
KAVVQSMSG

SEQ ID NO: 793545 - protein, 9 aa, Homo Sapiens
IIFGDVDEP

SEQ ID NO: 793546 - protein, 9 aa, Homo Sapiens
FLRPQRNME

SEQ ID NO: 793547 - protein, 9 aa, Homo Sapiens
CGVYPKKKK

SEQ ID NO: 793548 - protein, 9 aa, Homo Sapiens
ECKIKILDV

SEQ ID NO: 793549 - protein, 9 aa, Homo Sapiens
DSISSSSSA

SEQ ID NO: 793550 - protein, 9 aa, Homo Sapiens
KEPRTSPRD

SEQ ID NO: 793551 - protein, 9 aa, Homo Sapiens
YKGTGSVAD

SEQ ID NO: 793552 - protein, 9 aa, Homo Sapiens
ETLGQLLPN

SEQ ID NO: 793553 - protein, 9 aa, Homo Sapiens
NNHMNLHTG

SEQ ID NO: 793554 - protein, 9 aa, Homo Sapiens
PCVNGGSCR

SEQ ID NO: 793555 - protein, 9 aa, Homo Sapiens
SAMERDHYM

SEQ ID NO: 793556 - protein, 9 aa, Homo Sapiens
VAFRTSHGF

SEQ ID NO: 793557 - protein, 9 aa, Homo Sapiens
ERDHYMSPM

SEQ ID NO: 793558 - protein, 9 aa, Homo Sapiens
HQTPKGLMP

SEQ ID NO: 793559 - protein, 9 aa, Homo Sapiens
KGLMPYGQP

SEQ ID NO: 793560 - protein, 9 aa, Homo Sapiens
MESIDPQFT

SEQ ID NO: 793561 - protein, 9 aa, Homo Sapiens
TGQFCHQCY

SEQ ID NO: 793562 - protein, 9 aa, Homo Sapiens
SLIQQLILL

SEQ ID NO: 793563 - protein, 9 aa, Homo Sapiens
TVDKVLRLL

SEQ ID NO: 793564 - protein, 9 aa, Homo Sapiens
KIGNPSLYF

SEQ ID NO: 793565 - protein, 9 aa, Homo Sapiens
LSHRCAHAA

SEQ ID NO: 793566 - protein, 9 aa, Homo Sapiens
KALEKVEKR

SEQ ID NO: 793567 - protein, 9 aa, Homo Sapiens
HNIPTLHQM

SEQ ID NO: 793568 - protein, 9 aa, Homo Sapiens
LLWAGTVNA

SEQ ID NO: 793569 - protein, 9 aa, Homo Sapiens
RLTSVSWSF

SEQ ID NO: 793570 - protein, 9 aa, Homo Sapiens
AFRTSHGFG

SEQ ID NO: 793571 - protein, 9 aa, Homo Sapiens
PSPCVNGGS

SEQ ID NO: 793572 - protein, 9 aa, Homo Sapiens
DPATVDKVL

SEQ ID NO: 793573 - protein, 9 aa, Homo Sapiens
YAYKGTGSV

SEQ ID NO: 793574 - protein, 9 aa, Homo Sapiens
AFKYYNMCI

SEQ ID NO: 793575 - protein, 9 aa, Homo Sapiens
IMIDDHNIP

SEQ ID NO: 793576 - protein, 9 aa, Homo Sapiens
ALERLVVWH

SEQ ID NO: 793577 - protein, 9 aa, Homo Sapiens
CVNGGSCRQ

SEQ ID NO: 793578 - protein, 9 aa, Homo Sapiens
PQRNMESID

SEQ ID NO: 793579 - protein, 9 aa, Homo Sapiens
PKGLMPYGQ

SEQ ID NO: 793580 - protein, 9 aa, Homo Sapiens
AESLDPRRR

SEQ ID NO: 793581 - protein, 9 aa, Homo Sapiens
PKLESFNVS

SEQ ID NO: 793582 - protein, 9 aa, Homo Sapiens
QRNMESIDP

SEQ ID NO: 793583 - protein, 9 aa, Homo Sapiens
FPCWALRKD

SEQ ID NO: 793584 - protein, 9 aa, Homo Sapiens
KLESFNVSK

SEQ ID NO: 793585 - protein, 9 aa, Homo Sapiens
LWAGTVNAG

SEQ ID NO: 793586 - protein, 9 aa, Homo Sapiens
LLSHRCAHA

SEQ ID NO: 793587 - protein, 9 aa, Homo Sapiens
LNNHMNLHT

SEQ ID NO: 793588 - protein, 9 aa, Homo Sapiens
FSLLWAGTV

SEQ ID NO: 793589 - protein, 9 aa, Homo Sapiens
LPNLLDQLE

SEQ ID NO: 793590 - protein, 9 aa, Homo Sapiens
SEWRLVAFR

SEQ ID NO: 793591 - protein, 9 aa, Homo Sapiens
QPLWLRLLA

SEQ ID NO: 793592 - protein, 9 aa, Homo Sapiens
SDEIPLKEP

SEQ ID NO: 793593 - protein, 9 aa, Homo Sapiens
MKLKIGNPS

SEQ ID NO: 793594 - protein, 9 aa, Homo Sapiens
KMKLKIGNP

SEQ ID NO: 793595 - protein, 9 aa, Homo Sapiens
KVITVSKTS

SEQ ID NO: 793596 - protein, 9 aa, Homo Sapiens
EPRTSPRDS

SEQ ID NO: 793597 - protein, 9 aa, Homo Sapiens
GIFQKWAAV

SEQ ID NO: 793598 - protein, 9 aa, Homo Sapiens
GYGVCHGLS

SEQ ID NO: 793599 - protein, 9 aa, Homo Sapiens
ALEKVEKRA

SEQ ID NO: 793600 - protein, 9 aa, Homo Sapiens
KSTSTTGRL

SEQ ID NO: 793601 - protein, 9 aa, Homo Sapiens
MIDDHNIPT

SEQ ID NO: 793602 - protein, 9 aa, Homo Sapiens
SCCPSLHPS

SEQ ID NO: 793603 - protein, 9 aa, Homo Sapiens
AVVQSMSGR

SEQ ID NO: 793604 - protein, 9 aa, Homo Sapiens
ATVDKVLRL

SEQ ID NO: 793605 - protein, 9 aa, Homo Sapiens
RTSHGFGLF

SEQ ID NO: 793606 - protein, 9 aa, Homo Sapiens
LKDGHFVNP

SEQ ID NO: 793607 - protein, 9 aa, Homo Sapiens
LLDDEQPLW

SEQ ID NO: 793608 - protein, 9 aa, Homo Sapiens
VYACPGRDR

SEQ ID NO: 793609 - protein, 9 aa, Homo Sapiens
QTPKGLMPY

SEQ ID NO: 793610 - protein, 9 aa, Homo Sapiens
PLWLRLLAG

SEQ ID NO: 793611 - protein, 9 aa, Homo Sapiens
QCYNLCDLL

SEQ ID NO: 793612 - protein, 9 aa, Homo Sapiens
FGDVDEPPL

SEQ ID NO: 793613 - protein, 9 aa, Homo Sapiens
MTLQTKGFA

SEQ ID NO: 793614 - protein, 9 aa, Homo Sapiens
DATMLKIIF

SEQ ID NO: 793615 - protein, 9 aa, Homo Sapiens
TYAYKGTGS

SEQ ID NO: 793616 - protein, 9 aa, Homo Sapiens
GVCHGLSHI

SEQ ID NO: 793617 - protein, 9 aa, Homo Sapiens
TLIFDQIPK

SEQ ID NO: 793618 - protein, 9 aa, Homo Sapiens
GFGYGVCHG

SEQ ID NO: 793619 - protein, 9 aa, Homo Sapiens
NMCISLLGA

SEQ ID NO: 793620 - protein, 9 aa, Homo Sapiens
AMERDHYMS

SEQ ID NO: 793621 - protein, 9 aa, Homo Sapiens
HLLSHRCAH

SEQ ID NO: 793622 - protein, 9 aa, Homo Sapiens
DKVLRLLDE

SEQ ID NO: 793623 - protein, 9 aa, Homo Sapiens
PCWALRKDW

SEQ ID NO: 793624 - protein, 9 aa, Homo Sapiens
LRQEVLQEF

SEQ ID NO: 793625 - protein, 9 aa, Homo Sapiens
MGQDNFQNR

SEQ ID NO: 793626 - protein, 9 aa, Homo Sapiens
SLLWAGTVN

SEQ ID NO: 793627 - protein, 9 aa, Homo Sapiens
RNSFEVRVY

SEQ ID NO: 793628 - protein, 9 aa, Homo Sapiens
GMSAECECK

SEQ ID NO: 793629 - protein, 9 aa, Homo Sapiens
YPHQTPKGL

SEQ ID NO: 793630 - protein, 9 aa, Homo Sapiens
LKTLKTEQD

SEQ ID NO: 793631 - protein, 9 aa, Homo Sapiens
FGLTHLSHA

SEQ ID NO: 793632 - protein, 9 aa, Homo Sapiens
ERLVVWHVH

SEQ ID NO: 793633 - protein, 9 aa, Homo Sapiens
YGVCHGLSH

SEQ ID NO: 793634 - protein, 9 aa, Homo Sapiens
SQYKELKTL

SEQ ID NO: 793635 - protein, 9 aa, Homo Sapiens
CISLLGAIL

SEQ ID NO: 793636 - protein, 9 aa, Homo Sapiens
MNLHTGEKP

SEQ ID NO: 793637 - protein, 9 aa, Homo Sapiens
QYKELKTLK

SEQ ID NO: 793638 - protein, 9 aa, Homo Sapiens
TPKGLMPYG

SEQ ID NO: 793639 - protein, 9 aa, Homo Sapiens
PSLHPSSAP

SEQ ID NO: 793640 - protein, 9 aa, Homo Sapiens
NSFEVRVYA

SEQ ID NO: 793641 - protein, 9 aa, Homo Sapiens
KIIFGDVDE

SEQ ID NO: 793642 - protein, 9 aa, Homo Sapiens
GSCCPSLHP

SEQ ID NO: 793643 - protein, 9 aa, Homo Sapiens
GDGIFQKWA

SEQ ID NO: 793644 - protein, 9 aa, Homo Sapiens
SRPPFLSRL

SEQ ID NO: 793645 - protein, 9 aa, Homo Sapiens
QLILLRAMR

SEQ ID NO: 793646 - protein, 9 aa, Homo Sapiens
DNFQNRTLR

SEQ ID NO: 793647 - protein, 9 aa, Homo Sapiens
LSRLARGLY

SEQ ID NO: 793648 - protein, 9 aa, Homo Sapiens
TLGQLLPNL

SEQ ID NO: 793649 - protein, 9 aa, Homo Sapiens
PFLSRLARG

SEQ ID NO: 793650 - protein, 9 aa, Homo Sapiens
HFVNPSGQP

SEQ ID NO: 793651 - protein, 9 aa, Homo Sapiens
TLQTKGFAE

SEQ ID NO: 793652 - protein, 9 aa, Homo Sapiens
EVLQEFTLH

SEQ ID NO: 793653 - protein, 9 aa, Homo Sapiens
LPKLESFNV

SEQ ID NO: 793654 - protein, 9 aa, Homo Sapiens
CSDEIPLKE

SEQ ID NO: 793655 - protein, 9 aa, Homo Sapiens
SEWRLYCMR

SEQ ID NO: 793656 - protein, 9 aa, Homo Sapiens
NGTVTEMAI

SEQ ID NO: 793657 - protein, 9 aa, Homo Sapiens
LIFDQIPKV

SEQ ID NO: 793658 - protein, 9 aa, Homo Sapiens
QQLILLRAM

SEQ ID NO: 793659 - protein, 9 aa, Homo Sapiens
KELKTLKTE

SEQ ID NO: 793660 - protein, 9 aa, Homo Sapiens
QFCHQCYNL

SEQ ID NO: 793661 - protein, 9 aa, Homo Sapiens
YGVVYRAKY

SEQ ID NO: 793662 - protein, 9 aa, Homo Sapiens
YYNMCISLL

SEQ ID NO: 793663 - protein, 9 aa, Homo Sapiens
YCFPCWALR

SEQ ID NO: 793664 - protein, 9 aa, Homo Sapiens
VSKTNALNV

SEQ ID NO: 793665 - protein, 9 aa, Homo Sapiens
HGFGYGVCH

SEQ ID NO: 793666 - protein, 9 aa, Homo Sapiens
LKIIFGDVD

SEQ ID NO: 793667 - protein, 9 aa, Homo Sapiens
ENDFWIFAL

SEQ ID NO: 793668 - protein, 9 aa, Homo Sapiens
FYHHLRQEV

SEQ ID NO: 793669 - protein, 9 aa, Homo Sapiens
KYYNMCISL

SEQ ID NO: 793670 - protein, 9 aa, Homo Sapiens
NIPTLHQMV

SEQ ID NO: 793671 - protein, 9 aa, Homo Sapiens
MERDHYMSP

SEQ ID NO: 793672 - protein, 9 aa, Homo Sapiens
HLSHAASGA

SEQ ID NO: 793673 - protein, 9 aa, Homo Sapiens
LYCMRGEVP

SEQ ID NO: 793674 - protein, 9 aa, Homo Sapiens
DEIPLKEPR

SEQ ID NO: 793675 - protein, 9 aa, Homo Sapiens
PLKEPRTSP

SEQ ID NO: 793676 - protein, 9 aa, Homo Sapiens
VNGGSCRQT

SEQ ID NO: 793677 - protein, 9 aa, Homo Sapiens
RLVVWHVHS

SEQ ID NO: 793678 - protein, 9 aa, Homo Sapiens
GNPSLYFQK

SEQ ID NO: 793679 - protein, 9 aa, Homo Sapiens
ETRPAGDGI

SEQ ID NO: 793680 - protein, 9 aa, Homo Sapiens
RKALEKVEK

SEQ ID NO: 793681 - protein, 9 aa, Homo Sapiens
KKKSLIQQL

SEQ ID NO: 793682 - protein, 9 aa, Homo Sapiens
RIMIDDHNI

SEQ ID NO: 793683 - protein, 9 aa, Homo Sapiens
IFQKWAAVV

SEQ ID NO: 793684 - protein, 9 aa, Homo Sapiens
EKGDNENDF

SEQ ID NO: 793685 - protein, 9 aa, Homo Sapiens
AKYKKTDEI

SEQ ID NO: 793686 - protein, 9 aa, Homo Sapiens
LTHLSHAAS

SEQ ID NO: 793687 - protein, 9 aa, Homo Sapiens
LATYAYKGT

SEQ ID NO: 793688 - protein, 9 aa, Homo Sapiens
IFDQIPKVI

SEQ ID NO: 793689 - protein, 9 aa, Homo Sapiens
IPTLHQMVV

SEQ ID NO: 793690 - protein, 9 aa, Homo Sapiens
LGLDKAVVQ

SEQ ID NO: 793691 - protein, 9 aa, Homo Sapiens
STTGRLTSV

SEQ ID NO: 793692 - protein, 9 aa, Homo Sapiens
MCISLLGAI

SEQ ID NO: 793693 - protein, 9 aa, Homo Sapiens
RVYACPGRD

SEQ ID NO: 793694 - protein, 9 aa, Homo Sapiens
PNLKDGHFV

SEQ ID NO: 793695 - protein, 9 aa, Homo Sapiens
VDKVLRLLD

SEQ ID NO: 793696 - protein, 9 aa, Homo Sapiens
STSTTGRLT

SEQ ID NO: 793697 - protein, 9 aa, Homo Sapiens
DGHFVNPSG

SEQ ID NO: 793698 - protein, 9 aa, Homo Sapiens
ECECKIKIL

SEQ ID NO: 793699 - protein, 9 aa, Homo Sapiens
KKSLIQQLI

SEQ ID NO: 793700 - protein, 9 aa, Homo Sapiens
QEVLQEFTL

SEQ ID NO: 793701 - protein, 9 aa, Homo Sapiens
TTDVPMGQD

SEQ ID NO: 793702 - protein, 9 aa, Homo Sapiens
RDHYMSPME

SEQ ID NO: 793703 - protein, 9 aa, Homo Sapiens
VPMGQDNFQ

SEQ ID NO: 793704 - protein, 9 aa, Homo Sapiens
WALNNHMNL

SEQ ID NO: 793705 - protein, 9 aa, Homo Sapiens
KRKALEKVE

SEQ ID NO: 793706 - protein, 9 aa, Homo Sapiens
ELKTLKTEQ

SEQ ID NO: 793707 - protein, 9 aa, Homo Sapiens
MRGEVPVEG

SEQ ID NO: 793708 - protein, 9 aa, Homo Sapiens
AGPSDSNLN

SEQ ID NO: 793709 - protein, 9 aa, Homo Sapiens
VQSMSGRDG

SEQ ID NO: 793710 - protein, 9 aa, Homo Sapiens
NSPNLKDGH

SEQ ID NO: 793711 - protein, 9 aa, Homo Sapiens
SKRYCFPCW

SEQ ID NO: 793712 - protein, 9 aa, Homo Sapiens
TVNAGVTQT

SEQ ID NO: 793713 - protein, 9 aa, Homo Sapiens
NLNGTVTEM

SEQ ID NO: 793714 - protein, 9 aa, Homo Sapiens
AFSLLWAGT

SEQ ID NO: 793715 - protein, 9 aa, Homo Sapiens
LKEPRTSPR

SEQ ID NO: 793716 - protein, 9 aa, Homo Sapiens
MSAECECKI

SEQ ID NO: 793717 - protein, 9 aa, Homo Sapiens
IPKVITVSK

SEQ ID NO: 793718 - protein, 9 aa, Homo Sapiens
FGYGVCHGL

SEQ ID NO: 793719 - protein, 9 aa, Homo Sapiens
KIKILDVND

SEQ ID NO: 793720 - protein, 9 aa, Homo Sapiens
QTKGFAESL

SEQ ID NO: 793721 - protein, 9 aa, Homo Sapiens
SLATYAYKG

SEQ ID NO: 793722 - protein, 9 aa, Homo Sapiens
CAHAAASGA

SEQ ID NO: 793723 - protein, 9 aa, Homo Sapiens
KIASQYKEL

SEQ ID NO: 793724 - protein, 9 aa, Homo Sapiens
LLPNLLDQL

SEQ ID NO: 793725 - protein, 9 aa, Homo Sapiens
TKGFAESLD

SEQ ID NO: 793726 - protein, 9 aa, Homo Sapiens
PSDSNLNGT

SEQ ID NO: 793727 - protein, 9 aa, Homo Sapiens
EVRVYACPG

SEQ ID NO: 793728 - protein, 9 aa, Homo Sapiens
EKVEKRAVL

SEQ ID NO: 793729 - protein, 9 aa, Homo Sapiens
DHYMSPMEA

SEQ ID NO: 793730 - protein, 9 aa, Homo Sapiens
AYKGTGSVA

SEQ ID NO: 793731 - protein, 9 aa, Homo Sapiens
LNGTVTEMA

SEQ ID NO: 793732 - protein, 9 aa, Homo Sapiens
CKIKILDVN

SEQ ID NO: 793733 - protein, 9 aa, Homo Sapiens
VCHGLSHIH

SEQ ID NO: 793734 - protein, 9 aa, Homo Sapiens
HQCYNLCDL

SEQ ID NO: 793735 - protein, 9 aa, Homo Sapiens
DNENDFWIF

SEQ ID NO: 793736 - protein, 9 aa, Homo Sapiens
NGGSCRQTG

SEQ ID NO: 793737 - protein, 9 aa, Homo Sapiens
RPQRNMESI

SEQ ID NO: 793738 - protein, 9 aa, Homo Sapiens
LERLVVWHV

SEQ ID NO: 793739 - protein, 9 aa, Homo Sapiens
GDNENDFWI

SEQ ID NO: 793740 - protein, 9 aa, Homo Sapiens
TGRLTSVSW

SEQ ID NO: 793741 - protein, 9 aa, Homo Sapiens
GSCRQTGDF

SEQ ID NO: 793742 - protein, 9 aa, Homo Sapiens
CECKIKILD

SEQ ID NO: 793743 - protein, 9 aa, Homo Sapiens
MALERLVVW

SEQ ID NO: 793744 - protein, 9 aa, Homo Sapiens
LRPQRNMES

SEQ ID NO: 793745 - protein, 9 aa, Homo Sapiens
GQLLPNLLD

SEQ ID NO: 793746 - protein, 9 aa, Homo Sapiens
YHHLRQEVL

SEQ ID NO: 793747 - protein, 9 aa, Homo Sapiens
LEKVEKRAV

SEQ ID NO: 793748 - protein, 9 aa, Homo Sapiens
KDGHFVNPS

SEQ ID NO: 793749 - protein, 9 aa, Homo Sapiens
LKIGNPSLY

SEQ ID NO: 793750 - protein, 9 aa, Homo Sapiens
QIPKVITVS

SEQ ID NO: 793751 - protein, 9 aa, Homo Sapiens
KGFAESLDP

SEQ ID NO: 793752 - protein, 9 aa, Homo Sapiens
VVYRAKYKK

SEQ ID NO: 793753 - protein, 9 aa, Homo Sapiens
WRLVAFRTS

SEQ ID NO: 793754 - protein, 9 aa, Homo Sapiens
DDHNIPTLH

SEQ ID NO: 793755 - protein, 9 aa, Homo Sapiens
EIPLKEPRT

SEQ ID NO: 793756 - protein, 9 aa, Homo Sapiens
RLVAFRTSH

SEQ ID NO: 793757 - protein, 9 aa, Homo Sapiens
DEQPLWLRL

SEQ ID NO: 793758 - protein, 9 aa, Homo Sapiens
SHRCAHAAA

SEQ ID NO: 793759 - protein, 9 aa, Homo Sapiens
QDNFQNRTL

SEQ ID NO: 793760 - protein, 9 aa, Homo Sapiens
CFPCWALRK

SEQ ID NO: 793761 - protein, 9 aa, Homo Sapiens
IPLKEPRTS

SEQ ID NO: 793762 - protein, 9 aa, Homo Sapiens
YTGQFCHQC

SEQ ID NO: 793763 - protein, 9 aa, Homo Sapiens
RPAGDGIFQ

SEQ ID NO: 793764 - protein, 9 aa, Homo Sapiens
HDPATVDKV

SEQ ID NO: 793765 - protein, 9 aa, Homo Sapiens
YKKTDEIVA

SEQ ID NO: 793766 - protein, 9 aa, Homo Sapiens
HLRQEVLQE

SEQ ID NO: 793767 - protein, 9 aa, Homo Sapiens
SPNLKDGHF

SEQ ID NO: 793768 - protein, 9 aa, Homo Sapiens
LWLRLLAGP

SEQ ID NO: 793769 - protein, 9 aa, Homo Sapiens
VLQEFTLHD

SEQ ID NO: 793770 - protein, 9 aa, Homo Sapiens
DVPMGQDNF

SEQ ID NO: 793771 - protein, 9 aa, Homo Sapiens
ESAMERDHY

SEQ ID NO: 793772 - protein, 9 aa, Homo Sapiens
YKELKTLKT

SEQ ID NO: 793773 - protein, 9 aa, Homo Sapiens
PATVDKVLR

SEQ ID NO: 793774 - protein, 9 aa, Homo Sapiens
EQPLWLRLL

SEQ ID NO: 793775 - protein, 9 aa, Homo Sapiens
FCHQCYNLC

SEQ ID NO: 793776 - protein, 9 aa, Homo Sapiens
KGDNENDFW

SEQ ID NO: 793777 - protein, 9 aa, Homo Sapiens
FDQIPKVIT

SEQ ID NO: 793778 - protein, 9 aa, Homo Sapiens
LPYPHQTPK

SEQ ID NO: 793779 - protein, 9 aa, Homo Sapiens
NDFWIFALA

SEQ ID NO: 793780 - protein, 9 aa, Homo Sapiens
PSKRYCFPC

SEQ ID NO: 793781 - protein, 9 aa, Homo Sapiens
TMLKIIFGD

SEQ ID NO: 793782 - protein, 9 aa, Homo Sapiens
SNLNGTVTE

SEQ ID NO: 793783 - protein, 9 aa, Homo Sapiens
ALNNHMNLH

SEQ ID NO: 793784 - protein, 9 aa, Homo Sapiens
LGQLLPNLL

SEQ ID NO: 793785 - protein, 9 aa, Homo Sapiens
GTVNAGVTQ

SEQ ID NO: 793786 - protein, 9 aa, Homo Sapiens
ASQYKELKT

SEQ ID NO: 793787 - protein, 9 aa, Homo Sapiens
EWRLYCMRG

SEQ ID NO: 793788 - protein, 9 aa, Homo Sapiens
SLHPSSAPR

SEQ ID NO: 793789 - protein, 9 aa, Homo Sapiens
PKVITVSKT

SEQ ID NO: 793790 - protein, 9 aa, Homo Sapiens
SISSSSSAD

SEQ ID NO: 793791 - protein, 9 aa, Homo Sapiens
KVLRLLDED

SEQ ID NO: 793792 - protein, 9 aa, Homo Sapiens
LHPSSAPRS

SEQ ID NO: 793793 - protein, 9 aa, Homo Sapiens
GGGSCCPSL

SEQ ID NO: 793794 - protein, 9 aa, Homo Sapiens
IESAMERDH

SEQ ID NO: 793795 - protein, 9 aa, Homo Sapiens
LIQQLILLR

SEQ ID NO: 793796 - protein, 9 aa, Homo Sapiens
LDKAVVQSM

SEQ ID NO: 793797 - protein, 9 aa, Homo Sapiens
NLLDQLEIC

SEQ ID NO: 793798 - protein, 9 aa, Homo Sapiens
SSHLLSHRC

SEQ ID NO: 793799 - protein, 9 aa, Homo Sapiens
KKMKLKIGN

SEQ ID NO: 793800 - protein, 9 aa, Homo Sapiens
KGTGSVADS

SEQ ID NO: 793801 - protein, 9 aa, Homo Sapiens
NENDFWIFA

SEQ ID NO: 793802 - protein, 9 aa, Homo Sapiens
NHMNLHTGE

SEQ ID NO: 793803 - protein, 9 aa, Homo Sapiens
IQQLILLRA

SEQ ID NO: 793804 - protein, 9 aa, Homo Sapiens
QLLPNLLDQ

SEQ ID NO: 793805 - protein, 9 aa, Homo Sapiens
RCAHAAASG

SEQ ID NO: 793806 - protein, 9 aa, Homo Sapiens
DFWIFALAI

SEQ ID NO: 793807 - protein, 9 aa, Homo Sapiens
IFGDVDEPP

SEQ ID NO: 793808 - protein, 9 aa, Homo Sapiens
GVVYRAKYK

SEQ ID NO: 793809 - protein, 9 aa, Homo Sapiens
SPSKRYCFP

SEQ ID NO: 793810 - protein, 9 aa, Homo Sapiens
RYCFPCWAL

SEQ ID NO: 793811 - protein, 9 aa, Homo Sapiens
CPSLHPSSA

SEQ ID NO: 793812 - protein, 9 aa, Homo Sapiens
AGTVNAGVT

SEQ ID NO: 793813 - protein, 9 aa, Homo Sapiens
SFEVRVYAC

SEQ ID NO: 793814 - protein, 9 aa, Homo Sapiens
TDVPMGQDN

SEQ ID NO: 793815 - protein, 9 aa, Homo Sapiens
FKYYNMCIS

SEQ ID NO: 793816 - protein, 9 aa, Homo Sapiens
PPFLSRLAR

SEQ ID NO: 793817 - protein, 9 aa, Homo Sapiens
GQDNFQNRT

SEQ ID NO: 793818 - protein, 9 aa, Homo Sapiens
NLHTGEKPF

SEQ ID NO: 793819 - protein, 9 aa, Homo Sapiens
NLKDGHFVN

SEQ ID NO: 793820 - protein, 9 aa, Homo Sapiens
RNMESIDPQ

SEQ ID NO: 793821 - protein, 9 aa, Homo Sapiens
CMRGEVPVE

SEQ ID NO: 793822 - protein, 9 aa, Homo Sapiens
KVEKRAVLA

SEQ ID NO: 793823 - protein, 9 aa, Homo Sapiens
ATMLKIIFG

SEQ ID NO: 793824 - protein, 9 aa, Homo Sapiens
LARGLYSRS

SEQ ID NO: 793825 - protein, 9 aa, Homo Sapiens
HHLRQEVLQ

SEQ ID NO: 793826 - protein, 9 aa, Homo Sapiens
GRLTSVSWS

SEQ ID NO: 793827 - protein, 9 aa, Homo Sapiens
ATYAYKGTG

SEQ ID NO: 793828 - protein, 9 aa, Homo Sapiens
SHLLSHRCA

SEQ ID NO: 793829 - protein, 9 aa, Homo Sapiens
THGFGYGVC

SEQ ID NO: 793830 - protein, 9 aa, Homo Sapiens
ESFNVSKTN

SEQ ID NO: 793831 - protein, 9 aa, Homo Sapiens
GGSCRQTGD

SEQ ID NO: 793832 - protein, 9 aa, Homo Sapiens
DQIPKVITV

SEQ ID NO: 793833 - protein, 9 aa, Homo Sapiens
FKSTSTTGR

SEQ ID NO: 793834 - protein, 9 aa, Homo Sapiens
GPSDSNLNG

SEQ ID NO: 793835 - protein, 9 aa, Homo Sapiens
RQEVLQEFT

SEQ ID NO: 793836 - protein, 9 aa, Homo Sapiens
ALFGLTHLS

SEQ ID NO: 793837 - protein, 9 aa, Homo Sapiens
KWALNNHMN

SEQ ID NO: 793838 - protein, 9 aa, Homo Sapiens
PYPHQTPKG

SEQ ID NO: 793839 - protein, 9 aa, Homo Sapiens
KLKIGNPSL

SEQ ID NO: 793840 - protein, 9 aa, Homo Sapiens
WLRLLAGPS

SEQ ID NO: 793841 - protein, 9 aa, Homo Sapiens
AGDGIFQKW

SEQ ID NO: 793842 - protein, 9 aa, Homo Sapiens
QSEWRLYCM

SEQ ID NO: 793843 - protein, 9 aa, Homo Sapiens
SCRQTGDFT

SEQ ID NO: 793844 - protein, 9 aa, Homo Sapiens
WRLYCMRGE

SEQ ID NO: 793845 - protein, 9 aa, Homo Sapiens
SDSNLNGTV

SEQ ID NO: 793846 - protein, 9 aa, Homo Sapiens
DHNIPTLHQ

SEQ ID NO: 793847 - protein, 9 aa, Homo Sapiens
HRCAHAAAS

SEQ ID NO: 793848 - protein, 9 aa, Homo Sapiens
TTGRLTSVS

SEQ ID NO: 793849 - protein, 9 aa, Homo Sapiens
MLKIIFGDV

SEQ ID NO: 793850 - protein, 9 aa, Homo Sapiens
PHQTPKGLM

SEQ ID NO: 793851 - protein, 9 aa, Homo Sapiens
PAGDGIFQK

SEQ ID NO: 793852 - protein, 9 aa, Homo Sapiens
SRLARGLYS

SEQ ID NO: 793853 - protein, 9 aa, Homo Sapiens
GKRKALEKV

SEQ ID NO: 793854 - protein, 9 aa, Homo Sapiens
YRAKYKKTD

SEQ ID NO: 793855 - protein, 9 aa, Homo Sapiens
PNLLDQLEI

SEQ ID NO: 793856 - protein, 9 aa, Homo Sapiens
CCPSLHPSS

SEQ ID NO: 793857 - protein, 9 aa, Homo Sapiens
CHQCYNLCD

SEQ ID NO: 793858 - protein, 9 aa, Homo Sapiens
HYMSPMEAQ

SEQ ID NO: 793859 - protein, 9 aa, Homo Sapiens
RLARGLYSR

SEQ ID NO: 793860 - protein, 9 aa, Homo Sapiens
RPPFLSRLA

SEQ ID NO: 793861 - protein, 9 aa, Homo Sapiens
CYNLCDLLH

SEQ ID NO: 793862 - protein, 9 aa, Homo Sapiens
PHDPATVDK

SEQ ID NO: 793863 - protein, 9 aa, Homo Sapiens
VFLRPQRNM

SEQ ID NO: 793864 - protein, 9 aa, Homo Sapiens
ISSSSSADD

SEQ ID NO: 793865 - protein, 9 aa, Homo Sapiens
HLEATEYLV

SEQ ID NO: 793866 - protein, 9 aa, Homo Sapiens
LPSTSLGHW

SEQ ID NO: 793867 - protein, 9 aa, Homo Sapiens
LEALSSSLL

SEQ ID NO: 793868 - protein, 9 aa, Homo Sapiens
VDKIDVDKD

SEQ ID NO: 793869 - protein, 9 aa, Homo Sapiens
EIFIIDTPD

SEQ ID NO: 793870 - protein, 9 aa, Homo Sapiens
GAPRHVGAP

SEQ ID NO: 793871 - protein, 9 aa, Homo Sapiens
FIDIALQTR

SEQ ID NO: 793872 - protein, 9 aa, Homo Sapiens
DFYAHFPEF

SEQ ID NO: 793873 - protein, 9 aa, Homo Sapiens
RKKPKGTET

SEQ ID NO: 793874 - protein, 9 aa, Homo Sapiens
GFSKSSMSS

SEQ ID NO: 793875 - protein, 9 aa, Homo Sapiens
TIEFMCKLE

SEQ ID NO: 793876 - protein, 9 aa, Homo Sapiens
GRAEHLEAT

SEQ ID NO: 793877 - protein, 9 aa, Homo Sapiens
TQTVEVPCP

SEQ ID NO: 793878 - protein, 9 aa, Homo Sapiens
HCGRGLGGV

SEQ ID NO: 793879 - protein, 9 aa, Homo Sapiens
TNWYNNGKD

SEQ ID NO: 793880 - protein, 9 aa, Homo Sapiens
DVHEKSKAD

SEQ ID NO: 793881 - protein, 9 aa, Homo Sapiens
KKRSAFPSR

SEQ ID NO: 793882 - protein, 9 aa, Homo Sapiens
FSKSSMSSD

SEQ ID NO: 793883 - protein, 9 aa, Homo Sapiens
EPRIETDIL

SEQ ID NO: 793884 - protein, 9 aa, Homo Sapiens
DLEPIYEGY

SEQ ID NO: 793885 - protein, 9 aa, Homo Sapiens
SSLLVGKVP

SEQ ID NO: 793886 - protein, 9 aa, Homo Sapiens
DKFKLAGAT

SEQ ID NO: 793887 - protein, 9 aa, Homo Sapiens
LKEITDKKK

SEQ ID NO: 793888 - protein, 9 aa, Homo Sapiens
DQTEPQAAV

SEQ ID NO: 793889 - protein, 9 aa, Homo Sapiens
ASLATLLLG

SEQ ID NO: 793890 - protein, 9 aa, Homo Sapiens
ENELLGAAD

SEQ ID NO: 793891 - protein, 9 aa, Homo Sapiens
NEISEIESE

SEQ ID NO: 793892 - protein, 9 aa, Homo Sapiens
GTETFEPED

SEQ ID NO: 793893 - protein, 9 aa, Homo Sapiens
REECVDKFK

SEQ ID NO: 793894 - protein, 9 aa, Homo Sapiens
KKPKGTETF

SEQ ID NO: 793895 - protein, 9 aa, Homo Sapiens
GPAPSLFPA

SEQ ID NO: 793896 - protein, 9 aa, Homo Sapiens
SSSLLVGKV

SEQ ID NO: 793897 - protein, 9 aa, Homo Sapiens
KRWESAFQS

SEQ ID NO: 793898 - protein, 9 aa, Homo Sapiens
MFLYADNKD

SEQ ID NO: 793899 - protein, 9 aa, Homo Sapiens
FYAHFPEFF

SEQ ID NO: 793900 - protein, 9 aa, Homo Sapiens
LASSQEDGL

SEQ ID NO: 793901 - protein, 9 aa, Homo Sapiens
RAEHLEATE

SEQ ID NO: 793902 - protein, 9 aa, Homo Sapiens
IDVDKDGFV

SEQ ID NO: 793903 - protein, 9 aa, Homo Sapiens
CSNEKCGEP

SEQ ID NO: 793904 - protein, 9 aa, Homo Sapiens
GHLDQTDTQ

SEQ ID NO: 793905 - protein, 9 aa, Homo Sapiens
SNQPEEELE

SEQ ID NO: 793906 - protein, 9 aa, Homo Sapiens
STSLGHWTQ

SEQ ID NO: 793907 - protein, 9 aa, Homo Sapiens
SVSSGDQIL

SEQ ID NO: 793908 - protein, 9 aa, Homo Sapiens
FTYTLRNKG

SEQ ID NO: 793909 - protein, 9 aa, Homo Sapiens
VHKGRKPFE

SEQ ID NO: 793910 - protein, 9 aa, Homo Sapiens
KKLKEITDK

SEQ ID NO: 793911 - protein, 9 aa, Homo Sapiens
QEKLDVHEK

SEQ ID NO: 793912 - protein, 9 aa, Homo Sapiens
AQEVFQKCV

SEQ ID NO: 793913 - protein, 9 aa, Homo Sapiens
PSWSPDISG

SEQ ID NO: 793914 - protein, 9 aa, Homo Sapiens
RTVRRVIQE

SEQ ID NO: 793915 - protein, 9 aa, Homo Sapiens
TNEMELPPE

SEQ ID NO: 793916 - protein, 9 aa, Homo Sapiens
SGLSDSVNL

SEQ ID NO: 793917 - protein, 9 aa, Homo Sapiens
QTQKANGHL

SEQ ID NO: 793918 - protein, 9 aa, Homo Sapiens
WYNNGKDRG

SEQ ID NO: 793919 - protein, 9 aa, Homo Sapiens
AEGVHGAGR

SEQ ID NO: 793920 - protein, 9 aa, Homo Sapiens
SWGNREIFI

SEQ ID NO: 793921 - protein, 9 aa, Homo Sapiens
PLERAVFWI

SEQ ID NO: 793922 - protein, 9 aa, Homo Sapiens
YKTEGRAEH

SEQ ID NO: 793923 - protein, 9 aa, Homo Sapiens
LGLSNVTVI

SEQ ID NO: 793924 - protein, 9 aa, Homo Sapiens
QWQKHCYPL

SEQ ID NO: 793925 - protein, 9 aa, Homo Sapiens
LLLGLSNVT

SEQ ID NO: 793926 - protein, 9 aa, Homo Sapiens
TGTNEMELP

SEQ ID NO: 793927 - protein, 9 aa, Homo Sapiens
RGDETLTRQ

SEQ ID NO: 793928 - protein, 9 aa, Homo Sapiens
GPRPSESDS

SEQ ID NO: 793929 - protein, 9 aa, Homo Sapiens
QCARAARDS

SEQ ID NO: 793930 - protein, 9 aa, Homo Sapiens
ISSKCMMEF

SEQ ID NO: 793931 - protein, 9 aa, Homo Sapiens
SEPRIETDI

SEQ ID NO: 793932 - protein, 9 aa, Homo Sapiens
QLGSSVYNG

SEQ ID NO: 793933 - protein, 9 aa, Homo Sapiens
GDETLTRQF

SEQ ID NO: 793934 - protein, 9 aa, Homo Sapiens
IQWQKHCYP

SEQ ID NO: 793935 - protein, 9 aa, Homo Sapiens
LSSSLLVGK

SEQ ID NO: 793936 - protein, 9 aa, Homo Sapiens
HDQPVKPLE

SEQ ID NO: 793937 - protein, 9 aa, Homo Sapiens
CRGDETLTR

SEQ ID NO: 793938 - protein, 9 aa, Homo Sapiens
CMMEFSSTA

SEQ ID NO: 793939 - protein, 9 aa, Homo Sapiens
LLGAADAIE

SEQ ID NO: 793940 - protein, 9 aa, Homo Sapiens
GVHKGRKPF

SEQ ID NO: 793941 - protein, 9 aa, Homo Sapiens
SLATLLLGL

SEQ ID NO: 793942 - protein, 9 aa, Homo Sapiens
NKGMKGALR

SEQ ID NO: 793943 - protein, 9 aa, Homo Sapiens
SAQFQDIEG

SEQ ID NO: 793944 - protein, 9 aa, Homo Sapiens
NREIFIIDT

SEQ ID NO: 793945 - protein, 9 aa, Homo Sapiens
KRTQTVEVP

SEQ ID NO: 793946 - protein, 9 aa, Homo Sapiens
KCGEPVLRK

SEQ ID NO: 793947 - protein, 9 aa, Homo Sapiens
ALAWLALGT

SEQ ID NO: 793948 - protein, 9 aa, Homo Sapiens
DLNNCRKDL

SEQ ID NO: 793949 - protein, 9 aa, Homo Sapiens
EYNANTSVL

SEQ ID NO: 793950 - protein, 9 aa, Homo Sapiens
NPGAPRHVG

SEQ ID NO: 793951 - protein, 9 aa, Homo Sapiens
PRVHFLRKV

SEQ ID NO: 793952 - protein, 9 aa, Homo Sapiens
LKRAFRKVP

SEQ ID NO: 793953 - protein, 9 aa, Homo Sapiens
GMKGALRRL

SEQ ID NO: 793954 - protein, 9 aa, Homo Sapiens
SQEDGLYKE

SEQ ID NO: 793955 - protein, 9 aa, Homo Sapiens
LFLTKKLKE

SEQ ID NO: 793956 - protein, 9 aa, Homo Sapiens
LQSKDILRN

SEQ ID NO: 793957 - protein, 9 aa, Homo Sapiens
SVSKRTQNI

SEQ ID NO: 793958 - protein, 9 aa, Homo Sapiens
WSEEKVLPA

SEQ ID NO: 793959 - protein, 9 aa, Homo Sapiens
DISGGREIF

SEQ ID NO: 793960 - protein, 9 aa, Homo Sapiens
FLTKKLKEI

SEQ ID NO: 793961 - protein, 9 aa, Homo Sapiens
ECVLSGNTA

SEQ ID NO: 793962 - protein, 9 aa, Homo Sapiens
HWCKQWEAY

SEQ ID NO: 793963 - protein, 9 aa, Homo Sapiens
GMIVDKIDV

SEQ ID NO: 793964 - protein, 9 aa, Homo Sapiens
NCRKDLEPI

SEQ ID NO: 793965 - protein, 9 aa, Homo Sapiens
DISSKCMME

SEQ ID NO: 793966 - protein, 9 aa, Homo Sapiens
AAQCARAAR

SEQ ID NO: 793967 - protein, 9 aa, Homo Sapiens
VAGPAPSLF

SEQ ID NO: 793968 - protein, 9 aa, Homo Sapiens
PPHTKNCRP

SEQ ID NO: 793969 - protein, 9 aa, Homo Sapiens
NINIQWQKH

SEQ ID NO: 793970 - protein, 9 aa, Homo Sapiens
EVFQKCVSV

SEQ ID NO: 793971 - protein, 9 aa, Homo Sapiens
KDILRNAAT

SEQ ID NO: 793972 - protein, 9 aa, Homo Sapiens
CRKDLEPIY

SEQ ID NO: 793973 - protein, 9 aa, Homo Sapiens
QPVKPLERA

SEQ ID NO: 793974 - protein, 9 aa, Homo Sapiens
GSFFIDIAL

SEQ ID NO: 793975 - protein, 9 aa, Homo Sapiens
LPEVVEPKD

SEQ ID NO: 793976 - protein, 9 aa, Homo Sapiens
LGSFFIDIA

SEQ ID NO: 793977 - protein, 9 aa, Homo Sapiens
GAADAIEAA

SEQ ID NO: 793978 - protein, 9 aa, Homo Sapiens
VSGSLEGPR

SEQ ID NO: 793979 - protein, 9 aa, Homo Sapiens
TYTLRNKGM

SEQ ID NO: 793980 - protein, 9 aa, Homo Sapiens
IGHSSAECV

SEQ ID NO: 793981 - protein, 9 aa, Homo Sapiens
RHVGAPGPS

SEQ ID NO: 793982 - protein, 9 aa, Homo Sapiens
LERAVFWIE

SEQ ID NO: 793983 - protein, 9 aa, Homo Sapiens
FKLAGATIS

SEQ ID NO: 793984 - protein, 9 aa, Homo Sapiens
KRTQNIVQK

SEQ ID NO: 793985 - protein, 9 aa, Homo Sapiens
RNAATVDEL

SEQ ID NO: 793986 - protein, 9 aa, Homo Sapiens
MIVDKIDVD

SEQ ID NO: 793987 - protein, 9 aa, Homo Sapiens
KTVNAELRA

SEQ ID NO: 793988 - protein, 9 aa, Homo Sapiens
FLNGEANLQ

SEQ ID NO: 793989 - protein, 9 aa, Homo Sapiens
CKANTQGPS

SEQ ID NO: 793990 - protein, 9 aa, Homo Sapiens
EFMCKLEYN

SEQ ID NO: 793991 - protein, 9 aa, Homo Sapiens
SAFPSRSLS

SEQ ID NO: 793992 - protein, 9 aa, Homo Sapiens
WCKQWEAYV

SEQ ID NO: 793993 - protein, 9 aa, Homo Sapiens
EATPTELAK

SEQ ID NO: 793994 - protein, 9 aa, Homo Sapiens
CGRGLGGVH

SEQ ID NO: 793995 - protein, 9 aa, Homo Sapiens
AWLALGTTA

SEQ ID NO: 793996 - protein, 9 aa, Homo Sapiens
SWSPDISGG

SEQ ID NO: 793997 - protein, 9 aa, Homo Sapiens
AEHLEATEY

SEQ ID NO: 793998 - protein, 9 aa, Homo Sapiens
LSPSVFWSF

SEQ ID NO: 793999 - protein, 9 aa, Homo Sapiens
VSSGDQILT

SEQ ID NO: 794000 - protein, 9 aa, Homo Sapiens
NCRPQLLVL

SEQ ID NO: 794001 - protein, 9 aa, Homo Sapiens
TSLGHWTQS

SEQ ID NO: 794002 - protein, 9 aa, Homo Sapiens
QNEISEIES

SEQ ID NO: 794003 - protein, 9 aa, Homo Sapiens
EDGLYKELA

SEQ ID NO: 794004 - protein, 9 aa, Homo Sapiens
DNKDRAGRF

SEQ ID NO: 794005 - protein, 9 aa, Homo Sapiens
PSESDSDDL

SEQ ID NO: 794006 - protein, 9 aa, Homo Sapiens
SMGFLNGEA

SEQ ID NO: 794007 - protein, 9 aa, Homo Sapiens
SSQEDGLYK

SEQ ID NO: 794008 - protein, 9 aa, Homo Sapiens
RRGLAEGVH

SEQ ID NO: 794009 - protein, 9 aa, Homo Sapiens
IETDILKQA

SEQ ID NO: 794010 - protein, 9 aa, Homo Sapiens
VRPLSSCSY

SEQ ID NO: 794011 - protein, 9 aa, Homo Sapiens
LEYNANTSV

SEQ ID NO: 794012 - protein, 9 aa, Homo Sapiens
MMEFSSTAQ

SEQ ID NO: 794013 - protein, 9 aa, Homo Sapiens
KANGHLDQT

SEQ ID NO: 794014 - protein, 9 aa, Homo Sapiens
TGDYLLESV

SEQ ID NO: 794015 - protein, 9 aa, Homo Sapiens
TKKLKEITD

SEQ ID NO: 794016 - protein, 9 aa, Homo Sapiens
AECVLSGNT

SEQ ID NO: 794017 - protein, 9 aa, Homo Sapiens
PVSAQFQDI

SEQ ID NO: 794018 - protein, 9 aa, Homo Sapiens
DETLTRQFN

SEQ ID NO: 794019 - protein, 9 aa, Homo Sapiens
GEQEKLDVH

SEQ ID NO: 794020 - protein, 9 aa, Homo Sapiens
EISEIESEA

SEQ ID NO: 794021 - protein, 9 aa, Homo Sapiens
GHSSAECVL

SEQ ID NO: 794022 - protein, 9 aa, Homo Sapiens
RGLGGVHKG

SEQ ID NO: 794023 - protein, 9 aa, Homo Sapiens
PVVRPLSSC

SEQ ID NO: 794024 - protein, 9 aa, Homo Sapiens
DSEPRIETD

SEQ ID NO: 794025 - protein, 9 aa, Homo Sapiens
HTKNCRPQL

SEQ ID NO: 794026 - protein, 9 aa, Homo Sapiens
LREDTDTME

SEQ ID NO: 794027 - protein, 9 aa, Homo Sapiens
LRKGSTGTN

SEQ ID NO: 794028 - protein, 9 aa, Homo Sapiens
LEGPRPSPT

SEQ ID NO: 794029 - protein, 9 aa, Homo Sapiens
ERLKAKLPE

SEQ ID NO: 794030 - protein, 9 aa, Homo Sapiens
LIVSGSLEG

SEQ ID NO: 794031 - protein, 9 aa, Homo Sapiens
TETFEPEDK

SEQ ID NO: 794032 - protein, 9 aa, Homo Sapiens
GGREIFKPR

SEQ ID NO: 794033 - protein, 9 aa, Homo Sapiens
KPLERAVFW

SEQ ID NO: 794034 - protein, 9 aa, Homo Sapiens
LNGEANLQA

SEQ ID NO: 794035 - protein, 9 aa, Homo Sapiens
INASTGDYL

SEQ ID NO: 794036 - protein, 9 aa, Homo Sapiens
MSSDSSESP

SEQ ID NO: 794037 - protein, 9 aa, Homo Sapiens
KDLQDSLDR

SEQ ID NO: 794038 - protein, 9 aa, Homo Sapiens
SPSVFWSFI

SEQ ID NO: 794039 - protein, 9 aa, Homo Sapiens
RLNGLAAQC

SEQ ID NO: 794040 - protein, 9 aa, Homo Sapiens
AINASTGDY

SEQ ID NO: 794041 - protein, 9 aa, Homo Sapiens
QTVEVPCPP

SEQ ID NO: 794042 - protein, 9 aa, Homo Sapiens
EEKVLPASC

SEQ ID NO: 794043 - protein, 9 aa, Homo Sapiens
DLQMDFYAH

SEQ ID NO: 794044 - protein, 9 aa, Homo Sapiens
FLVFDLRED

SEQ ID NO: 794045 - protein, 9 aa, Homo Sapiens
LVFDLREDT

SEQ ID NO: 794046 - protein, 9 aa, Homo Sapiens
DSALEALSS

SEQ ID NO: 794047 - protein, 9 aa, Homo Sapiens
MCKLEYNAN

SEQ ID NO: 794048 - protein, 9 aa, Homo Sapiens
IRGRECFEM

SEQ ID NO: 794049 - protein, 9 aa, Homo Sapiens
VHFLRKVLS

SEQ ID NO: 794050 - protein, 9 aa, Homo Sapiens
ETDILKQAT

SEQ ID NO: 794051 - protein, 9 aa, Homo Sapiens
YRLEQPVVR

SEQ ID NO: 794052 - protein, 9 aa, Homo Sapiens
SALEALSSS

SEQ ID NO: 794053 - protein, 9 aa, Homo Sapiens
GLSDSVNLQ

SEQ ID NO: 794054 - protein, 9 aa, Homo Sapiens
GDYLLESVN

SEQ ID NO: 794055 - protein, 9 aa, Homo Sapiens
DPKDQTEPQ

SEQ ID NO: 794056 - protein, 9 aa, Homo Sapiens
SLGHWTQST

SEQ ID NO: 794057 - protein, 9 aa, Homo Sapiens
ALASSQEDG

SEQ ID NO: 794058 - protein, 9 aa, Homo Sapiens
IQEEIHRFS

SEQ ID NO: 794059 - protein, 9 aa, Homo Sapiens
SKRTQNIVQ

SEQ ID NO: 794060 - protein, 9 aa, Homo Sapiens
ETPKKKRSA

SEQ ID NO: 794061 - protein, 9 aa, Homo Sapiens
KPKGTETFE

SEQ ID NO: 794062 - protein, 9 aa, Homo Sapiens
AQTQKANGH

SEQ ID NO: 794063 - protein, 9 aa, Homo Sapiens
LYADNKDRA

SEQ ID NO: 794064 - protein, 9 aa, Homo Sapiens
VNLQESDTV

SEQ ID NO: 794065 - protein, 9 aa, Homo Sapiens
TCQLGSSVY

SEQ ID NO: 794066 - protein, 9 aa, Homo Sapiens
KCMMEFSST

SEQ ID NO: 794067 - protein, 9 aa, Homo Sapiens
GTNEMELPP

SEQ ID NO: 794068 - protein, 9 aa, Homo Sapiens
HDWSEEKVL

SEQ ID NO: 794069 - protein, 9 aa, Homo Sapiens
QPVVRPLSS

SEQ ID NO: 794070 - protein, 9 aa, Homo Sapiens
TLLLGLSNV

SEQ ID NO: 794071 - protein, 9 aa, Homo Sapiens
AREECVDKF

SEQ ID NO: 794072 - protein, 9 aa, Homo Sapiens
IFIIDTPDM

SEQ ID NO: 794073 - protein, 9 aa, Homo Sapiens
KGFSKSSMS

SEQ ID NO: 794074 - protein, 9 aa, Homo Sapiens
VVRPLSSCS

SEQ ID NO: 794075 - protein, 9 aa, Homo Sapiens
GSSVYNGCQ

SEQ ID NO: 794076 - protein, 9 aa, Homo Sapiens
QEVFQKCVS

SEQ ID NO: 794077 - protein, 9 aa, Homo Sapiens
LGPRPSESD

SEQ ID NO: 794078 - protein, 9 aa, Homo Sapiens
LQIRGRECF

SEQ ID NO: 794079 - protein, 9 aa, Homo Sapiens
KRSAFPSRS

SEQ ID NO: 794080 - protein, 9 aa, Homo Sapiens
SGSLEGPRP

SEQ ID NO: 794081 - protein, 9 aa, Homo Sapiens
SAECVLSGN

SEQ ID NO: 794082 - protein, 9 aa, Homo Sapiens
CVSVQEEWK

SEQ ID NO: 794083 - protein, 9 aa, Homo Sapiens
EPKDLQDSL

SEQ ID NO: 794084 - protein, 9 aa, Homo Sapiens
DSVNLQESD

SEQ ID NO: 794085 - protein, 9 aa, Homo Sapiens
AALAWLALG

SEQ ID NO: 794086 - protein, 9 aa, Homo Sapiens
DLQQNEISE

SEQ ID NO: 794087 - protein, 9 aa, Homo Sapiens
KLTPVSAQF

SEQ ID NO: 794088 - protein, 9 aa, Homo Sapiens
ASTGDYLLE

SEQ ID NO: 794089 - protein, 9 aa, Homo Sapiens
LLGLSNVTV

SEQ ID NO: 794090 - protein, 9 aa, Homo Sapiens
NLAPPTVAG

SEQ ID NO: 794091 - protein, 9 aa, Homo Sapiens
GKGFSKSSM

SEQ ID NO: 794092 - protein, 9 aa, Homo Sapiens
VRRVIQEEI

SEQ ID NO: 794093 - protein, 9 aa, Homo Sapiens
KEITDKKKI

SEQ ID NO: 794094 - protein, 9 aa, Homo Sapiens
VEAMSFLSP

SEQ ID NO: 794095 - protein, 9 aa, Homo Sapiens
LATLLLGLS

SEQ ID NO: 794096 - protein, 9 aa, Homo Sapiens
FQKCVSVQE

SEQ ID NO: 794097 - protein, 9 aa, Homo Sapiens
KDQTEPQAA

SEQ ID NO: 794098 - protein, 9 aa, Homo Sapiens
TEGRAEHLE

SEQ ID NO: 794099 - protein, 9 aa, Homo Sapiens
SSAECVLSG

SEQ ID NO: 794100 - protein, 9 aa, Homo Sapiens
EVVEPKDLQ

SEQ ID NO: 794101 - protein, 9 aa, Homo Sapiens
SEIESEAFF

SEQ ID NO: 794102 - protein, 9 aa, Homo Sapiens
NEMELPPEP

SEQ ID NO: 794103 - protein, 9 aa, Homo Sapiens
PKDLQDSLD

SEQ ID NO: 794104 - protein, 9 aa, Homo Sapiens
WGNREIFII

SEQ ID NO: 794105 - protein, 9 aa, Homo Sapiens
RNKGMKGAL

SEQ ID NO: 794106 - protein, 9 aa, Homo Sapiens
VKPLERAVF

SEQ ID NO: 794107 - protein, 9 aa, Homo Sapiens
ELLGAADAI

SEQ ID NO: 794108 - protein, 9 aa, Homo Sapiens
AKLPEATPT

SEQ ID NO: 794109 - protein, 9 aa, Homo Sapiens
VYNGCQETY

SEQ ID NO: 794110 - protein, 9 aa, Homo Sapiens
AAGNPGAPR

SEQ ID NO: 794111 - protein, 9 aa, Homo Sapiens
NGEANLQAL

SEQ ID NO: 794112 - protein, 9 aa, Homo Sapiens
QCSNEKCGE

SEQ ID NO: 794113 - protein, 9 aa, Homo Sapiens
SSGDQILTK

SEQ ID NO: 794114 - protein, 9 aa, Homo Sapiens
KLPEATPTE

SEQ ID NO: 794115 - protein, 9 aa, Homo Sapiens
FLSPSVFWS

SEQ ID NO: 794116 - protein, 9 aa, Homo Sapiens
DQPVKPLER

SEQ ID NO: 794117 - protein, 9 aa, Homo Sapiens
HEKSKADKM

SEQ ID NO: 794118 - protein, 9 aa, Homo Sapiens
LALGTTAAW

SEQ ID NO: 794119 - protein, 9 aa, Homo Sapiens
KRKKPKGTE

SEQ ID NO: 794120 - protein, 9 aa, Homo Sapiens
ASSQEDGLY

SEQ ID NO: 794121 - protein, 9 aa, Homo Sapiens
PLQSKDILR

SEQ ID NO: 794122 - protein, 9 aa, Homo Sapiens
PRIETDILK

SEQ ID NO: 794123 - protein, 9 aa, Homo Sapiens
KAKLPEATP

SEQ ID NO: 794124 - protein, 9 aa, Homo Sapiens
LAAQCARAA

SEQ ID NO: 794125 - protein, 9 aa, Homo Sapiens
EGRAEHLEA

SEQ ID NO: 794126 - protein, 9 aa, Homo Sapiens
DQILTKPET

SEQ ID NO: 794127 - protein, 9 aa, Homo Sapiens
SSKCMMEFS

SEQ ID NO: 794128 - protein, 9 aa, Homo Sapiens
EIESEAFFG

SEQ ID NO: 794129 - protein, 9 aa, Homo Sapiens
SGDQILTKP

SEQ ID NO: 794130 - protein, 9 aa, Homo Sapiens
DYLLESVNK

SEQ ID NO: 794131 - protein, 9 aa, Homo Sapiens
LSDSVNLQE

SEQ ID NO: 794132 - protein, 9 aa, Homo Sapiens
QKHCYPLIG

SEQ ID NO: 794133 - protein, 9 aa, Homo Sapiens
TQKANGHLD

SEQ ID NO: 794134 - protein, 9 aa, Homo Sapiens
SVNLQESDT

SEQ ID NO: 794135 - protein, 9 aa, Homo Sapiens
NGHLDQTDT

SEQ ID NO: 794136 - protein, 9 aa, Homo Sapiens
CCHDWSEEK

SEQ ID NO: 794137 - protein, 9 aa, Homo Sapiens
VLSGNTAHW

SEQ ID NO: 794138 - protein, 9 aa, Homo Sapiens
CQLGSSVYN

SEQ ID NO: 794139 - protein, 9 aa, Homo Sapiens
AQCARAARD

SEQ ID NO: 794140 - protein, 9 aa, Homo Sapiens
MSFLSPSVF

SEQ ID NO: 794141 - protein, 9 aa, Homo Sapiens
PRPSESDSD

SEQ ID NO: 794142 - protein, 9 aa, Homo Sapiens
KMFLYADNK

SEQ ID NO: 794143 - protein, 9 aa, Homo Sapiens
EQPVVRPLS

SEQ ID NO: 794144 - protein, 9 aa, Homo Sapiens
SSMSSDSSE

SEQ ID NO: 794145 - protein, 9 aa, Homo Sapiens
TVRRVIQEE

SEQ ID NO: 794146 - protein, 9 aa, Homo Sapiens
TLPSTSLGH

SEQ ID NO: 794147 - protein, 9 aa, Homo Sapiens
TQNIVQKKF

SEQ ID NO: 794148 - protein, 9 aa, Homo Sapiens
GNREIFIID

SEQ ID NO: 794149 - protein, 9 aa, Homo Sapiens
QSKDILRNA

SEQ ID NO: 794150 - protein, 9 aa, Homo Sapiens
RGLAEGVHG

SEQ ID NO: 794151 - protein, 9 aa, Homo Sapiens
RSAFPSRSL

SEQ ID NO: 794152 - protein, 9 aa, Homo Sapiens
CRPQLLVLL

SEQ ID NO: 794153 - protein, 9 aa, Homo Sapiens
NIQWQKHCY

SEQ ID NO: 794154 - protein, 9 aa, Homo Sapiens
LRNKGMKGA

SEQ ID NO: 794155 - protein, 9 aa, Homo Sapiens
TVEVPCPPP

SEQ ID NO: 794156 - protein, 9 aa, Homo Sapiens
KHCYPLIGS

SEQ ID NO: 794157 - protein, 9 aa, Homo Sapiens
KSSMSSDSS

SEQ ID NO: 794158 - protein, 9 aa, Homo Sapiens
RTQNIVQKK

SEQ ID NO: 794159 - protein, 9 aa, Homo Sapiens
ENTKSNQPE

SEQ ID NO: 794160 - protein, 9 aa, Homo Sapiens
SESDSDDLD

SEQ ID NO: 794161 - protein, 9 aa, Homo Sapiens
HSSAECVLS

SEQ ID NO: 794162 - protein, 9 aa, Homo Sapiens
VSVQEEWKQ

SEQ ID NO: 794163 - protein, 9 aa, Homo Sapiens
LDVHEKSKA

SEQ ID NO: 794164 - protein, 9 aa, Homo Sapiens
KKKRSAFPS

SEQ ID NO: 794165 - protein, 9 aa, Homo Sapiens
RIETDILKQ

SEQ ID NO: 794166 - protein, 9 aa, Homo Sapiens
KCKANTQGP

SEQ ID NO: 794167 - protein, 9 aa, Homo Sapiens
TRQFNLYMG

SEQ ID NO: 794168 - protein, 9 aa, Homo Sapiens
RVHFLRKVL

SEQ ID NO: 794169 - protein, 9 aa, Homo Sapiens
RECFEMFRE

SEQ ID NO: 794170 - protein, 9 aa, Homo Sapiens
WQKHCYPLI

SEQ ID NO: 794171 - protein, 9 aa, Homo Sapiens
KTLPSTSLG

SEQ ID NO: 794172 - protein, 9 aa, Homo Sapiens
APRHVGAPG

SEQ ID NO: 794173 - protein, 9 aa, Homo Sapiens
EQEKLDVHE

SEQ ID NO: 794174 - protein, 9 aa, Homo Sapiens
AMSFLSPSV

SEQ ID NO: 794175 - protein, 9 aa, Homo Sapiens
VFQKCVSVQ

SEQ ID NO: 794176 - protein, 9 aa, Homo Sapiens
QTEPQAAVR

SEQ ID NO: 794177 - protein, 9 aa, Homo Sapiens
KVPLLHHPK

SEQ ID NO: 794178 - protein, 9 aa, Homo Sapiens
KLEYNANTS

SEQ ID NO: 794179 - protein, 9 aa, Homo Sapiens
RAFRKVPLL

SEQ ID NO: 794180 - protein, 9 aa, Homo Sapiens
SKCMMEFSS

SEQ ID NO: 794181 - protein, 9 aa, Homo Sapiens
REDTDTMEM

SEQ ID NO: 794182 - protein, 9 aa, Homo Sapiens
CFEMFRELN

SEQ ID NO: 794183 - protein, 9 aa, Homo Sapiens
ISGGREIFK

SEQ ID NO: 794184 - protein, 9 aa, Homo Sapiens
LNGLAAQCA

SEQ ID NO: 794185 - protein, 9 aa, Homo Sapiens
RVIQEEIHR

SEQ ID NO: 794186 - protein, 9 aa, Homo Sapiens
NETPKKKRS

SEQ ID NO: 794187 - protein, 9 aa, Homo Sapiens
NNCRKDLEP

SEQ ID NO: 794188 - protein, 9 aa, Homo Sapiens
PDKKKCKAN

SEQ ID NO: 794189 - protein, 9 aa, Homo Sapiens
TLQIRGREC

SEQ ID NO: 794190 - protein, 9 aa, Homo Sapiens
NASTGDYLL

SEQ ID NO: 794191 - protein, 9 aa, Homo Sapiens
NGSGLSDSV

SEQ ID NO: 794192 - protein, 9 aa, Homo Sapiens
LTPVSAQFQ

SEQ ID NO: 794193 - protein, 9 aa, Homo Sapiens
KRAFRKVPL

SEQ ID NO: 794194 - protein, 9 aa, Homo Sapiens
PKGTETFEP

SEQ ID NO: 794195 - protein, 9 aa, Homo Sapiens
PTVAGPAPS

SEQ ID NO: 794196 - protein, 9 aa, Homo Sapiens
MEFSSTAQG

SEQ ID NO: 794197 - protein, 9 aa, Homo Sapiens
KRRTVRRVI

SEQ ID NO: 794198 - protein, 9 aa, Homo Sapiens
LVEKHWCKQ

SEQ ID NO: 794199 - protein, 9 aa, Homo Sapiens
QKTLPSTSL

SEQ ID NO: 794200 - protein, 9 aa, Homo Sapiens
KLDVHEKSK

SEQ ID NO: 794201 - protein, 9 aa, Homo Sapiens
FFFLVFDLR

SEQ ID NO: 794202 - protein, 9 aa, Homo Sapiens
GPPHTKNCR

SEQ ID NO: 794203 - protein, 9 aa, Homo Sapiens
LDPKDQTEP

SEQ ID NO: 794204 - protein, 9 aa, Homo Sapiens
VDKDGFVTE

SEQ ID NO: 794205 - protein, 9 aa, Homo Sapiens
PDISGGREI

SEQ ID NO: 794206 - protein, 9 aa, Homo Sapiens
MSVSSGDQI

SEQ ID NO: 794207 - protein, 9 aa, Homo Sapiens
STGTNEMEL

SEQ ID NO: 794208 - protein, 9 aa, Homo Sapiens
AHFPEFFLT

SEQ ID NO: 794209 - protein, 9 aa, Homo Sapiens
ATLLLGLSN

SEQ ID NO: 794210 - protein, 9 aa, Homo Sapiens
RRVIQEEIH

SEQ ID NO: 794211 - protein, 9 aa, Homo Sapiens
RSMGFLNGE

SEQ ID NO: 794212 - protein, 9 aa, Homo Sapiens
ELDKPRVHF

SEQ ID NO: 794213 - protein, 9 aa, Homo Sapiens
GVHGAGRAP

SEQ ID NO: 794214 - protein, 9 aa, Homo Sapiens
AQFQDIEGK

SEQ ID NO: 794215 - protein, 9 aa, Homo Sapiens
SKSSMSSDS

SEQ ID NO: 794216 - protein, 9 aa, Homo Sapiens
RPSESDSDD

SEQ ID NO: 794217 - protein, 9 aa, Homo Sapiens
CKLEYNANT

SEQ ID NO: 794218 - protein, 9 aa, Homo Sapiens
DVDKDGFVT

SEQ ID NO: 794219 - protein, 9 aa, Homo Sapiens
GLDPKDQTE

SEQ ID NO: 794220 - protein, 9 aa, Homo Sapiens
PVKPLERAV

SEQ ID NO: 794221 - protein, 9 aa, Homo Sapiens
PKRLKTNWY

SEQ ID NO: 794222 - protein, 9 aa, Homo Sapiens
MLALASSQE

SEQ ID NO: 794223 - protein, 9 aa, Homo Sapiens
SSVYNGCQE

SEQ ID NO: 794224 - protein, 9 aa, Homo Sapiens
QEDGLYKEL

SEQ ID NO: 794225 - protein, 9 aa, Homo Sapiens
FIIDTPDMF

SEQ ID NO: 794226 - protein, 9 aa, Homo Sapiens
GSTGTNEME

SEQ ID NO: 794227 - protein, 9 aa, Homo Sapiens
SKRWESAFQ

SEQ ID NO: 794228 - protein, 9 aa, Homo Sapiens
KILGPRPSE

SEQ ID NO: 794229 - protein, 9 aa, Homo Sapiens
KLFLTKKLK

SEQ ID NO: 794230 - protein, 9 aa, Homo Sapiens
SPDISGGRE

SEQ ID NO: 794231 - protein, 9 aa, Homo Sapiens
EKVLPASCG

SEQ ID NO: 794232 - protein, 9 aa, Homo Sapiens
SELDKPRVH

SEQ ID NO: 794233 - protein, 9 aa, Homo Sapiens
KLKEITDKK

SEQ ID NO: 794234 - protein, 9 aa, Homo Sapiens
PEATPTELA

SEQ ID NO: 794235 - protein, 9 aa, Homo Sapiens
EKLDVHEKS

SEQ ID NO: 794236 - protein, 9 aa, Homo Sapiens
CVDKFKLAG

SEQ ID NO: 794237 - protein, 9 aa, Homo Sapiens
RLKTNWYNN

SEQ ID NO: 794238 - protein, 9 aa, Homo Sapiens
KVLPASCGE

SEQ ID NO: 794239 - protein, 9 aa, Homo Sapiens
ALSSSLLVG

SEQ ID NO: 794240 - protein, 9 aa, Homo Sapiens
VFDLREDTD

SEQ ID NO: 794241 - protein, 9 aa, Homo Sapiens
SLEGPRPSP

SEQ ID NO: 794242 - protein, 9 aa, Homo Sapiens
GSGLSDSVN

SEQ ID NO: 794243 - protein, 9 aa, Homo Sapiens
AAALAWLAL

SEQ ID NO: 794244 - protein, 9 aa, Homo Sapiens
SAINASTGD

SEQ ID NO: 794245 - protein, 9 aa, Homo Sapiens
GSWGNREIF

SEQ ID NO: 794246 - protein, 9 aa, Homo Sapiens
NEKCGEPVL

SEQ ID NO: 794247 - protein, 9 aa, Homo Sapiens
VEPKDLQDS

SEQ ID NO: 794248 - protein, 9 aa, Homo Sapiens
TVAGPAPSL

SEQ ID NO: 794249 - protein, 9 aa, Homo Sapiens
VVEPKDLQD

SEQ ID NO: 794250 - protein, 9 aa, Homo Sapiens
REIFIIDTP

SEQ ID NO: 794251 - protein, 9 aa, Homo Sapiens
IVSGSLEGP

SEQ ID NO: 794252 - protein, 9 aa, Homo Sapiens
AYRLEQPVV

SEQ ID NO: 794253 - protein, 9 aa, Homo Sapiens
EKHWCKQWE

SEQ ID NO: 794254 - protein, 9 aa, Homo Sapiens
YADNKDRAG

SEQ ID NO: 794255 - protein, 9 aa, Homo Sapiens
LAWLALGTT

SEQ ID NO: 794256 - protein, 9 aa, Homo Sapiens
RRTVRRVIQ

SEQ ID NO: 794257 - protein, 9 aa, Homo Sapiens
VHEKSKADK

SEQ ID NO: 794258 - protein, 9 aa, Homo Sapiens
EGPRPSPTR

SEQ ID NO: 794259 - protein, 9 aa, Homo Sapiens
WLALGTTAA

SEQ ID NO: 794260 - protein, 9 aa, Homo Sapiens
KTEGRAEHL

SEQ ID NO: 794261 - protein, 9 aa, Homo Sapiens
ECVDKFKLA

SEQ ID NO: 794262 - protein, 9 aa, Homo Sapiens
LNNCRKDLE

SEQ ID NO: 794263 - protein, 9 aa, Homo Sapiens
AADAIEAAA

SEQ ID NO: 794264 - protein, 9 aa, Homo Sapiens
SVYNGCQET

SEQ ID NO: 794265 - protein, 9 aa, Homo Sapiens
HCYPLIGSM

SEQ ID NO: 794266 - protein, 9 aa, Homo Sapiens
GNPGAPRHV

SEQ ID NO: 794267 - protein, 9 aa, Homo Sapiens
GGVHKGRKP

SEQ ID NO: 794268 - protein, 9 aa, Homo Sapiens
FDLREDTDT

SEQ ID NO: 794269 - protein, 9 aa, Homo Sapiens
LKTNWYNNG

SEQ ID NO: 794270 - protein, 9 aa, Homo Sapiens
FVEAMSFLS

SEQ ID NO: 794271 - protein, 9 aa, Homo Sapiens
TLTRQFNLY

SEQ ID NO: 794272 - protein, 9 aa, Homo Sapiens
DKILGPRPS

SEQ ID NO: 794273 - protein, 9 aa, Homo Sapiens
NKDRAGRFH

SEQ ID NO: 794274 - protein, 9 aa, Homo Sapiens
VSKRTQNIV

SEQ ID NO: 794275 - protein, 9 aa, Homo Sapiens
KPRVHFLRK

SEQ ID NO: 794276 - protein, 9 aa, Homo Sapiens
KGTETFEPE

SEQ ID NO: 794277 - protein, 9 aa, Homo Sapiens
IDIALQTRT

SEQ ID NO: 794278 - protein, 9 aa, Homo Sapiens
FLYADNKDR

SEQ ID NO: 794279 - protein, 9 aa, Homo Sapiens
CHDWSEEKV

SEQ ID NO: 794280 - protein, 9 aa, Homo Sapiens
VEVPCPPPS

SEQ ID NO: 794281 - protein, 9 aa, Homo Sapiens
PPTVAGPAP

SEQ ID NO: 794282 - protein, 9 aa, Homo Sapiens
LDKPRVHFL

SEQ ID NO: 794283 - protein, 9 aa, Homo Sapiens
IEFMCKLEY

SEQ ID NO: 794284 - protein, 9 aa, Homo Sapiens
KTNWYNNGK

SEQ ID NO: 794285 - protein, 9 aa, Homo Sapiens
GLGGVHKGR

SEQ ID NO: 794286 - protein, 9 aa, Homo Sapiens
SNEKCGEPV

SEQ ID NO: 794287 - protein, 9 aa, Homo Sapiens
RLKAKLPEA

SEQ ID NO: 794288 - protein, 9 aa, Homo Sapiens
ASENTKSNQ

SEQ ID NO: 794289 - protein, 9 aa, Homo Sapiens
YTLRNKGMK

SEQ ID NO: 794290 - protein, 9 aa, Homo Sapiens
CGEPVLRKD

SEQ ID NO: 794291 - protein, 9 aa, Homo Sapiens
LQQNEISEI

SEQ ID NO: 794292 - protein, 9 aa, Homo Sapiens
LEQPVVRPL

SEQ ID NO: 794293 - protein, 9 aa, Homo Sapiens
ALQTRTLLD

SEQ ID NO: 794294 - protein, 9 aa, Homo Sapiens
TLGGQGGWI

SEQ ID NO: 794295 - protein, 9 aa, Homo Sapiens
PGAPRHVGA

SEQ ID NO: 794296 - protein, 9 aa, Homo Sapiens
CVLSGNTAH

SEQ ID NO: 794297 - protein, 9 aa, Homo Sapiens
RDLQMDFYA

SEQ ID NO: 794298 - protein, 9 aa, Homo Sapiens
KDRAGRFHK

SEQ ID NO: 794299 - protein, 9 aa, Homo Sapiens
LGGVHKGRK

SEQ ID NO: 794300 - protein, 9 aa, Homo Sapiens
VNAELRATI

SEQ ID NO: 794301 - protein, 9 aa, Homo Sapiens
LGGQGGWIT

SEQ ID NO: 794302 - protein, 9 aa, Homo Sapiens
VIQEEIHRF

SEQ ID NO: 794303 - protein, 9 aa, Homo Sapiens
NIVQKKFQK

SEQ ID NO: 794304 - protein, 9 aa, Homo Sapiens
IVDKIDVDK

SEQ ID NO: 794305 - protein, 9 aa, Homo Sapiens
GEANLQALI

SEQ ID NO: 794306 - protein, 9 aa, Homo Sapiens
TPVSAQFQD

SEQ ID NO: 794307 - protein, 9 aa, Homo Sapiens
DKIDVDKDG

SEQ ID NO: 794308 - protein, 9 aa, Homo Sapiens
KNCRPQLLV

SEQ ID NO: 794309 - protein, 9 aa, Homo Sapiens
CKQWEAYVQ

SEQ ID NO: 794310 - protein, 9 aa, Homo Sapiens
QMDFYAHFP

SEQ ID NO: 794311 - protein, 9 aa, Homo Sapiens
ISEIESEAF

SEQ ID NO: 794312 - protein, 9 aa, Homo Sapiens
NQPEEELEN

SEQ ID NO: 794313 - protein, 9 aa, Homo Sapiens
GRGLGGVHK

SEQ ID NO: 794314 - protein, 9 aa, Homo Sapiens
PKDQTEPQA

SEQ ID NO: 794315 - protein, 9 aa, Homo Sapiens
QQNEISEIE

SEQ ID NO: 794316 - protein, 9 aa, Homo Sapiens
APPTVAGPA

SEQ ID NO: 794317 - protein, 9 aa, Homo Sapiens
MDFYAHFPE

SEQ ID NO: 794318 - protein, 9 aa, Homo Sapiens
VVRKTVNAE

SEQ ID NO: 794319 - protein, 9 aa, Homo Sapiens
GDQILTKPE

SEQ ID NO: 794320 - protein, 9 aa, Homo Sapiens
DKKKCKANT

SEQ ID NO: 794321 - protein, 9 aa, Homo Sapiens
APKRLKTNW

SEQ ID NO: 794322 - protein, 9 aa, Homo Sapiens
GVVRKTVNA

SEQ ID NO: 794323 - protein, 9 aa, Homo Sapiens
VHGAGRAPP

SEQ ID NO: 794324 - protein, 9 aa, Homo Sapiens
SDSVNLQES

SEQ ID NO: 794325 - protein, 9 aa, Homo Sapiens
FFLVFDLRE

SEQ ID NO: 794326 - protein, 9 aa, Homo Sapiens
PSTSLGHWT

SEQ ID NO: 794327 - protein, 9 aa, Homo Sapiens
SGGREIFKP

SEQ ID NO: 794328 - protein, 9 aa, Homo Sapiens
HLDQTDTQI

SEQ ID NO: 794329 - protein, 9 aa, Homo Sapiens
NGLAAQCAR

SEQ ID NO: 794330 - protein, 9 aa, Homo Sapiens
AKRTQTVEV

SEQ ID NO: 794331 - protein, 9 aa, Homo Sapiens
RKDLEPIYE

SEQ ID NO: 794332 - protein, 9 aa, Homo Sapiens
YAHFPEFFL

SEQ ID NO: 794333 - protein, 9 aa, Homo Sapiens
NAELRATIW

SEQ ID NO: 794334 - protein, 9 aa, Homo Sapiens
INIQWQKHC

SEQ ID NO: 794335 - protein, 9 aa, Homo Sapiens
RTQTVEVPC

SEQ ID NO: 794336 - protein, 9 aa, Homo Sapiens
PRHVGAPGP

SEQ ID NO: 794337 - protein, 9 aa, Homo Sapiens
EASLATLLL

SEQ ID NO: 794338 - protein, 9 aa, Homo Sapiens
TKNCRPQLL

SEQ ID NO: 794339 - protein, 9 aa, Homo Sapiens
LALASSQED

SEQ ID NO: 794340 - protein, 9 aa, Homo Sapiens
KGSTGTNEM

SEQ ID NO: 794341 - protein, 9 aa, Homo Sapiens
SENTKSNQP

SEQ ID NO: 794342 - protein, 9 aa, Homo Sapiens
HFLRKVLSI

SEQ ID NO: 794343 - protein, 9 aa, Homo Sapiens
RKGSTGTNE

SEQ ID NO: 794344 - protein, 9 aa, Homo Sapiens
VDKFKLAGA

SEQ ID NO: 794345 - protein, 9 aa, Homo Sapiens
MGFLNGEAN

SEQ ID NO: 794346 - protein, 9 aa, Homo Sapiens
RKVPLLHHP

SEQ ID NO: 794347 - protein, 9 aa, Homo Sapiens
LDLNNCRKD

SEQ ID NO: 794348 - protein, 9 aa, Homo Sapiens
KRLKTNWYN

SEQ ID NO: 794349 - protein, 9 aa, Homo Sapiens
VSAQFQDIE

SEQ ID NO: 794350 - protein, 9 aa, Homo Sapiens
RQFNLYMGD

SEQ ID NO: 794351 - protein, 9 aa, Homo Sapiens
LKAKLPEAT

SEQ ID NO: 794352 - protein, 9 aa, Homo Sapiens
GLAAQCARA

SEQ ID NO: 794353 - protein, 9 aa, Homo Sapiens
ELPEVVEPK

SEQ ID NO: 794354 - protein, 9 aa, Homo Sapiens
ILGPRPSES

SEQ ID NO: 794355 - protein, 9 aa, Homo Sapiens
ANGHLDQTD

SEQ ID NO: 794356 - protein, 9 aa, Homo Sapiens
ETLTRQFNL

SEQ ID NO: 794357 - protein, 9 aa, Homo Sapiens
NTCQLGSSV

SEQ ID NO: 794358 - protein, 9 aa, Homo Sapiens
LRSMGFLNG

SEQ ID NO: 794359 - protein, 9 aa, Homo Sapiens
EECVDKFKL

SEQ ID NO: 794360 - protein, 9 aa, Homo Sapiens
DILRNAATV

SEQ ID NO: 794361 - protein, 9 aa, Homo Sapiens
KFKLAGATI

SEQ ID NO: 794362 - protein, 9 aa, Homo Sapiens
FFIDIALQT

SEQ ID NO: 794363 - protein, 9 aa, Homo Sapiens
GEPVLRKDL

SEQ ID NO: 794364 - protein, 9 aa, Homo Sapiens
LDSEPRIET

SEQ ID NO: 794365 - protein, 9 aa, Homo Sapiens
VEKHWCKQW

SEQ ID NO: 794366 - protein, 9 aa, Homo Sapiens
CLKRAFRKV

SEQ ID NO: 794367 - protein, 9 aa, Homo Sapiens
PEVVEPKDL

SEQ ID NO: 794368 - protein, 9 aa, Homo Sapiens
VPLLHHPKP

SEQ ID NO: 794369 - protein, 9 aa, Homo Sapiens
QKCVSVQEE

SEQ ID NO: 794370 - protein, 9 aa, Homo Sapiens
ADAIEAAAK

SEQ ID NO: 794371 - protein, 9 aa, Homo Sapiens
GLAEGVHGA

SEQ ID NO: 794372 - protein, 9 aa, Homo Sapiens
RKTVNAELR

SEQ ID NO: 794373 - protein, 9 aa, Homo Sapiens
EGVHGAGRA

SEQ ID NO: 794374 - protein, 9 aa, Homo Sapiens
DLREDTDTM

SEQ ID NO: 794375 - protein, 9 aa, Homo Sapiens
STLGGQGGW

SEQ ID NO: 794376 - protein, 9 aa, Homo Sapiens
FMCKLEYNA

SEQ ID NO: 794377 - protein, 9 aa, Homo Sapiens
EKCGEPVLR

SEQ ID NO: 794378 - protein, 9 aa, Homo Sapiens
ADNKDRAGR

SEQ ID NO: 794379 - protein, 9 aa, Homo Sapiens
KIDVDKDGF

SEQ ID NO: 794380 - protein, 9 aa, Homo Sapiens
ERAVFWIEF

SEQ ID NO: 794381 - protein, 9 aa, Homo Sapiens
IVQKKFQKN

SEQ ID NO: 794382 - protein, 9 aa, Homo Sapiens
VRKTVNAEL

SEQ ID NO: 794383 - protein, 9 aa, Homo Sapiens
LAPPTVAGP

SEQ ID NO: 794384 - protein, 9 aa, Homo Sapiens
LTRQFNLYM

SEQ ID NO: 794385 - protein, 9 aa, Homo Sapiens
GPRPSPTRS

SEQ ID NO: 794386 - protein, 9 aa, Homo Sapiens
QPEEELENI

SEQ ID NO: 794387 - protein, 9 aa, Homo Sapiens
LGSSVYNGC

SEQ ID NO: 794388 - protein, 9 aa, Homo Sapiens
LAEGVHGAG

SEQ ID NO: 794389 - protein, 9 aa, Homo Sapiens
ECFEMFREL

SEQ ID NO: 794390 - protein, 9 aa, Homo Sapiens
GSPDKKKCK

SEQ ID NO: 794391 - protein, 9 aa, Homo Sapiens
VQCSNEKCG

SEQ ID NO: 794392 - protein, 9 aa, Homo Sapiens
NWYNNGKDR

SEQ ID NO: 794393 - protein, 9 aa, Homo Sapiens
LGSPDKKKC

SEQ ID NO: 794394 - protein, 9 aa, Homo Sapiens
ALEALSSSL

SEQ ID NO: 794395 - protein, 9 aa, Homo Sapiens
KGMKGALRR

SEQ ID NO: 794396 - protein, 9 aa, Homo Sapiens
EHLEATEYL

SEQ ID NO: 794397 - protein, 9 aa, Homo Sapiens
DKPRVHFLR

SEQ ID NO: 794398 - protein, 9 aa, Homo Sapiens
LGTTAAWWG

SEQ ID NO: 794399 - protein, 9 aa, Homo Sapiens
EAMSFLSPS

SEQ ID NO: 794400 - protein, 9 aa, Homo Sapiens
AFRKVPLLH

SEQ ID NO: 794401 - protein, 9 aa, Homo Sapiens
EGPPHTKNC

SEQ ID NO: 794402 - protein, 9 aa, Homo Sapiens
LGHWTQSTP

SEQ ID NO: 794403 - protein, 9 aa, Homo Sapiens
NTKSNQPEE

SEQ ID NO: 794404 - protein, 9 aa, Homo Sapiens
AGNPGAPRH

SEQ ID NO: 794405 - protein, 9 aa, Homo Sapiens
GRECFEMFR

SEQ ID NO: 794406 - protein, 9 aa, Homo Sapiens
CARAARDSL

SEQ ID NO: 794407 - protein, 9 aa, Homo Sapiens
GSLEGPRPS

SEQ ID NO: 794408 - protein, 9 aa, Homo Sapiens
TLRNKGMKG

SEQ ID NO: 794409 - protein, 9 aa, Homo Sapiens
AFPSRSLSS

SEQ ID NO: 794410 - protein, 9 aa, Homo Sapiens
TVNAELRAT

SEQ ID NO: 794411 - protein, 9 aa, Homo Sapiens
WFLVEKHWC

SEQ ID NO: 794412 - protein, 9 aa, Homo Sapiens
EVPCPPPSP

SEQ ID NO: 794413 - protein, 9 aa, Homo Sapiens
DWSEEKVLP

SEQ ID NO: 794414 - protein, 9 aa, Homo Sapiens
LTKKLKEIT

SEQ ID NO: 794415 - protein, 9 aa, Homo Sapiens
AGPAPSLFP

SEQ ID NO: 794416 - protein, 9 aa, Homo Sapiens
WSPDISGGR

SEQ ID NO: 794417 - protein, 9 aa, Homo Sapiens
NLDSEPRIE

SEQ ID NO: 794418 - protein, 9 aa, Homo Sapiens
SMSSDSSES

SEQ ID NO: 794419 - protein, 9 aa, Homo Sapiens
RLEQPVVRP

SEQ ID NO: 794420 - protein, 9 aa, Homo Sapiens
DIALQTRTL

SEQ ID NO: 794421 - protein, 9 aa, Homo Sapiens
QKANGHLDQ

SEQ ID NO: 794422 - protein, 9 aa, Homo Sapiens
SKDILRNAA

SEQ ID NO: 794423 - protein, 9 aa, Homo Sapiens
VPCPPPSPR

SEQ ID NO: 794424 - protein, 9 aa, Homo Sapiens
SEEKVLPAS

SEQ ID NO: 794425 - protein, 9 aa, Homo Sapiens
FLVEKHWCK

SEQ ID NO: 794426 - protein, 9 aa, Homo Sapiens
FRKVPLLHH

SEQ ID NO: 794427 - protein, 9 aa, Homo Sapiens
KKKCKANTQ

SEQ ID NO: 794428 - protein, 9 aa, Homo Sapiens
LRNAATVDE

SEQ ID NO: 794429 - protein, 9 aa, Homo Sapiens
AELRATIWE

SEQ ID NO: 794430 - protein, 9 aa, Homo Sapiens
PGLDPKDQT

SEQ ID NO: 794431 - protein, 9 aa, Homo Sapiens
KSNQPEEEL

SEQ ID NO: 794432 - protein, 9 aa, Homo Sapiens
ILRNAATVD

SEQ ID NO: 794433 - protein, 9 aa, Homo Sapiens
EALSSSLLV

SEQ ID NO: 794434 - protein, 9 aa, Homo Sapiens
NELLGAADA

SEQ ID NO: 794435 - protein, 9 aa, Homo Sapiens
PKKKRSAFP

SEQ ID NO: 794436 - protein, 9 aa, Homo Sapiens
TKSNQPEEE

SEQ ID NO: 794437 - protein, 9 aa, Homo Sapiens
SPDKKKCKA

SEQ ID NO: 794438 - protein, 9 aa, Homo Sapiens
SFFIDIALQ

SEQ ID NO: 794439 - protein, 9 aa, Homo Sapiens
SFLSPSVFW

SEQ ID NO: 794440 - protein, 9 aa, Homo Sapiens
STGDYLLES

SEQ ID NO: 794441 - protein, 9 aa, Homo Sapiens
LPEATPTEL

SEQ ID NO: 794442 - protein, 9 aa, Homo Sapiens
KKCKANTQG

SEQ ID NO: 794443 - protein, 9 aa, Homo Sapiens
QIRGRECFE

SEQ ID NO: 794444 - protein, 9 aa, Homo Sapiens
RGRECFEMF

SEQ ID NO: 794445 - protein, 9 aa, Homo Sapiens
DAIEAAAKK

SEQ ID NO: 794446 - protein, 9 aa, Homo Sapiens
KDLEPIYEG

SEQ ID NO: 794447 - protein, 9 aa, Homo Sapiens
LGAADAIEA

SEQ ID NO: 794448 - protein, 9 aa, Homo Sapiens
FQDIEGKID

SEQ ID NO: 794449 - protein, 9 aa, Homo Sapiens
SNETPKKKR

SEQ ID NO: 794450 - protein, 9 aa, Homo Sapiens
QNIVQKKFQ

SEQ ID NO: 794451 - protein, 9 aa, Homo Sapiens
PHTKNCRPQ

SEQ ID NO: 794452 - protein, 9 aa, Homo Sapiens
LPGLDPKDQ

SEQ ID NO: 794453 - protein, 9 aa, Homo Sapiens
KKRKKPKGT

SEQ ID NO: 794454 - protein, 9 aa, Homo Sapiens
QFQDIEGKI

SEQ ID NO: 794455 - protein, 9 aa, Homo Sapiens
KCVSVQEEW

SEQ ID NO: 794456 - protein, 9 aa, Homo Sapiens
KHWCKQWEA

SEQ ID NO: 794457 - protein, 9 aa, Homo Sapiens
TPKKKRSAF

SEQ ID NO: 794458 - protein, 9 aa, Homo Sapiens
GFLNGEANL

SEQ ID NO: 794459 - protein, 9 aa, Homo Sapiens
ALGTTAAWW

SEQ ID NO: 794460 - protein, 9 aa, Homo Sapiens
VRRGLAEGV

SEQ ID NO: 794461 - protein, 9 aa, Homo Sapiens
LQMDFYAHF

SEQ ID NO: 794462 - protein, 9 aa, Homo Sapiens
IALQTRTLL

SEQ ID NO: 794463 - protein, 9 aa, Homo Sapiens
SYKSFTFVQ

SEQ ID NO: 794464 - protein, 9 aa, Homo Sapiens
KHALSYNQG

SEQ ID NO: 794465 - protein, 9 aa, Homo Sapiens
EVAAGENSQ

SEQ ID NO: 794466 - protein, 9 aa, Homo Sapiens
HLEATEYLV

SEQ ID NO: 794467 - protein, 9 aa, Homo Sapiens
SGTELTGSR

SEQ ID NO: 794468 - protein, 9 aa, Homo Sapiens
HCGRGLGGV

SEQ ID NO: 794469 - protein, 9 aa, Homo Sapiens
LPWLCLGLC

SEQ ID NO: 794470 - protein, 9 aa, Homo Sapiens
LGTLAVFSL

SEQ ID NO: 794471 - protein, 9 aa, Homo Sapiens
GIFEVKSMA

SEQ ID NO: 794472 - protein, 9 aa, Homo Sapiens
PDLALGTLA

SEQ ID NO: 794473 - protein, 9 aa, Homo Sapiens
FIDRTICHN

SEQ ID NO: 794474 - protein, 9 aa, Homo Sapiens
QQIQAKDTK

SEQ ID NO: 794475 - protein, 9 aa, Homo Sapiens
KLRVAEGHP

SEQ ID NO: 794476 - protein, 9 aa, Homo Sapiens
LVLKQGSHA

SEQ ID NO: 794477 - protein, 9 aa, Homo Sapiens
PSMRRSLAT

SEQ ID NO: 794478 - protein, 9 aa, Homo Sapiens
RPVGAGHVV

SEQ ID NO: 794479 - protein, 9 aa, Homo Sapiens
TIEFMCKLE

SEQ ID NO: 794480 - protein, 9 aa, Homo Sapiens
GRAEHLEAT

SEQ ID NO: 794481 - protein, 9 aa, Homo Sapiens
QMAVSSDVA

SEQ ID NO: 794482 - protein, 9 aa, Homo Sapiens
LAVFSLARH

SEQ ID NO: 794483 - protein, 9 aa, Homo Sapiens
EVPRAFLNL

SEQ ID NO: 794484 - protein, 9 aa, Homo Sapiens
LKNLQQFPA

SEQ ID NO: 794485 - protein, 9 aa, Homo Sapiens
LDLDSGAPG

SEQ ID NO: 794486 - protein, 9 aa, Homo Sapiens
EALKTQLKC

SEQ ID NO: 794487 - protein, 9 aa, Homo Sapiens
LLFMFICSS

SEQ ID NO: 794488 - protein, 9 aa, Homo Sapiens
GSRGCSTSG

SEQ ID NO: 794489 - protein, 9 aa, Homo Sapiens
SISYDYCRV

SEQ ID NO: 794490 - protein, 9 aa, Homo Sapiens
IGVTLSNAI

SEQ ID NO: 794491 - protein, 9 aa, Homo Sapiens
LGKIINLKI

SEQ ID NO: 794492 - protein, 9 aa, Homo Sapiens
IVSYKSFTF

SEQ ID NO: 794493 - protein, 9 aa, Homo Sapiens
GGLSVSSSF

SEQ ID NO: 794494 - protein, 9 aa, Homo Sapiens
SGLEHCAHV

SEQ ID NO: 794495 - protein, 9 aa, Homo Sapiens
AASKLVPRP

SEQ ID NO: 794496 - protein, 9 aa, Homo Sapiens
CFTASKPDG

SEQ ID NO: 794497 - protein, 9 aa, Homo Sapiens
MIVSYKSFT

SEQ ID NO: 794498 - protein, 9 aa, Homo Sapiens
LLVANMYFL

SEQ ID NO: 794499 - protein, 9 aa, Homo Sapiens
VTAAPLVLP

SEQ ID NO: 794500 - protein, 9 aa, Homo Sapiens
STVGSGLTV

SEQ ID NO: 794501 - protein, 9 aa, Homo Sapiens
LSYNQGQLK

SEQ ID NO: 794502 - protein, 9 aa, Homo Sapiens
GQLKELKDS

SEQ ID NO: 794503 - protein, 9 aa, Homo Sapiens
SYNRFQTAT

SEQ ID NO: 794504 - protein, 9 aa, Homo Sapiens
VTLSNAIVN

SEQ ID NO: 794505 - protein, 9 aa, Homo Sapiens
NFHVCLLLL

SEQ ID NO: 794506 - protein, 9 aa, Homo Sapiens
HESKLMQIT

SEQ ID NO: 794507 - protein, 9 aa, Homo Sapiens
HLLPLQTSA

SEQ ID NO: 794508 - protein, 9 aa, Homo Sapiens
DEESECQEK

SEQ ID NO: 794509 - protein, 9 aa, Homo Sapiens
PTKAPVYDW

SEQ ID NO: 794510 - protein, 9 aa, Homo Sapiens
KDTKGVSEE

SEQ ID NO: 794511 - protein, 9 aa, Homo Sapiens
NMVTAAPLV

SEQ ID NO: 794512 - protein, 9 aa, Homo Sapiens
ALGTLAVFS

SEQ ID NO: 794513 - protein, 9 aa, Homo Sapiens
ARTLHATVS

SEQ ID NO: 794514 - protein, 9 aa, Homo Sapiens
LIYSRKLHP

SEQ ID NO: 794515 - protein, 9 aa, Homo Sapiens
PQLPVKHLR

SEQ ID NO: 794516 - protein, 9 aa, Homo Sapiens
LSPLVMPSQ

SEQ ID NO: 794517 - protein, 9 aa, Homo Sapiens
LLLLFMFIC

SEQ ID NO: 794518 - protein, 9 aa, Homo Sapiens
KIGVTLSNA

SEQ ID NO: 794519 - protein, 9 aa, Homo Sapiens
SLIYSRKLH

SEQ ID NO: 794520 - protein, 9 aa, Homo Sapiens
LQTSARTLH

SEQ ID NO: 794521 - protein, 9 aa, Homo Sapiens
VHKGRKPFE

SEQ ID NO: 794522 - protein, 9 aa, Homo Sapiens
PSLKKGDVS

SEQ ID NO: 794523 - protein, 9 aa, Homo Sapiens
SHESKLMQI

SEQ ID NO: 794524 - protein, 9 aa, Homo Sapiens
FFTSTMRNH

SEQ ID NO: 794525 - protein, 9 aa, Homo Sapiens
AAPLVLPED

SEQ ID NO: 794526 - protein, 9 aa, Homo Sapiens
IVIKHKKVY

SEQ ID NO: 794527 - protein, 9 aa, Homo Sapiens
DPDSGLEHC

SEQ ID NO: 794528 - protein, 9 aa, Homo Sapiens
SKPDGSIRW

SEQ ID NO: 794529 - protein, 9 aa, Homo Sapiens
LHQNVREDL

SEQ ID NO: 794530 - protein, 9 aa, Homo Sapiens
LVPRPVGAG

SEQ ID NO: 794531 - protein, 9 aa, Homo Sapiens
EREIGPFQL

SEQ ID NO: 794532 - protein, 9 aa, Homo Sapiens
SSHLLGSLH

SEQ ID NO: 794533 - protein, 9 aa, Homo Sapiens
TVESGLPSG

SEQ ID NO: 794534 - protein, 9 aa, Homo Sapiens
ESSPDLKKY

SEQ ID NO: 794535 - protein, 9 aa, Homo Sapiens
RTLHATVSG

SEQ ID NO: 794536 - protein, 9 aa, Homo Sapiens
FSKNSIVIK

SEQ ID NO: 794537 - protein, 9 aa, Homo Sapiens
YKTEGRAEH

SEQ ID NO: 794538 - protein, 9 aa, Homo Sapiens
IQEEGADEE

SEQ ID NO: 794539 - protein, 9 aa, Homo Sapiens
MAGDTHLGG

SEQ ID NO: 794540 - protein, 9 aa, Homo Sapiens
KYIKSPVTS

SEQ ID NO: 794541 - protein, 9 aa, Homo Sapiens
AACQVSRFP

SEQ ID NO: 794542 - protein, 9 aa, Homo Sapiens
TLSRCIKDI

SEQ ID NO: 794543 - protein, 9 aa, Homo Sapiens
NRVPALPDV

SEQ ID NO: 794544 - protein, 9 aa, Homo Sapiens
NSIVIKHKK

SEQ ID NO: 794545 - protein, 9 aa, Homo Sapiens
QKQQSLIHT

SEQ ID NO: 794546 - protein, 9 aa, Homo Sapiens
GLTVESGLP

SEQ ID NO: 794547 - protein, 9 aa, Homo Sapiens
DSGLEHCAH

SEQ ID NO: 794548 - protein, 9 aa, Homo Sapiens
RSPRLSALP

SEQ ID NO: 794549 - protein, 9 aa, Homo Sapiens
ELEREREIG

SEQ ID NO: 794550 - protein, 9 aa, Homo Sapiens
CKLEYNANT

SEQ ID NO: 794551 - protein, 9 aa, Homo Sapiens
SQNTLCEAS

SEQ ID NO: 794552 - protein, 9 aa, Homo Sapiens
KDPFQMCPS

SEQ ID NO: 794553 - protein, 9 aa, Homo Sapiens
AGENSQNTL

SEQ ID NO: 794554 - protein, 9 aa, Homo Sapiens
FISKERAGA

SEQ ID NO: 794555 - protein, 9 aa, Homo Sapiens
WKIKSSKNS

SEQ ID NO: 794556 - protein, 9 aa, Homo Sapiens
LFFGRFCSP

SEQ ID NO: 794557 - protein, 9 aa, Homo Sapiens
LLLFMFICS

SEQ ID NO: 794558 - protein, 9 aa, Homo Sapiens
WLCLGLCSL

SEQ ID NO: 794559 - protein, 9 aa, Homo Sapiens
DLALGTLAV

SEQ ID NO: 794560 - protein, 9 aa, Homo Sapiens
AAGENSQNT

SEQ ID NO: 794561 - protein, 9 aa, Homo Sapiens
IINLKIKLF

SEQ ID NO: 794562 - protein, 9 aa, Homo Sapiens
CIKDIVGFA

SEQ ID NO: 794563 - protein, 9 aa, Homo Sapiens
IEFMCKLEY

SEQ ID NO: 794564 - protein, 9 aa, Homo Sapiens
GSSHLLGSL

SEQ ID NO: 794565 - protein, 9 aa, Homo Sapiens
LKQGSHAQH

SEQ ID NO: 794566 - protein, 9 aa, Homo Sapiens
PNCADSSKP

SEQ ID NO: 794567 - protein, 9 aa, Homo Sapiens
QLEKIGVTL

SEQ ID NO: 794568 - protein, 9 aa, Homo Sapiens
GKIINLKIK

SEQ ID NO: 794569 - protein, 9 aa, Homo Sapiens
PDSGLEHCA

SEQ ID NO: 794570 - protein, 9 aa, Homo Sapiens
LMQITTELA

SEQ ID NO: 794571 - protein, 9 aa, Homo Sapiens
QPQFPLPSG

SEQ ID NO: 794572 - protein, 9 aa, Homo Sapiens
EGQIGALLP

SEQ ID NO: 794573 - protein, 9 aa, Homo Sapiens
VSGTELTGS

SEQ ID NO: 794574 - protein, 9 aa, Homo Sapiens
LLVLASSFI

SEQ ID NO: 794575 - protein, 9 aa, Homo Sapiens
LDSLDSLSH

SEQ ID NO: 794576 - protein, 9 aa, Homo Sapiens
RKGSSHLLG

SEQ ID NO: 794577 - protein, 9 aa, Homo Sapiens
YGLDLDSGA

SEQ ID NO: 794578 - protein, 9 aa, Homo Sapiens
AGTPGPRAL

SEQ ID NO: 794579 - protein, 9 aa, Homo Sapiens
GVTRSPRLS

SEQ ID NO: 794580 - protein, 9 aa, Homo Sapiens
RKLHPGSLG

SEQ ID NO: 794581 - protein, 9 aa, Homo Sapiens
SKNSIVIKH

SEQ ID NO: 794582 - protein, 9 aa, Homo Sapiens
EYNANTSVL

SEQ ID NO: 794583 - protein, 9 aa, Homo Sapiens
ECQEKSGTR

SEQ ID NO: 794584 - protein, 9 aa, Homo Sapiens
KKTIESSSN

SEQ ID NO: 794585 - protein, 9 aa, Homo Sapiens
DWPSCGEIT

SEQ ID NO: 794586 - protein, 9 aa, Homo Sapiens
QLEVALVGA

SEQ ID NO: 794587 - protein, 9 aa, Homo Sapiens
QRKTPIQIL

SEQ ID NO: 794588 - protein, 9 aa, Homo Sapiens
TKAPVYDWS

SEQ ID NO: 794589 - protein, 9 aa, Homo Sapiens
VSYKSFTFV

SEQ ID NO: 794590 - protein, 9 aa, Homo Sapiens
TVTNSDSST

SEQ ID NO: 794591 - protein, 9 aa, Homo Sapiens
LQHFTDCKR

SEQ ID NO: 794592 - protein, 9 aa, Homo Sapiens
TVGSGLTVE

SEQ ID NO: 794593 - protein, 9 aa, Homo Sapiens
PDLKKYIKS

SEQ ID NO: 794594 - protein, 9 aa, Homo Sapiens
YILTHIGNG

SEQ ID NO: 794595 - protein, 9 aa, Homo Sapiens
GNLLQHFTD

SEQ ID NO: 794596 - protein, 9 aa, Homo Sapiens
KKKKLAFSQ

SEQ ID NO: 794597 - protein, 9 aa, Homo Sapiens
SLPTKAPVY

SEQ ID NO: 794598 - protein, 9 aa, Homo Sapiens
QNVREDLSV

SEQ ID NO: 794599 - protein, 9 aa, Homo Sapiens
KVPEMSVPD

SEQ ID NO: 794600 - protein, 9 aa, Homo Sapiens
FQYNKYVEV

SEQ ID NO: 794601 - protein, 9 aa, Homo Sapiens
LTAIVQKQQ

SEQ ID NO: 794602 - protein, 9 aa, Homo Sapiens
QTSCETPGV

SEQ ID NO: 794603 - protein, 9 aa, Homo Sapiens
FCRLHRREG

SEQ ID NO: 794604 - protein, 9 aa, Homo Sapiens
FTVTARDAD

SEQ ID NO: 794605 - protein, 9 aa, Homo Sapiens
TSTVGSGLT

SEQ ID NO: 794606 - protein, 9 aa, Homo Sapiens
KIINLKIKL

SEQ ID NO: 794607 - protein, 9 aa, Homo Sapiens
VANMYFLII

SEQ ID NO: 794608 - protein, 9 aa, Homo Sapiens
TPSSGASTV

SEQ ID NO: 794609 - protein, 9 aa, Homo Sapiens
NISKDSKRE

SEQ ID NO: 794610 - protein, 9 aa, Homo Sapiens
LNKVEGDNI

SEQ ID NO: 794611 - protein, 9 aa, Homo Sapiens
ISTEDIQEQ

SEQ ID NO: 794612 - protein, 9 aa, Homo Sapiens
EFMCKLEYN

SEQ ID NO: 794613 - protein, 9 aa, Homo Sapiens
SSPDLKKYI

SEQ ID NO: 794614 - protein, 9 aa, Homo Sapiens
SPENVRIIN

SEQ ID NO: 794615 - protein, 9 aa, Homo Sapiens
FTASKPDGS

SEQ ID NO: 794616 - protein, 9 aa, Homo Sapiens
LVANMYFLI

SEQ ID NO: 794617 - protein, 9 aa, Homo Sapiens
TPESTPQLP

SEQ ID NO: 794618 - protein, 9 aa, Homo Sapiens
ERLEAMIPN

SEQ ID NO: 794619 - protein, 9 aa, Homo Sapiens
ALVGASPRG

SEQ ID NO: 794620 - protein, 9 aa, Homo Sapiens
YGCKECGKT

SEQ ID NO: 794621 - protein, 9 aa, Homo Sapiens
EESECQEKS

SEQ ID NO: 794622 - protein, 9 aa, Homo Sapiens
YERLEAMIP

SEQ ID NO: 794623 - protein, 9 aa, Homo Sapiens
TRSPRLSAL

SEQ ID NO: 794624 - protein, 9 aa, Homo Sapiens
EGHPGNSPW

SEQ ID NO: 794625 - protein, 9 aa, Homo Sapiens
VDISTEDIQ

SEQ ID NO: 794626 - protein, 9 aa, Homo Sapiens
LTGSRGCST

SEQ ID NO: 794627 - protein, 9 aa, Homo Sapiens
REALKTQLK

SEQ ID NO: 794628 - protein, 9 aa, Homo Sapiens
RLEAMIPNC

SEQ ID NO: 794629 - protein, 9 aa, Homo Sapiens
SSYGLDLDS

SEQ ID NO: 794630 - protein, 9 aa, Homo Sapiens
PKSLPTKAP

SEQ ID NO: 794631 - protein, 9 aa, Homo Sapiens
NCGNNFRNS

SEQ ID NO: 794632 - protein, 9 aa, Homo Sapiens
LDSGAPGTP

SEQ ID NO: 794633 - protein, 9 aa, Homo Sapiens
GGAGTPGPR

SEQ ID NO: 794634 - protein, 9 aa, Homo Sapiens
KLVTDKKNK

SEQ ID NO: 794635 - protein, 9 aa, Homo Sapiens
EDKNYILTH

SEQ ID NO: 794636 - protein, 9 aa, Homo Sapiens
CAHVLEKGG

SEQ ID NO: 794637 - protein, 9 aa, Homo Sapiens
SDVAEKLLD

SEQ ID NO: 794638 - protein, 9 aa, Homo Sapiens
RCIKDIVGF

SEQ ID NO: 794639 - protein, 9 aa, Homo Sapiens
LLGSLHTCK

SEQ ID NO: 794640 - protein, 9 aa, Homo Sapiens
QIQAKDTKG

SEQ ID NO: 794641 - protein, 9 aa, Homo Sapiens
TVSGTELTG

SEQ ID NO: 794642 - protein, 9 aa, Homo Sapiens
GLSVSSSFS

SEQ ID NO: 794643 - protein, 9 aa, Homo Sapiens
AEHLEATEY

SEQ ID NO: 794644 - protein, 9 aa, Homo Sapiens
LSFTSLDKI

SEQ ID NO: 794645 - protein, 9 aa, Homo Sapiens
KLPKVPEMS

SEQ ID NO: 794646 - protein, 9 aa, Homo Sapiens
ELTGSRGCS

SEQ ID NO: 794647 - protein, 9 aa, Homo Sapiens
DKKNKAAKW

SEQ ID NO: 794648 - protein, 9 aa, Homo Sapiens
TIWKIKSSK

SEQ ID NO: 794649 - protein, 9 aa, Homo Sapiens
CHIFTVTAR

SEQ ID NO: 794650 - protein, 9 aa, Homo Sapiens
QHFTDCKRG

SEQ ID NO: 794651 - protein, 9 aa, Homo Sapiens
LEAMIPNCA

SEQ ID NO: 794652 - protein, 9 aa, Homo Sapiens
AFSQDGAES

SEQ ID NO: 794653 - protein, 9 aa, Homo Sapiens
TSTMRNHHS

SEQ ID NO: 794654 - protein, 9 aa, Homo Sapiens
EREALKTQL

SEQ ID NO: 794655 - protein, 9 aa, Homo Sapiens
SVSSSFSSG

SEQ ID NO: 794656 - protein, 9 aa, Homo Sapiens
VGASPRGNR

SEQ ID NO: 794657 - protein, 9 aa, Homo Sapiens
CGRGLGGVH

SEQ ID NO: 794658 - protein, 9 aa, Homo Sapiens
LRYLGVTRS

SEQ ID NO: 794659 - protein, 9 aa, Homo Sapiens
KGSSHLLGS

SEQ ID NO: 794660 - protein, 9 aa, Homo Sapiens
MCPSAGSQP

SEQ ID NO: 794661 - protein, 9 aa, Homo Sapiens
SCGEITFRD

SEQ ID NO: 794662 - protein, 9 aa, Homo Sapiens
LEYNANTSV

SEQ ID NO: 794663 - protein, 9 aa, Homo Sapiens
NYILTHIGN

SEQ ID NO: 794664 - protein, 9 aa, Homo Sapiens
FTFVQAGQD

SEQ ID NO: 794665 - protein, 9 aa, Homo Sapiens
NVREDLSVG

SEQ ID NO: 794666 - protein, 9 aa, Homo Sapiens
ILALSFTSL

SEQ ID NO: 794667 - protein, 9 aa, Homo Sapiens
SRFSILALS

SEQ ID NO: 794668 - protein, 9 aa, Homo Sapiens
KQLEKIGVT

SEQ ID NO: 794669 - protein, 9 aa, Homo Sapiens
HAQHVKHYW

SEQ ID NO: 794670 - protein, 9 aa, Homo Sapiens
GALLPNMVT

SEQ ID NO: 794671 - protein, 9 aa, Homo Sapiens
STSGNLLQH

SEQ ID NO: 794672 - protein, 9 aa, Homo Sapiens
IQAKDTKGV

SEQ ID NO: 794673 - protein, 9 aa, Homo Sapiens
ILPSLKKGD

SEQ ID NO: 794674 - protein, 9 aa, Homo Sapiens
HATVSGTEL

SEQ ID NO: 794675 - protein, 9 aa, Homo Sapiens
LALNKVEGD

SEQ ID NO: 794676 - protein, 9 aa, Homo Sapiens
RDVDISTED

SEQ ID NO: 794677 - protein, 9 aa, Homo Sapiens
NSDDEESEC

SEQ ID NO: 794678 - protein, 9 aa, Homo Sapiens
CGNNFRNSS

SEQ ID NO: 794679 - protein, 9 aa, Homo Sapiens
TTLSKIFQY

SEQ ID NO: 794680 - protein, 9 aa, Homo Sapiens
REGQIGALL

SEQ ID NO: 794681 - protein, 9 aa, Homo Sapiens
FKLVTDKKN

SEQ ID NO: 794682 - protein, 9 aa, Homo Sapiens
LSSTLSRCI

SEQ ID NO: 794683 - protein, 9 aa, Homo Sapiens
NRFQTATVT

SEQ ID NO: 794684 - protein, 9 aa, Homo Sapiens
RGLGGVHKG

SEQ ID NO: 794685 - protein, 9 aa, Homo Sapiens
ACQVSRFPH

SEQ ID NO: 794686 - protein, 9 aa, Homo Sapiens
FLNLVDLSE

SEQ ID NO: 794687 - protein, 9 aa, Homo Sapiens
RGCSTSGNL

SEQ ID NO: 794688 - protein, 9 aa, Homo Sapiens
FTSTMRNHH

SEQ ID NO: 794689 - protein, 9 aa, Homo Sapiens
LSPENVRII

SEQ ID NO: 794690 - protein, 9 aa, Homo Sapiens
NMPSMRRSL

SEQ ID NO: 794691 - protein, 9 aa, Homo Sapiens
INVAKKTIE

SEQ ID NO: 794692 - protein, 9 aa, Homo Sapiens
HFISKERAG

SEQ ID NO: 794693 - protein, 9 aa, Homo Sapiens
KTIESSSND

SEQ ID NO: 794694 - protein, 9 aa, Homo Sapiens
HVCLLLLQL

SEQ ID NO: 794695 - protein, 9 aa, Homo Sapiens
GSGLTVESG

SEQ ID NO: 794696 - protein, 9 aa, Homo Sapiens
TLHATVSGT

SEQ ID NO: 794697 - protein, 9 aa, Homo Sapiens
KSMAGDTHL

SEQ ID NO: 794698 - protein, 9 aa, Homo Sapiens
LPSGAQQCP

SEQ ID NO: 794699 - protein, 9 aa, Homo Sapiens
LGSLHTCKL

SEQ ID NO: 794700 - protein, 9 aa, Homo Sapiens
TKKKKKKLA

SEQ ID NO: 794701 - protein, 9 aa, Homo Sapiens
YNKYVEVFH

SEQ ID NO: 794702 - protein, 9 aa, Homo Sapiens
SGASTVTNS

SEQ ID NO: 794703 - protein, 9 aa, Homo Sapiens
QLPVKHLRA

SEQ ID NO: 794704 - protein, 9 aa, Homo Sapiens
PKTHISNNC

SEQ ID NO: 794705 - protein, 9 aa, Homo Sapiens
ASTVTNSDS

SEQ ID NO: 794706 - protein, 9 aa, Homo Sapiens
ADEELEETS

SEQ ID NO: 794707 - protein, 9 aa, Homo Sapiens
CFCRLHRRE

SEQ ID NO: 794708 - protein, 9 aa, Homo Sapiens
EEREALKTQ

SEQ ID NO: 794709 - protein, 9 aa, Homo Sapiens
QGQLKELKD

SEQ ID NO: 794710 - protein, 9 aa, Homo Sapiens
SYGLDLDSG

SEQ ID NO: 794711 - protein, 9 aa, Homo Sapiens
KLHPGSLGL

SEQ ID NO: 794712 - protein, 9 aa, Homo Sapiens
FMFICSSSC

SEQ ID NO: 794713 - protein, 9 aa, Homo Sapiens
INLKIKLFM

SEQ ID NO: 794714 - protein, 9 aa, Homo Sapiens
PAALHELSP

SEQ ID NO: 794715 - protein, 9 aa, Homo Sapiens
WPSCGEITF

SEQ ID NO: 794716 - protein, 9 aa, Homo Sapiens
EPTQTSCET

SEQ ID NO: 794717 - protein, 9 aa, Homo Sapiens
TIQEEGADE

SEQ ID NO: 794718 - protein, 9 aa, Homo Sapiens
MCKLEYNAN

SEQ ID NO: 794719 - protein, 9 aa, Homo Sapiens
ATVSGTELT

SEQ ID NO: 794720 - protein, 9 aa, Homo Sapiens
VHIPLKNLQ

SEQ ID NO: 794721 - protein, 9 aa, Homo Sapiens
HFTDCKRGT

SEQ ID NO: 794722 - protein, 9 aa, Homo Sapiens
PFQMCPSAG

SEQ ID NO: 794723 - protein, 9 aa, Homo Sapiens
EWNVNEMYL

SEQ ID NO: 794724 - protein, 9 aa, Homo Sapiens
AMIPNCADS

SEQ ID NO: 794725 - protein, 9 aa, Homo Sapiens
CEVAAGENS

SEQ ID NO: 794726 - protein, 9 aa, Homo Sapiens
SKLVPRPVG

SEQ ID NO: 794727 - protein, 9 aa, Homo Sapiens
EHLEATEYL

SEQ ID NO: 794728 - protein, 9 aa, Homo Sapiens
RTICHNISK

SEQ ID NO: 794729 - protein, 9 aa, Homo Sapiens
GDKAYEWNV

SEQ ID NO: 794730 - protein, 9 aa, Homo Sapiens
QEVPRAFLN

SEQ ID NO: 794731 - protein, 9 aa, Homo Sapiens
PLPSGAQQC

SEQ ID NO: 794732 - protein, 9 aa, Homo Sapiens
TICHNISKD

SEQ ID NO: 794733 - protein, 9 aa, Homo Sapiens
SRFPHLLPL

SEQ ID NO: 794734 - protein, 9 aa, Homo Sapiens
DLDSGAPGT

SEQ ID NO: 794735 - protein, 9 aa, Homo Sapiens
AQHVKHYWY

SEQ ID NO: 794736 - protein, 9 aa, Homo Sapiens
PRPVGAGHV

SEQ ID NO: 794737 - protein, 9 aa, Homo Sapiens
CGLLVLASS

SEQ ID NO: 794738 - protein, 9 aa, Homo Sapiens
CGEITFRDY

SEQ ID NO: 794739 - protein, 9 aa, Homo Sapiens
GDVSIYYVS

SEQ ID NO: 794740 - protein, 9 aa, Homo Sapiens
STIWKIKSS

SEQ ID NO: 794741 - protein, 9 aa, Homo Sapiens
EQQIQAKDT

SEQ ID NO: 794742 - protein, 9 aa, Homo Sapiens
HPLREGACS

SEQ ID NO: 794743 - protein, 9 aa, Homo Sapiens
HALSYNQGQ

SEQ ID NO: 794744 - protein, 9 aa, Homo Sapiens
REREIGPFQ

SEQ ID NO: 794745 - protein, 9 aa, Homo Sapiens
LQGGAGTPG

SEQ ID NO: 794746 - protein, 9 aa, Homo Sapiens
VTARDADAQ

SEQ ID NO: 794747 - protein, 9 aa, Homo Sapiens
SFSSGGACG

SEQ ID NO: 794748 - protein, 9 aa, Homo Sapiens
VPRAFLNLV

SEQ ID NO: 794749 - protein, 9 aa, Homo Sapiens
EILPSLKKG

SEQ ID NO: 794750 - protein, 9 aa, Homo Sapiens
ALLPNMVTA

SEQ ID NO: 794751 - protein, 9 aa, Homo Sapiens
RPALPWLCL

SEQ ID NO: 794752 - protein, 9 aa, Homo Sapiens
HRREGQIGA

SEQ ID NO: 794753 - protein, 9 aa, Homo Sapiens
SHAQHVKHY

SEQ ID NO: 794754 - protein, 9 aa, Homo Sapiens
EVKSMAGDT

SEQ ID NO: 794755 - protein, 9 aa, Homo Sapiens
AYEWNVNEM

SEQ ID NO: 794756 - protein, 9 aa, Homo Sapiens
QFPLPSGAQ

SEQ ID NO: 794757 - protein, 9 aa, Homo Sapiens
KSFSKNSIV

SEQ ID NO: 794758 - protein, 9 aa, Homo Sapiens
VAQLATFAS

SEQ ID NO: 794759 - protein, 9 aa, Homo Sapiens
SKERAGALM

SEQ ID NO: 794760 - protein, 9 aa, Homo Sapiens
VECVGNQMG

SEQ ID NO: 794761 - protein, 9 aa, Homo Sapiens
WCDPISGRA

SEQ ID NO: 794762 - protein, 9 aa, Homo Sapiens
TRDVDISTE

SEQ ID NO: 794763 - protein, 9 aa, Homo Sapiens
QVSRFPHLL

SEQ ID NO: 794764 - protein, 9 aa, Homo Sapiens
GADEELEET

SEQ ID NO: 794765 - protein, 9 aa, Homo Sapiens
GPAGERGRH

SEQ ID NO: 794766 - protein, 9 aa, Homo Sapiens
SPDLKKYIK

SEQ ID NO: 794767 - protein, 9 aa, Homo Sapiens
CDPISGRAT

SEQ ID NO: 794768 - protein, 9 aa, Homo Sapiens
LPLQTSART

SEQ ID NO: 794769 - protein, 9 aa, Homo Sapiens
CQVSRFPHL

SEQ ID NO: 794770 - protein, 9 aa, Homo Sapiens
VQKQQSLIH

SEQ ID NO: 794771 - protein, 9 aa, Homo Sapiens
TIESSSNDL

SEQ ID NO: 794772 - protein, 9 aa, Homo Sapiens
KLAFSQDGA

SEQ ID NO: 794773 - protein, 9 aa, Homo Sapiens
VALVGASPR

SEQ ID NO: 794774 - protein, 9 aa, Homo Sapiens
RLHRREGQI

SEQ ID NO: 794775 - protein, 9 aa, Homo Sapiens
FLTVMLLAL

SEQ ID NO: 794776 - protein, 9 aa, Homo Sapiens
VSSDVAEKL

SEQ ID NO: 794777 - protein, 9 aa, Homo Sapiens
QSYLHQNVR

SEQ ID NO: 794778 - protein, 9 aa, Homo Sapiens
NVNEMYLFR

SEQ ID NO: 794779 - protein, 9 aa, Homo Sapiens
NTCLLVANM

SEQ ID NO: 794780 - protein, 9 aa, Homo Sapiens
PKVPEMSVP

SEQ ID NO: 794781 - protein, 9 aa, Homo Sapiens
LHELSPLVM

SEQ ID NO: 794782 - protein, 9 aa, Homo Sapiens
LLLLLFMFI

SEQ ID NO: 794783 - protein, 9 aa, Homo Sapiens
LHRREGQIG

SEQ ID NO: 794784 - protein, 9 aa, Homo Sapiens
WNVNEMYLF

SEQ ID NO: 794785 - protein, 9 aa, Homo Sapiens
LLLNFHVCL

SEQ ID NO: 794786 - protein, 9 aa, Homo Sapiens
GQIGALLPN

SEQ ID NO: 794787 - protein, 9 aa, Homo Sapiens
MASISYDYC

SEQ ID NO: 794788 - protein, 9 aa, Homo Sapiens
TEGRAEHLE

SEQ ID NO: 794789 - protein, 9 aa, Homo Sapiens
ILFFGRFCS

SEQ ID NO: 794790 - protein, 9 aa, Homo Sapiens
LLLLLLFMF

SEQ ID NO: 794791 - protein, 9 aa, Homo Sapiens
FMCKLEYNA

SEQ ID NO: 794792 - protein, 9 aa, Homo Sapiens
RFSILALSF

SEQ ID NO: 794793 - protein, 9 aa, Homo Sapiens
TATVTEKGV

SEQ ID NO: 794794 - protein, 9 aa, Homo Sapiens
TSCETPGVP

SEQ ID NO: 794795 - protein, 9 aa, Homo Sapiens
DISQIKGEM

SEQ ID NO: 794796 - protein, 9 aa, Homo Sapiens
HLLGSLHTC

SEQ ID NO: 794797 - protein, 9 aa, Homo Sapiens
ALLLLLLFM

SEQ ID NO: 794798 - protein, 9 aa, Homo Sapiens
HPGSLGLER

SEQ ID NO: 794799 - protein, 9 aa, Homo Sapiens
FPHLLPLQT

SEQ ID NO: 794800 - protein, 9 aa, Homo Sapiens
KGEMEDIIQ

SEQ ID NO: 794801 - protein, 9 aa, Homo Sapiens
MLLALNKVE

SEQ ID NO: 794802 - protein, 9 aa, Homo Sapiens
SSSSSSTIW

SEQ ID NO: 794803 - protein, 9 aa, Homo Sapiens
IFTVTARDA

SEQ ID NO: 794804 - protein, 9 aa, Homo Sapiens
SFSKNSIVI

SEQ ID NO: 794805 - protein, 9 aa, Homo Sapiens
SHPLREGAC

SEQ ID NO: 794806 - protein, 9 aa, Homo Sapiens
SGNLLQHFT

SEQ ID NO: 794807 - protein, 9 aa, Homo Sapiens
KKLAFSQDG

SEQ ID NO: 794808 - protein, 9 aa, Homo Sapiens
APLVLPEDV

SEQ ID NO: 794809 - protein, 9 aa, Homo Sapiens
SLKKGDVSI

SEQ ID NO: 794810 - protein, 9 aa, Homo Sapiens
LEKIGVTLS

SEQ ID NO: 794811 - protein, 9 aa, Homo Sapiens
LPGPAGERG

SEQ ID NO: 794812 - protein, 9 aa, Homo Sapiens
TAIVQKQQS

SEQ ID NO: 794813 - protein, 9 aa, Homo Sapiens
PALPWLCLG

SEQ ID NO: 794814 - protein, 9 aa, Homo Sapiens
DGAESKEGS

SEQ ID NO: 794815 - protein, 9 aa, Homo Sapiens
SDDEESECQ

SEQ ID NO: 794816 - protein, 9 aa, Homo Sapiens
PWLCLGLCS

SEQ ID NO: 794817 - protein, 9 aa, Homo Sapiens
CHNISKDSK

SEQ ID NO: 794818 - protein, 9 aa, Homo Sapiens
LFMFICSSS

SEQ ID NO: 794819 - protein, 9 aa, Homo Sapiens
EGRAEHLEA

SEQ ID NO: 794820 - protein, 9 aa, Homo Sapiens
DSRFSILAL

SEQ ID NO: 794821 - protein, 9 aa, Homo Sapiens
ALSYNQGQL

SEQ ID NO: 794822 - protein, 9 aa, Homo Sapiens
FWCDPISGR

SEQ ID NO: 794823 - protein, 9 aa, Homo Sapiens
ISKERAGAL

SEQ ID NO: 794824 - protein, 9 aa, Homo Sapiens
PAACQVSRF

SEQ ID NO: 794825 - protein, 9 aa, Homo Sapiens
AVSSDVAEK

SEQ ID NO: 794826 - protein, 9 aa, Homo Sapiens
CLLVANMYF

SEQ ID NO: 794827 - protein, 9 aa, Homo Sapiens
DSLDSLSHA

SEQ ID NO: 794828 - protein, 9 aa, Homo Sapiens
LPSLKKGDV

SEQ ID NO: 794829 - protein, 9 aa, Homo Sapiens
PVFHSNTLQ

SEQ ID NO: 794830 - protein, 9 aa, Homo Sapiens
SFIIFWFSL

SEQ ID NO: 794831 - protein, 9 aa, Homo Sapiens
SSGASTVTN

SEQ ID NO: 794832 - protein, 9 aa, Homo Sapiens
LALGTLAVF

SEQ ID NO: 794833 - protein, 9 aa, Homo Sapiens
IGALLPNMV

SEQ ID NO: 794834 - protein, 9 aa, Homo Sapiens
LASSFIIFW

SEQ ID NO: 794835 - protein, 9 aa, Homo Sapiens
QYNKYVEVF

SEQ ID NO: 794836 - protein, 9 aa, Homo Sapiens
LLPLQTSAR

SEQ ID NO: 794837 - protein, 9 aa, Homo Sapiens
RFQTATVTE

SEQ ID NO: 794838 - protein, 9 aa, Homo Sapiens
SMRRSLATL

SEQ ID NO: 794839 - protein, 9 aa, Homo Sapiens
NVRIINMYK

SEQ ID NO: 794840 - protein, 9 aa, Homo Sapiens
LKSHESKLM

SEQ ID NO: 794841 - protein, 9 aa, Homo Sapiens
ECVGNQMGV

SEQ ID NO: 794842 - protein, 9 aa, Homo Sapiens
KVSKDPFQM

SEQ ID NO: 794843 - protein, 9 aa, Homo Sapiens
QGGAGTPGP

SEQ ID NO: 794844 - protein, 9 aa, Homo Sapiens
SPLVMPSQA

SEQ ID NO: 794845 - protein, 9 aa, Homo Sapiens
SFTFVQAGQ

SEQ ID NO: 794846 - protein, 9 aa, Homo Sapiens
STLSRCIKD

SEQ ID NO: 794847 - protein, 9 aa, Homo Sapiens
HCAHVLEKG

SEQ ID NO: 794848 - protein, 9 aa, Homo Sapiens
VTNSDSSTT

SEQ ID NO: 794849 - protein, 9 aa, Homo Sapiens
QEEGADEEL

SEQ ID NO: 794850 - protein, 9 aa, Homo Sapiens
PENVRIINM

SEQ ID NO: 794851 - protein, 9 aa, Homo Sapiens
TASKPDGSI

SEQ ID NO: 794852 - protein, 9 aa, Homo Sapiens
SVPDVHLPE

SEQ ID NO: 794853 - protein, 9 aa, Homo Sapiens
DSLSHALGV

SEQ ID NO: 794854 - protein, 9 aa, Homo Sapiens
KKSFSKNSI

SEQ ID NO: 794855 - protein, 9 aa, Homo Sapiens
TMRNHHSRV

SEQ ID NO: 794856 - protein, 9 aa, Homo Sapiens
QGSHAQHVK

SEQ ID NO: 794857 - protein, 9 aa, Homo Sapiens
HISNNCGNN

SEQ ID NO: 794858 - protein, 9 aa, Homo Sapiens
STPQLPVKH

SEQ ID NO: 794859 - protein, 9 aa, Homo Sapiens
AKCGLSPEN

SEQ ID NO: 794860 - protein, 9 aa, Homo Sapiens
KNKAAKWIL

SEQ ID NO: 794861 - protein, 9 aa, Homo Sapiens
EQSYLHQNV

SEQ ID NO: 794862 - protein, 9 aa, Homo Sapiens
IFEVKSMAG

SEQ ID NO: 794863 - protein, 9 aa, Homo Sapiens
RREGQIGAL

SEQ ID NO: 794864 - protein, 9 aa, Homo Sapiens
IPSGFVTSS

SEQ ID NO: 794865 - protein, 9 aa, Homo Sapiens
PLQTSARTL

SEQ ID NO: 794866 - protein, 9 aa, Homo Sapiens
GRATLYWYR

SEQ ID NO: 794867 - protein, 9 aa, Homo Sapiens
EELEETSET

SEQ ID NO: 794868 - protein, 9 aa, Homo Sapiens
LDSLSHALG

SEQ ID NO: 794869 - protein, 9 aa, Homo Sapiens
VLASSFIIF

SEQ ID NO: 794870 - protein, 9 aa, Homo Sapiens
LTVMLLALN

SEQ ID NO: 794871 - protein, 9 aa, Homo Sapiens
KAPKSLPTK

SEQ ID NO: 794872 - protein, 9 aa, Homo Sapiens
LSRCIKDIV

SEQ ID NO: 794873 - protein, 9 aa, Homo Sapiens
RFPHLLPLQ

SEQ ID NO: 794874 - protein, 9 aa, Homo Sapiens
KKKLAFSQD

SEQ ID NO: 794875 - protein, 9 aa, Homo Sapiens
TVMLLALNK

SEQ ID NO: 794876 - protein, 9 aa, Homo Sapiens
PSGFVTSSL

SEQ ID NO: 794877 - protein, 9 aa, Homo Sapiens
ERAGALMMP

SEQ ID NO: 794878 - protein, 9 aa, Homo Sapiens
EGACSSQSQ

SEQ ID NO: 794879 - protein, 9 aa, Homo Sapiens
TQTSCETPG

SEQ ID NO: 794880 - protein, 9 aa, Homo Sapiens
AALHELSPL

SEQ ID NO: 794881 - protein, 9 aa, Homo Sapiens
RAEHLEATE

SEQ ID NO: 794882 - protein, 9 aa, Homo Sapiens
MRRSLATLT

SEQ ID NO: 794883 - protein, 9 aa, Homo Sapiens
CPKDWPSCG

SEQ ID NO: 794884 - protein, 9 aa, Homo Sapiens
LSKIFQYNK

SEQ ID NO: 794885 - protein, 9 aa, Homo Sapiens
CNMPSMRRS

SEQ ID NO: 794886 - protein, 9 aa, Homo Sapiens
PTQTSCETP

SEQ ID NO: 794887 - protein, 9 aa, Homo Sapiens
RSKLRVAEG

SEQ ID NO: 794888 - protein, 9 aa, Homo Sapiens
ISNNCGNNF

SEQ ID NO: 794889 - protein, 9 aa, Homo Sapiens
KLEYNANTS

SEQ ID NO: 794890 - protein, 9 aa, Homo Sapiens
EAMIPNCAD

SEQ ID NO: 794891 - protein, 9 aa, Homo Sapiens
ALHELSPLV

SEQ ID NO: 794892 - protein, 9 aa, Homo Sapiens
VTDKKNKAA

SEQ ID NO: 794893 - protein, 9 aa, Homo Sapiens
SSSFSSGGA

SEQ ID NO: 794894 - protein, 9 aa, Homo Sapiens
QQEVPRAFL

SEQ ID NO: 794895 - protein, 9 aa, Homo Sapiens
LLQGGAGTP

SEQ ID NO: 794896 - protein, 9 aa, Homo Sapiens
SVAQLATFA

SEQ ID NO: 794897 - protein, 9 aa, Homo Sapiens
KKKKKKLAF

SEQ ID NO: 794898 - protein, 9 aa, Homo Sapiens
GCSTSGNLL

SEQ ID NO: 794899 - protein, 9 aa, Homo Sapiens
LMIVSYKSF

SEQ ID NO: 794900 - protein, 9 aa, Homo Sapiens
IVQKQQSLI

SEQ ID NO: 794901 - protein, 9 aa, Homo Sapiens
LPNMVTAAP

SEQ ID NO: 794902 - protein, 9 aa, Homo Sapiens
PLVLPEDVH

SEQ ID NO: 794903 - protein, 9 aa, Homo Sapiens
PLREGACSS

SEQ ID NO: 794904 - protein, 9 aa, Homo Sapiens
TLAVFSLAR

SEQ ID NO: 794905 - protein, 9 aa, Homo Sapiens
SGAPGTPEA

SEQ ID NO: 794906 - protein, 9 aa, Homo Sapiens
PAGERGRHG

SEQ ID NO: 794907 - protein, 9 aa, Homo Sapiens
EHCAHVLEK

SEQ ID NO: 794908 - protein, 9 aa, Homo Sapiens
NQGQLKELK

SEQ ID NO: 794909 - protein, 9 aa, Homo Sapiens
TAAPLVLPE

SEQ ID NO: 794910 - protein, 9 aa, Homo Sapiens
LVLASSFII

SEQ ID NO: 794911 - protein, 9 aa, Homo Sapiens
KSFTFVQAG

SEQ ID NO: 794912 - protein, 9 aa, Homo Sapiens
KQQSLIHTQ

SEQ ID NO: 794913 - protein, 9 aa, Homo Sapiens
AESKEGSSC

SEQ ID NO: 794914 - protein, 9 aa, Homo Sapiens
LFFTSTMRN

SEQ ID NO: 794915 - protein, 9 aa, Homo Sapiens
PSCGEITFR

SEQ ID NO: 794916 - protein, 9 aa, Homo Sapiens
GLGGVHKGR

SEQ ID NO: 794917 - protein, 9 aa, Homo Sapiens
YNRFQTATV

SEQ ID NO: 794918 - protein, 9 aa, Homo Sapiens
CSTSGNLLQ

SEQ ID NO: 794919 - protein, 9 aa, Homo Sapiens
GLEHCAHVL

SEQ ID NO: 794920 - protein, 9 aa, Homo Sapiens
KTHISNNCG

SEQ ID NO: 794921 - protein, 9 aa, Homo Sapiens
ENVRIINMY

SEQ ID NO: 794922 - protein, 9 aa, Homo Sapiens
GLSPENVRI

SEQ ID NO: 794923 - protein, 9 aa, Homo Sapiens
IPLKNLQQF

SEQ ID NO: 794924 - protein, 9 aa, Homo Sapiens
TCLLVANMY

SEQ ID NO: 794925 - protein, 9 aa, Homo Sapiens
GSHAQHVKH

SEQ ID NO: 794926 - protein, 9 aa, Homo Sapiens
GTPGPRALA

SEQ ID NO: 794927 - protein, 9 aa, Homo Sapiens
QIGALLPNM

SEQ ID NO: 794928 - protein, 9 aa, Homo Sapiens
ERGRHGKDG

SEQ ID NO: 794929 - protein, 9 aa, Homo Sapiens
QIKGEMEDI

SEQ ID NO: 794930 - protein, 9 aa, Homo Sapiens
QVVECVGNQ

SEQ ID NO: 794931 - protein, 9 aa, Homo Sapiens
KKYIKSPVT

SEQ ID NO: 794932 - protein, 9 aa, Homo Sapiens
LEREREIGP

SEQ ID NO: 794933 - protein, 9 aa, Homo Sapiens
FQMCPSAGS

SEQ ID NO: 794934 - protein, 9 aa, Homo Sapiens
THISNNCGN

SEQ ID NO: 794935 - protein, 9 aa, Homo Sapiens
VGSVAQLAT

SEQ ID NO: 794936 - protein, 9 aa, Homo Sapiens
IKDIVGFAI

SEQ ID NO: 794937 - protein, 9 aa, Homo Sapiens
KKKKKLAFS

SEQ ID NO: 794938 - protein, 9 aa, Homo Sapiens
PRVMVGSVA

SEQ ID NO: 794939 - protein, 9 aa, Homo Sapiens
TGSRGCSTS

SEQ ID NO: 794940 - protein, 9 aa, Homo Sapiens
SKDPFQMCP

SEQ ID NO: 794941 - protein, 9 aa, Homo Sapiens
NLKIKLFMN

SEQ ID NO: 794942 - protein, 9 aa, Homo Sapiens
SYNQGQLKE

SEQ ID NO: 794943 - protein, 9 aa, Homo Sapiens
TSARTLHAT

SEQ ID NO: 794944 - protein, 9 aa, Homo Sapiens
ALSFTSLDK

SEQ ID NO: 794945 - protein, 9 aa, Homo Sapiens
EVALVGASP

SEQ ID NO: 794946 - protein, 9 aa, Homo Sapiens
VAEKLLDCT

SEQ ID NO: 794947 - protein, 9 aa, Homo Sapiens
MRNHHSRVY

SEQ ID NO: 794948 - protein, 9 aa, Homo Sapiens
SPGPAACQV

SEQ ID NO: 794949 - protein, 9 aa, Homo Sapiens
VTRSPRLSA

SEQ ID NO: 794950 - protein, 9 aa, Homo Sapiens
KNLQQFPAF

SEQ ID NO: 794951 - protein, 9 aa, Homo Sapiens
VSRFPHLLP

SEQ ID NO: 794952 - protein, 9 aa, Homo Sapiens
SILALSFTS

SEQ ID NO: 794953 - protein, 9 aa, Homo Sapiens
LHPGSLGLE

SEQ ID NO: 794954 - protein, 9 aa, Homo Sapiens
RGRHGKDGL

SEQ ID NO: 794955 - protein, 9 aa, Homo Sapiens
KKNKAAKWI

SEQ ID NO: 794956 - protein, 9 aa, Homo Sapiens
GASTVTNSD

SEQ ID NO: 794957 - protein, 9 aa, Homo Sapiens
VKSMAGDTH

SEQ ID NO: 794958 - protein, 9 aa, Homo Sapiens
SSTIWKIKS

SEQ ID NO: 794959 - protein, 9 aa, Homo Sapiens
GLLVLASSF

SEQ ID NO: 794960 - protein, 9 aa, Homo Sapiens
TPGPRALAC

SEQ ID NO: 794961 - protein, 9 aa, Homo Sapiens
SLSHALGVL

SEQ ID NO: 794962 - protein, 9 aa, Homo Sapiens
SRQVVECVG

SEQ ID NO: 794963 - protein, 9 aa, Homo Sapiens
RRSLATLTL

SEQ ID NO: 794964 - protein, 9 aa, Homo Sapiens
CRLHRREGQ

SEQ ID NO: 794965 - protein, 9 aa, Homo Sapiens
LNRVPALPD

SEQ ID NO: 794966 - protein, 9 aa, Homo Sapiens
SQDGAESKE

SEQ ID NO: 794967 - protein, 9 aa, Homo Sapiens
PHLLPLQTS

SEQ ID NO: 794968 - protein, 9 aa, Homo Sapiens
DPISGRATL

SEQ ID NO: 794969 - protein, 9 aa, Homo Sapiens
CETPGVPRH

SEQ ID NO: 794970 - protein, 9 aa, Homo Sapiens
ELSPLVMPS

SEQ ID NO: 794971 - protein, 9 aa, Homo Sapiens
SEDKNYILT

SEQ ID NO: 794972 - protein, 9 aa, Homo Sapiens
GERGRHGKD

SEQ ID NO: 794973 - protein, 9 aa, Homo Sapiens
ISGRATLYW

SEQ ID NO: 794974 - protein, 9 aa, Homo Sapiens
PGPAGERGR

SEQ ID NO: 794975 - protein, 9 aa, Homo Sapiens
LCLGLCSLL

SEQ ID NO: 794976 - protein, 9 aa, Homo Sapiens
SHLLGSLHT

SEQ ID NO: 794977 - protein, 9 aa, Homo Sapiens
ELTAIVQKQ

SEQ ID NO: 794978 - protein, 9 aa, Homo Sapiens
DESHPLREG

SEQ ID NO: 794979 - protein, 9 aa, Homo Sapiens
GPAACQVSR

SEQ ID NO: 794980 - protein, 9 aa, Homo Sapiens
YLHQNVRED

SEQ ID NO: 794981 - protein, 9 aa, Homo Sapiens
SGLTVESGL

SEQ ID NO: 794982 - protein, 9 aa, Homo Sapiens
IFQYNKYVE

SEQ ID NO: 794983 - protein, 9 aa, Homo Sapiens
DPAALHELS

SEQ ID NO: 794984 - protein, 9 aa, Homo Sapiens
PHCFCRLHR

SEQ ID NO: 794985 - protein, 9 aa, Homo Sapiens
ILTHIGNGS

SEQ ID NO: 794986 - protein, 9 aa, Homo Sapiens
VVECVGNQM

SEQ ID NO: 794987 - protein, 9 aa, Homo Sapiens
SSSTIWKIK

SEQ ID NO: 794988 - protein, 9 aa, Homo Sapiens
VPEMSVPDV

SEQ ID NO: 794989 - protein, 9 aa, Homo Sapiens
KTEGRAEHL

SEQ ID NO: 794990 - protein, 9 aa, Homo Sapiens
SARTLHATV

SEQ ID NO: 794991 - protein, 9 aa, Homo Sapiens
KCGLSPENV

SEQ ID NO: 794992 - protein, 9 aa, Homo Sapiens
LSVSSSFSS

SEQ ID NO: 794993 - protein, 9 aa, Homo Sapiens
SNTLQRKTP

SEQ ID NO: 794994 - protein, 9 aa, Homo Sapiens
FLLLNFHVC

SEQ ID NO: 794995 - protein, 9 aa, Homo Sapiens
DSGAPGTPE

SEQ ID NO: 794996 - protein, 9 aa, Homo Sapiens
DKNYILTHI

SEQ ID NO: 794997 - protein, 9 aa, Homo Sapiens
GGVHKGRKP

SEQ ID NO: 794998 - protein, 9 aa, Homo Sapiens
CQEKSGTRC

SEQ ID NO: 794999 - protein, 9 aa, Homo Sapiens
VAEGHPGNS

SEQ ID NO: 795000 - protein, 9 aa, Homo Sapiens
YNQGQLKEL

SEQ ID NO: 795001 - protein, 9 aa, Homo Sapiens
LNLVDLSEV

SEQ ID NO: 795002 - protein, 9 aa, Homo Sapiens
QTATVTEKG

SEQ ID NO: 795003 - protein, 9 aa, Homo Sapiens
YKSFTFVQA

SEQ ID NO: 795004 - protein, 9 aa, Homo Sapiens
YIKSPVTSD

SEQ ID NO: 795005 - protein, 9 aa, Homo Sapiens
FNTCLLVAN

SEQ ID NO: 795006 - protein, 9 aa, Homo Sapiens
GVHKGRKPF

SEQ ID NO: 795007 - protein, 9 aa, Homo Sapiens
PSGAQQCPP

SEQ ID NO: 795008 - protein, 9 aa, Homo Sapiens
FSQDGAESK

SEQ ID NO: 795009 - protein, 9 aa, Homo Sapiens
LQRKTPIQI

SEQ ID NO: 795010 - protein, 9 aa, Homo Sapiens
RQVVECVGN

SEQ ID NO: 795011 - protein, 9 aa, Homo Sapiens
EMSVPDVHL

SEQ ID NO: 795012 - protein, 9 aa, Homo Sapiens
KGDVSIYYV

SEQ ID NO: 795013 - protein, 9 aa, Homo Sapiens
MQITTELAE

SEQ ID NO: 795014 - protein, 9 aa, Homo Sapiens
EGADEELEE

SEQ ID NO: 795015 - protein, 9 aa, Homo Sapiens
VNEMYLFRS

SEQ ID NO: 795016 - protein, 9 aa, Homo Sapiens
MAVSSDVAE

SEQ ID NO: 795017 - protein, 9 aa, Homo Sapiens
IPNCADSSK

SEQ ID NO: 795018 - protein, 9 aa, Homo Sapiens
HCFCRLHRR

SEQ ID NO: 795019 - protein, 9 aa, Homo Sapiens
VSKDPFQMC

SEQ ID NO: 795020 - protein, 9 aa, Homo Sapiens
QTSARTLHA

SEQ ID NO: 795021 - protein, 9 aa, Homo Sapiens
VALLLLLLF

SEQ ID NO: 795022 - protein, 9 aa, Homo Sapiens
LSHALGVLE

SEQ ID NO: 795023 - protein, 9 aa, Homo Sapiens
DTKGVSEET

SEQ ID NO: 795024 - protein, 9 aa, Homo Sapiens
EREREIGPF

SEQ ID NO: 795025 - protein, 9 aa, Homo Sapiens
LREGACSSQ

SEQ ID NO: 795026 - protein, 9 aa, Homo Sapiens
KLFFTSTMR

SEQ ID NO: 795027 - protein, 9 aa, Homo Sapiens
PRAFLNLVD

SEQ ID NO: 795028 - protein, 9 aa, Homo Sapiens
SKEGSSCLS

SEQ ID NO: 795029 - protein, 9 aa, Homo Sapiens
ISYDYCRVP

SEQ ID NO: 795030 - protein, 9 aa, Homo Sapiens
NNCGNNFRN

SEQ ID NO: 795031 - protein, 9 aa, Homo Sapiens
TLQRKTPIQ

SEQ ID NO: 795032 - protein, 9 aa, Homo Sapiens
ETDISQIKG

SEQ ID NO: 795033 - protein, 9 aa, Homo Sapiens
QEEREALKT

SEQ ID NO: 795034 - protein, 9 aa, Homo Sapiens
RSYNRFQTA

SEQ ID NO: 795035 - protein, 9 aa, Homo Sapiens
VREDLSVGL

SEQ ID NO: 795036 - protein, 9 aa, Homo Sapiens
MVGSVAQLA

SEQ ID NO: 795037 - protein, 9 aa, Homo Sapiens
LNFHVCLLL

SEQ ID NO: 795038 - protein, 9 aa, Homo Sapiens
PEVHIPLKN

SEQ ID NO: 795039 - protein, 9 aa, Homo Sapiens
RSYCFTASK

SEQ ID NO: 795040 - protein, 9 aa, Homo Sapiens
RYLGVTRSP

SEQ ID NO: 795041 - protein, 9 aa, Homo Sapiens
LRVAEGHPG

SEQ ID NO: 795042 - protein, 9 aa, Homo Sapiens
AIVQKQQSL

SEQ ID NO: 795043 - protein, 9 aa, Homo Sapiens
CILFFGRFC

SEQ ID NO: 795044 - protein, 9 aa, Homo Sapiens
GAESKEGSS

SEQ ID NO: 795045 - protein, 9 aa, Homo Sapiens
LGGVHKGRK

SEQ ID NO: 795046 - protein, 9 aa, Homo Sapiens
PESTPQLPV

SEQ ID NO: 795047 - protein, 9 aa, Homo Sapiens
AEGHPGNSP

SEQ ID NO: 795048 - protein, 9 aa, Homo Sapiens
KQGSHAQHV

SEQ ID NO: 795049 - protein, 9 aa, Homo Sapiens
NSQNTLCEA

SEQ ID NO: 795050 - protein, 9 aa, Homo Sapiens
LEHCAHVLE

SEQ ID NO: 795051 - protein, 9 aa, Homo Sapiens
LLPNMVTAA

SEQ ID NO: 795052 - protein, 9 aa, Homo Sapiens
ERLNRVPAL

SEQ ID NO: 795053 - protein, 9 aa, Homo Sapiens
ASSFIIFWF

SEQ ID NO: 795054 - protein, 9 aa, Homo Sapiens
CVGNQMGVG

SEQ ID NO: 795055 - protein, 9 aa, Homo Sapiens
RVAEGHPGN

SEQ ID NO: 795056 - protein, 9 aa, Homo Sapiens
GALMMPLVD

SEQ ID NO: 795057 - protein, 9 aa, Homo Sapiens
HELSPLVMP

SEQ ID NO: 795058 - protein, 9 aa, Homo Sapiens
SRGCSTSGN

SEQ ID NO: 795059 - protein, 9 aa, Homo Sapiens
TQLKCLLKG

SEQ ID NO: 795060 - protein, 9 aa, Homo Sapiens
YPEVHIPLK

SEQ ID NO: 795061 - protein, 9 aa, Homo Sapiens
SKLMQITTE

SEQ ID NO: 795062 - protein, 9 aa, Homo Sapiens
LAFSQDGAE

SEQ ID NO: 795063 - protein, 9 aa, Homo Sapiens
ESECQEKSG

SEQ ID NO: 795064 - protein, 9 aa, Homo Sapiens
KAYEWNVNE

SEQ ID NO: 795065 - protein, 9 aa, Homo Sapiens
GRGLGGVHK

SEQ ID NO: 795066 - protein, 9 aa, Homo Sapiens
VSSSFSSGG

SEQ ID NO: 795067 - protein, 9 aa, Homo Sapiens
FPLPSGAQQ

SEQ ID NO: 795068 - protein, 9 aa, Homo Sapiens
SGAQQCPPV

SEQ ID NO: 795069 - protein, 9 aa, Homo Sapiens
LTVESGLPS

SEQ ID NO: 795070 - protein, 9 aa, Homo Sapiens
SGFVTSSLS

SEQ ID NO: 795071 - protein, 9 aa, Homo Sapiens
GLDLDSGAP

SEQ ID NO: 795072 - protein, 9 aa, Homo Sapiens
EKIGVTLSN

SEQ ID NO: 795073 - protein, 9 aa, Homo Sapiens
KLMQITTEL

SEQ ID NO: 795074 - protein, 9 aa, Homo Sapiens
KNSIVIKHK

SEQ ID NO: 795075 - protein, 9 aa, Homo Sapiens
PLKNLQQFP

SEQ ID NO: 795076 - protein, 9 aa, Homo Sapiens
LCNMPSMRR

SEQ ID NO: 795077 - protein, 9 aa, Homo Sapiens
LEVALVGAS

SEQ ID NO: 795078 - protein, 9 aa, Homo Sapiens
ALPWLCLGL

SEQ ID NO: 795079 - protein, 9 aa, Homo Sapiens
DGIFEVKSM

SEQ ID NO: 795080 - protein, 9 aa, Homo Sapiens
LPTKAPVYD

SEQ ID NO: 795081 - protein, 9 aa, Homo Sapiens
FVTSSLSGL

SEQ ID NO: 795082 - protein, 9 aa, Homo Sapiens
IDRTICHNI

SEQ ID NO: 795083 - protein, 9 aa, Homo Sapiens
EEGADEELE

SEQ ID NO: 795084 - protein, 9 aa, Homo Sapiens
NLLQHFTDC

SEQ ID NO: 795085 - protein, 9 aa, Homo Sapiens
HSNTLQRKT

SEQ ID NO: 795086 - protein, 9 aa, Homo Sapiens
RRSKLRVAE

SEQ ID NO: 795087 - protein, 9 aa, Homo Sapiens
VLKQGSHAQ

SEQ ID NO: 795088 - protein, 9 aa, Homo Sapiens
DISTEDIQE

SEQ ID NO: 795089 - protein, 9 aa, Homo Sapiens
AGALMMPLV

SEQ ID NO: 795090 - protein, 9 aa, Homo Sapiens
FHVCLLLLQ

SEQ ID NO: 795091 - protein, 9 aa, Homo Sapiens
PTPESTPQL

SEQ ID NO: 795092 - protein, 9 aa, Homo Sapiens
NVAKKTIES

SEQ ID NO: 795093 - protein, 9 aa, Homo Sapiens
ASKPDGSIR

SEQ ID NO: 795094 - protein, 9 aa, Homo Sapiens
VAKKTIESS

SEQ ID NO: 795095 - protein, 9 aa, Homo Sapiens
KLVPRPVGA

SEQ ID NO: 795096 - protein, 9 aa, Homo Sapiens
AKKTIESSS

SEQ ID NO: 795097 - protein, 9 aa, Homo Sapiens
RAGALMMPL

SEQ ID NO: 795098 - protein, 9 aa, Homo Sapiens
ALNKVEGDN

SEQ ID NO: 795099 - protein, 9 aa, Homo Sapiens
GTELTGSRG

SEQ ID NO: 795100 - protein, 9 aa, Homo Sapiens
CLGLCSLLV

SEQ ID NO: 795101 - protein, 9 aa, Homo Sapiens
TPQLPVKHL

SEQ ID NO: 795102 - protein, 9 aa, Homo Sapiens
ALKTQLKCL

SEQ ID NO: 795103 - protein, 9 aa, Homo Sapiens
GENSQNTLC

SEQ ID NO: 795104 - protein, 9 aa, Homo Sapiens
IESSSNDLG

SEQ ID NO: 795105 - protein, 9 aa, Homo Sapiens
GCHIFTVTA

SEQ ID NO: 795106 - protein, 9 aa, Homo Sapiens
VVLGKIINL

SEQ ID NO: 795107 - protein, 9 aa, Homo Sapiens
MSVPDVHLP

SEQ ID NO: 795108 - protein, 9 aa, Homo Sapiens
FTDCKRGTC

SEQ ID NO: 795109 - protein, 9 aa, Homo Sapiens
LLQHFTDCK

SEQ ID NO: 795110 - protein, 9 aa, Homo Sapiens
AGERGRHGK

SEQ ID NO: 795111 - protein, 9 aa, Homo Sapiens
ISQIKGEME

SEQ ID NO: 795112 - protein, 9 aa, Homo Sapiens
EVHIPLKNL

SEQ ID NO: 795113 - protein, 9 aa, Homo Sapiens
DVAEKLLDC

SEQ ID NO: 795114 - protein, 9 aa, Homo Sapiens
PNMVTAAPL

SEQ ID NO: 795115 - protein, 9 aa, Homo Sapiens
SIVIKHKKV

SEQ ID NO: 795116 - protein, 9 aa, Homo Sapiens
YSRKLHPGS

SEQ ID NO: 795117 - protein, 9 aa, Homo Sapiens
ESKLMQITT

SEQ ID NO: 795118 - protein, 9 aa, Homo Sapiens
VMLLALNKV

SEQ ID NO: 795119 - protein, 9 aa, Homo Sapiens
SNNCGNNFR

SEQ ID NO: 795120 - protein, 9 aa, Homo Sapiens
AKDTKGVSE

SEQ ID NO: 795121 - protein, 9 aa, Homo Sapiens
GLPGPAGER

SEQ ID NO: 795122 - protein, 9 aa, Homo Sapiens
DLKKYIKSP

SEQ ID NO: 795123 - protein, 9 aa, Homo Sapiens
SKQLEKIGV

SEQ ID NO: 795124 - protein, 9 aa, Homo Sapiens
LKKYIKSPV

SEQ ID NO: 795125 - protein, 9 aa, Homo Sapiens
LVGASPRGN

SEQ ID NO: 795126 - protein, 9 aa, Homo Sapiens
RLLQGGAGT

SEQ ID NO: 795127 - protein, 9 aa, Homo Sapiens
LKIKLFMNC

SEQ ID NO: 795128 - protein, 9 aa, Homo Sapiens
ESTPQLPVK

SEQ ID NO: 795129 - protein, 9 aa, Homo Sapiens
RVMVGSVAQ

SEQ ID NO: 795130 - protein, 9 aa, Homo Sapiens
SRCIKDIVG

SEQ ID NO: 795131 - protein, 9 aa, Homo Sapiens
KKGDVSIYY

SEQ ID NO: 795132 - protein, 9 aa, Homo Sapiens
QMCPSAGSQ

SEQ ID NO: 795133 - protein, 9 aa, Homo Sapiens
RLNRVPALP

SEQ ID NO: 795134 - protein, 9 aa, Homo Sapiens
CIPSGFVTS

SEQ ID NO: 795135 - protein, 9 aa, Homo Sapiens
FHSNTLQRK

SEQ ID NO: 795136 - protein, 9 aa, Homo Sapiens
KNYILTHIG

SEQ ID NO: 795137 - protein, 9 aa, Homo Sapiens
SKLRVAEGH

SEQ ID NO: 795138 - protein, 9 aa, Homo Sapiens
LKTQLKCLL

SEQ ID NO: 795139 - protein, 9 aa, Homo Sapiens
DEELEETSE

SEQ ID NO: 795140 - protein, 9 aa, Homo Sapiens
SSFIIFWFS

SEQ ID NO: 795141 - protein, 9 aa, Homo Sapiens
IKGEMEDII

SEQ ID NO: 795142 - protein, 9 aa, Homo Sapiens
SSTLSRCIK

SEQ ID NO: 795143 - protein, 9 aa, Homo Sapiens
LSSRQVVEC

SEQ ID NO: 795144 - protein, 9 aa, Homo Sapiens
TDISQIKGE

SEQ ID NO: 795145 - protein, 9 aa, Homo Sapiens
PISGRATLY

SEQ ID NO: 795146 - protein, 9 aa, Homo Sapiens
EINVAKKTI

SEQ ID NO: 795147 - protein, 9 aa, Homo Sapiens
DRTICHNIS

SEQ ID NO: 795148 - protein, 9 aa, Homo Sapiens
TCQLEVALV

SEQ ID NO: 795149 - protein, 9 aa, Homo Sapiens
SCETPGVPR

SEQ ID NO: 795150 - protein, 9 aa, Homo Sapiens
LRSYCFTAS

SEQ ID NO: 795151 - protein, 9 aa, Homo Sapiens
TFNTCLLVA

SEQ ID NO: 795152 - protein, 9 aa, Homo Sapiens
VFHSNTLQR

SEQ ID NO: 795153 - protein, 9 aa, Homo Sapiens
ESKEGSSCL

SEQ ID NO: 795154 - protein, 9 aa, Homo Sapiens
LPTPESTPQ

SEQ ID NO: 795155 - protein, 9 aa, Homo Sapiens
TVTARDADA

SEQ ID NO: 795156 - protein, 9 aa, Homo Sapiens
LLNFHVCLL

SEQ ID NO: 795157 - protein, 9 aa, Homo Sapiens
QSCIPSGFV

SEQ ID NO: 795158 - protein, 9 aa, Homo Sapiens
IWKIKSSKN

SEQ ID NO: 795159 - protein, 9 aa, Homo Sapiens
HIFTVTARD

SEQ ID NO: 795160 - protein, 9 aa, Homo Sapiens
TSGNLLQHF

SEQ ID NO: 795161 - protein, 9 aa, Homo Sapiens
YLGVTRSPR

SEQ ID NO: 795162 - protein, 9 aa, Homo Sapiens
ISEDKNYIL

SEQ ID NO: 795163 - protein, 9 aa, Homo Sapiens
FATTRDVDI

SEQ ID NO: 795164 - protein, 9 aa, Homo Sapiens
LPKVPEMSV

SEQ ID NO: 795165 - protein, 9 aa, Homo Sapiens
FPHCFCRLH

SEQ ID NO: 795166 - protein, 9 aa, Homo Sapiens
VMVGSVAQL

SEQ ID NO: 795167 - protein, 9 aa, Homo Sapiens
REGACSSQS

SEQ ID NO: 795168 - protein, 9 aa, Homo Sapiens
LVTDKKNKA

SEQ ID NO: 795169 - protein, 9 aa, Homo Sapiens
LGVTRSPRL

SEQ ID NO: 795170 - protein, 9 aa, Homo Sapiens
KSLPTKAPV

SEQ ID NO: 795171 - protein, 9 aa, Homo Sapiens
ETPGVPRHG

SEQ ID NO: 795172 - protein, 9 aa, Homo Sapiens
SSSSTIWKI

SEQ ID NO: 795173 - protein, 9 aa, Homo Sapiens
HNISKDSKR

SEQ ID NO: 795174 - protein, 9 aa, Homo Sapiens
YEWNVNEMY

SEQ ID NO: 795175 - protein, 9 aa, Homo Sapiens
QDGAESKEG

SEQ ID NO: 795176 - protein, 9 aa, Homo Sapiens
CQLEVALVG

SEQ ID NO: 795177 - protein, 9 aa, Homo Sapiens
PRKGSSHLL

SEQ ID NO: 795178 - protein, 9 aa, Homo Sapiens
PGCHIFTVT

SEQ ID NO: 795179 - protein, 9 aa, Homo Sapiens
MIPNCADSS

SEQ ID NO: 795180 - protein, 9 aa, Homo Sapiens
TCPKDWPSC

SEQ ID NO: 795181 - protein, 9 aa, Homo Sapiens
LPDLALGTL

SEQ ID NO: 795182 - protein, 9 aa, Homo Sapiens
KSHESKLMQ

SEQ ID NO: 795183 - protein, 9 aa, Homo Sapiens
TDKKNKAAK

SEQ ID NO: 795184 - protein, 9 aa, Homo Sapiens
ICHNISKDS

SEQ ID NO: 795185 - protein, 9 aa, Homo Sapiens
KELTAIVQK

SEQ ID NO: 795186 - protein, 9 aa, Homo Sapiens
AQSCIPSGF

SEQ ID NO: 795187 - protein, 9 aa, Homo Sapiens
LKKGDVSIY

SEQ ID NO: 795188 - protein, 9 aa, Homo Sapiens
KDWPSCGEI

SEQ ID NO: 795189 - protein, 9 aa, Homo Sapiens
LETDISQIK

SEQ ID NO: 795190 - protein, 9 aa, Homo Sapiens
DKLFFTSTM

SEQ ID NO: 795191 - protein, 9 aa, Homo Sapiens
HALGVLEEH

SEQ ID NO: 795192 - protein, 9 aa, Homo Sapiens
DKAYEWNVN

SEQ ID NO: 795193 - protein, 9 aa, Homo Sapiens
SYCFTASKP

SEQ ID NO: 795194 - protein, 9 aa, Homo Sapiens
SSSSSTIWK

SEQ ID NO: 795195 - protein, 9 aa, Homo Sapiens
PGPAACQVS

SEQ ID NO: 795196 - protein, 9 aa, Homo Sapiens
FEVKSMAGD

SEQ ID NO: 795197 - protein, 9 aa, Homo Sapiens
KTKKKKKKL

SEQ ID NO: 795198 - protein, 9 aa, Homo Sapiens
APKSLPTKA

SEQ ID NO: 795199 - protein, 9 aa, Homo Sapiens
FQTATVTEK

SEQ ID NO: 795200 - protein, 9 aa, Homo Sapiens
LRPALPWLC

SEQ ID NO: 795201 - protein, 9 aa, Homo Sapiens
SQIKGEMED

SEQ ID NO: 795202 - protein, 9 aa, Homo Sapiens
RATLYWYRQ

SEQ ID NO: 795203 - protein, 9 aa, Homo Sapiens
TQPQFPLPS

SEQ ID NO: 795204 - protein, 9 aa, Homo Sapiens
NTLQRKTPI

SEQ ID NO: 795205 - protein, 9 aa, Homo Sapiens
SGRATLYWY

SEQ ID NO: 795206 - protein, 9 aa, Homo Sapiens
ASKLVPRPV

SEQ ID NO: 795207 - protein, 9 aa, Homo Sapiens
IYSRKLHPG

SEQ ID NO: 795208 - protein, 9 aa, Homo Sapiens
RELEREREI

SEQ ID NO: 795209 - protein, 9 aa, Homo Sapiens
ENSQNTLCE

SEQ ID NO: 795210 - protein, 9 aa, Homo Sapiens
GVTLSNAIV

SEQ ID NO: 795211 - protein, 9 aa, Homo Sapiens
RAFLNLVDL

SEQ ID NO: 795212 - protein, 9 aa, Homo Sapiens
ASISYDYCR

SEQ ID NO: 795213 - protein, 9 aa, Homo Sapiens
TKGVSEETL

SEQ ID NO: 795214 - protein, 9 aa, Homo Sapiens
KERAGALMM

SEQ ID NO: 795215 - protein, 9 aa, Homo Sapiens
SYLHQNVRE

SEQ ID NO: 795216 - protein, 9 aa, Homo Sapiens
QAKDTKGVS

SEQ ID NO: 795217 - protein, 9 aa, Homo Sapiens
DPFQMCPSA

SEQ ID NO: 795218 - protein, 9 aa, Homo Sapiens
TLSKIFQYN

SEQ ID NO: 795219 - protein, 9 aa, Homo Sapiens
ESHPLREGA

SEQ ID NO: 795220 - protein, 9 aa, Homo Sapiens
ARSYNRFQT

SEQ ID NO: 795221 - protein, 9 aa, Homo Sapiens
PKDWPSCGE

SEQ ID NO: 795222 - protein, 9 aa, Homo Sapiens
VAAGENSQN

SEQ ID NO: 795223 - protein, 9 aa, Homo Sapiens
RLRYLGVTR

SEQ ID NO: 795224 - protein, 9 aa, Homo Sapiens
FSILALSFT

SEQ ID NO: 795225 - protein, 9 aa, Homo Sapiens
VGSGLTVES

SEQ ID NO: 795226 - protein, 9 aa, Homo Sapiens
RSLATLTLL

SEQ ID NO: 795227 - protein, 9 aa, Homo Sapiens
TTRDVDIST

SEQ ID NO: 795228 - protein, 9 aa, Homo Sapiens
STVTNSDSS

SEQ ID NO: 795229 - protein, 9 aa, Homo Sapiens
GTLAVFSLA

SEQ ID NO: 795230 - protein, 9 aa, Homo Sapiens
MPSMRRSLA

SEQ ID NO: 795231 - protein, 9 aa, Homo Sapiens
SSRQVVECV

SEQ ID NO: 795232 - protein, 9 aa, Homo Sapiens
PQFPLPSGA

SEQ ID NO: 795233 - protein, 9 aa, Homo Sapiens
HIPLKNLQQ

SEQ ID NO: 795234 - protein, 9 aa, Homo Sapiens
SSDVAEKLL

SEQ ID NO: 795235 - protein, 9 aa, Homo Sapiens
SRKLHPGSL

SEQ ID NO: 795236 - protein, 9 aa, Homo Sapiens
PEMSVPDVH

SEQ ID NO: 795237 - protein, 9 aa, Homo Sapiens
SMAGDTHLG

SEQ ID NO: 795238 - protein, 9 aa, Homo Sapiens
STMRNHHSR

SEQ ID NO: 795239 - protein, 9 aa, Homo Sapiens
GACSSQSQE

SEQ ID NO: 795240 - protein, 9 aa, Homo Sapiens
AFLNLVDLS

SEQ ID NO: 795241 - protein, 9 aa, Homo Sapiens
SHALGVLEE

SEQ ID NO: 795242 - protein, 9 aa, Homo Sapiens
TPGVPRHGS

SEQ ID NO: 795243 - protein, 9 aa, Homo Sapiens
TARDADAQE

SEQ ID NO: 795244 - protein, 9 aa, Homo Sapiens
ATTRDVDIS

SEQ ID NO: 795245 - protein, 9 aa, Homo Sapiens
KTQLKCLLK

SEQ ID NO: 795246 - protein, 9 aa, Homo Sapiens
DVDISTEDI

SEQ ID NO: 795247 - protein, 9 aa, Homo Sapiens
LTHIGNGSN

SEQ ID NO: 795248 - protein, 9 aa, Homo Sapiens
YCFTASKPD

SEQ ID NO: 795249 - protein, 9 aa, Homo Sapiens
DDEESECQE

SEQ ID NO: 795250 - protein, 9 aa, Homo Sapiens
GFVTSSLSG

SEQ ID NO: 795251 - protein, 9 aa, Homo Sapiens
SKAPKSLPT

SEQ ID NO: 795252 - protein, 9 aa, Homo Sapiens
AEKLLDCTV

SEQ ID NO: 795253 - protein, 9 aa, Homo Sapiens
LLALNKVEG

SEQ ID NO: 795254 - protein, 9 aa, Homo Sapiens
LHATVSGTE

SEQ ID NO: 795255 - protein, 9 aa, Homo Sapiens
SSFSSGGAC

SEQ ID NO: 795256 - protein, 9 aa, Homo Sapiens
GSVAQLATF

SEQ ID NO: 795257 - protein, 9 aa, Homo Sapiens
CGLSPENVR

SEQ ID NO: 795258 - protein, 9 aa, Homo Sapiens
TELTGSRGC

SEQ ID NO: 795259 - protein, 9 aa, Homo Sapiens
LALSFTSLD

SEQ ID NO: 795260 - protein, 9 aa, Homo Sapiens
SCIPSGFVT

SEQ ID NO: 795261 - protein, 9 aa, Homo Sapiens
VLGKIINLK

SEQ ID NO: 795262 - protein, 9 aa, Homo Sapiens
ANMYFLIIS

SEQ ID NO: 795263 - protein, 9 aa, Homo Sapiens
PSSGASTVT

SEQ ID NO: 795264 - protein, 9 aa, Homo Sapiens
SLDSLSHAL

SEQ ID NO: 795265 - protein, 9 aa, Homo Sapiens
VPRPVGAGH

SEQ ID NO: 795266 - protein, 9 aa, Homo Sapiens
VPRVMVGSV

SEQ ID NO: 795267 - protein, 9 aa, Homo Sapiens
SECQEKSGT

SEQ ID NO: 795268 - protein, 9 aa, Homo Sapiens
GAGTPGPRA

SEQ ID NO: 795269 - protein, 9 aa, Homo Sapiens
MVTAAPLVL

SEQ ID NO: 795270 - protein, 9 aa, Homo Sapiens
HQNVREDLS

SEQ ID NO: 795271 - protein, 9 aa, Homo Sapiens
PVGAGHVVA

SEQ ID NO: 795272 - protein, 9 aa, Homo Sapiens
LGDQIQEPE

SEQ ID NO: 795273 - protein, 9 aa, Homo Sapiens
STSKVIPLI

SEQ ID NO: 795274 - protein, 9 aa, Homo Sapiens
DYTLTLRCS

SEQ ID NO: 795275 - protein, 9 aa, Homo Sapiens
EVEEGAGNA

SEQ ID NO: 795276 - protein, 9 aa, Homo Sapiens
DRIMRYAIA

SEQ ID NO: 795277 - protein, 9 aa, Homo Sapiens
MKKLLVGAL

SEQ ID NO: 795278 - protein, 9 aa, Homo Sapiens
FCEDDLQRN

SEQ ID NO: 795279 - protein, 9 aa, Homo Sapiens
APMANICED

SEQ ID NO: 795280 - protein, 9 aa, Homo Sapiens
NRIIKIANK

SEQ ID NO: 795281 - protein, 9 aa, Homo Sapiens
HCLAPMANI

SEQ ID NO: 795282 - protein, 9 aa, Homo Sapiens
HLACASDHV

SEQ ID NO: 795283 - protein, 9 aa, Homo Sapiens
NICPTKDTF

SEQ ID NO: 795284 - protein, 9 aa, Homo Sapiens
RIMRYAIAT

SEQ ID NO: 795285 - protein, 9 aa, Homo Sapiens
TSKVIPLIG

SEQ ID NO: 795286 - protein, 9 aa, Homo Sapiens
TLNPTSRSL

SEQ ID NO: 795287 - protein, 9 aa, Homo Sapiens
GSPLQSSSS

SEQ ID NO: 795288 - protein, 9 aa, Homo Sapiens
HYSLRIDLS

SEQ ID NO: 795289 - protein, 9 aa, Homo Sapiens
LRCSPDDIP

SEQ ID NO: 795290 - protein, 9 aa, Homo Sapiens
VAPLLGASL

SEQ ID NO: 795291 - protein, 9 aa, Homo Sapiens
RSLLNAVDG

SEQ ID NO: 795292 - protein, 9 aa, Homo Sapiens
VIPWKSEVE

SEQ ID NO: 795293 - protein, 9 aa, Homo Sapiens
PAPRPATSP

SEQ ID NO: 795294 - protein, 9 aa, Homo Sapiens
SYYTLIALS

SEQ ID NO: 795295 - protein, 9 aa, Homo Sapiens
PRPATSPSF

SEQ ID NO: 795296 - protein, 9 aa, Homo Sapiens
RFLQLSKCP

SEQ ID NO: 795297 - protein, 9 aa, Homo Sapiens
IPWKSEVEE

SEQ ID NO: 795298 - protein, 9 aa, Homo Sapiens
IIPSTSKVI

SEQ ID NO: 795299 - protein, 9 aa, Homo Sapiens
LLGASLGGI

SEQ ID NO: 795300 - protein, 9 aa, Homo Sapiens
QDKLGLAVC

SEQ ID NO: 795301 - protein, 9 aa, Homo Sapiens
QLHYSLRID

SEQ ID NO: 795302 - protein, 9 aa, Homo Sapiens
ALASVPSLF

SEQ ID NO: 795303 - protein, 9 aa, Homo Sapiens
VPNRIIKIA

SEQ ID NO: 795304 - protein, 9 aa, Homo Sapiens
STLNPTSRS

SEQ ID NO: 795305 - protein, 9 aa, Homo Sapiens
TVIDPDRIM

SEQ ID NO: 795306 - protein, 9 aa, Homo Sapiens
ENVAIKIHN

SEQ ID NO: 795307 - protein, 9 aa, Homo Sapiens
RCKNICPTK

SEQ ID NO: 795308 - protein, 9 aa, Homo Sapiens
ERCKNICPT

SEQ ID NO: 795309 - protein, 9 aa, Homo Sapiens
LRAAAEAAL

SEQ ID NO: 795310 - protein, 9 aa, Homo Sapiens
IHNISVSAS

SEQ ID NO: 795311 - protein, 9 aa, Homo Sapiens
GIPPQMMGS

SEQ ID NO: 795312 - protein, 9 aa, Homo Sapiens
KIANKTPKI

SEQ ID NO: 795313 - protein, 9 aa, Homo Sapiens
RMEWNGMEW

SEQ ID NO: 795314 - protein, 9 aa, Homo Sapiens
NPTSRSLLN

SEQ ID NO: 795315 - protein, 9 aa, Homo Sapiens
EVPNRIIKI

SEQ ID NO: 795316 - protein, 9 aa, Homo Sapiens
ACASDHVKV

SEQ ID NO: 795317 - protein, 9 aa, Homo Sapiens
KLLDQLHYS

SEQ ID NO: 795318 - protein, 9 aa, Homo Sapiens
GLAVCYRTD

SEQ ID NO: 795319 - protein, 9 aa, Homo Sapiens
SPLQSSSSE

SEQ ID NO: 795320 - protein, 9 aa, Homo Sapiens
LNPTSRSLL

SEQ ID NO: 795321 - protein, 9 aa, Homo Sapiens
SPPTPMKKL

SEQ ID NO: 795322 - protein, 9 aa, Homo Sapiens
EIIPSTSKV

SEQ ID NO: 795323 - protein, 9 aa, Homo Sapiens
YTLIALSPV

SEQ ID NO: 795324 - protein, 9 aa, Homo Sapiens
DHSYYTLIA

SEQ ID NO: 795325 - protein, 9 aa, Homo Sapiens
RRFLQLSKC

SEQ ID NO: 795326 - protein, 9 aa, Homo Sapiens
ALHLACASD

SEQ ID NO: 795327 - protein, 9 aa, Homo Sapiens
DLQRNGVVD

SEQ ID NO: 795328 - protein, 9 aa, Homo Sapiens
STQTSSSSQ

SEQ ID NO: 795329 - protein, 9 aa, Homo Sapiens
PPQMMGSPL

SEQ ID NO: 795330 - protein, 9 aa, Homo Sapiens
QMMGSPLQS

SEQ ID NO: 795331 - protein, 9 aa, Homo Sapiens
CASDHVKVV

SEQ ID NO: 795332 - protein, 9 aa, Homo Sapiens
PSTSKVIPL

SEQ ID NO: 795333 - protein, 9 aa, Homo Sapiens
VIDPDRIMR

SEQ ID NO: 795334 - protein, 9 aa, Homo Sapiens
FEFCEDDLQ

SEQ ID NO: 795335 - protein, 9 aa, Homo Sapiens
NVAIKIHNI

SEQ ID NO: 795336 - protein, 9 aa, Homo Sapiens
PDYTLTLRC

SEQ ID NO: 795337 - protein, 9 aa, Homo Sapiens
NGMEWNGMK

SEQ ID NO: 795338 - protein, 9 aa, Homo Sapiens
GLQGPAPRP

SEQ ID NO: 795339 - protein, 9 aa, Homo Sapiens
CSPDDIPLM

SEQ ID NO: 795340 - protein, 9 aa, Homo Sapiens
LHCLAPMAN

SEQ ID NO: 795341 - protein, 9 aa, Homo Sapiens
LHLACASDH

SEQ ID NO: 795342 - protein, 9 aa, Homo Sapiens
DRRFLQLSK

SEQ ID NO: 795343 - protein, 9 aa, Homo Sapiens
CKNICPTKD

SEQ ID NO: 795344 - protein, 9 aa, Homo Sapiens
EEIIPSTSK

SEQ ID NO: 795345 - protein, 9 aa, Homo Sapiens
MANICEDII

SEQ ID NO: 795346 - protein, 9 aa, Homo Sapiens
PTKDTFERT

SEQ ID NO: 795347 - protein, 9 aa, Homo Sapiens
PILQHISHN

SEQ ID NO: 795348 - protein, 9 aa, Homo Sapiens
LRENSRPLG

SEQ ID NO: 795349 - protein, 9 aa, Homo Sapiens
PMKKLLVGA

SEQ ID NO: 795350 - protein, 9 aa, Homo Sapiens
LVVALASVP

SEQ ID NO: 795351 - protein, 9 aa, Homo Sapiens
EWNGMEWNG

SEQ ID NO: 795352 - protein, 9 aa, Homo Sapiens
GASLGGIIY

SEQ ID NO: 795353 - protein, 9 aa, Homo Sapiens
PLGDQIQEP

SEQ ID NO: 795354 - protein, 9 aa, Homo Sapiens
GENVAIKIH

SEQ ID NO: 795355 - protein, 9 aa, Homo Sapiens
TSRSLLNAV

SEQ ID NO: 795356 - protein, 9 aa, Homo Sapiens
RLHCLAPMA

SEQ ID NO: 795357 - protein, 9 aa, Homo Sapiens
TQTSSSSQS

SEQ ID NO: 795358 - protein, 9 aa, Homo Sapiens
HISHNKEQG

SEQ ID NO: 795359 - protein, 9 aa, Homo Sapiens
GMEWNGMKW

SEQ ID NO: 795360 - protein, 9 aa, Homo Sapiens
LASVPSLFL

SEQ ID NO: 795361 - protein, 9 aa, Homo Sapiens
EAALSQTGF

SEQ ID NO: 795362 - protein, 9 aa, Homo Sapiens
AIKIHNISV

SEQ ID NO: 795363 - protein, 9 aa, Homo Sapiens
VEEGAGNAT

SEQ ID NO: 795364 - protein, 9 aa, Homo Sapiens
LGLAVCYRT

SEQ ID NO: 795365 - protein, 9 aa, Homo Sapiens
QTSSSSQSE

SEQ ID NO: 795366 - protein, 9 aa, Homo Sapiens
IPPQMMGSP

SEQ ID NO: 795367 - protein, 9 aa, Homo Sapiens
QGPAPRPAT

SEQ ID NO: 795368 - protein, 9 aa, Homo Sapiens
DDLQRNGVV

SEQ ID NO: 795369 - protein, 9 aa, Homo Sapiens
YSLRIDLSM

SEQ ID NO: 795370 - protein, 9 aa, Homo Sapiens
LIALSPVAA

SEQ ID NO: 795371 - protein, 9 aa, Homo Sapiens
RIIKIANKT

SEQ ID NO: 795372 - protein, 9 aa, Homo Sapiens
NSQDKLGLA

SEQ ID NO: 795373 - protein, 9 aa, Homo Sapiens
RPATSPSFL

SEQ ID NO: 795374 - protein, 9 aa, Homo Sapiens
LQLSKCPAC

SEQ ID NO: 795375 - protein, 9 aa, Homo Sapiens
FLQLSKCPA

SEQ ID NO: 795376 - protein, 9 aa, Homo Sapiens
LLDQLHYSL

SEQ ID NO: 795377 - protein, 9 aa, Homo Sapiens
LGASLGGII

SEQ ID NO: 795378 - protein, 9 aa, Homo Sapiens
SHNKEQGTY

SEQ ID NO: 795379 - protein, 9 aa, Homo Sapiens
CEDDLQRNG

SEQ ID NO: 795380 - protein, 9 aa, Homo Sapiens
PDRIMRYAI

SEQ ID NO: 795381 - protein, 9 aa, Homo Sapiens
FEVPNRIIK

SEQ ID NO: 795382 - protein, 9 aa, Homo Sapiens
IIKIANKTP

SEQ ID NO: 795383 - protein, 9 aa, Homo Sapiens
NSRPLGDQI

SEQ ID NO: 795384 - protein, 9 aa, Homo Sapiens
PQMMGSPLQ

SEQ ID NO: 795385 - protein, 9 aa, Homo Sapiens
HNKEQGTYE

SEQ ID NO: 795386 - protein, 9 aa, Homo Sapiens
LSQTGFSYD

SEQ ID NO: 795387 - protein, 9 aa, Homo Sapiens
TLTLRCSPD

SEQ ID NO: 795388 - protein, 9 aa, Homo Sapiens
PPTPMKKLL

SEQ ID NO: 795389 - protein, 9 aa, Homo Sapiens
IALSPVAAI

SEQ ID NO: 795390 - protein, 9 aa, Homo Sapiens
YTLTLRCSP

SEQ ID NO: 795391 - protein, 9 aa, Homo Sapiens
IPSTSKVIP

SEQ ID NO: 795392 - protein, 9 aa, Homo Sapiens
VVAPLLGAS

SEQ ID NO: 795393 - protein, 9 aa, Homo Sapiens
ALSPVAAIL

SEQ ID NO: 795394 - protein, 9 aa, Homo Sapiens
GPAPRPATS

SEQ ID NO: 795395 - protein, 9 aa, Homo Sapiens
LTLRCSPDD

SEQ ID NO: 795396 - protein, 9 aa, Homo Sapiens
LPILQHISH

SEQ ID NO: 795397 - protein, 9 aa, Homo Sapiens
RPLGDQIQE

SEQ ID NO: 795398 - protein, 9 aa, Homo Sapiens
QHISHNKEQ

SEQ ID NO: 795399 - protein, 9 aa, Homo Sapiens
KSEVEEGAG

SEQ ID NO: 795400 - protein, 9 aa, Homo Sapiens
CPTKDTFER

SEQ ID NO: 795401 - protein, 9 aa, Homo Sapiens
DQLHYSLRI

SEQ ID NO: 795402 - protein, 9 aa, Homo Sapiens
AVIPWKSEV

SEQ ID NO: 795403 - protein, 9 aa, Homo Sapiens
LQRNGVVDA

SEQ ID NO: 795404 - protein, 9 aa, Homo Sapiens
SHSPPTPMK

SEQ ID NO: 795405 - protein, 9 aa, Homo Sapiens
ASDHVKVVT

SEQ ID NO: 795406 - protein, 9 aa, Homo Sapiens
VVALASVPS

SEQ ID NO: 795407 - protein, 9 aa, Homo Sapiens
PNRIIKIAN

SEQ ID NO: 795408 - protein, 9 aa, Homo Sapiens
YYTLIALSP

SEQ ID NO: 795409 - protein, 9 aa, Homo Sapiens
VIEEIIPST

SEQ ID NO: 795410 - protein, 9 aa, Homo Sapiens
NRMEWNGME

SEQ ID NO: 795411 - protein, 9 aa, Homo Sapiens
RENSRPLGD

SEQ ID NO: 795412 - protein, 9 aa, Homo Sapiens
DPDRIMRYA

SEQ ID NO: 795413 - protein, 9 aa, Homo Sapiens
TKDTFERTL

SEQ ID NO: 795414 - protein, 9 aa, Homo Sapiens
DHVKVVTLL

SEQ ID NO: 795415 - protein, 9 aa, Homo Sapiens
IEEIIPSTS

SEQ ID NO: 795416 - protein, 9 aa, Homo Sapiens
SRPLGDQIQ

SEQ ID NO: 795417 - protein, 9 aa, Homo Sapiens
LDCCCCCCE

SEQ ID NO: 795418 - protein, 9 aa, Homo Sapiens
APRPATSPS

SEQ ID NO: 795419 - protein, 9 aa, Homo Sapiens
ALSQTGFSY

SEQ ID NO: 795420 - protein, 9 aa, Homo Sapiens
ICPTKDTFE

SEQ ID NO: 795421 - protein, 9 aa, Homo Sapiens
IKIANKTPK

SEQ ID NO: 795422 - protein, 9 aa, Homo Sapiens
AALSQTGFS

SEQ ID NO: 795423 - protein, 9 aa, Homo Sapiens
PTSRSLLNA

SEQ ID NO: 795424 - protein, 9 aa, Homo Sapiens
CLAPMANIC

SEQ ID NO: 795425 - protein, 9 aa, Homo Sapiens
LAPMANICE

SEQ ID NO: 795426 - protein, 9 aa, Homo Sapiens
TDRRFLQLS

SEQ ID NO: 795427 - protein, 9 aa, Homo Sapiens
HNISVSASS

SEQ ID NO: 795428 - protein, 9 aa, Homo Sapiens
AAAEAALSQ

SEQ ID NO: 795429 - protein, 9 aa, Homo Sapiens
ENSRPLGDQ

SEQ ID NO: 795430 - protein, 9 aa, Homo Sapiens
IKIHNISVS

SEQ ID NO: 795431 - protein, 9 aa, Homo Sapiens
LACASDHVK

SEQ ID NO: 795432 - protein, 9 aa, Homo Sapiens
TPMKKLLVG

SEQ ID NO: 795433 - protein, 9 aa, Homo Sapiens
LQHISHNKE

SEQ ID NO: 795434 - protein, 9 aa, Homo Sapiens
QLSKCPACF

SEQ ID NO: 795435 - protein, 9 aa, Homo Sapiens
RCSPDDIPL

SEQ ID NO: 795436 - protein, 9 aa, Homo Sapiens
VKLLDQLHY

SEQ ID NO: 795437 - protein, 9 aa, Homo Sapiens
LSKCPACFG

SEQ ID NO: 795438 - protein, 9 aa, Homo Sapiens
SKCPACFGT

SEQ ID NO: 795439 - protein, 9 aa, Homo Sapiens
KIHNISVSA

SEQ ID NO: 795440 - protein, 9 aa, Homo Sapiens
VPSLFLFSV

SEQ ID NO: 795441 - protein, 9 aa, Homo Sapiens
HSPPTPMKK

SEQ ID NO: 795442 - protein, 9 aa, Homo Sapiens
RGLQGPAPR

SEQ ID NO: 795443 - protein, 9 aa, Homo Sapiens
LQGPAPRPA

SEQ ID NO: 795444 - protein, 9 aa, Homo Sapiens
TLRCSPDDI

SEQ ID NO: 795445 - protein, 9 aa, Homo Sapiens
SLGGIIYLV

SEQ ID NO: 795446 - protein, 9 aa, Homo Sapiens
LDQLHYSLR

SEQ ID NO: 795447 - protein, 9 aa, Homo Sapiens
ASVPSLFLF

SEQ ID NO: 795448 - protein, 9 aa, Homo Sapiens
SEVEEGAGN

SEQ ID NO: 795449 - protein, 9 aa, Homo Sapiens
ASLGGIIYL

SEQ ID NO: 795450 - protein, 9 aa, Homo Sapiens
DCCCCCCEE

SEQ ID NO: 795451 - protein, 9 aa, Homo Sapiens
WKSEVEEGA

SEQ ID NO: 795452 - protein, 9 aa, Homo Sapiens
PWKSEVEEG

SEQ ID NO: 795453 - protein, 9 aa, Homo Sapiens
EDDLQRNGV

SEQ ID NO: 795454 - protein, 9 aa, Homo Sapiens
SQDKLGLAV

SEQ ID NO: 795455 - protein, 9 aa, Homo Sapiens
AVCYRTDDE

SEQ ID NO: 795456 - protein, 9 aa, Homo Sapiens
VLRENSRPL

SEQ ID NO: 795457 - protein, 9 aa, Homo Sapiens
APLLGASLG

SEQ ID NO: 795458 - protein, 9 aa, Homo Sapiens
QRNGVVDAD

SEQ ID NO: 795459 - protein, 9 aa, Homo Sapiens
TLIALSPVA

SEQ ID NO: 795460 - protein, 9 aa, Homo Sapiens
ISHNKEQGT

SEQ ID NO: 795461 - protein, 9 aa, Homo Sapiens
ILQHISHNK

SEQ ID NO: 795462 - protein, 9 aa, Homo Sapiens
TSSSSQSET

SEQ ID NO: 795463 - protein, 9 aa, Homo Sapiens
LAVCYRTDD

SEQ ID NO: 795464 - protein, 9 aa, Homo Sapiens
MGSPLQSSS

SEQ ID NO: 795465 - protein, 9 aa, Homo Sapiens
DTVIDPDRI

SEQ ID NO: 795466 - protein, 9 aa, Homo Sapiens
RAAAEAALS

SEQ ID NO: 795467 - protein, 9 aa, Homo Sapiens
EFCEDDLQR

SEQ ID NO: 795468 - protein, 9 aa, Homo Sapiens
DKLGLAVCY

SEQ ID NO: 795469 - protein, 9 aa, Homo Sapiens
SVPSLFLFS

SEQ ID NO: 795470 - protein, 9 aa, Homo Sapiens
HSYYTLIAL

SEQ ID NO: 795471 - protein, 9 aa, Homo Sapiens
PSHSPPTPM

SEQ ID NO: 795472 - protein, 9 aa, Homo Sapiens
AAEAALSQT

SEQ ID NO: 795473 - protein, 9 aa, Homo Sapiens
IMRYAIATK

SEQ ID NO: 795474 - protein, 9 aa, Homo Sapiens
PLLGASLGG

SEQ ID NO: 795475 - protein, 9 aa, Homo Sapiens
PTPMKKLLV

SEQ ID NO: 795476 - protein, 9 aa, Homo Sapiens
KLGLAVCYR

SEQ ID NO: 795477 - protein, 9 aa, Homo Sapiens
VAIKIHNIS

SEQ ID NO: 795478 - protein, 9 aa, Homo Sapiens
PSTLNPTSR

SEQ ID NO: 795479 - protein, 9 aa, Homo Sapiens
PSLFLFSVF

SEQ ID NO: 795480 - protein, 9 aa, Homo Sapiens
YRLHCLAPM

SEQ ID NO: 795481 - protein, 9 aa, Homo Sapiens
LHYSLRIDL

SEQ ID NO: 795482 - protein, 9 aa, Homo Sapiens
IDPDRIMRY

SEQ ID NO: 795483 - protein, 9 aa, Homo Sapiens
MMGSPLQSS

SEQ ID NO: 795484 - protein, 9 aa, Homo Sapiens
VALASVPSL

SEQ ID NO: 795485 - protein, 9 aa, Homo Sapiens
SRSLLNAVD

SEQ ID NO: 795486 - protein, 9 aa, Homo Sapiens
KNICPTKDT

SEQ ID NO: 795487 - protein, 9 aa, Homo Sapiens
PMANICEDI

SEQ ID NO: 795488 - protein, 9 aa, Homo Sapiens
AEAALSQTG

SEQ ID NO: 795489 - protein, 9 aa, Homo Sapiens
SDHVKVVTL

SEQ ID NO: 795490 - protein, 9 aa, Homo Sapiens
ESLFGEALD

SEQ ID NO: 795491 - protein, 9 aa, Homo Sapiens
GLPVASERV

SEQ ID NO: 795492 - protein, 9 aa, Homo Sapiens
EDIMLKEVL

SEQ ID NO: 795493 - protein, 9 aa, Homo Sapiens
QPLDLQIYH

SEQ ID NO: 795494 - protein, 9 aa, Homo Sapiens
DGYPHCGKD

SEQ ID NO: 795495 - protein, 9 aa, Homo Sapiens
TELRALVAV

SEQ ID NO: 795496 - protein, 9 aa, Homo Sapiens
IKLACMETY

SEQ ID NO: 795497 - protein, 9 aa, Homo Sapiens
LGTCVLSSP

SEQ ID NO: 795498 - protein, 9 aa, Homo Sapiens
QVIKLACME

SEQ ID NO: 795499 - protein, 9 aa, Homo Sapiens
HQMVIFTKE

SEQ ID NO: 795500 - protein, 9 aa, Homo Sapiens
QKENGNESH

SEQ ID NO: 795501 - protein, 9 aa, Homo Sapiens
LTPDIAVPG

SEQ ID NO: 795502 - protein, 9 aa, Homo Sapiens
TGPSGPQGR

SEQ ID NO: 795503 - protein, 9 aa, Homo Sapiens
QQKENGNES

SEQ ID NO: 795504 - protein, 9 aa, Homo Sapiens
RTSMGATQQ

SEQ ID NO: 795505 - protein, 9 aa, Homo Sapiens
PMPGDQIKD

SEQ ID NO: 795506 - protein, 9 aa, Homo Sapiens
GRPGVKGEA

SEQ ID NO: 795507 - protein, 9 aa, Homo Sapiens
DGDTAIWPD

SEQ ID NO: 795508 - protein, 9 aa, Homo Sapiens
DERHVAFRS

SEQ ID NO: 795509 - protein, 9 aa, Homo Sapiens
SEVFSGLGS

SEQ ID NO: 795510 - protein, 9 aa, Homo Sapiens
ARCPDVDDC

SEQ ID NO: 795511 - protein, 9 aa, Homo Sapiens
QPQEAIPTQ

SEQ ID NO: 795512 - protein, 9 aa, Homo Sapiens
RSLLRRLWS

SEQ ID NO: 795513 - protein, 9 aa, Homo Sapiens
NGNESHLPE

SEQ ID NO: 795514 - protein, 9 aa, Homo Sapiens
WIHLLFFYL

SEQ ID NO: 795515 - protein, 9 aa, Homo Sapiens
PHCGKDQVD

SEQ ID NO: 795516 - protein, 9 aa, Homo Sapiens
EAIPTQDTF

SEQ ID NO: 795517 - protein, 9 aa, Homo Sapiens
ITMSLGQTA

SEQ ID NO: 795518 - protein, 9 aa, Homo Sapiens
YEIPSFSET

SEQ ID NO: 795519 - protein, 9 aa, Homo Sapiens
TLFDTDEYT

SEQ ID NO: 795520 - protein, 9 aa, Homo Sapiens
TSAHGIRTT

SEQ ID NO: 795521 - protein, 9 aa, Homo Sapiens
QGAHGESSL

SEQ ID NO: 795522 - protein, 9 aa, Homo Sapiens
APARSHRLK

SEQ ID NO: 795523 - protein, 9 aa, Homo Sapiens
AHGESSLAS

SEQ ID NO: 795524 - protein, 9 aa, Homo Sapiens
METYVVEVL

SEQ ID NO: 795525 - protein, 9 aa, Homo Sapiens
KENGNESHL

SEQ ID NO: 795526 - protein, 9 aa, Homo Sapiens
FPMPGDQIK

SEQ ID NO: 795527 - protein, 9 aa, Homo Sapiens
TSMGATQQQ

SEQ ID NO: 795528 - protein, 9 aa, Homo Sapiens
LACMETYVV

SEQ ID NO: 795529 - protein, 9 aa, Homo Sapiens
HCGKDQVDE

SEQ ID NO: 795530 - protein, 9 aa, Homo Sapiens
AAIHGRFTC

SEQ ID NO: 795531 - protein, 9 aa, Homo Sapiens
STAPAAHGV

SEQ ID NO: 795532 - protein, 9 aa, Homo Sapiens
TQRRTSMGA

SEQ ID NO: 795533 - protein, 9 aa, Homo Sapiens
GEALDEKVA

SEQ ID NO: 795534 - protein, 9 aa, Homo Sapiens
HVAFRSLLR

SEQ ID NO: 795535 - protein, 9 aa, Homo Sapiens
PLHLTPDIA

SEQ ID NO: 795536 - protein, 9 aa, Homo Sapiens
HHQRLHTGE

SEQ ID NO: 795537 - protein, 9 aa, Homo Sapiens
PGIFRGDKW

SEQ ID NO: 795538 - protein, 9 aa, Homo Sapiens
RPGVKGEAG

SEQ ID NO: 795539 - protein, 9 aa, Homo Sapiens
KRVAYYSAA

SEQ ID NO: 795540 - protein, 9 aa, Homo Sapiens
GESSLASSQ

SEQ ID NO: 795541 - protein, 9 aa, Homo Sapiens
GSTAPAAHG

SEQ ID NO: 795542 - protein, 9 aa, Homo Sapiens
HLLFFYLPQ

SEQ ID NO: 795543 - protein, 9 aa, Homo Sapiens
SAQPLDLQI

SEQ ID NO: 795544 - protein, 9 aa, Homo Sapiens
MSGGRWRGM

SEQ ID NO: 795545 - protein, 9 aa, Homo Sapiens
STTSAHGIR

SEQ ID NO: 795546 - protein, 9 aa, Homo Sapiens
TDEYTPPVW

SEQ ID NO: 795547 - protein, 9 aa, Homo Sapiens
IQKTSAQPL

SEQ ID NO: 795548 - protein, 9 aa, Homo Sapiens
LLRRLWSGW

SEQ ID NO: 795549 - protein, 9 aa, Homo Sapiens
MQGVILFVY

SEQ ID NO: 795550 - protein, 9 aa, Homo Sapiens
HGRFTCSQI

SEQ ID NO: 795551 - protein, 9 aa, Homo Sapiens
MVIFTKEVN

SEQ ID NO: 795552 - protein, 9 aa, Homo Sapiens
AAANRKRVA

SEQ ID NO: 795553 - protein, 9 aa, Homo Sapiens
AHGIRTTTG

SEQ ID NO: 795554 - protein, 9 aa, Homo Sapiens
ISKPLLYPA

SEQ ID NO: 795555 - protein, 9 aa, Homo Sapiens
LAVLEDSAR

SEQ ID NO: 795556 - protein, 9 aa, Homo Sapiens
AAHGVTSAP

SEQ ID NO: 795557 - protein, 9 aa, Homo Sapiens
HPPKTTMTS

SEQ ID NO: 795558 - protein, 9 aa, Homo Sapiens
IIHTEEKPC

SEQ ID NO: 795559 - protein, 9 aa, Homo Sapiens
SYHPGIFRG

SEQ ID NO: 795560 - protein, 9 aa, Homo Sapiens
VAVEPEDLD

SEQ ID NO: 795561 - protein, 9 aa, Homo Sapiens
SAHGIRTTT

SEQ ID NO: 795562 - protein, 9 aa, Homo Sapiens
EIPSFSETK

SEQ ID NO: 795563 - protein, 9 aa, Homo Sapiens
DVDDCRLGL

SEQ ID NO: 795564 - protein, 9 aa, Homo Sapiens
FRSLLRRLW

SEQ ID NO: 795565 - protein, 9 aa, Homo Sapiens
GDGDTAIWP

SEQ ID NO: 795566 - protein, 9 aa, Homo Sapiens
GAHGESSLA

SEQ ID NO: 795567 - protein, 9 aa, Homo Sapiens
YARCPDVDD

SEQ ID NO: 795568 - protein, 9 aa, Homo Sapiens
QDPLQPMET

SEQ ID NO: 795569 - protein, 9 aa, Homo Sapiens
TTSAHGIRT

SEQ ID NO: 795570 - protein, 9 aa, Homo Sapiens
AEVLPHTGL

SEQ ID NO: 795571 - protein, 9 aa, Homo Sapiens
TCSQILIQN

SEQ ID NO: 795572 - protein, 9 aa, Homo Sapiens
CGKDQVDER

SEQ ID NO: 795573 - protein, 9 aa, Homo Sapiens
AEDIMLKEV

SEQ ID NO: 795574 - protein, 9 aa, Homo Sapiens
RALVAVEPE

SEQ ID NO: 795575 - protein, 9 aa, Homo Sapiens
LVHMQGVIL

SEQ ID NO: 795576 - protein, 9 aa, Homo Sapiens
AGVLGLGTC

SEQ ID NO: 795577 - protein, 9 aa, Homo Sapiens
RCPDVDDCR

SEQ ID NO: 795578 - protein, 9 aa, Homo Sapiens
GMSGGRWRG

SEQ ID NO: 795579 - protein, 9 aa, Homo Sapiens
GQGGMSGGR

SEQ ID NO: 795580 - protein, 9 aa, Homo Sapiens
HLTPDIAVP

SEQ ID NO: 795581 - protein, 9 aa, Homo Sapiens
RFTCSQILI

SEQ ID NO: 795582 - protein, 9 aa, Homo Sapiens
VLGLGTCVL

SEQ ID NO: 795583 - protein, 9 aa, Homo Sapiens
ENGNESHLP

SEQ ID NO: 795584 - protein, 9 aa, Homo Sapiens
HPGIFRGDK

SEQ ID NO: 795585 - protein, 9 aa, Homo Sapiens
MDGYPHCGK

SEQ ID NO: 795586 - protein, 9 aa, Homo Sapiens
ATQQQFVEG

SEQ ID NO: 795587 - protein, 9 aa, Homo Sapiens
VLGASEAVA

SEQ ID NO: 795588 - protein, 9 aa, Homo Sapiens
WPQGAHGES

SEQ ID NO: 795589 - protein, 9 aa, Homo Sapiens
GKDQVDERH

SEQ ID NO: 795590 - protein, 9 aa, Homo Sapiens
LDLQIYHPS

SEQ ID NO: 795591 - protein, 9 aa, Homo Sapiens
KLACMETYV

SEQ ID NO: 795592 - protein, 9 aa, Homo Sapiens
GDTAIWPDA

SEQ ID NO: 795593 - protein, 9 aa, Homo Sapiens
IHGRFTCSQ

SEQ ID NO: 795594 - protein, 9 aa, Homo Sapiens
LHQMVIFTK

SEQ ID NO: 795595 - protein, 9 aa, Homo Sapiens
CQPQEAIPT

SEQ ID NO: 795596 - protein, 9 aa, Homo Sapiens
AFRSLLRRL

SEQ ID NO: 795597 - protein, 9 aa, Homo Sapiens
EYTPPVWKS

SEQ ID NO: 795598 - protein, 9 aa, Homo Sapiens
PLQPMETRF

SEQ ID NO: 795599 - protein, 9 aa, Homo Sapiens
LIIRQAWLS

SEQ ID NO: 795600 - protein, 9 aa, Homo Sapiens
ARSHRLKHP

SEQ ID NO: 795601 - protein, 9 aa, Homo Sapiens
GIFRGDKWS

SEQ ID NO: 795602 - protein, 9 aa, Homo Sapiens
NESLDLEAL

SEQ ID NO: 795603 - protein, 9 aa, Homo Sapiens
HSEVFSGLG

SEQ ID NO: 795604 - protein, 9 aa, Homo Sapiens
PAAHGVTSA

SEQ ID NO: 795605 - protein, 9 aa, Homo Sapiens
ESSLASSQA

SEQ ID NO: 795606 - protein, 9 aa, Homo Sapiens
HGESSLASS

SEQ ID NO: 795607 - protein, 9 aa, Homo Sapiens
SSLASSQAK

SEQ ID NO: 795608 - protein, 9 aa, Homo Sapiens
YKGQWHSEV

SEQ ID NO: 795609 - protein, 9 aa, Homo Sapiens
IMLKEVLGA

SEQ ID NO: 795610 - protein, 9 aa, Homo Sapiens
VPTLHQMVI

SEQ ID NO: 795611 - protein, 9 aa, Homo Sapiens
QGVILFVYD

SEQ ID NO: 795612 - protein, 9 aa, Homo Sapiens
KGSQSFDDK

SEQ ID NO: 795613 - protein, 9 aa, Homo Sapiens
PLKGSQSFD

SEQ ID NO: 795614 - protein, 9 aa, Homo Sapiens
MNHLQSLLL

SEQ ID NO: 795615 - protein, 9 aa, Homo Sapiens
IFTKEVNEW

SEQ ID NO: 795616 - protein, 9 aa, Homo Sapiens
IRTTTGSTR

SEQ ID NO: 795617 - protein, 9 aa, Homo Sapiens
PQGRPGVKG

SEQ ID NO: 795618 - protein, 9 aa, Homo Sapiens
NHLQSLLLD

SEQ ID NO: 795619 - protein, 9 aa, Homo Sapiens
IHLLFFYLP

SEQ ID NO: 795620 - protein, 9 aa, Homo Sapiens
VDERHVAFR

SEQ ID NO: 795621 - protein, 9 aa, Homo Sapiens
SLDLEALKL

SEQ ID NO: 795622 - protein, 9 aa, Homo Sapiens
IRQAWLSDS

SEQ ID NO: 795623 - protein, 9 aa, Homo Sapiens
RQPLHLTPD

SEQ ID NO: 795624 - protein, 9 aa, Homo Sapiens
LFGEALDEK

SEQ ID NO: 795625 - protein, 9 aa, Homo Sapiens
HNLIIRQAW

SEQ ID NO: 795626 - protein, 9 aa, Homo Sapiens
LFDTDEYTP

SEQ ID NO: 795627 - protein, 9 aa, Homo Sapiens
KFPMPGDQI

SEQ ID NO: 795628 - protein, 9 aa, Homo Sapiens
GPSGPQGRP

SEQ ID NO: 795629 - protein, 9 aa, Homo Sapiens
QKTSAQPLD

SEQ ID NO: 795630 - protein, 9 aa, Homo Sapiens
LVAVEPEDL

SEQ ID NO: 795631 - protein, 9 aa, Homo Sapiens
RRTSMGATQ

SEQ ID NO: 795632 - protein, 9 aa, Homo Sapiens
IIPPPHPLK

SEQ ID NO: 795633 - protein, 9 aa, Homo Sapiens
LGLGTCVLS

SEQ ID NO: 795634 - protein, 9 aa, Homo Sapiens
HFYEIPSFS

SEQ ID NO: 795635 - protein, 9 aa, Homo Sapiens
EHYHFYEIP

SEQ ID NO: 795636 - protein, 9 aa, Homo Sapiens
VLEDSARDI

SEQ ID NO: 795637 - protein, 9 aa, Homo Sapiens
HPLKGSQSF

SEQ ID NO: 795638 - protein, 9 aa, Homo Sapiens
VSQQPRQAE

SEQ ID NO: 795639 - protein, 9 aa, Homo Sapiens
GATQQQFVE

SEQ ID NO: 795640 - protein, 9 aa, Homo Sapiens
MSLGQTAEL

SEQ ID NO: 795641 - protein, 9 aa, Homo Sapiens
PQGAHGESS

SEQ ID NO: 795642 - protein, 9 aa, Homo Sapiens
VIVNQKAGL

SEQ ID NO: 795643 - protein, 9 aa, Homo Sapiens
PDVDDCRLG

SEQ ID NO: 795644 - protein, 9 aa, Homo Sapiens
AVEPEDLDT

SEQ ID NO: 795645 - protein, 9 aa, Homo Sapiens
PMNNITMSL

SEQ ID NO: 795646 - protein, 9 aa, Homo Sapiens
KMKYIIKFP

SEQ ID NO: 795647 - protein, 9 aa, Homo Sapiens
NRKRVAYYS

SEQ ID NO: 795648 - protein, 9 aa, Homo Sapiens
GSYHPGIFR

SEQ ID NO: 795649 - protein, 9 aa, Homo Sapiens
LIHHQRLHT

SEQ ID NO: 795650 - protein, 9 aa, Homo Sapiens
RRLWSGWIH

SEQ ID NO: 795651 - protein, 9 aa, Homo Sapiens
QEAIPTQDT

SEQ ID NO: 795652 - protein, 9 aa, Homo Sapiens
ELRALVAVE

SEQ ID NO: 795653 - protein, 9 aa, Homo Sapiens
KTSAQPLDL

SEQ ID NO: 795654 - protein, 9 aa, Homo Sapiens
LDLEALKLQ

SEQ ID NO: 795655 - protein, 9 aa, Homo Sapiens
GTCVLSSPY

SEQ ID NO: 795656 - protein, 9 aa, Homo Sapiens
TMSLGQTAE

SEQ ID NO: 795657 - protein, 9 aa, Homo Sapiens
QQPRQAEVL

SEQ ID NO: 795658 - protein, 9 aa, Homo Sapiens
GVILFVYDN

SEQ ID NO: 795659 - protein, 9 aa, Homo Sapiens
MKYIIKFPM

SEQ ID NO: 795660 - protein, 9 aa, Homo Sapiens
ENESLDLEA

SEQ ID NO: 795661 - protein, 9 aa, Homo Sapiens
QKAGLPVAS

SEQ ID NO: 795662 - protein, 9 aa, Homo Sapiens
QVDERHVAF

SEQ ID NO: 795663 - protein, 9 aa, Homo Sapiens
PHPLKGSQS

SEQ ID NO: 795664 - protein, 9 aa, Homo Sapiens
TAIWPDAFH

SEQ ID NO: 795665 - protein, 9 aa, Homo Sapiens
GRFTCSQIL

SEQ ID NO: 795666 - protein, 9 aa, Homo Sapiens
IVNQKAGLP

SEQ ID NO: 795667 - protein, 9 aa, Homo Sapiens
VIFTKEVNE

SEQ ID NO: 795668 - protein, 9 aa, Homo Sapiens
YIIKFPMPG

SEQ ID NO: 795669 - protein, 9 aa, Homo Sapiens
KHPPKTTMT

SEQ ID NO: 795670 - protein, 9 aa, Homo Sapiens
AQPLDLQIY

SEQ ID NO: 795671 - protein, 9 aa, Homo Sapiens
QRRTSMGAT

SEQ ID NO: 795672 - protein, 9 aa, Homo Sapiens
DIMLKEVLG

SEQ ID NO: 795673 - protein, 9 aa, Homo Sapiens
LRQPLHLTP

SEQ ID NO: 795674 - protein, 9 aa, Homo Sapiens
EDSARDIRE

SEQ ID NO: 795675 - protein, 9 aa, Homo Sapiens
WSGWIHLLF

SEQ ID NO: 795676 - protein, 9 aa, Homo Sapiens
LWSGWIHLL

SEQ ID NO: 795677 - protein, 9 aa, Homo Sapiens
LKGSQSFDD

SEQ ID NO: 795678 - protein, 9 aa, Homo Sapiens
RQAWLSDSG

SEQ ID NO: 795679 - protein, 9 aa, Homo Sapiens
KEVLGASEA

SEQ ID NO: 795680 - protein, 9 aa, Homo Sapiens
GPQGRPGVK

SEQ ID NO: 795681 - protein, 9 aa, Homo Sapiens
DTAIWPDAF

SEQ ID NO: 795682 - protein, 9 aa, Homo Sapiens
DEYTPPVWK

SEQ ID NO: 795683 - protein, 9 aa, Homo Sapiens
QGRPGVKGE

SEQ ID NO: 795684 - protein, 9 aa, Homo Sapiens
PPHPLKGSQ

SEQ ID NO: 795685 - protein, 9 aa, Homo Sapiens
LRALVAVEP

SEQ ID NO: 795686 - protein, 9 aa, Homo Sapiens
AIHGRFTCS

SEQ ID NO: 795687 - protein, 9 aa, Homo Sapiens
DEPMNNITM

SEQ ID NO: 795688 - protein, 9 aa, Homo Sapiens
SGWIHLLFF

SEQ ID NO: 795689 - protein, 9 aa, Homo Sapiens
IPTQDTFTE

SEQ ID NO: 795690 - protein, 9 aa, Homo Sapiens
ARDIREALH

SEQ ID NO: 795691 - protein, 9 aa, Homo Sapiens
IHHQRLHTG

SEQ ID NO: 795692 - protein, 9 aa, Homo Sapiens
TPDIAVPGA

SEQ ID NO: 795693 - protein, 9 aa, Homo Sapiens
SARDIREAL

SEQ ID NO: 795694 - protein, 9 aa, Homo Sapiens
DDCRLGLAR

SEQ ID NO: 795695 - protein, 9 aa, Homo Sapiens
HYHFYEIPS

SEQ ID NO: 795696 - protein, 9 aa, Homo Sapiens
RHVAFRSLL

SEQ ID NO: 795697 - protein, 9 aa, Homo Sapiens
EPMNNITMS

SEQ ID NO: 795698 - protein, 9 aa, Homo Sapiens
NESHLPERD

SEQ ID NO: 795699 - protein, 9 aa, Homo Sapiens
KYIIKFPMP

SEQ ID NO: 795700 - protein, 9 aa, Homo Sapiens
ETYVVEVLV

SEQ ID NO: 795701 - protein, 9 aa, Homo Sapiens
QPMETRFVD

SEQ ID NO: 795702 - protein, 9 aa, Homo Sapiens
RSHRLKHPP

SEQ ID NO: 795703 - protein, 9 aa, Homo Sapiens
SMGATQQQF

SEQ ID NO: 795704 - protein, 9 aa, Homo Sapiens
LEDSARDIR

SEQ ID NO: 795705 - protein, 9 aa, Homo Sapiens
SGGRWRGMY

SEQ ID NO: 795706 - protein, 9 aa, Homo Sapiens
IIKFPMPGD

SEQ ID NO: 795707 - protein, 9 aa, Homo Sapiens
DYLVHMQGV

SEQ ID NO: 795708 - protein, 9 aa, Homo Sapiens
SHRLKHPPK

SEQ ID NO: 795709 - protein, 9 aa, Homo Sapiens
AGLPVASER

SEQ ID NO: 795710 - protein, 9 aa, Homo Sapiens
MTPAPARSH

SEQ ID NO: 795711 - protein, 9 aa, Homo Sapiens
PMDGYPHCG

SEQ ID NO: 795712 - protein, 9 aa, Homo Sapiens
QAEVLPHTG

SEQ ID NO: 795713 - protein, 9 aa, Homo Sapiens
GGMSGGRWR

SEQ ID NO: 795714 - protein, 9 aa, Homo Sapiens
SLIHHQRLH

SEQ ID NO: 795715 - protein, 9 aa, Homo Sapiens
CPDVDDCRL

SEQ ID NO: 795716 - protein, 9 aa, Homo Sapiens
TCVLSSPYD

SEQ ID NO: 795717 - protein, 9 aa, Homo Sapiens
FTCSQILIQ

SEQ ID NO: 795718 - protein, 9 aa, Homo Sapiens
IKFPMPGDQ

SEQ ID NO: 795719 - protein, 9 aa, Homo Sapiens
KDQVDERHV

SEQ ID NO: 795720 - protein, 9 aa, Homo Sapiens
SKPLLYPAI

SEQ ID NO: 795721 - protein, 9 aa, Homo Sapiens
DTDEYTPPV

SEQ ID NO: 795722 - protein, 9 aa, Homo Sapiens
LESLFGEAL

SEQ ID NO: 795723 - protein, 9 aa, Homo Sapiens
PSFSETKAK

SEQ ID NO: 795724 - protein, 9 aa, Homo Sapiens
VIKLACMET

SEQ ID NO: 795725 - protein, 9 aa, Homo Sapiens
LHLTPDIAV

SEQ ID NO: 795726 - protein, 9 aa, Homo Sapiens
HAGVLGLGT

SEQ ID NO: 795727 - protein, 9 aa, Homo Sapiens
TYKGQWHSE

SEQ ID NO: 795728 - protein, 9 aa, Homo Sapiens
ALVAVEPED

SEQ ID NO: 795729 - protein, 9 aa, Homo Sapiens
NQKAGLPVA

SEQ ID NO: 795730 - protein, 9 aa, Homo Sapiens
DCRLGLARC

SEQ ID NO: 795731 - protein, 9 aa, Homo Sapiens
PTLHQMVIF

SEQ ID NO: 795732 - protein, 9 aa, Homo Sapiens
LMTPAPARS

SEQ ID NO: 795733 - protein, 9 aa, Homo Sapiens
VAFRSLLRR

SEQ ID NO: 795734 - protein, 9 aa, Homo Sapiens
CMETYVVEV

SEQ ID NO: 795735 - protein, 9 aa, Homo Sapiens
RKRVAYYSA

SEQ ID NO: 795736 - protein, 9 aa, Homo Sapiens
CSQILIQNG

SEQ ID NO: 795737 - protein, 9 aa, Homo Sapiens
LQPMETRFV

SEQ ID NO: 795738 - protein, 9 aa, Homo Sapiens
SSTTSAHGI

SEQ ID NO: 795739 - protein, 9 aa, Homo Sapiens
VILFVYDNK

SEQ ID NO: 795740 - protein, 9 aa, Homo Sapiens
LEALKLQEP

SEQ ID NO: 795741 - protein, 9 aa, Homo Sapiens
VAYYSAAGP

SEQ ID NO: 795742 - protein, 9 aa, Homo Sapiens
FGDGDTAIW

SEQ ID NO: 795743 - protein, 9 aa, Homo Sapiens
WHSEVFSGL

SEQ ID NO: 795744 - protein, 9 aa, Homo Sapiens
QAWLSDSGN

SEQ ID NO: 795745 - protein, 9 aa, Homo Sapiens
TLHQMVIFT

SEQ ID NO: 795746 - protein, 9 aa, Homo Sapiens
VLAVLEDSA

SEQ ID NO: 795747 - protein, 9 aa, Homo Sapiens
ERHVAFRSL

SEQ ID NO: 795748 - protein, 9 aa, Homo Sapiens
RSSSLIHHQ

SEQ ID NO: 795749 - protein, 9 aa, Homo Sapiens
HMQGVILFV

SEQ ID NO: 795750 - protein, 9 aa, Homo Sapiens
DLEALKLQE

SEQ ID NO: 795751 - protein, 9 aa, Homo Sapiens
SLFGEALDE

SEQ ID NO: 795752 - protein, 9 aa, Homo Sapiens
LRRLWSGWI

SEQ ID NO: 795753 - protein, 9 aa, Homo Sapiens
LKHPPKTTM

SEQ ID NO: 795754 - protein, 9 aa, Homo Sapiens
FYEIPSFSE

SEQ ID NO: 795755 - protein, 9 aa, Homo Sapiens
IFRGDKWSC

SEQ ID NO: 795756 - protein, 9 aa, Homo Sapiens
DPLQPMETR

SEQ ID NO: 795757 - protein, 9 aa, Homo Sapiens
GNESHLPER

SEQ ID NO: 795758 - protein, 9 aa, Homo Sapiens
KENESLDLE

SEQ ID NO: 795759 - protein, 9 aa, Homo Sapiens
SVIVNQKAG

SEQ ID NO: 795760 - protein, 9 aa, Homo Sapiens
TPAPARSHR

SEQ ID NO: 795761 - protein, 9 aa, Homo Sapiens
YTPPVWKSY

SEQ ID NO: 795762 - protein, 9 aa, Homo Sapiens
GHFGDGDTA

SEQ ID NO: 795763 - protein, 9 aa, Homo Sapiens
ESLDLEALK

SEQ ID NO: 795764 - protein, 9 aa, Homo Sapiens
LQQKENGNE

SEQ ID NO: 795765 - protein, 9 aa, Homo Sapiens
EEMGSVNEA

SEQ ID NO: 795766 - protein, 9 aa, Homo Sapiens
AIPTQDTFT

SEQ ID NO: 795767 - protein, 9 aa, Homo Sapiens
EVLPHTGLS

SEQ ID NO: 795768 - protein, 9 aa, Homo Sapiens
LMELMTPAP

SEQ ID NO: 795769 - protein, 9 aa, Homo Sapiens
FGEALDEKV

SEQ ID NO: 795770 - protein, 9 aa, Homo Sapiens
VHMQGVILF

SEQ ID NO: 795771 - protein, 9 aa, Homo Sapiens
HRLKHPPKT

SEQ ID NO: 795772 - protein, 9 aa, Homo Sapiens
PMETRFVDG

SEQ ID NO: 795773 - protein, 9 aa, Homo Sapiens
SQDPLQPME

SEQ ID NO: 795774 - protein, 9 aa, Homo Sapiens
AHLESLFGE

SEQ ID NO: 795775 - protein, 9 aa, Homo Sapiens
AANRKRVAY

SEQ ID NO: 795776 - protein, 9 aa, Homo Sapiens
YHPGIFRGD

SEQ ID NO: 795777 - protein, 9 aa, Homo Sapiens
VNQKAGLPV

SEQ ID NO: 795778 - protein, 9 aa, Homo Sapiens
TQDTFTEIL

SEQ ID NO: 795779 - protein, 9 aa, Homo Sapiens
TLRQPLHLT

SEQ ID NO: 795780 - protein, 9 aa, Homo Sapiens
ANRKRVAYY

SEQ ID NO: 795781 - protein, 9 aa, Homo Sapiens
HGIRTTTGS

SEQ ID NO: 795782 - protein, 9 aa, Homo Sapiens
TSAQPLDLQ

SEQ ID NO: 795783 - protein, 9 aa, Homo Sapiens
QPRQAEVLP

SEQ ID NO: 795784 - protein, 9 aa, Homo Sapiens
RQAEVLPHT

SEQ ID NO: 795785 - protein, 9 aa, Homo Sapiens
TEEKPCKCE

SEQ ID NO: 795786 - protein, 9 aa, Homo Sapiens
EALKLQEPD

SEQ ID NO: 795787 - protein, 9 aa, Homo Sapiens
AWLSDSGNY

SEQ ID NO: 795788 - protein, 9 aa, Homo Sapiens
TAPAAHGVT

SEQ ID NO: 795789 - protein, 9 aa, Homo Sapiens
KAGLPVASE

SEQ ID NO: 795790 - protein, 9 aa, Homo Sapiens
NLIIRQAWL

SEQ ID NO: 795791 - protein, 9 aa, Homo Sapiens
MGATQQQFV

SEQ ID NO: 795792 - protein, 9 aa, Homo Sapiens
ACMETYVVE

SEQ ID NO: 795793 - protein, 9 aa, Homo Sapiens
MELMTPAPA

SEQ ID NO: 795794 - protein, 9 aa, Homo Sapiens
GGHFGDGDT

SEQ ID NO: 795795 - protein, 9 aa, Homo Sapiens
PAHLESLFG

SEQ ID NO: 795796 - protein, 9 aa, Homo Sapiens
NITMSLGQT

SEQ ID NO: 795797 - protein, 9 aa, Homo Sapiens
AAAANRKRV

SEQ ID NO: 795798 - protein, 9 aa, Homo Sapiens
GVLGLGTCV

SEQ ID NO: 795799 - protein, 9 aa, Homo Sapiens
PGSTAPAAH

SEQ ID NO: 795800 - protein, 9 aa, Homo Sapiens
GLGTCVLSS

SEQ ID NO: 795801 - protein, 9 aa, Homo Sapiens
IIRQAWLSD

SEQ ID NO: 795802 - protein, 9 aa, Homo Sapiens
QWHSEVFSG

SEQ ID NO: 795803 - protein, 9 aa, Homo Sapiens
EVLGASEAV

SEQ ID NO: 795804 - protein, 9 aa, Homo Sapiens
PPKTTMTSS

SEQ ID NO: 795805 - protein, 9 aa, Homo Sapiens
LKEVLGASE

SEQ ID NO: 795806 - protein, 9 aa, Homo Sapiens
GIRTTTGST

SEQ ID NO: 795807 - protein, 9 aa, Homo Sapiens
NNITMSLGQ

SEQ ID NO: 795808 - protein, 9 aa, Homo Sapiens
APGSTAPAA

SEQ ID NO: 795809 - protein, 9 aa, Homo Sapiens
PLDLQIYHP

SEQ ID NO: 795810 - protein, 9 aa, Homo Sapiens
GQWHSEVFS

SEQ ID NO: 795811 - protein, 9 aa, Homo Sapiens
MNNITMSLG

SEQ ID NO: 795812 - protein, 9 aa, Homo Sapiens
SLLRRLWSG

SEQ ID NO: 795813 - protein, 9 aa, Homo Sapiens
IPSFSETKA

SEQ ID NO: 795814 - protein, 9 aa, Homo Sapiens
MLKEVLGAS

SEQ ID NO: 795815 - protein, 9 aa, Homo Sapiens
IHTEEKPCK

SEQ ID NO: 795816 - protein, 9 aa, Homo Sapiens
HLESLFGEA

SEQ ID NO: 795817 - protein, 9 aa, Homo Sapiens
APAAHGVTS

SEQ ID NO: 795818 - protein, 9 aa, Homo Sapiens
PRQAEVLPH

SEQ ID NO: 795819 - protein, 9 aa, Homo Sapiens
YLVHMQGVI

SEQ ID NO: 795820 - protein, 9 aa, Homo Sapiens
METRFVDGR

SEQ ID NO: 795821 - protein, 9 aa, Homo Sapiens
ELMTPAPAR

SEQ ID NO: 795822 - protein, 9 aa, Homo Sapiens
QMVIFTKEV

SEQ ID NO: 795823 - protein, 9 aa, Homo Sapiens
TPPVWKSYL

SEQ ID NO: 795824 - protein, 9 aa, Homo Sapiens
YHFYEIPSF

SEQ ID NO: 795825 - protein, 9 aa, Homo Sapiens
AISKPLLYP

SEQ ID NO: 795826 - protein, 9 aa, Homo Sapiens
PSGPQGRPG

SEQ ID NO: 795827 - protein, 9 aa, Homo Sapiens
QPLHLTPDI

SEQ ID NO: 795828 - protein, 9 aa, Homo Sapiens
EVFSGLGSM

SEQ ID NO: 795829 - protein, 9 aa, Homo Sapiens
VDDCRLGLA

SEQ ID NO: 795830 - protein, 9 aa, Homo Sapiens
KGQWHSEVF

SEQ ID NO: 795831 - protein, 9 aa, Homo Sapiens
GYPHCGKDQ

SEQ ID NO: 795832 - protein, 9 aa, Homo Sapiens
DSARDIREA

SEQ ID NO: 795833 - protein, 9 aa, Homo Sapiens
QGGMSGGRW

SEQ ID NO: 795834 - protein, 9 aa, Homo Sapiens
PAPGSTAPA

SEQ ID NO: 795835 - protein, 9 aa, Homo Sapiens
PARSHRLKH

SEQ ID NO: 795836 - protein, 9 aa, Homo Sapiens
GWIHLLFFY

SEQ ID NO: 795837 - protein, 9 aa, Homo Sapiens
FDTDEYTPP

SEQ ID NO: 795838 - protein, 9 aa, Homo Sapiens
ASQDPLQPM

SEQ ID NO: 795839 - protein, 9 aa, Homo Sapiens
IPPPHPLKG

SEQ ID NO: 795840 - protein, 9 aa, Homo Sapiens
RVAYYSAAG

SEQ ID NO: 795841 - protein, 9 aa, Homo Sapiens
RLKHPPKTT

SEQ ID NO: 795842 - protein, 9 aa, Homo Sapiens
HFGDGDTAI

SEQ ID NO: 795843 - protein, 9 aa, Homo Sapiens
SEEMGSVNE

SEQ ID NO: 795844 - protein, 9 aa, Homo Sapiens
WLSDSGNYT

SEQ ID NO: 795845 - protein, 9 aa, Homo Sapiens
YPHCGKDQV

SEQ ID NO: 795846 - protein, 9 aa, Homo Sapiens
PAPARSHRL

SEQ ID NO: 795847 - protein, 9 aa, Homo Sapiens
DQVDERHVA

SEQ ID NO: 795848 - protein, 9 aa, Homo Sapiens
PTQDTFTEI

SEQ ID NO: 795849 - protein, 9 aa, Homo Sapiens
PQEAIPTQD

SEQ ID NO: 795850 - protein, 9 aa, Homo Sapiens
PPPHPLKGS

SEQ ID NO: 795851 - protein, 9 aa, Homo Sapiens
RLWSGWIHL

SEQ ID NO: 795852 - protein, 9 aa, Homo Sapiens
PLQQKENGN

SEQ ID NO: 795853 - protein, 9 aa, Homo Sapiens
SSLIHHQRL

SEQ ID NO: 795854 - protein, 9 aa, Homo Sapiens
AVLEDSARD

SEQ ID NO: 795855 - protein, 9 aa, Homo Sapiens
VEPEDLDTE

SEQ ID NO: 795856 - protein, 9 aa, Homo Sapiens
SQQPRQAEV

SEQ ID NO: 795857 - protein, 9 aa, Homo Sapiens
QETEALDVS

SEQ ID NO: 795858 - protein, 9 aa, Homo Sapiens
AMMMDTDVQ

SEQ ID NO: 795859 - protein, 9 aa, Homo Sapiens
DKGGAGEGL

SEQ ID NO: 795860 - protein, 9 aa, Homo Sapiens
LHFCATLRR

SEQ ID NO: 795861 - protein, 9 aa, Homo Sapiens
DHAAPDITL

SEQ ID NO: 795862 - protein, 9 aa, Homo Sapiens
DVVQRRQQA

SEQ ID NO: 795863 - protein, 9 aa, Homo Sapiens
NPSDKDRED

SEQ ID NO: 795864 - protein, 9 aa, Homo Sapiens
RCRVCPAPG

SEQ ID NO: 795865 - protein, 9 aa, Homo Sapiens
LPEAAGTRD

SEQ ID NO: 795866 - protein, 9 aa, Homo Sapiens
DADRQRMLE

SEQ ID NO: 795867 - protein, 9 aa, Homo Sapiens
RMLELEKNE

SEQ ID NO: 795868 - protein, 9 aa, Homo Sapiens
SFANVLKEG

SEQ ID NO: 795869 - protein, 9 aa, Homo Sapiens
CTEKQRKVS

SEQ ID NO: 795870 - protein, 9 aa, Homo Sapiens
GPHDIHKCS

SEQ ID NO: 795871 - protein, 9 aa, Homo Sapiens
TAYHMAVAC

SEQ ID NO: 795872 - protein, 9 aa, Homo Sapiens
FNILMDRPL

SEQ ID NO: 795873 - protein, 9 aa, Homo Sapiens
QQTAVAQRK

SEQ ID NO: 795874 - protein, 9 aa, Homo Sapiens
FNALLVDGT

SEQ ID NO: 795875 - protein, 9 aa, Homo Sapiens
EPEKELCKS

SEQ ID NO: 795876 - protein, 9 aa, Homo Sapiens
VCECQDSDF

SEQ ID NO: 795877 - protein, 9 aa, Homo Sapiens
ARIDVTSVG

SEQ ID NO: 795878 - protein, 9 aa, Homo Sapiens
SYYAYIFEL

SEQ ID NO: 795879 - protein, 9 aa, Homo Sapiens
LLGQLCQQG

SEQ ID NO: 795880 - protein, 9 aa, Homo Sapiens
EKELCKSRG

SEQ ID NO: 795881 - protein, 9 aa, Homo Sapiens
SMLDPAQIS

SEQ ID NO: 795882 - protein, 9 aa, Homo Sapiens
QDSDFLCDY

SEQ ID NO: 795883 - protein, 9 aa, Homo Sapiens
TKLVAEPNR

SEQ ID NO: 795884 - protein, 9 aa, Homo Sapiens
NMNEEISSD

SEQ ID NO: 795885 - protein, 9 aa, Homo Sapiens
NIRKQTNIA

SEQ ID NO: 795886 - protein, 9 aa, Homo Sapiens
HDDNPSDKD

SEQ ID NO: 795887 - protein, 9 aa, Homo Sapiens
KSKEELTEH

SEQ ID NO: 795888 - protein, 9 aa, Homo Sapiens
DQVSKNKHK

SEQ ID NO: 795889 - protein, 9 aa, Homo Sapiens
EKQASVSAE

SEQ ID NO: 795890 - protein, 9 aa, Homo Sapiens
VLLTRKLSL

SEQ ID NO: 795891 - protein, 9 aa, Homo Sapiens
KAQETEALD

SEQ ID NO: 795892 - protein, 9 aa, Homo Sapiens
ADRQRMLEL

SEQ ID NO: 795893 - protein, 9 aa, Homo Sapiens
EYLSQRLHI

SEQ ID NO: 795894 - protein, 9 aa, Homo Sapiens
DTPHPPCAP

SEQ ID NO: 795895 - protein, 9 aa, Homo Sapiens
DSFDGPESQ

SEQ ID NO: 795896 - protein, 9 aa, Homo Sapiens
IQLSEVDKS

SEQ ID NO: 795897 - protein, 9 aa, Homo Sapiens
SGLMNCRDA

SEQ ID NO: 795898 - protein, 9 aa, Homo Sapiens
LGRTGARSH

SEQ ID NO: 795899 - protein, 9 aa, Homo Sapiens
IYEQCGGQI

SEQ ID NO: 795900 - protein, 9 aa, Homo Sapiens
DMGTYTCEA

SEQ ID NO: 795901 - protein, 9 aa, Homo Sapiens
SGDTEKGQS

SEQ ID NO: 795902 - protein, 9 aa, Homo Sapiens
ALALLGRTG

SEQ ID NO: 795903 - protein, 9 aa, Homo Sapiens
ALALALLGR

SEQ ID NO: 795904 - protein, 9 aa, Homo Sapiens
WHPSRSAST

SEQ ID NO: 795905 - protein, 9 aa, Homo Sapiens
CSGFYSYFF

SEQ ID NO: 795906 - protein, 9 aa, Homo Sapiens
APGRKGDSR

SEQ ID NO: 795907 - protein, 9 aa, Homo Sapiens
SSERWCSGF

SEQ ID NO: 795908 - protein, 9 aa, Homo Sapiens
YHMAVACED

SEQ ID NO: 795909 - protein, 9 aa, Homo Sapiens
EWRIDQAFV

SEQ ID NO: 795910 - protein, 9 aa, Homo Sapiens
RSQSPLWGM

SEQ ID NO: 795911 - protein, 9 aa, Homo Sapiens
YICNNECDA

SEQ ID NO: 795912 - protein, 9 aa, Homo Sapiens
AMHTLFMRD

SEQ ID NO: 795913 - protein, 9 aa, Homo Sapiens
VSSGSSLVS

SEQ ID NO: 795914 - protein, 9 aa, Homo Sapiens
ELVQKGTRA

SEQ ID NO: 795915 - protein, 9 aa, Homo Sapiens
YHSLARHAD

SEQ ID NO: 795916 - protein, 9 aa, Homo Sapiens
LRATSRPPS

SEQ ID NO: 795917 - protein, 9 aa, Homo Sapiens
MSEILQSIA

SEQ ID NO: 795918 - protein, 9 aa, Homo Sapiens
RTGISSSER

SEQ ID NO: 795919 - protein, 9 aa, Homo Sapiens
KNKSGLAFR

SEQ ID NO: 795920 - protein, 9 aa, Homo Sapiens
VVTLYKHDD

SEQ ID NO: 795921 - protein, 9 aa, Homo Sapiens
KTLEGQAQQ

SEQ ID NO: 795922 - protein, 9 aa, Homo Sapiens
NLYHLTNYT

SEQ ID NO: 795923 - protein, 9 aa, Homo Sapiens
VSDADRQRM

SEQ ID NO: 795924 - protein, 9 aa, Homo Sapiens
PPCAPGRKG

SEQ ID NO: 795925 - protein, 9 aa, Homo Sapiens
AELVQKGTR

SEQ ID NO: 795926 - protein, 9 aa, Homo Sapiens
IDVTSVGSK

SEQ ID NO: 795927 - protein, 9 aa, Homo Sapiens
IFHSWKKEE

SEQ ID NO: 795928 - protein, 9 aa, Homo Sapiens
DKTSNIRKQ

SEQ ID NO: 795929 - protein, 9 aa, Homo Sapiens
IWGQRCRVC

SEQ ID NO: 795930 - protein, 9 aa, Homo Sapiens
GFDTVLQHQ

SEQ ID NO: 795931 - protein, 9 aa, Homo Sapiens
ESRFNWKLF

SEQ ID NO: 795932 - protein, 9 aa, Homo Sapiens
TSRPPSTEH

SEQ ID NO: 795933 - protein, 9 aa, Homo Sapiens
QAELVQKGT

SEQ ID NO: 795934 - protein, 9 aa, Homo Sapiens
LTQQSASYI

SEQ ID NO: 795935 - protein, 9 aa, Homo Sapiens
RILNFVVPA

SEQ ID NO: 795936 - protein, 9 aa, Homo Sapiens
PIIIHDDNP

SEQ ID NO: 795937 - protein, 9 aa, Homo Sapiens
TEKGQSPGV

SEQ ID NO: 795938 - protein, 9 aa, Homo Sapiens
LPAVPVVTL

SEQ ID NO: 795939 - protein, 9 aa, Homo Sapiens
SRETLQGLC

SEQ ID NO: 795940 - protein, 9 aa, Homo Sapiens
QVPVPYGPG

SEQ ID NO: 795941 - protein, 9 aa, Homo Sapiens
DIHKCSPRE

SEQ ID NO: 795942 - protein, 9 aa, Homo Sapiens
PLWGMPETT

SEQ ID NO: 795943 - protein, 9 aa, Homo Sapiens
EAAGTRDSR

SEQ ID NO: 795944 - protein, 9 aa, Homo Sapiens
LSTPPLLPP

SEQ ID NO: 795945 - protein, 9 aa, Homo Sapiens
CATLRRGRS

SEQ ID NO: 795946 - protein, 9 aa, Homo Sapiens
TLEGQAQQT

SEQ ID NO: 795947 - protein, 9 aa, Homo Sapiens
SALQKMESL

SEQ ID NO: 795948 - protein, 9 aa, Homo Sapiens
IKGEGSRKG

SEQ ID NO: 795949 - protein, 9 aa, Homo Sapiens
WEDTAAKEE

SEQ ID NO: 795950 - protein, 9 aa, Homo Sapiens
SQPGREPQA

SEQ ID NO: 795951 - protein, 9 aa, Homo Sapiens
SPLARCYPN

SEQ ID NO: 795952 - protein, 9 aa, Homo Sapiens
RSRVKVLKT

SEQ ID NO: 795953 - protein, 9 aa, Homo Sapiens
FANVLKEGT

SEQ ID NO: 795954 - protein, 9 aa, Homo Sapiens
ISSSERWCS

SEQ ID NO: 795955 - protein, 9 aa, Homo Sapiens
GTRDSRDNP

SEQ ID NO: 795956 - protein, 9 aa, Homo Sapiens
TPHVVESRF

SEQ ID NO: 795957 - protein, 9 aa, Homo Sapiens
RRQLRATSR

SEQ ID NO: 795958 - protein, 9 aa, Homo Sapiens
MAASATGSL

SEQ ID NO: 795959 - protein, 9 aa, Homo Sapiens
ETDKWVGNS

SEQ ID NO: 795960 - protein, 9 aa, Homo Sapiens
SAPPQPVLG

SEQ ID NO: 795961 - protein, 9 aa, Homo Sapiens
TIDFSSDLT

SEQ ID NO: 795962 - protein, 9 aa, Homo Sapiens
ANVLKEGTE

SEQ ID NO: 795963 - protein, 9 aa, Homo Sapiens
PSVGFDTVL

SEQ ID NO: 795964 - protein, 9 aa, Homo Sapiens
DIIFHSWKK

SEQ ID NO: 795965 - protein, 9 aa, Homo Sapiens
MLQGATKLV

SEQ ID NO: 795966 - protein, 9 aa, Homo Sapiens
IDFSSDLTQ

SEQ ID NO: 795967 - protein, 9 aa, Homo Sapiens
INLYHLTNY

SEQ ID NO: 795968 - protein, 9 aa, Homo Sapiens
CQDSDFLCD

SEQ ID NO: 795969 - protein, 9 aa, Homo Sapiens
KELRSNIQQ

SEQ ID NO: 795970 - protein, 9 aa, Homo Sapiens
ALLGRTGAR

SEQ ID NO: 795971 - protein, 9 aa, Homo Sapiens
RTHMNEVGY

SEQ ID NO: 795972 - protein, 9 aa, Homo Sapiens
VAPSQPGRE

SEQ ID NO: 795973 - protein, 9 aa, Homo Sapiens
PAQISHFYL

SEQ ID NO: 795974 - protein, 9 aa, Homo Sapiens
ALQKMESLD

SEQ ID NO: 795975 - protein, 9 aa, Homo Sapiens
KVFVDARDI

SEQ ID NO: 795976 - protein, 9 aa, Homo Sapiens
KGGAGEGLV

SEQ ID NO: 795977 - protein, 9 aa, Homo Sapiens
QISHFYLVT

SEQ ID NO: 795978 - protein, 9 aa, Homo Sapiens
DTVLQHQDK

SEQ ID NO: 795979 - protein, 9 aa, Homo Sapiens
ATKLVAEPN

SEQ ID NO: 795980 - protein, 9 aa, Homo Sapiens
FQAIAMMMD

SEQ ID NO: 795981 - protein, 9 aa, Homo Sapiens
GSCGFPGRG

SEQ ID NO: 795982 - protein, 9 aa, Homo Sapiens
PKQQLYQLQ

SEQ ID NO: 795983 - protein, 9 aa, Homo Sapiens
SWKKEENGN

SEQ ID NO: 795984 - protein, 9 aa, Homo Sapiens
TPPLLPPSP

SEQ ID NO: 795985 - protein, 9 aa, Homo Sapiens
TSDLYPDAS

SEQ ID NO: 795986 - protein, 9 aa, Homo Sapiens
SRPPSTEHA

SEQ ID NO: 795987 - protein, 9 aa, Homo Sapiens
DIKQNARTL

SEQ ID NO: 795988 - protein, 9 aa, Homo Sapiens
AGTRDSRDN

SEQ ID NO: 795989 - protein, 9 aa, Homo Sapiens
THMNEVGYN

SEQ ID NO: 795990 - protein, 9 aa, Homo Sapiens
IIIHDDNPS

SEQ ID NO: 795991 - protein, 9 aa, Homo Sapiens
KTKHDLMIK

SEQ ID NO: 795992 - protein, 9 aa, Homo Sapiens
GLPEAAGTR

SEQ ID NO: 795993 - protein, 9 aa, Homo Sapiens
ICNNECDAS

SEQ ID NO: 795994 - protein, 9 aa, Homo Sapiens
LCPEPTKTR

SEQ ID NO: 795995 - protein, 9 aa, Homo Sapiens
FPDKTSNIR

SEQ ID NO: 795996 - protein, 9 aa, Homo Sapiens
APPQPVLGL

SEQ ID NO: 795997 - protein, 9 aa, Homo Sapiens
EKAINAFFR

SEQ ID NO: 795998 - protein, 9 aa, Homo Sapiens
EVPGVFSRS

SEQ ID NO: 795999 - protein, 9 aa, Homo Sapiens
KMESLDAME

SEQ ID NO: 796000 - protein, 9 aa, Homo Sapiens
ESGPHDIHK

SEQ ID NO: 796001 - protein, 9 aa, Homo Sapiens
RIWGQRCRV

SEQ ID NO: 796002 - protein, 9 aa, Homo Sapiens
FKVQQGRTA

SEQ ID NO: 796003 - protein, 9 aa, Homo Sapiens
ESERRYHSL

SEQ ID NO: 796004 - protein, 9 aa, Homo Sapiens
DITLDPLEI

SEQ ID NO: 796005 - protein, 9 aa, Homo Sapiens
DPRVLHFCA

SEQ ID NO: 796006 - protein, 9 aa, Homo Sapiens
VVQRRQQAY

SEQ ID NO: 796007 - protein, 9 aa, Homo Sapiens
DVTSVGSKL

SEQ ID NO: 796008 - protein, 9 aa, Homo Sapiens
HPPCAPGRK

SEQ ID NO: 796009 - protein, 9 aa, Homo Sapiens
LARCYPNRD

SEQ ID NO: 796010 - protein, 9 aa, Homo Sapiens
PMPIDESFA

SEQ ID NO: 796011 - protein, 9 aa, Homo Sapiens
VGGRQGSPA

SEQ ID NO: 796012 - protein, 9 aa, Homo Sapiens
EVAAVAPSQ

SEQ ID NO: 796013 - protein, 9 aa, Homo Sapiens
FDTVLQHQD

SEQ ID NO: 796014 - protein, 9 aa, Homo Sapiens
PVPYGPGGG

SEQ ID NO: 796015 - protein, 9 aa, Homo Sapiens
SAENSVICS

SEQ ID NO: 796016 - protein, 9 aa, Homo Sapiens
FVDARDIKQ

SEQ ID NO: 796017 - protein, 9 aa, Homo Sapiens
AVSPLARCY

SEQ ID NO: 796018 - protein, 9 aa, Homo Sapiens
VSPLARCYP

SEQ ID NO: 796019 - protein, 9 aa, Homo Sapiens
APDITLDPL

SEQ ID NO: 796020 - protein, 9 aa, Homo Sapiens
RTANSEKET

SEQ ID NO: 796021 - protein, 9 aa, Homo Sapiens
HDIHKCSPR

SEQ ID NO: 796022 - protein, 9 aa, Homo Sapiens
GDQGLEWRI

SEQ ID NO: 796023 - protein, 9 aa, Homo Sapiens
RNLKNKSGL

SEQ ID NO: 796024 - protein, 9 aa, Homo Sapiens
TGVHLSGLQ

SEQ ID NO: 796025 - protein, 9 aa, Homo Sapiens
KICGLIATF

SEQ ID NO: 796026 - protein, 9 aa, Homo Sapiens
EGQAQQTAV

SEQ ID NO: 796027 - protein, 9 aa, Homo Sapiens
SVGFDTVLQ

SEQ ID NO: 796028 - protein, 9 aa, Homo Sapiens
KKTEKAINA

SEQ ID NO: 796029 - protein, 9 aa, Homo Sapiens
EILQSIANH

SEQ ID NO: 796030 - protein, 9 aa, Homo Sapiens
VESRFNWKL

SEQ ID NO: 796031 - protein, 9 aa, Homo Sapiens
MNCRDAIAK

SEQ ID NO: 796032 - protein, 9 aa, Homo Sapiens
KKLDLCLPL

SEQ ID NO: 796033 - protein, 9 aa, Homo Sapiens
STGDTTRHP

SEQ ID NO: 796034 - protein, 9 aa, Homo Sapiens
KSKGGGNMN

SEQ ID NO: 796035 - protein, 9 aa, Homo Sapiens
QLRATSRPP

SEQ ID NO: 796036 - protein, 9 aa, Homo Sapiens
ERTINLYHL

SEQ ID NO: 796037 - protein, 9 aa, Homo Sapiens
MPIDESFAN

SEQ ID NO: 796038 - protein, 9 aa, Homo Sapiens
GDWQVPVPY

SEQ ID NO: 796039 - protein, 9 aa, Homo Sapiens
EEVPGVFSR

SEQ ID NO: 796040 - protein, 9 aa, Homo Sapiens
KELCKSRGE

SEQ ID NO: 796041 - protein, 9 aa, Homo Sapiens
VRRQLRATS

SEQ ID NO: 796042 - protein, 9 aa, Homo Sapiens
VSAENSVIC

SEQ ID NO: 796043 - protein, 9 aa, Homo Sapiens
AAKQMRSRV

SEQ ID NO: 796044 - protein, 9 aa, Homo Sapiens
TKTRASHLK

SEQ ID NO: 796045 - protein, 9 aa, Homo Sapiens
ECTEKQRKV

SEQ ID NO: 796046 - protein, 9 aa, Homo Sapiens
LLPPSPSPS

SEQ ID NO: 796047 - protein, 9 aa, Homo Sapiens
AAPDITLDP

SEQ ID NO: 796048 - protein, 9 aa, Homo Sapiens
QRLHIKEED

SEQ ID NO: 796049 - protein, 9 aa, Homo Sapiens
KGVLLTRKL

SEQ ID NO: 796050 - protein, 9 aa, Homo Sapiens
MHTLFMRDH

SEQ ID NO: 796051 - protein, 9 aa, Homo Sapiens
GATETAFQG

SEQ ID NO: 796052 - protein, 9 aa, Homo Sapiens
HTLFMRDHN

SEQ ID NO: 796053 - protein, 9 aa, Homo Sapiens
AVAPSQPGR

SEQ ID NO: 796054 - protein, 9 aa, Homo Sapiens
TAFQGHLDL

SEQ ID NO: 796055 - protein, 9 aa, Homo Sapiens
STPPLLPPS

SEQ ID NO: 796056 - protein, 9 aa, Homo Sapiens
YFHMDTRNF

SEQ ID NO: 796057 - protein, 9 aa, Homo Sapiens
VCPAPGDCQ

SEQ ID NO: 796058 - protein, 9 aa, Homo Sapiens
GLEWRIDQA

SEQ ID NO: 796059 - protein, 9 aa, Homo Sapiens
KEGWICRTG

SEQ ID NO: 796060 - protein, 9 aa, Homo Sapiens
GLPPNPSLT

SEQ ID NO: 796061 - protein, 9 aa, Homo Sapiens
GNSKVRAFP

SEQ ID NO: 796062 - protein, 9 aa, Homo Sapiens
VLWSYYAYI

SEQ ID NO: 796063 - protein, 9 aa, Homo Sapiens
FDGPESQSR

SEQ ID NO: 796064 - protein, 9 aa, Homo Sapiens
RVCPAPGDC

SEQ ID NO: 796065 - protein, 9 aa, Homo Sapiens
QRKVSFSHS

SEQ ID NO: 796066 - protein, 9 aa, Homo Sapiens
EDMGTYTCE

SEQ ID NO: 796067 - protein, 9 aa, Homo Sapiens
GRPTGVHLS

SEQ ID NO: 796068 - protein, 9 aa, Homo Sapiens
VFPEDMGTY

SEQ ID NO: 796069 - protein, 9 aa, Homo Sapiens
IQEVFPEDM

SEQ ID NO: 796070 - protein, 9 aa, Homo Sapiens
KAINAFFRT

SEQ ID NO: 796071 - protein, 9 aa, Homo Sapiens
AIAMMMDTD

SEQ ID NO: 796072 - protein, 9 aa, Homo Sapiens
SQRLHIKEE

SEQ ID NO: 796073 - protein, 9 aa, Homo Sapiens
QRSQSPLWG

SEQ ID NO: 796074 - protein, 9 aa, Homo Sapiens
FSDIIFHSW

SEQ ID NO: 796075 - protein, 9 aa, Homo Sapiens
TSVGSKLEI

SEQ ID NO: 796076 - protein, 9 aa, Homo Sapiens
VQRRQQAYR

SEQ ID NO: 796077 - protein, 9 aa, Homo Sapiens
GGMAVSSGS

SEQ ID NO: 796078 - protein, 9 aa, Homo Sapiens
SKNKHKASE

SEQ ID NO: 796079 - protein, 9 aa, Homo Sapiens
RSNIQQQKS

SEQ ID NO: 796080 - protein, 9 aa, Homo Sapiens
HEYLSQRLH

SEQ ID NO: 796081 - protein, 9 aa, Homo Sapiens
LKNKSGLAF

SEQ ID NO: 796082 - protein, 9 aa, Homo Sapiens
RSASTGRSV

SEQ ID NO: 796083 - protein, 9 aa, Homo Sapiens
FCAMGNPYI

SEQ ID NO: 796084 - protein, 9 aa, Homo Sapiens
DFSSDLTQQ

SEQ ID NO: 796085 - protein, 9 aa, Homo Sapiens
HPVTNVSSA

SEQ ID NO: 796086 - protein, 9 aa, Homo Sapiens
YSEWAVFID

SEQ ID NO: 796087 - protein, 9 aa, Homo Sapiens
TETDKWVGN

SEQ ID NO: 796088 - protein, 9 aa, Homo Sapiens
RVLHFCATL

SEQ ID NO: 796089 - protein, 9 aa, Homo Sapiens
APSQPGREP

SEQ ID NO: 796090 - protein, 9 aa, Homo Sapiens
QLYQLQQQT

SEQ ID NO: 796091 - protein, 9 aa, Homo Sapiens
DNGYYSSNG

SEQ ID NO: 796092 - protein, 9 aa, Homo Sapiens
LERGRQLEV

SEQ ID NO: 796093 - protein, 9 aa, Homo Sapiens
GNMNEEISS

SEQ ID NO: 796094 - protein, 9 aa, Homo Sapiens
FCATLRRGR

SEQ ID NO: 796095 - protein, 9 aa, Homo Sapiens
PPLLPPSPS

SEQ ID NO: 796096 - protein, 9 aa, Homo Sapiens
AKEGWICRT

SEQ ID NO: 796097 - protein, 9 aa, Homo Sapiens
LPPSPSPSP

SEQ ID NO: 796098 - protein, 9 aa, Homo Sapiens
RHPVTNVSS

SEQ ID NO: 796099 - protein, 9 aa, Homo Sapiens
RKVSFSHSR

SEQ ID NO: 796100 - protein, 9 aa, Homo Sapiens
ELLRNLKNK

SEQ ID NO: 796101 - protein, 9 aa, Homo Sapiens
ACEDLDKVL

SEQ ID NO: 796102 - protein, 9 aa, Homo Sapiens
YQLQQQTQQ

SEQ ID NO: 796103 - protein, 9 aa, Homo Sapiens
LAAWRWARW

SEQ ID NO: 796104 - protein, 9 aa, Homo Sapiens
TRHPVTNVS

SEQ ID NO: 796105 - protein, 9 aa, Homo Sapiens
QGATKLVAE

SEQ ID NO: 796106 - protein, 9 aa, Homo Sapiens
AQGDQGLEW

SEQ ID NO: 796107 - protein, 9 aa, Homo Sapiens
TTVSGDTEK

SEQ ID NO: 796108 - protein, 9 aa, Homo Sapiens
FQGHLDLTQ

SEQ ID NO: 796109 - protein, 9 aa, Homo Sapiens
TDKWVGNSK

SEQ ID NO: 796110 - protein, 9 aa, Homo Sapiens
KTEKAINAF

SEQ ID NO: 796111 - protein, 9 aa, Homo Sapiens
TRATLRVSE

SEQ ID NO: 796112 - protein, 9 aa, Homo Sapiens
RIDVTSVGS

SEQ ID NO: 796113 - protein, 9 aa, Homo Sapiens
LEKQASVSA

SEQ ID NO: 796114 - protein, 9 aa, Homo Sapiens
KLDLCLPLH

SEQ ID NO: 796115 - protein, 9 aa, Homo Sapiens
QQLYQLQQQ

SEQ ID NO: 796116 - protein, 9 aa, Homo Sapiens
DLTQQSASY

SEQ ID NO: 796117 - protein, 9 aa, Homo Sapiens
SSGSSLVSH

SEQ ID NO: 796118 - protein, 9 aa, Homo Sapiens
RESERRYHS

SEQ ID NO: 796119 - protein, 9 aa, Homo Sapiens
SLLTGGRPT

SEQ ID NO: 796120 - protein, 9 aa, Homo Sapiens
EVFPEDMGT

SEQ ID NO: 796121 - protein, 9 aa, Homo Sapiens
EVGYNTPVH

SEQ ID NO: 796122 - protein, 9 aa, Homo Sapiens
IHKCSPREW

SEQ ID NO: 796123 - protein, 9 aa, Homo Sapiens
LSQRLHIKE

SEQ ID NO: 796124 - protein, 9 aa, Homo Sapiens
SWHPSRSAS

SEQ ID NO: 796125 - protein, 9 aa, Homo Sapiens
PGSCGFPGR

SEQ ID NO: 796126 - protein, 9 aa, Homo Sapiens
MGNPYICNN

SEQ ID NO: 796127 - protein, 9 aa, Homo Sapiens
MAVACEDLD

SEQ ID NO: 796128 - protein, 9 aa, Homo Sapiens
RLKAQETEA

SEQ ID NO: 796129 - protein, 9 aa, Homo Sapiens
PGVPGSCGF

SEQ ID NO: 796130 - protein, 9 aa, Homo Sapiens
DDNPSDKDR

SEQ ID NO: 796131 - protein, 9 aa, Homo Sapiens
HPPEIKDKG

SEQ ID NO: 796132 - protein, 9 aa, Homo Sapiens
VFIDDIDQF

SEQ ID NO: 796133 - protein, 9 aa, Homo Sapiens
PRVLHFCAT

SEQ ID NO: 796134 - protein, 9 aa, Homo Sapiens
LAFNILMDR

SEQ ID NO: 796135 - protein, 9 aa, Homo Sapiens
TEKAINAFF

SEQ ID NO: 796136 - protein, 9 aa, Homo Sapiens
WRWARWTAM

SEQ ID NO: 796137 - protein, 9 aa, Homo Sapiens
PDKTSNIRK

SEQ ID NO: 796138 - protein, 9 aa, Homo Sapiens
MGTYTCEAW

SEQ ID NO: 796139 - protein, 9 aa, Homo Sapiens
AMGNPYICN

SEQ ID NO: 796140 - protein, 9 aa, Homo Sapiens
DARDIKQNA

SEQ ID NO: 796141 - protein, 9 aa, Homo Sapiens
HAAPDITLD

SEQ ID NO: 796142 - protein, 9 aa, Homo Sapiens
PEDMGTYTC

SEQ ID NO: 796143 - protein, 9 aa, Homo Sapiens
AWYEDRQEV

SEQ ID NO: 796144 - protein, 9 aa, Homo Sapiens
PEAAGTRDS

SEQ ID NO: 796145 - protein, 9 aa, Homo Sapiens
QASVSAENS

SEQ ID NO: 796146 - protein, 9 aa, Homo Sapiens
KQQLYQLQQ

SEQ ID NO: 796147 - protein, 9 aa, Homo Sapiens
SFNRSSNLM

SEQ ID NO: 796148 - protein, 9 aa, Homo Sapiens
TEALDVSFS

SEQ ID NO: 796149 - protein, 9 aa, Homo Sapiens
RVCECQDSD

SEQ ID NO: 796150 - protein, 9 aa, Homo Sapiens
RKGHPQALP

SEQ ID NO: 796151 - protein, 9 aa, Homo Sapiens
TGDTTRHPV

SEQ ID NO: 796152 - protein, 9 aa, Homo Sapiens
RRYHSLARH

SEQ ID NO: 796153 - protein, 9 aa, Homo Sapiens
SDIIFHSWK

SEQ ID NO: 796154 - protein, 9 aa, Homo Sapiens
YIFELCLVT

SEQ ID NO: 796155 - protein, 9 aa, Homo Sapiens
TETAFQGHL

SEQ ID NO: 796156 - protein, 9 aa, Homo Sapiens
LGLPAVPVV

SEQ ID NO: 796157 - protein, 9 aa, Homo Sapiens
DESFANVLK

SEQ ID NO: 796158 - protein, 9 aa, Homo Sapiens
ESLDAMEGD

SEQ ID NO: 796159 - protein, 9 aa, Homo Sapiens
KTRASHLKE

SEQ ID NO: 796160 - protein, 9 aa, Homo Sapiens
QRRQQAYRD

SEQ ID NO: 796161 - protein, 9 aa, Homo Sapiens
MLELEKNEM

SEQ ID NO: 796162 - protein, 9 aa, Homo Sapiens
RWARWTAMC

SEQ ID NO: 796163 - protein, 9 aa, Homo Sapiens
GQKKCVSKL

SEQ ID NO: 796164 - protein, 9 aa, Homo Sapiens
IRKQTNIAS

SEQ ID NO: 796165 - protein, 9 aa, Homo Sapiens
AQETEALDV

SEQ ID NO: 796166 - protein, 9 aa, Homo Sapiens
LLGRTGARS

SEQ ID NO: 796167 - protein, 9 aa, Homo Sapiens
EGWICRTGI

SEQ ID NO: 796168 - protein, 9 aa, Homo Sapiens
WGQRCRVCP

SEQ ID NO: 796169 - protein, 9 aa, Homo Sapiens
RNIQYFHMD

SEQ ID NO: 796170 - protein, 9 aa, Homo Sapiens
LERTINLYH

SEQ ID NO: 796171 - protein, 9 aa, Homo Sapiens
AFQGHLDLT

SEQ ID NO: 796172 - protein, 9 aa, Homo Sapiens
RDIKQNART

SEQ ID NO: 796173 - protein, 9 aa, Homo Sapiens
MAVSSGSSL

SEQ ID NO: 796174 - protein, 9 aa, Homo Sapiens
PPQPVLGLP

SEQ ID NO: 796175 - protein, 9 aa, Homo Sapiens
HSDQVSKNK

SEQ ID NO: 796176 - protein, 9 aa, Homo Sapiens
SDNGYYSSN

SEQ ID NO: 796177 - protein, 9 aa, Homo Sapiens
CYLHSKGKM

SEQ ID NO: 796178 - protein, 9 aa, Homo Sapiens
GNPYICNNE

SEQ ID NO: 796179 - protein, 9 aa, Homo Sapiens
QKKCVSKLL

SEQ ID NO: 796180 - protein, 9 aa, Homo Sapiens
PNSSGLMNC

SEQ ID NO: 796181 - protein, 9 aa, Homo Sapiens
PHDIHKCSP

SEQ ID NO: 796182 - protein, 9 aa, Homo Sapiens
ISHFYLVTP

SEQ ID NO: 796183 - protein, 9 aa, Homo Sapiens
ELCKSRGEV

SEQ ID NO: 796184 - protein, 9 aa, Homo Sapiens
IHDDNPSDK

SEQ ID NO: 796185 - protein, 9 aa, Homo Sapiens
QRCRVCPAP

SEQ ID NO: 796186 - protein, 9 aa, Homo Sapiens
ERGRQLEVE

SEQ ID NO: 796187 - protein, 9 aa, Homo Sapiens
VDARDIKQN

SEQ ID NO: 796188 - protein, 9 aa, Homo Sapiens
IAMMMDTDV

SEQ ID NO: 796189 - protein, 9 aa, Homo Sapiens
VACEDLDKV

SEQ ID NO: 796190 - protein, 9 aa, Homo Sapiens
DTEKGQSPG

SEQ ID NO: 796191 - protein, 9 aa, Homo Sapiens
VRNIQYFHM

SEQ ID NO: 796192 - protein, 9 aa, Homo Sapiens
PVTMTGAIY

SEQ ID NO: 796193 - protein, 9 aa, Homo Sapiens
ASTGDTTRH

SEQ ID NO: 796194 - protein, 9 aa, Homo Sapiens
LMSEILQSI

SEQ ID NO: 796195 - protein, 9 aa, Homo Sapiens
RGRQLEVEV

SEQ ID NO: 796196 - protein, 9 aa, Homo Sapiens
QTVVRNIQY

SEQ ID NO: 796197 - protein, 9 aa, Homo Sapiens
GGRPTGVHL

SEQ ID NO: 796198 - protein, 9 aa, Homo Sapiens
KGHSDQVSK

SEQ ID NO: 796199 - protein, 9 aa, Homo Sapiens
NMLQGATKL

SEQ ID NO: 796200 - protein, 9 aa, Homo Sapiens
SPLWGMPET

SEQ ID NO: 796201 - protein, 9 aa, Homo Sapiens
HSWKKEENG

SEQ ID NO: 796202 - protein, 9 aa, Homo Sapiens
LQQQTQQQV

SEQ ID NO: 796203 - protein, 9 aa, Homo Sapiens
QPVLGLPPN

SEQ ID NO: 796204 - protein, 9 aa, Homo Sapiens
NGQKKCVSK

SEQ ID NO: 796205 - protein, 9 aa, Homo Sapiens
LDPAQISHF

SEQ ID NO: 796206 - protein, 9 aa, Homo Sapiens
SYFFNALLV

SEQ ID NO: 796207 - protein, 9 aa, Homo Sapiens
STSDNGYYS

SEQ ID NO: 796208 - protein, 9 aa, Homo Sapiens
ETLQGLCYL

SEQ ID NO: 796209 - protein, 9 aa, Homo Sapiens
WGMPETTQP

SEQ ID NO: 796210 - protein, 9 aa, Homo Sapiens
HIVHYTSDL

SEQ ID NO: 796211 - protein, 9 aa, Homo Sapiens
SQSPLWGMP

SEQ ID NO: 796212 - protein, 9 aa, Homo Sapiens
LMIKGEGSR

SEQ ID NO: 796213 - protein, 9 aa, Homo Sapiens
IIFHSWKKE

SEQ ID NO: 796214 - protein, 9 aa, Homo Sapiens
LLERGRQLE

SEQ ID NO: 796215 - protein, 9 aa, Homo Sapiens
WYEDRQEVL

SEQ ID NO: 796216 - protein, 9 aa, Homo Sapiens
PWEDTAAKE

SEQ ID NO: 796217 - protein, 9 aa, Homo Sapiens
SEILQSIAN

SEQ ID NO: 796218 - protein, 9 aa, Homo Sapiens
AVALALALL

SEQ ID NO: 796219 - protein, 9 aa, Homo Sapiens
MNPKICGLI

SEQ ID NO: 796220 - protein, 9 aa, Homo Sapiens
FHSWKKEEN

SEQ ID NO: 796221 - protein, 9 aa, Homo Sapiens
NKSGLAFRK

SEQ ID NO: 796222 - protein, 9 aa, Homo Sapiens
AVACEDLDK

SEQ ID NO: 796223 - protein, 9 aa, Homo Sapiens
TRKLSLLEQ

SEQ ID NO: 796224 - protein, 9 aa, Homo Sapiens
ASNKKELRS

SEQ ID NO: 796225 - protein, 9 aa, Homo Sapiens
FSSDLTQQS

SEQ ID NO: 796226 - protein, 9 aa, Homo Sapiens
RYHSLARHA

SEQ ID NO: 796227 - protein, 9 aa, Homo Sapiens
KKELRSNIQ

SEQ ID NO: 796228 - protein, 9 aa, Homo Sapiens
LLTRKLSLL

SEQ ID NO: 796229 - protein, 9 aa, Homo Sapiens
LLVDGTEKG

SEQ ID NO: 796230 - protein, 9 aa, Homo Sapiens
TGGRPTGVH

SEQ ID NO: 796231 - protein, 9 aa, Homo Sapiens
RFSDIIFHS

SEQ ID NO: 796232 - protein, 9 aa, Homo Sapiens
AQQTAVAQR

SEQ ID NO: 796233 - protein, 9 aa, Homo Sapiens
PHPPCAPGR

SEQ ID NO: 796234 - protein, 9 aa, Homo Sapiens
VKVLKTKDG

SEQ ID NO: 796235 - protein, 9 aa, Homo Sapiens
QSPLWGMPE

SEQ ID NO: 796236 - protein, 9 aa, Homo Sapiens
GYYSSNGSD

SEQ ID NO: 796237 - protein, 9 aa, Homo Sapiens
KVQQGRTAN

SEQ ID NO: 796238 - protein, 9 aa, Homo Sapiens
PSDKDREDS

SEQ ID NO: 796239 - protein, 9 aa, Homo Sapiens
KGHPQALPA

SEQ ID NO: 796240 - protein, 9 aa, Homo Sapiens
LKLMSEILQ

SEQ ID NO: 796241 - protein, 9 aa, Homo Sapiens
GATKLVAEP

SEQ ID NO: 796242 - protein, 9 aa, Homo Sapiens
SPKQQLYQL

SEQ ID NO: 796243 - protein, 9 aa, Homo Sapiens
GVLLTRKLS

SEQ ID NO: 796244 - protein, 9 aa, Homo Sapiens
LRGGKRAMS

SEQ ID NO: 796245 - protein, 9 aa, Homo Sapiens
CDPRVLHFC

SEQ ID NO: 796246 - protein, 9 aa, Homo Sapiens
RNGQKKCVS

SEQ ID NO: 796247 - protein, 9 aa, Homo Sapiens
HPSRSASTG

SEQ ID NO: 796248 - protein, 9 aa, Homo Sapiens
LTRKLSLLE

SEQ ID NO: 796249 - protein, 9 aa, Homo Sapiens
LVQKGTRAT

SEQ ID NO: 796250 - protein, 9 aa, Homo Sapiens
VSKNKHKAS

SEQ ID NO: 796251 - protein, 9 aa, Homo Sapiens
VPGSCGFPG

SEQ ID NO: 796252 - protein, 9 aa, Homo Sapiens
AVGGRQGSP

SEQ ID NO: 796253 - protein, 9 aa, Homo Sapiens
GAIYEQCGG

SEQ ID NO: 796254 - protein, 9 aa, Homo Sapiens
CRVCPAPGD

SEQ ID NO: 796255 - protein, 9 aa, Homo Sapiens
GLIATFSWI

SEQ ID NO: 796256 - protein, 9 aa, Homo Sapiens
RRESERRYH

SEQ ID NO: 796257 - protein, 9 aa, Homo Sapiens
AYIFELCLV

SEQ ID NO: 796258 - protein, 9 aa, Homo Sapiens
NYSALQKME

SEQ ID NO: 796259 - protein, 9 aa, Homo Sapiens
MNEVGYNTP

SEQ ID NO: 796260 - protein, 9 aa, Homo Sapiens
EIKDKGGAG

SEQ ID NO: 796261 - protein, 9 aa, Homo Sapiens
QPGREPQAG

SEQ ID NO: 796262 - protein, 9 aa, Homo Sapiens
FQNCLRGGK

SEQ ID NO: 796263 - protein, 9 aa, Homo Sapiens
RASHLKELF

SEQ ID NO: 796264 - protein, 9 aa, Homo Sapiens
LQKMESLDA

SEQ ID NO: 796265 - protein, 9 aa, Homo Sapiens
SNKKELRSN

SEQ ID NO: 796266 - protein, 9 aa, Homo Sapiens
TVSGDTEKG

SEQ ID NO: 796267 - protein, 9 aa, Homo Sapiens
SASTGRSVS

SEQ ID NO: 796268 - protein, 9 aa, Homo Sapiens
RPTGVHLSG

SEQ ID NO: 796269 - protein, 9 aa, Homo Sapiens
DPAQISHFY

SEQ ID NO: 796270 - protein, 9 aa, Homo Sapiens
TANSEKETA

SEQ ID NO: 796271 - protein, 9 aa, Homo Sapiens
LCLPLHGKI

SEQ ID NO: 796272 - protein, 9 aa, Homo Sapiens
HMAVACEDL

SEQ ID NO: 796273 - protein, 9 aa, Homo Sapiens
PKICGLIAT

SEQ ID NO: 796274 - protein, 9 aa, Homo Sapiens
YEQCGGQIN

SEQ ID NO: 796275 - protein, 9 aa, Homo Sapiens
LLTGGRPTG

SEQ ID NO: 796276 - protein, 9 aa, Homo Sapiens
EWAVFIDDI

SEQ ID NO: 796277 - protein, 9 aa, Homo Sapiens
PDTPHPPCA

SEQ ID NO: 796278 - protein, 9 aa, Homo Sapiens
NPYICNNEC

SEQ ID NO: 796279 - protein, 9 aa, Homo Sapiens
PDVVQRRQQ

SEQ ID NO: 796280 - protein, 9 aa, Homo Sapiens
ASTGRSVSA

SEQ ID NO: 796281 - protein, 9 aa, Homo Sapiens
WRIDQAFVL

SEQ ID NO: 796282 - protein, 9 aa, Homo Sapiens
KTSNIRKQT

SEQ ID NO: 796283 - protein, 9 aa, Homo Sapiens
MRDHNRLAT

SEQ ID NO: 796284 - protein, 9 aa, Homo Sapiens
ACYFQNCLR

SEQ ID NO: 796285 - protein, 9 aa, Homo Sapiens
SKEELTEHI

SEQ ID NO: 796286 - protein, 9 aa, Homo Sapiens
FMRDHNRLA

SEQ ID NO: 796287 - protein, 9 aa, Homo Sapiens
VFVDARDIK

SEQ ID NO: 796288 - protein, 9 aa, Homo Sapiens
AAKEEEASK

SEQ ID NO: 796289 - protein, 9 aa, Homo Sapiens
ERRYHSLAR

SEQ ID NO: 796290 - protein, 9 aa, Homo Sapiens
KKCVSKLLE

SEQ ID NO: 796291 - protein, 9 aa, Homo Sapiens
TRASHLKEL

SEQ ID NO: 796292 - protein, 9 aa, Homo Sapiens
GDTTRHPVT

SEQ ID NO: 796293 - protein, 9 aa, Homo Sapiens
ATETAFQGH

SEQ ID NO: 796294 - protein, 9 aa, Homo Sapiens
SFDGPESQS

SEQ ID NO: 796295 - protein, 9 aa, Homo Sapiens
LELLRNLKN

SEQ ID NO: 796296 - protein, 9 aa, Homo Sapiens
ICRTGISSS

SEQ ID NO: 796297 - protein, 9 aa, Homo Sapiens
FSTSDNGYY

SEQ ID NO: 796298 - protein, 9 aa, Homo Sapiens
ARNGQKKCV

SEQ ID NO: 796299 - protein, 9 aa, Homo Sapiens
KDKGGAGEG

SEQ ID NO: 796300 - protein, 9 aa, Homo Sapiens
NILMDRPLE

SEQ ID NO: 796301 - protein, 9 aa, Homo Sapiens
FGLPEAAGT

SEQ ID NO: 796302 - protein, 9 aa, Homo Sapiens
WLGLPAVPV

SEQ ID NO: 796303 - protein, 9 aa, Homo Sapiens
QGDQGLEWR

SEQ ID NO: 796304 - protein, 9 aa, Homo Sapiens
KSMLDPAQI

SEQ ID NO: 796305 - protein, 9 aa, Homo Sapiens
HMNEVGYNT

SEQ ID NO: 796306 - protein, 9 aa, Homo Sapiens
YYAYIFELC

SEQ ID NO: 796307 - protein, 9 aa, Homo Sapiens
KQRKVSFSH

SEQ ID NO: 796308 - protein, 9 aa, Homo Sapiens
GGRQGSPAT

SEQ ID NO: 796309 - protein, 9 aa, Homo Sapiens
QYFHLAAWR

SEQ ID NO: 796310 - protein, 9 aa, Homo Sapiens
TTRHPVTNV

SEQ ID NO: 796311 - protein, 9 aa, Homo Sapiens
HLAAWRWAR

SEQ ID NO: 796312 - protein, 9 aa, Homo Sapiens
VPYGPGGGN

SEQ ID NO: 796313 - protein, 9 aa, Homo Sapiens
VGNSKVRAF

SEQ ID NO: 796314 - protein, 9 aa, Homo Sapiens
TSDNGYYSS

SEQ ID NO: 796315 - protein, 9 aa, Homo Sapiens
GGNMNEEIS

SEQ ID NO: 796316 - protein, 9 aa, Homo Sapiens
LTGGRPTGV

SEQ ID NO: 796317 - protein, 9 aa, Homo Sapiens
TGAIYEQCG

SEQ ID NO: 796318 - protein, 9 aa, Homo Sapiens
YYSSNGSDF

SEQ ID NO: 796319 - protein, 9 aa, Homo Sapiens
SDQVSKNKH

SEQ ID NO: 796320 - protein, 9 aa, Homo Sapiens
EKQRKVSFS

SEQ ID NO: 796321 - protein, 9 aa, Homo Sapiens
SGPHDIHKC

SEQ ID NO: 796322 - protein, 9 aa, Homo Sapiens
WSYYAYIFE

SEQ ID NO: 796323 - protein, 9 aa, Homo Sapiens
LREEVPGVF

SEQ ID NO: 796324 - protein, 9 aa, Homo Sapiens
ADHAAPDIT

SEQ ID NO: 796325 - protein, 9 aa, Homo Sapiens
DTAAKEEEA

SEQ ID NO: 796326 - protein, 9 aa, Homo Sapiens
FYSYFFNAL

SEQ ID NO: 796327 - protein, 9 aa, Homo Sapiens
SKGGGNMNE

SEQ ID NO: 796328 - protein, 9 aa, Homo Sapiens
VPGVFSRSV

SEQ ID NO: 796329 - protein, 9 aa, Homo Sapiens
PDITLDPLE

SEQ ID NO: 796330 - protein, 9 aa, Homo Sapiens
STPHVVESR

SEQ ID NO: 796331 - protein, 9 aa, Homo Sapiens
GTRATLRVS

SEQ ID NO: 796332 - protein, 9 aa, Homo Sapiens
VMPDVVQRR

SEQ ID NO: 796333 - protein, 9 aa, Homo Sapiens
PEIKDKGGA

SEQ ID NO: 796334 - protein, 9 aa, Homo Sapiens
CRTGISSSE

SEQ ID NO: 796335 - protein, 9 aa, Homo Sapiens
AVFIDDIDQ

SEQ ID NO: 796336 - protein, 9 aa, Homo Sapiens
CYFQNCLRG

SEQ ID NO: 796337 - protein, 9 aa, Homo Sapiens
ERGLKLMSE

SEQ ID NO: 796338 - protein, 9 aa, Homo Sapiens
HVVESRFNW

SEQ ID NO: 796339 - protein, 9 aa, Homo Sapiens
PEPTKTRAS

SEQ ID NO: 796340 - protein, 9 aa, Homo Sapiens
QEVFPEDMG

SEQ ID NO: 796341 - protein, 9 aa, Homo Sapiens
GMAVSSGSS

SEQ ID NO: 796342 - protein, 9 aa, Homo Sapiens
EDTAAKEEE

SEQ ID NO: 796343 - protein, 9 aa, Homo Sapiens
LNFVVPAEY

SEQ ID NO: 796344 - protein, 9 aa, Homo Sapiens
FPEDMGTYT

SEQ ID NO: 796345 - protein, 9 aa, Homo Sapiens
VAAVAPSQP

SEQ ID NO: 796346 - protein, 9 aa, Homo Sapiens
PIDESFANV

SEQ ID NO: 796347 - protein, 9 aa, Homo Sapiens
NFVVPAEYT

SEQ ID NO: 796348 - protein, 9 aa, Homo Sapiens
GRQLEVEVP

SEQ ID NO: 796349 - protein, 9 aa, Homo Sapiens
TMTGAIYEQ

SEQ ID NO: 796350 - protein, 9 aa, Homo Sapiens
TADHAAPDI

SEQ ID NO: 796351 - protein, 9 aa, Homo Sapiens
WAVFIDDID

SEQ ID NO: 796352 - protein, 9 aa, Homo Sapiens
LFLAFNILM

SEQ ID NO: 796353 - protein, 9 aa, Homo Sapiens
SRVKVLKTK

SEQ ID NO: 796354 - protein, 9 aa, Homo Sapiens
GRTANSEKE

SEQ ID NO: 796355 - protein, 9 aa, Homo Sapiens
VLWPRILNF

SEQ ID NO: 796356 - protein, 9 aa, Homo Sapiens
SDLTQQSAS

SEQ ID NO: 796357 - protein, 9 aa, Homo Sapiens
TVLQHQDKS

SEQ ID NO: 796358 - protein, 9 aa, Homo Sapiens
FHLAAWRWA

SEQ ID NO: 796359 - protein, 9 aa, Homo Sapiens
RTADHAAPD

SEQ ID NO: 796360 - protein, 9 aa, Homo Sapiens
STGRSVSAC

SEQ ID NO: 796361 - protein, 9 aa, Homo Sapiens
TGISSSERW

SEQ ID NO: 796362 - protein, 9 aa, Homo Sapiens
NFSTSDNGY

SEQ ID NO: 796363 - protein, 9 aa, Homo Sapiens
YTSDLYPDA

SEQ ID NO: 796364 - protein, 9 aa, Homo Sapiens
GISSSERWC

SEQ ID NO: 796365 - protein, 9 aa, Homo Sapiens
DRQEVLSSD

SEQ ID NO: 796366 - protein, 9 aa, Homo Sapiens
AVMPDVVQR

SEQ ID NO: 796367 - protein, 9 aa, Homo Sapiens
LGLPPNPSL

SEQ ID NO: 796368 - protein, 9 aa, Homo Sapiens
QKMESLDAM

SEQ ID NO: 796369 - protein, 9 aa, Homo Sapiens
TEKQRKVSF

SEQ ID NO: 796370 - protein, 9 aa, Homo Sapiens
QGRTANSEK

SEQ ID NO: 796371 - protein, 9 aa, Homo Sapiens
CECQDSDFL

SEQ ID NO: 796372 - protein, 9 aa, Homo Sapiens
VGYNTPVHH

SEQ ID NO: 796373 - protein, 9 aa, Homo Sapiens
IATFSWILG

SEQ ID NO: 796374 - protein, 9 aa, Homo Sapiens
YFQNCLRGG

SEQ ID NO: 796375 - protein, 9 aa, Homo Sapiens
ASVSAENSV

SEQ ID NO: 796376 - protein, 9 aa, Homo Sapiens
YRDSFDGPE

SEQ ID NO: 796377 - protein, 9 aa, Homo Sapiens
ALLVDGTEK

SEQ ID NO: 796378 - protein, 9 aa, Homo Sapiens
HKTKHDLMI

SEQ ID NO: 796379 - protein, 9 aa, Homo Sapiens
CEDLDKVLN

SEQ ID NO: 796380 - protein, 9 aa, Homo Sapiens
CLLGQLCQQ

SEQ ID NO: 796381 - protein, 9 aa, Homo Sapiens
GLMNCRDAI

SEQ ID NO: 796382 - protein, 9 aa, Homo Sapiens
RDHNRLATE

SEQ ID NO: 796383 - protein, 9 aa, Homo Sapiens
RWCSGFYSY

SEQ ID NO: 796384 - protein, 9 aa, Homo Sapiens
GLPAVPVVT

SEQ ID NO: 796385 - protein, 9 aa, Homo Sapiens
CGFPGRGIP

SEQ ID NO: 796386 - protein, 9 aa, Homo Sapiens
PYICNNECD

SEQ ID NO: 796387 - protein, 9 aa, Homo Sapiens
SSLVSHNVY

SEQ ID NO: 796388 - protein, 9 aa, Homo Sapiens
ARDIKQNAR

SEQ ID NO: 796389 - protein, 9 aa, Homo Sapiens
EKGQSPGVF

SEQ ID NO: 796390 - protein, 9 aa, Homo Sapiens
LTSRVCECQ

SEQ ID NO: 796391 - protein, 9 aa, Homo Sapiens
CKSRGEVLG

SEQ ID NO: 796392 - protein, 9 aa, Homo Sapiens
RCYPNRDAE

SEQ ID NO: 796393 - protein, 9 aa, Homo Sapiens
PCAPGRKGD

SEQ ID NO: 796394 - protein, 9 aa, Homo Sapiens
QVSKNKHKA

SEQ ID NO: 796395 - protein, 9 aa, Homo Sapiens
GDTEKGQSP

SEQ ID NO: 796396 - protein, 9 aa, Homo Sapiens
QLEVEVPEA

SEQ ID NO: 796397 - protein, 9 aa, Homo Sapiens
VVRNIQYFH

SEQ ID NO: 796398 - protein, 9 aa, Homo Sapiens
HDLMIKGEG

SEQ ID NO: 796399 - protein, 9 aa, Homo Sapiens
WICRTGISS

SEQ ID NO: 796400 - protein, 9 aa, Homo Sapiens
SGFYSYFFN

SEQ ID NO: 796401 - protein, 9 aa, Homo Sapiens
WQVPVPYGP

SEQ ID NO: 796402 - protein, 9 aa, Homo Sapiens
QTAQHARKG

SEQ ID NO: 796403 - protein, 9 aa, Homo Sapiens
ACLLGQLCQ

SEQ ID NO: 796404 - protein, 9 aa, Homo Sapiens
RQLFLAFNI

SEQ ID NO: 796405 - protein, 9 aa, Homo Sapiens
ESFANVLKE

SEQ ID NO: 796406 - protein, 9 aa, Homo Sapiens
MMDTDVQSL

SEQ ID NO: 796407 - protein, 9 aa, Homo Sapiens
GLKLMSEIL

SEQ ID NO: 796408 - protein, 9 aa, Homo Sapiens
PPRTHMNEV

SEQ ID NO: 796409 - protein, 9 aa, Homo Sapiens
LWGMPETTQ

SEQ ID NO: 796410 - protein, 9 aa, Homo Sapiens
QGLCYLHSK

SEQ ID NO: 796411 - protein, 9 aa, Homo Sapiens
PQPVLGLPP

SEQ ID NO: 796412 - protein, 9 aa, Homo Sapiens
GQRCRVCPA

SEQ ID NO: 796413 - protein, 9 aa, Homo Sapiens
QLSEVDKSK

SEQ ID NO: 796414 - protein, 9 aa, Homo Sapiens
PVVTLYKHD

SEQ ID NO: 796415 - protein, 9 aa, Homo Sapiens
VSGDTEKGQ

SEQ ID NO: 796416 - protein, 9 aa, Homo Sapiens
DTTRHPVTN

SEQ ID NO: 796417 - protein, 9 aa, Homo Sapiens
AFNILMDRP

SEQ ID NO: 796418 - protein, 9 aa, Homo Sapiens
ETAKEGWIC

SEQ ID NO: 796419 - protein, 9 aa, Homo Sapiens
VVESRFNWK

SEQ ID NO: 796420 - protein, 9 aa, Homo Sapiens
ILNFVVPAE

SEQ ID NO: 796421 - protein, 9 aa, Homo Sapiens
EPGVPGSCG

SEQ ID NO: 796422 - protein, 9 aa, Homo Sapiens
CPEPTKTRA

SEQ ID NO: 796423 - protein, 9 aa, Homo Sapiens
DKWVGNSKV

SEQ ID NO: 796424 - protein, 9 aa, Homo Sapiens
HLTNYTFGT

SEQ ID NO: 796425 - protein, 9 aa, Homo Sapiens
VTMTGAIYE

SEQ ID NO: 796426 - protein, 9 aa, Homo Sapiens
REEVPGVFS

SEQ ID NO: 796427 - protein, 9 aa, Homo Sapiens
SNIRKQTNI

SEQ ID NO: 796428 - protein, 9 aa, Homo Sapiens
QRMLELEKN

SEQ ID NO: 796429 - protein, 9 aa, Homo Sapiens
WKLDKKLDL

SEQ ID NO: 796430 - protein, 9 aa, Homo Sapiens
FIDDIDQFK

SEQ ID NO: 796431 - protein, 9 aa, Homo Sapiens
CGLIATFSW

SEQ ID NO: 796432 - protein, 9 aa, Homo Sapiens
CVSKLLEYS

SEQ ID NO: 796433 - protein, 9 aa, Homo Sapiens
TKHDLMIKG

SEQ ID NO: 796434 - protein, 9 aa, Homo Sapiens
LEVEVPEAQ

SEQ ID NO: 796435 - protein, 9 aa, Homo Sapiens
FLAFNILMD

SEQ ID NO: 796436 - protein, 9 aa, Homo Sapiens
ALEPEKELC

SEQ ID NO: 796437 - protein, 9 aa, Homo Sapiens
TSRVCECQD

SEQ ID NO: 796438 - protein, 9 aa, Homo Sapiens
ECQDSDFLC

SEQ ID NO: 796439 - protein, 9 aa, Homo Sapiens
GHSDQVSKN

SEQ ID NO: 796440 - protein, 9 aa, Homo Sapiens
LYHLTNYTF

SEQ ID NO: 796441 - protein, 9 aa, Homo Sapiens
AVSSGSSLV

SEQ ID NO: 796442 - protein, 9 aa, Homo Sapiens
QMRSRVKVL

SEQ ID NO: 796443 - protein, 9 aa, Homo Sapiens
GQLCQQGVT

SEQ ID NO: 796444 - protein, 9 aa, Homo Sapiens
DKKLDLCLP

SEQ ID NO: 796445 - protein, 9 aa, Homo Sapiens
PAVPVVTLY

SEQ ID NO: 796446 - protein, 9 aa, Homo Sapiens
AACLLGQLC

SEQ ID NO: 796447 - protein, 9 aa, Homo Sapiens
GVPGSCGFP

SEQ ID NO: 796448 - protein, 9 aa, Homo Sapiens
DHNRLATEL

SEQ ID NO: 796449 - protein, 9 aa, Homo Sapiens
LWPRILNFV

SEQ ID NO: 796450 - protein, 9 aa, Homo Sapiens
VLQHQDKSK

SEQ ID NO: 796451 - protein, 9 aa, Homo Sapiens
LCQQGVTFD

SEQ ID NO: 796452 - protein, 9 aa, Homo Sapiens
AAVAPSQPG

SEQ ID NO: 796453 - protein, 9 aa, Homo Sapiens
PPSPSPSPS

SEQ ID NO: 796454 - protein, 9 aa, Homo Sapiens
AKQMRSRVK

SEQ ID NO: 796455 - protein, 9 aa, Homo Sapiens
LRLKAQETE

SEQ ID NO: 796456 - protein, 9 aa, Homo Sapiens
VLHFCATLR

SEQ ID NO: 796457 - protein, 9 aa, Homo Sapiens
KQMRSRVKV

SEQ ID NO: 796458 - protein, 9 aa, Homo Sapiens
NCLRGGKRA

SEQ ID NO: 796459 - protein, 9 aa, Homo Sapiens
LALALLGRT

SEQ ID NO: 796460 - protein, 9 aa, Homo Sapiens
NGYYSSNGS

SEQ ID NO: 796461 - protein, 9 aa, Homo Sapiens
MLDPAQISH

SEQ ID NO: 796462 - protein, 9 aa, Homo Sapiens
NPKICGLIA

SEQ ID NO: 796463 - protein, 9 aa, Homo Sapiens
HYTSDLYPD

SEQ ID NO: 796464 - protein, 9 aa, Homo Sapiens
LGQLCQQGV

SEQ ID NO: 796465 - protein, 9 aa, Homo Sapiens
LMNCRDAIA

SEQ ID NO: 796466 - protein, 9 aa, Homo Sapiens
SGSSLVSHN

SEQ ID NO: 796467 - protein, 9 aa, Homo Sapiens
LLRNLKNKS

SEQ ID NO: 796468 - protein, 9 aa, Homo Sapiens
LIATFSWIL

SEQ ID NO: 796469 - protein, 9 aa, Homo Sapiens
AKEEEASKL

SEQ ID NO: 796470 - protein, 9 aa, Homo Sapiens
ASSTPHVVE

SEQ ID NO: 796471 - protein, 9 aa, Homo Sapiens
NTETDKWVG

SEQ ID NO: 796472 - protein, 9 aa, Homo Sapiens
SNIQQQKSF

SEQ ID NO: 796473 - protein, 9 aa, Homo Sapiens
TKARIDVTS

SEQ ID NO: 796474 - protein, 9 aa, Homo Sapiens
PRTHMNEVG

SEQ ID NO: 796475 - protein, 9 aa, Homo Sapiens
DWQVPVPYG

SEQ ID NO: 796476 - protein, 9 aa, Homo Sapiens
RGLKLMSEI

SEQ ID NO: 796477 - protein, 9 aa, Homo Sapiens
RQLRATSRP

SEQ ID NO: 796478 - protein, 9 aa, Homo Sapiens
HAVSPLARC

SEQ ID NO: 796479 - protein, 9 aa, Homo Sapiens
VPSVGFDTV

SEQ ID NO: 796480 - protein, 9 aa, Homo Sapiens
TPHPPCAPG

SEQ ID NO: 796481 - protein, 9 aa, Homo Sapiens
SRSASTGRS

SEQ ID NO: 796482 - protein, 9 aa, Homo Sapiens
QNCLRGGKR

SEQ ID NO: 796483 - protein, 9 aa, Homo Sapiens
PTKTRASHL

SEQ ID NO: 796484 - protein, 9 aa, Homo Sapiens
IQYFHMDTR

SEQ ID NO: 796485 - protein, 9 aa, Homo Sapiens
EAWYEDRQE

SEQ ID NO: 796486 - protein, 9 aa, Homo Sapiens
ILEKQASVS

SEQ ID NO: 796487 - protein, 9 aa, Homo Sapiens
KLVAEPNRR

SEQ ID NO: 796488 - protein, 9 aa, Homo Sapiens
LYQLQQQTQ

SEQ ID NO: 796489 - protein, 9 aa, Homo Sapiens
KHDLMIKGE

SEQ ID NO: 796490 - protein, 9 aa, Homo Sapiens
AWRWARWTA

SEQ ID NO: 796491 - protein, 9 aa, Homo Sapiens
QLFLAFNIL

SEQ ID NO: 796492 - protein, 9 aa, Homo Sapiens
GWICRTGIS

SEQ ID NO: 796493 - protein, 9 aa, Homo Sapiens
MIKGEGSRK

SEQ ID NO: 796494 - protein, 9 aa, Homo Sapiens
LWSYYAYIF

SEQ ID NO: 796495 - protein, 9 aa, Homo Sapiens
AQHARKGHP

SEQ ID NO: 796496 - protein, 9 aa, Homo Sapiens
EVDKSKEEL

SEQ ID NO: 796497 - protein, 9 aa, Homo Sapiens
NSSGLMNCR

SEQ ID NO: 796498 - protein, 9 aa, Homo Sapiens
CNMLQGATK

SEQ ID NO: 796499 - protein, 9 aa, Homo Sapiens
VQKGTRATL

SEQ ID NO: 796500 - protein, 9 aa, Homo Sapiens
WPRILNFVV

SEQ ID NO: 796501 - protein, 9 aa, Homo Sapiens
SCGFPGRGI

SEQ ID NO: 796502 - protein, 9 aa, Homo Sapiens
PEKELCKSR

SEQ ID NO: 796503 - protein, 9 aa, Homo Sapiens
SHPPEIKDK

SEQ ID NO: 796504 - protein, 9 aa, Homo Sapiens
MAVGGRQGS

SEQ ID NO: 796505 - protein, 9 aa, Homo Sapiens
LVDGTEKGL

SEQ ID NO: 796506 - protein, 9 aa, Homo Sapiens
SLRLKAQET

SEQ ID NO: 796507 - protein, 9 aa, Homo Sapiens
VQQGRTANS

SEQ ID NO: 796508 - protein, 9 aa, Homo Sapiens
RTINLYHLT

SEQ ID NO: 796509 - protein, 9 aa, Homo Sapiens
LQGLCYLHS

SEQ ID NO: 796510 - protein, 9 aa, Homo Sapiens
DGPESQSRA

SEQ ID NO: 796511 - protein, 9 aa, Homo Sapiens
SSSERWCSG

SEQ ID NO: 796512 - protein, 9 aa, Homo Sapiens
PLARCYPNR

SEQ ID NO: 796513 - protein, 9 aa, Homo Sapiens
DQGLEWRID

SEQ ID NO: 796514 - protein, 9 aa, Homo Sapiens
ATSRPPSTE

SEQ ID NO: 796515 - protein, 9 aa, Homo Sapiens
PRRESERRY

SEQ ID NO: 796516 - protein, 9 aa, Homo Sapiens
ICGLIATFS

SEQ ID NO: 796517 - protein, 9 aa, Homo Sapiens
VPVPYGPGG

SEQ ID NO: 796518 - protein, 9 aa, Homo Sapiens
SVGSKLEIR

SEQ ID NO: 796519 - protein, 9 aa, Homo Sapiens
PRILNFVVP

SEQ ID NO: 796520 - protein, 9 aa, Homo Sapiens
HARKGHPQA

SEQ ID NO: 796521 - protein, 9 aa, Homo Sapiens
LRNLKNKSG

SEQ ID NO: 796522 - protein, 9 aa, Homo Sapiens
CFQAIAMMM

SEQ ID NO: 796523 - protein, 9 aa, Homo Sapiens
KCVSKLLEY

SEQ ID NO: 796524 - protein, 9 aa, Homo Sapiens
SERWCSGFY

SEQ ID NO: 796525 - protein, 9 aa, Homo Sapiens
WVGNSKVRA

SEQ ID NO: 796526 - protein, 9 aa, Homo Sapiens
RRQQAYRDK

SEQ ID NO: 796527 - protein, 9 aa, Homo Sapiens
MESLDAMEG

SEQ ID NO: 796528 - protein, 9 aa, Homo Sapiens
QETAKEGWI

SEQ ID NO: 796529 - protein, 9 aa, Homo Sapiens
VSFSHSRSR

SEQ ID NO: 796530 - protein, 9 aa, Homo Sapiens
ETAFQGHLD

SEQ ID NO: 796531 - protein, 9 aa, Homo Sapiens
VDGTEKGLF

SEQ ID NO: 796532 - protein, 9 aa, Homo Sapiens
CYPNRDAES

SEQ ID NO: 796533 - protein, 9 aa, Homo Sapiens
LPWEDTAAK

SEQ ID NO: 796534 - protein, 9 aa, Homo Sapiens
NIQYFHMDT

SEQ ID NO: 796535 - protein, 9 aa, Homo Sapiens
QAQQTAVAQ

SEQ ID NO: 796536 - protein, 9 aa, Homo Sapiens
TLFMRDHNR

SEQ ID NO: 796537 - protein, 9 aa, Homo Sapiens
LEPEKELCK

SEQ ID NO: 796538 - protein, 9 aa, Homo Sapiens
ERWCSGFYS

SEQ ID NO: 796539 - protein, 9 aa, Homo Sapiens
IIHDDNPSD

SEQ ID NO: 796540 - protein, 9 aa, Homo Sapiens
TLQGLCYLH

SEQ ID NO: 796541 - protein, 9 aa, Homo Sapiens
INAFFRTEG

SEQ ID NO: 796542 - protein, 9 aa, Homo Sapiens
MPDVVQRRQ

SEQ ID NO: 796543 - protein, 9 aa, Homo Sapiens
SEQETAKEG

SEQ ID NO: 796544 - protein, 9 aa, Homo Sapiens
LQGATKLVA

SEQ ID NO: 796545 - protein, 9 aa, Homo Sapiens
VLGLPPNPS

SEQ ID NO: 796546 - protein, 9 aa, Homo Sapiens
QQGRTANSE

SEQ ID NO: 796547 - protein, 9 aa, Homo Sapiens
CAMGNPYIC

SEQ ID NO: 796548 - protein, 9 aa, Homo Sapiens
AFFRTEGAE

SEQ ID NO: 796549 - protein, 9 aa, Homo Sapiens
DKSKEELTE

SEQ ID NO: 796550 - protein, 9 aa, Homo Sapiens
AIYEQCGGQ

SEQ ID NO: 796551 - protein, 9 aa, Homo Sapiens
GEPGVPGSC

SEQ ID NO: 796552 - protein, 9 aa, Homo Sapiens
GSSLVSHNV

SEQ ID NO: 796553 - protein, 9 aa, Homo Sapiens
DRQRMLELE

SEQ ID NO: 796554 - protein, 9 aa, Homo Sapiens
ETEALDVSF

SEQ ID NO: 796555 - protein, 9 aa, Homo Sapiens
AELHIVHYT

SEQ ID NO: 796556 - protein, 9 aa, Homo Sapiens
CRDAIAKTD

SEQ ID NO: 796557 - protein, 9 aa, Homo Sapiens
CLRGGKRAM

SEQ ID NO: 796558 - protein, 9 aa, Homo Sapiens
SSGLMNCRD

SEQ ID NO: 796559 - protein, 9 aa, Homo Sapiens
GCESGPHDI

SEQ ID NO: 796560 - protein, 9 aa, Homo Sapiens
YHLTNYTFG

SEQ ID NO: 796561 - protein, 9 aa, Homo Sapiens
VGFDTVLQH

SEQ ID NO: 796562 - protein, 9 aa, Homo Sapiens
LHIVHYTSD

SEQ ID NO: 796563 - protein, 9 aa, Homo Sapiens
TAKEGWICR

SEQ ID NO: 796564 - protein, 9 aa, Homo Sapiens
YSALQKMES

SEQ ID NO: 796565 - protein, 9 aa, Homo Sapiens
WCSGFYSYF

SEQ ID NO: 796566 - protein, 9 aa, Homo Sapiens
GQAQQTAVA

SEQ ID NO: 796567 - protein, 9 aa, Homo Sapiens
YEDRQEVLS

SEQ ID NO: 796568 - protein, 9 aa, Homo Sapiens
MDTDVQSLQ

SEQ ID NO: 796569 - protein, 9 aa, Homo Sapiens
TSNIRKQTN

SEQ ID NO: 796570 - protein, 9 aa, Homo Sapiens
KGGGNMNEE

SEQ ID NO: 796571 - protein, 9 aa, Homo Sapiens
LCKSRGEVL

SEQ ID NO: 796572 - protein, 9 aa, Homo Sapiens
EKGVLLTRK

SEQ ID NO: 796573 - protein, 9 aa, Homo Sapiens
GKSKGGGNM

SEQ ID NO: 796574 - protein, 9 aa, Homo Sapiens
SEWAVFIDD

SEQ ID NO: 796575 - protein, 9 aa, Homo Sapiens
RDSFDGPES

SEQ ID NO: 796576 - protein, 9 aa, Homo Sapiens
QYFHMDTRN

SEQ ID NO: 796577 - protein, 9 aa, Homo Sapiens
ELEAWYEDR

SEQ ID NO: 796578 - protein, 9 aa, Homo Sapiens
PQRSQSPLW

SEQ ID NO: 796579 - protein, 9 aa, Homo Sapiens
RQRMLELEK

SEQ ID NO: 796580 - protein, 9 aa, Homo Sapiens
TRDSRDNPL

SEQ ID NO: 796581 - protein, 9 aa, Homo Sapiens
ITVQQGRTA

SEQ ID NO: 796582 - protein, 9 aa, Homo Sapiens
MTGAIYEQC

SEQ ID NO: 796583 - protein, 9 aa, Homo Sapiens
AAWRWARWT

SEQ ID NO: 796584 - protein, 9 aa, Homo Sapiens
QAIAMMMDT

SEQ ID NO: 796585 - protein, 9 aa, Homo Sapiens
LRSNIQQQK

SEQ ID NO: 796586 - protein, 9 aa, Homo Sapiens
NKKELRSNI

SEQ ID NO: 796587 - protein, 9 aa, Homo Sapiens
LDKKLDLCL

SEQ ID NO: 796588 - protein, 9 aa, Homo Sapiens
LALLGRTGA

SEQ ID NO: 796589 - protein, 9 aa, Homo Sapiens
AAGTRDSRD

SEQ ID NO: 796590 - protein, 9 aa, Homo Sapiens
SEVDKSKEE

SEQ ID NO: 796591 - protein, 9 aa, Homo Sapiens
SDADRQRML

SEQ ID NO: 796592 - protein, 9 aa, Homo Sapiens
YFFNALLVD

SEQ ID NO: 796593 - protein, 9 aa, Homo Sapiens
TQQSASYIP

SEQ ID NO: 796594 - protein, 9 aa, Homo Sapiens
KEEEASKLT

SEQ ID NO: 796595 - protein, 9 aa, Homo Sapiens
RGKSKGGGN

SEQ ID NO: 796596 - protein, 9 aa, Homo Sapiens
YLSQRLHIK

SEQ ID NO: 796597 - protein, 9 aa, Homo Sapiens
RATSRPPST

SEQ ID NO: 796598 - protein, 9 aa, Homo Sapiens
ARCYPNRDA

SEQ ID NO: 796599 - protein, 9 aa, Homo Sapiens
PSRSASTGR

SEQ ID NO: 796600 - protein, 9 aa, Homo Sapiens
AKVFVDARD

SEQ ID NO: 796601 - protein, 9 aa, Homo Sapiens
PLLPPSPSP

SEQ ID NO: 796602 - protein, 9 aa, Homo Sapiens
AQISHFYLV

SEQ ID NO: 796603 - protein, 9 aa, Homo Sapiens
IFELCLVTV

SEQ ID NO: 796604 - protein, 9 aa, Homo Sapiens
AYHMAVACE

SEQ ID NO: 796605 - protein, 9 aa, Homo Sapiens
KLDKKLDLC

SEQ ID NO: 796606 - protein, 9 aa, Homo Sapiens
PTGVHLSGL

SEQ ID NO: 796607 - protein, 9 aa, Homo Sapiens
VPVVTLYKH

SEQ ID NO: 796608 - protein, 9 aa, Homo Sapiens
VSKLLEYSA

SEQ ID NO: 796609 - protein, 9 aa, Homo Sapiens
EDRQEVLSS

SEQ ID NO: 796610 - protein, 9 aa, Homo Sapiens
PQTAQHARK

SEQ ID NO: 796611 - protein, 9 aa, Homo Sapiens
VHYTSDLYP

SEQ ID NO: 796612 - protein, 9 aa, Homo Sapiens
IDDIDQFKT

SEQ ID NO: 796613 - protein, 9 aa, Homo Sapiens
EVEVPEAQQ

SEQ ID NO: 796614 - protein, 9 aa, Homo Sapiens
MMMDTDVQS

SEQ ID NO: 796615 - protein, 9 aa, Homo Sapiens
PVLGLPPNP

SEQ ID NO: 796616 - protein, 9 aa, Homo Sapiens
AINAFFRTE

SEQ ID NO: 796617 - protein, 9 aa, Homo Sapiens
SERRYHSLA

SEQ ID NO: 796618 - protein, 9 aa, Homo Sapiens
ILMDRPLEE

SEQ ID NO: 796619 - protein, 9 aa, Homo Sapiens
PPEIKDKGG

SEQ ID NO: 796620 - protein, 9 aa, Homo Sapiens
NAFFRTEGA

SEQ ID NO: 796621 - protein, 9 aa, Homo Sapiens
ANSEKETAL

SEQ ID NO: 796622 - protein, 9 aa, Homo Sapiens
YSYFFNALL

SEQ ID NO: 796623 - protein, 9 aa, Homo Sapiens
TRGATETAF

SEQ ID NO: 796624 - protein, 9 aa, Homo Sapiens
ELRSNIQQQ

SEQ ID NO: 796625 - protein, 9 aa, Homo Sapiens
RYRDSFDGP

SEQ ID NO: 796626 - protein, 9 aa, Homo Sapiens
QVLWPRILN

SEQ ID NO: 796627 - protein, 9 aa, Homo Sapiens
NYSEWAVFI

SEQ ID NO: 796628 - protein, 9 aa, Homo Sapiens
SVSAENSVI

SEQ ID NO: 796629 - protein, 9 aa, Homo Sapiens
CESGPHDIH

SEQ ID NO: 796630 - protein, 9 aa, Homo Sapiens
DLMIKGEGS

SEQ ID NO: 796631 - protein, 9 aa, Homo Sapiens
KARIDVTSV

SEQ ID NO: 796632 - protein, 9 aa, Homo Sapiens
TAQHARKGH

SEQ ID NO: 796633 - protein, 9 aa, Homo Sapiens
FFNALLVDG

SEQ ID NO: 796634 - protein, 9 aa, Homo Sapiens
GFYSYFFNA

SEQ ID NO: 796635 - protein, 9 aa, Homo Sapiens
LKAQETEAL

SEQ ID NO: 796636 - protein, 9 aa, Homo Sapiens
QHARKGHPQ

SEQ ID NO: 796637 - protein, 9 aa, Homo Sapiens
ARKGHPQAL

SEQ ID NO: 796638 - protein, 9 aa, Homo Sapiens
QLCQQGVTF

SEQ ID NO: 796639 - protein, 9 aa, Homo Sapiens
ELHIVHYTS

SEQ ID NO: 796640 - protein, 9 aa, Homo Sapiens
QKGTRATLR

SEQ ID NO: 796641 - protein, 9 aa, Homo Sapiens
VQEKGVLLT

SEQ ID NO: 796642 - protein, 9 aa, Homo Sapiens
YAYIFELCL

SEQ ID NO: 796643 - protein, 9 aa, Homo Sapiens
GYGDWQVPV

SEQ ID NO: 796644 - protein, 9 aa, Homo Sapiens
GLCYLHSKG

SEQ ID NO: 796645 - protein, 9 aa, Homo Sapiens
HFCATLRRG

SEQ ID NO: 796646 - protein, 9 aa, Homo Sapiens
SACYFQNCL

SEQ ID NO: 796647 - protein, 9 aa, Homo Sapiens
EPTKTRASH

SEQ ID NO: 796648 - protein, 9 aa, Homo Sapiens
EQETAKEGW

SEQ ID NO: 796649 - protein, 9 aa, Homo Sapiens
NALLVDGTE

SEQ ID NO: 796650 - protein, 9 aa, Homo Sapiens
LEWRIDQAF

SEQ ID NO: 796651 - protein, 9 aa, Homo Sapiens
SSTPHVVES

SEQ ID NO: 796652 - protein, 9 aa, Homo Sapiens
QLQQQTQQQ

SEQ ID NO: 796653 - protein, 9 aa, Homo Sapiens
IKDKGGAGE

SEQ ID NO: 796654 - protein, 9 aa, Homo Sapiens
PSQPGREPQ

SEQ ID NO: 796655 - protein, 9 aa, Homo Sapiens
VALALALLG

SEQ ID NO: 796656 - protein, 9 aa, Homo Sapiens
RQEVLSSDE

SEQ ID NO: 796657 - protein, 9 aa, Homo Sapiens
IVHYTSDLY

SEQ ID NO: 796658 - protein, 9 aa, Homo Sapiens
RLHIKEEDM

SEQ ID NO: 796659 - protein, 9 aa, Homo Sapiens
KQASVSAEN

SEQ ID NO: 796660 - protein, 9 aa, Homo Sapiens
QGLEWRIDQ

SEQ ID NO: 796661 - protein, 9 aa, Homo Sapiens
KGTRATLRV

SEQ ID NO: 796662 - protein, 9 aa, Homo Sapiens
GGGNMNEEI

SEQ ID NO: 796663 - protein, 9 aa, Homo Sapiens
KGQSPGVFN

SEQ ID NO: 796664 - protein, 9 aa, Homo Sapiens
LEGQAQQTA

SEQ ID NO: 796665 - protein, 9 aa, Homo Sapiens
IKGHSDQVS

SEQ ID NO: 796666 - protein, 9 aa, Homo Sapiens
NLKNKSGLA

SEQ ID NO: 796667 - protein, 9 aa, Homo Sapiens
QEKGVLLTR

SEQ ID NO: 796668 - protein, 9 aa, Homo Sapiens
KVSFSHSRS

SEQ ID NO: 796669 - protein, 9 aa, Homo Sapiens
PHVVESRFN

SEQ ID NO: 796670 - protein, 9 aa, Homo Sapiens
VTSVGSKLE

SEQ ID NO: 796671 - protein, 9 aa, Homo Sapiens
IDESFANVL

SEQ ID NO: 796672 - protein, 9 aa, Homo Sapiens
KWVGNSKVR

SEQ ID NO: 796673 - protein, 9 aa, Homo Sapiens
LCYLHSKGK

SEQ ID NO: 796674 - protein, 9 aa, Homo Sapiens
CQQGVTFDL

SEQ ID NO: 796675 - protein, 9 aa, Homo Sapiens
TVVRNIQYF

SEQ ID NO: 796676 - protein, 9 aa, Homo Sapiens
CAPGRKGDS

SEQ ID NO: 796677 - protein, 9 aa, Homo Sapiens
LFPDKTSNI

SEQ ID NO: 796678 - protein, 9 aa, Homo Sapiens
VDKSKEELT

SEQ ID NO: 796679 - protein, 9 aa, Homo Sapiens
RETLQGLCY

SEQ ID NO: 796680 - protein, 9 aa, Homo Sapiens
LDLCLPLHG

SEQ ID NO: 796681 - protein, 9 aa, Homo Sapiens
SSDLTQQSA

SEQ ID NO: 796682 - protein, 9 aa, Homo Sapiens
DNPSDKDRE

SEQ ID NO: 796683 - protein, 9 aa, Homo Sapiens
TINLYHLTN

SEQ ID NO: 796684 - protein, 9 aa, Homo Sapiens
HIKEEDMRL

SEQ ID NO: 796685 - protein, 9 aa, Homo Sapiens
MRSRVKVLK

SEQ ID NO: 796686 - protein, 9 aa, Homo Sapiens
AVPVVTLYK

SEQ ID NO: 796687 - protein, 9 aa, Homo Sapiens
LEAWYEDRQ

SEQ ID NO: 796688 - protein, 9 aa, Homo Sapiens
DLCLPLHGK

SEQ ID NO: 796689 - protein, 9 aa, Homo Sapiens
TAAKEEEAS

SEQ ID NO: 796690 - protein, 9 aa, Homo Sapiens
YFHLAAWRW

SEQ ID NO: 796691 - protein, 9 aa, Homo Sapiens
LSEVDKSKE

SEQ ID NO: 796692 - protein, 9 aa, Homo Sapiens
NCRDAIAKT

SEQ ID NO: 796693 - protein, 9 aa, Homo Sapiens
LFMRDHNRL

SEQ ID NO: 796694 - protein, 9 aa, Homo Sapiens
KLMSEILQS

SEQ ID NO: 796695 - protein, 9 aa, Homo Sapiens
YGDWQVPVP

SEQ ID NO: 796696 - protein, 9 aa, Homo Sapiens
TVQQGRTAN

SEQ ID NO: 796697 - protein, 9 aa, Homo Sapiens
RQLEVEVPE

SEQ ID NO: 796698 - protein, 9 aa, Homo Sapiens
RGATETAFQ

SEQ ID NO: 796699 - protein, 9 aa, Homo Sapiens
NEVGYNTPV

SEQ ID NO: 796700 - protein, 9 aa, Homo Sapiens
LHIKEEDMR

SEQ ID NO: 796701 - protein, 9 aa, Homo Sapiens
RVKVLKTKD

SEQ ID NO: 796702 - protein, 9 aa, Homo Sapiens
QTAVAQRKP

SEQ ID NO: 796703 - protein, 9 aa, Homo Sapiens
SRVCECQDS

SEQ ID NO: 796704 - protein, 9 aa, Homo Sapiens
FYHIIRLQI

SEQ ID NO: 796705 - protein, 9 aa, Homo Sapiens
CSADVEFCL

SEQ ID NO: 796706 - protein, 9 aa, Homo Sapiens
SLKAQSYEY

SEQ ID NO: 796707 - protein, 9 aa, Homo Sapiens
QSLLMEKAQ

SEQ ID NO: 796708 - protein, 9 aa, Homo Sapiens
SKSESRCPV

SEQ ID NO: 796709 - protein, 9 aa, Homo Sapiens
PDVLSHPER

SEQ ID NO: 796710 - protein, 9 aa, Homo Sapiens
CRTSYPIYI

SEQ ID NO: 796711 - protein, 9 aa, Homo Sapiens
KRSVPPPDG

SEQ ID NO: 796712 - protein, 9 aa, Homo Sapiens
IFLKVEVHE

SEQ ID NO: 796713 - protein, 9 aa, Homo Sapiens
TVSECLESI

SEQ ID NO: 796714 - protein, 9 aa, Homo Sapiens
HVPDYRQNG

SEQ ID NO: 796715 - protein, 9 aa, Homo Sapiens
ASNLLQHGD

SEQ ID NO: 796716 - protein, 9 aa, Homo Sapiens
QASEPLKVP

SEQ ID NO: 796717 - protein, 9 aa, Homo Sapiens
AFDNAVEER

SEQ ID NO: 796718 - protein, 9 aa, Homo Sapiens
LRDIPPSNN

SEQ ID NO: 796719 - protein, 9 aa, Homo Sapiens
EVHENVEKE

SEQ ID NO: 796720 - protein, 9 aa, Homo Sapiens
RGGFVNVEK

SEQ ID NO: 796721 - protein, 9 aa, Homo Sapiens
QRPAAGDEV

SEQ ID NO: 796722 - protein, 9 aa, Homo Sapiens
RDIPPSNNY

SEQ ID NO: 796723 - protein, 9 aa, Homo Sapiens
FFCDIPPLV

SEQ ID NO: 796724 - protein, 9 aa, Homo Sapiens
VPLLHSHSS

SEQ ID NO: 796725 - protein, 9 aa, Homo Sapiens
LVGKRGTGK

SEQ ID NO: 796726 - protein, 9 aa, Homo Sapiens
VSSAARVTI

SEQ ID NO: 796727 - protein, 9 aa, Homo Sapiens
GKRGTGKSA

SEQ ID NO: 796728 - protein, 9 aa, Homo Sapiens
KVFNHCSLL

SEQ ID NO: 796729 - protein, 9 aa, Homo Sapiens
PEVEDSDLQ

SEQ ID NO: 796730 - protein, 9 aa, Homo Sapiens
ECRNGPCVP

SEQ ID NO: 796731 - protein, 9 aa, Homo Sapiens
WMTVAHMWF

SEQ ID NO: 796732 - protein, 9 aa, Homo Sapiens
YFLLQPAQK

SEQ ID NO: 796733 - protein, 9 aa, Homo Sapiens
KILQAKTKQ

SEQ ID NO: 796734 - protein, 9 aa, Homo Sapiens
GKVFNHCSL

SEQ ID NO: 796735 - protein, 9 aa, Homo Sapiens
HQRGQQELG

SEQ ID NO: 796736 - protein, 9 aa, Homo Sapiens
KLGKKMKPD

SEQ ID NO: 796737 - protein, 9 aa, Homo Sapiens
RIILVGKRG

SEQ ID NO: 796738 - protein, 9 aa, Homo Sapiens
ILVGKRGTG

SEQ ID NO: 796739 - protein, 9 aa, Homo Sapiens
NGPCVPNSI

SEQ ID NO: 796740 - protein, 9 aa, Homo Sapiens
LMEKAQAER

SEQ ID NO: 796741 - protein, 9 aa, Homo Sapiens
CIDVVQCPE

SEQ ID NO: 796742 - protein, 9 aa, Homo Sapiens
VKISRRVLR

SEQ ID NO: 796743 - protein, 9 aa, Homo Sapiens
GDCTSGENS

SEQ ID NO: 796744 - protein, 9 aa, Homo Sapiens
LQTSLGQHQ

SEQ ID NO: 796745 - protein, 9 aa, Homo Sapiens
VPDYRQNGY

SEQ ID NO: 796746 - protein, 9 aa, Homo Sapiens
KWIKILQAK

SEQ ID NO: 796747 - protein, 9 aa, Homo Sapiens
PTSYSVPLP

SEQ ID NO: 796748 - protein, 9 aa, Homo Sapiens
GTLTQNWMT

SEQ ID NO: 796749 - protein, 9 aa, Homo Sapiens
IFERFVEST

SEQ ID NO: 796750 - protein, 9 aa, Homo Sapiens
CKECGKVLI

SEQ ID NO: 796751 - protein, 9 aa, Homo Sapiens
ISAEYFSQT

SEQ ID NO: 796752 - protein, 9 aa, Homo Sapiens
EMRRHAFEL

SEQ ID NO: 796753 - protein, 9 aa, Homo Sapiens
RLRLQLRPR

SEQ ID NO: 796754 - protein, 9 aa, Homo Sapiens
VSECLESIK

SEQ ID NO: 796755 - protein, 9 aa, Homo Sapiens
YTGTHKELF

SEQ ID NO: 796756 - protein, 9 aa, Homo Sapiens
LNSSSSVSS

SEQ ID NO: 796757 - protein, 9 aa, Homo Sapiens
SAEYFSQTD

SEQ ID NO: 796758 - protein, 9 aa, Homo Sapiens
SRASNKHDI

SEQ ID NO: 796759 - protein, 9 aa, Homo Sapiens
NKRNHEQRH

SEQ ID NO: 796760 - protein, 9 aa, Homo Sapiens
VEVHENVEK

SEQ ID NO: 796761 - protein, 9 aa, Homo Sapiens
ILHPPLVPS

SEQ ID NO: 796762 - protein, 9 aa, Homo Sapiens
GKHMGREQV

SEQ ID NO: 796763 - protein, 9 aa, Homo Sapiens
RNGPCVPNS

SEQ ID NO: 796764 - protein, 9 aa, Homo Sapiens
SIYSQTEKK

SEQ ID NO: 796765 - protein, 9 aa, Homo Sapiens
RPAAGDEVP

SEQ ID NO: 796766 - protein, 9 aa, Homo Sapiens
KICATKRKL

SEQ ID NO: 796767 - protein, 9 aa, Homo Sapiens
PPLVALSCS

SEQ ID NO: 796768 - protein, 9 aa, Homo Sapiens
YPIYISIEA

SEQ ID NO: 796769 - protein, 9 aa, Homo Sapiens
LRQYKVLFH

SEQ ID NO: 796770 - protein, 9 aa, Homo Sapiens
HGLVQPVAY

SEQ ID NO: 796771 - protein, 9 aa, Homo Sapiens
SLLMEKAQA

SEQ ID NO: 796772 - protein, 9 aa, Homo Sapiens
FEELGMYDM

SEQ ID NO: 796773 - protein, 9 aa, Homo Sapiens
SDEIYVDVT

SEQ ID NO: 796774 - protein, 9 aa, Homo Sapiens
GPYKCKICG

SEQ ID NO: 796775 - protein, 9 aa, Homo Sapiens
GECDPEEIC

SEQ ID NO: 796776 - protein, 9 aa, Homo Sapiens
SAWDPLDEW

SEQ ID NO: 796777 - protein, 9 aa, Homo Sapiens
GAKKRAIGQ

SEQ ID NO: 796778 - protein, 9 aa, Homo Sapiens
GKPVKISRR

SEQ ID NO: 796779 - protein, 9 aa, Homo Sapiens
RISAEYFSQ

SEQ ID NO: 796780 - protein, 9 aa, Homo Sapiens
ICGKALDCL

SEQ ID NO: 796781 - protein, 9 aa, Homo Sapiens
CTKSAWDPL

SEQ ID NO: 796782 - protein, 9 aa, Homo Sapiens
NAVEERVIN

SEQ ID NO: 796783 - protein, 9 aa, Homo Sapiens
PRLRLQLRP

SEQ ID NO: 796784 - protein, 9 aa, Homo Sapiens
LGMYDMMMD

SEQ ID NO: 796785 - protein, 9 aa, Homo Sapiens
KCTKSAWDP

SEQ ID NO: 796786 - protein, 9 aa, Homo Sapiens
AAFDNAVEE

SEQ ID NO: 796787 - protein, 9 aa, Homo Sapiens
WAARISAEY

SEQ ID NO: 796788 - protein, 9 aa, Homo Sapiens
AIGVLVGPP

SEQ ID NO: 796789 - protein, 9 aa, Homo Sapiens
EPRKRSVPP

SEQ ID NO: 796790 - protein, 9 aa, Homo Sapiens
RSSSLNSSS

SEQ ID NO: 796791 - protein, 9 aa, Homo Sapiens
KKWIKILQA

SEQ ID NO: 796792 - protein, 9 aa, Homo Sapiens
VPFRTVSEC

SEQ ID NO: 796793 - protein, 9 aa, Homo Sapiens
AWDPLDEWL

SEQ ID NO: 796794 - protein, 9 aa, Homo Sapiens
PSKYRSLLT

SEQ ID NO: 796795 - protein, 9 aa, Homo Sapiens
GITYTVFTP

SEQ ID NO: 796796 - protein, 9 aa, Homo Sapiens
ASEPLKVPL

SEQ ID NO: 796797 - protein, 9 aa, Homo Sapiens
HQDAIAAKD

SEQ ID NO: 796798 - protein, 9 aa, Homo Sapiens
YSQTEKKAQ

SEQ ID NO: 796799 - protein, 9 aa, Homo Sapiens
EPLKVPLLH

SEQ ID NO: 796800 - protein, 9 aa, Homo Sapiens
IALGGLAIG

SEQ ID NO: 796801 - protein, 9 aa, Homo Sapiens
YGGGGPVYG

SEQ ID NO: 796802 - protein, 9 aa, Homo Sapiens
DPPEIKDQG

SEQ ID NO: 796803 - protein, 9 aa, Homo Sapiens
SEPLKVPLL

SEQ ID NO: 796804 - protein, 9 aa, Homo Sapiens
PDYRQNGYI

SEQ ID NO: 796805 - protein, 9 aa, Homo Sapiens
SSLLRDIPP

SEQ ID NO: 796806 - protein, 9 aa, Homo Sapiens
VYGNQGGGY

SEQ ID NO: 796807 - protein, 9 aa, Homo Sapiens
KCKICGKAL

SEQ ID NO: 796808 - protein, 9 aa, Homo Sapiens
SVPPPDGNG

SEQ ID NO: 796809 - protein, 9 aa, Homo Sapiens
DVVQCPEMR

SEQ ID NO: 796810 - protein, 9 aa, Homo Sapiens
ICKAARHLE

SEQ ID NO: 796811 - protein, 9 aa, Homo Sapiens
GREQVHKDE

SEQ ID NO: 796812 - protein, 9 aa, Homo Sapiens
VALSCSDTR

SEQ ID NO: 796813 - protein, 9 aa, Homo Sapiens
VTFRKICAT

SEQ ID NO: 796814 - protein, 9 aa, Homo Sapiens
EAAFDNAVE

SEQ ID NO: 796815 - protein, 9 aa, Homo Sapiens
FLFYHIIRL

SEQ ID NO: 796816 - protein, 9 aa, Homo Sapiens
VYGDCTSGE

SEQ ID NO: 796817 - protein, 9 aa, Homo Sapiens
EPGVLNLVE

SEQ ID NO: 796818 - protein, 9 aa, Homo Sapiens
LTQNWMTVA

SEQ ID NO: 796819 - protein, 9 aa, Homo Sapiens
GKKMKPDVL

SEQ ID NO: 796820 - protein, 9 aa, Homo Sapiens
STGSSLKAQ

SEQ ID NO: 796821 - protein, 9 aa, Homo Sapiens
ATVEDVQIR

SEQ ID NO: 796822 - protein, 9 aa, Homo Sapiens
ECDPEEICK

SEQ ID NO: 796823 - protein, 9 aa, Homo Sapiens
HLSPYFLLQ

SEQ ID NO: 796824 - protein, 9 aa, Homo Sapiens
EASAHSDPP

SEQ ID NO: 796825 - protein, 9 aa, Homo Sapiens
TGTLTQNWM

SEQ ID NO: 796826 - protein, 9 aa, Homo Sapiens
YLSNKRNHE

SEQ ID NO: 796827 - protein, 9 aa, Homo Sapiens
RSSKSESRC

SEQ ID NO: 796828 - protein, 9 aa, Homo Sapiens
TNNSRIVRL

SEQ ID NO: 796829 - protein, 9 aa, Homo Sapiens
PEEICKAAR

SEQ ID NO: 796830 - protein, 9 aa, Homo Sapiens
GQKSRASNK

SEQ ID NO: 796831 - protein, 9 aa, Homo Sapiens
RAIGQRIVA

SEQ ID NO: 796832 - protein, 9 aa, Homo Sapiens
EVEDSDLQY

SEQ ID NO: 796833 - protein, 9 aa, Homo Sapiens
QCPEMRRHA

SEQ ID NO: 796834 - protein, 9 aa, Homo Sapiens
HMGREQVHK

SEQ ID NO: 796835 - protein, 9 aa, Homo Sapiens
SVSRSSSLN

SEQ ID NO: 796836 - protein, 9 aa, Homo Sapiens
LSPYFLLQP

SEQ ID NO: 796837 - protein, 9 aa, Homo Sapiens
QTEKKAQGK

SEQ ID NO: 796838 - protein, 9 aa, Homo Sapiens
NWMTVAHMW

SEQ ID NO: 796839 - protein, 9 aa, Homo Sapiens
NKHDIYSYA

SEQ ID NO: 796840 - protein, 9 aa, Homo Sapiens
KECGKVFNH

SEQ ID NO: 796841 - protein, 9 aa, Homo Sapiens
PGVLNLVEI

SEQ ID NO: 796842 - protein, 9 aa, Homo Sapiens
LTEASAHSD

SEQ ID NO: 796843 - protein, 9 aa, Homo Sapiens
HGDKILQAN

SEQ ID NO: 796844 - protein, 9 aa, Homo Sapiens
TILSTGSSL

SEQ ID NO: 796845 - protein, 9 aa, Homo Sapiens
LKGCAVEAM

SEQ ID NO: 796846 - protein, 9 aa, Homo Sapiens
LGGLAIGVL

SEQ ID NO: 796847 - protein, 9 aa, Homo Sapiens
IRGGFVNVE

SEQ ID NO: 796848 - protein, 9 aa, Homo Sapiens
PHGLVQPVA

SEQ ID NO: 796849 - protein, 9 aa, Homo Sapiens
NYVSSAARV

SEQ ID NO: 796850 - protein, 9 aa, Homo Sapiens
SSIYSQTEK

SEQ ID NO: 796851 - protein, 9 aa, Homo Sapiens
EDVTFRKIC

SEQ ID NO: 796852 - protein, 9 aa, Homo Sapiens
LFHSQEREL

SEQ ID NO: 796853 - protein, 9 aa, Homo Sapiens
GGGGPVYGN

SEQ ID NO: 796854 - protein, 9 aa, Homo Sapiens
MNYVSSAAR

SEQ ID NO: 796855 - protein, 9 aa, Homo Sapiens
ELRQYKVLF

SEQ ID NO: 796856 - protein, 9 aa, Homo Sapiens
ILSTGSSLK

SEQ ID NO: 796857 - protein, 9 aa, Homo Sapiens
LVQPVAYPL

SEQ ID NO: 796858 - protein, 9 aa, Homo Sapiens
LATVEDVQI

SEQ ID NO: 796859 - protein, 9 aa, Homo Sapiens
LFDESGKGK

SEQ ID NO: 796860 - protein, 9 aa, Homo Sapiens
LGQHQRGQQ

SEQ ID NO: 796861 - protein, 9 aa, Homo Sapiens
DAIAAKDPA

SEQ ID NO: 796862 - protein, 9 aa, Homo Sapiens
RTVSECLES

SEQ ID NO: 796863 - protein, 9 aa, Homo Sapiens
VLNLVEIMA

SEQ ID NO: 796864 - protein, 9 aa, Homo Sapiens
SRTPRLPCS

SEQ ID NO: 796865 - protein, 9 aa, Homo Sapiens
FEVHGNWLA

SEQ ID NO: 796866 - protein, 9 aa, Homo Sapiens
CPEMRRHAF

SEQ ID NO: 796867 - protein, 9 aa, Homo Sapiens
ELFDESGKG

SEQ ID NO: 796868 - protein, 9 aa, Homo Sapiens
PLVPSKYRS

SEQ ID NO: 796869 - protein, 9 aa, Homo Sapiens
EELGMYDMM

SEQ ID NO: 796870 - protein, 9 aa, Homo Sapiens
EWAARISAE

SEQ ID NO: 796871 - protein, 9 aa, Homo Sapiens
GTHKELFDE

SEQ ID NO: 796872 - protein, 9 aa, Homo Sapiens
ADKEAAFDN

SEQ ID NO: 796873 - protein, 9 aa, Homo Sapiens
YKCKICGKA

SEQ ID NO: 796874 - protein, 9 aa, Homo Sapiens
TISIFERFV

SEQ ID NO: 796875 - protein, 9 aa, Homo Sapiens
IRLQIFRTF

SEQ ID NO: 796876 - protein, 9 aa, Homo Sapiens
QHDLVYGDC

SEQ ID NO: 796877 - protein, 9 aa, Homo Sapiens
NSSSSVSSQ

SEQ ID NO: 796878 - protein, 9 aa, Homo Sapiens
TPDSGKPVK

SEQ ID NO: 796879 - protein, 9 aa, Homo Sapiens
EIYVDVTYI

SEQ ID NO: 796880 - protein, 9 aa, Homo Sapiens
SEPRKRSVP

SEQ ID NO: 796881 - protein, 9 aa, Homo Sapiens
GGYGGGGPV

SEQ ID NO: 796882 - protein, 9 aa, Homo Sapiens
SYSVPLPEN

SEQ ID NO: 796883 - protein, 9 aa, Homo Sapiens
IYISIEAAE

SEQ ID NO: 796884 - protein, 9 aa, Homo Sapiens
DPLDEWLPP

SEQ ID NO: 796885 - protein, 9 aa, Homo Sapiens
EKCKGKHMG

SEQ ID NO: 796886 - protein, 9 aa, Homo Sapiens
NSRIVRLLA

SEQ ID NO: 796887 - protein, 9 aa, Homo Sapiens
SRCPVQEDN

SEQ ID NO: 796888 - protein, 9 aa, Homo Sapiens
FRTVSECLE

SEQ ID NO: 796889 - protein, 9 aa, Homo Sapiens
KHMGREQVH

SEQ ID NO: 796890 - protein, 9 aa, Homo Sapiens
GMYDMMMDV

SEQ ID NO: 796891 - protein, 9 aa, Homo Sapiens
AKKRAIGQR

SEQ ID NO: 796892 - protein, 9 aa, Homo Sapiens
SGLEPGVLN

SEQ ID NO: 796893 - protein, 9 aa, Homo Sapiens
VHGNWLAIT

SEQ ID NO: 796894 - protein, 9 aa, Homo Sapiens
DKEAAFDNA

SEQ ID NO: 796895 - protein, 9 aa, Homo Sapiens
LTNNSRIVR

SEQ ID NO: 796896 - protein, 9 aa, Homo Sapiens
GGLAIGVLV

SEQ ID NO: 796897 - protein, 9 aa, Homo Sapiens
SFWMNYVSS

SEQ ID NO: 796898 - protein, 9 aa, Homo Sapiens
IGVLVGPPF

SEQ ID NO: 796899 - protein, 9 aa, Homo Sapiens
KGKHMGREQ

SEQ ID NO: 796900 - protein, 9 aa, Homo Sapiens
GQGAKKRAI

SEQ ID NO: 796901 - protein, 9 aa, Homo Sapiens
TLTQNWMTV

SEQ ID NO: 796902 - protein, 9 aa, Homo Sapiens
MEKAQAERL

SEQ ID NO: 796903 - protein, 9 aa, Homo Sapiens
KVEVHENVE

SEQ ID NO: 796904 - protein, 9 aa, Homo Sapiens
EDSDLQYAA

SEQ ID NO: 796905 - protein, 9 aa, Homo Sapiens
QPAQKCLEW

SEQ ID NO: 796906 - protein, 9 aa, Homo Sapiens
EQSLLMEKA

SEQ ID NO: 796907 - protein, 9 aa, Homo Sapiens
IYSQTEKKA

SEQ ID NO: 796908 - protein, 9 aa, Homo Sapiens
RQNGYIPGS

SEQ ID NO: 796909 - protein, 9 aa, Homo Sapiens
PVKISRRVL

SEQ ID NO: 796910 - protein, 9 aa, Homo Sapiens
KPVKISRRV

SEQ ID NO: 796911 - protein, 9 aa, Homo Sapiens
TLDGLPRLR

SEQ ID NO: 796912 - protein, 9 aa, Homo Sapiens
SSLNSSSSV

SEQ ID NO: 796913 - protein, 9 aa, Homo Sapiens
DLVYGDCTS

SEQ ID NO: 796914 - protein, 9 aa, Homo Sapiens
GIALGGLAI

SEQ ID NO: 796915 - protein, 9 aa, Homo Sapiens
AYYDLSYCA

SEQ ID NO: 796916 - protein, 9 aa, Homo Sapiens
MGQRPAAGD

SEQ ID NO: 796917 - protein, 9 aa, Homo Sapiens
CMEEMHQDA

SEQ ID NO: 796918 - protein, 9 aa, Homo Sapiens
DECRNGPCV

SEQ ID NO: 796919 - protein, 9 aa, Homo Sapiens
LHPPLVPSK

SEQ ID NO: 796920 - protein, 9 aa, Homo Sapiens
LMGITYTVF

SEQ ID NO: 796921 - protein, 9 aa, Homo Sapiens
LPRLRLQLR

SEQ ID NO: 796922 - protein, 9 aa, Homo Sapiens
LLQPAQKCL

SEQ ID NO: 796923 - protein, 9 aa, Homo Sapiens
MHQDAIAAK

SEQ ID NO: 796924 - protein, 9 aa, Homo Sapiens
GGPVYGNQG

SEQ ID NO: 796925 - protein, 9 aa, Homo Sapiens
FDNAVEERV

SEQ ID NO: 796926 - protein, 9 aa, Homo Sapiens
EKKAQGKSQ

SEQ ID NO: 796927 - protein, 9 aa, Homo Sapiens
LSTGSSLKA

SEQ ID NO: 796928 - protein, 9 aa, Homo Sapiens
FYFEELGMY

SEQ ID NO: 796929 - protein, 9 aa, Homo Sapiens
DEIYVDVTY

SEQ ID NO: 796930 - protein, 9 aa, Homo Sapiens
LPCSADVEF

SEQ ID NO: 796931 - protein, 9 aa, Homo Sapiens
TSYSVPLPE

SEQ ID NO: 796932 - protein, 9 aa, Homo Sapiens
KRGTGKSAA

SEQ ID NO: 796933 - protein, 9 aa, Homo Sapiens
SKYRSLLTD

SEQ ID NO: 796934 - protein, 9 aa, Homo Sapiens
YVSSAARVT

SEQ ID NO: 796935 - protein, 9 aa, Homo Sapiens
RCPVQEDNT

SEQ ID NO: 796936 - protein, 9 aa, Homo Sapiens
VAYPLGLVQ

SEQ ID NO: 796937 - protein, 9 aa, Homo Sapiens
SFSDEIYVD

SEQ ID NO: 796938 - protein, 9 aa, Homo Sapiens
NGYIPGSNA

SEQ ID NO: 796939 - protein, 9 aa, Homo Sapiens
SSFSDEIYV

SEQ ID NO: 796940 - protein, 9 aa, Homo Sapiens
LQPAQKCLE

SEQ ID NO: 796941 - protein, 9 aa, Homo Sapiens
IIRLQIFRT

SEQ ID NO: 796942 - protein, 9 aa, Homo Sapiens
RLQTSLGQH

SEQ ID NO: 796943 - protein, 9 aa, Homo Sapiens
RLLAQLEKI

SEQ ID NO: 796944 - protein, 9 aa, Homo Sapiens
LLRDIPPSN

SEQ ID NO: 796945 - protein, 9 aa, Homo Sapiens
IPPLVALSC

SEQ ID NO: 796946 - protein, 9 aa, Homo Sapiens
GQHQRGQQE

SEQ ID NO: 796947 - protein, 9 aa, Homo Sapiens
LNLVEIMAK

SEQ ID NO: 796948 - protein, 9 aa, Homo Sapiens
KGCAVEAMF

SEQ ID NO: 796949 - protein, 9 aa, Homo Sapiens
LLKGCAVEA

SEQ ID NO: 796950 - protein, 9 aa, Homo Sapiens
LKKWIKILQ

SEQ ID NO: 796951 - protein, 9 aa, Homo Sapiens
AGDEVPESV

SEQ ID NO: 796952 - protein, 9 aa, Homo Sapiens
DVTFRKICA

SEQ ID NO: 796953 - protein, 9 aa, Homo Sapiens
KICGKALDC

SEQ ID NO: 796954 - protein, 9 aa, Homo Sapiens
PDSGKPVKI

SEQ ID NO: 796955 - protein, 9 aa, Homo Sapiens
LKCTKSAWD

SEQ ID NO: 796956 - protein, 9 aa, Homo Sapiens
RTPRLPCSA

SEQ ID NO: 796957 - protein, 9 aa, Homo Sapiens
AAGDEVPES

SEQ ID NO: 796958 - protein, 9 aa, Homo Sapiens
QQASEPLKV

SEQ ID NO: 796959 - protein, 9 aa, Homo Sapiens
FLKVEVHEN

SEQ ID NO: 796960 - protein, 9 aa, Homo Sapiens
SCQNFYKDC

SEQ ID NO: 796961 - protein, 9 aa, Homo Sapiens
ASAHSDPPE

SEQ ID NO: 796962 - protein, 9 aa, Homo Sapiens
PCVPNSICV

SEQ ID NO: 796963 - protein, 9 aa, Homo Sapiens
EMHQDAIAA

SEQ ID NO: 796964 - protein, 9 aa, Homo Sapiens
VLFHSQERE

SEQ ID NO: 796965 - protein, 9 aa, Homo Sapiens
KCKECGKVL

SEQ ID NO: 796966 - protein, 9 aa, Homo Sapiens
GDGPYKCKI

SEQ ID NO: 796967 - protein, 9 aa, Homo Sapiens
YGDCTSGEN

SEQ ID NO: 796968 - protein, 9 aa, Homo Sapiens
NNSRIVRLL

SEQ ID NO: 796969 - protein, 9 aa, Homo Sapiens
SECLESIKM

SEQ ID NO: 796970 - protein, 9 aa, Homo Sapiens
VLIRSKSLL

SEQ ID NO: 796971 - protein, 9 aa, Homo Sapiens
WISFWMNYV

SEQ ID NO: 796972 - protein, 9 aa, Homo Sapiens
TVEDVQIRP

SEQ ID NO: 796973 - protein, 9 aa, Homo Sapiens
RKRSVPPPD

SEQ ID NO: 796974 - protein, 9 aa, Homo Sapiens
PLPENTAIR

SEQ ID NO: 796975 - protein, 9 aa, Homo Sapiens
FLYLSNKRN

SEQ ID NO: 796976 - protein, 9 aa, Homo Sapiens
FCDIPPLVA

SEQ ID NO: 796977 - protein, 9 aa, Homo Sapiens
QAKTKQLPK

SEQ ID NO: 796978 - protein, 9 aa, Homo Sapiens
TGSSLKAQS

SEQ ID NO: 796979 - protein, 9 aa, Homo Sapiens
CAVEAMFLR

SEQ ID NO: 796980 - protein, 9 aa, Homo Sapiens
ICATKRKLS

SEQ ID NO: 796981 - protein, 9 aa, Homo Sapiens
EICKAARHL

SEQ ID NO: 796982 - protein, 9 aa, Homo Sapiens
VPSKYRSLL

SEQ ID NO: 796983 - protein, 9 aa, Homo Sapiens
LTLDGLPRL

SEQ ID NO: 796984 - protein, 9 aa, Homo Sapiens
RPHAYYDLS

SEQ ID NO: 796985 - protein, 9 aa, Homo Sapiens
CDPEEICKA

SEQ ID NO: 796986 - protein, 9 aa, Homo Sapiens
PLKVPLLHS

SEQ ID NO: 796987 - protein, 9 aa, Homo Sapiens
SGKPVKISR

SEQ ID NO: 796988 - protein, 9 aa, Homo Sapiens
QRFLYLSNK

SEQ ID NO: 796989 - protein, 9 aa, Homo Sapiens
KSIFLKVEV

SEQ ID NO: 796990 - protein, 9 aa, Homo Sapiens
CKICGKALD

SEQ ID NO: 796991 - protein, 9 aa, Homo Sapiens
CTSGENSDG

SEQ ID NO: 796992 - protein, 9 aa, Homo Sapiens
PGQKSRASN

SEQ ID NO: 796993 - protein, 9 aa, Homo Sapiens
MGSSFSDEI

SEQ ID NO: 796994 - protein, 9 aa, Homo Sapiens
ITYTVFTPF

SEQ ID NO: 796995 - protein, 9 aa, Homo Sapiens
MEEMHQDAI

SEQ ID NO: 796996 - protein, 9 aa, Homo Sapiens
SLNSSSSVS

SEQ ID NO: 796997 - protein, 9 aa, Homo Sapiens
PPLVPSKYR

SEQ ID NO: 796998 - protein, 9 aa, Homo Sapiens
FHSQERELT

SEQ ID NO: 796999 - protein, 9 aa, Homo Sapiens
AARISAEYF

SEQ ID NO: 797000 - protein, 9 aa, Homo Sapiens
HSDPPEIKD

SEQ ID NO: 797001 - protein, 9 aa, Homo Sapiens
VSRSSSLNS

SEQ ID NO: 797002 - protein, 9 aa, Homo Sapiens
KVPLLHSHS

SEQ ID NO: 797003 - protein, 9 aa, Homo Sapiens
SYPIYISIE

SEQ ID NO: 797004 - protein, 9 aa, Homo Sapiens
PIYISIEAA

SEQ ID NO: 797005 - protein, 9 aa, Homo Sapiens
FWMNYVSSA

SEQ ID NO: 797006 - protein, 9 aa, Homo Sapiens
GSSFSDEIY

SEQ ID NO: 797007 - protein, 9 aa, Homo Sapiens
LAIGVLVGP

SEQ ID NO: 797008 - protein, 9 aa, Homo Sapiens
ECGKVLIRS

SEQ ID NO: 797009 - protein, 9 aa, Homo Sapiens
ALLKGCAVE

SEQ ID NO: 797010 - protein, 9 aa, Homo Sapiens
KELFDESGK

SEQ ID NO: 797011 - protein, 9 aa, Homo Sapiens
YFEELGMYD

SEQ ID NO: 797012 - protein, 9 aa, Homo Sapiens
YTKLIRGGF

SEQ ID NO: 797013 - protein, 9 aa, Homo Sapiens
YHTQVVEKS

SEQ ID NO: 797014 - protein, 9 aa, Homo Sapiens
TSLGQHQRG

SEQ ID NO: 797015 - protein, 9 aa, Homo Sapiens
TGTHKELFD

SEQ ID NO: 797016 - protein, 9 aa, Homo Sapiens
QHGFSSLLR

SEQ ID NO: 797017 - protein, 9 aa, Homo Sapiens
QNFYKDCTL

SEQ ID NO: 797018 - protein, 9 aa, Homo Sapiens
LGKKMKPDV

SEQ ID NO: 797019 - protein, 9 aa, Homo Sapiens
HDLVYGDCT

SEQ ID NO: 797020 - protein, 9 aa, Homo Sapiens
RASNKHDIY

SEQ ID NO: 797021 - protein, 9 aa, Homo Sapiens
MYDMMMDVW

SEQ ID NO: 797022 - protein, 9 aa, Homo Sapiens
DQIALLKGC

SEQ ID NO: 797023 - protein, 9 aa, Homo Sapiens
KSESRCPVQ

SEQ ID NO: 797024 - protein, 9 aa, Homo Sapiens
AEYFSQTDE

SEQ ID NO: 797025 - protein, 9 aa, Homo Sapiens
PCSADVEFC

SEQ ID NO: 797026 - protein, 9 aa, Homo Sapiens
EEMHQDAIA

SEQ ID NO: 797027 - protein, 9 aa, Homo Sapiens
TEASAHSDP

SEQ ID NO: 797028 - protein, 9 aa, Homo Sapiens
KPDVLSHPE

SEQ ID NO: 797029 - protein, 9 aa, Homo Sapiens
AHSDPPEIK

SEQ ID NO: 797030 - protein, 9 aa, Homo Sapiens
SDPPEIKDQ

SEQ ID NO: 797031 - protein, 9 aa, Homo Sapiens
DSDLQYAAW

SEQ ID NO: 797032 - protein, 9 aa, Homo Sapiens
VPLPENTAI

SEQ ID NO: 797033 - protein, 9 aa, Homo Sapiens
SRSSSLNSS

SEQ ID NO: 797034 - protein, 9 aa, Homo Sapiens
GELEQSLLM

SEQ ID NO: 797035 - protein, 9 aa, Homo Sapiens
DFEVHGNWL

SEQ ID NO: 797036 - protein, 9 aa, Homo Sapiens
RQYKVLFHS

SEQ ID NO: 797037 - protein, 9 aa, Homo Sapiens
STDFEVHGN

SEQ ID NO: 797038 - protein, 9 aa, Homo Sapiens
YDLSYCALI

SEQ ID NO: 797039 - protein, 9 aa, Homo Sapiens
QARPHAYYD

SEQ ID NO: 797040 - protein, 9 aa, Homo Sapiens
HGNWLAITH

SEQ ID NO: 797041 - protein, 9 aa, Homo Sapiens
VYHTQVVEK

SEQ ID NO: 797042 - protein, 9 aa, Homo Sapiens
DGPYKCKIC

SEQ ID NO: 797043 - protein, 9 aa, Homo Sapiens
PHAYYDLSY

SEQ ID NO: 797044 - protein, 9 aa, Homo Sapiens
LRIILVGKR

SEQ ID NO: 797045 - protein, 9 aa, Homo Sapiens
LVPSKYRSL

SEQ ID NO: 797046 - protein, 9 aa, Homo Sapiens
KSRASNKHD

SEQ ID NO: 797047 - protein, 9 aa, Homo Sapiens
GPVYGNQGG

SEQ ID NO: 797048 - protein, 9 aa, Homo Sapiens
LDGLPRLRL

SEQ ID NO: 797049 - protein, 9 aa, Homo Sapiens
QKSRASNKH

SEQ ID NO: 797050 - protein, 9 aa, Homo Sapiens
ELGMYDMMM

SEQ ID NO: 797051 - protein, 9 aa, Homo Sapiens
SRIVRLLAQ

SEQ ID NO: 797052 - protein, 9 aa, Homo Sapiens
TDFEVHGNW

SEQ ID NO: 797053 - protein, 9 aa, Homo Sapiens
QHGDKILQA

SEQ ID NO: 797054 - protein, 9 aa, Homo Sapiens
SNKRNHEQR

SEQ ID NO: 797055 - protein, 9 aa, Homo Sapiens
KRAIGQRIV

SEQ ID NO: 797056 - protein, 9 aa, Homo Sapiens
GNWLAITHS

SEQ ID NO: 797057 - protein, 9 aa, Homo Sapiens
LIRSKSLLL

SEQ ID NO: 797058 - protein, 9 aa, Homo Sapiens
HKELFDESG

SEQ ID NO: 797059 - protein, 9 aa, Homo Sapiens
QTPDSGKPV

SEQ ID NO: 797060 - protein, 9 aa, Homo Sapiens
CGKVFNHCS

SEQ ID NO: 797061 - protein, 9 aa, Homo Sapiens
LVALSCSDT

SEQ ID NO: 797062 - protein, 9 aa, Homo Sapiens
SAHSDPPEI

SEQ ID NO: 797063 - protein, 9 aa, Homo Sapiens
DVLSHPERF

SEQ ID NO: 797064 - protein, 9 aa, Homo Sapiens
CLESIKMQQ

SEQ ID NO: 797065 - protein, 9 aa, Homo Sapiens
CQNFYKDCT

SEQ ID NO: 797066 - protein, 9 aa, Homo Sapiens
AYTKLIRGG

SEQ ID NO: 797067 - protein, 9 aa, Homo Sapiens
QDAIAAKDP

SEQ ID NO: 797068 - protein, 9 aa, Homo Sapiens
ISIEAAELA

SEQ ID NO: 797069 - protein, 9 aa, Homo Sapiens
GVLNLVEIM

SEQ ID NO: 797070 - protein, 9 aa, Homo Sapiens
LQAKTKQLP

SEQ ID NO: 797071 - protein, 9 aa, Homo Sapiens
ELEQSLLME

SEQ ID NO: 797072 - protein, 9 aa, Homo Sapiens
SIFERFVES

SEQ ID NO: 797073 - protein, 9 aa, Homo Sapiens
SVPLPENTA

SEQ ID NO: 797074 - protein, 9 aa, Homo Sapiens
HGFSSLLRD

SEQ ID NO: 797075 - protein, 9 aa, Homo Sapiens
FRKICATKR

SEQ ID NO: 797076 - protein, 9 aa, Homo Sapiens
TPRLPCSAD

SEQ ID NO: 797077 - protein, 9 aa, Homo Sapiens
PVYGNQGGG

SEQ ID NO: 797078 - protein, 9 aa, Homo Sapiens
TKSAWDPLD

SEQ ID NO: 797079 - protein, 9 aa, Homo Sapiens
DGLPRLRLQ

SEQ ID NO: 797080 - protein, 9 aa, Homo Sapiens
LIRGGFVNV

SEQ ID NO: 797081 - protein, 9 aa, Homo Sapiens
TEKKAQGKS

SEQ ID NO: 797082 - protein, 9 aa, Homo Sapiens
PVAYPLGLV

SEQ ID NO: 797083 - protein, 9 aa, Homo Sapiens
HSTDFEVHG

SEQ ID NO: 797084 - protein, 9 aa, Homo Sapiens
ECLESIKMQ

SEQ ID NO: 797085 - protein, 9 aa, Homo Sapiens
KDCTLQIDM

SEQ ID NO: 797086 - protein, 9 aa, Homo Sapiens
PPPDGNGSP

SEQ ID NO: 797087 - protein, 9 aa, Homo Sapiens
SDLQYAAWG

SEQ ID NO: 797088 - protein, 9 aa, Homo Sapiens
THKELFDES

SEQ ID NO: 797089 - protein, 9 aa, Homo Sapiens
HIIRLQIFR

SEQ ID NO: 797090 - protein, 9 aa, Homo Sapiens
GKVLIRSKS

SEQ ID NO: 797091 - protein, 9 aa, Homo Sapiens
VEDSDLQYA

SEQ ID NO: 797092 - protein, 9 aa, Homo Sapiens
KSRTPRLPC

SEQ ID NO: 797093 - protein, 9 aa, Homo Sapiens
CKGKHMGRE

SEQ ID NO: 797094 - protein, 9 aa, Homo Sapiens
YRQNGYIPG

SEQ ID NO: 797095 - protein, 9 aa, Homo Sapiens
ESRCPVQED

SEQ ID NO: 797096 - protein, 9 aa, Homo Sapiens
DLQYAAWGV

SEQ ID NO: 797097 - protein, 9 aa, Homo Sapiens
GGFVNVEKV

SEQ ID NO: 797098 - protein, 9 aa, Homo Sapiens
QIALLKGCA

SEQ ID NO: 797099 - protein, 9 aa, Homo Sapiens
DIPPLVALS

SEQ ID NO: 797100 - protein, 9 aa, Homo Sapiens
TSYPIYISI

SEQ ID NO: 797101 - protein, 9 aa, Homo Sapiens
EVHGNWLAI

SEQ ID NO: 797102 - protein, 9 aa, Homo Sapiens
GSSLKAQSY

SEQ ID NO: 797103 - protein, 9 aa, Homo Sapiens
YYDLSYCAL

SEQ ID NO: 797104 - protein, 9 aa, Homo Sapiens
FSPTSYSVP

SEQ ID NO: 797105 - protein, 9 aa, Homo Sapiens
LSNKRNHEQ

SEQ ID NO: 797106 - protein, 9 aa, Homo Sapiens
SNLLQHGDK

SEQ ID NO: 797107 - protein, 9 aa, Homo Sapiens
LDQEEVYHT

SEQ ID NO: 797108 - protein, 9 aa, Homo Sapiens
IEWAARISA

SEQ ID NO: 797109 - protein, 9 aa, Homo Sapiens
HTQVVEKSL

SEQ ID NO: 797110 - protein, 9 aa, Homo Sapiens
KECGKVLIR

SEQ ID NO: 797111 - protein, 9 aa, Homo Sapiens
WDPLDEWLP

SEQ ID NO: 797112 - protein, 9 aa, Homo Sapiens
KYTGTHKEL

SEQ ID NO: 797113 - protein, 9 aa, Homo Sapiens
ERFVESTVE

SEQ ID NO: 797114 - protein, 9 aa, Homo Sapiens
LEQSLLMEK

SEQ ID NO: 797115 - protein, 9 aa, Homo Sapiens
CRNGPCVPN

SEQ ID NO: 797116 - protein, 9 aa, Homo Sapiens
SSKSESRCP

SEQ ID NO: 797117 - protein, 9 aa, Homo Sapiens
NFYKDCTLQ

SEQ ID NO: 797118 - protein, 9 aa, Homo Sapiens
GGQGAKKRA

SEQ ID NO: 797119 - protein, 9 aa, Homo Sapiens
GDEVPESVF

SEQ ID NO: 797120 - protein, 9 aa, Homo Sapiens
NLDQEEVYH

SEQ ID NO: 797121 - protein, 9 aa, Homo Sapiens
KKAQGKSQK

SEQ ID NO: 797122 - protein, 9 aa, Homo Sapiens
EEICKAARH

SEQ ID NO: 797123 - protein, 9 aa, Homo Sapiens
IKILQAKTK

SEQ ID NO: 797124 - protein, 9 aa, Homo Sapiens
GFSSLLRDI

SEQ ID NO: 797125 - protein, 9 aa, Homo Sapiens
ILQAKTKQL

SEQ ID NO: 797126 - protein, 9 aa, Homo Sapiens
SNKHDIYSY

SEQ ID NO: 797127 - protein, 9 aa, Homo Sapiens
DEVPESVFL

SEQ ID NO: 797128 - protein, 9 aa, Homo Sapiens
KEAAFDNAV

SEQ ID NO: 797129 - protein, 9 aa, Homo Sapiens
ALATVEDVQ

SEQ ID NO: 797130 - protein, 9 aa, Homo Sapiens
IILVGKRGT

SEQ ID NO: 797131 - protein, 9 aa, Homo Sapiens
SIFLKVEVH

SEQ ID NO: 797132 - protein, 9 aa, Homo Sapiens
LYLSNKRNH

SEQ ID NO: 797133 - protein, 9 aa, Homo Sapiens
KMKPDVLSH

SEQ ID NO: 797134 - protein, 9 aa, Homo Sapiens
GGGPVYGNQ

SEQ ID NO: 797135 - protein, 9 aa, Homo Sapiens
HAYYDLSYC

SEQ ID NO: 797136 - protein, 9 aa, Homo Sapiens
GPCVPNSIC

SEQ ID NO: 797137 - protein, 9 aa, Homo Sapiens
GLPRLRLQL

SEQ ID NO: 797138 - protein, 9 aa, Homo Sapiens
YKDCTLQID

SEQ ID NO: 797139 - protein, 9 aa, Homo Sapiens
VVQCPEMRR

SEQ ID NO: 797140 - protein, 9 aa, Homo Sapiens
QTSLGQHQR

SEQ ID NO: 797141 - protein, 9 aa, Homo Sapiens
HTILSTGSS

SEQ ID NO: 797142 - protein, 9 aa, Homo Sapiens
NLLQHGDKI

SEQ ID NO: 797143 - protein, 9 aa, Homo Sapiens
NLVEIMAKA

SEQ ID NO: 797144 - protein, 9 aa, Homo Sapiens
GQRPAAGDE

SEQ ID NO: 797145 - protein, 9 aa, Homo Sapiens
DCTSGENSD

SEQ ID NO: 797146 - protein, 9 aa, Homo Sapiens
PRKRSVPPP

SEQ ID NO: 797147 - protein, 9 aa, Homo Sapiens
QNWMTVAHM

SEQ ID NO: 797148 - protein, 9 aa, Homo Sapiens
FVESTVETE

SEQ ID NO: 797149 - protein, 9 aa, Homo Sapiens
PPEVEDSDL

SEQ ID NO: 797150 - protein, 9 aa, Homo Sapiens
SALATVEDV

SEQ ID NO: 797151 - protein, 9 aa, Homo Sapiens
VEDVQIRPH

SEQ ID NO: 797152 - protein, 9 aa, Homo Sapiens
EEVYHTQVV

SEQ ID NO: 797153 - protein, 9 aa, Homo Sapiens
WMNYVSSAA

SEQ ID NO: 797154 - protein, 9 aa, Homo Sapiens
SLLRDIPPS

SEQ ID NO: 797155 - protein, 9 aa, Homo Sapiens
PFRTVSECL

SEQ ID NO: 797156 - protein, 9 aa, Homo Sapiens
VESTVETEK

SEQ ID NO: 797157 - protein, 9 aa, Homo Sapiens
ACMEEMHQD

SEQ ID NO: 797158 - protein, 9 aa, Homo Sapiens
KVLFHSQER

SEQ ID NO: 797159 - protein, 9 aa, Homo Sapiens
KKMKPDVLS

SEQ ID NO: 797160 - protein, 9 aa, Homo Sapiens
GYIPGSNAT

SEQ ID NO: 797161 - protein, 9 aa, Homo Sapiens
MGITYTVFT

SEQ ID NO: 797162 - protein, 9 aa, Homo Sapiens
SESRCPVQE

SEQ ID NO: 797163 - protein, 9 aa, Homo Sapiens
DEDVTFRKI

SEQ ID NO: 797164 - protein, 9 aa, Homo Sapiens
SSSLNSSSS

SEQ ID NO: 797165 - protein, 9 aa, Homo Sapiens
ASNKHDIYS

SEQ ID NO: 797166 - protein, 9 aa, Homo Sapiens
RLPCSADVE

SEQ ID NO: 797167 - protein, 9 aa, Homo Sapiens
VFNHCSLLT

SEQ ID NO: 797168 - protein, 9 aa, Homo Sapiens
QPVAYPLGL

SEQ ID NO: 797169 - protein, 9 aa, Homo Sapiens
LEPGVLNLV

SEQ ID NO: 797170 - protein, 9 aa, Homo Sapiens
VPPPDGNGS

SEQ ID NO: 797171 - protein, 9 aa, Homo Sapiens
RGTGKSAAG

SEQ ID NO: 797172 - protein, 9 aa, Homo Sapiens
GPASNLLQH

SEQ ID NO: 797173 - protein, 9 aa, Homo Sapiens
DQEEVYHTQ

SEQ ID NO: 797174 - protein, 9 aa, Homo Sapiens
VQIRPHTLY

SEQ ID NO: 797175 - protein, 9 aa, Homo Sapiens
YSVPLPENT

SEQ ID NO: 797176 - protein, 9 aa, Homo Sapiens
FYKDCTLQI

SEQ ID NO: 797177 - protein, 9 aa, Homo Sapiens
LLQHGDKIL

SEQ ID NO: 797178 - protein, 9 aa, Homo Sapiens
PYFLLQPAQ

SEQ ID NO: 797179 - protein, 9 aa, Homo Sapiens
LVYGDCTSG

SEQ ID NO: 797180 - protein, 9 aa, Homo Sapiens
RFLYLSNKR

SEQ ID NO: 797181 - protein, 9 aa, Homo Sapiens
SSLKAQSYE

SEQ ID NO: 797182 - protein, 9 aa, Homo Sapiens
VRLLAQLEK

SEQ ID NO: 797183 - protein, 9 aa, Homo Sapiens
LQHGDKILQ

SEQ ID NO: 797184 - protein, 9 aa, Homo Sapiens
DSGKPVKIS

SEQ ID NO: 797185 - protein, 9 aa, Homo Sapiens
HLTLDGLPR

SEQ ID NO: 797186 - protein, 9 aa, Homo Sapiens
GLEPGVLNL

SEQ ID NO: 797187 - protein, 9 aa, Homo Sapiens
WIKILQAKT

SEQ ID NO: 797188 - protein, 9 aa, Homo Sapiens
QNGYIPGSN

SEQ ID NO: 797189 - protein, 9 aa, Homo Sapiens
KTGTLTQNW

SEQ ID NO: 797190 - protein, 9 aa, Homo Sapiens
MKPDVLSHP

SEQ ID NO: 797191 - protein, 9 aa, Homo Sapiens
RKICATKRK

SEQ ID NO: 797192 - protein, 9 aa, Homo Sapiens
FLLQPAQKC

SEQ ID NO: 797193 - protein, 9 aa, Homo Sapiens
QGAKKRAIG

SEQ ID NO: 797194 - protein, 9 aa, Homo Sapiens
CDIPPLVAL

SEQ ID NO: 797195 - protein, 9 aa, Homo Sapiens
LKVPLLHSH

SEQ ID NO: 797196 - protein, 9 aa, Homo Sapiens
EDVQIRPHT

SEQ ID NO: 797197 - protein, 9 aa, Homo Sapiens
ISIFERFVE

SEQ ID NO: 797198 - protein, 9 aa, Homo Sapiens
PEMRRHAFE

SEQ ID NO: 797199 - protein, 9 aa, Homo Sapiens
IDECRNGPC

SEQ ID NO: 797200 - protein, 9 aa, Homo Sapiens
DVQIRPHTL

SEQ ID NO: 797201 - protein, 9 aa, Homo Sapiens
ECGKVFNHC

SEQ ID NO: 797202 - protein, 9 aa, Homo Sapiens
HPPLVPSKY

SEQ ID NO: 797203 - protein, 9 aa, Homo Sapiens
SLGQHQRGQ

SEQ ID NO: 797204 - protein, 9 aa, Homo Sapiens
IVRLLAQLE

SEQ ID NO: 797205 - protein, 9 aa, Homo Sapiens
LLMEKAQAE

SEQ ID NO: 797206 - protein, 9 aa, Homo Sapiens
IDVVQCPEM

SEQ ID NO: 797207 - protein, 9 aa, Homo Sapiens
DIDECRNGP

SEQ ID NO: 797208 - protein, 9 aa, Homo Sapiens
SQTEKKAQG

SEQ ID NO: 797209 - protein, 9 aa, Homo Sapiens
SPYFLLQPA

SEQ ID NO: 797210 - protein, 9 aa, Homo Sapiens
LKVEVHENV

SEQ ID NO: 797211 - protein, 9 aa, Homo Sapiens
YISIEAAEL

SEQ ID NO: 797212 - protein, 9 aa, Homo Sapiens
DPHGLVQPV

SEQ ID NO: 797213 - protein, 9 aa, Homo Sapiens
ALGGLAIGV

SEQ ID NO: 797214 - protein, 9 aa, Homo Sapiens
FSDEIYVDV

SEQ ID NO: 797215 - protein, 9 aa, Homo Sapiens
PAAGDEVPE

SEQ ID NO: 797216 - protein, 9 aa, Homo Sapiens
IALLKGCAV

SEQ ID NO: 797217 - protein, 9 aa, Homo Sapiens
IFLFYHIIR

SEQ ID NO: 797218 - protein, 9 aa, Homo Sapiens
DCTLQIDMA

SEQ ID NO: 797219 - protein, 9 aa, Homo Sapiens
GCAVEAMFL

SEQ ID NO: 797220 - protein, 9 aa, Homo Sapiens
RSVPPPDGN

SEQ ID NO: 797221 - protein, 9 aa, Homo Sapiens
YHIIRLQIF

SEQ ID NO: 797222 - protein, 9 aa, Homo Sapiens
GFVNVEKVA

SEQ ID NO: 797223 - protein, 9 aa, Homo Sapiens
GIFLFYHII

SEQ ID NO: 797224 - protein, 9 aa, Homo Sapiens
DPEEICKAA

SEQ ID NO: 797225 - protein, 9 aa, Homo Sapiens
RGGQGAKKR

SEQ ID NO: 797226 - protein, 9 aa, Homo Sapiens
PLVALSCSD

SEQ ID NO: 797227 - protein, 9 aa, Homo Sapiens
EDDDDNDIL

SEQ ID NO: 797228 - protein, 9 aa, Homo Sapiens
GLAIGVLVG

SEQ ID NO: 797229 - protein, 9 aa, Homo Sapiens
DYRQNGYIP

SEQ ID NO: 797230 - protein, 9 aa, Homo Sapiens
PRLPCSADV

SEQ ID NO: 797231 - protein, 9 aa, Homo Sapiens
VGKRGTGKS

SEQ ID NO: 797232 - protein, 9 aa, Homo Sapiens
DLSYCALIL

SEQ ID NO: 797233 - protein, 9 aa, Homo Sapiens
ARPHAYYDL

SEQ ID NO: 797234 - protein, 9 aa, Homo Sapiens
GYGGGGPVY

SEQ ID NO: 797235 - protein, 9 aa, Homo Sapiens
TKLIRGGFV

SEQ ID NO: 797236 - protein, 9 aa, Homo Sapiens
KSAWDPLDE

SEQ ID NO: 797237 - protein, 9 aa, Homo Sapiens
KKRAIGQRI

SEQ ID NO: 797238 - protein, 9 aa, Homo Sapiens
IYVDVTYIV

SEQ ID NO: 797239 - protein, 9 aa, Homo Sapiens
SPTSYSVPL

SEQ ID NO: 797240 - protein, 9 aa, Homo Sapiens
FERFVESTV

SEQ ID NO: 797241 - protein, 9 aa, Homo Sapiens
VQPVAYPLG

SEQ ID NO: 797242 - protein, 9 aa, Homo Sapiens
ARISAEYFS

SEQ ID NO: 797243 - protein, 9 aa, Homo Sapiens
KLIRGGFVN

SEQ ID NO: 797244 - protein, 9 aa, Homo Sapiens
FQRFLYLSN

SEQ ID NO: 797245 - protein, 9 aa, Homo Sapiens
QHQRGQQEL

SEQ ID NO: 797246 - protein, 9 aa, Homo Sapiens
LFYHIIRLQ

SEQ ID NO: 797247 - protein, 9 aa, Homo Sapiens
CTLQIDMAF

SEQ ID NO: 797248 - protein, 9 aa, Homo Sapiens
MGREQVHKD

SEQ ID NO: 797249 - protein, 9 aa, Homo Sapiens
NPPEVEDSD

SEQ ID NO: 797250 - protein, 9 aa, Homo Sapiens
QYKVLFHSQ

SEQ ID NO: 797251 - protein, 9 aa, Homo Sapiens
TQNWMTVAH

SEQ ID NO: 797252 - protein, 9 aa, Homo Sapiens
RFVESTVET

SEQ ID NO: 797253 - protein, 9 aa, Homo Sapiens
FSSLLRDIP

SEQ ID NO: 797254 - protein, 9 aa, Homo Sapiens
VQCPEMRRH

SEQ ID NO: 797255 - protein, 9 aa, Homo Sapiens
TFRKICATK

SEQ ID NO: 797256 - protein, 9 aa, Homo Sapiens
KVLIRSKSL

SEQ ID NO: 797257 - protein, 9 aa, Homo Sapiens
GLVQPVAYP

SEQ ID NO: 797258 - protein, 9 aa, Homo Sapiens
CKAARHLEV

SEQ ID NO: 797259 - protein, 9 aa, Homo Sapiens
DNAVEERVI

SEQ ID NO: 797260 - protein, 9 aa, Homo Sapiens
YKVLFHSQE

SEQ ID NO: 797261 - protein, 9 aa, Homo Sapiens
SKSIFLKVE

SEQ ID NO: 797262 - protein, 9 aa, Homo Sapiens
PASNLLQHG

SEQ ID NO: 797263 - protein, 9 aa, Homo Sapiens
CPVQEDNTF

SEQ ID NO: 797264 - protein, 9 aa, Homo Sapiens
QEEVYHTQV

SEQ ID NO: 797265 - protein, 9 aa, Homo Sapiens
EVYHTQVVE

SEQ ID NO: 797266 - protein, 9 aa, Homo Sapiens
RTSYPIYIS

SEQ ID NO: 797267 - protein, 9 aa, Homo Sapiens
RIVRLLAQL

SEQ ID NO: 797268 - protein, 9 aa, Homo Sapiens
CGKVLIRSK

SEQ ID NO: 797269 - protein, 9 aa, Homo Sapiens
KCKGKHMGR

SEQ ID NO: 797270 - protein, 9 aa, Homo Sapiens
KFYFEELGM

SEQ ID NO: 797271 - protein, 9 aa, Homo Sapiens
ISFWMNYVS

SEQ ID NO: 797272 - protein, 9 aa, Homo Sapiens
AQLPSSRRL

SEQ ID NO: 797273 - protein, 9 aa, Homo Sapiens
VVRRCPHRE

SEQ ID NO: 797274 - protein, 9 aa, Homo Sapiens
AIADAEQRR

SEQ ID NO: 797275 - protein, 9 aa, Homo Sapiens
GPRPLFFLT

SEQ ID NO: 797276 - protein, 9 aa, Homo Sapiens
IAVGIVGVV

SEQ ID NO: 797277 - protein, 9 aa, Homo Sapiens
WRKSQEAER

SEQ ID NO: 797278 - protein, 9 aa, Homo Sapiens
NPGWSWDSQ

SEQ ID NO: 797279 - protein, 9 aa, Homo Sapiens
QKRYGSPHE

SEQ ID NO: 797280 - protein, 9 aa, Homo Sapiens
ERLRSIYNR

SEQ ID NO: 797281 - protein, 9 aa, Homo Sapiens
PSSRRLSGS

SEQ ID NO: 797282 - protein, 9 aa, Homo Sapiens
LEGPKGRKE

SEQ ID NO: 797283 - protein, 9 aa, Homo Sapiens
RRCPHRERC

SEQ ID NO: 797284 - protein, 9 aa, Homo Sapiens
LKSLSVLTE

SEQ ID NO: 797285 - protein, 9 aa, Homo Sapiens
KLSLPESLK

SEQ ID NO: 797286 - protein, 9 aa, Homo Sapiens
NSDISYFVV

SEQ ID NO: 797287 - protein, 9 aa, Homo Sapiens
LMEHQLTAT

SEQ ID NO: 797288 - protein, 9 aa, Homo Sapiens
SRKMSAAEQ

SEQ ID NO: 797289 - protein, 9 aa, Homo Sapiens
LPGPLPASH

SEQ ID NO: 797290 - protein, 9 aa, Homo Sapiens
DTKQLPNPG

SEQ ID NO: 797291 - protein, 9 aa, Homo Sapiens
YVLMEHQLT

SEQ ID NO: 797292 - protein, 9 aa, Homo Sapiens
LHTRVFEKL

SEQ ID NO: 797293 - protein, 9 aa, Homo Sapiens
HRERCSDSD

SEQ ID NO: 797294 - protein, 9 aa, Homo Sapiens
FIAVGIVGV

SEQ ID NO: 797295 - protein, 9 aa, Homo Sapiens
RDCALKDAR

SEQ ID NO: 797296 - protein, 9 aa, Homo Sapiens
RRLSGSTNT

SEQ ID NO: 797297 - protein, 9 aa, Homo Sapiens
RCPHRERCS

SEQ ID NO: 797298 - protein, 9 aa, Homo Sapiens
ECIFYNANW

SEQ ID NO: 797299 - protein, 9 aa, Homo Sapiens
SLVGWKFHW

SEQ ID NO: 797300 - protein, 9 aa, Homo Sapiens
EGPRPLFFL

SEQ ID NO: 797301 - protein, 9 aa, Homo Sapiens
YWRKSQEAE

SEQ ID NO: 797302 - protein, 9 aa, Homo Sapiens
WAAGQPDIV

SEQ ID NO: 797303 - protein, 9 aa, Homo Sapiens
SRGSAQDDD

SEQ ID NO: 797304 - protein, 9 aa, Homo Sapiens
VFTLDTAKI

SEQ ID NO: 797305 - protein, 9 aa, Homo Sapiens
PLKLAGWQC

SEQ ID NO: 797306 - protein, 9 aa, Homo Sapiens
TYVLMEHQL

SEQ ID NO: 797307 - protein, 9 aa, Homo Sapiens
PDRAYPEAA

SEQ ID NO: 797308 - protein, 9 aa, Homo Sapiens
RSIYNRDFK

SEQ ID NO: 797309 - protein, 9 aa, Homo Sapiens
ALSENSGMK

SEQ ID NO: 797310 - protein, 9 aa, Homo Sapiens
TKQIRKELS

SEQ ID NO: 797311 - protein, 9 aa, Homo Sapiens
EAETRECIF

SEQ ID NO: 797312 - protein, 9 aa, Homo Sapiens
GLDTKQLPN

SEQ ID NO: 797313 - protein, 9 aa, Homo Sapiens
AQDDDAGSR

SEQ ID NO: 797314 - protein, 9 aa, Homo Sapiens
IFYNANWEL

SEQ ID NO: 797315 - protein, 9 aa, Homo Sapiens
MPDAFNPCE

SEQ ID NO: 797316 - protein, 9 aa, Homo Sapiens
SPMPDAFNP

SEQ ID NO: 797317 - protein, 9 aa, Homo Sapiens
EKIMKLSLP

SEQ ID NO: 797318 - protein, 9 aa, Homo Sapiens
GSAQDDDAG

SEQ ID NO: 797319 - protein, 9 aa, Homo Sapiens
VELRAYALL

SEQ ID NO: 797320 - protein, 9 aa, Homo Sapiens
PAFRELPPL

SEQ ID NO: 797321 - protein, 9 aa, Homo Sapiens
LRAYALLAQ

SEQ ID NO: 797322 - protein, 9 aa, Homo Sapiens
VQTLANRMN

SEQ ID NO: 797323 - protein, 9 aa, Homo Sapiens
IDIASDFRK

SEQ ID NO: 797324 - protein, 9 aa, Homo Sapiens
TRECIFYNA

SEQ ID NO: 797325 - protein, 9 aa, Homo Sapiens
RAYPEAAWE

SEQ ID NO: 797326 - protein, 9 aa, Homo Sapiens
LTEVSTNGA

SEQ ID NO: 797327 - protein, 9 aa, Homo Sapiens
YPEAAWEPT

SEQ ID NO: 797328 - protein, 9 aa, Homo Sapiens
TCCTKWNTE

SEQ ID NO: 797329 - protein, 9 aa, Homo Sapiens
VTCSPMPDA

SEQ ID NO: 797330 - protein, 9 aa, Homo Sapiens
KRYGSPHET

SEQ ID NO: 797331 - protein, 9 aa, Homo Sapiens
LKLAGWQCP

SEQ ID NO: 797332 - protein, 9 aa, Homo Sapiens
EKHVEVQTL

SEQ ID NO: 797333 - protein, 9 aa, Homo Sapiens
ALGLNLVAF

SEQ ID NO: 797334 - protein, 9 aa, Homo Sapiens
TTTNLTVDV

SEQ ID NO: 797335 - protein, 9 aa, Homo Sapiens
RSSPGASEA

SEQ ID NO: 797336 - protein, 9 aa, Homo Sapiens
RHTGSVVIT

SEQ ID NO: 797337 - protein, 9 aa, Homo Sapiens
DLKSLSVLT

SEQ ID NO: 797338 - protein, 9 aa, Homo Sapiens
GSVVITNCS

SEQ ID NO: 797339 - protein, 9 aa, Homo Sapiens
EHQLTATKV

SEQ ID NO: 797340 - protein, 9 aa, Homo Sapiens
VDVTCSPMP

SEQ ID NO: 797341 - protein, 9 aa, Homo Sapiens
NLTVDVLDG

SEQ ID NO: 797342 - protein, 9 aa, Homo Sapiens
ITYVLMEHQ

SEQ ID NO: 797343 - protein, 9 aa, Homo Sapiens
AYPEAAWEP

SEQ ID NO: 797344 - protein, 9 aa, Homo Sapiens
LDTKQLPNP

SEQ ID NO: 797345 - protein, 9 aa, Homo Sapiens
CYWRKSQEA

SEQ ID NO: 797346 - protein, 9 aa, Homo Sapiens
PHRERCSDS

SEQ ID NO: 797347 - protein, 9 aa, Homo Sapiens
GEIPKFSFQ

SEQ ID NO: 797348 - protein, 9 aa, Homo Sapiens
SPDRAYPEA

SEQ ID NO: 797349 - protein, 9 aa, Homo Sapiens
FNSWEMSRD

SEQ ID NO: 797350 - protein, 9 aa, Homo Sapiens
FKDSNIKRE

SEQ ID NO: 797351 - protein, 9 aa, Homo Sapiens
QPDIVEEPW

SEQ ID NO: 797352 - protein, 9 aa, Homo Sapiens
PEAAEGDKD

SEQ ID NO: 797353 - protein, 9 aa, Homo Sapiens
EIPKFSFQD

SEQ ID NO: 797354 - protein, 9 aa, Homo Sapiens
LARHTGSVV

SEQ ID NO: 797355 - protein, 9 aa, Homo Sapiens
NDVQTICHK

SEQ ID NO: 797356 - protein, 9 aa, Homo Sapiens
DDIDIASDF

SEQ ID NO: 797357 - protein, 9 aa, Homo Sapiens
LSRTKQIRK

SEQ ID NO: 797358 - protein, 9 aa, Homo Sapiens
ELSRTKQIR

SEQ ID NO: 797359 - protein, 9 aa, Homo Sapiens
TTTTNLTVD

SEQ ID NO: 797360 - protein, 9 aa, Homo Sapiens
APWLTPVIL

SEQ ID NO: 797361 - protein, 9 aa, Homo Sapiens
PGPLPASHP

SEQ ID NO: 797362 - protein, 9 aa, Homo Sapiens
IMVLEGPKG

SEQ ID NO: 797363 - protein, 9 aa, Homo Sapiens
VLEGPKGRK

SEQ ID NO: 797364 - protein, 9 aa, Homo Sapiens
LPLSPVTVK

SEQ ID NO: 797365 - protein, 9 aa, Homo Sapiens
PKFSFQDPP

SEQ ID NO: 797366 - protein, 9 aa, Homo Sapiens
RERCSDSDG

SEQ ID NO: 797367 - protein, 9 aa, Homo Sapiens
IPKFSFQDP

SEQ ID NO: 797368 - protein, 9 aa, Homo Sapiens
QPPEGPRPL

SEQ ID NO: 797369 - protein, 9 aa, Homo Sapiens
LPASHPLFG

SEQ ID NO: 797370 - protein, 9 aa, Homo Sapiens
KEVYRCTSC

SEQ ID NO: 797371 - protein, 9 aa, Homo Sapiens
DAGSRKKKG

SEQ ID NO: 797372 - protein, 9 aa, Homo Sapiens
ASGSAPAFR

SEQ ID NO: 797373 - protein, 9 aa, Homo Sapiens
FITYVLMEH

SEQ ID NO: 797374 - protein, 9 aa, Homo Sapiens
TKWNTEDKV

SEQ ID NO: 797375 - protein, 9 aa, Homo Sapiens
AVKHSNEKE

SEQ ID NO: 797376 - protein, 9 aa, Homo Sapiens
VTVKRNWTI

SEQ ID NO: 797377 - protein, 9 aa, Homo Sapiens
GQPPEGPRP

SEQ ID NO: 797378 - protein, 9 aa, Homo Sapiens
RVRPFNSWE

SEQ ID NO: 797379 - protein, 9 aa, Homo Sapiens
SAPAFRELP

SEQ ID NO: 797380 - protein, 9 aa, Homo Sapiens
KIMKLSLPE

SEQ ID NO: 797381 - protein, 9 aa, Homo Sapiens
MLQRFKDSN

SEQ ID NO: 797382 - protein, 9 aa, Homo Sapiens
VGVVLLAIF

SEQ ID NO: 797383 - protein, 9 aa, Homo Sapiens
RLRSIYNRD

SEQ ID NO: 797384 - protein, 9 aa, Homo Sapiens
DRAYPEAAW

SEQ ID NO: 797385 - protein, 9 aa, Homo Sapiens
ICLHTRVFE

SEQ ID NO: 797386 - protein, 9 aa, Homo Sapiens
ETRECIFYN

SEQ ID NO: 797387 - protein, 9 aa, Homo Sapiens
PWLTPVILA

SEQ ID NO: 797388 - protein, 9 aa, Homo Sapiens
GIVGVVLLA

SEQ ID NO: 797389 - protein, 9 aa, Homo Sapiens
CLHTRVFEK

SEQ ID NO: 797390 - protein, 9 aa, Homo Sapiens
KMSAAEQGS

SEQ ID NO: 797391 - protein, 9 aa, Homo Sapiens
SFQDPPNKK

SEQ ID NO: 797392 - protein, 9 aa, Homo Sapiens
CSPMPDAFN

SEQ ID NO: 797393 - protein, 9 aa, Homo Sapiens
EGQPPEGPR

SEQ ID NO: 797394 - protein, 9 aa, Homo Sapiens
SVAEQGSRK

SEQ ID NO: 797395 - protein, 9 aa, Homo Sapiens
DISYFVVGG

SEQ ID NO: 797396 - protein, 9 aa, Homo Sapiens
PPEGPRPLF

SEQ ID NO: 797397 - protein, 9 aa, Homo Sapiens
KISVIILRN

SEQ ID NO: 797398 - protein, 9 aa, Homo Sapiens
NEKEVYRCT

SEQ ID NO: 797399 - protein, 9 aa, Homo Sapiens
EGWEYASLV

SEQ ID NO: 797400 - protein, 9 aa, Homo Sapiens
SGSAPAFRE

SEQ ID NO: 797401 - protein, 9 aa, Homo Sapiens
FGGTAKALR

SEQ ID NO: 797402 - protein, 9 aa, Homo Sapiens
GDKDKPTHA

SEQ ID NO: 797403 - protein, 9 aa, Homo Sapiens
QRFKDSNIK

SEQ ID NO: 797404 - protein, 9 aa, Homo Sapiens
RYGSPHETD

SEQ ID NO: 797405 - protein, 9 aa, Homo Sapiens
SLSVLTEVS

SEQ ID NO: 797406 - protein, 9 aa, Homo Sapiens
RVFEKLPDL

SEQ ID NO: 797407 - protein, 9 aa, Homo Sapiens
LGLNLVAFG

SEQ ID NO: 797408 - protein, 9 aa, Homo Sapiens
KPIQTMTEV

SEQ ID NO: 797409 - protein, 9 aa, Homo Sapiens
VKHSNEKEV

SEQ ID NO: 797410 - protein, 9 aa, Homo Sapiens
TPLKLAGWQ

SEQ ID NO: 797411 - protein, 9 aa, Homo Sapiens
QGSRKMSAA

SEQ ID NO: 797412 - protein, 9 aa, Homo Sapiens
AVDVELRAY

SEQ ID NO: 797413 - protein, 9 aa, Homo Sapiens
FVVGGKQAV

SEQ ID NO: 797414 - protein, 9 aa, Homo Sapiens
GSAPAFREL

SEQ ID NO: 797415 - protein, 9 aa, Homo Sapiens
RERLRSIYN

SEQ ID NO: 797416 - protein, 9 aa, Homo Sapiens
PDIVEEPWG

SEQ ID NO: 797417 - protein, 9 aa, Homo Sapiens
MVLEGPKGR

SEQ ID NO: 797418 - protein, 9 aa, Homo Sapiens
TKQLPNPGW

SEQ ID NO: 797419 - protein, 9 aa, Homo Sapiens
AAVDVELRA

SEQ ID NO: 797420 - protein, 9 aa, Homo Sapiens
AAGQPDIVE

SEQ ID NO: 797421 - protein, 9 aa, Homo Sapiens
DRERLRSIY

SEQ ID NO: 797422 - protein, 9 aa, Homo Sapiens
NLVAFGGTA

SEQ ID NO: 797423 - protein, 9 aa, Homo Sapiens
AEQGSRKMS

SEQ ID NO: 797424 - protein, 9 aa, Homo Sapiens
SAQDDDAGS

SEQ ID NO: 797425 - protein, 9 aa, Homo Sapiens
RAYALLAQL

SEQ ID NO: 797426 - protein, 9 aa, Homo Sapiens
SRRLSGSTN

SEQ ID NO: 797427 - protein, 9 aa, Homo Sapiens
CHKCQVVAR

SEQ ID NO: 797428 - protein, 9 aa, Homo Sapiens
LNSDISYFV

SEQ ID NO: 797429 - protein, 9 aa, Homo Sapiens
DSNIKRERE

SEQ ID NO: 797430 - protein, 9 aa, Homo Sapiens
AEGDKDKPT

SEQ ID NO: 797431 - protein, 9 aa, Homo Sapiens
NSWEMSRDS

SEQ ID NO: 797432 - protein, 9 aa, Homo Sapiens
EVQTLANRM

SEQ ID NO: 797433 - protein, 9 aa, Homo Sapiens
VVGGKQAVF

SEQ ID NO: 797434 - protein, 9 aa, Homo Sapiens
HTRVFEKLP

SEQ ID NO: 797435 - protein, 9 aa, Homo Sapiens
VDDIDIASD

SEQ ID NO: 797436 - protein, 9 aa, Homo Sapiens
FSFQDPPNK

SEQ ID NO: 797437 - protein, 9 aa, Homo Sapiens
YFVVGGKQA

SEQ ID NO: 797438 - protein, 9 aa, Homo Sapiens
VDVELRAYA

SEQ ID NO: 797439 - protein, 9 aa, Homo Sapiens
RLSGSTNTV

SEQ ID NO: 797440 - protein, 9 aa, Homo Sapiens
AGQPDIVEE

SEQ ID NO: 797441 - protein, 9 aa, Homo Sapiens
GPKGRKEYP

SEQ ID NO: 797442 - protein, 9 aa, Homo Sapiens
IASDFRKDD

SEQ ID NO: 797443 - protein, 9 aa, Homo Sapiens
YVDDIDIAS

SEQ ID NO: 797444 - protein, 9 aa, Homo Sapiens
PFNSWEMSR

SEQ ID NO: 797445 - protein, 9 aa, Homo Sapiens
WEYASLVGW

SEQ ID NO: 797446 - protein, 9 aa, Homo Sapiens
SPGASEAAE

SEQ ID NO: 797447 - protein, 9 aa, Homo Sapiens
RGSAQDDDA

SEQ ID NO: 797448 - protein, 9 aa, Homo Sapiens
SQKRYGSPH

SEQ ID NO: 797449 - protein, 9 aa, Homo Sapiens
YGSPHETDG

SEQ ID NO: 797450 - protein, 9 aa, Homo Sapiens
TLDTAKISV

SEQ ID NO: 797451 - protein, 9 aa, Homo Sapiens
ADAEQRRDC

SEQ ID NO: 797452 - protein, 9 aa, Homo Sapiens
FPAASGSAP

SEQ ID NO: 797453 - protein, 9 aa, Homo Sapiens
LLPGPLPAS

SEQ ID NO: 797454 - protein, 9 aa, Homo Sapiens
SPVTVKRNW

SEQ ID NO: 797455 - protein, 9 aa, Homo Sapiens
SPHETDGHG

SEQ ID NO: 797456 - protein, 9 aa, Homo Sapiens
TVKRNWTIT

SEQ ID NO: 797457 - protein, 9 aa, Homo Sapiens
PKGRKEYPM

SEQ ID NO: 797458 - protein, 9 aa, Homo Sapiens
PNPGWSWDS

SEQ ID NO: 797459 - protein, 9 aa, Homo Sapiens
LNLVAFGGT

SEQ ID NO: 797460 - protein, 9 aa, Homo Sapiens
AAEGDKDKP

SEQ ID NO: 797461 - protein, 9 aa, Homo Sapiens
ERRTTTTNL

SEQ ID NO: 797462 - protein, 9 aa, Homo Sapiens
NERRTTTTN

SEQ ID NO: 797463 - protein, 9 aa, Homo Sapiens
GPLPASHPL

SEQ ID NO: 797464 - protein, 9 aa, Homo Sapiens
KSLSVLTEV

SEQ ID NO: 797465 - protein, 9 aa, Homo Sapiens
GLNLVAFGG

SEQ ID NO: 797466 - protein, 9 aa, Homo Sapiens
VEEPWGLSQ

SEQ ID NO: 797467 - protein, 9 aa, Homo Sapiens
PASHPLFGR

SEQ ID NO: 797468 - protein, 9 aa, Homo Sapiens
FEKLPDLVR

SEQ ID NO: 797469 - protein, 9 aa, Homo Sapiens
LVAFGGTAK

SEQ ID NO: 797470 - protein, 9 aa, Homo Sapiens
LVGWKFHWK

SEQ ID NO: 797471 - protein, 9 aa, Homo Sapiens
FQDPPNKKP

SEQ ID NO: 797472 - protein, 9 aa, Homo Sapiens
SIYNRDFKI

SEQ ID NO: 797473 - protein, 9 aa, Homo Sapiens
SWEMSRDSK

SEQ ID NO: 797474 - protein, 9 aa, Homo Sapiens
PLPASHPLF

SEQ ID NO: 797475 - protein, 9 aa, Homo Sapiens
VRVRPFNSW

SEQ ID NO: 797476 - protein, 9 aa, Homo Sapiens
PAAVDVELR

SEQ ID NO: 797477 - protein, 9 aa, Homo Sapiens
CTKWNTEDK

SEQ ID NO: 797478 - protein, 9 aa, Homo Sapiens
IFITYVLME

SEQ ID NO: 797479 - protein, 9 aa, Homo Sapiens
AETRECIFY

SEQ ID NO: 797480 - protein, 9 aa, Homo Sapiens
SSRRLSGST

SEQ ID NO: 797481 - protein, 9 aa, Homo Sapiens
DTAKISVII

SEQ ID NO: 797482 - protein, 9 aa, Homo Sapiens
TDRERLRSI

SEQ ID NO: 797483 - protein, 9 aa, Homo Sapiens
IVGVVLLAI

SEQ ID NO: 797484 - protein, 9 aa, Homo Sapiens
DLPLSPVTV

SEQ ID NO: 797485 - protein, 9 aa, Homo Sapiens
VTPLKLAGW

SEQ ID NO: 797486 - protein, 9 aa, Homo Sapiens
YCYWRKSQE

SEQ ID NO: 797487 - protein, 9 aa, Homo Sapiens
VAEQGSRKM

SEQ ID NO: 797488 - protein, 9 aa, Homo Sapiens
SENSGMKPI

SEQ ID NO: 797489 - protein, 9 aa, Homo Sapiens
LDTAKISVI

SEQ ID NO: 797490 - protein, 9 aa, Homo Sapiens
SNEKEVYRC

SEQ ID NO: 797491 - protein, 9 aa, Homo Sapiens
GQPDIVEEP

SEQ ID NO: 797492 - protein, 9 aa, Homo Sapiens
EVYRCTSCN

SEQ ID NO: 797493 - protein, 9 aa, Homo Sapiens
RKMSAAEQG

SEQ ID NO: 797494 - protein, 9 aa, Homo Sapiens
VAFGGTAKA

SEQ ID NO: 797495 - protein, 9 aa, Homo Sapiens
RKSQEAERE

SEQ ID NO: 797496 - protein, 9 aa, Homo Sapiens
TNLTVDVLD

SEQ ID NO: 797497 - protein, 9 aa, Homo Sapiens
ATCCTKWNT

SEQ ID NO: 797498 - protein, 9 aa, Homo Sapiens
QEAEREYEK

SEQ ID NO: 797499 - protein, 9 aa, Homo Sapiens
REKIMKLSL

SEQ ID NO: 797500 - protein, 9 aa, Homo Sapiens
VLMEHQLTA

SEQ ID NO: 797501 - protein, 9 aa, Homo Sapiens
IAVTPLKLA

SEQ ID NO: 797502 - protein, 9 aa, Homo Sapiens
SVVITNCSA

SEQ ID NO: 797503 - protein, 9 aa, Homo Sapiens
VVDVTCSPM

SEQ ID NO: 797504 - protein, 9 aa, Homo Sapiens
VEVQTLANR

SEQ ID NO: 797505 - protein, 9 aa, Homo Sapiens
ISYFVVGGK

SEQ ID NO: 797506 - protein, 9 aa, Homo Sapiens
QLPNPGWSW

SEQ ID NO: 797507 - protein, 9 aa, Homo Sapiens
TTNLTVDVL

SEQ ID NO: 797508 - protein, 9 aa, Homo Sapiens
SAQLPSSRR

SEQ ID NO: 797509 - protein, 9 aa, Homo Sapiens
AVTPLKLAG

SEQ ID NO: 797510 - protein, 9 aa, Homo Sapiens
LQRFKDSNI

SEQ ID NO: 797511 - protein, 9 aa, Homo Sapiens
RTTTTNLTV

SEQ ID NO: 797512 - protein, 9 aa, Homo Sapiens
SSQKRYGSP

SEQ ID NO: 797513 - protein, 9 aa, Homo Sapiens
EALARHTGS

SEQ ID NO: 797514 - protein, 9 aa, Homo Sapiens
KELSRTKQI

SEQ ID NO: 797515 - protein, 9 aa, Homo Sapiens
WEMSRDSKC

SEQ ID NO: 797516 - protein, 9 aa, Homo Sapiens
EREGQPPEG

SEQ ID NO: 797517 - protein, 9 aa, Homo Sapiens
SGMKPIQTM

SEQ ID NO: 797518 - protein, 9 aa, Homo Sapiens
QTLANRMNT

SEQ ID NO: 797519 - protein, 9 aa, Homo Sapiens
ETDRERLRS

SEQ ID NO: 797520 - protein, 9 aa, Homo Sapiens
SLPESLKAY

SEQ ID NO: 797521 - protein, 9 aa, Homo Sapiens
YASLVGWKF

SEQ ID NO: 797522 - protein, 9 aa, Homo Sapiens
MSSQKRYGS

SEQ ID NO: 797523 - protein, 9 aa, Homo Sapiens
ASHPLFGRL

SEQ ID NO: 797524 - protein, 9 aa, Homo Sapiens
PAASGSAPA

SEQ ID NO: 797525 - protein, 9 aa, Homo Sapiens
QLPSSRRLS

SEQ ID NO: 797526 - protein, 9 aa, Homo Sapiens
DIASDFRKD

SEQ ID NO: 797527 - protein, 9 aa, Homo Sapiens
AASGSAPAF

SEQ ID NO: 797528 - protein, 9 aa, Homo Sapiens
GGDTATCCT

SEQ ID NO: 797529 - protein, 9 aa, Homo Sapiens
LRSIYNRDF

SEQ ID NO: 797530 - protein, 9 aa, Homo Sapiens
LAGWQCPEC

SEQ ID NO: 797531 - protein, 9 aa, Homo Sapiens
DDDAGSRKK

SEQ ID NO: 797532 - protein, 9 aa, Homo Sapiens
RECIFYNAN

SEQ ID NO: 797533 - protein, 9 aa, Homo Sapiens
DTATCCTKW

SEQ ID NO: 797534 - protein, 9 aa, Homo Sapiens
QEVSPDRAY

SEQ ID NO: 797535 - protein, 9 aa, Homo Sapiens
QRRDCALKD

SEQ ID NO: 797536 - protein, 9 aa, Homo Sapiens
TATCCTKWN

SEQ ID NO: 797537 - protein, 9 aa, Homo Sapiens
VGIVGVVLL

SEQ ID NO: 797538 - protein, 9 aa, Homo Sapiens
GSPHETDGH

SEQ ID NO: 797539 - protein, 9 aa, Homo Sapiens
SHPLFGRLV

SEQ ID NO: 797540 - protein, 9 aa, Homo Sapiens
SEAAERVES

SEQ ID NO: 797541 - protein, 9 aa, Homo Sapiens
ASLVGWKFH

SEQ ID NO: 797542 - protein, 9 aa, Homo Sapiens
SNIKREREV

SEQ ID NO: 797543 - protein, 9 aa, Homo Sapiens
ICHKCQVVA

SEQ ID NO: 797544 - protein, 9 aa, Homo Sapiens
PVTVKRNWT

SEQ ID NO: 797545 - protein, 9 aa, Homo Sapiens
LSPVTVKRN

SEQ ID NO: 797546 - protein, 9 aa, Homo Sapiens
DVELRAYAL

SEQ ID NO: 797547 - protein, 9 aa, Homo Sapiens
WLTPVILAL

SEQ ID NO: 797548 - protein, 9 aa, Homo Sapiens
LPSSRRLSG

SEQ ID NO: 797549 - protein, 9 aa, Homo Sapiens
PEGPRPLFF

SEQ ID NO: 797550 - protein, 9 aa, Homo Sapiens
RPFNSWEMS

SEQ ID NO: 797551 - protein, 9 aa, Homo Sapiens
SFIAVGIVG

SEQ ID NO: 797552 - protein, 9 aa, Homo Sapiens
DIMVLEGPK

SEQ ID NO: 797553 - protein, 9 aa, Homo Sapiens
LRKELSRTK

SEQ ID NO: 797554 - protein, 9 aa, Homo Sapiens
RKELSRTKQ

SEQ ID NO: 797555 - protein, 9 aa, Homo Sapiens
ALARHTGSV

SEQ ID NO: 797556 - protein, 9 aa, Homo Sapiens
ASEAAERVE

SEQ ID NO: 797557 - protein, 9 aa, Homo Sapiens
DIDIASDFR

SEQ ID NO: 797558 - protein, 9 aa, Homo Sapiens
YGEKHVEVQ

SEQ ID NO: 797559 - protein, 9 aa, Homo Sapiens
ASDFRKDDF

SEQ ID NO: 797560 - protein, 9 aa, Homo Sapiens
DAEQRRDCA

SEQ ID NO: 797561 - protein, 9 aa, Homo Sapiens
MKLSLPESL

SEQ ID NO: 797562 - protein, 9 aa, Homo Sapiens
ENSGMKPIQ

SEQ ID NO: 797563 - protein, 9 aa, Homo Sapiens
EQGSRKMSA

SEQ ID NO: 797564 - protein, 9 aa, Homo Sapiens
ELRAYALLA

SEQ ID NO: 797565 - protein, 9 aa, Homo Sapiens
DDAGSRKKK

SEQ ID NO: 797566 - protein, 9 aa, Homo Sapiens
EVSPDRAYP

SEQ ID NO: 797567 - protein, 9 aa, Homo Sapiens
KDKPTHAGG

SEQ ID NO: 797568 - protein, 9 aa, Homo Sapiens
AYVDDIDIA

SEQ ID NO: 797569 - protein, 9 aa, Homo Sapiens
GASEAAERV

SEQ ID NO: 797570 - protein, 9 aa, Homo Sapiens
GWEYASLVG

SEQ ID NO: 797571 - protein, 9 aa, Homo Sapiens
IMKLSLPES

SEQ ID NO: 797572 - protein, 9 aa, Homo Sapiens
DVFTLDTAK

SEQ ID NO: 797573 - protein, 9 aa, Homo Sapiens
GDTATCCTK

SEQ ID NO: 797574 - protein, 9 aa, Homo Sapiens
HSNEKEVYR

SEQ ID NO: 797575 - protein, 9 aa, Homo Sapiens
VGWKFHWKQ

SEQ ID NO: 797576 - protein, 9 aa, Homo Sapiens
LPNPGWSWD

SEQ ID NO: 797577 - protein, 9 aa, Homo Sapiens
VLTEVSTNG

SEQ ID NO: 797578 - protein, 9 aa, Homo Sapiens
LSVLTEVST

SEQ ID NO: 797579 - protein, 9 aa, Homo Sapiens
AEQRRDCAL

SEQ ID NO: 797580 - protein, 9 aa, Homo Sapiens
LSENSGMKP

SEQ ID NO: 797581 - protein, 9 aa, Homo Sapiens
KGRKEYPMY

SEQ ID NO: 797582 - protein, 9 aa, Homo Sapiens
SDISYFVVG

SEQ ID NO: 797583 - protein, 9 aa, Homo Sapiens
SGEIPKFSF

SEQ ID NO: 797584 - protein, 9 aa, Homo Sapiens
PGASEAAER

SEQ ID NO: 797585 - protein, 9 aa, Homo Sapiens
LREKIMKLS

SEQ ID NO: 797586 - protein, 9 aa, Homo Sapiens
DENDVQTIC

SEQ ID NO: 797587 - protein, 9 aa, Homo Sapiens
VRPFNSWEM

SEQ ID NO: 797588 - protein, 9 aa, Homo Sapiens
CIFYNANWE

SEQ ID NO: 797589 - protein, 9 aa, Homo Sapiens
ARHTGSVVI

SEQ ID NO: 797590 - protein, 9 aa, Homo Sapiens
TICHKCQVV

SEQ ID NO: 797591 - protein, 9 aa, Homo Sapiens
PLSPVTVKR

SEQ ID NO: 797592 - protein, 9 aa, Homo Sapiens
PMPDAFNPC

SEQ ID NO: 797593 - protein, 9 aa, Homo Sapiens
CPHRERCSD

SEQ ID NO: 797594 - protein, 9 aa, Homo Sapiens
LSLPESLKA

SEQ ID NO: 797595 - protein, 9 aa, Homo Sapiens
SYFVVGGKQ

SEQ ID NO: 797596 - protein, 9 aa, Homo Sapiens
EGDKDKPTH

SEQ ID NO: 797597 - protein, 9 aa, Homo Sapiens
FYNANWELE

SEQ ID NO: 797598 - protein, 9 aa, Homo Sapiens
AFGGTAKAL

SEQ ID NO: 797599 - protein, 9 aa, Homo Sapiens
REGQPPEGP

SEQ ID NO: 797600 - protein, 9 aa, Homo Sapiens
TAKISVIIL

SEQ ID NO: 797601 - protein, 9 aa, Homo Sapiens
RRTTTTNLT

SEQ ID NO: 797602 - protein, 9 aa, Homo Sapiens
TGSVVITNC

SEQ ID NO: 797603 - protein, 9 aa, Homo Sapiens
EQRRDCALK

SEQ ID NO: 797604 - protein, 9 aa, Homo Sapiens
VFEKLPDLV

SEQ ID NO: 797605 - protein, 9 aa, Homo Sapiens
SRTKQIRKE

SEQ ID NO: 797606 - protein, 9 aa, Homo Sapiens
KQIRKELSI

SEQ ID NO: 797607 - protein, 9 aa, Homo Sapiens
KHSNEKEVY

SEQ ID NO: 797608 - protein, 9 aa, Homo Sapiens
SDLKSLSVL

SEQ ID NO: 797609 - protein, 9 aa, Homo Sapiens
RTKQIRKEL

SEQ ID NO: 797610 - protein, 9 aa, Homo Sapiens
EPEAAEGDK

SEQ ID NO: 797611 - protein, 9 aa, Homo Sapiens
KLAGWQCPE

SEQ ID NO: 797612 - protein, 9 aa, Homo Sapiens
GMKPIQTMT

SEQ ID NO: 797613 - protein, 9 aa, Homo Sapiens
GSRKMSAAE

SEQ ID NO: 797614 - protein, 9 aa, Homo Sapiens
EGPKGRKEY

SEQ ID NO: 797615 - protein, 9 aa, Homo Sapiens
KSQEAEREY

SEQ ID NO: 797616 - protein, 9 aa, Homo Sapiens
LICLHTRVF

SEQ ID NO: 797617 - protein, 9 aa, Homo Sapiens
GEKHVEVQT

SEQ ID NO: 797618 - protein, 9 aa, Homo Sapiens
DIAVTPLKL

SEQ ID NO: 797619 - protein, 9 aa, Homo Sapiens
KDSNIKRER

SEQ ID NO: 797620 - protein, 9 aa, Homo Sapiens
KHVEVQTLA

SEQ ID NO: 797621 - protein, 9 aa, Homo Sapiens
EKEVYRCTS

SEQ ID NO: 797622 - protein, 9 aa, Homo Sapiens
MKPIQTMTE

SEQ ID NO: 797623 - protein, 9 aa, Homo Sapiens
SQEAEREYE

SEQ ID NO: 797624 - protein, 9 aa, Homo Sapiens
EAAEGDKDK

SEQ ID NO: 797625 - protein, 9 aa, Homo Sapiens
HTGSVVITN

SEQ ID NO: 797626 - protein, 9 aa, Homo Sapiens
PRSSPGASE

SEQ ID NO: 797627 - protein, 9 aa, Homo Sapiens
DKDKPTHAG

SEQ ID NO: 797628 - protein, 9 aa, Homo Sapiens
APAFRELPP

SEQ ID NO: 797629 - protein, 9 aa, Homo Sapiens
VRRCPHRER

SEQ ID NO: 797630 - protein, 9 aa, Homo Sapiens
EVVRRCPHR

SEQ ID NO: 797631 - protein, 9 aa, Homo Sapiens
VKRNWTITR

SEQ ID NO: 797632 - protein, 9 aa, Homo Sapiens
IADAEQRRD

SEQ ID NO: 797633 - protein, 9 aa, Homo Sapiens
VQTICHKCQ

SEQ ID NO: 797634 - protein, 9 aa, Homo Sapiens
DIVEEPWGL

SEQ ID NO: 797635 - protein, 9 aa, Homo Sapiens
KQLPNPGWS

SEQ ID NO: 797636 - protein, 9 aa, Homo Sapiens
EYASLVGWK

SEQ ID NO: 797637 - protein, 9 aa, Homo Sapiens
FTLDTAKIS

SEQ ID NO: 797638 - protein, 9 aa, Homo Sapiens
AVGIVGVVL

SEQ ID NO: 797639 - protein, 9 aa, Homo Sapiens
MEHQLTATK

SEQ ID NO: 797640 - protein, 9 aa, Homo Sapiens
VSPDRAYPE

SEQ ID NO: 797641 - protein, 9 aa, Homo Sapiens
SSFIAVGIV

SEQ ID NO: 797642 - protein, 9 aa, Homo Sapiens
RFKDSNIKR

SEQ ID NO: 797643 - protein, 9 aa, Homo Sapiens
SVLTEVSTN

SEQ ID NO: 797644 - protein, 9 aa, Homo Sapiens
KFSFQDPPN

SEQ ID NO: 797645 - protein, 9 aa, Homo Sapiens
CCTKWNTED

SEQ ID NO: 797646 - protein, 9 aa, Homo Sapiens
PPRSSPGAS

SEQ ID NO: 797647 - protein, 9 aa, Homo Sapiens
NIKREREVF

SEQ ID NO: 797648 - protein, 9 aa, Homo Sapiens
DVQTICHKC

SEQ ID NO: 797649 - protein, 9 aa, Homo Sapiens
RRDCALKDA

SEQ ID NO: 797650 - protein, 9 aa, Homo Sapiens
DVTCSPMPD

SEQ ID NO: 797651 - protein, 9 aa, Homo Sapiens
TCSPMPDAF

SEQ ID NO: 797652 - protein, 9 aa, Homo Sapiens
SSPGASEAA

SEQ ID NO: 797653 - protein, 9 aa, Homo Sapiens
NSGMKPIQT

SEQ ID NO: 797654 - protein, 9 aa, Homo Sapiens
IVEEPWGLS

SEQ ID NO: 797655 - protein, 9 aa, Homo Sapiens
AKISVIILR

SEQ ID NO: 797656 - protein, 9 aa, Homo Sapiens
QTICHKCQV

SEQ ID NO: 797657 - protein, 9 aa, Homo Sapiens
HVEVQTLAN

SEQ ID NO: 797658 - protein, 9 aa, Homo Sapiens
TRVFEKLPD

SEQ ID NO: 797659 - protein, 9 aa, Homo Sapiens
EAEREYEKI

SEQ ID NO: 797660 - protein, 9 aa, Homo Sapiens
ENDVQTICH

SEQ ID NO: 797661 - protein, 9 aa, Homo Sapiens
QDDDAGSRK

SEQ ID NO: 797662 - protein, 9 aa, Homo Sapiens
ISKSSDSTG

SEQ ID NO: 797663 - protein, 9 aa, Homo Sapiens
GAISKSSDS

SEQ ID NO: 797664 - protein, 9 aa, Homo Sapiens
IFNPTMYKG

SEQ ID NO: 797665 - protein, 9 aa, Homo Sapiens
ITMEDKGLQ

SEQ ID NO: 797666 - protein, 9 aa, Homo Sapiens
GILLPRIRR

SEQ ID NO: 797667 - protein, 9 aa, Homo Sapiens
QLENIRKTG

SEQ ID NO: 797668 - protein, 9 aa, Homo Sapiens
DKSRSSRSP

SEQ ID NO: 797669 - protein, 9 aa, Homo Sapiens
CNRKHRRLK

SEQ ID NO: 797670 - protein, 9 aa, Homo Sapiens
LLPLGIILF

SEQ ID NO: 797671 - protein, 9 aa, Homo Sapiens
VSKSSCNIP

SEQ ID NO: 797672 - protein, 9 aa, Homo Sapiens
TWLSYQLLK

SEQ ID NO: 797673 - protein, 9 aa, Homo Sapiens
CNIPRRHTL

SEQ ID NO: 797674 - protein, 9 aa, Homo Sapiens
YVLSMGFMP

SEQ ID NO: 797675 - protein, 9 aa, Homo Sapiens
VYCNRKHRR

SEQ ID NO: 797676 - protein, 9 aa, Homo Sapiens
SSDSTGPIT

SEQ ID NO: 797677 - protein, 9 aa, Homo Sapiens
NCGILLPRI

SEQ ID NO: 797678 - protein, 9 aa, Homo Sapiens
EGFPGHITM

SEQ ID NO: 797679 - protein, 9 aa, Homo Sapiens
SRGKSPSYS

SEQ ID NO: 797680 - protein, 9 aa, Homo Sapiens
HITMEDKGL

SEQ ID NO: 797681 - protein, 9 aa, Homo Sapiens
QRKDSHGFF

SEQ ID NO: 797682 - protein, 9 aa, Homo Sapiens
GDLAMSGLG

SEQ ID NO: 797683 - protein, 9 aa, Homo Sapiens
PIFNPTMYK

SEQ ID NO: 797684 - protein, 9 aa, Homo Sapiens
ENIRKTGQE

SEQ ID NO: 797685 - protein, 9 aa, Homo Sapiens
KSSDSTGPI

SEQ ID NO: 797686 - protein, 9 aa, Homo Sapiens
EFLLPLGII

SEQ ID NO: 797687 - protein, 9 aa, Homo Sapiens
RRRPNCGIL

SEQ ID NO: 797688 - protein, 9 aa, Homo Sapiens
EFPSRGKSP

SEQ ID NO: 797689 - protein, 9 aa, Homo Sapiens
SKSSCNIPR

SEQ ID NO: 797690 - protein, 9 aa, Homo Sapiens
LVYCNRKHR

SEQ ID NO: 797691 - protein, 9 aa, Homo Sapiens
FCLLLPTVV

SEQ ID NO: 797692 - protein, 9 aa, Homo Sapiens
AGAISKSSD

SEQ ID NO: 797693 - protein, 9 aa, Homo Sapiens
RPNCGILLP

SEQ ID NO: 797694 - protein, 9 aa, Homo Sapiens
NRKHRRLKN

SEQ ID NO: 797695 - protein, 9 aa, Homo Sapiens
VVIVFSYVK

SEQ ID NO: 797696 - protein, 9 aa, Homo Sapiens
VDGDSGQNT

SEQ ID NO: 797697 - protein, 9 aa, Homo Sapiens
SVSKSSCNI

SEQ ID NO: 797698 - protein, 9 aa, Homo Sapiens
HHLEQDLVR

SEQ ID NO: 797699 - protein, 9 aa, Homo Sapiens
GSGEGHCKA

SEQ ID NO: 797700 - protein, 9 aa, Homo Sapiens
CLLLPTVVI

SEQ ID NO: 797701 - protein, 9 aa, Homo Sapiens
LRGGGGRGD

SEQ ID NO: 797702 - protein, 9 aa, Homo Sapiens
GSVSKSSCN

SEQ ID NO: 797703 - protein, 9 aa, Homo Sapiens
FPGHITMED

SEQ ID NO: 797704 - protein, 9 aa, Homo Sapiens
SHGFFAFPV

SEQ ID NO: 797705 - protein, 9 aa, Homo Sapiens
MGFMPGIMP

SEQ ID NO: 797706 - protein, 9 aa, Homo Sapiens
HCKAFTTCS

SEQ ID NO: 797707 - protein, 9 aa, Homo Sapiens
DSHGFFAFP

SEQ ID NO: 797708 - protein, 9 aa, Homo Sapiens
GHITMEDKG

SEQ ID NO: 797709 - protein, 9 aa, Homo Sapiens
RGSVSKSSC

SEQ ID NO: 797710 - protein, 9 aa, Homo Sapiens
DSGQNTWLS

SEQ ID NO: 797711 - protein, 9 aa, Homo Sapiens
LLGRHHLEQ

SEQ ID NO: 797712 - protein, 9 aa, Homo Sapiens
EAMFLLEFL

SEQ ID NO: 797713 - protein, 9 aa, Homo Sapiens
PPIFNPTMY

SEQ ID NO: 797714 - protein, 9 aa, Homo Sapiens
SMGFMPGIM

SEQ ID NO: 797715 - protein, 9 aa, Homo Sapiens
DNLLVYCNR

SEQ ID NO: 797716 - protein, 9 aa, Homo Sapiens
LRQLQRKDS

SEQ ID NO: 797717 - protein, 9 aa, Homo Sapiens
LGRHHLEQD

SEQ ID NO: 797718 - protein, 9 aa, Homo Sapiens
LENIRKTGQ

SEQ ID NO: 797719 - protein, 9 aa, Homo Sapiens
GKSPSYSKQ

SEQ ID NO: 797720 - protein, 9 aa, Homo Sapiens
DLAMSGLGR

SEQ ID NO: 797721 - protein, 9 aa, Homo Sapiens
PSRGKSPSY

SEQ ID NO: 797722 - protein, 9 aa, Homo Sapiens
GRHHLEQDL

SEQ ID NO: 797723 - protein, 9 aa, Homo Sapiens
GRGDLAMSG

SEQ ID NO: 797724 - protein, 9 aa, Homo Sapiens
SPSYSKQFT

SEQ ID NO: 797725 - protein, 9 aa, Homo Sapiens
DGDSGQNTW

SEQ ID NO: 797726 - protein, 9 aa, Homo Sapiens
AISKSSDST

SEQ ID NO: 797727 - protein, 9 aa, Homo Sapiens
TQLENIRKT

SEQ ID NO: 797728 - protein, 9 aa, Homo Sapiens
GFPGHITME

SEQ ID NO: 797729 - protein, 9 aa, Homo Sapiens
LLEFLLPLG

SEQ ID NO: 797730 - protein, 9 aa, Homo Sapiens
GGRGDLAMS

SEQ ID NO: 797731 - protein, 9 aa, Homo Sapiens
NPTMYKGQV

SEQ ID NO: 797732 - protein, 9 aa, Homo Sapiens
EGHCKAFTT

SEQ ID NO: 797733 - protein, 9 aa, Homo Sapiens
MGSGEGHCK

SEQ ID NO: 797734 - protein, 9 aa, Homo Sapiens
TMYKGQVPE

SEQ ID NO: 797735 - protein, 9 aa, Homo Sapiens
LEFLLPLGI

SEQ ID NO: 797736 - protein, 9 aa, Homo Sapiens
CGILLPRIR

SEQ ID NO: 797737 - protein, 9 aa, Homo Sapiens
IHMGSGEGH

SEQ ID NO: 797738 - protein, 9 aa, Homo Sapiens
RRPNCGILL

SEQ ID NO: 797739 - protein, 9 aa, Homo Sapiens
KSPSYSKQF

SEQ ID NO: 797740 - protein, 9 aa, Homo Sapiens
ILLPRIRRW

SEQ ID NO: 797741 - protein, 9 aa, Homo Sapiens
MEDKGLQFG

SEQ ID NO: 797742 - protein, 9 aa, Homo Sapiens
RGGGGRGDL

SEQ ID NO: 797743 - protein, 9 aa, Homo Sapiens
SSCNIPRRH

SEQ ID NO: 797744 - protein, 9 aa, Homo Sapiens
FPSRGKSPS

SEQ ID NO: 797745 - protein, 9 aa, Homo Sapiens
NPPIFNPTM

SEQ ID NO: 797746 - protein, 9 aa, Homo Sapiens
NAAGAISKS

SEQ ID NO: 797747 - protein, 9 aa, Homo Sapiens
NLLVYCNRK

SEQ ID NO: 797748 - protein, 9 aa, Homo Sapiens
PGHITMEDK

SEQ ID NO: 797749 - protein, 9 aa, Homo Sapiens
LQRKDSHGF

SEQ ID NO: 797750 - protein, 9 aa, Homo Sapiens
KTQLENIRK

SEQ ID NO: 797751 - protein, 9 aa, Homo Sapiens
AAGAISKSS

SEQ ID NO: 797752 - protein, 9 aa, Homo Sapiens
SGQNTWLSY

SEQ ID NO: 797753 - protein, 9 aa, Homo Sapiens
GGGGRGDLA

SEQ ID NO: 797754 - protein, 9 aa, Homo Sapiens
RQLQRKDSH

SEQ ID NO: 797755 - protein, 9 aa, Homo Sapiens
TMEDKGLQF

SEQ ID NO: 797756 - protein, 9 aa, Homo Sapiens
PNCGILLPR

SEQ ID NO: 797757 - protein, 9 aa, Homo Sapiens
NIRKTGQEM

SEQ ID NO: 797758 - protein, 9 aa, Homo Sapiens
LSMGFMPGI

SEQ ID NO: 797759 - protein, 9 aa, Homo Sapiens
MYKGQVPEN

SEQ ID NO: 797760 - protein, 9 aa, Homo Sapiens
FDNLLVYCN

SEQ ID NO: 797761 - protein, 9 aa, Homo Sapiens
LLPTVVIVF

SEQ ID NO: 797762 - protein, 9 aa, Homo Sapiens
SKSSDSTGP

SEQ ID NO: 797763 - protein, 9 aa, Homo Sapiens
PSYSKQFTS

SEQ ID NO: 797764 - protein, 9 aa, Homo Sapiens
LLLPTVVIV

SEQ ID NO: 797765 - protein, 9 aa, Homo Sapiens
NNSYVLSMG

SEQ ID NO: 797766 - protein, 9 aa, Homo Sapiens
FLLPLGIIL

SEQ ID NO: 797767 - protein, 9 aa, Homo Sapiens
RGDLAMSGL

SEQ ID NO: 797768 - protein, 9 aa, Homo Sapiens
AMFLLEFLL

SEQ ID NO: 797769 - protein, 9 aa, Homo Sapiens
MFLLEFLLP

SEQ ID NO: 797770 - protein, 9 aa, Homo Sapiens
QNTWLSYQL

SEQ ID NO: 797771 - protein, 9 aa, Homo Sapiens
NSYVLSMGF

SEQ ID NO: 797772 - protein, 9 aa, Homo Sapiens
GEGHCKAFT

SEQ ID NO: 797773 - protein, 9 aa, Homo Sapiens
RRMLLGRHH

SEQ ID NO: 797774 - protein, 9 aa, Homo Sapiens
HLEQDLVRE

SEQ ID NO: 797775 - protein, 9 aa, Homo Sapiens
KDSHGFFAF

SEQ ID NO: 797776 - protein, 9 aa, Homo Sapiens
RKTGQEMIE

SEQ ID NO: 797777 - protein, 9 aa, Homo Sapiens
EKSKDKSHL

SEQ ID NO: 797778 - protein, 9 aa, Homo Sapiens
YCNRKHRRL

SEQ ID NO: 797779 - protein, 9 aa, Homo Sapiens
HMGSGEGHC

SEQ ID NO: 797780 - protein, 9 aa, Homo Sapiens
LLVYCNRKH

SEQ ID NO: 797781 - protein, 9 aa, Homo Sapiens
PTVVIVFSY

SEQ ID NO: 797782 - protein, 9 aa, Homo Sapiens
PTMYKGQVP

SEQ ID NO: 797783 - protein, 9 aa, Homo Sapiens
RKDSHGFFA

SEQ ID NO: 797784 - protein, 9 aa, Homo Sapiens
MLLGRHHLE

SEQ ID NO: 797785 - protein, 9 aa, Homo Sapiens
GDSGQNTWL

SEQ ID NO: 797786 - protein, 9 aa, Homo Sapiens
QLQRKDSHG

SEQ ID NO: 797787 - protein, 9 aa, Homo Sapiens
NTWLSYQLL

SEQ ID NO: 797788 - protein, 9 aa, Homo Sapiens
VLSMGFMPG

SEQ ID NO: 797789 - protein, 9 aa, Homo Sapiens
NKTQLENIR

SEQ ID NO: 797790 - protein, 9 aa, Homo Sapiens
IRKTGQEMI

SEQ ID NO: 797791 - protein, 9 aa, Homo Sapiens
RMLLGRHHL

SEQ ID NO: 797792 - protein, 9 aa, Homo Sapiens
SCNIPRRHT

SEQ ID NO: 797793 - protein, 9 aa, Homo Sapiens
QGDKSRSSR

SEQ ID NO: 797794 - protein, 9 aa, Homo Sapiens
FNPTMYKGQ

SEQ ID NO: 797795 - protein, 9 aa, Homo Sapiens
LLPRIRRWR

SEQ ID NO: 797796 - protein, 9 aa, Homo Sapiens
GQNTWLSYQ

SEQ ID NO: 797797 - protein, 9 aa, Homo Sapiens
SGEGHCKAF

SEQ ID NO: 797798 - protein, 9 aa, Homo Sapiens
LPTVVIVFS

SEQ ID NO: 797799 - protein, 9 aa, Homo Sapiens
RHHLEQDLV

SEQ ID NO: 797800 - protein, 9 aa, Homo Sapiens
TVVIVFSYV

SEQ ID NO: 797801 - protein, 9 aa, Homo Sapiens
KNNSYVLSM

SEQ ID NO: 797802 - protein, 9 aa, Homo Sapiens
FFCLLLPTV

SEQ ID NO: 797803 - protein, 9 aa, Homo Sapiens
SYVLSMGFM

SEQ ID NO: 797804 - protein, 9 aa, Homo Sapiens
GGGRGDLAM

SEQ ID NO: 797805 - protein, 9 aa, Homo Sapiens
GHCKAFTTC

SEQ ID NO: 797806 - protein, 9 aa, Homo Sapiens
GDKSRSSRS

SEQ ID NO: 797807 - protein, 9 aa, Homo Sapiens
RGKSPSYSK

SEQ ID NO: 797808 - protein, 9 aa, Homo Sapiens
KSSCNIPRR

SEQ ID NO: 797809 - protein, 9 aa, Homo Sapiens
FLLEFLLPL

SEQ ID NO: 797810 - protein, 9 aa, Homo Sapiens
REKLCEYKF

SEQ ID NO: 797811 - protein, 9 aa, Homo Sapiens
VDHTNSGKT

SEQ ID NO: 797812 - protein, 9 aa, Homo Sapiens
VQLEQDEYA

SEQ ID NO: 797813 - protein, 9 aa, Homo Sapiens
TSPVLETRR

SEQ ID NO: 797814 - protein, 9 aa, Homo Sapiens
LLYLNWVIR

SEQ ID NO: 797815 - protein, 9 aa, Homo Sapiens
LLQRWLRVL

SEQ ID NO: 797816 - protein, 9 aa, Homo Sapiens
APSRPGSRK

SEQ ID NO: 797817 - protein, 9 aa, Homo Sapiens
YAVRKLGNT

SEQ ID NO: 797818 - protein, 9 aa, Homo Sapiens
SHRTKNRRR

SEQ ID NO: 797819 - protein, 9 aa, Homo Sapiens
MKSDHLSKH

SEQ ID NO: 797820 - protein, 9 aa, Homo Sapiens
IIHVTSPVL

SEQ ID NO: 797821 - protein, 9 aa, Homo Sapiens
SCCSVDHTN

SEQ ID NO: 797822 - protein, 9 aa, Homo Sapiens
KDVPVQQVT

SEQ ID NO: 797823 - protein, 9 aa, Homo Sapiens
ESSSSSTEM

SEQ ID NO: 797824 - protein, 9 aa, Homo Sapiens
SLKDTSHSD

SEQ ID NO: 797825 - protein, 9 aa, Homo Sapiens
WLRVLLCRQ

SEQ ID NO: 797826 - protein, 9 aa, Homo Sapiens
AGGLESALH

SEQ ID NO: 797827 - protein, 9 aa, Homo Sapiens
EQDEYAKHI

SEQ ID NO: 797828 - protein, 9 aa, Homo Sapiens
RIVNIADGK

SEQ ID NO: 797829 - protein, 9 aa, Homo Sapiens
IWDLSMHLS

SEQ ID NO: 797830 - protein, 9 aa, Homo Sapiens
STPRPDTLP

SEQ ID NO: 797831 - protein, 9 aa, Homo Sapiens
LCEYKFEQT

SEQ ID NO: 797832 - protein, 9 aa, Homo Sapiens
MEALLLSAG

SEQ ID NO: 797833 - protein, 9 aa, Homo Sapiens
DGETAEEQL

SEQ ID NO: 797834 - protein, 9 aa, Homo Sapiens
VVSDGIVAF

SEQ ID NO: 797835 - protein, 9 aa, Homo Sapiens
TAEEQLHPA

SEQ ID NO: 797836 - protein, 9 aa, Homo Sapiens
SRKYLHQQL

SEQ ID NO: 797837 - protein, 9 aa, Homo Sapiens
AVLVLFTAV

SEQ ID NO: 797838 - protein, 9 aa, Homo Sapiens
SAVVSDGIV

SEQ ID NO: 797839 - protein, 9 aa, Homo Sapiens
HSWSTPRPD

SEQ ID NO: 797840 - protein, 9 aa, Homo Sapiens
HPADPAWAV

SEQ ID NO: 797841 - protein, 9 aa, Homo Sapiens
LVGSLMAAG

SEQ ID NO: 797842 - protein, 9 aa, Homo Sapiens
LEMSAVVSD

SEQ ID NO: 797843 - protein, 9 aa, Homo Sapiens
SLKQVQLEQ

SEQ ID NO: 797844 - protein, 9 aa, Homo Sapiens
LLVGSLMAA

SEQ ID NO: 797845 - protein, 9 aa, Homo Sapiens
PRPDTLPTI

SEQ ID NO: 797846 - protein, 9 aa, Homo Sapiens
KGEALQPQS

SEQ ID NO: 797847 - protein, 9 aa, Homo Sapiens
LDSLHHLSG

SEQ ID NO: 797848 - protein, 9 aa, Homo Sapiens
LMAAGGLES

SEQ ID NO: 797849 - protein, 9 aa, Homo Sapiens
HRRGGGGAG

SEQ ID NO: 797850 - protein, 9 aa, Homo Sapiens
RVEEEERNQ

SEQ ID NO: 797851 - protein, 9 aa, Homo Sapiens
SPVLETRRA

SEQ ID NO: 797852 - protein, 9 aa, Homo Sapiens
QQVTHADRE

SEQ ID NO: 797853 - protein, 9 aa, Homo Sapiens
RPSSCSRSL

SEQ ID NO: 797854 - protein, 9 aa, Homo Sapiens
QLEQDEYAK

SEQ ID NO: 797855 - protein, 9 aa, Homo Sapiens
LQRWLRVLL

SEQ ID NO: 797856 - protein, 9 aa, Homo Sapiens
QWKDVPVQQ

SEQ ID NO: 797857 - protein, 9 aa, Homo Sapiens
LAEDMTLCV

SEQ ID NO: 797858 - protein, 9 aa, Homo Sapiens
KRFMKSDHL

SEQ ID NO: 797859 - protein, 9 aa, Homo Sapiens
HWEDLHNNS

SEQ ID NO: 797860 - protein, 9 aa, Homo Sapiens
CPKRFMKSD

SEQ ID NO: 797861 - protein, 9 aa, Homo Sapiens
LCVADFGLS

SEQ ID NO: 797862 - protein, 9 aa, Homo Sapiens
VSDGIVAFF

SEQ ID NO: 797863 - protein, 9 aa, Homo Sapiens
SLHHLSGAE

SEQ ID NO: 797864 - protein, 9 aa, Homo Sapiens
RWLRVLLCR

SEQ ID NO: 797865 - protein, 9 aa, Homo Sapiens
SGSTEGKGE

SEQ ID NO: 797866 - protein, 9 aa, Homo Sapiens
GNTKFRSHE

SEQ ID NO: 797867 - protein, 9 aa, Homo Sapiens
LSLPYQLLL

SEQ ID NO: 797868 - protein, 9 aa, Homo Sapiens
AEDMTLCVA

SEQ ID NO: 797869 - protein, 9 aa, Homo Sapiens
AGYGAPPVG

SEQ ID NO: 797870 - protein, 9 aa, Homo Sapiens
HYQQQQVAG

SEQ ID NO: 797871 - protein, 9 aa, Homo Sapiens
VVRTDFDLT

SEQ ID NO: 797872 - protein, 9 aa, Homo Sapiens
HHLSGAENL

SEQ ID NO: 797873 - protein, 9 aa, Homo Sapiens
LLLYLNWVI

SEQ ID NO: 797874 - protein, 9 aa, Homo Sapiens
GESSSSSTE

SEQ ID NO: 797875 - protein, 9 aa, Homo Sapiens
LLPKLIWDL

SEQ ID NO: 797876 - protein, 9 aa, Homo Sapiens
WKDVPVQQV

SEQ ID NO: 797877 - protein, 9 aa, Homo Sapiens
SGAENLTEL

SEQ ID NO: 797878 - protein, 9 aa, Homo Sapiens
QLHPADPAW

SEQ ID NO: 797879 - protein, 9 aa, Homo Sapiens
SEVIKPGDS

SEQ ID NO: 797880 - protein, 9 aa, Homo Sapiens
KILLPKLIW

SEQ ID NO: 797881 - protein, 9 aa, Homo Sapiens
EQLHPADPA

SEQ ID NO: 797882 - protein, 9 aa, Homo Sapiens
DLSMHLSLP

SEQ ID NO: 797883 - protein, 9 aa, Homo Sapiens
HQQLQFIPI

SEQ ID NO: 797884 - protein, 9 aa, Homo Sapiens
GSTEGKGEA

SEQ ID NO: 797885 - protein, 9 aa, Homo Sapiens
ETAEEQLHP

SEQ ID NO: 797886 - protein, 9 aa, Homo Sapiens
RSLWLCRAP

SEQ ID NO: 797887 - protein, 9 aa, Homo Sapiens
DWGKGCVDK

SEQ ID NO: 797888 - protein, 9 aa, Homo Sapiens
GGFKKFIRR

SEQ ID NO: 797889 - protein, 9 aa, Homo Sapiens
YGAPPVGNE

SEQ ID NO: 797890 - protein, 9 aa, Homo Sapiens
IPIKKILLP

SEQ ID NO: 797891 - protein, 9 aa, Homo Sapiens
IVNIADGKW

SEQ ID NO: 797892 - protein, 9 aa, Homo Sapiens
SRVEEEERN

SEQ ID NO: 797893 - protein, 9 aa, Homo Sapiens
MAVLVLFTA

SEQ ID NO: 797894 - protein, 9 aa, Homo Sapiens
SCSRSLWLC

SEQ ID NO: 797895 - protein, 9 aa, Homo Sapiens
EVIKPGDSL

SEQ ID NO: 797896 - protein, 9 aa, Homo Sapiens
WLCRAPSRP

SEQ ID NO: 797897 - protein, 9 aa, Homo Sapiens
LGSPGGSGG

SEQ ID NO: 797898 - protein, 9 aa, Homo Sapiens
MAIGEMLVL

SEQ ID NO: 797899 - protein, 9 aa, Homo Sapiens
MTLCVADFG

SEQ ID NO: 797900 - protein, 9 aa, Homo Sapiens
KDTSHSDHR

SEQ ID NO: 797901 - protein, 9 aa, Homo Sapiens
LYLNWVIRH

SEQ ID NO: 797902 - protein, 9 aa, Homo Sapiens
VQGKDGGFK

SEQ ID NO: 797903 - protein, 9 aa, Homo Sapiens
IHVTSPVLE

SEQ ID NO: 797904 - protein, 9 aa, Homo Sapiens
VLETRRADS

SEQ ID NO: 797905 - protein, 9 aa, Homo Sapiens
AWAVLRGGG

SEQ ID NO: 797906 - protein, 9 aa, Homo Sapiens
VTSPVLETR

SEQ ID NO: 797907 - protein, 9 aa, Homo Sapiens
WGKGCVDKF

SEQ ID NO: 797908 - protein, 9 aa, Homo Sapiens
GYGAPPVGN

SEQ ID NO: 797909 - protein, 9 aa, Homo Sapiens
VPVQQVTHA

SEQ ID NO: 797910 - protein, 9 aa, Homo Sapiens
KLCEYKFEQ

SEQ ID NO: 797911 - protein, 9 aa, Homo Sapiens
AHSWSTPRP

SEQ ID NO: 797912 - protein, 9 aa, Homo Sapiens
GSRKYLHQQ

SEQ ID NO: 797913 - protein, 9 aa, Homo Sapiens
EMLVLAPEY

SEQ ID NO: 797914 - protein, 9 aa, Homo Sapiens
PSRPGSRKY

SEQ ID NO: 797915 - protein, 9 aa, Homo Sapiens
GAMAIGEML

SEQ ID NO: 797916 - protein, 9 aa, Homo Sapiens
EDLSHRTKN

SEQ ID NO: 797917 - protein, 9 aa, Homo Sapiens
PKIHWEDLH

SEQ ID NO: 797918 - protein, 9 aa, Homo Sapiens
CSFSEVIKP

SEQ ID NO: 797919 - protein, 9 aa, Homo Sapiens
GHRRGGGGA

SEQ ID NO: 797920 - protein, 9 aa, Homo Sapiens
VRKLGNTKF

SEQ ID NO: 797921 - protein, 9 aa, Homo Sapiens
GSLMAAGGL

SEQ ID NO: 797922 - protein, 9 aa, Homo Sapiens
SSSSSTEMN

SEQ ID NO: 797923 - protein, 9 aa, Homo Sapiens
LHQQLQFIP

SEQ ID NO: 797924 - protein, 9 aa, Homo Sapiens
KQVQLEQDE

SEQ ID NO: 797925 - protein, 9 aa, Homo Sapiens
TEGKGEALQ

SEQ ID NO: 797926 - protein, 9 aa, Homo Sapiens
VLVLFTAVL

SEQ ID NO: 797927 - protein, 9 aa, Homo Sapiens
SSCSRSLWL

SEQ ID NO: 797928 - protein, 9 aa, Homo Sapiens
YLHQQLQFI

SEQ ID NO: 797929 - protein, 9 aa, Homo Sapiens
TYSEKWQQL

SEQ ID NO: 797930 - protein, 9 aa, Homo Sapiens
LQFIPIKKI

SEQ ID NO: 797931 - protein, 9 aa, Homo Sapiens
KDIDWGKGC

SEQ ID NO: 797932 - protein, 9 aa, Homo Sapiens
VQQVTHADR

SEQ ID NO: 797933 - protein, 9 aa, Homo Sapiens
KGCVDKFDI

SEQ ID NO: 797934 - protein, 9 aa, Homo Sapiens
RPDTLPTIT

SEQ ID NO: 797935 - protein, 9 aa, Homo Sapiens
SSRLTLHLK

SEQ ID NO: 797936 - protein, 9 aa, Homo Sapiens
FIPIKKILL

SEQ ID NO: 797937 - protein, 9 aa, Homo Sapiens
SVDHTNSGK

SEQ ID NO: 797938 - protein, 9 aa, Homo Sapiens
QQLQFIPIK

SEQ ID NO: 797939 - protein, 9 aa, Homo Sapiens
SRPGSRKYL

SEQ ID NO: 797940 - protein, 9 aa, Homo Sapiens
DLSHRTKNR

SEQ ID NO: 797941 - protein, 9 aa, Homo Sapiens
RTKNRRRRP

SEQ ID NO: 797942 - protein, 9 aa, Homo Sapiens
PGSRKYLHQ

SEQ ID NO: 797943 - protein, 9 aa, Homo Sapiens
HLSGAENLT

SEQ ID NO: 797944 - protein, 9 aa, Homo Sapiens
SMHLSLPYQ

SEQ ID NO: 797945 - protein, 9 aa, Homo Sapiens
KNRRRRPSS

SEQ ID NO: 797946 - protein, 9 aa, Homo Sapiens
DIDWGKGCV

SEQ ID NO: 797947 - protein, 9 aa, Homo Sapiens
SRSLWLCRA

SEQ ID NO: 797948 - protein, 9 aa, Homo Sapiens
LTLHLKSDM

SEQ ID NO: 797949 - protein, 9 aa, Homo Sapiens
KLGNTKFRS

SEQ ID NO: 797950 - protein, 9 aa, Homo Sapiens
LKDTSHSDH

SEQ ID NO: 797951 - protein, 9 aa, Homo Sapiens
CRAPSRPGS

SEQ ID NO: 797952 - protein, 9 aa, Homo Sapiens
DAVVRTDFD

SEQ ID NO: 797953 - protein, 9 aa, Homo Sapiens
AAGGLESAL

SEQ ID NO: 797954 - protein, 9 aa, Homo Sapiens
VLRGGGGSP

SEQ ID NO: 797955 - protein, 9 aa, Homo Sapiens
LLSAGLLLG

SEQ ID NO: 797956 - protein, 9 aa, Homo Sapiens
SSTEMNNKN

SEQ ID NO: 797957 - protein, 9 aa, Homo Sapiens
APPVGNEGP

SEQ ID NO: 797958 - protein, 9 aa, Homo Sapiens
FAPFHIYIS

SEQ ID NO: 797959 - protein, 9 aa, Homo Sapiens
SEKWQQLQQ

SEQ ID NO: 797960 - protein, 9 aa, Homo Sapiens
CEYKFEQTV

SEQ ID NO: 797961 - protein, 9 aa, Homo Sapiens
SWSTPRPDT

SEQ ID NO: 797962 - protein, 9 aa, Homo Sapiens
QLLLYLNWV

SEQ ID NO: 797963 - protein, 9 aa, Homo Sapiens
LFTAVLLAF

SEQ ID NO: 797964 - protein, 9 aa, Homo Sapiens
EKWQQLQQE

SEQ ID NO: 797965 - protein, 9 aa, Homo Sapiens
TSHSDHRSH

SEQ ID NO: 797966 - protein, 9 aa, Homo Sapiens
LNWVIRHFL

SEQ ID NO: 797967 - protein, 9 aa, Homo Sapiens
YQLLLYLNW

SEQ ID NO: 797968 - protein, 9 aa, Homo Sapiens
PAGYGAPPV

SEQ ID NO: 797969 - protein, 9 aa, Homo Sapiens
KSDHLSKHI

SEQ ID NO: 797970 - protein, 9 aa, Homo Sapiens
AAHSWSTPR

SEQ ID NO: 797971 - protein, 9 aa, Homo Sapiens
QELFAPFHI

SEQ ID NO: 797972 - protein, 9 aa, Homo Sapiens
LLEMSAVVS

SEQ ID NO: 797973 - protein, 9 aa, Homo Sapiens
RRRRPSSCS

SEQ ID NO: 797974 - protein, 9 aa, Homo Sapiens
SPGGSGGGG

SEQ ID NO: 797975 - protein, 9 aa, Homo Sapiens
WSTPRPDTL

SEQ ID NO: 797976 - protein, 9 aa, Homo Sapiens
LLLSAGLLL

SEQ ID NO: 797977 - protein, 9 aa, Homo Sapiens
ECPKRFMKS

SEQ ID NO: 797978 - protein, 9 aa, Homo Sapiens
ILLQRWLRV

SEQ ID NO: 797979 - protein, 9 aa, Homo Sapiens
AVRKLGNTK

SEQ ID NO: 797980 - protein, 9 aa, Homo Sapiens
HVTSPVLET

SEQ ID NO: 797981 - protein, 9 aa, Homo Sapiens
LHHLSGAEN

SEQ ID NO: 797982 - protein, 9 aa, Homo Sapiens
FPKIHWEDL

SEQ ID NO: 797983 - protein, 9 aa, Homo Sapiens
CSRSLWLCR

SEQ ID NO: 797984 - protein, 9 aa, Homo Sapiens
LSHRTKNRR

SEQ ID NO: 797985 - protein, 9 aa, Homo Sapiens
LSMHLSLPY

SEQ ID NO: 797986 - protein, 9 aa, Homo Sapiens
APFHIYISP

SEQ ID NO: 797987 - protein, 9 aa, Homo Sapiens
SRLTLHLKS

SEQ ID NO: 797988 - protein, 9 aa, Homo Sapiens
ADPAWAVLR

SEQ ID NO: 797989 - protein, 9 aa, Homo Sapiens
EEQLHPADP

SEQ ID NO: 797990 - protein, 9 aa, Homo Sapiens
AVLRGGGGS

SEQ ID NO: 797991 - protein, 9 aa, Homo Sapiens
KDGGFKKFI

SEQ ID NO: 797992 - protein, 9 aa, Homo Sapiens
RKLGNTKFR

SEQ ID NO: 797993 - protein, 9 aa, Homo Sapiens
LGNTKFRSH

SEQ ID NO: 797994 - protein, 9 aa, Homo Sapiens
DFDLTVTYD

SEQ ID NO: 797995 - protein, 9 aa, Homo Sapiens
EDMTLCVAD

SEQ ID NO: 797996 - protein, 9 aa, Homo Sapiens
GSGSTEGKG

SEQ ID NO: 797997 - protein, 9 aa, Homo Sapiens
EPPPPPPFR

SEQ ID NO: 797998 - protein, 9 aa, Homo Sapiens
YGAMAIGEM

SEQ ID NO: 797999 - protein, 9 aa, Homo Sapiens
QLQFIPIKK

SEQ ID NO: 798000 - protein, 9 aa, Homo Sapiens
YPLFRIVNI

SEQ ID NO: 798001 - protein, 9 aa, Homo Sapiens
RIILLQRWL

SEQ ID NO: 798002 - protein, 9 aa, Homo Sapiens
YQHYQQQQV

SEQ ID NO: 798003 - protein, 9 aa, Homo Sapiens
NLEGSLKDT

SEQ ID NO: 798004 - protein, 9 aa, Homo Sapiens
CMLAEDMTL

SEQ ID NO: 798005 - protein, 9 aa, Homo Sapiens
MHLSLPYQL

SEQ ID NO: 798006 - protein, 9 aa, Homo Sapiens
RRGGGGAGF

SEQ ID NO: 798007 - protein, 9 aa, Homo Sapiens
SLWLCRAPS

SEQ ID NO: 798008 - protein, 9 aa, Homo Sapiens
YKFEQTVRH

SEQ ID NO: 798009 - protein, 9 aa, Homo Sapiens
RGGGGSPRS

SEQ ID NO: 798010 - protein, 9 aa, Homo Sapiens
KYLHQQLQF

SEQ ID NO: 798011 - protein, 9 aa, Homo Sapiens
YLNWVIRHF

SEQ ID NO: 798012 - protein, 9 aa, Homo Sapiens
ILLPKLIWD

SEQ ID NO: 798013 - protein, 9 aa, Homo Sapiens
VGSLMAAGG

SEQ ID NO: 798014 - protein, 9 aa, Homo Sapiens
FVQGKDGGF

SEQ ID NO: 798015 - protein, 9 aa, Homo Sapiens
EKDIDWGKG

SEQ ID NO: 798016 - protein, 9 aa, Homo Sapiens
HRTKNRRRR

SEQ ID NO: 798017 - protein, 9 aa, Homo Sapiens
ELGSPGGSG

SEQ ID NO: 798018 - protein, 9 aa, Homo Sapiens
THSSRLTLH

SEQ ID NO: 798019 - protein, 9 aa, Homo Sapiens
PIKKILLPK

SEQ ID NO: 798020 - protein, 9 aa, Homo Sapiens
VLFTAVLLA

SEQ ID NO: 798021 - protein, 9 aa, Homo Sapiens
GGGGSPRST

SEQ ID NO: 798022 - protein, 9 aa, Homo Sapiens
GETAEEQLH

SEQ ID NO: 798023 - protein, 9 aa, Homo Sapiens
KWQQLQQEL

SEQ ID NO: 798024 - protein, 9 aa, Homo Sapiens
PDEDLSHRT

SEQ ID NO: 798025 - protein, 9 aa, Homo Sapiens
AMAIGEMLV

SEQ ID NO: 798026 - protein, 9 aa, Homo Sapiens
DSLHHLSGA

SEQ ID NO: 798027 - protein, 9 aa, Homo Sapiens
EKLCEYKFE

SEQ ID NO: 798028 - protein, 9 aa, Homo Sapiens
FEQTVRHSP

SEQ ID NO: 798029 - protein, 9 aa, Homo Sapiens
LKQVQLEQD

SEQ ID NO: 798030 - protein, 9 aa, Homo Sapiens
RFMKSDHLS

SEQ ID NO: 798031 - protein, 9 aa, Homo Sapiens
PKRFMKSDH

SEQ ID NO: 798032 - protein, 9 aa, Homo Sapiens
IHQELFAPF

SEQ ID NO: 798033 - protein, 9 aa, Homo Sapiens
AVVRTDFDL

SEQ ID NO: 798034 - protein, 9 aa, Homo Sapiens
EIIHVTSPV

SEQ ID NO: 798035 - protein, 9 aa, Homo Sapiens
LEGSLKDTS

SEQ ID NO: 798036 - protein, 9 aa, Homo Sapiens
GSPGGSGGG

SEQ ID NO: 798037 - protein, 9 aa, Homo Sapiens
RKTYSEKWQ

SEQ ID NO: 798038 - protein, 9 aa, Homo Sapiens
LEQDEYAKH

SEQ ID NO: 798039 - protein, 9 aa, Homo Sapiens
KLIWDLSMH

SEQ ID NO: 798040 - protein, 9 aa, Homo Sapiens
PFHIYISPG

SEQ ID NO: 798041 - protein, 9 aa, Homo Sapiens
WAVLRGGGG

SEQ ID NO: 798042 - protein, 9 aa, Homo Sapiens
FSEVIKPGD

SEQ ID NO: 798043 - protein, 9 aa, Homo Sapiens
LFAPFHIYI

SEQ ID NO: 798044 - protein, 9 aa, Homo Sapiens
RGGGGAGFR

SEQ ID NO: 798045 - protein, 9 aa, Homo Sapiens
KFEQTVRHS

SEQ ID NO: 798046 - protein, 9 aa, Homo Sapiens
LWLCRAPSR

SEQ ID NO: 798047 - protein, 9 aa, Homo Sapiens
AEEQLHPAD

SEQ ID NO: 798048 - protein, 9 aa, Homo Sapiens
PADPAWAVL

SEQ ID NO: 798049 - protein, 9 aa, Homo Sapiens
DLTVTYDWN

SEQ ID NO: 798050 - protein, 9 aa, Homo Sapiens
SLPYQLLLY

SEQ ID NO: 798051 - protein, 9 aa, Homo Sapiens
HLSLPYQLL

SEQ ID NO: 798052 - protein, 9 aa, Homo Sapiens
STEGKGEAL

SEQ ID NO: 798053 - protein, 9 aa, Homo Sapiens
GKDGGFKKF

SEQ ID NO: 798054 - protein, 9 aa, Homo Sapiens
DYPLFRIVN

SEQ ID NO: 798055 - protein, 9 aa, Homo Sapiens
ALDSLHHLS

SEQ ID NO: 798056 - protein, 9 aa, Homo Sapiens
PAWAVLRGG

SEQ ID NO: 798057 - protein, 9 aa, Homo Sapiens
IDWGKGCVD

SEQ ID NO: 798058 - protein, 9 aa, Homo Sapiens
GKGCVDKFD

SEQ ID NO: 798059 - protein, 9 aa, Homo Sapiens
TDFDLTVTY

SEQ ID NO: 798060 - protein, 9 aa, Homo Sapiens
AVVSDGIVA

SEQ ID NO: 798061 - protein, 9 aa, Homo Sapiens
LMAVLVLFT

SEQ ID NO: 798062 - protein, 9 aa, Homo Sapiens
EYKFEQTVR

SEQ ID NO: 798063 - protein, 9 aa, Homo Sapiens
GNQFPKIHW

SEQ ID NO: 798064 - protein, 9 aa, Homo Sapiens
SSSSTEMNN

SEQ ID NO: 798065 - protein, 9 aa, Homo Sapiens
LVLFTAVLL

SEQ ID NO: 798066 - protein, 9 aa, Homo Sapiens
RPGSRKYLH

SEQ ID NO: 798067 - protein, 9 aa, Homo Sapiens
LTHSSRLTL

SEQ ID NO: 798068 - protein, 9 aa, Homo Sapiens
LCRAPSRPG

SEQ ID NO: 798069 - protein, 9 aa, Homo Sapiens
STEMNNKNF

SEQ ID NO: 798070 - protein, 9 aa, Homo Sapiens
PECPKRFMK

SEQ ID NO: 798071 - protein, 9 aa, Homo Sapiens
SFSEVIKPG

SEQ ID NO: 798072 - protein, 9 aa, Homo Sapiens
NEPPPPPPF

SEQ ID NO: 798073 - protein, 9 aa, Homo Sapiens
FTAVLLAFH

SEQ ID NO: 798074 - protein, 9 aa, Homo Sapiens
CGSGSTEGK

SEQ ID NO: 798075 - protein, 9 aa, Homo Sapiens
LRGGGGSPR

SEQ ID NO: 798076 - protein, 9 aa, Homo Sapiens
GGGSPRSTQ

SEQ ID NO: 798077 - protein, 9 aa, Homo Sapiens
QLRKTYSEK

SEQ ID NO: 798078 - protein, 9 aa, Homo Sapiens
YSEKWQQLQ

SEQ ID NO: 798079 - protein, 9 aa, Homo Sapiens
FGESSSSST

SEQ ID NO: 798080 - protein, 9 aa, Homo Sapiens
IGEMLVLAP

SEQ ID NO: 798081 - protein, 9 aa, Homo Sapiens
QHYQQQQVA

SEQ ID NO: 798082 - protein, 9 aa, Homo Sapiens
RRRPSSCSR

SEQ ID NO: 798083 - protein, 9 aa, Homo Sapiens
IKKILLPKL

SEQ ID NO: 798084 - protein, 9 aa, Homo Sapiens
SAGLLLGAY

SEQ ID NO: 798085 - protein, 9 aa, Homo Sapiens
PVQQVTHAD

SEQ ID NO: 798086 - protein, 9 aa, Homo Sapiens
YRFVQGKDG

SEQ ID NO: 798087 - protein, 9 aa, Homo Sapiens
DPAWAVLRG

SEQ ID NO: 798088 - protein, 9 aa, Homo Sapiens
LPKLIWDLS

SEQ ID NO: 798089 - protein, 9 aa, Homo Sapiens
PPVGNEGPP

SEQ ID NO: 798090 - protein, 9 aa, Homo Sapiens
IDICSFSEV

SEQ ID NO: 798091 - protein, 9 aa, Homo Sapiens
MAAGGLESA

SEQ ID NO: 798092 - protein, 9 aa, Homo Sapiens
WDLSMHLSL

SEQ ID NO: 798093 - protein, 9 aa, Homo Sapiens
RFVQGKDGG

SEQ ID NO: 798094 - protein, 9 aa, Homo Sapiens
CCSVDHTNS

SEQ ID NO: 798095 - protein, 9 aa, Homo Sapiens
VIKPGDSLL

SEQ ID NO: 798096 - protein, 9 aa, Homo Sapiens
PGGSGGGGG

SEQ ID NO: 798097 - protein, 9 aa, Homo Sapiens
RRPSSCSRS

SEQ ID NO: 798098 - protein, 9 aa, Homo Sapiens
LRVLLCRQH

SEQ ID NO: 798099 - protein, 9 aa, Homo Sapiens
HTNSGKTNL

SEQ ID NO: 798100 - protein, 9 aa, Homo Sapiens
TPRPDTLPT

SEQ ID NO: 798101 - protein, 9 aa, Homo Sapiens
DHTNSGKTN

SEQ ID NO: 798102 - protein, 9 aa, Homo Sapiens
PSSCSRSLW

SEQ ID NO: 798103 - protein, 9 aa, Homo Sapiens
FHIYISPGL

SEQ ID NO: 798104 - protein, 9 aa, Homo Sapiens
PKLIWDLSM

SEQ ID NO: 798105 - protein, 9 aa, Homo Sapiens
PLFRIVNIA

SEQ ID NO: 798106 - protein, 9 aa, Homo Sapiens
IHWEDLHNN

SEQ ID NO: 798107 - protein, 9 aa, Homo Sapiens
VEEEERNQI

SEQ ID NO: 798108 - protein, 9 aa, Homo Sapiens
WGNQFPKIH

SEQ ID NO: 798109 - protein, 9 aa, Homo Sapiens
AIGEMLVLA

SEQ ID NO: 798110 - protein, 9 aa, Homo Sapiens
RAPSRPGSR

SEQ ID NO: 798111 - protein, 9 aa, Homo Sapiens
MLAEDMTLC

SEQ ID NO: 798112 - protein, 9 aa, Homo Sapiens
RTDFDLTVT

SEQ ID NO: 798113 - protein, 9 aa, Homo Sapiens
GEMLVLAPE

SEQ ID NO: 798114 - protein, 9 aa, Homo Sapiens
LSGAENLTE

SEQ ID NO: 798115 - protein, 9 aa, Homo Sapiens
YQQQQVAGG

SEQ ID NO: 798116 - protein, 9 aa, Homo Sapiens
ELFAPFHIY

SEQ ID NO: 798117 - protein, 9 aa, Homo Sapiens
TKNRRRRPS

SEQ ID NO: 798118 - protein, 9 aa, Homo Sapiens
EGSLKDTSH

SEQ ID NO: 798119 - protein, 9 aa, Homo Sapiens
DMTLCVADF

SEQ ID NO: 798120 - protein, 9 aa, Homo Sapiens
AFGESSSSS

SEQ ID NO: 798121 - protein, 9 aa, Homo Sapiens
RLTLHLKSD

SEQ ID NO: 798122 - protein, 9 aa, Homo Sapiens
HSSRLTLHL

SEQ ID NO: 798123 - protein, 9 aa, Homo Sapiens
GKGEALQPQ

SEQ ID NO: 798124 - protein, 9 aa, Homo Sapiens
QVQLEQDEY

SEQ ID NO: 798125 - protein, 9 aa, Homo Sapiens
GCVDKFDII

SEQ ID NO: 798126 - protein, 9 aa, Homo Sapiens
ICSFSEVIK

SEQ ID NO: 798127 - protein, 9 aa, Homo Sapiens
LFRIVNIAD

SEQ ID NO: 798128 - protein, 9 aa, Homo Sapiens
EMSAVVSDG

SEQ ID NO: 798129 - protein, 9 aa, Homo Sapiens
SDGIVAFFT

SEQ ID NO: 798130 - protein, 9 aa, Homo Sapiens
FMKSDHLSK

SEQ ID NO: 798131 - protein, 9 aa, Homo Sapiens
IILLQRWLR

SEQ ID NO: 798132 - protein, 9 aa, Homo Sapiens
KTYSEKWQQ

SEQ ID NO: 798133 - protein, 9 aa, Homo Sapiens
DTSHSDHRS

SEQ ID NO: 798134 - protein, 9 aa, Homo Sapiens
TLCVADFGL

SEQ ID NO: 798135 - protein, 9 aa, Homo Sapiens
QFPKIHWED

SEQ ID NO: 798136 - protein, 9 aa, Homo Sapiens
HQELFAPFH

SEQ ID NO: 798137 - protein, 9 aa, Homo Sapiens
ALLLSAGLL

SEQ ID NO: 798138 - protein, 9 aa, Homo Sapiens
PEDYPLFRI

SEQ ID NO: 798139 - protein, 9 aa, Homo Sapiens
CSVDHTNSG

SEQ ID NO: 798140 - protein, 9 aa, Homo Sapiens
EDYPLFRIV

SEQ ID NO: 798141 - protein, 9 aa, Homo Sapiens
DGGFKKFIR

SEQ ID NO: 798142 - protein, 9 aa, Homo Sapiens
VRTDFDLTV

SEQ ID NO: 798143 - protein, 9 aa, Homo Sapiens
LHPADPAWA

SEQ ID NO: 798144 - protein, 9 aa, Homo Sapiens
KKILLPKLI

SEQ ID NO: 798145 - protein, 9 aa, Homo Sapiens
TNSGKTNLC

SEQ ID NO: 798146 - protein, 9 aa, Homo Sapiens
QGKDGGFKK

SEQ ID NO: 798147 - protein, 9 aa, Homo Sapiens
EALLLSAGL

SEQ ID NO: 798148 - protein, 9 aa, Homo Sapiens
FDLTVTYDW

SEQ ID NO: 798149 - protein, 9 aa, Homo Sapiens
NSGKTNLCQ

SEQ ID NO: 798150 - protein, 9 aa, Homo Sapiens
SQWKDVPVQ

SEQ ID NO: 798151 - protein, 9 aa, Homo Sapiens
TYAVRKLGN

SEQ ID NO: 798152 - protein, 9 aa, Homo Sapiens
NQFPKIHWE

SEQ ID NO: 798153 - protein, 9 aa, Homo Sapiens
GSLKDTSHS

SEQ ID NO: 798154 - protein, 9 aa, Homo Sapiens
LPYQLLLYL

SEQ ID NO: 798155 - protein, 9 aa, Homo Sapiens
DICSFSEVI

SEQ ID NO: 798156 - protein, 9 aa, Homo Sapiens
FRIVNIADG

SEQ ID NO: 798157 - protein, 9 aa, Homo Sapiens
ESRVEEEER

SEQ ID NO: 798158 - protein, 9 aa, Homo Sapiens
MLVLAPEYS

SEQ ID NO: 798159 - protein, 9 aa, Homo Sapiens
RKYLHQQLQ

SEQ ID NO: 798160 - protein, 9 aa, Homo Sapiens
SSSTEMNNK

SEQ ID NO: 798161 - protein, 9 aa, Homo Sapiens
LRKTYSEKW

SEQ ID NO: 798162 - protein, 9 aa, Homo Sapiens
LSAGLLLGA

SEQ ID NO: 798163 - protein, 9 aa, Homo Sapiens
LIWDLSMHL

SEQ ID NO: 798164 - protein, 9 aa, Homo Sapiens
NRRRRPSSC

SEQ ID NO: 798165 - protein, 9 aa, Homo Sapiens
KIHWEDLHN

SEQ ID NO: 798166 - protein, 9 aa, Homo Sapiens
PYQLLLYLN

SEQ ID NO: 798167 - protein, 9 aa, Homo Sapiens
QRWLRVLLC

SEQ ID NO: 798168 - protein, 9 aa, Homo Sapiens
QFIPIKKIL

SEQ ID NO: 798169 - protein, 9 aa, Homo Sapiens
MSAVVSDGI

SEQ ID NO: 798170 - protein, 9 aa, Homo Sapiens
SLMAAGGLE

SEQ ID NO: 798171 - protein, 9 aa, Homo Sapiens
LLMAVLVLF

SEQ ID NO: 798172 - protein, 9 aa, Homo Sapiens
AELGSPGGS

SEQ ID NO: 798173 - protein, 9 aa, Homo Sapiens
DVPVQQVTH

SEQ ID NO: 798174 - protein, 9 aa, Homo Sapiens
PVLETRRAD

SEQ ID NO: 798175 - protein, 9 aa, Homo Sapiens
QDEYAKHIK

SEQ ID NO: 798176 - protein, 9 aa, Homo Sapiens
GAPPVGNEG

SEQ ID NO: 798177 - protein, 9 aa, Homo Sapiens
EGKGEALQP

SEQ ID NO: 798178 - protein, 9 aa, Homo Sapiens
ALTHSSRLT

SEQ ID NO: 798179 - protein, 9 aa, Homo Sapiens
MTYAVRKLG

SEQ ID NO: 798180 - protein, 9 aa, Homo Sapiens
TLHLKSDMS

SEQ ID NO: 798181 - protein, 9 aa, Homo Sapiens
DEDLSHRTK

SEQ ID NO: 798182 - protein, 9 aa, Homo Sapiens
QAHGVTSAP

SEQ ID NO: 798183 - protein, 9 aa, Homo Sapiens
HLLSVCGFR

SEQ ID NO: 798184 - protein, 9 aa, Homo Sapiens
KTFLREKFE

SEQ ID NO: 798185 - protein, 9 aa, Homo Sapiens
PQAHGVTSA

SEQ ID NO: 798186 - protein, 9 aa, Homo Sapiens
HGTNPETTT

SEQ ID NO: 798187 - protein, 9 aa, Homo Sapiens
KKKINHGTN

SEQ ID NO: 798188 - protein, 9 aa, Homo Sapiens
KKINHGTNP

SEQ ID NO: 798189 - protein, 9 aa, Homo Sapiens
TRKTFLREK

SEQ ID NO: 798190 - protein, 9 aa, Homo Sapiens
KINHGTNPE

SEQ ID NO: 798191 - protein, 9 aa, Homo Sapiens
RKTFLREKF

SEQ ID NO: 798192 - protein, 9 aa, Homo Sapiens
APQAHGVTS

SEQ ID NO: 798193 - protein, 9 aa, Homo Sapiens
NHGTNPETT

SEQ ID NO: 798194 - protein, 9 aa, Homo Sapiens
INHGTNPET

SEQ ID NO: 798195 - protein, 9 aa, Homo Sapiens
RHLLSVCGF

SEQ ID NO: 798196 - protein, 9 aa, Homo Sapiens
KKKKINHGT

SEQ ID NO: 798197 - protein, 9 aa, Homo Sapiens
GDKSQSPRS

SEQ ID NO: 798198 - protein, 9 aa, Homo Sapiens
EPPNTTSPE

SEQ ID NO: 798199 - protein, 9 aa, Homo Sapiens
PCCQAACES

SEQ ID NO: 798200 - protein, 9 aa, Homo Sapiens
CCQAACESS

SEQ ID NO: 798201 - protein, 9 aa, Homo Sapiens
QDPLDRCYS

SEQ ID NO: 798202 - protein, 9 aa, Homo Sapiens
KSQSPRSPP

SEQ ID NO: 798203 - protein, 9 aa, Homo Sapiens
CESSACQSG

SEQ ID NO: 798204 - protein, 9 aa, Homo Sapiens
GLGLIIHHR

SEQ ID NO: 798205 - protein, 9 aa, Homo Sapiens
TSPEPPNTT

SEQ ID NO: 798206 - protein, 9 aa, Homo Sapiens
NTTSPESPD

SEQ ID NO: 798207 - protein, 9 aa, Homo Sapiens
QAACESSAC

SEQ ID NO: 798208 - protein, 9 aa, Homo Sapiens
ACESSACQS

SEQ ID NO: 798209 - protein, 9 aa, Homo Sapiens
FLGLGLIIH

SEQ ID NO: 798210 - protein, 9 aa, Homo Sapiens
PNTTSPESP

SEQ ID NO: 798211 - protein, 9 aa, Homo Sapiens
PPQGDKSQS

SEQ ID NO: 798212 - protein, 9 aa, Homo Sapiens
DPLDRCYST

SEQ ID NO: 798213 - protein, 9 aa, Homo Sapiens
PLDRCYSTP

SEQ ID NO: 798214 - protein, 9 aa, Homo Sapiens
SSACQSGCT

SEQ ID NO: 798215 - protein, 9 aa, Homo Sapiens
CQAACESSA

SEQ ID NO: 798216 - protein, 9 aa, Homo Sapiens
DKSQSPRSP

SEQ ID NO: 798217 - protein, 9 aa, Homo Sapiens
SPTSPEPPN

SEQ ID NO: 798218 - protein, 9 aa, Homo Sapiens
LGLGLIIHH

SEQ ID NO: 798219 - protein, 9 aa, Homo Sapiens
PPNTTSPES

SEQ ID NO: 798220 - protein, 9 aa, Homo Sapiens
PEVLQDPLD

SEQ ID NO: 798221 - protein, 9 aa, Homo Sapiens
QGDKSQSPR

SEQ ID NO: 798222 - protein, 9 aa, Homo Sapiens
ESSACQSGC

SEQ ID NO: 798223 - protein, 9 aa, Homo Sapiens
SPEPPNTTS

SEQ ID NO: 798224 - protein, 9 aa, Homo Sapiens
LQDPLDRCY

SEQ ID NO: 798225 - protein, 9 aa, Homo Sapiens
GLIIHHRGQ

SEQ ID NO: 798226 - protein, 9 aa, Homo Sapiens
AACESSACQ

SEQ ID NO: 798227 - protein, 9 aa, Homo Sapiens
IIHHRGQKG

SEQ ID NO: 798228 - protein, 9 aa, Homo Sapiens
IHHRGQKGP

SEQ ID NO: 798229 - protein, 9 aa, Homo Sapiens
PEPPNTTSP

SEQ ID NO: 798230 - protein, 9 aa, Homo Sapiens
PQGDKSQSP

SEQ ID NO: 798231 - protein, 9 aa, Homo Sapiens
PPPQGDKSQ

SEQ ID NO: 798232 - protein, 9 aa, Homo Sapiens
LGLIIHHRG

SEQ ID NO: 798233 - protein, 9 aa, Homo Sapiens
EPEVLQDPL

SEQ ID NO: 798234 - protein, 9 aa, Homo Sapiens
QSPRSPPGK

SEQ ID NO: 798235 - protein, 9 aa, Homo Sapiens
EVLQDPLDR

SEQ ID NO: 798236 - protein, 9 aa, Homo Sapiens
PTSPEPPNT

SEQ ID NO: 798237 - protein, 9 aa, Homo Sapiens
LIIHHRGQK

SEQ ID NO: 798238 - protein, 9 aa, Homo Sapiens
HHRGQKGPR

SEQ ID NO: 798239 - protein, 9 aa, Homo Sapiens
KEPEVLQDP

SEQ ID NO: 798240 - protein, 9 aa, Homo Sapiens
SQSPRSPPG

SEQ ID NO: 798241 - protein, 9 aa, Homo Sapiens
VLQDPLDRC

SEQ ID NO: 798242 - protein, 9 aa, Homo Sapiens
PSPAGAASC

SEQ ID NO: 798243 - protein, 9 aa, Homo Sapiens
GVCPRDFED

SEQ ID NO: 798244 - protein, 9 aa, Homo Sapiens
HPELHLFLQ

SEQ ID NO: 798245 - protein, 9 aa, Homo Sapiens
NGMKCVAGV

SEQ ID NO: 798246 - protein, 9 aa, Homo Sapiens
AGPSPWQRH

SEQ ID NO: 798247 - protein, 9 aa, Homo Sapiens
RGGRPFHCA

SEQ ID NO: 798248 - protein, 9 aa, Homo Sapiens
RRKIMDQWR

SEQ ID NO: 798249 - protein, 9 aa, Homo Sapiens
GGRPFHCAD

SEQ ID NO: 798250 - protein, 9 aa, Homo Sapiens
VLAYVDYLS

SEQ ID NO: 798251 - protein, 9 aa, Homo Sapiens
RLQKDLTTE

SEQ ID NO: 798252 - protein, 9 aa, Homo Sapiens
KSTREEKEC

SEQ ID NO: 798253 - protein, 9 aa, Homo Sapiens
MDQWRDMHN

SEQ ID NO: 798254 - protein, 9 aa, Homo Sapiens
GMKCVAGVC

SEQ ID NO: 798255 - protein, 9 aa, Homo Sapiens
PPPGTLGMA

SEQ ID NO: 798256 - protein, 9 aa, Homo Sapiens
AGVCPRDFE

SEQ ID NO: 798257 - protein, 9 aa, Homo Sapiens
LMALNGNLS

SEQ ID NO: 798258 - protein, 9 aa, Homo Sapiens
VTVLPLLNM

SEQ ID NO: 798259 - protein, 9 aa, Homo Sapiens
WRTCGPGSS

SEQ ID NO: 798260 - protein, 9 aa, Homo Sapiens
KCVAGVCPR

SEQ ID NO: 798261 - protein, 9 aa, Homo Sapiens
KTKLPSPGL

SEQ ID NO: 798262 - protein, 9 aa, Homo Sapiens
TVLPLLNMA

SEQ ID NO: 798263 - protein, 9 aa, Homo Sapiens
SCWPWAYTA

SEQ ID NO: 798264 - protein, 9 aa, Homo Sapiens
ALSCTCGTW

SEQ ID NO: 798265 - protein, 9 aa, Homo Sapiens
NVLRSPFQA

SEQ ID NO: 798266 - protein, 9 aa, Homo Sapiens
VRTRIPIVV

SEQ ID NO: 798267 - protein, 9 aa, Homo Sapiens
QWRDMHNAE

SEQ ID NO: 798268 - protein, 9 aa, Homo Sapiens
LRSPRDAIS

SEQ ID NO: 798269 - protein, 9 aa, Homo Sapiens
RHRRDEEEW

SEQ ID NO: 798270 - protein, 9 aa, Homo Sapiens
SGRGVSEAG

SEQ ID NO: 798271 - protein, 9 aa, Homo Sapiens
LQHVDGFDS

SEQ ID NO: 798272 - protein, 9 aa, Homo Sapiens
SCSCWPWAY

SEQ ID NO: 798273 - protein, 9 aa, Homo Sapiens
WRDMHNAEI

SEQ ID NO: 798274 - protein, 9 aa, Homo Sapiens
LLPTAAANS

SEQ ID NO: 798275 - protein, 9 aa, Homo Sapiens
TNQVDEELD

SEQ ID NO: 798276 - protein, 9 aa, Homo Sapiens
WRDDIRPGD

SEQ ID NO: 798277 - protein, 9 aa, Homo Sapiens
RELLAEKGP

SEQ ID NO: 798278 - protein, 9 aa, Homo Sapiens
LLLQLCVCA

SEQ ID NO: 798279 - protein, 9 aa, Homo Sapiens
QVFTFTWRD

SEQ ID NO: 798280 - protein, 9 aa, Homo Sapiens
RRDEEEWLL

SEQ ID NO: 798281 - protein, 9 aa, Homo Sapiens
GRLCGYRLQ

SEQ ID NO: 798282 - protein, 9 aa, Homo Sapiens
CVCASCSCW

SEQ ID NO: 798283 - protein, 9 aa, Homo Sapiens
SPTTFLKTK

SEQ ID NO: 798284 - protein, 9 aa, Homo Sapiens
EEEWLLGRC

SEQ ID NO: 798285 - protein, 9 aa, Homo Sapiens
LRSPFQAQC

SEQ ID NO: 798286 - protein, 9 aa, Homo Sapiens
TYHPGDPVF

SEQ ID NO: 798287 - protein, 9 aa, Homo Sapiens
VTNQVDEEL

SEQ ID NO: 798288 - protein, 9 aa, Homo Sapiens
AYVDYLSHL

SEQ ID NO: 798289 - protein, 9 aa, Homo Sapiens
AVTNQVDEE

SEQ ID NO: 798290 - protein, 9 aa, Homo Sapiens
GLEKPRDMG

SEQ ID NO: 798291 - protein, 9 aa, Homo Sapiens
ECWIHSKYE

SEQ ID NO: 798292 - protein, 9 aa, Homo Sapiens
PRGGRPFHC

SEQ ID NO: 798293 - protein, 9 aa, Homo Sapiens
GYRLQKDLT

SEQ ID NO: 798294 - protein, 9 aa, Homo Sapiens
GQPPPGTLG

SEQ ID NO: 798295 - protein, 9 aa, Homo Sapiens
LQLCVCASC

SEQ ID NO: 798296 - protein, 9 aa, Homo Sapiens
SLVSPIEKD

SEQ ID NO: 798297 - protein, 9 aa, Homo Sapiens
PFHCADCGM

SEQ ID NO: 798298 - protein, 9 aa, Homo Sapiens
HGKKVQISF

SEQ ID NO: 798299 - protein, 9 aa, Homo Sapiens
LGMAPHSMA

SEQ ID NO: 798300 - protein, 9 aa, Homo Sapiens
ASCSCWPWA

SEQ ID NO: 798301 - protein, 9 aa, Homo Sapiens
HHHHHQGGE

SEQ ID NO: 798302 - protein, 9 aa, Homo Sapiens
PGSSALSCT

SEQ ID NO: 798303 - protein, 9 aa, Homo Sapiens
LHLFLQHVD

SEQ ID NO: 798304 - protein, 9 aa, Homo Sapiens
QKDLTTELS

SEQ ID NO: 798305 - protein, 9 aa, Homo Sapiens
SPAGAASCG

SEQ ID NO: 798306 - protein, 9 aa, Homo Sapiens
GKKVQISFG

SEQ ID NO: 798307 - protein, 9 aa, Homo Sapiens
IFLMALNGN

SEQ ID NO: 798308 - protein, 9 aa, Homo Sapiens
LVAAPLLPT

SEQ ID NO: 798309 - protein, 9 aa, Homo Sapiens
GPRGGRPFH

SEQ ID NO: 798310 - protein, 9 aa, Homo Sapiens
LAYVDYLSH

SEQ ID NO: 798311 - protein, 9 aa, Homo Sapiens
WPSPAGAAS

SEQ ID NO: 798312 - protein, 9 aa, Homo Sapiens
DNCLVTVLP

SEQ ID NO: 798313 - protein, 9 aa, Homo Sapiens
HHHHHHQGG

SEQ ID NO: 798314 - protein, 9 aa, Homo Sapiens
HQGGEPPGD

SEQ ID NO: 798315 - protein, 9 aa, Homo Sapiens
DSGRGVSEA

SEQ ID NO: 798316 - protein, 9 aa, Homo Sapiens
PSPTTFLKT

SEQ ID NO: 798317 - protein, 9 aa, Homo Sapiens
TAAGPSPWQ

SEQ ID NO: 798318 - protein, 9 aa, Homo Sapiens
EDFTYHPGD

SEQ ID NO: 798319 - protein, 9 aa, Homo Sapiens
GTLGMAPHS

SEQ ID NO: 798320 - protein, 9 aa, Homo Sapiens
ALNGNLSMI

SEQ ID NO: 798321 - protein, 9 aa, Homo Sapiens
IVVLLRPFI

SEQ ID NO: 798322 - protein, 9 aa, Homo Sapiens
CWPWAYTAA

SEQ ID NO: 798323 - protein, 9 aa, Homo Sapiens
RDDIRPGDP

SEQ ID NO: 798324 - protein, 9 aa, Homo Sapiens
ELHLFLQHV

SEQ ID NO: 798325 - protein, 9 aa, Homo Sapiens
NCLVTVLPL

SEQ ID NO: 798326 - protein, 9 aa, Homo Sapiens
EYVLAYVDY

SEQ ID NO: 798327 - protein, 9 aa, Homo Sapiens
VAGVCPRDF

SEQ ID NO: 798328 - protein, 9 aa, Homo Sapiens
LFLQHVDGF

SEQ ID NO: 798329 - protein, 9 aa, Homo Sapiens
CTCGTWPSP

SEQ ID NO: 798330 - protein, 9 aa, Homo Sapiens
QISFGKAVM

SEQ ID NO: 798331 - protein, 9 aa, Homo Sapiens
KIMDQWRDM

SEQ ID NO: 798332 - protein, 9 aa, Homo Sapiens
TWRDDIRPG

SEQ ID NO: 798333 - protein, 9 aa, Homo Sapiens
PPGTLGMAP

SEQ ID NO: 798334 - protein, 9 aa, Homo Sapiens
RPFHCADCG

SEQ ID NO: 798335 - protein, 9 aa, Homo Sapiens
DAISPRYEQ

SEQ ID NO: 798336 - protein, 9 aa, Homo Sapiens
VFTFTWRDD

SEQ ID NO: 798337 - protein, 9 aa, Homo Sapiens
VSWAVTNQV

SEQ ID NO: 798338 - protein, 9 aa, Homo Sapiens
KECWIHSKY

SEQ ID NO: 798339 - protein, 9 aa, Homo Sapiens
PTTFLKTKL

SEQ ID NO: 798340 - protein, 9 aa, Homo Sapiens
HRRDEEEWL

SEQ ID NO: 798341 - protein, 9 aa, Homo Sapiens
GVSEAGDSD

SEQ ID NO: 798342 - protein, 9 aa, Homo Sapiens
LIQRLKAET

SEQ ID NO: 798343 - protein, 9 aa, Homo Sapiens
DFTYHPGDP

SEQ ID NO: 798344 - protein, 9 aa, Homo Sapiens
KVQISFGKA

SEQ ID NO: 798345 - protein, 9 aa, Homo Sapiens
QVDEELDSA

SEQ ID NO: 798346 - protein, 9 aa, Homo Sapiens
IQRLKAETE

SEQ ID NO: 798347 - protein, 9 aa, Homo Sapiens
LAEKGPEVL

SEQ ID NO: 798348 - protein, 9 aa, Homo Sapiens
EKECWIHSK

SEQ ID NO: 798349 - protein, 9 aa, Homo Sapiens
CGYRLQKDL

SEQ ID NO: 798350 - protein, 9 aa, Homo Sapiens
PGTLGMAPH

SEQ ID NO: 798351 - protein, 9 aa, Homo Sapiens
PTAAANSPP

SEQ ID NO: 798352 - protein, 9 aa, Homo Sapiens
RTCGPGSSA

SEQ ID NO: 798353 - protein, 9 aa, Homo Sapiens
VSEAGDSDY

SEQ ID NO: 798354 - protein, 9 aa, Homo Sapiens
LNGNLSMIL

SEQ ID NO: 798355 - protein, 9 aa, Homo Sapiens
FTWRDDIRP

SEQ ID NO: 798356 - protein, 9 aa, Homo Sapiens
EWLLGRCAC

SEQ ID NO: 798357 - protein, 9 aa, Homo Sapiens
IVRTRIPIV

SEQ ID NO: 798358 - protein, 9 aa, Homo Sapiens
PWAYTAAGP

SEQ ID NO: 798359 - protein, 9 aa, Homo Sapiens
SRELLAEKG

SEQ ID NO: 798360 - protein, 9 aa, Homo Sapiens
SPWQRHWRT

SEQ ID NO: 798361 - protein, 9 aa, Homo Sapiens
LCGYRLQKD

SEQ ID NO: 798362 - protein, 9 aa, Homo Sapiens
PRDAISPRY

SEQ ID NO: 798363 - protein, 9 aa, Homo Sapiens
TFTWRDDIR

SEQ ID NO: 798364 - protein, 9 aa, Homo Sapiens
SPRDAISPR

SEQ ID NO: 798365 - protein, 9 aa, Homo Sapiens
CRNVLRSPF

SEQ ID NO: 798366 - protein, 9 aa, Homo Sapiens
YVLAYVDYL

SEQ ID NO: 798367 - protein, 9 aa, Homo Sapiens
FTYHPGDPV

SEQ ID NO: 798368 - protein, 9 aa, Homo Sapiens
CVAGVCPRD

SEQ ID NO: 798369 - protein, 9 aa, Homo Sapiens
GTWPSPAGA

SEQ ID NO: 798370 - protein, 9 aa, Homo Sapiens
FHCADCGMV

SEQ ID NO: 798371 - protein, 9 aa, Homo Sapiens
RKIMDQWRD

SEQ ID NO: 798372 - protein, 9 aa, Homo Sapiens
TRIPIVVLL

SEQ ID NO: 798373 - protein, 9 aa, Homo Sapiens
REEKECWIH

SEQ ID NO: 798374 - protein, 9 aa, Homo Sapiens
HHQGGEPPG

SEQ ID NO: 798375 - protein, 9 aa, Homo Sapiens
SPFQAQCGH

SEQ ID NO: 798376 - protein, 9 aa, Homo Sapiens
HHHHQGGEP

SEQ ID NO: 798377 - protein, 9 aa, Homo Sapiens
LMRGLEKPR

SEQ ID NO: 798378 - protein, 9 aa, Homo Sapiens
TTFLKTKLP

SEQ ID NO: 798379 - protein, 9 aa, Homo Sapiens
AEKGPEVLQ

SEQ ID NO: 798380 - protein, 9 aa, Homo Sapiens
IMDQWRDMH

SEQ ID NO: 798381 - protein, 9 aa, Homo Sapiens
RTRIPIVVL

SEQ ID NO: 798382 - protein, 9 aa, Homo Sapiens
CLVTVLPLL

SEQ ID NO: 798383 - protein, 9 aa, Homo Sapiens
ETEHAKAQR

SEQ ID NO: 798384 - protein, 9 aa, Homo Sapiens
LCVCASCSC

SEQ ID NO: 798385 - protein, 9 aa, Homo Sapiens
PELHLFLQH

SEQ ID NO: 798386 - protein, 9 aa, Homo Sapiens
RDMGFTRLM

SEQ ID NO: 798387 - protein, 9 aa, Homo Sapiens
SLKDSGRGV

SEQ ID NO: 798388 - protein, 9 aa, Homo Sapiens
MRGLEKPRD

SEQ ID NO: 798389 - protein, 9 aa, Homo Sapiens
SACRNVLRS

SEQ ID NO: 798390 - protein, 9 aa, Homo Sapiens
LIFLMALNG

SEQ ID NO: 798391 - protein, 9 aa, Homo Sapiens
SEDFTYHPG

SEQ ID NO: 798392 - protein, 9 aa, Homo Sapiens
KKVQISFGK

SEQ ID NO: 798393 - protein, 9 aa, Homo Sapiens
LKDSGRGVS

SEQ ID NO: 798394 - protein, 9 aa, Homo Sapiens
SCTCGTWPS

SEQ ID NO: 798395 - protein, 9 aa, Homo Sapiens
GPSPWQRHW

SEQ ID NO: 798396 - protein, 9 aa, Homo Sapiens
GSSALSCTC

SEQ ID NO: 798397 - protein, 9 aa, Homo Sapiens
SPIEKDLQE

SEQ ID NO: 798398 - protein, 9 aa, Homo Sapiens
VLRSPFQAQ

SEQ ID NO: 798399 - protein, 9 aa, Homo Sapiens
HLFLQHVDG

SEQ ID NO: 798400 - protein, 9 aa, Homo Sapiens
TAAANSPPG

SEQ ID NO: 798401 - protein, 9 aa, Homo Sapiens
SSALSCTCG

SEQ ID NO: 798402 - protein, 9 aa, Homo Sapiens
EKPRDMGFT

SEQ ID NO: 798403 - protein, 9 aa, Homo Sapiens
VDYLSHLNE

SEQ ID NO: 798404 - protein, 9 aa, Homo Sapiens
RHWRTCGPG

SEQ ID NO: 798405 - protein, 9 aa, Homo Sapiens
PRDMGFTRL

SEQ ID NO: 798406 - protein, 9 aa, Homo Sapiens
YTAAGPSPW

SEQ ID NO: 798407 - protein, 9 aa, Homo Sapiens
WLLGRCACR

SEQ ID NO: 798408 - protein, 9 aa, Homo Sapiens
MKCVAGVCP

SEQ ID NO: 798409 - protein, 9 aa, Homo Sapiens
SWAVTNQVD

SEQ ID NO: 798410 - protein, 9 aa, Homo Sapiens
LVTVLPLLN

SEQ ID NO: 798411 - protein, 9 aa, Homo Sapiens
HHHQGGEPP

SEQ ID NO: 798412 - protein, 9 aa, Homo Sapiens
VCASCSCWP

SEQ ID NO: 798413 - protein, 9 aa, Homo Sapiens
WQRHWRTCG

SEQ ID NO: 798414 - protein, 9 aa, Homo Sapiens
FLQHVDGFD

SEQ ID NO: 798415 - protein, 9 aa, Homo Sapiens
VCPRDFEDY

SEQ ID NO: 798416 - protein, 9 aa, Homo Sapiens
NQVDEELDS

SEQ ID NO: 798417 - protein, 9 aa, Homo Sapiens
AAPLLPTAA

SEQ ID NO: 798418 - protein, 9 aa, Homo Sapiens
RLCGYRLQK

SEQ ID NO: 798419 - protein, 9 aa, Homo Sapiens
ACRNVLRSP

SEQ ID NO: 798420 - protein, 9 aa, Homo Sapiens
HCADCGMVF

SEQ ID NO: 798421 - protein, 9 aa, Homo Sapiens
LSCTCGTWP

SEQ ID NO: 798422 - protein, 9 aa, Homo Sapiens
CASCSCWPW

SEQ ID NO: 798423 - protein, 9 aa, Homo Sapiens
RDMHNAEIS

SEQ ID NO: 798424 - protein, 9 aa, Homo Sapiens
GPGSSALSC

SEQ ID NO: 798425 - protein, 9 aa, Homo Sapiens
MALNGNLSM

SEQ ID NO: 798426 - protein, 9 aa, Homo Sapiens
PSPWQRHWR

SEQ ID NO: 798427 - protein, 9 aa, Homo Sapiens
IPEYVLAYV

SEQ ID NO: 798428 - protein, 9 aa, Homo Sapiens
CSCWPWAYT

SEQ ID NO: 798429 - protein, 9 aa, Homo Sapiens
LLQLCVCAS

SEQ ID NO: 798430 - protein, 9 aa, Homo Sapiens
GRGVSEAGD

SEQ ID NO: 798431 - protein, 9 aa, Homo Sapiens
YRLQKDLTT

SEQ ID NO: 798432 - protein, 9 aa, Homo Sapiens
LPTAAANSP

SEQ ID NO: 798433 - protein, 9 aa, Homo Sapiens
RGLEKPRDM

SEQ ID NO: 798434 - protein, 9 aa, Homo Sapiens
TCGTWPSPA

SEQ ID NO: 798435 - protein, 9 aa, Homo Sapiens
CGTWPSPAG

SEQ ID NO: 798436 - protein, 9 aa, Homo Sapiens
WLRSPRDAI

SEQ ID NO: 798437 - protein, 9 aa, Homo Sapiens
QRLKAETEH

SEQ ID NO: 798438 - protein, 9 aa, Homo Sapiens
QLCVCASCS

SEQ ID NO: 798439 - protein, 9 aa, Homo Sapiens
TCGPGSSAL

SEQ ID NO: 798440 - protein, 9 aa, Homo Sapiens
WPWAYTAAG

SEQ ID NO: 798441 - protein, 9 aa, Homo Sapiens
EEKECWIHS

SEQ ID NO: 798442 - protein, 9 aa, Homo Sapiens
VAAPLLPTA

SEQ ID NO: 798443 - protein, 9 aa, Homo Sapiens
SGQPPPGTL

SEQ ID NO: 798444 - protein, 9 aa, Homo Sapiens
TREEKECWI

SEQ ID NO: 798445 - protein, 9 aa, Homo Sapiens
GDNCLVTVL

SEQ ID NO: 798446 - protein, 9 aa, Homo Sapiens
SSLVSPIEK

SEQ ID NO: 798447 - protein, 9 aa, Homo Sapiens
KAETEHAKA

SEQ ID NO: 798448 - protein, 9 aa, Homo Sapiens
RDEEEWLLG

SEQ ID NO: 798449 - protein, 9 aa, Homo Sapiens
RNVLRSPFQ

SEQ ID NO: 798450 - protein, 9 aa, Homo Sapiens
TFLKTKLPS

SEQ ID NO: 798451 - protein, 9 aa, Homo Sapiens
QGGEPPGDT

SEQ ID NO: 798452 - protein, 9 aa, Homo Sapiens
VVLLRPFIQ

SEQ ID NO: 798453 - protein, 9 aa, Homo Sapiens
VSPIEKDLQ

SEQ ID NO: 798454 - protein, 9 aa, Homo Sapiens
DQWRDMHNA

SEQ ID NO: 798455 - protein, 9 aa, Homo Sapiens
NGNLSMILL

SEQ ID NO: 798456 - protein, 9 aa, Homo Sapiens
AISPRYEQD

SEQ ID NO: 798457 - protein, 9 aa, Homo Sapiens
TLGMAPHSM

SEQ ID NO: 798458 - protein, 9 aa, Homo Sapiens
KAHGKKVQI

SEQ ID NO: 798459 - protein, 9 aa, Homo Sapiens
LEKPRDMGF

SEQ ID NO: 798460 - protein, 9 aa, Homo Sapiens
GRPFHCADC

SEQ ID NO: 798461 - protein, 9 aa, Homo Sapiens
IPIVVLLRP

SEQ ID NO: 798462 - protein, 9 aa, Homo Sapiens
NGDNCLVTV

SEQ ID NO: 798463 - protein, 9 aa, Homo Sapiens
FLKTKLPSP

SEQ ID NO: 798464 - protein, 9 aa, Homo Sapiens
SHSSLVSPI

SEQ ID NO: 798465 - protein, 9 aa, Homo Sapiens
ISPRYEQDS

SEQ ID NO: 798466 - protein, 9 aa, Homo Sapiens
APLLPTAAA

SEQ ID NO: 798467 - protein, 9 aa, Homo Sapiens
SALSCTCGT

SEQ ID NO: 798468 - protein, 9 aa, Homo Sapiens
PIEKDLQEI

SEQ ID NO: 798469 - protein, 9 aa, Homo Sapiens
TKLPSPGLS

SEQ ID NO: 798470 - protein, 9 aa, Homo Sapiens
DDIRPGDPQ

SEQ ID NO: 798471 - protein, 9 aa, Homo Sapiens
WAVTNQVDE

SEQ ID NO: 798472 - protein, 9 aa, Homo Sapiens
KDSGRGVSE

SEQ ID NO: 798473 - protein, 9 aa, Homo Sapiens
SVSWAVTNQ

SEQ ID NO: 798474 - protein, 9 aa, Homo Sapiens
LLAEKGPEV

SEQ ID NO: 798475 - protein, 9 aa, Homo Sapiens
FTFTWRDDI

SEQ ID NO: 798476 - protein, 9 aa, Homo Sapiens
HPGDPVFSF

SEQ ID NO: 798477 - protein, 9 aa, Homo Sapiens
RSPRDAISP

SEQ ID NO: 798478 - protein, 9 aa, Homo Sapiens
FLMALNGNL

SEQ ID NO: 798479 - protein, 9 aa, Homo Sapiens
RDAISPRYE

SEQ ID NO: 798480 - protein, 9 aa, Homo Sapiens
AAGPSPWQR

SEQ ID NO: 798481 - protein, 9 aa, Homo Sapiens
QRHWRTCGP

SEQ ID NO: 798482 - protein, 9 aa, Homo Sapiens
LKTKLPSPG

SEQ ID NO: 798483 - protein, 9 aa, Homo Sapiens
EEWLLGRCA

SEQ ID NO: 798484 - protein, 9 aa, Homo Sapiens
CGPGSSALS

SEQ ID NO: 798485 - protein, 9 aa, Homo Sapiens
PWQRHWRTC

SEQ ID NO: 798486 - protein, 9 aa, Homo Sapiens
ELLAEKGPE

SEQ ID NO: 798487 - protein, 9 aa, Homo Sapiens
TEHAKAQRA

SEQ ID NO: 798488 - protein, 9 aa, Homo Sapiens
PEYVLAYVD

SEQ ID NO: 798489 - protein, 9 aa, Homo Sapiens
YVDYLSHLN

SEQ ID NO: 798490 - protein, 9 aa, Homo Sapiens
VKAHGKKVQ

SEQ ID NO: 798491 - protein, 9 aa, Homo Sapiens
LQKDLTTEL

SEQ ID NO: 798492 - protein, 9 aa, Homo Sapiens
CWIHSKYEE

SEQ ID NO: 798493 - protein, 9 aa, Homo Sapiens
WAYTAAGPS

SEQ ID NO: 798494 - protein, 9 aa, Homo Sapiens
RIPIVVLLR

SEQ ID NO: 798495 - protein, 9 aa, Homo Sapiens
VQISFGKAV

SEQ ID NO: 798496 - protein, 9 aa, Homo Sapiens
HSSLVSPIE

SEQ ID NO: 798497 - protein, 9 aa, Homo Sapiens
RLKAETEHA

SEQ ID NO: 798498 - protein, 9 aa, Homo Sapiens
PLLPTAAAN

SEQ ID NO: 798499 - protein, 9 aa, Homo Sapiens
ASHSSLVSP

SEQ ID NO: 798500 - protein, 9 aa, Homo Sapiens
QPPPGTLGM

SEQ ID NO: 798501 - protein, 9 aa, Homo Sapiens
LKAETEHAK

SEQ ID NO: 798502 - protein, 9 aa, Homo Sapiens
TWPSPAGAA

SEQ ID NO: 798503 - protein, 9 aa, Homo Sapiens
DEEEWLLGR

SEQ ID NO: 798504 - protein, 9 aa, Homo Sapiens
ASEDFTYHP

SEQ ID NO: 798505 - protein, 9 aa, Homo Sapiens
KPRDMGFTR

SEQ ID NO: 798506 - protein, 9 aa, Homo Sapiens
PIVVLLRPF

SEQ ID NO: 798507 - protein, 9 aa, Homo Sapiens
YHPGDPVFS

SEQ ID NO: 798508 - protein, 9 aa, Homo Sapiens
AYTAAGPSP

SEQ ID NO: 798509 - protein, 9 aa, Homo Sapiens
STREEKECW

SEQ ID NO: 798510 - protein, 9 aa, Homo Sapiens
LVSPIEKDL

SEQ ID NO: 798511 - protein, 9 aa, Homo Sapiens
AHGKKVQIS

SEQ ID NO: 798512 - protein, 9 aa, Homo Sapiens
AASEDFTYH

SEQ ID NO: 798513 - protein, 9 aa, Homo Sapiens
AETEHAKAQ

SEQ ID NO: 798514 - protein, 9 aa, Homo Sapiens
VLPLLNMAY

SEQ ID NO: 798515 - protein, 9 aa, Homo Sapiens
RSPFQAQCG

SEQ ID NO: 798516 - protein, 9 aa, Homo Sapiens
VLIFLMALN

SEQ ID NO: 798517 - protein, 9 aa, Homo Sapiens
QHVDGFDSV

SEQ ID NO: 798518 - protein, 9 aa, Homo Sapiens
PAGAASCGS

SEQ ID NO: 798519 - protein, 9 aa, Homo Sapiens
HWRTCGPGS

SEQ ID NO: 798520 - protein, 9 aa, Homo Sapiens
RGVSEAGDS

SEQ ID NO: 798521 - protein, 9 aa, Homo Sapiens
VCLLKSDNK

SEQ ID NO: 798522 - protein, 9 aa, Homo Sapiens
GRLSQRQTE

SEQ ID NO: 798523 - protein, 9 aa, Homo Sapiens
MTELFLVGL

SEQ ID NO: 798524 - protein, 9 aa, Homo Sapiens
NRRAPEATP

SEQ ID NO: 798525 - protein, 9 aa, Homo Sapiens
AFNCRSPLT

SEQ ID NO: 798526 - protein, 9 aa, Homo Sapiens
RGHACVRPA

SEQ ID NO: 798527 - protein, 9 aa, Homo Sapiens
VRRMSLYPG

SEQ ID NO: 798528 - protein, 9 aa, Homo Sapiens
RRGHACVRP

SEQ ID NO: 798529 - protein, 9 aa, Homo Sapiens
RISHISLQK

SEQ ID NO: 798530 - protein, 9 aa, Homo Sapiens
RRMSLYPGL

SEQ ID NO: 798531 - protein, 9 aa, Homo Sapiens
DDAKWYCKD

SEQ ID NO: 798532 - protein, 9 aa, Homo Sapiens
LRAVSGEPG

SEQ ID NO: 798533 - protein, 9 aa, Homo Sapiens
TSSASKGHA

SEQ ID NO: 798534 - protein, 9 aa, Homo Sapiens
EGQRGLRAV

SEQ ID NO: 798535 - protein, 9 aa, Homo Sapiens
EPEVLQDSQ

SEQ ID NO: 798536 - protein, 9 aa, Homo Sapiens
LTNKVVSVN

SEQ ID NO: 798537 - protein, 9 aa, Homo Sapiens
DAKWYCKDP

SEQ ID NO: 798538 - protein, 9 aa, Homo Sapiens
LKSDNKVVD

SEQ ID NO: 798539 - protein, 9 aa, Homo Sapiens
SVNGLGVFV

SEQ ID NO: 798540 - protein, 9 aa, Homo Sapiens
EPLKMAGVS

SEQ ID NO: 798541 - protein, 9 aa, Homo Sapiens
KGHATPLPV

SEQ ID NO: 798542 - protein, 9 aa, Homo Sapiens
VECGKAFNC

SEQ ID NO: 798543 - protein, 9 aa, Homo Sapiens
EVCLLKSDN

SEQ ID NO: 798544 - protein, 9 aa, Homo Sapiens
SREVVRRMS

SEQ ID NO: 798545 - protein, 9 aa, Homo Sapiens
PLNRRAPEA

SEQ ID NO: 798546 - protein, 9 aa, Homo Sapiens
SAMTELFLV

SEQ ID NO: 798547 - protein, 9 aa, Homo Sapiens
VAVSELVPR

SEQ ID NO: 798548 - protein, 9 aa, Homo Sapiens
WYCKDPSPS

SEQ ID NO: 798549 - protein, 9 aa, Homo Sapiens
LNRRAPEAT

SEQ ID NO: 798550 - protein, 9 aa, Homo Sapiens
LLKSDNKVV

SEQ ID NO: 798551 - protein, 9 aa, Homo Sapiens
NCRSPLTRH

SEQ ID NO: 798552 - protein, 9 aa, Homo Sapiens
HACVRPACA

SEQ ID NO: 798553 - protein, 9 aa, Homo Sapiens
LFLVGLSQY

SEQ ID NO: 798554 - protein, 9 aa, Homo Sapiens
LQKGFHTNI

SEQ ID NO: 798555 - protein, 9 aa, Homo Sapiens
REAGRLSQR

SEQ ID NO: 798556 - protein, 9 aa, Homo Sapiens
GTGVAVSEL

SEQ ID NO: 798557 - protein, 9 aa, Homo Sapiens
YDDAKWYCK

SEQ ID NO: 798558 - protein, 9 aa, Homo Sapiens
MSLYPGLEG

SEQ ID NO: 798559 - protein, 9 aa, Homo Sapiens
HISLQKGFH

SEQ ID NO: 798560 - protein, 9 aa, Homo Sapiens
GHACVRPAC

SEQ ID NO: 798561 - protein, 9 aa, Homo Sapiens
CRSPLTRHQ

SEQ ID NO: 798562 - protein, 9 aa, Homo Sapiens
LKDGTMLCE

SEQ ID NO: 798563 - protein, 9 aa, Homo Sapiens
LKMAGVSLV

SEQ ID NO: 798564 - protein, 9 aa, Homo Sapiens
NWLKDGTML

SEQ ID NO: 798565 - protein, 9 aa, Homo Sapiens
DGTMLCELI

SEQ ID NO: 798566 - protein, 9 aa, Homo Sapiens
PLKMAGVSL

SEQ ID NO: 798567 - protein, 9 aa, Homo Sapiens
RVGGTGVAV

SEQ ID NO: 798568 - protein, 9 aa, Homo Sapiens
GQRGLRAVS

SEQ ID NO: 798569 - protein, 9 aa, Homo Sapiens
LRREAGRLS

SEQ ID NO: 798570 - protein, 9 aa, Homo Sapiens
GKAFNCRSP

SEQ ID NO: 798571 - protein, 9 aa, Homo Sapiens
RNYSAMTEL

SEQ ID NO: 798572 - protein, 9 aa, Homo Sapiens
SSASKGHAT

SEQ ID NO: 798573 - protein, 9 aa, Homo Sapiens
QEQLRREAG

SEQ ID NO: 798574 - protein, 9 aa, Homo Sapiens
VNGLGVFVR

SEQ ID NO: 798575 - protein, 9 aa, Homo Sapiens
RMSLYPGLE

SEQ ID NO: 798576 - protein, 9 aa, Homo Sapiens
VQEVMRRGH

SEQ ID NO: 798577 - protein, 9 aa, Homo Sapiens
WLKDGTMLC

SEQ ID NO: 798578 - protein, 9 aa, Homo Sapiens
EVMRRGHAC

SEQ ID NO: 798579 - protein, 9 aa, Homo Sapiens
KWYCKDPSP

SEQ ID NO: 798580 - protein, 9 aa, Homo Sapiens
AMTELFLVG

SEQ ID NO: 798581 - protein, 9 aa, Homo Sapiens
DTSSASKGH

SEQ ID NO: 798582 - protein, 9 aa, Homo Sapiens
KMAGVSLVG

SEQ ID NO: 798583 - protein, 9 aa, Homo Sapiens
KDGTMLCEL

SEQ ID NO: 798584 - protein, 9 aa, Homo Sapiens
AGVSLVGRV

SEQ ID NO: 798585 - protein, 9 aa, Homo Sapiens
ISHISLQKG

SEQ ID NO: 798586 - protein, 9 aa, Homo Sapiens
CLLKSDNKV

SEQ ID NO: 798587 - protein, 9 aa, Homo Sapiens
LQDSQDRCY

SEQ ID NO: 798588 - protein, 9 aa, Homo Sapiens
PRVGGTGVA

SEQ ID NO: 798589 - protein, 9 aa, Homo Sapiens
SDNKVVDNQ

SEQ ID NO: 798590 - protein, 9 aa, Homo Sapiens
SASKGHATP

SEQ ID NO: 798591 - protein, 9 aa, Homo Sapiens
MRRGHACVR

SEQ ID NO: 798592 - protein, 9 aa, Homo Sapiens
KAFNCRSPL

SEQ ID NO: 798593 - protein, 9 aa, Homo Sapiens
QEVMRRGHA

SEQ ID NO: 798594 - protein, 9 aa, Homo Sapiens
AEKEPLKMA

SEQ ID NO: 798595 - protein, 9 aa, Homo Sapiens
ASKGHATPL

SEQ ID NO: 798596 - protein, 9 aa, Homo Sapiens
QRGLRAVSG

SEQ ID NO: 798597 - protein, 9 aa, Homo Sapiens
QNWLKDGTM

SEQ ID NO: 798598 - protein, 9 aa, Homo Sapiens
EVLQDSQDR

SEQ ID NO: 798599 - protein, 9 aa, Homo Sapiens
VVSVNGLGV

SEQ ID NO: 798600 - protein, 9 aa, Homo Sapiens
NYSAMTELF

SEQ ID NO: 798601 - protein, 9 aa, Homo Sapiens
GYDDAKWYC

SEQ ID NO: 798602 - protein, 9 aa, Homo Sapiens
KGFHTNIIR

SEQ ID NO: 798603 - protein, 9 aa, Homo Sapiens
NKVVSVNGL

SEQ ID NO: 798604 - protein, 9 aa, Homo Sapiens
KVVSVNGLG

SEQ ID NO: 798605 - protein, 9 aa, Homo Sapiens
KSDNKVVDN

SEQ ID NO: 798606 - protein, 9 aa, Homo Sapiens
ISLQKGFHT

SEQ ID NO: 798607 - protein, 9 aa, Homo Sapiens
DNKVVDNQA

SEQ ID NO: 798608 - protein, 9 aa, Homo Sapiens
LEVCLLKSD

SEQ ID NO: 798609 - protein, 9 aa, Homo Sapiens
EKEPLKMAG

SEQ ID NO: 798610 - protein, 9 aa, Homo Sapiens
TGVAVSELV

SEQ ID NO: 798611 - protein, 9 aa, Homo Sapiens
SLQKGFHTN

SEQ ID NO: 798612 - protein, 9 aa, Homo Sapiens
TMLCELINA

SEQ ID NO: 798613 - protein, 9 aa, Homo Sapiens
VVRRMSLYP

SEQ ID NO: 798614 - protein, 9 aa, Homo Sapiens
PEVLQDSQD

SEQ ID NO: 798615 - protein, 9 aa, Homo Sapiens
MAGVSLVGR

SEQ ID NO: 798616 - protein, 9 aa, Homo Sapiens
FNCRSPLTR

SEQ ID NO: 798617 - protein, 9 aa, Homo Sapiens
RRAPEATPA

SEQ ID NO: 798618 - protein, 9 aa, Homo Sapiens
REGQRGLRA

SEQ ID NO: 798619 - protein, 9 aa, Homo Sapiens
AGRLSQRQT

SEQ ID NO: 798620 - protein, 9 aa, Homo Sapiens
RAVSGEPGN

SEQ ID NO: 798621 - protein, 9 aa, Homo Sapiens
QKGFHTNII

SEQ ID NO: 798622 - protein, 9 aa, Homo Sapiens
EVVRRMSLY

SEQ ID NO: 798623 - protein, 9 aa, Homo Sapiens
VLQDSQDRC

SEQ ID NO: 798624 - protein, 9 aa, Homo Sapiens
AVSGEPGNP

SEQ ID NO: 798625 - protein, 9 aa, Homo Sapiens
ELFLVGLSQ

SEQ ID NO: 798626 - protein, 9 aa, Homo Sapiens
EAGRLSQRQ

SEQ ID NO: 798627 - protein, 9 aa, Homo Sapiens
SKGHATPLP

SEQ ID NO: 798628 - protein, 9 aa, Homo Sapiens
GVAVSELVP

SEQ ID NO: 798629 - protein, 9 aa, Homo Sapiens
AKWYCKDPS

SEQ ID NO: 798630 - protein, 9 aa, Homo Sapiens
GGTGVAVSE

SEQ ID NO: 798631 - protein, 9 aa, Homo Sapiens
VPRVGGTGV

SEQ ID NO: 798632 - protein, 9 aa, Homo Sapiens
GTMLCELIN

SEQ ID NO: 798633 - protein, 9 aa, Homo Sapiens
TELFLVGLS

SEQ ID NO: 798634 - protein, 9 aa, Homo Sapiens
RGLRAVSGE

SEQ ID NO: 798635 - protein, 9 aa, Homo Sapiens
NGLGVFVRA

SEQ ID NO: 798636 - protein, 9 aa, Homo Sapiens
SHISLQKGF

SEQ ID NO: 798637 - protein, 9 aa, Homo Sapiens
VMRRGHACV

SEQ ID NO: 798638 - protein, 9 aa, Homo Sapiens
VSVNGLGVF

SEQ ID NO: 798639 - protein, 9 aa, Homo Sapiens
LPLNRRAPE

SEQ ID NO: 798640 - protein, 9 aa, Homo Sapiens
KGYDDAKWY

SEQ ID NO: 798641 - protein, 9 aa, Homo Sapiens
QLRREAGRL

SEQ ID NO: 798642 - protein, 9 aa, Homo Sapiens
RAPEATPAE

SEQ ID NO: 798643 - protein, 9 aa, Homo Sapiens
RREAGRLSQ

SEQ ID NO: 798644 - protein, 9 aa, Homo Sapiens
KEPLKMAGV

SEQ ID NO: 798645 - protein, 9 aa, Homo Sapiens
YSAMTELFL

SEQ ID NO: 798646 - protein, 9 aa, Homo Sapiens
TNKVVSVNG

SEQ ID NO: 798647 - protein, 9 aa, Homo Sapiens
VGGTGVAVS

SEQ ID NO: 798648 - protein, 9 aa, Homo Sapiens
PKGYDDAKW

SEQ ID NO: 798649 - protein, 9 aa, Homo Sapiens
REVVRRMSL

SEQ ID NO: 798650 - protein, 9 aa, Homo Sapiens
SLYPGLEGF

SEQ ID NO: 798651 - protein, 9 aa, Homo Sapiens
MLCELINAL

SEQ ID NO: 798652 - protein, 9 aa, Homo Sapiens
GLRAVSGEP

SEQ ID NO: 798653 - protein, 9 aa, Homo Sapiens
SDPEEMELW

SEQ ID NO: 798654 - protein, 9 aa, Homo Sapiens
LSVQWWMGG

SEQ ID NO: 798655 - protein, 9 aa, Homo Sapiens
GRDSLSLLI

SEQ ID NO: 798656 - protein, 9 aa, Homo Sapiens
EDMLNLLYI

SEQ ID NO: 798657 - protein, 9 aa, Homo Sapiens
RDSLSLLIG

SEQ ID NO: 798658 - protein, 9 aa, Homo Sapiens
CILTEKREK

SEQ ID NO: 798659 - protein, 9 aa, Homo Sapiens
IPAERLRGP

SEQ ID NO: 798660 - protein, 9 aa, Homo Sapiens
SPTYTNLNR

SEQ ID NO: 798661 - protein, 9 aa, Homo Sapiens
TLLLLPCRH

SEQ ID NO: 798662 - protein, 9 aa, Homo Sapiens
IPTLSVQWW

SEQ ID NO: 798663 - protein, 9 aa, Homo Sapiens
HEELKAIIW

SEQ ID NO: 798664 - protein, 9 aa, Homo Sapiens
LLYILVTIS

SEQ ID NO: 798665 - protein, 9 aa, Homo Sapiens
FFPQKVSEL

SEQ ID NO: 798666 - protein, 9 aa, Homo Sapiens
MEDMALFED

SEQ ID NO: 798667 - protein, 9 aa, Homo Sapiens
LLAFTKIVM

SEQ ID NO: 798668 - protein, 9 aa, Homo Sapiens
GSRTAAGPR

SEQ ID NO: 798669 - protein, 9 aa, Homo Sapiens
MELWGLQRE

SEQ ID NO: 798670 - protein, 9 aa, Homo Sapiens
EILRSGKLV

SEQ ID NO: 798671 - protein, 9 aa, Homo Sapiens
LRSGKLVSY

SEQ ID NO: 798672 - protein, 9 aa, Homo Sapiens
PWKCTAPTR

SEQ ID NO: 798673 - protein, 9 aa, Homo Sapiens
KRLRGPLPP

SEQ ID NO: 798674 - protein, 9 aa, Homo Sapiens
WPQPHYLLP

SEQ ID NO: 798675 - protein, 9 aa, Homo Sapiens
IVMGQDVRM

SEQ ID NO: 798676 - protein, 9 aa, Homo Sapiens
LIQKHLVHL

SEQ ID NO: 798677 - protein, 9 aa, Homo Sapiens
SIHQLKELD

SEQ ID NO: 798678 - protein, 9 aa, Homo Sapiens
SGRSSDKGL

SEQ ID NO: 798679 - protein, 9 aa, Homo Sapiens
IIIPPWKCT

SEQ ID NO: 798680 - protein, 9 aa, Homo Sapiens
ASSVWPQPH

SEQ ID NO: 798681 - protein, 9 aa, Homo Sapiens
TLEYRPIID

SEQ ID NO: 798682 - protein, 9 aa, Homo Sapiens
PPPGTLRGS

SEQ ID NO: 798683 - protein, 9 aa, Homo Sapiens
DQSKTLLLL

SEQ ID NO: 798684 - protein, 9 aa, Homo Sapiens
GSTGGQMVR

SEQ ID NO: 798685 - protein, 9 aa, Homo Sapiens
QKVSELHRA

SEQ ID NO: 798686 - protein, 9 aa, Homo Sapiens
TLRGSRTAA

SEQ ID NO: 798687 - protein, 9 aa, Homo Sapiens
GIPTLSVQW

SEQ ID NO: 798688 - protein, 9 aa, Homo Sapiens
ELHRATESH

SEQ ID NO: 798689 - protein, 9 aa, Homo Sapiens
GKLVSYVQT

SEQ ID NO: 798690 - protein, 9 aa, Homo Sapiens
PRWAVPVHV

SEQ ID NO: 798691 - protein, 9 aa, Homo Sapiens
SRTAAGPRW

SEQ ID NO: 798692 - protein, 9 aa, Homo Sapiens
ILLAFTKIV

SEQ ID NO: 798693 - protein, 9 aa, Homo Sapiens
GQMVRCTAE

SEQ ID NO: 798694 - protein, 9 aa, Homo Sapiens
ACMEFILRH

SEQ ID NO: 798695 - protein, 9 aa, Homo Sapiens
LKLLWDYSA

SEQ ID NO: 798696 - protein, 9 aa, Homo Sapiens
IPPPGTLRG

SEQ ID NO: 798697 - protein, 9 aa, Homo Sapiens
PPWKCTAPT

SEQ ID NO: 798698 - protein, 9 aa, Homo Sapiens
LFFFFPQKV

SEQ ID NO: 798699 - protein, 9 aa, Homo Sapiens
FHGIPTLSV

SEQ ID NO: 798700 - protein, 9 aa, Homo Sapiens
LWGLQREYP

SEQ ID NO: 798701 - protein, 9 aa, Homo Sapiens
MLNLLYILV

SEQ ID NO: 798702 - protein, 9 aa, Homo Sapiens
PSIHQLKEL

SEQ ID NO: 798703 - protein, 9 aa, Homo Sapiens
RRNLDIESP

SEQ ID NO: 798704 - protein, 9 aa, Homo Sapiens
KDIAFLEAK

SEQ ID NO: 798705 - protein, 9 aa, Homo Sapiens
CMEFILRHL

SEQ ID NO: 798706 - protein, 9 aa, Homo Sapiens
QDPASSVWP

SEQ ID NO: 798707 - protein, 9 aa, Homo Sapiens
DMALFEDVD

SEQ ID NO: 798708 - protein, 9 aa, Homo Sapiens
RSSDKGLSW

SEQ ID NO: 798709 - protein, 9 aa, Homo Sapiens
LTEEKKALQ

SEQ ID NO: 798710 - protein, 9 aa, Homo Sapiens
IKIPAERLR

SEQ ID NO: 798711 - protein, 9 aa, Homo Sapiens
SFHGIPTLS

SEQ ID NO: 798712 - protein, 9 aa, Homo Sapiens
RSGKLVSYV

SEQ ID NO: 798713 - protein, 9 aa, Homo Sapiens
PTLSVQWWM

SEQ ID NO: 798714 - protein, 9 aa, Homo Sapiens
HLSWCPSIH

SEQ ID NO: 798715 - protein, 9 aa, Homo Sapiens
WKCTAPTRV

SEQ ID NO: 798716 - protein, 9 aa, Homo Sapiens
ESVARLTEE

SEQ ID NO: 798717 - protein, 9 aa, Homo Sapiens
EEKKALQEA

SEQ ID NO: 798718 - protein, 9 aa, Homo Sapiens
ILTEKREKR

SEQ ID NO: 798719 - protein, 9 aa, Homo Sapiens
IKTPAKRLR

SEQ ID NO: 798720 - protein, 9 aa, Homo Sapiens
FPILFFFFP

SEQ ID NO: 798721 - protein, 9 aa, Homo Sapiens
HRATESHRC

SEQ ID NO: 798722 - protein, 9 aa, Homo Sapiens
VGAAGVGKS

SEQ ID NO: 798723 - protein, 9 aa, Homo Sapiens
GGQMVRCTA

SEQ ID NO: 798724 - protein, 9 aa, Homo Sapiens
CQDQSKTLL

SEQ ID NO: 798725 - protein, 9 aa, Homo Sapiens
CPSIHQLKE

SEQ ID NO: 798726 - protein, 9 aa, Homo Sapiens
LLLLPCRHL

SEQ ID NO: 798727 - protein, 9 aa, Homo Sapiens
SEKQWKACM

SEQ ID NO: 798728 - protein, 9 aa, Homo Sapiens
ALFEDVDLL

SEQ ID NO: 798729 - protein, 9 aa, Homo Sapiens
SEILRSGKL

SEQ ID NO: 798730 - protein, 9 aa, Homo Sapiens
WDYSADDTR

SEQ ID NO: 798731 - protein, 9 aa, Homo Sapiens
DIAFLEAKI

SEQ ID NO: 798732 - protein, 9 aa, Homo Sapiens
AIIWNNDLL

SEQ ID NO: 798733 - protein, 9 aa, Homo Sapiens
WKACMEFIL

SEQ ID NO: 798734 - protein, 9 aa, Homo Sapiens
CRRNLDIES

SEQ ID NO: 798735 - protein, 9 aa, Homo Sapiens
SGKLVSYVQ

SEQ ID NO: 798736 - protein, 9 aa, Homo Sapiens
SHRCLRIPP

SEQ ID NO: 798737 - protein, 9 aa, Homo Sapiens
YILVTISFL

SEQ ID NO: 798738 - protein, 9 aa, Homo Sapiens
MVRCTAEGT

SEQ ID NO: 798739 - protein, 9 aa, Homo Sapiens
AAGVGKSAL

SEQ ID NO: 798740 - protein, 9 aa, Homo Sapiens
LVVVGAAGV

SEQ ID NO: 798741 - protein, 9 aa, Homo Sapiens
YFKNKTNVM

SEQ ID NO: 798742 - protein, 9 aa, Homo Sapiens
LRIIIPPWK

SEQ ID NO: 798743 - protein, 9 aa, Homo Sapiens
ELWGLQREY

SEQ ID NO: 798744 - protein, 9 aa, Homo Sapiens
WAVPVHVPG

SEQ ID NO: 798745 - protein, 9 aa, Homo Sapiens
SLSLLIGSF

SEQ ID NO: 798746 - protein, 9 aa, Homo Sapiens
AGVGKSALT

SEQ ID NO: 798747 - protein, 9 aa, Homo Sapiens
PQDPASSVW

SEQ ID NO: 798748 - protein, 9 aa, Homo Sapiens
IWNNDLLWE

SEQ ID NO: 798749 - protein, 9 aa, Homo Sapiens
SVARLTEEK

SEQ ID NO: 798750 - protein, 9 aa, Homo Sapiens
DMLNLLYIL

SEQ ID NO: 798751 - protein, 9 aa, Homo Sapiens
SWCPSIHQL

SEQ ID NO: 798752 - protein, 9 aa, Homo Sapiens
HQLKELDLR

SEQ ID NO: 798753 - protein, 9 aa, Homo Sapiens
PASSVWPQP

SEQ ID NO: 798754 - protein, 9 aa, Homo Sapiens
IAFLEAKIY

SEQ ID NO: 798755 - protein, 9 aa, Homo Sapiens
KQWKACMEF

SEQ ID NO: 798756 - protein, 9 aa, Homo Sapiens
TGGQMVRCT

SEQ ID NO: 798757 - protein, 9 aa, Homo Sapiens
ESHRCLRIP

SEQ ID NO: 798758 - protein, 9 aa, Homo Sapiens
GTLRGSRTA

SEQ ID NO: 798759 - protein, 9 aa, Homo Sapiens
KVTLEYRPI

SEQ ID NO: 798760 - protein, 9 aa, Homo Sapiens
GHEELKAII

SEQ ID NO: 798761 - protein, 9 aa, Homo Sapiens
TEDMLNLLY

SEQ ID NO: 798762 - protein, 9 aa, Homo Sapiens
KHLVHLLSV

SEQ ID NO: 798763 - protein, 9 aa, Homo Sapiens
VHLLSVVLP

SEQ ID NO: 798764 - protein, 9 aa, Homo Sapiens
YDGRDSLSL

SEQ ID NO: 798765 - protein, 9 aa, Homo Sapiens
LKAIIWNND

SEQ ID NO: 798766 - protein, 9 aa, Homo Sapiens
LWDYSADDT

SEQ ID NO: 798767 - protein, 9 aa, Homo Sapiens
DVSTGKVTL

SEQ ID NO: 798768 - protein, 9 aa, Homo Sapiens
CLRIPPPGT

SEQ ID NO: 798769 - protein, 9 aa, Homo Sapiens
KLLWDYSAD

SEQ ID NO: 798770 - protein, 9 aa, Homo Sapiens
EDMALFEDV

SEQ ID NO: 798771 - protein, 9 aa, Homo Sapiens
DLALKLLWD

SEQ ID NO: 798772 - protein, 9 aa, Homo Sapiens
LDIESPTYT

SEQ ID NO: 798773 - protein, 9 aa, Homo Sapiens
ESPTYTNLN

SEQ ID NO: 798774 - protein, 9 aa, Homo Sapiens
VMGLLTNSA

SEQ ID NO: 798775 - protein, 9 aa, Homo Sapiens
DNIKIPAER

SEQ ID NO: 798776 - protein, 9 aa, Homo Sapiens
ARLTEEKKA

SEQ ID NO: 798777 - protein, 9 aa, Homo Sapiens
EEMELWGLQ

SEQ ID NO: 798778 - protein, 9 aa, Homo Sapiens
KLVSYVQTL

SEQ ID NO: 798779 - protein, 9 aa, Homo Sapiens
NVMGLLTNS

SEQ ID NO: 798780 - protein, 9 aa, Homo Sapiens
SSVWPQPHY

SEQ ID NO: 798781 - protein, 9 aa, Homo Sapiens
RATESHRCL

SEQ ID NO: 798782 - protein, 9 aa, Homo Sapiens
TPAKRLRGP

SEQ ID NO: 798783 - protein, 9 aa, Homo Sapiens
ATESHRCLR

SEQ ID NO: 798784 - protein, 9 aa, Homo Sapiens
TEEKKALQE

SEQ ID NO: 798785 - protein, 9 aa, Homo Sapiens
WGLQREYPV

SEQ ID NO: 798786 - protein, 9 aa, Homo Sapiens
TKIVMGQDV

SEQ ID NO: 798787 - protein, 9 aa, Homo Sapiens
VVGAAGVGK

SEQ ID NO: 798788 - protein, 9 aa, Homo Sapiens
NDLALKLLW

SEQ ID NO: 798789 - protein, 9 aa, Homo Sapiens
PPGTLRGSR

SEQ ID NO: 798790 - protein, 9 aa, Homo Sapiens
KTPAKRLRG

SEQ ID NO: 798791 - protein, 9 aa, Homo Sapiens
IPPWKCTAP

SEQ ID NO: 798792 - protein, 9 aa, Homo Sapiens
RLTEEKKAL

SEQ ID NO: 798793 - protein, 9 aa, Homo Sapiens
RCLRIPPPG

SEQ ID NO: 798794 - protein, 9 aa, Homo Sapiens
IIPPWKCTA

SEQ ID NO: 798795 - protein, 9 aa, Homo Sapiens
ILFFFFPQK

SEQ ID NO: 798796 - protein, 9 aa, Homo Sapiens
PEEMELWGL

SEQ ID NO: 798797 - protein, 9 aa, Homo Sapiens
LTEKREKRS

SEQ ID NO: 798798 - protein, 9 aa, Homo Sapiens
KIYEYVEIL

SEQ ID NO: 798799 - protein, 9 aa, Homo Sapiens
ECILTEKRE

SEQ ID NO: 798800 - protein, 9 aa, Homo Sapiens
DSLSLLIGS

SEQ ID NO: 798801 - protein, 9 aa, Homo Sapiens
NLLYILVTI

SEQ ID NO: 798802 - protein, 9 aa, Homo Sapiens
PILFFFFPQ

SEQ ID NO: 798803 - protein, 9 aa, Homo Sapiens
DESVARLTE

SEQ ID NO: 798804 - protein, 9 aa, Homo Sapiens
NIKIPAERL

SEQ ID NO: 798805 - protein, 9 aa, Homo Sapiens
SVWPQPHYL

SEQ ID NO: 798806 - protein, 9 aa, Homo Sapiens
SLLIGSFYG

SEQ ID NO: 798807 - protein, 9 aa, Homo Sapiens
MALFEDVDL

SEQ ID NO: 798808 - protein, 9 aa, Homo Sapiens
RIPPPGTLR

SEQ ID NO: 798809 - protein, 9 aa, Homo Sapiens
RNLDIESPT

SEQ ID NO: 798810 - protein, 9 aa, Homo Sapiens
KTNVMGLLT

SEQ ID NO: 798811 - protein, 9 aa, Homo Sapiens
LEAKIYEYV

SEQ ID NO: 798812 - protein, 9 aa, Homo Sapiens
EKQWKACME

SEQ ID NO: 798813 - protein, 9 aa, Homo Sapiens
GRSSDKGLS

SEQ ID NO: 798814 - protein, 9 aa, Homo Sapiens
FKNKTNVMG

SEQ ID NO: 798815 - protein, 9 aa, Homo Sapiens
LALKLLWDY

SEQ ID NO: 798816 - protein, 9 aa, Homo Sapiens
LRGSRTAAG

SEQ ID NO: 798817 - protein, 9 aa, Homo Sapiens
LSLLIGSFY

SEQ ID NO: 798818 - protein, 9 aa, Homo Sapiens
NLMEDMALF

SEQ ID NO: 798819 - protein, 9 aa, Homo Sapiens
LSWCPSIHQ

SEQ ID NO: 798820 - protein, 9 aa, Homo Sapiens
STGGQMVRC

SEQ ID NO: 798821 - protein, 9 aa, Homo Sapiens
KAIIWNNDL

SEQ ID NO: 798822 - protein, 9 aa, Homo Sapiens
IQKHLVHLL

SEQ ID NO: 798823 - protein, 9 aa, Homo Sapiens
EKRSTKKEV

SEQ ID NO: 798824 - protein, 9 aa, Homo Sapiens
DDNIKIPAE

SEQ ID NO: 798825 - protein, 9 aa, Homo Sapiens
VSTGKVTLE

SEQ ID NO: 798826 - protein, 9 aa, Homo Sapiens
STGKVTLEY

SEQ ID NO: 798827 - protein, 9 aa, Homo Sapiens
DIESPTYTN

SEQ ID NO: 798828 - protein, 9 aa, Homo Sapiens
DGRDSLSLL

SEQ ID NO: 798829 - protein, 9 aa, Homo Sapiens
VWPQPHYLL

SEQ ID NO: 798830 - protein, 9 aa, Homo Sapiens
GAAGVGKSA

SEQ ID NO: 798831 - protein, 9 aa, Homo Sapiens
NLDIESPTY

SEQ ID NO: 798832 - protein, 9 aa, Homo Sapiens
SDKGLSWSS

SEQ ID NO: 798833 - protein, 9 aa, Homo Sapiens
PAKRLRGPL

SEQ ID NO: 798834 - protein, 9 aa, Homo Sapiens
FEDVDLLED

SEQ ID NO: 798835 - protein, 9 aa, Homo Sapiens
RIIIPPWKC

SEQ ID NO: 798836 - protein, 9 aa, Homo Sapiens
ELKAIIWNN

SEQ ID NO: 798837 - protein, 9 aa, Homo Sapiens
AFLEAKIYE

SEQ ID NO: 798838 - protein, 9 aa, Homo Sapiens
HGIPTLSVQ

SEQ ID NO: 798839 - protein, 9 aa, Homo Sapiens
AGPRWAVPV

SEQ ID NO: 798840 - protein, 9 aa, Homo Sapiens
SSDKGLSWS

SEQ ID NO: 798841 - protein, 9 aa, Homo Sapiens
EKREKRSTK

SEQ ID NO: 798842 - protein, 9 aa, Homo Sapiens
KVSELHRAT

SEQ ID NO: 798843 - protein, 9 aa, Homo Sapiens
AKIYEYVEI

SEQ ID NO: 798844 - protein, 9 aa, Homo Sapiens
GEPAHHPGC

SEQ ID NO: 798845 - protein, 9 aa, Homo Sapiens
KACMEFILR

SEQ ID NO: 798846 - protein, 9 aa, Homo Sapiens
EPAHHPGCQ

SEQ ID NO: 798847 - protein, 9 aa, Homo Sapiens
TLSVQWWMG

SEQ ID NO: 798848 - protein, 9 aa, Homo Sapiens
CSFHGIPTL

SEQ ID NO: 798849 - protein, 9 aa, Homo Sapiens
LMEDMALFE

SEQ ID NO: 798850 - protein, 9 aa, Homo Sapiens
FPQKVSELH

SEQ ID NO: 798851 - protein, 9 aa, Homo Sapiens
TEKREKRST

SEQ ID NO: 798852 - protein, 9 aa, Homo Sapiens
KREKRSTKK

SEQ ID NO: 798853 - protein, 9 aa, Homo Sapiens
HLLSVVLPN

SEQ ID NO: 798854 - protein, 9 aa, Homo Sapiens
TAAGPRWAV

SEQ ID NO: 798855 - protein, 9 aa, Homo Sapiens
YKLVVVGAA

SEQ ID NO: 798856 - protein, 9 aa, Homo Sapiens
LAFTKIVMG

SEQ ID NO: 798857 - protein, 9 aa, Homo Sapiens
WCPSIHQLK

SEQ ID NO: 798858 - protein, 9 aa, Homo Sapiens
IIWNNDLLW

SEQ ID NO: 798859 - protein, 9 aa, Homo Sapiens
QWKACMEFI

SEQ ID NO: 798860 - protein, 9 aa, Homo Sapiens
EMELWGLQR

SEQ ID NO: 798861 - protein, 9 aa, Homo Sapiens
ICQDQSKTL

SEQ ID NO: 798862 - protein, 9 aa, Homo Sapiens
GPRWAVPVH

SEQ ID NO: 798863 - protein, 9 aa, Homo Sapiens
KTLLLLPCR

SEQ ID NO: 798864 - protein, 9 aa, Homo Sapiens
LSWSSRSLG

SEQ ID NO: 798865 - protein, 9 aa, Homo Sapiens
PQKVSELHR

SEQ ID NO: 798866 - protein, 9 aa, Homo Sapiens
FFFPQKVSE

SEQ ID NO: 798867 - protein, 9 aa, Homo Sapiens
VTLEYRPII

SEQ ID NO: 798868 - protein, 9 aa, Homo Sapiens
LNLLYILVT

SEQ ID NO: 798869 - protein, 9 aa, Homo Sapiens
AAGPRWAVP

SEQ ID NO: 798870 - protein, 9 aa, Homo Sapiens
REKRSTKKE

SEQ ID NO: 798871 - protein, 9 aa, Homo Sapiens
DKGLSWSSR

SEQ ID NO: 798872 - protein, 9 aa, Homo Sapiens
DDNIKTPAK

SEQ ID NO: 798873 - protein, 9 aa, Homo Sapiens
AKRLRGPLP

SEQ ID NO: 798874 - protein, 9 aa, Homo Sapiens
LVHLLSVVL

SEQ ID NO: 798875 - protein, 9 aa, Homo Sapiens
VVVGAAGVG

SEQ ID NO: 798876 - protein, 9 aa, Homo Sapiens
DILLAFTKI

SEQ ID NO: 798877 - protein, 9 aa, Homo Sapiens
LFEDVDLLE

SEQ ID NO: 798878 - protein, 9 aa, Homo Sapiens
KGLSWSSRS

SEQ ID NO: 798879 - protein, 9 aa, Homo Sapiens
ALKLLWDYS

SEQ ID NO: 798880 - protein, 9 aa, Homo Sapiens
FLEAKIYEY

SEQ ID NO: 798881 - protein, 9 aa, Homo Sapiens
LYILVTISF

SEQ ID NO: 798882 - protein, 9 aa, Homo Sapiens
RGSRTAAGP

SEQ ID NO: 798883 - protein, 9 aa, Homo Sapiens
PAHHPGCQL

SEQ ID NO: 798884 - protein, 9 aa, Homo Sapiens
LRIPPPGTL

SEQ ID NO: 798885 - protein, 9 aa, Homo Sapiens
NKTNVMGLL

SEQ ID NO: 798886 - protein, 9 aa, Homo Sapiens
KNKTNVMGL

SEQ ID NO: 798887 - protein, 9 aa, Homo Sapiens
SELHRATES

SEQ ID NO: 798888 - protein, 9 aa, Homo Sapiens
KIVMGQDVR

SEQ ID NO: 798889 - protein, 9 aa, Homo Sapiens
LLIGSFYGS

SEQ ID NO: 798890 - protein, 9 aa, Homo Sapiens
ESEKQWKAC

SEQ ID NO: 798891 - protein, 9 aa, Homo Sapiens
HRCLRIPPP

SEQ ID NO: 798892 - protein, 9 aa, Homo Sapiens
RWAVPVHVP

SEQ ID NO: 798893 - protein, 9 aa, Homo Sapiens
TESHRCLRI

SEQ ID NO: 798894 - protein, 9 aa, Homo Sapiens
FFFFPQKVS

SEQ ID NO: 798895 - protein, 9 aa, Homo Sapiens
NIKTPAKRL

SEQ ID NO: 798896 - protein, 9 aa, Homo Sapiens
FTKIVMGQD

SEQ ID NO: 798897 - protein, 9 aa, Homo Sapiens
AFTKIVMGQ

SEQ ID NO: 798898 - protein, 9 aa, Homo Sapiens
QKHLVHLLS

SEQ ID NO: 798899 - protein, 9 aa, Homo Sapiens
IESPTYTNL

SEQ ID NO: 798900 - protein, 9 aa, Homo Sapiens
KIPAERLRG

SEQ ID NO: 798901 - protein, 9 aa, Homo Sapiens
QMVRCTAEG

SEQ ID NO: 798902 - protein, 9 aa, Homo Sapiens
DPASSVWPQ

SEQ ID NO: 798903 - protein, 9 aa, Homo Sapiens
VLIQKHLVH

SEQ ID NO: 798904 - protein, 9 aa, Homo Sapiens
ILRSGKLVS

SEQ ID NO: 798905 - protein, 9 aa, Homo Sapiens
KLVVVGAAG

SEQ ID NO: 798906 - protein, 9 aa, Homo Sapiens
DPEEMELWG

SEQ ID NO: 798907 - protein, 9 aa, Homo Sapiens
VARLTEEKK

SEQ ID NO: 798908 - protein, 9 aa, Homo Sapiens
MGLLTNSAE

SEQ ID NO: 798909 - protein, 9 aa, Homo Sapiens
TNVMGLLTN

SEQ ID NO: 798910 - protein, 9 aa, Homo Sapiens
LEYRPIIDK

SEQ ID NO: 798911 - protein, 9 aa, Homo Sapiens
DNIKTPAKR

SEQ ID NO: 798912 - protein, 9 aa, Homo Sapiens
PGTLRGSRT

SEQ ID NO: 798913 - protein, 9 aa, Homo Sapiens
RTAAGPRWA

SEQ ID NO: 798914 - protein, 9 aa, Homo Sapiens
IHQLKELDL

SEQ ID NO: 798915 - protein, 9 aa, Homo Sapiens
QSKTLLLLP

SEQ ID NO: 798916 - protein, 9 aa, Homo Sapiens
VSELHRATE

SEQ ID NO: 798917 - protein, 9 aa, Homo Sapiens
SKTLLLLPC

SEQ ID NO: 798918 - protein, 9 aa, Homo Sapiens
EELKAIIWN

SEQ ID NO: 798919 - protein, 9 aa, Homo Sapiens
QDQSKTLLL

SEQ ID NO: 798920 - protein, 9 aa, Homo Sapiens
GLSWSSRSL

SEQ ID NO: 798921 - protein, 9 aa, Homo Sapiens
LHRATESHR

SEQ ID NO: 798922 - protein, 9 aa, Homo Sapiens
GLRIIIPPW

SEQ ID NO: 798923 - protein, 9 aa, Homo Sapiens
HLVHLLSVV

SEQ ID NO: 798924 - protein, 9 aa, Homo Sapiens
HGSTGGQMV

SEQ ID NO: 798925 - protein, 9 aa, Homo Sapiens
LLWDYSADD

SEQ ID NO: 798926 - protein, 9 aa, Homo Sapiens
HHGSTGGQM

SEQ ID NO: 798927 - protein, 9 aa, Homo Sapiens
EAKIYEYVE

SEQ ID NO: 798928 - protein, 9 aa, Homo Sapiens
ANTSTCMPS

SEQ ID NO: 798929 - protein, 9 aa, Homo Sapiens
SEHVNEENA

SEQ ID NO: 798930 - protein, 9 aa, Homo Sapiens
QPSSNPPPS

SEQ ID NO: 798931 - protein, 9 aa, Homo Sapiens
VPELHRPVV

SEQ ID NO: 798932 - protein, 9 aa, Homo Sapiens
HAFQSQDEF

SEQ ID NO: 798933 - protein, 9 aa, Homo Sapiens
SKEHVRTAV

SEQ ID NO: 798934 - protein, 9 aa, Homo Sapiens
DIQGNTKYR

SEQ ID NO: 798935 - protein, 9 aa, Homo Sapiens
NPYQLAPPS

SEQ ID NO: 798936 - protein, 9 aa, Homo Sapiens
NPPPSPLDA

SEQ ID NO: 798937 - protein, 9 aa, Homo Sapiens
PLTVAEMAP

SEQ ID NO: 798938 - protein, 9 aa, Homo Sapiens
KSTREEKEC

SEQ ID NO: 798939 - protein, 9 aa, Homo Sapiens
ARRTLSPLH

SEQ ID NO: 798940 - protein, 9 aa, Homo Sapiens
SSNPPPSPL

SEQ ID NO: 798941 - protein, 9 aa, Homo Sapiens
LGFGANTST

SEQ ID NO: 798942 - protein, 9 aa, Homo Sapiens
THAFQSQDE

SEQ ID NO: 798943 - protein, 9 aa, Homo Sapiens
SSEHVNEEN

SEQ ID NO: 798944 - protein, 9 aa, Homo Sapiens
LYVPLPLKV

SEQ ID NO: 798945 - protein, 9 aa, Homo Sapiens
LFLCCLLSP

SEQ ID NO: 798946 - protein, 9 aa, Homo Sapiens
RLCGNKIAD

SEQ ID NO: 798947 - protein, 9 aa, Homo Sapiens
NPLLYCWMN

SEQ ID NO: 798948 - protein, 9 aa, Homo Sapiens
EHVRTAVRH

SEQ ID NO: 798949 - protein, 9 aa, Homo Sapiens
LQIFHKLWC

SEQ ID NO: 798950 - protein, 9 aa, Homo Sapiens
TPGGARCGK

SEQ ID NO: 798951 - protein, 9 aa, Homo Sapiens
DPVAGALQD

SEQ ID NO: 798952 - protein, 9 aa, Homo Sapiens
PDVPELHRP

SEQ ID NO: 798953 - protein, 9 aa, Homo Sapiens
DRYLFLFDN

SEQ ID NO: 798954 - protein, 9 aa, Homo Sapiens
AEEMWLVAQ

SEQ ID NO: 798955 - protein, 9 aa, Homo Sapiens
LTTPPLETP

SEQ ID NO: 798956 - protein, 9 aa, Homo Sapiens
FLFLCCLLS

SEQ ID NO: 798957 - protein, 9 aa, Homo Sapiens
TLSPLHTDL

SEQ ID NO: 798958 - protein, 9 aa, Homo Sapiens
MWLVAQHPS

SEQ ID NO: 798959 - protein, 9 aa, Homo Sapiens
LSAEEMWLV

SEQ ID NO: 798960 - protein, 9 aa, Homo Sapiens
NKMDIQGNT

SEQ ID NO: 798961 - protein, 9 aa, Homo Sapiens
WLVAQHPSA

SEQ ID NO: 798962 - protein, 9 aa, Homo Sapiens
SNNTDVSPQ

SEQ ID NO: 798963 - protein, 9 aa, Homo Sapiens
LLQPLLLLP

SEQ ID NO: 798964 - protein, 9 aa, Homo Sapiens
SLFKNNPDV

SEQ ID NO: 798965 - protein, 9 aa, Homo Sapiens
SAEEMWLVA

SEQ ID NO: 798966 - protein, 9 aa, Homo Sapiens
VSPQGVTGL

SEQ ID NO: 798967 - protein, 9 aa, Homo Sapiens
FLFDNVVIV

SEQ ID NO: 798968 - protein, 9 aa, Homo Sapiens
LAYLQIFHK

SEQ ID NO: 798969 - protein, 9 aa, Homo Sapiens
SNPPPSPLD

SEQ ID NO: 798970 - protein, 9 aa, Homo Sapiens
PSPLTTPPL

SEQ ID NO: 798971 - protein, 9 aa, Homo Sapiens
ECWIHSKYE

SEQ ID NO: 798972 - protein, 9 aa, Homo Sapiens
AARRTLSPL

SEQ ID NO: 798973 - protein, 9 aa, Homo Sapiens
FDNVVIVCK

SEQ ID NO: 798974 - protein, 9 aa, Homo Sapiens
AFQSQDEFL

SEQ ID NO: 798975 - protein, 9 aa, Homo Sapiens
SQPSSNPPP

SEQ ID NO: 798976 - protein, 9 aa, Homo Sapiens
GNKIADPLV

SEQ ID NO: 798977 - protein, 9 aa, Homo Sapiens
VTHAFQSQD

SEQ ID NO: 798978 - protein, 9 aa, Homo Sapiens
GGARCGKGN

SEQ ID NO: 798979 - protein, 9 aa, Homo Sapiens
TTPPLETPS

SEQ ID NO: 798980 - protein, 9 aa, Homo Sapiens
VLAYLQIFH

SEQ ID NO: 798981 - protein, 9 aa, Homo Sapiens
TVAEMAPYM

SEQ ID NO: 798982 - protein, 9 aa, Homo Sapiens
EENAEEHMD

SEQ ID NO: 798983 - protein, 9 aa, Homo Sapiens
TDVSPQGVT

SEQ ID NO: 798984 - protein, 9 aa, Homo Sapiens
PPLETPSSI

SEQ ID NO: 798985 - protein, 9 aa, Homo Sapiens
LFDNVVIVC

SEQ ID NO: 798986 - protein, 9 aa, Homo Sapiens
FQSQDEFLS

SEQ ID NO: 798987 - protein, 9 aa, Homo Sapiens
YLQIFHKLW

SEQ ID NO: 798988 - protein, 9 aa, Homo Sapiens
ANPLLYCWM

SEQ ID NO: 798989 - protein, 9 aa, Homo Sapiens
LMEMLETLL

SEQ ID NO: 798990 - protein, 9 aa, Homo Sapiens
TNSNNTDVS

SEQ ID NO: 798991 - protein, 9 aa, Homo Sapiens
LTVAEMAPY

SEQ ID NO: 798992 - protein, 9 aa, Homo Sapiens
MAVVKPPAE

SEQ ID NO: 798993 - protein, 9 aa, Homo Sapiens
YSKEHVRTA

SEQ ID NO: 798994 - protein, 9 aa, Homo Sapiens
LHTDLLWAS

SEQ ID NO: 798995 - protein, 9 aa, Homo Sapiens
PLHTDLLWA

SEQ ID NO: 798996 - protein, 9 aa, Homo Sapiens
VRTAVRHQP

SEQ ID NO: 798997 - protein, 9 aa, Homo Sapiens
NVVIVCKRK

SEQ ID NO: 798998 - protein, 9 aa, Homo Sapiens
PSSNPPPSP

SEQ ID NO: 798999 - protein, 9 aa, Homo Sapiens
GFGANTSTC

SEQ ID NO: 799000 - protein, 9 aa, Homo Sapiens
CCLLSPLLK

SEQ ID NO: 799001 - protein, 9 aa, Homo Sapiens
LSPLHTDLL

SEQ ID NO: 799002 - protein, 9 aa, Homo Sapiens
VAGALQDSP

SEQ ID NO: 799003 - protein, 9 aa, Homo Sapiens
NSNNTDVSP

SEQ ID NO: 799004 - protein, 9 aa, Homo Sapiens
KECWIHSKY

SEQ ID NO: 799005 - protein, 9 aa, Homo Sapiens
INPYQLAPP

SEQ ID NO: 799006 - protein, 9 aa, Homo Sapiens
NNTDVSPQG

SEQ ID NO: 799007 - protein, 9 aa, Homo Sapiens
IADPLVATG

SEQ ID NO: 799008 - protein, 9 aa, Homo Sapiens
FLCCLLSPL

SEQ ID NO: 799009 - protein, 9 aa, Homo Sapiens
AVVKPPAED

SEQ ID NO: 799010 - protein, 9 aa, Homo Sapiens
KNNPDVPEL

SEQ ID NO: 799011 - protein, 9 aa, Homo Sapiens
GARCGKGNG

SEQ ID NO: 799012 - protein, 9 aa, Homo Sapiens
YQLAPPSGY

SEQ ID NO: 799013 - protein, 9 aa, Homo Sapiens
PLLLLPLLN

SEQ ID NO: 799014 - protein, 9 aa, Homo Sapiens
TKYRALTHL

SEQ ID NO: 799015 - protein, 9 aa, Homo Sapiens
HVRTAVRHQ

SEQ ID NO: 799016 - protein, 9 aa, Homo Sapiens
EWDPVAGAL

SEQ ID NO: 799017 - protein, 9 aa, Homo Sapiens
LFLFDNVVI

SEQ ID NO: 799018 - protein, 9 aa, Homo Sapiens
LETPSSIAT

SEQ ID NO: 799019 - protein, 9 aa, Homo Sapiens
NPDVPELHR

SEQ ID NO: 799020 - protein, 9 aa, Homo Sapiens
MLETLLQIT

SEQ ID NO: 799021 - protein, 9 aa, Homo Sapiens
NTDVSPQGV

SEQ ID NO: 799022 - protein, 9 aa, Homo Sapiens
RTLSPLHTD

SEQ ID NO: 799023 - protein, 9 aa, Homo Sapiens
GSQPSSNPP

SEQ ID NO: 799024 - protein, 9 aa, Homo Sapiens
REEKECWIH

SEQ ID NO: 799025 - protein, 9 aa, Homo Sapiens
HRLSAEEMW

SEQ ID NO: 799026 - protein, 9 aa, Homo Sapiens
NKIADPLVA

SEQ ID NO: 799027 - protein, 9 aa, Homo Sapiens
RLSAEEMWL

SEQ ID NO: 799028 - protein, 9 aa, Homo Sapiens
TFANPLLYC

SEQ ID NO: 799029 - protein, 9 aa, Homo Sapiens
ARCGKGNGQ

SEQ ID NO: 799030 - protein, 9 aa, Homo Sapiens
EDLLYVPLP

SEQ ID NO: 799031 - protein, 9 aa, Homo Sapiens
CRLGFGANT

SEQ ID NO: 799032 - protein, 9 aa, Homo Sapiens
KMDIQGNTK

SEQ ID NO: 799033 - protein, 9 aa, Homo Sapiens
LLYCWMNSN

SEQ ID NO: 799034 - protein, 9 aa, Homo Sapiens
GRLCGNKIA

SEQ ID NO: 799035 - protein, 9 aa, Homo Sapiens
KEHVRTAVR

SEQ ID NO: 799036 - protein, 9 aa, Homo Sapiens
LCCLLSPLL

SEQ ID NO: 799037 - protein, 9 aa, Homo Sapiens
LHAEWDPVA

SEQ ID NO: 799038 - protein, 9 aa, Homo Sapiens
SPLHTDLLW

SEQ ID NO: 799039 - protein, 9 aa, Homo Sapiens
VAEMAPYMK

SEQ ID NO: 799040 - protein, 9 aa, Homo Sapiens
RCGKGNGQI

SEQ ID NO: 799041 - protein, 9 aa, Homo Sapiens
IFHKLWCRQ

SEQ ID NO: 799042 - protein, 9 aa, Homo Sapiens
RLGFGANTS

SEQ ID NO: 799043 - protein, 9 aa, Homo Sapiens
ACRLGFGAN

SEQ ID NO: 799044 - protein, 9 aa, Homo Sapiens
GYSKEHVRT

SEQ ID NO: 799045 - protein, 9 aa, Homo Sapiens
LPLKVNLVV

SEQ ID NO: 799046 - protein, 9 aa, Homo Sapiens
GFGYSKEHV

SEQ ID NO: 799047 - protein, 9 aa, Homo Sapiens
YVPLPLKVN

SEQ ID NO: 799048 - protein, 9 aa, Homo Sapiens
NEENAEEHM

SEQ ID NO: 799049 - protein, 9 aa, Homo Sapiens
AYLQIFHKL

SEQ ID NO: 799050 - protein, 9 aa, Homo Sapiens
DLLYVPLPL

SEQ ID NO: 799051 - protein, 9 aa, Homo Sapiens
FLMEMLETL

SEQ ID NO: 799052 - protein, 9 aa, Homo Sapiens
VSLFTPLTV

SEQ ID NO: 799053 - protein, 9 aa, Homo Sapiens
IQGNTKYRA

SEQ ID NO: 799054 - protein, 9 aa, Homo Sapiens
FGANTSTCM

SEQ ID NO: 799055 - protein, 9 aa, Homo Sapiens
NNPDVPELH

SEQ ID NO: 799056 - protein, 9 aa, Homo Sapiens
ENAEEHMDL

SEQ ID NO: 799057 - protein, 9 aa, Homo Sapiens
EHVNEENAE

SEQ ID NO: 799058 - protein, 9 aa, Homo Sapiens
MEMLETLLQ

SEQ ID NO: 799059 - protein, 9 aa, Homo Sapiens
PDFFLFLCC

SEQ ID NO: 799060 - protein, 9 aa, Homo Sapiens
DNVVIVCKR

SEQ ID NO: 799061 - protein, 9 aa, Homo Sapiens
QLAPPSGYF

SEQ ID NO: 799062 - protein, 9 aa, Homo Sapiens
LEDLLYVPL

SEQ ID NO: 799063 - protein, 9 aa, Homo Sapiens
PLLYCWMNS

SEQ ID NO: 799064 - protein, 9 aa, Homo Sapiens
HAEWDPVAG

SEQ ID NO: 799065 - protein, 9 aa, Homo Sapiens
EVTHAFQSQ

SEQ ID NO: 799066 - protein, 9 aa, Homo Sapiens
QIFHKLWCR

SEQ ID NO: 799067 - protein, 9 aa, Homo Sapiens
LLYVPLPLK

SEQ ID NO: 799068 - protein, 9 aa, Homo Sapiens
PPPSPLDAS

SEQ ID NO: 799069 - protein, 9 aa, Homo Sapiens
EMWLVAQHP

SEQ ID NO: 799070 - protein, 9 aa, Homo Sapiens
LQPLLLLPL

SEQ ID NO: 799071 - protein, 9 aa, Homo Sapiens
EEKECWIHS

SEQ ID NO: 799072 - protein, 9 aa, Homo Sapiens
NTKYRALTH

SEQ ID NO: 799073 - protein, 9 aa, Homo Sapiens
MFEVTHAFQ

SEQ ID NO: 799074 - protein, 9 aa, Homo Sapiens
TPPLETPSS

SEQ ID NO: 799075 - protein, 9 aa, Homo Sapiens
LAPPSGYFM

SEQ ID NO: 799076 - protein, 9 aa, Homo Sapiens
SPLTTPPLE

SEQ ID NO: 799077 - protein, 9 aa, Homo Sapiens
RYLFLFDNV

SEQ ID NO: 799078 - protein, 9 aa, Homo Sapiens
CGKGNGQIW

SEQ ID NO: 799079 - protein, 9 aa, Homo Sapiens
GNTKYRALT

SEQ ID NO: 799080 - protein, 9 aa, Homo Sapiens
NPVINPYQL

SEQ ID NO: 799081 - protein, 9 aa, Homo Sapiens
FHKLWCRQI

SEQ ID NO: 799082 - protein, 9 aa, Homo Sapiens
DFFLFLCCL

SEQ ID NO: 799083 - protein, 9 aa, Homo Sapiens
LFTPLTVAE

SEQ ID NO: 799084 - protein, 9 aa, Homo Sapiens
FKNNPDVPE

SEQ ID NO: 799085 - protein, 9 aa, Homo Sapiens
PLPLKVNLV

SEQ ID NO: 799086 - protein, 9 aa, Homo Sapiens
EMLETLLQI

SEQ ID NO: 799087 - protein, 9 aa, Homo Sapiens
PLETPSSIA

SEQ ID NO: 799088 - protein, 9 aa, Homo Sapiens
DVSPQGVTG

SEQ ID NO: 799089 - protein, 9 aa, Homo Sapiens
FEVTHAFQS

SEQ ID NO: 799090 - protein, 9 aa, Homo Sapiens
VNEENAEEH

SEQ ID NO: 799091 - protein, 9 aa, Homo Sapiens
CWMNSNYRK

SEQ ID NO: 799092 - protein, 9 aa, Homo Sapiens
PGGARCGKG

SEQ ID NO: 799093 - protein, 9 aa, Homo Sapiens
EEMWLVAQH

SEQ ID NO: 799094 - protein, 9 aa, Homo Sapiens
PPSPLDASP

SEQ ID NO: 799095 - protein, 9 aa, Homo Sapiens
LYCWMNSNY

SEQ ID NO: 799096 - protein, 9 aa, Homo Sapiens
NTSTCMPSS

SEQ ID NO: 799097 - protein, 9 aa, Homo Sapiens
TPLTVAEMA

SEQ ID NO: 799098 - protein, 9 aa, Homo Sapiens
SLFTPLTVA

SEQ ID NO: 799099 - protein, 9 aa, Homo Sapiens
DVPELHRPV

SEQ ID NO: 799100 - protein, 9 aa, Homo Sapiens
VPLPLKVNL

SEQ ID NO: 799101 - protein, 9 aa, Homo Sapiens
HVNEENAEE

SEQ ID NO: 799102 - protein, 9 aa, Homo Sapiens
VINPYQLAP

SEQ ID NO: 799103 - protein, 9 aa, Homo Sapiens
LFKNNPDVP

SEQ ID NO: 799104 - protein, 9 aa, Homo Sapiens
PLTTPPLET

SEQ ID NO: 799105 - protein, 9 aa, Homo Sapiens
TREEKECWI

SEQ ID NO: 799106 - protein, 9 aa, Homo Sapiens
WDPVAGALQ

SEQ ID NO: 799107 - protein, 9 aa, Homo Sapiens
CGNKIADPL

SEQ ID NO: 799108 - protein, 9 aa, Homo Sapiens
KIADPLVAT

SEQ ID NO: 799109 - protein, 9 aa, Homo Sapiens
LCGNKIADP

SEQ ID NO: 799110 - protein, 9 aa, Homo Sapiens
LSTPGGARC

SEQ ID NO: 799111 - protein, 9 aa, Homo Sapiens
CWIHSKYEE

SEQ ID NO: 799112 - protein, 9 aa, Homo Sapiens
YLFLFDNVV

SEQ ID NO: 799113 - protein, 9 aa, Homo Sapiens
QGNTKYRAL

SEQ ID NO: 799114 - protein, 9 aa, Homo Sapiens
AEWDPVAGA

SEQ ID NO: 799115 - protein, 9 aa, Homo Sapiens
GLDAPLFGV

SEQ ID NO: 799116 - protein, 9 aa, Homo Sapiens
GANTSTCMP

SEQ ID NO: 799117 - protein, 9 aa, Homo Sapiens
ADPLVATGN

SEQ ID NO: 799118 - protein, 9 aa, Homo Sapiens
PYQLAPPSG

SEQ ID NO: 799119 - protein, 9 aa, Homo Sapiens
NAEEHMDLR

SEQ ID NO: 799120 - protein, 9 aa, Homo Sapiens
PVAGALQDS

SEQ ID NO: 799121 - protein, 9 aa, Homo Sapiens
YCWMNSNYR

SEQ ID NO: 799122 - protein, 9 aa, Homo Sapiens
FGYSKEHVR

SEQ ID NO: 799123 - protein, 9 aa, Homo Sapiens
QSQDEFLSS

SEQ ID NO: 799124 - protein, 9 aa, Homo Sapiens
ATNSNNTDV

SEQ ID NO: 799125 - protein, 9 aa, Homo Sapiens
HKLWCRQIP

SEQ ID NO: 799126 - protein, 9 aa, Homo Sapiens
PVINPYQLA

SEQ ID NO: 799127 - protein, 9 aa, Homo Sapiens
RRTLSPLHT

SEQ ID NO: 799128 - protein, 9 aa, Homo Sapiens
STREEKECW

SEQ ID NO: 799129 - protein, 9 aa, Homo Sapiens
FFLFLCCLL

SEQ ID NO: 799130 - protein, 9 aa, Homo Sapiens
CLLSPLLKA

SEQ ID NO: 799131 - protein, 9 aa, Homo Sapiens
FANPLLYCW

SEQ ID NO: 799132 - protein, 9 aa, Homo Sapiens
FTPLTVAEM

SEQ ID NO: 799133 - protein, 9 aa, Homo Sapiens
EKECWIHSK

SEQ ID NO: 799134 - protein, 9 aa, Homo Sapiens
QPLLLLPLL

SEQ ID NO: 799135 - protein, 9 aa, Homo Sapiens
STPGGARCG

SEQ ID NO: 799136 - protein, 9 aa, Homo Sapiens
VLHAEWDPV

SEQ ID NO: 799137 - protein, 9 aa, Homo Sapiens
MDIQGNTKY

SEQ ID NO: 799138 - protein, 9 aa, Homo Sapiens
STAPWESVG

SEQ ID NO: 799139 - protein, 9 aa, Homo Sapiens
VAEAPLPPG

SEQ ID NO: 799140 - protein, 9 aa, Homo Sapiens
YRSHNVAEA

SEQ ID NO: 799141 - protein, 9 aa, Homo Sapiens
MAIGAIARR

SEQ ID NO: 799142 - protein, 9 aa, Homo Sapiens
VTTTLKLIL

SEQ ID NO: 799143 - protein, 9 aa, Homo Sapiens
MGAELISFK

SEQ ID NO: 799144 - protein, 9 aa, Homo Sapiens
RLQSLKGTV

SEQ ID NO: 799145 - protein, 9 aa, Homo Sapiens
LEGDEDASH

SEQ ID NO: 799146 - protein, 9 aa, Homo Sapiens
DLKDVFGFH

SEQ ID NO: 799147 - protein, 9 aa, Homo Sapiens
TLKLILVML

SEQ ID NO: 799148 - protein, 9 aa, Homo Sapiens
KLILVMLEI

SEQ ID NO: 799149 - protein, 9 aa, Homo Sapiens
FGSHCSIPE

SEQ ID NO: 799150 - protein, 9 aa, Homo Sapiens
KKLKLAPLQ

SEQ ID NO: 799151 - protein, 9 aa, Homo Sapiens
AERKSLETK

SEQ ID NO: 799152 - protein, 9 aa, Homo Sapiens
TAPWESVGA

SEQ ID NO: 799153 - protein, 9 aa, Homo Sapiens
FIMGIDGGI

SEQ ID NO: 799154 - protein, 9 aa, Homo Sapiens
EDAERKSLE

SEQ ID NO: 799155 - protein, 9 aa, Homo Sapiens
PSQGISPGA

SEQ ID NO: 799156 - protein, 9 aa, Homo Sapiens
KDVFGFHEA

SEQ ID NO: 799157 - protein, 9 aa, Homo Sapiens
LLRKLMLPE

SEQ ID NO: 799158 - protein, 9 aa, Homo Sapiens
DEDASHMEE

SEQ ID NO: 799159 - protein, 9 aa, Homo Sapiens
LKDVFGFHE

SEQ ID NO: 799160 - protein, 9 aa, Homo Sapiens
SHNVAEAPL

SEQ ID NO: 799161 - protein, 9 aa, Homo Sapiens
VAPLLGASL

SEQ ID NO: 799162 - protein, 9 aa, Homo Sapiens
TSVMTLLFP

SEQ ID NO: 799163 - protein, 9 aa, Homo Sapiens
SLKGTVQQG

SEQ ID NO: 799164 - protein, 9 aa, Homo Sapiens
AELISFKAE

SEQ ID NO: 799165 - protein, 9 aa, Homo Sapiens
PSKKKLKLA

SEQ ID NO: 799166 - protein, 9 aa, Homo Sapiens
CPSTAPWES

SEQ ID NO: 799167 - protein, 9 aa, Homo Sapiens
GAELISFKA

SEQ ID NO: 799168 - protein, 9 aa, Homo Sapiens
IARRIVGIA

SEQ ID NO: 799169 - protein, 9 aa, Homo Sapiens
VFGFHEAND

SEQ ID NO: 799170 - protein, 9 aa, Homo Sapiens
SQEFLEDAE

SEQ ID NO: 799171 - protein, 9 aa, Homo Sapiens
YHTGVLEPK

SEQ ID NO: 799172 - protein, 9 aa, Homo Sapiens
DVFGFHEAN

SEQ ID NO: 799173 - protein, 9 aa, Homo Sapiens
LEWDMKINC

SEQ ID NO: 799174 - protein, 9 aa, Homo Sapiens
VEYYPSQGI

SEQ ID NO: 799175 - protein, 9 aa, Homo Sapiens
QLELYRERE

SEQ ID NO: 799176 - protein, 9 aa, Homo Sapiens
SRFGSHCSI

SEQ ID NO: 799177 - protein, 9 aa, Homo Sapiens
RFGSHCSIP

SEQ ID NO: 799178 - protein, 9 aa, Homo Sapiens
AIGAIARRI

SEQ ID NO: 799179 - protein, 9 aa, Homo Sapiens
NVAEAPLPP

SEQ ID NO: 799180 - protein, 9 aa, Homo Sapiens
KELQLELYR

SEQ ID NO: 799181 - protein, 9 aa, Homo Sapiens
PPRLQSLKG

SEQ ID NO: 799182 - protein, 9 aa, Homo Sapiens
SIPEEYCVS

SEQ ID NO: 799183 - protein, 9 aa, Homo Sapiens
QVTTTLKLI

SEQ ID NO: 799184 - protein, 9 aa, Homo Sapiens
LEDAERKSL

SEQ ID NO: 799185 - protein, 9 aa, Homo Sapiens
HCSIPEEYC

SEQ ID NO: 799186 - protein, 9 aa, Homo Sapiens
LRKLMLPEA

SEQ ID NO: 799187 - protein, 9 aa, Homo Sapiens
LQSLKGTVQ

SEQ ID NO: 799188 - protein, 9 aa, Homo Sapiens
MSSLLRKLM

SEQ ID NO: 799189 - protein, 9 aa, Homo Sapiens
RQVVEYYPS

SEQ ID NO: 799190 - protein, 9 aa, Homo Sapiens
GGIALSVLP

SEQ ID NO: 799191 - protein, 9 aa, Homo Sapiens
LMSSLLRKL

SEQ ID NO: 799192 - protein, 9 aa, Homo Sapiens
EYYPSQGIS

SEQ ID NO: 799193 - protein, 9 aa, Homo Sapiens
EDASHMEEV

SEQ ID NO: 799194 - protein, 9 aa, Homo Sapiens
TIMGAELIS

SEQ ID NO: 799195 - protein, 9 aa, Homo Sapiens
HTGVLEPKG

SEQ ID NO: 799196 - protein, 9 aa, Homo Sapiens
TIKFMKGDG

SEQ ID NO: 799197 - protein, 9 aa, Homo Sapiens
RTSVMTLLF

SEQ ID NO: 799198 - protein, 9 aa, Homo Sapiens
KDLKDVFGF

SEQ ID NO: 799199 - protein, 9 aa, Homo Sapiens
MERVSKETL

SEQ ID NO: 799200 - protein, 9 aa, Homo Sapiens
ELTQVTKQE

SEQ ID NO: 799201 - protein, 9 aa, Homo Sapiens
RSHNVAEAP

SEQ ID NO: 799202 - protein, 9 aa, Homo Sapiens
PRLQSLKGT

SEQ ID NO: 799203 - protein, 9 aa, Homo Sapiens
RYYHTGVLE

SEQ ID NO: 799204 - protein, 9 aa, Homo Sapiens
LQVTTTLKL

SEQ ID NO: 799205 - protein, 9 aa, Homo Sapiens
FFKLEWDMK

SEQ ID NO: 799206 - protein, 9 aa, Homo Sapiens
GASLGGIIY

SEQ ID NO: 799207 - protein, 9 aa, Homo Sapiens
GSHCSIPEE

SEQ ID NO: 799208 - protein, 9 aa, Homo Sapiens
TKVMERVSK

SEQ ID NO: 799209 - protein, 9 aa, Homo Sapiens
PSTAPWESV

SEQ ID NO: 799210 - protein, 9 aa, Homo Sapiens
PSSRGRDVF

SEQ ID NO: 799211 - protein, 9 aa, Homo Sapiens
SHCSIPEEY

SEQ ID NO: 799212 - protein, 9 aa, Homo Sapiens
QQEKKELQL

SEQ ID NO: 799213 - protein, 9 aa, Homo Sapiens
TEDFFKLEW

SEQ ID NO: 799214 - protein, 9 aa, Homo Sapiens
KLKLAPLQV

SEQ ID NO: 799215 - protein, 9 aa, Homo Sapiens
GWPSSRGRD

SEQ ID NO: 799216 - protein, 9 aa, Homo Sapiens
QTKVMERVS

SEQ ID NO: 799217 - protein, 9 aa, Homo Sapiens
KKKLKLAPL

SEQ ID NO: 799218 - protein, 9 aa, Homo Sapiens
LVMLEIVTE

SEQ ID NO: 799219 - protein, 9 aa, Homo Sapiens
LAPLQVTTT

SEQ ID NO: 799220 - protein, 9 aa, Homo Sapiens
PRQVVEYYP

SEQ ID NO: 799221 - protein, 9 aa, Homo Sapiens
FMKGDGAKE

SEQ ID NO: 799222 - protein, 9 aa, Homo Sapiens
EWDMKINCS

SEQ ID NO: 799223 - protein, 9 aa, Homo Sapiens
IGAIARRIV

SEQ ID NO: 799224 - protein, 9 aa, Homo Sapiens
APWESVGAR

SEQ ID NO: 799225 - protein, 9 aa, Homo Sapiens
GAIARRIVG

SEQ ID NO: 799226 - protein, 9 aa, Homo Sapiens
VMERVSKET

SEQ ID NO: 799227 - protein, 9 aa, Homo Sapiens
CSIPEEYCV

SEQ ID NO: 799228 - protein, 9 aa, Homo Sapiens
KFMKGDGAK

SEQ ID NO: 799229 - protein, 9 aa, Homo Sapiens
VVEYYPSQG

SEQ ID NO: 799230 - protein, 9 aa, Homo Sapiens
PIRTSVMTL

SEQ ID NO: 799231 - protein, 9 aa, Homo Sapiens
LILVMLEIV

SEQ ID NO: 799232 - protein, 9 aa, Homo Sapiens
FLEDAERKS

SEQ ID NO: 799233 - protein, 9 aa, Homo Sapiens
TQVTKQEEL

SEQ ID NO: 799234 - protein, 9 aa, Homo Sapiens
DAERKSLET

SEQ ID NO: 799235 - protein, 9 aa, Homo Sapiens
ILVMLEIVT

SEQ ID NO: 799236 - protein, 9 aa, Homo Sapiens
IMGAELISF

SEQ ID NO: 799237 - protein, 9 aa, Homo Sapiens
IDGGIALSV

SEQ ID NO: 799238 - protein, 9 aa, Homo Sapiens
YPSQGISPG

SEQ ID NO: 799239 - protein, 9 aa, Homo Sapiens
LGASLGGII

SEQ ID NO: 799240 - protein, 9 aa, Homo Sapiens
TTTLKLILV

SEQ ID NO: 799241 - protein, 9 aa, Homo Sapiens
KLMLPEASL

SEQ ID NO: 799242 - protein, 9 aa, Homo Sapiens
PLLGASLGG

SEQ ID NO: 799243 - protein, 9 aa, Homo Sapiens
MGIDGGIAL

SEQ ID NO: 799244 - protein, 9 aa, Homo Sapiens
LSRFGSHCS

SEQ ID NO: 799245 - protein, 9 aa, Homo Sapiens
NELTQVTKQ

SEQ ID NO: 799246 - protein, 9 aa, Homo Sapiens
RKLMLPEAS

SEQ ID NO: 799247 - protein, 9 aa, Homo Sapiens
EDFFKLEWD

SEQ ID NO: 799248 - protein, 9 aa, Homo Sapiens
QVVEYYPSQ

SEQ ID NO: 799249 - protein, 9 aa, Homo Sapiens
QEFLEDAER

SEQ ID NO: 799250 - protein, 9 aa, Homo Sapiens
MQTKVMERV

SEQ ID NO: 799251 - protein, 9 aa, Homo Sapiens
SVGARMQER

SEQ ID NO: 799252 - protein, 9 aa, Homo Sapiens
FGFHEANDG

SEQ ID NO: 799253 - protein, 9 aa, Homo Sapiens
ITIMGAELI

SEQ ID NO: 799254 - protein, 9 aa, Homo Sapiens
VVAPLLGAS

SEQ ID NO: 799255 - protein, 9 aa, Homo Sapiens
ILGRYYHTG

SEQ ID NO: 799256 - protein, 9 aa, Homo Sapiens
DFFKLEWDM

SEQ ID NO: 799257 - protein, 9 aa, Homo Sapiens
KVMERVSKE

SEQ ID NO: 799258 - protein, 9 aa, Homo Sapiens
IALSVLPMY

SEQ ID NO: 799259 - protein, 9 aa, Homo Sapiens
TKQEELGKD

SEQ ID NO: 799260 - protein, 9 aa, Homo Sapiens
LKLILVMLE

SEQ ID NO: 799261 - protein, 9 aa, Homo Sapiens
QEKKELQLE

SEQ ID NO: 799262 - protein, 9 aa, Homo Sapiens
VMTLLFPKR

SEQ ID NO: 799263 - protein, 9 aa, Homo Sapiens
EFLEDAERK

SEQ ID NO: 799264 - protein, 9 aa, Homo Sapiens
IYRSHNVAE

SEQ ID NO: 799265 - protein, 9 aa, Homo Sapiens
WPSSRGRDV

SEQ ID NO: 799266 - protein, 9 aa, Homo Sapiens
LFPIRTSVM

SEQ ID NO: 799267 - protein, 9 aa, Homo Sapiens
SMAIGAIAR

SEQ ID NO: 799268 - protein, 9 aa, Homo Sapiens
ITTPSKKKL

SEQ ID NO: 799269 - protein, 9 aa, Homo Sapiens
HNVAEAPLP

SEQ ID NO: 799270 - protein, 9 aa, Homo Sapiens
EKKELQLEL

SEQ ID NO: 799271 - protein, 9 aa, Homo Sapiens
KGTVQQGAQ

SEQ ID NO: 799272 - protein, 9 aa, Homo Sapiens
KGDGAKELP

SEQ ID NO: 799273 - protein, 9 aa, Homo Sapiens
SLGWPSSRG

SEQ ID NO: 799274 - protein, 9 aa, Homo Sapiens
APPRLQSLK

SEQ ID NO: 799275 - protein, 9 aa, Homo Sapiens
ERKSLETKS

SEQ ID NO: 799276 - protein, 9 aa, Homo Sapiens
GDGAKELPD

SEQ ID NO: 799277 - protein, 9 aa, Homo Sapiens
DGGIALSVL

SEQ ID NO: 799278 - protein, 9 aa, Homo Sapiens
RWSLGWPSS

SEQ ID NO: 799279 - protein, 9 aa, Homo Sapiens
LRWSLGWPS

SEQ ID NO: 799280 - protein, 9 aa, Homo Sapiens
MTLLFPKRP

SEQ ID NO: 799281 - protein, 9 aa, Homo Sapiens
APLQVTTTL

SEQ ID NO: 799282 - protein, 9 aa, Homo Sapiens
GIDGGIALS

SEQ ID NO: 799283 - protein, 9 aa, Homo Sapiens
AEAPLPPGS

SEQ ID NO: 799284 - protein, 9 aa, Homo Sapiens
LMLPEASLL

SEQ ID NO: 799285 - protein, 9 aa, Homo Sapiens
DINELTQVT

SEQ ID NO: 799286 - protein, 9 aa, Homo Sapiens
TTLKLILVM

SEQ ID NO: 799287 - protein, 9 aa, Homo Sapiens
AIKMQTKVM

SEQ ID NO: 799288 - protein, 9 aa, Homo Sapiens
MKGDGAKEL

SEQ ID NO: 799289 - protein, 9 aa, Homo Sapiens
TTPSKKKLK

SEQ ID NO: 799290 - protein, 9 aa, Homo Sapiens
SRHRIQSKQ

SEQ ID NO: 799291 - protein, 9 aa, Homo Sapiens
KMQTKVMER

SEQ ID NO: 799292 - protein, 9 aa, Homo Sapiens
WESVGARMQ

SEQ ID NO: 799293 - protein, 9 aa, Homo Sapiens
PWESVGARM

SEQ ID NO: 799294 - protein, 9 aa, Homo Sapiens
SSLLRKLML

SEQ ID NO: 799295 - protein, 9 aa, Homo Sapiens
FEKDLKDVF

SEQ ID NO: 799296 - protein, 9 aa, Homo Sapiens
INELTQVTK

SEQ ID NO: 799297 - protein, 9 aa, Homo Sapiens
GIALSVLPM

SEQ ID NO: 799298 - protein, 9 aa, Homo Sapiens
KKELQLELY

SEQ ID NO: 799299 - protein, 9 aa, Homo Sapiens
DASHMEEVD

SEQ ID NO: 799300 - protein, 9 aa, Homo Sapiens
EKDLKDVFG

SEQ ID NO: 799301 - protein, 9 aa, Homo Sapiens
LQLELYRER

SEQ ID NO: 799302 - protein, 9 aa, Homo Sapiens
VTKQEELGK

SEQ ID NO: 799303 - protein, 9 aa, Homo Sapiens
ARRIVGIAV

SEQ ID NO: 799304 - protein, 9 aa, Homo Sapiens
AIARRIVGI

SEQ ID NO: 799305 - protein, 9 aa, Homo Sapiens
YYHTGVLEP

SEQ ID NO: 799306 - protein, 9 aa, Homo Sapiens
SLGGIIYLV

SEQ ID NO: 799307 - protein, 9 aa, Homo Sapiens
AHITIMGAE

SEQ ID NO: 799308 - protein, 9 aa, Homo Sapiens
HITIMGAEL

SEQ ID NO: 799309 - protein, 9 aa, Homo Sapiens
ASLGGIIYL

SEQ ID NO: 799310 - protein, 9 aa, Homo Sapiens
RRIVGIAVE

SEQ ID NO: 799311 - protein, 9 aa, Homo Sapiens
SVMTLLFPK

SEQ ID NO: 799312 - protein, 9 aa, Homo Sapiens
EGDEDASHM

SEQ ID NO: 799313 - protein, 9 aa, Homo Sapiens
IRTSVMTLL

SEQ ID NO: 799314 - protein, 9 aa, Homo Sapiens
YYPSQGISP

SEQ ID NO: 799315 - protein, 9 aa, Homo Sapiens
QVTKQEELG

SEQ ID NO: 799316 - protein, 9 aa, Homo Sapiens
APLLGASLG

SEQ ID NO: 799317 - protein, 9 aa, Homo Sapiens
SKKKLKLAP

SEQ ID NO: 799318 - protein, 9 aa, Homo Sapiens
LTQVTKQEE

SEQ ID NO: 799319 - protein, 9 aa, Homo Sapiens
ELQLELYRE

SEQ ID NO: 799320 - protein, 9 aa, Homo Sapiens
WVTIKFMKG

SEQ ID NO: 799321 - protein, 9 aa, Homo Sapiens
LGWPSSRGR

SEQ ID NO: 799322 - protein, 9 aa, Homo Sapiens
SKILGRYYH

SEQ ID NO: 799323 - protein, 9 aa, Homo Sapiens
LKGTVQQGA

SEQ ID NO: 799324 - protein, 9 aa, Homo Sapiens
KILGRYYHT

SEQ ID NO: 799325 - protein, 9 aa, Homo Sapiens
WSLGWPSSR

SEQ ID NO: 799326 - protein, 9 aa, Homo Sapiens
FPIRTSVMT

SEQ ID NO: 799327 - protein, 9 aa, Homo Sapiens
ESVGARMQE

SEQ ID NO: 799328 - protein, 9 aa, Homo Sapiens
VTIKFMKGD

SEQ ID NO: 799329 - protein, 9 aa, Homo Sapiens
GRYYHTGVL

SEQ ID NO: 799330 - protein, 9 aa, Homo Sapiens
IKFMKGDGA

SEQ ID NO: 799331 - protein, 9 aa, Homo Sapiens
LLGASLGGI

SEQ ID NO: 799332 - protein, 9 aa, Homo Sapiens
KLAPLQVTT

SEQ ID NO: 799333 - protein, 9 aa, Homo Sapiens
GDEDASHME

SEQ ID NO: 799334 - protein, 9 aa, Homo Sapiens
IKMQTKVME

SEQ ID NO: 799335 - protein, 9 aa, Homo Sapiens
QSLKGTVQQ

SEQ ID NO: 799336 - protein, 9 aa, Homo Sapiens
PLQVTTTLK

SEQ ID NO: 799337 - protein, 9 aa, Homo Sapiens
IQQEKKELQ

SEQ ID NO: 799338 - protein, 9 aa, Homo Sapiens
LKLAPLQVT

SEQ ID NO: 799339 - protein, 9 aa, Homo Sapiens
SSRGRDVFA

SEQ ID NO: 799340 - protein, 9 aa, Homo Sapiens
WDMKINCSG

SEQ ID NO: 799341 - protein, 9 aa, Homo Sapiens
FKLEWDMKI

SEQ ID NO: 799342 - protein, 9 aa, Homo Sapiens
LGRYYHTGV

SEQ ID NO: 799343 - protein, 9 aa, Homo Sapiens
KLEWDMKIN

SEQ ID NO: 799344 - protein, 9 aa, Homo Sapiens
IMGIDGGIA

SEQ ID NO: 799345 - protein, 9 aa, Homo Sapiens
SLLRKLMLP

SEQ ID NO: 799346 - protein, 9 aa, Homo Sapiens
TPSKKKLKL

SEQ ID NO: 799347 - protein, 9 aa, Homo Sapiens
TAHITIMGA

SEQ ID NO: 799348 - protein, 9 aa, Homo Sapiens
YMLHETAAP

SEQ ID NO: 799349 - protein, 9 aa, Homo Sapiens
DTATVLHHQ

SEQ ID NO: 799350 - protein, 9 aa, Homo Sapiens
VIIEQRHHT

SEQ ID NO: 799351 - protein, 9 aa, Homo Sapiens
PLKLAGWQC

SEQ ID NO: 799352 - protein, 9 aa, Homo Sapiens
PVALYIYMH

SEQ ID NO: 799353 - protein, 9 aa, Homo Sapiens
TTEDPSHES

SEQ ID NO: 799354 - protein, 9 aa, Homo Sapiens
EEIILPKTN

SEQ ID NO: 799355 - protein, 9 aa, Homo Sapiens
PPPSTLNHT

SEQ ID NO: 799356 - protein, 9 aa, Homo Sapiens
LHETAAPSD

SEQ ID NO: 799357 - protein, 9 aa, Homo Sapiens
APVALYIYM

SEQ ID NO: 799358 - protein, 9 aa, Homo Sapiens
AIKVYGAYL

SEQ ID NO: 799359 - protein, 9 aa, Homo Sapiens
PSHESSQPI

SEQ ID NO: 799360 - protein, 9 aa, Homo Sapiens
LNHTSGSLL

SEQ ID NO: 799361 - protein, 9 aa, Homo Sapiens
VATLYKDGI

SEQ ID NO: 799362 - protein, 9 aa, Homo Sapiens
PKTNFFMWD

SEQ ID NO: 799363 - protein, 9 aa, Homo Sapiens
VTPLKLAGW

SEQ ID NO: 799364 - protein, 9 aa, Homo Sapiens
QKRLEDTAT

SEQ ID NO: 799365 - protein, 9 aa, Homo Sapiens
EAVATLYKD

SEQ ID NO: 799366 - protein, 9 aa, Homo Sapiens
TNSIPGCEE

SEQ ID NO: 799367 - protein, 9 aa, Homo Sapiens
FNLTNSIPG

SEQ ID NO: 799368 - protein, 9 aa, Homo Sapiens
APPPSTLNH

SEQ ID NO: 799369 - protein, 9 aa, Homo Sapiens
SHESSQPIP

SEQ ID NO: 799370 - protein, 9 aa, Homo Sapiens
ILPKTNFFM

SEQ ID NO: 799371 - protein, 9 aa, Homo Sapiens
LEDTATVLH

SEQ ID NO: 799372 - protein, 9 aa, Homo Sapiens
LYKDGIEFA

SEQ ID NO: 799373 - protein, 9 aa, Homo Sapiens
FAIKVYGAY

SEQ ID NO: 799374 - protein, 9 aa, Homo Sapiens
MLHETAAPS

SEQ ID NO: 799375 - protein, 9 aa, Homo Sapiens
DIPFNLTNS

SEQ ID NO: 799376 - protein, 9 aa, Homo Sapiens
TPLKLAGWQ

SEQ ID NO: 799377 - protein, 9 aa, Homo Sapiens
REAVATLYK

SEQ ID NO: 799378 - protein, 9 aa, Homo Sapiens
KLAGWQCPE

SEQ ID NO: 799379 - protein, 9 aa, Homo Sapiens
ATLYKDGIE

SEQ ID NO: 799380 - protein, 9 aa, Homo Sapiens
LPKTNFFMW

SEQ ID NO: 799381 - protein, 9 aa, Homo Sapiens
SSQPIPKEE

SEQ ID NO: 799382 - protein, 9 aa, Homo Sapiens
IAVTPLKLA

SEQ ID NO: 799383 - protein, 9 aa, Homo Sapiens
HTYDTPTKR

SEQ ID NO: 799384 - protein, 9 aa, Homo Sapiens
YYMLHETAA

SEQ ID NO: 799385 - protein, 9 aa, Homo Sapiens
HHTYDTPTK

SEQ ID NO: 799386 - protein, 9 aa, Homo Sapiens
TNFFMWDIV

SEQ ID NO: 799387 - protein, 9 aa, Homo Sapiens
HESSQPIPK

SEQ ID NO: 799388 - protein, 9 aa, Homo Sapiens
YPLPAPVAL

SEQ ID NO: 799389 - protein, 9 aa, Homo Sapiens
LAGWQCPEC

SEQ ID NO: 799390 - protein, 9 aa, Homo Sapiens
PPSTLNHTS

SEQ ID NO: 799391 - protein, 9 aa, Homo Sapiens
AVTPLKLAG

SEQ ID NO: 799392 - protein, 9 aa, Homo Sapiens
PFNLTNSIP

SEQ ID NO: 799393 - protein, 9 aa, Homo Sapiens
HTSGSLLNA

SEQ ID NO: 799394 - protein, 9 aa, Homo Sapiens
QYYMLHETA

SEQ ID NO: 799395 - protein, 9 aa, Homo Sapiens
DIAVTPLKL

SEQ ID NO: 799396 - protein, 9 aa, Homo Sapiens
AAPSDIVGA

SEQ ID NO: 799397 - protein, 9 aa, Homo Sapiens
RLEDTATVL

SEQ ID NO: 799398 - protein, 9 aa, Homo Sapiens
NFFMWDIVR

SEQ ID NO: 799399 - protein, 9 aa, Homo Sapiens
TYDTPTKRN

SEQ ID NO: 799400 - protein, 9 aa, Homo Sapiens
IPFNLTNSI

SEQ ID NO: 799401 - protein, 9 aa, Homo Sapiens
VALYIYMHI

SEQ ID NO: 799402 - protein, 9 aa, Homo Sapiens
PAPVALYIY

SEQ ID NO: 799403 - protein, 9 aa, Homo Sapiens
TATVLHHQG

SEQ ID NO: 799404 - protein, 9 aa, Homo Sapiens
TAAPSDIVG

SEQ ID NO: 799405 - protein, 9 aa, Homo Sapiens
TREAVATLY

SEQ ID NO: 799406 - protein, 9 aa, Homo Sapiens
EQRHHTYDT

SEQ ID NO: 799407 - protein, 9 aa, Homo Sapiens
LKLAGWQCP

SEQ ID NO: 799408 - protein, 9 aa, Homo Sapiens
ESSQPIPKE

SEQ ID NO: 799409 - protein, 9 aa, Homo Sapiens
STLNHTSGS

SEQ ID NO: 799410 - protein, 9 aa, Homo Sapiens
AVATLYKDG

SEQ ID NO: 799411 - protein, 9 aa, Homo Sapiens
KTNFFMWDI

SEQ ID NO: 799412 - protein, 9 aa, Homo Sapiens
EIILPKTNF

SEQ ID NO: 799413 - protein, 9 aa, Homo Sapiens
KRLEDTATV

SEQ ID NO: 799414 - protein, 9 aa, Homo Sapiens
LPAPVALYI

SEQ ID NO: 799415 - protein, 9 aa, Homo Sapiens
ATVLHHQGQ

SEQ ID NO: 799416 - protein, 9 aa, Homo Sapiens
YKDGIEFAF

SEQ ID NO: 799417 - protein, 9 aa, Homo Sapiens
PLPAPVALY

SEQ ID NO: 799418 - protein, 9 aa, Homo Sapiens
IKVYGAYLL

SEQ ID NO: 799419 - protein, 9 aa, Homo Sapiens
TEDPSHESS

SEQ ID NO: 799420 - protein, 9 aa, Homo Sapiens
EDPSHESSQ

SEQ ID NO: 799421 - protein, 9 aa, Homo Sapiens
HETAAPSDI

SEQ ID NO: 799422 - protein, 9 aa, Homo Sapiens
IILPKTNFF

SEQ ID NO: 799423 - protein, 9 aa, Homo Sapiens
TVLHHQGQQ

SEQ ID NO: 799424 - protein, 9 aa, Homo Sapiens
IIEQRHHTY

SEQ ID NO: 799425 - protein, 9 aa, Homo Sapiens
PSTLNHTSG

SEQ ID NO: 799426 - protein, 9 aa, Homo Sapiens
SIPGCEEED

SEQ ID NO: 799427 - protein, 9 aa, Homo Sapiens
LTNSIPGCE

SEQ ID NO: 799428 - protein, 9 aa, Homo Sapiens
IEQRHHTYD

SEQ ID NO: 799429 - protein, 9 aa, Homo Sapiens
NSIPGCEEE

SEQ ID NO: 799430 - protein, 9 aa, Homo Sapiens
EDTATVLHH

SEQ ID NO: 799431 - protein, 9 aa, Homo Sapiens
TYPLPAPVA

SEQ ID NO: 799432 - protein, 9 aa, Homo Sapiens
NHTSGSLLN

SEQ ID NO: 799433 - protein, 9 aa, Homo Sapiens
TLYKDGIEF

SEQ ID NO: 799434 - protein, 9 aa, Homo Sapiens
CTYPLPAPV

SEQ ID NO: 799435 - protein, 9 aa, Homo Sapiens
RHHTYDTPT

SEQ ID NO: 799436 - protein, 9 aa, Homo Sapiens
NLTNSIPGC

SEQ ID NO: 799437 - protein, 9 aa, Homo Sapiens
QRHHTYDTP

SEQ ID NO: 799438 - protein, 9 aa, Homo Sapiens
TLNHTSGSL

SEQ ID NO: 799439 - protein, 9 aa, Homo Sapiens
ETAAPSDIV

SEQ ID NO: 799440 - protein, 9 aa, Homo Sapiens
MFAIKVYGA

SEQ ID NO: 799441 - protein, 9 aa, Homo Sapiens
DPSHESSQP

SEQ ID NO: 799442 - protein, 9 aa, Homo Sapiens
KLQLVKGEY

SEQ ID NO: 799443 - protein, 9 aa, Homo Sapiens
SPKKGGNYD

SEQ ID NO: 799444 - protein, 9 aa, Homo Sapiens
GQSSGYGQN

SEQ ID NO: 799445 - protein, 9 aa, Homo Sapiens
YVSGLPGPP

SEQ ID NO: 799446 - protein, 9 aa, Homo Sapiens
PQVVKECRA

SEQ ID NO: 799447 - protein, 9 aa, Homo Sapiens
TYAAVKHSR

SEQ ID NO: 799448 - protein, 9 aa, Homo Sapiens
QAVTYAAVK

SEQ ID NO: 799449 - protein, 9 aa, Homo Sapiens
GGNYDLSHQ

SEQ ID NO: 799450 - protein, 9 aa, Homo Sapiens
ATPAVTWLL

SEQ ID NO: 799451 - protein, 9 aa, Homo Sapiens
HPVQANTLT

SEQ ID NO: 799452 - protein, 9 aa, Homo Sapiens
NGSSSGHSS

SEQ ID NO: 799453 - protein, 9 aa, Homo Sapiens
DPQAVTYAA

SEQ ID NO: 799454 - protein, 9 aa, Homo Sapiens
FFPDSMTTP

SEQ ID NO: 799455 - protein, 9 aa, Homo Sapiens
GTNSKKLPQ

SEQ ID NO: 799456 - protein, 9 aa, Homo Sapiens
AFTQKSALR

SEQ ID NO: 799457 - protein, 9 aa, Homo Sapiens
QANTLTLWV

SEQ ID NO: 799458 - protein, 9 aa, Homo Sapiens
NYDLSHQER

SEQ ID NO: 799459 - protein, 9 aa, Homo Sapiens
TWLLLSVEP

SEQ ID NO: 799460 - protein, 9 aa, Homo Sapiens
FPQVVKECR

SEQ ID NO: 799461 - protein, 9 aa, Homo Sapiens
VQANTLTLW

SEQ ID NO: 799462 - protein, 9 aa, Homo Sapiens
SSPKKGGNY

SEQ ID NO: 799463 - protein, 9 aa, Homo Sapiens
VTWLLLSVE

SEQ ID NO: 799464 - protein, 9 aa, Homo Sapiens
LVKGEYITS

SEQ ID NO: 799465 - protein, 9 aa, Homo Sapiens
QAWEELQDQ

SEQ ID NO: 799466 - protein, 9 aa, Homo Sapiens
YAAVKHSRP

SEQ ID NO: 799467 - protein, 9 aa, Homo Sapiens
KKLPQMKNC

SEQ ID NO: 799468 - protein, 9 aa, Homo Sapiens
STMYVSGLP

SEQ ID NO: 799469 - protein, 9 aa, Homo Sapiens
TGTNSKKLP

SEQ ID NO: 799470 - protein, 9 aa, Homo Sapiens
LLNPAVHFP

SEQ ID NO: 799471 - protein, 9 aa, Homo Sapiens
PAVHFPQVV

SEQ ID NO: 799472 - protein, 9 aa, Homo Sapiens
AWEELQDQL

SEQ ID NO: 799473 - protein, 9 aa, Homo Sapiens
KGEYITSAL

SEQ ID NO: 799474 - protein, 9 aa, Homo Sapiens
FQHPVQANT

SEQ ID NO: 799475 - protein, 9 aa, Homo Sapiens
EELQDQLPN

SEQ ID NO: 799476 - protein, 9 aa, Homo Sapiens
SGLPGPPGP

SEQ ID NO: 799477 - protein, 9 aa, Homo Sapiens
AAVKHSRPR

SEQ ID NO: 799478 - protein, 9 aa, Homo Sapiens
LQLVKGEYI

SEQ ID NO: 799479 - protein, 9 aa, Homo Sapiens
SKKLPQMKN

SEQ ID NO: 799480 - protein, 9 aa, Homo Sapiens
YGQNGSSSG

SEQ ID NO: 799481 - protein, 9 aa, Homo Sapiens
LTGTNSKKL

SEQ ID NO: 799482 - protein, 9 aa, Homo Sapiens
TNSKKLPQM

SEQ ID NO: 799483 - protein, 9 aa, Homo Sapiens
AVTYAAVKH

SEQ ID NO: 799484 - protein, 9 aa, Homo Sapiens
ELQDQLPNF

SEQ ID NO: 799485 - protein, 9 aa, Homo Sapiens
MYVSGLPGP

SEQ ID NO: 799486 - protein, 9 aa, Homo Sapiens
LNPAVHFPQ

SEQ ID NO: 799487 - protein, 9 aa, Homo Sapiens
NFFPDSMTT

SEQ ID NO: 799488 - protein, 9 aa, Homo Sapiens
LFQHPVQAN

SEQ ID NO: 799489 - protein, 9 aa, Homo Sapiens
QHPVQANTL

SEQ ID NO: 799490 - protein, 9 aa, Homo Sapiens
VSGLPGPPG

SEQ ID NO: 799491 - protein, 9 aa, Homo Sapiens
HFPQVVKEC

SEQ ID NO: 799492 - protein, 9 aa, Homo Sapiens
AVHFPQVVK

SEQ ID NO: 799493 - protein, 9 aa, Homo Sapiens
NPAVHFPQV

SEQ ID NO: 799494 - protein, 9 aa, Homo Sapiens
VKGEYITSA

SEQ ID NO: 799495 - protein, 9 aa, Homo Sapiens
CQAWEELQD

SEQ ID NO: 799496 - protein, 9 aa, Homo Sapiens
DSMTTPKGN

SEQ ID NO: 799497 - protein, 9 aa, Homo Sapiens
LQDQLPNFL

SEQ ID NO: 799498 - protein, 9 aa, Homo Sapiens
WLLLSVEPD

SEQ ID NO: 799499 - protein, 9 aa, Homo Sapiens
KGGNYDLSH

SEQ ID NO: 799500 - protein, 9 aa, Homo Sapiens
NTLTLWVTS

SEQ ID NO: 799501 - protein, 9 aa, Homo Sapiens
WEELQDQLP

SEQ ID NO: 799502 - protein, 9 aa, Homo Sapiens
TMYVSGLPG

SEQ ID NO: 799503 - protein, 9 aa, Homo Sapiens
SSGYGQNGS

SEQ ID NO: 799504 - protein, 9 aa, Homo Sapiens
TPAVTWLLL

SEQ ID NO: 799505 - protein, 9 aa, Homo Sapiens
PQAVTYAAV

SEQ ID NO: 799506 - protein, 9 aa, Homo Sapiens
GNYDLSHQE

SEQ ID NO: 799507 - protein, 9 aa, Homo Sapiens
ETKLQLVKG

SEQ ID NO: 799508 - protein, 9 aa, Homo Sapiens
FATPAVTWL

SEQ ID NO: 799509 - protein, 9 aa, Homo Sapiens
ANTLTLWVT

SEQ ID NO: 799510 - protein, 9 aa, Homo Sapiens
VHFPQVVKE

SEQ ID NO: 799511 - protein, 9 aa, Homo Sapiens
PKKGGNYDL

SEQ ID NO: 799512 - protein, 9 aa, Homo Sapiens
KKGGNYDLS

SEQ ID NO: 799513 - protein, 9 aa, Homo Sapiens
QLVKGEYIT

SEQ ID NO: 799514 - protein, 9 aa, Homo Sapiens
NSKKLPQMK

SEQ ID NO: 799515 - protein, 9 aa, Homo Sapiens
QCQAWEELQ

SEQ ID NO: 799516 - protein, 9 aa, Homo Sapiens
QDQLPNFLE

SEQ ID NO: 799517 - protein, 9 aa, Homo Sapiens
TKLQLVKGE

SEQ ID NO: 799518 - protein, 9 aa, Homo Sapiens
TPKGNLVDL

SEQ ID NO: 799519 - protein, 9 aa, Homo Sapiens
AVKHSRPRR

SEQ ID NO: 799520 - protein, 9 aa, Homo Sapiens
YDLSHQERL

SEQ ID NO: 799521 - protein, 9 aa, Homo Sapiens
QKSALRVHQ

SEQ ID NO: 799522 - protein, 9 aa, Homo Sapiens
GEYITSALE

SEQ ID NO: 799523 - protein, 9 aa, Homo Sapiens
SMTTPKGNL

SEQ ID NO: 799524 - protein, 9 aa, Homo Sapiens
PVQANTLTL

SEQ ID NO: 799525 - protein, 9 aa, Homo Sapiens
FPDSMTTPK

SEQ ID NO: 799526 - protein, 9 aa, Homo Sapiens
AVTWLLLSV

SEQ ID NO: 799527 - protein, 9 aa, Homo Sapiens
QSSGYGQNG

SEQ ID NO: 799528 - protein, 9 aa, Homo Sapiens
PDSMTTPKG

SEQ ID NO: 799529 - protein, 9 aa, Homo Sapiens
KLPQMKNCC

SEQ ID NO: 799530 - protein, 9 aa, Homo Sapiens
LPQMKNCCN

SEQ ID NO: 799531 - protein, 9 aa, Homo Sapiens
TQKSALRVH

SEQ ID NO: 799532 - protein, 9 aa, Homo Sapiens
ALRVHQRIH

SEQ ID NO: 799533 - protein, 9 aa, Homo Sapiens
SGYGQNGSS

SEQ ID NO: 799534 - protein, 9 aa, Homo Sapiens
KSALRVHQR

SEQ ID NO: 799535 - protein, 9 aa, Homo Sapiens
VTYAAVKHS

SEQ ID NO: 799536 - protein, 9 aa, Homo Sapiens
SSTMYVSGL

SEQ ID NO: 799537 - protein, 9 aa, Homo Sapiens
FTQKSALRV

SEQ ID NO: 799538 - protein, 9 aa, Homo Sapiens
GQNGSSSGH

SEQ ID NO: 799539 - protein, 9 aa, Homo Sapiens
TTPKGNLVD

SEQ ID NO: 799540 - protein, 9 aa, Homo Sapiens
SALRVHQRI

SEQ ID NO: 799541 - protein, 9 aa, Homo Sapiens
LLLSVEPDD

SEQ ID NO: 799542 - protein, 9 aa, Homo Sapiens
PAVTWLLLS

SEQ ID NO: 799543 - protein, 9 aa, Homo Sapiens
QNGSSSGHS

SEQ ID NO: 799544 - protein, 9 aa, Homo Sapiens
MTTPKGNLV

SEQ ID NO: 799545 - protein, 9 aa, Homo Sapiens
GYGQNGSSS

SEQ ID NO: 799546 - protein, 9 aa, Homo Sapiens
HSVSSPTMG

SEQ ID NO: 799547 - protein, 9 aa, Homo Sapiens
DGHRSFHIT

SEQ ID NO: 799548 - protein, 9 aa, Homo Sapiens
AVLRAPHAP

SEQ ID NO: 799549 - protein, 9 aa, Homo Sapiens
ALHLACASD

SEQ ID NO: 799550 - protein, 9 aa, Homo Sapiens
DSPSLFRRH

SEQ ID NO: 799551 - protein, 9 aa, Homo Sapiens
SPTMGKPYK

SEQ ID NO: 799552 - protein, 9 aa, Homo Sapiens
VSSPTMGKP

SEQ ID NO: 799553 - protein, 9 aa, Homo Sapiens
SPSLFRRHE

SEQ ID NO: 799554 - protein, 9 aa, Homo Sapiens
KKKIASLAR

SEQ ID NO: 799555 - protein, 9 aa, Homo Sapiens
CASDHVKVV

SEQ ID NO: 799556 - protein, 9 aa, Homo Sapiens
TASAQNKKK

SEQ ID NO: 799557 - protein, 9 aa, Homo Sapiens
SVSSPTMGK

SEQ ID NO: 799558 - protein, 9 aa, Homo Sapiens
LRAPHAPKS

SEQ ID NO: 799559 - protein, 9 aa, Homo Sapiens
ASAQNKKKI

SEQ ID NO: 799560 - protein, 9 aa, Homo Sapiens
VLRAPHAPK

SEQ ID NO: 799561 - protein, 9 aa, Homo Sapiens
DMQNEDRSV

SEQ ID NO: 799562 - protein, 9 aa, Homo Sapiens
HLACASDHV

SEQ ID NO: 799563 - protein, 9 aa, Homo Sapiens
CRRCDMQNE

SEQ ID NO: 799564 - protein, 9 aa, Homo Sapiens
VVDGHRSFH

SEQ ID NO: 799565 - protein, 9 aa, Homo Sapiens
KQIVVDGHR

SEQ ID NO: 799566 - protein, 9 aa, Homo Sapiens
SLFRRHERI

SEQ ID NO: 799567 - protein, 9 aa, Homo Sapiens
LHLACASDH

SEQ ID NO: 799568 - protein, 9 aa, Homo Sapiens
KKQIVVDGH

SEQ ID NO: 799569 - protein, 9 aa, Homo Sapiens
LFRRHERIH

SEQ ID NO: 799570 - protein, 9 aa, Homo Sapiens
GNHHDPAVL

SEQ ID NO: 799571 - protein, 9 aa, Homo Sapiens
NKKKIASLA

SEQ ID NO: 799572 - protein, 9 aa, Homo Sapiens
RRCDMQNED

SEQ ID NO: 799573 - protein, 9 aa, Homo Sapiens
KSFDSPSLF

SEQ ID NO: 799574 - protein, 9 aa, Homo Sapiens
PAVLRAPHA

SEQ ID NO: 799575 - protein, 9 aa, Homo Sapiens
NHHDPAVLR

SEQ ID NO: 799576 - protein, 9 aa, Homo Sapiens
KKIASLARQ

SEQ ID NO: 799577 - protein, 9 aa, Homo Sapiens
DPAVLRAPH

SEQ ID NO: 799578 - protein, 9 aa, Homo Sapiens
ASDHVKVVT

SEQ ID NO: 799579 - protein, 9 aa, Homo Sapiens
TMGKPYKCN

SEQ ID NO: 799580 - protein, 9 aa, Homo Sapiens
STASAQNKK

SEQ ID NO: 799581 - protein, 9 aa, Homo Sapiens
HHDPAVLRA

SEQ ID NO: 799582 - protein, 9 aa, Homo Sapiens
VMKKQIVVD

SEQ ID NO: 799583 - protein, 9 aa, Homo Sapiens
ACASDHVKV

SEQ ID NO: 799584 - protein, 9 aa, Homo Sapiens
SEIYEAGAP

SEQ ID NO: 799585 - protein, 9 aa, Homo Sapiens
LCRRCDMQN

SEQ ID NO: 799586 - protein, 9 aa, Homo Sapiens
SFDSPSLFR

SEQ ID NO: 799587 - protein, 9 aa, Homo Sapiens
CDMQNEDRS

SEQ ID NO: 799588 - protein, 9 aa, Homo Sapiens
DHVKVVTLL

SEQ ID NO: 799589 - protein, 9 aa, Homo Sapiens
IYEAGAPMA

SEQ ID NO: 799590 - protein, 9 aa, Homo Sapiens
RCDMQNEDR

SEQ ID NO: 799591 - protein, 9 aa, Homo Sapiens
FDSPSLFRR

SEQ ID NO: 799592 - protein, 9 aa, Homo Sapiens
PSLFRRHER

SEQ ID NO: 799593 - protein, 9 aa, Homo Sapiens
SAQNKKKIA

SEQ ID NO: 799594 - protein, 9 aa, Homo Sapiens
GKSFDSPSL

SEQ ID NO: 799595 - protein, 9 aa, Homo Sapiens
MQNEDRSVS

SEQ ID NO: 799596 - protein, 9 aa, Homo Sapiens
QIVVDGHRS

SEQ ID NO: 799597 - protein, 9 aa, Homo Sapiens
AQNKKKIAS

SEQ ID NO: 799598 - protein, 9 aa, Homo Sapiens
HDPAVLRAP

SEQ ID NO: 799599 - protein, 9 aa, Homo Sapiens
MGKPYKCNY

SEQ ID NO: 799600 - protein, 9 aa, Homo Sapiens
MKKQIVVDG

SEQ ID NO: 799601 - protein, 9 aa, Homo Sapiens
YEAGAPMAA

SEQ ID NO: 799602 - protein, 9 aa, Homo Sapiens
QNKKKIASL

SEQ ID NO: 799603 - protein, 9 aa, Homo Sapiens
PELCRRCDM

SEQ ID NO: 799604 - protein, 9 aa, Homo Sapiens
EAGAPMAAA

SEQ ID NO: 799605 - protein, 9 aa, Homo Sapiens
VDGHRSFHI

SEQ ID NO: 799606 - protein, 9 aa, Homo Sapiens
THSVSSPTM

SEQ ID NO: 799607 - protein, 9 aa, Homo Sapiens
ELCRRCDMQ

SEQ ID NO: 799608 - protein, 9 aa, Homo Sapiens
PTMGKPYKC

SEQ ID NO: 799609 - protein, 9 aa, Homo Sapiens
LACASDHVK

SEQ ID NO: 799610 - protein, 9 aa, Homo Sapiens
SSPTMGKPY

SEQ ID NO: 799611 - protein, 9 aa, Homo Sapiens
EIYEAGAPM

SEQ ID NO: 799612 - protein, 9 aa, Homo Sapiens
IVVDGHRSF

SEQ ID NO: 799613 - protein, 9 aa, Homo Sapiens
SDHVKVVTL

SEQ ID NO: 799614 - protein, 9 aa, Homo Sapiens
CLEAGSLYS

SEQ ID NO: 799615 - protein, 9 aa, Homo Sapiens
IFRPISSLM

SEQ ID NO: 799616 - protein, 9 aa, Homo Sapiens
LMNCSIPRT

SEQ ID NO: 799617 - protein, 9 aa, Homo Sapiens
LPRCWNEKI

SEQ ID NO: 799618 - protein, 9 aa, Homo Sapiens
VQLEQDEYA

SEQ ID NO: 799619 - protein, 9 aa, Homo Sapiens
ANRPGSQHD

SEQ ID NO: 799620 - protein, 9 aa, Homo Sapiens
SVYHKPYAD

SEQ ID NO: 799621 - protein, 9 aa, Homo Sapiens
SLCLEAGSL

SEQ ID NO: 799622 - protein, 9 aa, Homo Sapiens
VFSSQVVCR

SEQ ID NO: 799623 - protein, 9 aa, Homo Sapiens
RCWNEKIEL

SEQ ID NO: 799624 - protein, 9 aa, Homo Sapiens
QDYLVGNML

SEQ ID NO: 799625 - protein, 9 aa, Homo Sapiens
LGLDPGRDY

SEQ ID NO: 799626 - protein, 9 aa, Homo Sapiens
SQVVCRCLR

SEQ ID NO: 799627 - protein, 9 aa, Homo Sapiens
TGEGLNVIQ

SEQ ID NO: 799628 - protein, 9 aa, Homo Sapiens
PFMEEAERL

SEQ ID NO: 799629 - protein, 9 aa, Homo Sapiens
SSIRKSVQI

SEQ ID NO: 799630 - protein, 9 aa, Homo Sapiens
WNEKIELAI

SEQ ID NO: 799631 - protein, 9 aa, Homo Sapiens
AAPRCMTHA

SEQ ID NO: 799632 - protein, 9 aa, Homo Sapiens
TRKGMLDPR

SEQ ID NO: 799633 - protein, 9 aa, Homo Sapiens
VSIICSILR

SEQ ID NO: 799634 - protein, 9 aa, Homo Sapiens
EQDEYAKHI

SEQ ID NO: 799635 - protein, 9 aa, Homo Sapiens
DLEAALEAT

SEQ ID NO: 799636 - protein, 9 aa, Homo Sapiens
RALGLDPGR

SEQ ID NO: 799637 - protein, 9 aa, Homo Sapiens
GQLPPPPPR

SEQ ID NO: 799638 - protein, 9 aa, Homo Sapiens
LEATGEGLN

SEQ ID NO: 799639 - protein, 9 aa, Homo Sapiens
LLDPANRPG

SEQ ID NO: 799640 - protein, 9 aa, Homo Sapiens
TGRTQARAR

SEQ ID NO: 799641 - protein, 9 aa, Homo Sapiens
MNCSIPRTL

SEQ ID NO: 799642 - protein, 9 aa, Homo Sapiens
LEGRKSSIR

SEQ ID NO: 799643 - protein, 9 aa, Homo Sapiens
TLSIRRTGH

SEQ ID NO: 799644 - protein, 9 aa, Homo Sapiens
KKKGQLPPP

SEQ ID NO: 799645 - protein, 9 aa, Homo Sapiens
SPQLLDPAN

SEQ ID NO: 799646 - protein, 9 aa, Homo Sapiens
VSIKGGIQI

SEQ ID NO: 799647 - protein, 9 aa, Homo Sapiens
SLKQVQLEQ

SEQ ID NO: 799648 - protein, 9 aa, Homo Sapiens
NLKDDEFEC

SEQ ID NO: 799649 - protein, 9 aa, Homo Sapiens
FFHQAIFRP

SEQ ID NO: 799650 - protein, 9 aa, Homo Sapiens
ALEATGEGL

SEQ ID NO: 799651 - protein, 9 aa, Homo Sapiens
KPDGVLSYQ

SEQ ID NO: 799652 - protein, 9 aa, Homo Sapiens
TCTKNTGRT

SEQ ID NO: 799653 - protein, 9 aa, Homo Sapiens
CRQHFEKIK

SEQ ID NO: 799654 - protein, 9 aa, Homo Sapiens
SVLGTALHG

SEQ ID NO: 799655 - protein, 9 aa, Homo Sapiens
CWNEKIELA

SEQ ID NO: 799656 - protein, 9 aa, Homo Sapiens
GLPRCWNEK

SEQ ID NO: 799657 - protein, 9 aa, Homo Sapiens
DKKKFGLCR

SEQ ID NO: 799658 - protein, 9 aa, Homo Sapiens
KSGQVLIGC

SEQ ID NO: 799659 - protein, 9 aa, Homo Sapiens
YHKPYADPV

SEQ ID NO: 799660 - protein, 9 aa, Homo Sapiens
VVCRCLRFF

SEQ ID NO: 799661 - protein, 9 aa, Homo Sapiens
MDTGLPRCW

SEQ ID NO: 799662 - protein, 9 aa, Homo Sapiens
QLEQDEYAK

SEQ ID NO: 799663 - protein, 9 aa, Homo Sapiens
VLSYVSIIC

SEQ ID NO: 799664 - protein, 9 aa, Homo Sapiens
SLLSNDVNK

SEQ ID NO: 799665 - protein, 9 aa, Homo Sapiens
YEDVVQIVL

SEQ ID NO: 799666 - protein, 9 aa, Homo Sapiens
LWLHSVYHK

SEQ ID NO: 799667 - protein, 9 aa, Homo Sapiens
WKKAHTSLV

SEQ ID NO: 799668 - protein, 9 aa, Homo Sapiens
TALHGDVCT

SEQ ID NO: 799669 - protein, 9 aa, Homo Sapiens
RRDEHGRRP

SEQ ID NO: 799670 - protein, 9 aa, Homo Sapiens
SKVTDAVVW

SEQ ID NO: 799671 - protein, 9 aa, Homo Sapiens
TKLWKKAHT

SEQ ID NO: 799672 - protein, 9 aa, Homo Sapiens
DRRFWNAIS

SEQ ID NO: 799673 - protein, 9 aa, Homo Sapiens
EKRRDEHGR

SEQ ID NO: 799674 - protein, 9 aa, Homo Sapiens
YVSIICSIL

SEQ ID NO: 799675 - protein, 9 aa, Homo Sapiens
SMSSSPMIN

SEQ ID NO: 799676 - protein, 9 aa, Homo Sapiens
VLGTALHGD

SEQ ID NO: 799677 - protein, 9 aa, Homo Sapiens
RKWWYKICF

SEQ ID NO: 799678 - protein, 9 aa, Homo Sapiens
QVVCRCLRF

SEQ ID NO: 799679 - protein, 9 aa, Homo Sapiens
SNRVKMQQK

SEQ ID NO: 799680 - protein, 9 aa, Homo Sapiens
DIYQESMSS

SEQ ID NO: 799681 - protein, 9 aa, Homo Sapiens
QIVLGFQGA

SEQ ID NO: 799682 - protein, 9 aa, Homo Sapiens
VSLLSNDVN

SEQ ID NO: 799683 - protein, 9 aa, Homo Sapiens
LRFFFHQAI

SEQ ID NO: 799684 - protein, 9 aa, Homo Sapiens
GLCRQHFEK

SEQ ID NO: 799685 - protein, 9 aa, Homo Sapiens
YLCTECPTP

SEQ ID NO: 799686 - protein, 9 aa, Homo Sapiens
YLVGNMLSR

SEQ ID NO: 799687 - protein, 9 aa, Homo Sapiens
MLDPREVHL

SEQ ID NO: 799688 - protein, 9 aa, Homo Sapiens
CDVLVAVND

SEQ ID NO: 799689 - protein, 9 aa, Homo Sapiens
NRVKMQQKS

SEQ ID NO: 799690 - protein, 9 aa, Homo Sapiens
RKGMLDPRE

SEQ ID NO: 799691 - protein, 9 aa, Homo Sapiens
HSVYHKPYA

SEQ ID NO: 799692 - protein, 9 aa, Homo Sapiens
NCSIPRTLS

SEQ ID NO: 799693 - protein, 9 aa, Homo Sapiens
GLDPGRDYA

SEQ ID NO: 799694 - protein, 9 aa, Homo Sapiens
SFYCFCCVF

SEQ ID NO: 799695 - protein, 9 aa, Homo Sapiens
KGQLPPPPP

SEQ ID NO: 799696 - protein, 9 aa, Homo Sapiens
FRPISSLMN

SEQ ID NO: 799697 - protein, 9 aa, Homo Sapiens
RFFFHQAIF

SEQ ID NO: 799698 - protein, 9 aa, Homo Sapiens
DEFECFLGL

SEQ ID NO: 799699 - protein, 9 aa, Homo Sapiens
RTLSIRRTG

SEQ ID NO: 799700 - protein, 9 aa, Homo Sapiens
RDEHGRRPD

SEQ ID NO: 799701 - protein, 9 aa, Homo Sapiens
RTPPSSPKT

SEQ ID NO: 799702 - protein, 9 aa, Homo Sapiens
RCMTHAKRA

SEQ ID NO: 799703 - protein, 9 aa, Homo Sapiens
CFLGLLGLR

SEQ ID NO: 799704 - protein, 9 aa, Homo Sapiens
LAINATNIS

SEQ ID NO: 799705 - protein, 9 aa, Homo Sapiens
FWNAISFYT

SEQ ID NO: 799706 - protein, 9 aa, Homo Sapiens
ISSLMNCSI

SEQ ID NO: 799707 - protein, 9 aa, Homo Sapiens
DPGRDYATA

SEQ ID NO: 799708 - protein, 9 aa, Homo Sapiens
SIRKSVQIA

SEQ ID NO: 799709 - protein, 9 aa, Homo Sapiens
VYHKPYADP

SEQ ID NO: 799710 - protein, 9 aa, Homo Sapiens
GTALHGDVC

SEQ ID NO: 799711 - protein, 9 aa, Homo Sapiens
PISSLMNCS

SEQ ID NO: 799712 - protein, 9 aa, Homo Sapiens
LDPANRPGS

SEQ ID NO: 799713 - protein, 9 aa, Homo Sapiens
DPREVHLLD

SEQ ID NO: 799714 - protein, 9 aa, Homo Sapiens
TDKKKFGLC

SEQ ID NO: 799715 - protein, 9 aa, Homo Sapiens
PAAGSNKPD

SEQ ID NO: 799716 - protein, 9 aa, Homo Sapiens
HLGLRGNRL

SEQ ID NO: 799717 - protein, 9 aa, Homo Sapiens
ERPTAAPRC

SEQ ID NO: 799718 - protein, 9 aa, Homo Sapiens
PREVHLLDF

SEQ ID NO: 799719 - protein, 9 aa, Homo Sapiens
KMQQKSNLE

SEQ ID NO: 799720 - protein, 9 aa, Homo Sapiens
KKGQLPPPP

SEQ ID NO: 799721 - protein, 9 aa, Homo Sapiens
KAVSLTHLG

SEQ ID NO: 799722 - protein, 9 aa, Homo Sapiens
ICSILRIRT

SEQ ID NO: 799723 - protein, 9 aa, Homo Sapiens
EGRKSSIRK

SEQ ID NO: 799724 - protein, 9 aa, Homo Sapiens
LGLRGNRLK

SEQ ID NO: 799725 - protein, 9 aa, Homo Sapiens
NKPDGVLSY

SEQ ID NO: 799726 - protein, 9 aa, Homo Sapiens
LTHLGLRGN

SEQ ID NO: 799727 - protein, 9 aa, Homo Sapiens
KQVQLEQDE

SEQ ID NO: 799728 - protein, 9 aa, Homo Sapiens
KAPAKKKGQ

SEQ ID NO: 799729 - protein, 9 aa, Homo Sapiens
SGQVLIGCD

SEQ ID NO: 799730 - protein, 9 aa, Homo Sapiens
TTTGQIVSL

SEQ ID NO: 799731 - protein, 9 aa, Homo Sapiens
AVELDVSIK

SEQ ID NO: 799732 - protein, 9 aa, Homo Sapiens
TTDKKKFGL

SEQ ID NO: 799733 - protein, 9 aa, Homo Sapiens
KSSIRKSVQ

SEQ ID NO: 799734 - protein, 9 aa, Homo Sapiens
AEKRPFMEE

SEQ ID NO: 799735 - protein, 9 aa, Homo Sapiens
YQESMSSSP

SEQ ID NO: 799736 - protein, 9 aa, Homo Sapiens
SIRRTGHRK

SEQ ID NO: 799737 - protein, 9 aa, Homo Sapiens
VQIVLGFQG

SEQ ID NO: 799738 - protein, 9 aa, Homo Sapiens
VGSRTPPSS

SEQ ID NO: 799739 - protein, 9 aa, Homo Sapiens
KTTTGQIVS

SEQ ID NO: 799740 - protein, 9 aa, Homo Sapiens
VQGQKVGSR

SEQ ID NO: 799741 - protein, 9 aa, Homo Sapiens
EAALEATGE

SEQ ID NO: 799742 - protein, 9 aa, Homo Sapiens
AGSLYSFYC

SEQ ID NO: 799743 - protein, 9 aa, Homo Sapiens
IKGGIQIMA

SEQ ID NO: 799744 - protein, 9 aa, Homo Sapiens
REVHLLDFP

SEQ ID NO: 799745 - protein, 9 aa, Homo Sapiens
NWDGSLSIG

SEQ ID NO: 799746 - protein, 9 aa, Homo Sapiens
TGQIVSLLS

SEQ ID NO: 799747 - protein, 9 aa, Homo Sapiens
LEAALEATG

SEQ ID NO: 799748 - protein, 9 aa, Homo Sapiens
KNTGRTQAR

SEQ ID NO: 799749 - protein, 9 aa, Homo Sapiens
KDDEFECFL

SEQ ID NO: 799750 - protein, 9 aa, Homo Sapiens
DEADKNWDG

SEQ ID NO: 799751 - protein, 9 aa, Homo Sapiens
NTGRTQARA

SEQ ID NO: 799752 - protein, 9 aa, Homo Sapiens
HKPYADPVH

SEQ ID NO: 799753 - protein, 9 aa, Homo Sapiens
PTPSNRVKM

SEQ ID NO: 799754 - protein, 9 aa, Homo Sapiens
TDAVVWYQK

SEQ ID NO: 799755 - protein, 9 aa, Homo Sapiens
EADKNWDGS

SEQ ID NO: 799756 - protein, 9 aa, Homo Sapiens
LCRQHFEKI

SEQ ID NO: 799757 - protein, 9 aa, Homo Sapiens
VKMQQKSNL

SEQ ID NO: 799758 - protein, 9 aa, Homo Sapiens
GDRRFWNAI

SEQ ID NO: 799759 - protein, 9 aa, Homo Sapiens
CMTHAKRAR

SEQ ID NO: 799760 - protein, 9 aa, Homo Sapiens
LSIRRTGHR

SEQ ID NO: 799761 - protein, 9 aa, Homo Sapiens
PRTLSIRRT

SEQ ID NO: 799762 - protein, 9 aa, Homo Sapiens
SLYSFYCFC

SEQ ID NO: 799763 - protein, 9 aa, Homo Sapiens
LYSFYCFCC

SEQ ID NO: 799764 - protein, 9 aa, Homo Sapiens
AISFYTEAS

SEQ ID NO: 799765 - protein, 9 aa, Homo Sapiens
FYCFCCVFS

SEQ ID NO: 799766 - protein, 9 aa, Homo Sapiens
ECPTPSQCV

SEQ ID NO: 799767 - protein, 9 aa, Homo Sapiens
LIGCDVLVA

SEQ ID NO: 799768 - protein, 9 aa, Homo Sapiens
MEEAERLRV

SEQ ID NO: 799769 - protein, 9 aa, Homo Sapiens
GRDYATAVP

SEQ ID NO: 799770 - protein, 9 aa, Homo Sapiens
IVSLLSNDV

SEQ ID NO: 799771 - protein, 9 aa, Homo Sapiens
LLWLHSVYH

SEQ ID NO: 799772 - protein, 9 aa, Homo Sapiens
DYLVGNMLS

SEQ ID NO: 799773 - protein, 9 aa, Homo Sapiens
AGSNKPDGV

SEQ ID NO: 799774 - protein, 9 aa, Homo Sapiens
CCVFSSQVV

SEQ ID NO: 799775 - protein, 9 aa, Homo Sapiens
FHQAIFRPI

SEQ ID NO: 799776 - protein, 9 aa, Homo Sapiens
AINATNISC

SEQ ID NO: 799777 - protein, 9 aa, Homo Sapiens
GRKSSIRKS

SEQ ID NO: 799778 - protein, 9 aa, Homo Sapiens
ELDVSIKGG

SEQ ID NO: 799779 - protein, 9 aa, Homo Sapiens
TGHRKWWYK

SEQ ID NO: 799780 - protein, 9 aa, Homo Sapiens
VAVTETKLW

SEQ ID NO: 799781 - protein, 9 aa, Homo Sapiens
VSLTHLGLR

SEQ ID NO: 799782 - protein, 9 aa, Homo Sapiens
VVQIVLGFQ

SEQ ID NO: 799783 - protein, 9 aa, Homo Sapiens
GQDYLVGNM

SEQ ID NO: 799784 - protein, 9 aa, Homo Sapiens
KLWKKAHTS

SEQ ID NO: 799785 - protein, 9 aa, Homo Sapiens
APRCMTHAK

SEQ ID NO: 799786 - protein, 9 aa, Homo Sapiens
TLAEKRPFM

SEQ ID NO: 799787 - protein, 9 aa, Homo Sapiens
GMLDPREVH

SEQ ID NO: 799788 - protein, 9 aa, Homo Sapiens
IVLGFQGAR

SEQ ID NO: 799789 - protein, 9 aa, Homo Sapiens
MQQKSNLEL

SEQ ID NO: 799790 - protein, 9 aa, Homo Sapiens
LGFQGARPQ

SEQ ID NO: 799791 - protein, 9 aa, Homo Sapiens
KMLEGRKSS

SEQ ID NO: 799792 - protein, 9 aa, Homo Sapiens
EHGRRPDHP

SEQ ID NO: 799793 - protein, 9 aa, Homo Sapiens
LVGNMLSRA

SEQ ID NO: 799794 - protein, 9 aa, Homo Sapiens
SYVSIICSI

SEQ ID NO: 799795 - protein, 9 aa, Homo Sapiens
LHGDVCTHS

SEQ ID NO: 799796 - protein, 9 aa, Homo Sapiens
PAVELDVSI

SEQ ID NO: 799797 - protein, 9 aa, Homo Sapiens
CLRFFFHQA

SEQ ID NO: 799798 - protein, 9 aa, Homo Sapiens
ASKVTDAVV

SEQ ID NO: 799799 - protein, 9 aa, Homo Sapiens
PRCWNEKIE

SEQ ID NO: 799800 - protein, 9 aa, Homo Sapiens
ISCACRRSP

SEQ ID NO: 799801 - protein, 9 aa, Homo Sapiens
VCRCLRFFF

SEQ ID NO: 799802 - protein, 9 aa, Homo Sapiens
KVTTDKKKF

SEQ ID NO: 799803 - protein, 9 aa, Homo Sapiens
DEHGRRPDH

SEQ ID NO: 799804 - protein, 9 aa, Homo Sapiens
SSLMNCSIP

SEQ ID NO: 799805 - protein, 9 aa, Homo Sapiens
ISFYTEASY

SEQ ID NO: 799806 - protein, 9 aa, Homo Sapiens
HGRRPDHPD

SEQ ID NO: 799807 - protein, 9 aa, Homo Sapiens
CTECPTPSQ

SEQ ID NO: 799808 - protein, 9 aa, Homo Sapiens
AIFRPISSL

SEQ ID NO: 799809 - protein, 9 aa, Homo Sapiens
KRRDEHGRR

SEQ ID NO: 799810 - protein, 9 aa, Homo Sapiens
LGTALHGDV

SEQ ID NO: 799811 - protein, 9 aa, Homo Sapiens
LEAGSLYSF

SEQ ID NO: 799812 - protein, 9 aa, Homo Sapiens
TECPTPSQC

SEQ ID NO: 799813 - protein, 9 aa, Homo Sapiens
CRCLRFFFH

SEQ ID NO: 799814 - protein, 9 aa, Homo Sapiens
SIICSILRI

SEQ ID NO: 799815 - protein, 9 aa, Homo Sapiens
ALHGDVCTH

SEQ ID NO: 799816 - protein, 9 aa, Homo Sapiens
VLGFQGARP

SEQ ID NO: 799817 - protein, 9 aa, Homo Sapiens
SPKPKRWRV

SEQ ID NO: 799818 - protein, 9 aa, Homo Sapiens
TQARARTTR

SEQ ID NO: 799819 - protein, 9 aa, Homo Sapiens
VGNMLSRAD

SEQ ID NO: 799820 - protein, 9 aa, Homo Sapiens
APAKKKGQL

SEQ ID NO: 799821 - protein, 9 aa, Homo Sapiens
GQVLIGCDV

SEQ ID NO: 799822 - protein, 9 aa, Homo Sapiens
AVSLTHLGL

SEQ ID NO: 799823 - protein, 9 aa, Homo Sapiens
RFWNAISFY

SEQ ID NO: 799824 - protein, 9 aa, Homo Sapiens
IGCDVLVAV

SEQ ID NO: 799825 - protein, 9 aa, Homo Sapiens
EFECFLGLL

SEQ ID NO: 799826 - protein, 9 aa, Homo Sapiens
TTGQIVSLL

SEQ ID NO: 799827 - protein, 9 aa, Homo Sapiens
TNISCACRR

SEQ ID NO: 799828 - protein, 9 aa, Homo Sapiens
PSNRVKMQQ

SEQ ID NO: 799829 - protein, 9 aa, Homo Sapiens
HQAIFRPIS

SEQ ID NO: 799830 - protein, 9 aa, Homo Sapiens
MSSSPMINE

SEQ ID NO: 799831 - protein, 9 aa, Homo Sapiens
VTTDKKKFG

SEQ ID NO: 799832 - protein, 9 aa, Homo Sapiens
TGLPRCWNE

SEQ ID NO: 799833 - protein, 9 aa, Homo Sapiens
RCLRFFFHQ

SEQ ID NO: 799834 - protein, 9 aa, Homo Sapiens
FECFLGLLG

SEQ ID NO: 799835 - protein, 9 aa, Homo Sapiens
IKKYLCTEC

SEQ ID NO: 799836 - protein, 9 aa, Homo Sapiens
SSSPMINEL

SEQ ID NO: 799837 - protein, 9 aa, Homo Sapiens
CSIPRTLSI

SEQ ID NO: 799838 - protein, 9 aa, Homo Sapiens
TETKLWKKA

SEQ ID NO: 799839 - protein, 9 aa, Homo Sapiens
FMEEAERLR

SEQ ID NO: 799840 - protein, 9 aa, Homo Sapiens
RKVTTDKKK

SEQ ID NO: 799841 - protein, 9 aa, Homo Sapiens
IICSILRIR

SEQ ID NO: 799842 - protein, 9 aa, Homo Sapiens
LKQVQLEQD

SEQ ID NO: 799843 - protein, 9 aa, Homo Sapiens
TAAPRCMTH

SEQ ID NO: 799844 - protein, 9 aa, Homo Sapiens
KKKFGLCRQ

SEQ ID NO: 799845 - protein, 9 aa, Homo Sapiens
QLLDPANRP

SEQ ID NO: 799846 - protein, 9 aa, Homo Sapiens
VVWYQKKIG

SEQ ID NO: 799847 - protein, 9 aa, Homo Sapiens
NMLSRADIH

SEQ ID NO: 799848 - protein, 9 aa, Homo Sapiens
NATNISCAC

SEQ ID NO: 799849 - protein, 9 aa, Homo Sapiens
SLTHLGLRG

SEQ ID NO: 799850 - protein, 9 aa, Homo Sapiens
PRCMTHAKR

SEQ ID NO: 799851 - protein, 9 aa, Homo Sapiens
LEQDEYAKH

SEQ ID NO: 799852 - protein, 9 aa, Homo Sapiens
LDPREVHLL

SEQ ID NO: 799853 - protein, 9 aa, Homo Sapiens
KNWDGSLSI

SEQ ID NO: 799854 - protein, 9 aa, Homo Sapiens
KKFGLCRQH

SEQ ID NO: 799855 - protein, 9 aa, Homo Sapiens
QIVSLLSND

SEQ ID NO: 799856 - protein, 9 aa, Homo Sapiens
YSFYCFCCV

SEQ ID NO: 799857 - protein, 9 aa, Homo Sapiens
PGRDYATAV

SEQ ID NO: 799858 - protein, 9 aa, Homo Sapiens
GSRTPPSSP

SEQ ID NO: 799859 - protein, 9 aa, Homo Sapiens
DAVVWYQKK

SEQ ID NO: 799860 - protein, 9 aa, Homo Sapiens
PANRPGSQH

SEQ ID NO: 799861 - protein, 9 aa, Homo Sapiens
VTETKLWKK

SEQ ID NO: 799862 - protein, 9 aa, Homo Sapiens
MLSRADIHL

SEQ ID NO: 799863 - protein, 9 aa, Homo Sapiens
TPSNRVKMQ

SEQ ID NO: 799864 - protein, 9 aa, Homo Sapiens
LDIYQESMS

SEQ ID NO: 799865 - protein, 9 aa, Homo Sapiens
VELDVSIKG

SEQ ID NO: 799866 - protein, 9 aa, Homo Sapiens
IVLSYVSII

SEQ ID NO: 799867 - protein, 9 aa, Homo Sapiens
EEKRRDEHG

SEQ ID NO: 799868 - protein, 9 aa, Homo Sapiens
VTDAVVWYQ

SEQ ID NO: 799869 - protein, 9 aa, Homo Sapiens
QLPPPPPRH

SEQ ID NO: 799870 - protein, 9 aa, Homo Sapiens
RPFMEEAER

SEQ ID NO: 799871 - protein, 9 aa, Homo Sapiens
DTGLPRCWN

SEQ ID NO: 799872 - protein, 9 aa, Homo Sapiens
EKRPFMEEA

SEQ ID NO: 799873 - protein, 9 aa, Homo Sapiens
SSQVVCRCL

SEQ ID NO: 799874 - protein, 9 aa, Homo Sapiens
SIPRTLSIR

SEQ ID NO: 799875 - protein, 9 aa, Homo Sapiens
ARALGLDPG

SEQ ID NO: 799876 - protein, 9 aa, Homo Sapiens
ETKLWKKAH

SEQ ID NO: 799877 - protein, 9 aa, Homo Sapiens
ALGLDPGRD

SEQ ID NO: 799878 - protein, 9 aa, Homo Sapiens
GQIVSLLSN

SEQ ID NO: 799879 - protein, 9 aa, Homo Sapiens
GRRPDHPDF

SEQ ID NO: 799880 - protein, 9 aa, Homo Sapiens
EATGEGLNV

SEQ ID NO: 799881 - protein, 9 aa, Homo Sapiens
AVTETKLWK

SEQ ID NO: 799882 - protein, 9 aa, Homo Sapiens
RKSSIRKSV

SEQ ID NO: 799883 - protein, 9 aa, Homo Sapiens
DKNWDGSLS

SEQ ID NO: 799884 - protein, 9 aa, Homo Sapiens
GNMLSRADI

SEQ ID NO: 799885 - protein, 9 aa, Homo Sapiens
DVVQIVLGF

SEQ ID NO: 799886 - protein, 9 aa, Homo Sapiens
KKYLCTECP

SEQ ID NO: 799887 - protein, 9 aa, Homo Sapiens
FLAINATNI

SEQ ID NO: 799888 - protein, 9 aa, Homo Sapiens
LAEKRPFME

SEQ ID NO: 799889 - protein, 9 aa, Homo Sapiens
QAIFRPISS

SEQ ID NO: 799890 - protein, 9 aa, Homo Sapiens
RTQARARTT

SEQ ID NO: 799891 - protein, 9 aa, Homo Sapiens
QGQKVGSRT

SEQ ID NO: 799892 - protein, 9 aa, Homo Sapiens
CTKNTGRTQ

SEQ ID NO: 799893 - protein, 9 aa, Homo Sapiens
RPISSLMNC

SEQ ID NO: 799894 - protein, 9 aa, Homo Sapiens
HGDVCTHSV

SEQ ID NO: 799895 - protein, 9 aa, Homo Sapiens
KGMLDPREV

SEQ ID NO: 799896 - protein, 9 aa, Homo Sapiens
ATGEGLNVI

SEQ ID NO: 799897 - protein, 9 aa, Homo Sapiens
GRTQARART

SEQ ID NO: 799898 - protein, 9 aa, Homo Sapiens
QVLIGCDVL

SEQ ID NO: 799899 - protein, 9 aa, Homo Sapiens
EDVVQIVLG

SEQ ID NO: 799900 - protein, 9 aa, Homo Sapiens
SSLCLEAGS

SEQ ID NO: 799901 - protein, 9 aa, Homo Sapiens
MLEGRKSSI

SEQ ID NO: 799902 - protein, 9 aa, Homo Sapiens
KVGSRTPPS

SEQ ID NO: 799903 - protein, 9 aa, Homo Sapiens
FCCVFSSQV

SEQ ID NO: 799904 - protein, 9 aa, Homo Sapiens
AALEATGEG

SEQ ID NO: 799905 - protein, 9 aa, Homo Sapiens
ECFLGLLGL

SEQ ID NO: 799906 - protein, 9 aa, Homo Sapiens
QESMSSSPM

SEQ ID NO: 799907 - protein, 9 aa, Homo Sapiens
GSLYSFYCF

SEQ ID NO: 799908 - protein, 9 aa, Homo Sapiens
CFCCVFSSQ

SEQ ID NO: 799909 - protein, 9 aa, Homo Sapiens
RVKMQQKSN

SEQ ID NO: 799910 - protein, 9 aa, Homo Sapiens
YCFCCVFSS

SEQ ID NO: 799911 - protein, 9 aa, Homo Sapiens
KYLCTECPT

SEQ ID NO: 799912 - protein, 9 aa, Homo Sapiens
FDEADKNWD

SEQ ID NO: 799913 - protein, 9 aa, Homo Sapiens
THLGLRGNR

SEQ ID NO: 799914 - protein, 9 aa, Homo Sapiens
AAGSNKPDG

SEQ ID NO: 799915 - protein, 9 aa, Homo Sapiens
LCTECPTPS

SEQ ID NO: 799916 - protein, 9 aa, Homo Sapiens
QKVGSRTPP

SEQ ID NO: 799917 - protein, 9 aa, Homo Sapiens
ATNISCACR

SEQ ID NO: 799918 - protein, 9 aa, Homo Sapiens
GCDVLVAVN

SEQ ID NO: 799919 - protein, 9 aa, Homo Sapiens
LDVSIKGGI

SEQ ID NO: 799920 - protein, 9 aa, Homo Sapiens
GQKVGSRTP

SEQ ID NO: 799921 - protein, 9 aa, Homo Sapiens
NRPGSQHDA

SEQ ID NO: 799922 - protein, 9 aa, Homo Sapiens
WNAISFYTE

SEQ ID NO: 799923 - protein, 9 aa, Homo Sapiens
GHRKWWYKI

SEQ ID NO: 799924 - protein, 9 aa, Homo Sapiens
QSPKPKRWR

SEQ ID NO: 799925 - protein, 9 aa, Homo Sapiens
LWKKAHTSL

SEQ ID NO: 799926 - protein, 9 aa, Homo Sapiens
KRPFMEEAE

SEQ ID NO: 799927 - protein, 9 aa, Homo Sapiens
PTAAPRCMT

SEQ ID NO: 799928 - protein, 9 aa, Homo Sapiens
MASKVTDAV

SEQ ID NO: 799929 - protein, 9 aa, Homo Sapiens
DPANRPGSQ

SEQ ID NO: 799930 - protein, 9 aa, Homo Sapiens
ESMSSSPMI

SEQ ID NO: 799931 - protein, 9 aa, Homo Sapiens
FGLCRQHFE

SEQ ID NO: 799932 - protein, 9 aa, Homo Sapiens
PQLLDPANR

SEQ ID NO: 799933 - protein, 9 aa, Homo Sapiens
EAGSLYSFY

SEQ ID NO: 799934 - protein, 9 aa, Homo Sapiens
INATNISCA

SEQ ID NO: 799935 - protein, 9 aa, Homo Sapiens
GSNKPDGVL

SEQ ID NO: 799936 - protein, 9 aa, Homo Sapiens
FFFHQAIFR

SEQ ID NO: 799937 - protein, 9 aa, Homo Sapiens
QVQLEQDEY

SEQ ID NO: 799938 - protein, 9 aa, Homo Sapiens
LDPGRDYAT

SEQ ID NO: 799939 - protein, 9 aa, Homo Sapiens
LSYVSIICS

SEQ ID NO: 799940 - protein, 9 aa, Homo Sapiens
FSSQVVCRC

SEQ ID NO: 799941 - protein, 9 aa, Homo Sapiens
NISCACRRS

SEQ ID NO: 799942 - protein, 9 aa, Homo Sapiens
LHSVYHKPY

SEQ ID NO: 799943 - protein, 9 aa, Homo Sapiens
KVTDAVVWY

SEQ ID NO: 799944 - protein, 9 aa, Homo Sapiens
IRRTGHRKW

SEQ ID NO: 799945 - protein, 9 aa, Homo Sapiens
AKKKGQLPP

SEQ ID NO: 799946 - protein, 9 aa, Homo Sapiens
IPRTLSIRR

SEQ ID NO: 799947 - protein, 9 aa, Homo Sapiens
RRTGHRKWW

SEQ ID NO: 799948 - protein, 9 aa, Homo Sapiens
IYQESMSSS

SEQ ID NO: 799949 - protein, 9 aa, Homo Sapiens
GLRGNRLKV

SEQ ID NO: 799950 - protein, 9 aa, Homo Sapiens
KFGLCRQHF

SEQ ID NO: 799951 - protein, 9 aa, Homo Sapiens
WDGSLSIGE

SEQ ID NO: 799952 - protein, 9 aa, Homo Sapiens
SNKPDGVLS

SEQ ID NO: 799953 - protein, 9 aa, Homo Sapiens
SIKGGIQIM

SEQ ID NO: 799954 - protein, 9 aa, Homo Sapiens
HSVLGTALH

SEQ ID NO: 799955 - protein, 9 aa, Homo Sapiens
HRKWWYKIC

SEQ ID NO: 799956 - protein, 9 aa, Homo Sapiens
DVSIKGGIQ

SEQ ID NO: 799957 - protein, 9 aa, Homo Sapiens
AIKKYLCTE

SEQ ID NO: 799958 - protein, 9 aa, Homo Sapiens
MPAAGSNKP

SEQ ID NO: 799959 - protein, 9 aa, Homo Sapiens
VLIGCDVLV

SEQ ID NO: 799960 - protein, 9 aa, Homo Sapiens
LCLEAGSLY

SEQ ID NO: 799961 - protein, 9 aa, Homo Sapiens
TFDEADKNW

SEQ ID NO: 799962 - protein, 9 aa, Homo Sapiens
LKDDEFECF

SEQ ID NO: 799963 - protein, 9 aa, Homo Sapiens
RTGHRKWWY

SEQ ID NO: 799964 - protein, 9 aa, Homo Sapiens
RRFWNAISF

SEQ ID NO: 799965 - protein, 9 aa, Homo Sapiens
PAKKKGQLP

SEQ ID NO: 799966 - protein, 9 aa, Homo Sapiens
WLHSVYHKP

SEQ ID NO: 799967 - protein, 9 aa, Homo Sapiens
CVFSSQVVC

SEQ ID NO: 799968 - protein, 9 aa, Homo Sapiens
NAISFYTEA

SEQ ID NO: 799969 - protein, 9 aa, Homo Sapiens
SLMNCSIPR

SEQ ID NO: 799970 - protein, 9 aa, Homo Sapiens
RPTAAPRCM

SEQ ID NO: 799971 - protein, 9 aa, Homo Sapiens
DDEFECFLG

SEQ ID NO: 799972 - protein, 9 aa, Homo Sapiens
EQSPKPKRW

SEQ ID NO: 799973 - protein, 9 aa, Homo Sapiens
AVVWYQKKI

SEQ ID NO: 799974 - protein, 9 aa, Homo Sapiens
LPPPPPRHL

SEQ ID NO: 799975 - protein, 9 aa, Homo Sapiens
ADKNWDGSL

SEQ ID NO: 799976 - protein, 9 aa, Homo Sapiens
QDEYAKHIK

SEQ ID NO: 799977 - protein, 9 aa, Homo Sapiens
TKNTGRTQA

SEQ ID NO: 799978 - protein, 9 aa, Homo Sapiens
QLVDQDIMP

SEQ ID NO: 799979 - protein, 9 aa, Homo Sapiens
PAIVAALQG

SEQ ID NO: 799980 - protein, 9 aa, Homo Sapiens
QDIMPPLKS

SEQ ID NO: 799981 - protein, 9 aa, Homo Sapiens
SPREEKHLM

SEQ ID NO: 799982 - protein, 9 aa, Homo Sapiens
IIGAAMPDS

SEQ ID NO: 799983 - protein, 9 aa, Homo Sapiens
VPYSIISVL

SEQ ID NO: 799984 - protein, 9 aa, Homo Sapiens
HTGPILSFS

SEQ ID NO: 799985 - protein, 9 aa, Homo Sapiens
VPPTGDSGP

SEQ ID NO: 799986 - protein, 9 aa, Homo Sapiens
DLLEANIST

SEQ ID NO: 799987 - protein, 9 aa, Homo Sapiens
LLDLLEANI

SEQ ID NO: 799988 - protein, 9 aa, Homo Sapiens
AADDGEGII

SEQ ID NO: 799989 - protein, 9 aa, Homo Sapiens
QVAFGSLYQ

SEQ ID NO: 799990 - protein, 9 aa, Homo Sapiens
YSIISVLLK

SEQ ID NO: 799991 - protein, 9 aa, Homo Sapiens
LTAVGTTTQ

SEQ ID NO: 799992 - protein, 9 aa, Homo Sapiens
ISVLLKDKV

SEQ ID NO: 799993 - protein, 9 aa, Homo Sapiens
LYQDDVLIK

SEQ ID NO: 799994 - protein, 9 aa, Homo Sapiens
VFEIDPETD

SEQ ID NO: 799995 - protein, 9 aa, Homo Sapiens
CTVPRDVRI

SEQ ID NO: 799996 - protein, 9 aa, Homo Sapiens
SIRKPRINS

SEQ ID NO: 799997 - protein, 9 aa, Homo Sapiens
TTQDSLTEI

SEQ ID NO: 799998 - protein, 9 aa, Homo Sapiens
MPKDMLYLA

SEQ ID NO: 799999 - protein, 9 aa, Homo Sapiens
LHPCTVPRD

SEQ ID NO: 800000 - protein, 9 aa, Homo Sapiens
DQDIMPPLK

SEQ ID NO: 800001 - protein, 9 aa, Homo Sapiens
TREQLVDQD

SEQ ID NO: 800002 - protein, 9 aa, Homo Sapiens
FMPKDMLYL

SEQ ID NO: 800003 - protein, 9 aa, Homo Sapiens
GIIGAAMPD

SEQ ID NO: 800004 - protein, 9 aa, Homo Sapiens
LDFMRSFMP

SEQ ID NO: 800005 - protein, 9 aa, Homo Sapiens
TGPILSFSE

SEQ ID NO: 800006 - protein, 9 aa, Homo Sapiens
DPEAQRLRT

SEQ ID NO: 800007 - protein, 9 aa, Homo Sapiens
EAREVFEID

SEQ ID NO: 800008 - protein, 9 aa, Homo Sapiens
EKHLMCASP

SEQ ID NO: 800009 - protein, 9 aa, Homo Sapiens
SEYRLHPCT

SEQ ID NO: 800010 - protein, 9 aa, Homo Sapiens
YRLHPCTVP

SEQ ID NO: 800011 - protein, 9 aa, Homo Sapiens
AALQGNLLP

SEQ ID NO: 800012 - protein, 9 aa, Homo Sapiens
LLSPSSLGI

SEQ ID NO: 800013 - protein, 9 aa, Homo Sapiens
LQGNLLPSA

SEQ ID NO: 800014 - protein, 9 aa, Homo Sapiens
LVDQDIMPP

SEQ ID NO: 800015 - protein, 9 aa, Homo Sapiens
TSIRKPRIN

SEQ ID NO: 800016 - protein, 9 aa, Homo Sapiens
AVGTTTQDS

SEQ ID NO: 800017 - protein, 9 aa, Homo Sapiens
IVAALQGNL

SEQ ID NO: 800018 - protein, 9 aa, Homo Sapiens
VLHTGPILS

SEQ ID NO: 800019 - protein, 9 aa, Homo Sapiens
KHLMCASPT

SEQ ID NO: 800020 - protein, 9 aa, Homo Sapiens
RMLLDLLEA

SEQ ID NO: 800021 - protein, 9 aa, Homo Sapiens
IGAAMPDSG

SEQ ID NO: 800022 - protein, 9 aa, Homo Sapiens
VDQDIMPPL

SEQ ID NO: 800023 - protein, 9 aa, Homo Sapiens
PVLHTGPIL

SEQ ID NO: 800024 - protein, 9 aa, Homo Sapiens
VRKGTSIRK

SEQ ID NO: 800025 - protein, 9 aa, Homo Sapiens
DFMRSFMPK

SEQ ID NO: 800026 - protein, 9 aa, Homo Sapiens
EGIIGAAMP

SEQ ID NO: 800027 - protein, 9 aa, Homo Sapiens
LDLLEANIS

SEQ ID NO: 800028 - protein, 9 aa, Homo Sapiens
YPVLHTGPI

SEQ ID NO: 800029 - protein, 9 aa, Homo Sapiens
GEGIIGAAM

SEQ ID NO: 800030 - protein, 9 aa, Homo Sapiens
FMRSFMPKD

SEQ ID NO: 800031 - protein, 9 aa, Homo Sapiens
SPSSLGIPN

SEQ ID NO: 800032 - protein, 9 aa, Homo Sapiens
IRKPRINSQ

SEQ ID NO: 800033 - protein, 9 aa, Homo Sapiens
PYSIISVLL

SEQ ID NO: 800034 - protein, 9 aa, Homo Sapiens
SPAIVAALQ

SEQ ID NO: 800035 - protein, 9 aa, Homo Sapiens
IISVLLKDK

SEQ ID NO: 800036 - protein, 9 aa, Homo Sapiens
FYYPVLHTG

SEQ ID NO: 800037 - protein, 9 aa, Homo Sapiens
EVFEIDPET

SEQ ID NO: 800038 - protein, 9 aa, Homo Sapiens
REEKHLMCA

SEQ ID NO: 800039 - protein, 9 aa, Homo Sapiens
HPCTVPRDV

SEQ ID NO: 800040 - protein, 9 aa, Homo Sapiens
YQEFLLSPS

SEQ ID NO: 800041 - protein, 9 aa, Homo Sapiens
PPTGDSGPP

SEQ ID NO: 800042 - protein, 9 aa, Homo Sapiens
LMCASPTLT

SEQ ID NO: 800043 - protein, 9 aa, Homo Sapiens
VFYYPVLHT

SEQ ID NO: 800044 - protein, 9 aa, Homo Sapiens
SLYQDDVLI

SEQ ID NO: 800045 - protein, 9 aa, Homo Sapiens
EYRLHPCTV

SEQ ID NO: 800046 - protein, 9 aa, Homo Sapiens
SGPPPVPPT

SEQ ID NO: 800047 - protein, 9 aa, Homo Sapiens
TAVGTTTQD

SEQ ID NO: 800048 - protein, 9 aa, Homo Sapiens
FGSLYQDDV

SEQ ID NO: 800049 - protein, 9 aa, Homo Sapiens
GDSGPPPVP

SEQ ID NO: 800050 - protein, 9 aa, Homo Sapiens
TTTQDSLTE

SEQ ID NO: 800051 - protein, 9 aa, Homo Sapiens
AQRLRTVKN

SEQ ID NO: 800052 - protein, 9 aa, Homo Sapiens
EEKHLMCAS

SEQ ID NO: 800053 - protein, 9 aa, Homo Sapiens
DGEGIIGAA

SEQ ID NO: 800054 - protein, 9 aa, Homo Sapiens
YQDDVLIKP

SEQ ID NO: 800055 - protein, 9 aa, Homo Sapiens
GTSIRKPRI

SEQ ID NO: 800056 - protein, 9 aa, Homo Sapiens
YYPVLHTGP

SEQ ID NO: 800057 - protein, 9 aa, Homo Sapiens
VLLKDKVRE

SEQ ID NO: 800058 - protein, 9 aa, Homo Sapiens
VGTTTQDSL

SEQ ID NO: 800059 - protein, 9 aa, Homo Sapiens
RSFMPKDML

SEQ ID NO: 800060 - protein, 9 aa, Homo Sapiens
EDPEAQRLR

SEQ ID NO: 800061 - protein, 9 aa, Homo Sapiens
PKDMLYLAG

SEQ ID NO: 800062 - protein, 9 aa, Homo Sapiens
PEAQRLRTV

SEQ ID NO: 800063 - protein, 9 aa, Homo Sapiens
IDPETDYFY

SEQ ID NO: 800064 - protein, 9 aa, Homo Sapiens
EQLVDQDIM

SEQ ID NO: 800065 - protein, 9 aa, Homo Sapiens
TGEDPEAQR

SEQ ID NO: 800066 - protein, 9 aa, Homo Sapiens
RLHPCTVPR

SEQ ID NO: 800067 - protein, 9 aa, Homo Sapiens
DSGPPPVPP

SEQ ID NO: 800068 - protein, 9 aa, Homo Sapiens
REVFEIDPE

SEQ ID NO: 800069 - protein, 9 aa, Homo Sapiens
FLLSPSSLG

SEQ ID NO: 800070 - protein, 9 aa, Homo Sapiens
LTGEDPEAQ

SEQ ID NO: 800071 - protein, 9 aa, Homo Sapiens
EFLLSPSSL

SEQ ID NO: 800072 - protein, 9 aa, Homo Sapiens
PSSLGIPNS

SEQ ID NO: 800073 - protein, 9 aa, Homo Sapiens
RKGTSIRKP

SEQ ID NO: 800074 - protein, 9 aa, Homo Sapiens
QRLRTVKNI

SEQ ID NO: 800075 - protein, 9 aa, Homo Sapiens
FEIDPETDY

SEQ ID NO: 800076 - protein, 9 aa, Homo Sapiens
ADDGEGIIG

SEQ ID NO: 800077 - protein, 9 aa, Homo Sapiens
AIVAALQGN

SEQ ID NO: 800078 - protein, 9 aa, Homo Sapiens
KGTSIRKPR

SEQ ID NO: 800079 - protein, 9 aa, Homo Sapiens
DIMPPLKSP

SEQ ID NO: 800080 - protein, 9 aa, Homo Sapiens
SIISVLLKD

SEQ ID NO: 800081 - protein, 9 aa, Homo Sapiens
DDGEGIIGA

SEQ ID NO: 800082 - protein, 9 aa, Homo Sapiens
MCASPTLTT

SEQ ID NO: 800083 - protein, 9 aa, Homo Sapiens
EAQRLRTVK

SEQ ID NO: 800084 - protein, 9 aa, Homo Sapiens
MRSFMPKDM

SEQ ID NO: 800085 - protein, 9 aa, Homo Sapiens
DVRKGTSIR

SEQ ID NO: 800086 - protein, 9 aa, Homo Sapiens
LSPSSLGIP

SEQ ID NO: 800087 - protein, 9 aa, Homo Sapiens
ERMLLDLLE

SEQ ID NO: 800088 - protein, 9 aa, Homo Sapiens
QDSLTEINL

SEQ ID NO: 800089 - protein, 9 aa, Homo Sapiens
QDDVLIKPS

SEQ ID NO: 800090 - protein, 9 aa, Homo Sapiens
CDVRKGTSI

SEQ ID NO: 800091 - protein, 9 aa, Homo Sapiens
PCTVPRDVR

SEQ ID NO: 800092 - protein, 9 aa, Homo Sapiens
GTTTQDSLT

SEQ ID NO: 800093 - protein, 9 aa, Homo Sapiens
ALQGNLLPS

SEQ ID NO: 800094 - protein, 9 aa, Homo Sapiens
VAFGSLYQD

SEQ ID NO: 800095 - protein, 9 aa, Homo Sapiens
GSLYQDDVL

SEQ ID NO: 800096 - protein, 9 aa, Homo Sapiens
HLMCASPTL

SEQ ID NO: 800097 - protein, 9 aa, Homo Sapiens
QSPAIVAAL

SEQ ID NO: 800098 - protein, 9 aa, Homo Sapiens
AREVFEIDP

SEQ ID NO: 800099 - protein, 9 aa, Homo Sapiens
SFMPKDMLY

SEQ ID NO: 800100 - protein, 9 aa, Homo Sapiens
QSEYRLHPC

SEQ ID NO: 800101 - protein, 9 aa, Homo Sapiens
MLLDLLEAN

SEQ ID NO: 800102 - protein, 9 aa, Homo Sapiens
TQDSLTEIN

SEQ ID NO: 800103 - protein, 9 aa, Homo Sapiens
EEAREVFEI

SEQ ID NO: 800104 - protein, 9 aa, Homo Sapiens
PTGDSGPPP

SEQ ID NO: 800105 - protein, 9 aa, Homo Sapiens
SVLLKDKVR

SEQ ID NO: 800106 - protein, 9 aa, Homo Sapiens
QEFLLSPSS

SEQ ID NO: 800107 - protein, 9 aa, Homo Sapiens
EIDPETDYF

SEQ ID NO: 800108 - protein, 9 aa, Homo Sapiens
GEDPEAQRL

SEQ ID NO: 800109 - protein, 9 aa, Homo Sapiens
AFGSLYQDD

SEQ ID NO: 800110 - protein, 9 aa, Homo Sapiens
LHTGPILSF

SEQ ID NO: 800111 - protein, 9 aa, Homo Sapiens
PREEKHLMC

SEQ ID NO: 800112 - protein, 9 aa, Homo Sapiens
RVPYSIISV

SEQ ID NO: 800113 - protein, 9 aa, Homo Sapiens
REQLVDQDI

SEQ ID NO: 800114 - protein, 9 aa, Homo Sapiens
SSLGIPNSR

SEQ ID NO: 800115 - protein, 9 aa, Homo Sapiens
VAALQGNLL

SEQ ID NO: 800116 - protein, 9 aa, Homo Sapiens
TGDSGPPPV

SEQ ID NO: 800117 - protein, 9 aa, Homo Sapiens
GLSLLLLLT

SEQ ID NO: 800118 - protein, 9 aa, Homo Sapiens
LSLLLLLTF

SEQ ID NO: 800119 - protein, 9 aa, Homo Sapiens
KAEGTQNQG

SEQ ID NO: 800120 - protein, 9 aa, Homo Sapiens
SLLLLLTFV

SEQ ID NO: 800121 - protein, 9 aa, Homo Sapiens
TQNQGKKAE

SEQ ID NO: 800122 - protein, 9 aa, Homo Sapiens
AEGTQNQGK

SEQ ID NO: 800123 - protein, 9 aa, Homo Sapiens
GLLLLLLVT

SEQ ID NO: 800124 - protein, 9 aa, Homo Sapiens
GGLLLLLLV

SEQ ID NO: 800125 - protein, 9 aa, Homo Sapiens
EGTQNQGKK

SEQ ID NO: 800126 - protein, 9 aa, Homo Sapiens
GTQNQGKKA

SEQ ID NO: 800127 - protein, 9 aa, Homo Sapiens
RSQSRVCNI

SEQ ID NO: 800128 - protein, 9 aa, Homo Sapiens
PKLLPLDLE

SEQ ID NO: 800129 - protein, 9 aa, Homo Sapiens
PMTDGAHPQ

SEQ ID NO: 800130 - protein, 9 aa, Homo Sapiens
KYQLLDHVR

SEQ ID NO: 800131 - protein, 9 aa, Homo Sapiens
HQQQQQEPW

SEQ ID NO: 800132 - protein, 9 aa, Homo Sapiens
DKTLVGDFM

SEQ ID NO: 800133 - protein, 9 aa, Homo Sapiens
SRDITGREV

SEQ ID NO: 800134 - protein, 9 aa, Homo Sapiens
KRHRNQDEP

SEQ ID NO: 800135 - protein, 9 aa, Homo Sapiens
QLLDHVRRY

SEQ ID NO: 800136 - protein, 9 aa, Homo Sapiens
VCNIASRAK

SEQ ID NO: 800137 - protein, 9 aa, Homo Sapiens
FGYQDHNVR

SEQ ID NO: 800138 - protein, 9 aa, Homo Sapiens
SFNLITGMF

SEQ ID NO: 800139 - protein, 9 aa, Homo Sapiens
LAEVYQDKT

SEQ ID NO: 800140 - protein, 9 aa, Homo Sapiens
RQHQQNIRP

SEQ ID NO: 800141 - protein, 9 aa, Homo Sapiens
QIAGRPLPD

SEQ ID NO: 800142 - protein, 9 aa, Homo Sapiens
PIEVNIEVT

SEQ ID NO: 800143 - protein, 9 aa, Homo Sapiens
MVEICNANV

SEQ ID NO: 800144 - protein, 9 aa, Homo Sapiens
DTVIGRERW

SEQ ID NO: 800145 - protein, 9 aa, Homo Sapiens
DLEKTAIQN

SEQ ID NO: 800146 - protein, 9 aa, Homo Sapiens
SASDVHGSF

SEQ ID NO: 800147 - protein, 9 aa, Homo Sapiens
FMSFNLITG

SEQ ID NO: 800148 - protein, 9 aa, Homo Sapiens
RWPRLSDRP

SEQ ID NO: 800149 - protein, 9 aa, Homo Sapiens
EPRRWLHVQ

SEQ ID NO: 800150 - protein, 9 aa, Homo Sapiens
QLTAESPIE

SEQ ID NO: 800151 - protein, 9 aa, Homo Sapiens
MGMKKRHRN

SEQ ID NO: 800152 - protein, 9 aa, Homo Sapiens
HNIYLTGRQ

SEQ ID NO: 800153 - protein, 9 aa, Homo Sapiens
VHGSFAFEG

SEQ ID NO: 800154 - protein, 9 aa, Homo Sapiens
QLHQQQQQE

SEQ ID NO: 800155 - protein, 9 aa, Homo Sapiens
GREVHDARV

SEQ ID NO: 800156 - protein, 9 aa, Homo Sapiens
TFMSFNLIT

SEQ ID NO: 800157 - protein, 9 aa, Homo Sapiens
IYLTGRQFG

SEQ ID NO: 800158 - protein, 9 aa, Homo Sapiens
SHNIYLTGR

SEQ ID NO: 800159 - protein, 9 aa, Homo Sapiens
PRQHQQNIR

SEQ ID NO: 800160 - protein, 9 aa, Homo Sapiens
ASASDVHGS

SEQ ID NO: 800161 - protein, 9 aa, Homo Sapiens
HRNQDEPRR

SEQ ID NO: 800162 - protein, 9 aa, Homo Sapiens
DLTSSGTFK

SEQ ID NO: 800163 - protein, 9 aa, Homo Sapiens
LPLDLEKTA

SEQ ID NO: 800164 - protein, 9 aa, Homo Sapiens
GMKKRHRNQ

SEQ ID NO: 800165 - protein, 9 aa, Homo Sapiens
TSSGTFKEY

SEQ ID NO: 800166 - protein, 9 aa, Homo Sapiens
QSRVCNIAS

SEQ ID NO: 800167 - protein, 9 aa, Homo Sapiens
REVHDARVP

SEQ ID NO: 800168 - protein, 9 aa, Homo Sapiens
LHQQQQQEP

SEQ ID NO: 800169 - protein, 9 aa, Homo Sapiens
YQLLDHVRR

SEQ ID NO: 800170 - protein, 9 aa, Homo Sapiens
IAGRPLPDI

SEQ ID NO: 800171 - protein, 9 aa, Homo Sapiens
SSGTFKEYD

SEQ ID NO: 800172 - protein, 9 aa, Homo Sapiens
EVHDARVPH

SEQ ID NO: 800173 - protein, 9 aa, Homo Sapiens
ELTQTFMSF

SEQ ID NO: 800174 - protein, 9 aa, Homo Sapiens
HDARVPHHP

SEQ ID NO: 800175 - protein, 9 aa, Homo Sapiens
LAVPMVRVE

SEQ ID NO: 800176 - protein, 9 aa, Homo Sapiens
AAQLSCQIA

SEQ ID NO: 800177 - protein, 9 aa, Homo Sapiens
RLPMTDGAH

SEQ ID NO: 800178 - protein, 9 aa, Homo Sapiens
SFAFEGIGD

SEQ ID NO: 800179 - protein, 9 aa, Homo Sapiens
LPSPRLPMT

SEQ ID NO: 800180 - protein, 9 aa, Homo Sapiens
GSFAFEGIG

SEQ ID NO: 800181 - protein, 9 aa, Homo Sapiens
YQDHNVRKA

SEQ ID NO: 800182 - protein, 9 aa, Homo Sapiens
NQDEPRRWL

SEQ ID NO: 800183 - protein, 9 aa, Homo Sapiens
IMVEICNAN

SEQ ID NO: 800184 - protein, 9 aa, Homo Sapiens
ELEVFGYQD

SEQ ID NO: 800185 - protein, 9 aa, Homo Sapiens
FPGKVLGVT

SEQ ID NO: 800186 - protein, 9 aa, Homo Sapiens
HPMLAVPMV

SEQ ID NO: 800187 - protein, 9 aa, Homo Sapiens
SRVCNIASR

SEQ ID NO: 800188 - protein, 9 aa, Homo Sapiens
RHRNQDEPR

SEQ ID NO: 800189 - protein, 9 aa, Homo Sapiens
SSHNIYLTG

SEQ ID NO: 800190 - protein, 9 aa, Homo Sapiens
IEVNIEVTD

SEQ ID NO: 800191 - protein, 9 aa, Homo Sapiens
VHDARVPHH

SEQ ID NO: 800192 - protein, 9 aa, Homo Sapiens
YQDKTLVGD

SEQ ID NO: 800193 - protein, 9 aa, Homo Sapiens
WLHVQSRDI

SEQ ID NO: 800194 - protein, 9 aa, Homo Sapiens
DITGREVHD

SEQ ID NO: 800195 - protein, 9 aa, Homo Sapiens
LLPLDLEKT

SEQ ID NO: 800196 - protein, 9 aa, Homo Sapiens
QDHNVRKAF

SEQ ID NO: 800197 - protein, 9 aa, Homo Sapiens
PLDLEKTAI

SEQ ID NO: 800198 - protein, 9 aa, Homo Sapiens
PRLPMTDGA

SEQ ID NO: 800199 - protein, 9 aa, Homo Sapiens
VIGRERWPR

SEQ ID NO: 800200 - protein, 9 aa, Homo Sapiens
SFLDPRQHQ

SEQ ID NO: 800201 - protein, 9 aa, Homo Sapiens
AQLSCQIAG

SEQ ID NO: 800202 - protein, 9 aa, Homo Sapiens
GKVLGVTSE

SEQ ID NO: 800203 - protein, 9 aa, Homo Sapiens
HVQSRDITG

SEQ ID NO: 800204 - protein, 9 aa, Homo Sapiens
SGTFKEYDP

SEQ ID NO: 800205 - protein, 9 aa, Homo Sapiens
TVIGRERWP

SEQ ID NO: 800206 - protein, 9 aa, Homo Sapiens
QDKTLVGDF

SEQ ID NO: 800207 - protein, 9 aa, Homo Sapiens
QLSCQIAGR

SEQ ID NO: 800208 - protein, 9 aa, Homo Sapiens
ISSSHNIYL

SEQ ID NO: 800209 - protein, 9 aa, Homo Sapiens
DEPRRWLHV

SEQ ID NO: 800210 - protein, 9 aa, Homo Sapiens
VFGYQDHNV

SEQ ID NO: 800211 - protein, 9 aa, Homo Sapiens
SDVHGSFAF

SEQ ID NO: 800212 - protein, 9 aa, Homo Sapiens
LTAESPIEV

SEQ ID NO: 800213 - protein, 9 aa, Homo Sapiens
TNRKTLIEP

SEQ ID NO: 800214 - protein, 9 aa, Homo Sapiens
SRSQSRVCN

SEQ ID NO: 800215 - protein, 9 aa, Homo Sapiens
VQSRDITGR

SEQ ID NO: 800216 - protein, 9 aa, Homo Sapiens
SSSHNIYLT

SEQ ID NO: 800217 - protein, 9 aa, Homo Sapiens
ASDVHGSFA

SEQ ID NO: 800218 - protein, 9 aa, Homo Sapiens
TGREVHDAR

SEQ ID NO: 800219 - protein, 9 aa, Homo Sapiens
SSRSQSRVC

SEQ ID NO: 800220 - protein, 9 aa, Homo Sapiens
WPRLSDRPQ

SEQ ID NO: 800221 - protein, 9 aa, Homo Sapiens
FNLITGMFQ

SEQ ID NO: 800222 - protein, 9 aa, Homo Sapiens
TAESPIEVN

SEQ ID NO: 800223 - protein, 9 aa, Homo Sapiens
MKKRHRNQD

SEQ ID NO: 800224 - protein, 9 aa, Homo Sapiens
KTLVGDFMN

SEQ ID NO: 800225 - protein, 9 aa, Homo Sapiens
YIMVEICNA

SEQ ID NO: 800226 - protein, 9 aa, Homo Sapiens
LDLEKTAIQ

SEQ ID NO: 800227 - protein, 9 aa, Homo Sapiens
MSFNLITGM

SEQ ID NO: 800228 - protein, 9 aa, Homo Sapiens
NRKTLIEPF

SEQ ID NO: 800229 - protein, 9 aa, Homo Sapiens
ESPIEVNIE

SEQ ID NO: 800230 - protein, 9 aa, Homo Sapiens
HICYIMVEI

SEQ ID NO: 800231 - protein, 9 aa, Homo Sapiens
ERWPRLSDR

SEQ ID NO: 800232 - protein, 9 aa, Homo Sapiens
KPKLLPLDL

SEQ ID NO: 800233 - protein, 9 aa, Homo Sapiens
NKYQLLDHV

SEQ ID NO: 800234 - protein, 9 aa, Homo Sapiens
EVYQDKTLV

SEQ ID NO: 800235 - protein, 9 aa, Homo Sapiens
QHQQNIRPL

SEQ ID NO: 800236 - protein, 9 aa, Homo Sapiens
AESPIEVNI

SEQ ID NO: 800237 - protein, 9 aa, Homo Sapiens
LQHICYIMV

SEQ ID NO: 800238 - protein, 9 aa, Homo Sapiens
LEVFGYQDH

SEQ ID NO: 800239 - protein, 9 aa, Homo Sapiens
FLDPRQHQQ

SEQ ID NO: 800240 - protein, 9 aa, Homo Sapiens
EVFGYQDHN

SEQ ID NO: 800241 - protein, 9 aa, Homo Sapiens
SCQIAGRPL

SEQ ID NO: 800242 - protein, 9 aa, Homo Sapiens
SPRLPMTDG

SEQ ID NO: 800243 - protein, 9 aa, Homo Sapiens
SFPGKVLGV

SEQ ID NO: 800244 - protein, 9 aa, Homo Sapiens
RRWLHVQSR

SEQ ID NO: 800245 - protein, 9 aa, Homo Sapiens
KLLPLDLEK

SEQ ID NO: 800246 - protein, 9 aa, Homo Sapiens
PGKVLGVTS

SEQ ID NO: 800247 - protein, 9 aa, Homo Sapiens
CQIAGRPLP

SEQ ID NO: 800248 - protein, 9 aa, Homo Sapiens
QHICYIMVE

SEQ ID NO: 800249 - protein, 9 aa, Homo Sapiens
RERWPRLSD

SEQ ID NO: 800250 - protein, 9 aa, Homo Sapiens
TVTNRKTLI

SEQ ID NO: 800251 - protein, 9 aa, Homo Sapiens
WNKYQLLDH

SEQ ID NO: 800252 - protein, 9 aa, Homo Sapiens
PQLTAESPI

SEQ ID NO: 800253 - protein, 9 aa, Homo Sapiens
RLWEVTVTN

SEQ ID NO: 800254 - protein, 9 aa, Homo Sapiens
LKDLTSSGT

SEQ ID NO: 800255 - protein, 9 aa, Homo Sapiens
PHHPMLAVP

SEQ ID NO: 800256 - protein, 9 aa, Homo Sapiens
VPHHPMLAV

SEQ ID NO: 800257 - protein, 9 aa, Homo Sapiens
CNIASRAKE

SEQ ID NO: 800258 - protein, 9 aa, Homo Sapiens
VEICNANVP

SEQ ID NO: 800259 - protein, 9 aa, Homo Sapiens
RDITGREVH

SEQ ID NO: 800260 - protein, 9 aa, Homo Sapiens
HHPMLAVPM

SEQ ID NO: 800261 - protein, 9 aa, Homo Sapiens
LPMTDGAHP

SEQ ID NO: 800262 - protein, 9 aa, Homo Sapiens
YFISSSHNI

SEQ ID NO: 800263 - protein, 9 aa, Homo Sapiens
DARVPHHPM

SEQ ID NO: 800264 - protein, 9 aa, Homo Sapiens
KDLTSSGTF

SEQ ID NO: 800265 - protein, 9 aa, Homo Sapiens
LSCQIAGRP

SEQ ID NO: 800266 - protein, 9 aa, Homo Sapiens
IGRERWPRL

SEQ ID NO: 800267 - protein, 9 aa, Homo Sapiens
SQSRVCNIA

SEQ ID NO: 800268 - protein, 9 aa, Homo Sapiens
RVCNIASRA

SEQ ID NO: 800269 - protein, 9 aa, Homo Sapiens
ITGREVHDA

SEQ ID NO: 800270 - protein, 9 aa, Homo Sapiens
EKPKLLPLD

SEQ ID NO: 800271 - protein, 9 aa, Homo Sapiens
WEVTVTNRK

SEQ ID NO: 800272 - protein, 9 aa, Homo Sapiens
HQQNIRPLC

SEQ ID NO: 800273 - protein, 9 aa, Homo Sapiens
GTFKEYDPD

SEQ ID NO: 800274 - protein, 9 aa, Homo Sapiens
DVHGSFAFE

SEQ ID NO: 800275 - protein, 9 aa, Homo Sapiens
TLVGDFMNR

SEQ ID NO: 800276 - protein, 9 aa, Homo Sapiens
PRRWLHVQS

SEQ ID NO: 800277 - protein, 9 aa, Homo Sapiens
NIYLTGRQF

SEQ ID NO: 800278 - protein, 9 aa, Homo Sapiens
DELEVFGYQ

SEQ ID NO: 800279 - protein, 9 aa, Homo Sapiens
WGKWNKYQL

SEQ ID NO: 800280 - protein, 9 aa, Homo Sapiens
GYQDHNVRK

SEQ ID NO: 800281 - protein, 9 aa, Homo Sapiens
GRERWPRLS

SEQ ID NO: 800282 - protein, 9 aa, Homo Sapiens
AGRPLPDIK

SEQ ID NO: 800283 - protein, 9 aa, Homo Sapiens
VSFLDPRQH

SEQ ID NO: 800284 - protein, 9 aa, Homo Sapiens
SPIEVNIEV

SEQ ID NO: 800285 - protein, 9 aa, Homo Sapiens
LTSSGTFKE

SEQ ID NO: 800286 - protein, 9 aa, Homo Sapiens
ARVPHHPML

SEQ ID NO: 800287 - protein, 9 aa, Homo Sapiens
HGSFAFEGI

SEQ ID NO: 800288 - protein, 9 aa, Homo Sapiens
PSPRLPMTD

SEQ ID NO: 800289 - protein, 9 aa, Homo Sapiens
LDPRQHQQN

SEQ ID NO: 800290 - protein, 9 aa, Homo Sapiens
KLKDLTSSG

SEQ ID NO: 800291 - protein, 9 aa, Homo Sapiens
EVTVTNRKT

SEQ ID NO: 800292 - protein, 9 aa, Homo Sapiens
KWNKYQLLD

SEQ ID NO: 800293 - protein, 9 aa, Homo Sapiens
TQTFMSFNL

SEQ ID NO: 800294 - protein, 9 aa, Homo Sapiens
LWEVTVTNR

SEQ ID NO: 800295 - protein, 9 aa, Homo Sapiens
LHVQSRDIT

SEQ ID NO: 800296 - protein, 9 aa, Homo Sapiens
FISSSHNIY

SEQ ID NO: 800297 - protein, 9 aa, Homo Sapiens
CYIMVEICN

SEQ ID NO: 800298 - protein, 9 aa, Homo Sapiens
MTDGAHPQP

SEQ ID NO: 800299 - protein, 9 aa, Homo Sapiens
VYQDKTLVG

SEQ ID NO: 800300 - protein, 9 aa, Homo Sapiens
AEVYQDKTL

SEQ ID NO: 800301 - protein, 9 aa, Homo Sapiens
RWLHVQSRD

SEQ ID NO: 800302 - protein, 9 aa, Homo Sapiens
QTFMSFNLI

SEQ ID NO: 800303 - protein, 9 aa, Homo Sapiens
VTVTNRKTL

SEQ ID NO: 800304 - protein, 9 aa, Homo Sapiens
LLDHVRRYF

SEQ ID NO: 800305 - protein, 9 aa, Homo Sapiens
LTQTFMSFN

SEQ ID NO: 800306 - protein, 9 aa, Homo Sapiens
ALPSPRLPM

SEQ ID NO: 800307 - protein, 9 aa, Homo Sapiens
QDEPRRWLH

SEQ ID NO: 800308 - protein, 9 aa, Homo Sapiens
ICYIMVEIC

SEQ ID NO: 800309 - protein, 9 aa, Homo Sapiens
MLAVPMVRV

SEQ ID NO: 800310 - protein, 9 aa, Homo Sapiens
VTNRKTLIE

SEQ ID NO: 800311 - protein, 9 aa, Homo Sapiens
KKRHRNQDE

SEQ ID NO: 800312 - protein, 9 aa, Homo Sapiens
DPRQHQQNI

SEQ ID NO: 800313 - protein, 9 aa, Homo Sapiens
GKWNKYQLL

SEQ ID NO: 800314 - protein, 9 aa, Homo Sapiens
PMLAVPMVR

SEQ ID NO: 800315 - protein, 9 aa, Homo Sapiens
RVPHHPMLA

SEQ ID NO: 800316 - protein, 9 aa, Homo Sapiens
RNQDEPRRW

SEQ ID NO: 800317 - protein, 9 aa, Homo Sapiens
QSRDITGRE

SEQ ID NO: 800318 - protein, 9 aa, Homo Sapiens
GDKSQSPRS

SEQ ID NO: 800319 - protein, 9 aa, Homo Sapiens
AVKHSRPRR

SEQ ID NO: 800320 - protein, 9 aa, Homo Sapiens
AENKLHMSL

SEQ ID NO: 800321 - protein, 9 aa, Homo Sapiens
KLSLPESLK

SEQ ID NO: 800322 - protein, 9 aa, Homo Sapiens
KSQSPRSPP

SEQ ID NO: 800323 - protein, 9 aa, Homo Sapiens
KIMKLSLPE

SEQ ID NO: 800324 - protein, 9 aa, Homo Sapiens
IMKLSLPES

SEQ ID NO: 800325 - protein, 9 aa, Homo Sapiens
SLPESLKAY

SEQ ID NO: 800326 - protein, 9 aa, Homo Sapiens
LSLPESLKA

SEQ ID NO: 800327 - protein, 9 aa, Homo Sapiens
AAVKHSRPR

SEQ ID NO: 800328 - protein, 9 aa, Homo Sapiens
TYAAVKHSR

SEQ ID NO: 800329 - protein, 9 aa, Homo Sapiens
PPQGDKSQS

SEQ ID NO: 800330 - protein, 9 aa, Homo Sapiens
QSPRSPPGK

SEQ ID NO: 800331 - protein, 9 aa, Homo Sapiens
PQAVTYAAV

SEQ ID NO: 800332 - protein, 9 aa, Homo Sapiens
LHMSLMENY

SEQ ID NO: 800333 - protein, 9 aa, Homo Sapiens
DPQAVTYAA

SEQ ID NO: 800334 - protein, 9 aa, Homo Sapiens
DKSQSPRSP

SEQ ID NO: 800335 - protein, 9 aa, Homo Sapiens
QRAENKLHM

SEQ ID NO: 800336 - protein, 9 aa, Homo Sapiens
RAENKLHMS

SEQ ID NO: 800337 - protein, 9 aa, Homo Sapiens
KLHMSLMEN

SEQ ID NO: 800338 - protein, 9 aa, Homo Sapiens
ENKLHMSLM

SEQ ID NO: 800339 - protein, 9 aa, Homo Sapiens
AVTYAAVKH

SEQ ID NO: 800340 - protein, 9 aa, Homo Sapiens
REKIMKLSL

SEQ ID NO: 800341 - protein, 9 aa, Homo Sapiens
VTYAAVKHS

SEQ ID NO: 800342 - protein, 9 aa, Homo Sapiens
YAAVKHSRP

SEQ ID NO: 800343 - protein, 9 aa, Homo Sapiens
GGSSSSSSD

SEQ ID NO: 800344 - protein, 9 aa, Homo Sapiens
LREKIMKLS

SEQ ID NO: 800345 - protein, 9 aa, Homo Sapiens
PQGDKSQSP

SEQ ID NO: 800346 - protein, 9 aa, Homo Sapiens
PPPQGDKSQ

SEQ ID NO: 800347 - protein, 9 aa, Homo Sapiens
MSLMENYPG

SEQ ID NO: 800348 - protein, 9 aa, Homo Sapiens
QAVTYAAVK

SEQ ID NO: 800349 - protein, 9 aa, Homo Sapiens
NKLHMSLME

SEQ ID NO: 800350 - protein, 9 aa, Homo Sapiens
HMSLMENYP

SEQ ID NO: 800351 - protein, 9 aa, Homo Sapiens
QGDKSQSPR

SEQ ID NO: 800352 - protein, 9 aa, Homo Sapiens
EKIMKLSLP

SEQ ID NO: 800353 - protein, 9 aa, Homo Sapiens
MKLSLPESL

SEQ ID NO: 800354 - protein, 9 aa, Homo Sapiens
SQSPRSPPG

SEQ ID NO: 800355 - protein, 9 aa, Homo Sapiens
DNDGLLKLT

SEQ ID NO: 800356 - protein, 9 aa, Homo Sapiens
ASLLLLLLR

SEQ ID NO: 800357 - protein, 9 aa, Homo Sapiens
DPAYGKDCN

SEQ ID NO: 800358 - protein, 9 aa, Homo Sapiens
DGLLKLTCG

SEQ ID NO: 800359 - protein, 9 aa, Homo Sapiens
KLTCGRKVS

SEQ ID NO: 800360 - protein, 9 aa, Homo Sapiens
NTSIQVSPD

SEQ ID NO: 800361 - protein, 9 aa, Homo Sapiens
GEADGDPAY

SEQ ID NO: 800362 - protein, 9 aa, Homo Sapiens
SPDNTSIQV

SEQ ID NO: 800363 - protein, 9 aa, Homo Sapiens
PDNTSIQVS

SEQ ID NO: 800364 - protein, 9 aa, Homo Sapiens
GDPAYGKDC

SEQ ID NO: 800365 - protein, 9 aa, Homo Sapiens
ERKKKSYRW

SEQ ID NO: 800366 - protein, 9 aa, Homo Sapiens
ILERKKKSY

SEQ ID NO: 800367 - protein, 9 aa, Homo Sapiens
AQSGSSCVL

SEQ ID NO: 800368 - protein, 9 aa, Homo Sapiens
LPAQSGSSC

SEQ ID NO: 800369 - protein, 9 aa, Homo Sapiens
RKKKSYRWM

SEQ ID NO: 800370 - protein, 9 aa, Homo Sapiens
KSEMEETER

SEQ ID NO: 800371 - protein, 9 aa, Homo Sapiens
LSPDNTSIQ

SEQ ID NO: 800372 - protein, 9 aa, Homo Sapiens
LERKKKSYR

SEQ ID NO: 800373 - protein, 9 aa, Homo Sapiens
SCVLEAMRR

SEQ ID NO: 800374 - protein, 9 aa, Homo Sapiens
MEETERGEN

SEQ ID NO: 800375 - protein, 9 aa, Homo Sapiens
GYGQAFLGG

SEQ ID NO: 800376 - protein, 9 aa, Homo Sapiens
NDGLLKLTC

SEQ ID NO: 800377 - protein, 9 aa, Homo Sapiens
ERGENLLLI

SEQ ID NO: 800378 - protein, 9 aa, Homo Sapiens
LKLTCGRKV

SEQ ID NO: 800379 - protein, 9 aa, Homo Sapiens
GSSCVLEAM

SEQ ID NO: 800380 - protein, 9 aa, Homo Sapiens
SEMEETERG

SEQ ID NO: 800381 - protein, 9 aa, Homo Sapiens
YGKDCNGSL

SEQ ID NO: 800382 - protein, 9 aa, Homo Sapiens
SGSSCVLEA

SEQ ID NO: 800383 - protein, 9 aa, Homo Sapiens
SLSPDNTSI

SEQ ID NO: 800384 - protein, 9 aa, Homo Sapiens
SLLLLLLRL

SEQ ID NO: 800385 - protein, 9 aa, Homo Sapiens
CVLEAMRRG

SEQ ID NO: 800386 - protein, 9 aa, Homo Sapiens
QSGSSCVLE

SEQ ID NO: 800387 - protein, 9 aa, Homo Sapiens
SSCVLEAMR

SEQ ID NO: 800388 - protein, 9 aa, Homo Sapiens
EMEETERGE

SEQ ID NO: 800389 - protein, 9 aa, Homo Sapiens
PDNDGLLKL

SEQ ID NO: 800390 - protein, 9 aa, Homo Sapiens
LGYGQAFLG

SEQ ID NO: 800391 - protein, 9 aa, Homo Sapiens
DNTSIQVSP

SEQ ID NO: 800392 - protein, 9 aa, Homo Sapiens
GLLKLTCGR

SEQ ID NO: 800393 - protein, 9 aa, Homo Sapiens
ETERGENLL

SEQ ID NO: 800394 - protein, 9 aa, Homo Sapiens
GQAFLGGLA

SEQ ID NO: 800395 - protein, 9 aa, Homo Sapiens
YILERKKKS

SEQ ID NO: 800396 - protein, 9 aa, Homo Sapiens
AYGKDCNGS

SEQ ID NO: 800397 - protein, 9 aa, Homo Sapiens
TERGENLLL

SEQ ID NO: 800398 - protein, 9 aa, Homo Sapiens
YGQAFLGGL

SEQ ID NO: 800399 - protein, 9 aa, Homo Sapiens
PAYGKDCNG

SEQ ID NO: 800400 - protein, 9 aa, Homo Sapiens
EETERGENL

SEQ ID NO: 800401 - protein, 9 aa, Homo Sapiens
ALGYGQAFL

SEQ ID NO: 800402 - protein, 9 aa, Homo Sapiens
DGDPAYGKD

SEQ ID NO: 800403 - protein, 9 aa, Homo Sapiens
PAQSGSSCV

SEQ ID NO: 800404 - protein, 9 aa, Homo Sapiens
LLKLTCGRK

SEQ ID NO: 800405 - protein, 9 aa, Homo Sapiens
IQVSPDSLD

SEQ ID NO: 800406 - protein, 9 aa, Homo Sapiens
RGENLLLIQ

SEQ ID NO: 800407 - protein, 9 aa, Homo Sapiens
SIQVSPDSL

SEQ ID NO: 800408 - protein, 9 aa, Homo Sapiens
TSIQVSPDS

SEQ ID NO: 800409 - protein, 9 aa, Homo Sapiens
ADGDPAYGK

SEQ ID NO: 800410 - protein, 9 aa, Homo Sapiens
EADGDPAYG

SEQ ID NO: 800411 - protein, 9 aa, Homo Sapiens
LTCGRKVSL

SEQ ID NO: 800412 - protein, 9 aa, Homo Sapiens
ELEEEENEE

SEQ ID NO: 800413 - protein, 9 aa, Homo Sapiens
PEVAAPDPP

SEQ ID NO: 800414 - protein, 9 aa, Homo Sapiens
VEDLDWEKE

SEQ ID NO: 800415 - protein, 9 aa, Homo Sapiens
VELEEEENE

SEQ ID NO: 800416 - protein, 9 aa, Homo Sapiens
RVTVEDLDW

SEQ ID NO: 800417 - protein, 9 aa, Homo Sapiens
PTVFSSHHT

SEQ ID NO: 800418 - protein, 9 aa, Homo Sapiens
HHTAGGMTP

SEQ ID NO: 800419 - protein, 9 aa, Homo Sapiens
MTPTVFSSH

SEQ ID NO: 800420 - protein, 9 aa, Homo Sapiens
AAPDPPGSH

SEQ ID NO: 800421 - protein, 9 aa, Homo Sapiens
DPPGSHPVG

SEQ ID NO: 800422 - protein, 9 aa, Homo Sapiens
VFSSHHTAG

SEQ ID NO: 800423 - protein, 9 aa, Homo Sapiens
VELGYRVTV

SEQ ID NO: 800424 - protein, 9 aa, Homo Sapiens
VAAPDPPGS

SEQ ID NO: 800425 - protein, 9 aa, Homo Sapiens
SPEVAAPDP

SEQ ID NO: 800426 - protein, 9 aa, Homo Sapiens
LEEEENEEE

SEQ ID NO: 800427 - protein, 9 aa, Homo Sapiens
SHHTAGGMT

SEQ ID NO: 800428 - protein, 9 aa, Homo Sapiens
TVFSSHHTA

SEQ ID NO: 800429 - protein, 9 aa, Homo Sapiens
SSHHTAGGM

SEQ ID NO: 800430 - protein, 9 aa, Homo Sapiens
APDPPGSHP

SEQ ID NO: 800431 - protein, 9 aa, Homo Sapiens
VTVEDLDWE

SEQ ID NO: 800432 - protein, 9 aa, Homo Sapiens
AVELEEEEN

SEQ ID NO: 800433 - protein, 9 aa, Homo Sapiens
TPTVFSSHH

SEQ ID NO: 800434 - protein, 9 aa, Homo Sapiens
QSPEVAAPD

SEQ ID NO: 800435 - protein, 9 aa, Homo Sapiens
TVEDLDWEK

SEQ ID NO: 800436 - protein, 9 aa, Homo Sapiens
PDPPGSHPV

SEQ ID NO: 800437 - protein, 9 aa, Homo Sapiens
FSSHHTAGG

SEQ ID NO: 800438 - protein, 9 aa, Homo Sapiens
EVAAPDPPG

SEQ ID NO: 800439 - protein, 9 aa, Homo Sapiens
LILGTSWDA

SEQ ID NO: 800440 - protein, 9 aa, Homo Sapiens
PLILGTSWD

SEQ ID NO: 800441 - protein, 9 aa, Homo Sapiens
EGSRAAAGQ

SEQ ID NO: 800442 - protein, 9 aa, Homo Sapiens
VGDLLAMDV

SEQ ID NO: 800443 - protein, 9 aa, Homo Sapiens
PSCEAVGQE

SEQ ID NO: 800444 - protein, 9 aa, Homo Sapiens
GDLLAMDVS

SEQ ID NO: 800445 - protein, 9 aa, Homo Sapiens
RLDLKQERE

SEQ ID NO: 800446 - protein, 9 aa, Homo Sapiens
RREEKREPE

SEQ ID NO: 800447 - protein, 9 aa, Homo Sapiens
THYITVVTK

SEQ ID NO: 800448 - protein, 9 aa, Homo Sapiens
SDGKPWKVR

SEQ ID NO: 800449 - protein, 9 aa, Homo Sapiens
VVIMAIIFY

SEQ ID NO: 800450 - protein, 9 aa, Homo Sapiens
PEKYGKLPT

SEQ ID NO: 800451 - protein, 9 aa, Homo Sapiens
KRFMRSDNL

SEQ ID NO: 800452 - protein, 9 aa, Homo Sapiens
LKQEREAFF

SEQ ID NO: 800453 - protein, 9 aa, Homo Sapiens
DLLAMDVSS

SEQ ID NO: 800454 - protein, 9 aa, Homo Sapiens
DDDEEDTAK

SEQ ID NO: 800455 - protein, 9 aa, Homo Sapiens
TCQLRSFLY

SEQ ID NO: 800456 - protein, 9 aa, Homo Sapiens
LCLSSSCCS

SEQ ID NO: 800457 - protein, 9 aa, Homo Sapiens
DVVISTAKL

SEQ ID NO: 800458 - protein, 9 aa, Homo Sapiens
AKLEFFGVA

SEQ ID NO: 800459 - protein, 9 aa, Homo Sapiens
IVVGDLLAM

SEQ ID NO: 800460 - protein, 9 aa, Homo Sapiens
EWQWTDACL

SEQ ID NO: 800461 - protein, 9 aa, Homo Sapiens
QDRWRGPAT

SEQ ID NO: 800462 - protein, 9 aa, Homo Sapiens
QLRSFLYRD

SEQ ID NO: 800463 - protein, 9 aa, Homo Sapiens
TIVRAWGHP

SEQ ID NO: 800464 - protein, 9 aa, Homo Sapiens
HIVVGDLLA

SEQ ID NO: 800465 - protein, 9 aa, Homo Sapiens
PSTCQLRSF

SEQ ID NO: 800466 - protein, 9 aa, Homo Sapiens
SWDASTESS

SEQ ID NO: 800467 - protein, 9 aa, Homo Sapiens
AKDNVVPPL

SEQ ID NO: 800468 - protein, 9 aa, Homo Sapiens
VTLSTSKGL

SEQ ID NO: 800469 - protein, 9 aa, Homo Sapiens
MAIIFYVLP

SEQ ID NO: 800470 - protein, 9 aa, Homo Sapiens
LGSTDSPVK

SEQ ID NO: 800471 - protein, 9 aa, Homo Sapiens
KLPTCTGCR

SEQ ID NO: 800472 - protein, 9 aa, Homo Sapiens
RPPKMPVNY

SEQ ID NO: 800473 - protein, 9 aa, Homo Sapiens
KQEREAFFT

SEQ ID NO: 800474 - protein, 9 aa, Homo Sapiens
CQLRSFLYR

SEQ ID NO: 800475 - protein, 9 aa, Homo Sapiens
LGTSWDAST

SEQ ID NO: 800476 - protein, 9 aa, Homo Sapiens
GLSSADEKN

SEQ ID NO: 800477 - protein, 9 aa, Homo Sapiens
VVGDLLAMD

SEQ ID NO: 800478 - protein, 9 aa, Homo Sapiens
NNPIVRKRK

SEQ ID NO: 800479 - protein, 9 aa, Homo Sapiens
LCCATIVRA

SEQ ID NO: 800480 - protein, 9 aa, Homo Sapiens
DLESKNILV

SEQ ID NO: 800481 - protein, 9 aa, Homo Sapiens
LESKNILVK

SEQ ID NO: 800482 - protein, 9 aa, Homo Sapiens
DNESTQGDE

SEQ ID NO: 800483 - protein, 9 aa, Homo Sapiens
AHRDLESKN

SEQ ID NO: 800484 - protein, 9 aa, Homo Sapiens
QKSDGKPWK

SEQ ID NO: 800485 - protein, 9 aa, Homo Sapiens
LSSSCCSRT

SEQ ID NO: 800486 - protein, 9 aa, Homo Sapiens
PIVRKRKLL

SEQ ID NO: 800487 - protein, 9 aa, Homo Sapiens
STCQLRSFL

SEQ ID NO: 800488 - protein, 9 aa, Homo Sapiens
TKPQEMGSE

SEQ ID NO: 800489 - protein, 9 aa, Homo Sapiens
DDEEDTAKL

SEQ ID NO: 800490 - protein, 9 aa, Homo Sapiens
VVISTAKLE

SEQ ID NO: 800491 - protein, 9 aa, Homo Sapiens
STAKLEFFG

SEQ ID NO: 800492 - protein, 9 aa, Homo Sapiens
GRPPKMPVN

SEQ ID NO: 800493 - protein, 9 aa, Homo Sapiens
LLAMDVSSV

SEQ ID NO: 800494 - protein, 9 aa, Homo Sapiens
HRGRPPKMP

SEQ ID NO: 800495 - protein, 9 aa, Homo Sapiens
KPWKVRFKI

SEQ ID NO: 800496 - protein, 9 aa, Homo Sapiens
TERREEKRE

SEQ ID NO: 800497 - protein, 9 aa, Homo Sapiens
DQCKRAQAF

SEQ ID NO: 800498 - protein, 9 aa, Homo Sapiens
REEKREPEP

SEQ ID NO: 800499 - protein, 9 aa, Homo Sapiens
MGSEKVIDR

SEQ ID NO: 800500 - protein, 9 aa, Homo Sapiens
LHSVNNPIV

SEQ ID NO: 800501 - protein, 9 aa, Homo Sapiens
SVVVVIMAI

SEQ ID NO: 800502 - protein, 9 aa, Homo Sapiens
ALHRGRPPK

SEQ ID NO: 800503 - protein, 9 aa, Homo Sapiens
PPKMPVNYG

SEQ ID NO: 800504 - protein, 9 aa, Homo Sapiens
GKEWQWTDA

SEQ ID NO: 800505 - protein, 9 aa, Homo Sapiens
RFMRSDNLS

SEQ ID NO: 800506 - protein, 9 aa, Homo Sapiens
WKVRFKISS

SEQ ID NO: 800507 - protein, 9 aa, Homo Sapiens
KDNVVPPLT

SEQ ID NO: 800508 - protein, 9 aa, Homo Sapiens
LEFFGVAML

SEQ ID NO: 800509 - protein, 9 aa, Homo Sapiens
HRDLESKNI

SEQ ID NO: 800510 - protein, 9 aa, Homo Sapiens
ILAKDNVVP

SEQ ID NO: 800511 - protein, 9 aa, Homo Sapiens
ITVVTKDGG

SEQ ID NO: 800512 - protein, 9 aa, Homo Sapiens
TQGDERDDN

SEQ ID NO: 800513 - protein, 9 aa, Homo Sapiens
LVLKAVLGI

SEQ ID NO: 800514 - protein, 9 aa, Homo Sapiens
LDNESTQGD

SEQ ID NO: 800515 - protein, 9 aa, Homo Sapiens
NVVPPLTSN

SEQ ID NO: 800516 - protein, 9 aa, Homo Sapiens
VGFTGKEWQ

SEQ ID NO: 800517 - protein, 9 aa, Homo Sapiens
GSVVVVIMA

SEQ ID NO: 800518 - protein, 9 aa, Homo Sapiens
VGQEEEESC

SEQ ID NO: 800519 - protein, 9 aa, Homo Sapiens
TGKEWQWTD

SEQ ID NO: 800520 - protein, 9 aa, Homo Sapiens
TYRLDLKQE

SEQ ID NO: 800521 - protein, 9 aa, Homo Sapiens
SQQPDQCKR

SEQ ID NO: 800522 - protein, 9 aa, Homo Sapiens
LRSFLYRDC

SEQ ID NO: 800523 - protein, 9 aa, Homo Sapiens
KSDGKPWKV

SEQ ID NO: 800524 - protein, 9 aa, Homo Sapiens
TERPLPMEQ

SEQ ID NO: 800525 - protein, 9 aa, Homo Sapiens
TSWDASTES

SEQ ID NO: 800526 - protein, 9 aa, Homo Sapiens
SSCCSRTEP

SEQ ID NO: 800527 - protein, 9 aa, Homo Sapiens
LGDLEGSRA

SEQ ID NO: 800528 - protein, 9 aa, Homo Sapiens
QEREAFFTL

SEQ ID NO: 800529 - protein, 9 aa, Homo Sapiens
PGIAHRDLE

SEQ ID NO: 800530 - protein, 9 aa, Homo Sapiens
GKLPTCTGC

SEQ ID NO: 800531 - protein, 9 aa, Homo Sapiens
VNNPIVRKR

SEQ ID NO: 800532 - protein, 9 aa, Homo Sapiens
KLEFFGVAM

SEQ ID NO: 800533 - protein, 9 aa, Homo Sapiens
FMRSDNLSK

SEQ ID NO: 800534 - protein, 9 aa, Homo Sapiens
EKYGKLPTC

SEQ ID NO: 800535 - protein, 9 aa, Homo Sapiens
DGKPWKVRF

SEQ ID NO: 800536 - protein, 9 aa, Homo Sapiens
ISTAKLEFF

SEQ ID NO: 800537 - protein, 9 aa, Homo Sapiens
NQKSDGKPW

SEQ ID NO: 800538 - protein, 9 aa, Homo Sapiens
LGSVVVVIM

SEQ ID NO: 800539 - protein, 9 aa, Homo Sapiens
SPVKEKSTM

SEQ ID NO: 800540 - protein, 9 aa, Homo Sapiens
VVTKDGGGR

SEQ ID NO: 800541 - protein, 9 aa, Homo Sapiens
TSKGLSSAD

SEQ ID NO: 800542 - protein, 9 aa, Homo Sapiens
SKGLSSADE

SEQ ID NO: 800543 - protein, 9 aa, Homo Sapiens
RDLESKNIL

SEQ ID NO: 800544 - protein, 9 aa, Homo Sapiens
DRWRGPATE

SEQ ID NO: 800545 - protein, 9 aa, Homo Sapiens
VVVVIMAII

SEQ ID NO: 800546 - protein, 9 aa, Homo Sapiens
RGRPPKMPV

SEQ ID NO: 800547 - protein, 9 aa, Homo Sapiens
RSDNLSKHI

SEQ ID NO: 800548 - protein, 9 aa, Homo Sapiens
QGDERDDNW

SEQ ID NO: 800549 - protein, 9 aa, Homo Sapiens
EEKREPEPH

SEQ ID NO: 800550 - protein, 9 aa, Homo Sapiens
CEAVGQEEE

SEQ ID NO: 800551 - protein, 9 aa, Homo Sapiens
CLSSSCCSR

SEQ ID NO: 800552 - protein, 9 aa, Homo Sapiens
SEKVIDRKV

SEQ ID NO: 800553 - protein, 9 aa, Homo Sapiens
DASTESSAS

SEQ ID NO: 800554 - protein, 9 aa, Homo Sapiens
IAHRDLESK

SEQ ID NO: 800555 - protein, 9 aa, Homo Sapiens
VTKDGGGRL

SEQ ID NO: 800556 - protein, 9 aa, Homo Sapiens
SVNNPIVRK

SEQ ID NO: 800557 - protein, 9 aa, Homo Sapiens
MRSDNLSKH

SEQ ID NO: 800558 - protein, 9 aa, Homo Sapiens
DLKQEREAF

SEQ ID NO: 800559 - protein, 9 aa, Homo Sapiens
QVGFTGKEW

SEQ ID NO: 800560 - protein, 9 aa, Homo Sapiens
PKMPVNYGS

SEQ ID NO: 800561 - protein, 9 aa, Homo Sapiens
ESKNILVKK

SEQ ID NO: 800562 - protein, 9 aa, Homo Sapiens
GSEKVIDRK

SEQ ID NO: 800563 - protein, 9 aa, Homo Sapiens
VVPPLTSNV

SEQ ID NO: 800564 - protein, 9 aa, Homo Sapiens
RWRGPATER

SEQ ID NO: 800565 - protein, 9 aa, Homo Sapiens
LKAVLGIPS

SEQ ID NO: 800566 - protein, 9 aa, Homo Sapiens
SFLYRDCQK

SEQ ID NO: 800567 - protein, 9 aa, Homo Sapiens
TLCCATIVR

SEQ ID NO: 800568 - protein, 9 aa, Homo Sapiens
MLRRGVGAG

SEQ ID NO: 800569 - protein, 9 aa, Homo Sapiens
AVTLSTSKG

SEQ ID NO: 800570 - protein, 9 aa, Homo Sapiens
RSFLYRDCQ

SEQ ID NO: 800571 - protein, 9 aa, Homo Sapiens
CWLCLSSSC

SEQ ID NO: 800572 - protein, 9 aa, Homo Sapiens
DEEDTAKLL

SEQ ID NO: 800573 - protein, 9 aa, Homo Sapiens
DNLSKHIKT

SEQ ID NO: 800574 - protein, 9 aa, Homo Sapiens
GTSWDASTE

SEQ ID NO: 800575 - protein, 9 aa, Homo Sapiens
RTHYITVVT

SEQ ID NO: 800576 - protein, 9 aa, Homo Sapiens
TAKLLNSAS

SEQ ID NO: 800577 - protein, 9 aa, Homo Sapiens
DNVVPPLTS

SEQ ID NO: 800578 - protein, 9 aa, Homo Sapiens
SRAAAGQER

SEQ ID NO: 800579 - protein, 9 aa, Homo Sapiens
WQWTDACLS

SEQ ID NO: 800580 - protein, 9 aa, Homo Sapiens
YGKLPTCTG

SEQ ID NO: 800581 - protein, 9 aa, Homo Sapiens
SSSCCSRTE

SEQ ID NO: 800582 - protein, 9 aa, Homo Sapiens
EEEESCREE

SEQ ID NO: 800583 - protein, 9 aa, Homo Sapiens
KMPVNYGSP

SEQ ID NO: 800584 - protein, 9 aa, Homo Sapiens
LHIVVGDLL

SEQ ID NO: 800585 - protein, 9 aa, Homo Sapiens
PWKVRFKIS

SEQ ID NO: 800586 - protein, 9 aa, Homo Sapiens
YRLDLKQER

SEQ ID NO: 800587 - protein, 9 aa, Homo Sapiens
SCEAVGQEE

SEQ ID NO: 800588 - protein, 9 aa, Homo Sapiens
EAVGQEEEE

SEQ ID NO: 800589 - protein, 9 aa, Homo Sapiens
GQLGDLEGS

SEQ ID NO: 800590 - protein, 9 aa, Homo Sapiens
CATIVRAWG

SEQ ID NO: 800591 - protein, 9 aa, Homo Sapiens
HSVNNPIVR

SEQ ID NO: 800592 - protein, 9 aa, Homo Sapiens
WDASTESSA

SEQ ID NO: 800593 - protein, 9 aa, Homo Sapiens
EKREPEPHS

SEQ ID NO: 800594 - protein, 9 aa, Homo Sapiens
EEDTAKLLN

SEQ ID NO: 800595 - protein, 9 aa, Homo Sapiens
FTILAKDNV

SEQ ID NO: 800596 - protein, 9 aa, Homo Sapiens
WGTERREEK

SEQ ID NO: 800597 - protein, 9 aa, Homo Sapiens
EMGSEKVID

SEQ ID NO: 800598 - protein, 9 aa, Homo Sapiens
ERREEKREP

SEQ ID NO: 800599 - protein, 9 aa, Homo Sapiens
ASQQPDQCK

SEQ ID NO: 800600 - protein, 9 aa, Homo Sapiens
IVRKRKLLG

SEQ ID NO: 800601 - protein, 9 aa, Homo Sapiens
TILAKDNVV

SEQ ID NO: 800602 - protein, 9 aa, Homo Sapiens
QEEEESCRE

SEQ ID NO: 800603 - protein, 9 aa, Homo Sapiens
GIPSSTGRH

SEQ ID NO: 800604 - protein, 9 aa, Homo Sapiens
GFTGKEWQW

SEQ ID NO: 800605 - protein, 9 aa, Homo Sapiens
GIAHRDLES

SEQ ID NO: 800606 - protein, 9 aa, Homo Sapiens
QPDQCKRAQ

SEQ ID NO: 800607 - protein, 9 aa, Homo Sapiens
KEWQWTDAC

SEQ ID NO: 800608 - protein, 9 aa, Homo Sapiens
TAKLEFFGV

SEQ ID NO: 800609 - protein, 9 aa, Homo Sapiens
GPATERPLP

SEQ ID NO: 800610 - protein, 9 aa, Homo Sapiens
PATERPLPM

SEQ ID NO: 800611 - protein, 9 aa, Homo Sapiens
VIMAIIFYV

SEQ ID NO: 800612 - protein, 9 aa, Homo Sapiens
RGPATERPL

SEQ ID NO: 800613 - protein, 9 aa, Homo Sapiens
KAVLGIPSS

SEQ ID NO: 800614 - protein, 9 aa, Homo Sapiens
EDTAKLLNS

SEQ ID NO: 800615 - protein, 9 aa, Homo Sapiens
ESTQGDERD

SEQ ID NO: 800616 - protein, 9 aa, Homo Sapiens
ATERPLPME

SEQ ID NO: 800617 - protein, 9 aa, Homo Sapiens
NTKPQEMGS

SEQ ID NO: 800618 - protein, 9 aa, Homo Sapiens
QCKRAQAFI

SEQ ID NO: 800619 - protein, 9 aa, Homo Sapiens
VISTAKLEF

SEQ ID NO: 800620 - protein, 9 aa, Homo Sapiens
DSPVKEKST

SEQ ID NO: 800621 - protein, 9 aa, Homo Sapiens
LSTSKGLSS

SEQ ID NO: 800622 - protein, 9 aa, Homo Sapiens
RCWLCLSSS

SEQ ID NO: 800623 - protein, 9 aa, Homo Sapiens
VRAWGHPCE

SEQ ID NO: 800624 - protein, 9 aa, Homo Sapiens
IPSSTGRHK

SEQ ID NO: 800625 - protein, 9 aa, Homo Sapiens
SCCSRTEPE

SEQ ID NO: 800626 - protein, 9 aa, Homo Sapiens
GQEEEESCR

SEQ ID NO: 800627 - protein, 9 aa, Homo Sapiens
PLLDNESTQ

SEQ ID NO: 800628 - protein, 9 aa, Homo Sapiens
QQPDQCKRA

SEQ ID NO: 800629 - protein, 9 aa, Homo Sapiens
KTLCCATIV

SEQ ID NO: 800630 - protein, 9 aa, Homo Sapiens
IMAIIFYVL

SEQ ID NO: 800631 - protein, 9 aa, Homo Sapiens
YITVVTKDG

SEQ ID NO: 800632 - protein, 9 aa, Homo Sapiens
TLSTSKGLS

SEQ ID NO: 800633 - protein, 9 aa, Homo Sapiens
NESTQGDER

SEQ ID NO: 800634 - protein, 9 aa, Homo Sapiens
STQGDERDD

SEQ ID NO: 800635 - protein, 9 aa, Homo Sapiens
TDSPVKEKS

SEQ ID NO: 800636 - protein, 9 aa, Homo Sapiens
NLSKHIKTH

SEQ ID NO: 800637 - protein, 9 aa, Homo Sapiens
LLGSTDSPV

SEQ ID NO: 800638 - protein, 9 aa, Homo Sapiens
VVVIMAIIF

SEQ ID NO: 800639 - protein, 9 aa, Homo Sapiens
GDLEGSRAA

SEQ ID NO: 800640 - protein, 9 aa, Homo Sapiens
LEGSRAAAG

SEQ ID NO: 800641 - protein, 9 aa, Homo Sapiens
PQEMGSEKV

SEQ ID NO: 800642 - protein, 9 aa, Homo Sapiens
KYGKLPTCT

SEQ ID NO: 800643 - protein, 9 aa, Homo Sapiens
VLGIPSSTG

SEQ ID NO: 800644 - protein, 9 aa, Homo Sapiens
LGIPSSTGR

SEQ ID NO: 800645 - protein, 9 aa, Homo Sapiens
EDDDEEDTA

SEQ ID NO: 800646 - protein, 9 aa, Homo Sapiens
ETYRLDLKQ

SEQ ID NO: 800647 - protein, 9 aa, Homo Sapiens
STDSPVKEK

SEQ ID NO: 800648 - protein, 9 aa, Homo Sapiens
KGLSSADEK

SEQ ID NO: 800649 - protein, 9 aa, Homo Sapiens
CCATIVRAW

SEQ ID NO: 800650 - protein, 9 aa, Homo Sapiens
AVLGIPSST

SEQ ID NO: 800651 - protein, 9 aa, Homo Sapiens
HLLGSTDSP

SEQ ID NO: 800652 - protein, 9 aa, Homo Sapiens
QPEKYGKLP

SEQ ID NO: 800653 - protein, 9 aa, Homo Sapiens
QLGDLEGSR

SEQ ID NO: 800654 - protein, 9 aa, Homo Sapiens
GTERREEKR

SEQ ID NO: 800655 - protein, 9 aa, Homo Sapiens
DTAKLLNSA

SEQ ID NO: 800656 - protein, 9 aa, Homo Sapiens
WLCLSSSCC

SEQ ID NO: 800657 - protein, 9 aa, Homo Sapiens
VRKRKLLGT

SEQ ID NO: 800658 - protein, 9 aa, Homo Sapiens
PDQCKRAQA

SEQ ID NO: 800659 - protein, 9 aa, Homo Sapiens
LHRGRPPKM

SEQ ID NO: 800660 - protein, 9 aa, Homo Sapiens
LAKDNVVPP

SEQ ID NO: 800661 - protein, 9 aa, Homo Sapiens
WRGPATERP

SEQ ID NO: 800662 - protein, 9 aa, Homo Sapiens
ALHIVVGDL

SEQ ID NO: 800663 - protein, 9 aa, Homo Sapiens
GSRAAAGQE

SEQ ID NO: 800664 - protein, 9 aa, Homo Sapiens
KPQEMGSEK

SEQ ID NO: 800665 - protein, 9 aa, Homo Sapiens
ATIVRAWGH

SEQ ID NO: 800666 - protein, 9 aa, Homo Sapiens
VLKAVLGIP

SEQ ID NO: 800667 - protein, 9 aa, Homo Sapiens
NKRFMRSDN

SEQ ID NO: 800668 - protein, 9 aa, Homo Sapiens
ILASQQPDQ

SEQ ID NO: 800669 - protein, 9 aa, Homo Sapiens
LPTCTGCRT

SEQ ID NO: 800670 - protein, 9 aa, Homo Sapiens
ILGTSWDAS

SEQ ID NO: 800671 - protein, 9 aa, Homo Sapiens
TVVTKDGGG

SEQ ID NO: 800672 - protein, 9 aa, Homo Sapiens
AKLLNSASD

SEQ ID NO: 800673 - protein, 9 aa, Homo Sapiens
LDLKQEREA

SEQ ID NO: 800674 - protein, 9 aa, Homo Sapiens
DLEGSRAAA

SEQ ID NO: 800675 - protein, 9 aa, Homo Sapiens
HYITVVTKD

SEQ ID NO: 800676 - protein, 9 aa, Homo Sapiens
TKDGGGRLH

SEQ ID NO: 800677 - protein, 9 aa, Homo Sapiens
PVKEKSTMK

SEQ ID NO: 800678 - protein, 9 aa, Homo Sapiens
SDNLSKHIK

SEQ ID NO: 800679 - protein, 9 aa, Homo Sapiens
KREPEPHSR

SEQ ID NO: 800680 - protein, 9 aa, Homo Sapiens
LRRGVGAGA

SEQ ID NO: 800681 - protein, 9 aa, Homo Sapiens
LLDNESTQG

SEQ ID NO: 800682 - protein, 9 aa, Homo Sapiens
AVGQEEEES

SEQ ID NO: 800683 - protein, 9 aa, Homo Sapiens
GSTDSPVKE

SEQ ID NO: 800684 - protein, 9 aa, Homo Sapiens
GKPWKVRFK

SEQ ID NO: 800685 - protein, 9 aa, Homo Sapiens
FLYRDCQKT

SEQ ID NO: 800686 - protein, 9 aa, Homo Sapiens
IVRAWGHPC

SEQ ID NO: 800687 - protein, 9 aa, Homo Sapiens
QEMGSEKVI

SEQ ID NO: 800688 - protein, 9 aa, Homo Sapiens
STSKGLSSA

SEQ ID NO: 800689 - protein, 9 aa, Homo Sapiens
LASQQPDQC

SEQ ID NO: 800690 - protein, 9 aa, Homo Sapiens
NPIVRKRKL

SEQ ID NO: 800691 - protein, 9 aa, Homo Sapiens
PTCTGCRTQ

SEQ ID NO: 800692 - protein, 9 aa, Homo Sapiens
FTGKEWQWT

SEQ ID NO: 800693 - protein, 9 aa, Homo Sapiens
PDLNQDFSV

SEQ ID NO: 800694 - protein, 9 aa, Homo Sapiens
SSDAGDEST

SEQ ID NO: 800695 - protein, 9 aa, Homo Sapiens
LFEIQPLEK

SEQ ID NO: 800696 - protein, 9 aa, Homo Sapiens
PAVLLCTFT

SEQ ID NO: 800697 - protein, 9 aa, Homo Sapiens
PLRRISESE

SEQ ID NO: 800698 - protein, 9 aa, Homo Sapiens
DGKHFVGER

SEQ ID NO: 800699 - protein, 9 aa, Homo Sapiens
ILKTVPPPV

SEQ ID NO: 800700 - protein, 9 aa, Homo Sapiens
QSPLSSFCS

SEQ ID NO: 800701 - protein, 9 aa, Homo Sapiens
EIAEKKHGK

SEQ ID NO: 800702 - protein, 9 aa, Homo Sapiens
AEKKHGKIE

SEQ ID NO: 800703 - protein, 9 aa, Homo Sapiens
VVMSSYQDF

SEQ ID NO: 800704 - protein, 9 aa, Homo Sapiens
EGYCVDLSY

SEQ ID NO: 800705 - protein, 9 aa, Homo Sapiens
IGSLNWGYQ

SEQ ID NO: 800706 - protein, 9 aa, Homo Sapiens
AKWLFEIQP

SEQ ID NO: 800707 - protein, 9 aa, Homo Sapiens
ASHLTIVIL

SEQ ID NO: 800708 - protein, 9 aa, Homo Sapiens
SQEILKTVP

SEQ ID NO: 800709 - protein, 9 aa, Homo Sapiens
PIVPVVMSS

SEQ ID NO: 800710 - protein, 9 aa, Homo Sapiens
TLTQIFPHS

SEQ ID NO: 800711 - protein, 9 aa, Homo Sapiens
EFVPTKTLY

SEQ ID NO: 800712 - protein, 9 aa, Homo Sapiens
PYFAEKKST

SEQ ID NO: 800713 - protein, 9 aa, Homo Sapiens
SLNWGYQVA

SEQ ID NO: 800714 - protein, 9 aa, Homo Sapiens
KLRQELCDM

SEQ ID NO: 800715 - protein, 9 aa, Homo Sapiens
LAEWCRLAQ

SEQ ID NO: 800716 - protein, 9 aa, Homo Sapiens
FEELEDPSN

SEQ ID NO: 800717 - protein, 9 aa, Homo Sapiens
RQRKREEDI

SEQ ID NO: 800718 - protein, 9 aa, Homo Sapiens
ETRLATCLD

SEQ ID NO: 800719 - protein, 9 aa, Homo Sapiens
WYFPDPTGK

SEQ ID NO: 800720 - protein, 9 aa, Homo Sapiens
VQKQIEWVL

SEQ ID NO: 800721 - protein, 9 aa, Homo Sapiens
HLTIVILFY

SEQ ID NO: 800722 - protein, 9 aa, Homo Sapiens
SVFQLLVDV

SEQ ID NO: 800723 - protein, 9 aa, Homo Sapiens
QVALREKKV

SEQ ID NO: 800724 - protein, 9 aa, Homo Sapiens
RNVFLHTGH

SEQ ID NO: 800725 - protein, 9 aa, Homo Sapiens
LHTGHGEPM

SEQ ID NO: 800726 - protein, 9 aa, Homo Sapiens
FLHTGHGEP

SEQ ID NO: 800727 - protein, 9 aa, Homo Sapiens
MKVTVTQVT

SEQ ID NO: 800728 - protein, 9 aa, Homo Sapiens
EGVNPFIKT

SEQ ID NO: 800729 - protein, 9 aa, Homo Sapiens
SIAQKIQMT

SEQ ID NO: 800730 - protein, 9 aa, Homo Sapiens
VTQVTVALS

SEQ ID NO: 800731 - protein, 9 aa, Homo Sapiens
RQELCDMLA

SEQ ID NO: 800732 - protein, 9 aa, Homo Sapiens
TKTLYDPRW

SEQ ID NO: 800733 - protein, 9 aa, Homo Sapiens
VFQLLVDVA

SEQ ID NO: 800734 - protein, 9 aa, Homo Sapiens
IEIFWHFKG

SEQ ID NO: 800735 - protein, 9 aa, Homo Sapiens
ELEDPSNRS

SEQ ID NO: 800736 - protein, 9 aa, Homo Sapiens
SELVEPSSV

SEQ ID NO: 800737 - protein, 9 aa, Homo Sapiens
MVQKQIEWV

SEQ ID NO: 800738 - protein, 9 aa, Homo Sapiens
TLYDPRWML

SEQ ID NO: 800739 - protein, 9 aa, Homo Sapiens
GIKVQLILF

SEQ ID NO: 800740 - protein, 9 aa, Homo Sapiens
VAIHYINPL

SEQ ID NO: 800741 - protein, 9 aa, Homo Sapiens
CVDLSYEIA

SEQ ID NO: 800742 - protein, 9 aa, Homo Sapiens
HSTLTQIFP

SEQ ID NO: 800743 - protein, 9 aa, Homo Sapiens
RHLYVITVF

SEQ ID NO: 800744 - protein, 9 aa, Homo Sapiens
SPLSSFCSS

SEQ ID NO: 800745 - protein, 9 aa, Homo Sapiens
KLESQKARL

SEQ ID NO: 800746 - protein, 9 aa, Homo Sapiens
QGIKVQLIL

SEQ ID NO: 800747 - protein, 9 aa, Homo Sapiens
TCLDGMRIE

SEQ ID NO: 800748 - protein, 9 aa, Homo Sapiens
VWEKWYFPD

SEQ ID NO: 800749 - protein, 9 aa, Homo Sapiens
KGKLRWNLR

SEQ ID NO: 800750 - protein, 9 aa, Homo Sapiens
KQIEWVLIM

SEQ ID NO: 800751 - protein, 9 aa, Homo Sapiens
WCRLAQHLV

SEQ ID NO: 800752 - protein, 9 aa, Homo Sapiens
TSSSNHILD

SEQ ID NO: 800753 - protein, 9 aa, Homo Sapiens
HGEPMVQKQ

SEQ ID NO: 800754 - protein, 9 aa, Homo Sapiens
FILRALMIN

SEQ ID NO: 800755 - protein, 9 aa, Homo Sapiens
LCDMLAKAA

SEQ ID NO: 800756 - protein, 9 aa, Homo Sapiens
IFPHSEMTT

SEQ ID NO: 800757 - protein, 9 aa, Homo Sapiens
PALSQEILK

SEQ ID NO: 800758 - protein, 9 aa, Homo Sapiens
LTIVILFYS

SEQ ID NO: 800759 - protein, 9 aa, Homo Sapiens
VITVFEDYL

SEQ ID NO: 800760 - protein, 9 aa, Homo Sapiens
QRKREEDIV

SEQ ID NO: 800761 - protein, 9 aa, Homo Sapiens
AVLLCTFTT

SEQ ID NO: 800762 - protein, 9 aa, Homo Sapiens
PVVMSSYQD

SEQ ID NO: 800763 - protein, 9 aa, Homo Sapiens
DGDIDPMWF

SEQ ID NO: 800764 - protein, 9 aa, Homo Sapiens
RKREEDIVK

SEQ ID NO: 800765 - protein, 9 aa, Homo Sapiens
QEILKTVPP

SEQ ID NO: 800766 - protein, 9 aa, Homo Sapiens
NGVDLTSLH

SEQ ID NO: 800767 - protein, 9 aa, Homo Sapiens
IEEGKGKLR

SEQ ID NO: 800768 - protein, 9 aa, Homo Sapiens
RLATCLDGM

SEQ ID NO: 800769 - protein, 9 aa, Homo Sapiens
LESQKARLP

SEQ ID NO: 800770 - protein, 9 aa, Homo Sapiens
DLQEQLAEW

SEQ ID NO: 800771 - protein, 9 aa, Homo Sapiens
FVGERRFES

SEQ ID NO: 800772 - protein, 9 aa, Homo Sapiens
EIQPLEKIK

SEQ ID NO: 800773 - protein, 9 aa, Homo Sapiens
QVTVALSSL

SEQ ID NO: 800774 - protein, 9 aa, Homo Sapiens
QEQLAEWCR

SEQ ID NO: 800775 - protein, 9 aa, Homo Sapiens
HILDSRNVF

SEQ ID NO: 800776 - protein, 9 aa, Homo Sapiens
DLSYEIAKH

SEQ ID NO: 800777 - protein, 9 aa, Homo Sapiens
SPYFAEKKS

SEQ ID NO: 800778 - protein, 9 aa, Homo Sapiens
VDLSYEIAK

SEQ ID NO: 800779 - protein, 9 aa, Homo Sapiens
LIEIFWHFK

SEQ ID NO: 800780 - protein, 9 aa, Homo Sapiens
TSLHQMKLQ

SEQ ID NO: 800781 - protein, 9 aa, Homo Sapiens
FSSDAGDES

SEQ ID NO: 800782 - protein, 9 aa, Homo Sapiens
QPAVLLCTF

SEQ ID NO: 800783 - protein, 9 aa, Homo Sapiens
FPDPTGKFN

SEQ ID NO: 800784 - protein, 9 aa, Homo Sapiens
LRQELCDML

SEQ ID NO: 800785 - protein, 9 aa, Homo Sapiens
ELSEEEEYE

SEQ ID NO: 800786 - protein, 9 aa, Homo Sapiens
YNKKKRLFN

SEQ ID NO: 800787 - protein, 9 aa, Homo Sapiens
CGCANCRVV

SEQ ID NO: 800788 - protein, 9 aa, Homo Sapiens
DPMWFESLN

SEQ ID NO: 800789 - protein, 9 aa, Homo Sapiens
RLFNTPYVD

SEQ ID NO: 800790 - protein, 9 aa, Homo Sapiens
WEKWYFPDP

SEQ ID NO: 800791 - protein, 9 aa, Homo Sapiens
SLHQMKLQR

SEQ ID NO: 800792 - protein, 9 aa, Homo Sapiens
FNTPYVDNS

SEQ ID NO: 800793 - protein, 9 aa, Homo Sapiens
QEIAEKKHG

SEQ ID NO: 800794 - protein, 9 aa, Homo Sapiens
LGGGKTPPE

SEQ ID NO: 800795 - protein, 9 aa, Homo Sapiens
EKKHGKIEP

SEQ ID NO: 800796 - protein, 9 aa, Homo Sapiens
KIQMTSGVT

SEQ ID NO: 800797 - protein, 9 aa, Homo Sapiens
IAEKKHGKI

SEQ ID NO: 800798 - protein, 9 aa, Homo Sapiens
LSPALSQEI

SEQ ID NO: 800799 - protein, 9 aa, Homo Sapiens
IQMTSGVTG

SEQ ID NO: 800800 - protein, 9 aa, Homo Sapiens
FESLNTVMD

SEQ ID NO: 800801 - protein, 9 aa, Homo Sapiens
INTSSSNHI

SEQ ID NO: 800802 - protein, 9 aa, Homo Sapiens
RRCLIEIFW

SEQ ID NO: 800803 - protein, 9 aa, Homo Sapiens
NFRCFRYQE

SEQ ID NO: 800804 - protein, 9 aa, Homo Sapiens
KAKWLFEIQ

SEQ ID NO: 800805 - protein, 9 aa, Homo Sapiens
ARLPQLLYE

SEQ ID NO: 800806 - protein, 9 aa, Homo Sapiens
ATCLDGMRI

SEQ ID NO: 800807 - protein, 9 aa, Homo Sapiens
KKKRLFNTP

SEQ ID NO: 800808 - protein, 9 aa, Homo Sapiens
ALSQEILKT

SEQ ID NO: 800809 - protein, 9 aa, Homo Sapiens
ASLLKCQCC

SEQ ID NO: 800810 - protein, 9 aa, Homo Sapiens
KNGSPSPYF

SEQ ID NO: 800811 - protein, 9 aa, Homo Sapiens
GKHFVGERR

SEQ ID NO: 800812 - protein, 9 aa, Homo Sapiens
RSKDNQGIK

SEQ ID NO: 800813 - protein, 9 aa, Homo Sapiens
TQIFPHSEM

SEQ ID NO: 800814 - protein, 9 aa, Homo Sapiens
GSPSPYFAE

SEQ ID NO: 800815 - protein, 9 aa, Homo Sapiens
LATCLDGMR

SEQ ID NO: 800816 - protein, 9 aa, Homo Sapiens
EELEDPSNR

SEQ ID NO: 800817 - protein, 9 aa, Homo Sapiens
LCTFTTSAA

SEQ ID NO: 800818 - protein, 9 aa, Homo Sapiens
QLAEWCRLA

SEQ ID NO: 800819 - protein, 9 aa, Homo Sapiens
GERRFESIH

SEQ ID NO: 800820 - protein, 9 aa, Homo Sapiens
IHYINPLNP

SEQ ID NO: 800821 - protein, 9 aa, Homo Sapiens
QIFPHSEMT

SEQ ID NO: 800822 - protein, 9 aa, Homo Sapiens
EGKGKLRWN

SEQ ID NO: 800823 - protein, 9 aa, Homo Sapiens
SPSPYFAEK

SEQ ID NO: 800824 - protein, 9 aa, Homo Sapiens
SVCGCANCR

SEQ ID NO: 800825 - protein, 9 aa, Homo Sapiens
DIVKVSSGK

SEQ ID NO: 800826 - protein, 9 aa, Homo Sapiens
VNPFIKTTN

SEQ ID NO: 800827 - protein, 9 aa, Homo Sapiens
EETRLATCL

SEQ ID NO: 800828 - protein, 9 aa, Homo Sapiens
GEPMVQKQI

SEQ ID NO: 800829 - protein, 9 aa, Homo Sapiens
LILFILRAL

SEQ ID NO: 800830 - protein, 9 aa, Homo Sapiens
TDVWEKWYF

SEQ ID NO: 800831 - protein, 9 aa, Homo Sapiens
AIHYINPLN

SEQ ID NO: 800832 - protein, 9 aa, Homo Sapiens
EWCRLAQHL

SEQ ID NO: 800833 - protein, 9 aa, Homo Sapiens
EDRPRMGEH

SEQ ID NO: 800834 - protein, 9 aa, Homo Sapiens
FFEELEDPS

SEQ ID NO: 800835 - protein, 9 aa, Homo Sapiens
ELCDMLAKA

SEQ ID NO: 800836 - protein, 9 aa, Homo Sapiens
MVHASLLKC

SEQ ID NO: 800837 - protein, 9 aa, Homo Sapiens
KRLFNTPYV

SEQ ID NO: 800838 - protein, 9 aa, Homo Sapiens
KHFVGERRF

SEQ ID NO: 800839 - protein, 9 aa, Homo Sapiens
QTAEDRPRM

SEQ ID NO: 800840 - protein, 9 aa, Homo Sapiens
EKWYFPDPT

SEQ ID NO: 800841 - protein, 9 aa, Homo Sapiens
LPQLLYESK

SEQ ID NO: 800842 - protein, 9 aa, Homo Sapiens
NQDFSVFQL

SEQ ID NO: 800843 - protein, 9 aa, Homo Sapiens
LRWNLRKTC

SEQ ID NO: 800844 - protein, 9 aa, Homo Sapiens
PSPYFAEKK

SEQ ID NO: 800845 - protein, 9 aa, Homo Sapiens
VPTKTLYDP

SEQ ID NO: 800846 - protein, 9 aa, Homo Sapiens
HLYVITVFE

SEQ ID NO: 800847 - protein, 9 aa, Homo Sapiens
VFLHTGHGE

SEQ ID NO: 800848 - protein, 9 aa, Homo Sapiens
RALMINTSS

SEQ ID NO: 800849 - protein, 9 aa, Homo Sapiens
NHILDSRNV

SEQ ID NO: 800850 - protein, 9 aa, Homo Sapiens
NKKKRLFNT

SEQ ID NO: 800851 - protein, 9 aa, Homo Sapiens
RCFRYQEAA

SEQ ID NO: 800852 - protein, 9 aa, Homo Sapiens
EQLAEWCRL

SEQ ID NO: 800853 - protein, 9 aa, Homo Sapiens
DLTSLHQMK

SEQ ID NO: 800854 - protein, 9 aa, Homo Sapiens
CFRYQEAAS

SEQ ID NO: 800855 - protein, 9 aa, Homo Sapiens
SHQNFRCFR

SEQ ID NO: 800856 - protein, 9 aa, Homo Sapiens
PMVQKQIEW

SEQ ID NO: 800857 - protein, 9 aa, Homo Sapiens
EIFWHFKGV

SEQ ID NO: 800858 - protein, 9 aa, Homo Sapiens
NVFLHTGHG

SEQ ID NO: 800859 - protein, 9 aa, Homo Sapiens
ERRFESIHD

SEQ ID NO: 800860 - protein, 9 aa, Homo Sapiens
IIEDEIKQR

SEQ ID NO: 800861 - protein, 9 aa, Homo Sapiens
EPMVQKQIE

SEQ ID NO: 800862 - protein, 9 aa, Homo Sapiens
SPALSQEIL

SEQ ID NO: 800863 - protein, 9 aa, Homo Sapiens
HYINPLNPA

SEQ ID NO: 800864 - protein, 9 aa, Homo Sapiens
AEDRPRMGE

SEQ ID NO: 800865 - protein, 9 aa, Homo Sapiens
ILRALMINT

SEQ ID NO: 800866 - protein, 9 aa, Homo Sapiens
RHTKFFEEL

SEQ ID NO: 800867 - protein, 9 aa, Homo Sapiens
ILDSRNVFL

SEQ ID NO: 800868 - protein, 9 aa, Homo Sapiens
YQVALREKK

SEQ ID NO: 800869 - protein, 9 aa, Homo Sapiens
PLSSFCSSF

SEQ ID NO: 800870 - protein, 9 aa, Homo Sapiens
KREEDIVKV

SEQ ID NO: 800871 - protein, 9 aa, Homo Sapiens
TSHQNFRCF

SEQ ID NO: 800872 - protein, 9 aa, Homo Sapiens
ILFILRALM

SEQ ID NO: 800873 - protein, 9 aa, Homo Sapiens
MLAKAAPHV

SEQ ID NO: 800874 - protein, 9 aa, Homo Sapiens
IAQKIQMTS

SEQ ID NO: 800875 - protein, 9 aa, Homo Sapiens
KMKVTVTQV

SEQ ID NO: 800876 - protein, 9 aa, Homo Sapiens
EYEEEEEEE

SEQ ID NO: 800877 - protein, 9 aa, Homo Sapiens
KFQEIAEKK

SEQ ID NO: 800878 - protein, 9 aa, Homo Sapiens
YFAEKKSTA

SEQ ID NO: 800879 - protein, 9 aa, Homo Sapiens
ISESELVEP

SEQ ID NO: 800880 - protein, 9 aa, Homo Sapiens
IVKVSSGKL

SEQ ID NO: 800881 - protein, 9 aa, Homo Sapiens
VDLTSLHQM

SEQ ID NO: 800882 - protein, 9 aa, Homo Sapiens
IKQRSKDNQ

SEQ ID NO: 800883 - protein, 9 aa, Homo Sapiens
SQKARLPQL

SEQ ID NO: 800884 - protein, 9 aa, Homo Sapiens
LQEQLAEWC

SEQ ID NO: 800885 - protein, 9 aa, Homo Sapiens
SNHILDSRN

SEQ ID NO: 800886 - protein, 9 aa, Homo Sapiens
KQRSKDNQG

SEQ ID NO: 800887 - protein, 9 aa, Homo Sapiens
HSVCGCANC

SEQ ID NO: 800888 - protein, 9 aa, Homo Sapiens
GKGKLRWNL

SEQ ID NO: 800889 - protein, 9 aa, Homo Sapiens
GDIDPMWFE

SEQ ID NO: 800890 - protein, 9 aa, Homo Sapiens
VCGCANCRV

SEQ ID NO: 800891 - protein, 9 aa, Homo Sapiens
THSTLTQIF

SEQ ID NO: 800892 - protein, 9 aa, Homo Sapiens
PSQSPLSSF

SEQ ID NO: 800893 - protein, 9 aa, Homo Sapiens
YFPDPTGKF

SEQ ID NO: 800894 - protein, 9 aa, Homo Sapiens
WGYQVALRE

SEQ ID NO: 800895 - protein, 9 aa, Homo Sapiens
VQLILFILR

SEQ ID NO: 800896 - protein, 9 aa, Homo Sapiens
AGDESTDGF

SEQ ID NO: 800897 - protein, 9 aa, Homo Sapiens
VLIMELIKM

SEQ ID NO: 800898 - protein, 9 aa, Homo Sapiens
SSSNHILDS

SEQ ID NO: 800899 - protein, 9 aa, Homo Sapiens
RQVRHLYVI

SEQ ID NO: 800900 - protein, 9 aa, Homo Sapiens
NTSSSNHIL

SEQ ID NO: 800901 - protein, 9 aa, Homo Sapiens
ALMINTSSS

SEQ ID NO: 800902 - protein, 9 aa, Homo Sapiens
IDPMWFESL

SEQ ID NO: 800903 - protein, 9 aa, Homo Sapiens
CHCGAWNCQ

SEQ ID NO: 800904 - protein, 9 aa, Homo Sapiens
RPRMGEHQP

SEQ ID NO: 800905 - protein, 9 aa, Homo Sapiens
VSSIAQKIQ

SEQ ID NO: 800906 - protein, 9 aa, Homo Sapiens
SKDNQGIKV

SEQ ID NO: 800907 - protein, 9 aa, Homo Sapiens
FRCFRYQEA

SEQ ID NO: 800908 - protein, 9 aa, Homo Sapiens
EILKTVPPP

SEQ ID NO: 800909 - protein, 9 aa, Homo Sapiens
LNPAKDNFT

SEQ ID NO: 800910 - protein, 9 aa, Homo Sapiens
RCLIEIFWH

SEQ ID NO: 800911 - protein, 9 aa, Homo Sapiens
DEIKQRSKD

SEQ ID NO: 800912 - protein, 9 aa, Homo Sapiens
LKCQCCVGA

SEQ ID NO: 800913 - protein, 9 aa, Homo Sapiens
SEEEEYEEE

SEQ ID NO: 800914 - protein, 9 aa, Homo Sapiens
DFSVFQLLV

SEQ ID NO: 800915 - protein, 9 aa, Homo Sapiens
HCGAWNCQK

SEQ ID NO: 800916 - protein, 9 aa, Homo Sapiens
IEWVLIMEL

SEQ ID NO: 800917 - protein, 9 aa, Homo Sapiens
IQPLEKIKE

SEQ ID NO: 800918 - protein, 9 aa, Homo Sapiens
QDFSVFQLL

SEQ ID NO: 800919 - protein, 9 aa, Homo Sapiens
DLNQDFSVF

SEQ ID NO: 800920 - protein, 9 aa, Homo Sapiens
CDMLAKAAP

SEQ ID NO: 800921 - protein, 9 aa, Homo Sapiens
WLFEIQPLE

SEQ ID NO: 800922 - protein, 9 aa, Homo Sapiens
SYEIAKHVR

SEQ ID NO: 800923 - protein, 9 aa, Homo Sapiens
ARGQPAVLL

SEQ ID NO: 800924 - protein, 9 aa, Homo Sapiens
CGAWNCQKW

SEQ ID NO: 800925 - protein, 9 aa, Homo Sapiens
SQSPLSSFC

SEQ ID NO: 800926 - protein, 9 aa, Homo Sapiens
HFVGERRFE

SEQ ID NO: 800927 - protein, 9 aa, Homo Sapiens
DIDPMWFES

SEQ ID NO: 800928 - protein, 9 aa, Homo Sapiens
LNWGYQVAL

SEQ ID NO: 800929 - protein, 9 aa, Homo Sapiens
PTKTLYDPR

SEQ ID NO: 800930 - protein, 9 aa, Homo Sapiens
LSEEEEYEE

SEQ ID NO: 800931 - protein, 9 aa, Homo Sapiens
RISESELVE

SEQ ID NO: 800932 - protein, 9 aa, Homo Sapiens
NQGIKVQLI

SEQ ID NO: 800933 - protein, 9 aa, Homo Sapiens
LRALMINTS

SEQ ID NO: 800934 - protein, 9 aa, Homo Sapiens
STLTQIFPH

SEQ ID NO: 800935 - protein, 9 aa, Homo Sapiens
LSQEILKTV

SEQ ID NO: 800936 - protein, 9 aa, Homo Sapiens
WFESLNTVM

SEQ ID NO: 800937 - protein, 9 aa, Homo Sapiens
RRFESIHDL

SEQ ID NO: 800938 - protein, 9 aa, Homo Sapiens
YVITVFEDY

SEQ ID NO: 800939 - protein, 9 aa, Homo Sapiens
SRNVFLHTG

SEQ ID NO: 800940 - protein, 9 aa, Homo Sapiens
QVRHLYVIT

SEQ ID NO: 800941 - protein, 9 aa, Homo Sapiens
LHQMKLQRP

SEQ ID NO: 800942 - protein, 9 aa, Homo Sapiens
VRHLYVITV

SEQ ID NO: 800943 - protein, 9 aa, Homo Sapiens
YINPLNPAK

SEQ ID NO: 800944 - protein, 9 aa, Homo Sapiens
LNQDFSVFQ

SEQ ID NO: 800945 - protein, 9 aa, Homo Sapiens
SRHKSFSTC

SEQ ID NO: 800946 - protein, 9 aa, Homo Sapiens
QRSKDNQGI

SEQ ID NO: 800947 - protein, 9 aa, Homo Sapiens
HKSFSTCAS

SEQ ID NO: 800948 - protein, 9 aa, Homo Sapiens
RRISESELV

SEQ ID NO: 800949 - protein, 9 aa, Homo Sapiens
MINTSSSNH

SEQ ID NO: 800950 - protein, 9 aa, Homo Sapiens
VPLRRISES

SEQ ID NO: 800951 - protein, 9 aa, Homo Sapiens
PFIKTTNIV

SEQ ID NO: 800952 - protein, 9 aa, Homo Sapiens
LTQIFPHSE

SEQ ID NO: 800953 - protein, 9 aa, Homo Sapiens
QKARLPQLL

SEQ ID NO: 800954 - protein, 9 aa, Homo Sapiens
HTGHGEPMV

SEQ ID NO: 800955 - protein, 9 aa, Homo Sapiens
DVWEKWYFP

SEQ ID NO: 800956 - protein, 9 aa, Homo Sapiens
IVPVVMSSY

SEQ ID NO: 800957 - protein, 9 aa, Homo Sapiens
RELSEEEEY

SEQ ID NO: 800958 - protein, 9 aa, Homo Sapiens
SESELVEPS

SEQ ID NO: 800959 - protein, 9 aa, Homo Sapiens
KWLFEIQPL

SEQ ID NO: 800960 - protein, 9 aa, Homo Sapiens
KFFEELEDP

SEQ ID NO: 800961 - protein, 9 aa, Homo Sapiens
VPVVMSSYQ

SEQ ID NO: 800962 - protein, 9 aa, Homo Sapiens
DSRNVFLHT

SEQ ID NO: 800963 - protein, 9 aa, Homo Sapiens
FVPTKTLYD

SEQ ID NO: 800964 - protein, 9 aa, Homo Sapiens
KARLPQLLY

SEQ ID NO: 800965 - protein, 9 aa, Homo Sapiens
CLIEIFWHF

SEQ ID NO: 800966 - protein, 9 aa, Homo Sapiens
SSIAQKIQM

SEQ ID NO: 800967 - protein, 9 aa, Homo Sapiens
IVILFYSMT

SEQ ID NO: 800968 - protein, 9 aa, Homo Sapiens
HQMKLQRPM

SEQ ID NO: 800969 - protein, 9 aa, Homo Sapiens
DAGDESTDG

SEQ ID NO: 800970 - protein, 9 aa, Homo Sapiens
PMWFESLNT

SEQ ID NO: 800971 - protein, 9 aa, Homo Sapiens
AWNCQKWMN

SEQ ID NO: 800972 - protein, 9 aa, Homo Sapiens
LLKCQCCVG

SEQ ID NO: 800973 - protein, 9 aa, Homo Sapiens
KKHGKIEPY

SEQ ID NO: 800974 - protein, 9 aa, Homo Sapiens
EIKQRSKDN

SEQ ID NO: 800975 - protein, 9 aa, Homo Sapiens
PLNPAKDNF

SEQ ID NO: 800976 - protein, 9 aa, Homo Sapiens
QKIQMTSGV

SEQ ID NO: 800977 - protein, 9 aa, Homo Sapiens
VPIVPVVMS

SEQ ID NO: 800978 - protein, 9 aa, Homo Sapiens
FEIQPLEKI

SEQ ID NO: 800979 - protein, 9 aa, Homo Sapiens
TKFFEELED

SEQ ID NO: 800980 - protein, 9 aa, Homo Sapiens
TAEDRPRMG

SEQ ID NO: 800981 - protein, 9 aa, Homo Sapiens
SAESRHKSF

SEQ ID NO: 800982 - protein, 9 aa, Homo Sapiens
MCVPHSVCG

SEQ ID NO: 800983 - protein, 9 aa, Homo Sapiens
GHGEPMVQK

SEQ ID NO: 800984 - protein, 9 aa, Homo Sapiens
KKRLFNTPY

SEQ ID NO: 800985 - protein, 9 aa, Homo Sapiens
ESRHKSFST

SEQ ID NO: 800986 - protein, 9 aa, Homo Sapiens
RGQPAVLLC

SEQ ID NO: 800987 - protein, 9 aa, Homo Sapiens
GVNPFIKTT

SEQ ID NO: 800988 - protein, 9 aa, Homo Sapiens
VTVALSSLK

SEQ ID NO: 800989 - protein, 9 aa, Homo Sapiens
REEDIVKVS

SEQ ID NO: 800990 - protein, 9 aa, Homo Sapiens
TGHGEPMVQ

SEQ ID NO: 800991 - protein, 9 aa, Homo Sapiens
AESRHKSFS

SEQ ID NO: 800992 - protein, 9 aa, Homo Sapiens
VLLCTFTTS

SEQ ID NO: 800993 - protein, 9 aa, Homo Sapiens
GDESTDGFH

SEQ ID NO: 800994 - protein, 9 aa, Homo Sapiens
GYCVDLSYE

SEQ ID NO: 800995 - protein, 9 aa, Homo Sapiens
FQEIAEKKH

SEQ ID NO: 800996 - protein, 9 aa, Homo Sapiens
ETSHQNFRC

SEQ ID NO: 800997 - protein, 9 aa, Homo Sapiens
HASLLKCQC

SEQ ID NO: 800998 - protein, 9 aa, Homo Sapiens
GQPAVLLCT

SEQ ID NO: 800999 - protein, 9 aa, Homo Sapiens
TQVTVALSS

SEQ ID NO: 801000 - protein, 9 aa, Homo Sapiens
VGERRFESI

SEQ ID NO: 801001 - protein, 9 aa, Homo Sapiens
WVLIMELIK

SEQ ID NO: 801002 - protein, 9 aa, Homo Sapiens
IMCVPHSVC

SEQ ID NO: 801003 - protein, 9 aa, Homo Sapiens
QKQIEWVLI

SEQ ID NO: 801004 - protein, 9 aa, Homo Sapiens
QIEWVLIME

SEQ ID NO: 801005 - protein, 9 aa, Homo Sapiens
SKAKWLFEI

SEQ ID NO: 801006 - protein, 9 aa, Homo Sapiens
MWFESLNTV

SEQ ID NO: 801007 - protein, 9 aa, Homo Sapiens
GVDLTSLHQ

SEQ ID NO: 801008 - protein, 9 aa, Homo Sapiens
GKLRWNLRK

SEQ ID NO: 801009 - protein, 9 aa, Homo Sapiens
LYVITVFED

SEQ ID NO: 801010 - protein, 9 aa, Homo Sapiens
VYNKKKRLF

SEQ ID NO: 801011 - protein, 9 aa, Homo Sapiens
IKVQLILFI

SEQ ID NO: 801012 - protein, 9 aa, Homo Sapiens
HSAESRHKS

SEQ ID NO: 801013 - protein, 9 aa, Homo Sapiens
EDEIKQRSK

SEQ ID NO: 801014 - protein, 9 aa, Homo Sapiens
INPLNPAKD

SEQ ID NO: 801015 - protein, 9 aa, Homo Sapiens
FCSSFSWSS

SEQ ID NO: 801016 - protein, 9 aa, Homo Sapiens
LFILRALMI

SEQ ID NO: 801017 - protein, 9 aa, Homo Sapiens
LFNTPYVDN

SEQ ID NO: 801018 - protein, 9 aa, Homo Sapiens
KEETRLATC

SEQ ID NO: 801019 - protein, 9 aa, Homo Sapiens
AEWCRLAQH

SEQ ID NO: 801020 - protein, 9 aa, Homo Sapiens
RQTAEDRPR

SEQ ID NO: 801021 - protein, 9 aa, Homo Sapiens
VPHSVCGCA

SEQ ID NO: 801022 - protein, 9 aa, Homo Sapiens
EEDIVKVSS

SEQ ID NO: 801023 - protein, 9 aa, Homo Sapiens
KVQLILFIL

SEQ ID NO: 801024 - protein, 9 aa, Homo Sapiens
EDIVKVSSG

SEQ ID NO: 801025 - protein, 9 aa, Homo Sapiens
NWGYQVALR

SEQ ID NO: 801026 - protein, 9 aa, Homo Sapiens
QLILFILRA

SEQ ID NO: 801027 - protein, 9 aa, Homo Sapiens
LDSRNVFLH

SEQ ID NO: 801028 - protein, 9 aa, Homo Sapiens
CLDGMRIEN

SEQ ID NO: 801029 - protein, 9 aa, Homo Sapiens
YCVDLSYEI

SEQ ID NO: 801030 - protein, 9 aa, Homo Sapiens
EWVLIMELI

SEQ ID NO: 801031 - protein, 9 aa, Homo Sapiens
MFSSDAGDE

SEQ ID NO: 801032 - protein, 9 aa, Homo Sapiens
LSYEIAKHV

SEQ ID NO: 801033 - protein, 9 aa, Homo Sapiens
RLPQLLYES

SEQ ID NO: 801034 - protein, 9 aa, Homo Sapiens
LLCTFTTSA

SEQ ID NO: 801035 - protein, 9 aa, Homo Sapiens
AQKIQMTSG

SEQ ID NO: 801036 - protein, 9 aa, Homo Sapiens
KCQCCVGAL

SEQ ID NO: 801037 - protein, 9 aa, Homo Sapiens
KLRWNLRKT

SEQ ID NO: 801038 - protein, 9 aa, Homo Sapiens
LRRISESEL

SEQ ID NO: 801039 - protein, 9 aa, Homo Sapiens
SLLKCQCCV

SEQ ID NO: 801040 - protein, 9 aa, Homo Sapiens
GSLNWGYQV

SEQ ID NO: 801041 - protein, 9 aa, Homo Sapiens
CVPHSVCGC

SEQ ID NO: 801042 - protein, 9 aa, Homo Sapiens
LTSLHQMKL

SEQ ID NO: 801043 - protein, 9 aa, Homo Sapiens
SSFCSSFSW

SEQ ID NO: 801044 - protein, 9 aa, Homo Sapiens
NPFIKTTNI

SEQ ID NO: 801045 - protein, 9 aa, Homo Sapiens
IEDEIKQRS

SEQ ID NO: 801046 - protein, 9 aa, Homo Sapiens
VHASLLKCQ

SEQ ID NO: 801047 - protein, 9 aa, Homo Sapiens
FSVFQLLVD

SEQ ID NO: 801048 - protein, 9 aa, Homo Sapiens
KTHSTLTQI

SEQ ID NO: 801049 - protein, 9 aa, Homo Sapiens
LSSFCSSFS

SEQ ID NO: 801050 - protein, 9 aa, Homo Sapiens
LYDPRWMLA

SEQ ID NO: 801051 - protein, 9 aa, Homo Sapiens
NGSPSPYFA

SEQ ID NO: 801052 - protein, 9 aa, Homo Sapiens
RHKSFSTCA

SEQ ID NO: 801053 - protein, 9 aa, Homo Sapiens
SFCSSFSWS

SEQ ID NO: 801054 - protein, 9 aa, Homo Sapiens
QVPIVPVVM

SEQ ID NO: 801055 - protein, 9 aa, Homo Sapiens
GYQVALREK

SEQ ID NO: 801056 - protein, 9 aa, Homo Sapiens
KRQTAEDRP

SEQ ID NO: 801057 - protein, 9 aa, Homo Sapiens
TRLATCLDG

SEQ ID NO: 801058 - protein, 9 aa, Homo Sapiens
VTVTQVTVA

SEQ ID NO: 801059 - protein, 9 aa, Homo Sapiens
PHSVCGCAN

SEQ ID NO: 801060 - protein, 9 aa, Homo Sapiens
DRPRMGEHQ

SEQ ID NO: 801061 - protein, 9 aa, Homo Sapiens
QMTSGVTGD

SEQ ID NO: 801062 - protein, 9 aa, Homo Sapiens
ESQKARLPQ

SEQ ID NO: 801063 - protein, 9 aa, Homo Sapiens
QELCDMLAK

SEQ ID NO: 801064 - protein, 9 aa, Homo Sapiens
HTKFFEELE

SEQ ID NO: 801065 - protein, 9 aa, Homo Sapiens
SDAGDESTD

SEQ ID NO: 801066 - protein, 9 aa, Homo Sapiens
TVTQVTVAL

SEQ ID NO: 801067 - protein, 9 aa, Homo Sapiens
DMLAKAAPH

SEQ ID NO: 801068 - protein, 9 aa, Homo Sapiens
KVTVTQVTV

SEQ ID NO: 801069 - protein, 9 aa, Homo Sapiens
CKNGSPSPY

SEQ ID NO: 801070 - protein, 9 aa, Homo Sapiens
NPLNPAKDN

SEQ ID NO: 801071 - protein, 9 aa, Homo Sapiens
EEGKGKLRW

SEQ ID NO: 801072 - protein, 9 aa, Homo Sapiens
HQNFRCFRY

SEQ ID NO: 801073 - protein, 9 aa, Homo Sapiens
LEDPSNRSF

SEQ ID NO: 801074 - protein, 9 aa, Homo Sapiens
DESTDGFHD

SEQ ID NO: 801075 - protein, 9 aa, Homo Sapiens
KWYFPDPTG

SEQ ID NO: 801076 - protein, 9 aa, Homo Sapiens
ESELVEPSS

SEQ ID NO: 801077 - protein, 9 aa, Homo Sapiens
TIVILFYSM

SEQ ID NO: 801078 - protein, 9 aa, Homo Sapiens
ESTDGFHDI

SEQ ID NO: 801079 - protein, 9 aa, Homo Sapiens
SKRQTAEDR

SEQ ID NO: 801080 - protein, 9 aa, Homo Sapiens
IEFVPTKTL

SEQ ID NO: 801081 - protein, 9 aa, Homo Sapiens
SHLTIVILF

SEQ ID NO: 801082 - protein, 9 aa, Homo Sapiens
KTLYDPRWM

SEQ ID NO: 801083 - protein, 9 aa, Homo Sapiens
GRQVRHLYV

SEQ ID NO: 801084 - protein, 9 aa, Homo Sapiens
KDNQGIKVQ

SEQ ID NO: 801085 - protein, 9 aa, Homo Sapiens
LMINTSSSN

SEQ ID NO: 801086 - protein, 9 aa, Homo Sapiens
YEGYCVDLS

SEQ ID NO: 801087 - protein, 9 aa, Homo Sapiens
CASHLTIVI

SEQ ID NO: 801088 - protein, 9 aa, Homo Sapiens
CQCCVGALG

SEQ ID NO: 801089 - protein, 9 aa, Homo Sapiens
GAWNCQKWM

SEQ ID NO: 801090 - protein, 9 aa, Homo Sapiens
QNFRCFRYQ

SEQ ID NO: 801091 - protein, 9 aa, Homo Sapiens
SSNHILDSR

SEQ ID NO: 801092 - protein, 9 aa, Homo Sapiens
GGGKTPPER

SEQ ID NO: 801093 - protein, 9 aa, Homo Sapiens
DNQGIKVQL

SEQ ID NO: 801094 - protein, 9 aa, Homo Sapiens
RWNLRKTCY

SEQ ID NO: 801095 - protein, 9 aa, Homo Sapiens
FAIFAFRSC

SEQ ID NO: 801096 - protein, 9 aa, Homo Sapiens
QLDAQDGTH

SEQ ID NO: 801097 - protein, 9 aa, Homo Sapiens
NKTVLHQFC

SEQ ID NO: 801098 - protein, 9 aa, Homo Sapiens
ISIHIQEMY

SEQ ID NO: 801099 - protein, 9 aa, Homo Sapiens
DSDSLPSSS

SEQ ID NO: 801100 - protein, 9 aa, Homo Sapiens
IWLLILSYV

SEQ ID NO: 801101 - protein, 9 aa, Homo Sapiens
EKDGSGEEK

SEQ ID NO: 801102 - protein, 9 aa, Homo Sapiens
VKGFISEAA

SEQ ID NO: 801103 - protein, 9 aa, Homo Sapiens
YITGKKSNN

SEQ ID NO: 801104 - protein, 9 aa, Homo Sapiens
DTHGRFILL

SEQ ID NO: 801105 - protein, 9 aa, Homo Sapiens
RVGTVARRD

SEQ ID NO: 801106 - protein, 9 aa, Homo Sapiens
KLVVVGAGD

SEQ ID NO: 801107 - protein, 9 aa, Homo Sapiens
GENIGCSMP

SEQ ID NO: 801108 - protein, 9 aa, Homo Sapiens
PSVINQERK

SEQ ID NO: 801109 - protein, 9 aa, Homo Sapiens
VLFNPQKHK

SEQ ID NO: 801110 - protein, 9 aa, Homo Sapiens
EGYIPSNYI

SEQ ID NO: 801111 - protein, 9 aa, Homo Sapiens
QEFPPRPTS

SEQ ID NO: 801112 - protein, 9 aa, Homo Sapiens
ENEGHQNVE

SEQ ID NO: 801113 - protein, 9 aa, Homo Sapiens
AERAIKKRN

SEQ ID NO: 801114 - protein, 9 aa, Homo Sapiens
YDIVKNPMD

SEQ ID NO: 801115 - protein, 9 aa, Homo Sapiens
REARLWRGR

SEQ ID NO: 801116 - protein, 9 aa, Homo Sapiens
PIPRRPVTP

SEQ ID NO: 801117 - protein, 9 aa, Homo Sapiens
DPYSDNPRL

SEQ ID NO: 801118 - protein, 9 aa, Homo Sapiens
RVRDGISIL

SEQ ID NO: 801119 - protein, 9 aa, Homo Sapiens
SCLVTPDLA

SEQ ID NO: 801120 - protein, 9 aa, Homo Sapiens
LKGYMISGS

SEQ ID NO: 801121 - protein, 9 aa, Homo Sapiens
LSSHLLDDG

SEQ ID NO: 801122 - protein, 9 aa, Homo Sapiens
GVPGQEFPP

SEQ ID NO: 801123 - protein, 9 aa, Homo Sapiens
PQNCCAAWE

SEQ ID NO: 801124 - protein, 9 aa, Homo Sapiens
SNPWSLEEE

SEQ ID NO: 801125 - protein, 9 aa, Homo Sapiens
ENKTVLHQF

SEQ ID NO: 801126 - protein, 9 aa, Homo Sapiens
ALTGLSCLV

SEQ ID NO: 801127 - protein, 9 aa, Homo Sapiens
THGRFILLG

SEQ ID NO: 801128 - protein, 9 aa, Homo Sapiens
MKKKCVVLR

SEQ ID NO: 801129 - protein, 9 aa, Homo Sapiens
FPWSSVKGF

SEQ ID NO: 801130 - protein, 9 aa, Homo Sapiens
PYSDNPRLG

SEQ ID NO: 801131 - protein, 9 aa, Homo Sapiens
YLCSKILIQ

SEQ ID NO: 801132 - protein, 9 aa, Homo Sapiens
WLFAIFAFR

SEQ ID NO: 801133 - protein, 9 aa, Homo Sapiens
QERKKKTGP

SEQ ID NO: 801134 - protein, 9 aa, Homo Sapiens
GSLPRSGTA

SEQ ID NO: 801135 - protein, 9 aa, Homo Sapiens
LGCQGWWSM

SEQ ID NO: 801136 - protein, 9 aa, Homo Sapiens
GRFILLGDP

SEQ ID NO: 801137 - protein, 9 aa, Homo Sapiens
HTNNYKIIK

SEQ ID NO: 801138 - protein, 9 aa, Homo Sapiens
NCCAAWEGK

SEQ ID NO: 801139 - protein, 9 aa, Homo Sapiens
GWVVIFQRE

SEQ ID NO: 801140 - protein, 9 aa, Homo Sapiens
LDGGSLPRS

SEQ ID NO: 801141 - protein, 9 aa, Homo Sapiens
EECKSNAKR

SEQ ID NO: 801142 - protein, 9 aa, Homo Sapiens
FRDSPLSSH

SEQ ID NO: 801143 - protein, 9 aa, Homo Sapiens
SHLLDDGFG

SEQ ID NO: 801144 - protein, 9 aa, Homo Sapiens
PSNYITGKK

SEQ ID NO: 801145 - protein, 9 aa, Homo Sapiens
NYYDIVKNP

SEQ ID NO: 801146 - protein, 9 aa, Homo Sapiens
EGHQNVEKL

SEQ ID NO: 801147 - protein, 9 aa, Homo Sapiens
LPAFPEESP

SEQ ID NO: 801148 - protein, 9 aa, Homo Sapiens
LRYAKMKMA

SEQ ID NO: 801149 - protein, 9 aa, Homo Sapiens
NPWSLEEEK

SEQ ID NO: 801150 - protein, 9 aa, Homo Sapiens
EGVPGQEFP

SEQ ID NO: 801151 - protein, 9 aa, Homo Sapiens
NYRQAYGEC

SEQ ID NO: 801152 - protein, 9 aa, Homo Sapiens
LIQYLNWEQ

SEQ ID NO: 801153 - protein, 9 aa, Homo Sapiens
GHQNVEKLS

SEQ ID NO: 801154 - protein, 9 aa, Homo Sapiens
LSLPAFPEE

SEQ ID NO: 801155 - protein, 9 aa, Homo Sapiens
SPTQQLPTS

SEQ ID NO: 801156 - protein, 9 aa, Homo Sapiens
GEVDYKKKI

SEQ ID NO: 801157 - protein, 9 aa, Homo Sapiens
RWRQKLEWR

SEQ ID NO: 801158 - protein, 9 aa, Homo Sapiens
AIFAFRSCG

SEQ ID NO: 801159 - protein, 9 aa, Homo Sapiens
WERGLARNP

SEQ ID NO: 801160 - protein, 9 aa, Homo Sapiens
KSPQNCCAA

SEQ ID NO: 801161 - protein, 9 aa, Homo Sapiens
KILIQYLNW

SEQ ID NO: 801162 - protein, 9 aa, Homo Sapiens
VRDGISILT

SEQ ID NO: 801163 - protein, 9 aa, Homo Sapiens
NITRMGSQP

SEQ ID NO: 801164 - protein, 9 aa, Homo Sapiens
VMSTQCVAN

SEQ ID NO: 801165 - protein, 9 aa, Homo Sapiens
MGDEEAPTM

SEQ ID NO: 801166 - protein, 9 aa, Homo Sapiens
SDNPRLGIQ

SEQ ID NO: 801167 - protein, 9 aa, Homo Sapiens
PLSSHLLDD

SEQ ID NO: 801168 - protein, 9 aa, Homo Sapiens
DPKTFQTAT

SEQ ID NO: 801169 - protein, 9 aa, Homo Sapiens
FNPQKHKQH

SEQ ID NO: 801170 - protein, 9 aa, Homo Sapiens
AKENCYRVA

SEQ ID NO: 801171 - protein, 9 aa, Homo Sapiens
DMLERELNI

SEQ ID NO: 801172 - protein, 9 aa, Homo Sapiens
NPKPRERQT

SEQ ID NO: 801173 - protein, 9 aa, Homo Sapiens
RFILLGDPQ

SEQ ID NO: 801174 - protein, 9 aa, Homo Sapiens
RQLDAQDGT

SEQ ID NO: 801175 - protein, 9 aa, Homo Sapiens
QNVEKLSWS

SEQ ID NO: 801176 - protein, 9 aa, Homo Sapiens
TSFPWSSVK

SEQ ID NO: 801177 - protein, 9 aa, Homo Sapiens
FWAELNIAR

SEQ ID NO: 801178 - protein, 9 aa, Homo Sapiens
PKFIFLRNL

SEQ ID NO: 801179 - protein, 9 aa, Homo Sapiens
EAEAQVPHL

SEQ ID NO: 801180 - protein, 9 aa, Homo Sapiens
GVGRVGTVA

SEQ ID NO: 801181 - protein, 9 aa, Homo Sapiens
EDADNQRNI

SEQ ID NO: 801182 - protein, 9 aa, Homo Sapiens
HPLVPKEIS

SEQ ID NO: 801183 - protein, 9 aa, Homo Sapiens
PRVMSTQCV

SEQ ID NO: 801184 - protein, 9 aa, Homo Sapiens
KPRERQTES

SEQ ID NO: 801185 - protein, 9 aa, Homo Sapiens
TNGLCIWLL

SEQ ID NO: 801186 - protein, 9 aa, Homo Sapiens
SPFHHIFMG

SEQ ID NO: 801187 - protein, 9 aa, Homo Sapiens
WSSVKGFIS

SEQ ID NO: 801188 - protein, 9 aa, Homo Sapiens
YLNWEQNNN

SEQ ID NO: 801189 - protein, 9 aa, Homo Sapiens
HLRARVLPG

SEQ ID NO: 801190 - protein, 9 aa, Homo Sapiens
IGSTMYGRK

SEQ ID NO: 801191 - protein, 9 aa, Homo Sapiens
SGEEKDGGG

SEQ ID NO: 801192 - protein, 9 aa, Homo Sapiens
ERGLARNPT

SEQ ID NO: 801193 - protein, 9 aa, Homo Sapiens
HIQEMYTPG

SEQ ID NO: 801194 - protein, 9 aa, Homo Sapiens
DVEGSRQLI

SEQ ID NO: 801195 - protein, 9 aa, Homo Sapiens
KEIGSTMYG

SEQ ID NO: 801196 - protein, 9 aa, Homo Sapiens
QCVANTSTQ

SEQ ID NO: 801197 - protein, 9 aa, Homo Sapiens
ENIGCSMPS

SEQ ID NO: 801198 - protein, 9 aa, Homo Sapiens
VVGAGDVGK

SEQ ID NO: 801199 - protein, 9 aa, Homo Sapiens
EITEGVPGQ

SEQ ID NO: 801200 - protein, 9 aa, Homo Sapiens
FLHVCRLKE

SEQ ID NO: 801201 - protein, 9 aa, Homo Sapiens
QNCCAAWEG

SEQ ID NO: 801202 - protein, 9 aa, Homo Sapiens
YFFSPKFIF

SEQ ID NO: 801203 - protein, 9 aa, Homo Sapiens
SGCFGEDCS

SEQ ID NO: 801204 - protein, 9 aa, Homo Sapiens
GSHVYFFFQ

SEQ ID NO: 801205 - protein, 9 aa, Homo Sapiens
NNYKIIKLL

SEQ ID NO: 801206 - protein, 9 aa, Homo Sapiens
RRMKKKCVV

SEQ ID NO: 801207 - protein, 9 aa, Homo Sapiens
PTSAVRERG

SEQ ID NO: 801208 - protein, 9 aa, Homo Sapiens
LRARVLPGG

SEQ ID NO: 801209 - protein, 9 aa, Homo Sapiens
RIIEIERIL

SEQ ID NO: 801210 - protein, 9 aa, Homo Sapiens
IEENRQKAV

SEQ ID NO: 801211 - protein, 9 aa, Homo Sapiens
LRCRTARRP

SEQ ID NO: 801212 - protein, 9 aa, Homo Sapiens
PPSSAASPT

SEQ ID NO: 801213 - protein, 9 aa, Homo Sapiens
DGGSLPRSG

SEQ ID NO: 801214 - protein, 9 aa, Homo Sapiens
SWLIAASSR

SEQ ID NO: 801215 - protein, 9 aa, Homo Sapiens
TDLMKKFSG

SEQ ID NO: 801216 - protein, 9 aa, Homo Sapiens
SKILIQYLN

SEQ ID NO: 801217 - protein, 9 aa, Homo Sapiens
SLPAFPEES

SEQ ID NO: 801218 - protein, 9 aa, Homo Sapiens
IMAVKRIWS

SEQ ID NO: 801219 - protein, 9 aa, Homo Sapiens
KSNAKRMSM

SEQ ID NO: 801220 - protein, 9 aa, Homo Sapiens
EAPTMCSIP

SEQ ID NO: 801221 - protein, 9 aa, Homo Sapiens
MCSIPIDYN

SEQ ID NO: 801222 - protein, 9 aa, Homo Sapiens
LERQLDAQD

SEQ ID NO: 801223 - protein, 9 aa, Homo Sapiens
QRPEPQLKG

SEQ ID NO: 801224 - protein, 9 aa, Homo Sapiens
LAAHTNNYK

SEQ ID NO: 801225 - protein, 9 aa, Homo Sapiens
VVPTEHVVA

SEQ ID NO: 801226 - protein, 9 aa, Homo Sapiens
PTQQLPTSH

SEQ ID NO: 801227 - protein, 9 aa, Homo Sapiens
RVLPGGAEE

SEQ ID NO: 801228 - protein, 9 aa, Homo Sapiens
PHLRARVLP

SEQ ID NO: 801229 - protein, 9 aa, Homo Sapiens
ILIQYLNWE

SEQ ID NO: 801230 - protein, 9 aa, Homo Sapiens
TAGRRQSLW

SEQ ID NO: 801231 - protein, 9 aa, Homo Sapiens
RPTSAVRER

SEQ ID NO: 801232 - protein, 9 aa, Homo Sapiens
APLSSFISI

SEQ ID NO: 801233 - protein, 9 aa, Homo Sapiens
QGDADKEKI

SEQ ID NO: 801234 - protein, 9 aa, Homo Sapiens
KTLCQQPPV

SEQ ID NO: 801235 - protein, 9 aa, Homo Sapiens
ENCYRVANW

SEQ ID NO: 801236 - protein, 9 aa, Homo Sapiens
LRNLIYSYL

SEQ ID NO: 801237 - protein, 9 aa, Homo Sapiens
CWPRGTVGE

SEQ ID NO: 801238 - protein, 9 aa, Homo Sapiens
EDLPLALST

SEQ ID NO: 801239 - protein, 9 aa, Homo Sapiens
SCMLDPKTF

SEQ ID NO: 801240 - protein, 9 aa, Homo Sapiens
RQTESPPVF

SEQ ID NO: 801241 - protein, 9 aa, Homo Sapiens
ILERQLDAQ

SEQ ID NO: 801242 - protein, 9 aa, Homo Sapiens
VGTVARRDA

SEQ ID NO: 801243 - protein, 9 aa, Homo Sapiens
GCSMPSLYL

SEQ ID NO: 801244 - protein, 9 aa, Homo Sapiens
TALSLPAFP

SEQ ID NO: 801245 - protein, 9 aa, Homo Sapiens
KRMSMLVGK

SEQ ID NO: 801246 - protein, 9 aa, Homo Sapiens
RNGMLLNGR

SEQ ID NO: 801247 - protein, 9 aa, Homo Sapiens
ERAIKKRNG

SEQ ID NO: 801248 - protein, 9 aa, Homo Sapiens
QEDTHGRFI

SEQ ID NO: 801249 - protein, 9 aa, Homo Sapiens
APIPRRPVT

SEQ ID NO: 801250 - protein, 9 aa, Homo Sapiens
ALRCHPLVP

SEQ ID NO: 801251 - protein, 9 aa, Homo Sapiens
KLLRKCSQV

SEQ ID NO: 801252 - protein, 9 aa, Homo Sapiens
DNQRNITRM

SEQ ID NO: 801253 - protein, 9 aa, Homo Sapiens
KDGSGEEKD

SEQ ID NO: 801254 - protein, 9 aa, Homo Sapiens
FFFQEIAME

SEQ ID NO: 801255 - protein, 9 aa, Homo Sapiens
RTARRPDSR

SEQ ID NO: 801256 - protein, 9 aa, Homo Sapiens
QRNITRMGS

SEQ ID NO: 801257 - protein, 9 aa, Homo Sapiens
PSSVNEKKS

SEQ ID NO: 801258 - protein, 9 aa, Homo Sapiens
KCVVLREQA

SEQ ID NO: 801259 - protein, 9 aa, Homo Sapiens
MATNIYLLN

SEQ ID NO: 801260 - protein, 9 aa, Homo Sapiens
SYLCSKILI

SEQ ID NO: 801261 - protein, 9 aa, Homo Sapiens
KKFSGAFET

SEQ ID NO: 801262 - protein, 9 aa, Homo Sapiens
PLSSFISIN

SEQ ID NO: 801263 - protein, 9 aa, Homo Sapiens
SFPWSSVKG

SEQ ID NO: 801264 - protein, 9 aa, Homo Sapiens
ASAGTILLR

SEQ ID NO: 801265 - protein, 9 aa, Homo Sapiens
QVPHLRARV

SEQ ID NO: 801266 - protein, 9 aa, Homo Sapiens
TFQTATSLS

SEQ ID NO: 801267 - protein, 9 aa, Homo Sapiens
RVMSTQCVA

SEQ ID NO: 801268 - protein, 9 aa, Homo Sapiens
LCQQPPVST

SEQ ID NO: 801269 - protein, 9 aa, Homo Sapiens
VPRVMSTQC

SEQ ID NO: 801270 - protein, 9 aa, Homo Sapiens
LVKEVLKRI

SEQ ID NO: 801271 - protein, 9 aa, Homo Sapiens
QKLEWRSWE

SEQ ID NO: 801272 - protein, 9 aa, Homo Sapiens
KRNGMLLNG

SEQ ID NO: 801273 - protein, 9 aa, Homo Sapiens
SRQLIDEHT

SEQ ID NO: 801274 - protein, 9 aa, Homo Sapiens
GSFDPYSDN

SEQ ID NO: 801275 - protein, 9 aa, Homo Sapiens
VVVLFNPQK

SEQ ID NO: 801276 - protein, 9 aa, Homo Sapiens
NPRLGIQKI

SEQ ID NO: 801277 - protein, 9 aa, Homo Sapiens
ESAKEITEG

SEQ ID NO: 801278 - protein, 9 aa, Homo Sapiens
GGWVVIFQR

SEQ ID NO: 801279 - protein, 9 aa, Homo Sapiens
LPRSGTAQV

SEQ ID NO: 801280 - protein, 9 aa, Homo Sapiens
EKISNTYSQ

SEQ ID NO: 801281 - protein, 9 aa, Homo Sapiens
KHRRIPQKS

SEQ ID NO: 801282 - protein, 9 aa, Homo Sapiens
EGSRQLIDE

SEQ ID NO: 801283 - protein, 9 aa, Homo Sapiens
LTGLSCLVT

SEQ ID NO: 801284 - protein, 9 aa, Homo Sapiens
KCSQVWKPK

SEQ ID NO: 801285 - protein, 9 aa, Homo Sapiens
DNPRLGIQK

SEQ ID NO: 801286 - protein, 9 aa, Homo Sapiens
MTNGLCIWL

SEQ ID NO: 801287 - protein, 9 aa, Homo Sapiens
ENGKRMKEK

SEQ ID NO: 801288 - protein, 9 aa, Homo Sapiens
IYSYLCSKI

SEQ ID NO: 801289 - protein, 9 aa, Homo Sapiens
SRRPENKTV

SEQ ID NO: 801290 - protein, 9 aa, Homo Sapiens
TNGNGLQAM

SEQ ID NO: 801291 - protein, 9 aa, Homo Sapiens
SPPPSCTST

SEQ ID NO: 801292 - protein, 9 aa, Homo Sapiens
SIHIQEMYT

SEQ ID NO: 801293 - protein, 9 aa, Homo Sapiens
LGLHNYYDI

SEQ ID NO: 801294 - protein, 9 aa, Homo Sapiens
RNLIYSYLC

SEQ ID NO: 801295 - protein, 9 aa, Homo Sapiens
LALRCRTAR

SEQ ID NO: 801296 - protein, 9 aa, Homo Sapiens
AKEITEGVP

SEQ ID NO: 801297 - protein, 9 aa, Homo Sapiens
EVLKRIIEI

SEQ ID NO: 801298 - protein, 9 aa, Homo Sapiens
GQEFPPRPT

SEQ ID NO: 801299 - protein, 9 aa, Homo Sapiens
VDVEGSRQL

SEQ ID NO: 801300 - protein, 9 aa, Homo Sapiens
LHQLITPDS

SEQ ID NO: 801301 - protein, 9 aa, Homo Sapiens
GISILTTAA

SEQ ID NO: 801302 - protein, 9 aa, Homo Sapiens
RGTVGENIG

SEQ ID NO: 801303 - protein, 9 aa, Homo Sapiens
CMLDPKTFQ

SEQ ID NO: 801304 - protein, 9 aa, Homo Sapiens
RESLGEGLR

SEQ ID NO: 801305 - protein, 9 aa, Homo Sapiens
IVKNPMDLG

SEQ ID NO: 801306 - protein, 9 aa, Homo Sapiens
RIWSTVDEK

SEQ ID NO: 801307 - protein, 9 aa, Homo Sapiens
NYKIIKLLV

SEQ ID NO: 801308 - protein, 9 aa, Homo Sapiens
LRKCSQVWK

SEQ ID NO: 801309 - protein, 9 aa, Homo Sapiens
GLSCLVTPD

SEQ ID NO: 801310 - protein, 9 aa, Homo Sapiens
IRKSTLGPD

SEQ ID NO: 801311 - protein, 9 aa, Homo Sapiens
KRPVRQRPE

SEQ ID NO: 801312 - protein, 9 aa, Homo Sapiens
IQYLNWEQN

SEQ ID NO: 801313 - protein, 9 aa, Homo Sapiens
LRCHPLVPK

SEQ ID NO: 801314 - protein, 9 aa, Homo Sapiens
FQEIAMEFN

SEQ ID NO: 801315 - protein, 9 aa, Homo Sapiens
WAELNIARL

SEQ ID NO: 801316 - protein, 9 aa, Homo Sapiens
GDEEAPTMC

SEQ ID NO: 801317 - protein, 9 aa, Homo Sapiens
MQEEVKTLC

SEQ ID NO: 801318 - protein, 9 aa, Homo Sapiens
TMCSIPIDY

SEQ ID NO: 801319 - protein, 9 aa, Homo Sapiens
ADNQRNITR

SEQ ID NO: 801320 - protein, 9 aa, Homo Sapiens
RCRTARRPD

SEQ ID NO: 801321 - protein, 9 aa, Homo Sapiens
EEAPTMCSI

SEQ ID NO: 801322 - protein, 9 aa, Homo Sapiens
DYKKKIPES

SEQ ID NO: 801323 - protein, 9 aa, Homo Sapiens
ADKEKISNT

SEQ ID NO: 801324 - protein, 9 aa, Homo Sapiens
VGENIGCSM

SEQ ID NO: 801325 - protein, 9 aa, Homo Sapiens
QSLWYATHY

SEQ ID NO: 801326 - protein, 9 aa, Homo Sapiens
TQQLPTSHP

SEQ ID NO: 801327 - protein, 9 aa, Homo Sapiens
TNNYKIIKL

SEQ ID NO: 801328 - protein, 9 aa, Homo Sapiens
AEESAKEIT

SEQ ID NO: 801329 - protein, 9 aa, Homo Sapiens
NKDEYEPNY

SEQ ID NO: 801330 - protein, 9 aa, Homo Sapiens
PSCTSTNGN

SEQ ID NO: 801331 - protein, 9 aa, Homo Sapiens
LINGGENKD

SEQ ID NO: 801332 - protein, 9 aa, Homo Sapiens
EWRRQLRES

SEQ ID NO: 801333 - protein, 9 aa, Homo Sapiens
LRWSNMATL

SEQ ID NO: 801334 - protein, 9 aa, Homo Sapiens
WSLEEEKYD

SEQ ID NO: 801335 - protein, 9 aa, Homo Sapiens
GGEEKDGSG

SEQ ID NO: 801336 - protein, 9 aa, Homo Sapiens
NMATLPTLP

SEQ ID NO: 801337 - protein, 9 aa, Homo Sapiens
PMYFFSPKF

SEQ ID NO: 801338 - protein, 9 aa, Homo Sapiens
DGSGEEKDG

SEQ ID NO: 801339 - protein, 9 aa, Homo Sapiens
RLALRCRTA

SEQ ID NO: 801340 - protein, 9 aa, Homo Sapiens
IFAFRSCGS

SEQ ID NO: 801341 - protein, 9 aa, Homo Sapiens
ATGDKGGWV

SEQ ID NO: 801342 - protein, 9 aa, Homo Sapiens
DQGDADKEK

SEQ ID NO: 801343 - protein, 9 aa, Homo Sapiens
DLLPNITLS

SEQ ID NO: 801344 - protein, 9 aa, Homo Sapiens
KDEYEPNYS

SEQ ID NO: 801345 - protein, 9 aa, Homo Sapiens
GGVGRVGTV

SEQ ID NO: 801346 - protein, 9 aa, Homo Sapiens
HQLITPDSS

SEQ ID NO: 801347 - protein, 9 aa, Homo Sapiens
KMKMATNIY

SEQ ID NO: 801348 - protein, 9 aa, Homo Sapiens
LCSKILIQY

SEQ ID NO: 801349 - protein, 9 aa, Homo Sapiens
TSTNGNGLQ

SEQ ID NO: 801350 - protein, 9 aa, Homo Sapiens
ITAGRRQSL

SEQ ID NO: 801351 - protein, 9 aa, Homo Sapiens
YMISGSSYA

SEQ ID NO: 801352 - protein, 9 aa, Homo Sapiens
QGGEEKDGS

SEQ ID NO: 801353 - protein, 9 aa, Homo Sapiens
DADKEKISN

SEQ ID NO: 801354 - protein, 9 aa, Homo Sapiens
MYTPGEMLM

SEQ ID NO: 801355 - protein, 9 aa, Homo Sapiens
SGFPAQPLV

SEQ ID NO: 801356 - protein, 9 aa, Homo Sapiens
QKAVARRAE

SEQ ID NO: 801357 - protein, 9 aa, Homo Sapiens
AVARRAEKL

SEQ ID NO: 801358 - protein, 9 aa, Homo Sapiens
QRLALRCRT

SEQ ID NO: 801359 - protein, 9 aa, Homo Sapiens
GENKDEYEP

SEQ ID NO: 801360 - protein, 9 aa, Homo Sapiens
VLSRRPENK

SEQ ID NO: 801361 - protein, 9 aa, Homo Sapiens
DALSIRKST

SEQ ID NO: 801362 - protein, 9 aa, Homo Sapiens
RDSPLSSHL

SEQ ID NO: 801363 - protein, 9 aa, Homo Sapiens
KIPESEAEA

SEQ ID NO: 801364 - protein, 9 aa, Homo Sapiens
GSTMYGRKG

SEQ ID NO: 801365 - protein, 9 aa, Homo Sapiens
VSPADSPFH

SEQ ID NO: 801366 - protein, 9 aa, Homo Sapiens
PAQPLVVPT

SEQ ID NO: 801367 - protein, 9 aa, Homo Sapiens
MSTQCVANT

SEQ ID NO: 801368 - protein, 9 aa, Homo Sapiens
QEDLPLALS

SEQ ID NO: 801369 - protein, 9 aa, Homo Sapiens
YYDIVKNPM

SEQ ID NO: 801370 - protein, 9 aa, Homo Sapiens
PTMCSIPID

SEQ ID NO: 801371 - protein, 9 aa, Homo Sapiens
HGRFILLGD

SEQ ID NO: 801372 - protein, 9 aa, Homo Sapiens
QAYGECTDF

SEQ ID NO: 801373 - protein, 9 aa, Homo Sapiens
VVKDKLKDA

SEQ ID NO: 801374 - protein, 9 aa, Homo Sapiens
FISINSNTG

SEQ ID NO: 801375 - protein, 9 aa, Homo Sapiens
RRQLRESLG

SEQ ID NO: 801376 - protein, 9 aa, Homo Sapiens
LEECKSNAK

SEQ ID NO: 801377 - protein, 9 aa, Homo Sapiens
NDALSIRKS

SEQ ID NO: 801378 - protein, 9 aa, Homo Sapiens
QEQIDIMHL

SEQ ID NO: 801379 - protein, 9 aa, Homo Sapiens
CRTARRPDS

SEQ ID NO: 801380 - protein, 9 aa, Homo Sapiens
EEQSWLIAA

SEQ ID NO: 801381 - protein, 9 aa, Homo Sapiens
AELNIARLR

SEQ ID NO: 801382 - protein, 9 aa, Homo Sapiens
ALDGGSLPR

SEQ ID NO: 801383 - protein, 9 aa, Homo Sapiens
NRRMKKKCV

SEQ ID NO: 801384 - protein, 9 aa, Homo Sapiens
KMATNIYLL

SEQ ID NO: 801385 - protein, 9 aa, Homo Sapiens
QIMAVKRIW

SEQ ID NO: 801386 - protein, 9 aa, Homo Sapiens
NVVKDKLKD

SEQ ID NO: 801387 - protein, 9 aa, Homo Sapiens
STNGNGLQA

SEQ ID NO: 801388 - protein, 9 aa, Homo Sapiens
PETEEEFLH

SEQ ID NO: 801389 - protein, 9 aa, Homo Sapiens
SSVNEKKSR

SEQ ID NO: 801390 - protein, 9 aa, Homo Sapiens
GFPAQPLVV

SEQ ID NO: 801391 - protein, 9 aa, Homo Sapiens
TVGENIGCS

SEQ ID NO: 801392 - protein, 9 aa, Homo Sapiens
AQPLVVPTE

SEQ ID NO: 801393 - protein, 9 aa, Homo Sapiens
QNRRMKKKC

SEQ ID NO: 801394 - protein, 9 aa, Homo Sapiens
DFSDAKENC

SEQ ID NO: 801395 - protein, 9 aa, Homo Sapiens
LHNYYDIVK

SEQ ID NO: 801396 - protein, 9 aa, Homo Sapiens
VYFFFQEIA

SEQ ID NO: 801397 - protein, 9 aa, Homo Sapiens
AGTILLRWL

SEQ ID NO: 801398 - protein, 9 aa, Homo Sapiens
AGNASAGTI

SEQ ID NO: 801399 - protein, 9 aa, Homo Sapiens
WLIAASSRP

SEQ ID NO: 801400 - protein, 9 aa, Homo Sapiens
QITAGRRQS

SEQ ID NO: 801401 - protein, 9 aa, Homo Sapiens
RQRPEPQLK

SEQ ID NO: 801402 - protein, 9 aa, Homo Sapiens
LDPKTFQTA

SEQ ID NO: 801403 - protein, 9 aa, Homo Sapiens
TGLSCLVTP

SEQ ID NO: 801404 - protein, 9 aa, Homo Sapiens
NPTPTCSGP

SEQ ID NO: 801405 - protein, 9 aa, Homo Sapiens
EEFLHVCRL

SEQ ID NO: 801406 - protein, 9 aa, Homo Sapiens
GPSVINQER

SEQ ID NO: 801407 - protein, 9 aa, Homo Sapiens
MATLPTLPE

SEQ ID NO: 801408 - protein, 9 aa, Homo Sapiens
SEAEAQVPH

SEQ ID NO: 801409 - protein, 9 aa, Homo Sapiens
ADSPFHHIF

SEQ ID NO: 801410 - protein, 9 aa, Homo Sapiens
EVDYKKKIP

SEQ ID NO: 801411 - protein, 9 aa, Homo Sapiens
LNWEQNNNV

SEQ ID NO: 801412 - protein, 9 aa, Homo Sapiens
LPNITLSWQ

SEQ ID NO: 801413 - protein, 9 aa, Homo Sapiens
IDMLERELN

SEQ ID NO: 801414 - protein, 9 aa, Homo Sapiens
GAPLSSFIS

SEQ ID NO: 801415 - protein, 9 aa, Homo Sapiens
MAVKRIWST

SEQ ID NO: 801416 - protein, 9 aa, Homo Sapiens
HQNVEKLSW

SEQ ID NO: 801417 - protein, 9 aa, Homo Sapiens
KSREREERQ

SEQ ID NO: 801418 - protein, 9 aa, Homo Sapiens
EKKSREREE

SEQ ID NO: 801419 - protein, 9 aa, Homo Sapiens
QLAEREIDM

SEQ ID NO: 801420 - protein, 9 aa, Homo Sapiens
KSTLGPDHP

SEQ ID NO: 801421 - protein, 9 aa, Homo Sapiens
LKTPMYFFS

SEQ ID NO: 801422 - protein, 9 aa, Homo Sapiens
FIFLRNLIY

SEQ ID NO: 801423 - protein, 9 aa, Homo Sapiens
SNYITGKKS

SEQ ID NO: 801424 - protein, 9 aa, Homo Sapiens
RSCGSYSGE

SEQ ID NO: 801425 - protein, 9 aa, Homo Sapiens
KTVLHQFCC

SEQ ID NO: 801426 - protein, 9 aa, Homo Sapiens
DGISILTTA

SEQ ID NO: 801427 - protein, 9 aa, Homo Sapiens
GAFETTLGK

SEQ ID NO: 801428 - protein, 9 aa, Homo Sapiens
WWSMLNPYL

SEQ ID NO: 801429 - protein, 9 aa, Homo Sapiens
IPRRPVTPG

SEQ ID NO: 801430 - protein, 9 aa, Homo Sapiens
AGRRQSLWY

SEQ ID NO: 801431 - protein, 9 aa, Homo Sapiens
KKSREREER

SEQ ID NO: 801432 - protein, 9 aa, Homo Sapiens
QSWLIAASS

SEQ ID NO: 801433 - protein, 9 aa, Homo Sapiens
FRSCGSYSG

SEQ ID NO: 801434 - protein, 9 aa, Homo Sapiens
FDPYSDNPR

SEQ ID NO: 801435 - protein, 9 aa, Homo Sapiens
AIKKRNGML

SEQ ID NO: 801436 - protein, 9 aa, Homo Sapiens
KRIIEIERI

SEQ ID NO: 801437 - protein, 9 aa, Homo Sapiens
ENKDEYEPN

SEQ ID NO: 801438 - protein, 9 aa, Homo Sapiens
RKRPVRQRP

SEQ ID NO: 801439 - protein, 9 aa, Homo Sapiens
KKIPESEAE

SEQ ID NO: 801440 - protein, 9 aa, Homo Sapiens
KDLEEQSWL

SEQ ID NO: 801441 - protein, 9 aa, Homo Sapiens
AEREIDMLE

SEQ ID NO: 801442 - protein, 9 aa, Homo Sapiens
STMYGRKGT

SEQ ID NO: 801443 - protein, 9 aa, Homo Sapiens
LSIRKSTLG

SEQ ID NO: 801444 - protein, 9 aa, Homo Sapiens
CVVVLFNPQ

SEQ ID NO: 801445 - protein, 9 aa, Homo Sapiens
LLPNITLSW

SEQ ID NO: 801446 - protein, 9 aa, Homo Sapiens
KEITEGVPG

SEQ ID NO: 801447 - protein, 9 aa, Homo Sapiens
STQCVANTS

SEQ ID NO: 801448 - protein, 9 aa, Homo Sapiens
LKRIIEIER

SEQ ID NO: 801449 - protein, 9 aa, Homo Sapiens
QYLNWEQNN

SEQ ID NO: 801450 - protein, 9 aa, Homo Sapiens
STFGSIGRL

SEQ ID NO: 801451 - protein, 9 aa, Homo Sapiens
RDKSPQNCC

SEQ ID NO: 801452 - protein, 9 aa, Homo Sapiens
WSMLNPYLL

SEQ ID NO: 801453 - protein, 9 aa, Homo Sapiens
GGENKDEYE

SEQ ID NO: 801454 - protein, 9 aa, Homo Sapiens
AVKRIWSTV

SEQ ID NO: 801455 - protein, 9 aa, Homo Sapiens
LHVCRLKEK

SEQ ID NO: 801456 - protein, 9 aa, Homo Sapiens
VRVALRCHP

SEQ ID NO: 801457 - protein, 9 aa, Homo Sapiens
LSTFGSIGR

SEQ ID NO: 801458 - protein, 9 aa, Homo Sapiens
LDAQDGTHA

SEQ ID NO: 801459 - protein, 9 aa, Homo Sapiens
LNIARLRHD

SEQ ID NO: 801460 - protein, 9 aa, Homo Sapiens
YKKKIPESE

SEQ ID NO: 801461 - protein, 9 aa, Homo Sapiens
RSFWAELNI

SEQ ID NO: 801462 - protein, 9 aa, Homo Sapiens
NGPSVINQE

SEQ ID NO: 801463 - protein, 9 aa, Homo Sapiens
EDTHGRFIL

SEQ ID NO: 801464 - protein, 9 aa, Homo Sapiens
VVVGAGDVG

SEQ ID NO: 801465 - protein, 9 aa, Homo Sapiens
PRAPIPRRP

SEQ ID NO: 801466 - protein, 9 aa, Homo Sapiens
AKRMSMLVG

SEQ ID NO: 801467 - protein, 9 aa, Homo Sapiens
KEKISNTYS

SEQ ID NO: 801468 - protein, 9 aa, Homo Sapiens
APTMCSIPI

SEQ ID NO: 801469 - protein, 9 aa, Homo Sapiens
NYITGKKSN

SEQ ID NO: 801470 - protein, 9 aa, Homo Sapiens
KKRNGMLLN

SEQ ID NO: 801471 - protein, 9 aa, Homo Sapiens
LKLLRKCSQ

SEQ ID NO: 801472 - protein, 9 aa, Homo Sapiens
QLIDEHTQL

SEQ ID NO: 801473 - protein, 9 aa, Homo Sapiens
GGSLPRSGT

SEQ ID NO: 801474 - protein, 9 aa, Homo Sapiens
IKKRNGMLL

SEQ ID NO: 801475 - protein, 9 aa, Homo Sapiens
RWSNMATLP

SEQ ID NO: 801476 - protein, 9 aa, Homo Sapiens
ELNIARLRH

SEQ ID NO: 801477 - protein, 9 aa, Homo Sapiens
GTVGENIGC

SEQ ID NO: 801478 - protein, 9 aa, Homo Sapiens
DPRAPIPRR

SEQ ID NO: 801479 - protein, 9 aa, Homo Sapiens
IDIMHLGHC

SEQ ID NO: 801480 - protein, 9 aa, Homo Sapiens
KRLHQLITP

SEQ ID NO: 801481 - protein, 9 aa, Homo Sapiens
EREIDMLER

SEQ ID NO: 801482 - protein, 9 aa, Homo Sapiens
GRRQSLWYA

SEQ ID NO: 801483 - protein, 9 aa, Homo Sapiens
LEEQSWLIA

SEQ ID NO: 801484 - protein, 9 aa, Homo Sapiens
LPSSSADAS

SEQ ID NO: 801485 - protein, 9 aa, Homo Sapiens
IMHLGHCTD

SEQ ID NO: 801486 - protein, 9 aa, Homo Sapiens
PENKTVLHQ

SEQ ID NO: 801487 - protein, 9 aa, Homo Sapiens
RDGISILTT

SEQ ID NO: 801488 - protein, 9 aa, Homo Sapiens
KLEWRSWEE

SEQ ID NO: 801489 - protein, 9 aa, Homo Sapiens
FPEESPLLV

SEQ ID NO: 801490 - protein, 9 aa, Homo Sapiens
RERQTESPP

SEQ ID NO: 801491 - protein, 9 aa, Homo Sapiens
GLARNPTPT

SEQ ID NO: 801492 - protein, 9 aa, Homo Sapiens
VVLFNPQKH

SEQ ID NO: 801493 - protein, 9 aa, Homo Sapiens
MISGSSYAR

SEQ ID NO: 801494 - protein, 9 aa, Homo Sapiens
SPADSPFHH

SEQ ID NO: 801495 - protein, 9 aa, Homo Sapiens
TMYGRKGTD

SEQ ID NO: 801496 - protein, 9 aa, Homo Sapiens
ETEEEFLHV

SEQ ID NO: 801497 - protein, 9 aa, Homo Sapiens
VINQERKKK

SEQ ID NO: 801498 - protein, 9 aa, Homo Sapiens
AEPTDSDSL

SEQ ID NO: 801499 - protein, 9 aa, Homo Sapiens
WLLILSYVG

SEQ ID NO: 801500 - protein, 9 aa, Homo Sapiens
LVTPDLARD

SEQ ID NO: 801501 - protein, 9 aa, Homo Sapiens
TEEEFLHVC

SEQ ID NO: 801502 - protein, 9 aa, Homo Sapiens
SPLSSHLLD

SEQ ID NO: 801503 - protein, 9 aa, Homo Sapiens
ARLWRGRQT

SEQ ID NO: 801504 - protein, 9 aa, Homo Sapiens
QGAPLSSFI

SEQ ID NO: 801505 - protein, 9 aa, Homo Sapiens
RQKAVARRA

SEQ ID NO: 801506 - protein, 9 aa, Homo Sapiens
DLMKKFSGA

SEQ ID NO: 801507 - protein, 9 aa, Homo Sapiens
TPDLLPNIT

SEQ ID NO: 801508 - protein, 9 aa, Homo Sapiens
TVARRDAAS

SEQ ID NO: 801509 - protein, 9 aa, Homo Sapiens
ALKLLRKCS

SEQ ID NO: 801510 - protein, 9 aa, Homo Sapiens
RRPVTPGGL

SEQ ID NO: 801511 - protein, 9 aa, Homo Sapiens
GAEESAKEI

SEQ ID NO: 801512 - protein, 9 aa, Homo Sapiens
GLHNYYDIV

SEQ ID NO: 801513 - protein, 9 aa, Homo Sapiens
PQKHKQHHI

SEQ ID NO: 801514 - protein, 9 aa, Homo Sapiens
DNYRQAYGE

SEQ ID NO: 801515 - protein, 9 aa, Homo Sapiens
RNYDNYRQA

SEQ ID NO: 801516 - protein, 9 aa, Homo Sapiens
GCFGEDCSY

SEQ ID NO: 801517 - protein, 9 aa, Homo Sapiens
TLPTLPETQ

SEQ ID NO: 801518 - protein, 9 aa, Homo Sapiens
LPLALSTFG

SEQ ID NO: 801519 - protein, 9 aa, Homo Sapiens
SDSLPSSSA

SEQ ID NO: 801520 - protein, 9 aa, Homo Sapiens
CKSNAKRMS

SEQ ID NO: 801521 - protein, 9 aa, Homo Sapiens
PVDVEGSRQ

SEQ ID NO: 801522 - protein, 9 aa, Homo Sapiens
HVCRLKEKE

SEQ ID NO: 801523 - protein, 9 aa, Homo Sapiens
SSVKGFISE

SEQ ID NO: 801524 - protein, 9 aa, Homo Sapiens
QLRESLGEG

SEQ ID NO: 801525 - protein, 9 aa, Homo Sapiens
TEGVPGQEF

SEQ ID NO: 801526 - protein, 9 aa, Homo Sapiens
GTVARRDAA

SEQ ID NO: 801527 - protein, 9 aa, Homo Sapiens
KFIFLRNLI

SEQ ID NO: 801528 - protein, 9 aa, Homo Sapiens
DLEEQSWLI

SEQ ID NO: 801529 - protein, 9 aa, Homo Sapiens
MYFFSPKFI

SEQ ID NO: 801530 - protein, 9 aa, Homo Sapiens
LALSTFGSI

SEQ ID NO: 801531 - protein, 9 aa, Homo Sapiens
IQITAGRRQ

SEQ ID NO: 801532 - protein, 9 aa, Homo Sapiens
WPRGTVGEN

SEQ ID NO: 801533 - protein, 9 aa, Homo Sapiens
MHLGHCTDT

SEQ ID NO: 801534 - protein, 9 aa, Homo Sapiens
CIWLLILSY

SEQ ID NO: 801535 - protein, 9 aa, Homo Sapiens
ILLGDPQTN

SEQ ID NO: 801536 - protein, 9 aa, Homo Sapiens
GDKGGWVVI

SEQ ID NO: 801537 - protein, 9 aa, Homo Sapiens
KKCVVLREQ

SEQ ID NO: 801538 - protein, 9 aa, Homo Sapiens
FFQEIAMEF

SEQ ID NO: 801539 - protein, 9 aa, Homo Sapiens
LVVVGAGDV

SEQ ID NO: 801540 - protein, 9 aa, Homo Sapiens
LPGGAEESA

SEQ ID NO: 801541 - protein, 9 aa, Homo Sapiens
IARLRHDNI

SEQ ID NO: 801542 - protein, 9 aa, Homo Sapiens
RQLRESLGE

SEQ ID NO: 801543 - protein, 9 aa, Homo Sapiens
PPPSCTSTN

SEQ ID NO: 801544 - protein, 9 aa, Homo Sapiens
TPMYFFSPK

SEQ ID NO: 801545 - protein, 9 aa, Homo Sapiens
SPSMSGCFG

SEQ ID NO: 801546 - protein, 9 aa, Homo Sapiens
IKQEQIDIM

SEQ ID NO: 801547 - protein, 9 aa, Homo Sapiens
ISINSNTGV

SEQ ID NO: 801548 - protein, 9 aa, Homo Sapiens
KTFQTATSL

SEQ ID NO: 801549 - protein, 9 aa, Homo Sapiens
CQGWWSMLN

SEQ ID NO: 801550 - protein, 9 aa, Homo Sapiens
SNAKRMSML

SEQ ID NO: 801551 - protein, 9 aa, Homo Sapiens
QPLVVPTEH

SEQ ID NO: 801552 - protein, 9 aa, Homo Sapiens
WQKHRRIPQ

SEQ ID NO: 801553 - protein, 9 aa, Homo Sapiens
NQERKKKTG

SEQ ID NO: 801554 - protein, 9 aa, Homo Sapiens
MYGRKGTDD

SEQ ID NO: 801555 - protein, 9 aa, Homo Sapiens
AFRSCGSYS

SEQ ID NO: 801556 - protein, 9 aa, Homo Sapiens
RARVLPGGA

SEQ ID NO: 801557 - protein, 9 aa, Homo Sapiens
YTPGEMLMT

SEQ ID NO: 801558 - protein, 9 aa, Homo Sapiens
MLNPYLLES

SEQ ID NO: 801559 - protein, 9 aa, Homo Sapiens
FQTATSLSK

SEQ ID NO: 801560 - protein, 9 aa, Homo Sapiens
CLVTPDLAR

SEQ ID NO: 801561 - protein, 9 aa, Homo Sapiens
VKRIWSTVD

SEQ ID NO: 801562 - protein, 9 aa, Homo Sapiens
KQEQIDIMH

SEQ ID NO: 801563 - protein, 9 aa, Homo Sapiens
DVGKSALTI

SEQ ID NO: 801564 - protein, 9 aa, Homo Sapiens
FPPRPTSAV

SEQ ID NO: 801565 - protein, 9 aa, Homo Sapiens
PVRVALRCH

SEQ ID NO: 801566 - protein, 9 aa, Homo Sapiens
ALRCRTARR

SEQ ID NO: 801567 - protein, 9 aa, Homo Sapiens
HNYYDIVKN

SEQ ID NO: 801568 - protein, 9 aa, Homo Sapiens
YGRKGTDDS

SEQ ID NO: 801569 - protein, 9 aa, Homo Sapiens
SAKEITEGV

SEQ ID NO: 801570 - protein, 9 aa, Homo Sapiens
VLKRIIEIE

SEQ ID NO: 801571 - protein, 9 aa, Homo Sapiens
CFGEDCSYE

SEQ ID NO: 801572 - protein, 9 aa, Homo Sapiens
EIDMLEREL

SEQ ID NO: 801573 - protein, 9 aa, Homo Sapiens
RPVTPGGLP

SEQ ID NO: 801574 - protein, 9 aa, Homo Sapiens
IGCSMPSLY

SEQ ID NO: 801575 - protein, 9 aa, Homo Sapiens
LVVPTEHVV

SEQ ID NO: 801576 - protein, 9 aa, Homo Sapiens
ARVRDGISI

SEQ ID NO: 801577 - protein, 9 aa, Homo Sapiens
FSPKFIFLR

SEQ ID NO: 801578 - protein, 9 aa, Homo Sapiens
TALDGGSLP

SEQ ID NO: 801579 - protein, 9 aa, Homo Sapiens
ALSIRKSTL

SEQ ID NO: 801580 - protein, 9 aa, Homo Sapiens
MLERELNIL

SEQ ID NO: 801581 - protein, 9 aa, Homo Sapiens
PSMSGCFGE

SEQ ID NO: 801582 - protein, 9 aa, Homo Sapiens
RRPENKTVL

SEQ ID NO: 801583 - protein, 9 aa, Homo Sapiens
SILTTAASS

SEQ ID NO: 801584 - protein, 9 aa, Homo Sapiens
REIDMLERE

SEQ ID NO: 801585 - protein, 9 aa, Homo Sapiens
SAASPTQQL

SEQ ID NO: 801586 - protein, 9 aa, Homo Sapiens
RMKKKCVVL

SEQ ID NO: 801587 - protein, 9 aa, Homo Sapiens
SCTSTNGNG

SEQ ID NO: 801588 - protein, 9 aa, Homo Sapiens
ASPTQQLPT

SEQ ID NO: 801589 - protein, 9 aa, Homo Sapiens
NEGHQNVEK

SEQ ID NO: 801590 - protein, 9 aa, Homo Sapiens
YIPSNYITG

SEQ ID NO: 801591 - protein, 9 aa, Homo Sapiens
KIIKLLVQK

SEQ ID NO: 801592 - protein, 9 aa, Homo Sapiens
NIARLRHDN

SEQ ID NO: 801593 - protein, 9 aa, Homo Sapiens
LLRKCSQVW

SEQ ID NO: 801594 - protein, 9 aa, Homo Sapiens
VRQRPEPQL

SEQ ID NO: 801595 - protein, 9 aa, Homo Sapiens
EAQVPHLRA

SEQ ID NO: 801596 - protein, 9 aa, Homo Sapiens
LMKKFSGAF

SEQ ID NO: 801597 - protein, 9 aa, Homo Sapiens
EIGSTMYGR

SEQ ID NO: 801598 - protein, 9 aa, Homo Sapiens
CCAAWEGKE

SEQ ID NO: 801599 - protein, 9 aa, Homo Sapiens
DKEKISNTY

SEQ ID NO: 801600 - protein, 9 aa, Homo Sapiens
QEEWRRQLR

SEQ ID NO: 801601 - protein, 9 aa, Homo Sapiens
RYAKMKMAT

SEQ ID NO: 801602 - protein, 9 aa, Homo Sapiens
GENGKRMKE

SEQ ID NO: 801603 - protein, 9 aa, Homo Sapiens
WVVIFQREP

SEQ ID NO: 801604 - protein, 9 aa, Homo Sapiens
SGAFETTLG

SEQ ID NO: 801605 - protein, 9 aa, Homo Sapiens
PLVVPTEHV

SEQ ID NO: 801606 - protein, 9 aa, Homo Sapiens
DAKENCYRV

SEQ ID NO: 801607 - protein, 9 aa, Homo Sapiens
CTSTNGNGL

SEQ ID NO: 801608 - protein, 9 aa, Homo Sapiens
ALSLPAFPE

SEQ ID NO: 801609 - protein, 9 aa, Homo Sapiens
RQLIDEHTQ

SEQ ID NO: 801610 - protein, 9 aa, Homo Sapiens
RLKGYMISG

SEQ ID NO: 801611 - protein, 9 aa, Homo Sapiens
PADSPFHHI

SEQ ID NO: 801612 - protein, 9 aa, Homo Sapiens
SEIGNVVKD

SEQ ID NO: 801613 - protein, 9 aa, Homo Sapiens
SFWAELNIA

SEQ ID NO: 801614 - protein, 9 aa, Homo Sapiens
SGENGKRMK

SEQ ID NO: 801615 - protein, 9 aa, Homo Sapiens
MLDPKTFQT

SEQ ID NO: 801616 - protein, 9 aa, Homo Sapiens
KGGWVVIFQ

SEQ ID NO: 801617 - protein, 9 aa, Homo Sapiens
PRWRQKLEW

SEQ ID NO: 801618 - protein, 9 aa, Homo Sapiens
LPRLKGYMI

SEQ ID NO: 801619 - protein, 9 aa, Homo Sapiens
LRESLGEGL

SEQ ID NO: 801620 - protein, 9 aa, Homo Sapiens
GDVGKSALT

SEQ ID NO: 801621 - protein, 9 aa, Homo Sapiens
VPHLRARVL

SEQ ID NO: 801622 - protein, 9 aa, Homo Sapiens
EESAKEITE

SEQ ID NO: 801623 - protein, 9 aa, Homo Sapiens
EEWRRQLRE

SEQ ID NO: 801624 - protein, 9 aa, Homo Sapiens
GAGDVGKSA

SEQ ID NO: 801625 - protein, 9 aa, Homo Sapiens
NGGENKDEY

SEQ ID NO: 801626 - protein, 9 aa, Homo Sapiens
SIRKSTLGP

SEQ ID NO: 801627 - protein, 9 aa, Homo Sapiens
AASPTQQLP

SEQ ID NO: 801628 - protein, 9 aa, Homo Sapiens
EENRQKAVA

SEQ ID NO: 801629 - protein, 9 aa, Homo Sapiens
DSPLSSHLL

SEQ ID NO: 801630 - protein, 9 aa, Homo Sapiens
PWSLEEEKY

SEQ ID NO: 801631 - protein, 9 aa, Homo Sapiens
SVINQERKK

SEQ ID NO: 801632 - protein, 9 aa, Homo Sapiens
LPTLPETQA

SEQ ID NO: 801633 - protein, 9 aa, Homo Sapiens
NQRNITRMG

SEQ ID NO: 801634 - protein, 9 aa, Homo Sapiens
AFPEESPLL

SEQ ID NO: 801635 - protein, 9 aa, Homo Sapiens
LLPRLKGYM

SEQ ID NO: 801636 - protein, 9 aa, Homo Sapiens
SVNEKKSRE

SEQ ID NO: 801637 - protein, 9 aa, Homo Sapiens
PRLKGYMIS

SEQ ID NO: 801638 - protein, 9 aa, Homo Sapiens
IIEIERILS

SEQ ID NO: 801639 - protein, 9 aa, Homo Sapiens
QEIAMEFNY

SEQ ID NO: 801640 - protein, 9 aa, Homo Sapiens
LFAIFAFRS

SEQ ID NO: 801641 - protein, 9 aa, Homo Sapiens
LAEREIDML

SEQ ID NO: 801642 - protein, 9 aa, Homo Sapiens
FGEDCSYEI

SEQ ID NO: 801643 - protein, 9 aa, Homo Sapiens
MENEGHQNV

SEQ ID NO: 801644 - protein, 9 aa, Homo Sapiens
SDAKENCYR

SEQ ID NO: 801645 - protein, 9 aa, Homo Sapiens
PPSCTSTNG

SEQ ID NO: 801646 - protein, 9 aa, Homo Sapiens
AHTNNYKII

SEQ ID NO: 801647 - protein, 9 aa, Homo Sapiens
NIGCSMPSL

SEQ ID NO: 801648 - protein, 9 aa, Homo Sapiens
ITGKKSNNL

SEQ ID NO: 801649 - protein, 9 aa, Homo Sapiens
DAQDGTHAE

SEQ ID NO: 801650 - protein, 9 aa, Homo Sapiens
QTESPPVFT

SEQ ID NO: 801651 - protein, 9 aa, Homo Sapiens
ILLRWLPPV

SEQ ID NO: 801652 - protein, 9 aa, Homo Sapiens
KFSGAFETT

SEQ ID NO: 801653 - protein, 9 aa, Homo Sapiens
PPRPTSAVR

SEQ ID NO: 801654 - protein, 9 aa, Homo Sapiens
SNMATLPTL

SEQ ID NO: 801655 - protein, 9 aa, Homo Sapiens
YDNYRQAYG

SEQ ID NO: 801656 - protein, 9 aa, Homo Sapiens
RQAYGECTD

SEQ ID NO: 801657 - protein, 9 aa, Homo Sapiens
ARNPTPTCS

SEQ ID NO: 801658 - protein, 9 aa, Homo Sapiens
SLTPDLLPN

SEQ ID NO: 801659 - protein, 9 aa, Homo Sapiens
YKIIKLLVQ

SEQ ID NO: 801660 - protein, 9 aa, Homo Sapiens
PLINGGENK

SEQ ID NO: 801661 - protein, 9 aa, Homo Sapiens
VALTGLSCL

SEQ ID NO: 801662 - protein, 9 aa, Homo Sapiens
RKCSQVWKP

SEQ ID NO: 801663 - protein, 9 aa, Homo Sapiens
PRRPVTPGG

SEQ ID NO: 801664 - protein, 9 aa, Homo Sapiens
GKRMKEKYG

SEQ ID NO: 801665 - protein, 9 aa, Homo Sapiens
RKRLHQLIT

SEQ ID NO: 801666 - protein, 9 aa, Homo Sapiens
VGRVGTVAR

SEQ ID NO: 801667 - protein, 9 aa, Homo Sapiens
MSNPWSLEE

SEQ ID NO: 801668 - protein, 9 aa, Homo Sapiens
INGGENKDE

SEQ ID NO: 801669 - protein, 9 aa, Homo Sapiens
NEKKSRERE

SEQ ID NO: 801670 - protein, 9 aa, Homo Sapiens
FLRNLIYSY

SEQ ID NO: 801671 - protein, 9 aa, Homo Sapiens
RLWRGRQTP

SEQ ID NO: 801672 - protein, 9 aa, Homo Sapiens
RAPIPRRPV

SEQ ID NO: 801673 - protein, 9 aa, Homo Sapiens
DKSPQNCCA

SEQ ID NO: 801674 - protein, 9 aa, Homo Sapiens
GCQGWWSML

SEQ ID NO: 801675 - protein, 9 aa, Homo Sapiens
EARVRDGIS

SEQ ID NO: 801676 - protein, 9 aa, Homo Sapiens
SFISINSNT

SEQ ID NO: 801677 - protein, 9 aa, Homo Sapiens
CVVLREQAL

SEQ ID NO: 801678 - protein, 9 aa, Homo Sapiens
KAVARRAEK

SEQ ID NO: 801679 - protein, 9 aa, Homo Sapiens
VNEKKSRER

SEQ ID NO: 801680 - protein, 9 aa, Homo Sapiens
WSTVDEKEQ

SEQ ID NO: 801681 - protein, 9 aa, Homo Sapiens
AQVPHLRAR

SEQ ID NO: 801682 - protein, 9 aa, Homo Sapiens
PGQEFPPRP

SEQ ID NO: 801683 - protein, 9 aa, Homo Sapiens
GTILLRWLP

SEQ ID NO: 801684 - protein, 9 aa, Homo Sapiens
QRRWQKHRR

SEQ ID NO: 801685 - protein, 9 aa, Homo Sapiens
DADNQRNIT

SEQ ID NO: 801686 - protein, 9 aa, Homo Sapiens
GRVGTVARR

SEQ ID NO: 801687 - protein, 9 aa, Homo Sapiens
KEVLKRIIE

SEQ ID NO: 801688 - protein, 9 aa, Homo Sapiens
NCYRVANWL

SEQ ID NO: 801689 - protein, 9 aa, Homo Sapiens
EARLWRGRQ

SEQ ID NO: 801690 - protein, 9 aa, Homo Sapiens
RGLARNPTP

SEQ ID NO: 801691 - protein, 9 aa, Homo Sapiens
RNITRMGSQ

SEQ ID NO: 801692 - protein, 9 aa, Homo Sapiens
SSFISINSN

SEQ ID NO: 801693 - protein, 9 aa, Homo Sapiens
IPSNYITGK

SEQ ID NO: 801694 - protein, 9 aa, Homo Sapiens
PESEAEAQV

SEQ ID NO: 801695 - protein, 9 aa, Homo Sapiens
IHIQEMYTP

SEQ ID NO: 801696 - protein, 9 aa, Homo Sapiens
HRRIPQKSA

SEQ ID NO: 801697 - protein, 9 aa, Homo Sapiens
HVYFFFQEI

SEQ ID NO: 801698 - protein, 9 aa, Homo Sapiens
YAKMKMATN

SEQ ID NO: 801699 - protein, 9 aa, Homo Sapiens
EMYTPGEML

SEQ ID NO: 801700 - protein, 9 aa, Homo Sapiens
LARNPTPTC

SEQ ID NO: 801701 - protein, 9 aa, Homo Sapiens
KRIWSTVDE

SEQ ID NO: 801702 - protein, 9 aa, Homo Sapiens
ISILTTAAS

SEQ ID NO: 801703 - protein, 9 aa, Homo Sapiens
RNPTPTCSG

SEQ ID NO: 801704 - protein, 9 aa, Homo Sapiens
VLPGGAEES

SEQ ID NO: 801705 - protein, 9 aa, Homo Sapiens
EQSWLIAAS

SEQ ID NO: 801706 - protein, 9 aa, Homo Sapiens
KPKPKKPTI

SEQ ID NO: 801707 - protein, 9 aa, Homo Sapiens
TGDKGGWVV

SEQ ID NO: 801708 - protein, 9 aa, Homo Sapiens
WRSWEETPA

SEQ ID NO: 801709 - protein, 9 aa, Homo Sapiens
SVKGFISEA

SEQ ID NO: 801710 - protein, 9 aa, Homo Sapiens
SHVYFFFQE

SEQ ID NO: 801711 - protein, 9 aa, Homo Sapiens
FSDAKENCY

SEQ ID NO: 801712 - protein, 9 aa, Homo Sapiens
DKGGWVVIF

SEQ ID NO: 801713 - protein, 9 aa, Homo Sapiens
YSYLCSKIL

SEQ ID NO: 801714 - protein, 9 aa, Homo Sapiens
IGNVVKDKL

SEQ ID NO: 801715 - protein, 9 aa, Homo Sapiens
VKEIGSTMY

SEQ ID NO: 801716 - protein, 9 aa, Homo Sapiens
GNVVKDKLK

SEQ ID NO: 801717 - protein, 9 aa, Homo Sapiens
VEGSRQLID

SEQ ID NO: 801718 - protein, 9 aa, Homo Sapiens
TILLRWLPP

SEQ ID NO: 801719 - protein, 9 aa, Homo Sapiens
AKMKMATNI

SEQ ID NO: 801720 - protein, 9 aa, Homo Sapiens
KDSLTPDLL

SEQ ID NO: 801721 - protein, 9 aa, Homo Sapiens
LEWRSWEET

SEQ ID NO: 801722 - protein, 9 aa, Homo Sapiens
GLCIWLLIL

SEQ ID NO: 801723 - protein, 9 aa, Homo Sapiens
RAIKKRNGM

SEQ ID NO: 801724 - protein, 9 aa, Homo Sapiens
WRQKLEWRS

SEQ ID NO: 801725 - protein, 9 aa, Homo Sapiens
SAGTILLRW

SEQ ID NO: 801726 - protein, 9 aa, Homo Sapiens
EFPPRPTSA

SEQ ID NO: 801727 - protein, 9 aa, Homo Sapiens
PFRKRLHQL

SEQ ID NO: 801728 - protein, 9 aa, Homo Sapiens
SMLNPYLLE

SEQ ID NO: 801729 - protein, 9 aa, Homo Sapiens
QGWWSMLNP

SEQ ID NO: 801730 - protein, 9 aa, Homo Sapiens
GDADKEKIS

SEQ ID NO: 801731 - protein, 9 aa, Homo Sapiens
NRQKAVARR

SEQ ID NO: 801732 - protein, 9 aa, Homo Sapiens
SREREERQN

SEQ ID NO: 801733 - protein, 9 aa, Homo Sapiens
SSPSMSGCF

SEQ ID NO: 801734 - protein, 9 aa, Homo Sapiens
HLLDDGFGM

SEQ ID NO: 801735 - protein, 9 aa, Homo Sapiens
PAFPEESPL

SEQ ID NO: 801736 - protein, 9 aa, Homo Sapiens
DIMHLGHCT

SEQ ID NO: 801737 - protein, 9 aa, Homo Sapiens
TNGPSVINQ

SEQ ID NO: 801738 - protein, 9 aa, Homo Sapiens
VDYKKKIPE

SEQ ID NO: 801739 - protein, 9 aa, Homo Sapiens
CSKILIQYL

SEQ ID NO: 801740 - protein, 9 aa, Homo Sapiens
PKPRERQTE

SEQ ID NO: 801741 - protein, 9 aa, Homo Sapiens
RLHQLITPD

SEQ ID NO: 801742 - protein, 9 aa, Homo Sapiens
SSHLLDDGF

SEQ ID NO: 801743 - protein, 9 aa, Homo Sapiens
CHPLVPKEI

SEQ ID NO: 801744 - protein, 9 aa, Homo Sapiens
TLCQQPPVS

SEQ ID NO: 801745 - protein, 9 aa, Homo Sapiens
LSCLVTPDL

SEQ ID NO: 801746 - protein, 9 aa, Homo Sapiens
PSSAASPTQ

SEQ ID NO: 801747 - protein, 9 aa, Homo Sapiens
AQRRWQKHR

SEQ ID NO: 801748 - protein, 9 aa, Homo Sapiens
KGYMISGSS

SEQ ID NO: 801749 - protein, 9 aa, Homo Sapiens
QKHKQHHIL

SEQ ID NO: 801750 - protein, 9 aa, Homo Sapiens
LWRGRQTPG

SEQ ID NO: 801751 - protein, 9 aa, Homo Sapiens
PSEIGNVVK

SEQ ID NO: 801752 - protein, 9 aa, Homo Sapiens
GNPKPRERQ

SEQ ID NO: 801753 - protein, 9 aa, Homo Sapiens
EIGNVVKDK

SEQ ID NO: 801754 - protein, 9 aa, Homo Sapiens
GSGEEKDGG

SEQ ID NO: 801755 - protein, 9 aa, Homo Sapiens
FILLGDPQT

SEQ ID NO: 801756 - protein, 9 aa, Homo Sapiens
RRWQKHRRI

SEQ ID NO: 801757 - protein, 9 aa, Homo Sapiens
EEEFLHVCR

SEQ ID NO: 801758 - protein, 9 aa, Homo Sapiens
KTPMYFFSP

SEQ ID NO: 801759 - protein, 9 aa, Homo Sapiens
VPGQEFPPR

SEQ ID NO: 801760 - protein, 9 aa, Homo Sapiens
LSSFISINS

SEQ ID NO: 801761 - protein, 9 aa, Homo Sapiens
SALKLLRKC

SEQ ID NO: 801762 - protein, 9 aa, Homo Sapiens
PFHHIFMGR

SEQ ID NO: 801763 - protein, 9 aa, Homo Sapiens
FSGAFETTL

SEQ ID NO: 801764 - protein, 9 aa, Homo Sapiens
SSAASPTQQ

SEQ ID NO: 801765 - protein, 9 aa, Homo Sapiens
RPENKTVLH

SEQ ID NO: 801766 - protein, 9 aa, Homo Sapiens
KKKCVVLRE

SEQ ID NO: 801767 - protein, 9 aa, Homo Sapiens
SRNYDNYRQ

SEQ ID NO: 801768 - protein, 9 aa, Homo Sapiens
EWRSWEETP

SEQ ID NO: 801769 - protein, 9 aa, Homo Sapiens
NLIYSYLCS

SEQ ID NO: 801770 - protein, 9 aa, Homo Sapiens
EVKTLCQQP

SEQ ID NO: 801771 - protein, 9 aa, Homo Sapiens
PRERQTESP

SEQ ID NO: 801772 - protein, 9 aa, Homo Sapiens
ARVLPGGAE

SEQ ID NO: 801773 - protein, 9 aa, Homo Sapiens
DSLTPDLLP

SEQ ID NO: 801774 - protein, 9 aa, Homo Sapiens
SFDPYSDNP

SEQ ID NO: 801775 - protein, 9 aa, Homo Sapiens
VKTLCQQPP

SEQ ID NO: 801776 - protein, 9 aa, Homo Sapiens
PKTFQTATS

SEQ ID NO: 801777 - protein, 9 aa, Homo Sapiens
FHHIFMGRG

SEQ ID NO: 801778 - protein, 9 aa, Homo Sapiens
PWSSVKGFI

SEQ ID NO: 801779 - protein, 9 aa, Homo Sapiens
NAKRMSMLV

SEQ ID NO: 801780 - protein, 9 aa, Homo Sapiens
NPQKHKQHH

SEQ ID NO: 801781 - protein, 9 aa, Homo Sapiens
AGDVGKSAL

SEQ ID NO: 801782 - protein, 9 aa, Homo Sapiens
AAHTNNYKI

SEQ ID NO: 801783 - protein, 9 aa, Homo Sapiens
FRKRLHQLI

SEQ ID NO: 801784 - protein, 9 aa, Homo Sapiens
DLPLALSTF

SEQ ID NO: 801785 - protein, 9 aa, Homo Sapiens
WRRQLRESL

SEQ ID NO: 801786 - protein, 9 aa, Homo Sapiens
RQKLEWRSW

SEQ ID NO: 801787 - protein, 9 aa, Homo Sapiens
PVRQRPEPQ

SEQ ID NO: 801788 - protein, 9 aa, Homo Sapiens
LTPDLLPNI

SEQ ID NO: 801789 - protein, 9 aa, Homo Sapiens
QQFSGENGK

SEQ ID NO: 801790 - protein, 9 aa, Homo Sapiens
NGKRMKEKY

SEQ ID NO: 801791 - protein, 9 aa, Homo Sapiens
ALSTFGSIG

SEQ ID NO: 801792 - protein, 9 aa, Homo Sapiens
EFLHVCRLK

SEQ ID NO: 801793 - protein, 9 aa, Homo Sapiens
EEVKTLCQQ

SEQ ID NO: 801794 - protein, 9 aa, Homo Sapiens
KENCYRVAN

SEQ ID NO: 801795 - protein, 9 aa, Homo Sapiens
CVANTSTQT

SEQ ID NO: 801796 - protein, 9 aa, Homo Sapiens
AEAQVPHLR

SEQ ID NO: 801797 - protein, 9 aa, Homo Sapiens
ERQLDAQDG

SEQ ID NO: 801798 - protein, 9 aa, Homo Sapiens
YAQRRWQKH

SEQ ID NO: 801799 - protein, 9 aa, Homo Sapiens
LFNPQKHKQ

SEQ ID NO: 801800 - protein, 9 aa, Homo Sapiens
KISNTYSQV

SEQ ID NO: 801801 - protein, 9 aa, Homo Sapiens
MSGCFGEDC

SEQ ID NO: 801802 - protein, 9 aa, Homo Sapiens
HHIFMGRGD

SEQ ID NO: 801803 - protein, 9 aa, Homo Sapiens
DEEAPTMCS

SEQ ID NO: 801804 - protein, 9 aa, Homo Sapiens
LIYSYLCSK

SEQ ID NO: 801805 - protein, 9 aa, Homo Sapiens
DSPFHHIFM

SEQ ID NO: 801806 - protein, 9 aa, Homo Sapiens
PLALSTFGS

SEQ ID NO: 801807 - protein, 9 aa, Homo Sapiens
AAERAIKKR

SEQ ID NO: 801808 - protein, 9 aa, Homo Sapiens
TDSDSLPSS

SEQ ID NO: 801809 - protein, 9 aa, Homo Sapiens
ITRMGSQPP

SEQ ID NO: 801810 - protein, 9 aa, Homo Sapiens
EQRLALRCR

SEQ ID NO: 801811 - protein, 9 aa, Homo Sapiens
GSRQLIDEH

SEQ ID NO: 801812 - protein, 9 aa, Homo Sapiens
EEKDGSGEE

SEQ ID NO: 801813 - protein, 9 aa, Homo Sapiens
IPESEAEAQ

SEQ ID NO: 801814 - protein, 9 aa, Homo Sapiens
ITEGVPGQE

SEQ ID NO: 801815 - protein, 9 aa, Homo Sapiens
SPKFIFLRN

SEQ ID NO: 801816 - protein, 9 aa, Homo Sapiens
ERQTESPPV

SEQ ID NO: 801817 - protein, 9 aa, Homo Sapiens
TQCVANTST

SEQ ID NO: 801818 - protein, 9 aa, Homo Sapiens
NYDNYRQAY

SEQ ID NO: 801819 - protein, 9 aa, Homo Sapiens
VTSFPWSSV

SEQ ID NO: 801820 - protein, 9 aa, Homo Sapiens
FAFRSCGSY

SEQ ID NO: 801821 - protein, 9 aa, Homo Sapiens
NGLCIWLLI

SEQ ID NO: 801822 - protein, 9 aa, Homo Sapiens
VKEVLKRII

SEQ ID NO: 801823 - protein, 9 aa, Homo Sapiens
AQDGTHAEG

SEQ ID NO: 801824 - protein, 9 aa, Homo Sapiens
CSQVWKPKV

SEQ ID NO: 801825 - protein, 9 aa, Homo Sapiens
RWQKHRRIP

SEQ ID NO: 801826 - protein, 9 aa, Homo Sapiens
VARRDAASQ

SEQ ID NO: 801827 - protein, 9 aa, Homo Sapiens
EPTDSDSLP

SEQ ID NO: 801828 - protein, 9 aa, Homo Sapiens
INQERKKKT

SEQ ID NO: 801829 - protein, 9 aa, Homo Sapiens
SGRKRPVRQ

SEQ ID NO: 801830 - protein, 9 aa, Homo Sapiens
CYRVANWLV

SEQ ID NO: 801831 - protein, 9 aa, Homo Sapiens
KRMKEKYGV

SEQ ID NO: 801832 - protein, 9 aa, Homo Sapiens
PILERQLDA

SEQ ID NO: 801833 - protein, 9 aa, Homo Sapiens
PRGTVGENI

SEQ ID NO: 801834 - protein, 9 aa, Homo Sapiens
EKDLEEQSW

SEQ ID NO: 801835 - protein, 9 aa, Homo Sapiens
GEEKDGSGE

SEQ ID NO: 801836 - protein, 9 aa, Homo Sapiens
YSDNPRLGI

SEQ ID NO: 801837 - protein, 9 aa, Homo Sapiens
RPVRQRPEP

SEQ ID NO: 801838 - protein, 9 aa, Homo Sapiens
RKSTLGPDH

SEQ ID NO: 801839 - protein, 9 aa, Homo Sapiens
VALRCHPLV

SEQ ID NO: 801840 - protein, 9 aa, Homo Sapiens
ESEAEAQVP

SEQ ID NO: 801841 - protein, 9 aa, Homo Sapiens
GGAEESAKE

SEQ ID NO: 801842 - protein, 9 aa, Homo Sapiens
FSGENGKRM

SEQ ID NO: 801843 - protein, 9 aa, Homo Sapiens
IWSTVDEKE

SEQ ID NO: 801844 - protein, 9 aa, Homo Sapiens
SPQNCCAAW

SEQ ID NO: 801845 - protein, 9 aa, Homo Sapiens
LSRRPENKT

SEQ ID NO: 801846 - protein, 9 aa, Homo Sapiens
FPAQPLVVP

SEQ ID NO: 801847 - protein, 9 aa, Homo Sapiens
CQQPPVSTG

SEQ ID NO: 801848 - protein, 9 aa, Homo Sapiens
GWERGLARN

SEQ ID NO: 801849 - protein, 9 aa, Homo Sapiens
GNASAGTIL

SEQ ID NO: 801850 - protein, 9 aa, Homo Sapiens
VGAGDVGKS

SEQ ID NO: 801851 - protein, 9 aa, Homo Sapiens
MKMATNIYL

SEQ ID NO: 801852 - protein, 9 aa, Homo Sapiens
GYMISGSSY

SEQ ID NO: 801853 - protein, 9 aa, Homo Sapiens
IFLRNLIYS

SEQ ID NO: 801854 - protein, 9 aa, Homo Sapiens
LTALDGGSL

SEQ ID NO: 801855 - protein, 9 aa, Homo Sapiens
SLPRSGTAQ

SEQ ID NO: 801856 - protein, 9 aa, Homo Sapiens
RGPFRKRLH

SEQ ID NO: 801857 - protein, 9 aa, Homo Sapiens
LCIWLLILS

SEQ ID NO: 801858 - protein, 9 aa, Homo Sapiens
KKKIPESEA

SEQ ID NO: 801859 - protein, 9 aa, Homo Sapiens
YRQAYGECT

SEQ ID NO: 801860 - protein, 9 aa, Homo Sapiens
KEPSEIGNV

SEQ ID NO: 801861 - protein, 9 aa, Homo Sapiens
QEMYTPGEM

SEQ ID NO: 801862 - protein, 9 aa, Homo Sapiens
QKHRRIPQK

SEQ ID NO: 801863 - protein, 9 aa, Homo Sapiens
PRPTSAVRE

SEQ ID NO: 801864 - protein, 9 aa, Homo Sapiens
EQIDIMHLG

SEQ ID NO: 801865 - protein, 9 aa, Homo Sapiens
TTALSLPAF

SEQ ID NO: 801866 - protein, 9 aa, Homo Sapiens
ECKSNAKRM

SEQ ID NO: 801867 - protein, 9 aa, Homo Sapiens
RCHPLVPKE

SEQ ID NO: 801868 - protein, 9 aa, Homo Sapiens
DSLPSSSAD

SEQ ID NO: 801869 - protein, 9 aa, Homo Sapiens
RRQSLWYAT

SEQ ID NO: 801870 - protein, 9 aa, Homo Sapiens
SLPSSSADA

SEQ ID NO: 801871 - protein, 9 aa, Homo Sapiens
GWWSMLNPY

SEQ ID NO: 801872 - protein, 9 aa, Homo Sapiens
YRDKSPQNC

SEQ ID NO: 801873 - protein, 9 aa, Homo Sapiens
RVALRCHPL

SEQ ID NO: 801874 - protein, 9 aa, Homo Sapiens
PGGAEESAK

SEQ ID NO: 801875 - protein, 9 aa, Homo Sapiens
EPSEIGNVV

SEQ ID NO: 801876 - protein, 9 aa, Homo Sapiens
YFFFQEIAM

SEQ ID NO: 801877 - protein, 9 aa, Homo Sapiens
RQSLWYATH

SEQ ID NO: 801878 - protein, 9 aa, Homo Sapiens
LATGDKGGW

SEQ ID NO: 801879 - protein, 9 aa, Homo Sapiens
IQEMYTPGE

SEQ ID NO: 801880 - protein, 9 aa, Homo Sapiens
MKKFSGAFE

SEQ ID NO: 801881 - protein, 9 aa, Homo Sapiens
QFSGENGKR

SEQ ID NO: 801882 - protein, 9 aa, Homo Sapiens
SMSGCFGED

SEQ ID NO: 801883 - protein, 9 aa, Homo Sapiens
GYIPSNYIT

SEQ ID NO: 801884 - protein, 9 aa, Homo Sapiens
ATLPTLPET

SEQ ID NO: 801885 - protein, 9 aa, Homo Sapiens
ILRYAKMKM

SEQ ID NO: 801886 - protein, 9 aa, Homo Sapiens
PTDSDSLPS

SEQ ID NO: 801887 - protein, 9 aa, Homo Sapiens
GRKRPVRQR

SEQ ID NO: 801888 - protein, 9 aa, Homo Sapiens
FFSPKFIFL

SEQ ID NO: 801889 - protein, 9 aa, Homo Sapiens
NASAGTILL

SEQ ID NO: 801890 - protein, 9 aa, Homo Sapiens
LNDALSIRK

SEQ ID NO: 801891 - protein, 9 aa, Homo Sapiens
QIDIMHLGH

SEQ ID NO: 801892 - protein, 9 aa, Homo Sapiens
IMTNGLCIW

SEQ ID NO: 801893 - protein, 9 aa, Homo Sapiens
GPFRKRLHQ

SEQ ID NO: 801894 - protein, 9 aa, Homo Sapiens
QEEVKTLCQ

SEQ ID NO: 801895 - protein, 9 aa, Homo Sapiens
ENRQKAVAR

SEQ ID NO: 801896 - protein, 9 aa, Homo Sapiens
WSNMATLPT

SEQ ID NO: 801897 - protein, 9 aa, Homo Sapiens
HPIQQVSWR

SEQ ID NO: 801898 - protein, 9 aa, Homo Sapiens
KQIFLDIQF

SEQ ID NO: 801899 - protein, 9 aa, Homo Sapiens
VIIHRGDHV

SEQ ID NO: 801900 - protein, 9 aa, Homo Sapiens
LPDHFSENT

SEQ ID NO: 801901 - protein, 9 aa, Homo Sapiens
LSNEEKEID

SEQ ID NO: 801902 - protein, 9 aa, Homo Sapiens
PVMPRDFPF

SEQ ID NO: 801903 - protein, 9 aa, Homo Sapiens
HRAPLGGTP

SEQ ID NO: 801904 - protein, 9 aa, Homo Sapiens
NTVWTKYEL

SEQ ID NO: 801905 - protein, 9 aa, Homo Sapiens
ADQVEARRS

SEQ ID NO: 801906 - protein, 9 aa, Homo Sapiens
SVSRASNLH

SEQ ID NO: 801907 - protein, 9 aa, Homo Sapiens
LGSLVSSSA

SEQ ID NO: 801908 - protein, 9 aa, Homo Sapiens
CHIRPQRTI

SEQ ID NO: 801909 - protein, 9 aa, Homo Sapiens
LVCGRVERT

SEQ ID NO: 801910 - protein, 9 aa, Homo Sapiens
VISNICHIR

SEQ ID NO: 801911 - protein, 9 aa, Homo Sapiens
SLTVLTCII

SEQ ID NO: 801912 - protein, 9 aa, Homo Sapiens
CGRVERTGG

SEQ ID NO: 801913 - protein, 9 aa, Homo Sapiens
LGAPPRLGH

SEQ ID NO: 801914 - protein, 9 aa, Homo Sapiens
NLMRENVEM

SEQ ID NO: 801915 - protein, 9 aa, Homo Sapiens
PVVARNPFV

SEQ ID NO: 801916 - protein, 9 aa, Homo Sapiens
WSKEKTCDH

SEQ ID NO: 801917 - protein, 9 aa, Homo Sapiens
ICRLRYSNP

SEQ ID NO: 801918 - protein, 9 aa, Homo Sapiens
VGTTALHLV

SEQ ID NO: 801919 - protein, 9 aa, Homo Sapiens
PSQPRSTHP

SEQ ID NO: 801920 - protein, 9 aa, Homo Sapiens
VRVVPTCVA

SEQ ID NO: 801921 - protein, 9 aa, Homo Sapiens
ARGPQPSTC

SEQ ID NO: 801922 - protein, 9 aa, Homo Sapiens
HFSENTADF

SEQ ID NO: 801923 - protein, 9 aa, Homo Sapiens
APSTGNNPS

SEQ ID NO: 801924 - protein, 9 aa, Homo Sapiens
PTAPSTGNN

SEQ ID NO: 801925 - protein, 9 aa, Homo Sapiens
LEPLDSNMS

SEQ ID NO: 801926 - protein, 9 aa, Homo Sapiens
RECVGYINS

SEQ ID NO: 801927 - protein, 9 aa, Homo Sapiens
LNAQPQECL

SEQ ID NO: 801928 - protein, 9 aa, Homo Sapiens
PLDSNMSLS

SEQ ID NO: 801929 - protein, 9 aa, Homo Sapiens
QSSGPVPEM

SEQ ID NO: 801930 - protein, 9 aa, Homo Sapiens
IAYDDDDKV

SEQ ID NO: 801931 - protein, 9 aa, Homo Sapiens
EFSPEAWKC

SEQ ID NO: 801932 - protein, 9 aa, Homo Sapiens
AKYKRIHTG

SEQ ID NO: 801933 - protein, 9 aa, Homo Sapiens
LVVLPDSPP

SEQ ID NO: 801934 - protein, 9 aa, Homo Sapiens
KALYPVMPR

SEQ ID NO: 801935 - protein, 9 aa, Homo Sapiens
KLLGAPPRL

SEQ ID NO: 801936 - protein, 9 aa, Homo Sapiens
RHPIQQVSW

SEQ ID NO: 801937 - protein, 9 aa, Homo Sapiens
VGACGVGKS

SEQ ID NO: 801938 - protein, 9 aa, Homo Sapiens
TTKNTTTAK

SEQ ID NO: 801939 - protein, 9 aa, Homo Sapiens
ERINGSHFK

SEQ ID NO: 801940 - protein, 9 aa, Homo Sapiens
PGSLYRVVV

SEQ ID NO: 801941 - protein, 9 aa, Homo Sapiens
LGSLPSRRP

SEQ ID NO: 801942 - protein, 9 aa, Homo Sapiens
VTKDLVQEG

SEQ ID NO: 801943 - protein, 9 aa, Homo Sapiens
FSRLLDNIA

SEQ ID NO: 801944 - protein, 9 aa, Homo Sapiens
TPSQPRSTH

SEQ ID NO: 801945 - protein, 9 aa, Homo Sapiens
VECVPITRS

SEQ ID NO: 801946 - protein, 9 aa, Homo Sapiens
TRAVLVEKR

SEQ ID NO: 801947 - protein, 9 aa, Homo Sapiens
DEDPDTKKI

SEQ ID NO: 801948 - protein, 9 aa, Homo Sapiens
TAFVISNIC

SEQ ID NO: 801949 - protein, 9 aa, Homo Sapiens
YKPEGCNNA

SEQ ID NO: 801950 - protein, 9 aa, Homo Sapiens
LWVDSTHPP

SEQ ID NO: 801951 - protein, 9 aa, Homo Sapiens
EMVRSYFPE

SEQ ID NO: 801952 - protein, 9 aa, Homo Sapiens
VVRSTKTFL

SEQ ID NO: 801953 - protein, 9 aa, Homo Sapiens
DSESSETTK

SEQ ID NO: 801954 - protein, 9 aa, Homo Sapiens
TYHIAFRPV

SEQ ID NO: 801955 - protein, 9 aa, Homo Sapiens
GEEKQIFLD

SEQ ID NO: 801956 - protein, 9 aa, Homo Sapiens
GLTWKNIIK

SEQ ID NO: 801957 - protein, 9 aa, Homo Sapiens
PDHFSENTA

SEQ ID NO: 801958 - protein, 9 aa, Homo Sapiens
ICHIRPQRT

SEQ ID NO: 801959 - protein, 9 aa, Homo Sapiens
GAPPRLGHK

SEQ ID NO: 801960 - protein, 9 aa, Homo Sapiens
RGPQPSTCE

SEQ ID NO: 801961 - protein, 9 aa, Homo Sapiens
VVNGDTCII

SEQ ID NO: 801962 - protein, 9 aa, Homo Sapiens
YDDDDKVYT

SEQ ID NO: 801963 - protein, 9 aa, Homo Sapiens
LVIIHRGDH

SEQ ID NO: 801964 - protein, 9 aa, Homo Sapiens
KNLMRENVE

SEQ ID NO: 801965 - protein, 9 aa, Homo Sapiens
GGQPLHVRV

SEQ ID NO: 801966 - protein, 9 aa, Homo Sapiens
SKTLETASY

SEQ ID NO: 801967 - protein, 9 aa, Homo Sapiens
QVSWRLLSR

SEQ ID NO: 801968 - protein, 9 aa, Homo Sapiens
LGHGEGTTT

SEQ ID NO: 801969 - protein, 9 aa, Homo Sapiens
SSGPVPEMV

SEQ ID NO: 801970 - protein, 9 aa, Homo Sapiens
SLITTIMLV

SEQ ID NO: 801971 - protein, 9 aa, Homo Sapiens
LVLGVQPSL

SEQ ID NO: 801972 - protein, 9 aa, Homo Sapiens
TALHLVEEA

SEQ ID NO: 801973 - protein, 9 aa, Homo Sapiens
MEEKIKNLM

SEQ ID NO: 801974 - protein, 9 aa, Homo Sapiens
ILLVLGVQP

SEQ ID NO: 801975 - protein, 9 aa, Homo Sapiens
SLPSRRPTA

SEQ ID NO: 801976 - protein, 9 aa, Homo Sapiens
PEMVRSYFP

SEQ ID NO: 801977 - protein, 9 aa, Homo Sapiens
ETASYVKSV

SEQ ID NO: 801978 - protein, 9 aa, Homo Sapiens
PSTGNNPST

SEQ ID NO: 801979 - protein, 9 aa, Homo Sapiens
GCNNACDNI

SEQ ID NO: 801980 - protein, 9 aa, Homo Sapiens
GKKPYACGQ

SEQ ID NO: 801981 - protein, 9 aa, Homo Sapiens
TGNNPSTHS

SEQ ID NO: 801982 - protein, 9 aa, Homo Sapiens
MELGHGEGT

SEQ ID NO: 801983 - protein, 9 aa, Homo Sapiens
AVKKKACML

SEQ ID NO: 801984 - protein, 9 aa, Homo Sapiens
FLGNFFFLE

SEQ ID NO: 801985 - protein, 9 aa, Homo Sapiens
GRVERTGGY

SEQ ID NO: 801986 - protein, 9 aa, Homo Sapiens
TTVECVPIT

SEQ ID NO: 801987 - protein, 9 aa, Homo Sapiens
QPLHVRVVP

SEQ ID NO: 801988 - protein, 9 aa, Homo Sapiens
DLVQEGYLE

SEQ ID NO: 801989 - protein, 9 aa, Homo Sapiens
KACMLAQFL

SEQ ID NO: 801990 - protein, 9 aa, Homo Sapiens
DYRVMGDTV

SEQ ID NO: 801991 - protein, 9 aa, Homo Sapiens
INIQQGRDH

SEQ ID NO: 801992 - protein, 9 aa, Homo Sapiens
VRSTKTFLL

SEQ ID NO: 801993 - protein, 9 aa, Homo Sapiens
LANSHGVSP

SEQ ID NO: 801994 - protein, 9 aa, Homo Sapiens
NFFFLEIWY

SEQ ID NO: 801995 - protein, 9 aa, Homo Sapiens
TCEAQAGAR

SEQ ID NO: 801996 - protein, 9 aa, Homo Sapiens
KTSLIGIFD

SEQ ID NO: 801997 - protein, 9 aa, Homo Sapiens
RVMGDTVLC

SEQ ID NO: 801998 - protein, 9 aa, Homo Sapiens
YHIAFRPVI

SEQ ID NO: 801999 - protein, 9 aa, Homo Sapiens
SVYWCTEAL

SEQ ID NO: 802000 - protein, 9 aa, Homo Sapiens
AHICRLRYS

SEQ ID NO: 802001 - protein, 9 aa, Homo Sapiens
KIKNLMREN

SEQ ID NO: 802002 - protein, 9 aa, Homo Sapiens
KILEPKRNQ

SEQ ID NO: 802003 - protein, 9 aa, Homo Sapiens
QLWVDSTHP

SEQ ID NO: 802004 - protein, 9 aa, Homo Sapiens
VHSVHGGES

SEQ ID NO: 802005 - protein, 9 aa, Homo Sapiens
MLAQFLQKK

SEQ ID NO: 802006 - protein, 9 aa, Homo Sapiens
CLFVILLMS

SEQ ID NO: 802007 - protein, 9 aa, Homo Sapiens
KTFVFLTLL

SEQ ID NO: 802008 - protein, 9 aa, Homo Sapiens
LVVRSTKTF

SEQ ID NO: 802009 - protein, 9 aa, Homo Sapiens
MGDTVLCYC

SEQ ID NO: 802010 - protein, 9 aa, Homo Sapiens
KLVVVGACG

SEQ ID NO: 802011 - protein, 9 aa, Homo Sapiens
EGTTTFTRA

SEQ ID NO: 802012 - protein, 9 aa, Homo Sapiens
SAKVNKLKT

SEQ ID NO: 802013 - protein, 9 aa, Homo Sapiens
GNFFFLEIW

SEQ ID NO: 802014 - protein, 9 aa, Homo Sapiens
LILLVLGVQ

SEQ ID NO: 802015 - protein, 9 aa, Homo Sapiens
DLGSLVSSS

SEQ ID NO: 802016 - protein, 9 aa, Homo Sapiens
FCWPKWGLA

SEQ ID NO: 802017 - protein, 9 aa, Homo Sapiens
RYSTELAQM

SEQ ID NO: 802018 - protein, 9 aa, Homo Sapiens
TGKKPYACG

SEQ ID NO: 802019 - protein, 9 aa, Homo Sapiens
DAVKKKACM

SEQ ID NO: 802020 - protein, 9 aa, Homo Sapiens
EEKIKNLMR

SEQ ID NO: 802021 - protein, 9 aa, Homo Sapiens
LDLGLTWKN

SEQ ID NO: 802022 - protein, 9 aa, Homo Sapiens
GACGVGKSA

SEQ ID NO: 802023 - protein, 9 aa, Homo Sapiens
EKIKNLMRE

SEQ ID NO: 802024 - protein, 9 aa, Homo Sapiens
STTVECVPI

SEQ ID NO: 802025 - protein, 9 aa, Homo Sapiens
AKVNKLKTF

SEQ ID NO: 802026 - protein, 9 aa, Homo Sapiens
PPPPPRNWP

SEQ ID NO: 802027 - protein, 9 aa, Homo Sapiens
QIFLDIQFL

SEQ ID NO: 802028 - protein, 9 aa, Homo Sapiens
YMFLGNFFF

SEQ ID NO: 802029 - protein, 9 aa, Homo Sapiens
IAFRPVIDG

SEQ ID NO: 802030 - protein, 9 aa, Homo Sapiens
SENTADFVR

SEQ ID NO: 802031 - protein, 9 aa, Homo Sapiens
EISMPQKSF

SEQ ID NO: 802032 - protein, 9 aa, Homo Sapiens
QTPSQPRST

SEQ ID NO: 802033 - protein, 9 aa, Homo Sapiens
DSGYLSKNN

SEQ ID NO: 802034 - protein, 9 aa, Homo Sapiens
SLIGIFDSD

SEQ ID NO: 802035 - protein, 9 aa, Homo Sapiens
NNPSTHSSL

SEQ ID NO: 802036 - protein, 9 aa, Homo Sapiens
HSVHGGESG

SEQ ID NO: 802037 - protein, 9 aa, Homo Sapiens
QEQVLWNPH

SEQ ID NO: 802038 - protein, 9 aa, Homo Sapiens
QWSVSRASN

SEQ ID NO: 802039 - protein, 9 aa, Homo Sapiens
SKEKTCDHL

SEQ ID NO: 802040 - protein, 9 aa, Homo Sapiens
RNVEERING

SEQ ID NO: 802041 - protein, 9 aa, Homo Sapiens
VPPEISMPQ

SEQ ID NO: 802042 - protein, 9 aa, Homo Sapiens
PTLSNEEKE

SEQ ID NO: 802043 - protein, 9 aa, Homo Sapiens
RNQTFVYSH

SEQ ID NO: 802044 - protein, 9 aa, Homo Sapiens
MRENVEMKE

SEQ ID NO: 802045 - protein, 9 aa, Homo Sapiens
RAVLVEKRL

SEQ ID NO: 802046 - protein, 9 aa, Homo Sapiens
AEKALYPVM

SEQ ID NO: 802047 - protein, 9 aa, Homo Sapiens
KTFLLYSAK

SEQ ID NO: 802048 - protein, 9 aa, Homo Sapiens
PTPLGSLPS

SEQ ID NO: 802049 - protein, 9 aa, Homo Sapiens
SDLGSLVSS

SEQ ID NO: 802050 - protein, 9 aa, Homo Sapiens
TVECVPITR

SEQ ID NO: 802051 - protein, 9 aa, Homo Sapiens
APPRLGHKD

SEQ ID NO: 802052 - protein, 9 aa, Homo Sapiens
DSEKTKMVL

SEQ ID NO: 802053 - protein, 9 aa, Homo Sapiens
RLLDNIAEF

SEQ ID NO: 802054 - protein, 9 aa, Homo Sapiens
LVQEGYLEY

SEQ ID NO: 802055 - protein, 9 aa, Homo Sapiens
IAEFFRPTE

SEQ ID NO: 802056 - protein, 9 aa, Homo Sapiens
STKTFLLYS

SEQ ID NO: 802057 - protein, 9 aa, Homo Sapiens
NNLILVLSQ

SEQ ID NO: 802058 - protein, 9 aa, Homo Sapiens
LVRSPQLHR

SEQ ID NO: 802059 - protein, 9 aa, Homo Sapiens
FVISNICHI

SEQ ID NO: 802060 - protein, 9 aa, Homo Sapiens
QQGRDHGIP

SEQ ID NO: 802061 - protein, 9 aa, Homo Sapiens
GVSPTPSIP

SEQ ID NO: 802062 - protein, 9 aa, Homo Sapiens
SPTPLGSLP

SEQ ID NO: 802063 - protein, 9 aa, Homo Sapiens
IEFSPEAWK

SEQ ID NO: 802064 - protein, 9 aa, Homo Sapiens
HIAFRPVID

SEQ ID NO: 802065 - protein, 9 aa, Homo Sapiens
ASYVKSVLE

SEQ ID NO: 802066 - protein, 9 aa, Homo Sapiens
VQEGYLEYQ

SEQ ID NO: 802067 - protein, 9 aa, Homo Sapiens
GLEPLDSNM

SEQ ID NO: 802068 - protein, 9 aa, Homo Sapiens
VFIAYDDDD

SEQ ID NO: 802069 - protein, 9 aa, Homo Sapiens
GFPGLLGRK

SEQ ID NO: 802070 - protein, 9 aa, Homo Sapiens
HPEAITCGN

SEQ ID NO: 802071 - protein, 9 aa, Homo Sapiens
VRSPQLHRA

SEQ ID NO: 802072 - protein, 9 aa, Homo Sapiens
LPTVPTSMG

SEQ ID NO: 802073 - protein, 9 aa, Homo Sapiens
WPKWGLAEQ

SEQ ID NO: 802074 - protein, 9 aa, Homo Sapiens
KIHVGEEKQ

SEQ ID NO: 802075 - protein, 9 aa, Homo Sapiens
IFEEGFQSP

SEQ ID NO: 802076 - protein, 9 aa, Homo Sapiens
INSNMENAV

SEQ ID NO: 802077 - protein, 9 aa, Homo Sapiens
SEDILLLVV

SEQ ID NO: 802078 - protein, 9 aa, Homo Sapiens
ITCGNSEDI

SEQ ID NO: 802079 - protein, 9 aa, Homo Sapiens
PITRSNSLP

SEQ ID NO: 802080 - protein, 9 aa, Homo Sapiens
SLVSSSAGQ

SEQ ID NO: 802081 - protein, 9 aa, Homo Sapiens
MPRDFPFTI

SEQ ID NO: 802082 - protein, 9 aa, Homo Sapiens
LWNPHDAGL

SEQ ID NO: 802083 - protein, 9 aa, Homo Sapiens
ARNPFVVPD

SEQ ID NO: 802084 - protein, 9 aa, Homo Sapiens
DTKKIKKVQ

SEQ ID NO: 802085 - protein, 9 aa, Homo Sapiens
EHLHMVNPM

SEQ ID NO: 802086 - protein, 9 aa, Homo Sapiens
QVEARRSKT

SEQ ID NO: 802087 - protein, 9 aa, Homo Sapiens
PSTHSSLDL

SEQ ID NO: 802088 - protein, 9 aa, Homo Sapiens
ILLLVVRST

SEQ ID NO: 802089 - protein, 9 aa, Homo Sapiens
PTVPTSMGL

SEQ ID NO: 802090 - protein, 9 aa, Homo Sapiens
HIPGSLYRV

SEQ ID NO: 802091 - protein, 9 aa, Homo Sapiens
GLLGRKGAM

SEQ ID NO: 802092 - protein, 9 aa, Homo Sapiens
PKRNQTFVY

SEQ ID NO: 802093 - protein, 9 aa, Homo Sapiens
VMPRDFPFT

SEQ ID NO: 802094 - protein, 9 aa, Homo Sapiens
RYSNPDAKP

SEQ ID NO: 802095 - protein, 9 aa, Homo Sapiens
KKKACMLAQ

SEQ ID NO: 802096 - protein, 9 aa, Homo Sapiens
TIIQEKLQE

SEQ ID NO: 802097 - protein, 9 aa, Homo Sapiens
VEARRSKTK

SEQ ID NO: 802098 - protein, 9 aa, Homo Sapiens
NVTWWETFD

SEQ ID NO: 802099 - protein, 9 aa, Homo Sapiens
YVAVLSLIT

SEQ ID NO: 802100 - protein, 9 aa, Homo Sapiens
RWRECVGYI

SEQ ID NO: 802101 - protein, 9 aa, Homo Sapiens
SPPATSTAA

SEQ ID NO: 802102 - protein, 9 aa, Homo Sapiens
NIAEFFRPT

SEQ ID NO: 802103 - protein, 9 aa, Homo Sapiens
QSPSKSEEQ

SEQ ID NO: 802104 - protein, 9 aa, Homo Sapiens
LEPKRNQTF

SEQ ID NO: 802105 - protein, 9 aa, Homo Sapiens
VMGDTVLCY

SEQ ID NO: 802106 - protein, 9 aa, Homo Sapiens
VGYINSNME

SEQ ID NO: 802107 - protein, 9 aa, Homo Sapiens
PASGHWSPS

SEQ ID NO: 802108 - protein, 9 aa, Homo Sapiens
LHLVEEAWA

SEQ ID NO: 802109 - protein, 9 aa, Homo Sapiens
LYPVMPRDF

SEQ ID NO: 802110 - protein, 9 aa, Homo Sapiens
AESFCWPKW

SEQ ID NO: 802111 - protein, 9 aa, Homo Sapiens
LGGQPLHVR

SEQ ID NO: 802112 - protein, 9 aa, Homo Sapiens
ILEPKRNQT

SEQ ID NO: 802113 - protein, 9 aa, Homo Sapiens
NVYSDLGSL

SEQ ID NO: 802114 - protein, 9 aa, Homo Sapiens
DPDTKKIKK

SEQ ID NO: 802115 - protein, 9 aa, Homo Sapiens
TADFVRMCL

SEQ ID NO: 802116 - protein, 9 aa, Homo Sapiens
CEAQAGARA

SEQ ID NO: 802117 - protein, 9 aa, Homo Sapiens
PPPASGHWS

SEQ ID NO: 802118 - protein, 9 aa, Homo Sapiens
EQVLWNPHD

SEQ ID NO: 802119 - protein, 9 aa, Homo Sapiens
RLVHHNVTW

SEQ ID NO: 802120 - protein, 9 aa, Homo Sapiens
RSTHPEAIT

SEQ ID NO: 802121 - protein, 9 aa, Homo Sapiens
DRYSTELAQ

SEQ ID NO: 802122 - protein, 9 aa, Homo Sapiens
FLCNTVWTK

SEQ ID NO: 802123 - protein, 9 aa, Homo Sapiens
TLLVCGRVE

SEQ ID NO: 802124 - protein, 9 aa, Homo Sapiens
SFCWPKWGL

SEQ ID NO: 802125 - protein, 9 aa, Homo Sapiens
LHQEQVLWN

SEQ ID NO: 802126 - protein, 9 aa, Homo Sapiens
TKKIKKVQS

SEQ ID NO: 802127 - protein, 9 aa, Homo Sapiens
SESSETTKN

SEQ ID NO: 802128 - protein, 9 aa, Homo Sapiens
PSRRPTAPS

SEQ ID NO: 802129 - protein, 9 aa, Homo Sapiens
GNSEDILLL

SEQ ID NO: 802130 - protein, 9 aa, Homo Sapiens
LADQVEARR

SEQ ID NO: 802131 - protein, 9 aa, Homo Sapiens
PRNVEERIN

SEQ ID NO: 802132 - protein, 9 aa, Homo Sapiens
STHPPGTRV

SEQ ID NO: 802133 - protein, 9 aa, Homo Sapiens
AFVISNICH

SEQ ID NO: 802134 - protein, 9 aa, Homo Sapiens
FLLSDYRVM

SEQ ID NO: 802135 - protein, 9 aa, Homo Sapiens
PPPRNWPSL

SEQ ID NO: 802136 - protein, 9 aa, Homo Sapiens
FVILLMSVY

SEQ ID NO: 802137 - protein, 9 aa, Homo Sapiens
VSRASNLHD

SEQ ID NO: 802138 - protein, 9 aa, Homo Sapiens
TAPSTGNNP

SEQ ID NO: 802139 - protein, 9 aa, Homo Sapiens
LIGIFDSDV

SEQ ID NO: 802140 - protein, 9 aa, Homo Sapiens
QLLNAQPQE

SEQ ID NO: 802141 - protein, 9 aa, Homo Sapiens
GNNPSTHSS

SEQ ID NO: 802142 - protein, 9 aa, Homo Sapiens
PRLGHKDQT

SEQ ID NO: 802143 - protein, 9 aa, Homo Sapiens
KDLVQEGYL

SEQ ID NO: 802144 - protein, 9 aa, Homo Sapiens
KKPYACGQC

SEQ ID NO: 802145 - protein, 9 aa, Homo Sapiens
YTPPSPTPL

SEQ ID NO: 802146 - protein, 9 aa, Homo Sapiens
EHRRIHTGK

SEQ ID NO: 802147 - protein, 9 aa, Homo Sapiens
IKNLMRENV

SEQ ID NO: 802148 - protein, 9 aa, Homo Sapiens
NQEDEDPDT

SEQ ID NO: 802149 - protein, 9 aa, Homo Sapiens
AAINIQQGR

SEQ ID NO: 802150 - protein, 9 aa, Homo Sapiens
LFVILLMSV

SEQ ID NO: 802151 - protein, 9 aa, Homo Sapiens
SYVKSVLER

SEQ ID NO: 802152 - protein, 9 aa, Homo Sapiens
CVGYINSNM

SEQ ID NO: 802153 - protein, 9 aa, Homo Sapiens
DTRAVLVEK

SEQ ID NO: 802154 - protein, 9 aa, Homo Sapiens
GPQPSTCEA

SEQ ID NO: 802155 - protein, 9 aa, Homo Sapiens
SPRNVEERI

SEQ ID NO: 802156 - protein, 9 aa, Homo Sapiens
DPMGLNATP

SEQ ID NO: 802157 - protein, 9 aa, Homo Sapiens
ESPVQLPPP

SEQ ID NO: 802158 - protein, 9 aa, Homo Sapiens
SHGVSPTPS

SEQ ID NO: 802159 - protein, 9 aa, Homo Sapiens
LLVVRSTKT

SEQ ID NO: 802160 - protein, 9 aa, Homo Sapiens
FQSPSKSEE

SEQ ID NO: 802161 - protein, 9 aa, Homo Sapiens
PSTCEAQAG

SEQ ID NO: 802162 - protein, 9 aa, Homo Sapiens
VVGACGVGK

SEQ ID NO: 802163 - protein, 9 aa, Homo Sapiens
TVPTSMGLQ

SEQ ID NO: 802164 - protein, 9 aa, Homo Sapiens
PKWGLAEQY

SEQ ID NO: 802165 - protein, 9 aa, Homo Sapiens
EHNRMPREV

SEQ ID NO: 802166 - protein, 9 aa, Homo Sapiens
VPITRSNSL

SEQ ID NO: 802167 - protein, 9 aa, Homo Sapiens
VLQTPSQPR

SEQ ID NO: 802168 - protein, 9 aa, Homo Sapiens
FIAYDDDDK

SEQ ID NO: 802169 - protein, 9 aa, Homo Sapiens
DIMEKAVVN

SEQ ID NO: 802170 - protein, 9 aa, Homo Sapiens
WRLLSRPQD

SEQ ID NO: 802171 - protein, 9 aa, Homo Sapiens
RPMYTPPSP

SEQ ID NO: 802172 - protein, 9 aa, Homo Sapiens
FSPEAWKCL

SEQ ID NO: 802173 - protein, 9 aa, Homo Sapiens
RSPQLHRAP

SEQ ID NO: 802174 - protein, 9 aa, Homo Sapiens
NKLKTFVFL

SEQ ID NO: 802175 - protein, 9 aa, Homo Sapiens
RPTAPSTGN

SEQ ID NO: 802176 - protein, 9 aa, Homo Sapiens
LCEAEDRYS

SEQ ID NO: 802177 - protein, 9 aa, Homo Sapiens
LGLTWKNII

SEQ ID NO: 802178 - protein, 9 aa, Homo Sapiens
QHDVISDPM

SEQ ID NO: 802179 - protein, 9 aa, Homo Sapiens
VILLMSVYW

SEQ ID NO: 802180 - protein, 9 aa, Homo Sapiens
NIQQGRDHG

SEQ ID NO: 802181 - protein, 9 aa, Homo Sapiens
VFLTLLVCG

SEQ ID NO: 802182 - protein, 9 aa, Homo Sapiens
PDTKKIKKV

SEQ ID NO: 802183 - protein, 9 aa, Homo Sapiens
VQLWVDSTH

SEQ ID NO: 802184 - protein, 9 aa, Homo Sapiens
QVLWNPHDA

SEQ ID NO: 802185 - protein, 9 aa, Homo Sapiens
AVLSLITTI

SEQ ID NO: 802186 - protein, 9 aa, Homo Sapiens
EAWKCLDPA

SEQ ID NO: 802187 - protein, 9 aa, Homo Sapiens
NMSLSGAGP

SEQ ID NO: 802188 - protein, 9 aa, Homo Sapiens
VSWRLLSRP

SEQ ID NO: 802189 - protein, 9 aa, Homo Sapiens
ILLMSVYWC

SEQ ID NO: 802190 - protein, 9 aa, Homo Sapiens
ICIKMHESG

SEQ ID NO: 802191 - protein, 9 aa, Homo Sapiens
AVLVEKRLR

SEQ ID NO: 802192 - protein, 9 aa, Homo Sapiens
TPPSPTPLG

SEQ ID NO: 802193 - protein, 9 aa, Homo Sapiens
LLMSVYWCT

SEQ ID NO: 802194 - protein, 9 aa, Homo Sapiens
IIQEKLQEI

SEQ ID NO: 802195 - protein, 9 aa, Homo Sapiens
QVVGTTALH

SEQ ID NO: 802196 - protein, 9 aa, Homo Sapiens
ALHQEQVLW

SEQ ID NO: 802197 - protein, 9 aa, Homo Sapiens
STELAQMQS

SEQ ID NO: 802198 - protein, 9 aa, Homo Sapiens
VSPTPSIPL

SEQ ID NO: 802199 - protein, 9 aa, Homo Sapiens
VLKTSLIGI

SEQ ID NO: 802200 - protein, 9 aa, Homo Sapiens
WNPHDAGLS

SEQ ID NO: 802201 - protein, 9 aa, Homo Sapiens
FLTLLVCGR

SEQ ID NO: 802202 - protein, 9 aa, Homo Sapiens
KWNEEHLHM

SEQ ID NO: 802203 - protein, 9 aa, Homo Sapiens
PTSMGLQLP

SEQ ID NO: 802204 - protein, 9 aa, Homo Sapiens
KKACMLAQF

SEQ ID NO: 802205 - protein, 9 aa, Homo Sapiens
GDSEKTKMV

SEQ ID NO: 802206 - protein, 9 aa, Homo Sapiens
EEHLHMVNP

SEQ ID NO: 802207 - protein, 9 aa, Homo Sapiens
ANSHGVSPT

SEQ ID NO: 802208 - protein, 9 aa, Homo Sapiens
LHMVNPMML

SEQ ID NO: 802209 - protein, 9 aa, Homo Sapiens
SAERITIIQ

SEQ ID NO: 802210 - protein, 9 aa, Homo Sapiens
ALLANSHGV

SEQ ID NO: 802211 - protein, 9 aa, Homo Sapiens
GHWSPSWGS

SEQ ID NO: 802212 - protein, 9 aa, Homo Sapiens
IGKVHSVHG

SEQ ID NO: 802213 - protein, 9 aa, Homo Sapiens
QQVSWRLLS

SEQ ID NO: 802214 - protein, 9 aa, Homo Sapiens
CGVGKSALT

SEQ ID NO: 802215 - protein, 9 aa, Homo Sapiens
SRLLDNIAE

SEQ ID NO: 802216 - protein, 9 aa, Homo Sapiens
THPPGTRVR

SEQ ID NO: 802217 - protein, 9 aa, Homo Sapiens
QPRSTHPEA

SEQ ID NO: 802218 - protein, 9 aa, Homo Sapiens
STHPEAITC

SEQ ID NO: 802219 - protein, 9 aa, Homo Sapiens
TLETASYVK

SEQ ID NO: 802220 - protein, 9 aa, Homo Sapiens
ACMLAQFLQ

SEQ ID NO: 802221 - protein, 9 aa, Homo Sapiens
LVTKDLVQE

SEQ ID NO: 802222 - protein, 9 aa, Homo Sapiens
GRTICIKMH

SEQ ID NO: 802223 - protein, 9 aa, Homo Sapiens
VQLPPPPPR

SEQ ID NO: 802224 - protein, 9 aa, Homo Sapiens
DSPPATSTA

SEQ ID NO: 802225 - protein, 9 aa, Homo Sapiens
ELVTKDLVQ

SEQ ID NO: 802226 - protein, 9 aa, Homo Sapiens
SNPDAKPTK

SEQ ID NO: 802227 - protein, 9 aa, Homo Sapiens
VLVEKRLRY

SEQ ID NO: 802228 - protein, 9 aa, Homo Sapiens
STCEAQAGA

SEQ ID NO: 802229 - protein, 9 aa, Homo Sapiens
LDSNMSLSG

SEQ ID NO: 802230 - protein, 9 aa, Homo Sapiens
AERITIIQE

SEQ ID NO: 802231 - protein, 9 aa, Homo Sapiens
VKKKACMLA

SEQ ID NO: 802232 - protein, 9 aa, Homo Sapiens
KEKTCDHLP

SEQ ID NO: 802233 - protein, 9 aa, Homo Sapiens
PQPSTCEAQ

SEQ ID NO: 802234 - protein, 9 aa, Homo Sapiens
GYINSNMEN

SEQ ID NO: 802235 - protein, 9 aa, Homo Sapiens
DNIAEFFRP

SEQ ID NO: 802236 - protein, 9 aa, Homo Sapiens
DDIFEEGFQ

SEQ ID NO: 802237 - protein, 9 aa, Homo Sapiens
NRMPREVEA

SEQ ID NO: 802238 - protein, 9 aa, Homo Sapiens
LGRKGAMGD

SEQ ID NO: 802239 - protein, 9 aa, Homo Sapiens
RRIHTGKKP

SEQ ID NO: 802240 - protein, 9 aa, Homo Sapiens
PGLLGRKGA

SEQ ID NO: 802241 - protein, 9 aa, Homo Sapiens
VVGTTALHL

SEQ ID NO: 802242 - protein, 9 aa, Homo Sapiens
SRASNLHDL

SEQ ID NO: 802243 - protein, 9 aa, Homo Sapiens
VLGVQPSLG

SEQ ID NO: 802244 - protein, 9 aa, Homo Sapiens
TLAKYKRIH

SEQ ID NO: 802245 - protein, 9 aa, Homo Sapiens
PEGCNNACD

SEQ ID NO: 802246 - protein, 9 aa, Homo Sapiens
PPPPRNWPS

SEQ ID NO: 802247 - protein, 9 aa, Homo Sapiens
MGLNATPLP

SEQ ID NO: 802248 - protein, 9 aa, Homo Sapiens
CEAEDRYST

SEQ ID NO: 802249 - protein, 9 aa, Homo Sapiens
HGGESGHSL

SEQ ID NO: 802250 - protein, 9 aa, Homo Sapiens
AWKCLDPAQ

SEQ ID NO: 802251 - protein, 9 aa, Homo Sapiens
ENTADFVRM

SEQ ID NO: 802252 - protein, 9 aa, Homo Sapiens
KMVLQTPSQ

SEQ ID NO: 802253 - protein, 9 aa, Homo Sapiens
NSEDILLLV

SEQ ID NO: 802254 - protein, 9 aa, Homo Sapiens
ECVGYINSN

SEQ ID NO: 802255 - protein, 9 aa, Homo Sapiens
CRLRYSNPD

SEQ ID NO: 802256 - protein, 9 aa, Homo Sapiens
LVSSSAGQT

SEQ ID NO: 802257 - protein, 9 aa, Homo Sapiens
SEKTKMVLQ

SEQ ID NO: 802258 - protein, 9 aa, Homo Sapiens
DHFSENTAD

SEQ ID NO: 802259 - protein, 9 aa, Homo Sapiens
SQPRSTHPE

SEQ ID NO: 802260 - protein, 9 aa, Homo Sapiens
LLANSHGVS

SEQ ID NO: 802261 - protein, 9 aa, Homo Sapiens
CMLAQFLQK

SEQ ID NO: 802262 - protein, 9 aa, Homo Sapiens
CNTVWTKYE

SEQ ID NO: 802263 - protein, 9 aa, Homo Sapiens
GDEHIPGSL

SEQ ID NO: 802264 - protein, 9 aa, Homo Sapiens
FFLEIWYVS

SEQ ID NO: 802265 - protein, 9 aa, Homo Sapiens
LQLLNAQPQ

SEQ ID NO: 802266 - protein, 9 aa, Homo Sapiens
VIVNVPPEI

SEQ ID NO: 802267 - protein, 9 aa, Homo Sapiens
APGFPGLLG

SEQ ID NO: 802268 - protein, 9 aa, Homo Sapiens
PKNNLVIIH

SEQ ID NO: 802269 - protein, 9 aa, Homo Sapiens
VNKLKTFVF

SEQ ID NO: 802270 - protein, 9 aa, Homo Sapiens
SGHWSPSWG

SEQ ID NO: 802271 - protein, 9 aa, Homo Sapiens
NICHIRPQR

SEQ ID NO: 802272 - protein, 9 aa, Homo Sapiens
TTIMLVQVS

SEQ ID NO: 802273 - protein, 9 aa, Homo Sapiens
VEERINGSH

SEQ ID NO: 802274 - protein, 9 aa, Homo Sapiens
PPRLGHKDQ

SEQ ID NO: 802275 - protein, 9 aa, Homo Sapiens
KQIDTRAVL

SEQ ID NO: 802276 - protein, 9 aa, Homo Sapiens
IQQVSWRLL

SEQ ID NO: 802277 - protein, 9 aa, Homo Sapiens
GFSRLLDNI

SEQ ID NO: 802278 - protein, 9 aa, Homo Sapiens
SMGLQLPPT

SEQ ID NO: 802279 - protein, 9 aa, Homo Sapiens
CWPKWGLAE

SEQ ID NO: 802280 - protein, 9 aa, Homo Sapiens
RPVIDGDVI

SEQ ID NO: 802281 - protein, 9 aa, Homo Sapiens
FQWSVSRAS

SEQ ID NO: 802282 - protein, 9 aa, Homo Sapiens
ALYPVMPRD

SEQ ID NO: 802283 - protein, 9 aa, Homo Sapiens
HGVSPTPSI

SEQ ID NO: 802284 - protein, 9 aa, Homo Sapiens
EDEDPDTKK

SEQ ID NO: 802285 - protein, 9 aa, Homo Sapiens
TWKNIIKFL

SEQ ID NO: 802286 - protein, 9 aa, Homo Sapiens
TKDLVQEGY

SEQ ID NO: 802287 - protein, 9 aa, Homo Sapiens
AFRPVIDGD

SEQ ID NO: 802288 - protein, 9 aa, Homo Sapiens
IPGSLYRVV

SEQ ID NO: 802289 - protein, 9 aa, Homo Sapiens
FVHPTLSNE

SEQ ID NO: 802290 - protein, 9 aa, Homo Sapiens
HLVEEAWAE

SEQ ID NO: 802291 - protein, 9 aa, Homo Sapiens
STLAKYKRI

SEQ ID NO: 802292 - protein, 9 aa, Homo Sapiens
LPDSPPATS

SEQ ID NO: 802293 - protein, 9 aa, Homo Sapiens
CVPITRSNS

SEQ ID NO: 802294 - protein, 9 aa, Homo Sapiens
MEKAVVNGD

SEQ ID NO: 802295 - protein, 9 aa, Homo Sapiens
TPLGSLPSR

SEQ ID NO: 802296 - protein, 9 aa, Homo Sapiens
IMEKAVVNG

SEQ ID NO: 802297 - protein, 9 aa, Homo Sapiens
IHRGDHVWD

SEQ ID NO: 802298 - protein, 9 aa, Homo Sapiens
PPATSTAAP

SEQ ID NO: 802299 - protein, 9 aa, Homo Sapiens
TKTFLLYSA

SEQ ID NO: 802300 - protein, 9 aa, Homo Sapiens
PVPEMVRSY

SEQ ID NO: 802301 - protein, 9 aa, Homo Sapiens
MHESGQKEI

SEQ ID NO: 802302 - protein, 9 aa, Homo Sapiens
FFFLEIWYV

SEQ ID NO: 802303 - protein, 9 aa, Homo Sapiens
ESEPVVARN

SEQ ID NO: 802304 - protein, 9 aa, Homo Sapiens
PEAWKCLDP

SEQ ID NO: 802305 - protein, 9 aa, Homo Sapiens
RVERTGGYF

SEQ ID NO: 802306 - protein, 9 aa, Homo Sapiens
LVHHNVTWW

SEQ ID NO: 802307 - protein, 9 aa, Homo Sapiens
KLLADQVEA

SEQ ID NO: 802308 - protein, 9 aa, Homo Sapiens
PDSPPATST

SEQ ID NO: 802309 - protein, 9 aa, Homo Sapiens
GVQPSLGKE

SEQ ID NO: 802310 - protein, 9 aa, Homo Sapiens
VHHNVTWWE

SEQ ID NO: 802311 - protein, 9 aa, Homo Sapiens
QRPMYTPPS

SEQ ID NO: 802312 - protein, 9 aa, Homo Sapiens
EAEDRYSTE

SEQ ID NO: 802313 - protein, 9 aa, Homo Sapiens
EEKEIDEYI

SEQ ID NO: 802314 - protein, 9 aa, Homo Sapiens
VYSDLGSLV

SEQ ID NO: 802315 - protein, 9 aa, Homo Sapiens
MVNPMMLRL

SEQ ID NO: 802316 - protein, 9 aa, Homo Sapiens
VDSTHPPGT

SEQ ID NO: 802317 - protein, 9 aa, Homo Sapiens
PIQQVSWRL

SEQ ID NO: 802318 - protein, 9 aa, Homo Sapiens
AQRPMYTPP

SEQ ID NO: 802319 - protein, 9 aa, Homo Sapiens
EPLDSNMSL

SEQ ID NO: 802320 - protein, 9 aa, Homo Sapiens
WSPSWGSSL

SEQ ID NO: 802321 - protein, 9 aa, Homo Sapiens
MVLQTPSQP

SEQ ID NO: 802322 - protein, 9 aa, Homo Sapiens
KNNLILVLS

SEQ ID NO: 802323 - protein, 9 aa, Homo Sapiens
FLLYSAKVN

SEQ ID NO: 802324 - protein, 9 aa, Homo Sapiens
IGIFDSDVN

SEQ ID NO: 802325 - protein, 9 aa, Homo Sapiens
SSTLAKYKR

SEQ ID NO: 802326 - protein, 9 aa, Homo Sapiens
HVRVVPTCV

SEQ ID NO: 802327 - protein, 9 aa, Homo Sapiens
HRRIHTGKK

SEQ ID NO: 802328 - protein, 9 aa, Homo Sapiens
HVGEEKQIF

SEQ ID NO: 802329 - protein, 9 aa, Homo Sapiens
PMGLNATPL

SEQ ID NO: 802330 - protein, 9 aa, Homo Sapiens
ASGHWSPSW

SEQ ID NO: 802331 - protein, 9 aa, Homo Sapiens
HLHMVNPMM

SEQ ID NO: 802332 - protein, 9 aa, Homo Sapiens
YLVVLPDSP

SEQ ID NO: 802333 - protein, 9 aa, Homo Sapiens
TICIKMHES

SEQ ID NO: 802334 - protein, 9 aa, Homo Sapiens
LLADQVEAR

SEQ ID NO: 802335 - protein, 9 aa, Homo Sapiens
IVIVNVPPE

SEQ ID NO: 802336 - protein, 9 aa, Homo Sapiens
SHSSTLAKY

SEQ ID NO: 802337 - protein, 9 aa, Homo Sapiens
EERINGSHF

SEQ ID NO: 802338 - protein, 9 aa, Homo Sapiens
ITTIMLVQV

SEQ ID NO: 802339 - protein, 9 aa, Homo Sapiens
RTGGYFKFF

SEQ ID NO: 802340 - protein, 9 aa, Homo Sapiens
ETTKNTTTA

SEQ ID NO: 802341 - protein, 9 aa, Homo Sapiens
PPEISMPQK

SEQ ID NO: 802342 - protein, 9 aa, Homo Sapiens
VISDPMGLN

SEQ ID NO: 802343 - protein, 9 aa, Homo Sapiens
PQFQWSVSR

SEQ ID NO: 802344 - protein, 9 aa, Homo Sapiens
LLGRKGAMG

SEQ ID NO: 802345 - protein, 9 aa, Homo Sapiens
VVLPDSPPA

SEQ ID NO: 802346 - protein, 9 aa, Homo Sapiens
TCGNSEDIL

SEQ ID NO: 802347 - protein, 9 aa, Homo Sapiens
KYKRIHTGE

SEQ ID NO: 802348 - protein, 9 aa, Homo Sapiens
SGPVPEMVR

SEQ ID NO: 802349 - protein, 9 aa, Homo Sapiens
RAPLGGTPT

SEQ ID NO: 802350 - protein, 9 aa, Homo Sapiens
AINIQQGRD

SEQ ID NO: 802351 - protein, 9 aa, Homo Sapiens
LPPPPPRNW

SEQ ID NO: 802352 - protein, 9 aa, Homo Sapiens
RVVPTCVAS

SEQ ID NO: 802353 - protein, 9 aa, Homo Sapiens
PATYHIAFR

SEQ ID NO: 802354 - protein, 9 aa, Homo Sapiens
DEHIPGSLY

SEQ ID NO: 802355 - protein, 9 aa, Homo Sapiens
MVRSYFPET

SEQ ID NO: 802356 - protein, 9 aa, Homo Sapiens
CDIMEKAVV

SEQ ID NO: 802357 - protein, 9 aa, Homo Sapiens
KIGKVHSVH

SEQ ID NO: 802358 - protein, 9 aa, Homo Sapiens
LCNTVWTKY

SEQ ID NO: 802359 - protein, 9 aa, Homo Sapiens
LSLITTIML

SEQ ID NO: 802360 - protein, 9 aa, Homo Sapiens
NVPPEISMP

SEQ ID NO: 802361 - protein, 9 aa, Homo Sapiens
RNPFVVPDA

SEQ ID NO: 802362 - protein, 9 aa, Homo Sapiens
FPGLLGRKG

SEQ ID NO: 802363 - protein, 9 aa, Homo Sapiens
LAKYKRIHT

SEQ ID NO: 802364 - protein, 9 aa, Homo Sapiens
HNVTWWETF

SEQ ID NO: 802365 - protein, 9 aa, Homo Sapiens
YRVMGDTVL

SEQ ID NO: 802366 - protein, 9 aa, Homo Sapiens
QFQWSVSRA

SEQ ID NO: 802367 - protein, 9 aa, Homo Sapiens
VHGGESGHS

SEQ ID NO: 802368 - protein, 9 aa, Homo Sapiens
NLILVLSQY

SEQ ID NO: 802369 - protein, 9 aa, Homo Sapiens
QGRDHGIPP

SEQ ID NO: 802370 - protein, 9 aa, Homo Sapiens
EGCNNACDN

SEQ ID NO: 802371 - protein, 9 aa, Homo Sapiens
GSLPSRRPT

SEQ ID NO: 802372 - protein, 9 aa, Homo Sapiens
ELGHGEGTT

SEQ ID NO: 802373 - protein, 9 aa, Homo Sapiens
SEPVVARNP

SEQ ID NO: 802374 - protein, 9 aa, Homo Sapiens
QIDTRAVLV

SEQ ID NO: 802375 - protein, 9 aa, Homo Sapiens
NTADFVRMC

SEQ ID NO: 802376 - protein, 9 aa, Homo Sapiens
LGVQPSLGK

SEQ ID NO: 802377 - protein, 9 aa, Homo Sapiens
GQPLHVRVV

SEQ ID NO: 802378 - protein, 9 aa, Homo Sapiens
LLVLGVQPS

SEQ ID NO: 802379 - protein, 9 aa, Homo Sapiens
SVHGGESGH

SEQ ID NO: 802380 - protein, 9 aa, Homo Sapiens
CGNSEDILL

SEQ ID NO: 802381 - protein, 9 aa, Homo Sapiens
GYLSKNNLI

SEQ ID NO: 802382 - protein, 9 aa, Homo Sapiens
HGEGTTTFT

SEQ ID NO: 802383 - protein, 9 aa, Homo Sapiens
LTVLTCIIS

SEQ ID NO: 802384 - protein, 9 aa, Homo Sapiens
CIKMHESGQ

SEQ ID NO: 802385 - protein, 9 aa, Homo Sapiens
LGNFFFLEI

SEQ ID NO: 802386 - protein, 9 aa, Homo Sapiens
MSVYWCTEA

SEQ ID NO: 802387 - protein, 9 aa, Homo Sapiens
MYTPPSPTP

SEQ ID NO: 802388 - protein, 9 aa, Homo Sapiens
QLPPPPPRN

SEQ ID NO: 802389 - protein, 9 aa, Homo Sapiens
SAESFCWPK

SEQ ID NO: 802390 - protein, 9 aa, Homo Sapiens
AIEFSPEAW

SEQ ID NO: 802391 - protein, 9 aa, Homo Sapiens
SCVWSVRST

SEQ ID NO: 802392 - protein, 9 aa, Homo Sapiens
RSTKTFLLY

SEQ ID NO: 802393 - protein, 9 aa, Homo Sapiens
NVEERINGS

SEQ ID NO: 802394 - protein, 9 aa, Homo Sapiens
GTTALHLVE

SEQ ID NO: 802395 - protein, 9 aa, Homo Sapiens
VFLCNTVWT

SEQ ID NO: 802396 - protein, 9 aa, Homo Sapiens
EAITCGNSE

SEQ ID NO: 802397 - protein, 9 aa, Homo Sapiens
GAPGFPGLL

SEQ ID NO: 802398 - protein, 9 aa, Homo Sapiens
WEGDSEKTK

SEQ ID NO: 802399 - protein, 9 aa, Homo Sapiens
VNVPPEISM

SEQ ID NO: 802400 - protein, 9 aa, Homo Sapiens
LETASYVKS

SEQ ID NO: 802401 - protein, 9 aa, Homo Sapiens
WWETFDVSP

SEQ ID NO: 802402 - protein, 9 aa, Homo Sapiens
GSLVSSSAG

SEQ ID NO: 802403 - protein, 9 aa, Homo Sapiens
SPQLHRAPL

SEQ ID NO: 802404 - protein, 9 aa, Homo Sapiens
DQVEARRSK

SEQ ID NO: 802405 - protein, 9 aa, Homo Sapiens
PLHVRVVPT

SEQ ID NO: 802406 - protein, 9 aa, Homo Sapiens
ISNICHIRP

SEQ ID NO: 802407 - protein, 9 aa, Homo Sapiens
DSTHPPGTR

SEQ ID NO: 802408 - protein, 9 aa, Homo Sapiens
QEDEDPDTK

SEQ ID NO: 802409 - protein, 9 aa, Homo Sapiens
LYSAKVNKL

SEQ ID NO: 802410 - protein, 9 aa, Homo Sapiens
KRNQTFVYS

SEQ ID NO: 802411 - protein, 9 aa, Homo Sapiens
LVVVGACGV

SEQ ID NO: 802412 - protein, 9 aa, Homo Sapiens
PPASGHWSP

SEQ ID NO: 802413 - protein, 9 aa, Homo Sapiens
YPVMPRDFP

SEQ ID NO: 802414 - protein, 9 aa, Homo Sapiens
DLGLTWKNI

SEQ ID NO: 802415 - protein, 9 aa, Homo Sapiens
TSAERITII

SEQ ID NO: 802416 - protein, 9 aa, Homo Sapiens
ESFCWPKWG

SEQ ID NO: 802417 - protein, 9 aa, Homo Sapiens
AYDDDDKVY

SEQ ID NO: 802418 - protein, 9 aa, Homo Sapiens
LRYSNPDAK

SEQ ID NO: 802419 - protein, 9 aa, Homo Sapiens
AQPQECLMG

SEQ ID NO: 802420 - protein, 9 aa, Homo Sapiens
PQLHRAPLG

SEQ ID NO: 802421 - protein, 9 aa, Homo Sapiens
HSSCVWSVR

SEQ ID NO: 802422 - protein, 9 aa, Homo Sapiens
VLILLVLGV

SEQ ID NO: 802423 - protein, 9 aa, Homo Sapiens
LYKPEGCNN

SEQ ID NO: 802424 - protein, 9 aa, Homo Sapiens
EGDSEKTKM

SEQ ID NO: 802425 - protein, 9 aa, Homo Sapiens
IFDSDVNKL

SEQ ID NO: 802426 - protein, 9 aa, Homo Sapiens
ICDIMEKAV

SEQ ID NO: 802427 - protein, 9 aa, Homo Sapiens
SSCVWSVRS

SEQ ID NO: 802428 - protein, 9 aa, Homo Sapiens
KNNLVIIHR

SEQ ID NO: 802429 - protein, 9 aa, Homo Sapiens
AITCGNSED

SEQ ID NO: 802430 - protein, 9 aa, Homo Sapiens
SETTKNTTT

SEQ ID NO: 802431 - protein, 9 aa, Homo Sapiens
RLRYSNPDA

SEQ ID NO: 802432 - protein, 9 aa, Homo Sapiens
LLVCGRVER

SEQ ID NO: 802433 - protein, 9 aa, Homo Sapiens
YINSNMENA

SEQ ID NO: 802434 - protein, 9 aa, Homo Sapiens
HQEQVLWNP

SEQ ID NO: 802435 - protein, 9 aa, Homo Sapiens
NSHGVSPTP

SEQ ID NO: 802436 - protein, 9 aa, Homo Sapiens
GEGTTTFTR

SEQ ID NO: 802437 - protein, 9 aa, Homo Sapiens
GPVPEMVRS

SEQ ID NO: 802438 - protein, 9 aa, Homo Sapiens
IIHRGDHVW

SEQ ID NO: 802439 - protein, 9 aa, Homo Sapiens
WSVSRASNL

SEQ ID NO: 802440 - protein, 9 aa, Homo Sapiens
THPEAITCG

SEQ ID NO: 802441 - protein, 9 aa, Homo Sapiens
HPPGTRVRA

SEQ ID NO: 802442 - protein, 9 aa, Homo Sapiens
TTALHLVEE

SEQ ID NO: 802443 - protein, 9 aa, Homo Sapiens
HNRMPREVE

SEQ ID NO: 802444 - protein, 9 aa, Homo Sapiens
WKNIIKFLN

SEQ ID NO: 802445 - protein, 9 aa, Homo Sapiens
ESSETTKNT

SEQ ID NO: 802446 - protein, 9 aa, Homo Sapiens
IVNVPPEIS

SEQ ID NO: 802447 - protein, 9 aa, Homo Sapiens
PPSPTPLGS

SEQ ID NO: 802448 - protein, 9 aa, Homo Sapiens
KPEGCNNAC

SEQ ID NO: 802449 - protein, 9 aa, Homo Sapiens
FRPVIDGDV

SEQ ID NO: 802450 - protein, 9 aa, Homo Sapiens
VVARNPFVV

SEQ ID NO: 802451 - protein, 9 aa, Homo Sapiens
MSLSGAGPP

SEQ ID NO: 802452 - protein, 9 aa, Homo Sapiens
HAEHNRMPR

SEQ ID NO: 802453 - protein, 9 aa, Homo Sapiens
DIFEEGFQS

SEQ ID NO: 802454 - protein, 9 aa, Homo Sapiens
NPSTHSSLD

SEQ ID NO: 802455 - protein, 9 aa, Homo Sapiens
ATYHIAFRP

SEQ ID NO: 802456 - protein, 9 aa, Homo Sapiens
NEEKEIDEY

SEQ ID NO: 802457 - protein, 9 aa, Homo Sapiens
PEISMPQKS

SEQ ID NO: 802458 - protein, 9 aa, Homo Sapiens
EEGFQSPSK

SEQ ID NO: 802459 - protein, 9 aa, Homo Sapiens
SPEAWKCLD

SEQ ID NO: 802460 - protein, 9 aa, Homo Sapiens
LAAINIQQG

SEQ ID NO: 802461 - protein, 9 aa, Homo Sapiens
YSDLGSLVS

SEQ ID NO: 802462 - protein, 9 aa, Homo Sapiens
RTICIKMHE

SEQ ID NO: 802463 - protein, 9 aa, Homo Sapiens
VWSVRSTPR

SEQ ID NO: 802464 - protein, 9 aa, Homo Sapiens
IQQGRDHGI

SEQ ID NO: 802465 - protein, 9 aa, Homo Sapiens
KNIIKFLNE

SEQ ID NO: 802466 - protein, 9 aa, Homo Sapiens
FSENTADFV

SEQ ID NO: 802467 - protein, 9 aa, Homo Sapiens
PRSTHPEAI

SEQ ID NO: 802468 - protein, 9 aa, Homo Sapiens
SGRTICIKM

SEQ ID NO: 802469 - protein, 9 aa, Homo Sapiens
YLSKNNLIL

SEQ ID NO: 802470 - protein, 9 aa, Homo Sapiens
VGEEKQIFL

SEQ ID NO: 802471 - protein, 9 aa, Homo Sapiens
HHNVTWWET

SEQ ID NO: 802472 - protein, 9 aa, Homo Sapiens
HPTLSNEEK

SEQ ID NO: 802473 - protein, 9 aa, Homo Sapiens
LTLLVCGRV

SEQ ID NO: 802474 - protein, 9 aa, Homo Sapiens
TWWETFDVS

SEQ ID NO: 802475 - protein, 9 aa, Homo Sapiens
SNICHIRPQ

SEQ ID NO: 802476 - protein, 9 aa, Homo Sapiens
EGFQSPSKS

SEQ ID NO: 802477 - protein, 9 aa, Homo Sapiens
DILLLVVRS

SEQ ID NO: 802478 - protein, 9 aa, Homo Sapiens
VPTSMGLQL

SEQ ID NO: 802479 - protein, 9 aa, Homo Sapiens
FVFLTLLVC

SEQ ID NO: 802480 - protein, 9 aa, Homo Sapiens
ECVPITRSN

SEQ ID NO: 802481 - protein, 9 aa, Homo Sapiens
ALHLVEEAW

SEQ ID NO: 802482 - protein, 9 aa, Homo Sapiens
TKMVLQTPS

SEQ ID NO: 802483 - protein, 9 aa, Homo Sapiens
WRECVGYIN

SEQ ID NO: 802484 - protein, 9 aa, Homo Sapiens
VPEMVRSYF

SEQ ID NO: 802485 - protein, 9 aa, Homo Sapiens
IHVGEEKQI

SEQ ID NO: 802486 - protein, 9 aa, Homo Sapiens
TFVFLTLLV

SEQ ID NO: 802487 - protein, 9 aa, Homo Sapiens
TKNTTTAKE

SEQ ID NO: 802488 - protein, 9 aa, Homo Sapiens
RRPTAPSTG

SEQ ID NO: 802489 - protein, 9 aa, Homo Sapiens
QLHRAPLGG

SEQ ID NO: 802490 - protein, 9 aa, Homo Sapiens
WNEEHLHMV

SEQ ID NO: 802491 - protein, 9 aa, Homo Sapiens
NNLVIIHRG

SEQ ID NO: 802492 - protein, 9 aa, Homo Sapiens
TFLLYSAKV

SEQ ID NO: 802493 - protein, 9 aa, Homo Sapiens
VLWNPHDAG

SEQ ID NO: 802494 - protein, 9 aa, Homo Sapiens
VLPDSPPAT

SEQ ID NO: 802495 - protein, 9 aa, Homo Sapiens
SDPMGLNAT

SEQ ID NO: 802496 - protein, 9 aa, Homo Sapiens
DPQFQWSVS

SEQ ID NO: 802497 - protein, 9 aa, Homo Sapiens
LLDNIAEFF

SEQ ID NO: 802498 - protein, 9 aa, Homo Sapiens
KKLLADQVE

SEQ ID NO: 802499 - protein, 9 aa, Homo Sapiens
YSTELAQMQ

SEQ ID NO: 802500 - protein, 9 aa, Homo Sapiens
VHAEHNRMP

SEQ ID NO: 802501 - protein, 9 aa, Homo Sapiens
TKYELEGQE

SEQ ID NO: 802502 - protein, 9 aa, Homo Sapiens
HMVNPMMLR

SEQ ID NO: 802503 - protein, 9 aa, Homo Sapiens
MFLGNFFFL

SEQ ID NO: 802504 - protein, 9 aa, Homo Sapiens
SGYLSKNNL

SEQ ID NO: 802505 - protein, 9 aa, Homo Sapiens
YSNPDAKPT

SEQ ID NO: 802506 - protein, 9 aa, Homo Sapiens
QPSTCEAQA

SEQ ID NO: 802507 - protein, 9 aa, Homo Sapiens
EPKRNQTFV

SEQ ID NO: 802508 - protein, 9 aa, Homo Sapiens
VERTGGYFK

SEQ ID NO: 802509 - protein, 9 aa, Homo Sapiens
YSAKVNKLK

SEQ ID NO: 802510 - protein, 9 aa, Homo Sapiens
RLGHKDQTR

SEQ ID NO: 802511 - protein, 9 aa, Homo Sapiens
KNTTTAKEM

SEQ ID NO: 802512 - protein, 9 aa, Homo Sapiens
VCGRVERTG

SEQ ID NO: 802513 - protein, 9 aa, Homo Sapiens
VWTKYELEG

SEQ ID NO: 802514 - protein, 9 aa, Homo Sapiens
LLLVVRSTK

SEQ ID NO: 802515 - protein, 9 aa, Homo Sapiens
FEEGFQSPS

SEQ ID NO: 802516 - protein, 9 aa, Homo Sapiens
LQTPSQPRS

SEQ ID NO: 802517 - protein, 9 aa, Homo Sapiens
VLPTVPTSM

SEQ ID NO: 802518 - protein, 9 aa, Homo Sapiens
GHGEGTTTF

SEQ ID NO: 802519 - protein, 9 aa, Homo Sapiens
KVHSVHGGE

SEQ ID NO: 802520 - protein, 9 aa, Homo Sapiens
HICRLRYSN

SEQ ID NO: 802521 - protein, 9 aa, Homo Sapiens
GEKLYKPEG

SEQ ID NO: 802522 - protein, 9 aa, Homo Sapiens
EKQIFLDIQ

SEQ ID NO: 802523 - protein, 9 aa, Homo Sapiens
SNMSLSGAG

SEQ ID NO: 802524 - protein, 9 aa, Homo Sapiens
GIFDSDVNK

SEQ ID NO: 802525 - protein, 9 aa, Homo Sapiens
LDNIAEFFR

SEQ ID NO: 802526 - protein, 9 aa, Homo Sapiens
ACGVGKSAL

SEQ ID NO: 802527 - protein, 9 aa, Homo Sapiens
INLQLLNAQ

SEQ ID NO: 802528 - protein, 9 aa, Homo Sapiens
DLAAINIQQ

SEQ ID NO: 802529 - protein, 9 aa, Homo Sapiens
LHRAPLGGT

SEQ ID NO: 802530 - protein, 9 aa, Homo Sapiens
NLVIIHRGD

SEQ ID NO: 802531 - protein, 9 aa, Homo Sapiens
HDVISDPMG

SEQ ID NO: 802532 - protein, 9 aa, Homo Sapiens
TSMGLQLPP

SEQ ID NO: 802533 - protein, 9 aa, Homo Sapiens
VKKILEPKR

SEQ ID NO: 802534 - protein, 9 aa, Homo Sapiens
LLYSAKVNK

SEQ ID NO: 802535 - protein, 9 aa, Homo Sapiens
LKTFVFLTL

SEQ ID NO: 802536 - protein, 9 aa, Homo Sapiens
KLKTFVFLT

SEQ ID NO: 802537 - protein, 9 aa, Homo Sapiens
DVISDPMGL

SEQ ID NO: 802538 - protein, 9 aa, Homo Sapiens
PMYTPPSPT

SEQ ID NO: 802539 - protein, 9 aa, Homo Sapiens
LLGAPPRLG

SEQ ID NO: 802540 - protein, 9 aa, Homo Sapiens
HWSPSWGSS

SEQ ID NO: 802541 - protein, 9 aa, Homo Sapiens
VHPTLSNEE

SEQ ID NO: 802542 - protein, 9 aa, Homo Sapiens
VLSLITTIM

SEQ ID NO: 802543 - protein, 9 aa, Homo Sapiens
ERITIIQEK

SEQ ID NO: 802544 - protein, 9 aa, Homo Sapiens
IQEKLQEIR

SEQ ID NO: 802545 - protein, 9 aa, Homo Sapiens
EKLYKPEGC

SEQ ID NO: 802546 - protein, 9 aa, Homo Sapiens
VTWWETFDV

SEQ ID NO: 802547 - protein, 9 aa, Homo Sapiens
EKAVVNGDT

SEQ ID NO: 802548 - protein, 9 aa, Homo Sapiens
KTLETASYV

SEQ ID NO: 802549 - protein, 9 aa, Homo Sapiens
EEKQIFLDI

SEQ ID NO: 802550 - protein, 9 aa, Homo Sapiens
LWEGDSEKT

SEQ ID NO: 802551 - protein, 9 aa, Homo Sapiens
ERTGGYFKF

SEQ ID NO: 802552 - protein, 9 aa, Homo Sapiens
EDILLLVVR

SEQ ID NO: 802553 - protein, 9 aa, Homo Sapiens
EDRYSTELA

SEQ ID NO: 802554 - protein, 9 aa, Homo Sapiens
RKKLLADQV

SEQ ID NO: 802555 - protein, 9 aa, Homo Sapiens
LMRENVEMK

SEQ ID NO: 802556 - protein, 9 aa, Homo Sapiens
LITTIMLVQ

SEQ ID NO: 802557 - protein, 9 aa, Homo Sapiens
LSKTLETAS

SEQ ID NO: 802558 - protein, 9 aa, Homo Sapiens
EHIPGSLYR

SEQ ID NO: 802559 - protein, 9 aa, Homo Sapiens
SRRPTAPST

SEQ ID NO: 802560 - protein, 9 aa, Homo Sapiens
EDPDTKKIK

SEQ ID NO: 802561 - protein, 9 aa, Homo Sapiens
RMPREVEAT

SEQ ID NO: 802562 - protein, 9 aa, Homo Sapiens
LESEPVVAR

SEQ ID NO: 802563 - protein, 9 aa, Homo Sapiens
TVWTKYELE

SEQ ID NO: 802564 - protein, 9 aa, Homo Sapiens
NEEHLHMVN

SEQ ID NO: 802565 - protein, 9 aa, Homo Sapiens
CVWSVRSTP

SEQ ID NO: 802566 - protein, 9 aa, Homo Sapiens
TASYVKSVL

SEQ ID NO: 802567 - protein, 9 aa, Homo Sapiens
VAIEFSPEA

SEQ ID NO: 802568 - protein, 9 aa, Homo Sapiens
YKLVVVGAC

SEQ ID NO: 802569 - protein, 9 aa, Homo Sapiens
IDTRAVLVE

SEQ ID NO: 802570 - protein, 9 aa, Homo Sapiens
VAVLSLITT

SEQ ID NO: 802571 - protein, 9 aa, Homo Sapiens
DSNMSLSGA

SEQ ID NO: 802572 - protein, 9 aa, Homo Sapiens
KTKMVLQTP

SEQ ID NO: 802573 - protein, 9 aa, Homo Sapiens
TSLIGIFDS

SEQ ID NO: 802574 - protein, 9 aa, Homo Sapiens
PEAITCGNS

SEQ ID NO: 802575 - protein, 9 aa, Homo Sapiens
EKTKMVLQT

SEQ ID NO: 802576 - protein, 9 aa, Homo Sapiens
SDYRVMGDT

SEQ ID NO: 802577 - protein, 9 aa, Homo Sapiens
NIIKFLNEK

SEQ ID NO: 802578 - protein, 9 aa, Homo Sapiens
AEHNRMPRE

SEQ ID NO: 802579 - protein, 9 aa, Homo Sapiens
MYMFLGNFF

SEQ ID NO: 802580 - protein, 9 aa, Homo Sapiens
ITRSNSLPF

SEQ ID NO: 802581 - protein, 9 aa, Homo Sapiens
KMHESGQKE

SEQ ID NO: 802582 - protein, 9 aa, Homo Sapiens
DPKNNLVII

SEQ ID NO: 802583 - protein, 9 aa, Homo Sapiens
VARNPFVVP

SEQ ID NO: 802584 - protein, 9 aa, Homo Sapiens
RINGSHFKD

SEQ ID NO: 802585 - protein, 9 aa, Homo Sapiens
GKVHSVHGG

SEQ ID NO: 802586 - protein, 9 aa, Homo Sapiens
LGHKDQTRT

SEQ ID NO: 802587 - protein, 9 aa, Homo Sapiens
NAQPQECLM

SEQ ID NO: 802588 - protein, 9 aa, Homo Sapiens
RITIIQEKL

SEQ ID NO: 802589 - protein, 9 aa, Homo Sapiens
ISDPMGLNA

SEQ ID NO: 802590 - protein, 9 aa, Homo Sapiens
MGLQLPPTV

SEQ ID NO: 802591 - protein, 9 aa, Homo Sapiens
SSETTKNTT

SEQ ID NO: 802592 - protein, 9 aa, Homo Sapiens
TLSNEEKEI

SEQ ID NO: 802593 - protein, 9 aa, Homo Sapiens
GSLYRVVVP

SEQ ID NO: 802594 - protein, 9 aa, Homo Sapiens
LPSRRPTAP

SEQ ID NO: 802595 - protein, 9 aa, Homo Sapiens
PLGSLPSRR

SEQ ID NO: 802596 - protein, 9 aa, Homo Sapiens
KWGLAEQYP

SEQ ID NO: 802597 - protein, 9 aa, Homo Sapiens
KVNKLKTFV

SEQ ID NO: 802598 - protein, 9 aa, Homo Sapiens
LTWKNIIKF

SEQ ID NO: 802599 - protein, 9 aa, Homo Sapiens
KLYKPEGCN

SEQ ID NO: 802600 - protein, 9 aa, Homo Sapiens
IKMHESGQK

SEQ ID NO: 802601 - protein, 9 aa, Homo Sapiens
RVHAEHNRM

SEQ ID NO: 802602 - protein, 9 aa, Homo Sapiens
LSDYRVMGD

SEQ ID NO: 802603 - protein, 9 aa, Homo Sapiens
STGNNPSTH

SEQ ID NO: 802604 - protein, 9 aa, Homo Sapiens
WTKYELEGQ

SEQ ID NO: 802605 - protein, 9 aa, Homo Sapiens
PSPTPLGSL

SEQ ID NO: 802606 - protein, 9 aa, Homo Sapiens
VVVGACGVG

SEQ ID NO: 802607 - protein, 9 aa, Homo Sapiens
PGFPGLLGR

SEQ ID NO: 802608 - protein, 9 aa, Homo Sapiens
SWRLLSRPQ

SEQ ID NO: 802609 - protein, 9 aa, Homo Sapiens
QKQIDTRAV

SEQ ID NO: 802610 - protein, 9 aa, Homo Sapiens
AVVNGDTCI

SEQ ID NO: 802611 - protein, 9 aa, Homo Sapiens
GFQSPSKSE

SEQ ID NO: 802612 - protein, 9 aa, Homo Sapiens
LHVRVVPTC

SEQ ID NO: 802613 - protein, 9 aa, Homo Sapiens
QEGYLEYQQ

SEQ ID NO: 802614 - protein, 9 aa, Homo Sapiens
LSKNNLILV

SEQ ID NO: 802615 - protein, 9 aa, Homo Sapiens
AEDRYSTEL

SEQ ID NO: 802616 - protein, 9 aa, Homo Sapiens
LLNAQPQEC

SEQ ID NO: 802617 - protein, 9 aa, Homo Sapiens
WVDSTHPPG

SEQ ID NO: 802618 - protein, 9 aa, Homo Sapiens
ITIIQEKLQ

SEQ ID NO: 802619 - protein, 9 aa, Homo Sapiens
HSSTLAKYK

SEQ ID NO: 802620 - protein, 9 aa, Homo Sapiens
EKALYPVMP

SEQ ID NO: 802621 - protein, 9 aa, Homo Sapiens
SKNNLILVL

SEQ ID NO: 802622 - protein, 9 aa, Homo Sapiens
KKILEPKRN

SEQ ID NO: 802623 - protein, 9 aa, Homo Sapiens
LMSVYWCTE

SEQ ID NO: 802624 - protein, 9 aa, Homo Sapiens
KPPPASGHW

SEQ ID NO: 802625 - protein, 9 aa, Homo Sapiens
SPVQLPPPP

SEQ ID NO: 802626 - protein, 9 aa, Homo Sapiens
LKTSLIGIF

SEQ ID NO: 802627 - protein, 9 aa, Homo Sapiens
EPVVARNPF

SEQ ID NO: 802628 - protein, 9 aa, Homo Sapiens
INGSHFKDE

SEQ ID NO: 802629 - protein, 9 aa, Homo Sapiens
LLSDYRVMG

SEQ ID NO: 802630 - protein, 9 aa, Homo Sapiens
KAVVNGDTC

SEQ ID NO: 802631 - protein, 9 aa, Homo Sapiens
SNEEKEIDE

SEQ ID NO: 802632 - protein, 9 aa, Homo Sapiens
QPQECLMGT

SEQ ID NO: 802633 - protein, 9 aa, Homo Sapiens
NLQLLNAQP

SEQ ID NO: 802634 - protein, 9 aa, Homo Sapiens
PNPNPVFES

SEQ ID NO: 802635 - protein, 9 aa, Homo Sapiens
GVDIGFWFC

SEQ ID NO: 802636 - protein, 9 aa, Homo Sapiens
LNVDHKLKK

SEQ ID NO: 802637 - protein, 9 aa, Homo Sapiens
RLNYDQKEL

SEQ ID NO: 802638 - protein, 9 aa, Homo Sapiens
NLSKGEWVR

SEQ ID NO: 802639 - protein, 9 aa, Homo Sapiens
ASTTRSAPA

SEQ ID NO: 802640 - protein, 9 aa, Homo Sapiens
FYMCDHANL

SEQ ID NO: 802641 - protein, 9 aa, Homo Sapiens
MCDHANLFM

SEQ ID NO: 802642 - protein, 9 aa, Homo Sapiens
AILWLAMSS

SEQ ID NO: 802643 - protein, 9 aa, Homo Sapiens
EVQVLAFTH

SEQ ID NO: 802644 - protein, 9 aa, Homo Sapiens
PQPPRAQPK

SEQ ID NO: 802645 - protein, 9 aa, Homo Sapiens
TGLADPDAV

SEQ ID NO: 802646 - protein, 9 aa, Homo Sapiens
ASAPLGPSE

SEQ ID NO: 802647 - protein, 9 aa, Homo Sapiens
AQRLSRKGP

SEQ ID NO: 802648 - protein, 9 aa, Homo Sapiens
GTSSLVSVE

SEQ ID NO: 802649 - protein, 9 aa, Homo Sapiens
DHANLFMKE

SEQ ID NO: 802650 - protein, 9 aa, Homo Sapiens
LCQACDGPT

SEQ ID NO: 802651 - protein, 9 aa, Homo Sapiens
SSKPEEGGS

SEQ ID NO: 802652 - protein, 9 aa, Homo Sapiens
WKTNFRCAV

SEQ ID NO: 802653 - protein, 9 aa, Homo Sapiens
EMLQHPGCN

SEQ ID NO: 802654 - protein, 9 aa, Homo Sapiens
TPPCPCVMA

SEQ ID NO: 802655 - protein, 9 aa, Homo Sapiens
THTSTGKIK

SEQ ID NO: 802656 - protein, 9 aa, Homo Sapiens
DQSCTDIVD

SEQ ID NO: 802657 - protein, 9 aa, Homo Sapiens
SLAVLVIHL

SEQ ID NO: 802658 - protein, 9 aa, Homo Sapiens
EKKDTKKYP

SEQ ID NO: 802659 - protein, 9 aa, Homo Sapiens
PPGAPLGLR

SEQ ID NO: 802660 - protein, 9 aa, Homo Sapiens
KSMQWAQRL

SEQ ID NO: 802661 - protein, 9 aa, Homo Sapiens
MCPICGEWF

SEQ ID NO: 802662 - protein, 9 aa, Homo Sapiens
GGSPSNEGL

SEQ ID NO: 802663 - protein, 9 aa, Homo Sapiens
ICYRRHHPL

SEQ ID NO: 802664 - protein, 9 aa, Homo Sapiens
VTVLQPNPN

SEQ ID NO: 802665 - protein, 9 aa, Homo Sapiens
NHYKINNLC

SEQ ID NO: 802666 - protein, 9 aa, Homo Sapiens
PPAPGSSLR

SEQ ID NO: 802667 - protein, 9 aa, Homo Sapiens
RRLNYDQKE

SEQ ID NO: 802668 - protein, 9 aa, Homo Sapiens
RQLAEQELL

SEQ ID NO: 802669 - protein, 9 aa, Homo Sapiens
DEEPWSWLE

SEQ ID NO: 802670 - protein, 9 aa, Homo Sapiens
DNSQSALKL

SEQ ID NO: 802671 - protein, 9 aa, Homo Sapiens
LKTFKRSRY

SEQ ID NO: 802672 - protein, 9 aa, Homo Sapiens
FRCAVRSTR

SEQ ID NO: 802673 - protein, 9 aa, Homo Sapiens
TCLCWASTT

SEQ ID NO: 802674 - protein, 9 aa, Homo Sapiens
HGLHSYEKW

SEQ ID NO: 802675 - protein, 9 aa, Homo Sapiens
LPRPLSPPG

SEQ ID NO: 802676 - protein, 9 aa, Homo Sapiens
SMQWAQRLS

SEQ ID NO: 802677 - protein, 9 aa, Homo Sapiens
CATYGNVNI

SEQ ID NO: 802678 - protein, 9 aa, Homo Sapiens
TRCFWSTLW

SEQ ID NO: 802679 - protein, 9 aa, Homo Sapiens
TTSMSNDVC

SEQ ID NO: 802680 - protein, 9 aa, Homo Sapiens
YCPQENTLW

SEQ ID NO: 802681 - protein, 9 aa, Homo Sapiens
EWFPSLLTL

SEQ ID NO: 802682 - protein, 9 aa, Homo Sapiens
MCPSWPRPA

SEQ ID NO: 802683 - protein, 9 aa, Homo Sapiens
SRQLAEQEL

SEQ ID NO: 802684 - protein, 9 aa, Homo Sapiens
STTNITPNL

SEQ ID NO: 802685 - protein, 9 aa, Homo Sapiens
EEPWSWLEE

SEQ ID NO: 802686 - protein, 9 aa, Homo Sapiens
ERARATSDV

SEQ ID NO: 802687 - protein, 9 aa, Homo Sapiens
LSKGEWVRA

SEQ ID NO: 802688 - protein, 9 aa, Homo Sapiens
KVQNKGLGS

SEQ ID NO: 802689 - protein, 9 aa, Homo Sapiens
SQRVTVLQP

SEQ ID NO: 802690 - protein, 9 aa, Homo Sapiens
VEEDLMKLI

SEQ ID NO: 802691 - protein, 9 aa, Homo Sapiens
ITKDELSSR

SEQ ID NO: 802692 - protein, 9 aa, Homo Sapiens
ICALCRLGL

SEQ ID NO: 802693 - protein, 9 aa, Homo Sapiens
GERSRQLAE

SEQ ID NO: 802694 - protein, 9 aa, Homo Sapiens
NTLWPNLTV

SEQ ID NO: 802695 - protein, 9 aa, Homo Sapiens
AEGERARAT

SEQ ID NO: 802696 - protein, 9 aa, Homo Sapiens
PQLAESHGT

SEQ ID NO: 802697 - protein, 9 aa, Homo Sapiens
RNAITCIFF

SEQ ID NO: 802698 - protein, 9 aa, Homo Sapiens
CEGRLAVLM

SEQ ID NO: 802699 - protein, 9 aa, Homo Sapiens
NRYLNVDHK

SEQ ID NO: 802700 - protein, 9 aa, Homo Sapiens
KSMSMSAAG

SEQ ID NO: 802701 - protein, 9 aa, Homo Sapiens
WNFYLPTIL

SEQ ID NO: 802702 - protein, 9 aa, Homo Sapiens
QHSQFQSPH

SEQ ID NO: 802703 - protein, 9 aa, Homo Sapiens
HGNLSQTQW

SEQ ID NO: 802704 - protein, 9 aa, Homo Sapiens
EQGERSRQL

SEQ ID NO: 802705 - protein, 9 aa, Homo Sapiens
TSTKTRQRV

SEQ ID NO: 802706 - protein, 9 aa, Homo Sapiens
DFNSLAVLV

SEQ ID NO: 802707 - protein, 9 aa, Homo Sapiens
AELEGPAQP

SEQ ID NO: 802708 - protein, 9 aa, Homo Sapiens
RTLTNETFF

SEQ ID NO: 802709 - protein, 9 aa, Homo Sapiens
DEKKDTKKY

SEQ ID NO: 802710 - protein, 9 aa, Homo Sapiens
PACTTRCFW

SEQ ID NO: 802711 - protein, 9 aa, Homo Sapiens
GYCPQENTL

SEQ ID NO: 802712 - protein, 9 aa, Homo Sapiens
GGILFLVLN

SEQ ID NO: 802713 - protein, 9 aa, Homo Sapiens
NNLCAERHY

SEQ ID NO: 802714 - protein, 9 aa, Homo Sapiens
SSTLKTFKR

SEQ ID NO: 802715 - protein, 9 aa, Homo Sapiens
RRHHPLNWL

SEQ ID NO: 802716 - protein, 9 aa, Homo Sapiens
RSRQLAEQE

SEQ ID NO: 802717 - protein, 9 aa, Homo Sapiens
WVRAWIRAR

SEQ ID NO: 802718 - protein, 9 aa, Homo Sapiens
LATVEEDLM

SEQ ID NO: 802719 - protein, 9 aa, Homo Sapiens
FEHFIQSHH

SEQ ID NO: 802720 - protein, 9 aa, Homo Sapiens
PRPAPCCPR

SEQ ID NO: 802721 - protein, 9 aa, Homo Sapiens
QGERSRQLA

SEQ ID NO: 802722 - protein, 9 aa, Homo Sapiens
FYKPITKDE

SEQ ID NO: 802723 - protein, 9 aa, Homo Sapiens
LVAEYLTWK

SEQ ID NO: 802724 - protein, 9 aa, Homo Sapiens
SQPCSPLSA

SEQ ID NO: 802725 - protein, 9 aa, Homo Sapiens
IKILCATYG

SEQ ID NO: 802726 - protein, 9 aa, Homo Sapiens
EWVRAWIRA

SEQ ID NO: 802727 - protein, 9 aa, Homo Sapiens
CLCWASTTR

SEQ ID NO: 802728 - protein, 9 aa, Homo Sapiens
WPRPAPCCP

SEQ ID NO: 802729 - protein, 9 aa, Homo Sapiens
DTHTSTGKI

SEQ ID NO: 802730 - protein, 9 aa, Homo Sapiens
WKEAVQWEP

SEQ ID NO: 802731 - protein, 9 aa, Homo Sapiens
EGRRKAVAT

SEQ ID NO: 802732 - protein, 9 aa, Homo Sapiens
RRKAVATCS

SEQ ID NO: 802733 - protein, 9 aa, Homo Sapiens
PAPCCPRPR

SEQ ID NO: 802734 - protein, 9 aa, Homo Sapiens
PPPPEPYTV

SEQ ID NO: 802735 - protein, 9 aa, Homo Sapiens
PPPAPGSSL

SEQ ID NO: 802736 - protein, 9 aa, Homo Sapiens
PAPASAPLG

SEQ ID NO: 802737 - protein, 9 aa, Homo Sapiens
ASRPPVTQR

SEQ ID NO: 802738 - protein, 9 aa, Homo Sapiens
PCTTSMSND

SEQ ID NO: 802739 - protein, 9 aa, Homo Sapiens
APCCPRPRP

SEQ ID NO: 802740 - protein, 9 aa, Homo Sapiens
PLAKELGSY

SEQ ID NO: 802741 - protein, 9 aa, Homo Sapiens
PLQPMCPSW

SEQ ID NO: 802742 - protein, 9 aa, Homo Sapiens
VSFEHFIQS

SEQ ID NO: 802743 - protein, 9 aa, Homo Sapiens
IGHGGSPSN

SEQ ID NO: 802744 - protein, 9 aa, Homo Sapiens
NITPNLTST

SEQ ID NO: 802745 - protein, 9 aa, Homo Sapiens
CDHANLFMK

SEQ ID NO: 802746 - protein, 9 aa, Homo Sapiens
CPCVMAPAP

SEQ ID NO: 802747 - protein, 9 aa, Homo Sapiens
DQKELERKR

SEQ ID NO: 802748 - protein, 9 aa, Homo Sapiens
TGKIKAAEK

SEQ ID NO: 802749 - protein, 9 aa, Homo Sapiens
ATYGNVNIR

SEQ ID NO: 802750 - protein, 9 aa, Homo Sapiens
PSETFLATV

SEQ ID NO: 802751 - protein, 9 aa, Homo Sapiens
QQAKLPLPR

SEQ ID NO: 802752 - protein, 9 aa, Homo Sapiens
LSAPPRPPA

SEQ ID NO: 802753 - protein, 9 aa, Homo Sapiens
ATSDVLCRS

SEQ ID NO: 802754 - protein, 9 aa, Homo Sapiens
FPGLQIGHG

SEQ ID NO: 802755 - protein, 9 aa, Homo Sapiens
CFWSTLWGC

SEQ ID NO: 802756 - protein, 9 aa, Homo Sapiens
CLGWNFYLP

SEQ ID NO: 802757 - protein, 9 aa, Homo Sapiens
KNTKDAVWN

SEQ ID NO: 802758 - protein, 9 aa, Homo Sapiens
GEWVRAWIR

SEQ ID NO: 802759 - protein, 9 aa, Homo Sapiens
HFTMESNKI

SEQ ID NO: 802760 - protein, 9 aa, Homo Sapiens
DAVASMFWV

SEQ ID NO: 802761 - protein, 9 aa, Homo Sapiens
LTPPCPCVM

SEQ ID NO: 802762 - protein, 9 aa, Homo Sapiens
HTSTGKIKA

SEQ ID NO: 802763 - protein, 9 aa, Homo Sapiens
LDLPWRGRS

SEQ ID NO: 802764 - protein, 9 aa, Homo Sapiens
PPCPCVMAP

SEQ ID NO: 802765 - protein, 9 aa, Homo Sapiens
PCEMDNSQS

SEQ ID NO: 802766 - protein, 9 aa, Homo Sapiens
NETFFVLAH

SEQ ID NO: 802767 - protein, 9 aa, Homo Sapiens
LDTHTSTGK

SEQ ID NO: 802768 - protein, 9 aa, Homo Sapiens
RRSKKAELE

SEQ ID NO: 802769 - protein, 9 aa, Homo Sapiens
DPDAVASMF

SEQ ID NO: 802770 - protein, 9 aa, Homo Sapiens
HVSNHFTME

SEQ ID NO: 802771 - protein, 9 aa, Homo Sapiens
HTLDPLAKE

SEQ ID NO: 802772 - protein, 9 aa, Homo Sapiens
LLDLATLPE

SEQ ID NO: 802773 - protein, 9 aa, Homo Sapiens
WPLQPMCPS

SEQ ID NO: 802774 - protein, 9 aa, Homo Sapiens
CLRRLNYDQ

SEQ ID NO: 802775 - protein, 9 aa, Homo Sapiens
LEQGERSRQ

SEQ ID NO: 802776 - protein, 9 aa, Homo Sapiens
PSWPRPAPC

SEQ ID NO: 802777 - protein, 9 aa, Homo Sapiens
RSRYFPTRV

SEQ ID NO: 802778 - protein, 9 aa, Homo Sapiens
AEGRRKAVA

SEQ ID NO: 802779 - protein, 9 aa, Homo Sapiens
ITPNLTSTG

SEQ ID NO: 802780 - protein, 9 aa, Homo Sapiens
KDELSSRSE

SEQ ID NO: 802781 - protein, 9 aa, Homo Sapiens
LQIGHGGSP

SEQ ID NO: 802782 - protein, 9 aa, Homo Sapiens
VLLPQLAES

SEQ ID NO: 802783 - protein, 9 aa, Homo Sapiens
GWRLDLPWR

SEQ ID NO: 802784 - protein, 9 aa, Homo Sapiens
HWTLENSPI

SEQ ID NO: 802785 - protein, 9 aa, Homo Sapiens
WGPHWPLQP

SEQ ID NO: 802786 - protein, 9 aa, Homo Sapiens
PGLQIGHGG

SEQ ID NO: 802787 - protein, 9 aa, Homo Sapiens
RSKGPLDQL

SEQ ID NO: 802788 - protein, 9 aa, Homo Sapiens
DHKLKKEIH

SEQ ID NO: 802789 - protein, 9 aa, Homo Sapiens
TQKPQPPRA

SEQ ID NO: 802790 - protein, 9 aa, Homo Sapiens
LCRLGLGSS

SEQ ID NO: 802791 - protein, 9 aa, Homo Sapiens
PSPSSKPEE

SEQ ID NO: 802792 - protein, 9 aa, Homo Sapiens
LEEYNKALE

SEQ ID NO: 802793 - protein, 9 aa, Homo Sapiens
TTRCFWSTL

SEQ ID NO: 802794 - protein, 9 aa, Homo Sapiens
LPWRGRSGL

SEQ ID NO: 802795 - protein, 9 aa, Homo Sapiens
PRRSKKAEL

SEQ ID NO: 802796 - protein, 9 aa, Homo Sapiens
QLAESHGTS

SEQ ID NO: 802797 - protein, 9 aa, Homo Sapiens
FWVGGILFL

SEQ ID NO: 802798 - protein, 9 aa, Homo Sapiens
CPICGEWFP

SEQ ID NO: 802799 - protein, 9 aa, Homo Sapiens
SHGTSAGPH

SEQ ID NO: 802800 - protein, 9 aa, Homo Sapiens
SKGEWVRAW

SEQ ID NO: 802801 - protein, 9 aa, Homo Sapiens
GFWFCAGNE

SEQ ID NO: 802802 - protein, 9 aa, Homo Sapiens
KILCATYGN

SEQ ID NO: 802803 - protein, 9 aa, Homo Sapiens
CALCRLGLG

SEQ ID NO: 802804 - protein, 9 aa, Homo Sapiens
CIFFTFWHG

SEQ ID NO: 802805 - protein, 9 aa, Homo Sapiens
SFWVGGILF

SEQ ID NO: 802806 - protein, 9 aa, Homo Sapiens
KTNFRCAVR

SEQ ID NO: 802807 - protein, 9 aa, Homo Sapiens
APLGPSEEL

SEQ ID NO: 802808 - protein, 9 aa, Homo Sapiens
MLQPSGLLL

SEQ ID NO: 802809 - protein, 9 aa, Homo Sapiens
EPWSWLEEY

SEQ ID NO: 802810 - protein, 9 aa, Homo Sapiens
QAKLPLPRP

SEQ ID NO: 802811 - protein, 9 aa, Homo Sapiens
FTHIGDGSP

SEQ ID NO: 802812 - protein, 9 aa, Homo Sapiens
FQSPHPQHP

SEQ ID NO: 802813 - protein, 9 aa, Homo Sapiens
CPSWPRPAP

SEQ ID NO: 802814 - protein, 9 aa, Homo Sapiens
LAFTHIGDG

SEQ ID NO: 802815 - protein, 9 aa, Homo Sapiens
TLTNETFFV

SEQ ID NO: 802816 - protein, 9 aa, Homo Sapiens
RLRPGTSSL

SEQ ID NO: 802817 - protein, 9 aa, Homo Sapiens
RFLCEGRLA

SEQ ID NO: 802818 - protein, 9 aa, Homo Sapiens
HIGDGSPSH

SEQ ID NO: 802819 - protein, 9 aa, Homo Sapiens
PRPPACTTR

SEQ ID NO: 802820 - protein, 9 aa, Homo Sapiens
KGLGSCAVS

SEQ ID NO: 802821 - protein, 9 aa, Homo Sapiens
SEEFKEMMD

SEQ ID NO: 802822 - protein, 9 aa, Homo Sapiens
ACTTRCFWS

SEQ ID NO: 802823 - protein, 9 aa, Homo Sapiens
TKDAVWNSV

SEQ ID NO: 802824 - protein, 9 aa, Homo Sapiens
AEYLTWKEA

SEQ ID NO: 802825 - protein, 9 aa, Homo Sapiens
PWRGRSGLT

SEQ ID NO: 802826 - protein, 9 aa, Homo Sapiens
GLADPDAVA

SEQ ID NO: 802827 - protein, 9 aa, Homo Sapiens
LAVLVIHLK

SEQ ID NO: 802828 - protein, 9 aa, Homo Sapiens
RHWTLENSP

SEQ ID NO: 802829 - protein, 9 aa, Homo Sapiens
HDEEPWSWL

SEQ ID NO: 802830 - protein, 9 aa, Homo Sapiens
AQPKMDWKW

SEQ ID NO: 802831 - protein, 9 aa, Homo Sapiens
NICYRRHHP

SEQ ID NO: 802832 - protein, 9 aa, Homo Sapiens
CRLGLGSSF

SEQ ID NO: 802833 - protein, 9 aa, Homo Sapiens
TVEEDLMKL

SEQ ID NO: 802834 - protein, 9 aa, Homo Sapiens
LRRLNYDQK

SEQ ID NO: 802835 - protein, 9 aa, Homo Sapiens
ITCIFFTFW

SEQ ID NO: 802836 - protein, 9 aa, Homo Sapiens
FEEKVSFEH

SEQ ID NO: 802837 - protein, 9 aa, Homo Sapiens
GRSKGPLDQ

SEQ ID NO: 802838 - protein, 9 aa, Homo Sapiens
TVDGYVDLS

SEQ ID NO: 802839 - protein, 9 aa, Homo Sapiens
FVRLNICMA

SEQ ID NO: 802840 - protein, 9 aa, Homo Sapiens
QPPRAQPKM

SEQ ID NO: 802841 - protein, 9 aa, Homo Sapiens
TTNITPNLT

SEQ ID NO: 802842 - protein, 9 aa, Homo Sapiens
AHPPPPEPY

SEQ ID NO: 802843 - protein, 9 aa, Homo Sapiens
MFVRMLQPS

SEQ ID NO: 802844 - protein, 9 aa, Homo Sapiens
KGEWVRAWI

SEQ ID NO: 802845 - protein, 9 aa, Homo Sapiens
LKSMSMSAA

SEQ ID NO: 802846 - protein, 9 aa, Homo Sapiens
PMCPSWPRP

SEQ ID NO: 802847 - protein, 9 aa, Homo Sapiens
SQTQWLEAL

SEQ ID NO: 802848 - protein, 9 aa, Homo Sapiens
PSPVICALC

SEQ ID NO: 802849 - protein, 9 aa, Homo Sapiens
FLATVEEDL

SEQ ID NO: 802850 - protein, 9 aa, Homo Sapiens
TSSLVSVEP

SEQ ID NO: 802851 - protein, 9 aa, Homo Sapiens
GIPFIETST

SEQ ID NO: 802852 - protein, 9 aa, Homo Sapiens
QRLVVPATQ

SEQ ID NO: 802853 - protein, 9 aa, Homo Sapiens
ILWLAMSST

SEQ ID NO: 802854 - protein, 9 aa, Homo Sapiens
HWPLQPMCP

SEQ ID NO: 802855 - protein, 9 aa, Homo Sapiens
LLARFLCEG

SEQ ID NO: 802856 - protein, 9 aa, Homo Sapiens
AESHGTSAG

SEQ ID NO: 802857 - protein, 9 aa, Homo Sapiens
WTLENSPIS

SEQ ID NO: 802858 - protein, 9 aa, Homo Sapiens
RTNHQVCSL

SEQ ID NO: 802859 - protein, 9 aa, Homo Sapiens
WLEEYNKAL

SEQ ID NO: 802860 - protein, 9 aa, Homo Sapiens
EYLTWKEAV

SEQ ID NO: 802861 - protein, 9 aa, Homo Sapiens
LSQTQWLEA

SEQ ID NO: 802862 - protein, 9 aa, Homo Sapiens
ATVEEDLMK

SEQ ID NO: 802863 - protein, 9 aa, Homo Sapiens
ACDGPTYIL

SEQ ID NO: 802864 - protein, 9 aa, Homo Sapiens
CEMLQHPGC

SEQ ID NO: 802865 - protein, 9 aa, Homo Sapiens
PLPRPLSPP

SEQ ID NO: 802866 - protein, 9 aa, Homo Sapiens
VMAPAPPCH

SEQ ID NO: 802867 - protein, 9 aa, Homo Sapiens
RPGTSSLVS

SEQ ID NO: 802868 - protein, 9 aa, Homo Sapiens
GAPLGLRLL

SEQ ID NO: 802869 - protein, 9 aa, Homo Sapiens
PWSWLEEYN

SEQ ID NO: 802870 - protein, 9 aa, Homo Sapiens
GNLSQTQWL

SEQ ID NO: 802871 - protein, 9 aa, Homo Sapiens
TLWGCQQAK

SEQ ID NO: 802872 - protein, 9 aa, Homo Sapiens
TFKRSRYFP

SEQ ID NO: 802873 - protein, 9 aa, Homo Sapiens
LADPDAVAS

SEQ ID NO: 802874 - protein, 9 aa, Homo Sapiens
SCTDIVDTY

SEQ ID NO: 802875 - protein, 9 aa, Homo Sapiens
LPQLAESHG

SEQ ID NO: 802876 - protein, 9 aa, Homo Sapiens
RNRYLNVDH

SEQ ID NO: 802877 - protein, 9 aa, Homo Sapiens
SPTWGPHWP

SEQ ID NO: 802878 - protein, 9 aa, Homo Sapiens
ARATSDVLC

SEQ ID NO: 802879 - protein, 9 aa, Homo Sapiens
LETVRELAI

SEQ ID NO: 802880 - protein, 9 aa, Homo Sapiens
KIKAAEKKE

SEQ ID NO: 802881 - protein, 9 aa, Homo Sapiens
DAVWNSVCH

SEQ ID NO: 802882 - protein, 9 aa, Homo Sapiens
APASAPLGP

SEQ ID NO: 802883 - protein, 9 aa, Homo Sapiens
LNYDQKELE

SEQ ID NO: 802884 - protein, 9 aa, Homo Sapiens
GNLSKGEWV

SEQ ID NO: 802885 - protein, 9 aa, Homo Sapiens
TRSAPASSP

SEQ ID NO: 802886 - protein, 9 aa, Homo Sapiens
YGNVNIRDI

SEQ ID NO: 802887 - protein, 9 aa, Homo Sapiens
YLLPVLSDT

SEQ ID NO: 802888 - protein, 9 aa, Homo Sapiens
PQENTLWPN

SEQ ID NO: 802889 - protein, 9 aa, Homo Sapiens
QSCTDIVDT

SEQ ID NO: 802890 - protein, 9 aa, Homo Sapiens
LSGGDRFCL

SEQ ID NO: 802891 - protein, 9 aa, Homo Sapiens
RGRSGLTRS

SEQ ID NO: 802892 - protein, 9 aa, Homo Sapiens
GNVNIRDID

SEQ ID NO: 802893 - protein, 9 aa, Homo Sapiens
EPCEMDNSQ

SEQ ID NO: 802894 - protein, 9 aa, Homo Sapiens
GILFLVLNS

SEQ ID NO: 802895 - protein, 9 aa, Homo Sapiens
EKAAHPPPP

SEQ ID NO: 802896 - protein, 9 aa, Homo Sapiens
LWGCQQAKL

SEQ ID NO: 802897 - protein, 9 aa, Homo Sapiens
HNLLDLATL

SEQ ID NO: 802898 - protein, 9 aa, Homo Sapiens
KPQPPRAQP

SEQ ID NO: 802899 - protein, 9 aa, Homo Sapiens
RMSEAEGRR

SEQ ID NO: 802900 - protein, 9 aa, Homo Sapiens
ILFLVLNSQ

SEQ ID NO: 802901 - protein, 9 aa, Homo Sapiens
PPRPPACTT

SEQ ID NO: 802902 - protein, 9 aa, Homo Sapiens
IPFIETSTK

SEQ ID NO: 802903 - protein, 9 aa, Homo Sapiens
QVYLAILWL

SEQ ID NO: 802904 - protein, 9 aa, Homo Sapiens
RLNICMAGG

SEQ ID NO: 802905 - protein, 9 aa, Homo Sapiens
TFLATVEED

SEQ ID NO: 802906 - protein, 9 aa, Homo Sapiens
SSLRPTAST

SEQ ID NO: 802907 - protein, 9 aa, Homo Sapiens
EAEGRRKAV

SEQ ID NO: 802908 - protein, 9 aa, Homo Sapiens
RAQPKMDWK

SEQ ID NO: 802909 - protein, 9 aa, Homo Sapiens
EMMDLPTCG

SEQ ID NO: 802910 - protein, 9 aa, Homo Sapiens
SLRPTASTC

SEQ ID NO: 802911 - protein, 9 aa, Homo Sapiens
YLAILWLAM

SEQ ID NO: 802912 - protein, 9 aa, Homo Sapiens
WGCQQAKLP

SEQ ID NO: 802913 - protein, 9 aa, Homo Sapiens
DLSGGDRFC

SEQ ID NO: 802914 - protein, 9 aa, Homo Sapiens
STTRSAPAS

SEQ ID NO: 802915 - protein, 9 aa, Homo Sapiens
CGEWFPSLL

SEQ ID NO: 802916 - protein, 9 aa, Homo Sapiens
KTFKRSRYF

SEQ ID NO: 802917 - protein, 9 aa, Homo Sapiens
PGMRVLCEM

SEQ ID NO: 802918 - protein, 9 aa, Homo Sapiens
RCAVRSTRR

SEQ ID NO: 802919 - protein, 9 aa, Homo Sapiens
WNSVCHTAT

SEQ ID NO: 802920 - protein, 9 aa, Homo Sapiens
ALVAEYLTW

SEQ ID NO: 802921 - protein, 9 aa, Homo Sapiens
KHKNHYKIN

SEQ ID NO: 802922 - protein, 9 aa, Homo Sapiens
LEGPAQPCP

SEQ ID NO: 802923 - protein, 9 aa, Homo Sapiens
WQFLETVRE

SEQ ID NO: 802924 - protein, 9 aa, Homo Sapiens
DPLAKELGS

SEQ ID NO: 802925 - protein, 9 aa, Homo Sapiens
FWFCAGNEN

SEQ ID NO: 802926 - protein, 9 aa, Homo Sapiens
YLHNLLDLA

SEQ ID NO: 802927 - protein, 9 aa, Homo Sapiens
LSPPGAPLG

SEQ ID NO: 802928 - protein, 9 aa, Homo Sapiens
PGAPLGLRL

SEQ ID NO: 802929 - protein, 9 aa, Homo Sapiens
GPTYILGQL

SEQ ID NO: 802930 - protein, 9 aa, Homo Sapiens
NFRCAVRST

SEQ ID NO: 802931 - protein, 9 aa, Homo Sapiens
IAVNICYRR

SEQ ID NO: 802932 - protein, 9 aa, Homo Sapiens
TNFRCAVRS

SEQ ID NO: 802933 - protein, 9 aa, Homo Sapiens
TTGLADPDA

SEQ ID NO: 802934 - protein, 9 aa, Homo Sapiens
PSSKPEEGG

SEQ ID NO: 802935 - protein, 9 aa, Homo Sapiens
TCIFFTFWH

SEQ ID NO: 802936 - protein, 9 aa, Homo Sapiens
VLVIHLKTI

SEQ ID NO: 802937 - protein, 9 aa, Homo Sapiens
RPPVTQRLV

SEQ ID NO: 802938 - protein, 9 aa, Homo Sapiens
SKKAELEGP

SEQ ID NO: 802939 - protein, 9 aa, Homo Sapiens
LIITSAWGR

SEQ ID NO: 802940 - protein, 9 aa, Homo Sapiens
YKPITKDEL

SEQ ID NO: 802941 - protein, 9 aa, Homo Sapiens
SQFQSPHPQ

SEQ ID NO: 802942 - protein, 9 aa, Homo Sapiens
CWASTTRSA

SEQ ID NO: 802943 - protein, 9 aa, Homo Sapiens
GLHSYEKWL

SEQ ID NO: 802944 - protein, 9 aa, Homo Sapiens
PQSPVFRHW

SEQ ID NO: 802945 - protein, 9 aa, Homo Sapiens
HYKINNLCA

SEQ ID NO: 802946 - protein, 9 aa, Homo Sapiens
VTVDGYVDL

SEQ ID NO: 802947 - protein, 9 aa, Homo Sapiens
MLQHPGCNI

SEQ ID NO: 802948 - protein, 9 aa, Homo Sapiens
PHWPLQPMC

SEQ ID NO: 802949 - protein, 9 aa, Homo Sapiens
SPLSAPPRP

SEQ ID NO: 802950 - protein, 9 aa, Homo Sapiens
DTSRIALMW

SEQ ID NO: 802951 - protein, 9 aa, Homo Sapiens
KPITKDELS

SEQ ID NO: 802952 - protein, 9 aa, Homo Sapiens
WRGRSGLTR

SEQ ID NO: 802953 - protein, 9 aa, Homo Sapiens
PPPEPYTVA

SEQ ID NO: 802954 - protein, 9 aa, Homo Sapiens
ICGEWFPSL

SEQ ID NO: 802955 - protein, 9 aa, Homo Sapiens
PVTQRLVVP

SEQ ID NO: 802956 - protein, 9 aa, Homo Sapiens
TSDVLCRSL

SEQ ID NO: 802957 - protein, 9 aa, Homo Sapiens
TLDPLAKEL

SEQ ID NO: 802958 - protein, 9 aa, Homo Sapiens
HANLFMKEN

SEQ ID NO: 802959 - protein, 9 aa, Homo Sapiens
TYILGQLCL

SEQ ID NO: 802960 - protein, 9 aa, Homo Sapiens
HKLKKEIHH

SEQ ID NO: 802961 - protein, 9 aa, Homo Sapiens
AVRSTRRFV

SEQ ID NO: 802962 - protein, 9 aa, Homo Sapiens
RPTASTCLC

SEQ ID NO: 802963 - protein, 9 aa, Homo Sapiens
RPAPCCPRP

SEQ ID NO: 802964 - protein, 9 aa, Homo Sapiens
LYHKVQNKG

SEQ ID NO: 802965 - protein, 9 aa, Homo Sapiens
CCPRPRPSQ

SEQ ID NO: 802966 - protein, 9 aa, Homo Sapiens
MSEAEGRRK

SEQ ID NO: 802967 - protein, 9 aa, Homo Sapiens
YFSFWVGGI

SEQ ID NO: 802968 - protein, 9 aa, Homo Sapiens
TDIVDTYNK

SEQ ID NO: 802969 - protein, 9 aa, Homo Sapiens
GPHWPLQPM

SEQ ID NO: 802970 - protein, 9 aa, Homo Sapiens
PCPCVMAPA

SEQ ID NO: 802971 - protein, 9 aa, Homo Sapiens
TTRSAPASS

SEQ ID NO: 802972 - protein, 9 aa, Homo Sapiens
LNFVRLNIC

SEQ ID NO: 802973 - protein, 9 aa, Homo Sapiens
HPQQHSQFQ

SEQ ID NO: 802974 - protein, 9 aa, Homo Sapiens
ELSSRSELN

SEQ ID NO: 802975 - protein, 9 aa, Homo Sapiens
SAPSPSSKP

SEQ ID NO: 802976 - protein, 9 aa, Homo Sapiens
AVNICYRRH

SEQ ID NO: 802977 - protein, 9 aa, Homo Sapiens
GDQSCTDIV

SEQ ID NO: 802978 - protein, 9 aa, Homo Sapiens
QVLAFTHIG

SEQ ID NO: 802979 - protein, 9 aa, Homo Sapiens
NHFTMESNK

SEQ ID NO: 802980 - protein, 9 aa, Homo Sapiens
TASTCLCWA

SEQ ID NO: 802981 - protein, 9 aa, Homo Sapiens
NVDHKLKKE

SEQ ID NO: 802982 - protein, 9 aa, Homo Sapiens
LAKELGSYG

SEQ ID NO: 802983 - protein, 9 aa, Homo Sapiens
DLATLPERS

SEQ ID NO: 802984 - protein, 9 aa, Homo Sapiens
PGSSLRPTA

SEQ ID NO: 802985 - protein, 9 aa, Homo Sapiens
AITCIFFTF

SEQ ID NO: 802986 - protein, 9 aa, Homo Sapiens
SAPASSPTW

SEQ ID NO: 802987 - protein, 9 aa, Homo Sapiens
DIGFWFCAG

SEQ ID NO: 802988 - protein, 9 aa, Homo Sapiens
QKPQPPRAQ

SEQ ID NO: 802989 - protein, 9 aa, Homo Sapiens
TPNLTSTGT

SEQ ID NO: 802990 - protein, 9 aa, Homo Sapiens
LTSTGTPPM

SEQ ID NO: 802991 - protein, 9 aa, Homo Sapiens
WAQRLSRKG

SEQ ID NO: 802992 - protein, 9 aa, Homo Sapiens
LQEKAAHPP

SEQ ID NO: 802993 - protein, 9 aa, Homo Sapiens
WVGGILFLV

SEQ ID NO: 802994 - protein, 9 aa, Homo Sapiens
FRHWTLENS

SEQ ID NO: 802995 - protein, 9 aa, Homo Sapiens
PASSPTWGP

SEQ ID NO: 802996 - protein, 9 aa, Homo Sapiens
SSPTWGPHW

SEQ ID NO: 802997 - protein, 9 aa, Homo Sapiens
KAELEGPAQ

SEQ ID NO: 802998 - protein, 9 aa, Homo Sapiens
KLKSMSMSA

SEQ ID NO: 802999 - protein, 9 aa, Homo Sapiens
DIVDTYNKI

SEQ ID NO: 803000 - protein, 9 aa, Homo Sapiens
QRVTVLQPN

SEQ ID NO: 803001 - protein, 9 aa, Homo Sapiens
RPLSPPGAP

SEQ ID NO: 803002 - protein, 9 aa, Homo Sapiens
PPRAQPKMD

SEQ ID NO: 803003 - protein, 9 aa, Homo Sapiens
VICALCRLG

SEQ ID NO: 803004 - protein, 9 aa, Homo Sapiens
RPSQPCSPL

SEQ ID NO: 803005 - protein, 9 aa, Homo Sapiens
QQVYLAILW

SEQ ID NO: 803006 - protein, 9 aa, Homo Sapiens
GMRVLCEML

SEQ ID NO: 803007 - protein, 9 aa, Homo Sapiens
TNETFFVLA

SEQ ID NO: 803008 - protein, 9 aa, Homo Sapiens
ISLSMFVRM

SEQ ID NO: 803009 - protein, 9 aa, Homo Sapiens
SLSMFVRML

SEQ ID NO: 803010 - protein, 9 aa, Homo Sapiens
GLYLHNLLD

SEQ ID NO: 803011 - protein, 9 aa, Homo Sapiens
ITPCTTSMS

SEQ ID NO: 803012 - protein, 9 aa, Homo Sapiens
AKLPLPRPL

SEQ ID NO: 803013 - protein, 9 aa, Homo Sapiens
SAAGGAFRP

SEQ ID NO: 803014 - protein, 9 aa, Homo Sapiens
ENTLWPNLT

SEQ ID NO: 803015 - protein, 9 aa, Homo Sapiens
AAHPPPPEP

SEQ ID NO: 803016 - protein, 9 aa, Homo Sapiens
RARATSDVL

SEQ ID NO: 803017 - protein, 9 aa, Homo Sapiens
YDQKELERK

SEQ ID NO: 803018 - protein, 9 aa, Homo Sapiens
DRTNHQVCS

SEQ ID NO: 803019 - protein, 9 aa, Homo Sapiens
VLCEMLQHP

SEQ ID NO: 803020 - protein, 9 aa, Homo Sapiens
VFRHWTLEN

SEQ ID NO: 803021 - protein, 9 aa, Homo Sapiens
THIGDGSPS

SEQ ID NO: 803022 - protein, 9 aa, Homo Sapiens
LGYCPQENT

SEQ ID NO: 803023 - protein, 9 aa, Homo Sapiens
STLWGCQQA

SEQ ID NO: 803024 - protein, 9 aa, Homo Sapiens
LYLHNLLDL

SEQ ID NO: 803025 - protein, 9 aa, Homo Sapiens
NLTSTGTPP

SEQ ID NO: 803026 - protein, 9 aa, Homo Sapiens
MSNDVCNRR

SEQ ID NO: 803027 - protein, 9 aa, Homo Sapiens
QPCSPLSAP

SEQ ID NO: 803028 - protein, 9 aa, Homo Sapiens
KEMMDLPTC

SEQ ID NO: 803029 - protein, 9 aa, Homo Sapiens
YKINNLCAE

SEQ ID NO: 803030 - protein, 9 aa, Homo Sapiens
HSQFQSPHP

SEQ ID NO: 803031 - protein, 9 aa, Homo Sapiens
TWGPHWPLQ

SEQ ID NO: 803032 - protein, 9 aa, Homo Sapiens
VGGILFLVL

SEQ ID NO: 803033 - protein, 9 aa, Homo Sapiens
SEPCEMDNS

SEQ ID NO: 803034 - protein, 9 aa, Homo Sapiens
WLEALRRFK

SEQ ID NO: 803035 - protein, 9 aa, Homo Sapiens
NSQSALKLS

SEQ ID NO: 803036 - protein, 9 aa, Homo Sapiens
SEAEGRRKA

SEQ ID NO: 803037 - protein, 9 aa, Homo Sapiens
RPRPSQPCS

SEQ ID NO: 803038 - protein, 9 aa, Homo Sapiens
AWGRSKGPL

SEQ ID NO: 803039 - protein, 9 aa, Homo Sapiens
RSKKAELEG

SEQ ID NO: 803040 - protein, 9 aa, Homo Sapiens
RYLNVDHKL

SEQ ID NO: 803041 - protein, 9 aa, Homo Sapiens
PTASTCLCW

SEQ ID NO: 803042 - protein, 9 aa, Homo Sapiens
KINNLCAER

SEQ ID NO: 803043 - protein, 9 aa, Homo Sapiens
YMCDHANLF

SEQ ID NO: 803044 - protein, 9 aa, Homo Sapiens
KKLKKDDEK

SEQ ID NO: 803045 - protein, 9 aa, Homo Sapiens
VRSTRRFVM

SEQ ID NO: 803046 - protein, 9 aa, Homo Sapiens
KRSRYFPTR

SEQ ID NO: 803047 - protein, 9 aa, Homo Sapiens
CTTRCFWST

SEQ ID NO: 803048 - protein, 9 aa, Homo Sapiens
PQQHSQFQS

SEQ ID NO: 803049 - protein, 9 aa, Homo Sapiens
NTKDAVWNS

SEQ ID NO: 803050 - protein, 9 aa, Homo Sapiens
TFFVLAHSP

SEQ ID NO: 803051 - protein, 9 aa, Homo Sapiens
KKDDEKKDT

SEQ ID NO: 803052 - protein, 9 aa, Homo Sapiens
SPPGAPLGL

SEQ ID NO: 803053 - protein, 9 aa, Homo Sapiens
MSMSAAGGA

SEQ ID NO: 803054 - protein, 9 aa, Homo Sapiens
KDDEKKDTK

SEQ ID NO: 803055 - protein, 9 aa, Homo Sapiens
KFEEKVSFE

SEQ ID NO: 803056 - protein, 9 aa, Homo Sapiens
FTMESNKIP

SEQ ID NO: 803057 - protein, 9 aa, Homo Sapiens
QRLSRKGPK

SEQ ID NO: 803058 - protein, 9 aa, Homo Sapiens
NYDQKELER

SEQ ID NO: 803059 - protein, 9 aa, Homo Sapiens
QLAEQELLE

SEQ ID NO: 803060 - protein, 9 aa, Homo Sapiens
WFPSLLTLT

SEQ ID NO: 803061 - protein, 9 aa, Homo Sapiens
RELAIYKQT

SEQ ID NO: 803062 - protein, 9 aa, Homo Sapiens
PCVMAPAPP

SEQ ID NO: 803063 - protein, 9 aa, Homo Sapiens
WSWLEEYNK

SEQ ID NO: 803064 - protein, 9 aa, Homo Sapiens
ASTCLCWAS

SEQ ID NO: 803065 - protein, 9 aa, Homo Sapiens
PPACTTRCF

SEQ ID NO: 803066 - protein, 9 aa, Homo Sapiens
LQPMCPSWP

SEQ ID NO: 803067 - protein, 9 aa, Homo Sapiens
VDIGFWFCA

SEQ ID NO: 803068 - protein, 9 aa, Homo Sapiens
TNITPNLTS

SEQ ID NO: 803069 - protein, 9 aa, Homo Sapiens
VDLSGGDRF

SEQ ID NO: 803070 - protein, 9 aa, Homo Sapiens
KVSFEHFIQ

SEQ ID NO: 803071 - protein, 9 aa, Homo Sapiens
VDHKLKKEI

SEQ ID NO: 803072 - protein, 9 aa, Homo Sapiens
DGPTYILGQ

SEQ ID NO: 803073 - protein, 9 aa, Homo Sapiens
YHKVQNKGL

SEQ ID NO: 803074 - protein, 9 aa, Homo Sapiens
RRKSMQWAQ

SEQ ID NO: 803075 - protein, 9 aa, Homo Sapiens
NLLDLATLP

SEQ ID NO: 803076 - protein, 9 aa, Homo Sapiens
GRRKAVATC

SEQ ID NO: 803077 - protein, 9 aa, Homo Sapiens
VSNHFTMES

SEQ ID NO: 803078 - protein, 9 aa, Homo Sapiens
PVLSDTSRI

SEQ ID NO: 803079 - protein, 9 aa, Homo Sapiens
KNHYKINNL

SEQ ID NO: 803080 - protein, 9 aa, Homo Sapiens
WASTTRSAP

SEQ ID NO: 803081 - protein, 9 aa, Homo Sapiens
NSLAVLVIH

SEQ ID NO: 803082 - protein, 9 aa, Homo Sapiens
KKKLKKDDE

SEQ ID NO: 803083 - protein, 9 aa, Homo Sapiens
MSAAGGAFR

SEQ ID NO: 803084 - protein, 9 aa, Homo Sapiens
SSAPSPSSK

SEQ ID NO: 803085 - protein, 9 aa, Homo Sapiens
APSPSSKPE

SEQ ID NO: 803086 - protein, 9 aa, Homo Sapiens
AAGGVDIGF

SEQ ID NO: 803087 - protein, 9 aa, Homo Sapiens
PVICALCRL

SEQ ID NO: 803088 - protein, 9 aa, Homo Sapiens
LWLAMSSTM

SEQ ID NO: 803089 - protein, 9 aa, Homo Sapiens
LCWASTTRS

SEQ ID NO: 803090 - protein, 9 aa, Homo Sapiens
FSFWVGGIL

SEQ ID NO: 803091 - protein, 9 aa, Homo Sapiens
LLPVLSDTS

SEQ ID NO: 803092 - protein, 9 aa, Homo Sapiens
ALCRLGLGS

SEQ ID NO: 803093 - protein, 9 aa, Homo Sapiens
AYFYMCDHA

SEQ ID NO: 803094 - protein, 9 aa, Homo Sapiens
CAVRSTRRF

SEQ ID NO: 803095 - protein, 9 aa, Homo Sapiens
QNKGLGSCA

SEQ ID NO: 803096 - protein, 9 aa, Homo Sapiens
KKAELEGPA

SEQ ID NO: 803097 - protein, 9 aa, Homo Sapiens
FVRMLQPSG

SEQ ID NO: 803098 - protein, 9 aa, Homo Sapiens
GHVSNHFTM

SEQ ID NO: 803099 - protein, 9 aa, Homo Sapiens
YLTWKEAVQ

SEQ ID NO: 803100 - protein, 9 aa, Homo Sapiens
GERARATSD

SEQ ID NO: 803101 - protein, 9 aa, Homo Sapiens
HKVQNKGLG

SEQ ID NO: 803102 - protein, 9 aa, Homo Sapiens
APGSSLRPT

SEQ ID NO: 803103 - protein, 9 aa, Homo Sapiens
APAPASAPL

SEQ ID NO: 803104 - protein, 9 aa, Homo Sapiens
LCATYGNVN

SEQ ID NO: 803105 - protein, 9 aa, Homo Sapiens
RVTVLQPNP

SEQ ID NO: 803106 - protein, 9 aa, Homo Sapiens
CYRRHHPLN

SEQ ID NO: 803107 - protein, 9 aa, Homo Sapiens
DDEKKDTKK

SEQ ID NO: 803108 - protein, 9 aa, Homo Sapiens
QQHSQFQSP

SEQ ID NO: 803109 - protein, 9 aa, Homo Sapiens
FSLLNFVRL

SEQ ID NO: 803110 - protein, 9 aa, Homo Sapiens
RMLQPSGLL

SEQ ID NO: 803111 - protein, 9 aa, Homo Sapiens
LVIHLKTIH

SEQ ID NO: 803112 - protein, 9 aa, Homo Sapiens
DLPWRGRSG

SEQ ID NO: 803113 - protein, 9 aa, Homo Sapiens
VQVLAFTHI

SEQ ID NO: 803114 - protein, 9 aa, Homo Sapiens
LPVLSDTSR

SEQ ID NO: 803115 - protein, 9 aa, Homo Sapiens
VDGYVDLSG

SEQ ID NO: 803116 - protein, 9 aa, Homo Sapiens
VNICYRRHH

SEQ ID NO: 803117 - protein, 9 aa, Homo Sapiens
NFYLPTILT

SEQ ID NO: 803118 - protein, 9 aa, Homo Sapiens
PLGPSEELL

SEQ ID NO: 803119 - protein, 9 aa, Homo Sapiens
CQACDGPTY

SEQ ID NO: 803120 - protein, 9 aa, Homo Sapiens
PDAVASMFW

SEQ ID NO: 803121 - protein, 9 aa, Homo Sapiens
VDRTNHQVC

SEQ ID NO: 803122 - protein, 9 aa, Homo Sapiens
SCSEEFKEM

SEQ ID NO: 803123 - protein, 9 aa, Homo Sapiens
QWAQRLSRK

SEQ ID NO: 803124 - protein, 9 aa, Homo Sapiens
TVRELAIYK

SEQ ID NO: 803125 - protein, 9 aa, Homo Sapiens
VYLAILWLA

SEQ ID NO: 803126 - protein, 9 aa, Homo Sapiens
HGGSPSNEG

SEQ ID NO: 803127 - protein, 9 aa, Homo Sapiens
SMSNDVCNR

SEQ ID NO: 803128 - protein, 9 aa, Homo Sapiens
PGTSSLVSV

SEQ ID NO: 803129 - protein, 9 aa, Homo Sapiens
LKVRPLCPS

SEQ ID NO: 803130 - protein, 9 aa, Homo Sapiens
KELGSYGKL

SEQ ID NO: 803131 - protein, 9 aa, Homo Sapiens
SFEHFIQSH

SEQ ID NO: 803132 - protein, 9 aa, Homo Sapiens
MESNKIPFA

SEQ ID NO: 803133 - protein, 9 aa, Homo Sapiens
IVDTYNKIK

SEQ ID NO: 803134 - protein, 9 aa, Homo Sapiens
AVWNSVCHT

SEQ ID NO: 803135 - protein, 9 aa, Homo Sapiens
GWNFYLPTI

SEQ ID NO: 803136 - protein, 9 aa, Homo Sapiens
QACDGPTYI

SEQ ID NO: 803137 - protein, 9 aa, Homo Sapiens
RKSMQWAQR

SEQ ID NO: 803138 - protein, 9 aa, Homo Sapiens
ASSPTWGPH

SEQ ID NO: 803139 - protein, 9 aa, Homo Sapiens
FVLAHSPLH

SEQ ID NO: 803140 - protein, 9 aa, Homo Sapiens
YLNVDHKLK

SEQ ID NO: 803141 - protein, 9 aa, Homo Sapiens
AKELGSYGK

SEQ ID NO: 803142 - protein, 9 aa, Homo Sapiens
PRPRPSQPC

SEQ ID NO: 803143 - protein, 9 aa, Homo Sapiens
QSPVFRHWT

SEQ ID NO: 803144 - protein, 9 aa, Homo Sapiens
VRMLQPSGL

SEQ ID NO: 803145 - protein, 9 aa, Homo Sapiens
VLAFTHIGD

SEQ ID NO: 803146 - protein, 9 aa, Homo Sapiens
GYVDLSGGD

SEQ ID NO: 803147 - protein, 9 aa, Homo Sapiens
VRELAIYKQ

SEQ ID NO: 803148 - protein, 9 aa, Homo Sapiens
PICGEWFPS

SEQ ID NO: 803149 - protein, 9 aa, Homo Sapiens
QFLETVREL

SEQ ID NO: 803150 - protein, 9 aa, Homo Sapiens
RKAVATCSS

SEQ ID NO: 803151 - protein, 9 aa, Homo Sapiens
PNLTSTGTP

SEQ ID NO: 803152 - protein, 9 aa, Homo Sapiens
ETFFVLAHS

SEQ ID NO: 803153 - protein, 9 aa, Homo Sapiens
LHSYEKWLY

SEQ ID NO: 803154 - protein, 9 aa, Homo Sapiens
FKEMMDLPT

SEQ ID NO: 803155 - protein, 9 aa, Homo Sapiens
IETSTKTRQ

SEQ ID NO: 803156 - protein, 9 aa, Homo Sapiens
INNLCAERH

SEQ ID NO: 803157 - protein, 9 aa, Homo Sapiens
EGNLSKGEW

SEQ ID NO: 803158 - protein, 9 aa, Homo Sapiens
SWPRPAPCC

SEQ ID NO: 803159 - protein, 9 aa, Homo Sapiens
SAPLGPSEE

SEQ ID NO: 803160 - protein, 9 aa, Homo Sapiens
SMSAAGGAF

SEQ ID NO: 803161 - protein, 9 aa, Homo Sapiens
KLPLPRPLS

SEQ ID NO: 803162 - protein, 9 aa, Homo Sapiens
PAPGSSLRP

SEQ ID NO: 803163 - protein, 9 aa, Homo Sapiens
NKGLGSCAV

SEQ ID NO: 803164 - protein, 9 aa, Homo Sapiens
LGPSEELLR

SEQ ID NO: 803165 - protein, 9 aa, Homo Sapiens
TWKEAVQWE

SEQ ID NO: 803166 - protein, 9 aa, Homo Sapiens
EEFKEMMDL

SEQ ID NO: 803167 - protein, 9 aa, Homo Sapiens
RATSDVLCR

SEQ ID NO: 803168 - protein, 9 aa, Homo Sapiens
QTQWLEALR

SEQ ID NO: 803169 - protein, 9 aa, Homo Sapiens
YMCPICGEW

SEQ ID NO: 803170 - protein, 9 aa, Homo Sapiens
VLQPNPNPV

SEQ ID NO: 803171 - protein, 9 aa, Homo Sapiens
GEWFPSLLT

SEQ ID NO: 803172 - protein, 9 aa, Homo Sapiens
SMFVRMLQP

SEQ ID NO: 803173 - protein, 9 aa, Homo Sapiens
EGERARATS

SEQ ID NO: 803174 - protein, 9 aa, Homo Sapiens
LHNLLDLAT

SEQ ID NO: 803175 - protein, 9 aa, Homo Sapiens
NFVRLNICM

SEQ ID NO: 803176 - protein, 9 aa, Homo Sapiens
RSAPASSPT

SEQ ID NO: 803177 - protein, 9 aa, Homo Sapiens
IQQVYLAIL

SEQ ID NO: 803178 - protein, 9 aa, Homo Sapiens
QFQSPHPQH

SEQ ID NO: 803179 - protein, 9 aa, Homo Sapiens
APPRPPACT

SEQ ID NO: 803180 - protein, 9 aa, Homo Sapiens
STCLCWAST

SEQ ID NO: 803181 - protein, 9 aa, Homo Sapiens
MRVLCEMLQ

SEQ ID NO: 803182 - protein, 9 aa, Homo Sapiens
PTILTLGIT

SEQ ID NO: 803183 - protein, 9 aa, Homo Sapiens
PPVTQRLVV

SEQ ID NO: 803184 - protein, 9 aa, Homo Sapiens
SAWGRSKGP

SEQ ID NO: 803185 - protein, 9 aa, Homo Sapiens
ERSRQLAEQ

SEQ ID NO: 803186 - protein, 9 aa, Homo Sapiens
ITSAWGRSK

SEQ ID NO: 803187 - protein, 9 aa, Homo Sapiens
WRLDLPWRG

SEQ ID NO: 803188 - protein, 9 aa, Homo Sapiens
RLLARFLCE

SEQ ID NO: 803189 - protein, 9 aa, Homo Sapiens
YFYMCDHAN

SEQ ID NO: 803190 - protein, 9 aa, Homo Sapiens
PCSPLSAPP

SEQ ID NO: 803191 - protein, 9 aa, Homo Sapiens
LGWNFYLPT

SEQ ID NO: 803192 - protein, 9 aa, Homo Sapiens
MAYFYMCDH

SEQ ID NO: 803193 - protein, 9 aa, Homo Sapiens
VDTYNKIKA

SEQ ID NO: 803194 - protein, 9 aa, Homo Sapiens
IGFWFCAGN

SEQ ID NO: 803195 - protein, 9 aa, Homo Sapiens
SPVFRHWTL

SEQ ID NO: 803196 - protein, 9 aa, Homo Sapiens
CSEEFKEMM

SEQ ID NO: 803197 - protein, 9 aa, Homo Sapiens
QIGHGGSPS

SEQ ID NO: 803198 - protein, 9 aa, Homo Sapiens
PLSPPGAPL

SEQ ID NO: 803199 - protein, 9 aa, Homo Sapiens
PASAPLGPS

SEQ ID NO: 803200 - protein, 9 aa, Homo Sapiens
CTDIVDTYN

SEQ ID NO: 803201 - protein, 9 aa, Homo Sapiens
LDPLAKELG

SEQ ID NO: 803202 - protein, 9 aa, Homo Sapiens
AVLVIHLKT

SEQ ID NO: 803203 - protein, 9 aa, Homo Sapiens
TMESNKIPF

SEQ ID NO: 803204 - protein, 9 aa, Homo Sapiens
EFKEMMDLP

SEQ ID NO: 803205 - protein, 9 aa, Homo Sapiens
MMDLPTCGA

SEQ ID NO: 803206 - protein, 9 aa, Homo Sapiens
HKNHYKINN

SEQ ID NO: 803207 - protein, 9 aa, Homo Sapiens
PRPSQPCSP

SEQ ID NO: 803208 - protein, 9 aa, Homo Sapiens
STLKTFKRS

SEQ ID NO: 803209 - protein, 9 aa, Homo Sapiens
CPRPRPSQP

SEQ ID NO: 803210 - protein, 9 aa, Homo Sapiens
LKKDDEKKD

SEQ ID NO: 803211 - protein, 9 aa, Homo Sapiens
TQWLEALRR

SEQ ID NO: 803212 - protein, 9 aa, Homo Sapiens
DGYVDLSGG

SEQ ID NO: 803213 - protein, 9 aa, Homo Sapiens
SAPPRPPAC

SEQ ID NO: 803214 - protein, 9 aa, Homo Sapiens
VIHLKTIHA

SEQ ID NO: 803215 - protein, 9 aa, Homo Sapiens
ETSTKTRQR

SEQ ID NO: 803216 - protein, 9 aa, Homo Sapiens
TPCTTSMSN

SEQ ID NO: 803217 - protein, 9 aa, Homo Sapiens
SRPPVTQRL

SEQ ID NO: 803218 - protein, 9 aa, Homo Sapiens
GGVDIGFWF

SEQ ID NO: 803219 - protein, 9 aa, Homo Sapiens
LCEGRLAVL

SEQ ID NO: 803220 - protein, 9 aa, Homo Sapiens
APASSPTWG

SEQ ID NO: 803221 - protein, 9 aa, Homo Sapiens
CVMAPAPPC

SEQ ID NO: 803222 - protein, 9 aa, Homo Sapiens
CTTSMSNDV

SEQ ID NO: 803223 - protein, 9 aa, Homo Sapiens
STGKIKAAE

SEQ ID NO: 803224 - protein, 9 aa, Homo Sapiens
CDGPTYILG

SEQ ID NO: 803225 - protein, 9 aa, Homo Sapiens
LAILWLAMS

SEQ ID NO: 803226 - protein, 9 aa, Homo Sapiens
PTWGPHWPL

SEQ ID NO: 803227 - protein, 9 aa, Homo Sapiens
NLSQTQWLE

SEQ ID NO: 803228 - protein, 9 aa, Homo Sapiens
ADPDAVASM

SEQ ID NO: 803229 - protein, 9 aa, Homo Sapiens
GKIKAAEKK

SEQ ID NO: 803230 - protein, 9 aa, Homo Sapiens
SPVICALCR

SEQ ID NO: 803231 - protein, 9 aa, Homo Sapiens
QWLEALRRF

SEQ ID NO: 803232 - protein, 9 aa, Homo Sapiens
CPQENTLWP

SEQ ID NO: 803233 - protein, 9 aa, Homo Sapiens
PRPLSPPGA

SEQ ID NO: 803234 - protein, 9 aa, Homo Sapiens
PVFRHWTLE

SEQ ID NO: 803235 - protein, 9 aa, Homo Sapiens
YLYHKVQNK

SEQ ID NO: 803236 - protein, 9 aa, Homo Sapiens
KLKKDDEKK

SEQ ID NO: 803237 - protein, 9 aa, Homo Sapiens
PRAQPKMDW

SEQ ID NO: 803238 - protein, 9 aa, Homo Sapiens
GHGGSPSNE

SEQ ID NO: 803239 - protein, 9 aa, Homo Sapiens
SPSSKPEEG

SEQ ID NO: 803240 - protein, 9 aa, Homo Sapiens
RPPACTTRC

SEQ ID NO: 803241 - protein, 9 aa, Homo Sapiens
LSDTSRIAL

SEQ ID NO: 803242 - protein, 9 aa, Homo Sapiens
ARLLARFLC

SEQ ID NO: 803243 - protein, 9 aa, Homo Sapiens
RIAVNICYR

SEQ ID NO: 803244 - protein, 9 aa, Homo Sapiens
APLGLRLLA

SEQ ID NO: 803245 - protein, 9 aa, Homo Sapiens
VAEYLTWKE

SEQ ID NO: 803246 - protein, 9 aa, Homo Sapiens
LPTILTLGI

SEQ ID NO: 803247 - protein, 9 aa, Homo Sapiens
VRLNICMAG

SEQ ID NO: 803248 - protein, 9 aa, Homo Sapiens
ASEPCEMDN

SEQ ID NO: 803249 - protein, 9 aa, Homo Sapiens
CEMDNSQSA

SEQ ID NO: 803250 - protein, 9 aa, Homo Sapiens
TSAWGRSKG

SEQ ID NO: 803251 - protein, 9 aa, Homo Sapiens
YITPCTTSM

SEQ ID NO: 803252 - protein, 9 aa, Homo Sapiens
LRPTASTCL

SEQ ID NO: 803253 - protein, 9 aa, Homo Sapiens
GCQQAKLPL

SEQ ID NO: 803254 - protein, 9 aa, Homo Sapiens
DELSSRSEL

SEQ ID NO: 803255 - protein, 9 aa, Homo Sapiens
TQRLVVPAT

SEQ ID NO: 803256 - protein, 9 aa, Homo Sapiens
LARFLCEGR

SEQ ID NO: 803257 - protein, 9 aa, Homo Sapiens
TYGNVNIRD

SEQ ID NO: 803258 - protein, 9 aa, Homo Sapiens
LPLPRPLSP

SEQ ID NO: 803259 - protein, 9 aa, Homo Sapiens
ARFLCEGRL

SEQ ID NO: 803260 - protein, 9 aa, Homo Sapiens
TKTRQRVED

SEQ ID NO: 803261 - protein, 9 aa, Homo Sapiens
LQPNPNPVF

SEQ ID NO: 803262 - protein, 9 aa, Homo Sapiens
EEKVSFEHF

SEQ ID NO: 803263 - protein, 9 aa, Homo Sapiens
ETVRELAIY

SEQ ID NO: 803264 - protein, 9 aa, Homo Sapiens
AASRPPVTQ

SEQ ID NO: 803265 - protein, 9 aa, Homo Sapiens
ETTGLADPD

SEQ ID NO: 803266 - protein, 9 aa, Homo Sapiens
VWNSVCHTA

SEQ ID NO: 803267 - protein, 9 aa, Homo Sapiens
VRPLCPSVW

SEQ ID NO: 803268 - protein, 9 aa, Homo Sapiens
RPLCPSVWE

SEQ ID NO: 803269 - protein, 9 aa, Homo Sapiens
CQQAKLPLP

SEQ ID NO: 803270 - protein, 9 aa, Homo Sapiens
SDTSRIALM

SEQ ID NO: 803271 - protein, 9 aa, Homo Sapiens
CKFEEKVSF

SEQ ID NO: 803272 - protein, 9 aa, Homo Sapiens
PTYILGQLC

SEQ ID NO: 803273 - protein, 9 aa, Homo Sapiens
RVLCEMLQH

SEQ ID NO: 803274 - protein, 9 aa, Homo Sapiens
KVRPLCPSV

SEQ ID NO: 803275 - protein, 9 aa, Homo Sapiens
SETFLATVE

SEQ ID NO: 803276 - protein, 9 aa, Homo Sapiens
LDLATLPER

SEQ ID NO: 803277 - protein, 9 aa, Homo Sapiens
NAITCIFFT

SEQ ID NO: 803278 - protein, 9 aa, Homo Sapiens
GLTPPCPCV

SEQ ID NO: 803279 - protein, 9 aa, Homo Sapiens
LLNFVRLNI

SEQ ID NO: 803280 - protein, 9 aa, Homo Sapiens
LLPQLAESH

SEQ ID NO: 803281 - protein, 9 aa, Homo Sapiens
FNSLAVLVI

SEQ ID NO: 803282 - protein, 9 aa, Homo Sapiens
YPPPAPGSS

SEQ ID NO: 803283 - protein, 9 aa, Homo Sapiens
FWQFLETVR

SEQ ID NO: 803284 - protein, 9 aa, Homo Sapiens
KDAVWNSVC

SEQ ID NO: 803285 - protein, 9 aa, Homo Sapiens
VQNKGLGSC

SEQ ID NO: 803286 - protein, 9 aa, Homo Sapiens
GLQIGHGGS

SEQ ID NO: 803287 - protein, 9 aa, Homo Sapiens
IITSAWGRS

SEQ ID NO: 803288 - protein, 9 aa, Homo Sapiens
QPNPNPVFE

SEQ ID NO: 803289 - protein, 9 aa, Homo Sapiens
QKELERKRE

SEQ ID NO: 803290 - protein, 9 aa, Homo Sapiens
FYLPTILTL

SEQ ID NO: 803291 - protein, 9 aa, Homo Sapiens
LCEMLQHPG

SEQ ID NO: 803292 - protein, 9 aa, Homo Sapiens
HPPPPEPYT

SEQ ID NO: 803293 - protein, 9 aa, Homo Sapiens
QPMCPSWPR

SEQ ID NO: 803294 - protein, 9 aa, Homo Sapiens
PHPQQHSQF

SEQ ID NO: 803295 - protein, 9 aa, Homo Sapiens
MQWAQRLSR

SEQ ID NO: 803296 - protein, 9 aa, Homo Sapiens
CYPPPAPGS

SEQ ID NO: 803297 - protein, 9 aa, Homo Sapiens
FFVLAHSPL

SEQ ID NO: 803298 - protein, 9 aa, Homo Sapiens
TKDELSSRS

SEQ ID NO: 803299 - protein, 9 aa, Homo Sapiens
LKNTKDAVW

SEQ ID NO: 803300 - protein, 9 aa, Homo Sapiens
NKLKSMSMS

SEQ ID NO: 803301 - protein, 9 aa, Homo Sapiens
QENTLWPNL

SEQ ID NO: 803302 - protein, 9 aa, Homo Sapiens
ETFLATVEE

SEQ ID NO: 803303 - protein, 9 aa, Homo Sapiens
TLWPNLTVR

SEQ ID NO: 803304 - protein, 9 aa, Homo Sapiens
LRPGTSSLV

SEQ ID NO: 803305 - protein, 9 aa, Homo Sapiens
GSSLRPTAS

SEQ ID NO: 803306 - protein, 9 aa, Homo Sapiens
IHTLDPLAK

SEQ ID NO: 803307 - protein, 9 aa, Homo Sapiens
PLSAPPRPP

SEQ ID NO: 803308 - protein, 9 aa, Homo Sapiens
LSMFVRMLQ

SEQ ID NO: 803309 - protein, 9 aa, Homo Sapiens
TVLQPNPNP

SEQ ID NO: 803310 - protein, 9 aa, Homo Sapiens
QEKAAHPPP

SEQ ID NO: 803311 - protein, 9 aa, Homo Sapiens
RLDLPWRGR

SEQ ID NO: 803312 - protein, 9 aa, Homo Sapiens
SLLNFVRLN

SEQ ID NO: 803313 - protein, 9 aa, Homo Sapiens
MDNSQSALK

SEQ ID NO: 803314 - protein, 9 aa, Homo Sapiens
FLCEGRLAV

SEQ ID NO: 803315 - protein, 9 aa, Homo Sapiens
FLETVRELA

SEQ ID NO: 803316 - protein, 9 aa, Homo Sapiens
PFIETSTKT

SEQ ID NO: 803317 - protein, 9 aa, Homo Sapiens
TSMSNDVCN

SEQ ID NO: 803318 - protein, 9 aa, Homo Sapiens
VTQRLVVPA

SEQ ID NO: 803319 - protein, 9 aa, Homo Sapiens
FKRSRYFPT

SEQ ID NO: 803320 - protein, 9 aa, Homo Sapiens
PLGLRLLAC

SEQ ID NO: 803321 - protein, 9 aa, Homo Sapiens
SMSMSAAGG

SEQ ID NO: 803322 - protein, 9 aa, Homo Sapiens
LTWKEAVQW

SEQ ID NO: 803323 - protein, 9 aa, Homo Sapiens
FIETSTKTR

SEQ ID NO: 803324 - protein, 9 aa, Homo Sapiens
EMDNSQSAL

SEQ ID NO: 803325 - protein, 9 aa, Homo Sapiens
WSTLWGCQQ

SEQ ID NO: 803326 - protein, 9 aa, Homo Sapiens
PITKDELSS

SEQ ID NO: 803327 - protein, 9 aa, Homo Sapiens
ELEGPAQPC

SEQ ID NO: 803328 - protein, 9 aa, Homo Sapiens
LTNETFFVL

SEQ ID NO: 803329 - protein, 9 aa, Homo Sapiens
TSRIALMWK

SEQ ID NO: 803330 - protein, 9 aa, Homo Sapiens
YRRHHPLNW

SEQ ID NO: 803331 - protein, 9 aa, Homo Sapiens
CSPLSAPPR

SEQ ID NO: 803332 - protein, 9 aa, Homo Sapiens
PCCPRPRPS

SEQ ID NO: 803333 - protein, 9 aa, Homo Sapiens
TSTGKIKAA

SEQ ID NO: 803334 - protein, 9 aa, Homo Sapiens
STKTRQRVE

SEQ ID NO: 803335 - protein, 9 aa, Homo Sapiens
ESHGTSAGP

SEQ ID NO: 803336 - protein, 9 aa, Homo Sapiens
SWLEEYNKA

SEQ ID NO: 803337 - protein, 9 aa, Homo Sapiens
RCFWSTLWG

SEQ ID NO: 803338 - protein, 9 aa, Homo Sapiens
YLPTILTLG

SEQ ID NO: 803339 - protein, 9 aa, Homo Sapiens
SNHFTMESN

SEQ ID NO: 803340 - protein, 9 aa, Homo Sapiens
TLKTFKRSR

SEQ ID NO: 803341 - protein, 9 aa, Homo Sapiens
WGRSKGPLD

SEQ ID NO: 803342 - protein, 9 aa, Homo Sapiens
FWSTLWGCQ

SEQ ID NO: 803343 - protein, 9 aa, Homo Sapiens
ILCATYGNV

SEQ ID NO: 803344 - protein, 9 aa, Homo Sapiens
AGGVDIGFW

SEQ ID NO: 803345 - protein, 9 aa, Homo Sapiens
LAESHGTSA

SEQ ID NO: 803346 - protein, 9 aa, Homo Sapiens
VLSDTSRIA

SEQ ID NO: 803347 - protein, 9 aa, Homo Sapiens
PSQPCSPLS

SEQ ID NO: 803348 - protein, 9 aa, Homo Sapiens
IFSLLNFVR

SEQ ID NO: 803349 - protein, 9 aa, Homo Sapiens
EKVSFEHFI

SEQ ID NO: 803350 - protein, 9 aa, Homo Sapiens
AFTHIGDGS

SEQ ID NO: 803351 - protein, 9 aa, Homo Sapiens
YVDLSGGDR

SEQ ID NO: 803352 - protein, 9 aa, Homo Sapiens
KAAHPPPPE

SEQ ID NO: 803353 - protein, 9 aa, Homo Sapiens
SPIHFHPES

SEQ ID NO: 803354 - protein, 9 aa, Homo Sapiens
KSFSLGYIY

SEQ ID NO: 803355 - protein, 9 aa, Homo Sapiens
SQSNYMALQ

SEQ ID NO: 803356 - protein, 9 aa, Homo Sapiens
YVLSAQQLQ

SEQ ID NO: 803357 - protein, 9 aa, Homo Sapiens
VTYEVLSLL

SEQ ID NO: 803358 - protein, 9 aa, Homo Sapiens
GRESYMSTL

SEQ ID NO: 803359 - protein, 9 aa, Homo Sapiens
NPGVFLSVC

SEQ ID NO: 803360 - protein, 9 aa, Homo Sapiens
KDVIMQYFP

SEQ ID NO: 803361 - protein, 9 aa, Homo Sapiens
YSIFILYQN

SEQ ID NO: 803362 - protein, 9 aa, Homo Sapiens
AHLSGTVGV

SEQ ID NO: 803363 - protein, 9 aa, Homo Sapiens
ITMVLTMST

SEQ ID NO: 803364 - protein, 9 aa, Homo Sapiens
DTRRLSSSV

SEQ ID NO: 803365 - protein, 9 aa, Homo Sapiens
IRQFHSHGW

SEQ ID NO: 803366 - protein, 9 aa, Homo Sapiens
TRYEQREYG

SEQ ID NO: 803367 - protein, 9 aa, Homo Sapiens
QENVDYVTL

SEQ ID NO: 803368 - protein, 9 aa, Homo Sapiens
LYLVTLGNT

SEQ ID NO: 803369 - protein, 9 aa, Homo Sapiens
LPVLNFCKV

SEQ ID NO: 803370 - protein, 9 aa, Homo Sapiens
PQSRGKTAV

SEQ ID NO: 803371 - protein, 9 aa, Homo Sapiens
KEAHKIMKY

SEQ ID NO: 803372 - protein, 9 aa, Homo Sapiens
LLNKTLHEV

SEQ ID NO: 803373 - protein, 9 aa, Homo Sapiens
RQRDAFGIY

SEQ ID NO: 803374 - protein, 9 aa, Homo Sapiens
LSYSSLMLD

SEQ ID NO: 803375 - protein, 9 aa, Homo Sapiens
HPQPLLHSF

SEQ ID NO: 803376 - protein, 9 aa, Homo Sapiens
CLVIIFISP

SEQ ID NO: 803377 - protein, 9 aa, Homo Sapiens
LSGKWLHSH

SEQ ID NO: 803378 - protein, 9 aa, Homo Sapiens
LAHFYNDFV

SEQ ID NO: 803379 - protein, 9 aa, Homo Sapiens
EMPGPGCYN

SEQ ID NO: 803380 - protein, 9 aa, Homo Sapiens
ISIWNRNAR

SEQ ID NO: 803381 - protein, 9 aa, Homo Sapiens
DKKPLETGV

SEQ ID NO: 803382 - protein, 9 aa, Homo Sapiens
SHRSFTNMS

SEQ ID NO: 803383 - protein, 9 aa, Homo Sapiens
IFELEAIMH

SEQ ID NO: 803384 - protein, 9 aa, Homo Sapiens
PAFYSVEVI

SEQ ID NO: 803385 - protein, 9 aa, Homo Sapiens
VKSCLDILV

SEQ ID NO: 803386 - protein, 9 aa, Homo Sapiens
NYVIKEINK

SEQ ID NO: 803387 - protein, 9 aa, Homo Sapiens
AREGWAVQD

SEQ ID NO: 803388 - protein, 9 aa, Homo Sapiens
HVQQVEKHM

SEQ ID NO: 803389 - protein, 9 aa, Homo Sapiens
GEDGNYIKV

SEQ ID NO: 803390 - protein, 9 aa, Homo Sapiens
GSLIGVGTK

SEQ ID NO: 803391 - protein, 9 aa, Homo Sapiens
RVKSVLPIA

SEQ ID NO: 803392 - protein, 9 aa, Homo Sapiens
EENPGVFLS

SEQ ID NO: 803393 - protein, 9 aa, Homo Sapiens
TSQRYAWPL

SEQ ID NO: 803394 - protein, 9 aa, Homo Sapiens
GGALKLASQ

SEQ ID NO: 803395 - protein, 9 aa, Homo Sapiens
EMYCKSCYG

SEQ ID NO: 803396 - protein, 9 aa, Homo Sapiens
DVQARMLSL

SEQ ID NO: 803397 - protein, 9 aa, Homo Sapiens
NFLRNKPIV

SEQ ID NO: 803398 - protein, 9 aa, Homo Sapiens
DMDNNLNAI

SEQ ID NO: 803399 - protein, 9 aa, Homo Sapiens
CLPLFQLVF

SEQ ID NO: 803400 - protein, 9 aa, Homo Sapiens
RHPALKANS

SEQ ID NO: 803401 - protein, 9 aa, Homo Sapiens
HSSEGRCKA

SEQ ID NO: 803402 - protein, 9 aa, Homo Sapiens
PLARERIAT

SEQ ID NO: 803403 - protein, 9 aa, Homo Sapiens
NNTFNALPR

SEQ ID NO: 803404 - protein, 9 aa, Homo Sapiens
EDSSVAQIY

SEQ ID NO: 803405 - protein, 9 aa, Homo Sapiens
LCPALKIFN

SEQ ID NO: 803406 - protein, 9 aa, Homo Sapiens
KKRPVIVHQ

SEQ ID NO: 803407 - protein, 9 aa, Homo Sapiens
QRKSITCQK

SEQ ID NO: 803408 - protein, 9 aa, Homo Sapiens
KALNARFPG

SEQ ID NO: 803409 - protein, 9 aa, Homo Sapiens
QYTIDYSHF

SEQ ID NO: 803410 - protein, 9 aa, Homo Sapiens
YFVIRIKDG

SEQ ID NO: 803411 - protein, 9 aa, Homo Sapiens
SPTENYFTL

SEQ ID NO: 803412 - protein, 9 aa, Homo Sapiens
ANQDPVYPS

SEQ ID NO: 803413 - protein, 9 aa, Homo Sapiens
HFPLEEVWG

SEQ ID NO: 803414 - protein, 9 aa, Homo Sapiens
EGLCYERQI

SEQ ID NO: 803415 - protein, 9 aa, Homo Sapiens
LDGDKLELL

SEQ ID NO: 803416 - protein, 9 aa, Homo Sapiens
RPAFSLMGL

SEQ ID NO: 803417 - protein, 9 aa, Homo Sapiens
TYTMPHSLR

SEQ ID NO: 803418 - protein, 9 aa, Homo Sapiens
YRMTNQKIQ

SEQ ID NO: 803419 - protein, 9 aa, Homo Sapiens
KERTFKRFT

SEQ ID NO: 803420 - protein, 9 aa, Homo Sapiens
FTMGSGAEE

SEQ ID NO: 803421 - protein, 9 aa, Homo Sapiens
FVAGAVGMT

SEQ ID NO: 803422 - protein, 9 aa, Homo Sapiens
IKKIKYKSL

SEQ ID NO: 803423 - protein, 9 aa, Homo Sapiens
DGENRAHFL

SEQ ID NO: 803424 - protein, 9 aa, Homo Sapiens
PALTVSQVL

SEQ ID NO: 803425 - protein, 9 aa, Homo Sapiens
SKTRLELSN

SEQ ID NO: 803426 - protein, 9 aa, Homo Sapiens
DFHVTVLPK

SEQ ID NO: 803427 - protein, 9 aa, Homo Sapiens
SWWPMKAQH

SEQ ID NO: 803428 - protein, 9 aa, Homo Sapiens
NAGKTLTDA

SEQ ID NO: 803429 - protein, 9 aa, Homo Sapiens
SSLSYLAAT

SEQ ID NO: 803430 - protein, 9 aa, Homo Sapiens
ATFQDVYFV

SEQ ID NO: 803431 - protein, 9 aa, Homo Sapiens
GDNLQCGQG

SEQ ID NO: 803432 - protein, 9 aa, Homo Sapiens
YCLKCAEYN

SEQ ID NO: 803433 - protein, 9 aa, Homo Sapiens
LLPWTNCLP

SEQ ID NO: 803434 - protein, 9 aa, Homo Sapiens
KLLDAEKDI

SEQ ID NO: 803435 - protein, 9 aa, Homo Sapiens
VTDFLDNGY

SEQ ID NO: 803436 - protein, 9 aa, Homo Sapiens
DQRRARMHE

SEQ ID NO: 803437 - protein, 9 aa, Homo Sapiens
TDLSHLIRH

SEQ ID NO: 803438 - protein, 9 aa, Homo Sapiens
SHFSISTIT

SEQ ID NO: 803439 - protein, 9 aa, Homo Sapiens
KAGFTIIYK

SEQ ID NO: 803440 - protein, 9 aa, Homo Sapiens
ISPVPYKDL

SEQ ID NO: 803441 - protein, 9 aa, Homo Sapiens
RGVINEFMG

SEQ ID NO: 803442 - protein, 9 aa, Homo Sapiens
QVQHSETYC

SEQ ID NO: 803443 - protein, 9 aa, Homo Sapiens
NCSISDNKS

SEQ ID NO: 803444 - protein, 9 aa, Homo Sapiens
GDQNCSTIT

SEQ ID NO: 803445 - protein, 9 aa, Homo Sapiens
RSFTLALTS

SEQ ID NO: 803446 - protein, 9 aa, Homo Sapiens
IEGMTVTVH

SEQ ID NO: 803447 - protein, 9 aa, Homo Sapiens
SVNRNKKCI

SEQ ID NO: 803448 - protein, 9 aa, Homo Sapiens
FDRNKQTFS

SEQ ID NO: 803449 - protein, 9 aa, Homo Sapiens
EAQLIGEPP

SEQ ID NO: 803450 - protein, 9 aa, Homo Sapiens
RMHEGNISK

SEQ ID NO: 803451 - protein, 9 aa, Homo Sapiens
SANQRARWC

SEQ ID NO: 803452 - protein, 9 aa, Homo Sapiens
TLVLIGNVE

SEQ ID NO: 803453 - protein, 9 aa, Homo Sapiens
DIHVTRYVV

SEQ ID NO: 803454 - protein, 9 aa, Homo Sapiens
KRYVLLFAK

SEQ ID NO: 803455 - protein, 9 aa, Homo Sapiens
CLAALSCDT

SEQ ID NO: 803456 - protein, 9 aa, Homo Sapiens
LISPHNPLG

SEQ ID NO: 803457 - protein, 9 aa, Homo Sapiens
ENLLHLVDQ

SEQ ID NO: 803458 - protein, 9 aa, Homo Sapiens
YYFLRDTCT

SEQ ID NO: 803459 - protein, 9 aa, Homo Sapiens
SCLSDHFQI

SEQ ID NO: 803460 - protein, 9 aa, Homo Sapiens
EQIVETLSN

SEQ ID NO: 803461 - protein, 9 aa, Homo Sapiens
PFIWPGQMM

SEQ ID NO: 803462 - protein, 9 aa, Homo Sapiens
RYQWKHDYV

SEQ ID NO: 803463 - protein, 9 aa, Homo Sapiens
SEEAAITMV

SEQ ID NO: 803464 - protein, 9 aa, Homo Sapiens
PGLKRFSCL

SEQ ID NO: 803465 - protein, 9 aa, Homo Sapiens
PPPMEPNHP

SEQ ID NO: 803466 - protein, 9 aa, Homo Sapiens
LVGIQYFYS

SEQ ID NO: 803467 - protein, 9 aa, Homo Sapiens
SNVEDNCVN

SEQ ID NO: 803468 - protein, 9 aa, Homo Sapiens
DNLREVNIT

SEQ ID NO: 803469 - protein, 9 aa, Homo Sapiens
DMTNVLEGI

SEQ ID NO: 803470 - protein, 9 aa, Homo Sapiens
RKAYFRWDF

SEQ ID NO: 803471 - protein, 9 aa, Homo Sapiens
WWNNTEYRG

SEQ ID NO: 803472 - protein, 9 aa, Homo Sapiens
ALKRHNLYN

SEQ ID NO: 803473 - protein, 9 aa, Homo Sapiens
CLHTPMYFS

SEQ ID NO: 803474 - protein, 9 aa, Homo Sapiens
QPFGLYPNF

SEQ ID NO: 803475 - protein, 9 aa, Homo Sapiens
EYNLFLRGG

SEQ ID NO: 803476 - protein, 9 aa, Homo Sapiens
CFQLRYRTP

SEQ ID NO: 803477 - protein, 9 aa, Homo Sapiens
WLEPKIYLS

SEQ ID NO: 803478 - protein, 9 aa, Homo Sapiens
RGAWTMSDV

SEQ ID NO: 803479 - protein, 9 aa, Homo Sapiens
HDQTFSEKP

SEQ ID NO: 803480 - protein, 9 aa, Homo Sapiens
SNYPPFCLG

SEQ ID NO: 803481 - protein, 9 aa, Homo Sapiens
VLDKSGSVL

SEQ ID NO: 803482 - protein, 9 aa, Homo Sapiens
GLDCLQWEN

SEQ ID NO: 803483 - protein, 9 aa, Homo Sapiens
KPIEPLNNL

SEQ ID NO: 803484 - protein, 9 aa, Homo Sapiens
QTYFQEFSL

SEQ ID NO: 803485 - protein, 9 aa, Homo Sapiens
AAAPTPTNA

SEQ ID NO: 803486 - protein, 9 aa, Homo Sapiens
ASEPGEGLG

SEQ ID NO: 803487 - protein, 9 aa, Homo Sapiens
QALGIISQE

SEQ ID NO: 803488 - protein, 9 aa, Homo Sapiens
KEGTVEIKL

SEQ ID NO: 803489 - protein, 9 aa, Homo Sapiens
PICTLPTYH

SEQ ID NO: 803490 - protein, 9 aa, Homo Sapiens
FKIGNLFVI

SEQ ID NO: 803491 - protein, 9 aa, Homo Sapiens
LNAGYNVVL

SEQ ID NO: 803492 - protein, 9 aa, Homo Sapiens
RTGRSQKVN

SEQ ID NO: 803493 - protein, 9 aa, Homo Sapiens
TNYYVGSNY

SEQ ID NO: 803494 - protein, 9 aa, Homo Sapiens
AFVVPASIA

SEQ ID NO: 803495 - protein, 9 aa, Homo Sapiens
FLLIQPCIL

SEQ ID NO: 803496 - protein, 9 aa, Homo Sapiens
EHIARKFVP

SEQ ID NO: 803497 - protein, 9 aa, Homo Sapiens
VEKHKREQN

SEQ ID NO: 803498 - protein, 9 aa, Homo Sapiens
KLRVHPLFK

SEQ ID NO: 803499 - protein, 9 aa, Homo Sapiens
NEESGYFVL

SEQ ID NO: 803500 - protein, 9 aa, Homo Sapiens
NIENVPLLV

SEQ ID NO: 803501 - protein, 9 aa, Homo Sapiens
GTQCNNMAT

SEQ ID NO: 803502 - protein, 9 aa, Homo Sapiens
YKIILNDYE

SEQ ID NO: 803503 - protein, 9 aa, Homo Sapiens
LLDVLCEMA

SEQ ID NO: 803504 - protein, 9 aa, Homo Sapiens
ISDPDSQFP

SEQ ID NO: 803505 - protein, 9 aa, Homo Sapiens
SECYHKLDY

SEQ ID NO: 803506 - protein, 9 aa, Homo Sapiens
RLYDNIEDM

SEQ ID NO: 803507 - protein, 9 aa, Homo Sapiens
MNRLIINYL

SEQ ID NO: 803508 - protein, 9 aa, Homo Sapiens
RGHITMKKL

SEQ ID NO: 803509 - protein, 9 aa, Homo Sapiens
YLEEIQSAR

SEQ ID NO: 803510 - protein, 9 aa, Homo Sapiens
ERCNMPLTH

SEQ ID NO: 803511 - protein, 9 aa, Homo Sapiens
LGIGLKHYA

SEQ ID NO: 803512 - protein, 9 aa, Homo Sapiens
QPLNRRAIH

SEQ ID NO: 803513 - protein, 9 aa, Homo Sapiens
VRNKSTHLK

SEQ ID NO: 803514 - protein, 9 aa, Homo Sapiens
KCTLCLSML

SEQ ID NO: 803515 - protein, 9 aa, Homo Sapiens
DITLVELQQ

SEQ ID NO: 803516 - protein, 9 aa, Homo Sapiens
ETSEEKRGF

SEQ ID NO: 803517 - protein, 9 aa, Homo Sapiens
GAEELEYTC

SEQ ID NO: 803518 - protein, 9 aa, Homo Sapiens
IIYYRHFVG

SEQ ID NO: 803519 - protein, 9 aa, Homo Sapiens
AKELPARIF

SEQ ID NO: 803520 - protein, 9 aa, Homo Sapiens
DIIKVGSGP

SEQ ID NO: 803521 - protein, 9 aa, Homo Sapiens
LLNNLIYLK

SEQ ID NO: 803522 - protein, 9 aa, Homo Sapiens
LIPPDTLPL

SEQ ID NO: 803523 - protein, 9 aa, Homo Sapiens
EEKANGPEL

SEQ ID NO: 803524 - protein, 9 aa, Homo Sapiens
AERKETEFV

SEQ ID NO: 803525 - protein, 9 aa, Homo Sapiens
RITLSDFGF

SEQ ID NO: 803526 - protein, 9 aa, Homo Sapiens
DPLAWGENH

SEQ ID NO: 803527 - protein, 9 aa, Homo Sapiens
GNLQRHMVV

SEQ ID NO: 803528 - protein, 9 aa, Homo Sapiens
LAEDKREGY

SEQ ID NO: 803529 - protein, 9 aa, Homo Sapiens
ALVQGVSDS

SEQ ID NO: 803530 - protein, 9 aa, Homo Sapiens
QHQKKHLRD

SEQ ID NO: 803531 - protein, 9 aa, Homo Sapiens
FDKLKLARD

SEQ ID NO: 803532 - protein, 9 aa, Homo Sapiens
MLLNDHKVF

SEQ ID NO: 803533 - protein, 9 aa, Homo Sapiens
RDDKDTIDK

SEQ ID NO: 803534 - protein, 9 aa, Homo Sapiens
KNVQKTWQE

SEQ ID NO: 803535 - protein, 9 aa, Homo Sapiens
KSEEELEEE

SEQ ID NO: 803536 - protein, 9 aa, Homo Sapiens
HELTHKTMP

SEQ ID NO: 803537 - protein, 9 aa, Homo Sapiens
RPPNSPLVP

SEQ ID NO: 803538 - protein, 9 aa, Homo Sapiens
PCLIAPGTK

SEQ ID NO: 803539 - protein, 9 aa, Homo Sapiens
DLSICCGLD

SEQ ID NO: 803540 - protein, 9 aa, Homo Sapiens
AKATVEEED

SEQ ID NO: 803541 - protein, 9 aa, Homo Sapiens
LKRHFVAHK

SEQ ID NO: 803542 - protein, 9 aa, Homo Sapiens
SKCTLIHKP

SEQ ID NO: 803543 - protein, 9 aa, Homo Sapiens
MRLIRFQSV

SEQ ID NO: 803544 - protein, 9 aa, Homo Sapiens
MQEIIHNFV

SEQ ID NO: 803545 - protein, 9 aa, Homo Sapiens
TLQVLGISA

SEQ ID NO: 803546 - protein, 9 aa, Homo Sapiens
AQKNEWPLD

SEQ ID NO: 803547 - protein, 9 aa, Homo Sapiens
KLSPVAVQV

SEQ ID NO: 803548 - protein, 9 aa, Homo Sapiens
TKLGENLQE

SEQ ID NO: 803549 - protein, 9 aa, Homo Sapiens
QEVLFNVIK

SEQ ID NO: 803550 - protein, 9 aa, Homo Sapiens
LPVVLKDVD

SEQ ID NO: 803551 - protein, 9 aa, Homo Sapiens
RPTLQPEPL

SEQ ID NO: 803552 - protein, 9 aa, Homo Sapiens
SAVTATKSP

SEQ ID NO: 803553 - protein, 9 aa, Homo Sapiens
FSPLESNVK

SEQ ID NO: 803554 - protein, 9 aa, Homo Sapiens
VSRKRSSSR

SEQ ID NO: 803555 - protein, 9 aa, Homo Sapiens
LCSRGLQSG

SEQ ID NO: 803556 - protein, 9 aa, Homo Sapiens
SIQLPKAAK

SEQ ID NO: 803557 - protein, 9 aa, Homo Sapiens
YNSPVPEFS

SEQ ID NO: 803558 - protein, 9 aa, Homo Sapiens
QMRAGKGKM

SEQ ID NO: 803559 - protein, 9 aa, Homo Sapiens
RMSSTTVYS

SEQ ID NO: 803560 - protein, 9 aa, Homo Sapiens
SNVWIGLHY

SEQ ID NO: 803561 - protein, 9 aa, Homo Sapiens
FNPIMYSFR

SEQ ID NO: 803562 - protein, 9 aa, Homo Sapiens
NEEIDKFDI

SEQ ID NO: 803563 - protein, 9 aa, Homo Sapiens
GYVTIFGGS

SEQ ID NO: 803564 - protein, 9 aa, Homo Sapiens
ECASHLKKI

SEQ ID NO: 803565 - protein, 9 aa, Homo Sapiens
NGSEEHEDI

SEQ ID NO: 803566 - protein, 9 aa, Homo Sapiens
VAEELTLEQ

SEQ ID NO: 803567 - protein, 9 aa, Homo Sapiens
RTWGNESYV

SEQ ID NO: 803568 - protein, 9 aa, Homo Sapiens
MNRYSTFIV

SEQ ID NO: 803569 - protein, 9 aa, Homo Sapiens
TKLDMARGK

SEQ ID NO: 803570 - protein, 9 aa, Homo Sapiens
TFIFKRNLF

SEQ ID NO: 803571 - protein, 9 aa, Homo Sapiens
LIHLQLFKE

SEQ ID NO: 803572 - protein, 9 aa, Homo Sapiens
ASGTENAFE

SEQ ID NO: 803573 - protein, 9 aa, Homo Sapiens
DLERLALKL

SEQ ID NO: 803574 - protein, 9 aa, Homo Sapiens
EPFQMRIVL

SEQ ID NO: 803575 - protein, 9 aa, Homo Sapiens
VLHDYTIFE

SEQ ID NO: 803576 - protein, 9 aa, Homo Sapiens
YQRTYYMKY

SEQ ID NO: 803577 - protein, 9 aa, Homo Sapiens
SYPTNSYGV

SEQ ID NO: 803578 - protein, 9 aa, Homo Sapiens
LMGRHDFGF

SEQ ID NO: 803579 - protein, 9 aa, Homo Sapiens
PLVTFNLLG

SEQ ID NO: 803580 - protein, 9 aa, Homo Sapiens
KGGKKGDKK

SEQ ID NO: 803581 - protein, 9 aa, Homo Sapiens
TTPPNSMES

SEQ ID NO: 803582 - protein, 9 aa, Homo Sapiens
RARVENIIW

SEQ ID NO: 803583 - protein, 9 aa, Homo Sapiens
SGVVQMPEY

SEQ ID NO: 803584 - protein, 9 aa, Homo Sapiens
PGYVTIFGG

SEQ ID NO: 803585 - protein, 9 aa, Homo Sapiens
LIIHQQTHT

SEQ ID NO: 803586 - protein, 9 aa, Homo Sapiens
GYQDVNTSL

SEQ ID NO: 803587 - protein, 9 aa, Homo Sapiens
KNLEEAKII

SEQ ID NO: 803588 - protein, 9 aa, Homo Sapiens
LGLNSRLYK

SEQ ID NO: 803589 - protein, 9 aa, Homo Sapiens
QHARKKLRS

SEQ ID NO: 803590 - protein, 9 aa, Homo Sapiens
QPMIKKACK

SEQ ID NO: 803591 - protein, 9 aa, Homo Sapiens
TIAAEFKKE

SEQ ID NO: 803592 - protein, 9 aa, Homo Sapiens
SYCIEGFCC

SEQ ID NO: 803593 - protein, 9 aa, Homo Sapiens
DQGLYSWLL

SEQ ID NO: 803594 - protein, 9 aa, Homo Sapiens
CDKAFINQA

SEQ ID NO: 803595 - protein, 9 aa, Homo Sapiens
LLLVQAGAW

SEQ ID NO: 803596 - protein, 9 aa, Homo Sapiens
SWCLNKPGH

SEQ ID NO: 803597 - protein, 9 aa, Homo Sapiens
RVIFWGRIL

SEQ ID NO: 803598 - protein, 9 aa, Homo Sapiens
ERQIHTLQD

SEQ ID NO: 803599 - protein, 9 aa, Homo Sapiens
WNYKAPAPV

SEQ ID NO: 803600 - protein, 9 aa, Homo Sapiens
VVVAGNIFL

SEQ ID NO: 803601 - protein, 9 aa, Homo Sapiens
LFLVFNDNE

SEQ ID NO: 803602 - protein, 9 aa, Homo Sapiens
ETFTMGSGA

SEQ ID NO: 803603 - protein, 9 aa, Homo Sapiens
HRKKRSSSA

SEQ ID NO: 803604 - protein, 9 aa, Homo Sapiens
KGQRGATLG

SEQ ID NO: 803605 - protein, 9 aa, Homo Sapiens
HIARVLKLL

SEQ ID NO: 803606 - protein, 9 aa, Homo Sapiens
HDFGYFYGS

SEQ ID NO: 803607 - protein, 9 aa, Homo Sapiens
NDKVFVASV

SEQ ID NO: 803608 - protein, 9 aa, Homo Sapiens
LTNLADRGL

SEQ ID NO: 803609 - protein, 9 aa, Homo Sapiens
LNILEIPGP

SEQ ID NO: 803610 - protein, 9 aa, Homo Sapiens
SHPNIIKRK

SEQ ID NO: 803611 - protein, 9 aa, Homo Sapiens
SEYVYKVVV

SEQ ID NO: 803612 - protein, 9 aa, Homo Sapiens
PFCCEFDSQ

SEQ ID NO: 803613 - protein, 9 aa, Homo Sapiens
WISHDPHNR

SEQ ID NO: 803614 - protein, 9 aa, Homo Sapiens
EIDNLHRTF

SEQ ID NO: 803615 - protein, 9 aa, Homo Sapiens
HMFQIYQTS

SEQ ID NO: 803616 - protein, 9 aa, Homo Sapiens
DHLGIELME

SEQ ID NO: 803617 - protein, 9 aa, Homo Sapiens
KPISKKPTM

SEQ ID NO: 803618 - protein, 9 aa, Homo Sapiens
LEGNQIEII

SEQ ID NO: 803619 - protein, 9 aa, Homo Sapiens
LHYRFARIA

SEQ ID NO: 803620 - protein, 9 aa, Homo Sapiens
DSSQTKKQP

SEQ ID NO: 803621 - protein, 9 aa, Homo Sapiens
TEYCNKCEF

SEQ ID NO: 803622 - protein, 9 aa, Homo Sapiens
CHRILHSGE

SEQ ID NO: 803623 - protein, 9 aa, Homo Sapiens
TSTLSSKSA

SEQ ID NO: 803624 - protein, 9 aa, Homo Sapiens
DQGPSSFYF

SEQ ID NO: 803625 - protein, 9 aa, Homo Sapiens
IVPVLNPFI

SEQ ID NO: 803626 - protein, 9 aa, Homo Sapiens
TDLQPNTEY

SEQ ID NO: 803627 - protein, 9 aa, Homo Sapiens
ALVGVMPHE

SEQ ID NO: 803628 - protein, 9 aa, Homo Sapiens
ADSIDIYIP

SEQ ID NO: 803629 - protein, 9 aa, Homo Sapiens
KSPLETLTL

SEQ ID NO: 803630 - protein, 9 aa, Homo Sapiens
NLRWTVALL

SEQ ID NO: 803631 - protein, 9 aa, Homo Sapiens
KGVSNNVTQ

SEQ ID NO: 803632 - protein, 9 aa, Homo Sapiens
ENCMAIDKL

SEQ ID NO: 803633 - protein, 9 aa, Homo Sapiens
DLSYGVLSF

SEQ ID NO: 803634 - protein, 9 aa, Homo Sapiens
LTQTANKNN

SEQ ID NO: 803635 - protein, 9 aa, Homo Sapiens
SFPKTNHHM

SEQ ID NO: 803636 - protein, 9 aa, Homo Sapiens
LKEDLDALT

SEQ ID NO: 803637 - protein, 9 aa, Homo Sapiens
MVLLPSYPV

SEQ ID NO: 803638 - protein, 9 aa, Homo Sapiens
FNTAVCERK

SEQ ID NO: 803639 - protein, 9 aa, Homo Sapiens
MQDGPKAGQ

SEQ ID NO: 803640 - protein, 9 aa, Homo Sapiens
CLLLNVQPD

SEQ ID NO: 803641 - protein, 9 aa, Homo Sapiens
ENRAHFLPG

SEQ ID NO: 803642 - protein, 9 aa, Homo Sapiens
VWNSYQLCN

SEQ ID NO: 803643 - protein, 9 aa, Homo Sapiens
IIRCKRKLG

SEQ ID NO: 803644 - protein, 9 aa, Homo Sapiens
SVGLCVHVC

SEQ ID NO: 803645 - protein, 9 aa, Homo Sapiens
DALDHFVLF

SEQ ID NO: 803646 - protein, 9 aa, Homo Sapiens
GMEITNCSR

SEQ ID NO: 803647 - protein, 9 aa, Homo Sapiens
LNTNIRALQ

SEQ ID NO: 803648 - protein, 9 aa, Homo Sapiens
SEIKEIGSK

SEQ ID NO: 803649 - protein, 9 aa, Homo Sapiens
SSKFQEGVE

SEQ ID NO: 803650 - protein, 9 aa, Homo Sapiens
QSQLEKLDI

SEQ ID NO: 803651 - protein, 9 aa, Homo Sapiens
PSMTNWSPA

SEQ ID NO: 803652 - protein, 9 aa, Homo Sapiens
RILNTHLST

SEQ ID NO: 803653 - protein, 9 aa, Homo Sapiens
ADTPRINSS

SEQ ID NO: 803654 - protein, 9 aa, Homo Sapiens
TDIKELFPD

SEQ ID NO: 803655 - protein, 9 aa, Homo Sapiens
DLPEDQLRG

SEQ ID NO: 803656 - protein, 9 aa, Homo Sapiens
RLEHHAKLK

SEQ ID NO: 803657 - protein, 9 aa, Homo Sapiens
PCVLNNKKV

SEQ ID NO: 803658 - protein, 9 aa, Homo Sapiens
LGEKRYKCD

SEQ ID NO: 803659 - protein, 9 aa, Homo Sapiens
RIHQQGQGD

SEQ ID NO: 803660 - protein, 9 aa, Homo Sapiens
DPTRRLFKV

SEQ ID NO: 803661 - protein, 9 aa, Homo Sapiens
VKSRSNSGC

SEQ ID NO: 803662 - protein, 9 aa, Homo Sapiens
WKNCSRWKC

SEQ ID NO: 803663 - protein, 9 aa, Homo Sapiens
SQTRMATMG

SEQ ID NO: 803664 - protein, 9 aa, Homo Sapiens
SSSYNDQLF

SEQ ID NO: 803665 - protein, 9 aa, Homo Sapiens
GPPVLTQEE

SEQ ID NO: 803666 - protein, 9 aa, Homo Sapiens
IQNRLQDIA

SEQ ID NO: 803667 - protein, 9 aa, Homo Sapiens
CEKLYLFPL

SEQ ID NO: 803668 - protein, 9 aa, Homo Sapiens
ERDLIKGVN

SEQ ID NO: 803669 - protein, 9 aa, Homo Sapiens
KYLAEINEI

SEQ ID NO: 803670 - protein, 9 aa, Homo Sapiens
SGVGKRCDT

SEQ ID NO: 803671 - protein, 9 aa, Homo Sapiens
LPAGFLYLQ

SEQ ID NO: 803672 - protein, 9 aa, Homo Sapiens
PKLVQIINS

SEQ ID NO: 803673 - protein, 9 aa, Homo Sapiens
QITGPGILQ

SEQ ID NO: 803674 - protein, 9 aa, Homo Sapiens
RYIKWTQIE

SEQ ID NO: 803675 - protein, 9 aa, Homo Sapiens
YSFKHQRIV

SEQ ID NO: 803676 - protein, 9 aa, Homo Sapiens
EVASHSPAC

SEQ ID NO: 803677 - protein, 9 aa, Homo Sapiens
QEMEEAKDN

SEQ ID NO: 803678 - protein, 9 aa, Homo Sapiens
KFNKRKEQG

SEQ ID NO: 803679 - protein, 9 aa, Homo Sapiens
SAGKMNGRV

SEQ ID NO: 803680 - protein, 9 aa, Homo Sapiens
DIQVPGASH

SEQ ID NO: 803681 - protein, 9 aa, Homo Sapiens
KRWLDSESS

SEQ ID NO: 803682 - protein, 9 aa, Homo Sapiens
MAHKSERSS

SEQ ID NO: 803683 - protein, 9 aa, Homo Sapiens
GEINQEELI

SEQ ID NO: 803684 - protein, 9 aa, Homo Sapiens
LGLYTDQAF

SEQ ID NO: 803685 - protein, 9 aa, Homo Sapiens
TMYNVLAYI

SEQ ID NO: 803686 - protein, 9 aa, Homo Sapiens
MAAGAVFMA

SEQ ID NO: 803687 - protein, 9 aa, Homo Sapiens
IYLTLEILG

SEQ ID NO: 803688 - protein, 9 aa, Homo Sapiens
WSGDPFIKD

SEQ ID NO: 803689 - protein, 9 aa, Homo Sapiens
DASGGEQDQ

SEQ ID NO: 803690 - protein, 9 aa, Homo Sapiens
TPNLKCLDV

SEQ ID NO: 803691 - protein, 9 aa, Homo Sapiens
ALEPFIYDA

SEQ ID NO: 803692 - protein, 9 aa, Homo Sapiens
EVVDKQLQQ

SEQ ID NO: 803693 - protein, 9 aa, Homo Sapiens
YLPGCQDIA

SEQ ID NO: 803694 - protein, 9 aa, Homo Sapiens
KKDGKKRKG

SEQ ID NO: 803695 - protein, 9 aa, Homo Sapiens
FSLMGLSLF

SEQ ID NO: 803696 - protein, 9 aa, Homo Sapiens
VTSALRMPS

SEQ ID NO: 803697 - protein, 9 aa, Homo Sapiens
RITRNFSNY

SEQ ID NO: 803698 - protein, 9 aa, Homo Sapiens
WKAMKGLGT

SEQ ID NO: 803699 - protein, 9 aa, Homo Sapiens
PSIKTPLGT

SEQ ID NO: 803700 - protein, 9 aa, Homo Sapiens
PTPACKNLD

SEQ ID NO: 803701 - protein, 9 aa, Homo Sapiens
ERTFYLVAD

SEQ ID NO: 803702 - protein, 9 aa, Homo Sapiens
KSFSNLANN

SEQ ID NO: 803703 - protein, 9 aa, Homo Sapiens
NRFWLETLL

SEQ ID NO: 803704 - protein, 9 aa, Homo Sapiens
ESSLGVLRA

SEQ ID NO: 803705 - protein, 9 aa, Homo Sapiens
AIKCKFYHP

SEQ ID NO: 803706 - protein, 9 aa, Homo Sapiens
MILQLGGGP

SEQ ID NO: 803707 - protein, 9 aa, Homo Sapiens
PQPLPWDQC

SEQ ID NO: 803708 - protein, 9 aa, Homo Sapiens
KGVLVGCKL

SEQ ID NO: 803709 - protein, 9 aa, Homo Sapiens
KKTFDECQQ

SEQ ID NO: 803710 - protein, 9 aa, Homo Sapiens
LVPEVDTID

SEQ ID NO: 803711 - protein, 9 aa, Homo Sapiens
TFGREELFG

SEQ ID NO: 803712 - protein, 9 aa, Homo Sapiens
AIWKHNKFH

SEQ ID NO: 803713 - protein, 9 aa, Homo Sapiens
PSKNYFISY

SEQ ID NO: 803714 - protein, 9 aa, Homo Sapiens
TVPFHLWIR

SEQ ID NO: 803715 - protein, 9 aa, Homo Sapiens
SSIQMISVQ

SEQ ID NO: 803716 - protein, 9 aa, Homo Sapiens
CSKRSSHHR

SEQ ID NO: 803717 - protein, 9 aa, Homo Sapiens
LLGEEKFSY

SEQ ID NO: 803718 - protein, 9 aa, Homo Sapiens
SGNENGELY

SEQ ID NO: 803719 - protein, 9 aa, Homo Sapiens
GRYVSAEIF

SEQ ID NO: 803720 - protein, 9 aa, Homo Sapiens
LQISVADEA

SEQ ID NO: 803721 - protein, 9 aa, Homo Sapiens
YAKCRALSK

SEQ ID NO: 803722 - protein, 9 aa, Homo Sapiens
GHGRLLRRT

SEQ ID NO: 803723 - protein, 9 aa, Homo Sapiens
TGNETFAGG

SEQ ID NO: 803724 - protein, 9 aa, Homo Sapiens
AKVKRVGDT

SEQ ID NO: 803725 - protein, 9 aa, Homo Sapiens
ELPTALTQL

SEQ ID NO: 803726 - protein, 9 aa, Homo Sapiens
SIKGTSQKE

SEQ ID NO: 803727 - protein, 9 aa, Homo Sapiens
LLKNDTSDV

SEQ ID NO: 803728 - protein, 9 aa, Homo Sapiens
HGIITNWDY

SEQ ID NO: 803729 - protein, 9 aa, Homo Sapiens
NFQGIVKHL

SEQ ID NO: 803730 - protein, 9 aa, Homo Sapiens
LNGCHLPFF

SEQ ID NO: 803731 - protein, 9 aa, Homo Sapiens
IHKQGDKSK

SEQ ID NO: 803732 - protein, 9 aa, Homo Sapiens
TGPKGQGKY

SEQ ID NO: 803733 - protein, 9 aa, Homo Sapiens
RHFNSNCKG

SEQ ID NO: 803734 - protein, 9 aa, Homo Sapiens
LFIQVEAAY

SEQ ID NO: 803735 - protein, 9 aa, Homo Sapiens
QTEPVVLVF

SEQ ID NO: 803736 - protein, 9 aa, Homo Sapiens
EITGYTLDV

SEQ ID NO: 803737 - protein, 9 aa, Homo Sapiens
SPSSCLMGR

SEQ ID NO: 803738 - protein, 9 aa, Homo Sapiens
VDLLGPNQT

SEQ ID NO: 803739 - protein, 9 aa, Homo Sapiens
ATTLFTYTM

SEQ ID NO: 803740 - protein, 9 aa, Homo Sapiens
YIVIEDPFY

SEQ ID NO: 803741 - protein, 9 aa, Homo Sapiens
HGSDTPNPE

SEQ ID NO: 803742 - protein, 9 aa, Homo Sapiens
ARRITRVQR

SEQ ID NO: 803743 - protein, 9 aa, Homo Sapiens
PGEQTSYGT

SEQ ID NO: 803744 - protein, 9 aa, Homo Sapiens
LSPRQTAPR

SEQ ID NO: 803745 - protein, 9 aa, Homo Sapiens
PAWQKLSDG

SEQ ID NO: 803746 - protein, 9 aa, Homo Sapiens
KWSYFPSEA

SEQ ID NO: 803747 - protein, 9 aa, Homo Sapiens
EYLKESYFD

SEQ ID NO: 803748 - protein, 9 aa, Homo Sapiens
RPYSFIECD

SEQ ID NO: 803749 - protein, 9 aa, Homo Sapiens
AQGLGQSLA

SEQ ID NO: 803750 - protein, 9 aa, Homo Sapiens
PEHRAGLLT

SEQ ID NO: 803751 - protein, 9 aa, Homo Sapiens
NVSPKGMMK

SEQ ID NO: 803752 - protein, 9 aa, Homo Sapiens
ACWIIEDTA

SEQ ID NO: 803753 - protein, 9 aa, Homo Sapiens
LAVDEQLEH

SEQ ID NO: 803754 - protein, 9 aa, Homo Sapiens
LNMALGLMR

SEQ ID NO: 803755 - protein, 9 aa, Homo Sapiens
KTLQKKDVL

SEQ ID NO: 803756 - protein, 9 aa, Homo Sapiens
VVKSAVDFH

SEQ ID NO: 803757 - protein, 9 aa, Homo Sapiens
ANQRARWCS

SEQ ID NO: 803758 - protein, 9 aa, Homo Sapiens
YEQHNQQGS

SEQ ID NO: 803759 - protein, 9 aa, Homo Sapiens
TLQPEPLSY

SEQ ID NO: 803760 - protein, 9 aa, Homo Sapiens
WMTQQEYQE

SEQ ID NO: 803761 - protein, 9 aa, Homo Sapiens
FMYSQSNIS

SEQ ID NO: 803762 - protein, 9 aa, Homo Sapiens
KIDLVCNAM

SEQ ID NO: 803763 - protein, 9 aa, Homo Sapiens
RFSEVHGAD

SEQ ID NO: 803764 - protein, 9 aa, Homo Sapiens
GSKVQEQHD

SEQ ID NO: 803765 - protein, 9 aa, Homo Sapiens
DSTSSVSVG

SEQ ID NO: 803766 - protein, 9 aa, Homo Sapiens
NWFTDLECK

SEQ ID NO: 803767 - protein, 9 aa, Homo Sapiens
HKEELEGQS

SEQ ID NO: 803768 - protein, 9 aa, Homo Sapiens
TVTENMYLT

SEQ ID NO: 803769 - protein, 9 aa, Homo Sapiens
WKPSFGRKV

SEQ ID NO: 803770 - protein, 9 aa, Homo Sapiens
HEEHMAENK

SEQ ID NO: 803771 - protein, 9 aa, Homo Sapiens
LAPLAKILK

SEQ ID NO: 803772 - protein, 9 aa, Homo Sapiens
RMVESAPKQ

SEQ ID NO: 803773 - protein, 9 aa, Homo Sapiens
TPTAQTFDW

SEQ ID NO: 803774 - protein, 9 aa, Homo Sapiens
CLQYYDSYN

SEQ ID NO: 803775 - protein, 9 aa, Homo Sapiens
LLEEKVCAL

SEQ ID NO: 803776 - protein, 9 aa, Homo Sapiens
DTHVKTKHA

SEQ ID NO: 803777 - protein, 9 aa, Homo Sapiens
YCSMLCKAL

SEQ ID NO: 803778 - protein, 9 aa, Homo Sapiens
VQTNIFEEN

SEQ ID NO: 803779 - protein, 9 aa, Homo Sapiens
KRKSPTKKE

SEQ ID NO: 803780 - protein, 9 aa, Homo Sapiens
YICDFHKNV

SEQ ID NO: 803781 - protein, 9 aa, Homo Sapiens
KDIEHLESF

SEQ ID NO: 803782 - protein, 9 aa, Homo Sapiens
RGRFWSGNY

SEQ ID NO: 803783 - protein, 9 aa, Homo Sapiens
ECLKQLFVT

SEQ ID NO: 803784 - protein, 9 aa, Homo Sapiens
PLGSVVINE

SEQ ID NO: 803785 - protein, 9 aa, Homo Sapiens
LSTDLDRPE

SEQ ID NO: 803786 - protein, 9 aa, Homo Sapiens
LYNSEESHP

SEQ ID NO: 803787 - protein, 9 aa, Homo Sapiens
STGISYLIP

SEQ ID NO: 803788 - protein, 9 aa, Homo Sapiens
CTYAIKCKF

SEQ ID NO: 803789 - protein, 9 aa, Homo Sapiens
DDFADCMDF

SEQ ID NO: 803790 - protein, 9 aa, Homo Sapiens
HAVQAYSEV

SEQ ID NO: 803791 - protein, 9 aa, Homo Sapiens
YKFYPCEEC

SEQ ID NO: 803792 - protein, 9 aa, Homo Sapiens
TYDSTSEQR

SEQ ID NO: 803793 - protein, 9 aa, Homo Sapiens
KIEFEDVIA

SEQ ID NO: 803794 - protein, 9 aa, Homo Sapiens
DKPEAKATV

SEQ ID NO: 803795 - protein, 9 aa, Homo Sapiens
YSGRETLYS

SEQ ID NO: 803796 - protein, 9 aa, Homo Sapiens
ELNRAMANC

SEQ ID NO: 803797 - protein, 9 aa, Homo Sapiens
EDCQLSISD

SEQ ID NO: 803798 - protein, 9 aa, Homo Sapiens
FDEPLLKIT

SEQ ID NO: 803799 - protein, 9 aa, Homo Sapiens
GERSARLTR

SEQ ID NO: 803800 - protein, 9 aa, Homo Sapiens
VTIDNAKDT

SEQ ID NO: 803801 - protein, 9 aa, Homo Sapiens
KGEHLSKKA

SEQ ID NO: 803802 - protein, 9 aa, Homo Sapiens
QNQLLRGNR

SEQ ID NO: 803803 - protein, 9 aa, Homo Sapiens
QEDPGAQCL

SEQ ID NO: 803804 - protein, 9 aa, Homo Sapiens
TEEHILKRV

SEQ ID NO: 803805 - protein, 9 aa, Homo Sapiens
KALVFLFTL

SEQ ID NO: 803806 - protein, 9 aa, Homo Sapiens
VRWDLHVST

SEQ ID NO: 803807 - protein, 9 aa, Homo Sapiens
PFRQPTYTD

SEQ ID NO: 803808 - protein, 9 aa, Homo Sapiens
SIATLLLQI

SEQ ID NO: 803809 - protein, 9 aa, Homo Sapiens
INLCDSTQA

SEQ ID NO: 803810 - protein, 9 aa, Homo Sapiens
YKLYGGKLI

SEQ ID NO: 803811 - protein, 9 aa, Homo Sapiens
KTKGNGFEM

SEQ ID NO: 803812 - protein, 9 aa, Homo Sapiens
CAVFGLGGA

SEQ ID NO: 803813 - protein, 9 aa, Homo Sapiens
HEITHLAGR

SEQ ID NO: 803814 - protein, 9 aa, Homo Sapiens
NGHQLLDTC

SEQ ID NO: 803815 - protein, 9 aa, Homo Sapiens
PDNVQLVNQ

SEQ ID NO: 803816 - protein, 9 aa, Homo Sapiens
YILALAAAD

SEQ ID NO: 803817 - protein, 9 aa, Homo Sapiens
PLPKGACTC

SEQ ID NO: 803818 - protein, 9 aa, Homo Sapiens
DSRYQHLFE

SEQ ID NO: 803819 - protein, 9 aa, Homo Sapiens
TMSPFCQIR

SEQ ID NO: 803820 - protein, 9 aa, Homo Sapiens
QVVKLTEEL

SEQ ID NO: 803821 - protein, 9 aa, Homo Sapiens
ANVHRKASV

SEQ ID NO: 803822 - protein, 9 aa, Homo Sapiens
IAADRIRHK

SEQ ID NO: 803823 - protein, 9 aa, Homo Sapiens
TLELEGISP

SEQ ID NO: 803824 - protein, 9 aa, Homo Sapiens
PRIRKTQKL

SEQ ID NO: 803825 - protein, 9 aa, Homo Sapiens
NAIQGGVED

SEQ ID NO: 803826 - protein, 9 aa, Homo Sapiens
KKNIFHMVP

SEQ ID NO: 803827 - protein, 9 aa, Homo Sapiens
YAEELASQG

SEQ ID NO: 803828 - protein, 9 aa, Homo Sapiens
VFPYTLLLV

SEQ ID NO: 803829 - protein, 9 aa, Homo Sapiens
PKIIKVTVN

SEQ ID NO: 803830 - protein, 9 aa, Homo Sapiens
LKLPLQFQR

SEQ ID NO: 803831 - protein, 9 aa, Homo Sapiens
SPCCVSQYL

SEQ ID NO: 803832 - protein, 9 aa, Homo Sapiens
CCDDSQRVK

SEQ ID NO: 803833 - protein, 9 aa, Homo Sapiens
CSFHPIPTQ

SEQ ID NO: 803834 - protein, 9 aa, Homo Sapiens
HEQHLFYIH

SEQ ID NO: 803835 - protein, 9 aa, Homo Sapiens
GARLTCHIL

SEQ ID NO: 803836 - protein, 9 aa, Homo Sapiens
KIHPPADWQ

SEQ ID NO: 803837 - protein, 9 aa, Homo Sapiens
LADCSEACL

SEQ ID NO: 803838 - protein, 9 aa, Homo Sapiens
SIIVISTPN

SEQ ID NO: 803839 - protein, 9 aa, Homo Sapiens
QLAQLYGPE

SEQ ID NO: 803840 - protein, 9 aa, Homo Sapiens
YPETELYAV

SEQ ID NO: 803841 - protein, 9 aa, Homo Sapiens
VKKQIKHTM

SEQ ID NO: 803842 - protein, 9 aa, Homo Sapiens
VFPWIIHAY

SEQ ID NO: 803843 - protein, 9 aa, Homo Sapiens
EAFRTKENL

SEQ ID NO: 803844 - protein, 9 aa, Homo Sapiens
REFNMNLLS

SEQ ID NO: 803845 - protein, 9 aa, Homo Sapiens
NIPENIYRG

SEQ ID NO: 803846 - protein, 9 aa, Homo Sapiens
VKQQLENKK

SEQ ID NO: 803847 - protein, 9 aa, Homo Sapiens
QDTAEALTA

SEQ ID NO: 803848 - protein, 9 aa, Homo Sapiens
TLILSIHSC

SEQ ID NO: 803849 - protein, 9 aa, Homo Sapiens
EQRKKICEQ

SEQ ID NO: 803850 - protein, 9 aa, Homo Sapiens
YYLCLDKKK

SEQ ID NO: 803851 - protein, 9 aa, Homo Sapiens
LYHTEVAYG

SEQ ID NO: 803852 - protein, 9 aa, Homo Sapiens
FIYGHKYYF

SEQ ID NO: 803853 - protein, 9 aa, Homo Sapiens
IKDGHLVNL

SEQ ID NO: 803854 - protein, 9 aa, Homo Sapiens
SSPSELPVK

SEQ ID NO: 803855 - protein, 9 aa, Homo Sapiens
PDISDEVTC

SEQ ID NO: 803856 - protein, 9 aa, Homo Sapiens
LMFKDLKLR

SEQ ID NO: 803857 - protein, 9 aa, Homo Sapiens
AVLYVKEEM

SEQ ID NO: 803858 - protein, 9 aa, Homo Sapiens
GGSKSDGEE

SEQ ID NO: 803859 - protein, 9 aa, Homo Sapiens
FQAMDGRFW

SEQ ID NO: 803860 - protein, 9 aa, Homo Sapiens
CHGCLKWSM

SEQ ID NO: 803861 - protein, 9 aa, Homo Sapiens
NYFFVEIRG

SEQ ID NO: 803862 - protein, 9 aa, Homo Sapiens
VLQGYNNRN

SEQ ID NO: 803863 - protein, 9 aa, Homo Sapiens
QNKSLNLKH

SEQ ID NO: 803864 - protein, 9 aa, Homo Sapiens
IGLKHYAEY

SEQ ID NO: 803865 - protein, 9 aa, Homo Sapiens
LFFGTYFCV

SEQ ID NO: 803866 - protein, 9 aa, Homo Sapiens
KIAKYMNHL

SEQ ID NO: 803867 - protein, 9 aa, Homo Sapiens
TIPNALIGS

SEQ ID NO: 803868 - protein, 9 aa, Homo Sapiens
DHVKKDYLR

SEQ ID NO: 803869 - protein, 9 aa, Homo Sapiens
ANPGKIITI

SEQ ID NO: 803870 - protein, 9 aa, Homo Sapiens
DCSINGQWD

SEQ ID NO: 803871 - protein, 9 aa, Homo Sapiens
NNKYGQLGT

SEQ ID NO: 803872 - protein, 9 aa, Homo Sapiens
QIISHFSQD

SEQ ID NO: 803873 - protein, 9 aa, Homo Sapiens
SLRRHTQKM

SEQ ID NO: 803874 - protein, 9 aa, Homo Sapiens
SHCQERPSK

SEQ ID NO: 803875 - protein, 9 aa, Homo Sapiens
NHPKMSLAQ

SEQ ID NO: 803876 - protein, 9 aa, Homo Sapiens
IAHKITRYT

SEQ ID NO: 803877 - protein, 9 aa, Homo Sapiens
AMTKNSKSK

SEQ ID NO: 803878 - protein, 9 aa, Homo Sapiens
KEMRHVNIS

SEQ ID NO: 803879 - protein, 9 aa, Homo Sapiens
FDLSYLIVS

SEQ ID NO: 803880 - protein, 9 aa, Homo Sapiens
MLQEDTRKF

SEQ ID NO: 803881 - protein, 9 aa, Homo Sapiens
LLETLYQNR

SEQ ID NO: 803882 - protein, 9 aa, Homo Sapiens
VFEFNHHLE

SEQ ID NO: 803883 - protein, 9 aa, Homo Sapiens
QIIRDLEDK

SEQ ID NO: 803884 - protein, 9 aa, Homo Sapiens
SFIFRLINI

SEQ ID NO: 803885 - protein, 9 aa, Homo Sapiens
FQNISLGDC

SEQ ID NO: 803886 - protein, 9 aa, Homo Sapiens
ADHQTLDKV

SEQ ID NO: 803887 - protein, 9 aa, Homo Sapiens
NNLVTEPTH

SEQ ID NO: 803888 - protein, 9 aa, Homo Sapiens
KASPKAAST

SEQ ID NO: 803889 - protein, 9 aa, Homo Sapiens
SLRMVGDSR

SEQ ID NO: 803890 - protein, 9 aa, Homo Sapiens
ISFSKFASS

SEQ ID NO: 803891 - protein, 9 aa, Homo Sapiens
QKYYLDGVS

SEQ ID NO: 803892 - protein, 9 aa, Homo Sapiens
ALQQGKIVL

SEQ ID NO: 803893 - protein, 9 aa, Homo Sapiens
SETPGYIYY

SEQ ID NO: 803894 - protein, 9 aa, Homo Sapiens
WVGGRSNSE

SEQ ID NO: 803895 - protein, 9 aa, Homo Sapiens
LDNMLAELT

SEQ ID NO: 803896 - protein, 9 aa, Homo Sapiens
TGNAQKAVE

SEQ ID NO: 803897 - protein, 9 aa, Homo Sapiens
QMVRYELPH

SEQ ID NO: 803898 - protein, 9 aa, Homo Sapiens
EKQSNSTAW

SEQ ID NO: 803899 - protein, 9 aa, Homo Sapiens
AAIECLAQS

SEQ ID NO: 803900 - protein, 9 aa, Homo Sapiens
ARREQPESF

SEQ ID NO: 803901 - protein, 9 aa, Homo Sapiens
FQICYGLSG

SEQ ID NO: 803902 - protein, 9 aa, Homo Sapiens
GIALFIIIL

SEQ ID NO: 803903 - protein, 9 aa, Homo Sapiens
ALQRQALKE

SEQ ID NO: 803904 - protein, 9 aa, Homo Sapiens
FQEYHYPDS

SEQ ID NO: 803905 - protein, 9 aa, Homo Sapiens
HIALLVAKN

SEQ ID NO: 803906 - protein, 9 aa, Homo Sapiens
LLEALCRDE

SEQ ID NO: 803907 - protein, 9 aa, Homo Sapiens
KSDKLPSSS

SEQ ID NO: 803908 - protein, 9 aa, Homo Sapiens
TETGNNWIE

SEQ ID NO: 803909 - protein, 9 aa, Homo Sapiens
EDGITPGLV

SEQ ID NO: 803910 - protein, 9 aa, Homo Sapiens
LHWSQAVNY

SEQ ID NO: 803911 - protein, 9 aa, Homo Sapiens
ILAGLPAPG

SEQ ID NO: 803912 - protein, 9 aa, Homo Sapiens
GSPITYEKC

SEQ ID NO: 803913 - protein, 9 aa, Homo Sapiens
VRGLKIIDP

SEQ ID NO: 803914 - protein, 9 aa, Homo Sapiens
LPEDQLRGT

SEQ ID NO: 803915 - protein, 9 aa, Homo Sapiens
PQFTVAKNN

SEQ ID NO: 803916 - protein, 9 aa, Homo Sapiens
RGKGIRLTA

SEQ ID NO: 803917 - protein, 9 aa, Homo Sapiens
SLLQVPLKE

SEQ ID NO: 803918 - protein, 9 aa, Homo Sapiens
KSNNSFLQS

SEQ ID NO: 803919 - protein, 9 aa, Homo Sapiens
QKIMKKLDQ

SEQ ID NO: 803920 - protein, 9 aa, Homo Sapiens
YLNSGQGPS

SEQ ID NO: 803921 - protein, 9 aa, Homo Sapiens
CISLAQTMK

SEQ ID NO: 803922 - protein, 9 aa, Homo Sapiens
TPRLQDSNN

SEQ ID NO: 803923 - protein, 9 aa, Homo Sapiens
SSGFGHKYS

SEQ ID NO: 803924 - protein, 9 aa, Homo Sapiens
AMLEAPYTK

SEQ ID NO: 803925 - protein, 9 aa, Homo Sapiens
QQTRPVWTA

SEQ ID NO: 803926 - protein, 9 aa, Homo Sapiens
LQVPCSLEC

SEQ ID NO: 803927 - protein, 9 aa, Homo Sapiens
PLSVVLASY

SEQ ID NO: 803928 - protein, 9 aa, Homo Sapiens
PGSITKETT

SEQ ID NO: 803929 - protein, 9 aa, Homo Sapiens
MGDHNRNLL

SEQ ID NO: 803930 - protein, 9 aa, Homo Sapiens
GLPVCCVKS

SEQ ID NO: 803931 - protein, 9 aa, Homo Sapiens
QDLVDLVRE

SEQ ID NO: 803932 - protein, 9 aa, Homo Sapiens
GFSFDNCQR

SEQ ID NO: 803933 - protein, 9 aa, Homo Sapiens
QLEGVLAGL

SEQ ID NO: 803934 - protein, 9 aa, Homo Sapiens
LSFYRFSRD

SEQ ID NO: 803935 - protein, 9 aa, Homo Sapiens
PRAHFQRRA

SEQ ID NO: 803936 - protein, 9 aa, Homo Sapiens
DTDAASRRR

SEQ ID NO: 803937 - protein, 9 aa, Homo Sapiens
LTSFSVLGL

SEQ ID NO: 803938 - protein, 9 aa, Homo Sapiens
QGYAEGVEL

SEQ ID NO: 803939 - protein, 9 aa, Homo Sapiens
QKGCYALVT

SEQ ID NO: 803940 - protein, 9 aa, Homo Sapiens
RELIHKVQA

SEQ ID NO: 803941 - protein, 9 aa, Homo Sapiens
CEQDKLPGQ

SEQ ID NO: 803942 - protein, 9 aa, Homo Sapiens
TASEYPIFD

SEQ ID NO: 803943 - protein, 9 aa, Homo Sapiens
AVVVDHKGN

SEQ ID NO: 803944 - protein, 9 aa, Homo Sapiens
PLHYPVAGY

SEQ ID NO: 803945 - protein, 9 aa, Homo Sapiens
TRPPLIQNL

SEQ ID NO: 803946 - protein, 9 aa, Homo Sapiens
SKCLEKVHV

SEQ ID NO: 803947 - protein, 9 aa, Homo Sapiens
IYCVQAITG

SEQ ID NO: 803948 - protein, 9 aa, Homo Sapiens
RGLPQDIHK

SEQ ID NO: 803949 - protein, 9 aa, Homo Sapiens
FCRIDTSRK

SEQ ID NO: 803950 - protein, 9 aa, Homo Sapiens
VLELEAEVA

SEQ ID NO: 803951 - protein, 9 aa, Homo Sapiens
SFLTGVMLG

SEQ ID NO: 803952 - protein, 9 aa, Homo Sapiens
PYKYTSWIP

SEQ ID NO: 803953 - protein, 9 aa, Homo Sapiens
SSTYHTIIG

SEQ ID NO: 803954 - protein, 9 aa, Homo Sapiens
MTCKTFRPA

SEQ ID NO: 803955 - protein, 9 aa, Homo Sapiens
VRRQIGELK

SEQ ID NO: 803956 - protein, 9 aa, Homo Sapiens
QEYFRKFNK

SEQ ID NO: 803957 - protein, 9 aa, Homo Sapiens
AFKDLQRDE

SEQ ID NO: 803958 - protein, 9 aa, Homo Sapiens
SRSCGLLDE

SEQ ID NO: 803959 - protein, 9 aa, Homo Sapiens
SLMPVSGAE

SEQ ID NO: 803960 - protein, 9 aa, Homo Sapiens
PLTASTLAH

SEQ ID NO: 803961 - protein, 9 aa, Homo Sapiens
GNAIYGLIV

SEQ ID NO: 803962 - protein, 9 aa, Homo Sapiens
RRGQSLYVQ

SEQ ID NO: 803963 - protein, 9 aa, Homo Sapiens
RIYVTVKEH

SEQ ID NO: 803964 - protein, 9 aa, Homo Sapiens
SVIYWQMVR

SEQ ID NO: 803965 - protein, 9 aa, Homo Sapiens
PSPKPSPNN

SEQ ID NO: 803966 - protein, 9 aa, Homo Sapiens
VAKEASNII

SEQ ID NO: 803967 - protein, 9 aa, Homo Sapiens
HRDHLQFDQ

SEQ ID NO: 803968 - protein, 9 aa, Homo Sapiens
IIDFHVTVL

SEQ ID NO: 803969 - protein, 9 aa, Homo Sapiens
SIISNIRQS

SEQ ID NO: 803970 - protein, 9 aa, Homo Sapiens
MQLIKYKKA

SEQ ID NO: 803971 - protein, 9 aa, Homo Sapiens
VEHLELLQR

SEQ ID NO: 803972 - protein, 9 aa, Homo Sapiens
REECGKRFT

SEQ ID NO: 803973 - protein, 9 aa, Homo Sapiens
RKKRRREIN

SEQ ID NO: 803974 - protein, 9 aa, Homo Sapiens
YVDPIFYVS

SEQ ID NO: 803975 - protein, 9 aa, Homo Sapiens
GLVCMVTVC

SEQ ID NO: 803976 - protein, 9 aa, Homo Sapiens
DDIGNLNIP

SEQ ID NO: 803977 - protein, 9 aa, Homo Sapiens
QLLGTFGSA

SEQ ID NO: 803978 - protein, 9 aa, Homo Sapiens
LLNVDMWDK

SEQ ID NO: 803979 - protein, 9 aa, Homo Sapiens
FYLKRVKKE

SEQ ID NO: 803980 - protein, 9 aa, Homo Sapiens
KPIHSSDFV

SEQ ID NO: 803981 - protein, 9 aa, Homo Sapiens
DPGLRGAGL

SEQ ID NO: 803982 - protein, 9 aa, Homo Sapiens
PMFNPIMYS

SEQ ID NO: 803983 - protein, 9 aa, Homo Sapiens
RRQNGYRAL

SEQ ID NO: 803984 - protein, 9 aa, Homo Sapiens
SGEIVSANL

SEQ ID NO: 803985 - protein, 9 aa, Homo Sapiens
QRVMHRDIK

SEQ ID NO: 803986 - protein, 9 aa, Homo Sapiens
VLMTAEIDS

SEQ ID NO: 803987 - protein, 9 aa, Homo Sapiens
PVDNLYAET

SEQ ID NO: 803988 - protein, 9 aa, Homo Sapiens
EHPPICQVE

SEQ ID NO: 803989 - protein, 9 aa, Homo Sapiens
HEKIQSRET

SEQ ID NO: 803990 - protein, 9 aa, Homo Sapiens
ETLLTYPMF

SEQ ID NO: 803991 - protein, 9 aa, Homo Sapiens
RRVQIHNSF

SEQ ID NO: 803992 - protein, 9 aa, Homo Sapiens
GRSLEELTC

SEQ ID NO: 803993 - protein, 9 aa, Homo Sapiens
HFHNIFWSS

SEQ ID NO: 803994 - protein, 9 aa, Homo Sapiens
LLNVGFLEV

SEQ ID NO: 803995 - protein, 9 aa, Homo Sapiens
EIKTTDFGL

SEQ ID NO: 803996 - protein, 9 aa, Homo Sapiens
SLPVLRNQR

SEQ ID NO: 803997 - protein, 9 aa, Homo Sapiens
YQCLISPDC

SEQ ID NO: 803998 - protein, 9 aa, Homo Sapiens
LYTFPDHTL

SEQ ID NO: 803999 - protein, 9 aa, Homo Sapiens
LLNPKCRNV

SEQ ID NO: 804000 - protein, 9 aa, Homo Sapiens
SYIKIKEEN

SEQ ID NO: 804001 - protein, 9 aa, Homo Sapiens
PAALTPPKM

SEQ ID NO: 804002 - protein, 9 aa, Homo Sapiens
PGRKTEDTH

SEQ ID NO: 804003 - protein, 9 aa, Homo Sapiens
LIYTLINEE

SEQ ID NO: 804004 - protein, 9 aa, Homo Sapiens
DNPLLRSVA

SEQ ID NO: 804005 - protein, 9 aa, Homo Sapiens
DSINTVLVF

SEQ ID NO: 804006 - protein, 9 aa, Homo Sapiens
NEMQPHGKV

SEQ ID NO: 804007 - protein, 9 aa, Homo Sapiens
EKTGQEYTP

SEQ ID NO: 804008 - protein, 9 aa, Homo Sapiens
SSPGPLASS

SEQ ID NO: 804009 - protein, 9 aa, Homo Sapiens
HSTETLTKQ

SEQ ID NO: 804010 - protein, 9 aa, Homo Sapiens
DYTIMTGGD

SEQ ID NO: 804011 - protein, 9 aa, Homo Sapiens
GVLLDALFN

SEQ ID NO: 804012 - protein, 9 aa, Homo Sapiens
PDTGNIIME

SEQ ID NO: 804013 - protein, 9 aa, Homo Sapiens
RVEYMEKEK

SEQ ID NO: 804014 - protein, 9 aa, Homo Sapiens
VLSGDPHNL

SEQ ID NO: 804015 - protein, 9 aa, Homo Sapiens
SAIKIQMAS

SEQ ID NO: 804016 - protein, 9 aa, Homo Sapiens
GSSTNKIST

SEQ ID NO: 804017 - protein, 9 aa, Homo Sapiens
PDYNDEICQ

SEQ ID NO: 804018 - protein, 9 aa, Homo Sapiens
KQNGLYACS

SEQ ID NO: 804019 - protein, 9 aa, Homo Sapiens
HEGYTFMFD

SEQ ID NO: 804020 - protein, 9 aa, Homo Sapiens
YYAKKKRIH

SEQ ID NO: 804021 - protein, 9 aa, Homo Sapiens
KYQSLNKQN

SEQ ID NO: 804022 - protein, 9 aa, Homo Sapiens
YIEEHVEQV

SEQ ID NO: 804023 - protein, 9 aa, Homo Sapiens
PLARAPYRL

SEQ ID NO: 804024 - protein, 9 aa, Homo Sapiens
LPSAKDDVE

SEQ ID NO: 804025 - protein, 9 aa, Homo Sapiens
NVEDVLNAQ

SEQ ID NO: 804026 - protein, 9 aa, Homo Sapiens
YGELFPVPE

SEQ ID NO: 804027 - protein, 9 aa, Homo Sapiens
AAEPSASAP

SEQ ID NO: 804028 - protein, 9 aa, Homo Sapiens
EKHCCPIFS

SEQ ID NO: 804029 - protein, 9 aa, Homo Sapiens
LHKILRRKD

SEQ ID NO: 804030 - protein, 9 aa, Homo Sapiens
MCKVIGSFL

SEQ ID NO: 804031 - protein, 9 aa, Homo Sapiens
IPIKVEQIE

SEQ ID NO: 804032 - protein, 9 aa, Homo Sapiens
IEAPISKFT

SEQ ID NO: 804033 - protein, 9 aa, Homo Sapiens
REPELLYPN

SEQ ID NO: 804034 - protein, 9 aa, Homo Sapiens
QRGAWTMSD

SEQ ID NO: 804035 - protein, 9 aa, Homo Sapiens
PVHKSTQIY

SEQ ID NO: 804036 - protein, 9 aa, Homo Sapiens
YCDPVLDLH

SEQ ID NO: 804037 - protein, 9 aa, Homo Sapiens
LALPLLSVS

SEQ ID NO: 804038 - protein, 9 aa, Homo Sapiens
VRNEEHACH

SEQ ID NO: 804039 - protein, 9 aa, Homo Sapiens
CISYYMTYG

SEQ ID NO: 804040 - protein, 9 aa, Homo Sapiens
PNSIMGSMV

SEQ ID NO: 804041 - protein, 9 aa, Homo Sapiens
VPQAADPAA

SEQ ID NO: 804042 - protein, 9 aa, Homo Sapiens
GPSVVDLVS

SEQ ID NO: 804043 - protein, 9 aa, Homo Sapiens
HFCGQRKKY

SEQ ID NO: 804044 - protein, 9 aa, Homo Sapiens
GNYIKVNLI

SEQ ID NO: 804045 - protein, 9 aa, Homo Sapiens
KEACKLYSS

SEQ ID NO: 804046 - protein, 9 aa, Homo Sapiens
LLLLRDYKS

SEQ ID NO: 804047 - protein, 9 aa, Homo Sapiens
GEKPFQREE

SEQ ID NO: 804048 - protein, 9 aa, Homo Sapiens
VLKWVRDIN

SEQ ID NO: 804049 - protein, 9 aa, Homo Sapiens
LSLLREQSI

SEQ ID NO: 804050 - protein, 9 aa, Homo Sapiens
ICKIHPPAD

SEQ ID NO: 804051 - protein, 9 aa, Homo Sapiens
DCFIAICTP

SEQ ID NO: 804052 - protein, 9 aa, Homo Sapiens
DDCSQLMAL

SEQ ID NO: 804053 - protein, 9 aa, Homo Sapiens
LSKATLVPS

SEQ ID NO: 804054 - protein, 9 aa, Homo Sapiens
PVNVTLRQI

SEQ ID NO: 804055 - protein, 9 aa, Homo Sapiens
QLLDMDGII

SEQ ID NO: 804056 - protein, 9 aa, Homo Sapiens
SETALQSSH

SEQ ID NO: 804057 - protein, 9 aa, Homo Sapiens
ICYLGCDLP

SEQ ID NO: 804058 - protein, 9 aa, Homo Sapiens
VTPIIQPKT

SEQ ID NO: 804059 - protein, 9 aa, Homo Sapiens
PNHNQQNGD

SEQ ID NO: 804060 - protein, 9 aa, Homo Sapiens
MPQLFMEQY

SEQ ID NO: 804061 - protein, 9 aa, Homo Sapiens
ISEGTETVE

SEQ ID NO: 804062 - protein, 9 aa, Homo Sapiens
INTYKQVAG

SEQ ID NO: 804063 - protein, 9 aa, Homo Sapiens
ESNKLVEEL

SEQ ID NO: 804064 - protein, 9 aa, Homo Sapiens
PLGYMGENL

SEQ ID NO: 804065 - protein, 9 aa, Homo Sapiens
KQQASSLTF

SEQ ID NO: 804066 - protein, 9 aa, Homo Sapiens
LFLFMVLCG

SEQ ID NO: 804067 - protein, 9 aa, Homo Sapiens
LYQGIKVEA

SEQ ID NO: 804068 - protein, 9 aa, Homo Sapiens
CRALEERWS

SEQ ID NO: 804069 - protein, 9 aa, Homo Sapiens
MAMAMQMAA

SEQ ID NO: 804070 - protein, 9 aa, Homo Sapiens
HPKYPDCAL

SEQ ID NO: 804071 - protein, 9 aa, Homo Sapiens
NDIPFEKHV

SEQ ID NO: 804072 - protein, 9 aa, Homo Sapiens
FQSHMITHT

SEQ ID NO: 804073 - protein, 9 aa, Homo Sapiens
NTFEKLGIC

SEQ ID NO: 804074 - protein, 9 aa, Homo Sapiens
VLTPLMLDF

SEQ ID NO: 804075 - protein, 9 aa, Homo Sapiens
ECIGETRFS

SEQ ID NO: 804076 - protein, 9 aa, Homo Sapiens
RVRKNHCSR

SEQ ID NO: 804077 - protein, 9 aa, Homo Sapiens
DGIPFFHSA

SEQ ID NO: 804078 - protein, 9 aa, Homo Sapiens
INSSSSSSP

SEQ ID NO: 804079 - protein, 9 aa, Homo Sapiens
ANPNINDSK

SEQ ID NO: 804080 - protein, 9 aa, Homo Sapiens
KSITCQKVI

SEQ ID NO: 804081 - protein, 9 aa, Homo Sapiens
EILQDTDED

SEQ ID NO: 804082 - protein, 9 aa, Homo Sapiens
FLGVMADGV

SEQ ID NO: 804083 - protein, 9 aa, Homo Sapiens
TPPPGRVSS

SEQ ID NO: 804084 - protein, 9 aa, Homo Sapiens
GREELFGEA

SEQ ID NO: 804085 - protein, 9 aa, Homo Sapiens
SCDLREGRQ

SEQ ID NO: 804086 - protein, 9 aa, Homo Sapiens
QLGPPKHCP

SEQ ID NO: 804087 - protein, 9 aa, Homo Sapiens
RKLFHPFNQ

SEQ ID NO: 804088 - protein, 9 aa, Homo Sapiens
QLEPDPSLD

SEQ ID NO: 804089 - protein, 9 aa, Homo Sapiens
NSDVGMFVA

SEQ ID NO: 804090 - protein, 9 aa, Homo Sapiens
SCDNCSTQR

SEQ ID NO: 804091 - protein, 9 aa, Homo Sapiens
VDAVFIKDG

SEQ ID NO: 804092 - protein, 9 aa, Homo Sapiens
GGDSGGIAE

SEQ ID NO: 804093 - protein, 9 aa, Homo Sapiens
VGGQGSERK

SEQ ID NO: 804094 - protein, 9 aa, Homo Sapiens
DDVWAFIHY

SEQ ID NO: 804095 - protein, 9 aa, Homo Sapiens
INKKMQMLK

SEQ ID NO: 804096 - protein, 9 aa, Homo Sapiens
HLAHHQQIH

SEQ ID NO: 804097 - protein, 9 aa, Homo Sapiens
DVMKKPSCG

SEQ ID NO: 804098 - protein, 9 aa, Homo Sapiens
PSPHPVTPL

SEQ ID NO: 804099 - protein, 9 aa, Homo Sapiens
EPKKSHRCV

SEQ ID NO: 804100 - protein, 9 aa, Homo Sapiens
PITECFELL

SEQ ID NO: 804101 - protein, 9 aa, Homo Sapiens
YDSTSEQRT

SEQ ID NO: 804102 - protein, 9 aa, Homo Sapiens
NVAQYIKFE

SEQ ID NO: 804103 - protein, 9 aa, Homo Sapiens
PYKCNEGGK

SEQ ID NO: 804104 - protein, 9 aa, Homo Sapiens
DFQRESQIL

SEQ ID NO: 804105 - protein, 9 aa, Homo Sapiens
TIYVIPGLK

SEQ ID NO: 804106 - protein, 9 aa, Homo Sapiens
LANQRRYWE

SEQ ID NO: 804107 - protein, 9 aa, Homo Sapiens
NNMATKYGF

SEQ ID NO: 804108 - protein, 9 aa, Homo Sapiens
VSFLLHNPS

SEQ ID NO: 804109 - protein, 9 aa, Homo Sapiens
PLNPPIKKA

SEQ ID NO: 804110 - protein, 9 aa, Homo Sapiens
MHDLFPSLI

SEQ ID NO: 804111 - protein, 9 aa, Homo Sapiens
LESNVKPRK

SEQ ID NO: 804112 - protein, 9 aa, Homo Sapiens
LDLLFVSKL

SEQ ID NO: 804113 - protein, 9 aa, Homo Sapiens
ANLIRHQII

SEQ ID NO: 804114 - protein, 9 aa, Homo Sapiens
GEPEAPMLT

SEQ ID NO: 804115 - protein, 9 aa, Homo Sapiens
YSHPHFVNT

SEQ ID NO: 804116 - protein, 9 aa, Homo Sapiens
QLAPGSWVC

SEQ ID NO: 804117 - protein, 9 aa, Homo Sapiens
SQPPQLINL

SEQ ID NO: 804118 - protein, 9 aa, Homo Sapiens
PENLEYKLY

SEQ ID NO: 804119 - protein, 9 aa, Homo Sapiens
ENVMATKYG

SEQ ID NO: 804120 - protein, 9 aa, Homo Sapiens
LAVLPILTF

SEQ ID NO: 804121 - protein, 9 aa, Homo Sapiens
QDPVYPSLV

SEQ ID NO: 804122 - protein, 9 aa, Homo Sapiens
LQTFMIKFP

SEQ ID NO: 804123 - protein, 9 aa, Homo Sapiens
LNKPFSIEE

SEQ ID NO: 804124 - protein, 9 aa, Homo Sapiens
ITRYTTEGR

SEQ ID NO: 804125 - protein, 9 aa, Homo Sapiens
NYPSTRVMR

SEQ ID NO: 804126 - protein, 9 aa, Homo Sapiens
IQMYLWAQK

SEQ ID NO: 804127 - protein, 9 aa, Homo Sapiens
SELSLLHNL

SEQ ID NO: 804128 - protein, 9 aa, Homo Sapiens
NYLESIEDN

SEQ ID NO: 804129 - protein, 9 aa, Homo Sapiens
NPRLAKAIV

SEQ ID NO: 804130 - protein, 9 aa, Homo Sapiens
RVYLIMNSI

SEQ ID NO: 804131 - protein, 9 aa, Homo Sapiens
VMGIQSGKH

SEQ ID NO: 804132 - protein, 9 aa, Homo Sapiens
YFFDRNSPS

SEQ ID NO: 804133 - protein, 9 aa, Homo Sapiens
LATDRGTIH

SEQ ID NO: 804134 - protein, 9 aa, Homo Sapiens
ETMSLYDLD

SEQ ID NO: 804135 - protein, 9 aa, Homo Sapiens
MGSMVPPPV

SEQ ID NO: 804136 - protein, 9 aa, Homo Sapiens
TIWCGARPL

SEQ ID NO: 804137 - protein, 9 aa, Homo Sapiens
QESKNLCKA

SEQ ID NO: 804138 - protein, 9 aa, Homo Sapiens
TRMPSSVSL

SEQ ID NO: 804139 - protein, 9 aa, Homo Sapiens
LSLNTSTAP

SEQ ID NO: 804140 - protein, 9 aa, Homo Sapiens
DGDLVSLTV

SEQ ID NO: 804141 - protein, 9 aa, Homo Sapiens
KGICTEDRG

SEQ ID NO: 804142 - protein, 9 aa, Homo Sapiens
TQSFSRKRP

SEQ ID NO: 804143 - protein, 9 aa, Homo Sapiens
EGKGPEGQP

SEQ ID NO: 804144 - protein, 9 aa, Homo Sapiens
LAEATITNI

SEQ ID NO: 804145 - protein, 9 aa, Homo Sapiens
PLNRRAIHD

SEQ ID NO: 804146 - protein, 9 aa, Homo Sapiens
LKITAGLEH

SEQ ID NO: 804147 - protein, 9 aa, Homo Sapiens
YNVLAYIKH

SEQ ID NO: 804148 - protein, 9 aa, Homo Sapiens
LAKSKGFGV

SEQ ID NO: 804149 - protein, 9 aa, Homo Sapiens
KDYDMPHVV

SEQ ID NO: 804150 - protein, 9 aa, Homo Sapiens
EQKAKDLPK

SEQ ID NO: 804151 - protein, 9 aa, Homo Sapiens
GSGKKTPPR

SEQ ID NO: 804152 - protein, 9 aa, Homo Sapiens
MVYFVSNYS

SEQ ID NO: 804153 - protein, 9 aa, Homo Sapiens
LLHNPSNFL

SEQ ID NO: 804154 - protein, 9 aa, Homo Sapiens
RGEKLTLTP

SEQ ID NO: 804155 - protein, 9 aa, Homo Sapiens
GEIENITAP

SEQ ID NO: 804156 - protein, 9 aa, Homo Sapiens
VDGVGTLQL

SEQ ID NO: 804157 - protein, 9 aa, Homo Sapiens
RRINTLQAI

SEQ ID NO: 804158 - protein, 9 aa, Homo Sapiens
INTTVSQYP

SEQ ID NO: 804159 - protein, 9 aa, Homo Sapiens
IKKILKEGL

SEQ ID NO: 804160 - protein, 9 aa, Homo Sapiens
EMPQGSYML

SEQ ID NO: 804161 - protein, 9 aa, Homo Sapiens
DPLIAEKPL

SEQ ID NO: 804162 - protein, 9 aa, Homo Sapiens
LWNCDVQGA

SEQ ID NO: 804163 - protein, 9 aa, Homo Sapiens
DDDDVETNW

SEQ ID NO: 804164 - protein, 9 aa, Homo Sapiens
VLLNTKDKH

SEQ ID NO: 804165 - protein, 9 aa, Homo Sapiens
GPLFTFPSD

SEQ ID NO: 804166 - protein, 9 aa, Homo Sapiens
LEPGQPDND

SEQ ID NO: 804167 - protein, 9 aa, Homo Sapiens
EGRFGVSHR

SEQ ID NO: 804168 - protein, 9 aa, Homo Sapiens
AMSTTELRK

SEQ ID NO: 804169 - protein, 9 aa, Homo Sapiens
GKSRGKPLP

SEQ ID NO: 804170 - protein, 9 aa, Homo Sapiens
RGTKRYEDR

SEQ ID NO: 804171 - protein, 9 aa, Homo Sapiens
ELCQIQEPG

SEQ ID NO: 804172 - protein, 9 aa, Homo Sapiens
ICLDDPPGP

SEQ ID NO: 804173 - protein, 9 aa, Homo Sapiens
KIIGHFLFW

SEQ ID NO: 804174 - protein, 9 aa, Homo Sapiens
KRLTVSQRN

SEQ ID NO: 804175 - protein, 9 aa, Homo Sapiens
EPLNNLSLT

SEQ ID NO: 804176 - protein, 9 aa, Homo Sapiens
RSCGLLDED

SEQ ID NO: 804177 - protein, 9 aa, Homo Sapiens
KENSITLNI

SEQ ID NO: 804178 - protein, 9 aa, Homo Sapiens
YFDAVFLDP

SEQ ID NO: 804179 - protein, 9 aa, Homo Sapiens
FINNYMKKY

SEQ ID NO: 804180 - protein, 9 aa, Homo Sapiens
ILELDPWEH

SEQ ID NO: 804181 - protein, 9 aa, Homo Sapiens
KPGHRSEDQ

SEQ ID NO: 804182 - protein, 9 aa, Homo Sapiens
VLSVYIFSF

SEQ ID NO: 804183 - protein, 9 aa, Homo Sapiens
SGDDKLIGN

SEQ ID NO: 804184 - protein, 9 aa, Homo Sapiens
ENVQLRKGC

SEQ ID NO: 804185 - protein, 9 aa, Homo Sapiens
RLIEQSNLR

SEQ ID NO: 804186 - protein, 9 aa, Homo Sapiens
AATVLIYFG

SEQ ID NO: 804187 - protein, 9 aa, Homo Sapiens
QKELVNILH

SEQ ID NO: 804188 - protein, 9 aa, Homo Sapiens
DTINYSVVE

SEQ ID NO: 804189 - protein, 9 aa, Homo Sapiens
FLLVGDLRA

SEQ ID NO: 804190 - protein, 9 aa, Homo Sapiens
MENQDLLGL

SEQ ID NO: 804191 - protein, 9 aa, Homo Sapiens
AAPDIRRRL

SEQ ID NO: 804192 - protein, 9 aa, Homo Sapiens
SPAPPTQPQ

SEQ ID NO: 804193 - protein, 9 aa, Homo Sapiens
SPECSKHSH

SEQ ID NO: 804194 - protein, 9 aa, Homo Sapiens
KSILEIISK

SEQ ID NO: 804195 - protein, 9 aa, Homo Sapiens
QIIHSGDRP

SEQ ID NO: 804196 - protein, 9 aa, Homo Sapiens
ATLSAWSSM

SEQ ID NO: 804197 - protein, 9 aa, Homo Sapiens
IDSTGVLDK

SEQ ID NO: 804198 - protein, 9 aa, Homo Sapiens
TLVPSEREA

SEQ ID NO: 804199 - protein, 9 aa, Homo Sapiens
KDLLEDTPR

SEQ ID NO: 804200 - protein, 9 aa, Homo Sapiens
LNQLDECRL

SEQ ID NO: 804201 - protein, 9 aa, Homo Sapiens
AITMVNYYT

SEQ ID NO: 804202 - protein, 9 aa, Homo Sapiens
KLGADTVGM

SEQ ID NO: 804203 - protein, 9 aa, Homo Sapiens
PTALTQLVK

SEQ ID NO: 804204 - protein, 9 aa, Homo Sapiens
SVSDKSNDL

SEQ ID NO: 804205 - protein, 9 aa, Homo Sapiens
DYVSSRAPQ

SEQ ID NO: 804206 - protein, 9 aa, Homo Sapiens
MTEERGIIS

SEQ ID NO: 804207 - protein, 9 aa, Homo Sapiens
IIGNALVIL

SEQ ID NO: 804208 - protein, 9 aa, Homo Sapiens
WTDKEELNK

SEQ ID NO: 804209 - protein, 9 aa, Homo Sapiens
QLKTEPFEE

SEQ ID NO: 804210 - protein, 9 aa, Homo Sapiens
KITSTIDDP

SEQ ID NO: 804211 - protein, 9 aa, Homo Sapiens
GQISPDGPV

SEQ ID NO: 804212 - protein, 9 aa, Homo Sapiens
TLSILLTPL

SEQ ID NO: 804213 - protein, 9 aa, Homo Sapiens
LAAPQIPSY

SEQ ID NO: 804214 - protein, 9 aa, Homo Sapiens
EFWSKPFNK

SEQ ID NO: 804215 - protein, 9 aa, Homo Sapiens
SRSGLYHSP

SEQ ID NO: 804216 - protein, 9 aa, Homo Sapiens
NKYFDFSLF

SEQ ID NO: 804217 - protein, 9 aa, Homo Sapiens
CGRVQPAAK

SEQ ID NO: 804218 - protein, 9 aa, Homo Sapiens
PPYKQVVKA

SEQ ID NO: 804219 - protein, 9 aa, Homo Sapiens
RESIIWKGS

SEQ ID NO: 804220 - protein, 9 aa, Homo Sapiens
APLKGAQEQ

SEQ ID NO: 804221 - protein, 9 aa, Homo Sapiens
ETGAFTFFA

SEQ ID NO: 804222 - protein, 9 aa, Homo Sapiens
GLDRTHSHG

SEQ ID NO: 804223 - protein, 9 aa, Homo Sapiens
QDCHVLTYT

SEQ ID NO: 804224 - protein, 9 aa, Homo Sapiens
IAVENQVSG

SEQ ID NO: 804225 - protein, 9 aa, Homo Sapiens
KVYKSHKRE

SEQ ID NO: 804226 - protein, 9 aa, Homo Sapiens
PDQTRGLLE

SEQ ID NO: 804227 - protein, 9 aa, Homo Sapiens
YPGFYGEAC

SEQ ID NO: 804228 - protein, 9 aa, Homo Sapiens
IILALMFLH

SEQ ID NO: 804229 - protein, 9 aa, Homo Sapiens
GDKKNHYNY

SEQ ID NO: 804230 - protein, 9 aa, Homo Sapiens
ETILQHTLQ

SEQ ID NO: 804231 - protein, 9 aa, Homo Sapiens
VERIEEPIK

SEQ ID NO: 804232 - protein, 9 aa, Homo Sapiens
RIVVSNAWA

SEQ ID NO: 804233 - protein, 9 aa, Homo Sapiens
QQTEYCNKC

SEQ ID NO: 804234 - protein, 9 aa, Homo Sapiens
QDKTAVPYF

SEQ ID NO: 804235 - protein, 9 aa, Homo Sapiens
TFECDCKAK

SEQ ID NO: 804236 - protein, 9 aa, Homo Sapiens
RCEGECPDP

SEQ ID NO: 804237 - protein, 9 aa, Homo Sapiens
GVDEDADIS

SEQ ID NO: 804238 - protein, 9 aa, Homo Sapiens
ERSEKDIGN

SEQ ID NO: 804239 - protein, 9 aa, Homo Sapiens
CTEHNLKSW

SEQ ID NO: 804240 - protein, 9 aa, Homo Sapiens
HNAIISPTV

SEQ ID NO: 804241 - protein, 9 aa, Homo Sapiens
AATATAPTG

SEQ ID NO: 804242 - protein, 9 aa, Homo Sapiens
SMAQDGLDS

SEQ ID NO: 804243 - protein, 9 aa, Homo Sapiens
KRTLPAFLC

SEQ ID NO: 804244 - protein, 9 aa, Homo Sapiens
HAIARSLSY

SEQ ID NO: 804245 - protein, 9 aa, Homo Sapiens
YLATDRGTI

SEQ ID NO: 804246 - protein, 9 aa, Homo Sapiens
ESHCSIIHP

SEQ ID NO: 804247 - protein, 9 aa, Homo Sapiens
ILQTAMSSR

SEQ ID NO: 804248 - protein, 9 aa, Homo Sapiens
NYQTPDLAI

SEQ ID NO: 804249 - protein, 9 aa, Homo Sapiens
ADIIKPSFV

SEQ ID NO: 804250 - protein, 9 aa, Homo Sapiens
LPGKLSLPC

SEQ ID NO: 804251 - protein, 9 aa, Homo Sapiens
NQSILLLLV

SEQ ID NO: 804252 - protein, 9 aa, Homo Sapiens
EHNLKSWNG

SEQ ID NO: 804253 - protein, 9 aa, Homo Sapiens
AVLDAIYEV

SEQ ID NO: 804254 - protein, 9 aa, Homo Sapiens
AHIYIQTLC

SEQ ID NO: 804255 - protein, 9 aa, Homo Sapiens
SNEELQNLS

SEQ ID NO: 804256 - protein, 9 aa, Homo Sapiens
QDEQRNSTA

SEQ ID NO: 804257 - protein, 9 aa, Homo Sapiens
TGANVIVTG

SEQ ID NO: 804258 - protein, 9 aa, Homo Sapiens
SSSFQSHMI

SEQ ID NO: 804259 - protein, 9 aa, Homo Sapiens
SCWAKGLGA

SEQ ID NO: 804260 - protein, 9 aa, Homo Sapiens
HIPYFPSLK

SEQ ID NO: 804261 - protein, 9 aa, Homo Sapiens
QLHGHFEQY

SEQ ID NO: 804262 - protein, 9 aa, Homo Sapiens
ICSLHSNLY

SEQ ID NO: 804263 - protein, 9 aa, Homo Sapiens
RLDPNFSIP

SEQ ID NO: 804264 - protein, 9 aa, Homo Sapiens
SLERTNKFP

SEQ ID NO: 804265 - protein, 9 aa, Homo Sapiens
LLIQAARGY

SEQ ID NO: 804266 - protein, 9 aa, Homo Sapiens
TEVATEILY

SEQ ID NO: 804267 - protein, 9 aa, Homo Sapiens
MFQFPLERC

SEQ ID NO: 804268 - protein, 9 aa, Homo Sapiens
QAHIYIQTL

SEQ ID NO: 804269 - protein, 9 aa, Homo Sapiens
FLGNYLGLQ

SEQ ID NO: 804270 - protein, 9 aa, Homo Sapiens
SHCSIIHPV

SEQ ID NO: 804271 - protein, 9 aa, Homo Sapiens
ALGIISQEE

SEQ ID NO: 804272 - protein, 9 aa, Homo Sapiens
ADYLVVIMF

SEQ ID NO: 804273 - protein, 9 aa, Homo Sapiens
NFVRGHLRE

SEQ ID NO: 804274 - protein, 9 aa, Homo Sapiens
LSSNSSFVL

SEQ ID NO: 804275 - protein, 9 aa, Homo Sapiens
TNDERAAQR

SEQ ID NO: 804276 - protein, 9 aa, Homo Sapiens
YNSRENCWT

SEQ ID NO: 804277 - protein, 9 aa, Homo Sapiens
EHYNLVTRL

SEQ ID NO: 804278 - protein, 9 aa, Homo Sapiens
ERVALAKYH

SEQ ID NO: 804279 - protein, 9 aa, Homo Sapiens
VERRSEKYS

SEQ ID NO: 804280 - protein, 9 aa, Homo Sapiens
TQNYLKVLA

SEQ ID NO: 804281 - protein, 9 aa, Homo Sapiens
NHKKLYCSE

SEQ ID NO: 804282 - protein, 9 aa, Homo Sapiens
CDKSFHLYC

SEQ ID NO: 804283 - protein, 9 aa, Homo Sapiens
QRLNISIND

SEQ ID NO: 804284 - protein, 9 aa, Homo Sapiens
HRSIDPMGG

SEQ ID NO: 804285 - protein, 9 aa, Homo Sapiens
GAWGFPRPP

SEQ ID NO: 804286 - protein, 9 aa, Homo Sapiens
PEKLDQIGS

SEQ ID NO: 804287 - protein, 9 aa, Homo Sapiens
TAFPFLQLY

SEQ ID NO: 804288 - protein, 9 aa, Homo Sapiens
GRSKLQNQI

SEQ ID NO: 804289 - protein, 9 aa, Homo Sapiens
TLGIAYAIH

SEQ ID NO: 804290 - protein, 9 aa, Homo Sapiens
QIYCGAGVQ

SEQ ID NO: 804291 - protein, 9 aa, Homo Sapiens
CPATSTRIT

SEQ ID NO: 804292 - protein, 9 aa, Homo Sapiens
EDNGGRGGG

SEQ ID NO: 804293 - protein, 9 aa, Homo Sapiens
GDPGLRGAG

SEQ ID NO: 804294 - protein, 9 aa, Homo Sapiens
TGDNLQCGQ

SEQ ID NO: 804295 - protein, 9 aa, Homo Sapiens
VQRKRADTY

SEQ ID NO: 804296 - protein, 9 aa, Homo Sapiens
PRVPSHLSR

SEQ ID NO: 804297 - protein, 9 aa, Homo Sapiens
FKGKYFNFI

SEQ ID NO: 804298 - protein, 9 aa, Homo Sapiens
ILASVPSNP

SEQ ID NO: 804299 - protein, 9 aa, Homo Sapiens
LSPRNQFNL

SEQ ID NO: 804300 - protein, 9 aa, Homo Sapiens
ESVEVLWPG

SEQ ID NO: 804301 - protein, 9 aa, Homo Sapiens
KTRAMCRRL

SEQ ID NO: 804302 - protein, 9 aa, Homo Sapiens
SSPDLLPED

SEQ ID NO: 804303 - protein, 9 aa, Homo Sapiens
QGSLLFGDV

SEQ ID NO: 804304 - protein, 9 aa, Homo Sapiens
ITAESLFYK

SEQ ID NO: 804305 - protein, 9 aa, Homo Sapiens
DPYSAFLSA

SEQ ID NO: 804306 - protein, 9 aa, Homo Sapiens
IQGSIVANV

SEQ ID NO: 804307 - protein, 9 aa, Homo Sapiens
LKKFLEKKH

SEQ ID NO: 804308 - protein, 9 aa, Homo Sapiens
DDLFPVEPV

SEQ ID NO: 804309 - protein, 9 aa, Homo Sapiens
PPKPLPNDG

SEQ ID NO: 804310 - protein, 9 aa, Homo Sapiens
MGQSDIETM

SEQ ID NO: 804311 - protein, 9 aa, Homo Sapiens
DQKVWPNEE

SEQ ID NO: 804312 - protein, 9 aa, Homo Sapiens
SILLTPLFE

SEQ ID NO: 804313 - protein, 9 aa, Homo Sapiens
GGKFTCGCN

SEQ ID NO: 804314 - protein, 9 aa, Homo Sapiens
EVLNNNKCP

SEQ ID NO: 804315 - protein, 9 aa, Homo Sapiens
EHKGCQIIL

SEQ ID NO: 804316 - protein, 9 aa, Homo Sapiens
EREMAFHTE

SEQ ID NO: 804317 - protein, 9 aa, Homo Sapiens
WENCMAIDK

SEQ ID NO: 804318 - protein, 9 aa, Homo Sapiens
WEEVKQQLE

SEQ ID NO: 804319 - protein, 9 aa, Homo Sapiens
SWVDTMQED

SEQ ID NO: 804320 - protein, 9 aa, Homo Sapiens
WTEGLLQEA

SEQ ID NO: 804321 - protein, 9 aa, Homo Sapiens
SQQRAEELS

SEQ ID NO: 804322 - protein, 9 aa, Homo Sapiens
QVCCCHLPL

SEQ ID NO: 804323 - protein, 9 aa, Homo Sapiens
CADTSVFKN

SEQ ID NO: 804324 - protein, 9 aa, Homo Sapiens
TQADIVRGE

SEQ ID NO: 804325 - protein, 9 aa, Homo Sapiens
FLDENLKRC

SEQ ID NO: 804326 - protein, 9 aa, Homo Sapiens
EEEENKAPT

SEQ ID NO: 804327 - protein, 9 aa, Homo Sapiens
AYKCTICGQ

SEQ ID NO: 804328 - protein, 9 aa, Homo Sapiens
INMVTDEEG

SEQ ID NO: 804329 - protein, 9 aa, Homo Sapiens
LTLHTWLSF

SEQ ID NO: 804330 - protein, 9 aa, Homo Sapiens
VQRQKGLMR

SEQ ID NO: 804331 - protein, 9 aa, Homo Sapiens
ANEYNNGYE

SEQ ID NO: 804332 - protein, 9 aa, Homo Sapiens
CHFCDKAFI

SEQ ID NO: 804333 - protein, 9 aa, Homo Sapiens
RLMLINNAG

SEQ ID NO: 804334 - protein, 9 aa, Homo Sapiens
YEMFERNPS

SEQ ID NO: 804335 - protein, 9 aa, Homo Sapiens
PSEHREESY

SEQ ID NO: 804336 - protein, 9 aa, Homo Sapiens
VFEDNFLST

SEQ ID NO: 804337 - protein, 9 aa, Homo Sapiens
LRNKIIGHF

SEQ ID NO: 804338 - protein, 9 aa, Homo Sapiens
GQNEKGQLG

SEQ ID NO: 804339 - protein, 9 aa, Homo Sapiens
SLRNGSMKA

SEQ ID NO: 804340 - protein, 9 aa, Homo Sapiens
NKDATAEII

SEQ ID NO: 804341 - protein, 9 aa, Homo Sapiens
SPMSIGHPV

SEQ ID NO: 804342 - protein, 9 aa, Homo Sapiens
RMTNQKIQM

SEQ ID NO: 804343 - protein, 9 aa, Homo Sapiens
ARRHTNSTS

SEQ ID NO: 804344 - protein, 9 aa, Homo Sapiens
LSSIYESIQ

SEQ ID NO: 804345 - protein, 9 aa, Homo Sapiens
LHDALCLAY

SEQ ID NO: 804346 - protein, 9 aa, Homo Sapiens
WLISDLQKY

SEQ ID NO: 804347 - protein, 9 aa, Homo Sapiens
KTLGETLSG

SEQ ID NO: 804348 - protein, 9 aa, Homo Sapiens
HQTGLDRIT

SEQ ID NO: 804349 - protein, 9 aa, Homo Sapiens
STVKDNQVV

SEQ ID NO: 804350 - protein, 9 aa, Homo Sapiens
IFLGFPTRP

SEQ ID NO: 804351 - protein, 9 aa, Homo Sapiens
KKEQYSNVT

SEQ ID NO: 804352 - protein, 9 aa, Homo Sapiens
QNIENVPLL

SEQ ID NO: 804353 - protein, 9 aa, Homo Sapiens
DDGIDLNQT

SEQ ID NO: 804354 - protein, 9 aa, Homo Sapiens
FTSGKHYWD

SEQ ID NO: 804355 - protein, 9 aa, Homo Sapiens
IIETQKQTL

SEQ ID NO: 804356 - protein, 9 aa, Homo Sapiens
KKVDAQSLA

SEQ ID NO: 804357 - protein, 9 aa, Homo Sapiens
PSLNKLQKL

SEQ ID NO: 804358 - protein, 9 aa, Homo Sapiens
PDPHLLVSE

SEQ ID NO: 804359 - protein, 9 aa, Homo Sapiens
EQRQATDDA

SEQ ID NO: 804360 - protein, 9 aa, Homo Sapiens
SLAAFQLQM

SEQ ID NO: 804361 - protein, 9 aa, Homo Sapiens
FDKEVKVFD

SEQ ID NO: 804362 - protein, 9 aa, Homo Sapiens
GRSCEKFGP

SEQ ID NO: 804363 - protein, 9 aa, Homo Sapiens
SPEKNKVPA

SEQ ID NO: 804364 - protein, 9 aa, Homo Sapiens
WNFDFVTKT

SEQ ID NO: 804365 - protein, 9 aa, Homo Sapiens
YLFFKTRYC

SEQ ID NO: 804366 - protein, 9 aa, Homo Sapiens
ATCTSLSKL

SEQ ID NO: 804367 - protein, 9 aa, Homo Sapiens
HEMDADNPL

SEQ ID NO: 804368 - protein, 9 aa, Homo Sapiens
YQWKHDYVG

SEQ ID NO: 804369 - protein, 9 aa, Homo Sapiens
SMYIQAMEE

SEQ ID NO: 804370 - protein, 9 aa, Homo Sapiens
THIISIHAS

SEQ ID NO: 804371 - protein, 9 aa, Homo Sapiens
KMRAEKRKN

SEQ ID NO: 804372 - protein, 9 aa, Homo Sapiens
HKGCQIILF

SEQ ID NO: 804373 - protein, 9 aa, Homo Sapiens
NILMCTGET

SEQ ID NO: 804374 - protein, 9 aa, Homo Sapiens
QGNIMSYKR

SEQ ID NO: 804375 - protein, 9 aa, Homo Sapiens
QAWCETNLW

SEQ ID NO: 804376 - protein, 9 aa, Homo Sapiens
DKTPSYFVT

SEQ ID NO: 804377 - protein, 9 aa, Homo Sapiens
TGECWLEKL

SEQ ID NO: 804378 - protein, 9 aa, Homo Sapiens
CLHYEIKDI

SEQ ID NO: 804379 - protein, 9 aa, Homo Sapiens
LHTWLSFYE

SEQ ID NO: 804380 - protein, 9 aa, Homo Sapiens
IAHSSGSED

SEQ ID NO: 804381 - protein, 9 aa, Homo Sapiens
KFSKCGVMT

SEQ ID NO: 804382 - protein, 9 aa, Homo Sapiens
ELEEMQQRA

SEQ ID NO: 804383 - protein, 9 aa, Homo Sapiens
GNKPYACKE

SEQ ID NO: 804384 - protein, 9 aa, Homo Sapiens
NITKSLVYG

SEQ ID NO: 804385 - protein, 9 aa, Homo Sapiens
MQTEITALA

SEQ ID NO: 804386 - protein, 9 aa, Homo Sapiens
VVALILQYD

SEQ ID NO: 804387 - protein, 9 aa, Homo Sapiens
ITDNPFMTS

SEQ ID NO: 804388 - protein, 9 aa, Homo Sapiens
VTVVASVVD

SEQ ID NO: 804389 - protein, 9 aa, Homo Sapiens
PVRTLQSFG

SEQ ID NO: 804390 - protein, 9 aa, Homo Sapiens
SSHLTKHKI

SEQ ID NO: 804391 - protein, 9 aa, Homo Sapiens
TSIRPLDTV

SEQ ID NO: 804392 - protein, 9 aa, Homo Sapiens
SQGDEEKYP

SEQ ID NO: 804393 - protein, 9 aa, Homo Sapiens
IITYEDSEP

SEQ ID NO: 804394 - protein, 9 aa, Homo Sapiens
VQVGDSLRT

SEQ ID NO: 804395 - protein, 9 aa, Homo Sapiens
RPDNYFHEN

SEQ ID NO: 804396 - protein, 9 aa, Homo Sapiens
EIKDRFAFV

SEQ ID NO: 804397 - protein, 9 aa, Homo Sapiens
STQEGEAVM

SEQ ID NO: 804398 - protein, 9 aa, Homo Sapiens
EVFEFMVYK

SEQ ID NO: 804399 - protein, 9 aa, Homo Sapiens
EGDQQLLTR

SEQ ID NO: 804400 - protein, 9 aa, Homo Sapiens
LYKNRGVLH

SEQ ID NO: 804401 - protein, 9 aa, Homo Sapiens
YIKIKEENL

SEQ ID NO: 804402 - protein, 9 aa, Homo Sapiens
VIYLMGAIF

SEQ ID NO: 804403 - protein, 9 aa, Homo Sapiens
SLIQVIGKQ

SEQ ID NO: 804404 - protein, 9 aa, Homo Sapiens
LTHFLRKEY

SEQ ID NO: 804405 - protein, 9 aa, Homo Sapiens
VLKVLTNKT

SEQ ID NO: 804406 - protein, 9 aa, Homo Sapiens
TSIPVSGTS

SEQ ID NO: 804407 - protein, 9 aa, Homo Sapiens
DTVSSSYNI

SEQ ID NO: 804408 - protein, 9 aa, Homo Sapiens
DYSYEQHNQ

SEQ ID NO: 804409 - protein, 9 aa, Homo Sapiens
LKEVHTINE

SEQ ID NO: 804410 - protein, 9 aa, Homo Sapiens
RHYSREQRC

SEQ ID NO: 804411 - protein, 9 aa, Homo Sapiens
SKHNLFQTG

SEQ ID NO: 804412 - protein, 9 aa, Homo Sapiens
SMDLSQYVR

SEQ ID NO: 804413 - protein, 9 aa, Homo Sapiens
LLLILASQV

SEQ ID NO: 804414 - protein, 9 aa, Homo Sapiens
KEQIKWSLF

SEQ ID NO: 804415 - protein, 9 aa, Homo Sapiens
FLFSIRKGY

SEQ ID NO: 804416 - protein, 9 aa, Homo Sapiens
TINSLSYYQ

SEQ ID NO: 804417 - protein, 9 aa, Homo Sapiens
DDVKDKFDY

SEQ ID NO: 804418 - protein, 9 aa, Homo Sapiens
SHPHFVNTV

SEQ ID NO: 804419 - protein, 9 aa, Homo Sapiens
YYDKIERTT

SEQ ID NO: 804420 - protein, 9 aa, Homo Sapiens
NPCPKMCQW

SEQ ID NO: 804421 - protein, 9 aa, Homo Sapiens
EKPYRCKKC

SEQ ID NO: 804422 - protein, 9 aa, Homo Sapiens
NYRFMSSHI

SEQ ID NO: 804423 - protein, 9 aa, Homo Sapiens
VRHILRINR

SEQ ID NO: 804424 - protein, 9 aa, Homo Sapiens
AKKYNLRVE

SEQ ID NO: 804425 - protein, 9 aa, Homo Sapiens
MMSIQDKSK

SEQ ID NO: 804426 - protein, 9 aa, Homo Sapiens
LKKDNKVTW

SEQ ID NO: 804427 - protein, 9 aa, Homo Sapiens
TSDRTYQRE

SEQ ID NO: 804428 - protein, 9 aa, Homo Sapiens
YRCSANVQS

SEQ ID NO: 804429 - protein, 9 aa, Homo Sapiens
LFTKTPIFQ

SEQ ID NO: 804430 - protein, 9 aa, Homo Sapiens
VCIRWVYGA

SEQ ID NO: 804431 - protein, 9 aa, Homo Sapiens
LRDDKDTID

SEQ ID NO: 804432 - protein, 9 aa, Homo Sapiens
IGGLLVSLT

SEQ ID NO: 804433 - protein, 9 aa, Homo Sapiens
LQQDAKERA

SEQ ID NO: 804434 - protein, 9 aa, Homo Sapiens
NKSLEGIFD

SEQ ID NO: 804435 - protein, 9 aa, Homo Sapiens
DYRYDRVIF

SEQ ID NO: 804436 - protein, 9 aa, Homo Sapiens
FKIPEVELV

SEQ ID NO: 804437 - protein, 9 aa, Homo Sapiens
PRFLQINPI

SEQ ID NO: 804438 - protein, 9 aa, Homo Sapiens
TVLLWANQF

SEQ ID NO: 804439 - protein, 9 aa, Homo Sapiens
QEPIERKYY

SEQ ID NO: 804440 - protein, 9 aa, Homo Sapiens
SQPIRLQNI

SEQ ID NO: 804441 - protein, 9 aa, Homo Sapiens
LIAEKPLGE

SEQ ID NO: 804442 - protein, 9 aa, Homo Sapiens
DMLHETVAP

SEQ ID NO: 804443 - protein, 9 aa, Homo Sapiens
TGSNPNKAT

SEQ ID NO: 804444 - protein, 9 aa, Homo Sapiens
TKCTVSVSG

SEQ ID NO: 804445 - protein, 9 aa, Homo Sapiens
EYFKTPKEI

SEQ ID NO: 804446 - protein, 9 aa, Homo Sapiens
LVCSNSNSN

SEQ ID NO: 804447 - protein, 9 aa, Homo Sapiens
NFLNYLPEE

SEQ ID NO: 804448 - protein, 9 aa, Homo Sapiens
GLFIDVVQR

SEQ ID NO: 804449 - protein, 9 aa, Homo Sapiens
SWRSWQSRH

SEQ ID NO: 804450 - protein, 9 aa, Homo Sapiens
VCVAHEIYQ

SEQ ID NO: 804451 - protein, 9 aa, Homo Sapiens
HNRTNTTLS

SEQ ID NO: 804452 - protein, 9 aa, Homo Sapiens
SQQNGAPLK

SEQ ID NO: 804453 - protein, 9 aa, Homo Sapiens
LGHSAKLAF

SEQ ID NO: 804454 - protein, 9 aa, Homo Sapiens
FAVGVGFGA

SEQ ID NO: 804455 - protein, 9 aa, Homo Sapiens
ETHVWYRTC

SEQ ID NO: 804456 - protein, 9 aa, Homo Sapiens
CISGDCDDM

SEQ ID NO: 804457 - protein, 9 aa, Homo Sapiens
DAKKENSKL

SEQ ID NO: 804458 - protein, 9 aa, Homo Sapiens
ILRDLFLSD

SEQ ID NO: 804459 - protein, 9 aa, Homo Sapiens
LAHRTCLEP

SEQ ID NO: 804460 - protein, 9 aa, Homo Sapiens
QDVRLAQNI

SEQ ID NO: 804461 - protein, 9 aa, Homo Sapiens
SRHWIIHTG

SEQ ID NO: 804462 - protein, 9 aa, Homo Sapiens
GSEEVWKVN

SEQ ID NO: 804463 - protein, 9 aa, Homo Sapiens
ENTKDLSEA

SEQ ID NO: 804464 - protein, 9 aa, Homo Sapiens
AGRHGDALR

SEQ ID NO: 804465 - protein, 9 aa, Homo Sapiens
AAESTGLET

SEQ ID NO: 804466 - protein, 9 aa, Homo Sapiens
LLNRICRIS

SEQ ID NO: 804467 - protein, 9 aa, Homo Sapiens
AKVMSEPLS

SEQ ID NO: 804468 - protein, 9 aa, Homo Sapiens
GVMTSSGLC

SEQ ID NO: 804469 - protein, 9 aa, Homo Sapiens
FVWFMNYCW

SEQ ID NO: 804470 - protein, 9 aa, Homo Sapiens
CIFLLLINV

SEQ ID NO: 804471 - protein, 9 aa, Homo Sapiens
REPQLRPNK

SEQ ID NO: 804472 - protein, 9 aa, Homo Sapiens
PQGNIGSYA

SEQ ID NO: 804473 - protein, 9 aa, Homo Sapiens
VLWPGTIQR

SEQ ID NO: 804474 - protein, 9 aa, Homo Sapiens
KEKTGQEYT

SEQ ID NO: 804475 - protein, 9 aa, Homo Sapiens
NKRDSIGTH

SEQ ID NO: 804476 - protein, 9 aa, Homo Sapiens
NIFHMVPVS

SEQ ID NO: 804477 - protein, 9 aa, Homo Sapiens
TREKEHEMS

SEQ ID NO: 804478 - protein, 9 aa, Homo Sapiens
TVTLSNQII

SEQ ID NO: 804479 - protein, 9 aa, Homo Sapiens
SSVSGICIK

SEQ ID NO: 804480 - protein, 9 aa, Homo Sapiens
SNTYPPDLT

SEQ ID NO: 804481 - protein, 9 aa, Homo Sapiens
EARTYIFNS

SEQ ID NO: 804482 - protein, 9 aa, Homo Sapiens
GNYDFVQAI

SEQ ID NO: 804483 - protein, 9 aa, Homo Sapiens
PLIAFSLLS

SEQ ID NO: 804484 - protein, 9 aa, Homo Sapiens
ELKILVSAP

SEQ ID NO: 804485 - protein, 9 aa, Homo Sapiens
SSLTYHQTI

SEQ ID NO: 804486 - protein, 9 aa, Homo Sapiens
WVMARVIFE

SEQ ID NO: 804487 - protein, 9 aa, Homo Sapiens
ATVLIYFGA

SEQ ID NO: 804488 - protein, 9 aa, Homo Sapiens
FMMPQIVNV

SEQ ID NO: 804489 - protein, 9 aa, Homo Sapiens
SERNQEQEE

SEQ ID NO: 804490 - protein, 9 aa, Homo Sapiens
VRPHLQNIE

SEQ ID NO: 804491 - protein, 9 aa, Homo Sapiens
KGLEKAIRD

SEQ ID NO: 804492 - protein, 9 aa, Homo Sapiens
FYKFYPCEE

SEQ ID NO: 804493 - protein, 9 aa, Homo Sapiens
LNTGMQTTE

SEQ ID NO: 804494 - protein, 9 aa, Homo Sapiens
KLQGRLGWV

SEQ ID NO: 804495 - protein, 9 aa, Homo Sapiens
NKVDFNEFV

SEQ ID NO: 804496 - protein, 9 aa, Homo Sapiens
LVMQKLFPR

SEQ ID NO: 804497 - protein, 9 aa, Homo Sapiens
NFPRGCKKH

SEQ ID NO: 804498 - protein, 9 aa, Homo Sapiens
EMVKYGFFH

SEQ ID NO: 804499 - protein, 9 aa, Homo Sapiens
ERIAPKVLR

SEQ ID NO: 804500 - protein, 9 aa, Homo Sapiens
MSPSKNYFI

SEQ ID NO: 804501 - protein, 9 aa, Homo Sapiens
EMIGWIYLG

SEQ ID NO: 804502 - protein, 9 aa, Homo Sapiens
RLPSLNKLQ

SEQ ID NO: 804503 - protein, 9 aa, Homo Sapiens
STTLIYGLL

SEQ ID NO: 804504 - protein, 9 aa, Homo Sapiens
EKPYECHKC

SEQ ID NO: 804505 - protein, 9 aa, Homo Sapiens
VLVDTLASH

SEQ ID NO: 804506 - protein, 9 aa, Homo Sapiens
GFSNYKLFL

SEQ ID NO: 804507 - protein, 9 aa, Homo Sapiens
IPKGKAGTT

SEQ ID NO: 804508 - protein, 9 aa, Homo Sapiens
TFSSTINTH

SEQ ID NO: 804509 - protein, 9 aa, Homo Sapiens
EDKPEEEVQ

SEQ ID NO: 804510 - protein, 9 aa, Homo Sapiens
ALEETILQH

SEQ ID NO: 804511 - protein, 9 aa, Homo Sapiens
RQVVHGKER

SEQ ID NO: 804512 - protein, 9 aa, Homo Sapiens
MNSWVKTQT

SEQ ID NO: 804513 - protein, 9 aa, Homo Sapiens
EDLLMGMDS

SEQ ID NO: 804514 - protein, 9 aa, Homo Sapiens
ARHQALGTT

SEQ ID NO: 804515 - protein, 9 aa, Homo Sapiens
EVEVTQVQV

SEQ ID NO: 804516 - protein, 9 aa, Homo Sapiens
EDEVWYLQS

SEQ ID NO: 804517 - protein, 9 aa, Homo Sapiens
RNCWSPVLS

SEQ ID NO: 804518 - protein, 9 aa, Homo Sapiens
AWGFPRPPG

SEQ ID NO: 804519 - protein, 9 aa, Homo Sapiens
GVLEGKQFE

SEQ ID NO: 804520 - protein, 9 aa, Homo Sapiens
QVTDSAYVM

SEQ ID NO: 804521 - protein, 9 aa, Homo Sapiens
KLLTVYLCD

SEQ ID NO: 804522 - protein, 9 aa, Homo Sapiens
ASNARTEKE

SEQ ID NO: 804523 - protein, 9 aa, Homo Sapiens
SEAVMSVAF

SEQ ID NO: 804524 - protein, 9 aa, Homo Sapiens
TNTIEDNFP

SEQ ID NO: 804525 - protein, 9 aa, Homo Sapiens
SRTISCDQL

SEQ ID NO: 804526 - protein, 9 aa, Homo Sapiens
DLKVVSVES

SEQ ID NO: 804527 - protein, 9 aa, Homo Sapiens
DKAVNPIWK

SEQ ID NO: 804528 - protein, 9 aa, Homo Sapiens
SILEIISKS

SEQ ID NO: 804529 - protein, 9 aa, Homo Sapiens
KVLRKIEQP

SEQ ID NO: 804530 - protein, 9 aa, Homo Sapiens
APTPTNATA

SEQ ID NO: 804531 - protein, 9 aa, Homo Sapiens
LEPFRLFIP

SEQ ID NO: 804532 - protein, 9 aa, Homo Sapiens
VGEALLGNE

SEQ ID NO: 804533 - protein, 9 aa, Homo Sapiens
WKEMSAKKA

SEQ ID NO: 804534 - protein, 9 aa, Homo Sapiens
FFRTIPSDN

SEQ ID NO: 804535 - protein, 9 aa, Homo Sapiens
QGFALVYAI

SEQ ID NO: 804536 - protein, 9 aa, Homo Sapiens
HLKSVEDEM

SEQ ID NO: 804537 - protein, 9 aa, Homo Sapiens
DVLCEMAVN

SEQ ID NO: 804538 - protein, 9 aa, Homo Sapiens
LVHGYIFVY

SEQ ID NO: 804539 - protein, 9 aa, Homo Sapiens
TASTSFMMT

SEQ ID NO: 804540 - protein, 9 aa, Homo Sapiens
SHLTVVVLL

SEQ ID NO: 804541 - protein, 9 aa, Homo Sapiens
AVRATLPIF

SEQ ID NO: 804542 - protein, 9 aa, Homo Sapiens
TQNINLYDS

SEQ ID NO: 804543 - protein, 9 aa, Homo Sapiens
KLITVNLVG

SEQ ID NO: 804544 - protein, 9 aa, Homo Sapiens
RLLTTIGKY

SEQ ID NO: 804545 - protein, 9 aa, Homo Sapiens
QDKYSVNMV

SEQ ID NO: 804546 - protein, 9 aa, Homo Sapiens
AVKARTTIN

SEQ ID NO: 804547 - protein, 9 aa, Homo Sapiens
VAHVTSTVN

SEQ ID NO: 804548 - protein, 9 aa, Homo Sapiens
IIEDILERD

SEQ ID NO: 804549 - protein, 9 aa, Homo Sapiens
IIIMLLNIA

SEQ ID NO: 804550 - protein, 9 aa, Homo Sapiens
DTMRTRLAQ

SEQ ID NO: 804551 - protein, 9 aa, Homo Sapiens
NLWRCISEQ

SEQ ID NO: 804552 - protein, 9 aa, Homo Sapiens
PFTIQFYFV

SEQ ID NO: 804553 - protein, 9 aa, Homo Sapiens
PQAPTDGVL

SEQ ID NO: 804554 - protein, 9 aa, Homo Sapiens
HLSINFFLL

SEQ ID NO: 804555 - protein, 9 aa, Homo Sapiens
LDNLDSLGG

SEQ ID NO: 804556 - protein, 9 aa, Homo Sapiens
LGGQPVVER

SEQ ID NO: 804557 - protein, 9 aa, Homo Sapiens
NKVNQWALE

SEQ ID NO: 804558 - protein, 9 aa, Homo Sapiens
IPTQSSTLE

SEQ ID NO: 804559 - protein, 9 aa, Homo Sapiens
KGAKEKNKE

SEQ ID NO: 804560 - protein, 9 aa, Homo Sapiens
AQSIAAQEE

SEQ ID NO: 804561 - protein, 9 aa, Homo Sapiens
QKNKLLIDG

SEQ ID NO: 804562 - protein, 9 aa, Homo Sapiens
NPPNNDDQW

SEQ ID NO: 804563 - protein, 9 aa, Homo Sapiens
YKELFGGVS

SEQ ID NO: 804564 - protein, 9 aa, Homo Sapiens
TQHQIIYIG

SEQ ID NO: 804565 - protein, 9 aa, Homo Sapiens
VLQLSLIIL

SEQ ID NO: 804566 - protein, 9 aa, Homo Sapiens
IRRKSSRPQ

SEQ ID NO: 804567 - protein, 9 aa, Homo Sapiens
GSILSGLVL

SEQ ID NO: 804568 - protein, 9 aa, Homo Sapiens
TKKRKHQHD

SEQ ID NO: 804569 - protein, 9 aa, Homo Sapiens
STIPAGSFS

SEQ ID NO: 804570 - protein, 9 aa, Homo Sapiens
IQAPKTVDT

SEQ ID NO: 804571 - protein, 9 aa, Homo Sapiens
NNFEITIKA

SEQ ID NO: 804572 - protein, 9 aa, Homo Sapiens
GKISPVPYK

SEQ ID NO: 804573 - protein, 9 aa, Homo Sapiens
NGPEKTSSS

SEQ ID NO: 804574 - protein, 9 aa, Homo Sapiens
PSTTKPLRA

SEQ ID NO: 804575 - protein, 9 aa, Homo Sapiens
NLTAVNVQN

SEQ ID NO: 804576 - protein, 9 aa, Homo Sapiens
EIISPRQVS

SEQ ID NO: 804577 - protein, 9 aa, Homo Sapiens
NPLSIIPNY

SEQ ID NO: 804578 - protein, 9 aa, Homo Sapiens
TNLSPVDVS

SEQ ID NO: 804579 - protein, 9 aa, Homo Sapiens
LKDDRTETY

SEQ ID NO: 804580 - protein, 9 aa, Homo Sapiens
MVILFTHKE

SEQ ID NO: 804581 - protein, 9 aa, Homo Sapiens
MPEYPALSL

SEQ ID NO: 804582 - protein, 9 aa, Homo Sapiens
QSEIISKQY

SEQ ID NO: 804583 - protein, 9 aa, Homo Sapiens
SQTVSERND

SEQ ID NO: 804584 - protein, 9 aa, Homo Sapiens
QQAWVLQEA

SEQ ID NO: 804585 - protein, 9 aa, Homo Sapiens
IPTVGIPLF

SEQ ID NO: 804586 - protein, 9 aa, Homo Sapiens
KEHIKEYTE

SEQ ID NO: 804587 - protein, 9 aa, Homo Sapiens
EIFLKLILP

SEQ ID NO: 804588 - protein, 9 aa, Homo Sapiens
KAVDVLERL

SEQ ID NO: 804589 - protein, 9 aa, Homo Sapiens
HVQPYIPYI

SEQ ID NO: 804590 - protein, 9 aa, Homo Sapiens
ILTDKSYDD

SEQ ID NO: 804591 - protein, 9 aa, Homo Sapiens
PKGACTCWM

SEQ ID NO: 804592 - protein, 9 aa, Homo Sapiens
WWPMKAQHL

SEQ ID NO: 804593 - protein, 9 aa, Homo Sapiens
HKGPPVLTQ

SEQ ID NO: 804594 - protein, 9 aa, Homo Sapiens
VYTLRTESI

SEQ ID NO: 804595 - protein, 9 aa, Homo Sapiens
PMDSAGAPV

SEQ ID NO: 804596 - protein, 9 aa, Homo Sapiens
TCGECGHCF

SEQ ID NO: 804597 - protein, 9 aa, Homo Sapiens
LAREGWAVQ

SEQ ID NO: 804598 - protein, 9 aa, Homo Sapiens
QLQILSSVL

SEQ ID NO: 804599 - protein, 9 aa, Homo Sapiens
EDLYPNINV

SEQ ID NO: 804600 - protein, 9 aa, Homo Sapiens
IIKKIINLK

SEQ ID NO: 804601 - protein, 9 aa, Homo Sapiens
AYLIALLYS

SEQ ID NO: 804602 - protein, 9 aa, Homo Sapiens
YCIPSPGQL

SEQ ID NO: 804603 - protein, 9 aa, Homo Sapiens
YFILFTKKE

SEQ ID NO: 804604 - protein, 9 aa, Homo Sapiens
ATYYKIKRT

SEQ ID NO: 804605 - protein, 9 aa, Homo Sapiens
GPLALGGFY

SEQ ID NO: 804606 - protein, 9 aa, Homo Sapiens
RSSQTQDKA

SEQ ID NO: 804607 - protein, 9 aa, Homo Sapiens
GPPLIPASQ

SEQ ID NO: 804608 - protein, 9 aa, Homo Sapiens
ELTLEQAKK

SEQ ID NO: 804609 - protein, 9 aa, Homo Sapiens
IILAIQSFQ

SEQ ID NO: 804610 - protein, 9 aa, Homo Sapiens
LMAPTPVSP

SEQ ID NO: 804611 - protein, 9 aa, Homo Sapiens
FPLIPALSP

SEQ ID NO: 804612 - protein, 9 aa, Homo Sapiens
GPDGDLSPT

SEQ ID NO: 804613 - protein, 9 aa, Homo Sapiens
DSNGSTNLV

SEQ ID NO: 804614 - protein, 9 aa, Homo Sapiens
VTRYVVKHH

SEQ ID NO: 804615 - protein, 9 aa, Homo Sapiens
RGTNDERAA

SEQ ID NO: 804616 - protein, 9 aa, Homo Sapiens
SIHASPQPL

SEQ ID NO: 804617 - protein, 9 aa, Homo Sapiens
KVECREKRR

SEQ ID NO: 804618 - protein, 9 aa, Homo Sapiens
RTIKTLQIT

SEQ ID NO: 804619 - protein, 9 aa, Homo Sapiens
EALICSFHP

SEQ ID NO: 804620 - protein, 9 aa, Homo Sapiens
VLIREEECS

SEQ ID NO: 804621 - protein, 9 aa, Homo Sapiens
AVLKLRYKV

SEQ ID NO: 804622 - protein, 9 aa, Homo Sapiens
DNTQKSGLD

SEQ ID NO: 804623 - protein, 9 aa, Homo Sapiens
SLSVIEDDA

SEQ ID NO: 804624 - protein, 9 aa, Homo Sapiens
VFIADLLIY

SEQ ID NO: 804625 - protein, 9 aa, Homo Sapiens
SPGTPLLDF

SEQ ID NO: 804626 - protein, 9 aa, Homo Sapiens
VKAAMAGVK

SEQ ID NO: 804627 - protein, 9 aa, Homo Sapiens
SIGYRALQW

SEQ ID NO: 804628 - protein, 9 aa, Homo Sapiens
NYVLNTATK

SEQ ID NO: 804629 - protein, 9 aa, Homo Sapiens
IILTQNDFG

SEQ ID NO: 804630 - protein, 9 aa, Homo Sapiens
MFNPCGYLM

SEQ ID NO: 804631 - protein, 9 aa, Homo Sapiens
PSQMDRNVE

SEQ ID NO: 804632 - protein, 9 aa, Homo Sapiens
VLYILCTMS

SEQ ID NO: 804633 - protein, 9 aa, Homo Sapiens
QELERQQRL

SEQ ID NO: 804634 - protein, 9 aa, Homo Sapiens
GEPLHLIVE

SEQ ID NO: 804635 - protein, 9 aa, Homo Sapiens
GLKIIDPNY

SEQ ID NO: 804636 - protein, 9 aa, Homo Sapiens
NSGIHSGAN

SEQ ID NO: 804637 - protein, 9 aa, Homo Sapiens
HHIRRFVHD

SEQ ID NO: 804638 - protein, 9 aa, Homo Sapiens
SGNETQHYP

SEQ ID NO: 804639 - protein, 9 aa, Homo Sapiens
SYFFGAAIH

SEQ ID NO: 804640 - protein, 9 aa, Homo Sapiens
PFPVTSHQC

SEQ ID NO: 804641 - protein, 9 aa, Homo Sapiens
RWLRRDISE

SEQ ID NO: 804642 - protein, 9 aa, Homo Sapiens
KPQNDWKCS

SEQ ID NO: 804643 - protein, 9 aa, Homo Sapiens
HTGNKPYAC

SEQ ID NO: 804644 - protein, 9 aa, Homo Sapiens
KSMDPFKPT

SEQ ID NO: 804645 - protein, 9 aa, Homo Sapiens
DLSKLPSMS

SEQ ID NO: 804646 - protein, 9 aa, Homo Sapiens
TTVDASGSP

SEQ ID NO: 804647 - protein, 9 aa, Homo Sapiens
APQISLAEM

SEQ ID NO: 804648 - protein, 9 aa, Homo Sapiens
NDIAYANDF

SEQ ID NO: 804649 - protein, 9 aa, Homo Sapiens
PLPTEHASR

SEQ ID NO: 804650 - protein, 9 aa, Homo Sapiens
GFNKKYGEL

SEQ ID NO: 804651 - protein, 9 aa, Homo Sapiens
KRMLVGGVR

SEQ ID NO: 804652 - protein, 9 aa, Homo Sapiens
CTRAGEPIL

SEQ ID NO: 804653 - protein, 9 aa, Homo Sapiens
FHFSSDRTD

SEQ ID NO: 804654 - protein, 9 aa, Homo Sapiens
HPLESLAKD

SEQ ID NO: 804655 - protein, 9 aa, Homo Sapiens
TDGDREVQQ

SEQ ID NO: 804656 - protein, 9 aa, Homo Sapiens
PSSEVVKCG

SEQ ID NO: 804657 - protein, 9 aa, Homo Sapiens
LKPTIATWM

SEQ ID NO: 804658 - protein, 9 aa, Homo Sapiens
QQARKMVLE

SEQ ID NO: 804659 - protein, 9 aa, Homo Sapiens
SQYFEVTQC

SEQ ID NO: 804660 - protein, 9 aa, Homo Sapiens
GQKLHKMGL

SEQ ID NO: 804661 - protein, 9 aa, Homo Sapiens
DSIEILGKS

SEQ ID NO: 804662 - protein, 9 aa, Homo Sapiens
KPSTKKVKK

SEQ ID NO: 804663 - protein, 9 aa, Homo Sapiens
FYYKNTHRL

SEQ ID NO: 804664 - protein, 9 aa, Homo Sapiens
GTNCIDVDK

SEQ ID NO: 804665 - protein, 9 aa, Homo Sapiens
TVLLKVPKD

SEQ ID NO: 804666 - protein, 9 aa, Homo Sapiens
DRFAFVAGP

SEQ ID NO: 804667 - protein, 9 aa, Homo Sapiens
RLRDYIKEY

SEQ ID NO: 804668 - protein, 9 aa, Homo Sapiens
TEKSDIDLL

SEQ ID NO: 804669 - protein, 9 aa, Homo Sapiens
ETKVGTEPL

SEQ ID NO: 804670 - protein, 9 aa, Homo Sapiens
ELQNLSLSG

SEQ ID NO: 804671 - protein, 9 aa, Homo Sapiens
TDDNEENPT

SEQ ID NO: 804672 - protein, 9 aa, Homo Sapiens
SSSVVDTQS

SEQ ID NO: 804673 - protein, 9 aa, Homo Sapiens
FPACSPFVL

SEQ ID NO: 804674 - protein, 9 aa, Homo Sapiens
GHLNAGYNV

SEQ ID NO: 804675 - protein, 9 aa, Homo Sapiens
VFDLFNTAI

SEQ ID NO: 804676 - protein, 9 aa, Homo Sapiens
MKEIMYGTN

SEQ ID NO: 804677 - protein, 9 aa, Homo Sapiens
HEQMQTVIE

SEQ ID NO: 804678 - protein, 9 aa, Homo Sapiens
MLLGALALT

SEQ ID NO: 804679 - protein, 9 aa, Homo Sapiens
FALLFGRQF

SEQ ID NO: 804680 - protein, 9 aa, Homo Sapiens
SLLSHEQKM

SEQ ID NO: 804681 - protein, 9 aa, Homo Sapiens
GRQYLWLKD

SEQ ID NO: 804682 - protein, 9 aa, Homo Sapiens
SEVSRISKV

SEQ ID NO: 804683 - protein, 9 aa, Homo Sapiens
CALDKEPVP

SEQ ID NO: 804684 - protein, 9 aa, Homo Sapiens
NGHKFDFIH

SEQ ID NO: 804685 - protein, 9 aa, Homo Sapiens
EGHVVKCYR

SEQ ID NO: 804686 - protein, 9 aa, Homo Sapiens
RKLECPDPN

SEQ ID NO: 804687 - protein, 9 aa, Homo Sapiens
VPVIGANVT

SEQ ID NO: 804688 - protein, 9 aa, Homo Sapiens
QVLQISVAD

SEQ ID NO: 804689 - protein, 9 aa, Homo Sapiens
RTDEFKNDL

SEQ ID NO: 804690 - protein, 9 aa, Homo Sapiens
ACLYQCYLI

SEQ ID NO: 804691 - protein, 9 aa, Homo Sapiens
DVVRIFNLI

SEQ ID NO: 804692 - protein, 9 aa, Homo Sapiens
PMPFSIYEG

SEQ ID NO: 804693 - protein, 9 aa, Homo Sapiens
HVQIHTGEK

SEQ ID NO: 804694 - protein, 9 aa, Homo Sapiens
HSGEKPFQR

SEQ ID NO: 804695 - protein, 9 aa, Homo Sapiens
GGGYPHGPP

SEQ ID NO: 804696 - protein, 9 aa, Homo Sapiens
YLCGLSDAV

SEQ ID NO: 804697 - protein, 9 aa, Homo Sapiens
LGITPSMTN

SEQ ID NO: 804698 - protein, 9 aa, Homo Sapiens
ESQQNGAPL

SEQ ID NO: 804699 - protein, 9 aa, Homo Sapiens
KSEVSLVRE

SEQ ID NO: 804700 - protein, 9 aa, Homo Sapiens
NTGEKPYKC

SEQ ID NO: 804701 - protein, 9 aa, Homo Sapiens
KIDFTTGDA

SEQ ID NO: 804702 - protein, 9 aa, Homo Sapiens
ILTCMLGYV

SEQ ID NO: 804703 - protein, 9 aa, Homo Sapiens
SLMGFGKDV

SEQ ID NO: 804704 - protein, 9 aa, Homo Sapiens
SLKHCELWL

SEQ ID NO: 804705 - protein, 9 aa, Homo Sapiens
VPVSYFIWN

SEQ ID NO: 804706 - protein, 9 aa, Homo Sapiens
RFKDKENSE

SEQ ID NO: 804707 - protein, 9 aa, Homo Sapiens
QQTFPARER

SEQ ID NO: 804708 - protein, 9 aa, Homo Sapiens
AEPDGSNQT

SEQ ID NO: 804709 - protein, 9 aa, Homo Sapiens
PLLLDLGGQ

SEQ ID NO: 804710 - protein, 9 aa, Homo Sapiens
SQIDAVCSK

SEQ ID NO: 804711 - protein, 9 aa, Homo Sapiens
GSSNYRASA

SEQ ID NO: 804712 - protein, 9 aa, Homo Sapiens
FSPFCVQHM

SEQ ID NO: 804713 - protein, 9 aa, Homo Sapiens
KKCFPEPHQ

SEQ ID NO: 804714 - protein, 9 aa, Homo Sapiens
PKKSHRCVL

SEQ ID NO: 804715 - protein, 9 aa, Homo Sapiens
CNLSDRQAE

SEQ ID NO: 804716 - protein, 9 aa, Homo Sapiens
ISKEDILES

SEQ ID NO: 804717 - protein, 9 aa, Homo Sapiens
LVGRRQRAP

SEQ ID NO: 804718 - protein, 9 aa, Homo Sapiens
ENVRELFFR

SEQ ID NO: 804719 - protein, 9 aa, Homo Sapiens
RVIILAFSL

SEQ ID NO: 804720 - protein, 9 aa, Homo Sapiens
IGRQAEYVI

SEQ ID NO: 804721 - protein, 9 aa, Homo Sapiens
AMCDVFTQF

SEQ ID NO: 804722 - protein, 9 aa, Homo Sapiens
QHGTQQQNL

SEQ ID NO: 804723 - protein, 9 aa, Homo Sapiens
HHCWVHILD

SEQ ID NO: 804724 - protein, 9 aa, Homo Sapiens
TNGVVYNDS

SEQ ID NO: 804725 - protein, 9 aa, Homo Sapiens
HLKLRDSNE

SEQ ID NO: 804726 - protein, 9 aa, Homo Sapiens
SATRGLNPT

SEQ ID NO: 804727 - protein, 9 aa, Homo Sapiens
SDPPFNTQR

SEQ ID NO: 804728 - protein, 9 aa, Homo Sapiens
VLISNKACG

SEQ ID NO: 804729 - protein, 9 aa, Homo Sapiens
DLAIQLNQG

SEQ ID NO: 804730 - protein, 9 aa, Homo Sapiens
RANCLAQTT

SEQ ID NO: 804731 - protein, 9 aa, Homo Sapiens
GNQAHAQEF

SEQ ID NO: 804732 - protein, 9 aa, Homo Sapiens
LGDKPYGCI

SEQ ID NO: 804733 - protein, 9 aa, Homo Sapiens
ATGLLCDLL

SEQ ID NO: 804734 - protein, 9 aa, Homo Sapiens
HQKLFRHKH

SEQ ID NO: 804735 - protein, 9 aa, Homo Sapiens
FRPQCLVMA

SEQ ID NO: 804736 - protein, 9 aa, Homo Sapiens
EAEELFKQA

SEQ ID NO: 804737 - protein, 9 aa, Homo Sapiens
MYVVDIPMS

SEQ ID NO: 804738 - protein, 9 aa, Homo Sapiens
CSRWKCISQ

SEQ ID NO: 804739 - protein, 9 aa, Homo Sapiens
NDFSPEALK

SEQ ID NO: 804740 - protein, 9 aa, Homo Sapiens
DIINELNRL

SEQ ID NO: 804741 - protein, 9 aa, Homo Sapiens
NIQSGEGCQ

SEQ ID NO: 804742 - protein, 9 aa, Homo Sapiens
LPARSVDVS

SEQ ID NO: 804743 - protein, 9 aa, Homo Sapiens
SPIYHQGQP

SEQ ID NO: 804744 - protein, 9 aa, Homo Sapiens
TDSGSLQRD

SEQ ID NO: 804745 - protein, 9 aa, Homo Sapiens
MTRSPLRVS

SEQ ID NO: 804746 - protein, 9 aa, Homo Sapiens
SYLEEIQSA

SEQ ID NO: 804747 - protein, 9 aa, Homo Sapiens
ENSVDTGGD

SEQ ID NO: 804748 - protein, 9 aa, Homo Sapiens
EVFINKGKE

SEQ ID NO: 804749 - protein, 9 aa, Homo Sapiens
KVTSMFEPS

SEQ ID NO: 804750 - protein, 9 aa, Homo Sapiens
RVPGLVGSP

SEQ ID NO: 804751 - protein, 9 aa, Homo Sapiens
LPHWTKVVL

SEQ ID NO: 804752 - protein, 9 aa, Homo Sapiens
LHKSCVDPW

SEQ ID NO: 804753 - protein, 9 aa, Homo Sapiens
SSPAAARLR

SEQ ID NO: 804754 - protein, 9 aa, Homo Sapiens
CPRVLAPKA

SEQ ID NO: 804755 - protein, 9 aa, Homo Sapiens
LDRTHSHGT

SEQ ID NO: 804756 - protein, 9 aa, Homo Sapiens
ILQLPQAQS

SEQ ID NO: 804757 - protein, 9 aa, Homo Sapiens
CKEAHPKYP

SEQ ID NO: 804758 - protein, 9 aa, Homo Sapiens
GLRIKETKK

SEQ ID NO: 804759 - protein, 9 aa, Homo Sapiens
KEMAEHEAF

SEQ ID NO: 804760 - protein, 9 aa, Homo Sapiens
CAGLLEDNN

SEQ ID NO: 804761 - protein, 9 aa, Homo Sapiens
TLINEEVKN

SEQ ID NO: 804762 - protein, 9 aa, Homo Sapiens
QIQEPGSSL

SEQ ID NO: 804763 - protein, 9 aa, Homo Sapiens
VLLTENVEV

SEQ ID NO: 804764 - protein, 9 aa, Homo Sapiens
PRILNTHLS

SEQ ID NO: 804765 - protein, 9 aa, Homo Sapiens
LILASQVLS

SEQ ID NO: 804766 - protein, 9 aa, Homo Sapiens
VYEMIQCFW

SEQ ID NO: 804767 - protein, 9 aa, Homo Sapiens
TEEVSSKEI

SEQ ID NO: 804768 - protein, 9 aa, Homo Sapiens
EINKIAAAK

SEQ ID NO: 804769 - protein, 9 aa, Homo Sapiens
KYFGFNTNA

SEQ ID NO: 804770 - protein, 9 aa, Homo Sapiens
DFPKDVLVQ

SEQ ID NO: 804771 - protein, 9 aa, Homo Sapiens
MDLAYTSYS

SEQ ID NO: 804772 - protein, 9 aa, Homo Sapiens
ILCSRGLQS

SEQ ID NO: 804773 - protein, 9 aa, Homo Sapiens
VRRQRLRSK

SEQ ID NO: 804774 - protein, 9 aa, Homo Sapiens
RRRMHLVYA

SEQ ID NO: 804775 - protein, 9 aa, Homo Sapiens
YRLVVFKLE

SEQ ID NO: 804776 - protein, 9 aa, Homo Sapiens
PTNNQQVKP

SEQ ID NO: 804777 - protein, 9 aa, Homo Sapiens
GTTRPNGPN

SEQ ID NO: 804778 - protein, 9 aa, Homo Sapiens
EASFISAQA

SEQ ID NO: 804779 - protein, 9 aa, Homo Sapiens
GFERDVGTN

SEQ ID NO: 804780 - protein, 9 aa, Homo Sapiens
QSKTYSTKI

SEQ ID NO: 804781 - protein, 9 aa, Homo Sapiens
MYNIIEDIL

SEQ ID NO: 804782 - protein, 9 aa, Homo Sapiens
IQKFICASN

SEQ ID NO: 804783 - protein, 9 aa, Homo Sapiens
ICLCFSFII

SEQ ID NO: 804784 - protein, 9 aa, Homo Sapiens
QDSEFGWIN

SEQ ID NO: 804785 - protein, 9 aa, Homo Sapiens
EKAILISYD

SEQ ID NO: 804786 - protein, 9 aa, Homo Sapiens
DEYNLFLRG

SEQ ID NO: 804787 - protein, 9 aa, Homo Sapiens
IHLGEKRYK

SEQ ID NO: 804788 - protein, 9 aa, Homo Sapiens
QSPHSLSVS

SEQ ID NO: 804789 - protein, 9 aa, Homo Sapiens
GWNLRWTVA

SEQ ID NO: 804790 - protein, 9 aa, Homo Sapiens
TMLNRKCKK

SEQ ID NO: 804791 - protein, 9 aa, Homo Sapiens
HQEWDGKDS

SEQ ID NO: 804792 - protein, 9 aa, Homo Sapiens
KIICRYQET

SEQ ID NO: 804793 - protein, 9 aa, Homo Sapiens
TDLEYVKLA

SEQ ID NO: 804794 - protein, 9 aa, Homo Sapiens
YLSKQEVDK

SEQ ID NO: 804795 - protein, 9 aa, Homo Sapiens
LTGVMLGSI

SEQ ID NO: 804796 - protein, 9 aa, Homo Sapiens
SSPVRTLQS

SEQ ID NO: 804797 - protein, 9 aa, Homo Sapiens
NMYDVNLNN

SEQ ID NO: 804798 - protein, 9 aa, Homo Sapiens
ISAQASCSG

SEQ ID NO: 804799 - protein, 9 aa, Homo Sapiens
DKTSNIVNI

SEQ ID NO: 804800 - protein, 9 aa, Homo Sapiens
FHLKLRDSN

SEQ ID NO: 804801 - protein, 9 aa, Homo Sapiens
YFEIEFSPG

SEQ ID NO: 804802 - protein, 9 aa, Homo Sapiens
GGILRMFPE

SEQ ID NO: 804803 - protein, 9 aa, Homo Sapiens
ELLGQAAQN

SEQ ID NO: 804804 - protein, 9 aa, Homo Sapiens
QTYPVGTGR

SEQ ID NO: 804805 - protein, 9 aa, Homo Sapiens
VSQFVACEE

SEQ ID NO: 804806 - protein, 9 aa, Homo Sapiens
LLMGMDSTL

SEQ ID NO: 804807 - protein, 9 aa, Homo Sapiens
DLSLAFLVR

SEQ ID NO: 804808 - protein, 9 aa, Homo Sapiens
VPHAETERL

SEQ ID NO: 804809 - protein, 9 aa, Homo Sapiens
DRIRHKEAQ

SEQ ID NO: 804810 - protein, 9 aa, Homo Sapiens
DIISDPDSQ

SEQ ID NO: 804811 - protein, 9 aa, Homo Sapiens
ANLIMEVYH

SEQ ID NO: 804812 - protein, 9 aa, Homo Sapiens
KHQPPPIKL

SEQ ID NO: 804813 - protein, 9 aa, Homo Sapiens
VLGKSNIQF

SEQ ID NO: 804814 - protein, 9 aa, Homo Sapiens
MDNYSSLVS

SEQ ID NO: 804815 - protein, 9 aa, Homo Sapiens
KAHVKCKAF

SEQ ID NO: 804816 - protein, 9 aa, Homo Sapiens
ICMHTNKRV

SEQ ID NO: 804817 - protein, 9 aa, Homo Sapiens
YDLEPFLQR

SEQ ID NO: 804818 - protein, 9 aa, Homo Sapiens
DNQIMPNTG

SEQ ID NO: 804819 - protein, 9 aa, Homo Sapiens
LEIMDGKIF

SEQ ID NO: 804820 - protein, 9 aa, Homo Sapiens
LNTSTAPNS

SEQ ID NO: 804821 - protein, 9 aa, Homo Sapiens
HTYQSITER

SEQ ID NO: 804822 - protein, 9 aa, Homo Sapiens
QTCHFSTLK

SEQ ID NO: 804823 - protein, 9 aa, Homo Sapiens
FSSLFKGFF

SEQ ID NO: 804824 - protein, 9 aa, Homo Sapiens
TGLFNPQGF

SEQ ID NO: 804825 - protein, 9 aa, Homo Sapiens
EKRSQTQEA

SEQ ID NO: 804826 - protein, 9 aa, Homo Sapiens
GASVAVFLL

SEQ ID NO: 804827 - protein, 9 aa, Homo Sapiens
ESDTRRLSS

SEQ ID NO: 804828 - protein, 9 aa, Homo Sapiens
CLGPQIQIG

SEQ ID NO: 804829 - protein, 9 aa, Homo Sapiens
SSLAAFQLQ

SEQ ID NO: 804830 - protein, 9 aa, Homo Sapiens
IPGLAYAEI

SEQ ID NO: 804831 - protein, 9 aa, Homo Sapiens
QDKIKTNIT

SEQ ID NO: 804832 - protein, 9 aa, Homo Sapiens
KDSDKLKEE

SEQ ID NO: 804833 - protein, 9 aa, Homo Sapiens
EIRDQIQRR

SEQ ID NO: 804834 - protein, 9 aa, Homo Sapiens
PNTPGYLVG

SEQ ID NO: 804835 - protein, 9 aa, Homo Sapiens
QKCPLLPVR

SEQ ID NO: 804836 - protein, 9 aa, Homo Sapiens
EAQEILARN

SEQ ID NO: 804837 - protein, 9 aa, Homo Sapiens
KQKQLKSKL

SEQ ID NO: 804838 - protein, 9 aa, Homo Sapiens
MPNTGFLII

SEQ ID NO: 804839 - protein, 9 aa, Homo Sapiens
DSYYSLLID

SEQ ID NO: 804840 - protein, 9 aa, Homo Sapiens
ETQGNDRLK

SEQ ID NO: 804841 - protein, 9 aa, Homo Sapiens
IYLKGMYRI

SEQ ID NO: 804842 - protein, 9 aa, Homo Sapiens
LPLYISILF

SEQ ID NO: 804843 - protein, 9 aa, Homo Sapiens
DNLKDMIFL

SEQ ID NO: 804844 - protein, 9 aa, Homo Sapiens
IIRNEDIKS

SEQ ID NO: 804845 - protein, 9 aa, Homo Sapiens
QKLFDELRM

SEQ ID NO: 804846 - protein, 9 aa, Homo Sapiens
HRKYSHHDK

SEQ ID NO: 804847 - protein, 9 aa, Homo Sapiens
HERIHMRDK

SEQ ID NO: 804848 - protein, 9 aa, Homo Sapiens
FSQGFNEQQ

SEQ ID NO: 804849 - protein, 9 aa, Homo Sapiens
QSFLGCDEL

SEQ ID NO: 804850 - protein, 9 aa, Homo Sapiens
RWTCIGDLH

SEQ ID NO: 804851 - protein, 9 aa, Homo Sapiens
FCSDELRRH

SEQ ID NO: 804852 - protein, 9 aa, Homo Sapiens
LINGAWEIV

SEQ ID NO: 804853 - protein, 9 aa, Homo Sapiens
LIRDQLKTE

SEQ ID NO: 804854 - protein, 9 aa, Homo Sapiens
ISTPTATVA

SEQ ID NO: 804855 - protein, 9 aa, Homo Sapiens
SLICAYRVR

SEQ ID NO: 804856 - protein, 9 aa, Homo Sapiens
IKEIVKSHS

SEQ ID NO: 804857 - protein, 9 aa, Homo Sapiens
LLRAGTGFS

SEQ ID NO: 804858 - protein, 9 aa, Homo Sapiens
PRKQLQFEG

SEQ ID NO: 804859 - protein, 9 aa, Homo Sapiens
IDMLHIEFK

SEQ ID NO: 804860 - protein, 9 aa, Homo Sapiens
KVEGSKYGI

SEQ ID NO: 804861 - protein, 9 aa, Homo Sapiens
SPAHIVQIP

SEQ ID NO: 804862 - protein, 9 aa, Homo Sapiens
PTKSMMEVE

SEQ ID NO: 804863 - protein, 9 aa, Homo Sapiens
GSLKEVHTI

SEQ ID NO: 804864 - protein, 9 aa, Homo Sapiens
ESKRMIYNH

SEQ ID NO: 804865 - protein, 9 aa, Homo Sapiens
PGTPLLDFP

SEQ ID NO: 804866 - protein, 9 aa, Homo Sapiens
TADVVLAHL

SEQ ID NO: 804867 - protein, 9 aa, Homo Sapiens
LSDTKIISL

SEQ ID NO: 804868 - protein, 9 aa, Homo Sapiens
ADKMFLITR

SEQ ID NO: 804869 - protein, 9 aa, Homo Sapiens
DKSGKAFGQ

SEQ ID NO: 804870 - protein, 9 aa, Homo Sapiens
HDFSVIFSV

SEQ ID NO: 804871 - protein, 9 aa, Homo Sapiens
LGVGVFLRD

SEQ ID NO: 804872 - protein, 9 aa, Homo Sapiens
ESRVNAIHL

SEQ ID NO: 804873 - protein, 9 aa, Homo Sapiens
QTLLNETPE

SEQ ID NO: 804874 - protein, 9 aa, Homo Sapiens
KNLYYAAVP

SEQ ID NO: 804875 - protein, 9 aa, Homo Sapiens
IHFSQWEMK

SEQ ID NO: 804876 - protein, 9 aa, Homo Sapiens
FLLLINVDR

SEQ ID NO: 804877 - protein, 9 aa, Homo Sapiens
NCVNSGSGS

SEQ ID NO: 804878 - protein, 9 aa, Homo Sapiens
SPKEVRKNV

SEQ ID NO: 804879 - protein, 9 aa, Homo Sapiens
VSLFFGTYF

SEQ ID NO: 804880 - protein, 9 aa, Homo Sapiens
LEQLLKFIT

SEQ ID NO: 804881 - protein, 9 aa, Homo Sapiens
MTQQEYQEK

SEQ ID NO: 804882 - protein, 9 aa, Homo Sapiens
RSVEYHYLV

SEQ ID NO: 804883 - protein, 9 aa, Homo Sapiens
QLTKDTESI

SEQ ID NO: 804884 - protein, 9 aa, Homo Sapiens
PAHQRCDDF

SEQ ID NO: 804885 - protein, 9 aa, Homo Sapiens
LFNDVRLLL

SEQ ID NO: 804886 - protein, 9 aa, Homo Sapiens
AATPIKDGP

SEQ ID NO: 804887 - protein, 9 aa, Homo Sapiens
PGFPGDVGA

SEQ ID NO: 804888 - protein, 9 aa, Homo Sapiens
SFLVTVVDY

SEQ ID NO: 804889 - protein, 9 aa, Homo Sapiens
KEDGIVPLC

SEQ ID NO: 804890 - protein, 9 aa, Homo Sapiens
DAGSAVLIR

SEQ ID NO: 804891 - protein, 9 aa, Homo Sapiens
NNRTMKYKP

SEQ ID NO: 804892 - protein, 9 aa, Homo Sapiens
RYQNNNPPN

SEQ ID NO: 804893 - protein, 9 aa, Homo Sapiens
GIYTEDIPG

SEQ ID NO: 804894 - protein, 9 aa, Homo Sapiens
LLILGSYAI

SEQ ID NO: 804895 - protein, 9 aa, Homo Sapiens
IDPMGGNTT

SEQ ID NO: 804896 - protein, 9 aa, Homo Sapiens
CQVARSREL

SEQ ID NO: 804897 - protein, 9 aa, Homo Sapiens
CNSVIQALY

SEQ ID NO: 804898 - protein, 9 aa, Homo Sapiens
QQFDVLFRS

SEQ ID NO: 804899 - protein, 9 aa, Homo Sapiens
LTSGSLETT

SEQ ID NO: 804900 - protein, 9 aa, Homo Sapiens
HIDLGAYSY

SEQ ID NO: 804901 - protein, 9 aa, Homo Sapiens
NFTKLENKT

SEQ ID NO: 804902 - protein, 9 aa, Homo Sapiens
TQSITSQNN

SEQ ID NO: 804903 - protein, 9 aa, Homo Sapiens
RGDRIKSLS

SEQ ID NO: 804904 - protein, 9 aa, Homo Sapiens
IEDSKEAEK

SEQ ID NO: 804905 - protein, 9 aa, Homo Sapiens
PEAERVLQY

SEQ ID NO: 804906 - protein, 9 aa, Homo Sapiens
ELPSVRPLP

SEQ ID NO: 804907 - protein, 9 aa, Homo Sapiens
NNIEHIPKF

SEQ ID NO: 804908 - protein, 9 aa, Homo Sapiens
IIYLSTVMH

SEQ ID NO: 804909 - protein, 9 aa, Homo Sapiens
RMVGDSRAL

SEQ ID NO: 804910 - protein, 9 aa, Homo Sapiens
NVTSKFPRQ

SEQ ID NO: 804911 - protein, 9 aa, Homo Sapiens
VCCGSCRDS

SEQ ID NO: 804912 - protein, 9 aa, Homo Sapiens
IGTDSWNHS

SEQ ID NO: 804913 - protein, 9 aa, Homo Sapiens
YANIPAHTR

SEQ ID NO: 804914 - protein, 9 aa, Homo Sapiens
SSYLSLPNP

SEQ ID NO: 804915 - protein, 9 aa, Homo Sapiens
CGARPLSCS

SEQ ID NO: 804916 - protein, 9 aa, Homo Sapiens
TNVLEIMKE

SEQ ID NO: 804917 - protein, 9 aa, Homo Sapiens
GVSPQPLQS

SEQ ID NO: 804918 - protein, 9 aa, Homo Sapiens
KLHWEDFNV

SEQ ID NO: 804919 - protein, 9 aa, Homo Sapiens
IINYLVTEG

SEQ ID NO: 804920 - protein, 9 aa, Homo Sapiens
LNMWLCPIK

SEQ ID NO: 804921 - protein, 9 aa, Homo Sapiens
NVYPSQRDE

SEQ ID NO: 804922 - protein, 9 aa, Homo Sapiens
MEKSTMVYN

SEQ ID NO: 804923 - protein, 9 aa, Homo Sapiens
LPRVISPES

SEQ ID NO: 804924 - protein, 9 aa, Homo Sapiens
LQFPGCFSP

SEQ ID NO: 804925 - protein, 9 aa, Homo Sapiens
NHVQPYIPY

SEQ ID NO: 804926 - protein, 9 aa, Homo Sapiens
DNRWVPVTV

SEQ ID NO: 804927 - protein, 9 aa, Homo Sapiens
AVNDEIEAN

SEQ ID NO: 804928 - protein, 9 aa, Homo Sapiens
DWISKNIYW

SEQ ID NO: 804929 - protein, 9 aa, Homo Sapiens
MSQTTISHL

SEQ ID NO: 804930 - protein, 9 aa, Homo Sapiens
QKLFYLGAG

SEQ ID NO: 804931 - protein, 9 aa, Homo Sapiens
AEEQGYDQD

SEQ ID NO: 804932 - protein, 9 aa, Homo Sapiens
WEMEHTDIT

SEQ ID NO: 804933 - protein, 9 aa, Homo Sapiens
STVFSSVLS

SEQ ID NO: 804934 - protein, 9 aa, Homo Sapiens
INPILYDIM

SEQ ID NO: 804935 - protein, 9 aa, Homo Sapiens
LKQVIEICS

SEQ ID NO: 804936 - protein, 9 aa, Homo Sapiens
DMKLIFLGS

SEQ ID NO: 804937 - protein, 9 aa, Homo Sapiens
QGYVPVIGA

SEQ ID NO: 804938 - protein, 9 aa, Homo Sapiens
PCQKGKCSR

SEQ ID NO: 804939 - protein, 9 aa, Homo Sapiens
WAQLNRYMI

SEQ ID NO: 804940 - protein, 9 aa, Homo Sapiens
EISEDTRSR

SEQ ID NO: 804941 - protein, 9 aa, Homo Sapiens
CYVHNDMFR

SEQ ID NO: 804942 - protein, 9 aa, Homo Sapiens
RIRYFPVFE

SEQ ID NO: 804943 - protein, 9 aa, Homo Sapiens
LEHASDLQV

SEQ ID NO: 804944 - protein, 9 aa, Homo Sapiens
DYKIKYEFF

SEQ ID NO: 804945 - protein, 9 aa, Homo Sapiens
TQISYLVQH

SEQ ID NO: 804946 - protein, 9 aa, Homo Sapiens
SVLQNQDNK

SEQ ID NO: 804947 - protein, 9 aa, Homo Sapiens
PYWSPAMAG

SEQ ID NO: 804948 - protein, 9 aa, Homo Sapiens
RGQTCGICG

SEQ ID NO: 804949 - protein, 9 aa, Homo Sapiens
ENIADNGDL

SEQ ID NO: 804950 - protein, 9 aa, Homo Sapiens
EKLDLRTVA

SEQ ID NO: 804951 - protein, 9 aa, Homo Sapiens
CLARCWDTA

SEQ ID NO: 804952 - protein, 9 aa, Homo Sapiens
LRRHTQKMQ

SEQ ID NO: 804953 - protein, 9 aa, Homo Sapiens
GIDYNCRER

SEQ ID NO: 804954 - protein, 9 aa, Homo Sapiens
VKKKRWNHP

SEQ ID NO: 804955 - protein, 9 aa, Homo Sapiens
PHAETERLF

SEQ ID NO: 804956 - protein, 9 aa, Homo Sapiens
NFIGYKNFN

SEQ ID NO: 804957 - protein, 9 aa, Homo Sapiens
AENASCGLC

SEQ ID NO: 804958 - protein, 9 aa, Homo Sapiens
HDNLQLKIG

SEQ ID NO: 804959 - protein, 9 aa, Homo Sapiens
HSSPRRKMA

SEQ ID NO: 804960 - protein, 9 aa, Homo Sapiens
VSTNWSDVG

SEQ ID NO: 804961 - protein, 9 aa, Homo Sapiens
ILAKLQANH

SEQ ID NO: 804962 - protein, 9 aa, Homo Sapiens
KEIKVSNRK

SEQ ID NO: 804963 - protein, 9 aa, Homo Sapiens
DEDAVKTIS

SEQ ID NO: 804964 - protein, 9 aa, Homo Sapiens
IVIHFPHPN

SEQ ID NO: 804965 - protein, 9 aa, Homo Sapiens
DGMRESFTA

SEQ ID NO: 804966 - protein, 9 aa, Homo Sapiens
NPDGKIKEE

SEQ ID NO: 804967 - protein, 9 aa, Homo Sapiens
KYWALPSLK

SEQ ID NO: 804968 - protein, 9 aa, Homo Sapiens
GPLHLGYIE

SEQ ID NO: 804969 - protein, 9 aa, Homo Sapiens
KCLDVSSNK

SEQ ID NO: 804970 - protein, 9 aa, Homo Sapiens
NTQSSLIYL

SEQ ID NO: 804971 - protein, 9 aa, Homo Sapiens
THKDDSVMK

SEQ ID NO: 804972 - protein, 9 aa, Homo Sapiens
LRFGKTKSI

SEQ ID NO: 804973 - protein, 9 aa, Homo Sapiens
LCWLFLNIL

SEQ ID NO: 804974 - protein, 9 aa, Homo Sapiens
TSNRSVCDT

SEQ ID NO: 804975 - protein, 9 aa, Homo Sapiens
IRLLATNYL

SEQ ID NO: 804976 - protein, 9 aa, Homo Sapiens
ISTVYAGTF

SEQ ID NO: 804977 - protein, 9 aa, Homo Sapiens
RRNTGQLDC

SEQ ID NO: 804978 - protein, 9 aa, Homo Sapiens
SQATKYRSL

SEQ ID NO: 804979 - protein, 9 aa, Homo Sapiens
PPKEHARAT

SEQ ID NO: 804980 - protein, 9 aa, Homo Sapiens
LSFYYFSCH

SEQ ID NO: 804981 - protein, 9 aa, Homo Sapiens
EEIVQNFQS

SEQ ID NO: 804982 - protein, 9 aa, Homo Sapiens
TKMNECVMK

SEQ ID NO: 804983 - protein, 9 aa, Homo Sapiens
GTNTNKLLA

SEQ ID NO: 804984 - protein, 9 aa, Homo Sapiens
LLNAEYYRW

SEQ ID NO: 804985 - protein, 9 aa, Homo Sapiens
KSPVGVQPV

SEQ ID NO: 804986 - protein, 9 aa, Homo Sapiens
FTSNSLSVI

SEQ ID NO: 804987 - protein, 9 aa, Homo Sapiens
KASEKSICI

SEQ ID NO: 804988 - protein, 9 aa, Homo Sapiens
MNNAIFSVA

SEQ ID NO: 804989 - protein, 9 aa, Homo Sapiens
GSFNWHQSA

SEQ ID NO: 804990 - protein, 9 aa, Homo Sapiens
DISSSQMVL

SEQ ID NO: 804991 - protein, 9 aa, Homo Sapiens
LHCQKLVHR

SEQ ID NO: 804992 - protein, 9 aa, Homo Sapiens
GLNTLMESV

SEQ ID NO: 804993 - protein, 9 aa, Homo Sapiens
FTLALTSRV

SEQ ID NO: 804994 - protein, 9 aa, Homo Sapiens
QHQIIYIGE

SEQ ID NO: 804995 - protein, 9 aa, Homo Sapiens
TYPSPYCIV

SEQ ID NO: 804996 - protein, 9 aa, Homo Sapiens
GLEYLVYHL

SEQ ID NO: 804997 - protein, 9 aa, Homo Sapiens
ELNKQKIAF

SEQ ID NO: 804998 - protein, 9 aa, Homo Sapiens
PYEAAHMFF

SEQ ID NO: 804999 - protein, 9 aa, Homo Sapiens
NAYHMSYTM

SEQ ID NO: 805000 - protein, 9 aa, Homo Sapiens
PCWVPQVLR

SEQ ID NO: 805001 - protein, 9 aa, Homo Sapiens
LDAKKYERI

SEQ ID NO: 805002 - protein, 9 aa, Homo Sapiens
LENYLESIE

SEQ ID NO: 805003 - protein, 9 aa, Homo Sapiens
CRQSLLLLP

SEQ ID NO: 805004 - protein, 9 aa, Homo Sapiens
ALEYLELLF

SEQ ID NO: 805005 - protein, 9 aa, Homo Sapiens
GPQLPQYHH

SEQ ID NO: 805006 - protein, 9 aa, Homo Sapiens
FTEDDNPLL

SEQ ID NO: 805007 - protein, 9 aa, Homo Sapiens
LYDIMSKKY

SEQ ID NO: 805008 - protein, 9 aa, Homo Sapiens
RVEGDCFKH

SEQ ID NO: 805009 - protein, 9 aa, Homo Sapiens
ESSSMVLRY

SEQ ID NO: 805010 - protein, 9 aa, Homo Sapiens
CPPQHCQQK

SEQ ID NO: 805011 - protein, 9 aa, Homo Sapiens
KLQANHEKL

SEQ ID NO: 805012 - protein, 9 aa, Homo Sapiens
EAGKAKIED

SEQ ID NO: 805013 - protein, 9 aa, Homo Sapiens
NLVKTAIYA

SEQ ID NO: 805014 - protein, 9 aa, Homo Sapiens
ETYNVDKKQ

SEQ ID NO: 805015 - protein, 9 aa, Homo Sapiens
HLKVLIDNK

SEQ ID NO: 805016 - protein, 9 aa, Homo Sapiens
ETSTKTRQR

SEQ ID NO: 805017 - protein, 9 aa, Homo Sapiens
EIEFSPGGE

SEQ ID NO: 805018 - protein, 9 aa, Homo Sapiens
AMKKICDDA

SEQ ID NO: 805019 - protein, 9 aa, Homo Sapiens
GYENVQLRK

SEQ ID NO: 805020 - protein, 9 aa, Homo Sapiens
LRKNKRQYV

SEQ ID NO: 805021 - protein, 9 aa, Homo Sapiens
PNSGKDEIK

SEQ ID NO: 805022 - protein, 9 aa, Homo Sapiens
NHPTPIIPA

SEQ ID NO: 805023 - protein, 9 aa, Homo Sapiens
EYLDIFGNT

SEQ ID NO: 805024 - protein, 9 aa, Homo Sapiens
VQKLFESLF

SEQ ID NO: 805025 - protein, 9 aa, Homo Sapiens
RAYCESEIN

SEQ ID NO: 805026 - protein, 9 aa, Homo Sapiens
YMDDNFISR

SEQ ID NO: 805027 - protein, 9 aa, Homo Sapiens
HPHMKIFLF

SEQ ID NO: 805028 - protein, 9 aa, Homo Sapiens
KPFSFKWWI

SEQ ID NO: 805029 - protein, 9 aa, Homo Sapiens
LGVPCVGGD

SEQ ID NO: 805030 - protein, 9 aa, Homo Sapiens
LLSHQIIHT

SEQ ID NO: 805031 - protein, 9 aa, Homo Sapiens
SLVNDNKWK

SEQ ID NO: 805032 - protein, 9 aa, Homo Sapiens
RWWGRLSIK

SEQ ID NO: 805033 - protein, 9 aa, Homo Sapiens
GTSPSQNNL

SEQ ID NO: 805034 - protein, 9 aa, Homo Sapiens
EIHAKNIIV

SEQ ID NO: 805035 - protein, 9 aa, Homo Sapiens
EGMRMNYET

SEQ ID NO: 805036 - protein, 9 aa, Homo Sapiens
QEDAHEFIM

SEQ ID NO: 805037 - protein, 9 aa, Homo Sapiens
ILNMTTPNK

SEQ ID NO: 805038 - protein, 9 aa, Homo Sapiens
AHFYNDFVN

SEQ ID NO: 805039 - protein, 9 aa, Homo Sapiens
NEYFFDRNS

SEQ ID NO: 805040 - protein, 9 aa, Homo Sapiens
KVVQRGREL

SEQ ID NO: 805041 - protein, 9 aa, Homo Sapiens
EKSSVLHHC

SEQ ID NO: 805042 - protein, 9 aa, Homo Sapiens
RYNFHSLKS

SEQ ID NO: 805043 - protein, 9 aa, Homo Sapiens
LLIPLSVVL

SEQ ID NO: 805044 - protein, 9 aa, Homo Sapiens
IKPDPPVSH

SEQ ID NO: 805045 - protein, 9 aa, Homo Sapiens
AMINVCPLR

SEQ ID NO: 805046 - protein, 9 aa, Homo Sapiens
IDAQCEAYL

SEQ ID NO: 805047 - protein, 9 aa, Homo Sapiens
VEFGTAIDD

SEQ ID NO: 805048 - protein, 9 aa, Homo Sapiens
KDLRFQEEY

SEQ ID NO: 805049 - protein, 9 aa, Homo Sapiens
AKSENTKDL

SEQ ID NO: 805050 - protein, 9 aa, Homo Sapiens
DQLEQFWTL

SEQ ID NO: 805051 - protein, 9 aa, Homo Sapiens
DSSPVRTLQ

SEQ ID NO: 805052 - protein, 9 aa, Homo Sapiens
GTERFQHVI

SEQ ID NO: 805053 - protein, 9 aa, Homo Sapiens
DLSYLIVSI

SEQ ID NO: 805054 - protein, 9 aa, Homo Sapiens
GRTLPKLYY

SEQ ID NO: 805055 - protein, 9 aa, Homo Sapiens
LPEVLSMES

SEQ ID NO: 805056 - protein, 9 aa, Homo Sapiens
LLLDGISVN

SEQ ID NO: 805057 - protein, 9 aa, Homo Sapiens
KRYFELYEG

SEQ ID NO: 805058 - protein, 9 aa, Homo Sapiens
LPERLAPGH

SEQ ID NO: 805059 - protein, 9 aa, Homo Sapiens
IFLSAHHDK

SEQ ID NO: 805060 - protein, 9 aa, Homo Sapiens
AEPLVPEPP

SEQ ID NO: 805061 - protein, 9 aa, Homo Sapiens
RVAGDKLTG

SEQ ID NO: 805062 - protein, 9 aa, Homo Sapiens
TQERDHTGN

SEQ ID NO: 805063 - protein, 9 aa, Homo Sapiens
KIADRGHLK

SEQ ID NO: 805064 - protein, 9 aa, Homo Sapiens
HNGTKAFFF

SEQ ID NO: 805065 - protein, 9 aa, Homo Sapiens
DYPEKEDYI

SEQ ID NO: 805066 - protein, 9 aa, Homo Sapiens
VSQTNIQHL

SEQ ID NO: 805067 - protein, 9 aa, Homo Sapiens
NAYMLLQPI

SEQ ID NO: 805068 - protein, 9 aa, Homo Sapiens
SNLLNFDID

SEQ ID NO: 805069 - protein, 9 aa, Homo Sapiens
ELSDTMTTT

SEQ ID NO: 805070 - protein, 9 aa, Homo Sapiens
SAGRIYIRA

SEQ ID NO: 805071 - protein, 9 aa, Homo Sapiens
TTLPLPVAT

SEQ ID NO: 805072 - protein, 9 aa, Homo Sapiens
DNFEVQRYD

SEQ ID NO: 805073 - protein, 9 aa, Homo Sapiens
WSDKSEEEL

SEQ ID NO: 805074 - protein, 9 aa, Homo Sapiens
DFTALLTGP

SEQ ID NO: 805075 - protein, 9 aa, Homo Sapiens
QFNAIRVLL

SEQ ID NO: 805076 - protein, 9 aa, Homo Sapiens
PPPATREKK

SEQ ID NO: 805077 - protein, 9 aa, Homo Sapiens
AWGVEVGWD

SEQ ID NO: 805078 - protein, 9 aa, Homo Sapiens
VVQWCDCCL

SEQ ID NO: 805079 - protein, 9 aa, Homo Sapiens
LQFVMGSSR

SEQ ID NO: 805080 - protein, 9 aa, Homo Sapiens
VYPAVMVIL

SEQ ID NO: 805081 - protein, 9 aa, Homo Sapiens
DSIAHSSGS

SEQ ID NO: 805082 - protein, 9 aa, Homo Sapiens
AALASRHEY

SEQ ID NO: 805083 - protein, 9 aa, Homo Sapiens
ASKNIITVL

SEQ ID NO: 805084 - protein, 9 aa, Homo Sapiens
WKVLSGFAL

SEQ ID NO: 805085 - protein, 9 aa, Homo Sapiens
VIRQYLDAL

SEQ ID NO: 805086 - protein, 9 aa, Homo Sapiens
INSAVKTSR

SEQ ID NO: 805087 - protein, 9 aa, Homo Sapiens
TESLLFEQS

SEQ ID NO: 805088 - protein, 9 aa, Homo Sapiens
EQDKFLTCD

SEQ ID NO: 805089 - protein, 9 aa, Homo Sapiens
KYMHLKVLK

SEQ ID NO: 805090 - protein, 9 aa, Homo Sapiens
WDASVLAAD

SEQ ID NO: 805091 - protein, 9 aa, Homo Sapiens
LHDQAPQLK

SEQ ID NO: 805092 - protein, 9 aa, Homo Sapiens
AAMEDRLRK

SEQ ID NO: 805093 - protein, 9 aa, Homo Sapiens
RIRRKSSRP

SEQ ID NO: 805094 - protein, 9 aa, Homo Sapiens
GITEIVTKP

SEQ ID NO: 805095 - protein, 9 aa, Homo Sapiens
AVDVTQGYN

SEQ ID NO: 805096 - protein, 9 aa, Homo Sapiens
YYVARELDQ

SEQ ID NO: 805097 - protein, 9 aa, Homo Sapiens
AEQDKFLTC

SEQ ID NO: 805098 - protein, 9 aa, Homo Sapiens
PTCVAVCVS

SEQ ID NO: 805099 - protein, 9 aa, Homo Sapiens
VRWLRRDIS

SEQ ID NO: 805100 - protein, 9 aa, Homo Sapiens
KTIASLRAQ

SEQ ID NO: 805101 - protein, 9 aa, Homo Sapiens
QNLPKPIES

SEQ ID NO: 805102 - protein, 9 aa, Homo Sapiens
LRFHENHCG

SEQ ID NO: 805103 - protein, 9 aa, Homo Sapiens
LITTLTFPF

SEQ ID NO: 805104 - protein, 9 aa, Homo Sapiens
INSVINCFN

SEQ ID NO: 805105 - protein, 9 aa, Homo Sapiens
YFKIFDSLS

SEQ ID NO: 805106 - protein, 9 aa, Homo Sapiens
TPNHNQQNG

SEQ ID NO: 805107 - protein, 9 aa, Homo Sapiens
KRPFPDETH

SEQ ID NO: 805108 - protein, 9 aa, Homo Sapiens
IGPACWDLT

SEQ ID NO: 805109 - protein, 9 aa, Homo Sapiens
IEQPFGLYP

SEQ ID NO: 805110 - protein, 9 aa, Homo Sapiens
VMEYLGRPI

SEQ ID NO: 805111 - protein, 9 aa, Homo Sapiens
HTFYFENLL

SEQ ID NO: 805112 - protein, 9 aa, Homo Sapiens
NNVPRQNSA

SEQ ID NO: 805113 - protein, 9 aa, Homo Sapiens
QKAWRCHVA

SEQ ID NO: 805114 - protein, 9 aa, Homo Sapiens
PSWAGLSLA

SEQ ID NO: 805115 - protein, 9 aa, Homo Sapiens
FILFRGFFP

SEQ ID NO: 805116 - protein, 9 aa, Homo Sapiens
SSTSTDVEM

SEQ ID NO: 805117 - protein, 9 aa, Homo Sapiens
PSLLSYMIS

SEQ ID NO: 805118 - protein, 9 aa, Homo Sapiens
RDLSRHEQR

SEQ ID NO: 805119 - protein, 9 aa, Homo Sapiens
VPRMPQWRC

SEQ ID NO: 805120 - protein, 9 aa, Homo Sapiens
TENLLHLVD

SEQ ID NO: 805121 - protein, 9 aa, Homo Sapiens
KLSRSDPHH

SEQ ID NO: 805122 - protein, 9 aa, Homo Sapiens
EEQERERRW

SEQ ID NO: 805123 - protein, 9 aa, Homo Sapiens
FFFVFSIKQ

SEQ ID NO: 805124 - protein, 9 aa, Homo Sapiens
DLRENGEVT

SEQ ID NO: 805125 - protein, 9 aa, Homo Sapiens
KEEAIIPCF

SEQ ID NO: 805126 - protein, 9 aa, Homo Sapiens
EGRKVCAIY

SEQ ID NO: 805127 - protein, 9 aa, Homo Sapiens
FDHQGEIYV

SEQ ID NO: 805128 - protein, 9 aa, Homo Sapiens
LMGELLMHS

SEQ ID NO: 805129 - protein, 9 aa, Homo Sapiens
RIAVEYSDL

SEQ ID NO: 805130 - protein, 9 aa, Homo Sapiens
NYLFRAIQE

SEQ ID NO: 805131 - protein, 9 aa, Homo Sapiens
HDAHIVHIA

SEQ ID NO: 805132 - protein, 9 aa, Homo Sapiens
RCPFGVVDE

SEQ ID NO: 805133 - protein, 9 aa, Homo Sapiens
ICDFHKNVI

SEQ ID NO: 805134 - protein, 9 aa, Homo Sapiens
PLFSYCLAQ

SEQ ID NO: 805135 - protein, 9 aa, Homo Sapiens
LHGRCLGNK

SEQ ID NO: 805136 - protein, 9 aa, Homo Sapiens
RRQQRSEKK

SEQ ID NO: 805137 - protein, 9 aa, Homo Sapiens
TSGLEISHK

SEQ ID NO: 805138 - protein, 9 aa, Homo Sapiens
SDEDCQLSI

SEQ ID NO: 805139 - protein, 9 aa, Homo Sapiens
KGPMSIPII

SEQ ID NO: 805140 - protein, 9 aa, Homo Sapiens
PHPKPETTL

SEQ ID NO: 805141 - protein, 9 aa, Homo Sapiens
KKDQQIAVT

SEQ ID NO: 805142 - protein, 9 aa, Homo Sapiens
GTVNTKNKR

SEQ ID NO: 805143 - protein, 9 aa, Homo Sapiens
QNNVSPKGM

SEQ ID NO: 805144 - protein, 9 aa, Homo Sapiens
AHISTNPRL

SEQ ID NO: 805145 - protein, 9 aa, Homo Sapiens
SLENNLLLQ

SEQ ID NO: 805146 - protein, 9 aa, Homo Sapiens
GERTLQRLQ

SEQ ID NO: 805147 - protein, 9 aa, Homo Sapiens
DTLASHSFT

SEQ ID NO: 805148 - protein, 9 aa, Homo Sapiens
RVETLMFSN

SEQ ID NO: 805149 - protein, 9 aa, Homo Sapiens
TLGGDHTLT

SEQ ID NO: 805150 - protein, 9 aa, Homo Sapiens
SSHYTFSKP

SEQ ID NO: 805151 - protein, 9 aa, Homo Sapiens
TKTEVAIQI

SEQ ID NO: 805152 - protein, 9 aa, Homo Sapiens
GLMWWMLAW

SEQ ID NO: 805153 - protein, 9 aa, Homo Sapiens
FAFMYITIL

SEQ ID NO: 805154 - protein, 9 aa, Homo Sapiens
DQNIEYEEL

SEQ ID NO: 805155 - protein, 9 aa, Homo Sapiens
PESVKKPIH

SEQ ID NO: 805156 - protein, 9 aa, Homo Sapiens
MILHFATEN

SEQ ID NO: 805157 - protein, 9 aa, Homo Sapiens
DCRYKTIQT

SEQ ID NO: 805158 - protein, 9 aa, Homo Sapiens
EKSGELRKD

SEQ ID NO: 805159 - protein, 9 aa, Homo Sapiens
QLFRDMDDE

SEQ ID NO: 805160 - protein, 9 aa, Homo Sapiens
QEILARNLN

SEQ ID NO: 805161 - protein, 9 aa, Homo Sapiens
FMFFGPEIK

SEQ ID NO: 805162 - protein, 9 aa, Homo Sapiens
GEGGKNFSR

SEQ ID NO: 805163 - protein, 9 aa, Homo Sapiens
SKDDTRVST

SEQ ID NO: 805164 - protein, 9 aa, Homo Sapiens
GDRGQGVLH

SEQ ID NO: 805165 - protein, 9 aa, Homo Sapiens
DVEPCKNGG

SEQ ID NO: 805166 - protein, 9 aa, Homo Sapiens
ADVQKILEI

SEQ ID NO: 805167 - protein, 9 aa, Homo Sapiens
FPISHIHYW

SEQ ID NO: 805168 - protein, 9 aa, Homo Sapiens
PLPTHFEED

SEQ ID NO: 805169 - protein, 9 aa, Homo Sapiens
DVLYKLSPK

SEQ ID NO: 805170 - protein, 9 aa, Homo Sapiens
LVDNEELNL

SEQ ID NO: 805171 - protein, 9 aa, Homo Sapiens
SAKSFKNKT

SEQ ID NO: 805172 - protein, 9 aa, Homo Sapiens
CIHSLSNVK

SEQ ID NO: 805173 - protein, 9 aa, Homo Sapiens
RFAGCLHPW

SEQ ID NO: 805174 - protein, 9 aa, Homo Sapiens
SCYHDHRSV

SEQ ID NO: 805175 - protein, 9 aa, Homo Sapiens
SVSLRAPAQ

SEQ ID NO: 805176 - protein, 9 aa, Homo Sapiens
SVRKHPDCS

SEQ ID NO: 805177 - protein, 9 aa, Homo Sapiens
ATGRDRRGR

SEQ ID NO: 805178 - protein, 9 aa, Homo Sapiens
AHPKYPDCA

SEQ ID NO: 805179 - protein, 9 aa, Homo Sapiens
PCLSPDTQP

SEQ ID NO: 805180 - protein, 9 aa, Homo Sapiens
LVVLDYISP

SEQ ID NO: 805181 - protein, 9 aa, Homo Sapiens
AWCETNLWR

SEQ ID NO: 805182 - protein, 9 aa, Homo Sapiens
DYPPTTKPL

SEQ ID NO: 805183 - protein, 9 aa, Homo Sapiens
NSAESHGLC

SEQ ID NO: 805184 - protein, 9 aa, Homo Sapiens
HQIIRDLED

SEQ ID NO: 805185 - protein, 9 aa, Homo Sapiens
LSNGQNPLP

SEQ ID NO: 805186 - protein, 9 aa, Homo Sapiens
HNPLGDVYS

SEQ ID NO: 805187 - protein, 9 aa, Homo Sapiens
FKLDYNYLY

SEQ ID NO: 805188 - protein, 9 aa, Homo Sapiens
VTNQTGLKL

SEQ ID NO: 805189 - protein, 9 aa, Homo Sapiens
FDLLSQFQS

SEQ ID NO: 805190 - protein, 9 aa, Homo Sapiens
AQPNPGLLQ

SEQ ID NO: 805191 - protein, 9 aa, Homo Sapiens
AKKQKKGAK

SEQ ID NO: 805192 - protein, 9 aa, Homo Sapiens
GNVTINFSG

SEQ ID NO: 805193 - protein, 9 aa, Homo Sapiens
GWAVQDVAR

SEQ ID NO: 805194 - protein, 9 aa, Homo Sapiens
CLAAAPSRY

SEQ ID NO: 805195 - protein, 9 aa, Homo Sapiens
LQTDSKIIT

SEQ ID NO: 805196 - protein, 9 aa, Homo Sapiens
SKSGCSRDE

SEQ ID NO: 805197 - protein, 9 aa, Homo Sapiens
AKDPKPAIH

SEQ ID NO: 805198 - protein, 9 aa, Homo Sapiens
TLETLLTYP

SEQ ID NO: 805199 - protein, 9 aa, Homo Sapiens
AHTRHYQSY

SEQ ID NO: 805200 - protein, 9 aa, Homo Sapiens
CPVQNDIAY

SEQ ID NO: 805201 - protein, 9 aa, Homo Sapiens
FTEREASKI

SEQ ID NO: 805202 - protein, 9 aa, Homo Sapiens
LCVGAYTIL

SEQ ID NO: 805203 - protein, 9 aa, Homo Sapiens
VGKEESLPE

SEQ ID NO: 805204 - protein, 9 aa, Homo Sapiens
CMPSTLGLQ

SEQ ID NO: 805205 - protein, 9 aa, Homo Sapiens
ITSNTYPPD

SEQ ID NO: 805206 - protein, 9 aa, Homo Sapiens
YLESIEDNS

SEQ ID NO: 805207 - protein, 9 aa, Homo Sapiens
AGGVRMDVV

SEQ ID NO: 805208 - protein, 9 aa, Homo Sapiens
VKVKVNCSD

SEQ ID NO: 805209 - protein, 9 aa, Homo Sapiens
TFTCYYVLF

SEQ ID NO: 805210 - protein, 9 aa, Homo Sapiens
YKHIDHTFE

SEQ ID NO: 805211 - protein, 9 aa, Homo Sapiens
SMDEFILKK

SEQ ID NO: 805212 - protein, 9 aa, Homo Sapiens
CVPISTELD

SEQ ID NO: 805213 - protein, 9 aa, Homo Sapiens
AHKVLLNIR

SEQ ID NO: 805214 - protein, 9 aa, Homo Sapiens
GKQTWRRKG

SEQ ID NO: 805215 - protein, 9 aa, Homo Sapiens
NLNLVWEEK

SEQ ID NO: 805216 - protein, 9 aa, Homo Sapiens
SCLDILVNW

SEQ ID NO: 805217 - protein, 9 aa, Homo Sapiens
VALASVYSL

SEQ ID NO: 805218 - protein, 9 aa, Homo Sapiens
ASVANVACG

SEQ ID NO: 805219 - protein, 9 aa, Homo Sapiens
KQGHTRQWL

SEQ ID NO: 805220 - protein, 9 aa, Homo Sapiens
IIHPVLGHP

SEQ ID NO: 805221 - protein, 9 aa, Homo Sapiens
PSPPPLGAA

SEQ ID NO: 805222 - protein, 9 aa, Homo Sapiens
ICAELTAIQ

SEQ ID NO: 805223 - protein, 9 aa, Homo Sapiens
HITTPEQLY

SEQ ID NO: 805224 - protein, 9 aa, Homo Sapiens
FANECPKPE

SEQ ID NO: 805225 - protein, 9 aa, Homo Sapiens
LVLAPSGGE

SEQ ID NO: 805226 - protein, 9 aa, Homo Sapiens
ILAHKDCPV

SEQ ID NO: 805227 - protein, 9 aa, Homo Sapiens
VWKNRKKLK

SEQ ID NO: 805228 - protein, 9 aa, Homo Sapiens
VLNSPKLFC

SEQ ID NO: 805229 - protein, 9 aa, Homo Sapiens
IFSYDKTKD

SEQ ID NO: 805230 - protein, 9 aa, Homo Sapiens
GKGIRLTAA

SEQ ID NO: 805231 - protein, 9 aa, Homo Sapiens
EMQKYVPNK

SEQ ID NO: 805232 - protein, 9 aa, Homo Sapiens
STLRYFCGR

SEQ ID NO: 805233 - protein, 9 aa, Homo Sapiens
TQERMHHDI

SEQ ID NO: 805234 - protein, 9 aa, Homo Sapiens
KEINQYGEV

SEQ ID NO: 805235 - protein, 9 aa, Homo Sapiens
EAEKPQRNG

SEQ ID NO: 805236 - protein, 9 aa, Homo Sapiens
DCDIIKNYG

SEQ ID NO: 805237 - protein, 9 aa, Homo Sapiens
YFDFRLYCL

SEQ ID NO: 805238 - protein, 9 aa, Homo Sapiens
CPIYYLMAN

SEQ ID NO: 805239 - protein, 9 aa, Homo Sapiens
SVRGTTHVL

SEQ ID NO: 805240 - protein, 9 aa, Homo Sapiens
TFKLTLQAR

SEQ ID NO: 805241 - protein, 9 aa, Homo Sapiens
LSTHHLRDC

SEQ ID NO: 805242 - protein, 9 aa, Homo Sapiens
VLNNAIFDE

SEQ ID NO: 805243 - protein, 9 aa, Homo Sapiens
EKIITKKKS

SEQ ID NO: 805244 - protein, 9 aa, Homo Sapiens
FARFDQLAH

SEQ ID NO: 805245 - protein, 9 aa, Homo Sapiens
RRHHPKTYP

SEQ ID NO: 805246 - protein, 9 aa, Homo Sapiens
FTRDEWQHL

SEQ ID NO: 805247 - protein, 9 aa, Homo Sapiens
RQPGAYQPC

SEQ ID NO: 805248 - protein, 9 aa, Homo Sapiens
DYGLFRAIS

SEQ ID NO: 805249 - protein, 9 aa, Homo Sapiens
AIMGDHNRN

SEQ ID NO: 805250 - protein, 9 aa, Homo Sapiens
SDQSLSHLP

SEQ ID NO: 805251 - protein, 9 aa, Homo Sapiens
QPYISIGKQ

SEQ ID NO: 805252 - protein, 9 aa, Homo Sapiens
QFRFSTDYE

SEQ ID NO: 805253 - protein, 9 aa, Homo Sapiens
DPQNIYLRR

SEQ ID NO: 805254 - protein, 9 aa, Homo Sapiens
YLDNMLAEL

SEQ ID NO: 805255 - protein, 9 aa, Homo Sapiens
DKKRQSKIN

SEQ ID NO: 805256 - protein, 9 aa, Homo Sapiens
LNACFDHQG

SEQ ID NO: 805257 - protein, 9 aa, Homo Sapiens
ILYALERAT

SEQ ID NO: 805258 - protein, 9 aa, Homo Sapiens
YVVFGSRNP

SEQ ID NO: 805259 - protein, 9 aa, Homo Sapiens
WNHPKMSLA

SEQ ID NO: 805260 - protein, 9 aa, Homo Sapiens
TSADKSVAK

SEQ ID NO: 805261 - protein, 9 aa, Homo Sapiens
IEAQVKPCL

SEQ ID NO: 805262 - protein, 9 aa, Homo Sapiens
LDKYEQFFR

SEQ ID NO: 805263 - protein, 9 aa, Homo Sapiens
KHLHNKENQ

SEQ ID NO: 805264 - protein, 9 aa, Homo Sapiens
VLDDTNHAR

SEQ ID NO: 805265 - protein, 9 aa, Homo Sapiens
EEAVSFCRE

SEQ ID NO: 805266 - protein, 9 aa, Homo Sapiens
YVIRHGADA

SEQ ID NO: 805267 - protein, 9 aa, Homo Sapiens
TKFERHTLL

SEQ ID NO: 805268 - protein, 9 aa, Homo Sapiens
LGQSHRRQS

SEQ ID NO: 805269 - protein, 9 aa, Homo Sapiens
IGGRKFDLH

SEQ ID NO: 805270 - protein, 9 aa, Homo Sapiens
TNKASILLI

SEQ ID NO: 805271 - protein, 9 aa, Homo Sapiens
SIFGTMLPA

SEQ ID NO: 805272 - protein, 9 aa, Homo Sapiens
EGFLYPSCT

SEQ ID NO: 805273 - protein, 9 aa, Homo Sapiens
EAGPEAERL

SEQ ID NO: 805274 - protein, 9 aa, Homo Sapiens
SSSYNIETA

SEQ ID NO: 805275 - protein, 9 aa, Homo Sapiens
RFKNSLEDF

SEQ ID NO: 805276 - protein, 9 aa, Homo Sapiens
VYFPRIGDK

SEQ ID NO: 805277 - protein, 9 aa, Homo Sapiens
ELSYSFVQY

SEQ ID NO: 805278 - protein, 9 aa, Homo Sapiens
STVHCMHLH

SEQ ID NO: 805279 - protein, 9 aa, Homo Sapiens
AHMTRSELY

SEQ ID NO: 805280 - protein, 9 aa, Homo Sapiens
FKERVRSHI

SEQ ID NO: 805281 - protein, 9 aa, Homo Sapiens
AGTFSKNCN

SEQ ID NO: 805282 - protein, 9 aa, Homo Sapiens
EKTYPYVEV

SEQ ID NO: 805283 - protein, 9 aa, Homo Sapiens
LRKHREVCK

SEQ ID NO: 805284 - protein, 9 aa, Homo Sapiens
GGQSDENKD

SEQ ID NO: 805285 - protein, 9 aa, Homo Sapiens
PKYEFFWGS

SEQ ID NO: 805286 - protein, 9 aa, Homo Sapiens
QQDAKERAE

SEQ ID NO: 805287 - protein, 9 aa, Homo Sapiens
LYQKPNGTN

SEQ ID NO: 805288 - protein, 9 aa, Homo Sapiens
QGYNNRNQD

SEQ ID NO: 805289 - protein, 9 aa, Homo Sapiens
NLIQTIQGA

SEQ ID NO: 805290 - protein, 9 aa, Homo Sapiens
VQGQFLYAY

SEQ ID NO: 805291 - protein, 9 aa, Homo Sapiens
KNNFDNLDF

SEQ ID NO: 805292 - protein, 9 aa, Homo Sapiens
QHGSLLFST

SEQ ID NO: 805293 - protein, 9 aa, Homo Sapiens
FLAYIVFLV

SEQ ID NO: 805294 - protein, 9 aa, Homo Sapiens
DGVQNLFQI

SEQ ID NO: 805295 - protein, 9 aa, Homo Sapiens
NQGDTPLHW

SEQ ID NO: 805296 - protein, 9 aa, Homo Sapiens
HPGNQESDQ

SEQ ID NO: 805297 - protein, 9 aa, Homo Sapiens
MYITILPGF

SEQ ID NO: 805298 - protein, 9 aa, Homo Sapiens
KHCKVKKKS

SEQ ID NO: 805299 - protein, 9 aa, Homo Sapiens
PQLKFASQI

SEQ ID NO: 805300 - protein, 9 aa, Homo Sapiens
ARRICGERA

SEQ ID NO: 805301 - protein, 9 aa, Homo Sapiens
FFQDTPRSI

SEQ ID NO: 805302 - protein, 9 aa, Homo Sapiens
CFLPIKESA

SEQ ID NO: 805303 - protein, 9 aa, Homo Sapiens
LGIKNIGFE

SEQ ID NO: 805304 - protein, 9 aa, Homo Sapiens
AVVILLFVP

SEQ ID NO: 805305 - protein, 9 aa, Homo Sapiens
SVITSSTIN

SEQ ID NO: 805306 - protein, 9 aa, Homo Sapiens
EIAVNAILT

SEQ ID NO: 805307 - protein, 9 aa, Homo Sapiens
DSKIFPVRD

SEQ ID NO: 805308 - protein, 9 aa, Homo Sapiens
GSYLIVHKI

SEQ ID NO: 805309 - protein, 9 aa, Homo Sapiens
ETKTFLVFQ

SEQ ID NO: 805310 - protein, 9 aa, Homo Sapiens
EGKILNQSQ

SEQ ID NO: 805311 - protein, 9 aa, Homo Sapiens
HIYIQTLCG

SEQ ID NO: 805312 - protein, 9 aa, Homo Sapiens
VQKLEEQFQ

SEQ ID NO: 805313 - protein, 9 aa, Homo Sapiens
QVKRYDLEL

SEQ ID NO: 805314 - protein, 9 aa, Homo Sapiens
GAHKLYFPE

SEQ ID NO: 805315 - protein, 9 aa, Homo Sapiens
HNQVWGKVF

SEQ ID NO: 805316 - protein, 9 aa, Homo Sapiens
KSQARRIWK

SEQ ID NO: 805317 - protein, 9 aa, Homo Sapiens
QQKKEEKTK

SEQ ID NO: 805318 - protein, 9 aa, Homo Sapiens
YYSAKAVDV

SEQ ID NO: 805319 - protein, 9 aa, Homo Sapiens
ERTGHYSTV

SEQ ID NO: 805320 - protein, 9 aa, Homo Sapiens
KSFHLYCRL

SEQ ID NO: 805321 - protein, 9 aa, Homo Sapiens
NFQTCKGQV

SEQ ID NO: 805322 - protein, 9 aa, Homo Sapiens
MRPYTCKTV

SEQ ID NO: 805323 - protein, 9 aa, Homo Sapiens
PVLTKVSYL

SEQ ID NO: 805324 - protein, 9 aa, Homo Sapiens
PNAKCEIHN

SEQ ID NO: 805325 - protein, 9 aa, Homo Sapiens
SVLKMEEEQ

SEQ ID NO: 805326 - protein, 9 aa, Homo Sapiens
CLEPTLRLE

SEQ ID NO: 805327 - protein, 9 aa, Homo Sapiens
PGEPEAPML

SEQ ID NO: 805328 - protein, 9 aa, Homo Sapiens
DRIQNIRLL

SEQ ID NO: 805329 - protein, 9 aa, Homo Sapiens
VKHNPLPLL

SEQ ID NO: 805330 - protein, 9 aa, Homo Sapiens
LQNELRETV

SEQ ID NO: 805331 - protein, 9 aa, Homo Sapiens
NVWLTHKEM

SEQ ID NO: 805332 - protein, 9 aa, Homo Sapiens
LYMSLFSFI

SEQ ID NO: 805333 - protein, 9 aa, Homo Sapiens
INTFIVLNK

SEQ ID NO: 805334 - protein, 9 aa, Homo Sapiens
VDYFLCDIP

SEQ ID NO: 805335 - protein, 9 aa, Homo Sapiens
QQKVKKTVE

SEQ ID NO: 805336 - protein, 9 aa, Homo Sapiens
LTTTAEHQL

SEQ ID NO: 805337 - protein, 9 aa, Homo Sapiens
GNRIKRVQL

SEQ ID NO: 805338 - protein, 9 aa, Homo Sapiens
RDCHQPGTL

SEQ ID NO: 805339 - protein, 9 aa, Homo Sapiens
KVHEIIHSG

SEQ ID NO: 805340 - protein, 9 aa, Homo Sapiens
FPESLDFSD

SEQ ID NO: 805341 - protein, 9 aa, Homo Sapiens
HDQLEQFWT

SEQ ID NO: 805342 - protein, 9 aa, Homo Sapiens
QKKISHYMK

SEQ ID NO: 805343 - protein, 9 aa, Homo Sapiens
SEDLFPFPR

SEQ ID NO: 805344 - protein, 9 aa, Homo Sapiens
KAEGLGTGP

SEQ ID NO: 805345 - protein, 9 aa, Homo Sapiens
SFDELLASK

SEQ ID NO: 805346 - protein, 9 aa, Homo Sapiens
QLQEHQIIH

SEQ ID NO: 805347 - protein, 9 aa, Homo Sapiens
PRNGTKNRY

SEQ ID NO: 805348 - protein, 9 aa, Homo Sapiens
LSSKSDVWS

SEQ ID NO: 805349 - protein, 9 aa, Homo Sapiens
PLKSDTFFR

SEQ ID NO: 805350 - protein, 9 aa, Homo Sapiens
NKQFQYQNC

SEQ ID NO: 805351 - protein, 9 aa, Homo Sapiens
SLFGLRTKA

SEQ ID NO: 805352 - protein, 9 aa, Homo Sapiens
LPSPVTSIP

SEQ ID NO: 805353 - protein, 9 aa, Homo Sapiens
TDGGDLPEE

SEQ ID NO: 805354 - protein, 9 aa, Homo Sapiens
SVKKDDTEK

SEQ ID NO: 805355 - protein, 9 aa, Homo Sapiens
LKILVSAPT

SEQ ID NO: 805356 - protein, 9 aa, Homo Sapiens
TTHEPVLKA

SEQ ID NO: 805357 - protein, 9 aa, Homo Sapiens
KVLIEFYLL

SEQ ID NO: 805358 - protein, 9 aa, Homo Sapiens
ININAYLIA

SEQ ID NO: 805359 - protein, 9 aa, Homo Sapiens
FRYYLMDLL

SEQ ID NO: 805360 - protein, 9 aa, Homo Sapiens
KYRSLRSQR

SEQ ID NO: 805361 - protein, 9 aa, Homo Sapiens
DKSVAKKED

SEQ ID NO: 805362 - protein, 9 aa, Homo Sapiens
VAGTLMTFF

SEQ ID NO: 805363 - protein, 9 aa, Homo Sapiens
LYFTVGTFV

SEQ ID NO: 805364 - protein, 9 aa, Homo Sapiens
DMIKDQCLK

SEQ ID NO: 805365 - protein, 9 aa, Homo Sapiens
TTENLLHLV

SEQ ID NO: 805366 - protein, 9 aa, Homo Sapiens
VPPTQHFPM

SEQ ID NO: 805367 - protein, 9 aa, Homo Sapiens
ADAWDVDAL

SEQ ID NO: 805368 - protein, 9 aa, Homo Sapiens
CYNSRENCW

SEQ ID NO: 805369 - protein, 9 aa, Homo Sapiens
YQLLQGIVF

SEQ ID NO: 805370 - protein, 9 aa, Homo Sapiens
LLYSITQVV

SEQ ID NO: 805371 - protein, 9 aa, Homo Sapiens
FNLPAENLT

SEQ ID NO: 805372 - protein, 9 aa, Homo Sapiens
DAGRMIQRL

SEQ ID NO: 805373 - protein, 9 aa, Homo Sapiens
IAKAKQSHS

SEQ ID NO: 805374 - protein, 9 aa, Homo Sapiens
APNFSFSKE

SEQ ID NO: 805375 - protein, 9 aa, Homo Sapiens
GPPGFPGDV

SEQ ID NO: 805376 - protein, 9 aa, Homo Sapiens
TFEGCPALL

SEQ ID NO: 805377 - protein, 9 aa, Homo Sapiens
ALFVRDNNS

SEQ ID NO: 805378 - protein, 9 aa, Homo Sapiens
LEYVKLAKQ

SEQ ID NO: 805379 - protein, 9 aa, Homo Sapiens
RCASSVQSH

SEQ ID NO: 805380 - protein, 9 aa, Homo Sapiens
CNLQYHFES

SEQ ID NO: 805381 - protein, 9 aa, Homo Sapiens
RASCGSALH

SEQ ID NO: 805382 - protein, 9 aa, Homo Sapiens
EAIWNNIFS

SEQ ID NO: 805383 - protein, 9 aa, Homo Sapiens
GSTECVLPT

SEQ ID NO: 805384 - protein, 9 aa, Homo Sapiens
LGYIEDFDG

SEQ ID NO: 805385 - protein, 9 aa, Homo Sapiens
HVCKRMKIC

SEQ ID NO: 805386 - protein, 9 aa, Homo Sapiens
LRALRLLRS

SEQ ID NO: 805387 - protein, 9 aa, Homo Sapiens
HIIAAVKDG

SEQ ID NO: 805388 - protein, 9 aa, Homo Sapiens
EITIIKIEL

SEQ ID NO: 805389 - protein, 9 aa, Homo Sapiens
VQVLDLSEN

SEQ ID NO: 805390 - protein, 9 aa, Homo Sapiens
DKYQALCSI

SEQ ID NO: 805391 - protein, 9 aa, Homo Sapiens
SKALWGRHT

SEQ ID NO: 805392 - protein, 9 aa, Homo Sapiens
TWSPDNWLQ

SEQ ID NO: 805393 - protein, 9 aa, Homo Sapiens
PEARNVSVS

SEQ ID NO: 805394 - protein, 9 aa, Homo Sapiens
RKDPGANNR

SEQ ID NO: 805395 - protein, 9 aa, Homo Sapiens
KFDEPLYMS

SEQ ID NO: 805396 - protein, 9 aa, Homo Sapiens
ATQPKGPMS

SEQ ID NO: 805397 - protein, 9 aa, Homo Sapiens
ALKGLTKVN

SEQ ID NO: 805398 - protein, 9 aa, Homo Sapiens
AGIVQEDAQ

SEQ ID NO: 805399 - protein, 9 aa, Homo Sapiens
DQNYNYKQV

SEQ ID NO: 805400 - protein, 9 aa, Homo Sapiens
RRTVNALKI

SEQ ID NO: 805401 - protein, 9 aa, Homo Sapiens
FLTVRGLKI

SEQ ID NO: 805402 - protein, 9 aa, Homo Sapiens
YHNMTTTLN

SEQ ID NO: 805403 - protein, 9 aa, Homo Sapiens
RFMFQFPLE

SEQ ID NO: 805404 - protein, 9 aa, Homo Sapiens
LQTPVVRPA

SEQ ID NO: 805405 - protein, 9 aa, Homo Sapiens
RIYIRANRQ

SEQ ID NO: 805406 - protein, 9 aa, Homo Sapiens
PKLEEVCTS

SEQ ID NO: 805407 - protein, 9 aa, Homo Sapiens
LDSVGDITK

SEQ ID NO: 805408 - protein, 9 aa, Homo Sapiens
RELINIPLV

SEQ ID NO: 805409 - protein, 9 aa, Homo Sapiens
YMISLTSGL

SEQ ID NO: 805410 - protein, 9 aa, Homo Sapiens
LQDGLKPRC

SEQ ID NO: 805411 - protein, 9 aa, Homo Sapiens
PQSPSFPLE

SEQ ID NO: 805412 - protein, 9 aa, Homo Sapiens
AEILLSHHA

SEQ ID NO: 805413 - protein, 9 aa, Homo Sapiens
FTQVSNELF

SEQ ID NO: 805414 - protein, 9 aa, Homo Sapiens
ELPDSCSTD

SEQ ID NO: 805415 - protein, 9 aa, Homo Sapiens
LHTGERPFK

SEQ ID NO: 805416 - protein, 9 aa, Homo Sapiens
IFTLQCEEF

SEQ ID NO: 805417 - protein, 9 aa, Homo Sapiens
GDPFIKDGS

SEQ ID NO: 805418 - protein, 9 aa, Homo Sapiens
VISLKVKAM

SEQ ID NO: 805419 - protein, 9 aa, Homo Sapiens
YGVILHSHK

SEQ ID NO: 805420 - protein, 9 aa, Homo Sapiens
RGREGAKRA

SEQ ID NO: 805421 - protein, 9 aa, Homo Sapiens
AAVQCLQSA

SEQ ID NO: 805422 - protein, 9 aa, Homo Sapiens
PCWDAAKYL

SEQ ID NO: 805423 - protein, 9 aa, Homo Sapiens
SMLESCELR

SEQ ID NO: 805424 - protein, 9 aa, Homo Sapiens
AKNLFKKAA

SEQ ID NO: 805425 - protein, 9 aa, Homo Sapiens
FQNVQGQFL

SEQ ID NO: 805426 - protein, 9 aa, Homo Sapiens
EDEDASGGE

SEQ ID NO: 805427 - protein, 9 aa, Homo Sapiens
DLPPSRNWR

SEQ ID NO: 805428 - protein, 9 aa, Homo Sapiens
TGEIRVKYL

SEQ ID NO: 805429 - protein, 9 aa, Homo Sapiens
QRFSGSLCA

SEQ ID NO: 805430 - protein, 9 aa, Homo Sapiens
MVQVVRLIA

SEQ ID NO: 805431 - protein, 9 aa, Homo Sapiens
RESENSPGQ

SEQ ID NO: 805432 - protein, 9 aa, Homo Sapiens
TSTVPQLMI

SEQ ID NO: 805433 - protein, 9 aa, Homo Sapiens
FMEQLHTYQ

SEQ ID NO: 805434 - protein, 9 aa, Homo Sapiens
QHILISRKH

SEQ ID NO: 805435 - protein, 9 aa, Homo Sapiens
GSLVILRFS

SEQ ID NO: 805436 - protein, 9 aa, Homo Sapiens
GKLMKIPGT

SEQ ID NO: 805437 - protein, 9 aa, Homo Sapiens
YRHGISSQI

SEQ ID NO: 805438 - protein, 9 aa, Homo Sapiens
AENLFNKLV

SEQ ID NO: 805439 - protein, 9 aa, Homo Sapiens
EKRGSQPAC

SEQ ID NO: 805440 - protein, 9 aa, Homo Sapiens
TLLLLAVFN

SEQ ID NO: 805441 - protein, 9 aa, Homo Sapiens
LFPNGLRYY

SEQ ID NO: 805442 - protein, 9 aa, Homo Sapiens
LIKAALDIS

SEQ ID NO: 805443 - protein, 9 aa, Homo Sapiens
QFTSSSIGD

SEQ ID NO: 805444 - protein, 9 aa, Homo Sapiens
GPAERATKV

SEQ ID NO: 805445 - protein, 9 aa, Homo Sapiens
YKKLRVFLG

SEQ ID NO: 805446 - protein, 9 aa, Homo Sapiens
ASLGEEARG

SEQ ID NO: 805447 - protein, 9 aa, Homo Sapiens
QVLAAHILK

SEQ ID NO: 805448 - protein, 9 aa, Homo Sapiens
FVGHQVLQI

SEQ ID NO: 805449 - protein, 9 aa, Homo Sapiens
FSQEEINNM

SEQ ID NO: 805450 - protein, 9 aa, Homo Sapiens
KGPGVSCCI

SEQ ID NO: 805451 - protein, 9 aa, Homo Sapiens
VEGVPVVVH

SEQ ID NO: 805452 - protein, 9 aa, Homo Sapiens
PTSFKHGEW

SEQ ID NO: 805453 - protein, 9 aa, Homo Sapiens
FQEHRGLPP

SEQ ID NO: 805454 - protein, 9 aa, Homo Sapiens
KPTCDVFCK

SEQ ID NO: 805455 - protein, 9 aa, Homo Sapiens
LKRGLRNKI

SEQ ID NO: 805456 - protein, 9 aa, Homo Sapiens
FLGTASPSP

SEQ ID NO: 805457 - protein, 9 aa, Homo Sapiens
DSQEANGNK

SEQ ID NO: 805458 - protein, 9 aa, Homo Sapiens
AAMQDKYVN

SEQ ID NO: 805459 - protein, 9 aa, Homo Sapiens
GSSLIQHKI

SEQ ID NO: 805460 - protein, 9 aa, Homo Sapiens
AGAPSRAEH

SEQ ID NO: 805461 - protein, 9 aa, Homo Sapiens
SSPVTTGPL

SEQ ID NO: 805462 - protein, 9 aa, Homo Sapiens
FQAFGYLFD

SEQ ID NO: 805463 - protein, 9 aa, Homo Sapiens
RFVHDQGCV

SEQ ID NO: 805464 - protein, 9 aa, Homo Sapiens
HRKSLGRNI

SEQ ID NO: 805465 - protein, 9 aa, Homo Sapiens
FGATYLQQR

SEQ ID NO: 805466 - protein, 9 aa, Homo Sapiens
LSIKSLPDS

SEQ ID NO: 805467 - protein, 9 aa, Homo Sapiens
RTPVDVILD

SEQ ID NO: 805468 - protein, 9 aa, Homo Sapiens
PNTPTAQTF

SEQ ID NO: 805469 - protein, 9 aa, Homo Sapiens
EIILLTGLD

SEQ ID NO: 805470 - protein, 9 aa, Homo Sapiens
LTGENVREL

SEQ ID NO: 805471 - protein, 9 aa, Homo Sapiens
FSTNLHKIL

SEQ ID NO: 805472 - protein, 9 aa, Homo Sapiens
GKQALEIQS

SEQ ID NO: 805473 - protein, 9 aa, Homo Sapiens
INFDDIASS

SEQ ID NO: 805474 - protein, 9 aa, Homo Sapiens
AGCKCSYHT

SEQ ID NO: 805475 - protein, 9 aa, Homo Sapiens
LWGRHTNPP

SEQ ID NO: 805476 - protein, 9 aa, Homo Sapiens
SLDSIAHSS

SEQ ID NO: 805477 - protein, 9 aa, Homo Sapiens
KIIYFIAPK

SEQ ID NO: 805478 - protein, 9 aa, Homo Sapiens
ILASLFERY

SEQ ID NO: 805479 - protein, 9 aa, Homo Sapiens
SFLGCDELS

SEQ ID NO: 805480 - protein, 9 aa, Homo Sapiens
LKSLIQINL

SEQ ID NO: 805481 - protein, 9 aa, Homo Sapiens
ILLKGKWLT

SEQ ID NO: 805482 - protein, 9 aa, Homo Sapiens
GKYPMTDAR

SEQ ID NO: 805483 - protein, 9 aa, Homo Sapiens
VIQKKYDDS

SEQ ID NO: 805484 - protein, 9 aa, Homo Sapiens
NYEIKKYSD

SEQ ID NO: 805485 - protein, 9 aa, Homo Sapiens
TSDSTLLVF

SEQ ID NO: 805486 - protein, 9 aa, Homo Sapiens
KTCLDNLKI

SEQ ID NO: 805487 - protein, 9 aa, Homo Sapiens
SLATGALGG

SEQ ID NO: 805488 - protein, 9 aa, Homo Sapiens
GDQRRARMH

SEQ ID NO: 805489 - protein, 9 aa, Homo Sapiens
ILYQKPNGT

SEQ ID NO: 805490 - protein, 9 aa, Homo Sapiens
DLVCNAMRA

SEQ ID NO: 805491 - protein, 9 aa, Homo Sapiens
TVSIISNIR

SEQ ID NO: 805492 - protein, 9 aa, Homo Sapiens
IKLMDVWGF

SEQ ID NO: 805493 - protein, 9 aa, Homo Sapiens
LCSLKHCEL

SEQ ID NO: 805494 - protein, 9 aa, Homo Sapiens
CRPRSLIYY

SEQ ID NO: 805495 - protein, 9 aa, Homo Sapiens
RYANIPAHT

SEQ ID NO: 805496 - protein, 9 aa, Homo Sapiens
EQFWTLLFT

SEQ ID NO: 805497 - protein, 9 aa, Homo Sapiens
KFWAFLRIL

SEQ ID NO: 805498 - protein, 9 aa, Homo Sapiens
GWYENIYII

SEQ ID NO: 805499 - protein, 9 aa, Homo Sapiens
HSATFAWSH

SEQ ID NO: 805500 - protein, 9 aa, Homo Sapiens
KWTTKMNEC

SEQ ID NO: 805501 - protein, 9 aa, Homo Sapiens
GFKPPGYER

SEQ ID NO: 805502 - protein, 9 aa, Homo Sapiens
EFKGLFKMY

SEQ ID NO: 805503 - protein, 9 aa, Homo Sapiens
PNIAERVKE

SEQ ID NO: 805504 - protein, 9 aa, Homo Sapiens
APPNIYFPI

SEQ ID NO: 805505 - protein, 9 aa, Homo Sapiens
LPPSADDYL

SEQ ID NO: 805506 - protein, 9 aa, Homo Sapiens
DHIKKASDV

SEQ ID NO: 805507 - protein, 9 aa, Homo Sapiens
IQYSSDVQI

SEQ ID NO: 805508 - protein, 9 aa, Homo Sapiens
RPIHCGVCF

SEQ ID NO: 805509 - protein, 9 aa, Homo Sapiens
ITTTTLERT

SEQ ID NO: 805510 - protein, 9 aa, Homo Sapiens
EYGWLGLGE

SEQ ID NO: 805511 - protein, 9 aa, Homo Sapiens
LKNIFYIVN

SEQ ID NO: 805512 - protein, 9 aa, Homo Sapiens
CGSREIARF

SEQ ID NO: 805513 - protein, 9 aa, Homo Sapiens
ASWSDNLRE

SEQ ID NO: 805514 - protein, 9 aa, Homo Sapiens
GRSYPHLSP

SEQ ID NO: 805515 - protein, 9 aa, Homo Sapiens
RDKVELLDR

SEQ ID NO: 805516 - protein, 9 aa, Homo Sapiens
HAWPKCLTK

SEQ ID NO: 805517 - protein, 9 aa, Homo Sapiens
PGYIYYSNF

SEQ ID NO: 805518 - protein, 9 aa, Homo Sapiens
ALRMPSARG

SEQ ID NO: 805519 - protein, 9 aa, Homo Sapiens
VMVTVAKSL

SEQ ID NO: 805520 - protein, 9 aa, Homo Sapiens
VYCLKRNPR

SEQ ID NO: 805521 - protein, 9 aa, Homo Sapiens
SNYEIRICR

SEQ ID NO: 805522 - protein, 9 aa, Homo Sapiens
VISNHPKIQ

SEQ ID NO: 805523 - protein, 9 aa, Homo Sapiens
ESLESSDDE

SEQ ID NO: 805524 - protein, 9 aa, Homo Sapiens
LMSIQMYLW

SEQ ID NO: 805525 - protein, 9 aa, Homo Sapiens
PPALESSEE

SEQ ID NO: 805526 - protein, 9 aa, Homo Sapiens
SGTVEVKVQ

SEQ ID NO: 805527 - protein, 9 aa, Homo Sapiens
LSSPEDLIV

SEQ ID NO: 805528 - protein, 9 aa, Homo Sapiens
YLNRHWVHR

SEQ ID NO: 805529 - protein, 9 aa, Homo Sapiens
SYFDAVFLD

SEQ ID NO: 805530 - protein, 9 aa, Homo Sapiens
GFTQISYLV

SEQ ID NO: 805531 - protein, 9 aa, Homo Sapiens
AWRAATPLL

SEQ ID NO: 805532 - protein, 9 aa, Homo Sapiens
TKMEISVKR

SEQ ID NO: 805533 - protein, 9 aa, Homo Sapiens
RWLEDGFPN

SEQ ID NO: 805534 - protein, 9 aa, Homo Sapiens
LIKWLEANA

SEQ ID NO: 805535 - protein, 9 aa, Homo Sapiens
ITVDDKLDI

SEQ ID NO: 805536 - protein, 9 aa, Homo Sapiens
KLSEEQNKP

SEQ ID NO: 805537 - protein, 9 aa, Homo Sapiens
FLSKPYVYI

SEQ ID NO: 805538 - protein, 9 aa, Homo Sapiens
HTMLRVGLI

SEQ ID NO: 805539 - protein, 9 aa, Homo Sapiens
CFDEPLLKI

SEQ ID NO: 805540 - protein, 9 aa, Homo Sapiens
CGIEAFSNS

SEQ ID NO: 805541 - protein, 9 aa, Homo Sapiens
YHTGEGRRK

SEQ ID NO: 805542 - protein, 9 aa, Homo Sapiens
RNPWRCSYH

SEQ ID NO: 805543 - protein, 9 aa, Homo Sapiens
DWDVWEKNS

SEQ ID NO: 805544 - protein, 9 aa, Homo Sapiens
VSRPSHLYT

SEQ ID NO: 805545 - protein, 9 aa, Homo Sapiens
YTMKPNTKC

SEQ ID NO: 805546 - protein, 9 aa, Homo Sapiens
QNPLLSTFK

SEQ ID NO: 805547 - protein, 9 aa, Homo Sapiens
DLNQTKLEC

SEQ ID NO: 805548 - protein, 9 aa, Homo Sapiens
LQERVPIDW

SEQ ID NO: 805549 - protein, 9 aa, Homo Sapiens
AVVQELAET

SEQ ID NO: 805550 - protein, 9 aa, Homo Sapiens
VSHRRHNSS

SEQ ID NO: 805551 - protein, 9 aa, Homo Sapiens
NECGKLFLD

SEQ ID NO: 805552 - protein, 9 aa, Homo Sapiens
THFRSKDHN

SEQ ID NO: 805553 - protein, 9 aa, Homo Sapiens
IFQLKADRD

SEQ ID NO: 805554 - protein, 9 aa, Homo Sapiens
CQHNINECD

SEQ ID NO: 805555 - protein, 9 aa, Homo Sapiens
LLHQAKYFG

SEQ ID NO: 805556 - protein, 9 aa, Homo Sapiens
ISDNKSEYL

SEQ ID NO: 805557 - protein, 9 aa, Homo Sapiens
TALKVIKFL

SEQ ID NO: 805558 - protein, 9 aa, Homo Sapiens
RKQDVRLAQ

SEQ ID NO: 805559 - protein, 9 aa, Homo Sapiens
TATPQTFSN

SEQ ID NO: 805560 - protein, 9 aa, Homo Sapiens
YDYVERKQK

SEQ ID NO: 805561 - protein, 9 aa, Homo Sapiens
SHKRTCQLK

SEQ ID NO: 805562 - protein, 9 aa, Homo Sapiens
NPIIYSLIN

SEQ ID NO: 805563 - protein, 9 aa, Homo Sapiens
FVPGSTRKS

SEQ ID NO: 805564 - protein, 9 aa, Homo Sapiens
YRKTLNCHL

SEQ ID NO: 805565 - protein, 9 aa, Homo Sapiens
HQRLHSGVQ

SEQ ID NO: 805566 - protein, 9 aa, Homo Sapiens
NLTEKLKLL

SEQ ID NO: 805567 - protein, 9 aa, Homo Sapiens
IKIEQIKCD

SEQ ID NO: 805568 - protein, 9 aa, Homo Sapiens
VEEVTYNVA

SEQ ID NO: 805569 - protein, 9 aa, Homo Sapiens
WIDQSLSAD

SEQ ID NO: 805570 - protein, 9 aa, Homo Sapiens
FPSNVLQDV

SEQ ID NO: 805571 - protein, 9 aa, Homo Sapiens
SCSNNEIDI

SEQ ID NO: 805572 - protein, 9 aa, Homo Sapiens
QIFTIQART

SEQ ID NO: 805573 - protein, 9 aa, Homo Sapiens
KEDNSCSHG

SEQ ID NO: 805574 - protein, 9 aa, Homo Sapiens
MEVMTDFKL

SEQ ID NO: 805575 - protein, 9 aa, Homo Sapiens
ALLLILASQ

SEQ ID NO: 805576 - protein, 9 aa, Homo Sapiens
EADVSSDLQ

SEQ ID NO: 805577 - protein, 9 aa, Homo Sapiens
LSTDAVDCM

SEQ ID NO: 805578 - protein, 9 aa, Homo Sapiens
RTSFRQRAH

SEQ ID NO: 805579 - protein, 9 aa, Homo Sapiens
IERQDKSDT

SEQ ID NO: 805580 - protein, 9 aa, Homo Sapiens
FSCLEDRHD

SEQ ID NO: 805581 - protein, 9 aa, Homo Sapiens
RLFSRQAKR

SEQ ID NO: 805582 - protein, 9 aa, Homo Sapiens
YLSKATQLV

SEQ ID NO: 805583 - protein, 9 aa, Homo Sapiens
HRDKLTKPE

SEQ ID NO: 805584 - protein, 9 aa, Homo Sapiens
PVEKEILLN

SEQ ID NO: 805585 - protein, 9 aa, Homo Sapiens
GDQYRTTDF

SEQ ID NO: 805586 - protein, 9 aa, Homo Sapiens
NLVNNLQKE

SEQ ID NO: 805587 - protein, 9 aa, Homo Sapiens
KGRSFTLAL

SEQ ID NO: 805588 - protein, 9 aa, Homo Sapiens
DTVRLNKKQ

SEQ ID NO: 805589 - protein, 9 aa, Homo Sapiens
QFFDLMTLF

SEQ ID NO: 805590 - protein, 9 aa, Homo Sapiens
DKLLKYLPE

SEQ ID NO: 805591 - protein, 9 aa, Homo Sapiens
NYNPKYFDW

SEQ ID NO: 805592 - protein, 9 aa, Homo Sapiens
RSKHSDDEE

SEQ ID NO: 805593 - protein, 9 aa, Homo Sapiens
PQCLQYYDS

SEQ ID NO: 805594 - protein, 9 aa, Homo Sapiens
VTQVQVPTP

SEQ ID NO: 805595 - protein, 9 aa, Homo Sapiens
PGHSGVEGP

SEQ ID NO: 805596 - protein, 9 aa, Homo Sapiens
CTCVCVCMS

SEQ ID NO: 805597 - protein, 9 aa, Homo Sapiens
KCCNLLRAA

SEQ ID NO: 805598 - protein, 9 aa, Homo Sapiens
HCWVHILDN

SEQ ID NO: 805599 - protein, 9 aa, Homo Sapiens
LFWWEQDEI

SEQ ID NO: 805600 - protein, 9 aa, Homo Sapiens
PKANMPVRP

SEQ ID NO: 805601 - protein, 9 aa, Homo Sapiens
TWEKVNKYF

SEQ ID NO: 805602 - protein, 9 aa, Homo Sapiens
SKGNGSNGY

SEQ ID NO: 805603 - protein, 9 aa, Homo Sapiens
HLSLLNIWD

SEQ ID NO: 805604 - protein, 9 aa, Homo Sapiens
YDTQNINLY

SEQ ID NO: 805605 - protein, 9 aa, Homo Sapiens
INTKEVAHR

SEQ ID NO: 805606 - protein, 9 aa, Homo Sapiens
FVQLVLEIL

SEQ ID NO: 805607 - protein, 9 aa, Homo Sapiens
TYNDGATKL

SEQ ID NO: 805608 - protein, 9 aa, Homo Sapiens
EHERMSRIH

SEQ ID NO: 805609 - protein, 9 aa, Homo Sapiens
TSVARLTRE

SEQ ID NO: 805610 - protein, 9 aa, Homo Sapiens
ESTLHLVLH

SEQ ID NO: 805611 - protein, 9 aa, Homo Sapiens
LASHTIQGT

SEQ ID NO: 805612 - protein, 9 aa, Homo Sapiens
LNFLCCGCL

SEQ ID NO: 805613 - protein, 9 aa, Homo Sapiens
IIVLLMHRW

SEQ ID NO: 805614 - protein, 9 aa, Homo Sapiens
NTCKTQTTS

SEQ ID NO: 805615 - protein, 9 aa, Homo Sapiens
RTCQLKCQW

SEQ ID NO: 805616 - protein, 9 aa, Homo Sapiens
KSEYTVKWQ

SEQ ID NO: 805617 - protein, 9 aa, Homo Sapiens
LALSMIKCL

SEQ ID NO: 805618 - protein, 9 aa, Homo Sapiens
TWSWEWYLK

SEQ ID NO: 805619 - protein, 9 aa, Homo Sapiens
GAAAAYLSV

SEQ ID NO: 805620 - protein, 9 aa, Homo Sapiens
DIDQFQTQK

SEQ ID NO: 805621 - protein, 9 aa, Homo Sapiens
HISDHYNCV

SEQ ID NO: 805622 - protein, 9 aa, Homo Sapiens
AVAPNISQR

SEQ ID NO: 805623 - protein, 9 aa, Homo Sapiens
DGIWLLGTT

SEQ ID NO: 805624 - protein, 9 aa, Homo Sapiens
NNSSLDAPV

SEQ ID NO: 805625 - protein, 9 aa, Homo Sapiens
PEEDVHAER

SEQ ID NO: 805626 - protein, 9 aa, Homo Sapiens
IDYALATWS

SEQ ID NO: 805627 - protein, 9 aa, Homo Sapiens
PHFKGVKKI

SEQ ID NO: 805628 - protein, 9 aa, Homo Sapiens
NSATPDSSA

SEQ ID NO: 805629 - protein, 9 aa, Homo Sapiens
FNISAKHEK

SEQ ID NO: 805630 - protein, 9 aa, Homo Sapiens
TTSTVFSSV

SEQ ID NO: 805631 - protein, 9 aa, Homo Sapiens
NARRIIVQP

SEQ ID NO: 805632 - protein, 9 aa, Homo Sapiens
KCVKRLDEC

SEQ ID NO: 805633 - protein, 9 aa, Homo Sapiens
HYFDEKHLQ

SEQ ID NO: 805634 - protein, 9 aa, Homo Sapiens
NFSLSYSSL

SEQ ID NO: 805635 - protein, 9 aa, Homo Sapiens
LPSHVKISA

SEQ ID NO: 805636 - protein, 9 aa, Homo Sapiens
KNKELSADQ

SEQ ID NO: 805637 - protein, 9 aa, Homo Sapiens
NHPFYSNIS

SEQ ID NO: 805638 - protein, 9 aa, Homo Sapiens
ILSIHSCYL

SEQ ID NO: 805639 - protein, 9 aa, Homo Sapiens
TSLAMQWPF

SEQ ID NO: 805640 - protein, 9 aa, Homo Sapiens
LYGDLSLKE

SEQ ID NO: 805641 - protein, 9 aa, Homo Sapiens
SPTEINVVR

SEQ ID NO: 805642 - protein, 9 aa, Homo Sapiens
EVFSEFKDL

SEQ ID NO: 805643 - protein, 9 aa, Homo Sapiens
NEQLMEEII

SEQ ID NO: 805644 - protein, 9 aa, Homo Sapiens
RQKYKRWLD

SEQ ID NO: 805645 - protein, 9 aa, Homo Sapiens
YDADTGIFT

SEQ ID NO: 805646 - protein, 9 aa, Homo Sapiens
YNIQYTCLH

SEQ ID NO: 805647 - protein, 9 aa, Homo Sapiens
TPLLNAGGE

SEQ ID NO: 805648 - protein, 9 aa, Homo Sapiens
DPGQGLSMA

SEQ ID NO: 805649 - protein, 9 aa, Homo Sapiens
CVIALRYVA

SEQ ID NO: 805650 - protein, 9 aa, Homo Sapiens
LSVLFTPYH

SEQ ID NO: 805651 - protein, 9 aa, Homo Sapiens
RLSPAYPAA

SEQ ID NO: 805652 - protein, 9 aa, Homo Sapiens
GLESPQQTF

SEQ ID NO: 805653 - protein, 9 aa, Homo Sapiens
RSPSFSTDS

SEQ ID NO: 805654 - protein, 9 aa, Homo Sapiens
PEPSSSNAA

SEQ ID NO: 805655 - protein, 9 aa, Homo Sapiens
MIKDQCLKS

SEQ ID NO: 805656 - protein, 9 aa, Homo Sapiens
REDIAHSIQ

SEQ ID NO: 805657 - protein, 9 aa, Homo Sapiens
ISSLFPPGY

SEQ ID NO: 805658 - protein, 9 aa, Homo Sapiens
QHRGERYKY

SEQ ID NO: 805659 - protein, 9 aa, Homo Sapiens
SVNEHEDGY

SEQ ID NO: 805660 - protein, 9 aa, Homo Sapiens
LCLDDNFLT

SEQ ID NO: 805661 - protein, 9 aa, Homo Sapiens
KFDLHLYVL

SEQ ID NO: 805662 - protein, 9 aa, Homo Sapiens
GRCHVVRKL

SEQ ID NO: 805663 - protein, 9 aa, Homo Sapiens
LPLTMESAA

SEQ ID NO: 805664 - protein, 9 aa, Homo Sapiens
EKNRVAAQI

SEQ ID NO: 805665 - protein, 9 aa, Homo Sapiens
TQKMQHNGH

SEQ ID NO: 805666 - protein, 9 aa, Homo Sapiens
AGLPQDLTF

SEQ ID NO: 805667 - protein, 9 aa, Homo Sapiens
PDKCALFNS

SEQ ID NO: 805668 - protein, 9 aa, Homo Sapiens
VPEPPAGPS

SEQ ID NO: 805669 - protein, 9 aa, Homo Sapiens
EESTCTAIR

SEQ ID NO: 805670 - protein, 9 aa, Homo Sapiens
CQQNNPATE

SEQ ID NO: 805671 - protein, 9 aa, Homo Sapiens
KSPVVSDED

SEQ ID NO: 805672 - protein, 9 aa, Homo Sapiens
TLCLDDNFL

SEQ ID NO: 805673 - protein, 9 aa, Homo Sapiens
ITCLQSGID

SEQ ID NO: 805674 - protein, 9 aa, Homo Sapiens
SLETLEIIP

SEQ ID NO: 805675 - protein, 9 aa, Homo Sapiens
EGSVPNKCY

SEQ ID NO: 805676 - protein, 9 aa, Homo Sapiens
RGLDRTHSH

SEQ ID NO: 805677 - protein, 9 aa, Homo Sapiens
YLHFAQVRT

SEQ ID NO: 805678 - protein, 9 aa, Homo Sapiens
QAKNECYRA

SEQ ID NO: 805679 - protein, 9 aa, Homo Sapiens
LEIQSSLSE

SEQ ID NO: 805680 - protein, 9 aa, Homo Sapiens
LVFPYTLLL

SEQ ID NO: 805681 - protein, 9 aa, Homo Sapiens
FKLEMAQEG

SEQ ID NO: 805682 - protein, 9 aa, Homo Sapiens
FWYDIRSIS

SEQ ID NO: 805683 - protein, 9 aa, Homo Sapiens
TGQNYFSLE

SEQ ID NO: 805684 - protein, 9 aa, Homo Sapiens
GGLPSIANM

SEQ ID NO: 805685 - protein, 9 aa, Homo Sapiens
LIYNFIEDQ

SEQ ID NO: 805686 - protein, 9 aa, Homo Sapiens
ENSELRAFS

SEQ ID NO: 805687 - protein, 9 aa, Homo Sapiens
CGGCGSRCC

SEQ ID NO: 805688 - protein, 9 aa, Homo Sapiens
KFLEKKHII

SEQ ID NO: 805689 - protein, 9 aa, Homo Sapiens
PAGSPLSVT

SEQ ID NO: 805690 - protein, 9 aa, Homo Sapiens
GVNVNMKTN

SEQ ID NO: 805691 - protein, 9 aa, Homo Sapiens
SVPIEVADV

SEQ ID NO: 805692 - protein, 9 aa, Homo Sapiens
IGKYLAPGF

SEQ ID NO: 805693 - protein, 9 aa, Homo Sapiens
NKIIGHFLF

SEQ ID NO: 805694 - protein, 9 aa, Homo Sapiens
FNESQRQAT

SEQ ID NO: 805695 - protein, 9 aa, Homo Sapiens
NNVDGKSLL

SEQ ID NO: 805696 - protein, 9 aa, Homo Sapiens
KKLWSSVAA

SEQ ID NO: 805697 - protein, 9 aa, Homo Sapiens
YDQSTWDAS

SEQ ID NO: 805698 - protein, 9 aa, Homo Sapiens
FCVQHMDLS

SEQ ID NO: 805699 - protein, 9 aa, Homo Sapiens
LQGFKPPGY

SEQ ID NO: 805700 - protein, 9 aa, Homo Sapiens
YLGDPKINV

SEQ ID NO: 805701 - protein, 9 aa, Homo Sapiens
FKGSRFQYS

SEQ ID NO: 805702 - protein, 9 aa, Homo Sapiens
LIHREPGSY

SEQ ID NO: 805703 - protein, 9 aa, Homo Sapiens
SKDGKYALL

SEQ ID NO: 805704 - protein, 9 aa, Homo Sapiens
GAIPQAHFL

SEQ ID NO: 805705 - protein, 9 aa, Homo Sapiens
PSKSETSKP

SEQ ID NO: 805706 - protein, 9 aa, Homo Sapiens
YAGICLNLL

SEQ ID NO: 805707 - protein, 9 aa, Homo Sapiens
EPVKITKPN

SEQ ID NO: 805708 - protein, 9 aa, Homo Sapiens
VVDARPLIQ

SEQ ID NO: 805709 - protein, 9 aa, Homo Sapiens
KGIIELLDS

SEQ ID NO: 805710 - protein, 9 aa, Homo Sapiens
SVEAEAEDG

SEQ ID NO: 805711 - protein, 9 aa, Homo Sapiens
EEIPRQNIW

SEQ ID NO: 805712 - protein, 9 aa, Homo Sapiens
CCVKSIIRQ

SEQ ID NO: 805713 - protein, 9 aa, Homo Sapiens
QDLMTYLDK

SEQ ID NO: 805714 - protein, 9 aa, Homo Sapiens
RDKLQCTQG

SEQ ID NO: 805715 - protein, 9 aa, Homo Sapiens
KDLAWLYFK

SEQ ID NO: 805716 - protein, 9 aa, Homo Sapiens
DSSKKNLLE

SEQ ID NO: 805717 - protein, 9 aa, Homo Sapiens
WPAKEDNSC

SEQ ID NO: 805718 - protein, 9 aa, Homo Sapiens
TFILKVLED

SEQ ID NO: 805719 - protein, 9 aa, Homo Sapiens
AKKRKMNLS

SEQ ID NO: 805720 - protein, 9 aa, Homo Sapiens
MCDLYPNGV

SEQ ID NO: 805721 - protein, 9 aa, Homo Sapiens
EILTKQQAS

SEQ ID NO: 805722 - protein, 9 aa, Homo Sapiens
LVQATFPDN

SEQ ID NO: 805723 - protein, 9 aa, Homo Sapiens
NILPLNSAE

SEQ ID NO: 805724 - protein, 9 aa, Homo Sapiens
GPSQRHSSM

SEQ ID NO: 805725 - protein, 9 aa, Homo Sapiens
HQRVHTEDK

SEQ ID NO: 805726 - protein, 9 aa, Homo Sapiens
SRILFYQRW

SEQ ID NO: 805727 - protein, 9 aa, Homo Sapiens
PTPSNKLAI

SEQ ID NO: 805728 - protein, 9 aa, Homo Sapiens
CERNDKVFV

SEQ ID NO: 805729 - protein, 9 aa, Homo Sapiens
YDKWEMEHT

SEQ ID NO: 805730 - protein, 9 aa, Homo Sapiens
TLNEKSVQK

SEQ ID NO: 805731 - protein, 9 aa, Homo Sapiens
TAFLDGFNE

SEQ ID NO: 805732 - protein, 9 aa, Homo Sapiens
DNQGDTPLH

SEQ ID NO: 805733 - protein, 9 aa, Homo Sapiens
EQPPHGSDT

SEQ ID NO: 805734 - protein, 9 aa, Homo Sapiens
PLPILAPFL

SEQ ID NO: 805735 - protein, 9 aa, Homo Sapiens
EEGITHEQM

SEQ ID NO: 805736 - protein, 9 aa, Homo Sapiens
NMSPGFPKK

SEQ ID NO: 805737 - protein, 9 aa, Homo Sapiens
GSAGKMNGR

SEQ ID NO: 805738 - protein, 9 aa, Homo Sapiens
SNSLLVSWQ

SEQ ID NO: 805739 - protein, 9 aa, Homo Sapiens
ELENFSSKI

SEQ ID NO: 805740 - protein, 9 aa, Homo Sapiens
LCAFQGYSN

SEQ ID NO: 805741 - protein, 9 aa, Homo Sapiens
IPGDTYGPV

SEQ ID NO: 805742 - protein, 9 aa, Homo Sapiens
ICTKGIEAP

SEQ ID NO: 805743 - protein, 9 aa, Homo Sapiens
QEHERMSRI

SEQ ID NO: 805744 - protein, 9 aa, Homo Sapiens
SFHPVCKAE

SEQ ID NO: 805745 - protein, 9 aa, Homo Sapiens
TTIRIRCSP

SEQ ID NO: 805746 - protein, 9 aa, Homo Sapiens
IKGQKLHKM

SEQ ID NO: 805747 - protein, 9 aa, Homo Sapiens
AGAINHISI

SEQ ID NO: 805748 - protein, 9 aa, Homo Sapiens
SICCGLDRF

SEQ ID NO: 805749 - protein, 9 aa, Homo Sapiens
RGGFGVVFK

SEQ ID NO: 805750 - protein, 9 aa, Homo Sapiens
PQERVIGST

SEQ ID NO: 805751 - protein, 9 aa, Homo Sapiens
KHTQSYPTN

SEQ ID NO: 805752 - protein, 9 aa, Homo Sapiens
RVARKLDIY

SEQ ID NO: 805753 - protein, 9 aa, Homo Sapiens
PVLNPFIYS

SEQ ID NO: 805754 - protein, 9 aa, Homo Sapiens
TIPEDRIQN

SEQ ID NO: 805755 - protein, 9 aa, Homo Sapiens
CSTVDNTYV

SEQ ID NO: 805756 - protein, 9 aa, Homo Sapiens
AHNRIQSFK

SEQ ID NO: 805757 - protein, 9 aa, Homo Sapiens
ARERLEQLF

SEQ ID NO: 805758 - protein, 9 aa, Homo Sapiens
AQDLGEKHK

SEQ ID NO: 805759 - protein, 9 aa, Homo Sapiens
RHILRINRG

SEQ ID NO: 805760 - protein, 9 aa, Homo Sapiens
LKGLSHTKH

SEQ ID NO: 805761 - protein, 9 aa, Homo Sapiens
YLFDIFNSD

SEQ ID NO: 805762 - protein, 9 aa, Homo Sapiens
ARRSKAKYL

SEQ ID NO: 805763 - protein, 9 aa, Homo Sapiens
CSENCLSAQ

SEQ ID NO: 805764 - protein, 9 aa, Homo Sapiens
HKNFHADAI

SEQ ID NO: 805765 - protein, 9 aa, Homo Sapiens
AKMENKVSK

SEQ ID NO: 805766 - protein, 9 aa, Homo Sapiens
HSSDYPSRS

SEQ ID NO: 805767 - protein, 9 aa, Homo Sapiens
MEGHDYDPL

SEQ ID NO: 805768 - protein, 9 aa, Homo Sapiens
FTGSIFVVF

SEQ ID NO: 805769 - protein, 9 aa, Homo Sapiens
TFIELSSPD

SEQ ID NO: 805770 - protein, 9 aa, Homo Sapiens
PLRKPQKAH

SEQ ID NO: 805771 - protein, 9 aa, Homo Sapiens
SVTPTKAVR

SEQ ID NO: 805772 - protein, 9 aa, Homo Sapiens
TFLVVAILV

SEQ ID NO: 805773 - protein, 9 aa, Homo Sapiens
VPPSTAVEF

SEQ ID NO: 805774 - protein, 9 aa, Homo Sapiens
DGESTQSGY

SEQ ID NO: 805775 - protein, 9 aa, Homo Sapiens
SSYVPREIR

SEQ ID NO: 805776 - protein, 9 aa, Homo Sapiens
EDGNYIKVN

SEQ ID NO: 805777 - protein, 9 aa, Homo Sapiens
GFVTNRAYA

SEQ ID NO: 805778 - protein, 9 aa, Homo Sapiens
AICDIIVVV

SEQ ID NO: 805779 - protein, 9 aa, Homo Sapiens
KKSHRCVLL

SEQ ID NO: 805780 - protein, 9 aa, Homo Sapiens
PRGRRGWNK

SEQ ID NO: 805781 - protein, 9 aa, Homo Sapiens
NLKERMAQH

SEQ ID NO: 805782 - protein, 9 aa, Homo Sapiens
TTVGKHYRD

SEQ ID NO: 805783 - protein, 9 aa, Homo Sapiens
IDAVCSKLK

SEQ ID NO: 805784 - protein, 9 aa, Homo Sapiens
FEHVDQDLM

SEQ ID NO: 805785 - protein, 9 aa, Homo Sapiens
TGMKEMLRQ

SEQ ID NO: 805786 - protein, 9 aa, Homo Sapiens
KVIYCRKKV

SEQ ID NO: 805787 - protein, 9 aa, Homo Sapiens
KLSLPCDAV

SEQ ID NO: 805788 - protein, 9 aa, Homo Sapiens
KALWRLHEL

SEQ ID NO: 805789 - protein, 9 aa, Homo Sapiens
VISQPDEFE

SEQ ID NO: 805790 - protein, 9 aa, Homo Sapiens
LGNGSYLSV

SEQ ID NO: 805791 - protein, 9 aa, Homo Sapiens
LIEKNIKLF

SEQ ID NO: 805792 - protein, 9 aa, Homo Sapiens
LYDYKRFLL

SEQ ID NO: 805793 - protein, 9 aa, Homo Sapiens
IFLVSIILL

SEQ ID NO: 805794 - protein, 9 aa, Homo Sapiens
HFQIHTGIK

SEQ ID NO: 805795 - protein, 9 aa, Homo Sapiens
MKKVLVAPP

SEQ ID NO: 805796 - protein, 9 aa, Homo Sapiens
AKPVNKKNT

SEQ ID NO: 805797 - protein, 9 aa, Homo Sapiens
CICPATSTR

SEQ ID NO: 805798 - protein, 9 aa, Homo Sapiens
AVSHTTILC

SEQ ID NO: 805799 - protein, 9 aa, Homo Sapiens
PQAIIMFPP

SEQ ID NO: 805800 - protein, 9 aa, Homo Sapiens
PMLQEDTRK

SEQ ID NO: 805801 - protein, 9 aa, Homo Sapiens
RSDPHHCSF

SEQ ID NO: 805802 - protein, 9 aa, Homo Sapiens
YMLVDSSDH

SEQ ID NO: 805803 - protein, 9 aa, Homo Sapiens
LEPQEPNYA

SEQ ID NO: 805804 - protein, 9 aa, Homo Sapiens
KLAVLEGDI

SEQ ID NO: 805805 - protein, 9 aa, Homo Sapiens
RHILDWHFA

SEQ ID NO: 805806 - protein, 9 aa, Homo Sapiens
APRARITII

SEQ ID NO: 805807 - protein, 9 aa, Homo Sapiens
PAEKGSHMP

SEQ ID NO: 805808 - protein, 9 aa, Homo Sapiens
EAYIAKQKQ

SEQ ID NO: 805809 - protein, 9 aa, Homo Sapiens
AWDVDALFC

SEQ ID NO: 805810 - protein, 9 aa, Homo Sapiens
FYLKKGAAA

SEQ ID NO: 805811 - protein, 9 aa, Homo Sapiens
LMESEEVYQ

SEQ ID NO: 805812 - protein, 9 aa, Homo Sapiens
DNFWMTQQE

SEQ ID NO: 805813 - protein, 9 aa, Homo Sapiens
QPPPIKLPS

SEQ ID NO: 805814 - protein, 9 aa, Homo Sapiens
DIICGFLKG

SEQ ID NO: 805815 - protein, 9 aa, Homo Sapiens
PHLQNIENV

SEQ ID NO: 805816 - protein, 9 aa, Homo Sapiens
KNVPILRVL

SEQ ID NO: 805817 - protein, 9 aa, Homo Sapiens
TECEQSFSQ

SEQ ID NO: 805818 - protein, 9 aa, Homo Sapiens
VFSEFKDLI

SEQ ID NO: 805819 - protein, 9 aa, Homo Sapiens
ATFKSGKRV

SEQ ID NO: 805820 - protein, 9 aa, Homo Sapiens
SPRSYLFDN

SEQ ID NO: 805821 - protein, 9 aa, Homo Sapiens
ITRDNAAIC

SEQ ID NO: 805822 - protein, 9 aa, Homo Sapiens
FQEEQINAR

SEQ ID NO: 805823 - protein, 9 aa, Homo Sapiens
PNRVCMFGP

SEQ ID NO: 805824 - protein, 9 aa, Homo Sapiens
PLLHSFLLN

SEQ ID NO: 805825 - protein, 9 aa, Homo Sapiens
VVKFLIKTK

SEQ ID NO: 805826 - protein, 9 aa, Homo Sapiens
KAILISYDD

SEQ ID NO: 805827 - protein, 9 aa, Homo Sapiens
PSFVPGSTR

SEQ ID NO: 805828 - protein, 9 aa, Homo Sapiens
WPGAWALPC

SEQ ID NO: 805829 - protein, 9 aa, Homo Sapiens
KVIENNTTF

SEQ ID NO: 805830 - protein, 9 aa, Homo Sapiens
LVMLGKVGI

SEQ ID NO: 805831 - protein, 9 aa, Homo Sapiens
DLAERTVRL

SEQ ID NO: 805832 - protein, 9 aa, Homo Sapiens
GDKMYVESK

SEQ ID NO: 805833 - protein, 9 aa, Homo Sapiens
QGSVMAYQL

SEQ ID NO: 805834 - protein, 9 aa, Homo Sapiens
GSSTPMSSP

SEQ ID NO: 805835 - protein, 9 aa, Homo Sapiens
LVEYLKESY

SEQ ID NO: 805836 - protein, 9 aa, Homo Sapiens
TFENFYIGW

SEQ ID NO: 805837 - protein, 9 aa, Homo Sapiens
RCWDTAETN

SEQ ID NO: 805838 - protein, 9 aa, Homo Sapiens
SEAVFGNSW

SEQ ID NO: 805839 - protein, 9 aa, Homo Sapiens
SANGGSKSD

SEQ ID NO: 805840 - protein, 9 aa, Homo Sapiens
YHYFKGYFL

SEQ ID NO: 805841 - protein, 9 aa, Homo Sapiens
MWTKLPCTN

SEQ ID NO: 805842 - protein, 9 aa, Homo Sapiens
DNAPIGTLL

SEQ ID NO: 805843 - protein, 9 aa, Homo Sapiens
GNRGVIVFN

SEQ ID NO: 805844 - protein, 9 aa, Homo Sapiens
SLEIIAVLA

SEQ ID NO: 805845 - protein, 9 aa, Homo Sapiens
RVGTHSEKQ

SEQ ID NO: 805846 - protein, 9 aa, Homo Sapiens
QKSAVAGFL

SEQ ID NO: 805847 - protein, 9 aa, Homo Sapiens
SKGTNNEGG

SEQ ID NO: 805848 - protein, 9 aa, Homo Sapiens
VYAKVDNEI

SEQ ID NO: 805849 - protein, 9 aa, Homo Sapiens
HVERHFRTT

SEQ ID NO: 805850 - protein, 9 aa, Homo Sapiens
TQLEQEAEK

SEQ ID NO: 805851 - protein, 9 aa, Homo Sapiens
YICKDLKIN

SEQ ID NO: 805852 - protein, 9 aa, Homo Sapiens
RVSPIFSKK

SEQ ID NO: 805853 - protein, 9 aa, Homo Sapiens
SVQENINML

SEQ ID NO: 805854 - protein, 9 aa, Homo Sapiens
MILKIKKNQ

SEQ ID NO: 805855 - protein, 9 aa, Homo Sapiens
FRKMNEKSV

SEQ ID NO: 805856 - protein, 9 aa, Homo Sapiens
SQFVACEEL

SEQ ID NO: 805857 - protein, 9 aa, Homo Sapiens
DNLILNEFS

SEQ ID NO: 805858 - protein, 9 aa, Homo Sapiens
RGRKCRRIN

SEQ ID NO: 805859 - protein, 9 aa, Homo Sapiens
LSPGTLDQF

SEQ ID NO: 805860 - protein, 9 aa, Homo Sapiens
LGTTHKNPN

SEQ ID NO: 805861 - protein, 9 aa, Homo Sapiens
GVPAWGLVA

SEQ ID NO: 805862 - protein, 9 aa, Homo Sapiens
QILKLLDAE

SEQ ID NO: 805863 - protein, 9 aa, Homo Sapiens
HLAALQCEE

SEQ ID NO: 805864 - protein, 9 aa, Homo Sapiens
IALWSEGKG

SEQ ID NO: 805865 - protein, 9 aa, Homo Sapiens
VSSSYNIET

SEQ ID NO: 805866 - protein, 9 aa, Homo Sapiens
HLVLNEVYL

SEQ ID NO: 805867 - protein, 9 aa, Homo Sapiens
TVECSKTSD

SEQ ID NO: 805868 - protein, 9 aa, Homo Sapiens
QGSRMLHVV

SEQ ID NO: 805869 - protein, 9 aa, Homo Sapiens
GAVFRRPHD

SEQ ID NO: 805870 - protein, 9 aa, Homo Sapiens
VKEACKLYS

SEQ ID NO: 805871 - protein, 9 aa, Homo Sapiens
VGTERWWLN

SEQ ID NO: 805872 - protein, 9 aa, Homo Sapiens
EEVEVTQVQ

SEQ ID NO: 805873 - protein, 9 aa, Homo Sapiens
NYIIVIFVI

SEQ ID NO: 805874 - protein, 9 aa, Homo Sapiens
RSCQIEQPV

SEQ ID NO: 805875 - protein, 9 aa, Homo Sapiens
YRQAKTHMM

SEQ ID NO: 805876 - protein, 9 aa, Homo Sapiens
KLQGIPRYH

SEQ ID NO: 805877 - protein, 9 aa, Homo Sapiens
GAKELPARI

SEQ ID NO: 805878 - protein, 9 aa, Homo Sapiens
KEELTWENF

SEQ ID NO: 805879 - protein, 9 aa, Homo Sapiens
SVEVLWPGT

SEQ ID NO: 805880 - protein, 9 aa, Homo Sapiens
SIGDVINHD

SEQ ID NO: 805881 - protein, 9 aa, Homo Sapiens
KKKKSDDPV

SEQ ID NO: 805882 - protein, 9 aa, Homo Sapiens
FTDDIDQFQ

SEQ ID NO: 805883 - protein, 9 aa, Homo Sapiens
YYKLSSKSD

SEQ ID NO: 805884 - protein, 9 aa, Homo Sapiens
FRKLFKNKS

SEQ ID NO: 805885 - protein, 9 aa, Homo Sapiens
GYDVAVNIV

SEQ ID NO: 805886 - protein, 9 aa, Homo Sapiens
RHSKAQITG

SEQ ID NO: 805887 - protein, 9 aa, Homo Sapiens
YRNEFLDFT

SEQ ID NO: 805888 - protein, 9 aa, Homo Sapiens
IPAMSSYLQ

SEQ ID NO: 805889 - protein, 9 aa, Homo Sapiens
RAWVWAGLG

SEQ ID NO: 805890 - protein, 9 aa, Homo Sapiens
ATPVSPGSI

SEQ ID NO: 805891 - protein, 9 aa, Homo Sapiens
HIAASKCRK

SEQ ID NO: 805892 - protein, 9 aa, Homo Sapiens
SEGKNCELD

SEQ ID NO: 805893 - protein, 9 aa, Homo Sapiens
SFSKHYKFT

SEQ ID NO: 805894 - protein, 9 aa, Homo Sapiens
TLGRSPINA

SEQ ID NO: 805895 - protein, 9 aa, Homo Sapiens
SYRKFFYGK

SEQ ID NO: 805896 - protein, 9 aa, Homo Sapiens
LIPSTARIT

SEQ ID NO: 805897 - protein, 9 aa, Homo Sapiens
YRSQSKSRD

SEQ ID NO: 805898 - protein, 9 aa, Homo Sapiens
KNKGKRKSE

SEQ ID NO: 805899 - protein, 9 aa, Homo Sapiens
SKDPHSQVG

SEQ ID NO: 805900 - protein, 9 aa, Homo Sapiens
VGIRNILVD

SEQ ID NO: 805901 - protein, 9 aa, Homo Sapiens
LEMDVPIYL

SEQ ID NO: 805902 - protein, 9 aa, Homo Sapiens
ETATTPKRQ

SEQ ID NO: 805903 - protein, 9 aa, Homo Sapiens
EFLKLLPES

SEQ ID NO: 805904 - protein, 9 aa, Homo Sapiens
RAADLVEAI

SEQ ID NO: 805905 - protein, 9 aa, Homo Sapiens
QIFLDSEDS

SEQ ID NO: 805906 - protein, 9 aa, Homo Sapiens
PHVSQMFLI

SEQ ID NO: 805907 - protein, 9 aa, Homo Sapiens
KLSGSHRLL

SEQ ID NO: 805908 - protein, 9 aa, Homo Sapiens
YCADCGEAF

SEQ ID NO: 805909 - protein, 9 aa, Homo Sapiens
KRKQSEYIE

SEQ ID NO: 805910 - protein, 9 aa, Homo Sapiens
NAKDLDVGQ

SEQ ID NO: 805911 - protein, 9 aa, Homo Sapiens
QALGTTVLG

SEQ ID NO: 805912 - protein, 9 aa, Homo Sapiens
VIQVIVYIL

SEQ ID NO: 805913 - protein, 9 aa, Homo Sapiens
RDKPEAKAT

SEQ ID NO: 805914 - protein, 9 aa, Homo Sapiens
NYYKLSSKS

SEQ ID NO: 805915 - protein, 9 aa, Homo Sapiens
VVEVPNSKE

SEQ ID NO: 805916 - protein, 9 aa, Homo Sapiens
LDWRIQKGV

SEQ ID NO: 805917 - protein, 9 aa, Homo Sapiens
GLGSKAVWM

SEQ ID NO: 805918 - protein, 9 aa, Homo Sapiens
NYSLHVAVT

SEQ ID NO: 805919 - protein, 9 aa, Homo Sapiens
IQHINIIYR

SEQ ID NO: 805920 - protein, 9 aa, Homo Sapiens
GHFDRTKNG

SEQ ID NO: 805921 - protein, 9 aa, Homo Sapiens
PDEDDPRLK

SEQ ID NO: 805922 - protein, 9 aa, Homo Sapiens
LEDYLTNIL

SEQ ID NO: 805923 - protein, 9 aa, Homo Sapiens
DTENETMSK

SEQ ID NO: 805924 - protein, 9 aa, Homo Sapiens
PEGQLPIYS

SEQ ID NO: 805925 - protein, 9 aa, Homo Sapiens
APNDLWYNL

SEQ ID NO: 805926 - protein, 9 aa, Homo Sapiens
AEKEYFTVH

SEQ ID NO: 805927 - protein, 9 aa, Homo Sapiens
KLFMRTTVF

SEQ ID NO: 805928 - protein, 9 aa, Homo Sapiens
QNRVPLNEI

SEQ ID NO: 805929 - protein, 9 aa, Homo Sapiens
PIKICIIGP

SEQ ID NO: 805930 - protein, 9 aa, Homo Sapiens
IITEHANQA

SEQ ID NO: 805931 - protein, 9 aa, Homo Sapiens
YTQSFSRKR

SEQ ID NO: 805932 - protein, 9 aa, Homo Sapiens
LFHTGKTSF

SEQ ID NO: 805933 - protein, 9 aa, Homo Sapiens
AILLKWHVP

SEQ ID NO: 805934 - protein, 9 aa, Homo Sapiens
SSSSTRDYQ

SEQ ID NO: 805935 - protein, 9 aa, Homo Sapiens
SKLKEFVKE

SEQ ID NO: 805936 - protein, 9 aa, Homo Sapiens
QSECEGFEY

SEQ ID NO: 805937 - protein, 9 aa, Homo Sapiens
GDGDITLVE

SEQ ID NO: 805938 - protein, 9 aa, Homo Sapiens
VAYWENTFK

SEQ ID NO: 805939 - protein, 9 aa, Homo Sapiens
GAYSYRKFF

SEQ ID NO: 805940 - protein, 9 aa, Homo Sapiens
WNRDKVELL

SEQ ID NO: 805941 - protein, 9 aa, Homo Sapiens
MDAILLYLT

SEQ ID NO: 805942 - protein, 9 aa, Homo Sapiens
IIKAWLFSN

SEQ ID NO: 805943 - protein, 9 aa, Homo Sapiens
GDYLQARIN

SEQ ID NO: 805944 - protein, 9 aa, Homo Sapiens
TDNFFLGLI

SEQ ID NO: 805945 - protein, 9 aa, Homo Sapiens
SALQIHLRL

SEQ ID NO: 805946 - protein, 9 aa, Homo Sapiens
KLGGKQRAT

SEQ ID NO: 805947 - protein, 9 aa, Homo Sapiens
MTDYPPTTK

SEQ ID NO: 805948 - protein, 9 aa, Homo Sapiens
KSRSLPRVI

SEQ ID NO: 805949 - protein, 9 aa, Homo Sapiens
LTFLSAPVT

SEQ ID NO: 805950 - protein, 9 aa, Homo Sapiens
KNNTLQFTG

SEQ ID NO: 805951 - protein, 9 aa, Homo Sapiens
FFPAGGDPG

SEQ ID NO: 805952 - protein, 9 aa, Homo Sapiens
KRLAILDNT

SEQ ID NO: 805953 - protein, 9 aa, Homo Sapiens
AAVKHSRPR

SEQ ID NO: 805954 - protein, 9 aa, Homo Sapiens
PFSKMPLHP

SEQ ID NO: 805955 - protein, 9 aa, Homo Sapiens
ARNTPNWYF

SEQ ID NO: 805956 - protein, 9 aa, Homo Sapiens
SPNWGLPSL

SEQ ID NO: 805957 - protein, 9 aa, Homo Sapiens
QELAETIKC

SEQ ID NO: 805958 - protein, 9 aa, Homo Sapiens
IKTPLAPFF

SEQ ID NO: 805959 - protein, 9 aa, Homo Sapiens
NPEQLNKLQ

SEQ ID NO: 805960 - protein, 9 aa, Homo Sapiens
DGSFADTIR

SEQ ID NO: 805961 - protein, 9 aa, Homo Sapiens
LRVGIPDNA

SEQ ID NO: 805962 - protein, 9 aa, Homo Sapiens
CVYHAKPAI

SEQ ID NO: 805963 - protein, 9 aa, Homo Sapiens
QQGLQTLST

SEQ ID NO: 805964 - protein, 9 aa, Homo Sapiens
PTEINVVRQ

SEQ ID NO: 805965 - protein, 9 aa, Homo Sapiens
GLSVDDFYS

SEQ ID NO: 805966 - protein, 9 aa, Homo Sapiens
YAEDQGFQF

SEQ ID NO: 805967 - protein, 9 aa, Homo Sapiens
QREADAALF

SEQ ID NO: 805968 - protein, 9 aa, Homo Sapiens
NIRDGSEGT

SEQ ID NO: 805969 - protein, 9 aa, Homo Sapiens
PATGLLCDL

SEQ ID NO: 805970 - protein, 9 aa, Homo Sapiens
KQGVSPQPL

SEQ ID NO: 805971 - protein, 9 aa, Homo Sapiens
FSVATVSSS

SEQ ID NO: 805972 - protein, 9 aa, Homo Sapiens
TKLPCTNFH

SEQ ID NO: 805973 - protein, 9 aa, Homo Sapiens
AKKVHLGAD

SEQ ID NO: 805974 - protein, 9 aa, Homo Sapiens
KIIYPEFNK

SEQ ID NO: 805975 - protein, 9 aa, Homo Sapiens
CWSTSLIRH

SEQ ID NO: 805976 - protein, 9 aa, Homo Sapiens
RDEGEHRMT

SEQ ID NO: 805977 - protein, 9 aa, Homo Sapiens
ITFIKKRDE

SEQ ID NO: 805978 - protein, 9 aa, Homo Sapiens
SVKGSLDRN

SEQ ID NO: 805979 - protein, 9 aa, Homo Sapiens
NLCTKAIVE

SEQ ID NO: 805980 - protein, 9 aa, Homo Sapiens
NNYMKKYSL

SEQ ID NO: 805981 - protein, 9 aa, Homo Sapiens
RVKYLKIHA

SEQ ID NO: 805982 - protein, 9 aa, Homo Sapiens
RLTLSGICT

SEQ ID NO: 805983 - protein, 9 aa, Homo Sapiens
PSISKEDIL

SEQ ID NO: 805984 - protein, 9 aa, Homo Sapiens
MWQFMGQSD

SEQ ID NO: 805985 - protein, 9 aa, Homo Sapiens
SPSNYVHRE

SEQ ID NO: 805986 - protein, 9 aa, Homo Sapiens
YDKRFPTCP

SEQ ID NO: 805987 - protein, 9 aa, Homo Sapiens
YQDNALLDK

SEQ ID NO: 805988 - protein, 9 aa, Homo Sapiens
QAQQQLPRR

SEQ ID NO: 805989 - protein, 9 aa, Homo Sapiens
TEINKILNN

SEQ ID NO: 805990 - protein, 9 aa, Homo Sapiens
KCSDQRGAL

SEQ ID NO: 805991 - protein, 9 aa, Homo Sapiens
SFHLENITT

SEQ ID NO: 805992 - protein, 9 aa, Homo Sapiens
RCLENVLSC

SEQ ID NO: 805993 - protein, 9 aa, Homo Sapiens
SIVSNLSHK

SEQ ID NO: 805994 - protein, 9 aa, Homo Sapiens
ISNQRIYYS

SEQ ID NO: 805995 - protein, 9 aa, Homo Sapiens
PTCYNYSEN

SEQ ID NO: 805996 - protein, 9 aa, Homo Sapiens
EEKNQYTID

SEQ ID NO: 805997 - protein, 9 aa, Homo Sapiens
EDLFMSGQK

SEQ ID NO: 805998 - protein, 9 aa, Homo Sapiens
AVQCLQSAS

SEQ ID NO: 805999 - protein, 9 aa, Homo Sapiens
DLTSNSLNR

SEQ ID NO: 806000 - protein, 9 aa, Homo Sapiens
IHVCLALRI

SEQ ID NO: 806001 - protein, 9 aa, Homo Sapiens
FFKSALQTI

SEQ ID NO: 806002 - protein, 9 aa, Homo Sapiens
HKRYFSEIK

SEQ ID NO: 806003 - protein, 9 aa, Homo Sapiens
FCFLTDTSH

SEQ ID NO: 806004 - protein, 9 aa, Homo Sapiens
HQSKMEKAE

SEQ ID NO: 806005 - protein, 9 aa, Homo Sapiens
NLAMNYSTV

SEQ ID NO: 806006 - protein, 9 aa, Homo Sapiens
SSAADFDDR

SEQ ID NO: 806007 - protein, 9 aa, Homo Sapiens
ATLHAENLW

SEQ ID NO: 806008 - protein, 9 aa, Homo Sapiens
NFDELNAPQ

SEQ ID NO: 806009 - protein, 9 aa, Homo Sapiens
LVNSEGGSG

SEQ ID NO: 806010 - protein, 9 aa, Homo Sapiens
QEIEITPPT

SEQ ID NO: 806011 - protein, 9 aa, Homo Sapiens
DRWRNPRRF

SEQ ID NO: 806012 - protein, 9 aa, Homo Sapiens
KKSSGMYKE

SEQ ID NO: 806013 - protein, 9 aa, Homo Sapiens
WCETNLWRC

SEQ ID NO: 806014 - protein, 9 aa, Homo Sapiens
ARDMIMKIL

SEQ ID NO: 806015 - protein, 9 aa, Homo Sapiens
SHLAAVGML

SEQ ID NO: 806016 - protein, 9 aa, Homo Sapiens
IKHTMAFIE

SEQ ID NO: 806017 - protein, 9 aa, Homo Sapiens
RTEVVLTII

SEQ ID NO: 806018 - protein, 9 aa, Homo Sapiens
LYQRVGVPK

SEQ ID NO: 806019 - protein, 9 aa, Homo Sapiens
GVLEAKKIK

SEQ ID NO: 806020 - protein, 9 aa, Homo Sapiens
LHEKCKQRR

SEQ ID NO: 806021 - protein, 9 aa, Homo Sapiens
QEEINNMWA

SEQ ID NO: 806022 - protein, 9 aa, Homo Sapiens
RNTVQGPAY

SEQ ID NO: 806023 - protein, 9 aa, Homo Sapiens
GTSLGGVTF

SEQ ID NO: 806024 - protein, 9 aa, Homo Sapiens
KASLCSPTF

SEQ ID NO: 806025 - protein, 9 aa, Homo Sapiens
GVTFLGLCS

SEQ ID NO: 806026 - protein, 9 aa, Homo Sapiens
PRHGHSGGY

SEQ ID NO: 806027 - protein, 9 aa, Homo Sapiens
REQRCTDHG

SEQ ID NO: 806028 - protein, 9 aa, Homo Sapiens
KEKQEKLKQ

SEQ ID NO: 806029 - protein, 9 aa, Homo Sapiens
LLPTALLLI

SEQ ID NO: 806030 - protein, 9 aa, Homo Sapiens
SLISLEEEE

SEQ ID NO: 806031 - protein, 9 aa, Homo Sapiens
CIQWLVKFI

SEQ ID NO: 806032 - protein, 9 aa, Homo Sapiens
LLDAEKDIS

SEQ ID NO: 806033 - protein, 9 aa, Homo Sapiens
QKERRSLMP

SEQ ID NO: 806034 - protein, 9 aa, Homo Sapiens
KYGGCGFPP

SEQ ID NO: 806035 - protein, 9 aa, Homo Sapiens
FDNQFGLDE

SEQ ID NO: 806036 - protein, 9 aa, Homo Sapiens
YNYLYHLLH

SEQ ID NO: 806037 - protein, 9 aa, Homo Sapiens
DHLNKHSYP

SEQ ID NO: 806038 - protein, 9 aa, Homo Sapiens
MRGYQRCCE

SEQ ID NO: 806039 - protein, 9 aa, Homo Sapiens
LETLTLTYG

SEQ ID NO: 806040 - protein, 9 aa, Homo Sapiens
VNVLTFIGI

SEQ ID NO: 806041 - protein, 9 aa, Homo Sapiens
KQNLALSRE

SEQ ID NO: 806042 - protein, 9 aa, Homo Sapiens
HHRPRLFHQ

SEQ ID NO: 806043 - protein, 9 aa, Homo Sapiens
ATQAAEIWD

SEQ ID NO: 806044 - protein, 9 aa, Homo Sapiens
RHNLYNNPF

SEQ ID NO: 806045 - protein, 9 aa, Homo Sapiens
MYLLFTTGN

SEQ ID NO: 806046 - protein, 9 aa, Homo Sapiens
PQMLFHSPT

SEQ ID NO: 806047 - protein, 9 aa, Homo Sapiens
FKMYPLPED

SEQ ID NO: 806048 - protein, 9 aa, Homo Sapiens
REPGHSGVE

SEQ ID NO: 806049 - protein, 9 aa, Homo Sapiens
KRFILFRPF

SEQ ID NO: 806050 - protein, 9 aa, Homo Sapiens
VFNFLLMTY

SEQ ID NO: 806051 - protein, 9 aa, Homo Sapiens
RPHYMFLFQ

SEQ ID NO: 806052 - protein, 9 aa, Homo Sapiens
RDELQRRII

SEQ ID NO: 806053 - protein, 9 aa, Homo Sapiens
NGNLENSCL

SEQ ID NO: 806054 - protein, 9 aa, Homo Sapiens
IQTGVDTTN

SEQ ID NO: 806055 - protein, 9 aa, Homo Sapiens
QFSGAAQAS

SEQ ID NO: 806056 - protein, 9 aa, Homo Sapiens
AGLSKRWPK

SEQ ID NO: 806057 - protein, 9 aa, Homo Sapiens
KLQESVVQW

SEQ ID NO: 806058 - protein, 9 aa, Homo Sapiens
THKTMPHIN

SEQ ID NO: 806059 - protein, 9 aa, Homo Sapiens
ELTANKRKL

SEQ ID NO: 806060 - protein, 9 aa, Homo Sapiens
TFSQSSILT

SEQ ID NO: 806061 - protein, 9 aa, Homo Sapiens
SLWNNLIDE

SEQ ID NO: 806062 - protein, 9 aa, Homo Sapiens
VAVALASAH

SEQ ID NO: 806063 - protein, 9 aa, Homo Sapiens
VDSTTMYGL

SEQ ID NO: 806064 - protein, 9 aa, Homo Sapiens
CERKDLSDT

SEQ ID NO: 806065 - protein, 9 aa, Homo Sapiens
CHSPSPGLS

SEQ ID NO: 806066 - protein, 9 aa, Homo Sapiens
AKNSLKNMA

SEQ ID NO: 806067 - protein, 9 aa, Homo Sapiens
KDTPSLRRV

SEQ ID NO: 806068 - protein, 9 aa, Homo Sapiens
RFKRVLGPC

SEQ ID NO: 806069 - protein, 9 aa, Homo Sapiens
LYAETAVLK

SEQ ID NO: 806070 - protein, 9 aa, Homo Sapiens
HNLRTLWIE

SEQ ID NO: 806071 - protein, 9 aa, Homo Sapiens
YTIMTGGDV

SEQ ID NO: 806072 - protein, 9 aa, Homo Sapiens
AVFNKALPA

SEQ ID NO: 806073 - protein, 9 aa, Homo Sapiens
APPICLRHR

SEQ ID NO: 806074 - protein, 9 aa, Homo Sapiens
AGLFRSWAI

SEQ ID NO: 806075 - protein, 9 aa, Homo Sapiens
CFQNGEEED

SEQ ID NO: 806076 - protein, 9 aa, Homo Sapiens
REQSIDGTG

SEQ ID NO: 806077 - protein, 9 aa, Homo Sapiens
NISYVVEAI

SEQ ID NO: 806078 - protein, 9 aa, Homo Sapiens
SQGILFPDS

SEQ ID NO: 806079 - protein, 9 aa, Homo Sapiens
LTKGGKKGD

SEQ ID NO: 806080 - protein, 9 aa, Homo Sapiens
SSSSARRPS

SEQ ID NO: 806081 - protein, 9 aa, Homo Sapiens
FITYSFILR

SEQ ID NO: 806082 - protein, 9 aa, Homo Sapiens
FTALINFWD

SEQ ID NO: 806083 - protein, 9 aa, Homo Sapiens
KGNLNIHQQ

SEQ ID NO: 806084 - protein, 9 aa, Homo Sapiens
YFNESQRQA

SEQ ID NO: 806085 - protein, 9 aa, Homo Sapiens
LDKYEQACN

SEQ ID NO: 806086 - protein, 9 aa, Homo Sapiens
FLDSEDSEL

SEQ ID NO: 806087 - protein, 9 aa, Homo Sapiens
AIHWIYPEG

SEQ ID NO: 806088 - protein, 9 aa, Homo Sapiens
KQLTQMTRC

SEQ ID NO: 806089 - protein, 9 aa, Homo Sapiens
ILLLLFLGA

SEQ ID NO: 806090 - protein, 9 aa, Homo Sapiens
PLSKKVECR

SEQ ID NO: 806091 - protein, 9 aa, Homo Sapiens
SLLKKYQAV

SEQ ID NO: 806092 - protein, 9 aa, Homo Sapiens
DTNERTPYI

SEQ ID NO: 806093 - protein, 9 aa, Homo Sapiens
KQALEIQSS

SEQ ID NO: 806094 - protein, 9 aa, Homo Sapiens
KMEISVKRQ

SEQ ID NO: 806095 - protein, 9 aa, Homo Sapiens
EVLQLCSYV

SEQ ID NO: 806096 - protein, 9 aa, Homo Sapiens
PNQVASMHC

SEQ ID NO: 806097 - protein, 9 aa, Homo Sapiens
VLLKCVNHT

SEQ ID NO: 806098 - protein, 9 aa, Homo Sapiens
WALLLDGIS

SEQ ID NO: 806099 - protein, 9 aa, Homo Sapiens
QSSLIYLTL

SEQ ID NO: 806100 - protein, 9 aa, Homo Sapiens
ILAAMGFDR

SEQ ID NO: 806101 - protein, 9 aa, Homo Sapiens
DYAIDDQDL

SEQ ID NO: 806102 - protein, 9 aa, Homo Sapiens
RTEQTAPTG

SEQ ID NO: 806103 - protein, 9 aa, Homo Sapiens
TTSLLTFWH

SEQ ID NO: 806104 - protein, 9 aa, Homo Sapiens
RHPEERAQP

SEQ ID NO: 806105 - protein, 9 aa, Homo Sapiens
FEDMLDNPL

SEQ ID NO: 806106 - protein, 9 aa, Homo Sapiens
LAKVIRLLA

SEQ ID NO: 806107 - protein, 9 aa, Homo Sapiens
QNMVLQEDA

SEQ ID NO: 806108 - protein, 9 aa, Homo Sapiens
SANLQERVR

SEQ ID NO: 806109 - protein, 9 aa, Homo Sapiens
RLWEVMWTK

SEQ ID NO: 806110 - protein, 9 aa, Homo Sapiens
FKGNAIISN

SEQ ID NO: 806111 - protein, 9 aa, Homo Sapiens
QQLKEITAK

SEQ ID NO: 806112 - protein, 9 aa, Homo Sapiens
RFPQLTTRR

SEQ ID NO: 806113 - protein, 9 aa, Homo Sapiens
EIFILAAMG

SEQ ID NO: 806114 - protein, 9 aa, Homo Sapiens
RPNKMDGAS

SEQ ID NO: 806115 - protein, 9 aa, Homo Sapiens
KPVNKKNTW

SEQ ID NO: 806116 - protein, 9 aa, Homo Sapiens
INRPRRVLN

SEQ ID NO: 806117 - protein, 9 aa, Homo Sapiens
VDKLLLFTT

SEQ ID NO: 806118 - protein, 9 aa, Homo Sapiens
FVFSTLANI

SEQ ID NO: 806119 - protein, 9 aa, Homo Sapiens
KRIIPLRFV

SEQ ID NO: 806120 - protein, 9 aa, Homo Sapiens
KFKAESNLF

SEQ ID NO: 806121 - protein, 9 aa, Homo Sapiens
HLELLQRKQ

SEQ ID NO: 806122 - protein, 9 aa, Homo Sapiens
RYDNSAHGY

SEQ ID NO: 806123 - protein, 9 aa, Homo Sapiens
LTNAVQSDS

SEQ ID NO: 806124 - protein, 9 aa, Homo Sapiens
LKTKVLDMY

SEQ ID NO: 806125 - protein, 9 aa, Homo Sapiens
SRIWQEARL

SEQ ID NO: 806126 - protein, 9 aa, Homo Sapiens
QVPFFLFAA

SEQ ID NO: 806127 - protein, 9 aa, Homo Sapiens
LKQILSLSE

SEQ ID NO: 806128 - protein, 9 aa, Homo Sapiens
SCVEAQDGE

SEQ ID NO: 806129 - protein, 9 aa, Homo Sapiens
KNGEDKLLP

SEQ ID NO: 806130 - protein, 9 aa, Homo Sapiens
ESTKISALC

SEQ ID NO: 806131 - protein, 9 aa, Homo Sapiens
LKYYQILID

SEQ ID NO: 806132 - protein, 9 aa, Homo Sapiens
MLFLSDISD

SEQ ID NO: 806133 - protein, 9 aa, Homo Sapiens
WGLPSLLRP

SEQ ID NO: 806134 - protein, 9 aa, Homo Sapiens
LRNLGLYTD

SEQ ID NO: 806135 - protein, 9 aa, Homo Sapiens
FIGRLQSLT

SEQ ID NO: 806136 - protein, 9 aa, Homo Sapiens
VEDLYSELS

SEQ ID NO: 806137 - protein, 9 aa, Homo Sapiens
PLSYPDLDA

SEQ ID NO: 806138 - protein, 9 aa, Homo Sapiens
QYDKCYIHE

SEQ ID NO: 806139 - protein, 9 aa, Homo Sapiens
TYWCLCTVN

SEQ ID NO: 806140 - protein, 9 aa, Homo Sapiens
FQVTEGLCA

SEQ ID NO: 806141 - protein, 9 aa, Homo Sapiens
PSHLSRLPL

SEQ ID NO: 806142 - protein, 9 aa, Homo Sapiens
RFCDNIIVS

SEQ ID NO: 806143 - protein, 9 aa, Homo Sapiens
SYMLVDSSD

SEQ ID NO: 806144 - protein, 9 aa, Homo Sapiens
AEIAVNAIL

SEQ ID NO: 806145 - protein, 9 aa, Homo Sapiens
FQGAWATLQ

SEQ ID NO: 806146 - protein, 9 aa, Homo Sapiens
RKRTLPAFL

SEQ ID NO: 806147 - protein, 9 aa, Homo Sapiens
KWEMEHTDI

SEQ ID NO: 806148 - protein, 9 aa, Homo Sapiens
CDTFIQKTK

SEQ ID NO: 806149 - protein, 9 aa, Homo Sapiens
HNAPAKLQG

SEQ ID NO: 806150 - protein, 9 aa, Homo Sapiens
NVYALLKDL

SEQ ID NO: 806151 - protein, 9 aa, Homo Sapiens
EVQDLFETQ

SEQ ID NO: 806152 - protein, 9 aa, Homo Sapiens
MFLITREPA

SEQ ID NO: 806153 - protein, 9 aa, Homo Sapiens
RCKALSSCA

SEQ ID NO: 806154 - protein, 9 aa, Homo Sapiens
CAILNIQSG

SEQ ID NO: 806155 - protein, 9 aa, Homo Sapiens
DKAKYTTSA

SEQ ID NO: 806156 - protein, 9 aa, Homo Sapiens
QLNKLQDKI

SEQ ID NO: 806157 - protein, 9 aa, Homo Sapiens
TGNKTITEF

SEQ ID NO: 806158 - protein, 9 aa, Homo Sapiens
EMVIYLMGA

SEQ ID NO: 806159 - protein, 9 aa, Homo Sapiens
EQIKCDKYI

SEQ ID NO: 806160 - protein, 9 aa, Homo Sapiens
DGPSRIDHF

SEQ ID NO: 806161 - protein, 9 aa, Homo Sapiens
ADSNFKDLQ

SEQ ID NO: 806162 - protein, 9 aa, Homo Sapiens
VGFSFVSGC

SEQ ID NO: 806163 - protein, 9 aa, Homo Sapiens
TVQRIILEP

SEQ ID NO: 806164 - protein, 9 aa, Homo Sapiens
RHKARENTF

SEQ ID NO: 806165 - protein, 9 aa, Homo Sapiens
PPPSWTGIR

SEQ ID NO: 806166 - protein, 9 aa, Homo Sapiens
IDTLKEVDA

SEQ ID NO: 806167 - protein, 9 aa, Homo Sapiens
RIKARIELP

SEQ ID NO: 806168 - protein, 9 aa, Homo Sapiens
DYIVLIVEK

SEQ ID NO: 806169 - protein, 9 aa, Homo Sapiens
TLSDFGFCA

SEQ ID NO: 806170 - protein, 9 aa, Homo Sapiens
RTEEERKHT

SEQ ID NO: 806171 - protein, 9 aa, Homo Sapiens
CTIRTRRNS

SEQ ID NO: 806172 - protein, 9 aa, Homo Sapiens
GSKRGIYSR

SEQ ID NO: 806173 - protein, 9 aa, Homo Sapiens
EVLNRRSLT

SEQ ID NO: 806174 - protein, 9 aa, Homo Sapiens
PGTRRQFST

SEQ ID NO: 806175 - protein, 9 aa, Homo Sapiens
LKVKAMQSN

SEQ ID NO: 806176 - protein, 9 aa, Homo Sapiens
LVTLGNTFE

SEQ ID NO: 806177 - protein, 9 aa, Homo Sapiens
LYRGLIALD

SEQ ID NO: 806178 - protein, 9 aa, Homo Sapiens
GLKQNVLDY

SEQ ID NO: 806179 - protein, 9 aa, Homo Sapiens
TAGEMAGAS

SEQ ID NO: 806180 - protein, 9 aa, Homo Sapiens
KYFYVHTVM

SEQ ID NO: 806181 - protein, 9 aa, Homo Sapiens
FFDLSICCG

SEQ ID NO: 806182 - protein, 9 aa, Homo Sapiens
DGDQSVSSQ

SEQ ID NO: 806183 - protein, 9 aa, Homo Sapiens
IKEIGSKYS

SEQ ID NO: 806184 - protein, 9 aa, Homo Sapiens
SSRLQTDNL

SEQ ID NO: 806185 - protein, 9 aa, Homo Sapiens
VDEDTTSFD

SEQ ID NO: 806186 - protein, 9 aa, Homo Sapiens
IKDILPEMR

SEQ ID NO: 806187 - protein, 9 aa, Homo Sapiens
VRTLQSFGT

SEQ ID NO: 806188 - protein, 9 aa, Homo Sapiens
QRVHTEDKF

SEQ ID NO: 806189 - protein, 9 aa, Homo Sapiens
HTGDKFYKC

SEQ ID NO: 806190 - protein, 9 aa, Homo Sapiens
IIFEDGNIN

SEQ ID NO: 806191 - protein, 9 aa, Homo Sapiens
LIQLSCSST

SEQ ID NO: 806192 - protein, 9 aa, Homo Sapiens
QEWLRSQHR

SEQ ID NO: 806193 - protein, 9 aa, Homo Sapiens
VSSTSLGTL

SEQ ID NO: 806194 - protein, 9 aa, Homo Sapiens
DMLDNPLNS

SEQ ID NO: 806195 - protein, 9 aa, Homo Sapiens
QWRELGEQV

SEQ ID NO: 806196 - protein, 9 aa, Homo Sapiens
ERHFRTTGQ

SEQ ID NO: 806197 - protein, 9 aa, Homo Sapiens
NVSGLACDP

SEQ ID NO: 806198 - protein, 9 aa, Homo Sapiens
PNMTHPEFI

SEQ ID NO: 806199 - protein, 9 aa, Homo Sapiens
VQYDSSEPA

SEQ ID NO: 806200 - protein, 9 aa, Homo Sapiens
HPSRTIFRK

SEQ ID NO: 806201 - protein, 9 aa, Homo Sapiens
GISRIQYCI

SEQ ID NO: 806202 - protein, 9 aa, Homo Sapiens
CLEHGEHGC

SEQ ID NO: 806203 - protein, 9 aa, Homo Sapiens
LMNKHQVPK

SEQ ID NO: 806204 - protein, 9 aa, Homo Sapiens
DYSTQKQSS

SEQ ID NO: 806205 - protein, 9 aa, Homo Sapiens
TLSNKPEIP

SEQ ID NO: 806206 - protein, 9 aa, Homo Sapiens
EMRAFPVFL

SEQ ID NO: 806207 - protein, 9 aa, Homo Sapiens
RLVDNEELN

SEQ ID NO: 806208 - protein, 9 aa, Homo Sapiens
LETVSCCPT

SEQ ID NO: 806209 - protein, 9 aa, Homo Sapiens
DLNQNEENI

SEQ ID NO: 806210 - protein, 9 aa, Homo Sapiens
DTKKNKINN

SEQ ID NO: 806211 - protein, 9 aa, Homo Sapiens
LNPTSWEKR

SEQ ID NO: 806212 - protein, 9 aa, Homo Sapiens
ILEQEYNKL

SEQ ID NO: 806213 - protein, 9 aa, Homo Sapiens
NFYSHPHFV

SEQ ID NO: 806214 - protein, 9 aa, Homo Sapiens
RVPVATLVK

SEQ ID NO: 806215 - protein, 9 aa, Homo Sapiens
QIIRTCSRD

SEQ ID NO: 806216 - protein, 9 aa, Homo Sapiens
LFGYMQMTI

SEQ ID NO: 806217 - protein, 9 aa, Homo Sapiens
TVLFEWERT

SEQ ID NO: 806218 - protein, 9 aa, Homo Sapiens
TKRTKGMGK

SEQ ID NO: 806219 - protein, 9 aa, Homo Sapiens
SHMCLHDYR

SEQ ID NO: 806220 - protein, 9 aa, Homo Sapiens
SKLNPQQFD

SEQ ID NO: 806221 - protein, 9 aa, Homo Sapiens
GDTAILFTR

SEQ ID NO: 806222 - protein, 9 aa, Homo Sapiens
LKWPTLVAA

SEQ ID NO: 806223 - protein, 9 aa, Homo Sapiens
PERLVFKMC

SEQ ID NO: 806224 - protein, 9 aa, Homo Sapiens
NLEVQLCRA

SEQ ID NO: 806225 - protein, 9 aa, Homo Sapiens
CPVVTVNHI

SEQ ID NO: 806226 - protein, 9 aa, Homo Sapiens
GLEKAIRDK

SEQ ID NO: 806227 - protein, 9 aa, Homo Sapiens
GYKDPAAIP

SEQ ID NO: 806228 - protein, 9 aa, Homo Sapiens
RYGYPEGKD

SEQ ID NO: 806229 - protein, 9 aa, Homo Sapiens
FFAHGPPLQ

SEQ ID NO: 806230 - protein, 9 aa, Homo Sapiens
GPSSYMWRD

SEQ ID NO: 806231 - protein, 9 aa, Homo Sapiens
DSTLLVFMS

SEQ ID NO: 806232 - protein, 9 aa, Homo Sapiens
RNKEFKSAI

SEQ ID NO: 806233 - protein, 9 aa, Homo Sapiens
NVEVKLVDF

SEQ ID NO: 806234 - protein, 9 aa, Homo Sapiens
DKFCKVCGV

SEQ ID NO: 806235 - protein, 9 aa, Homo Sapiens
TKIFIYNIP

SEQ ID NO: 806236 - protein, 9 aa, Homo Sapiens
TSHLNDHWR

SEQ ID NO: 806237 - protein, 9 aa, Homo Sapiens
FMGVIQCNP

SEQ ID NO: 806238 - protein, 9 aa, Homo Sapiens
QAIQIIQER

SEQ ID NO: 806239 - protein, 9 aa, Homo Sapiens
EIFELIHKY

SEQ ID NO: 806240 - protein, 9 aa, Homo Sapiens
AGSTPTTFS

SEQ ID NO: 806241 - protein, 9 aa, Homo Sapiens
KTLGGVIFQ

SEQ ID NO: 806242 - protein, 9 aa, Homo Sapiens
ELVQIGHEV

SEQ ID NO: 806243 - protein, 9 aa, Homo Sapiens
SASAVPCTQ

SEQ ID NO: 806244 - protein, 9 aa, Homo Sapiens
KFQTEGNIY

SEQ ID NO: 806245 - protein, 9 aa, Homo Sapiens
NGSNWEGIP

SEQ ID NO: 806246 - protein, 9 aa, Homo Sapiens
NSSESVGPE

SEQ ID NO: 806247 - protein, 9 aa, Homo Sapiens
QYIYVGELL

SEQ ID NO: 806248 - protein, 9 aa, Homo Sapiens
RFGRRFIIR

SEQ ID NO: 806249 - protein, 9 aa, Homo Sapiens
YRGPDTNPR

SEQ ID NO: 806250 - protein, 9 aa, Homo Sapiens
DCAVIEGHD

SEQ ID NO: 806251 - protein, 9 aa, Homo Sapiens
EKREDVKLE

SEQ ID NO: 806252 - protein, 9 aa, Homo Sapiens
RQVLAVDEQ

SEQ ID NO: 806253 - protein, 9 aa, Homo Sapiens
WELPHAYKC

SEQ ID NO: 806254 - protein, 9 aa, Homo Sapiens
SVPQSEKSK

SEQ ID NO: 806255 - protein, 9 aa, Homo Sapiens
IQSKDTTIQ

SEQ ID NO: 806256 - protein, 9 aa, Homo Sapiens
VVFNFLLMT

SEQ ID NO: 806257 - protein, 9 aa, Homo Sapiens
IKEDAGRMI

SEQ ID NO: 806258 - protein, 9 aa, Homo Sapiens
LLDIINELN

SEQ ID NO: 806259 - protein, 9 aa, Homo Sapiens
PESPKFVRV

SEQ ID NO: 806260 - protein, 9 aa, Homo Sapiens
EEQLMSCGA

SEQ ID NO: 806261 - protein, 9 aa, Homo Sapiens
PMIKKACKV

SEQ ID NO: 806262 - protein, 9 aa, Homo Sapiens
LAVTRISTE

SEQ ID NO: 806263 - protein, 9 aa, Homo Sapiens
DKRIPQIRI

SEQ ID NO: 806264 - protein, 9 aa, Homo Sapiens
SCYICYRQM

SEQ ID NO: 806265 - protein, 9 aa, Homo Sapiens
CQVWAYIRH

SEQ ID NO: 806266 - protein, 9 aa, Homo Sapiens
CEKMLDNGN

SEQ ID NO: 806267 - protein, 9 aa, Homo Sapiens
NVGIVKVVK

SEQ ID NO: 806268 - protein, 9 aa, Homo Sapiens
LGDDGVLLY

SEQ ID NO: 806269 - protein, 9 aa, Homo Sapiens
KEVIQREGK

SEQ ID NO: 806270 - protein, 9 aa, Homo Sapiens
QQEEEGLYP

SEQ ID NO: 806271 - protein, 9 aa, Homo Sapiens
ALAGVLLWY

SEQ ID NO: 806272 - protein, 9 aa, Homo Sapiens
FNKLKIKAR

SEQ ID NO: 806273 - protein, 9 aa, Homo Sapiens
AGSEGTTYS

SEQ ID NO: 806274 - protein, 9 aa, Homo Sapiens
KIFWRDQGK

SEQ ID NO: 806275 - protein, 9 aa, Homo Sapiens
MNVVDVLAI

SEQ ID NO: 806276 - protein, 9 aa, Homo Sapiens
IKDNDIIGD

SEQ ID NO: 806277 - protein, 9 aa, Homo Sapiens
KALCAFQGY

SEQ ID NO: 806278 - protein, 9 aa, Homo Sapiens
YSPGGDWEV

SEQ ID NO: 806279 - protein, 9 aa, Homo Sapiens
ETTSTTLKY

SEQ ID NO: 806280 - protein, 9 aa, Homo Sapiens
SYVPPSCCS

SEQ ID NO: 806281 - protein, 9 aa, Homo Sapiens
QSNSTAWQD

SEQ ID NO: 806282 - protein, 9 aa, Homo Sapiens
SRKIFDLCI

SEQ ID NO: 806283 - protein, 9 aa, Homo Sapiens
LSDYATCLY

SEQ ID NO: 806284 - protein, 9 aa, Homo Sapiens
ERRKIIKTY

SEQ ID NO: 806285 - protein, 9 aa, Homo Sapiens
IGPRCVLNL

SEQ ID NO: 806286 - protein, 9 aa, Homo Sapiens
GLSCAFGGS

SEQ ID NO: 806287 - protein, 9 aa, Homo Sapiens
TVPQLMINL

SEQ ID NO: 806288 - protein, 9 aa, Homo Sapiens
QHHKLCDII

SEQ ID NO: 806289 - protein, 9 aa, Homo Sapiens
AYSPKLERK

SEQ ID NO: 806290 - protein, 9 aa, Homo Sapiens
RHCVTRRET

SEQ ID NO: 806291 - protein, 9 aa, Homo Sapiens
YWYCTRLKT

SEQ ID NO: 806292 - protein, 9 aa, Homo Sapiens
IRKEINQYG

SEQ ID NO: 806293 - protein, 9 aa, Homo Sapiens
YPIGLITSS

SEQ ID NO: 806294 - protein, 9 aa, Homo Sapiens
SSFQNHERT

SEQ ID NO: 806295 - protein, 9 aa, Homo Sapiens
QSLYVQIDF

SEQ ID NO: 806296 - protein, 9 aa, Homo Sapiens
CKKEENNLV

SEQ ID NO: 806297 - protein, 9 aa, Homo Sapiens
MTMDDSKNN

SEQ ID NO: 806298 - protein, 9 aa, Homo Sapiens
LSGKEADKL

SEQ ID NO: 806299 - protein, 9 aa, Homo Sapiens
YLAHNYDIP

SEQ ID NO: 806300 - protein, 9 aa, Homo Sapiens
KDNVVLDVG

SEQ ID NO: 806301 - protein, 9 aa, Homo Sapiens
NSPMMCPQA

SEQ ID NO: 806302 - protein, 9 aa, Homo Sapiens
LRKIEQPFG

SEQ ID NO: 806303 - protein, 9 aa, Homo Sapiens
VVAIILAGI

SEQ ID NO: 806304 - protein, 9 aa, Homo Sapiens
CVQKFIKID

SEQ ID NO: 806305 - protein, 9 aa, Homo Sapiens
ESYMKLGRN

SEQ ID NO: 806306 - protein, 9 aa, Homo Sapiens
YSRKKYYYI

SEQ ID NO: 806307 - protein, 9 aa, Homo Sapiens
EEMHHLQQE

SEQ ID NO: 806308 - protein, 9 aa, Homo Sapiens
QGHSIVISS

SEQ ID NO: 806309 - protein, 9 aa, Homo Sapiens
YDATRQKRK

SEQ ID NO: 806310 - protein, 9 aa, Homo Sapiens
ILTVADMER

SEQ ID NO: 806311 - protein, 9 aa, Homo Sapiens
TALEARIHK

SEQ ID NO: 806312 - protein, 9 aa, Homo Sapiens
TFMFDEKLV

SEQ ID NO: 806313 - protein, 9 aa, Homo Sapiens
QGCDCDKDM

SEQ ID NO: 806314 - protein, 9 aa, Homo Sapiens
EKKDQQIAV

SEQ ID NO: 806315 - protein, 9 aa, Homo Sapiens
TKLPFPLST

SEQ ID NO: 806316 - protein, 9 aa, Homo Sapiens
HGDALRNTK

SEQ ID NO: 806317 - protein, 9 aa, Homo Sapiens
SIYGSITIG

SEQ ID NO: 806318 - protein, 9 aa, Homo Sapiens
RNVFEPARA

SEQ ID NO: 806319 - protein, 9 aa, Homo Sapiens
RKADFHGDH

SEQ ID NO: 806320 - protein, 9 aa, Homo Sapiens
HVVKCYRGK

SEQ ID NO: 806321 - protein, 9 aa, Homo Sapiens
HAYRYCKPL

SEQ ID NO: 806322 - protein, 9 aa, Homo Sapiens
NVQWLRSQL

SEQ ID NO: 806323 - protein, 9 aa, Homo Sapiens
RYWELLIYL

SEQ ID NO: 806324 - protein, 9 aa, Homo Sapiens
SGGPLHLGY

SEQ ID NO: 806325 - protein, 9 aa, Homo Sapiens
KAHHDFGYF

SEQ ID NO: 806326 - protein, 9 aa, Homo Sapiens
LKYTSVFEF

SEQ ID NO: 806327 - protein, 9 aa, Homo Sapiens
NEIYAGVCE

SEQ ID NO: 806328 - protein, 9 aa, Homo Sapiens
TPVEKKNKG

SEQ ID NO: 806329 - protein, 9 aa, Homo Sapiens
IIQYDKCYI

SEQ ID NO: 806330 - protein, 9 aa, Homo Sapiens
RYCYTDVAL

SEQ ID NO: 806331 - protein, 9 aa, Homo Sapiens
QKIAKAFAI

SEQ ID NO: 806332 - protein, 9 aa, Homo Sapiens
TSKIKVLEF

SEQ ID NO: 806333 - protein, 9 aa, Homo Sapiens
SLRVNALLA

SEQ ID NO: 806334 - protein, 9 aa, Homo Sapiens
DLRLNGCHL

SEQ ID NO: 806335 - protein, 9 aa, Homo Sapiens
KDLQNGMII

SEQ ID NO: 806336 - protein, 9 aa, Homo Sapiens
MLGYVTLLE

SEQ ID NO: 806337 - protein, 9 aa, Homo Sapiens
GVSEDARLF

SEQ ID NO: 806338 - protein, 9 aa, Homo Sapiens
DFVSILPVI

SEQ ID NO: 806339 - protein, 9 aa, Homo Sapiens
DRICRVLSH

SEQ ID NO: 806340 - protein, 9 aa, Homo Sapiens
LRSLDYVKI

SEQ ID NO: 806341 - protein, 9 aa, Homo Sapiens
TIVTSGTRT

SEQ ID NO: 806342 - protein, 9 aa, Homo Sapiens
TDTGINPQI

SEQ ID NO: 806343 - protein, 9 aa, Homo Sapiens
TQMAVAQVH

SEQ ID NO: 806344 - protein, 9 aa, Homo Sapiens
ILDYQVPLD

SEQ ID NO: 806345 - protein, 9 aa, Homo Sapiens
HNSYYVHQN

SEQ ID NO: 806346 - protein, 9 aa, Homo Sapiens
EYKNLYYAA

SEQ ID NO: 806347 - protein, 9 aa, Homo Sapiens
HQSQHRKFV

SEQ ID NO: 806348 - protein, 9 aa, Homo Sapiens
DSDREEINV

SEQ ID NO: 806349 - protein, 9 aa, Homo Sapiens
IIQPKTCQV

SEQ ID NO: 806350 - protein, 9 aa, Homo Sapiens
VSFCRERST

SEQ ID NO: 806351 - protein, 9 aa, Homo Sapiens
IRFCLEGME

SEQ ID NO: 806352 - protein, 9 aa, Homo Sapiens
TRMATMGIL

SEQ ID NO: 806353 - protein, 9 aa, Homo Sapiens
QPGRLKTVQ

SEQ ID NO: 806354 - protein, 9 aa, Homo Sapiens
KAAVKAARE

SEQ ID NO: 806355 - protein, 9 aa, Homo Sapiens
QPHLPWVLI

SEQ ID NO: 806356 - protein, 9 aa, Homo Sapiens
FPHLYKITQ

SEQ ID NO: 806357 - protein, 9 aa, Homo Sapiens
QIHNSFSPN

SEQ ID NO: 806358 - protein, 9 aa, Homo Sapiens
SQSSKLIMH

SEQ ID NO: 806359 - protein, 9 aa, Homo Sapiens
QIYLKRPRH

SEQ ID NO: 806360 - protein, 9 aa, Homo Sapiens
HHLRDCMDP

SEQ ID NO: 806361 - protein, 9 aa, Homo Sapiens
VNTKNKRKL

SEQ ID NO: 806362 - protein, 9 aa, Homo Sapiens
RLSFETKII

SEQ ID NO: 806363 - protein, 9 aa, Homo Sapiens
VQKSITQWI

SEQ ID NO: 806364 - protein, 9 aa, Homo Sapiens
DIVLEHPNF

SEQ ID NO: 806365 - protein, 9 aa, Homo Sapiens
PQWRCRHPS

SEQ ID NO: 806366 - protein, 9 aa, Homo Sapiens
GSLLGIAVG

SEQ ID NO: 806367 - protein, 9 aa, Homo Sapiens
IHYWVFQII

SEQ ID NO: 806368 - protein, 9 aa, Homo Sapiens
QVIAHLGAL

SEQ ID NO: 806369 - protein, 9 aa, Homo Sapiens
DALNHMGQM

SEQ ID NO: 806370 - protein, 9 aa, Homo Sapiens
EGKLIYTLS

SEQ ID NO: 806371 - protein, 9 aa, Homo Sapiens
EENICLDLQ

SEQ ID NO: 806372 - protein, 9 aa, Homo Sapiens
HPVVPALRE

SEQ ID NO: 806373 - protein, 9 aa, Homo Sapiens
LKTDGSPNQ

SEQ ID NO: 806374 - protein, 9 aa, Homo Sapiens
DISVTMMAL

SEQ ID NO: 806375 - protein, 9 aa, Homo Sapiens
KICEGLGPK

SEQ ID NO: 806376 - protein, 9 aa, Homo Sapiens
ERTRAEMTK

SEQ ID NO: 806377 - protein, 9 aa, Homo Sapiens
MEKRIEKGS

SEQ ID NO: 806378 - protein, 9 aa, Homo Sapiens
PQPMIKKAC

SEQ ID NO: 806379 - protein, 9 aa, Homo Sapiens
KQFPVEGNL

SEQ ID NO: 806380 - protein, 9 aa, Homo Sapiens
SYAIIVSSI

SEQ ID NO: 806381 - protein, 9 aa, Homo Sapiens
MLYAVMQEV

SEQ ID NO: 806382 - protein, 9 aa, Homo Sapiens
HDLQQNSAL

SEQ ID NO: 806383 - protein, 9 aa, Homo Sapiens
YLTNSSQSS

SEQ ID NO: 806384 - protein, 9 aa, Homo Sapiens
RRPSNNCRA

SEQ ID NO: 806385 - protein, 9 aa, Homo Sapiens
ADTYWEYTF

SEQ ID NO: 806386 - protein, 9 aa, Homo Sapiens
NLCRQSILG

SEQ ID NO: 806387 - protein, 9 aa, Homo Sapiens
KNGRMVESA

SEQ ID NO: 806388 - protein, 9 aa, Homo Sapiens
LKEEDNGGR

SEQ ID NO: 806389 - protein, 9 aa, Homo Sapiens
RTFIYLGVE

SEQ ID NO: 806390 - protein, 9 aa, Homo Sapiens
TEEVISVET

SEQ ID NO: 806391 - protein, 9 aa, Homo Sapiens
WISCEEYKT

SEQ ID NO: 806392 - protein, 9 aa, Homo Sapiens
DKEITSEDM

SEQ ID NO: 806393 - protein, 9 aa, Homo Sapiens
LSAATATAP

SEQ ID NO: 806394 - protein, 9 aa, Homo Sapiens
TNRKADFHG

SEQ ID NO: 806395 - protein, 9 aa, Homo Sapiens
LARHRRINT

SEQ ID NO: 806396 - protein, 9 aa, Homo Sapiens
IYADIFAGA

SEQ ID NO: 806397 - protein, 9 aa, Homo Sapiens
TKDPCQKGK

SEQ ID NO: 806398 - protein, 9 aa, Homo Sapiens
ALRYVAPLV

SEQ ID NO: 806399 - protein, 9 aa, Homo Sapiens
QLLTRVLVR

SEQ ID NO: 806400 - protein, 9 aa, Homo Sapiens
VLLFYITII

SEQ ID NO: 806401 - protein, 9 aa, Homo Sapiens
KVWKMPETF

SEQ ID NO: 806402 - protein, 9 aa, Homo Sapiens
LNGVARTSA

SEQ ID NO: 806403 - protein, 9 aa, Homo Sapiens
IFPQIKEGK

SEQ ID NO: 806404 - protein, 9 aa, Homo Sapiens
AIARSLSYN

SEQ ID NO: 806405 - protein, 9 aa, Homo Sapiens
IKDGNGRRA

SEQ ID NO: 806406 - protein, 9 aa, Homo Sapiens
QRPRTSAPT

SEQ ID NO: 806407 - protein, 9 aa, Homo Sapiens
VNDMYLPLE

SEQ ID NO: 806408 - protein, 9 aa, Homo Sapiens
SVRSKQDTI

SEQ ID NO: 806409 - protein, 9 aa, Homo Sapiens
KNGSKTVIQ

SEQ ID NO: 806410 - protein, 9 aa, Homo Sapiens
VWGLDLDDF

SEQ ID NO: 806411 - protein, 9 aa, Homo Sapiens
ADTMRTRLA

SEQ ID NO: 806412 - protein, 9 aa, Homo Sapiens
YPRDIHTLG

SEQ ID NO: 806413 - protein, 9 aa, Homo Sapiens
LATIAWMVY

SEQ ID NO: 806414 - protein, 9 aa, Homo Sapiens
DILPQYVSA

SEQ ID NO: 806415 - protein, 9 aa, Homo Sapiens
ANTSGNALL

SEQ ID NO: 806416 - protein, 9 aa, Homo Sapiens
LLAENDTYD

SEQ ID NO: 806417 - protein, 9 aa, Homo Sapiens
YEQSPHSLS

SEQ ID NO: 806418 - protein, 9 aa, Homo Sapiens
CVVDLLAAT

SEQ ID NO: 806419 - protein, 9 aa, Homo Sapiens
KDGVSKSRI

SEQ ID NO: 806420 - protein, 9 aa, Homo Sapiens
AINMRYPVM

SEQ ID NO: 806421 - protein, 9 aa, Homo Sapiens
IQMASFYQP

SEQ ID NO: 806422 - protein, 9 aa, Homo Sapiens
YRCSIGGGS

SEQ ID NO: 806423 - protein, 9 aa, Homo Sapiens
HGGDRDRMT

SEQ ID NO: 806424 - protein, 9 aa, Homo Sapiens
RGMEQDNKG

SEQ ID NO: 806425 - protein, 9 aa, Homo Sapiens
RFSGKMCFQ

SEQ ID NO: 806426 - protein, 9 aa, Homo Sapiens
CFGGKEAVL

SEQ ID NO: 806427 - protein, 9 aa, Homo Sapiens
CGSAVSLSG

SEQ ID NO: 806428 - protein, 9 aa, Homo Sapiens
NLKDMDIGG

SEQ ID NO: 806429 - protein, 9 aa, Homo Sapiens
LQKHDIPED

SEQ ID NO: 806430 - protein, 9 aa, Homo Sapiens
GAWTMSDVV

SEQ ID NO: 806431 - protein, 9 aa, Homo Sapiens
NNDKEKERY

SEQ ID NO: 806432 - protein, 9 aa, Homo Sapiens
EDNKVRQYD

SEQ ID NO: 806433 - protein, 9 aa, Homo Sapiens
RTHTGEQPF

SEQ ID NO: 806434 - protein, 9 aa, Homo Sapiens
DALIASLAL

SEQ ID NO: 806435 - protein, 9 aa, Homo Sapiens
NYYIKMSIN

SEQ ID NO: 806436 - protein, 9 aa, Homo Sapiens
YISLLLRVE

SEQ ID NO: 806437 - protein, 9 aa, Homo Sapiens
RVKCQGYSI

SEQ ID NO: 806438 - protein, 9 aa, Homo Sapiens
EHNARKFNE

SEQ ID NO: 806439 - protein, 9 aa, Homo Sapiens
ETDEEDNLH

SEQ ID NO: 806440 - protein, 9 aa, Homo Sapiens
RVSSQAESS

SEQ ID NO: 806441 - protein, 9 aa, Homo Sapiens
YGGPELEHA

SEQ ID NO: 806442 - protein, 9 aa, Homo Sapiens
GQGSRMLHV

SEQ ID NO: 806443 - protein, 9 aa, Homo Sapiens
FNKDSGIVT

SEQ ID NO: 806444 - protein, 9 aa, Homo Sapiens
QYYGKSPEL

SEQ ID NO: 806445 - protein, 9 aa, Homo Sapiens
GSPRLECSD

SEQ ID NO: 806446 - protein, 9 aa, Homo Sapiens
CQYVYGVLF

SEQ ID NO: 806447 - protein, 9 aa, Homo Sapiens
TVIHLYQAL

SEQ ID NO: 806448 - protein, 9 aa, Homo Sapiens
PLASHSEKT

SEQ ID NO: 806449 - protein, 9 aa, Homo Sapiens
KVCAIYDFE

SEQ ID NO: 806450 - protein, 9 aa, Homo Sapiens
PYAAVNALC

SEQ ID NO: 806451 - protein, 9 aa, Homo Sapiens
IPFYLQYLT

SEQ ID NO: 806452 - protein, 9 aa, Homo Sapiens
VLLCRQAQQ

SEQ ID NO: 806453 - protein, 9 aa, Homo Sapiens
AELIMFIHD

SEQ ID NO: 806454 - protein, 9 aa, Homo Sapiens
RRLIDRIQI

SEQ ID NO: 806455 - protein, 9 aa, Homo Sapiens
NGIRTEQGF

SEQ ID NO: 806456 - protein, 9 aa, Homo Sapiens
VLYAWCGKR

SEQ ID NO: 806457 - protein, 9 aa, Homo Sapiens
SLINCPGIK

SEQ ID NO: 806458 - protein, 9 aa, Homo Sapiens
LSVSEAMVD

SEQ ID NO: 806459 - protein, 9 aa, Homo Sapiens
EDSNPNGSW

SEQ ID NO: 806460 - protein, 9 aa, Homo Sapiens
DTNRWFDKS

SEQ ID NO: 806461 - protein, 9 aa, Homo Sapiens
HPRVPLKDK

SEQ ID NO: 806462 - protein, 9 aa, Homo Sapiens
CSIYGSITI

SEQ ID NO: 806463 - protein, 9 aa, Homo Sapiens
YLSMQEALS

SEQ ID NO: 806464 - protein, 9 aa, Homo Sapiens
FHKYSNSNI

SEQ ID NO: 806465 - protein, 9 aa, Homo Sapiens
GGFSLFFFT

SEQ ID NO: 806466 - protein, 9 aa, Homo Sapiens
LQFNAIRVL

SEQ ID NO: 806467 - protein, 9 aa, Homo Sapiens
TESASGEMW

SEQ ID NO: 806468 - protein, 9 aa, Homo Sapiens
TNLTLIPNQ

SEQ ID NO: 806469 - protein, 9 aa, Homo Sapiens
AASSYSLSD

SEQ ID NO: 806470 - protein, 9 aa, Homo Sapiens
GLSAYQLYQ

SEQ ID NO: 806471 - protein, 9 aa, Homo Sapiens
RKRADTYWE

SEQ ID NO: 806472 - protein, 9 aa, Homo Sapiens
HREKECGDK

SEQ ID NO: 806473 - protein, 9 aa, Homo Sapiens
DKSGELLAL

SEQ ID NO: 806474 - protein, 9 aa, Homo Sapiens
SVKILCDWM

SEQ ID NO: 806475 - protein, 9 aa, Homo Sapiens
RHTNPPPEP

SEQ ID NO: 806476 - protein, 9 aa, Homo Sapiens
IFSVEKFLP

SEQ ID NO: 806477 - protein, 9 aa, Homo Sapiens
FWRDQGKVT

SEQ ID NO: 806478 - protein, 9 aa, Homo Sapiens
VTNTIEDNF

SEQ ID NO: 806479 - protein, 9 aa, Homo Sapiens
LRESCWDEY

SEQ ID NO: 806480 - protein, 9 aa, Homo Sapiens
QQLSSSSAR

SEQ ID NO: 806481 - protein, 9 aa, Homo Sapiens
TLHQESPTQ

SEQ ID NO: 806482 - protein, 9 aa, Homo Sapiens
VQCHEHIEI

SEQ ID NO: 806483 - protein, 9 aa, Homo Sapiens
VVLLMGLMF

SEQ ID NO: 806484 - protein, 9 aa, Homo Sapiens
LSVETGFHH

SEQ ID NO: 806485 - protein, 9 aa, Homo Sapiens
VTLKVQDVK

SEQ ID NO: 806486 - protein, 9 aa, Homo Sapiens
AFAFGDQNC

SEQ ID NO: 806487 - protein, 9 aa, Homo Sapiens
TNASNTEKL

SEQ ID NO: 806488 - protein, 9 aa, Homo Sapiens
RSFSAKSFK

SEQ ID NO: 806489 - protein, 9 aa, Homo Sapiens
LWDILIKAT

SEQ ID NO: 806490 - protein, 9 aa, Homo Sapiens
QLLQGIVFC

SEQ ID NO: 806491 - protein, 9 aa, Homo Sapiens
IHTGDKFYK

SEQ ID NO: 806492 - protein, 9 aa, Homo Sapiens
WYQDNALLD

SEQ ID NO: 806493 - protein, 9 aa, Homo Sapiens
FPINPPKYD

SEQ ID NO: 806494 - protein, 9 aa, Homo Sapiens
IFGPFDLAA

SEQ ID NO: 806495 - protein, 9 aa, Homo Sapiens
MPWPGKSSY

SEQ ID NO: 806496 - protein, 9 aa, Homo Sapiens
HSSLNTHLR

SEQ ID NO: 806497 - protein, 9 aa, Homo Sapiens
SELLGQAAQ

SEQ ID NO: 806498 - protein, 9 aa, Homo Sapiens
SCLLGSPTL

SEQ ID NO: 806499 - protein, 9 aa, Homo Sapiens
KGKQPTSAD

SEQ ID NO: 806500 - protein, 9 aa, Homo Sapiens
GVSIYGDTF

SEQ ID NO: 806501 - protein, 9 aa, Homo Sapiens
DSSSWPQSR

SEQ ID NO: 806502 - protein, 9 aa, Homo Sapiens
VRSKIAKYM

SEQ ID NO: 806503 - protein, 9 aa, Homo Sapiens
FSKKGYLHF

SEQ ID NO: 806504 - protein, 9 aa, Homo Sapiens
DPPAKSKCI

SEQ ID NO: 806505 - protein, 9 aa, Homo Sapiens
TRYKFYLYA

SEQ ID NO: 806506 - protein, 9 aa, Homo Sapiens
GGTLSSGLC

SEQ ID NO: 806507 - protein, 9 aa, Homo Sapiens
IQKDLETRK

SEQ ID NO: 806508 - protein, 9 aa, Homo Sapiens
LYTNSFLNL

SEQ ID NO: 806509 - protein, 9 aa, Homo Sapiens
RMGPGRKWD

SEQ ID NO: 806510 - protein, 9 aa, Homo Sapiens
TLLEIMDGK

SEQ ID NO: 806511 - protein, 9 aa, Homo Sapiens
NNEKYCIFA

SEQ ID NO: 806512 - protein, 9 aa, Homo Sapiens
NIHKKLATK

SEQ ID NO: 806513 - protein, 9 aa, Homo Sapiens
PSRLDLTVE

SEQ ID NO: 806514 - protein, 9 aa, Homo Sapiens
SYGVLSFSL

SEQ ID NO: 806515 - protein, 9 aa, Homo Sapiens
DSNKTLDKM

SEQ ID NO: 806516 - protein, 9 aa, Homo Sapiens
DQQDSAPNS

SEQ ID NO: 806517 - protein, 9 aa, Homo Sapiens
HQKRQKINL

SEQ ID NO: 806518 - protein, 9 aa, Homo Sapiens
TKVLLLLRP

SEQ ID NO: 806519 - protein, 9 aa, Homo Sapiens
QIQNAGGSV

SEQ ID NO: 806520 - protein, 9 aa, Homo Sapiens
MKTLNRKNI

SEQ ID NO: 806521 - protein, 9 aa, Homo Sapiens
KTQTILFYD

SEQ ID NO: 806522 - protein, 9 aa, Homo Sapiens
RRCYLFSHC

SEQ ID NO: 806523 - protein, 9 aa, Homo Sapiens
GQGSYFTKK

SEQ ID NO: 806524 - protein, 9 aa, Homo Sapiens
LPGFVFQFI

SEQ ID NO: 806525 - protein, 9 aa, Homo Sapiens
PQGEGGIRL

SEQ ID NO: 806526 - protein, 9 aa, Homo Sapiens
DSNEESGYF

SEQ ID NO: 806527 - protein, 9 aa, Homo Sapiens
KEKAKKQGE

SEQ ID NO: 806528 - protein, 9 aa, Homo Sapiens
FSGTRRVSF

SEQ ID NO: 806529 - protein, 9 aa, Homo Sapiens
YLRSAGDHA

SEQ ID NO: 806530 - protein, 9 aa, Homo Sapiens
NKRKEQGLV

SEQ ID NO: 806531 - protein, 9 aa, Homo Sapiens
HHYFHKPCA

SEQ ID NO: 806532 - protein, 9 aa, Homo Sapiens
KHLESPQLG

SEQ ID NO: 806533 - protein, 9 aa, Homo Sapiens
QQNSALPAT

SEQ ID NO: 806534 - protein, 9 aa, Homo Sapiens
KDGKYALLT

SEQ ID NO: 806535 - protein, 9 aa, Homo Sapiens
GTSRGHSIK

SEQ ID NO: 806536 - protein, 9 aa, Homo Sapiens
WNLRWTVAL

SEQ ID NO: 806537 - protein, 9 aa, Homo Sapiens
VSASQGAKP

SEQ ID NO: 806538 - protein, 9 aa, Homo Sapiens
AMMHILQAE

SEQ ID NO: 806539 - protein, 9 aa, Homo Sapiens
SKLNRSKCL

SEQ ID NO: 806540 - protein, 9 aa, Homo Sapiens
YSEPTSFKH

SEQ ID NO: 806541 - protein, 9 aa, Homo Sapiens
CNIPLAFLK

SEQ ID NO: 806542 - protein, 9 aa, Homo Sapiens
KVLSGFALQ

SEQ ID NO: 806543 - protein, 9 aa, Homo Sapiens
WASEVGPVM

SEQ ID NO: 806544 - protein, 9 aa, Homo Sapiens
QQKKTFFLG

SEQ ID NO: 806545 - protein, 9 aa, Homo Sapiens
NKDYHSLTT

SEQ ID NO: 806546 - protein, 9 aa, Homo Sapiens
SKLAQGRGS

SEQ ID NO: 806547 - protein, 9 aa, Homo Sapiens
DAFRESDTN

SEQ ID NO: 806548 - protein, 9 aa, Homo Sapiens
ETVNLQNNP

SEQ ID NO: 806549 - protein, 9 aa, Homo Sapiens
NLQKYLETR

SEQ ID NO: 806550 - protein, 9 aa, Homo Sapiens
TMSLPKPME

SEQ ID NO: 806551 - protein, 9 aa, Homo Sapiens
IGLKMATNR

SEQ ID NO: 806552 - protein, 9 aa, Homo Sapiens
RSFKDELLC

SEQ ID NO: 806553 - protein, 9 aa, Homo Sapiens
LGQAAQNMV

SEQ ID NO: 806554 - protein, 9 aa, Homo Sapiens
FVHGGDRDR

SEQ ID NO: 806555 - protein, 9 aa, Homo Sapiens
YLSLPNPFR

SEQ ID NO: 806556 - protein, 9 aa, Homo Sapiens
AELESVPLC

SEQ ID NO: 806557 - protein, 9 aa, Homo Sapiens
QLSKSAKEE

SEQ ID NO: 806558 - protein, 9 aa, Homo Sapiens
LSKRLTHKD

SEQ ID NO: 806559 - protein, 9 aa, Homo Sapiens
LYYNFWCGI

SEQ ID NO: 806560 - protein, 9 aa, Homo Sapiens
LGCRKAMTK

SEQ ID NO: 806561 - protein, 9 aa, Homo Sapiens
SQRLPPPLP

SEQ ID NO: 806562 - protein, 9 aa, Homo Sapiens
IGVCSESVS

SEQ ID NO: 806563 - protein, 9 aa, Homo Sapiens
DCGERFSQS

SEQ ID NO: 806564 - protein, 9 aa, Homo Sapiens
HNNSPQLST

SEQ ID NO: 806565 - protein, 9 aa, Homo Sapiens
VQNDIAYAN

SEQ ID NO: 806566 - protein, 9 aa, Homo Sapiens
RSFQIVCTF

SEQ ID NO: 806567 - protein, 9 aa, Homo Sapiens
EAKIAHKIT

SEQ ID NO: 806568 - protein, 9 aa, Homo Sapiens
RTVSRLAHR

SEQ ID NO: 806569 - protein, 9 aa, Homo Sapiens
ILKRASAEE

SEQ ID NO: 806570 - protein, 9 aa, Homo Sapiens
NPNAGQVWR

SEQ ID NO: 806571 - protein, 9 aa, Homo Sapiens
KELKTDGSP

SEQ ID NO: 806572 - protein, 9 aa, Homo Sapiens
LHFQSLAGL

SEQ ID NO: 806573 - protein, 9 aa, Homo Sapiens
RSPLKVVKK

SEQ ID NO: 806574 - protein, 9 aa, Homo Sapiens
GFLKGRCFR

SEQ ID NO: 806575 - protein, 9 aa, Homo Sapiens
IWCGARPLS

SEQ ID NO: 806576 - protein, 9 aa, Homo Sapiens
SYDNLDYTL

SEQ ID NO: 806577 - protein, 9 aa, Homo Sapiens
AAQGTWSWE

SEQ ID NO: 806578 - protein, 9 aa, Homo Sapiens
YDDEQRTFQ

SEQ ID NO: 806579 - protein, 9 aa, Homo Sapiens
DWALCQEIS

SEQ ID NO: 806580 - protein, 9 aa, Homo Sapiens
AIMHKRPLV

SEQ ID NO: 806581 - protein, 9 aa, Homo Sapiens
AKNLPSYSG

SEQ ID NO: 806582 - protein, 9 aa, Homo Sapiens
LQNLYSFQK

SEQ ID NO: 806583 - protein, 9 aa, Homo Sapiens
YSLSDLNST

SEQ ID NO: 806584 - protein, 9 aa, Homo Sapiens
VKVKISSSW

SEQ ID NO: 806585 - protein, 9 aa, Homo Sapiens
LPPSKIASM

SEQ ID NO: 806586 - protein, 9 aa, Homo Sapiens
DLAKTGCVY

SEQ ID NO: 806587 - protein, 9 aa, Homo Sapiens
YFLLPEEST

SEQ ID NO: 806588 - protein, 9 aa, Homo Sapiens
DWWIGRLLK

SEQ ID NO: 806589 - protein, 9 aa, Homo Sapiens
CACEVKGEE

SEQ ID NO: 806590 - protein, 9 aa, Homo Sapiens
DKFGHNECI

SEQ ID NO: 806591 - protein, 9 aa, Homo Sapiens
EPFIYDAPP

SEQ ID NO: 806592 - protein, 9 aa, Homo Sapiens
MVPPPVGMV

SEQ ID NO: 806593 - protein, 9 aa, Homo Sapiens
DEFIESCQE

SEQ ID NO: 806594 - protein, 9 aa, Homo Sapiens
ILGSYAIIV

SEQ ID NO: 806595 - protein, 9 aa, Homo Sapiens
RQHHRQNSW

SEQ ID NO: 806596 - protein, 9 aa, Homo Sapiens
FECMNFLAE

SEQ ID NO: 806597 - protein, 9 aa, Homo Sapiens
EIQCYVRDK

SEQ ID NO: 806598 - protein, 9 aa, Homo Sapiens
LEIAREKHQ

SEQ ID NO: 806599 - protein, 9 aa, Homo Sapiens
GYIYFKLFR

SEQ ID NO: 806600 - protein, 9 aa, Homo Sapiens
DNCGGLDHH

SEQ ID NO: 806601 - protein, 9 aa, Homo Sapiens
LLEERAKAA

SEQ ID NO: 806602 - protein, 9 aa, Homo Sapiens
ACKLLLAHL

SEQ ID NO: 806603 - protein, 9 aa, Homo Sapiens
KGDIGIIHE

SEQ ID NO: 806604 - protein, 9 aa, Homo Sapiens
ETELLLALA

SEQ ID NO: 806605 - protein, 9 aa, Homo Sapiens
YLRMIKDNS

SEQ ID NO: 806606 - protein, 9 aa, Homo Sapiens
EIKCNSYNN

SEQ ID NO: 806607 - protein, 9 aa, Homo Sapiens
FRIGVANVD

SEQ ID NO: 806608 - protein, 9 aa, Homo Sapiens
SELFINTTR

SEQ ID NO: 806609 - protein, 9 aa, Homo Sapiens
LALVATLHH

SEQ ID NO: 806610 - protein, 9 aa, Homo Sapiens
VSVRVYFNK

SEQ ID NO: 806611 - protein, 9 aa, Homo Sapiens
DPCLRSSYC

SEQ ID NO: 806612 - protein, 9 aa, Homo Sapiens
SFTLYMTYF

SEQ ID NO: 806613 - protein, 9 aa, Homo Sapiens
IQAGGTKVL

SEQ ID NO: 806614 - protein, 9 aa, Homo Sapiens
VCVSSPGTV

SEQ ID NO: 806615 - protein, 9 aa, Homo Sapiens
AATLLNIPR

SEQ ID NO: 806616 - protein, 9 aa, Homo Sapiens
LILVDYILL

SEQ ID NO: 806617 - protein, 9 aa, Homo Sapiens
NGCDLLFLL

SEQ ID NO: 806618 - protein, 9 aa, Homo Sapiens
KICEQEKKE

SEQ ID NO: 806619 - protein, 9 aa, Homo Sapiens
YYLMDLLSK

SEQ ID NO: 806620 - protein, 9 aa, Homo Sapiens
TTNEYNSND

SEQ ID NO: 806621 - protein, 9 aa, Homo Sapiens
QEWDGKDST

SEQ ID NO: 806622 - protein, 9 aa, Homo Sapiens
CLDDVKDKF

SEQ ID NO: 806623 - protein, 9 aa, Homo Sapiens
KVDFNEFVV

SEQ ID NO: 806624 - protein, 9 aa, Homo Sapiens
IHCGVCFGA

SEQ ID NO: 806625 - protein, 9 aa, Homo Sapiens
CGNTYTTGS

SEQ ID NO: 806626 - protein, 9 aa, Homo Sapiens
IVSTGNKTI

SEQ ID NO: 806627 - protein, 9 aa, Homo Sapiens
QICYGLSGK

SEQ ID NO: 806628 - protein, 9 aa, Homo Sapiens
RNSGEIVSA

SEQ ID NO: 806629 - protein, 9 aa, Homo Sapiens
LSKRWPKYR

SEQ ID NO: 806630 - protein, 9 aa, Homo Sapiens
ILVSVCAIL

SEQ ID NO: 806631 - protein, 9 aa, Homo Sapiens
KSSDTRCCK

SEQ ID NO: 806632 - protein, 9 aa, Homo Sapiens
SQSVITSST

SEQ ID NO: 806633 - protein, 9 aa, Homo Sapiens
VDDLTRQKA

SEQ ID NO: 806634 - protein, 9 aa, Homo Sapiens
HARHQALGT

SEQ ID NO: 806635 - protein, 9 aa, Homo Sapiens
YTLSDYATC

SEQ ID NO: 806636 - protein, 9 aa, Homo Sapiens
YFFYIISPG

SEQ ID NO: 806637 - protein, 9 aa, Homo Sapiens
SEAESTELV

SEQ ID NO: 806638 - protein, 9 aa, Homo Sapiens
SSLIPTHTT

SEQ ID NO: 806639 - protein, 9 aa, Homo Sapiens
ILKLSTSAL

SEQ ID NO: 806640 - protein, 9 aa, Homo Sapiens
APPRPETGI

SEQ ID NO: 806641 - protein, 9 aa, Homo Sapiens
ETSRYNFHS

SEQ ID NO: 806642 - protein, 9 aa, Homo Sapiens
KDISTNTEQ

SEQ ID NO: 806643 - protein, 9 aa, Homo Sapiens
SRTLISHKI

SEQ ID NO: 806644 - protein, 9 aa, Homo Sapiens
QQEMAIAVS

SEQ ID NO: 806645 - protein, 9 aa, Homo Sapiens
QRVRKNHCS

SEQ ID NO: 806646 - protein, 9 aa, Homo Sapiens
VVQMYSSRD

SEQ ID NO: 806647 - protein, 9 aa, Homo Sapiens
RLMEYLDRN

SEQ ID NO: 806648 - protein, 9 aa, Homo Sapiens
AIAVNKCDL

SEQ ID NO: 806649 - protein, 9 aa, Homo Sapiens
LCNHSESSG

SEQ ID NO: 806650 - protein, 9 aa, Homo Sapiens
HALEETILQ

SEQ ID NO: 806651 - protein, 9 aa, Homo Sapiens
MDEFKYFFY

SEQ ID NO: 806652 - protein, 9 aa, Homo Sapiens
ARKQDVRLA

SEQ ID NO: 806653 - protein, 9 aa, Homo Sapiens
ISASRQTLF

SEQ ID NO: 806654 - protein, 9 aa, Homo Sapiens
DVHELRVKC

SEQ ID NO: 806655 - protein, 9 aa, Homo Sapiens
YDTINTTDG

SEQ ID NO: 806656 - protein, 9 aa, Homo Sapiens
SLEGLMKHL

SEQ ID NO: 806657 - protein, 9 aa, Homo Sapiens
AKELMVKLQ

SEQ ID NO: 806658 - protein, 9 aa, Homo Sapiens
VPTCRDSCD

SEQ ID NO: 806659 - protein, 9 aa, Homo Sapiens
MTSNTEVML

SEQ ID NO: 806660 - protein, 9 aa, Homo Sapiens
YLTPQSVLL

SEQ ID NO: 806661 - protein, 9 aa, Homo Sapiens
KTLELEGIS

SEQ ID NO: 806662 - protein, 9 aa, Homo Sapiens
RICRVLSHK

SEQ ID NO: 806663 - protein, 9 aa, Homo Sapiens
EKEVKQLLS

SEQ ID NO: 806664 - protein, 9 aa, Homo Sapiens
LVQAAEAQR

SEQ ID NO: 806665 - protein, 9 aa, Homo Sapiens
FLPCSFNVS

SEQ ID NO: 806666 - protein, 9 aa, Homo Sapiens
SKSWSSYLS

SEQ ID NO: 806667 - protein, 9 aa, Homo Sapiens
KGQGKYSGS

SEQ ID NO: 806668 - protein, 9 aa, Homo Sapiens
NMIADTFVE

SEQ ID NO: 806669 - protein, 9 aa, Homo Sapiens
EEKVAQAVC

SEQ ID NO: 806670 - protein, 9 aa, Homo Sapiens
KDLKINDAT

SEQ ID NO: 806671 - protein, 9 aa, Homo Sapiens
SSSRSIFGT

SEQ ID NO: 806672 - protein, 9 aa, Homo Sapiens
NKAPTPQEK

SEQ ID NO: 806673 - protein, 9 aa, Homo Sapiens
EDCAVALNL

SEQ ID NO: 806674 - protein, 9 aa, Homo Sapiens
AFHLDRIMD

SEQ ID NO: 806675 - protein, 9 aa, Homo Sapiens
YEELPTSFQ

SEQ ID NO: 806676 - protein, 9 aa, Homo Sapiens
SGTAWVSEI

SEQ ID NO: 806677 - protein, 9 aa, Homo Sapiens
KVKYQSLNK

SEQ ID NO: 806678 - protein, 9 aa, Homo Sapiens
KKYLSNKAM

SEQ ID NO: 806679 - protein, 9 aa, Homo Sapiens
CRDEPVVQG

SEQ ID NO: 806680 - protein, 9 aa, Homo Sapiens
KIILNDYEY

SEQ ID NO: 806681 - protein, 9 aa, Homo Sapiens
IFINNEWQT

SEQ ID NO: 806682 - protein, 9 aa, Homo Sapiens
LWCRNEKKR

SEQ ID NO: 806683 - protein, 9 aa, Homo Sapiens
TDDRKCLED

SEQ ID NO: 806684 - protein, 9 aa, Homo Sapiens
VFGNSWQVS

SEQ ID NO: 806685 - protein, 9 aa, Homo Sapiens
VIFQKFECA

SEQ ID NO: 806686 - protein, 9 aa, Homo Sapiens
VLFQNVQGQ

SEQ ID NO: 806687 - protein, 9 aa, Homo Sapiens
EDRCFRVDL

SEQ ID NO: 806688 - protein, 9 aa, Homo Sapiens
SAFRMLSSL

SEQ ID NO: 806689 - protein, 9 aa, Homo Sapiens
KVLQNLYSF

SEQ ID NO: 806690 - protein, 9 aa, Homo Sapiens
IEIWKESTT

SEQ ID NO: 806691 - protein, 9 aa, Homo Sapiens
NLKIKFNTI

SEQ ID NO: 806692 - protein, 9 aa, Homo Sapiens
HNSWTQDGM

SEQ ID NO: 806693 - protein, 9 aa, Homo Sapiens
HMETKGAGV

SEQ ID NO: 806694 - protein, 9 aa, Homo Sapiens
LQQGAPGCT

SEQ ID NO: 806695 - protein, 9 aa, Homo Sapiens
PRISFNLFV

SEQ ID NO: 806696 - protein, 9 aa, Homo Sapiens
FALIVLLGT

SEQ ID NO: 806697 - protein, 9 aa, Homo Sapiens
IDKSRRDPS

SEQ ID NO: 806698 - protein, 9 aa, Homo Sapiens
PRMHEGNIS

SEQ ID NO: 806699 - protein, 9 aa, Homo Sapiens
SGNCPENCS

SEQ ID NO: 806700 - protein, 9 aa, Homo Sapiens
CYYYFICPL

SEQ ID NO: 806701 - protein, 9 aa, Homo Sapiens
EHSCSAESD

SEQ ID NO: 806702 - protein, 9 aa, Homo Sapiens
QRLEDLEQD

SEQ ID NO: 806703 - protein, 9 aa, Homo Sapiens
TSKIKRLYK

SEQ ID NO: 806704 - protein, 9 aa, Homo Sapiens
RKMKERWEN

SEQ ID NO: 806705 - protein, 9 aa, Homo Sapiens
IIVEKLEKS

SEQ ID NO: 806706 - protein, 9 aa, Homo Sapiens
VDEDADISD

SEQ ID NO: 806707 - protein, 9 aa, Homo Sapiens
NYLNSGQGP

SEQ ID NO: 806708 - protein, 9 aa, Homo Sapiens
APGRYFKHY

SEQ ID NO: 806709 - protein, 9 aa, Homo Sapiens
HSLSNVKLN

SEQ ID NO: 806710 - protein, 9 aa, Homo Sapiens
TIMTGGDVA

SEQ ID NO: 806711 - protein, 9 aa, Homo Sapiens
WNYCVRRRK

SEQ ID NO: 806712 - protein, 9 aa, Homo Sapiens
HKVQAAKEE

SEQ ID NO: 806713 - protein, 9 aa, Homo Sapiens
VYHAKPAIA

SEQ ID NO: 806714 - protein, 9 aa, Homo Sapiens
ETTKMNILK

SEQ ID NO: 806715 - protein, 9 aa, Homo Sapiens
LAIKAVLEV

SEQ ID NO: 806716 - protein, 9 aa, Homo Sapiens
MLNRKCKKE

SEQ ID NO: 806717 - protein, 9 aa, Homo Sapiens
RRSAHLIQH

SEQ ID NO: 806718 - protein, 9 aa, Homo Sapiens
IVGFDPRLQ

SEQ ID NO: 806719 - protein, 9 aa, Homo Sapiens
TGKKPYTCQ

SEQ ID NO: 806720 - protein, 9 aa, Homo Sapiens
DNLGNGTSL

SEQ ID NO: 806721 - protein, 9 aa, Homo Sapiens
LHERGLTLH

SEQ ID NO: 806722 - protein, 9 aa, Homo Sapiens
KKFPNHYSI

SEQ ID NO: 806723 - protein, 9 aa, Homo Sapiens
HGRRPPPAP

SEQ ID NO: 806724 - protein, 9 aa, Homo Sapiens
PPLPAAAHN

SEQ ID NO: 806725 - protein, 9 aa, Homo Sapiens
FIEKRQQGL

SEQ ID NO: 806726 - protein, 9 aa, Homo Sapiens
HFFRELAED

SEQ ID NO: 806727 - protein, 9 aa, Homo Sapiens
HDDHECCKR

SEQ ID NO: 806728 - protein, 9 aa, Homo Sapiens
RYVAVAIKT

SEQ ID NO: 806729 - protein, 9 aa, Homo Sapiens
KQLEDYLTN

SEQ ID NO: 806730 - protein, 9 aa, Homo Sapiens
IVRRGQSLY

SEQ ID NO: 806731 - protein, 9 aa, Homo Sapiens
LLELGNDQL

SEQ ID NO: 806732 - protein, 9 aa, Homo Sapiens
IKGHLCQLE

SEQ ID NO: 806733 - protein, 9 aa, Homo Sapiens
KPRETRVRA

SEQ ID NO: 806734 - protein, 9 aa, Homo Sapiens
FEDPDWRDF

SEQ ID NO: 806735 - protein, 9 aa, Homo Sapiens
TLSFHLNHA

SEQ ID NO: 806736 - protein, 9 aa, Homo Sapiens
INDHSPVFW

SEQ ID NO: 806737 - protein, 9 aa, Homo Sapiens
QLVPELCNH

SEQ ID NO: 806738 - protein, 9 aa, Homo Sapiens
SLADTLFWW

SEQ ID NO: 806739 - protein, 9 aa, Homo Sapiens
SSRQPSSAG

SEQ ID NO: 806740 - protein, 9 aa, Homo Sapiens
NRWWSQYTG

SEQ ID NO: 806741 - protein, 9 aa, Homo Sapiens
VAFVNMFTC

SEQ ID NO: 806742 - protein, 9 aa, Homo Sapiens
PGSPFNERN

SEQ ID NO: 806743 - protein, 9 aa, Homo Sapiens
DNDIIGDIY

SEQ ID NO: 806744 - protein, 9 aa, Homo Sapiens
NSEFIQALH

SEQ ID NO: 806745 - protein, 9 aa, Homo Sapiens
DEQVRRQRL

SEQ ID NO: 806746 - protein, 9 aa, Homo Sapiens
HHGLHTAGF

SEQ ID NO: 806747 - protein, 9 aa, Homo Sapiens
CFIAICTPL

SEQ ID NO: 806748 - protein, 9 aa, Homo Sapiens
HPSVPESPK

SEQ ID NO: 806749 - protein, 9 aa, Homo Sapiens
VHRKFRLME

SEQ ID NO: 806750 - protein, 9 aa, Homo Sapiens
RFRASEHLT

SEQ ID NO: 806751 - protein, 9 aa, Homo Sapiens
ATLPIFDKE

SEQ ID NO: 806752 - protein, 9 aa, Homo Sapiens
SSTSSGRSG

SEQ ID NO: 806753 - protein, 9 aa, Homo Sapiens
SLPKYQAGE

SEQ ID NO: 806754 - protein, 9 aa, Homo Sapiens
SEEDLQLLD

SEQ ID NO: 806755 - protein, 9 aa, Homo Sapiens
CLAQEAAQV

SEQ ID NO: 806756 - protein, 9 aa, Homo Sapiens
RVVKYFEHL

SEQ ID NO: 806757 - protein, 9 aa, Homo Sapiens
VLIFSQVTR

SEQ ID NO: 806758 - protein, 9 aa, Homo Sapiens
ASSFVAGAV

SEQ ID NO: 806759 - protein, 9 aa, Homo Sapiens
QYLHQFMLQ

SEQ ID NO: 806760 - protein, 9 aa, Homo Sapiens
HRVLFQNVQ

SEQ ID NO: 806761 - protein, 9 aa, Homo Sapiens
TLMTFFLAL

SEQ ID NO: 806762 - protein, 9 aa, Homo Sapiens
FEKINSEGT

SEQ ID NO: 806763 - protein, 9 aa, Homo Sapiens
NAIISNVEF

SEQ ID NO: 806764 - protein, 9 aa, Homo Sapiens
GNIQVEIPD

SEQ ID NO: 806765 - protein, 9 aa, Homo Sapiens
SVPQPGKQS

SEQ ID NO: 806766 - protein, 9 aa, Homo Sapiens
LANKDNGTG

SEQ ID NO: 806767 - protein, 9 aa, Homo Sapiens
VPYIFLFIG

SEQ ID NO: 806768 - protein, 9 aa, Homo Sapiens
AKILKGSGV

SEQ ID NO: 806769 - protein, 9 aa, Homo Sapiens
LICAYRVRI

SEQ ID NO: 806770 - protein, 9 aa, Homo Sapiens
ADTFKSGIV

SEQ ID NO: 806771 - protein, 9 aa, Homo Sapiens
MDMQPFKDR

SEQ ID NO: 806772 - protein, 9 aa, Homo Sapiens
ISYCLKCAE

SEQ ID NO: 806773 - protein, 9 aa, Homo Sapiens
LLDSKLSLD

SEQ ID NO: 806774 - protein, 9 aa, Homo Sapiens
NHSDPENMS

SEQ ID NO: 806775 - protein, 9 aa, Homo Sapiens
YMKTPPGIP

SEQ ID NO: 806776 - protein, 9 aa, Homo Sapiens
PIPDNAPET

SEQ ID NO: 806777 - protein, 9 aa, Homo Sapiens
CQDMRGYQR

SEQ ID NO: 806778 - protein, 9 aa, Homo Sapiens
GDTQLDVES

SEQ ID NO: 806779 - protein, 9 aa, Homo Sapiens
QAEYVIRHG

SEQ ID NO: 806780 - protein, 9 aa, Homo Sapiens
NDNRLKALQ

SEQ ID NO: 806781 - protein, 9 aa, Homo Sapiens
PNSAAWAVY

SEQ ID NO: 806782 - protein, 9 aa, Homo Sapiens
SPQSVGSTA

SEQ ID NO: 806783 - protein, 9 aa, Homo Sapiens
HGGYLVANY

SEQ ID NO: 806784 - protein, 9 aa, Homo Sapiens
ELRPKYNGL

SEQ ID NO: 806785 - protein, 9 aa, Homo Sapiens
FRRCQRRLI

SEQ ID NO: 806786 - protein, 9 aa, Homo Sapiens
TSMKYSCNP

SEQ ID NO: 806787 - protein, 9 aa, Homo Sapiens
EFYLLRLEN

SEQ ID NO: 806788 - protein, 9 aa, Homo Sapiens
NSLRRHTQK

SEQ ID NO: 806789 - protein, 9 aa, Homo Sapiens
LRICSLHSN

SEQ ID NO: 806790 - protein, 9 aa, Homo Sapiens
PKMCQWYQN

SEQ ID NO: 806791 - protein, 9 aa, Homo Sapiens
YRLRLQEDK

SEQ ID NO: 806792 - protein, 9 aa, Homo Sapiens
LLEEEAAFP

SEQ ID NO: 806793 - protein, 9 aa, Homo Sapiens
KGHEDYHMM

SEQ ID NO: 806794 - protein, 9 aa, Homo Sapiens
EQRMNIDRE

SEQ ID NO: 806795 - protein, 9 aa, Homo Sapiens
GGNPGYVTI

SEQ ID NO: 806796 - protein, 9 aa, Homo Sapiens
WKVNPAAAL

SEQ ID NO: 806797 - protein, 9 aa, Homo Sapiens
TIATRNTKK

SEQ ID NO: 806798 - protein, 9 aa, Homo Sapiens
LASVYSLFL

SEQ ID NO: 806799 - protein, 9 aa, Homo Sapiens
HLTKHKIIH

SEQ ID NO: 806800 - protein, 9 aa, Homo Sapiens
SERIKNFAE

SEQ ID NO: 806801 - protein, 9 aa, Homo Sapiens
LTPDYDVFQ

SEQ ID NO: 806802 - protein, 9 aa, Homo Sapiens
QSDLVRVDI

SEQ ID NO: 806803 - protein, 9 aa, Homo Sapiens
IDRDPDTIR

SEQ ID NO: 806804 - protein, 9 aa, Homo Sapiens
THPVVPALR

SEQ ID NO: 806805 - protein, 9 aa, Homo Sapiens
TVHPESGDL

SEQ ID NO: 806806 - protein, 9 aa, Homo Sapiens
VQQILLLRN

SEQ ID NO: 806807 - protein, 9 aa, Homo Sapiens
GTRLAAEGY

SEQ ID NO: 806808 - protein, 9 aa, Homo Sapiens
SGELRKDIS

SEQ ID NO: 806809 - protein, 9 aa, Homo Sapiens
KKRKMNLSE

SEQ ID NO: 806810 - protein, 9 aa, Homo Sapiens
LSIPVYIMK

SEQ ID NO: 806811 - protein, 9 aa, Homo Sapiens
MDFLTRQNK

SEQ ID NO: 806812 - protein, 9 aa, Homo Sapiens
SRGCVARAG

SEQ ID NO: 806813 - protein, 9 aa, Homo Sapiens
RSGYGPGDG

SEQ ID NO: 806814 - protein, 9 aa, Homo Sapiens
SDNNELWKK

SEQ ID NO: 806815 - protein, 9 aa, Homo Sapiens
TFRYSPNNY

SEQ ID NO: 806816 - protein, 9 aa, Homo Sapiens
NYLYHLLHI

SEQ ID NO: 806817 - protein, 9 aa, Homo Sapiens
YPHLAPPYA

SEQ ID NO: 806818 - protein, 9 aa, Homo Sapiens
FAFCCALGR

SEQ ID NO: 806819 - protein, 9 aa, Homo Sapiens
NNVSPKGMM

SEQ ID NO: 806820 - protein, 9 aa, Homo Sapiens
EGELMVEKH

SEQ ID NO: 806821 - protein, 9 aa, Homo Sapiens
MEGMHLSQE

SEQ ID NO: 806822 - protein, 9 aa, Homo Sapiens
RFFSEAFYD

SEQ ID NO: 806823 - protein, 9 aa, Homo Sapiens
HRLGIIYRY

SEQ ID NO: 806824 - protein, 9 aa, Homo Sapiens
STSDGDQSV

SEQ ID NO: 806825 - protein, 9 aa, Homo Sapiens
LSAWSSMDE

SEQ ID NO: 806826 - protein, 9 aa, Homo Sapiens
IFKCLSKDA

SEQ ID NO: 806827 - protein, 9 aa, Homo Sapiens
NLIRKISDS

SEQ ID NO: 806828 - protein, 9 aa, Homo Sapiens
PKQFLPTMS

SEQ ID NO: 806829 - protein, 9 aa, Homo Sapiens
RWPGAWALP

SEQ ID NO: 806830 - protein, 9 aa, Homo Sapiens
QTANKNNDA

SEQ ID NO: 806831 - protein, 9 aa, Homo Sapiens
FMFQFPLER

SEQ ID NO: 806832 - protein, 9 aa, Homo Sapiens
YSENCGPPP

SEQ ID NO: 806833 - protein, 9 aa, Homo Sapiens
EPMTDKMLV

SEQ ID NO: 806834 - protein, 9 aa, Homo Sapiens
GRAQYTFQN

SEQ ID NO: 806835 - protein, 9 aa, Homo Sapiens
YHNQVWGKV

SEQ ID NO: 806836 - protein, 9 aa, Homo Sapiens
WSNLTFSLF

SEQ ID NO: 806837 - protein, 9 aa, Homo Sapiens
SLGGRTVEV

SEQ ID NO: 806838 - protein, 9 aa, Homo Sapiens
RFLSGLLSL

SEQ ID NO: 806839 - protein, 9 aa, Homo Sapiens
CIARFRFRA

SEQ ID NO: 806840 - protein, 9 aa, Homo Sapiens
KTVPLVNSE

SEQ ID NO: 806841 - protein, 9 aa, Homo Sapiens
REEHTEFVL

SEQ ID NO: 806842 - protein, 9 aa, Homo Sapiens
MWQSAGISK

SEQ ID NO: 806843 - protein, 9 aa, Homo Sapiens
MPGGLDKTC

SEQ ID NO: 806844 - protein, 9 aa, Homo Sapiens
GIDSDNLKD

SEQ ID NO: 806845 - protein, 9 aa, Homo Sapiens
ILVFLSTGD

SEQ ID NO: 806846 - protein, 9 aa, Homo Sapiens
SLLHNLRTL

SEQ ID NO: 806847 - protein, 9 aa, Homo Sapiens
RMIKDNSSG

SEQ ID NO: 806848 - protein, 9 aa, Homo Sapiens
YRENVCVYG

SEQ ID NO: 806849 - protein, 9 aa, Homo Sapiens
VTMPGPSSE

SEQ ID NO: 806850 - protein, 9 aa, Homo Sapiens
HPVQFYSMT

SEQ ID NO: 806851 - protein, 9 aa, Homo Sapiens
VENFLEACI

SEQ ID NO: 806852 - protein, 9 aa, Homo Sapiens
RKYDLTRIK

SEQ ID NO: 806853 - protein, 9 aa, Homo Sapiens
ERRSLMPVS

SEQ ID NO: 806854 - protein, 9 aa, Homo Sapiens
RRITKNCAN

SEQ ID NO: 806855 - protein, 9 aa, Homo Sapiens
HKELKTDGS

SEQ ID NO: 806856 - protein, 9 aa, Homo Sapiens
VTKNALLRW

SEQ ID NO: 806857 - protein, 9 aa, Homo Sapiens
VQQIMEGMH

SEQ ID NO: 806858 - protein, 9 aa, Homo Sapiens
SGVGKLDLD

SEQ ID NO: 806859 - protein, 9 aa, Homo Sapiens
NGVDKLLLF

SEQ ID NO: 806860 - protein, 9 aa, Homo Sapiens
RYNKIGIKL

SEQ ID NO: 806861 - protein, 9 aa, Homo Sapiens
KQLAVGKHN

SEQ ID NO: 806862 - protein, 9 aa, Homo Sapiens
LKLLPESEE

SEQ ID NO: 806863 - protein, 9 aa, Homo Sapiens
RVATPDVVS

SEQ ID NO: 806864 - protein, 9 aa, Homo Sapiens
VYKVPGQDL

SEQ ID NO: 806865 - protein, 9 aa, Homo Sapiens
KLFPKGATW

SEQ ID NO: 806866 - protein, 9 aa, Homo Sapiens
QIDDAMCNF

SEQ ID NO: 806867 - protein, 9 aa, Homo Sapiens
YTCDKCGKG

SEQ ID NO: 806868 - protein, 9 aa, Homo Sapiens
LYREGVIRT

SEQ ID NO: 806869 - protein, 9 aa, Homo Sapiens
LSQVSQFVA

SEQ ID NO: 806870 - protein, 9 aa, Homo Sapiens
YSQPPGFSD

SEQ ID NO: 806871 - protein, 9 aa, Homo Sapiens
TQENLEKAF

SEQ ID NO: 806872 - protein, 9 aa, Homo Sapiens
CAFQGYSNN

SEQ ID NO: 806873 - protein, 9 aa, Homo Sapiens
DEEEGPFDH

SEQ ID NO: 806874 - protein, 9 aa, Homo Sapiens
LFSPVLISG

SEQ ID NO: 806875 - protein, 9 aa, Homo Sapiens
TSIDRLDDI

SEQ ID NO: 806876 - protein, 9 aa, Homo Sapiens
GLITLAFPS

SEQ ID NO: 806877 - protein, 9 aa, Homo Sapiens
HNQMLQYFI

SEQ ID NO: 806878 - protein, 9 aa, Homo Sapiens
ASFSVQQHK

SEQ ID NO: 806879 - protein, 9 aa, Homo Sapiens
KEDPVCTPE

SEQ ID NO: 806880 - protein, 9 aa, Homo Sapiens
TSDQSYGIF

SEQ ID NO: 806881 - protein, 9 aa, Homo Sapiens
KAPQCLQYY

SEQ ID NO: 806882 - protein, 9 aa, Homo Sapiens
FFRPHYMFL

SEQ ID NO: 806883 - protein, 9 aa, Homo Sapiens
NNQIRKIDQ

SEQ ID NO: 806884 - protein, 9 aa, Homo Sapiens
DDNFLTTLP

SEQ ID NO: 806885 - protein, 9 aa, Homo Sapiens
HVFDLFNTA

SEQ ID NO: 806886 - protein, 9 aa, Homo Sapiens
GGVIFQKFE

SEQ ID NO: 806887 - protein, 9 aa, Homo Sapiens
SEASGKTSV

SEQ ID NO: 806888 - protein, 9 aa, Homo Sapiens
IYNNVSEDL

SEQ ID NO: 806889 - protein, 9 aa, Homo Sapiens
RRKEQEHIH

SEQ ID NO: 806890 - protein, 9 aa, Homo Sapiens
MTKKRKHQH

SEQ ID NO: 806891 - protein, 9 aa, Homo Sapiens
PLHPDANPM

SEQ ID NO: 806892 - protein, 9 aa, Homo Sapiens
ALCLAYQTD

SEQ ID NO: 806893 - protein, 9 aa, Homo Sapiens
INRAQEHLN

SEQ ID NO: 806894 - protein, 9 aa, Homo Sapiens
SEKPINWQR

SEQ ID NO: 806895 - protein, 9 aa, Homo Sapiens
GGHLVTTLT

SEQ ID NO: 806896 - protein, 9 aa, Homo Sapiens
LADHLKVLI

SEQ ID NO: 806897 - protein, 9 aa, Homo Sapiens
WLFLIILSY

SEQ ID NO: 806898 - protein, 9 aa, Homo Sapiens
MIMKISNAQ

SEQ ID NO: 806899 - protein, 9 aa, Homo Sapiens
MRKVMQIQA

SEQ ID NO: 806900 - protein, 9 aa, Homo Sapiens
NVSSIQMIS

SEQ ID NO: 806901 - protein, 9 aa, Homo Sapiens
VLAVHYCHQ

SEQ ID NO: 806902 - protein, 9 aa, Homo Sapiens
QYDMLHETV

SEQ ID NO: 806903 - protein, 9 aa, Homo Sapiens
EEDISELKA

SEQ ID NO: 806904 - protein, 9 aa, Homo Sapiens
LNKQNVFNR

SEQ ID NO: 806905 - protein, 9 aa, Homo Sapiens
DDIKENPFF

SEQ ID NO: 806906 - protein, 9 aa, Homo Sapiens
GFENESKIL

SEQ ID NO: 806907 - protein, 9 aa, Homo Sapiens
SYLIVSILY

SEQ ID NO: 806908 - protein, 9 aa, Homo Sapiens
QIIPRDLAM

SEQ ID NO: 806909 - protein, 9 aa, Homo Sapiens
PKKNKLTFV

SEQ ID NO: 806910 - protein, 9 aa, Homo Sapiens
PYGRQTVPS

SEQ ID NO: 806911 - protein, 9 aa, Homo Sapiens
DLQKEVENH

SEQ ID NO: 806912 - protein, 9 aa, Homo Sapiens
IELYKNRGV

SEQ ID NO: 806913 - protein, 9 aa, Homo Sapiens
PHPPLSVVC

SEQ ID NO: 806914 - protein, 9 aa, Homo Sapiens
RLQEDRGVV

SEQ ID NO: 806915 - protein, 9 aa, Homo Sapiens
HQPYEAAHM

SEQ ID NO: 806916 - protein, 9 aa, Homo Sapiens
KHCCPIFSS

SEQ ID NO: 806917 - protein, 9 aa, Homo Sapiens
HLEDRTLTS

SEQ ID NO: 806918 - protein, 9 aa, Homo Sapiens
LTEKESKKR

SEQ ID NO: 806919 - protein, 9 aa, Homo Sapiens
AVHLLLPGE

SEQ ID NO: 806920 - protein, 9 aa, Homo Sapiens
GTGVHRLEH

SEQ ID NO: 806921 - protein, 9 aa, Homo Sapiens
GTPQRKLPQ

SEQ ID NO: 806922 - protein, 9 aa, Homo Sapiens
QGDLYSLLS

SEQ ID NO: 806923 - protein, 9 aa, Homo Sapiens
KVSFLLHNP

SEQ ID NO: 806924 - protein, 9 aa, Homo Sapiens
EYIKNVPIL

SEQ ID NO: 806925 - protein, 9 aa, Homo Sapiens
NTNSQGHKL

SEQ ID NO: 806926 - protein, 9 aa, Homo Sapiens
QRIQRQLAR

SEQ ID NO: 806927 - protein, 9 aa, Homo Sapiens
CLLKASEPG

SEQ ID NO: 806928 - protein, 9 aa, Homo Sapiens
VQENINMLS

SEQ ID NO: 806929 - protein, 9 aa, Homo Sapiens
GIQLAINQN

SEQ ID NO: 806930 - protein, 9 aa, Homo Sapiens
ITLDLIKSH

SEQ ID NO: 806931 - protein, 9 aa, Homo Sapiens
NYRASASRA

SEQ ID NO: 806932 - protein, 9 aa, Homo Sapiens
PGYKPMHDF

SEQ ID NO: 806933 - protein, 9 aa, Homo Sapiens
LEEGITHEQ

SEQ ID NO: 806934 - protein, 9 aa, Homo Sapiens
YLNLSQNQL

SEQ ID NO: 806935 - protein, 9 aa, Homo Sapiens
TIKQSSPPL

SEQ ID NO: 806936 - protein, 9 aa, Homo Sapiens
LGTPSKDTW

SEQ ID NO: 806937 - protein, 9 aa, Homo Sapiens
KCPPKFSNT

SEQ ID NO: 806938 - protein, 9 aa, Homo Sapiens
EWLPMASSM

SEQ ID NO: 806939 - protein, 9 aa, Homo Sapiens
LQTQQAQDQ

SEQ ID NO: 806940 - protein, 9 aa, Homo Sapiens
LHVSPEEPQ

SEQ ID NO: 806941 - protein, 9 aa, Homo Sapiens
PVRPVTFPS

SEQ ID NO: 806942 - protein, 9 aa, Homo Sapiens
KIVQCHEHI

SEQ ID NO: 806943 - protein, 9 aa, Homo Sapiens
MDNSQNAPL

SEQ ID NO: 806944 - protein, 9 aa, Homo Sapiens
AEIDLNDWW

SEQ ID NO: 806945 - protein, 9 aa, Homo Sapiens
LMQKKLADH

SEQ ID NO: 806946 - protein, 9 aa, Homo Sapiens
RHAHLHTPG

SEQ ID NO: 806947 - protein, 9 aa, Homo Sapiens
PHPRVPLKD

SEQ ID NO: 806948 - protein, 9 aa, Homo Sapiens
LTYGKLWTI

SEQ ID NO: 806949 - protein, 9 aa, Homo Sapiens
ARTGVCIRC

SEQ ID NO: 806950 - protein, 9 aa, Homo Sapiens
ALAYRNLIK

SEQ ID NO: 806951 - protein, 9 aa, Homo Sapiens
PQKNAVAHR

SEQ ID NO: 806952 - protein, 9 aa, Homo Sapiens
PSCRKSFHL

SEQ ID NO: 806953 - protein, 9 aa, Homo Sapiens
VEEYGLVDG

SEQ ID NO: 806954 - protein, 9 aa, Homo Sapiens
KQLTEDDLI

SEQ ID NO: 806955 - protein, 9 aa, Homo Sapiens
ESDIKDEDL

SEQ ID NO: 806956 - protein, 9 aa, Homo Sapiens
CPFNSENAK

SEQ ID NO: 806957 - protein, 9 aa, Homo Sapiens
GVALGQYAI

SEQ ID NO: 806958 - protein, 9 aa, Homo Sapiens
HLFYKFYPC

SEQ ID NO: 806959 - protein, 9 aa, Homo Sapiens
DDYYRRPLW

SEQ ID NO: 806960 - protein, 9 aa, Homo Sapiens
KTGQQTTTF

SEQ ID NO: 806961 - protein, 9 aa, Homo Sapiens
PQLKITAGL

SEQ ID NO: 806962 - protein, 9 aa, Homo Sapiens
DIKTGQQTT

SEQ ID NO: 806963 - protein, 9 aa, Homo Sapiens
MSALKRHNL

SEQ ID NO: 806964 - protein, 9 aa, Homo Sapiens
NTKDKHLSL

SEQ ID NO: 806965 - protein, 9 aa, Homo Sapiens
EQSLPHLIQ

SEQ ID NO: 806966 - protein, 9 aa, Homo Sapiens
PDAGSAVLI

SEQ ID NO: 806967 - protein, 9 aa, Homo Sapiens
TYKSKNFET

SEQ ID NO: 806968 - protein, 9 aa, Homo Sapiens
LGTFILKVL

SEQ ID NO: 806969 - protein, 9 aa, Homo Sapiens
RRTPLRAAA

SEQ ID NO: 806970 - protein, 9 aa, Homo Sapiens
IQSELFINT

SEQ ID NO: 806971 - protein, 9 aa, Homo Sapiens
IICGFLKGR

SEQ ID NO: 806972 - protein, 9 aa, Homo Sapiens
KYLAPGFVI

SEQ ID NO: 806973 - protein, 9 aa, Homo Sapiens
YIVNRGEHN

SEQ ID NO: 806974 - protein, 9 aa, Homo Sapiens
KFPNNNLKK

SEQ ID NO: 806975 - protein, 9 aa, Homo Sapiens
CDKLFRRLS

SEQ ID NO: 806976 - protein, 9 aa, Homo Sapiens
APDDIQDLM

SEQ ID NO: 806977 - protein, 9 aa, Homo Sapiens
AQEALVHYY

SEQ ID NO: 806978 - protein, 9 aa, Homo Sapiens
RAKLHEIEL

SEQ ID NO: 806979 - protein, 9 aa, Homo Sapiens
APLEPDYGT

SEQ ID NO: 806980 - protein, 9 aa, Homo Sapiens
DEEVFGDID

SEQ ID NO: 806981 - protein, 9 aa, Homo Sapiens
GLALLRALL

SEQ ID NO: 806982 - protein, 9 aa, Homo Sapiens
SSVDKTSFL

SEQ ID NO: 806983 - protein, 9 aa, Homo Sapiens
DVAEGTYKE

SEQ ID NO: 806984 - protein, 9 aa, Homo Sapiens
NMRVFSQRT

SEQ ID NO: 806985 - protein, 9 aa, Homo Sapiens
GLSLTESVR

SEQ ID NO: 806986 - protein, 9 aa, Homo Sapiens
ELLMGELLM

SEQ ID NO: 806987 - protein, 9 aa, Homo Sapiens
LLTLPFWVH

SEQ ID NO: 806988 - protein, 9 aa, Homo Sapiens
KSSLNNGVV

SEQ ID NO: 806989 - protein, 9 aa, Homo Sapiens
KKLCFDIEG

SEQ ID NO: 806990 - protein, 9 aa, Homo Sapiens
YFWQQVLAP

SEQ ID NO: 806991 - protein, 9 aa, Homo Sapiens
LSLPNPFRS

SEQ ID NO: 806992 - protein, 9 aa, Homo Sapiens
WYFPSTAEH

SEQ ID NO: 806993 - protein, 9 aa, Homo Sapiens
NHCSRLTLE

SEQ ID NO: 806994 - protein, 9 aa, Homo Sapiens
LGGESAGGG

SEQ ID NO: 806995 - protein, 9 aa, Homo Sapiens
KGVKKIKWI

SEQ ID NO: 806996 - protein, 9 aa, Homo Sapiens
ESGWIRYLP

SEQ ID NO: 806997 - protein, 9 aa, Homo Sapiens
VCRLCGNYN

SEQ ID NO: 806998 - protein, 9 aa, Homo Sapiens
KASALNTNI

SEQ ID NO: 806999 - protein, 9 aa, Homo Sapiens
EGERSARLT

SEQ ID NO: 807000 - protein, 9 aa, Homo Sapiens
SDSEERSLD

SEQ ID NO: 807001 - protein, 9 aa, Homo Sapiens
TGRDRRGRR

SEQ ID NO: 807002 - protein, 9 aa, Homo Sapiens
MWDLQFASS

SEQ ID NO: 807003 - protein, 9 aa, Homo Sapiens
NAFVKKSKQ

SEQ ID NO: 807004 - protein, 9 aa, Homo Sapiens
VILIFIMAG

SEQ ID NO: 807005 - protein, 9 aa, Homo Sapiens
AQVVMGNKL

SEQ ID NO: 807006 - protein, 9 aa, Homo Sapiens
SCRNYNKQS

SEQ ID NO: 807007 - protein, 9 aa, Homo Sapiens
ALGLMRGTI

SEQ ID NO: 807008 - protein, 9 aa, Homo Sapiens
EPLYELVTS

SEQ ID NO: 807009 - protein, 9 aa, Homo Sapiens
HLSRHQIIH

SEQ ID NO: 807010 - protein, 9 aa, Homo Sapiens
QDSVERHMG

SEQ ID NO: 807011 - protein, 9 aa, Homo Sapiens
FPLRKPQKA

SEQ ID NO: 807012 - protein, 9 aa, Homo Sapiens
LINFLSEKK

SEQ ID NO: 807013 - protein, 9 aa, Homo Sapiens
RRLIEEQLT

SEQ ID NO: 807014 - protein, 9 aa, Homo Sapiens
ITDKYRTYS

SEQ ID NO: 807015 - protein, 9 aa, Homo Sapiens
GIFFYYLGC

SEQ ID NO: 807016 - protein, 9 aa, Homo Sapiens
THRPHPKPE

SEQ ID NO: 807017 - protein, 9 aa, Homo Sapiens
DQGINGEGS

SEQ ID NO: 807018 - protein, 9 aa, Homo Sapiens
DEQYQSFKL

SEQ ID NO: 807019 - protein, 9 aa, Homo Sapiens
ISEDTRSRG

SEQ ID NO: 807020 - protein, 9 aa, Homo Sapiens
EDPAALTPP

SEQ ID NO: 807021 - protein, 9 aa, Homo Sapiens
FLTLFLTTL

SEQ ID NO: 807022 - protein, 9 aa, Homo Sapiens
LVLYFTVGT

SEQ ID NO: 807023 - protein, 9 aa, Homo Sapiens
LASENQHPG

SEQ ID NO: 807024 - protein, 9 aa, Homo Sapiens
ISGNCFIMI

SEQ ID NO: 807025 - protein, 9 aa, Homo Sapiens
RKYSHHDKH

SEQ ID NO: 807026 - protein, 9 aa, Homo Sapiens
YLHVLLDAI

SEQ ID NO: 807027 - protein, 9 aa, Homo Sapiens
IEFYLLRLE

SEQ ID NO: 807028 - protein, 9 aa, Homo Sapiens
YLSTLGSAN

SEQ ID NO: 807029 - protein, 9 aa, Homo Sapiens
HERLAKDSD

SEQ ID NO: 807030 - protein, 9 aa, Homo Sapiens
LMQRQGLTC

SEQ ID NO: 807031 - protein, 9 aa, Homo Sapiens
WLTQRYREY

SEQ ID NO: 807032 - protein, 9 aa, Homo Sapiens
LESSDDEKA

SEQ ID NO: 807033 - protein, 9 aa, Homo Sapiens
DESSYYRHN

SEQ ID NO: 807034 - protein, 9 aa, Homo Sapiens
LSAIQADLA

SEQ ID NO: 807035 - protein, 9 aa, Homo Sapiens
HLYDVNTSE

SEQ ID NO: 807036 - protein, 9 aa, Homo Sapiens
GGKQRATFK

SEQ ID NO: 807037 - protein, 9 aa, Homo Sapiens
GVLLQWRVT

SEQ ID NO: 807038 - protein, 9 aa, Homo Sapiens
DFLKVPQIH

SEQ ID NO: 807039 - protein, 9 aa, Homo Sapiens
NGSLSEEKA

SEQ ID NO: 807040 - protein, 9 aa, Homo Sapiens
HFNGNYIKT

SEQ ID NO: 807041 - protein, 9 aa, Homo Sapiens
VHHIIHVGD

SEQ ID NO: 807042 - protein, 9 aa, Homo Sapiens
NQVETPGCS

SEQ ID NO: 807043 - protein, 9 aa, Homo Sapiens
GGGGDSGGI

SEQ ID NO: 807044 - protein, 9 aa, Homo Sapiens
QGGYNQYSY

SEQ ID NO: 807045 - protein, 9 aa, Homo Sapiens
AEVPPDLAF

SEQ ID NO: 807046 - protein, 9 aa, Homo Sapiens
DKRGKGRTE

SEQ ID NO: 807047 - protein, 9 aa, Homo Sapiens
NPKSVILFG

SEQ ID NO: 807048 - protein, 9 aa, Homo Sapiens
LIYGLLILM

SEQ ID NO: 807049 - protein, 9 aa, Homo Sapiens
KSLQQKLES

SEQ ID NO: 807050 - protein, 9 aa, Homo Sapiens
RKNKRQYVT

SEQ ID NO: 807051 - protein, 9 aa, Homo Sapiens
RYTIKTDVF

SEQ ID NO: 807052 - protein, 9 aa, Homo Sapiens
GSCRDSRED

SEQ ID NO: 807053 - protein, 9 aa, Homo Sapiens
FTVGVDFAL

SEQ ID NO: 807054 - protein, 9 aa, Homo Sapiens
AVSTISSLF

SEQ ID NO: 807055 - protein, 9 aa, Homo Sapiens
PDNAPIGTL

SEQ ID NO: 807056 - protein, 9 aa, Homo Sapiens
LEEIQSARR

SEQ ID NO: 807057 - protein, 9 aa, Homo Sapiens
DNNIPGEYL

SEQ ID NO: 807058 - protein, 9 aa, Homo Sapiens
QQFRIGVAN

SEQ ID NO: 807059 - protein, 9 aa, Homo Sapiens
LARAPYRLE

SEQ ID NO: 807060 - protein, 9 aa, Homo Sapiens
CTDRNYTLV

SEQ ID NO: 807061 - protein, 9 aa, Homo Sapiens
RTFYLVADT

SEQ ID NO: 807062 - protein, 9 aa, Homo Sapiens
LSTFKSTRN

SEQ ID NO: 807063 - protein, 9 aa, Homo Sapiens
HSEKKARKA

SEQ ID NO: 807064 - protein, 9 aa, Homo Sapiens
PDLAIQLNQ

SEQ ID NO: 807065 - protein, 9 aa, Homo Sapiens
QKVNKRSLS

SEQ ID NO: 807066 - protein, 9 aa, Homo Sapiens
AAHMFFEGL

SEQ ID NO: 807067 - protein, 9 aa, Homo Sapiens
SCCPTGLTV

SEQ ID NO: 807068 - protein, 9 aa, Homo Sapiens
SSSNQSYRD

SEQ ID NO: 807069 - protein, 9 aa, Homo Sapiens
RITPDSYAL

SEQ ID NO: 807070 - protein, 9 aa, Homo Sapiens
AFFEQMLKI

SEQ ID NO: 807071 - protein, 9 aa, Homo Sapiens
PTQELAVQV

SEQ ID NO: 807072 - protein, 9 aa, Homo Sapiens
TVVSHHLAR

SEQ ID NO: 807073 - protein, 9 aa, Homo Sapiens
QQIQRAITG

SEQ ID NO: 807074 - protein, 9 aa, Homo Sapiens
VSPQSGVVS

SEQ ID NO: 807075 - protein, 9 aa, Homo Sapiens
HRQNSWTQK

SEQ ID NO: 807076 - protein, 9 aa, Homo Sapiens
CGKGFQHPS

SEQ ID NO: 807077 - protein, 9 aa, Homo Sapiens
PRYLRFTWS

SEQ ID NO: 807078 - protein, 9 aa, Homo Sapiens
LESQVCTPS

SEQ ID NO: 807079 - protein, 9 aa, Homo Sapiens
KKNGEDKLL

SEQ ID NO: 807080 - protein, 9 aa, Homo Sapiens
AWMVYFVSN

SEQ ID NO: 807081 - protein, 9 aa, Homo Sapiens
ATTPKRQTA

SEQ ID NO: 807082 - protein, 9 aa, Homo Sapiens
DVNKTVDTF

SEQ ID NO: 807083 - protein, 9 aa, Homo Sapiens
HILQAETTA

SEQ ID NO: 807084 - protein, 9 aa, Homo Sapiens
VPVFIHFQR

SEQ ID NO: 807085 - protein, 9 aa, Homo Sapiens
ELSKWSFES

SEQ ID NO: 807086 - protein, 9 aa, Homo Sapiens
LVKTFIDKN

SEQ ID NO: 807087 - protein, 9 aa, Homo Sapiens
SFSHLSYLK

SEQ ID NO: 807088 - protein, 9 aa, Homo Sapiens
DSIGTHLSQ

SEQ ID NO: 807089 - protein, 9 aa, Homo Sapiens
VQNILHEVI

SEQ ID NO: 807090 - protein, 9 aa, Homo Sapiens
QEMVQHYME

SEQ ID NO: 807091 - protein, 9 aa, Homo Sapiens
TQIKNTNRK

SEQ ID NO: 807092 - protein, 9 aa, Homo Sapiens
MTAVVTNHW

SEQ ID NO: 807093 - protein, 9 aa, Homo Sapiens
LARRIALAS

SEQ ID NO: 807094 - protein, 9 aa, Homo Sapiens
TMVTTVGGL

SEQ ID NO: 807095 - protein, 9 aa, Homo Sapiens
KKCKNSSTN

SEQ ID NO: 807096 - protein, 9 aa, Homo Sapiens
LQRDMQPLS

SEQ ID NO: 807097 - protein, 9 aa, Homo Sapiens
LDGISVNKA

SEQ ID NO: 807098 - protein, 9 aa, Homo Sapiens
GAINHISIR

SEQ ID NO: 807099 - protein, 9 aa, Homo Sapiens
DEKIIYPEF

SEQ ID NO: 807100 - protein, 9 aa, Homo Sapiens
HLHFSAFRM

SEQ ID NO: 807101 - protein, 9 aa, Homo Sapiens
EQHPRLIQQ

SEQ ID NO: 807102 - protein, 9 aa, Homo Sapiens
PLEDDIIVK

SEQ ID NO: 807103 - protein, 9 aa, Homo Sapiens
KPETTLSPE

SEQ ID NO: 807104 - protein, 9 aa, Homo Sapiens
LWKEFCSYL

SEQ ID NO: 807105 - protein, 9 aa, Homo Sapiens
ALPCFPETT

SEQ ID NO: 807106 - protein, 9 aa, Homo Sapiens
ACSPFVLIM

SEQ ID NO: 807107 - protein, 9 aa, Homo Sapiens
ALEDSGLST

SEQ ID NO: 807108 - protein, 9 aa, Homo Sapiens
YNKQSSEQN

SEQ ID NO: 807109 - protein, 9 aa, Homo Sapiens
LYGSILQEH

SEQ ID NO: 807110 - protein, 9 aa, Homo Sapiens
NDYLWHRSD

SEQ ID NO: 807111 - protein, 9 aa, Homo Sapiens
VVTVWDSNA

SEQ ID NO: 807112 - protein, 9 aa, Homo Sapiens
GLSNASSQR

SEQ ID NO: 807113 - protein, 9 aa, Homo Sapiens
VDFLSVKKI

SEQ ID NO: 807114 - protein, 9 aa, Homo Sapiens
SLKQIHLKK

SEQ ID NO: 807115 - protein, 9 aa, Homo Sapiens
GEYQELLDI

SEQ ID NO: 807116 - protein, 9 aa, Homo Sapiens
INVRVLKIH

SEQ ID NO: 807117 - protein, 9 aa, Homo Sapiens
DAHANGRAQ

SEQ ID NO: 807118 - protein, 9 aa, Homo Sapiens
RARITIICL

SEQ ID NO: 807119 - protein, 9 aa, Homo Sapiens
SDSIECSTF

SEQ ID NO: 807120 - protein, 9 aa, Homo Sapiens
QMRLGGSEG

SEQ ID NO: 807121 - protein, 9 aa, Homo Sapiens
LLDGVRGVL

SEQ ID NO: 807122 - protein, 9 aa, Homo Sapiens
IFPSIYINN

SEQ ID NO: 807123 - protein, 9 aa, Homo Sapiens
VDESGKGVD

SEQ ID NO: 807124 - protein, 9 aa, Homo Sapiens
TKEINQGIQ

SEQ ID NO: 807125 - protein, 9 aa, Homo Sapiens
LYSSMSRAL

SEQ ID NO: 807126 - protein, 9 aa, Homo Sapiens
DTLVCCRDE

SEQ ID NO: 807127 - protein, 9 aa, Homo Sapiens
INEFDPEED

SEQ ID NO: 807128 - protein, 9 aa, Homo Sapiens
KDNRWVPVT

SEQ ID NO: 807129 - protein, 9 aa, Homo Sapiens
ALRESFQIL

SEQ ID NO: 807130 - protein, 9 aa, Homo Sapiens
ELMMKTTEH

SEQ ID NO: 807131 - protein, 9 aa, Homo Sapiens
AQIKEKLEC

SEQ ID NO: 807132 - protein, 9 aa, Homo Sapiens
FQQNKDHSV

SEQ ID NO: 807133 - protein, 9 aa, Homo Sapiens
QREGMRQYG

SEQ ID NO: 807134 - protein, 9 aa, Homo Sapiens
NMSSMNERT

SEQ ID NO: 807135 - protein, 9 aa, Homo Sapiens
NLCARRITR

SEQ ID NO: 807136 - protein, 9 aa, Homo Sapiens
DEDTTSFDS

SEQ ID NO: 807137 - protein, 9 aa, Homo Sapiens
VHAVWDSEL

SEQ ID NO: 807138 - protein, 9 aa, Homo Sapiens
EEQKAKDLP

SEQ ID NO: 807139 - protein, 9 aa, Homo Sapiens
NNTGSGLLG

SEQ ID NO: 807140 - protein, 9 aa, Homo Sapiens
RELAEDKRE

SEQ ID NO: 807141 - protein, 9 aa, Homo Sapiens
MLDLLLLGL

SEQ ID NO: 807142 - protein, 9 aa, Homo Sapiens
KSLKYCNVD

SEQ ID NO: 807143 - protein, 9 aa, Homo Sapiens
LDLFPGVKL

SEQ ID NO: 807144 - protein, 9 aa, Homo Sapiens
MSLPKPMEP

SEQ ID NO: 807145 - protein, 9 aa, Homo Sapiens
LAVLLVVAI

SEQ ID NO: 807146 - protein, 9 aa, Homo Sapiens
DFFPRPSRS

SEQ ID NO: 807147 - protein, 9 aa, Homo Sapiens
CSRLTLEQL

SEQ ID NO: 807148 - protein, 9 aa, Homo Sapiens
FQDQVCRLC

SEQ ID NO: 807149 - protein, 9 aa, Homo Sapiens
LNLYMRLED

SEQ ID NO: 807150 - protein, 9 aa, Homo Sapiens
KIIHSGQKP

SEQ ID NO: 807151 - protein, 9 aa, Homo Sapiens
KTAAKLRKC

SEQ ID NO: 807152 - protein, 9 aa, Homo Sapiens
NNSKNYYLK

SEQ ID NO: 807153 - protein, 9 aa, Homo Sapiens
AADLVEAIY

SEQ ID NO: 807154 - protein, 9 aa, Homo Sapiens
ILFMKESST

SEQ ID NO: 807155 - protein, 9 aa, Homo Sapiens
PVVPAMAAQ

SEQ ID NO: 807156 - protein, 9 aa, Homo Sapiens
MAPVANIFH

SEQ ID NO: 807157 - protein, 9 aa, Homo Sapiens
RDPDTIRRQ

SEQ ID NO: 807158 - protein, 9 aa, Homo Sapiens
EKERLANTE

SEQ ID NO: 807159 - protein, 9 aa, Homo Sapiens
SCVCCGSCR

SEQ ID NO: 807160 - protein, 9 aa, Homo Sapiens
ISIFGSSLS

SEQ ID NO: 807161 - protein, 9 aa, Homo Sapiens
IIVGVELPV

SEQ ID NO: 807162 - protein, 9 aa, Homo Sapiens
WAGLGGRHV

SEQ ID NO: 807163 - protein, 9 aa, Homo Sapiens
PISIASALG

SEQ ID NO: 807164 - protein, 9 aa, Homo Sapiens
SAGEEQKID

SEQ ID NO: 807165 - protein, 9 aa, Homo Sapiens
FLFITPPII

SEQ ID NO: 807166 - protein, 9 aa, Homo Sapiens
VDIQPEEKH

SEQ ID NO: 807167 - protein, 9 aa, Homo Sapiens
RGEGKISKY

SEQ ID NO: 807168 - protein, 9 aa, Homo Sapiens
SEHNLADVV

SEQ ID NO: 807169 - protein, 9 aa, Homo Sapiens
ELVPLVCKS

SEQ ID NO: 807170 - protein, 9 aa, Homo Sapiens
SGGEGLWAW

SEQ ID NO: 807171 - protein, 9 aa, Homo Sapiens
LVSMYYIPA

SEQ ID NO: 807172 - protein, 9 aa, Homo Sapiens
GICAELTAI

SEQ ID NO: 807173 - protein, 9 aa, Homo Sapiens
EKDKWDKSA

SEQ ID NO: 807174 - protein, 9 aa, Homo Sapiens
YFEFVSALC

SEQ ID NO: 807175 - protein, 9 aa, Homo Sapiens
VPKEPISFS

SEQ ID NO: 807176 - protein, 9 aa, Homo Sapiens
ALWDIKTGQ

SEQ ID NO: 807177 - protein, 9 aa, Homo Sapiens
KNDTSDVLL

SEQ ID NO: 807178 - protein, 9 aa, Homo Sapiens
PESHQNGII

SEQ ID NO: 807179 - protein, 9 aa, Homo Sapiens
TIIFVITHH

SEQ ID NO: 807180 - protein, 9 aa, Homo Sapiens
YGTPDSIDI

SEQ ID NO: 807181 - protein, 9 aa, Homo Sapiens
VMMTKRTKG

SEQ ID NO: 807182 - protein, 9 aa, Homo Sapiens
DCFKHTNGG

SEQ ID NO: 807183 - protein, 9 aa, Homo Sapiens
EGFFDLLSQ

SEQ ID NO: 807184 - protein, 9 aa, Homo Sapiens
QAGEFLCLW

SEQ ID NO: 807185 - protein, 9 aa, Homo Sapiens
EGMDIEEVK

SEQ ID NO: 807186 - protein, 9 aa, Homo Sapiens
LSSYDVDAN

SEQ ID NO: 807187 - protein, 9 aa, Homo Sapiens
ITFIERENM

SEQ ID NO: 807188 - protein, 9 aa, Homo Sapiens
VDKLVELQE

SEQ ID NO: 807189 - protein, 9 aa, Homo Sapiens
GNQLLGTFG

SEQ ID NO: 807190 - protein, 9 aa, Homo Sapiens
ENTKEDKFW

SEQ ID NO: 807191 - protein, 9 aa, Homo Sapiens
DLDVSLQKV

SEQ ID NO: 807192 - protein, 9 aa, Homo Sapiens
QSNAFNGTT

SEQ ID NO: 807193 - protein, 9 aa, Homo Sapiens
YFVRSITPN

SEQ ID NO: 807194 - protein, 9 aa, Homo Sapiens
FLRLFAPAI

SEQ ID NO: 807195 - protein, 9 aa, Homo Sapiens
PTDGEGAGK

SEQ ID NO: 807196 - protein, 9 aa, Homo Sapiens
KKGKKIDLD

SEQ ID NO: 807197 - protein, 9 aa, Homo Sapiens
DLKEFSPDL

SEQ ID NO: 807198 - protein, 9 aa, Homo Sapiens
PSKINTLLR

SEQ ID NO: 807199 - protein, 9 aa, Homo Sapiens
ESHQDNEDR

SEQ ID NO: 807200 - protein, 9 aa, Homo Sapiens
KVVSLLLEN

SEQ ID NO: 807201 - protein, 9 aa, Homo Sapiens
IAYANDFAS

SEQ ID NO: 807202 - protein, 9 aa, Homo Sapiens
QSSLNSSLN

SEQ ID NO: 807203 - protein, 9 aa, Homo Sapiens
FKFLGSSDL

SEQ ID NO: 807204 - protein, 9 aa, Homo Sapiens
YTRMELFRN

SEQ ID NO: 807205 - protein, 9 aa, Homo Sapiens
PSAAYTTSI

SEQ ID NO: 807206 - protein, 9 aa, Homo Sapiens
HTYQEGKES

SEQ ID NO: 807207 - protein, 9 aa, Homo Sapiens
QNLQNKDKN

SEQ ID NO: 807208 - protein, 9 aa, Homo Sapiens
LRSEEYEQA

SEQ ID NO: 807209 - protein, 9 aa, Homo Sapiens
SQRMMYATL

SEQ ID NO: 807210 - protein, 9 aa, Homo Sapiens
LAEAELVGR

SEQ ID NO: 807211 - protein, 9 aa, Homo Sapiens
GSSSPGPLA

SEQ ID NO: 807212 - protein, 9 aa, Homo Sapiens
FVSLYQYFE

SEQ ID NO: 807213 - protein, 9 aa, Homo Sapiens
SKLIMHQRI

SEQ ID NO: 807214 - protein, 9 aa, Homo Sapiens
ASQNLEPKP

SEQ ID NO: 807215 - protein, 9 aa, Homo Sapiens
ERYYSDIGN

SEQ ID NO: 807216 - protein, 9 aa, Homo Sapiens
NPGLLQASV

SEQ ID NO: 807217 - protein, 9 aa, Homo Sapiens
NQVLGYKDP

SEQ ID NO: 807218 - protein, 9 aa, Homo Sapiens
LKQIHLKKK

SEQ ID NO: 807219 - protein, 9 aa, Homo Sapiens
AGVWVTTGI

SEQ ID NO: 807220 - protein, 9 aa, Homo Sapiens
HNMTLQWKS

SEQ ID NO: 807221 - protein, 9 aa, Homo Sapiens
CSYHKRKKA

SEQ ID NO: 807222 - protein, 9 aa, Homo Sapiens
PACQFEEGQ

SEQ ID NO: 807223 - protein, 9 aa, Homo Sapiens
SQTGRKQHM

SEQ ID NO: 807224 - protein, 9 aa, Homo Sapiens
QEGQDPFLY

SEQ ID NO: 807225 - protein, 9 aa, Homo Sapiens
NSVGSLPPS

SEQ ID NO: 807226 - protein, 9 aa, Homo Sapiens
NVYGFSALW

SEQ ID NO: 807227 - protein, 9 aa, Homo Sapiens
LWRCISEQH

SEQ ID NO: 807228 - protein, 9 aa, Homo Sapiens
APQTLPQSS

SEQ ID NO: 807229 - protein, 9 aa, Homo Sapiens
WLPMASSME

SEQ ID NO: 807230 - protein, 9 aa, Homo Sapiens
LYEIARRHT

SEQ ID NO: 807231 - protein, 9 aa, Homo Sapiens
KSGELLKPQ

SEQ ID NO: 807232 - protein, 9 aa, Homo Sapiens
TIRIRCSPQ

SEQ ID NO: 807233 - protein, 9 aa, Homo Sapiens
LKKTQVSTD

SEQ ID NO: 807234 - protein, 9 aa, Homo Sapiens
AEPDKMGGA

SEQ ID NO: 807235 - protein, 9 aa, Homo Sapiens
DVSMIKMAH

SEQ ID NO: 807236 - protein, 9 aa, Homo Sapiens
GIVKVVKPL

SEQ ID NO: 807237 - protein, 9 aa, Homo Sapiens
QFFSSPITE

SEQ ID NO: 807238 - protein, 9 aa, Homo Sapiens
NNSYVLSAG

SEQ ID NO: 807239 - protein, 9 aa, Homo Sapiens
AARVNKKTI

SEQ ID NO: 807240 - protein, 9 aa, Homo Sapiens
QLGQAVVIT

SEQ ID NO: 807241 - protein, 9 aa, Homo Sapiens
HEEERRRQN

SEQ ID NO: 807242 - protein, 9 aa, Homo Sapiens
SLEYLDNTV

SEQ ID NO: 807243 - protein, 9 aa, Homo Sapiens
LDSTMRILS

SEQ ID NO: 807244 - protein, 9 aa, Homo Sapiens
VLKMWQFMG

SEQ ID NO: 807245 - protein, 9 aa, Homo Sapiens
VWMDEFKYF

SEQ ID NO: 807246 - protein, 9 aa, Homo Sapiens
QDSKLQLPI

SEQ ID NO: 807247 - protein, 9 aa, Homo Sapiens
VSPGPDNKY

SEQ ID NO: 807248 - protein, 9 aa, Homo Sapiens
HFRQLLLHL

SEQ ID NO: 807249 - protein, 9 aa, Homo Sapiens
YDRVIFWGR

SEQ ID NO: 807250 - protein, 9 aa, Homo Sapiens
WRDQGKVTD

SEQ ID NO: 807251 - protein, 9 aa, Homo Sapiens
DPHLLVSES

SEQ ID NO: 807252 - protein, 9 aa, Homo Sapiens
AATVVVPCL

SEQ ID NO: 807253 - protein, 9 aa, Homo Sapiens
QVLRVVKYF

SEQ ID NO: 807254 - protein, 9 aa, Homo Sapiens
KNPAFNKDS

SEQ ID NO: 807255 - protein, 9 aa, Homo Sapiens
KTIEGMTVT

SEQ ID NO: 807256 - protein, 9 aa, Homo Sapiens
TIVNLKKTI

SEQ ID NO: 807257 - protein, 9 aa, Homo Sapiens
TGVTASPPT

SEQ ID NO: 807258 - protein, 9 aa, Homo Sapiens
DYPSRSPKT

SEQ ID NO: 807259 - protein, 9 aa, Homo Sapiens
DLVQAALIM

SEQ ID NO: 807260 - protein, 9 aa, Homo Sapiens
EPDRKKLGN

SEQ ID NO: 807261 - protein, 9 aa, Homo Sapiens
LFAPAILTP

SEQ ID NO: 807262 - protein, 9 aa, Homo Sapiens
NRDVSLGGC

SEQ ID NO: 807263 - protein, 9 aa, Homo Sapiens
RQLEFSETD

SEQ ID NO: 807264 - protein, 9 aa, Homo Sapiens
GNTYTTGSK

SEQ ID NO: 807265 - protein, 9 aa, Homo Sapiens
IQHQLFHTG

SEQ ID NO: 807266 - protein, 9 aa, Homo Sapiens
GTVEIKLES

SEQ ID NO: 807267 - protein, 9 aa, Homo Sapiens
INRQIVDHV

SEQ ID NO: 807268 - protein, 9 aa, Homo Sapiens
AVLIREEEC

SEQ ID NO: 807269 - protein, 9 aa, Homo Sapiens
ELVKATQIC

SEQ ID NO: 807270 - protein, 9 aa, Homo Sapiens
AGAAKHEIK

SEQ ID NO: 807271 - protein, 9 aa, Homo Sapiens
SCKAKQQLE

SEQ ID NO: 807272 - protein, 9 aa, Homo Sapiens
CVDFANVQE

SEQ ID NO: 807273 - protein, 9 aa, Homo Sapiens
LIHKVQAAK

SEQ ID NO: 807274 - protein, 9 aa, Homo Sapiens
AVAQASLQS

SEQ ID NO: 807275 - protein, 9 aa, Homo Sapiens
ITKEQLFFV

SEQ ID NO: 807276 - protein, 9 aa, Homo Sapiens
HKYVNVRVS

SEQ ID NO: 807277 - protein, 9 aa, Homo Sapiens
GKRVIMRVY

SEQ ID NO: 807278 - protein, 9 aa, Homo Sapiens
PSDSAITYH

SEQ ID NO: 807279 - protein, 9 aa, Homo Sapiens
YAYEEQKKK

SEQ ID NO: 807280 - protein, 9 aa, Homo Sapiens
KEQQLKEIT

SEQ ID NO: 807281 - protein, 9 aa, Homo Sapiens
VDGVKFMVE

SEQ ID NO: 807282 - protein, 9 aa, Homo Sapiens
FWMTQQEYQ

SEQ ID NO: 807283 - protein, 9 aa, Homo Sapiens
LQQAHQIIR

SEQ ID NO: 807284 - protein, 9 aa, Homo Sapiens
NFWMTQQEY

SEQ ID NO: 807285 - protein, 9 aa, Homo Sapiens
SRSLEPPEK

SEQ ID NO: 807286 - protein, 9 aa, Homo Sapiens
NLTVLNPMK

SEQ ID NO: 807287 - protein, 9 aa, Homo Sapiens
CHQPGTLGE

SEQ ID NO: 807288 - protein, 9 aa, Homo Sapiens
NAKDTTKNE

SEQ ID NO: 807289 - protein, 9 aa, Homo Sapiens
KLYPKRDIY

SEQ ID NO: 807290 - protein, 9 aa, Homo Sapiens
FAAHCGMIL

SEQ ID NO: 807291 - protein, 9 aa, Homo Sapiens
QPEVPIIYH

SEQ ID NO: 807292 - protein, 9 aa, Homo Sapiens
RKWVTTVGK

SEQ ID NO: 807293 - protein, 9 aa, Homo Sapiens
LEKFPLNTI

SEQ ID NO: 807294 - protein, 9 aa, Homo Sapiens
GREYFPKKL

SEQ ID NO: 807295 - protein, 9 aa, Homo Sapiens
LIIEQSRRK

SEQ ID NO: 807296 - protein, 9 aa, Homo Sapiens
LLETSAKSS

SEQ ID NO: 807297 - protein, 9 aa, Homo Sapiens
DSLLKSTNC

SEQ ID NO: 807298 - protein, 9 aa, Homo Sapiens
GEKLERYSS

SEQ ID NO: 807299 - protein, 9 aa, Homo Sapiens
QDHVKKDYL

SEQ ID NO: 807300 - protein, 9 aa, Homo Sapiens
YTEESYMKL

SEQ ID NO: 807301 - protein, 9 aa, Homo Sapiens
FPRHGHSGG

SEQ ID NO: 807302 - protein, 9 aa, Homo Sapiens
YSQISLADI

SEQ ID NO: 807303 - protein, 9 aa, Homo Sapiens
WSRSLNEHM

SEQ ID NO: 807304 - protein, 9 aa, Homo Sapiens
LKWISHDPH

SEQ ID NO: 807305 - protein, 9 aa, Homo Sapiens
CQPVCSCVH

SEQ ID NO: 807306 - protein, 9 aa, Homo Sapiens
YNPDSEQDK

SEQ ID NO: 807307 - protein, 9 aa, Homo Sapiens
GMEVSQTNL

SEQ ID NO: 807308 - protein, 9 aa, Homo Sapiens
PVNQPKEVW

SEQ ID NO: 807309 - protein, 9 aa, Homo Sapiens
VLAMMGALH

SEQ ID NO: 807310 - protein, 9 aa, Homo Sapiens
FLVPKVGFF

SEQ ID NO: 807311 - protein, 9 aa, Homo Sapiens
GNAGGSTEY

SEQ ID NO: 807312 - protein, 9 aa, Homo Sapiens
YLIVHKITH

SEQ ID NO: 807313 - protein, 9 aa, Homo Sapiens
CDVFCKHED

SEQ ID NO: 807314 - protein, 9 aa, Homo Sapiens
QEIYQASLL

SEQ ID NO: 807315 - protein, 9 aa, Homo Sapiens
PPGILKNAS

SEQ ID NO: 807316 - protein, 9 aa, Homo Sapiens
QKRSTTKLG

SEQ ID NO: 807317 - protein, 9 aa, Homo Sapiens
RRTLFKEYF

SEQ ID NO: 807318 - protein, 9 aa, Homo Sapiens
LCQAASDPM

SEQ ID NO: 807319 - protein, 9 aa, Homo Sapiens
EENRNNRTI

SEQ ID NO: 807320 - protein, 9 aa, Homo Sapiens
ILLALCTLV

SEQ ID NO: 807321 - protein, 9 aa, Homo Sapiens
YQIQEPNRE

SEQ ID NO: 807322 - protein, 9 aa, Homo Sapiens
CQAPVCGFP

SEQ ID NO: 807323 - protein, 9 aa, Homo Sapiens
PTYCRAPNC

SEQ ID NO: 807324 - protein, 9 aa, Homo Sapiens
EEEIQYIIL

SEQ ID NO: 807325 - protein, 9 aa, Homo Sapiens
PFVFESRKD

SEQ ID NO: 807326 - protein, 9 aa, Homo Sapiens
RNGEATGRD

SEQ ID NO: 807327 - protein, 9 aa, Homo Sapiens
NPSTLCSGS

SEQ ID NO: 807328 - protein, 9 aa, Homo Sapiens
VASMNSATP

SEQ ID NO: 807329 - protein, 9 aa, Homo Sapiens
FGPDCQPVC

SEQ ID NO: 807330 - protein, 9 aa, Homo Sapiens
EPHRNYVTH

SEQ ID NO: 807331 - protein, 9 aa, Homo Sapiens
QAGSNQSRV

SEQ ID NO: 807332 - protein, 9 aa, Homo Sapiens
ESDLPYNEM

SEQ ID NO: 807333 - protein, 9 aa, Homo Sapiens
VPPFYGEYD

SEQ ID NO: 807334 - protein, 9 aa, Homo Sapiens
AKYMFFLMY

SEQ ID NO: 807335 - protein, 9 aa, Homo Sapiens
IKYLDYEDA

SEQ ID NO: 807336 - protein, 9 aa, Homo Sapiens
TFISASKIE

SEQ ID NO: 807337 - protein, 9 aa, Homo Sapiens
ERNNITEYC

SEQ ID NO: 807338 - protein, 9 aa, Homo Sapiens
FHLYCRLKV

SEQ ID NO: 807339 - protein, 9 aa, Homo Sapiens
VIESGILLA

SEQ ID NO: 807340 - protein, 9 aa, Homo Sapiens
RNELEEMQQ

SEQ ID NO: 807341 - protein, 9 aa, Homo Sapiens
SKKIKHCKV

SEQ ID NO: 807342 - protein, 9 aa, Homo Sapiens
YWNERIAPK

SEQ ID NO: 807343 - protein, 9 aa, Homo Sapiens
LKDTPSLRR

SEQ ID NO: 807344 - protein, 9 aa, Homo Sapiens
YQKIAKEIT

SEQ ID NO: 807345 - protein, 9 aa, Homo Sapiens
NQIFSSQPH

SEQ ID NO: 807346 - protein, 9 aa, Homo Sapiens
VESEEHDQT

SEQ ID NO: 807347 - protein, 9 aa, Homo Sapiens
FHEASTAML

SEQ ID NO: 807348 - protein, 9 aa, Homo Sapiens
KLIKKKRNR

SEQ ID NO: 807349 - protein, 9 aa, Homo Sapiens
GPNKRGPKP

SEQ ID NO: 807350 - protein, 9 aa, Homo Sapiens
LLEGKNYLQ

SEQ ID NO: 807351 - protein, 9 aa, Homo Sapiens
QPQLPPQCL

SEQ ID NO: 807352 - protein, 9 aa, Homo Sapiens
LLHCLTTIW

SEQ ID NO: 807353 - protein, 9 aa, Homo Sapiens
GSNWEGIPG

SEQ ID NO: 807354 - protein, 9 aa, Homo Sapiens
VPQVRIPKA

SEQ ID NO: 807355 - protein, 9 aa, Homo Sapiens
QREYGNLEL

SEQ ID NO: 807356 - protein, 9 aa, Homo Sapiens
RKYEEAQKE

SEQ ID NO: 807357 - protein, 9 aa, Homo Sapiens
QRAEELSEA

SEQ ID NO: 807358 - protein, 9 aa, Homo Sapiens
VFDFFGDHQ

SEQ ID NO: 807359 - protein, 9 aa, Homo Sapiens
PPKYEFFWG

SEQ ID NO: 807360 - protein, 9 aa, Homo Sapiens
TPPPPYKQV

SEQ ID NO: 807361 - protein, 9 aa, Homo Sapiens
VLVVLHGIR

SEQ ID NO: 807362 - protein, 9 aa, Homo Sapiens
TFDVIKYDF

SEQ ID NO: 807363 - protein, 9 aa, Homo Sapiens
GQFFDLSIC

SEQ ID NO: 807364 - protein, 9 aa, Homo Sapiens
EFGRETNNL

SEQ ID NO: 807365 - protein, 9 aa, Homo Sapiens
TAPFSLHFL

SEQ ID NO: 807366 - protein, 9 aa, Homo Sapiens
KRHPGIQRT

SEQ ID NO: 807367 - protein, 9 aa, Homo Sapiens
CYPKVALRV

SEQ ID NO: 807368 - protein, 9 aa, Homo Sapiens
GEIKTTDFG

SEQ ID NO: 807369 - protein, 9 aa, Homo Sapiens
NNADRLFRS

SEQ ID NO: 807370 - protein, 9 aa, Homo Sapiens
ICVVLLIYA

SEQ ID NO: 807371 - protein, 9 aa, Homo Sapiens
HEIKAAKTL

SEQ ID NO: 807372 - protein, 9 aa, Homo Sapiens
PQQQQQIAP

SEQ ID NO: 807373 - protein, 9 aa, Homo Sapiens
PEVLSFSRY

SEQ ID NO: 807374 - protein, 9 aa, Homo Sapiens
ALCQNAREM

SEQ ID NO: 807375 - protein, 9 aa, Homo Sapiens
TVKQVYFHC

SEQ ID NO: 807376 - protein, 9 aa, Homo Sapiens
MDVPIYLSK

SEQ ID NO: 807377 - protein, 9 aa, Homo Sapiens
LVTDSDEDI

SEQ ID NO: 807378 - protein, 9 aa, Homo Sapiens
LFKVTPPPG

SEQ ID NO: 807379 - protein, 9 aa, Homo Sapiens
IEALKTTRI

SEQ ID NO: 807380 - protein, 9 aa, Homo Sapiens
EVGEELEMT

SEQ ID NO: 807381 - protein, 9 aa, Homo Sapiens
KDLKTELGN

SEQ ID NO: 807382 - protein, 9 aa, Homo Sapiens
KCKASYHLK

SEQ ID NO: 807383 - protein, 9 aa, Homo Sapiens
QLAVGKHNG

SEQ ID NO: 807384 - protein, 9 aa, Homo Sapiens
IILKYAPFY

SEQ ID NO: 807385 - protein, 9 aa, Homo Sapiens
EKIKTKRNT

SEQ ID NO: 807386 - protein, 9 aa, Homo Sapiens
ALTSAGEEQ

SEQ ID NO: 807387 - protein, 9 aa, Homo Sapiens
TACDEAIAE

SEQ ID NO: 807388 - protein, 9 aa, Homo Sapiens
WQIILEQAF

SEQ ID NO: 807389 - protein, 9 aa, Homo Sapiens
PFWLEDPAN

SEQ ID NO: 807390 - protein, 9 aa, Homo Sapiens
FAHVKGIKK

SEQ ID NO: 807391 - protein, 9 aa, Homo Sapiens
GFGHKYSSG

SEQ ID NO: 807392 - protein, 9 aa, Homo Sapiens
FPVRDQVLQ

SEQ ID NO: 807393 - protein, 9 aa, Homo Sapiens
VPGSTRKSQ

SEQ ID NO: 807394 - protein, 9 aa, Homo Sapiens
KEMFAQGHP

SEQ ID NO: 807395 - protein, 9 aa, Homo Sapiens
QKLYPKRDI

SEQ ID NO: 807396 - protein, 9 aa, Homo Sapiens
DCGEAFRTK

SEQ ID NO: 807397 - protein, 9 aa, Homo Sapiens
SALMGHQRV

SEQ ID NO: 807398 - protein, 9 aa, Homo Sapiens
FLQREGMRQ

SEQ ID NO: 807399 - protein, 9 aa, Homo Sapiens
RIDTKENNG

SEQ ID NO: 807400 - protein, 9 aa, Homo Sapiens
ADVGIYANI

SEQ ID NO: 807401 - protein, 9 aa, Homo Sapiens
EPPSRSCGL

SEQ ID NO: 807402 - protein, 9 aa, Homo Sapiens
DSTRTISAG

SEQ ID NO: 807403 - protein, 9 aa, Homo Sapiens
SDDIKENPF

SEQ ID NO: 807404 - protein, 9 aa, Homo Sapiens
ILALMFLHD

SEQ ID NO: 807405 - protein, 9 aa, Homo Sapiens
GSEKETMPF

SEQ ID NO: 807406 - protein, 9 aa, Homo Sapiens
QERDLIKGV

SEQ ID NO: 807407 - protein, 9 aa, Homo Sapiens
PPLSYGSRF

SEQ ID NO: 807408 - protein, 9 aa, Homo Sapiens
WPPQIQGII

SEQ ID NO: 807409 - protein, 9 aa, Homo Sapiens
KIFQGEDEI

SEQ ID NO: 807410 - protein, 9 aa, Homo Sapiens
LCAKVFGSD

SEQ ID NO: 807411 - protein, 9 aa, Homo Sapiens
SPPCPYEMC

SEQ ID NO: 807412 - protein, 9 aa, Homo Sapiens
ISMKVAYSI

SEQ ID NO: 807413 - protein, 9 aa, Homo Sapiens
MLESCELRE

SEQ ID NO: 807414 - protein, 9 aa, Homo Sapiens
PPASLHYRF

SEQ ID NO: 807415 - protein, 9 aa, Homo Sapiens
STSNLAAHI

SEQ ID NO: 807416 - protein, 9 aa, Homo Sapiens
WLSTFCGRP

SEQ ID NO: 807417 - protein, 9 aa, Homo Sapiens
NPDCVIYSS

SEQ ID NO: 807418 - protein, 9 aa, Homo Sapiens
HQIDLIKVD

SEQ ID NO: 807419 - protein, 9 aa, Homo Sapiens
NQRARWCSS

SEQ ID NO: 807420 - protein, 9 aa, Homo Sapiens
AVLEGDILD

SEQ ID NO: 807421 - protein, 9 aa, Homo Sapiens
NVIGGLKLN

SEQ ID NO: 807422 - protein, 9 aa, Homo Sapiens
KYHLKQIKE

SEQ ID NO: 807423 - protein, 9 aa, Homo Sapiens
LRMVGDSRA

SEQ ID NO: 807424 - protein, 9 aa, Homo Sapiens
LPPSIISLE

SEQ ID NO: 807425 - protein, 9 aa, Homo Sapiens
EPNAVDPVL

SEQ ID NO: 807426 - protein, 9 aa, Homo Sapiens
EQSFSQSST

SEQ ID NO: 807427 - protein, 9 aa, Homo Sapiens
TAQKNNKKR

SEQ ID NO: 807428 - protein, 9 aa, Homo Sapiens
TLLQEDYGL

SEQ ID NO: 807429 - protein, 9 aa, Homo Sapiens
CDWTMISRP

SEQ ID NO: 807430 - protein, 9 aa, Homo Sapiens
NMVNPRALD

SEQ ID NO: 807431 - protein, 9 aa, Homo Sapiens
FDMIKDQCL

SEQ ID NO: 807432 - protein, 9 aa, Homo Sapiens
KTCHARDKD

SEQ ID NO: 807433 - protein, 9 aa, Homo Sapiens
EIRWGHRFN

SEQ ID NO: 807434 - protein, 9 aa, Homo Sapiens
MNRGITDGG

SEQ ID NO: 807435 - protein, 9 aa, Homo Sapiens
FIIQAKLDQ

SEQ ID NO: 807436 - protein, 9 aa, Homo Sapiens
YLTYLYTGL

SEQ ID NO: 807437 - protein, 9 aa, Homo Sapiens
DIQLPYKLA

SEQ ID NO: 807438 - protein, 9 aa, Homo Sapiens
LNILQPGHS

SEQ ID NO: 807439 - protein, 9 aa, Homo Sapiens
CYNIYSKTW

SEQ ID NO: 807440 - protein, 9 aa, Homo Sapiens
ENIIWGMSH

SEQ ID NO: 807441 - protein, 9 aa, Homo Sapiens
EVTFPAPFY

SEQ ID NO: 807442 - protein, 9 aa, Homo Sapiens
TRCCKLCKY

SEQ ID NO: 807443 - protein, 9 aa, Homo Sapiens
ELAREYYII

SEQ ID NO: 807444 - protein, 9 aa, Homo Sapiens
PSGVGKRCD

SEQ ID NO: 807445 - protein, 9 aa, Homo Sapiens
VDSEIERMG

SEQ ID NO: 807446 - protein, 9 aa, Homo Sapiens
FGEDDDDVE

SEQ ID NO: 807447 - protein, 9 aa, Homo Sapiens
QGEFKELVQ

SEQ ID NO: 807448 - protein, 9 aa, Homo Sapiens
ILTIFRMKS

SEQ ID NO: 807449 - protein, 9 aa, Homo Sapiens
NGVARTSAT

SEQ ID NO: 807450 - protein, 9 aa, Homo Sapiens
LSKPLMTPT

SEQ ID NO: 807451 - protein, 9 aa, Homo Sapiens
APKTVDTIK

SEQ ID NO: 807452 - protein, 9 aa, Homo Sapiens
IEDNFPLGT

SEQ ID NO: 807453 - protein, 9 aa, Homo Sapiens
SPKCKLQVI

SEQ ID NO: 807454 - protein, 9 aa, Homo Sapiens
GSVSTTDRD

SEQ ID NO: 807455 - protein, 9 aa, Homo Sapiens
LMFYVVHQA

SEQ ID NO: 807456 - protein, 9 aa, Homo Sapiens
PKKRVETLM

SEQ ID NO: 807457 - protein, 9 aa, Homo Sapiens
ENICLDLQS

SEQ ID NO: 807458 - protein, 9 aa, Homo Sapiens
DQAVMPCWV

SEQ ID NO: 807459 - protein, 9 aa, Homo Sapiens
REVCRAVLN

SEQ ID NO: 807460 - protein, 9 aa, Homo Sapiens
KLNDGSPIT

SEQ ID NO: 807461 - protein, 9 aa, Homo Sapiens
HFDYIGHSH

SEQ ID NO: 807462 - protein, 9 aa, Homo Sapiens
QRRARMHER

SEQ ID NO: 807463 - protein, 9 aa, Homo Sapiens
HVKGIKKEV

SEQ ID NO: 807464 - protein, 9 aa, Homo Sapiens
TFDAMNNST

SEQ ID NO: 807465 - protein, 9 aa, Homo Sapiens
LGQEPVLAA

SEQ ID NO: 807466 - protein, 9 aa, Homo Sapiens
KSPTLITVY

SEQ ID NO: 807467 - protein, 9 aa, Homo Sapiens
DFNYLKLLG

SEQ ID NO: 807468 - protein, 9 aa, Homo Sapiens
KANVEYIKM

SEQ ID NO: 807469 - protein, 9 aa, Homo Sapiens
NTLNPVSGQ

SEQ ID NO: 807470 - protein, 9 aa, Homo Sapiens
AVLAMSRRS

SEQ ID NO: 807471 - protein, 9 aa, Homo Sapiens
EHSEDMDTH

SEQ ID NO: 807472 - protein, 9 aa, Homo Sapiens
ACRDVEQGE

SEQ ID NO: 807473 - protein, 9 aa, Homo Sapiens
YIKSQTGEI

SEQ ID NO: 807474 - protein, 9 aa, Homo Sapiens
IKEKLECYP

SEQ ID NO: 807475 - protein, 9 aa, Homo Sapiens
NENVVPNNR

SEQ ID NO: 807476 - protein, 9 aa, Homo Sapiens
SFQVIESGI

SEQ ID NO: 807477 - protein, 9 aa, Homo Sapiens
QGAKPSLLP

SEQ ID NO: 807478 - protein, 9 aa, Homo Sapiens
KGHFIYNNV

SEQ ID NO: 807479 - protein, 9 aa, Homo Sapiens
PHKFLQVYD

SEQ ID NO: 807480 - protein, 9 aa, Homo Sapiens
PPPPPSSLS

SEQ ID NO: 807481 - protein, 9 aa, Homo Sapiens
QIVDHVDWM

SEQ ID NO: 807482 - protein, 9 aa, Homo Sapiens
KSLDSPRED

SEQ ID NO: 807483 - protein, 9 aa, Homo Sapiens
VQYLKKQPL

SEQ ID NO: 807484 - protein, 9 aa, Homo Sapiens
EDPQGNIGS

SEQ ID NO: 807485 - protein, 9 aa, Homo Sapiens
QGKIVLTAT

SEQ ID NO: 807486 - protein, 9 aa, Homo Sapiens
FTTGNSRSS

SEQ ID NO: 807487 - protein, 9 aa, Homo Sapiens
TLIFSYNRL

SEQ ID NO: 807488 - protein, 9 aa, Homo Sapiens
QFQKEDAAF

SEQ ID NO: 807489 - protein, 9 aa, Homo Sapiens
GKKGDKKKV

SEQ ID NO: 807490 - protein, 9 aa, Homo Sapiens
PDLKVKLHM

SEQ ID NO: 807491 - protein, 9 aa, Homo Sapiens
VVMEYLGRP

SEQ ID NO: 807492 - protein, 9 aa, Homo Sapiens
ELQVYISPN

SEQ ID NO: 807493 - protein, 9 aa, Homo Sapiens
LKIKCSLFE

SEQ ID NO: 807494 - protein, 9 aa, Homo Sapiens
QQLNDLDKS

SEQ ID NO: 807495 - protein, 9 aa, Homo Sapiens
AIQLNQGKF

SEQ ID NO: 807496 - protein, 9 aa, Homo Sapiens
TQVSTDQAA

SEQ ID NO: 807497 - protein, 9 aa, Homo Sapiens
KNILKELTS

SEQ ID NO: 807498 - protein, 9 aa, Homo Sapiens
QSFECSRKK

SEQ ID NO: 807499 - protein, 9 aa, Homo Sapiens
NQLDECRLY

SEQ ID NO: 807500 - protein, 9 aa, Homo Sapiens
ALAFLAYIV

SEQ ID NO: 807501 - protein, 9 aa, Homo Sapiens
IGEGRFCRM

SEQ ID NO: 807502 - protein, 9 aa, Homo Sapiens
GIDLNQTKL

SEQ ID NO: 807503 - protein, 9 aa, Homo Sapiens
KVGTYNNFF

SEQ ID NO: 807504 - protein, 9 aa, Homo Sapiens
RIDLDTFIC

SEQ ID NO: 807505 - protein, 9 aa, Homo Sapiens
NSLYLATFD

SEQ ID NO: 807506 - protein, 9 aa, Homo Sapiens
FSKHYKFTV

SEQ ID NO: 807507 - protein, 9 aa, Homo Sapiens
MPVRPKPSF

SEQ ID NO: 807508 - protein, 9 aa, Homo Sapiens
SELITHQII

SEQ ID NO: 807509 - protein, 9 aa, Homo Sapiens
QVALFIFFL

SEQ ID NO: 807510 - protein, 9 aa, Homo Sapiens
LKYCNVDSV

SEQ ID NO: 807511 - protein, 9 aa, Homo Sapiens
HLPSSSEDS

SEQ ID NO: 807512 - protein, 9 aa, Homo Sapiens
NSLIHNNYK

SEQ ID NO: 807513 - protein, 9 aa, Homo Sapiens
DGLDSEHVY

SEQ ID NO: 807514 - protein, 9 aa, Homo Sapiens
LGKSNIQFS

SEQ ID NO: 807515 - protein, 9 aa, Homo Sapiens
LDMEGSVPA

SEQ ID NO: 807516 - protein, 9 aa, Homo Sapiens
CVHQALKDF

SEQ ID NO: 807517 - protein, 9 aa, Homo Sapiens
TVEVKVQGQ

SEQ ID NO: 807518 - protein, 9 aa, Homo Sapiens
LICLSIWGL

SEQ ID NO: 807519 - protein, 9 aa, Homo Sapiens
NIMSYKRRI

SEQ ID NO: 807520 - protein, 9 aa, Homo Sapiens
LRMFPEGKS

SEQ ID NO: 807521 - protein, 9 aa, Homo Sapiens
VIGKYLAPG

SEQ ID NO: 807522 - protein, 9 aa, Homo Sapiens
VLRSKGEGD

SEQ ID NO: 807523 - protein, 9 aa, Homo Sapiens
SRGVLLGRF

SEQ ID NO: 807524 - protein, 9 aa, Homo Sapiens
ILIILRLPF

SEQ ID NO: 807525 - protein, 9 aa, Homo Sapiens
LATSNAEHL

SEQ ID NO: 807526 - protein, 9 aa, Homo Sapiens
LEDRTLTSF

SEQ ID NO: 807527 - protein, 9 aa, Homo Sapiens
CGEIKTTDF

SEQ ID NO: 807528 - protein, 9 aa, Homo Sapiens
YRLESQEEE

SEQ ID NO: 807529 - protein, 9 aa, Homo Sapiens
LFSGIFPGL

SEQ ID NO: 807530 - protein, 9 aa, Homo Sapiens
FLSASAVPC

SEQ ID NO: 807531 - protein, 9 aa, Homo Sapiens
KIKCSLFEY

SEQ ID NO: 807532 - protein, 9 aa, Homo Sapiens
IISGNFFLL

SEQ ID NO: 807533 - protein, 9 aa, Homo Sapiens
DLRAYCESE

SEQ ID NO: 807534 - protein, 9 aa, Homo Sapiens
TYLGNKAIL

SEQ ID NO: 807535 - protein, 9 aa, Homo Sapiens
SNRDELQRR

SEQ ID NO: 807536 - protein, 9 aa, Homo Sapiens
QSGMYVIYS

SEQ ID NO: 807537 - protein, 9 aa, Homo Sapiens
KGFIKGQKL

SEQ ID NO: 807538 - protein, 9 aa, Homo Sapiens
QLITVDDKL

SEQ ID NO: 807539 - protein, 9 aa, Homo Sapiens
RPKRNVIQK

SEQ ID NO: 807540 - protein, 9 aa, Homo Sapiens
QGYSFFHDA

SEQ ID NO: 807541 - protein, 9 aa, Homo Sapiens
KKVGTYNNF

SEQ ID NO: 807542 - protein, 9 aa, Homo Sapiens
EEIGKIFGP

SEQ ID NO: 807543 - protein, 9 aa, Homo Sapiens
IFLKHHDGQ

SEQ ID NO: 807544 - protein, 9 aa, Homo Sapiens
LGETDEDKL

SEQ ID NO: 807545 - protein, 9 aa, Homo Sapiens
RKDFGQKRA

SEQ ID NO: 807546 - protein, 9 aa, Homo Sapiens
LYRDVTKNA

SEQ ID NO: 807547 - protein, 9 aa, Homo Sapiens
PVRYAIYRE

SEQ ID NO: 807548 - protein, 9 aa, Homo Sapiens
KQFQAFGYL

SEQ ID NO: 807549 - protein, 9 aa, Homo Sapiens
VIQREGKSY

SEQ ID NO: 807550 - protein, 9 aa, Homo Sapiens
PWNQYAPPE

SEQ ID NO: 807551 - protein, 9 aa, Homo Sapiens
RCDDFADCM

SEQ ID NO: 807552 - protein, 9 aa, Homo Sapiens
TLNEQQRSS

SEQ ID NO: 807553 - protein, 9 aa, Homo Sapiens
SLHIDQFKR

SEQ ID NO: 807554 - protein, 9 aa, Homo Sapiens
LYVLQVHDN

SEQ ID NO: 807555 - protein, 9 aa, Homo Sapiens
VPTGMNPTG

SEQ ID NO: 807556 - protein, 9 aa, Homo Sapiens
IKDEDLKLE

SEQ ID NO: 807557 - protein, 9 aa, Homo Sapiens
SGVRKCCSN

SEQ ID NO: 807558 - protein, 9 aa, Homo Sapiens
KCIKHIALK

SEQ ID NO: 807559 - protein, 9 aa, Homo Sapiens
ARSLSYNDN

SEQ ID NO: 807560 - protein, 9 aa, Homo Sapiens
DKEELTWEN

SEQ ID NO: 807561 - protein, 9 aa, Homo Sapiens
SGAHDTLNA

SEQ ID NO: 807562 - protein, 9 aa, Homo Sapiens
MIPIENMVN

SEQ ID NO: 807563 - protein, 9 aa, Homo Sapiens
WGREQLEVT

SEQ ID NO: 807564 - protein, 9 aa, Homo Sapiens
VSYGNIISN

SEQ ID NO: 807565 - protein, 9 aa, Homo Sapiens
SSPKECILL

SEQ ID NO: 807566 - protein, 9 aa, Homo Sapiens
RLNLFKRSK

SEQ ID NO: 807567 - protein, 9 aa, Homo Sapiens
QHLLPVPPT

SEQ ID NO: 807568 - protein, 9 aa, Homo Sapiens
SKEESKLLK

SEQ ID NO: 807569 - protein, 9 aa, Homo Sapiens
SADDYLKTP

SEQ ID NO: 807570 - protein, 9 aa, Homo Sapiens
AKKQGEGSS

SEQ ID NO: 807571 - protein, 9 aa, Homo Sapiens
IHFRLEQVV

SEQ ID NO: 807572 - protein, 9 aa, Homo Sapiens
LYRSPEHGV

SEQ ID NO: 807573 - protein, 9 aa, Homo Sapiens
STSNHQLFL

SEQ ID NO: 807574 - protein, 9 aa, Homo Sapiens
DDNMLVIFI

SEQ ID NO: 807575 - protein, 9 aa, Homo Sapiens
VILFTHKEE

SEQ ID NO: 807576 - protein, 9 aa, Homo Sapiens
PTSSGKPST

SEQ ID NO: 807577 - protein, 9 aa, Homo Sapiens
FNMLCYTPN

SEQ ID NO: 807578 - protein, 9 aa, Homo Sapiens
YHKQNLTKI

SEQ ID NO: 807579 - protein, 9 aa, Homo Sapiens
LLLIKCRFQ

SEQ ID NO: 807580 - protein, 9 aa, Homo Sapiens
DKQQKRQNG

SEQ ID NO: 807581 - protein, 9 aa, Homo Sapiens
WCDCCLWEA

SEQ ID NO: 807582 - protein, 9 aa, Homo Sapiens
HNTCFHCMA

SEQ ID NO: 807583 - protein, 9 aa, Homo Sapiens
EQEVLFKMT

SEQ ID NO: 807584 - protein, 9 aa, Homo Sapiens
GPPQSIKLM

SEQ ID NO: 807585 - protein, 9 aa, Homo Sapiens
GLSSMFLSV

SEQ ID NO: 807586 - protein, 9 aa, Homo Sapiens
QTPLTGFSS

SEQ ID NO: 807587 - protein, 9 aa, Homo Sapiens
SNNCRASWS

SEQ ID NO: 807588 - protein, 9 aa, Homo Sapiens
PPPPHLSCL

SEQ ID NO: 807589 - protein, 9 aa, Homo Sapiens
FTMVFSLDC

SEQ ID NO: 807590 - protein, 9 aa, Homo Sapiens
ALVKVLLYS

SEQ ID NO: 807591 - protein, 9 aa, Homo Sapiens
NDTVYLASS

SEQ ID NO: 807592 - protein, 9 aa, Homo Sapiens
IHFYLKQSV

SEQ ID NO: 807593 - protein, 9 aa, Homo Sapiens
DATNFTINM

SEQ ID NO: 807594 - protein, 9 aa, Homo Sapiens
FSALHIVSR

SEQ ID NO: 807595 - protein, 9 aa, Homo Sapiens
AEAPSPPPL

SEQ ID NO: 807596 - protein, 9 aa, Homo Sapiens
TFKRFTPRK

SEQ ID NO: 807597 - protein, 9 aa, Homo Sapiens
RRYMEENNI

SEQ ID NO: 807598 - protein, 9 aa, Homo Sapiens
KIVLTATFP

SEQ ID NO: 807599 - protein, 9 aa, Homo Sapiens
LLVLQTDSK

SEQ ID NO: 807600 - protein, 9 aa, Homo Sapiens
GAPQTLPQS

SEQ ID NO: 807601 - protein, 9 aa, Homo Sapiens
HDQAPQLKI

SEQ ID NO: 807602 - protein, 9 aa, Homo Sapiens
CQICQPRKK

SEQ ID NO: 807603 - protein, 9 aa, Homo Sapiens
TDIKEANLF

SEQ ID NO: 807604 - protein, 9 aa, Homo Sapiens
LVDIDDISV

SEQ ID NO: 807605 - protein, 9 aa, Homo Sapiens
HFKPNEGSD

SEQ ID NO: 807606 - protein, 9 aa, Homo Sapiens
QRGFGKSGE

SEQ ID NO: 807607 - protein, 9 aa, Homo Sapiens
YTQTLSNKP

SEQ ID NO: 807608 - protein, 9 aa, Homo Sapiens
LSAVTATKS

SEQ ID NO: 807609 - protein, 9 aa, Homo Sapiens
QYSSCLTIF

SEQ ID NO: 807610 - protein, 9 aa, Homo Sapiens
PPPTYRTHD

SEQ ID NO: 807611 - protein, 9 aa, Homo Sapiens
NPGFIGSIG

SEQ ID NO: 807612 - protein, 9 aa, Homo Sapiens
HLEDAANKS

SEQ ID NO: 807613 - protein, 9 aa, Homo Sapiens
FRNRLNNYL

SEQ ID NO: 807614 - protein, 9 aa, Homo Sapiens
LVVALASVY

SEQ ID NO: 807615 - protein, 9 aa, Homo Sapiens
SIRQGFCFN

SEQ ID NO: 807616 - protein, 9 aa, Homo Sapiens
KDRINHCGI

SEQ ID NO: 807617 - protein, 9 aa, Homo Sapiens
YVARELDQK

SEQ ID NO: 807618 - protein, 9 aa, Homo Sapiens
RQGRKEHTL

SEQ ID NO: 807619 - protein, 9 aa, Homo Sapiens
LGDPKINVR

SEQ ID NO: 807620 - protein, 9 aa, Homo Sapiens
MFFLYTDLF

SEQ ID NO: 807621 - protein, 9 aa, Homo Sapiens
KLESKGLEK

SEQ ID NO: 807622 - protein, 9 aa, Homo Sapiens
AVVALILMT

SEQ ID NO: 807623 - protein, 9 aa, Homo Sapiens
ANSKVTFSA

SEQ ID NO: 807624 - protein, 9 aa, Homo Sapiens
TVGEAHNLI

SEQ ID NO: 807625 - protein, 9 aa, Homo Sapiens
TLTYPILQA

SEQ ID NO: 807626 - protein, 9 aa, Homo Sapiens
SDGRITLSD

SEQ ID NO: 807627 - protein, 9 aa, Homo Sapiens
IISNVEFYH

SEQ ID NO: 807628 - protein, 9 aa, Homo Sapiens
LVSGIQTPP

SEQ ID NO: 807629 - protein, 9 aa, Homo Sapiens
NRTNTTLSS

SEQ ID NO: 807630 - protein, 9 aa, Homo Sapiens
PDCQPVCSC

SEQ ID NO: 807631 - protein, 9 aa, Homo Sapiens
TTCSLVRPK

SEQ ID NO: 807632 - protein, 9 aa, Homo Sapiens
NASPQGNLC

SEQ ID NO: 807633 - protein, 9 aa, Homo Sapiens
LSDSSKKLD

SEQ ID NO: 807634 - protein, 9 aa, Homo Sapiens
NRCLETKVG

SEQ ID NO: 807635 - protein, 9 aa, Homo Sapiens
GAEKIKTKR

SEQ ID NO: 807636 - protein, 9 aa, Homo Sapiens
LSDACSARM

SEQ ID NO: 807637 - protein, 9 aa, Homo Sapiens
ENLLHQEES

SEQ ID NO: 807638 - protein, 9 aa, Homo Sapiens
LSLLHNLRT

SEQ ID NO: 807639 - protein, 9 aa, Homo Sapiens
LYAVMQEVP

SEQ ID NO: 807640 - protein, 9 aa, Homo Sapiens
VLTAGLSKR

SEQ ID NO: 807641 - protein, 9 aa, Homo Sapiens
VSQYPETEL

SEQ ID NO: 807642 - protein, 9 aa, Homo Sapiens
LKSEIRRSE

SEQ ID NO: 807643 - protein, 9 aa, Homo Sapiens
QVSTDQAAA

SEQ ID NO: 807644 - protein, 9 aa, Homo Sapiens
LQLCALTQV

SEQ ID NO: 807645 - protein, 9 aa, Homo Sapiens
GAKKVHLGA

SEQ ID NO: 807646 - protein, 9 aa, Homo Sapiens
ETEFVSSLP

SEQ ID NO: 807647 - protein, 9 aa, Homo Sapiens
KNIFHMVPV

SEQ ID NO: 807648 - protein, 9 aa, Homo Sapiens
AWECVGQEV

SEQ ID NO: 807649 - protein, 9 aa, Homo Sapiens
QVRAKKPLF

SEQ ID NO: 807650 - protein, 9 aa, Homo Sapiens
PDEMGDMQK

SEQ ID NO: 807651 - protein, 9 aa, Homo Sapiens
KSGTAWVSE

SEQ ID NO: 807652 - protein, 9 aa, Homo Sapiens
FSRLFELFD

SEQ ID NO: 807653 - protein, 9 aa, Homo Sapiens
TCTSLSKLC

SEQ ID NO: 807654 - protein, 9 aa, Homo Sapiens
TTHEDAVAA

SEQ ID NO: 807655 - protein, 9 aa, Homo Sapiens
VEIGPRCVL

SEQ ID NO: 807656 - protein, 9 aa, Homo Sapiens
IYGLGLCSL

SEQ ID NO: 807657 - protein, 9 aa, Homo Sapiens
KKHFEKINS

SEQ ID NO: 807658 - protein, 9 aa, Homo Sapiens
DTPLHWACY

SEQ ID NO: 807659 - protein, 9 aa, Homo Sapiens
TVYYYAGKN

SEQ ID NO: 807660 - protein, 9 aa, Homo Sapiens
IVTILQATP

SEQ ID NO: 807661 - protein, 9 aa, Homo Sapiens
AVALDECAS

SEQ ID NO: 807662 - protein, 9 aa, Homo Sapiens
GTSFGTGNY

SEQ ID NO: 807663 - protein, 9 aa, Homo Sapiens
RQQRKSEKR

SEQ ID NO: 807664 - protein, 9 aa, Homo Sapiens
LSNLIPSIK

SEQ ID NO: 807665 - protein, 9 aa, Homo Sapiens
LKLRINENR

SEQ ID NO: 807666 - protein, 9 aa, Homo Sapiens
KMNSWVKTQ

SEQ ID NO: 807667 - protein, 9 aa, Homo Sapiens
PLYLNGRRI

SEQ ID NO: 807668 - protein, 9 aa, Homo Sapiens
DAEEDGDTG

SEQ ID NO: 807669 - protein, 9 aa, Homo Sapiens
HSFLLNTNM

SEQ ID NO: 807670 - protein, 9 aa, Homo Sapiens
YTKQLIISC

SEQ ID NO: 807671 - protein, 9 aa, Homo Sapiens
LIVYYTGWR

SEQ ID NO: 807672 - protein, 9 aa, Homo Sapiens
DTELSACSA

SEQ ID NO: 807673 - protein, 9 aa, Homo Sapiens
RSSPTHHRL

SEQ ID NO: 807674 - protein, 9 aa, Homo Sapiens
SKQDTILAC

SEQ ID NO: 807675 - protein, 9 aa, Homo Sapiens
LPHAIYLLR

SEQ ID NO: 807676 - protein, 9 aa, Homo Sapiens
NYILALAAA

SEQ ID NO: 807677 - protein, 9 aa, Homo Sapiens
FCPNAKGVL

SEQ ID NO: 807678 - protein, 9 aa, Homo Sapiens
EFEECNGKP

SEQ ID NO: 807679 - protein, 9 aa, Homo Sapiens
DVDGVGTLQ

SEQ ID NO: 807680 - protein, 9 aa, Homo Sapiens
VHGKPKYQN

SEQ ID NO: 807681 - protein, 9 aa, Homo Sapiens
PVFDLSYLI

SEQ ID NO: 807682 - protein, 9 aa, Homo Sapiens
NALKGPNVC

SEQ ID NO: 807683 - protein, 9 aa, Homo Sapiens
PDKEPSVLR

SEQ ID NO: 807684 - protein, 9 aa, Homo Sapiens
YSVPQPGKQ

SEQ ID NO: 807685 - protein, 9 aa, Homo Sapiens
EAKTDTKKE

SEQ ID NO: 807686 - protein, 9 aa, Homo Sapiens
LIEFYLLRL

SEQ ID NO: 807687 - protein, 9 aa, Homo Sapiens
STHHLRDCM

SEQ ID NO: 807688 - protein, 9 aa, Homo Sapiens
KVKTIVMIA

SEQ ID NO: 807689 - protein, 9 aa, Homo Sapiens
SPKSLRLKP

SEQ ID NO: 807690 - protein, 9 aa, Homo Sapiens
EPKIYLSNH

SEQ ID NO: 807691 - protein, 9 aa, Homo Sapiens
KALREQARL

SEQ ID NO: 807692 - protein, 9 aa, Homo Sapiens
ITVKSCLDI

SEQ ID NO: 807693 - protein, 9 aa, Homo Sapiens
NMLHGDDTN

SEQ ID NO: 807694 - protein, 9 aa, Homo Sapiens
RCTFETARH

SEQ ID NO: 807695 - protein, 9 aa, Homo Sapiens
WENNLRENL

SEQ ID NO: 807696 - protein, 9 aa, Homo Sapiens
ASGGRWVEH

SEQ ID NO: 807697 - protein, 9 aa, Homo Sapiens
ERSRINYSG

SEQ ID NO: 807698 - protein, 9 aa, Homo Sapiens
QKAKDLPKL

SEQ ID NO: 807699 - protein, 9 aa, Homo Sapiens
HLALHNKRT

SEQ ID NO: 807700 - protein, 9 aa, Homo Sapiens
LEMTPMVFA

SEQ ID NO: 807701 - protein, 9 aa, Homo Sapiens
DKPYGCILC

SEQ ID NO: 807702 - protein, 9 aa, Homo Sapiens
SGGGATSQL

SEQ ID NO: 807703 - protein, 9 aa, Homo Sapiens
PGLSHLPTS

SEQ ID NO: 807704 - protein, 9 aa, Homo Sapiens
LRNKRFEQA

SEQ ID NO: 807705 - protein, 9 aa, Homo Sapiens
TLRTLSLVL

SEQ ID NO: 807706 - protein, 9 aa, Homo Sapiens
PYGCNKCGK

SEQ ID NO: 807707 - protein, 9 aa, Homo Sapiens
TTEPPTKSM

SEQ ID NO: 807708 - protein, 9 aa, Homo Sapiens
EPLSLIEDL

SEQ ID NO: 807709 - protein, 9 aa, Homo Sapiens
DELVACIDI

SEQ ID NO: 807710 - protein, 9 aa, Homo Sapiens
ILLFVPCIF

SEQ ID NO: 807711 - protein, 9 aa, Homo Sapiens
CHFSTLKDD

SEQ ID NO: 807712 - protein, 9 aa, Homo Sapiens
GEGGACSVD

SEQ ID NO: 807713 - protein, 9 aa, Homo Sapiens
VIGSTSGKN

SEQ ID NO: 807714 - protein, 9 aa, Homo Sapiens
GSGCTLAQW

SEQ ID NO: 807715 - protein, 9 aa, Homo Sapiens
MKKYLVMPK

SEQ ID NO: 807716 - protein, 9 aa, Homo Sapiens
SLNGHLPHP

SEQ ID NO: 807717 - protein, 9 aa, Homo Sapiens
AYILEPLIL

SEQ ID NO: 807718 - protein, 9 aa, Homo Sapiens
DSLALLANQ

SEQ ID NO: 807719 - protein, 9 aa, Homo Sapiens
EVDATRKCY

SEQ ID NO: 807720 - protein, 9 aa, Homo Sapiens
LLAAAYSLK

SEQ ID NO: 807721 - protein, 9 aa, Homo Sapiens
LTTCGTLKI

SEQ ID NO: 807722 - protein, 9 aa, Homo Sapiens
KIMKYLIKV

SEQ ID NO: 807723 - protein, 9 aa, Homo Sapiens
GKVRLDLLS

SEQ ID NO: 807724 - protein, 9 aa, Homo Sapiens
HTEVAYGPE

SEQ ID NO: 807725 - protein, 9 aa, Homo Sapiens
LLVQMQGVG

SEQ ID NO: 807726 - protein, 9 aa, Homo Sapiens
KDNNGRLDP

SEQ ID NO: 807727 - protein, 9 aa, Homo Sapiens
YLREAPDDI

SEQ ID NO: 807728 - protein, 9 aa, Homo Sapiens
DNSEILPTL

SEQ ID NO: 807729 - protein, 9 aa, Homo Sapiens
DPVLSQAKC

SEQ ID NO: 807730 - protein, 9 aa, Homo Sapiens
SLTYDNQIH

SEQ ID NO: 807731 - protein, 9 aa, Homo Sapiens
EALSNGQNP

SEQ ID NO: 807732 - protein, 9 aa, Homo Sapiens
IPQSLDLLG

SEQ ID NO: 807733 - protein, 9 aa, Homo Sapiens
ESFTATAKF

SEQ ID NO: 807734 - protein, 9 aa, Homo Sapiens
QIKHQNLAA

SEQ ID NO: 807735 - protein, 9 aa, Homo Sapiens
PQTLPQSSL

SEQ ID NO: 807736 - protein, 9 aa, Homo Sapiens
RRHHQFIEP

SEQ ID NO: 807737 - protein, 9 aa, Homo Sapiens
LQNQDNKLL

SEQ ID NO: 807738 - protein, 9 aa, Homo Sapiens
IVGDILWEH

SEQ ID NO: 807739 - protein, 9 aa, Homo Sapiens
IGAKHSRLG

SEQ ID NO: 807740 - protein, 9 aa, Homo Sapiens
KLERYSSSE

SEQ ID NO: 807741 - protein, 9 aa, Homo Sapiens
PSGDAFVSG

SEQ ID NO: 807742 - protein, 9 aa, Homo Sapiens
MRKHTGKKP

SEQ ID NO: 807743 - protein, 9 aa, Homo Sapiens
FKEMSNAFA

SEQ ID NO: 807744 - protein, 9 aa, Homo Sapiens
YILYRLRAS

SEQ ID NO: 807745 - protein, 9 aa, Homo Sapiens
NINISEVVI

SEQ ID NO: 807746 - protein, 9 aa, Homo Sapiens
FQIKHLPYT

SEQ ID NO: 807747 - protein, 9 aa, Homo Sapiens
DPAALTPPK

SEQ ID NO: 807748 - protein, 9 aa, Homo Sapiens
FIDKFLSLA

SEQ ID NO: 807749 - protein, 9 aa, Homo Sapiens
NLDSSKKNL

SEQ ID NO: 807750 - protein, 9 aa, Homo Sapiens
FVQYSNQII

SEQ ID NO: 807751 - protein, 9 aa, Homo Sapiens
PDFFIGKQT

SEQ ID NO: 807752 - protein, 9 aa, Homo Sapiens
SLSSNSSFV

SEQ ID NO: 807753 - protein, 9 aa, Homo Sapiens
TLSNALNQN

SEQ ID NO: 807754 - protein, 9 aa, Homo Sapiens
RRYFILLSA

SEQ ID NO: 807755 - protein, 9 aa, Homo Sapiens
QSLAAGPQG

SEQ ID NO: 807756 - protein, 9 aa, Homo Sapiens
CDTLLVEEI

SEQ ID NO: 807757 - protein, 9 aa, Homo Sapiens
LLITTSLLT

SEQ ID NO: 807758 - protein, 9 aa, Homo Sapiens
LGINLMRQK

SEQ ID NO: 807759 - protein, 9 aa, Homo Sapiens
SEEINNYIE

SEQ ID NO: 807760 - protein, 9 aa, Homo Sapiens
MQNTGDEER

SEQ ID NO: 807761 - protein, 9 aa, Homo Sapiens
LNLLRQHHK

SEQ ID NO: 807762 - protein, 9 aa, Homo Sapiens
YDCQTRQHE

SEQ ID NO: 807763 - protein, 9 aa, Homo Sapiens
PSKYIATIL

SEQ ID NO: 807764 - protein, 9 aa, Homo Sapiens
IILTIFRMK

SEQ ID NO: 807765 - protein, 9 aa, Homo Sapiens
IIHNFVRVH

SEQ ID NO: 807766 - protein, 9 aa, Homo Sapiens
DKEVKVFDF

SEQ ID NO: 807767 - protein, 9 aa, Homo Sapiens
QVWLQLFKT

SEQ ID NO: 807768 - protein, 9 aa, Homo Sapiens
GYQCLISPD

SEQ ID NO: 807769 - protein, 9 aa, Homo Sapiens
SLLFEQSFQ

SEQ ID NO: 807770 - protein, 9 aa, Homo Sapiens
GPENTLMMD

SEQ ID NO: 807771 - protein, 9 aa, Homo Sapiens
CRASNYSME

SEQ ID NO: 807772 - protein, 9 aa, Homo Sapiens
SSWGKRKLQ

SEQ ID NO: 807773 - protein, 9 aa, Homo Sapiens
PDKDGHGNS

SEQ ID NO: 807774 - protein, 9 aa, Homo Sapiens
LLFLSFFFV

SEQ ID NO: 807775 - protein, 9 aa, Homo Sapiens
YFGRLSLQP

SEQ ID NO: 807776 - protein, 9 aa, Homo Sapiens
MGMRLICEG

SEQ ID NO: 807777 - protein, 9 aa, Homo Sapiens
DVMMDNYSS

SEQ ID NO: 807778 - protein, 9 aa, Homo Sapiens
ESTQSGYCA

SEQ ID NO: 807779 - protein, 9 aa, Homo Sapiens
PLLVAYWEN

SEQ ID NO: 807780 - protein, 9 aa, Homo Sapiens
LPCLSPDTQ

SEQ ID NO: 807781 - protein, 9 aa, Homo Sapiens
QSACVHFKP

SEQ ID NO: 807782 - protein, 9 aa, Homo Sapiens
IGLITSSWG

SEQ ID NO: 807783 - protein, 9 aa, Homo Sapiens
AVDLGLQDK

SEQ ID NO: 807784 - protein, 9 aa, Homo Sapiens
DIEADDNPF

SEQ ID NO: 807785 - protein, 9 aa, Homo Sapiens
GRGNYGKVL

SEQ ID NO: 807786 - protein, 9 aa, Homo Sapiens
MCFYRLLQI

SEQ ID NO: 807787 - protein, 9 aa, Homo Sapiens
AHFQRRALR

SEQ ID NO: 807788 - protein, 9 aa, Homo Sapiens
LSVYKQVIE

SEQ ID NO: 807789 - protein, 9 aa, Homo Sapiens
GTNLVKTAI

SEQ ID NO: 807790 - protein, 9 aa, Homo Sapiens
IKKVAKTPT

SEQ ID NO: 807791 - protein, 9 aa, Homo Sapiens
PPPRHQNTG

SEQ ID NO: 807792 - protein, 9 aa, Homo Sapiens
AASNGVVDA

SEQ ID NO: 807793 - protein, 9 aa, Homo Sapiens
PFSSPSLPW

SEQ ID NO: 807794 - protein, 9 aa, Homo Sapiens
SDGHGRLLR

SEQ ID NO: 807795 - protein, 9 aa, Homo Sapiens
IMDFRRVPP

SEQ ID NO: 807796 - protein, 9 aa, Homo Sapiens
MGEGSYTCD

SEQ ID NO: 807797 - protein, 9 aa, Homo Sapiens
EWENNLREN

SEQ ID NO: 807798 - protein, 9 aa, Homo Sapiens
FLRLNHNKI

SEQ ID NO: 807799 - protein, 9 aa, Homo Sapiens
HEPPSRSCG

SEQ ID NO: 807800 - protein, 9 aa, Homo Sapiens
APWLGDGLL

SEQ ID NO: 807801 - protein, 9 aa, Homo Sapiens
SQSKTYSTK

SEQ ID NO: 807802 - protein, 9 aa, Homo Sapiens
EKPNSPMMC

SEQ ID NO: 807803 - protein, 9 aa, Homo Sapiens
ELFDEKLNS

SEQ ID NO: 807804 - protein, 9 aa, Homo Sapiens
YVNVRVSSL

SEQ ID NO: 807805 - protein, 9 aa, Homo Sapiens
SKSVHFYAK

SEQ ID NO: 807806 - protein, 9 aa, Homo Sapiens
SCRKSFHLF

SEQ ID NO: 807807 - protein, 9 aa, Homo Sapiens
LEAIMHKRP

SEQ ID NO: 807808 - protein, 9 aa, Homo Sapiens
QKFIDNRPG

SEQ ID NO: 807809 - protein, 9 aa, Homo Sapiens
VKMVADTSK

SEQ ID NO: 807810 - protein, 9 aa, Homo Sapiens
GPGPHRLRR

SEQ ID NO: 807811 - protein, 9 aa, Homo Sapiens
IRSYCEKLY

SEQ ID NO: 807812 - protein, 9 aa, Homo Sapiens
FEPFVENDI

SEQ ID NO: 807813 - protein, 9 aa, Homo Sapiens
KLADHLKVL

SEQ ID NO: 807814 - protein, 9 aa, Homo Sapiens
QSLRERGRL

SEQ ID NO: 807815 - protein, 9 aa, Homo Sapiens
LNLFKRSKL

SEQ ID NO: 807816 - protein, 9 aa, Homo Sapiens
FPTDWMNVL

SEQ ID NO: 807817 - protein, 9 aa, Homo Sapiens
LPDNLSNID

SEQ ID NO: 807818 - protein, 9 aa, Homo Sapiens
RKSGYFPMP

SEQ ID NO: 807819 - protein, 9 aa, Homo Sapiens
SHKNFHADA

SEQ ID NO: 807820 - protein, 9 aa, Homo Sapiens
RSVLTEHKR

SEQ ID NO: 807821 - protein, 9 aa, Homo Sapiens
SESYSCPSC

SEQ ID NO: 807822 - protein, 9 aa, Homo Sapiens
YLTINSMFL

SEQ ID NO: 807823 - protein, 9 aa, Homo Sapiens
TSEQRTPSY

SEQ ID NO: 807824 - protein, 9 aa, Homo Sapiens
HMPEKEMLC

SEQ ID NO: 807825 - protein, 9 aa, Homo Sapiens
MPVAYQVYS

SEQ ID NO: 807826 - protein, 9 aa, Homo Sapiens
MAQFIHLFY

SEQ ID NO: 807827 - protein, 9 aa, Homo Sapiens
MNLFEEVFI

SEQ ID NO: 807828 - protein, 9 aa, Homo Sapiens
CNCPSMYIQ

SEQ ID NO: 807829 - protein, 9 aa, Homo Sapiens
SRINTNLTL

SEQ ID NO: 807830 - protein, 9 aa, Homo Sapiens
WYNVPDQAD

SEQ ID NO: 807831 - protein, 9 aa, Homo Sapiens
GFVSISSPA

SEQ ID NO: 807832 - protein, 9 aa, Homo Sapiens
DTLEHKLRR

SEQ ID NO: 807833 - protein, 9 aa, Homo Sapiens
RFILFRPFG

SEQ ID NO: 807834 - protein, 9 aa, Homo Sapiens
VKYFEHLNS

SEQ ID NO: 807835 - protein, 9 aa, Homo Sapiens
LRILCFVLC

SEQ ID NO: 807836 - protein, 9 aa, Homo Sapiens
SKPYVYICL

SEQ ID NO: 807837 - protein, 9 aa, Homo Sapiens
CNAACSSQP

SEQ ID NO: 807838 - protein, 9 aa, Homo Sapiens
SLVAHQIIH

SEQ ID NO: 807839 - protein, 9 aa, Homo Sapiens
CRQSILGTP

SEQ ID NO: 807840 - protein, 9 aa, Homo Sapiens
KNVIQSVRN

SEQ ID NO: 807841 - protein, 9 aa, Homo Sapiens
SGPGSVCTT

SEQ ID NO: 807842 - protein, 9 aa, Homo Sapiens
HNEHLSPVV

SEQ ID NO: 807843 - protein, 9 aa, Homo Sapiens
FSEYISYFG

SEQ ID NO: 807844 - protein, 9 aa, Homo Sapiens
GFNVRGIRG

SEQ ID NO: 807845 - protein, 9 aa, Homo Sapiens
VYAGTFSKN

SEQ ID NO: 807846 - protein, 9 aa, Homo Sapiens
PTQSVPSGS

SEQ ID NO: 807847 - protein, 9 aa, Homo Sapiens
KANSSSAWS

SEQ ID NO: 807848 - protein, 9 aa, Homo Sapiens
RLQRDQECL

SEQ ID NO: 807849 - protein, 9 aa, Homo Sapiens
ETGFHHVGL

SEQ ID NO: 807850 - protein, 9 aa, Homo Sapiens
IQAIKLFKD

SEQ ID NO: 807851 - protein, 9 aa, Homo Sapiens
RYELPHFFS

SEQ ID NO: 807852 - protein, 9 aa, Homo Sapiens
DMDFLTRQN

SEQ ID NO: 807853 - protein, 9 aa, Homo Sapiens
LPIYSENDS

SEQ ID NO: 807854 - protein, 9 aa, Homo Sapiens
ESSYYRHNF

SEQ ID NO: 807855 - protein, 9 aa, Homo Sapiens
PLIPASQPP

SEQ ID NO: 807856 - protein, 9 aa, Homo Sapiens
GVVLYAPPL

SEQ ID NO: 807857 - protein, 9 aa, Homo Sapiens
NSIMGSMVP

SEQ ID NO: 807858 - protein, 9 aa, Homo Sapiens
ARNILVENN

SEQ ID NO: 807859 - protein, 9 aa, Homo Sapiens
TLQEYQKIM

SEQ ID NO: 807860 - protein, 9 aa, Homo Sapiens
DVLHTLRNY

SEQ ID NO: 807861 - protein, 9 aa, Homo Sapiens
RESKTRLEL

SEQ ID NO: 807862 - protein, 9 aa, Homo Sapiens
QDTVHMLLE

SEQ ID NO: 807863 - protein, 9 aa, Homo Sapiens
SQRTALSDK

SEQ ID NO: 807864 - protein, 9 aa, Homo Sapiens
ANGSLSEEK

SEQ ID NO: 807865 - protein, 9 aa, Homo Sapiens
EESMKETLQ

SEQ ID NO: 807866 - protein, 9 aa, Homo Sapiens
KHKIQCQQE

SEQ ID NO: 807867 - protein, 9 aa, Homo Sapiens
DKTDMTPST

SEQ ID NO: 807868 - protein, 9 aa, Homo Sapiens
DMDTHVKTK

SEQ ID NO: 807869 - protein, 9 aa, Homo Sapiens
DLPVHGDIL

SEQ ID NO: 807870 - protein, 9 aa, Homo Sapiens
STNKAKKRE

SEQ ID NO: 807871 - protein, 9 aa, Homo Sapiens
QKDKELLIC

SEQ ID NO: 807872 - protein, 9 aa, Homo Sapiens
HWHPFEPNT

SEQ ID NO: 807873 - protein, 9 aa, Homo Sapiens
QLQAIQIIQ

SEQ ID NO: 807874 - protein, 9 aa, Homo Sapiens
DEDTLFCQD

SEQ ID NO: 807875 - protein, 9 aa, Homo Sapiens
KSTHYADLW

SEQ ID NO: 807876 - protein, 9 aa, Homo Sapiens
VFLGRESPE

SEQ ID NO: 807877 - protein, 9 aa, Homo Sapiens
GIISQEERC

SEQ ID NO: 807878 - protein, 9 aa, Homo Sapiens
EQRARATLR

SEQ ID NO: 807879 - protein, 9 aa, Homo Sapiens
SGDIYALQS

SEQ ID NO: 807880 - protein, 9 aa, Homo Sapiens
FLIKTKANL

SEQ ID NO: 807881 - protein, 9 aa, Homo Sapiens
EVPNSKEQR

SEQ ID NO: 807882 - protein, 9 aa, Homo Sapiens
EFSPDLGKN

SEQ ID NO: 807883 - protein, 9 aa, Homo Sapiens
TDYIFVLVL

SEQ ID NO: 807884 - protein, 9 aa, Homo Sapiens
FPQPLPWDQ

SEQ ID NO: 807885 - protein, 9 aa, Homo Sapiens
YFLYLEVAA

SEQ ID NO: 807886 - protein, 9 aa, Homo Sapiens
RPTFRVVDT

SEQ ID NO: 807887 - protein, 9 aa, Homo Sapiens
FLGFILTGE

SEQ ID NO: 807888 - protein, 9 aa, Homo Sapiens
SLEDKEEAI

SEQ ID NO: 807889 - protein, 9 aa, Homo Sapiens
PYPVCTVWY

SEQ ID NO: 807890 - protein, 9 aa, Homo Sapiens
YFCGRCIRE

SEQ ID NO: 807891 - protein, 9 aa, Homo Sapiens
EQGLVGFGI

SEQ ID NO: 807892 - protein, 9 aa, Homo Sapiens
TIVKAVEFI

SEQ ID NO: 807893 - protein, 9 aa, Homo Sapiens
CIFNNNTNS

SEQ ID NO: 807894 - protein, 9 aa, Homo Sapiens
ISCDQLSTT

SEQ ID NO: 807895 - protein, 9 aa, Homo Sapiens
EIKLESFEE

SEQ ID NO: 807896 - protein, 9 aa, Homo Sapiens
KHDIPEDIS

SEQ ID NO: 807897 - protein, 9 aa, Homo Sapiens
GQDIEIWKE

SEQ ID NO: 807898 - protein, 9 aa, Homo Sapiens
LYKKCPLTV

SEQ ID NO: 807899 - protein, 9 aa, Homo Sapiens
ELNRCPFGV

SEQ ID NO: 807900 - protein, 9 aa, Homo Sapiens
SIKAQDLSN

SEQ ID NO: 807901 - protein, 9 aa, Homo Sapiens
KREDVKLED

SEQ ID NO: 807902 - protein, 9 aa, Homo Sapiens
DSRESWRAD

SEQ ID NO: 807903 - protein, 9 aa, Homo Sapiens
KPIHKQGDK

SEQ ID NO: 807904 - protein, 9 aa, Homo Sapiens
AIFFCCFED

SEQ ID NO: 807905 - protein, 9 aa, Homo Sapiens
INSNGENIG

SEQ ID NO: 807906 - protein, 9 aa, Homo Sapiens
SKVAFVSEL

SEQ ID NO: 807907 - protein, 9 aa, Homo Sapiens
PFLQLYYSL

SEQ ID NO: 807908 - protein, 9 aa, Homo Sapiens
LCENYHSHE

SEQ ID NO: 807909 - protein, 9 aa, Homo Sapiens
DFFNELPET

SEQ ID NO: 807910 - protein, 9 aa, Homo Sapiens
NNNPRHSSS

SEQ ID NO: 807911 - protein, 9 aa, Homo Sapiens
LNNEGSLNI

SEQ ID NO: 807912 - protein, 9 aa, Homo Sapiens
FLSKCQNSW

SEQ ID NO: 807913 - protein, 9 aa, Homo Sapiens
YKKINTFIV

SEQ ID NO: 807914 - protein, 9 aa, Homo Sapiens
ITGACNNRT

SEQ ID NO: 807915 - protein, 9 aa, Homo Sapiens
RKWKKIKTA

SEQ ID NO: 807916 - protein, 9 aa, Homo Sapiens
YKRRAISLL

SEQ ID NO: 807917 - protein, 9 aa, Homo Sapiens
KVMGYWYFG

SEQ ID NO: 807918 - protein, 9 aa, Homo Sapiens
AVCYVLPRL

SEQ ID NO: 807919 - protein, 9 aa, Homo Sapiens
NRIFLADSG

SEQ ID NO: 807920 - protein, 9 aa, Homo Sapiens
LSGLHSGGE

SEQ ID NO: 807921 - protein, 9 aa, Homo Sapiens
VRAFKPLGK

SEQ ID NO: 807922 - protein, 9 aa, Homo Sapiens
LKNAKDLDV

SEQ ID NO: 807923 - protein, 9 aa, Homo Sapiens
EENMDNFCS

SEQ ID NO: 807924 - protein, 9 aa, Homo Sapiens
LLKGKWLTP

SEQ ID NO: 807925 - protein, 9 aa, Homo Sapiens
RTTEPPTKS

SEQ ID NO: 807926 - protein, 9 aa, Homo Sapiens
VAILVVCLL

SEQ ID NO: 807927 - protein, 9 aa, Homo Sapiens
EHEPPSRSC

SEQ ID NO: 807928 - protein, 9 aa, Homo Sapiens
GQLKHEDTN

SEQ ID NO: 807929 - protein, 9 aa, Homo Sapiens
GIPCVNAGS

SEQ ID NO: 807930 - protein, 9 aa, Homo Sapiens
PYCQSHVLS

SEQ ID NO: 807931 - protein, 9 aa, Homo Sapiens
KRRYFILLS

SEQ ID NO: 807932 - protein, 9 aa, Homo Sapiens
GAQRACPNN

SEQ ID NO: 807933 - protein, 9 aa, Homo Sapiens
IFLDSEDSE

SEQ ID NO: 807934 - protein, 9 aa, Homo Sapiens
KLLLVNNKI

SEQ ID NO: 807935 - protein, 9 aa, Homo Sapiens
YICSGTLVM

SEQ ID NO: 807936 - protein, 9 aa, Homo Sapiens
LYSNASLLI

SEQ ID NO: 807937 - protein, 9 aa, Homo Sapiens
RVHPLFKDL

SEQ ID NO: 807938 - protein, 9 aa, Homo Sapiens
CYLYACGSA

SEQ ID NO: 807939 - protein, 9 aa, Homo Sapiens
VPVVFALIV

SEQ ID NO: 807940 - protein, 9 aa, Homo Sapiens
MNECVMKKM

SEQ ID NO: 807941 - protein, 9 aa, Homo Sapiens
GLEDYFSGD

SEQ ID NO: 807942 - protein, 9 aa, Homo Sapiens
HMAENKELQ

SEQ ID NO: 807943 - protein, 9 aa, Homo Sapiens
HVYSFHNVQ

SEQ ID NO: 807944 - protein, 9 aa, Homo Sapiens
IHFFRNALW

SEQ ID NO: 807945 - protein, 9 aa, Homo Sapiens
AAVCHHHHH

SEQ ID NO: 807946 - protein, 9 aa, Homo Sapiens
FSFERFCVV

SEQ ID NO: 807947 - protein, 9 aa, Homo Sapiens
ESSSFLTGV

SEQ ID NO: 807948 - protein, 9 aa, Homo Sapiens
IDDAMCNFA

SEQ ID NO: 807949 - protein, 9 aa, Homo Sapiens
FRFIVLFYL

SEQ ID NO: 807950 - protein, 9 aa, Homo Sapiens
VVGMYLAHN

SEQ ID NO: 807951 - protein, 9 aa, Homo Sapiens
CQNAREMTL

SEQ ID NO: 807952 - protein, 9 aa, Homo Sapiens
PRHQNTGPC

SEQ ID NO: 807953 - protein, 9 aa, Homo Sapiens
EKQAEQKVH

SEQ ID NO: 807954 - protein, 9 aa, Homo Sapiens
REQPESFRA

SEQ ID NO: 807955 - protein, 9 aa, Homo Sapiens
EFINNYMKK

SEQ ID NO: 807956 - protein, 9 aa, Homo Sapiens
LINMFNNPA

SEQ ID NO: 807957 - protein, 9 aa, Homo Sapiens
RKYDDVTET

SEQ ID NO: 807958 - protein, 9 aa, Homo Sapiens
DITQERMHH

SEQ ID NO: 807959 - protein, 9 aa, Homo Sapiens
LPFHHRNPG

SEQ ID NO: 807960 - protein, 9 aa, Homo Sapiens
KEAMARFHK

SEQ ID NO: 807961 - protein, 9 aa, Homo Sapiens
FVLQELGTI

SEQ ID NO: 807962 - protein, 9 aa, Homo Sapiens
VKKIKWIYD

SEQ ID NO: 807963 - protein, 9 aa, Homo Sapiens
DSYPDEELS

SEQ ID NO: 807964 - protein, 9 aa, Homo Sapiens
NGKTYFFCG

SEQ ID NO: 807965 - protein, 9 aa, Homo Sapiens
CGLDNGDCD

SEQ ID NO: 807966 - protein, 9 aa, Homo Sapiens
DKASRKRQH

SEQ ID NO: 807967 - protein, 9 aa, Homo Sapiens
RKQSEYIEE

SEQ ID NO: 807968 - protein, 9 aa, Homo Sapiens
YLAEINEIT

SEQ ID NO: 807969 - protein, 9 aa, Homo Sapiens
KLQKLELSD

SEQ ID NO: 807970 - protein, 9 aa, Homo Sapiens
YLDNTVFGA

SEQ ID NO: 807971 - protein, 9 aa, Homo Sapiens
NSLDILKED

SEQ ID NO: 807972 - protein, 9 aa, Homo Sapiens
LYSSQWHVV

SEQ ID NO: 807973 - protein, 9 aa, Homo Sapiens
NKPHTVLKP

SEQ ID NO: 807974 - protein, 9 aa, Homo Sapiens
FGQSSGFRG

SEQ ID NO: 807975 - protein, 9 aa, Homo Sapiens
DVKLLYTIQ

SEQ ID NO: 807976 - protein, 9 aa, Homo Sapiens
EHQIDLIKV

SEQ ID NO: 807977 - protein, 9 aa, Homo Sapiens
LIGKYITNK

SEQ ID NO: 807978 - protein, 9 aa, Homo Sapiens
GRHIEVMNS

SEQ ID NO: 807979 - protein, 9 aa, Homo Sapiens
QYSSDVQIT

SEQ ID NO: 807980 - protein, 9 aa, Homo Sapiens
NEAENKRMH

SEQ ID NO: 807981 - protein, 9 aa, Homo Sapiens
LCNQLLRCS

SEQ ID NO: 807982 - protein, 9 aa, Homo Sapiens
GKGPEGQPT

SEQ ID NO: 807983 - protein, 9 aa, Homo Sapiens
VIAACSLQP

SEQ ID NO: 807984 - protein, 9 aa, Homo Sapiens
QGLGVPCVG

SEQ ID NO: 807985 - protein, 9 aa, Homo Sapiens
VQEDEFRYQ

SEQ ID NO: 807986 - protein, 9 aa, Homo Sapiens
KEELEVKII

SEQ ID NO: 807987 - protein, 9 aa, Homo Sapiens
TFIILGFSE

SEQ ID NO: 807988 - protein, 9 aa, Homo Sapiens
TQETTDIKE

SEQ ID NO: 807989 - protein, 9 aa, Homo Sapiens
LIGLIPVSV

SEQ ID NO: 807990 - protein, 9 aa, Homo Sapiens
LRQHHKLCD

SEQ ID NO: 807991 - protein, 9 aa, Homo Sapiens
MKGQWPEGQ

SEQ ID NO: 807992 - protein, 9 aa, Homo Sapiens
YIILRSGFT

SEQ ID NO: 807993 - protein, 9 aa, Homo Sapiens
RKITCTNPE

SEQ ID NO: 807994 - protein, 9 aa, Homo Sapiens
MMDNYSSLV

SEQ ID NO: 807995 - protein, 9 aa, Homo Sapiens
KEVSGDKSF

SEQ ID NO: 807996 - protein, 9 aa, Homo Sapiens
RPVNHSYPK

SEQ ID NO: 807997 - protein, 9 aa, Homo Sapiens
PSNYVHREL

SEQ ID NO: 807998 - protein, 9 aa, Homo Sapiens
GSLPPSKIA

SEQ ID NO: 807999 - protein, 9 aa, Homo Sapiens
EDVFRHRNP

SEQ ID NO: 808000 - protein, 9 aa, Homo Sapiens
KLDYNYLYH

SEQ ID NO: 808001 - protein, 9 aa, Homo Sapiens
ALVTAYGDI

SEQ ID NO: 808002 - protein, 9 aa, Homo Sapiens
PYLYTLWNS

SEQ ID NO: 808003 - protein, 9 aa, Homo Sapiens
PGTRKAYFR

SEQ ID NO: 808004 - protein, 9 aa, Homo Sapiens
ETDLEYVKL

SEQ ID NO: 808005 - protein, 9 aa, Homo Sapiens
KIFSKTSSN

SEQ ID NO: 808006 - protein, 9 aa, Homo Sapiens
RCGQKVDKP

SEQ ID NO: 808007 - protein, 9 aa, Homo Sapiens
FRQDITKCL

SEQ ID NO: 808008 - protein, 9 aa, Homo Sapiens
PSLELNIKD

SEQ ID NO: 808009 - protein, 9 aa, Homo Sapiens
KKYKNSESQ

SEQ ID NO: 808010 - protein, 9 aa, Homo Sapiens
TPLCCDSRA

SEQ ID NO: 808011 - protein, 9 aa, Homo Sapiens
IIMFIFCSF

SEQ ID NO: 808012 - protein, 9 aa, Homo Sapiens
VKKSVEVLN

SEQ ID NO: 808013 - protein, 9 aa, Homo Sapiens
TGHNYLRDK

SEQ ID NO: 808014 - protein, 9 aa, Homo Sapiens
EKNWQMLQL

SEQ ID NO: 808015 - protein, 9 aa, Homo Sapiens
KSGNSKLSI

SEQ ID NO: 808016 - protein, 9 aa, Homo Sapiens
DLKEKFTPE

SEQ ID NO: 808017 - protein, 9 aa, Homo Sapiens
VPVEVRPRK

SEQ ID NO: 808018 - protein, 9 aa, Homo Sapiens
NDELDKLTG

SEQ ID NO: 808019 - protein, 9 aa, Homo Sapiens
MEENNIEHI

SEQ ID NO: 808020 - protein, 9 aa, Homo Sapiens
QQILNKRKD

SEQ ID NO: 808021 - protein, 9 aa, Homo Sapiens
RKKEEHEEE

SEQ ID NO: 808022 - protein, 9 aa, Homo Sapiens
SIQMISVQP

SEQ ID NO: 808023 - protein, 9 aa, Homo Sapiens
IFMQGNNKY

SEQ ID NO: 808024 - protein, 9 aa, Homo Sapiens
VCLIMGLFN

SEQ ID NO: 808025 - protein, 9 aa, Homo Sapiens
CKGGFNFYA

SEQ ID NO: 808026 - protein, 9 aa, Homo Sapiens
LCPPIINLK

SEQ ID NO: 808027 - protein, 9 aa, Homo Sapiens
FGTGNYCGI

SEQ ID NO: 808028 - protein, 9 aa, Homo Sapiens
NSVINCFNV

SEQ ID NO: 808029 - protein, 9 aa, Homo Sapiens
YRDALLLQI

SEQ ID NO: 808030 - protein, 9 aa, Homo Sapiens
SIFGSSLSG

SEQ ID NO: 808031 - protein, 9 aa, Homo Sapiens
LSHPKEHMF

SEQ ID NO: 808032 - protein, 9 aa, Homo Sapiens
CTCWMAGIP

SEQ ID NO: 808033 - protein, 9 aa, Homo Sapiens
IHDRTILHR

SEQ ID NO: 808034 - protein, 9 aa, Homo Sapiens
ARAAQSDLA

SEQ ID NO: 808035 - protein, 9 aa, Homo Sapiens
IMNQWWRVG

SEQ ID NO: 808036 - protein, 9 aa, Homo Sapiens
RFGPDCQPV

SEQ ID NO: 808037 - protein, 9 aa, Homo Sapiens
VHVRVNNVN

SEQ ID NO: 808038 - protein, 9 aa, Homo Sapiens
PYAASNKTI

SEQ ID NO: 808039 - protein, 9 aa, Homo Sapiens
LILALPLST

SEQ ID NO: 808040 - protein, 9 aa, Homo Sapiens
FHLNHAIGG

SEQ ID NO: 808041 - protein, 9 aa, Homo Sapiens
ASVKFSEFV

SEQ ID NO: 808042 - protein, 9 aa, Homo Sapiens
KARGPRSSL

SEQ ID NO: 808043 - protein, 9 aa, Homo Sapiens
GKLKMDDDE

SEQ ID NO: 808044 - protein, 9 aa, Homo Sapiens
PVVVVVIVG

SEQ ID NO: 808045 - protein, 9 aa, Homo Sapiens
ETDDRKCLE

SEQ ID NO: 808046 - protein, 9 aa, Homo Sapiens
GRAWLCLAL

SEQ ID NO: 808047 - protein, 9 aa, Homo Sapiens
PVIQMWDLQ

SEQ ID NO: 808048 - protein, 9 aa, Homo Sapiens
VVVDGKNKS

SEQ ID NO: 808049 - protein, 9 aa, Homo Sapiens
TLIYGLLIL

SEQ ID NO: 808050 - protein, 9 aa, Homo Sapiens
KLRTLWGPE

SEQ ID NO: 808051 - protein, 9 aa, Homo Sapiens
IKNMKEIEF

SEQ ID NO: 808052 - protein, 9 aa, Homo Sapiens
FRASEHLTQ

SEQ ID NO: 808053 - protein, 9 aa, Homo Sapiens
LKHNIRNIE

SEQ ID NO: 808054 - protein, 9 aa, Homo Sapiens
DEQDELLKM

SEQ ID NO: 808055 - protein, 9 aa, Homo Sapiens
QERDHTGNK

SEQ ID NO: 808056 - protein, 9 aa, Homo Sapiens
EGKKIYLPG

SEQ ID NO: 808057 - protein, 9 aa, Homo Sapiens
KEICNAFTF

SEQ ID NO: 808058 - protein, 9 aa, Homo Sapiens
LRENNFDEF

SEQ ID NO: 808059 - protein, 9 aa, Homo Sapiens
VYFNKCPFT

SEQ ID NO: 808060 - protein, 9 aa, Homo Sapiens
ILFGGMCQP

SEQ ID NO: 808061 - protein, 9 aa, Homo Sapiens
PALLRPSIA

SEQ ID NO: 808062 - protein, 9 aa, Homo Sapiens
LHKLSLRWH

SEQ ID NO: 808063 - protein, 9 aa, Homo Sapiens
LKQNLALSR

SEQ ID NO: 808064 - protein, 9 aa, Homo Sapiens
EQRTPSYTD

SEQ ID NO: 808065 - protein, 9 aa, Homo Sapiens
PLKFRDAET

SEQ ID NO: 808066 - protein, 9 aa, Homo Sapiens
SLCCGGVLI

SEQ ID NO: 808067 - protein, 9 aa, Homo Sapiens
AEAELVGRV

SEQ ID NO: 808068 - protein, 9 aa, Homo Sapiens
NSISTSTKM

SEQ ID NO: 808069 - protein, 9 aa, Homo Sapiens
LILLRAGTG

SEQ ID NO: 808070 - protein, 9 aa, Homo Sapiens
KTDTLEHKL

SEQ ID NO: 808071 - protein, 9 aa, Homo Sapiens
DYTIFEIFN

SEQ ID NO: 808072 - protein, 9 aa, Homo Sapiens
SHRYGQYTM

SEQ ID NO: 808073 - protein, 9 aa, Homo Sapiens
QTLPQSSLS

SEQ ID NO: 808074 - protein, 9 aa, Homo Sapiens
VYSMDYFPP

SEQ ID NO: 808075 - protein, 9 aa, Homo Sapiens
EPTCRNQTR

SEQ ID NO: 808076 - protein, 9 aa, Homo Sapiens
DIPGDTYGP

SEQ ID NO: 808077 - protein, 9 aa, Homo Sapiens
MEISAPLPL

SEQ ID NO: 808078 - protein, 9 aa, Homo Sapiens
EAPISKFTC

SEQ ID NO: 808079 - protein, 9 aa, Homo Sapiens
WDEKIEELE

SEQ ID NO: 808080 - protein, 9 aa, Homo Sapiens
YSFLAPWLG

SEQ ID NO: 808081 - protein, 9 aa, Homo Sapiens
TVRKERLGM

SEQ ID NO: 808082 - protein, 9 aa, Homo Sapiens
AVNVQNILH

SEQ ID NO: 808083 - protein, 9 aa, Homo Sapiens
QLFSNSSIM

SEQ ID NO: 808084 - protein, 9 aa, Homo Sapiens
APEELSSPE

SEQ ID NO: 808085 - protein, 9 aa, Homo Sapiens
FRKIIHSHV

SEQ ID NO: 808086 - protein, 9 aa, Homo Sapiens
SPIINKTQN

SEQ ID NO: 808087 - protein, 9 aa, Homo Sapiens
DHAPGVGLV

SEQ ID NO: 808088 - protein, 9 aa, Homo Sapiens
RQPTYTDYI

SEQ ID NO: 808089 - protein, 9 aa, Homo Sapiens
LGKFDEPLY

SEQ ID NO: 808090 - protein, 9 aa, Homo Sapiens
FEGEGHINL

SEQ ID NO: 808091 - protein, 9 aa, Homo Sapiens
DILMKRLTY

SEQ ID NO: 808092 - protein, 9 aa, Homo Sapiens
YGEECIFYD

SEQ ID NO: 808093 - protein, 9 aa, Homo Sapiens
LPEASDRCL

SEQ ID NO: 808094 - protein, 9 aa, Homo Sapiens
RTWRFGVAA

SEQ ID NO: 808095 - protein, 9 aa, Homo Sapiens
PDIQLEEGA

SEQ ID NO: 808096 - protein, 9 aa, Homo Sapiens
ECLIATFQD

SEQ ID NO: 808097 - protein, 9 aa, Homo Sapiens
LAYYQAVAL

SEQ ID NO: 808098 - protein, 9 aa, Homo Sapiens
IDKETDDRK

SEQ ID NO: 808099 - protein, 9 aa, Homo Sapiens
IIKAGDTED

SEQ ID NO: 808100 - protein, 9 aa, Homo Sapiens
QCTCEEDFY

SEQ ID NO: 808101 - protein, 9 aa, Homo Sapiens
QPFWIVFLL

SEQ ID NO: 808102 - protein, 9 aa, Homo Sapiens
RESLMAALR

SEQ ID NO: 808103 - protein, 9 aa, Homo Sapiens
IDNKSMSQW

SEQ ID NO: 808104 - protein, 9 aa, Homo Sapiens
KTGQEYTPG

SEQ ID NO: 808105 - protein, 9 aa, Homo Sapiens
IVGFFQDIE

SEQ ID NO: 808106 - protein, 9 aa, Homo Sapiens
LKKKIHRFQ

SEQ ID NO: 808107 - protein, 9 aa, Homo Sapiens
VQNLFQIVS

SEQ ID NO: 808108 - protein, 9 aa, Homo Sapiens
GNGKKQYQD

SEQ ID NO: 808109 - protein, 9 aa, Homo Sapiens
ISGNFFLLK

SEQ ID NO: 808110 - protein, 9 aa, Homo Sapiens
LDGQVENLR

SEQ ID NO: 808111 - protein, 9 aa, Homo Sapiens
KIIHRLLET

SEQ ID NO: 808112 - protein, 9 aa, Homo Sapiens
RDEPVVQGP

SEQ ID NO: 808113 - protein, 9 aa, Homo Sapiens
KVETFTSDN

SEQ ID NO: 808114 - protein, 9 aa, Homo Sapiens
LTDYLMQIL

SEQ ID NO: 808115 - protein, 9 aa, Homo Sapiens
QQNLNKKER

SEQ ID NO: 808116 - protein, 9 aa, Homo Sapiens
LSYNDNCWI

SEQ ID NO: 808117 - protein, 9 aa, Homo Sapiens
AHIVHIAME

SEQ ID NO: 808118 - protein, 9 aa, Homo Sapiens
KKTITTTGI

SEQ ID NO: 808119 - protein, 9 aa, Homo Sapiens
KFASQINDI

SEQ ID NO: 808120 - protein, 9 aa, Homo Sapiens
FSFIITLLV

SEQ ID NO: 808121 - protein, 9 aa, Homo Sapiens
HELLYTFEK

SEQ ID NO: 808122 - protein, 9 aa, Homo Sapiens
DISNVQSKC

SEQ ID NO: 808123 - protein, 9 aa, Homo Sapiens
ISLAFLDTA

SEQ ID NO: 808124 - protein, 9 aa, Homo Sapiens
ECGSAVSLS

SEQ ID NO: 808125 - protein, 9 aa, Homo Sapiens
NTIIDGSQV

SEQ ID NO: 808126 - protein, 9 aa, Homo Sapiens
VIMGTYKTA

SEQ ID NO: 808127 - protein, 9 aa, Homo Sapiens
ISNSCSNNE

SEQ ID NO: 808128 - protein, 9 aa, Homo Sapiens
SHGLCSSGV

SEQ ID NO: 808129 - protein, 9 aa, Homo Sapiens
NMPAISDQD

SEQ ID NO: 808130 - protein, 9 aa, Homo Sapiens
RYSFSNAWL

SEQ ID NO: 808131 - protein, 9 aa, Homo Sapiens
FILRNANKT

SEQ ID NO: 808132 - protein, 9 aa, Homo Sapiens
AASFQINQL

SEQ ID NO: 808133 - protein, 9 aa, Homo Sapiens
AKPSLLPGR

SEQ ID NO: 808134 - protein, 9 aa, Homo Sapiens
VYKDVLYKL

SEQ ID NO: 808135 - protein, 9 aa, Homo Sapiens
SANRIFLAD

SEQ ID NO: 808136 - protein, 9 aa, Homo Sapiens
NVAKHISKT

SEQ ID NO: 808137 - protein, 9 aa, Homo Sapiens
ICDTPQKTL

SEQ ID NO: 808138 - protein, 9 aa, Homo Sapiens
GVTSHWHTK

SEQ ID NO: 808139 - protein, 9 aa, Homo Sapiens
WLLFLFMVL

SEQ ID NO: 808140 - protein, 9 aa, Homo Sapiens
EYLSADTFK

SEQ ID NO: 808141 - protein, 9 aa, Homo Sapiens
KIEQPFGLY

SEQ ID NO: 808142 - protein, 9 aa, Homo Sapiens
ETGNQAHAQ

SEQ ID NO: 808143 - protein, 9 aa, Homo Sapiens
IKTDTTGGQ

SEQ ID NO: 808144 - protein, 9 aa, Homo Sapiens
HTRMRPYTC

SEQ ID NO: 808145 - protein, 9 aa, Homo Sapiens
SDEDISDEE

SEQ ID NO: 808146 - protein, 9 aa, Homo Sapiens
HRRHNSSDG

SEQ ID NO: 808147 - protein, 9 aa, Homo Sapiens
VKLAEATIT

SEQ ID NO: 808148 - protein, 9 aa, Homo Sapiens
PGCTLVLDT

SEQ ID NO: 808149 - protein, 9 aa, Homo Sapiens
PDIVGDILW

SEQ ID NO: 808150 - protein, 9 aa, Homo Sapiens
SEKGSHMPE

SEQ ID NO: 808151 - protein, 9 aa, Homo Sapiens
GPFGMMGTF

SEQ ID NO: 808152 - protein, 9 aa, Homo Sapiens
TYSRLQTLE

SEQ ID NO: 808153 - protein, 9 aa, Homo Sapiens
LFFLYSWWL

SEQ ID NO: 808154 - protein, 9 aa, Homo Sapiens
GIRTPNATL

SEQ ID NO: 808155 - protein, 9 aa, Homo Sapiens
VLEGKQFEN

SEQ ID NO: 808156 - protein, 9 aa, Homo Sapiens
GDKYIEEAL

SEQ ID NO: 808157 - protein, 9 aa, Homo Sapiens
CRKPTTTKQ

SEQ ID NO: 808158 - protein, 9 aa, Homo Sapiens
QTKLECESA

SEQ ID NO: 808159 - protein, 9 aa, Homo Sapiens
VVEVKSWQI

SEQ ID NO: 808160 - protein, 9 aa, Homo Sapiens
LSEGIDSDN

SEQ ID NO: 808161 - protein, 9 aa, Homo Sapiens
NGSAGLSAT

SEQ ID NO: 808162 - protein, 9 aa, Homo Sapiens
CGYLMNGMK

SEQ ID NO: 808163 - protein, 9 aa, Homo Sapiens
KQAEKRQGD

SEQ ID NO: 808164 - protein, 9 aa, Homo Sapiens
KSTQATEPE

SEQ ID NO: 808165 - protein, 9 aa, Homo Sapiens
EIARRHTYF

SEQ ID NO: 808166 - protein, 9 aa, Homo Sapiens
KAFSRSLGL

SEQ ID NO: 808167 - protein, 9 aa, Homo Sapiens
KPLSYSQLD

SEQ ID NO: 808168 - protein, 9 aa, Homo Sapiens
YSWDYMSFT

SEQ ID NO: 808169 - protein, 9 aa, Homo Sapiens
WELRGHRYL

SEQ ID NO: 808170 - protein, 9 aa, Homo Sapiens
PGVTHRPPR

SEQ ID NO: 808171 - protein, 9 aa, Homo Sapiens
KHCELWLER

SEQ ID NO: 808172 - protein, 9 aa, Homo Sapiens
GIIYILFAP

SEQ ID NO: 808173 - protein, 9 aa, Homo Sapiens
VILFSALHI

SEQ ID NO: 808174 - protein, 9 aa, Homo Sapiens
LPYFGLEES

SEQ ID NO: 808175 - protein, 9 aa, Homo Sapiens
GVTRSWKSI

SEQ ID NO: 808176 - protein, 9 aa, Homo Sapiens
LISMECYNI

SEQ ID NO: 808177 - protein, 9 aa, Homo Sapiens
NLFGSIFVL

SEQ ID NO: 808178 - protein, 9 aa, Homo Sapiens
IAQPQLPPQ

SEQ ID NO: 808179 - protein, 9 aa, Homo Sapiens
ALREQARLR

SEQ ID NO: 808180 - protein, 9 aa, Homo Sapiens
KLTQTRLHR

SEQ ID NO: 808181 - protein, 9 aa, Homo Sapiens
QGFNEQQQQ

SEQ ID NO: 808182 - protein, 9 aa, Homo Sapiens
ILGFSEYPE

SEQ ID NO: 808183 - protein, 9 aa, Homo Sapiens
PPYAAVNAL

SEQ ID NO: 808184 - protein, 9 aa, Homo Sapiens
KKEKEKEPG

SEQ ID NO: 808185 - protein, 9 aa, Homo Sapiens
IVIDKAQNF

SEQ ID NO: 808186 - protein, 9 aa, Homo Sapiens
WSGNYRFDP

SEQ ID NO: 808187 - protein, 9 aa, Homo Sapiens
EYHVRISTS

SEQ ID NO: 808188 - protein, 9 aa, Homo Sapiens
VKNVLYAWC

SEQ ID NO: 808189 - protein, 9 aa, Homo Sapiens
HVDSLTEHS

SEQ ID NO: 808190 - protein, 9 aa, Homo Sapiens
FTGNAQKAV

SEQ ID NO: 808191 - protein, 9 aa, Homo Sapiens
VSHLARHQT

SEQ ID NO: 808192 - protein, 9 aa, Homo Sapiens
HLGIELMES

SEQ ID NO: 808193 - protein, 9 aa, Homo Sapiens
QFCDKSFSH

SEQ ID NO: 808194 - protein, 9 aa, Homo Sapiens
RSKDDTRVS

SEQ ID NO: 808195 - protein, 9 aa, Homo Sapiens
SAKDDVEEA

SEQ ID NO: 808196 - protein, 9 aa, Homo Sapiens
TTKLGENLQ

SEQ ID NO: 808197 - protein, 9 aa, Homo Sapiens
KGIYYIPLE

SEQ ID NO: 808198 - protein, 9 aa, Homo Sapiens
IIVIFVIAV

SEQ ID NO: 808199 - protein, 9 aa, Homo Sapiens
NVMMPPWRK

SEQ ID NO: 808200 - protein, 9 aa, Homo Sapiens
FLGPQRLSS

SEQ ID NO: 808201 - protein, 9 aa, Homo Sapiens
VKEGPVRLY

SEQ ID NO: 808202 - protein, 9 aa, Homo Sapiens
YTKLIMYSA

SEQ ID NO: 808203 - protein, 9 aa, Homo Sapiens
NTEVMLLNP

SEQ ID NO: 808204 - protein, 9 aa, Homo Sapiens
YYIIVCENS

SEQ ID NO: 808205 - protein, 9 aa, Homo Sapiens
RDGVMLDGA

SEQ ID NO: 808206 - protein, 9 aa, Homo Sapiens
AFLSVYKQV

SEQ ID NO: 808207 - protein, 9 aa, Homo Sapiens
CGPGPHRLR

SEQ ID NO: 808208 - protein, 9 aa, Homo Sapiens
RYHTGEGRR

SEQ ID NO: 808209 - protein, 9 aa, Homo Sapiens
AVLLKRLDS

SEQ ID NO: 808210 - protein, 9 aa, Homo Sapiens
LFKVIENNT

SEQ ID NO: 808211 - protein, 9 aa, Homo Sapiens
GKTCRRILF

SEQ ID NO: 808212 - protein, 9 aa, Homo Sapiens
RSACQYVYG

SEQ ID NO: 808213 - protein, 9 aa, Homo Sapiens
YFNPRSRQI

SEQ ID NO: 808214 - protein, 9 aa, Homo Sapiens
IVLTATFPT

SEQ ID NO: 808215 - protein, 9 aa, Homo Sapiens
DANGDGAID

SEQ ID NO: 808216 - protein, 9 aa, Homo Sapiens
YLINPLLYT

SEQ ID NO: 808217 - protein, 9 aa, Homo Sapiens
DPPSVPMCD

SEQ ID NO: 808218 - protein, 9 aa, Homo Sapiens
PRINSSSSS

SEQ ID NO: 808219 - protein, 9 aa, Homo Sapiens
HTQNKIAIL

SEQ ID NO: 808220 - protein, 9 aa, Homo Sapiens
GGEQDQEER

SEQ ID NO: 808221 - protein, 9 aa, Homo Sapiens
AEALYSVPH

SEQ ID NO: 808222 - protein, 9 aa, Homo Sapiens
NNYLKPVTL

SEQ ID NO: 808223 - protein, 9 aa, Homo Sapiens
ANHEQLHTA

SEQ ID NO: 808224 - protein, 9 aa, Homo Sapiens
RTINKQIWD

SEQ ID NO: 808225 - protein, 9 aa, Homo Sapiens
KRPFSTPAG

SEQ ID NO: 808226 - protein, 9 aa, Homo Sapiens
LFTRKLCGL

SEQ ID NO: 808227 - protein, 9 aa, Homo Sapiens
RYKCDVCGK

SEQ ID NO: 808228 - protein, 9 aa, Homo Sapiens
KSEFTKLSS

SEQ ID NO: 808229 - protein, 9 aa, Homo Sapiens
SRSADGANN

SEQ ID NO: 808230 - protein, 9 aa, Homo Sapiens
NVIDKELEE

SEQ ID NO: 808231 - protein, 9 aa, Homo Sapiens
LDYHNQVWG

SEQ ID NO: 808232 - protein, 9 aa, Homo Sapiens
FSPVLISGN

SEQ ID NO: 808233 - protein, 9 aa, Homo Sapiens
QELSKEERD

SEQ ID NO: 808234 - protein, 9 aa, Homo Sapiens
AACNATNQI

SEQ ID NO: 808235 - protein, 9 aa, Homo Sapiens
AAPTECFSF

SEQ ID NO: 808236 - protein, 9 aa, Homo Sapiens
GGFCYKMDT

SEQ ID NO: 808237 - protein, 9 aa, Homo Sapiens
LILHKIIHS

SEQ ID NO: 808238 - protein, 9 aa, Homo Sapiens
KFSEFVKKC

SEQ ID NO: 808239 - protein, 9 aa, Homo Sapiens
TQVQWQIIL

SEQ ID NO: 808240 - protein, 9 aa, Homo Sapiens
TDSDKLNDY

SEQ ID NO: 808241 - protein, 9 aa, Homo Sapiens
GCDLLFLLQ

SEQ ID NO: 808242 - protein, 9 aa, Homo Sapiens
GLIFAIVFS

SEQ ID NO: 808243 - protein, 9 aa, Homo Sapiens
GTKIDYILE

SEQ ID NO: 808244 - protein, 9 aa, Homo Sapiens
IMTCKTFRP

SEQ ID NO: 808245 - protein, 9 aa, Homo Sapiens
QMDNAKHME

SEQ ID NO: 808246 - protein, 9 aa, Homo Sapiens
QVPTQMSFI

SEQ ID NO: 808247 - protein, 9 aa, Homo Sapiens
FSYDAILYY

SEQ ID NO: 808248 - protein, 9 aa, Homo Sapiens
FKYYNLVVR

SEQ ID NO: 808249 - protein, 9 aa, Homo Sapiens
ALKEKVIRA

SEQ ID NO: 808250 - protein, 9 aa, Homo Sapiens
SPIVHILMV

SEQ ID NO: 808251 - protein, 9 aa, Homo Sapiens
PKLPLQSDA

SEQ ID NO: 808252 - protein, 9 aa, Homo Sapiens
VSVKHNPLP

SEQ ID NO: 808253 - protein, 9 aa, Homo Sapiens
EVLSFSRYS

SEQ ID NO: 808254 - protein, 9 aa, Homo Sapiens
EEFENIQKD

SEQ ID NO: 808255 - protein, 9 aa, Homo Sapiens
MHITQMLLQ

SEQ ID NO: 808256 - protein, 9 aa, Homo Sapiens
FQPPEPPPS

SEQ ID NO: 808257 - protein, 9 aa, Homo Sapiens
FSLIQDNEV

SEQ ID NO: 808258 - protein, 9 aa, Homo Sapiens
TMPHSLRSP

SEQ ID NO: 808259 - protein, 9 aa, Homo Sapiens
LNSRLYKWI

SEQ ID NO: 808260 - protein, 9 aa, Homo Sapiens
ERDKSSLDK

SEQ ID NO: 808261 - protein, 9 aa, Homo Sapiens
QLTWSDNGN

SEQ ID NO: 808262 - protein, 9 aa, Homo Sapiens
YNTLSELNA

SEQ ID NO: 808263 - protein, 9 aa, Homo Sapiens
IWDACAETP

SEQ ID NO: 808264 - protein, 9 aa, Homo Sapiens
PVGVQPVLN

SEQ ID NO: 808265 - protein, 9 aa, Homo Sapiens
LPLPGHRVR

SEQ ID NO: 808266 - protein, 9 aa, Homo Sapiens
PEKNKVPAP

SEQ ID NO: 808267 - protein, 9 aa, Homo Sapiens
ERYGEFLNK

SEQ ID NO: 808268 - protein, 9 aa, Homo Sapiens
RQEANARKR

SEQ ID NO: 808269 - protein, 9 aa, Homo Sapiens
MPNILLALT

SEQ ID NO: 808270 - protein, 9 aa, Homo Sapiens
LFERLRSAT

SEQ ID NO: 808271 - protein, 9 aa, Homo Sapiens
DLRQQLCEI

SEQ ID NO: 808272 - protein, 9 aa, Homo Sapiens
KISFALTFR

SEQ ID NO: 808273 - protein, 9 aa, Homo Sapiens
AEDIKAIDG

SEQ ID NO: 808274 - protein, 9 aa, Homo Sapiens
LRHPKFIQL

SEQ ID NO: 808275 - protein, 9 aa, Homo Sapiens
CEAIQNEMN

SEQ ID NO: 808276 - protein, 9 aa, Homo Sapiens
IICLPQTKG

SEQ ID NO: 808277 - protein, 9 aa, Homo Sapiens
CGLEANNLG

SEQ ID NO: 808278 - protein, 8 aa, Homo Sapiens
HSLKKVTF

SEQ ID NO: 808279 - protein, 9 aa, Homo Sapiens
ATDYNDNCS

SEQ ID NO: 808280 - protein, 9 aa, Homo Sapiens
NKINISKNE

SEQ ID NO: 808281 - protein, 9 aa, Homo Sapiens
IRARFGGWT

SEQ ID NO: 808282 - protein, 9 aa, Homo Sapiens
GACLGPQIQ

SEQ ID NO: 808283 - protein, 9 aa, Homo Sapiens
DISELKAER

SEQ ID NO: 808284 - protein, 9 aa, Homo Sapiens
TDTGQLHSE

SEQ ID NO: 808285 - protein, 9 aa, Homo Sapiens
QLEQFWTLL

SEQ ID NO: 808286 - protein, 9 aa, Homo Sapiens
TPEFEECNG

SEQ ID NO: 808287 - protein, 9 aa, Homo Sapiens
ALLLGGGSG

SEQ ID NO: 808288 - protein, 9 aa, Homo Sapiens
KDKLGENVA

SEQ ID NO: 808289 - protein, 9 aa, Homo Sapiens
GYAVISFGC

SEQ ID NO: 808290 - protein, 9 aa, Homo Sapiens
DVEAAKRAD

SEQ ID NO: 808291 - protein, 9 aa, Homo Sapiens
HAHMASQPV

SEQ ID NO: 808292 - protein, 9 aa, Homo Sapiens
KAQITGPGI

SEQ ID NO: 808293 - protein, 9 aa, Homo Sapiens
TDSNLQNII

SEQ ID NO: 808294 - protein, 9 aa, Homo Sapiens
QKLELSDNI

SEQ ID NO: 808295 - protein, 9 aa, Homo Sapiens
IRENYYRCE

SEQ ID NO: 808296 - protein, 9 aa, Homo Sapiens
GVQFSWNVW

SEQ ID NO: 808297 - protein, 9 aa, Homo Sapiens
MQLSAHQNT

SEQ ID NO: 808298 - protein, 9 aa, Homo Sapiens
PEYFVRSIT

SEQ ID NO: 808299 - protein, 9 aa, Homo Sapiens
VAEAKNKLS

SEQ ID NO: 808300 - protein, 9 aa, Homo Sapiens
VRDLADVDC

SEQ ID NO: 808301 - protein, 9 aa, Homo Sapiens
HNPFAKGFW

SEQ ID NO: 808302 - protein, 9 aa, Homo Sapiens
EQTSYGTFQ

SEQ ID NO: 808303 - protein, 9 aa, Homo Sapiens
AAARLRFPG

SEQ ID NO: 808304 - protein, 9 aa, Homo Sapiens
LKVIIFFDP

SEQ ID NO: 808305 - protein, 9 aa, Homo Sapiens
CLKLIRLDL

SEQ ID NO: 808306 - protein, 9 aa, Homo Sapiens
KKKKKKIKH

SEQ ID NO: 808307 - protein, 9 aa, Homo Sapiens
DIEHLESFT

SEQ ID NO: 808308 - protein, 9 aa, Homo Sapiens
DRKGQSPKS

SEQ ID NO: 808309 - protein, 9 aa, Homo Sapiens
RNVCRVPGS

SEQ ID NO: 808310 - protein, 9 aa, Homo Sapiens
APTRAGALL

SEQ ID NO: 808311 - protein, 9 aa, Homo Sapiens
GFGDLSGLH

SEQ ID NO: 808312 - protein, 9 aa, Homo Sapiens
IKENPFFQK

SEQ ID NO: 808313 - protein, 9 aa, Homo Sapiens
WQDLYAWTD

SEQ ID NO: 808314 - protein, 9 aa, Homo Sapiens
QKQHALYLD

SEQ ID NO: 808315 - protein, 9 aa, Homo Sapiens
VDFHMKGKE

SEQ ID NO: 808316 - protein, 9 aa, Homo Sapiens
NGDGTALFE

SEQ ID NO: 808317 - protein, 9 aa, Homo Sapiens
YGSCIFLLL

SEQ ID NO: 808318 - protein, 9 aa, Homo Sapiens
KLPLQSDAP

SEQ ID NO: 808319 - protein, 9 aa, Homo Sapiens
DPYGNNKFS

SEQ ID NO: 808320 - protein, 9 aa, Homo Sapiens
HDYDPLQFQ

SEQ ID NO: 808321 - protein, 9 aa, Homo Sapiens
QKPGTDEAE

SEQ ID NO: 808322 - protein, 9 aa, Homo Sapiens
RALLGTLCE

SEQ ID NO: 808323 - protein, 9 aa, Homo Sapiens
FYWPKMLKC

SEQ ID NO: 808324 - protein, 9 aa, Homo Sapiens
PNRTTSFPC

SEQ ID NO: 808325 - protein, 9 aa, Homo Sapiens
FCSYLSQPR

SEQ ID NO: 808326 - protein, 9 aa, Homo Sapiens
LEEKNKILQ

SEQ ID NO: 808327 - protein, 9 aa, Homo Sapiens
KLPSGFPIE

SEQ ID NO: 808328 - protein, 9 aa, Homo Sapiens
KYFEIEFSP

SEQ ID NO: 808329 - protein, 9 aa, Homo Sapiens
DNSSPNSLD

SEQ ID NO: 808330 - protein, 9 aa, Homo Sapiens
LLLKKLVKD

SEQ ID NO: 808331 - protein, 9 aa, Homo Sapiens
DQVPDLKDL

SEQ ID NO: 808332 - protein, 9 aa, Homo Sapiens
AKYHLKQIK

SEQ ID NO: 808333 - protein, 9 aa, Homo Sapiens
TKMNILKFM

SEQ ID NO: 808334 - protein, 9 aa, Homo Sapiens
RHELTHKTM

SEQ ID NO: 808335 - protein, 9 aa, Homo Sapiens
IQHFNGKYM

SEQ ID NO: 808336 - protein, 9 aa, Homo Sapiens
GTTGRFMGH

SEQ ID NO: 808337 - protein, 9 aa, Homo Sapiens
PGLPGPLGP

SEQ ID NO: 808338 - protein, 9 aa, Homo Sapiens
LEVRHFSKI

SEQ ID NO: 808339 - protein, 9 aa, Homo Sapiens
LAIQDLKRT

SEQ ID NO: 808340 - protein, 9 aa, Homo Sapiens
LRDCMDPTM

SEQ ID NO: 808341 - protein, 9 aa, Homo Sapiens
RLAPGHFDY

SEQ ID NO: 808342 - protein, 9 aa, Homo Sapiens
QTRTEVVAG

SEQ ID NO: 808343 - protein, 9 aa, Homo Sapiens
VPRVPSHLS

SEQ ID NO: 808344 - protein, 9 aa, Homo Sapiens
FKDLRFQEE

SEQ ID NO: 808345 - protein, 9 aa, Homo Sapiens
GVHVHTCHH

SEQ ID NO: 808346 - protein, 9 aa, Homo Sapiens
YTYATVLTF

SEQ ID NO: 808347 - protein, 9 aa, Homo Sapiens
LNSAGNKFT

SEQ ID NO: 808348 - protein, 9 aa, Homo Sapiens
QPFECNECG

SEQ ID NO: 808349 - protein, 9 aa, Homo Sapiens
LRRENNLEE

SEQ ID NO: 808350 - protein, 9 aa, Homo Sapiens
HLASVVIYT

SEQ ID NO: 808351 - protein, 9 aa, Homo Sapiens
PVTSIPFSV

SEQ ID NO: 808352 - protein, 9 aa, Homo Sapiens
KSAVYFLLP

SEQ ID NO: 808353 - protein, 9 aa, Homo Sapiens
AGWHRITII

SEQ ID NO: 808354 - protein, 9 aa, Homo Sapiens
KAESRNSNF

SEQ ID NO: 808355 - protein, 9 aa, Homo Sapiens
QIEIIDQLF

SEQ ID NO: 808356 - protein, 9 aa, Homo Sapiens
LLYEEPFPA

SEQ ID NO: 808357 - protein, 9 aa, Homo Sapiens
PNKATPCLE

SEQ ID NO: 808358 - protein, 9 aa, Homo Sapiens
GSGSESGPS

SEQ ID NO: 808359 - protein, 9 aa, Homo Sapiens
FTFKHECKI

SEQ ID NO: 808360 - protein, 9 aa, Homo Sapiens
NKQCVGETQ

SEQ ID NO: 808361 - protein, 9 aa, Homo Sapiens
MIDRIKYNV

SEQ ID NO: 808362 - protein, 9 aa, Homo Sapiens
KLLAYTNSA

SEQ ID NO: 808363 - protein, 9 aa, Homo Sapiens
IVCTFKMAS

SEQ ID NO: 808364 - protein, 9 aa, Homo Sapiens
KKSKQKMNA

SEQ ID NO: 808365 - protein, 9 aa, Homo Sapiens
AIKIQMASF

SEQ ID NO: 808366 - protein, 9 aa, Homo Sapiens
LKRNPRSYN

SEQ ID NO: 808367 - protein, 9 aa, Homo Sapiens
GTPDSIDIW

SEQ ID NO: 808368 - protein, 9 aa, Homo Sapiens
YNRYQKEMK

SEQ ID NO: 808369 - protein, 9 aa, Homo Sapiens
TFWNKPSSS

SEQ ID NO: 808370 - protein, 9 aa, Homo Sapiens
TYNNLSDKT

SEQ ID NO: 808371 - protein, 9 aa, Homo Sapiens
AFGRGNRGV

SEQ ID NO: 808372 - protein, 9 aa, Homo Sapiens
SCVISNHPK

SEQ ID NO: 808373 - protein, 9 aa, Homo Sapiens
LRTESINER

SEQ ID NO: 808374 - protein, 9 aa, Homo Sapiens
LQLLDAVKT

SEQ ID NO: 808375 - protein, 9 aa, Homo Sapiens
SCSENTSSR

SEQ ID NO: 808376 - protein, 9 aa, Homo Sapiens
NGGAHREKK

SEQ ID NO: 808377 - protein, 9 aa, Homo Sapiens
GNYWLEMFD

SEQ ID NO: 808378 - protein, 9 aa, Homo Sapiens
ERYSSSEPP

SEQ ID NO: 808379 - protein, 9 aa, Homo Sapiens
MLLQPIRKE

SEQ ID NO: 808380 - protein, 9 aa, Homo Sapiens
KLTFVQSFD

SEQ ID NO: 808381 - protein, 9 aa, Homo Sapiens
TNVVMGHQQ

SEQ ID NO: 808382 - protein, 9 aa, Homo Sapiens
SNNSSLDAP

SEQ ID NO: 808383 - protein, 9 aa, Homo Sapiens
PGHRVREIT

SEQ ID NO: 808384 - protein, 9 aa, Homo Sapiens
SSFCSVRAI

SEQ ID NO: 808385 - protein, 9 aa, Homo Sapiens
KEKITFQEE

SEQ ID NO: 808386 - protein, 9 aa, Homo Sapiens
NYYLKYTKY

SEQ ID NO: 808387 - protein, 9 aa, Homo Sapiens
NHWFVLSVY

SEQ ID NO: 808388 - protein, 9 aa, Homo Sapiens
QEKRRSADI

SEQ ID NO: 808389 - protein, 9 aa, Homo Sapiens
RTITFHLDL

SEQ ID NO: 808390 - protein, 9 aa, Homo Sapiens
KLPLQFQRL

SEQ ID NO: 808391 - protein, 9 aa, Homo Sapiens
VRPAPSLGA

SEQ ID NO: 808392 - protein, 9 aa, Homo Sapiens
LGRVDNLFR

SEQ ID NO: 808393 - protein, 9 aa, Homo Sapiens
FQGSVMAYQ

SEQ ID NO: 808394 - protein, 9 aa, Homo Sapiens
DIQNQLRRN

SEQ ID NO: 808395 - protein, 9 aa, Homo Sapiens
HHPNPPPDN

SEQ ID NO: 808396 - protein, 9 aa, Homo Sapiens
PATSTRITL

SEQ ID NO: 808397 - protein, 9 aa, Homo Sapiens
IRIKDGNGR

SEQ ID NO: 808398 - protein, 9 aa, Homo Sapiens
DPYYYKKIN

SEQ ID NO: 808399 - protein, 9 aa, Homo Sapiens
QNENVVPNN

SEQ ID NO: 808400 - protein, 9 aa, Homo Sapiens
SYIKAFFEQ

SEQ ID NO: 808401 - protein, 9 aa, Homo Sapiens
SEEVWKVNC

SEQ ID NO: 808402 - protein, 9 aa, Homo Sapiens
NIAAIDSLN

SEQ ID NO: 808403 - protein, 9 aa, Homo Sapiens
SSSLTVHQI

SEQ ID NO: 808404 - protein, 9 aa, Homo Sapiens
FTEAIDESK

SEQ ID NO: 808405 - protein, 9 aa, Homo Sapiens
LNKHFPLEE

SEQ ID NO: 808406 - protein, 9 aa, Homo Sapiens
KEIKRLTGL

SEQ ID NO: 808407 - protein, 9 aa, Homo Sapiens
EIRVKYLKI

SEQ ID NO: 808408 - protein, 9 aa, Homo Sapiens
MVQDVSFKY

SEQ ID NO: 808409 - protein, 9 aa, Homo Sapiens
LTKTEEHIL

SEQ ID NO: 808410 - protein, 9 aa, Homo Sapiens
KGLQEQQEH

SEQ ID NO: 808411 - protein, 9 aa, Homo Sapiens
VILFGESAG

SEQ ID NO: 808412 - protein, 9 aa, Homo Sapiens
DSLISLEEE

SEQ ID NO: 808413 - protein, 9 aa, Homo Sapiens
LRRAAFSED

SEQ ID NO: 808414 - protein, 9 aa, Homo Sapiens
ENLTELSTF

SEQ ID NO: 808415 - protein, 9 aa, Homo Sapiens
DLKSGLEDC

SEQ ID NO: 808416 - protein, 9 aa, Homo Sapiens
VWATVRGPC

SEQ ID NO: 808417 - protein, 9 aa, Homo Sapiens
VLLLPLIDS

SEQ ID NO: 808418 - protein, 9 aa, Homo Sapiens
RVLFQNVQG

SEQ ID NO: 808419 - protein, 9 aa, Homo Sapiens
QQNTIKYMT

SEQ ID NO: 808420 - protein, 9 aa, Homo Sapiens
GSHNMTLQW

SEQ ID NO: 808421 - protein, 9 aa, Homo Sapiens
VGRFAPQLS

SEQ ID NO: 808422 - protein, 9 aa, Homo Sapiens
GLSVEKPYR

SEQ ID NO: 808423 - protein, 9 aa, Homo Sapiens
SNTHEIESI

SEQ ID NO: 808424 - protein, 9 aa, Homo Sapiens
LDVPNIIIT

SEQ ID NO: 808425 - protein, 9 aa, Homo Sapiens
NQLLGTFGS

SEQ ID NO: 808426 - protein, 9 aa, Homo Sapiens
LTRQNKLQA

SEQ ID NO: 808427 - protein, 9 aa, Homo Sapiens
GIIAPFMLF

SEQ ID NO: 808428 - protein, 9 aa, Homo Sapiens
DFAAHCGMI

SEQ ID NO: 808429 - protein, 9 aa, Homo Sapiens
KNSITRNLS

SEQ ID NO: 808430 - protein, 9 aa, Homo Sapiens
LGRCVIYKK

SEQ ID NO: 808431 - protein, 9 aa, Homo Sapiens
RARATLRER

SEQ ID NO: 808432 - protein, 9 aa, Homo Sapiens
GKDCAIFFC

SEQ ID NO: 808433 - protein, 9 aa, Homo Sapiens
KGVTSHWHT

SEQ ID NO: 808434 - protein, 9 aa, Homo Sapiens
HISQFFRPH

SEQ ID NO: 808435 - protein, 9 aa, Homo Sapiens
MPSNSFPYN

SEQ ID NO: 808436 - protein, 9 aa, Homo Sapiens
WCGIYNASK

SEQ ID NO: 808437 - protein, 9 aa, Homo Sapiens
KMASDYLMK

SEQ ID NO: 808438 - protein, 9 aa, Homo Sapiens
LSEVRGVEF

SEQ ID NO: 808439 - protein, 9 aa, Homo Sapiens
RTPLRAAAY

SEQ ID NO: 808440 - protein, 9 aa, Homo Sapiens
ADIIKVGSG

SEQ ID NO: 808441 - protein, 9 aa, Homo Sapiens
NELIGRYIK

SEQ ID NO: 808442 - protein, 9 aa, Homo Sapiens
PGEKLWDHT

SEQ ID NO: 808443 - protein, 9 aa, Homo Sapiens
QLTAEDIKA

SEQ ID NO: 808444 - protein, 9 aa, Homo Sapiens
TVAEEKSIK

SEQ ID NO: 808445 - protein, 9 aa, Homo Sapiens
NDLKITGEC

SEQ ID NO: 808446 - protein, 9 aa, Homo Sapiens
VLLKRLDSE

SEQ ID NO: 808447 - protein, 9 aa, Homo Sapiens
NFSCNKFPA

SEQ ID NO: 808448 - protein, 9 aa, Homo Sapiens
VSGNAQNGV

SEQ ID NO: 808449 - protein, 9 aa, Homo Sapiens
PQYSLEEEA

SEQ ID NO: 808450 - protein, 9 aa, Homo Sapiens
DKKKKGKKL

SEQ ID NO: 808451 - protein, 9 aa, Homo Sapiens
GEVLPGAKY

SEQ ID NO: 808452 - protein, 9 aa, Homo Sapiens
FITRSWLQD

SEQ ID NO: 808453 - protein, 9 aa, Homo Sapiens
CEVKASEQA

SEQ ID NO: 808454 - protein, 9 aa, Homo Sapiens
SRRARRDHS

SEQ ID NO: 808455 - protein, 9 aa, Homo Sapiens
LICNKSFLA

SEQ ID NO: 808456 - protein, 9 aa, Homo Sapiens
LECPLILYI

SEQ ID NO: 808457 - protein, 9 aa, Homo Sapiens
SYALFVRDN

SEQ ID NO: 808458 - protein, 9 aa, Homo Sapiens
LRIKGDYVL

SEQ ID NO: 808459 - protein, 9 aa, Homo Sapiens
CTTNEHTYS

SEQ ID NO: 808460 - protein, 9 aa, Homo Sapiens
GYPYRDLDF

SEQ ID NO: 808461 - protein, 9 aa, Homo Sapiens
GPPLQAQSP

SEQ ID NO: 808462 - protein, 9 aa, Homo Sapiens
VERKQKENS

SEQ ID NO: 808463 - protein, 9 aa, Homo Sapiens
VSPKLPSGF

SEQ ID NO: 808464 - protein, 9 aa, Homo Sapiens
KSYHLKAHR

SEQ ID NO: 808465 - protein, 9 aa, Homo Sapiens
GGDKLANGS

SEQ ID NO: 808466 - protein, 9 aa, Homo Sapiens
GIQDRVLYI

SEQ ID NO: 808467 - protein, 9 aa, Homo Sapiens
GDVKNVLYA

SEQ ID NO: 808468 - protein, 9 aa, Homo Sapiens
SYDKTKDNV

SEQ ID NO: 808469 - protein, 9 aa, Homo Sapiens
KPEIHGAPV

SEQ ID NO: 808470 - protein, 9 aa, Homo Sapiens
LANPKELYH

SEQ ID NO: 808471 - protein, 9 aa, Homo Sapiens
LGLDCAGNT

SEQ ID NO: 808472 - protein, 9 aa, Homo Sapiens
RLFEEFYED

SEQ ID NO: 808473 - protein, 9 aa, Homo Sapiens
QDLAPSCTG

SEQ ID NO: 808474 - protein, 9 aa, Homo Sapiens
IQNLKVLFV

SEQ ID NO: 808475 - protein, 9 aa, Homo Sapiens
YISPNNTVI

SEQ ID NO: 808476 - protein, 9 aa, Homo Sapiens
PLIYTLINE

SEQ ID NO: 808477 - protein, 9 aa, Homo Sapiens
INCFNVEED

SEQ ID NO: 808478 - protein, 9 aa, Homo Sapiens
NTVQQARSP

SEQ ID NO: 808479 - protein, 9 aa, Homo Sapiens
INLITRQIY

SEQ ID NO: 808480 - protein, 9 aa, Homo Sapiens
GDKLEIARE

SEQ ID NO: 808481 - protein, 9 aa, Homo Sapiens
DVSFKYTKD

SEQ ID NO: 808482 - protein, 9 aa, Homo Sapiens
IIVFLFACS

SEQ ID NO: 808483 - protein, 9 aa, Homo Sapiens
DFREIIIAI

SEQ ID NO: 808484 - protein, 9 aa, Homo Sapiens
PLTYPTKCT

SEQ ID NO: 808485 - protein, 9 aa, Homo Sapiens
FLPGLEEDK

SEQ ID NO: 808486 - protein, 9 aa, Homo Sapiens
DDDVETNWI

SEQ ID NO: 808487 - protein, 9 aa, Homo Sapiens
LLTSYSWDY

SEQ ID NO: 808488 - protein, 9 aa, Homo Sapiens
LGSPSDDEG

SEQ ID NO: 808489 - protein, 9 aa, Homo Sapiens
LWPWWYVLL

SEQ ID NO: 808490 - protein, 9 aa, Homo Sapiens
HITIEPLYQ

SEQ ID NO: 808491 - protein, 9 aa, Homo Sapiens
PCIFPSIYI

SEQ ID NO: 808492 - protein, 9 aa, Homo Sapiens
INIIYRDRN

SEQ ID NO: 808493 - protein, 9 aa, Homo Sapiens
AAECMILGT

SEQ ID NO: 808494 - protein, 9 aa, Homo Sapiens
VHKITHTGE

SEQ ID NO: 808495 - protein, 9 aa, Homo Sapiens
TNDDIFSIL

SEQ ID NO: 808496 - protein, 9 aa, Homo Sapiens
LIQAARGYV

SEQ ID NO: 808497 - protein, 9 aa, Homo Sapiens
NQLEPDPSL

SEQ ID NO: 808498 - protein, 9 aa, Homo Sapiens
HRPHKGPGG

SEQ ID NO: 808499 - protein, 9 aa, Homo Sapiens
EKGKEIFAF

SEQ ID NO: 808500 - protein, 9 aa, Homo Sapiens
IGKQNGNIT

SEQ ID NO: 808501 - protein, 9 aa, Homo Sapiens
KAAMAGVKL

SEQ ID NO: 808502 - protein, 9 aa, Homo Sapiens
YYRCEECGK

SEQ ID NO: 808503 - protein, 9 aa, Homo Sapiens
ALVILAIIT

SEQ ID NO: 808504 - protein, 9 aa, Homo Sapiens
ADTGANVIV

SEQ ID NO: 808505 - protein, 9 aa, Homo Sapiens
FIPTLFGPQ

SEQ ID NO: 808506 - protein, 9 aa, Homo Sapiens
LGSSTPMSS

SEQ ID NO: 808507 - protein, 9 aa, Homo Sapiens
LKTTRIRDI

SEQ ID NO: 808508 - protein, 9 aa, Homo Sapiens
RRVRKTDTN

SEQ ID NO: 808509 - protein, 9 aa, Homo Sapiens
MWLLWCVLL

SEQ ID NO: 808510 - protein, 9 aa, Homo Sapiens
QLLLDLSCE

SEQ ID NO: 808511 - protein, 9 aa, Homo Sapiens
FSQRTYRIW

SEQ ID NO: 808512 - protein, 9 aa, Homo Sapiens
DLLGRQQRK

SEQ ID NO: 808513 - protein, 9 aa, Homo Sapiens
KNGRMVNLG

SEQ ID NO: 808514 - protein, 9 aa, Homo Sapiens
ELLSEFSPQ

SEQ ID NO: 808515 - protein, 9 aa, Homo Sapiens
AQYTFQNGE

SEQ ID NO: 808516 - protein, 9 aa, Homo Sapiens
LNFMEKRIE

SEQ ID NO: 808517 - protein, 9 aa, Homo Sapiens
DAETLWKAM

SEQ ID NO: 808518 - protein, 9 aa, Homo Sapiens
PSIPENLEY

SEQ ID NO: 808519 - protein, 9 aa, Homo Sapiens
DGAIDFREF

SEQ ID NO: 808520 - protein, 9 aa, Homo Sapiens
IIVALMAGK

SEQ ID NO: 808521 - protein, 9 aa, Homo Sapiens
KTKWIIGVC

SEQ ID NO: 808522 - protein, 9 aa, Homo Sapiens
KYFDFSLFK

SEQ ID NO: 808523 - protein, 9 aa, Homo Sapiens
NITVHLVGL

SEQ ID NO: 808524 - protein, 9 aa, Homo Sapiens
QKPSPHPVT

SEQ ID NO: 808525 - protein, 9 aa, Homo Sapiens
ESDTNGDGE

SEQ ID NO: 808526 - protein, 9 aa, Homo Sapiens
MAKEDPVCT

SEQ ID NO: 808527 - protein, 9 aa, Homo Sapiens
REYFPKKLL

SEQ ID NO: 808528 - protein, 9 aa, Homo Sapiens
LGPTVVSHH

SEQ ID NO: 808529 - protein, 9 aa, Homo Sapiens
RWTTYRGPD

SEQ ID NO: 808530 - protein, 9 aa, Homo Sapiens
VTLAILLCV

SEQ ID NO: 808531 - protein, 9 aa, Homo Sapiens
TSYIKIKEE

SEQ ID NO: 808532 - protein, 9 aa, Homo Sapiens
EGTEAVNKS

SEQ ID NO: 808533 - protein, 9 aa, Homo Sapiens
ALLFGRQFD

SEQ ID NO: 808534 - protein, 9 aa, Homo Sapiens
NRRDVCSCK

SEQ ID NO: 808535 - protein, 9 aa, Homo Sapiens
KVLQKLQNE

SEQ ID NO: 808536 - protein, 9 aa, Homo Sapiens
YQFMLADRD

SEQ ID NO: 808537 - protein, 9 aa, Homo Sapiens
FKNKSSGSE

SEQ ID NO: 808538 - protein, 9 aa, Homo Sapiens
RQSSDLQHS

SEQ ID NO: 808539 - protein, 9 aa, Homo Sapiens
RINDEELET

SEQ ID NO: 808540 - protein, 9 aa, Homo Sapiens
SRILFTVAF

SEQ ID NO: 808541 - protein, 9 aa, Homo Sapiens
PSKAFVNCA

SEQ ID NO: 808542 - protein, 9 aa, Homo Sapiens
TEVAYGPEG

SEQ ID NO: 808543 - protein, 9 aa, Homo Sapiens
DYSGRSSSE

SEQ ID NO: 808544 - protein, 9 aa, Homo Sapiens
QQIKKAEES

SEQ ID NO: 808545 - protein, 9 aa, Homo Sapiens
DQTRGLLEP

SEQ ID NO: 808546 - protein, 9 aa, Homo Sapiens
RSIRQGFCF

SEQ ID NO: 808547 - protein, 9 aa, Homo Sapiens
LSNVKYFYR

SEQ ID NO: 808548 - protein, 9 aa, Homo Sapiens
YMRLEDESF

SEQ ID NO: 808549 - protein, 9 aa, Homo Sapiens
DADLDAFLT

SEQ ID NO: 808550 - protein, 9 aa, Homo Sapiens
QVLHQVTPE

SEQ ID NO: 808551 - protein, 9 aa, Homo Sapiens
DAGTYTCEM

SEQ ID NO: 808552 - protein, 9 aa, Homo Sapiens
KLPKANMPV

SEQ ID NO: 808553 - protein, 9 aa, Homo Sapiens
TLITFIERE

SEQ ID NO: 808554 - protein, 9 aa, Homo Sapiens
LQQPDDRIP

SEQ ID NO: 808555 - protein, 9 aa, Homo Sapiens
SHDTSTNGL

SEQ ID NO: 808556 - protein, 9 aa, Homo Sapiens
NHDTGECWL

SEQ ID NO: 808557 - protein, 9 aa, Homo Sapiens
KEIARAEEH

SEQ ID NO: 808558 - protein, 9 aa, Homo Sapiens
VPAWGLVAT

SEQ ID NO: 808559 - protein, 9 aa, Homo Sapiens
WSPALTVSQ

SEQ ID NO: 808560 - protein, 9 aa, Homo Sapiens
PQSIKLMDV

SEQ ID NO: 808561 - protein, 9 aa, Homo Sapiens
KPLPDRPTK

SEQ ID NO: 808562 - protein, 9 aa, Homo Sapiens
SRLPEHEMN

SEQ ID NO: 808563 - protein, 9 aa, Homo Sapiens
DNLYAETAV

SEQ ID NO: 808564 - protein, 9 aa, Homo Sapiens
VITVGGAHE

SEQ ID NO: 808565 - protein, 9 aa, Homo Sapiens
YQFQLFQEA

SEQ ID NO: 808566 - protein, 9 aa, Homo Sapiens
ASPRLRHVG

SEQ ID NO: 808567 - protein, 9 aa, Homo Sapiens
TLLDPRFKN

SEQ ID NO: 808568 - protein, 9 aa, Homo Sapiens
VAKHISKTN

SEQ ID NO: 808569 - protein, 9 aa, Homo Sapiens
VSSKSRTAE

SEQ ID NO: 808570 - protein, 9 aa, Homo Sapiens
IKDGPKRSV

SEQ ID NO: 808571 - protein, 9 aa, Homo Sapiens
EQAADEISL

SEQ ID NO: 808572 - protein, 9 aa, Homo Sapiens
LAALQCEEI

SEQ ID NO: 808573 - protein, 9 aa, Homo Sapiens
FPIDELSFK

SEQ ID NO: 808574 - protein, 9 aa, Homo Sapiens
MDTHVKTKH

SEQ ID NO: 808575 - protein, 9 aa, Homo Sapiens
IKVLFIKKT

SEQ ID NO: 808576 - protein, 9 aa, Homo Sapiens
FNKCPFTVK

SEQ ID NO: 808577 - protein, 9 aa, Homo Sapiens
ELAHCPSPT

SEQ ID NO: 808578 - protein, 9 aa, Homo Sapiens
VDGAATEPE

SEQ ID NO: 808579 - protein, 9 aa, Homo Sapiens
HLVGLLSGL

SEQ ID NO: 808580 - protein, 9 aa, Homo Sapiens
WSTGDCGNG

SEQ ID NO: 808581 - protein, 9 aa, Homo Sapiens
TTEVTSKVE

SEQ ID NO: 808582 - protein, 9 aa, Homo Sapiens
YRESDLDQI

SEQ ID NO: 808583 - protein, 9 aa, Homo Sapiens
FLWPWWYVL

SEQ ID NO: 808584 - protein, 9 aa, Homo Sapiens
VDKEEEIQY

SEQ ID NO: 808585 - protein, 9 aa, Homo Sapiens
EQVQHSETY

SEQ ID NO: 808586 - protein, 9 aa, Homo Sapiens
PDERRRKFM

SEQ ID NO: 808587 - protein, 9 aa, Homo Sapiens
RSPRGVLRY

SEQ ID NO: 808588 - protein, 9 aa, Homo Sapiens
VQDKQGTSR

SEQ ID NO: 808589 - protein, 9 aa, Homo Sapiens
LEVPVPAEE

SEQ ID NO: 808590 - protein, 9 aa, Homo Sapiens
QAVALDECA

SEQ ID NO: 808591 - protein, 9 aa, Homo Sapiens
PIANTTNGR

SEQ ID NO: 808592 - protein, 9 aa, Homo Sapiens
DVETNWIVD

SEQ ID NO: 808593 - protein, 9 aa, Homo Sapiens
VVAGAFSRC

SEQ ID NO: 808594 - protein, 9 aa, Homo Sapiens
EGVHGSAKL

SEQ ID NO: 808595 - protein, 9 aa, Homo Sapiens
SDLQVEVQK

SEQ ID NO: 808596 - protein, 9 aa, Homo Sapiens
TTTKQTTSL

SEQ ID NO: 808597 - protein, 9 aa, Homo Sapiens
GKTKSIVEL

SEQ ID NO: 808598 - protein, 9 aa, Homo Sapiens
PGRLGPWRV

SEQ ID NO: 808599 - protein, 9 aa, Homo Sapiens
CNFAEKVFA

SEQ ID NO: 808600 - protein, 9 aa, Homo Sapiens
GKRSVEYHY

SEQ ID NO: 808601 - protein, 9 aa, Homo Sapiens
YTEIPSPFS

SEQ ID NO: 808602 - protein, 9 aa, Homo Sapiens
KGLSCAHTQ

SEQ ID NO: 808603 - protein, 9 aa, Homo Sapiens
GKPTAPSKL

SEQ ID NO: 808604 - protein, 9 aa, Homo Sapiens
YFPRIGDKN

SEQ ID NO: 808605 - protein, 9 aa, Homo Sapiens
ASPQPLLQD

SEQ ID NO: 808606 - protein, 9 aa, Homo Sapiens
YFGGVGSQM

SEQ ID NO: 808607 - protein, 9 aa, Homo Sapiens
NIQFSGMNI

SEQ ID NO: 808608 - protein, 9 aa, Homo Sapiens
RVAASYALG

SEQ ID NO: 808609 - protein, 9 aa, Homo Sapiens
IVYYTGWRN

SEQ ID NO: 808610 - protein, 9 aa, Homo Sapiens
VTSDSELEP

SEQ ID NO: 808611 - protein, 9 aa, Homo Sapiens
IKHCKVKKK

SEQ ID NO: 808612 - protein, 9 aa, Homo Sapiens
KNFPLKTKG

SEQ ID NO: 808613 - protein, 9 aa, Homo Sapiens
LLRGDNSRK

SEQ ID NO: 808614 - protein, 9 aa, Homo Sapiens
RFQDTVLQH

SEQ ID NO: 808615 - protein, 9 aa, Homo Sapiens
PVHQRRSVF

SEQ ID NO: 808616 - protein, 9 aa, Homo Sapiens
RWLHSMTDY

SEQ ID NO: 808617 - protein, 9 aa, Homo Sapiens
QSRVKCGRD

SEQ ID NO: 808618 - protein, 9 aa, Homo Sapiens
NDVVRGRII

SEQ ID NO: 808619 - protein, 9 aa, Homo Sapiens
IYVLLCRQA

SEQ ID NO: 808620 - protein, 9 aa, Homo Sapiens
NGEGGACSV

SEQ ID NO: 808621 - protein, 9 aa, Homo Sapiens
LNRKCKKEE

SEQ ID NO: 808622 - protein, 9 aa, Homo Sapiens
CQEQKAKLD

SEQ ID NO: 808623 - protein, 9 aa, Homo Sapiens
KDFGQKRAT

SEQ ID NO: 808624 - protein, 9 aa, Homo Sapiens
YEDGIFFYY

SEQ ID NO: 808625 - protein, 9 aa, Homo Sapiens
HTIYECLTV

SEQ ID NO: 808626 - protein, 9 aa, Homo Sapiens
GQLIIRPSN

SEQ ID NO: 808627 - protein, 9 aa, Homo Sapiens
VFWAKYTTC

SEQ ID NO: 808628 - protein, 9 aa, Homo Sapiens
TVRLNKKQQ

SEQ ID NO: 808629 - protein, 9 aa, Homo Sapiens
DCSFIVLYI

SEQ ID NO: 808630 - protein, 9 aa, Homo Sapiens
KCLEKVHVV

SEQ ID NO: 808631 - protein, 9 aa, Homo Sapiens
IINSIYNAK

SEQ ID NO: 808632 - protein, 9 aa, Homo Sapiens
DVLNAQKLE

SEQ ID NO: 808633 - protein, 9 aa, Homo Sapiens
RSPRASSSR

SEQ ID NO: 808634 - protein, 9 aa, Homo Sapiens
AQLCLAQEA

SEQ ID NO: 808635 - protein, 9 aa, Homo Sapiens
QTQDKASRK

SEQ ID NO: 808636 - protein, 9 aa, Homo Sapiens
NCPSMYIQA

SEQ ID NO: 808637 - protein, 9 aa, Homo Sapiens
FLCSSCGRE

SEQ ID NO: 808638 - protein, 9 aa, Homo Sapiens
VRNSGEIVS

SEQ ID NO: 808639 - protein, 9 aa, Homo Sapiens
HMTDLIYAD

SEQ ID NO: 808640 - protein, 9 aa, Homo Sapiens
EWGKIMRTP

SEQ ID NO: 808641 - protein, 9 aa, Homo Sapiens
LTRMPSSVS

SEQ ID NO: 808642 - protein, 9 aa, Homo Sapiens
KWLNTWKKK

SEQ ID NO: 808643 - protein, 9 aa, Homo Sapiens
EWERTGLTY

SEQ ID NO: 808644 - protein, 9 aa, Homo Sapiens
IAVGLSLSA

SEQ ID NO: 808645 - protein, 9 aa, Homo Sapiens
SLLILVLIS

SEQ ID NO: 808646 - protein, 9 aa, Homo Sapiens
VVDGVKFMV

SEQ ID NO: 808647 - protein, 9 aa, Homo Sapiens
PEQSMEDYF

SEQ ID NO: 808648 - protein, 9 aa, Homo Sapiens
VIISEAASL

SEQ ID NO: 808649 - protein, 9 aa, Homo Sapiens
PNQDGDIFR

SEQ ID NO: 808650 - protein, 9 aa, Homo Sapiens
LRQRDAFGI

SEQ ID NO: 808651 - protein, 9 aa, Homo Sapiens
NNNLKKNYC

SEQ ID NO: 808652 - protein, 9 aa, Homo Sapiens
LFSTNPPKA

SEQ ID NO: 808653 - protein, 9 aa, Homo Sapiens
RQLDQLSCL

SEQ ID NO: 808654 - protein, 9 aa, Homo Sapiens
PESTKISAL

SEQ ID NO: 808655 - protein, 9 aa, Homo Sapiens
LLPLIDSFQ

SEQ ID NO: 808656 - protein, 9 aa, Homo Sapiens
WWIGRLLKE

SEQ ID NO: 808657 - protein, 9 aa, Homo Sapiens
ASEVLPLLL

SEQ ID NO: 808658 - protein, 9 aa, Homo Sapiens
DMTSKRHFK

SEQ ID NO: 808659 - protein, 9 aa, Homo Sapiens
GLRGAGLLG

SEQ ID NO: 808660 - protein, 9 aa, Homo Sapiens
KMCDQWDRL

SEQ ID NO: 808661 - protein, 9 aa, Homo Sapiens
YHFESKHPT

SEQ ID NO: 808662 - protein, 9 aa, Homo Sapiens
FVGLQVLGH

SEQ ID NO: 808663 - protein, 9 aa, Homo Sapiens
IDNAKDTTK

SEQ ID NO: 808664 - protein, 9 aa, Homo Sapiens
QYASTNMDK

SEQ ID NO: 808665 - protein, 9 aa, Homo Sapiens
NFKDLQTLL

SEQ ID NO: 808666 - protein, 9 aa, Homo Sapiens
GHCWCVDDK

SEQ ID NO: 808667 - protein, 9 aa, Homo Sapiens
SKSSQLSTL

SEQ ID NO: 808668 - protein, 9 aa, Homo Sapiens
RKQMWGDLF

SEQ ID NO: 808669 - protein, 9 aa, Homo Sapiens
ENDIPFEKH

SEQ ID NO: 808670 - protein, 9 aa, Homo Sapiens
EGLLTSYSW

SEQ ID NO: 808671 - protein, 9 aa, Homo Sapiens
DLVIFLDNV

SEQ ID NO: 808672 - protein, 9 aa, Homo Sapiens
PQYHKQLVN

SEQ ID NO: 808673 - protein, 9 aa, Homo Sapiens
LCTLENVQV

SEQ ID NO: 808674 - protein, 9 aa, Homo Sapiens
PLESNVKPR

SEQ ID NO: 808675 - protein, 9 aa, Homo Sapiens
GVCYPVLTP

SEQ ID NO: 808676 - protein, 9 aa, Homo Sapiens
LDISNVQSK

SEQ ID NO: 808677 - protein, 9 aa, Homo Sapiens
LQVMLTMHQ

SEQ ID NO: 808678 - protein, 9 aa, Homo Sapiens
NEIFDEDYK

SEQ ID NO: 808679 - protein, 9 aa, Homo Sapiens
AYQGFTSGN

SEQ ID NO: 808680 - protein, 9 aa, Homo Sapiens
GPHQKEKCI

SEQ ID NO: 808681 - protein, 9 aa, Homo Sapiens
QSARRHTNS

SEQ ID NO: 808682 - protein, 9 aa, Homo Sapiens
WKINHSRAR

SEQ ID NO: 808683 - protein, 9 aa, Homo Sapiens
GKLYLREKF

SEQ ID NO: 808684 - protein, 9 aa, Homo Sapiens
TMSLYDLDI

SEQ ID NO: 808685 - protein, 9 aa, Homo Sapiens
IKKYSDPSQ

SEQ ID NO: 808686 - protein, 9 aa, Homo Sapiens
FIHGQVLYT

SEQ ID NO: 808687 - protein, 9 aa, Homo Sapiens
LHGKVVMEY

SEQ ID NO: 808688 - protein, 9 aa, Homo Sapiens
RFCGGLIKY

SEQ ID NO: 808689 - protein, 9 aa, Homo Sapiens
QVILINSSF

SEQ ID NO: 808690 - protein, 9 aa, Homo Sapiens
SANSSFKPV

SEQ ID NO: 808691 - protein, 9 aa, Homo Sapiens
VVALILMTS

SEQ ID NO: 808692 - protein, 9 aa, Homo Sapiens
DEEHLEVLR

SEQ ID NO: 808693 - protein, 9 aa, Homo Sapiens
PQMSQCTCE

SEQ ID NO: 808694 - protein, 9 aa, Homo Sapiens
LDDVKDKFD

SEQ ID NO: 808695 - protein, 9 aa, Homo Sapiens
SLEESRKVF

SEQ ID NO: 808696 - protein, 9 aa, Homo Sapiens
HQQIHTGES

SEQ ID NO: 808697 - protein, 9 aa, Homo Sapiens
VLESVTILV

SEQ ID NO: 808698 - protein, 9 aa, Homo Sapiens
CSDQRGALA

SEQ ID NO: 808699 - protein, 9 aa, Homo Sapiens
TPSTGSSTN

SEQ ID NO: 808700 - protein, 9 aa, Homo Sapiens
IARAEEHQE

SEQ ID NO: 808701 - protein, 9 aa, Homo Sapiens
TYFYAPELL

SEQ ID NO: 808702 - protein, 9 aa, Homo Sapiens
YYLCVIALR

SEQ ID NO: 808703 - protein, 9 aa, Homo Sapiens
FQANMNTGD

SEQ ID NO: 808704 - protein, 9 aa, Homo Sapiens
KMFDVGGQI

SEQ ID NO: 808705 - protein, 9 aa, Homo Sapiens
PGGVKTTDP

SEQ ID NO: 808706 - protein, 9 aa, Homo Sapiens
PNQHNAVKL

SEQ ID NO: 808707 - protein, 9 aa, Homo Sapiens
LCGLDNGDC

SEQ ID NO: 808708 - protein, 9 aa, Homo Sapiens
KMFDVGGQG

SEQ ID NO: 808709 - protein, 9 aa, Homo Sapiens
RPNVETTKC

SEQ ID NO: 808710 - protein, 9 aa, Homo Sapiens
QQIQKRQML

SEQ ID NO: 808711 - protein, 9 aa, Homo Sapiens
FRESSSKGP

SEQ ID NO: 808712 - protein, 9 aa, Homo Sapiens
LRVLFITAA

SEQ ID NO: 808713 - protein, 9 aa, Homo Sapiens
NGERLRLQQ

SEQ ID NO: 808714 - protein, 9 aa, Homo Sapiens
GLEANNLGF

SEQ ID NO: 808715 - protein, 9 aa, Homo Sapiens
SMVLCCAIQ

SEQ ID NO: 808716 - protein, 9 aa, Homo Sapiens
GLGRHCVTR

SEQ ID NO: 808717 - protein, 9 aa, Homo Sapiens
WVNTVNKDA

SEQ ID NO: 808718 - protein, 9 aa, Homo Sapiens
EQSINLLTW

SEQ ID NO: 808719 - protein, 9 aa, Homo Sapiens
GANIYLPSI

SEQ ID NO: 808720 - protein, 9 aa, Homo Sapiens
YNSLEIIAV

SEQ ID NO: 808721 - protein, 9 aa, Homo Sapiens
YGYSTVTVT

SEQ ID NO: 808722 - protein, 9 aa, Homo Sapiens
DSFLQYFGR

SEQ ID NO: 808723 - protein, 9 aa, Homo Sapiens
SINTPAVSA

SEQ ID NO: 808724 - protein, 9 aa, Homo Sapiens
QTSRTGYWI

SEQ ID NO: 808725 - protein, 9 aa, Homo Sapiens
SYSWFQDEE

SEQ ID NO: 808726 - protein, 9 aa, Homo Sapiens
FNEGGESEC

SEQ ID NO: 808727 - protein, 9 aa, Homo Sapiens
IIGFVLKIS

SEQ ID NO: 808728 - protein, 9 aa, Homo Sapiens
WGKRKLQGR

SEQ ID NO: 808729 - protein, 9 aa, Homo Sapiens
FTTHEDAVA

SEQ ID NO: 808730 - protein, 9 aa, Homo Sapiens
KRSGKLLNK

SEQ ID NO: 808731 - protein, 9 aa, Homo Sapiens
SFLNNSVLT

SEQ ID NO: 808732 - protein, 9 aa, Homo Sapiens
QEPGDNSEI

SEQ ID NO: 808733 - protein, 9 aa, Homo Sapiens
YLDITNGMF

SEQ ID NO: 808734 - protein, 9 aa, Homo Sapiens
YPMRMLYDL

SEQ ID NO: 808735 - protein, 9 aa, Homo Sapiens
LGIELMESE

SEQ ID NO: 808736 - protein, 9 aa, Homo Sapiens
PQALKQILS

SEQ ID NO: 808737 - protein, 9 aa, Homo Sapiens
ECFFQNFVP

SEQ ID NO: 808738 - protein, 9 aa, Homo Sapiens
NTYKQVAGS

SEQ ID NO: 808739 - protein, 9 aa, Homo Sapiens
PINPSMADY

SEQ ID NO: 808740 - protein, 9 aa, Homo Sapiens
PPDIQVPGA

SEQ ID NO: 808741 - protein, 9 aa, Homo Sapiens
HENGNLENS

SEQ ID NO: 808742 - protein, 9 aa, Homo Sapiens
DQLSTTVNS

SEQ ID NO: 808743 - protein, 9 aa, Homo Sapiens
TAGSQTGRK

SEQ ID NO: 808744 - protein, 9 aa, Homo Sapiens
AFRSFPENE

SEQ ID NO: 808745 - protein, 9 aa, Homo Sapiens
RGTTHVLVH

SEQ ID NO: 808746 - protein, 9 aa, Homo Sapiens
YNIYSKTWT

SEQ ID NO: 808747 - protein, 9 aa, Homo Sapiens
QQLRHDCEE

SEQ ID NO: 808748 - protein, 9 aa, Homo Sapiens
KALEYLELL

SEQ ID NO: 808749 - protein, 9 aa, Homo Sapiens
NKYVIYIER

SEQ ID NO: 808750 - protein, 9 aa, Homo Sapiens
SLHVDSLTE

SEQ ID NO: 808751 - protein, 9 aa, Homo Sapiens
IQVEAAYCC

SEQ ID NO: 808752 - protein, 9 aa, Homo Sapiens
KKLSSYLGN

SEQ ID NO: 808753 - protein, 9 aa, Homo Sapiens
RNPQEWHCK

SEQ ID NO: 808754 - protein, 9 aa, Homo Sapiens
HTFLVEEVV

SEQ ID NO: 808755 - protein, 9 aa, Homo Sapiens
SQMDRNVEM

SEQ ID NO: 808756 - protein, 9 aa, Homo Sapiens
QRATFKSGK

SEQ ID NO: 808757 - protein, 9 aa, Homo Sapiens
LHELGPLAS

SEQ ID NO: 808758 - protein, 9 aa, Homo Sapiens
HSKDKPFKC

SEQ ID NO: 808759 - protein, 9 aa, Homo Sapiens
VVITVGGAH

SEQ ID NO: 808760 - protein, 9 aa, Homo Sapiens
GRAEYGWLG

SEQ ID NO: 808761 - protein, 9 aa, Homo Sapiens
QRPTSSFLA

SEQ ID NO: 808762 - protein, 9 aa, Homo Sapiens
GRYIKLRTG

SEQ ID NO: 808763 - protein, 9 aa, Homo Sapiens
IISLPPGDI

SEQ ID NO: 808764 - protein, 9 aa, Homo Sapiens
MLSFYYFSC

SEQ ID NO: 808765 - protein, 9 aa, Homo Sapiens
LKYGLLLLL

SEQ ID NO: 808766 - protein, 9 aa, Homo Sapiens
KETPQMLFH

SEQ ID NO: 808767 - protein, 9 aa, Homo Sapiens
RPRSLIYYK

SEQ ID NO: 808768 - protein, 9 aa, Homo Sapiens
VRVYFNKCP

SEQ ID NO: 808769 - protein, 9 aa, Homo Sapiens
NGTAPEEKQ

SEQ ID NO: 808770 - protein, 9 aa, Homo Sapiens
HTAPSRALL

SEQ ID NO: 808771 - protein, 9 aa, Homo Sapiens
YLMNGMKSD

SEQ ID NO: 808772 - protein, 9 aa, Homo Sapiens
YIIIYFIFK

SEQ ID NO: 808773 - protein, 9 aa, Homo Sapiens
HLVTTLTLR

SEQ ID NO: 808774 - protein, 9 aa, Homo Sapiens
SDLNPLVIL

SEQ ID NO: 808775 - protein, 9 aa, Homo Sapiens
HYIAISQPL

SEQ ID NO: 808776 - protein, 9 aa, Homo Sapiens
SASVTASGL

SEQ ID NO: 808777 - protein, 9 aa, Homo Sapiens
RQEIKNKSS

SEQ ID NO: 808778 - protein, 9 aa, Homo Sapiens
ADGIPFFHS

SEQ ID NO: 808779 - protein, 9 aa, Homo Sapiens
LNNINIRHI

SEQ ID NO: 808780 - protein, 9 aa, Homo Sapiens
SGGKFTCGC

SEQ ID NO: 808781 - protein, 9 aa, Homo Sapiens
KESSWISDG

SEQ ID NO: 808782 - protein, 9 aa, Homo Sapiens
HQCDVAGCS

SEQ ID NO: 808783 - protein, 9 aa, Homo Sapiens
GKYFEIEFS

SEQ ID NO: 808784 - protein, 9 aa, Homo Sapiens
FELDSEQVW

SEQ ID NO: 808785 - protein, 9 aa, Homo Sapiens
DNRYGYPEG

SEQ ID NO: 808786 - protein, 9 aa, Homo Sapiens
TIPPDWVEA

SEQ ID NO: 808787 - protein, 9 aa, Homo Sapiens
FTVEYLLCL

SEQ ID NO: 808788 - protein, 9 aa, Homo Sapiens
QSRVTVVGP

SEQ ID NO: 808789 - protein, 9 aa, Homo Sapiens
IEHIPKFFK

SEQ ID NO: 808790 - protein, 9 aa, Homo Sapiens
HMRIHKEVK

SEQ ID NO: 808791 - protein, 9 aa, Homo Sapiens
IDWFDGKEL

SEQ ID NO: 808792 - protein, 9 aa, Homo Sapiens
IPVTLSSSL

SEQ ID NO: 808793 - protein, 9 aa, Homo Sapiens
PSGNVAKHI

SEQ ID NO: 808794 - protein, 9 aa, Homo Sapiens
TAEIDSTFL

SEQ ID NO: 808795 - protein, 9 aa, Homo Sapiens
LCSHCSGTR

SEQ ID NO: 808796 - protein, 9 aa, Homo Sapiens
GYRALQWTG

SEQ ID NO: 808797 - protein, 9 aa, Homo Sapiens
NAFEPATGR

SEQ ID NO: 808798 - protein, 9 aa, Homo Sapiens
KIITYEDSE

SEQ ID NO: 808799 - protein, 9 aa, Homo Sapiens
QISCKAEVN

SEQ ID NO: 808800 - protein, 9 aa, Homo Sapiens
QDLLGLPTP

SEQ ID NO: 808801 - protein, 9 aa, Homo Sapiens
ENAGLFIDV

SEQ ID NO: 808802 - protein, 9 aa, Homo Sapiens
PPELCLLIP

SEQ ID NO: 808803 - protein, 9 aa, Homo Sapiens
KGPEGQPTA

SEQ ID NO: 808804 - protein, 9 aa, Homo Sapiens
EVKILAHFY

SEQ ID NO: 808805 - protein, 9 aa, Homo Sapiens
EEGKAAASV

SEQ ID NO: 808806 - protein, 9 aa, Homo Sapiens
HFYNLVLLP

SEQ ID NO: 808807 - protein, 9 aa, Homo Sapiens
LLEREEDIS

SEQ ID NO: 808808 - protein, 9 aa, Homo Sapiens
LLFFLYSWW

SEQ ID NO: 808809 - protein, 9 aa, Homo Sapiens
VSLRAPAQF

SEQ ID NO: 808810 - protein, 9 aa, Homo Sapiens
AGLAPETTK

SEQ ID NO: 808811 - protein, 9 aa, Homo Sapiens
GTSGMEESY

SEQ ID NO: 808812 - protein, 9 aa, Homo Sapiens
FVWFICISL

SEQ ID NO: 808813 - protein, 9 aa, Homo Sapiens
HKKKKKKIK

SEQ ID NO: 808814 - protein, 9 aa, Homo Sapiens
SQHNHHVII

SEQ ID NO: 808815 - protein, 9 aa, Homo Sapiens
DEYTEFIDK

SEQ ID NO: 808816 - protein, 9 aa, Homo Sapiens
DLEVKRVAA

SEQ ID NO: 808817 - protein, 9 aa, Homo Sapiens
VCERNSRWS

SEQ ID NO: 808818 - protein, 9 aa, Homo Sapiens
IPRVEYMEK

SEQ ID NO: 808819 - protein, 9 aa, Homo Sapiens
FFFLQREGM

SEQ ID NO: 808820 - protein, 9 aa, Homo Sapiens
EVARALNLT

SEQ ID NO: 808821 - protein, 9 aa, Homo Sapiens
INKFVVTQC

SEQ ID NO: 808822 - protein, 9 aa, Homo Sapiens
YFFNNFTLG

SEQ ID NO: 808823 - protein, 9 aa, Homo Sapiens
AWLYFKIFD

SEQ ID NO: 808824 - protein, 9 aa, Homo Sapiens
YTKTEACQL

SEQ ID NO: 808825 - protein, 9 aa, Homo Sapiens
ATNFTINMV

SEQ ID NO: 808826 - protein, 9 aa, Homo Sapiens
GYAEGVELM

SEQ ID NO: 808827 - protein, 9 aa, Homo Sapiens
LKIYKYHVK

SEQ ID NO: 808828 - protein, 9 aa, Homo Sapiens
EPYFLYLEV

SEQ ID NO: 808829 - protein, 9 aa, Homo Sapiens
CSRKVSRKR

SEQ ID NO: 808830 - protein, 9 aa, Homo Sapiens
MLWKLQKQE

SEQ ID NO: 808831 - protein, 9 aa, Homo Sapiens
CKECGVAFS

SEQ ID NO: 808832 - protein, 9 aa, Homo Sapiens
NWYFHNHEE

SEQ ID NO: 808833 - protein, 9 aa, Homo Sapiens
KDTTIQELK

SEQ ID NO: 808834 - protein, 9 aa, Homo Sapiens
PVKHKIQCQ

SEQ ID NO: 808835 - protein, 9 aa, Homo Sapiens
KLHIRIKHS

SEQ ID NO: 808836 - protein, 9 aa, Homo Sapiens
WYRTCMMEY

SEQ ID NO: 808837 - protein, 9 aa, Homo Sapiens
NNAIFSVAC

SEQ ID NO: 808838 - protein, 9 aa, Homo Sapiens
GQFFDLMTL

SEQ ID NO: 808839 - protein, 9 aa, Homo Sapiens
YHIIIPVLL

SEQ ID NO: 808840 - protein, 9 aa, Homo Sapiens
TLHTWLSFY

SEQ ID NO: 808841 - protein, 9 aa, Homo Sapiens
CLPSRLWSG

SEQ ID NO: 808842 - protein, 9 aa, Homo Sapiens
YGQIPLSAF

SEQ ID NO: 808843 - protein, 9 aa, Homo Sapiens
ELTIIKYLD

SEQ ID NO: 808844 - protein, 9 aa, Homo Sapiens
GAAQASPSS

SEQ ID NO: 808845 - protein, 9 aa, Homo Sapiens
FEVFTPVCE

SEQ ID NO: 808846 - protein, 9 aa, Homo Sapiens
VELDNTPNN

SEQ ID NO: 808847 - protein, 9 aa, Homo Sapiens
QVYRNKYVI

SEQ ID NO: 808848 - protein, 9 aa, Homo Sapiens
YSGNKQRLH

SEQ ID NO: 808849 - protein, 9 aa, Homo Sapiens
LRQELERQQ

SEQ ID NO: 808850 - protein, 9 aa, Homo Sapiens
EQDKLPGQE

SEQ ID NO: 808851 - protein, 9 aa, Homo Sapiens
TAQRAAIIV

SEQ ID NO: 808852 - protein, 9 aa, Homo Sapiens
FLFPDAVSD

SEQ ID NO: 808853 - protein, 9 aa, Homo Sapiens
STNQTGMSH

SEQ ID NO: 808854 - protein, 9 aa, Homo Sapiens
HLPTCYNYS

SEQ ID NO: 808855 - protein, 9 aa, Homo Sapiens
ESDEEQLFS

SEQ ID NO: 808856 - protein, 9 aa, Homo Sapiens
TQPSAIISV

SEQ ID NO: 808857 - protein, 9 aa, Homo Sapiens
IILTFVSIF

SEQ ID NO: 808858 - protein, 9 aa, Homo Sapiens
IVLIIYNFG

SEQ ID NO: 808859 - protein, 9 aa, Homo Sapiens
KTIILLTIF

SEQ ID NO: 808860 - protein, 9 aa, Homo Sapiens
NYAKVWKMP

SEQ ID NO: 808861 - protein, 9 aa, Homo Sapiens
PGPSRSFKD

SEQ ID NO: 808862 - protein, 9 aa, Homo Sapiens
LSLKQIHLK

SEQ ID NO: 808863 - protein, 9 aa, Homo Sapiens
LICLKHNIR

SEQ ID NO: 808864 - protein, 9 aa, Homo Sapiens
DELQCLDDP

SEQ ID NO: 808865 - protein, 9 aa, Homo Sapiens
VIGANVTAF

SEQ ID NO: 808866 - protein, 9 aa, Homo Sapiens
NELSGKLDT

SEQ ID NO: 808867 - protein, 9 aa, Homo Sapiens
WEKTKGNGF

SEQ ID NO: 808868 - protein, 9 aa, Homo Sapiens
DKALKRAVA

SEQ ID NO: 808869 - protein, 9 aa, Homo Sapiens
REQLEKDMQ

SEQ ID NO: 808870 - protein, 9 aa, Homo Sapiens
ADGSFHLEN

SEQ ID NO: 808871 - protein, 9 aa, Homo Sapiens
VLLLFIIMF

SEQ ID NO: 808872 - protein, 9 aa, Homo Sapiens
NIRITGIYG

SEQ ID NO: 808873 - protein, 9 aa, Homo Sapiens
RIKETKKVY

SEQ ID NO: 808874 - protein, 9 aa, Homo Sapiens
QDIHVTRYV

SEQ ID NO: 808875 - protein, 9 aa, Homo Sapiens
RMVGMSFQK

SEQ ID NO: 808876 - protein, 9 aa, Homo Sapiens
SRRDSLSVP

SEQ ID NO: 808877 - protein, 9 aa, Homo Sapiens
MGDVKNVLY

SEQ ID NO: 808878 - protein, 9 aa, Homo Sapiens
VDKSGELLA

SEQ ID NO: 808879 - protein, 9 aa, Homo Sapiens
SLSMHSSDY

SEQ ID NO: 808880 - protein, 9 aa, Homo Sapiens
HNIRNIEKK

SEQ ID NO: 808881 - protein, 9 aa, Homo Sapiens
EQIIRTCSR

SEQ ID NO: 808882 - protein, 9 aa, Homo Sapiens
LNNGSLFAF

SEQ ID NO: 808883 - protein, 9 aa, Homo Sapiens
DISIRARFG

SEQ ID NO: 808884 - protein, 9 aa, Homo Sapiens
KTYPYVEVN

SEQ ID NO: 808885 - protein, 9 aa, Homo Sapiens
LDKYYMLIC

SEQ ID NO: 808886 - protein, 9 aa, Homo Sapiens
DADPAKEYA

SEQ ID NO: 808887 - protein, 9 aa, Homo Sapiens
VRAAEFINN

SEQ ID NO: 808888 - protein, 9 aa, Homo Sapiens
ERVKTSVEH

SEQ ID NO: 808889 - protein, 9 aa, Homo Sapiens
EKRDEQRPG

SEQ ID NO: 808890 - protein, 9 aa, Homo Sapiens
IIATKALCA

SEQ ID NO: 808891 - protein, 9 aa, Homo Sapiens
CMEVPNVAY

SEQ ID NO: 808892 - protein, 9 aa, Homo Sapiens
EIAREKHQA

SEQ ID NO: 808893 - protein, 9 aa, Homo Sapiens
LKESYFDAV

SEQ ID NO: 808894 - protein, 9 aa, Homo Sapiens
PQGQPQEAF

SEQ ID NO: 808895 - protein, 9 aa, Homo Sapiens
IFLVDSSWA

SEQ ID NO: 808896 - protein, 9 aa, Homo Sapiens
ADDSQEANG

SEQ ID NO: 808897 - protein, 9 aa, Homo Sapiens
DKENYNKFY

SEQ ID NO: 808898 - protein, 9 aa, Homo Sapiens
PQTLVTPAA

SEQ ID NO: 808899 - protein, 9 aa, Homo Sapiens
LNVEDSNRG

SEQ ID NO: 808900 - protein, 9 aa, Homo Sapiens
CLNTIAWPL

SEQ ID NO: 808901 - protein, 9 aa, Homo Sapiens
RLLSVDGIW

SEQ ID NO: 808902 - protein, 9 aa, Homo Sapiens
ITSTIDDPS

SEQ ID NO: 808903 - protein, 9 aa, Homo Sapiens
QSRGMLLFY

SEQ ID NO: 808904 - protein, 9 aa, Homo Sapiens
LFALSRGQA

SEQ ID NO: 808905 - protein, 9 aa, Homo Sapiens
IENYCDPVL

SEQ ID NO: 808906 - protein, 9 aa, Homo Sapiens
LSRSPLKVV

SEQ ID NO: 808907 - protein, 9 aa, Homo Sapiens
SRIDHFMKS

SEQ ID NO: 808908 - protein, 9 aa, Homo Sapiens
TKTNIDEHL

SEQ ID NO: 808909 - protein, 9 aa, Homo Sapiens
LYEQGDEEA

SEQ ID NO: 808910 - protein, 9 aa, Homo Sapiens
LFKWQHQNN

SEQ ID NO: 808911 - protein, 9 aa, Homo Sapiens
CVIYKKSVL

SEQ ID NO: 808912 - protein, 9 aa, Homo Sapiens
RATTENLLH

SEQ ID NO: 808913 - protein, 9 aa, Homo Sapiens
GELSYSFVQ

SEQ ID NO: 808914 - protein, 9 aa, Homo Sapiens
LALAPLPPS

SEQ ID NO: 808915 - protein, 9 aa, Homo Sapiens
AKSSCNQNV

SEQ ID NO: 808916 - protein, 9 aa, Homo Sapiens
LNMYHLGTQ

SEQ ID NO: 808917 - protein, 9 aa, Homo Sapiens
RNWRERAEL

SEQ ID NO: 808918 - protein, 9 aa, Homo Sapiens
PEDTLVCCR

SEQ ID NO: 808919 - protein, 9 aa, Homo Sapiens
VGIPDNAPI

SEQ ID NO: 808920 - protein, 9 aa, Homo Sapiens
DYCNAIKIN

SEQ ID NO: 808921 - protein, 9 aa, Homo Sapiens
KSLSDQVLL

SEQ ID NO: 808922 - protein, 9 aa, Homo Sapiens
TIVIGNGTA

SEQ ID NO: 808923 - protein, 9 aa, Homo Sapiens
INSIKLLQT

SEQ ID NO: 808924 - protein, 9 aa, Homo Sapiens
HQPKCPEKD

SEQ ID NO: 808925 - protein, 9 aa, Homo Sapiens
EVPVPAEEL

SEQ ID NO: 808926 - protein, 9 aa, Homo Sapiens
AIQSGRMTA

SEQ ID NO: 808927 - protein, 9 aa, Homo Sapiens
RLRQKRINS

SEQ ID NO: 808928 - protein, 9 aa, Homo Sapiens
GNSKLSIKK

SEQ ID NO: 808929 - protein, 9 aa, Homo Sapiens
FKTIILLTI

SEQ ID NO: 808930 - protein, 9 aa, Homo Sapiens
KCGRNSNIC

SEQ ID NO: 808931 - protein, 9 aa, Homo Sapiens
YSLWNCDVQ

SEQ ID NO: 808932 - protein, 9 aa, Homo Sapiens
AMFSEYISY

SEQ ID NO: 808933 - protein, 9 aa, Homo Sapiens
LREQSIDGT

SEQ ID NO: 808934 - protein, 9 aa, Homo Sapiens
QQALVNRWL

SEQ ID NO: 808935 - protein, 9 aa, Homo Sapiens
SICITAMDT

SEQ ID NO: 808936 - protein, 9 aa, Homo Sapiens
IIKVGSGPG

SEQ ID NO: 808937 - protein, 9 aa, Homo Sapiens
CCCHLPLMQ

SEQ ID NO: 808938 - protein, 9 aa, Homo Sapiens
LFFDEGTID

SEQ ID NO: 808939 - protein, 9 aa, Homo Sapiens
KSLGRNIFL

SEQ ID NO: 808940 - protein, 9 aa, Homo Sapiens
HLRVLFITA

SEQ ID NO: 808941 - protein, 9 aa, Homo Sapiens
GDAKDKVQD

SEQ ID NO: 808942 - protein, 9 aa, Homo Sapiens
QKLHKMGLK

SEQ ID NO: 808943 - protein, 9 aa, Homo Sapiens
ACVHFKPNE

SEQ ID NO: 808944 - protein, 9 aa, Homo Sapiens
IKIQMASFY

SEQ ID NO: 808945 - protein, 9 aa, Homo Sapiens
KLRRSQSNY

SEQ ID NO: 808946 - protein, 9 aa, Homo Sapiens
EQQPEVPII

SEQ ID NO: 808947 - protein, 9 aa, Homo Sapiens
YIFPSTFPH

SEQ ID NO: 808948 - protein, 9 aa, Homo Sapiens
QWLRSQLAI

SEQ ID NO: 808949 - protein, 9 aa, Homo Sapiens
KIDKILAKK

SEQ ID NO: 808950 - protein, 9 aa, Homo Sapiens
YSSPSLCIA

SEQ ID NO: 808951 - protein, 9 aa, Homo Sapiens
MEIPSTSNV

SEQ ID NO: 808952 - protein, 9 aa, Homo Sapiens
VKDVQMLQG

SEQ ID NO: 808953 - protein, 9 aa, Homo Sapiens
AYNHFFKES

SEQ ID NO: 808954 - protein, 9 aa, Homo Sapiens
SPGSSSPGP

SEQ ID NO: 808955 - protein, 9 aa, Homo Sapiens
DHVTFSQRV

SEQ ID NO: 808956 - protein, 9 aa, Homo Sapiens
ILIKTPLAP

SEQ ID NO: 808957 - protein, 9 aa, Homo Sapiens
NRSSYLIQH

SEQ ID NO: 808958 - protein, 9 aa, Homo Sapiens
VITTTTLER

SEQ ID NO: 808959 - protein, 9 aa, Homo Sapiens
GEARALCLG

SEQ ID NO: 808960 - protein, 9 aa, Homo Sapiens
QRLLLPHWT

SEQ ID NO: 808961 - protein, 9 aa, Homo Sapiens
LPDRVATSQ

SEQ ID NO: 808962 - protein, 9 aa, Homo Sapiens
PPAKAEKLA

SEQ ID NO: 808963 - protein, 9 aa, Homo Sapiens
WGKPNAKEC

SEQ ID NO: 808964 - protein, 9 aa, Homo Sapiens
IMAGIDLKF

SEQ ID NO: 808965 - protein, 9 aa, Homo Sapiens
TVAHQRKSM

SEQ ID NO: 808966 - protein, 9 aa, Homo Sapiens
HMCLHDYRE

SEQ ID NO: 808967 - protein, 9 aa, Homo Sapiens
TKKVYEGEV

SEQ ID NO: 808968 - protein, 9 aa, Homo Sapiens
LALHNKRTE

SEQ ID NO: 808969 - protein, 9 aa, Homo Sapiens
NKTIYTYIM

SEQ ID NO: 808970 - protein, 9 aa, Homo Sapiens
NAFIPHLPH

SEQ ID NO: 808971 - protein, 9 aa, Homo Sapiens
ITPVLRRNR

SEQ ID NO: 808972 - protein, 9 aa, Homo Sapiens
LPVTEAEML

SEQ ID NO: 808973 - protein, 9 aa, Homo Sapiens
SVTWQGITH

SEQ ID NO: 808974 - protein, 9 aa, Homo Sapiens
KVVQPAGAS

SEQ ID NO: 808975 - protein, 9 aa, Homo Sapiens
WFNALRAAC

SEQ ID NO: 808976 - protein, 9 aa, Homo Sapiens
TFQSFLGCD

SEQ ID NO: 808977 - protein, 9 aa, Homo Sapiens
RERQQANLL

SEQ ID NO: 808978 - protein, 9 aa, Homo Sapiens
NKLGVSVSP

SEQ ID NO: 808979 - protein, 9 aa, Homo Sapiens
LKCLDVSSN

SEQ ID NO: 808980 - protein, 9 aa, Homo Sapiens
EEQPQSPKA

SEQ ID NO: 808981 - protein, 9 aa, Homo Sapiens
AVTIDNAKD

SEQ ID NO: 808982 - protein, 9 aa, Homo Sapiens
YFFIHGQVL

SEQ ID NO: 808983 - protein, 9 aa, Homo Sapiens
CRSAHIHYF

SEQ ID NO: 808984 - protein, 9 aa, Homo Sapiens
PRNTYSDRS

SEQ ID NO: 808985 - protein, 9 aa, Homo Sapiens
IGAKVMFVA

SEQ ID NO: 808986 - protein, 9 aa, Homo Sapiens
LLNFDIDRG

SEQ ID NO: 808987 - protein, 9 aa, Homo Sapiens
VDGILFGGM

SEQ ID NO: 808988 - protein, 9 aa, Homo Sapiens
LVITKFLRL

SEQ ID NO: 808989 - protein, 9 aa, Homo Sapiens
PYAGIKNAE

SEQ ID NO: 808990 - protein, 9 aa, Homo Sapiens
GDITELNIL

SEQ ID NO: 808991 - protein, 9 aa, Homo Sapiens
ILSQLLLDL

SEQ ID NO: 808992 - protein, 9 aa, Homo Sapiens
PHLYKITQN

SEQ ID NO: 808993 - protein, 9 aa, Homo Sapiens
KGDGYVDTD

SEQ ID NO: 808994 - protein, 9 aa, Homo Sapiens
EANIGLPIS

SEQ ID NO: 808995 - protein, 9 aa, Homo Sapiens
QRDFQRESQ

SEQ ID NO: 808996 - protein, 9 aa, Homo Sapiens
LIPLSVVLA

SEQ ID NO: 808997 - protein, 9 aa, Homo Sapiens
YPTQLQAIL

SEQ ID NO: 808998 - protein, 9 aa, Homo Sapiens
FSKSLQSSN

SEQ ID NO: 808999 - protein, 9 aa, Homo Sapiens
PERQSGHQE

SEQ ID NO: 809000 - protein, 9 aa, Homo Sapiens
DVEAEKLFW

SEQ ID NO: 809001 - protein, 9 aa, Homo Sapiens
PGAQTPLTG

SEQ ID NO: 809002 - protein, 9 aa, Homo Sapiens
KLAFAFGDQ

SEQ ID NO: 809003 - protein, 9 aa, Homo Sapiens
LPTALTQLV

SEQ ID NO: 809004 - protein, 9 aa, Homo Sapiens
SRFYRINRA

SEQ ID NO: 809005 - protein, 9 aa, Homo Sapiens
ANKNIIEDK

SEQ ID NO: 809006 - protein, 9 aa, Homo Sapiens
EKQARIKAR

SEQ ID NO: 809007 - protein, 9 aa, Homo Sapiens
AEFLGFILT

SEQ ID NO: 809008 - protein, 9 aa, Homo Sapiens
AGLRWFSMY

SEQ ID NO: 809009 - protein, 9 aa, Homo Sapiens
QQRSEKKKA

SEQ ID NO: 809010 - protein, 9 aa, Homo Sapiens
QYTISMPSD

SEQ ID NO: 809011 - protein, 9 aa, Homo Sapiens
YANTNNNVV

SEQ ID NO: 809012 - protein, 9 aa, Homo Sapiens
GRSFLFITP

SEQ ID NO: 809013 - protein, 9 aa, Homo Sapiens
GATYLQQRY

SEQ ID NO: 809014 - protein, 9 aa, Homo Sapiens
QFCGKYAYV

SEQ ID NO: 809015 - protein, 9 aa, Homo Sapiens
SICYLGCDL

SEQ ID NO: 809016 - protein, 9 aa, Homo Sapiens
FNQKAKLAR

SEQ ID NO: 809017 - protein, 9 aa, Homo Sapiens
DAHEFIMFT

SEQ ID NO: 809018 - protein, 9 aa, Homo Sapiens
WSQAVNYGE

SEQ ID NO: 809019 - protein, 9 aa, Homo Sapiens
DTFRMLFQH

SEQ ID NO: 809020 - protein, 9 aa, Homo Sapiens
VCCRDEFLL

SEQ ID NO: 809021 - protein, 9 aa, Homo Sapiens
VKINNATIT

SEQ ID NO: 809022 - protein, 9 aa, Homo Sapiens
RYWIKETDL

SEQ ID NO: 809023 - protein, 9 aa, Homo Sapiens
TGINPQIES

SEQ ID NO: 809024 - protein, 9 aa, Homo Sapiens
DTDNNGEGG

SEQ ID NO: 809025 - protein, 9 aa, Homo Sapiens
CYERQISEL

SEQ ID NO: 809026 - protein, 9 aa, Homo Sapiens
SLTPEAKAA

SEQ ID NO: 809027 - protein, 9 aa, Homo Sapiens
IQELNGVAR

SEQ ID NO: 809028 - protein, 9 aa, Homo Sapiens
TCYNYSENC

SEQ ID NO: 809029 - protein, 9 aa, Homo Sapiens
ITHEQMQTV

SEQ ID NO: 809030 - protein, 9 aa, Homo Sapiens
IADTGANVI

SEQ ID NO: 809031 - protein, 9 aa, Homo Sapiens
IFKTKFLSQ

SEQ ID NO: 809032 - protein, 9 aa, Homo Sapiens
HEDISVIVN

SEQ ID NO: 809033 - protein, 9 aa, Homo Sapiens
PLDLSDQFS

SEQ ID NO: 809034 - protein, 9 aa, Homo Sapiens
DTVKDPVSN

SEQ ID NO: 809035 - protein, 9 aa, Homo Sapiens
TRIIWKRTA

SEQ ID NO: 809036 - protein, 9 aa, Homo Sapiens
DIDDISVGK

SEQ ID NO: 809037 - protein, 9 aa, Homo Sapiens
MFERNPSDN

SEQ ID NO: 809038 - protein, 9 aa, Homo Sapiens
TCPFGTKYL

SEQ ID NO: 809039 - protein, 9 aa, Homo Sapiens
RTEAPEFPC

SEQ ID NO: 809040 - protein, 9 aa, Homo Sapiens
CGKPVINVR

SEQ ID NO: 809041 - protein, 9 aa, Homo Sapiens
HNLFQTGSN

SEQ ID NO: 809042 - protein, 9 aa, Homo Sapiens
NPRAKHLES

SEQ ID NO: 809043 - protein, 9 aa, Homo Sapiens
EHDQTFSEK

SEQ ID NO: 809044 - protein, 9 aa, Homo Sapiens
CDLIVGCDV

SEQ ID NO: 809045 - protein, 9 aa, Homo Sapiens
TLVNDLIGQ

SEQ ID NO: 809046 - protein, 9 aa, Homo Sapiens
SGSAPTPLC

SEQ ID NO: 809047 - protein, 9 aa, Homo Sapiens
YFISYSRGT

SEQ ID NO: 809048 - protein, 9 aa, Homo Sapiens
TLKEVDATR

SEQ ID NO: 809049 - protein, 9 aa, Homo Sapiens
EKTSAINQL

SEQ ID NO: 809050 - protein, 9 aa, Homo Sapiens
TQMDLEVKR

SEQ ID NO: 809051 - protein, 9 aa, Homo Sapiens
ITLHHEEVN

SEQ ID NO: 809052 - protein, 9 aa, Homo Sapiens
SHRLYYNTR

SEQ ID NO: 809053 - protein, 9 aa, Homo Sapiens
NPQLLEAWN

SEQ ID NO: 809054 - protein, 9 aa, Homo Sapiens
ELEKFPLNT

SEQ ID NO: 809055 - protein, 9 aa, Homo Sapiens
MYILPYKEL

SEQ ID NO: 809056 - protein, 9 aa, Homo Sapiens
SVIYPGVVE

SEQ ID NO: 809057 - protein, 9 aa, Homo Sapiens
NLNKKERRV

SEQ ID NO: 809058 - protein, 9 aa, Homo Sapiens
SAFDKQVME

SEQ ID NO: 809059 - protein, 9 aa, Homo Sapiens
LGLSMSKPN

SEQ ID NO: 809060 - protein, 9 aa, Homo Sapiens
ERNSSLWNN

SEQ ID NO: 809061 - protein, 9 aa, Homo Sapiens
KGFHDAFNL

SEQ ID NO: 809062 - protein, 9 aa, Homo Sapiens
LVKATQICA

SEQ ID NO: 809063 - protein, 9 aa, Homo Sapiens
YLPYKYTCE

SEQ ID NO: 809064 - protein, 9 aa, Homo Sapiens
LEILTRGVK

SEQ ID NO: 809065 - protein, 9 aa, Homo Sapiens
RFTQVSNEL

SEQ ID NO: 809066 - protein, 9 aa, Homo Sapiens
GLVQELWRR

SEQ ID NO: 809067 - protein, 9 aa, Homo Sapiens
LGATGLPHL

SEQ ID NO: 809068 - protein, 9 aa, Homo Sapiens
IDDLLSSIA

SEQ ID NO: 809069 - protein, 9 aa, Homo Sapiens
ETKSQAFVL

SEQ ID NO: 809070 - protein, 9 aa, Homo Sapiens
SQDSEFGWI

SEQ ID NO: 809071 - protein, 9 aa, Homo Sapiens
AQEQQVRHE

SEQ ID NO: 809072 - protein, 9 aa, Homo Sapiens
EDVIINSHS

SEQ ID NO: 809073 - protein, 9 aa, Homo Sapiens
KLSIPVYIM

SEQ ID NO: 809074 - protein, 9 aa, Homo Sapiens
KQHLWLVFD

SEQ ID NO: 809075 - protein, 9 aa, Homo Sapiens
DLLVTNNHF

SEQ ID NO: 809076 - protein, 9 aa, Homo Sapiens
VLYFTVGTF

SEQ ID NO: 809077 - protein, 9 aa, Homo Sapiens
MNGRIYVTG

SEQ ID NO: 809078 - protein, 9 aa, Homo Sapiens
QVPQHKLFS

SEQ ID NO: 809079 - protein, 9 aa, Homo Sapiens
QVSKRMLVG

SEQ ID NO: 809080 - protein, 9 aa, Homo Sapiens
GDLHRSPHQ

SEQ ID NO: 809081 - protein, 9 aa, Homo Sapiens
DEIDEDCTL

SEQ ID NO: 809082 - protein, 9 aa, Homo Sapiens
TSLCKLWLM

SEQ ID NO: 809083 - protein, 9 aa, Homo Sapiens
GTSSSLATL

SEQ ID NO: 809084 - protein, 9 aa, Homo Sapiens
ENPGQITFH

SEQ ID NO: 809085 - protein, 9 aa, Homo Sapiens
KLAKYLDFI

SEQ ID NO: 809086 - protein, 9 aa, Homo Sapiens
DVNTFLTWV

SEQ ID NO: 809087 - protein, 9 aa, Homo Sapiens
EKEMSKLKQ

SEQ ID NO: 809088 - protein, 9 aa, Homo Sapiens
YKDPSLCMF

SEQ ID NO: 809089 - protein, 9 aa, Homo Sapiens
VTRISTEDD

SEQ ID NO: 809090 - protein, 9 aa, Homo Sapiens
QASEENVEH

SEQ ID NO: 809091 - protein, 9 aa, Homo Sapiens
REIIIAINS

SEQ ID NO: 809092 - protein, 9 aa, Homo Sapiens
QHSLTWGLT

SEQ ID NO: 809093 - protein, 9 aa, Homo Sapiens
EHLHNLENS

SEQ ID NO: 809094 - protein, 9 aa, Homo Sapiens
LTSLVAAPV

SEQ ID NO: 809095 - protein, 9 aa, Homo Sapiens
KLEELPKDD

SEQ ID NO: 809096 - protein, 9 aa, Homo Sapiens
LDNVTRLLS

SEQ ID NO: 809097 - protein, 9 aa, Homo Sapiens
VQEMVQHYM

SEQ ID NO: 809098 - protein, 9 aa, Homo Sapiens
ISSSAILRA

SEQ ID NO: 809099 - protein, 9 aa, Homo Sapiens
VKQVYFHCL

SEQ ID NO: 809100 - protein, 9 aa, Homo Sapiens
NIYLPSISL

SEQ ID NO: 809101 - protein, 9 aa, Homo Sapiens
ITIIPLIWI

SEQ ID NO: 809102 - protein, 9 aa, Homo Sapiens
VTLDEFIES

SEQ ID NO: 809103 - protein, 9 aa, Homo Sapiens
TTDGSTICK

SEQ ID NO: 809104 - protein, 9 aa, Homo Sapiens
YDMLHETVA

SEQ ID NO: 809105 - protein, 9 aa, Homo Sapiens
LVENNYTNS

SEQ ID NO: 809106 - protein, 9 aa, Homo Sapiens
LYLATDRGT

SEQ ID NO: 809107 - protein, 9 aa, Homo Sapiens
IELNKHFPL

SEQ ID NO: 809108 - protein, 9 aa, Homo Sapiens
MEAVRGSLN

SEQ ID NO: 809109 - protein, 9 aa, Homo Sapiens
IPGFTNLDL

SEQ ID NO: 809110 - protein, 9 aa, Homo Sapiens
TDAVLNNRF

SEQ ID NO: 809111 - protein, 9 aa, Homo Sapiens
NNVVDCNQV

SEQ ID NO: 809112 - protein, 9 aa, Homo Sapiens
AHAGDSKAA

SEQ ID NO: 809113 - protein, 9 aa, Homo Sapiens
GAASAWGMP

SEQ ID NO: 809114 - protein, 9 aa, Homo Sapiens
GGNVTINFS

SEQ ID NO: 809115 - protein, 9 aa, Homo Sapiens
EARKKMNSW

SEQ ID NO: 809116 - protein, 9 aa, Homo Sapiens
LALDCKDSL

SEQ ID NO: 809117 - protein, 9 aa, Homo Sapiens
SSDEDISDE

SEQ ID NO: 809118 - protein, 9 aa, Homo Sapiens
ATNQIISHF

SEQ ID NO: 809119 - protein, 9 aa, Homo Sapiens
EEIQYIILR

SEQ ID NO: 809120 - protein, 9 aa, Homo Sapiens
CCCLSRGMR

SEQ ID NO: 809121 - protein, 9 aa, Homo Sapiens
NGKKQYQDS

SEQ ID NO: 809122 - protein, 9 aa, Homo Sapiens
LATLLDPRF

SEQ ID NO: 809123 - protein, 9 aa, Homo Sapiens
TQVTEKSTK

SEQ ID NO: 809124 - protein, 9 aa, Homo Sapiens
LSVIEDDAF

SEQ ID NO: 809125 - protein, 9 aa, Homo Sapiens
ELSEGIDSD

SEQ ID NO: 809126 - protein, 9 aa, Homo Sapiens
LLGWLHWGP

SEQ ID NO: 809127 - protein, 9 aa, Homo Sapiens
TVTVTLLTL

SEQ ID NO: 809128 - protein, 9 aa, Homo Sapiens
NVNDNPPKF

SEQ ID NO: 809129 - protein, 9 aa, Homo Sapiens
TQCNCRKTI

SEQ ID NO: 809130 - protein, 9 aa, Homo Sapiens
EEKNHSKLL

SEQ ID NO: 809131 - protein, 9 aa, Homo Sapiens
PLALTSTSN

SEQ ID NO: 809132 - protein, 9 aa, Homo Sapiens
HSSSFQSHM

SEQ ID NO: 809133 - protein, 9 aa, Homo Sapiens
LRKDKMYSF

SEQ ID NO: 809134 - protein, 9 aa, Homo Sapiens
KCNEGGKAF

SEQ ID NO: 809135 - protein, 9 aa, Homo Sapiens
PQAADPAAM

SEQ ID NO: 809136 - protein, 9 aa, Homo Sapiens
SDKLKEEIG

SEQ ID NO: 809137 - protein, 9 aa, Homo Sapiens
PVATLVKEV

SEQ ID NO: 809138 - protein, 9 aa, Homo Sapiens
HQNLQDCLQ

SEQ ID NO: 809139 - protein, 9 aa, Homo Sapiens
YVGVEDLVL

SEQ ID NO: 809140 - protein, 9 aa, Homo Sapiens
NQSCCVYVN

SEQ ID NO: 809141 - protein, 9 aa, Homo Sapiens
ELRTKVQKQ

SEQ ID NO: 809142 - protein, 9 aa, Homo Sapiens
NTYSDRSGS

SEQ ID NO: 809143 - protein, 9 aa, Homo Sapiens
VKVKGYEDG

SEQ ID NO: 809144 - protein, 9 aa, Homo Sapiens
FPDIVGFTA

SEQ ID NO: 809145 - protein, 9 aa, Homo Sapiens
TKNLHVIDL

SEQ ID NO: 809146 - protein, 9 aa, Homo Sapiens
SIVRDDGIQ

SEQ ID NO: 809147 - protein, 9 aa, Homo Sapiens
KGKLYRSPE

SEQ ID NO: 809148 - protein, 9 aa, Homo Sapiens
TLDNFYSNL

SEQ ID NO: 809149 - protein, 9 aa, Homo Sapiens
VVIDSTRTI

SEQ ID NO: 809150 - protein, 9 aa, Homo Sapiens
ENKSHECKE

SEQ ID NO: 809151 - protein, 9 aa, Homo Sapiens
FYHAHMASQ

SEQ ID NO: 809152 - protein, 9 aa, Homo Sapiens
GKYVLVIQN

SEQ ID NO: 809153 - protein, 9 aa, Homo Sapiens
IIRDLEDKT

SEQ ID NO: 809154 - protein, 9 aa, Homo Sapiens
DANNNARND

SEQ ID NO: 809155 - protein, 9 aa, Homo Sapiens
PREVEEIRR

SEQ ID NO: 809156 - protein, 9 aa, Homo Sapiens
ATAANYLLA

SEQ ID NO: 809157 - protein, 9 aa, Homo Sapiens
KLDQIGSYL

SEQ ID NO: 809158 - protein, 9 aa, Homo Sapiens
TTEILRLFG

SEQ ID NO: 809159 - protein, 9 aa, Homo Sapiens
PDLIPKMPY

SEQ ID NO: 809160 - protein, 9 aa, Homo Sapiens
PQKLYPKRD

SEQ ID NO: 809161 - protein, 9 aa, Homo Sapiens
TTAQETLAA

SEQ ID NO: 809162 - protein, 9 aa, Homo Sapiens
LLIAMPQLF

SEQ ID NO: 809163 - protein, 9 aa, Homo Sapiens
SLEAPIKLV

SEQ ID NO: 809164 - protein, 9 aa, Homo Sapiens
EYQIQEPNR

SEQ ID NO: 809165 - protein, 9 aa, Homo Sapiens
LDDNFLTTL

SEQ ID NO: 809166 - protein, 9 aa, Homo Sapiens
NRCTFETAR

SEQ ID NO: 809167 - protein, 9 aa, Homo Sapiens
LWKVNPAAA

SEQ ID NO: 809168 - protein, 9 aa, Homo Sapiens
DANKDNKVD

SEQ ID NO: 809169 - protein, 9 aa, Homo Sapiens
LKGKMRARY

SEQ ID NO: 809170 - protein, 9 aa, Homo Sapiens
PAKKRKMNL

SEQ ID NO: 809171 - protein, 9 aa, Homo Sapiens
LVIFLDVKH

SEQ ID NO: 809172 - protein, 9 aa, Homo Sapiens
VGIDYNCRE

SEQ ID NO: 809173 - protein, 9 aa, Homo Sapiens
MGPGRKWDF

SEQ ID NO: 809174 - protein, 9 aa, Homo Sapiens
MNSVIQVLS

SEQ ID NO: 809175 - protein, 9 aa, Homo Sapiens
ILYLNEKGW

SEQ ID NO: 809176 - protein, 9 aa, Homo Sapiens
LVRESENSP

SEQ ID NO: 809177 - protein, 9 aa, Homo Sapiens
LLVTNNHFA

SEQ ID NO: 809178 - protein, 9 aa, Homo Sapiens
SGSMRIGKY

SEQ ID NO: 809179 - protein, 9 aa, Homo Sapiens
VDTSWKELS

SEQ ID NO: 809180 - protein, 9 aa, Homo Sapiens
LLKKQFFNR

SEQ ID NO: 809181 - protein, 9 aa, Homo Sapiens
TKNVNLNTG

SEQ ID NO: 809182 - protein, 9 aa, Homo Sapiens
KCPDCGERF

SEQ ID NO: 809183 - protein, 9 aa, Homo Sapiens
VEDVLNAQK

SEQ ID NO: 809184 - protein, 9 aa, Homo Sapiens
ATWKTLLHM

SEQ ID NO: 809185 - protein, 9 aa, Homo Sapiens
VYPKCLFDD

SEQ ID NO: 809186 - protein, 9 aa, Homo Sapiens
QISRKKQTQ

SEQ ID NO: 809187 - protein, 9 aa, Homo Sapiens
FLARTKFKL

SEQ ID NO: 809188 - protein, 9 aa, Homo Sapiens
ELDNEDLKL

SEQ ID NO: 809189 - protein, 9 aa, Homo Sapiens
QDPFLYDYK

SEQ ID NO: 809190 - protein, 9 aa, Homo Sapiens
EVAHRITAE

SEQ ID NO: 809191 - protein, 9 aa, Homo Sapiens
AGGQSDENK

SEQ ID NO: 809192 - protein, 9 aa, Homo Sapiens
KPTKSEFTK

SEQ ID NO: 809193 - protein, 9 aa, Homo Sapiens
VVMNSRDFG

SEQ ID NO: 809194 - protein, 9 aa, Homo Sapiens
PLNEAVYTC

SEQ ID NO: 809195 - protein, 9 aa, Homo Sapiens
AQDGLDSEH

SEQ ID NO: 809196 - protein, 9 aa, Homo Sapiens
KEYARLCQE

SEQ ID NO: 809197 - protein, 9 aa, Homo Sapiens
VLGYLGCYC

SEQ ID NO: 809198 - protein, 9 aa, Homo Sapiens
FEIYGFFIL

SEQ ID NO: 809199 - protein, 9 aa, Homo Sapiens
GLGEPFELK

SEQ ID NO: 809200 - protein, 9 aa, Homo Sapiens
VEDLLPNST

SEQ ID NO: 809201 - protein, 9 aa, Homo Sapiens
ERAHFIRCI

SEQ ID NO: 809202 - protein, 9 aa, Homo Sapiens
GNTRSSSVY

SEQ ID NO: 809203 - protein, 9 aa, Homo Sapiens
IPTPSNKLA

SEQ ID NO: 809204 - protein, 9 aa, Homo Sapiens
ICASYFSSH

SEQ ID NO: 809205 - protein, 9 aa, Homo Sapiens
GSECLFSVV

SEQ ID NO: 809206 - protein, 9 aa, Homo Sapiens
PGKVLQNLY

SEQ ID NO: 809207 - protein, 9 aa, Homo Sapiens
FDRFQDTVL

SEQ ID NO: 809208 - protein, 9 aa, Homo Sapiens
NTKNKRKLF

SEQ ID NO: 809209 - protein, 9 aa, Homo Sapiens
QSINKWAAQ

SEQ ID NO: 809210 - protein, 9 aa, Homo Sapiens
NLPKSSIVY

SEQ ID NO: 809211 - protein, 9 aa, Homo Sapiens
ATAEIIDEF

SEQ ID NO: 809212 - protein, 9 aa, Homo Sapiens
TSRKLPHSK

SEQ ID NO: 809213 - protein, 9 aa, Homo Sapiens
NEAVMSTLE

SEQ ID NO: 809214 - protein, 9 aa, Homo Sapiens
LGLLCFPIN

SEQ ID NO: 809215 - protein, 9 aa, Homo Sapiens
EFSVSLLIF

SEQ ID NO: 809216 - protein, 9 aa, Homo Sapiens
SGFLFLRLF

SEQ ID NO: 809217 - protein, 9 aa, Homo Sapiens
ILHFAIQDI

SEQ ID NO: 809218 - protein, 9 aa, Homo Sapiens
IRVSPIFSK

SEQ ID NO: 809219 - protein, 9 aa, Homo Sapiens
TLENYNSPV

SEQ ID NO: 809220 - protein, 9 aa, Homo Sapiens
RDIVNINIS

SEQ ID NO: 809221 - protein, 9 aa, Homo Sapiens
NCKEAFQHE

SEQ ID NO: 809222 - protein, 9 aa, Homo Sapiens
KKLADHLKV

SEQ ID NO: 809223 - protein, 9 aa, Homo Sapiens
NFWDKVLEE

SEQ ID NO: 809224 - protein, 9 aa, Homo Sapiens
PVNYEHVTV

SEQ ID NO: 809225 - protein, 9 aa, Homo Sapiens
DIAHSIQTL

SEQ ID NO: 809226 - protein, 9 aa, Homo Sapiens
EKLPEVLSM

SEQ ID NO: 809227 - protein, 9 aa, Homo Sapiens
QPKCPEKDI

SEQ ID NO: 809228 - protein, 9 aa, Homo Sapiens
SIPFSVKDI

SEQ ID NO: 809229 - protein, 9 aa, Homo Sapiens
TQLTNKGQP

SEQ ID NO: 809230 - protein, 9 aa, Homo Sapiens
TYAIKCKFY

SEQ ID NO: 809231 - protein, 9 aa, Homo Sapiens
EFIDKFLSL

SEQ ID NO: 809232 - protein, 9 aa, Homo Sapiens
RDVGTNTSF

SEQ ID NO: 809233 - protein, 9 aa, Homo Sapiens
WDALFDIDR

SEQ ID NO: 809234 - protein, 9 aa, Homo Sapiens
DGSDSSDSS

SEQ ID NO: 809235 - protein, 9 aa, Homo Sapiens
DSRKSKHFE

SEQ ID NO: 809236 - protein, 9 aa, Homo Sapiens
QFFQGGPIQ

SEQ ID NO: 809237 - protein, 9 aa, Homo Sapiens
GETLIHNRT

SEQ ID NO: 809238 - protein, 9 aa, Homo Sapiens
CFKDNQGDT

SEQ ID NO: 809239 - protein, 9 aa, Homo Sapiens
QKYLETRPT

SEQ ID NO: 809240 - protein, 9 aa, Homo Sapiens
KGITFEIFH

SEQ ID NO: 809241 - protein, 9 aa, Homo Sapiens
YLDTPFSGT

SEQ ID NO: 809242 - protein, 9 aa, Homo Sapiens
YLFDNPRRY

SEQ ID NO: 809243 - protein, 9 aa, Homo Sapiens
LSCGVPGSQ

SEQ ID NO: 809244 - protein, 9 aa, Homo Sapiens
EFDSDYLRH

SEQ ID NO: 809245 - protein, 9 aa, Homo Sapiens
DAVQVNLTA

SEQ ID NO: 809246 - protein, 9 aa, Homo Sapiens
QKSKSSQLS

SEQ ID NO: 809247 - protein, 9 aa, Homo Sapiens
FLHNNKLST

SEQ ID NO: 809248 - protein, 9 aa, Homo Sapiens
KPRYLRFTW

SEQ ID NO: 809249 - protein, 9 aa, Homo Sapiens
KKLGNACDN

SEQ ID NO: 809250 - protein, 9 aa, Homo Sapiens
KNLLCLDAS

SEQ ID NO: 809251 - protein, 9 aa, Homo Sapiens
QNAPPICLR

SEQ ID NO: 809252 - protein, 9 aa, Homo Sapiens
LDQKDKELL

SEQ ID NO: 809253 - protein, 9 aa, Homo Sapiens
QFLVIEDNK

SEQ ID NO: 809254 - protein, 9 aa, Homo Sapiens
LTFIGINFG

SEQ ID NO: 809255 - protein, 9 aa, Homo Sapiens
MVDGYRYTS

SEQ ID NO: 809256 - protein, 9 aa, Homo Sapiens
DEDYRGNAG

SEQ ID NO: 809257 - protein, 9 aa, Homo Sapiens
RLQDIAERI

SEQ ID NO: 809258 - protein, 9 aa, Homo Sapiens
LVSTFNNYY

SEQ ID NO: 809259 - protein, 9 aa, Homo Sapiens
FIYDAPPNI

SEQ ID NO: 809260 - protein, 9 aa, Homo Sapiens
VSYLRSGTK

SEQ ID NO: 809261 - protein, 9 aa, Homo Sapiens
VSKSRIRST

SEQ ID NO: 809262 - protein, 9 aa, Homo Sapiens
PISFFLSKC

SEQ ID NO: 809263 - protein, 9 aa, Homo Sapiens
ITVTLSNQI

SEQ ID NO: 809264 - protein, 9 aa, Homo Sapiens
PNSKEQRVK

SEQ ID NO: 809265 - protein, 9 aa, Homo Sapiens
QQQNLNKKE

SEQ ID NO: 809266 - protein, 9 aa, Homo Sapiens
HTVIRSLNR

SEQ ID NO: 809267 - protein, 9 aa, Homo Sapiens
LFKNKSSGS

SEQ ID NO: 809268 - protein, 9 aa, Homo Sapiens
QMKDPLPSE

SEQ ID NO: 809269 - protein, 9 aa, Homo Sapiens
GENLKDDSL

SEQ ID NO: 809270 - protein, 9 aa, Homo Sapiens
EISRIKTLQ

SEQ ID NO: 809271 - protein, 9 aa, Homo Sapiens
SAFQELPAS

SEQ ID NO: 809272 - protein, 9 aa, Homo Sapiens
FGADTIGQI

SEQ ID NO: 809273 - protein, 9 aa, Homo Sapiens
AMLHYIQDK

SEQ ID NO: 809274 - protein, 9 aa, Homo Sapiens
QVVPRMHEG

SEQ ID NO: 809275 - protein, 9 aa, Homo Sapiens
CGRTYRHAS

SEQ ID NO: 809276 - protein, 9 aa, Homo Sapiens
SHGIGTDSW

SEQ ID NO: 809277 - protein, 9 aa, Homo Sapiens
KSNEPSSAD

SEQ ID NO: 809278 - protein, 9 aa, Homo Sapiens
RLYELDILF

SEQ ID NO: 809279 - protein, 9 aa, Homo Sapiens
SPKFSTQFH

SEQ ID NO: 809280 - protein, 9 aa, Homo Sapiens
EGYTFMFDE

SEQ ID NO: 809281 - protein, 9 aa, Homo Sapiens
HQDFSRLSD

SEQ ID NO: 809282 - protein, 9 aa, Homo Sapiens
ELANTVCHS

SEQ ID NO: 809283 - protein, 9 aa, Homo Sapiens
EETILQHTL

SEQ ID NO: 809284 - protein, 9 aa, Homo Sapiens
NTGDNFRKN

SEQ ID NO: 809285 - protein, 9 aa, Homo Sapiens
MAAKNKECV

SEQ ID NO: 809286 - protein, 9 aa, Homo Sapiens
SCCSTPGVE

SEQ ID NO: 809287 - protein, 9 aa, Homo Sapiens
RIVTMPREV

SEQ ID NO: 809288 - protein, 9 aa, Homo Sapiens
AVNYHDKTG

SEQ ID NO: 809289 - protein, 9 aa, Homo Sapiens
IVRDDGIQK

SEQ ID NO: 809290 - protein, 9 aa, Homo Sapiens
MAQKNEWPL

SEQ ID NO: 809291 - protein, 9 aa, Homo Sapiens
LDYNYLYHL

SEQ ID NO: 809292 - protein, 9 aa, Homo Sapiens
DRNASVGNA

SEQ ID NO: 809293 - protein, 9 aa, Homo Sapiens
PRSSYYFDM

SEQ ID NO: 809294 - protein, 9 aa, Homo Sapiens
SIWNRNARY

SEQ ID NO: 809295 - protein, 9 aa, Homo Sapiens
ESVCIECNC

SEQ ID NO: 809296 - protein, 9 aa, Homo Sapiens
SVQRDASLP

SEQ ID NO: 809297 - protein, 9 aa, Homo Sapiens
LMAALRRGG

SEQ ID NO: 809298 - protein, 9 aa, Homo Sapiens
KNELEKFPL

SEQ ID NO: 809299 - protein, 9 aa, Homo Sapiens
LPHGRCHGC

SEQ ID NO: 809300 - protein, 9 aa, Homo Sapiens
LYQCYLIVY

SEQ ID NO: 809301 - protein, 9 aa, Homo Sapiens
YCLCHKVQC

SEQ ID NO: 809302 - protein, 9 aa, Homo Sapiens
YICFQNGEE

SEQ ID NO: 809303 - protein, 9 aa, Homo Sapiens
KPEMNVRSA

SEQ ID NO: 809304 - protein, 9 aa, Homo Sapiens
PSRSCGLLD

SEQ ID NO: 809305 - protein, 9 aa, Homo Sapiens
LHTSIPQQL

SEQ ID NO: 809306 - protein, 9 aa, Homo Sapiens
EQLSVVKGI

SEQ ID NO: 809307 - protein, 9 aa, Homo Sapiens
APDETIQSK

SEQ ID NO: 809308 - protein, 9 aa, Homo Sapiens
GDEERPQLS

SEQ ID NO: 809309 - protein, 9 aa, Homo Sapiens
PTSSCCAPR

SEQ ID NO: 809310 - protein, 9 aa, Homo Sapiens
VCENCKPLR

SEQ ID NO: 809311 - protein, 9 aa, Homo Sapiens
TYGDTINRQ

SEQ ID NO: 809312 - protein, 9 aa, Homo Sapiens
VQDVKSTTI

SEQ ID NO: 809313 - protein, 9 aa, Homo Sapiens
DTSQDEQDE

SEQ ID NO: 809314 - protein, 9 aa, Homo Sapiens
RLHLEDRVE

SEQ ID NO: 809315 - protein, 9 aa, Homo Sapiens
IAHDAELVD

SEQ ID NO: 809316 - protein, 9 aa, Homo Sapiens
ASEESQILV

SEQ ID NO: 809317 - protein, 9 aa, Homo Sapiens
YAAPGSLIG

SEQ ID NO: 809318 - protein, 9 aa, Homo Sapiens
TQVQVPTPA

SEQ ID NO: 809319 - protein, 9 aa, Homo Sapiens
EASASEVLP

SEQ ID NO: 809320 - protein, 9 aa, Homo Sapiens
VINNTFQSF

SEQ ID NO: 809321 - protein, 9 aa, Homo Sapiens
EANNLGFNC

SEQ ID NO: 809322 - protein, 9 aa, Homo Sapiens
MPFSIYEGQ

SEQ ID NO: 809323 - protein, 9 aa, Homo Sapiens
PLSHSITQG

SEQ ID NO: 809324 - protein, 9 aa, Homo Sapiens
RSTTKLGEN

SEQ ID NO: 809325 - protein, 9 aa, Homo Sapiens
DPTLYRDVT

SEQ ID NO: 809326 - protein, 9 aa, Homo Sapiens
DFKLALRLQ

SEQ ID NO: 809327 - protein, 9 aa, Homo Sapiens
KAFTGSIFV

SEQ ID NO: 809328 - protein, 9 aa, Homo Sapiens
QLGVELFDE

SEQ ID NO: 809329 - protein, 9 aa, Homo Sapiens
QHEALRREV

SEQ ID NO: 809330 - protein, 9 aa, Homo Sapiens
QVEGGAIYL

SEQ ID NO: 809331 - protein, 9 aa, Homo Sapiens
QQCYWLCQQ

SEQ ID NO: 809332 - protein, 9 aa, Homo Sapiens
TVQTSLAMQ

SEQ ID NO: 809333 - protein, 9 aa, Homo Sapiens
IGPPAVGKS

SEQ ID NO: 809334 - protein, 9 aa, Homo Sapiens
IKRPDVCGK

SEQ ID NO: 809335 - protein, 9 aa, Homo Sapiens
TCTYADKYT

SEQ ID NO: 809336 - protein, 9 aa, Homo Sapiens
IDSFQGSVM

SEQ ID NO: 809337 - protein, 9 aa, Homo Sapiens
NNLKKNYCR

SEQ ID NO: 809338 - protein, 9 aa, Homo Sapiens
SLLYMSTEI

SEQ ID NO: 809339 - protein, 9 aa, Homo Sapiens
APPYAAVNA

SEQ ID NO: 809340 - protein, 9 aa, Homo Sapiens
HLYEQPEIN

SEQ ID NO: 809341 - protein, 9 aa, Homo Sapiens
GRWKRPKGI

SEQ ID NO: 809342 - protein, 9 aa, Homo Sapiens
KISRNSERC

SEQ ID NO: 809343 - protein, 9 aa, Homo Sapiens
ISRMYKELK

SEQ ID NO: 809344 - protein, 9 aa, Homo Sapiens
SRSKHSDDE

SEQ ID NO: 809345 - protein, 9 aa, Homo Sapiens
PAGPCFQLR

SEQ ID NO: 809346 - protein, 9 aa, Homo Sapiens
SRTDNGIFY

SEQ ID NO: 809347 - protein, 9 aa, Homo Sapiens
FYLIHLQLF

SEQ ID NO: 809348 - protein, 9 aa, Homo Sapiens
PGQYTISMP

SEQ ID NO: 809349 - protein, 9 aa, Homo Sapiens
SLLEHYLPW

SEQ ID NO: 809350 - protein, 9 aa, Homo Sapiens
RELFSECFF

SEQ ID NO: 809351 - protein, 9 aa, Homo Sapiens
MPGTERFQH

SEQ ID NO: 809352 - protein, 9 aa, Homo Sapiens
CSLKEEDNG

SEQ ID NO: 809353 - protein, 9 aa, Homo Sapiens
PNPGLLQAS

SEQ ID NO: 809354 - protein, 9 aa, Homo Sapiens
SLASVVFLL

SEQ ID NO: 809355 - protein, 9 aa, Homo Sapiens
VNYLTHMVV

SEQ ID NO: 809356 - protein, 9 aa, Homo Sapiens
PEVASHSPA

SEQ ID NO: 809357 - protein, 9 aa, Homo Sapiens
KEKVIRAVV

SEQ ID NO: 809358 - protein, 9 aa, Homo Sapiens
TTGHLIYTC

SEQ ID NO: 809359 - protein, 9 aa, Homo Sapiens
WLKEAGGNT

SEQ ID NO: 809360 - protein, 9 aa, Homo Sapiens
VNLRNNYFI

SEQ ID NO: 809361 - protein, 9 aa, Homo Sapiens
ALVEHVFRI

SEQ ID NO: 809362 - protein, 9 aa, Homo Sapiens
ERLKYYQIL

SEQ ID NO: 809363 - protein, 9 aa, Homo Sapiens
LAFLIFNIL

SEQ ID NO: 809364 - protein, 9 aa, Homo Sapiens
RVQVWFQNQ

SEQ ID NO: 809365 - protein, 9 aa, Homo Sapiens
TEKSKLNIL

SEQ ID NO: 809366 - protein, 9 aa, Homo Sapiens
CWIIEDTAC

SEQ ID NO: 809367 - protein, 9 aa, Homo Sapiens
FIPIKVEQI

SEQ ID NO: 809368 - protein, 9 aa, Homo Sapiens
VGLVNLCIF

SEQ ID NO: 809369 - protein, 9 aa, Homo Sapiens
YSLLKTDLL

SEQ ID NO: 809370 - protein, 9 aa, Homo Sapiens
SKSPDVSKH

SEQ ID NO: 809371 - protein, 9 aa, Homo Sapiens
NRFKNIDES

SEQ ID NO: 809372 - protein, 9 aa, Homo Sapiens
YSTSGNELG

SEQ ID NO: 809373 - protein, 9 aa, Homo Sapiens
MLRADANNN

SEQ ID NO: 809374 - protein, 9 aa, Homo Sapiens
LCKKPRKNV

SEQ ID NO: 809375 - protein, 9 aa, Homo Sapiens
YSDEDNLPE

SEQ ID NO: 809376 - protein, 9 aa, Homo Sapiens
TVESITYIR

SEQ ID NO: 809377 - protein, 9 aa, Homo Sapiens
WKRLQLRLN

SEQ ID NO: 809378 - protein, 9 aa, Homo Sapiens
ALGGRESYM

SEQ ID NO: 809379 - protein, 9 aa, Homo Sapiens
CYLIVYYTG

SEQ ID NO: 809380 - protein, 9 aa, Homo Sapiens
RNMTIKAEL

SEQ ID NO: 809381 - protein, 9 aa, Homo Sapiens
DHVQQVEKH

SEQ ID NO: 809382 - protein, 9 aa, Homo Sapiens
LQMRLKRPE

SEQ ID NO: 809383 - protein, 9 aa, Homo Sapiens
LLVYLIHSV

SEQ ID NO: 809384 - protein, 9 aa, Homo Sapiens
SSSEDREPL

SEQ ID NO: 809385 - protein, 9 aa, Homo Sapiens
DCKRSNIDS

SEQ ID NO: 809386 - protein, 9 aa, Homo Sapiens
TKQLIISCL

SEQ ID NO: 809387 - protein, 9 aa, Homo Sapiens
ELDEKDEDT

SEQ ID NO: 809388 - protein, 9 aa, Homo Sapiens
MPIKICIIG

SEQ ID NO: 809389 - protein, 9 aa, Homo Sapiens
LIKGRNIYE

SEQ ID NO: 809390 - protein, 9 aa, Homo Sapiens
RIEEVMIGE

SEQ ID NO: 809391 - protein, 9 aa, Homo Sapiens
LPAEAPSPP

SEQ ID NO: 809392 - protein, 9 aa, Homo Sapiens
NSKRVRIIA

SEQ ID NO: 809393 - protein, 9 aa, Homo Sapiens
YRKYDLTRI

SEQ ID NO: 809394 - protein, 9 aa, Homo Sapiens
EKDKIYLSA

SEQ ID NO: 809395 - protein, 9 aa, Homo Sapiens
IALRYVAPL

SEQ ID NO: 809396 - protein, 9 aa, Homo Sapiens
HNLYGLTKA

SEQ ID NO: 809397 - protein, 9 aa, Homo Sapiens
KVAQAVCFL

SEQ ID NO: 809398 - protein, 9 aa, Homo Sapiens
LTTAIHTYQ

SEQ ID NO: 809399 - protein, 9 aa, Homo Sapiens
QTALRVSSQ

SEQ ID NO: 809400 - protein, 9 aa, Homo Sapiens
SLEYLDIFG

SEQ ID NO: 809401 - protein, 9 aa, Homo Sapiens
TGVLYVNKK

SEQ ID NO: 809402 - protein, 9 aa, Homo Sapiens
QRFTQVSNE

SEQ ID NO: 809403 - protein, 9 aa, Homo Sapiens
KDQPGRLKT

SEQ ID NO: 809404 - protein, 9 aa, Homo Sapiens
RERVKTSVE

SEQ ID NO: 809405 - protein, 9 aa, Homo Sapiens
DHMSLWRGF

SEQ ID NO: 809406 - protein, 9 aa, Homo Sapiens
AVKKMQMLS

SEQ ID NO: 809407 - protein, 9 aa, Homo Sapiens
RNTFQGGAN

SEQ ID NO: 809408 - protein, 9 aa, Homo Sapiens
SDTMTTTER

SEQ ID NO: 809409 - protein, 9 aa, Homo Sapiens
TEKTMIYFV

SEQ ID NO: 809410 - protein, 9 aa, Homo Sapiens
EMRLIRFQS

SEQ ID NO: 809411 - protein, 9 aa, Homo Sapiens
CKQRRIRTT

SEQ ID NO: 809412 - protein, 9 aa, Homo Sapiens
YTSWIPPFP

SEQ ID NO: 809413 - protein, 9 aa, Homo Sapiens
VDSNGSTNL

SEQ ID NO: 809414 - protein, 9 aa, Homo Sapiens
EKRQIAAHT

SEQ ID NO: 809415 - protein, 9 aa, Homo Sapiens
KLRTRVHKE

SEQ ID NO: 809416 - protein, 9 aa, Homo Sapiens
QIIHFVLCV

SEQ ID NO: 809417 - protein, 9 aa, Homo Sapiens
NVVRQLVAG

SEQ ID NO: 809418 - protein, 9 aa, Homo Sapiens
VNIRFCLEG

SEQ ID NO: 809419 - protein, 9 aa, Homo Sapiens
KVFDFFGDH

SEQ ID NO: 809420 - protein, 9 aa, Homo Sapiens
PYGAGRTKA

SEQ ID NO: 809421 - protein, 9 aa, Homo Sapiens
RAAIIVGVE

SEQ ID NO: 809422 - protein, 9 aa, Homo Sapiens
VIPFSLANK

SEQ ID NO: 809423 - protein, 9 aa, Homo Sapiens
RLKALQLNE

SEQ ID NO: 809424 - protein, 9 aa, Homo Sapiens
RKQKQTNLN

SEQ ID NO: 809425 - protein, 9 aa, Homo Sapiens
DGDREVQQA

SEQ ID NO: 809426 - protein, 9 aa, Homo Sapiens
ACIRRAGGK

SEQ ID NO: 809427 - protein, 9 aa, Homo Sapiens
NVVSEPIKG

SEQ ID NO: 809428 - protein, 9 aa, Homo Sapiens
KYLIYGPVL

SEQ ID NO: 809429 - protein, 9 aa, Homo Sapiens
PAQEGGPCA

SEQ ID NO: 809430 - protein, 9 aa, Homo Sapiens
EGNLTLRYI

SEQ ID NO: 809431 - protein, 9 aa, Homo Sapiens
RRCWLVFRE

SEQ ID NO: 809432 - protein, 9 aa, Homo Sapiens
MIILEKKFY

SEQ ID NO: 809433 - protein, 9 aa, Homo Sapiens
VLDNLGNGT

SEQ ID NO: 809434 - protein, 9 aa, Homo Sapiens
CGGAYPIGT

SEQ ID NO: 809435 - protein, 9 aa, Homo Sapiens
TAPYKYPSK

SEQ ID NO: 809436 - protein, 9 aa, Homo Sapiens
EYPALSLQD

SEQ ID NO: 809437 - protein, 9 aa, Homo Sapiens
TAVVWTDAF

SEQ ID NO: 809438 - protein, 9 aa, Homo Sapiens
HARHAQIRK

SEQ ID NO: 809439 - protein, 9 aa, Homo Sapiens
KKAHHDFGY

SEQ ID NO: 809440 - protein, 9 aa, Homo Sapiens
PVTTGPLFT

SEQ ID NO: 809441 - protein, 9 aa, Homo Sapiens
PSPDIIPPG

SEQ ID NO: 809442 - protein, 9 aa, Homo Sapiens
IISNIRQSS

SEQ ID NO: 809443 - protein, 9 aa, Homo Sapiens
PASLNGHLP

SEQ ID NO: 809444 - protein, 9 aa, Homo Sapiens
ILQEHPQVV

SEQ ID NO: 809445 - protein, 9 aa, Homo Sapiens
NLFQQNKDH

SEQ ID NO: 809446 - protein, 9 aa, Homo Sapiens
LLLSQGILF

SEQ ID NO: 809447 - protein, 9 aa, Homo Sapiens
ELQRRIIQW

SEQ ID NO: 809448 - protein, 9 aa, Homo Sapiens
NMKRALNDV

SEQ ID NO: 809449 - protein, 9 aa, Homo Sapiens
LESEDTPNQ

SEQ ID NO: 809450 - protein, 9 aa, Homo Sapiens
KSPLRHARH

SEQ ID NO: 809451 - protein, 9 aa, Homo Sapiens
DKEKERYAE

SEQ ID NO: 809452 - protein, 9 aa, Homo Sapiens
SVEDLLNYQ

SEQ ID NO: 809453 - protein, 9 aa, Homo Sapiens
EERSLDSRG

SEQ ID NO: 809454 - protein, 9 aa, Homo Sapiens
LLILLFCLF

SEQ ID NO: 809455 - protein, 9 aa, Homo Sapiens
YLFDEAIKL

SEQ ID NO: 809456 - protein, 9 aa, Homo Sapiens
FKGVKKIKW

SEQ ID NO: 809457 - protein, 9 aa, Homo Sapiens
PYSRDYKIK

SEQ ID NO: 809458 - protein, 9 aa, Homo Sapiens
HQLRHADID

SEQ ID NO: 809459 - protein, 9 aa, Homo Sapiens
QRKDILQVI

SEQ ID NO: 809460 - protein, 9 aa, Homo Sapiens
PDASYLDNM

SEQ ID NO: 809461 - protein, 9 aa, Homo Sapiens
IATDDEIDE

SEQ ID NO: 809462 - protein, 9 aa, Homo Sapiens
VVAGNIFLI

SEQ ID NO: 809463 - protein, 9 aa, Homo Sapiens
GNLAMNYST

SEQ ID NO: 809464 - protein, 9 aa, Homo Sapiens
VKAVEFILI

SEQ ID NO: 809465 - protein, 9 aa, Homo Sapiens
RIIYVSLPD

SEQ ID NO: 809466 - protein, 9 aa, Homo Sapiens
PDASTGRVS

SEQ ID NO: 809467 - protein, 9 aa, Homo Sapiens
RAHSSPVTP

SEQ ID NO: 809468 - protein, 9 aa, Homo Sapiens
FGFLQELSK

SEQ ID NO: 809469 - protein, 9 aa, Homo Sapiens
VEPPKYEFF

SEQ ID NO: 809470 - protein, 9 aa, Homo Sapiens
VIQQRKSYR

SEQ ID NO: 809471 - protein, 9 aa, Homo Sapiens
LKEFSPDLG

SEQ ID NO: 809472 - protein, 9 aa, Homo Sapiens
SLLEGADYV

SEQ ID NO: 809473 - protein, 9 aa, Homo Sapiens
TGEALIHLD

SEQ ID NO: 809474 - protein, 9 aa, Homo Sapiens
HNLEKLRVD

SEQ ID NO: 809475 - protein, 9 aa, Homo Sapiens
MPTHKNLCS

SEQ ID NO: 809476 - protein, 9 aa, Homo Sapiens
AKQVRAKKP

SEQ ID NO: 809477 - protein, 9 aa, Homo Sapiens
MEVYHLSYL

SEQ ID NO: 809478 - protein, 9 aa, Homo Sapiens
CAEYNSDLH

SEQ ID NO: 809479 - protein, 9 aa, Homo Sapiens
ERPSKYIAT

SEQ ID NO: 809480 - protein, 9 aa, Homo Sapiens
PKLGLRAED

SEQ ID NO: 809481 - protein, 9 aa, Homo Sapiens
DARMPRKRK

SEQ ID NO: 809482 - protein, 9 aa, Homo Sapiens
RPPGILKNA

SEQ ID NO: 809483 - protein, 9 aa, Homo Sapiens
KPYGCNKCG

SEQ ID NO: 809484 - protein, 9 aa, Homo Sapiens
HYHNSRDRW

SEQ ID NO: 809485 - protein, 9 aa, Homo Sapiens
DNFPLGTVQ

SEQ ID NO: 809486 - protein, 9 aa, Homo Sapiens
EPTFAARPF

SEQ ID NO: 809487 - protein, 9 aa, Homo Sapiens
FHDHAEVVF

SEQ ID NO: 809488 - protein, 9 aa, Homo Sapiens
VSKCSEEIN

SEQ ID NO: 809489 - protein, 9 aa, Homo Sapiens
SWNGEDRLL

SEQ ID NO: 809490 - protein, 9 aa, Homo Sapiens
IRKILGTNE

SEQ ID NO: 809491 - protein, 9 aa, Homo Sapiens
WALCQEIST

SEQ ID NO: 809492 - protein, 9 aa, Homo Sapiens
SNKLENGGA

SEQ ID NO: 809493 - protein, 9 aa, Homo Sapiens
PGGDWEVNG

SEQ ID NO: 809494 - protein, 9 aa, Homo Sapiens
SSRSPRASS

SEQ ID NO: 809495 - protein, 9 aa, Homo Sapiens
KLEKRDEQR

SEQ ID NO: 809496 - protein, 9 aa, Homo Sapiens
PSHQKKLVL

SEQ ID NO: 809497 - protein, 9 aa, Homo Sapiens
VQMTVKYYM

SEQ ID NO: 809498 - protein, 9 aa, Homo Sapiens
KESYAIQSL

SEQ ID NO: 809499 - protein, 9 aa, Homo Sapiens
SKSVSSTNF

SEQ ID NO: 809500 - protein, 9 aa, Homo Sapiens
IFDSPAEET

SEQ ID NO: 809501 - protein, 9 aa, Homo Sapiens
CSCQTLKLH

SEQ ID NO: 809502 - protein, 9 aa, Homo Sapiens
SSTLILHKI

SEQ ID NO: 809503 - protein, 9 aa, Homo Sapiens
LLLYSFAAT

SEQ ID NO: 809504 - protein, 9 aa, Homo Sapiens
QLRIKGDYV

SEQ ID NO: 809505 - protein, 9 aa, Homo Sapiens
PIFRDVLNR

SEQ ID NO: 809506 - protein, 9 aa, Homo Sapiens
AFILDHHCW

SEQ ID NO: 809507 - protein, 9 aa, Homo Sapiens
LKEEKPRAQ

SEQ ID NO: 809508 - protein, 9 aa, Homo Sapiens
LVGYRISHM

SEQ ID NO: 809509 - protein, 9 aa, Homo Sapiens
MLVMVECFG

SEQ ID NO: 809510 - protein, 9 aa, Homo Sapiens
DGGHGGCLL

SEQ ID NO: 809511 - protein, 9 aa, Homo Sapiens
DKEEEIQYI

SEQ ID NO: 809512 - protein, 9 aa, Homo Sapiens
HAETERLFG

SEQ ID NO: 809513 - protein, 9 aa, Homo Sapiens
LQGIQNYHS

SEQ ID NO: 809514 - protein, 9 aa, Homo Sapiens
LLHLVDQEE

SEQ ID NO: 809515 - protein, 9 aa, Homo Sapiens
LTCQGSSQW

SEQ ID NO: 809516 - protein, 9 aa, Homo Sapiens
FLENKRFTE

SEQ ID NO: 809517 - protein, 9 aa, Homo Sapiens
DRVLLGNDT

SEQ ID NO: 809518 - protein, 9 aa, Homo Sapiens
NILTELRRL

SEQ ID NO: 809519 - protein, 9 aa, Homo Sapiens
EDIKSLWSG

SEQ ID NO: 809520 - protein, 9 aa, Homo Sapiens
NYLKLLGKG

SEQ ID NO: 809521 - protein, 9 aa, Homo Sapiens
VFSNKVLEK

SEQ ID NO: 809522 - protein, 9 aa, Homo Sapiens
INFLIGILY

SEQ ID NO: 809523 - protein, 9 aa, Homo Sapiens
RLCEQDKLP

SEQ ID NO: 809524 - protein, 9 aa, Homo Sapiens
QGGGGGGDS

SEQ ID NO: 809525 - protein, 9 aa, Homo Sapiens
VWYEHRFAP

SEQ ID NO: 809526 - protein, 9 aa, Homo Sapiens
QQSVRLDDN

SEQ ID NO: 809527 - protein, 9 aa, Homo Sapiens
FATLTNHKI

SEQ ID NO: 809528 - protein, 9 aa, Homo Sapiens
TKNGTSSKK

SEQ ID NO: 809529 - protein, 9 aa, Homo Sapiens
QESKLDVLL

SEQ ID NO: 809530 - protein, 9 aa, Homo Sapiens
QTRCAPFLP

SEQ ID NO: 809531 - protein, 9 aa, Homo Sapiens
IFTTEILGL

SEQ ID NO: 809532 - protein, 9 aa, Homo Sapiens
EDETINGNY

SEQ ID NO: 809533 - protein, 9 aa, Homo Sapiens
IGLSVGLGN

SEQ ID NO: 809534 - protein, 9 aa, Homo Sapiens
MALGLQRAM

SEQ ID NO: 809535 - protein, 9 aa, Homo Sapiens
TTAIIQLAP

SEQ ID NO: 809536 - protein, 9 aa, Homo Sapiens
LFGGMCQPC

SEQ ID NO: 809537 - protein, 9 aa, Homo Sapiens
QQLPRRVAV

SEQ ID NO: 809538 - protein, 9 aa, Homo Sapiens
VVYTNQNVV

SEQ ID NO: 809539 - protein, 9 aa, Homo Sapiens
MEKNIEAPI

SEQ ID NO: 809540 - protein, 9 aa, Homo Sapiens
RLQESREGL

SEQ ID NO: 809541 - protein, 9 aa, Homo Sapiens
KDSAVCSTI

SEQ ID NO: 809542 - protein, 9 aa, Homo Sapiens
KRQNGQTDP

SEQ ID NO: 809543 - protein, 9 aa, Homo Sapiens
VVSQAGGPK

SEQ ID NO: 809544 - protein, 9 aa, Homo Sapiens
SPVTTGPLF

SEQ ID NO: 809545 - protein, 9 aa, Homo Sapiens
ASCFPACSP

SEQ ID NO: 809546 - protein, 9 aa, Homo Sapiens
EHLQNELRE

SEQ ID NO: 809547 - protein, 9 aa, Homo Sapiens
QRPGNIYST

SEQ ID NO: 809548 - protein, 9 aa, Homo Sapiens
VWVTTGITP

SEQ ID NO: 809549 - protein, 9 aa, Homo Sapiens
KSLPHKKTH

SEQ ID NO: 809550 - protein, 9 aa, Homo Sapiens
GLYSWLLVI

SEQ ID NO: 809551 - protein, 9 aa, Homo Sapiens
KLFQVDIQP

SEQ ID NO: 809552 - protein, 9 aa, Homo Sapiens
QTFMIKFPW

SEQ ID NO: 809553 - protein, 9 aa, Homo Sapiens
EIMDGPNQY

SEQ ID NO: 809554 - protein, 9 aa, Homo Sapiens
VTGFILLGL

SEQ ID NO: 809555 - protein, 9 aa, Homo Sapiens
PVKKKRKFP

SEQ ID NO: 809556 - protein, 9 aa, Homo Sapiens
KIIDPNYRF

SEQ ID NO: 809557 - protein, 9 aa, Homo Sapiens
YGFLIDDIR

SEQ ID NO: 809558 - protein, 9 aa, Homo Sapiens
IFVSYPSLV

SEQ ID NO: 809559 - protein, 9 aa, Homo Sapiens
LGSHTMDCF

SEQ ID NO: 809560 - protein, 9 aa, Homo Sapiens
QQVEEWWAQ

SEQ ID NO: 809561 - protein, 9 aa, Homo Sapiens
NHFSMAIRH

SEQ ID NO: 809562 - protein, 9 aa, Homo Sapiens
RHARHAQIR

SEQ ID NO: 809563 - protein, 9 aa, Homo Sapiens
AVTATKSPI

SEQ ID NO: 809564 - protein, 9 aa, Homo Sapiens
GKDTKDRDS

SEQ ID NO: 809565 - protein, 9 aa, Homo Sapiens
KSFSHLSYL

SEQ ID NO: 809566 - protein, 9 aa, Homo Sapiens
MLEAPYTKE

SEQ ID NO: 809567 - protein, 9 aa, Homo Sapiens
ESNAVHDSF

SEQ ID NO: 809568 - protein, 9 aa, Homo Sapiens
LINYTDPIN

SEQ ID NO: 809569 - protein, 9 aa, Homo Sapiens
SEGSTLAGV

SEQ ID NO: 809570 - protein, 9 aa, Homo Sapiens
GLPHNLSSG

SEQ ID NO: 809571 - protein, 9 aa, Homo Sapiens
AADRIRHKE

SEQ ID NO: 809572 - protein, 9 aa, Homo Sapiens
KLKQLEEET

SEQ ID NO: 809573 - protein, 9 aa, Homo Sapiens
AWVWATVRG

SEQ ID NO: 809574 - protein, 9 aa, Homo Sapiens
ANTLNPVSG

SEQ ID NO: 809575 - protein, 9 aa, Homo Sapiens
IRGFIVRKN

SEQ ID NO: 809576 - protein, 9 aa, Homo Sapiens
EGIPGLAYA

SEQ ID NO: 809577 - protein, 9 aa, Homo Sapiens
KQIWDTVSW

SEQ ID NO: 809578 - protein, 9 aa, Homo Sapiens
PVRVDITLK

SEQ ID NO: 809579 - protein, 9 aa, Homo Sapiens
LHYFVEFIF

SEQ ID NO: 809580 - protein, 9 aa, Homo Sapiens
LFYITIIAV

SEQ ID NO: 809581 - protein, 9 aa, Homo Sapiens
RDFPNHWEY

SEQ ID NO: 809582 - protein, 9 aa, Homo Sapiens
RKVIYCRKK

SEQ ID NO: 809583 - protein, 9 aa, Homo Sapiens
ASSLLNHRR

SEQ ID NO: 809584 - protein, 9 aa, Homo Sapiens
QDRGEWDSL

SEQ ID NO: 809585 - protein, 9 aa, Homo Sapiens
IKAAKTLGI

SEQ ID NO: 809586 - protein, 9 aa, Homo Sapiens
TTGSNGSGC

SEQ ID NO: 809587 - protein, 9 aa, Homo Sapiens
DSKFLKLVA

SEQ ID NO: 809588 - protein, 9 aa, Homo Sapiens
HTPGFPTSC

SEQ ID NO: 809589 - protein, 9 aa, Homo Sapiens
PVNPRSLET

SEQ ID NO: 809590 - protein, 9 aa, Homo Sapiens
KNEERKLQE

SEQ ID NO: 809591 - protein, 9 aa, Homo Sapiens
IFVTSYIKI

SEQ ID NO: 809592 - protein, 9 aa, Homo Sapiens
NDWWNNTEY

SEQ ID NO: 809593 - protein, 9 aa, Homo Sapiens
AKAEKLAIL

SEQ ID NO: 809594 - protein, 9 aa, Homo Sapiens
VEVIITAYN

SEQ ID NO: 809595 - protein, 9 aa, Homo Sapiens
SKRGMEQDN

SEQ ID NO: 809596 - protein, 9 aa, Homo Sapiens
QTYDYAKNI

SEQ ID NO: 809597 - protein, 9 aa, Homo Sapiens
TSHDTSTNG

SEQ ID NO: 809598 - protein, 9 aa, Homo Sapiens
RGVNVNMKT

SEQ ID NO: 809599 - protein, 9 aa, Homo Sapiens
IKSVALCVT

SEQ ID NO: 809600 - protein, 9 aa, Homo Sapiens
RTIQASEAS

SEQ ID NO: 809601 - protein, 9 aa, Homo Sapiens
NLNNNFSLS

SEQ ID NO: 809602 - protein, 9 aa, Homo Sapiens
WLYFKIFDS

SEQ ID NO: 809603 - protein, 9 aa, Homo Sapiens
RQGLTCSRA

SEQ ID NO: 809604 - protein, 9 aa, Homo Sapiens
IDELSKKEH

SEQ ID NO: 809605 - protein, 9 aa, Homo Sapiens
EELNKLRQS

SEQ ID NO: 809606 - protein, 9 aa, Homo Sapiens
VAWRVAQGE

SEQ ID NO: 809607 - protein, 9 aa, Homo Sapiens
IADRMQTEI

SEQ ID NO: 809608 - protein, 9 aa, Homo Sapiens
VTENMYLTD

SEQ ID NO: 809609 - protein, 9 aa, Homo Sapiens
PDTLGLNSR

SEQ ID NO: 809610 - protein, 9 aa, Homo Sapiens
SGLACDPAL

SEQ ID NO: 809611 - protein, 9 aa, Homo Sapiens
RRSAIKIQM

SEQ ID NO: 809612 - protein, 9 aa, Homo Sapiens
RLRLQEDKS

SEQ ID NO: 809613 - protein, 9 aa, Homo Sapiens
TTLKYGLLL

SEQ ID NO: 809614 - protein, 9 aa, Homo Sapiens
QCDVAGCSK

SEQ ID NO: 809615 - protein, 9 aa, Homo Sapiens
YILFAPLCF

SEQ ID NO: 809616 - protein, 9 aa, Homo Sapiens
NIFYIVNQK

SEQ ID NO: 809617 - protein, 9 aa, Homo Sapiens
KLLLKLSVE

SEQ ID NO: 809618 - protein, 9 aa, Homo Sapiens
HLETTKMNI

SEQ ID NO: 809619 - protein, 9 aa, Homo Sapiens
LHPRYLERQ

SEQ ID NO: 809620 - protein, 9 aa, Homo Sapiens
DGVKVCTCT

SEQ ID NO: 809621 - protein, 9 aa, Homo Sapiens
ELKATIHEN

SEQ ID NO: 809622 - protein, 9 aa, Homo Sapiens
HQPPPIKLP

SEQ ID NO: 809623 - protein, 9 aa, Homo Sapiens
IVSANLVVK

SEQ ID NO: 809624 - protein, 9 aa, Homo Sapiens
LILDSMKAK

SEQ ID NO: 809625 - protein, 9 aa, Homo Sapiens
LQVPFFLFA

SEQ ID NO: 809626 - protein, 9 aa, Homo Sapiens
GKYDAVNYP

SEQ ID NO: 809627 - protein, 9 aa, Homo Sapiens
MAKSVHILS

SEQ ID NO: 809628 - protein, 9 aa, Homo Sapiens
VIYPCHFYI

SEQ ID NO: 809629 - protein, 9 aa, Homo Sapiens
CFSEEQGTR

SEQ ID NO: 809630 - protein, 9 aa, Homo Sapiens
FLFVGLHWM

SEQ ID NO: 809631 - protein, 9 aa, Homo Sapiens
SPSRTVASQ

SEQ ID NO: 809632 - protein, 9 aa, Homo Sapiens
DERLGMKKE

SEQ ID NO: 809633 - protein, 9 aa, Homo Sapiens
AAAAAFQRA

SEQ ID NO: 809634 - protein, 9 aa, Homo Sapiens
KTRTMFGEF

SEQ ID NO: 809635 - protein, 9 aa, Homo Sapiens
IFSNMGAWT

SEQ ID NO: 809636 - protein, 9 aa, Homo Sapiens
GLDKNKKTS

SEQ ID NO: 809637 - protein, 9 aa, Homo Sapiens
ITFLNQSSL

SEQ ID NO: 809638 - protein, 9 aa, Homo Sapiens
LMTTKNYCD

SEQ ID NO: 809639 - protein, 9 aa, Homo Sapiens
KVILYQILR

SEQ ID NO: 809640 - protein, 9 aa, Homo Sapiens
QRPALGLLD

SEQ ID NO: 809641 - protein, 9 aa, Homo Sapiens
VSFPKMSVP

SEQ ID NO: 809642 - protein, 9 aa, Homo Sapiens
AKLEQVEGG

SEQ ID NO: 809643 - protein, 9 aa, Homo Sapiens
EIKEIGSKY

SEQ ID NO: 809644 - protein, 9 aa, Homo Sapiens
CGKAFIYSN

SEQ ID NO: 809645 - protein, 9 aa, Homo Sapiens
LLAAEQLLE

SEQ ID NO: 809646 - protein, 9 aa, Homo Sapiens
EIARIWSLE

SEQ ID NO: 809647 - protein, 9 aa, Homo Sapiens
DNGNHIKKE

SEQ ID NO: 809648 - protein, 9 aa, Homo Sapiens
LDGGHGGCL

SEQ ID NO: 809649 - protein, 9 aa, Homo Sapiens
FQMRIVLII

SEQ ID NO: 809650 - protein, 9 aa, Homo Sapiens
RHCPRTYRD

SEQ ID NO: 809651 - protein, 9 aa, Homo Sapiens
LGQKPVLHR

SEQ ID NO: 809652 - protein, 9 aa, Homo Sapiens
RGLTLHQTI

SEQ ID NO: 809653 - protein, 9 aa, Homo Sapiens
GAVKKMQML

SEQ ID NO: 809654 - protein, 9 aa, Homo Sapiens
VLDYISPGK

SEQ ID NO: 809655 - protein, 9 aa, Homo Sapiens
QSLHIDQFK

SEQ ID NO: 809656 - protein, 9 aa, Homo Sapiens
IRYQWKHDY

SEQ ID NO: 809657 - protein, 9 aa, Homo Sapiens
EINEDFIEI

SEQ ID NO: 809658 - protein, 9 aa, Homo Sapiens
LIQLLNSSG

SEQ ID NO: 809659 - protein, 9 aa, Homo Sapiens
LTYHQTIHT

SEQ ID NO: 809660 - protein, 9 aa, Homo Sapiens
SFVSGCTIS

SEQ ID NO: 809661 - protein, 9 aa, Homo Sapiens
ADVVREKLA

SEQ ID NO: 809662 - protein, 9 aa, Homo Sapiens
AEAASFQIN

SEQ ID NO: 809663 - protein, 9 aa, Homo Sapiens
VTLRQIAHG

SEQ ID NO: 809664 - protein, 9 aa, Homo Sapiens
LLCLDASEN

SEQ ID NO: 809665 - protein, 9 aa, Homo Sapiens
RKEHIKEYT

SEQ ID NO: 809666 - protein, 9 aa, Homo Sapiens
GYDQDSEKS

SEQ ID NO: 809667 - protein, 9 aa, Homo Sapiens
IRGTKRYED

SEQ ID NO: 809668 - protein, 9 aa, Homo Sapiens
VWFICISLA

SEQ ID NO: 809669 - protein, 9 aa, Homo Sapiens
HSHRLYYNT

SEQ ID NO: 809670 - protein, 9 aa, Homo Sapiens
EMNTGKAES

SEQ ID NO: 809671 - protein, 9 aa, Homo Sapiens
MKQSLNENS

SEQ ID NO: 809672 - protein, 9 aa, Homo Sapiens
TLSTEAPGL

SEQ ID NO: 809673 - protein, 9 aa, Homo Sapiens
LSLPLGPIL

SEQ ID NO: 809674 - protein, 9 aa, Homo Sapiens
VKQLLSTDA

SEQ ID NO: 809675 - protein, 9 aa, Homo Sapiens
NNTHVPDFI

SEQ ID NO: 809676 - protein, 9 aa, Homo Sapiens
RQQRSEKKK

SEQ ID NO: 809677 - protein, 9 aa, Homo Sapiens
DRTILHRDI

SEQ ID NO: 809678 - protein, 9 aa, Homo Sapiens
LPGLEEDKK

SEQ ID NO: 809679 - protein, 9 aa, Homo Sapiens
LAGTNQPDI

SEQ ID NO: 809680 - protein, 9 aa, Homo Sapiens
GTISLPCQP

SEQ ID NO: 809681 - protein, 9 aa, Homo Sapiens
TSYAGYIEN

SEQ ID NO: 809682 - protein, 9 aa, Homo Sapiens
ALSMIKCLD

SEQ ID NO: 809683 - protein, 9 aa, Homo Sapiens
MVEKHLNSH

SEQ ID NO: 809684 - protein, 9 aa, Homo Sapiens
SNSFQTLNH

SEQ ID NO: 809685 - protein, 9 aa, Homo Sapiens
EVVYTNQNV

SEQ ID NO: 809686 - protein, 9 aa, Homo Sapiens
SLGSPAIKS

SEQ ID NO: 809687 - protein, 9 aa, Homo Sapiens
LYMGRPTYG

SEQ ID NO: 809688 - protein, 9 aa, Homo Sapiens
ERMAQHFYN

SEQ ID NO: 809689 - protein, 9 aa, Homo Sapiens
TPKVIKLLK

SEQ ID NO: 809690 - protein, 9 aa, Homo Sapiens
VNQNGFNRS

SEQ ID NO: 809691 - protein, 9 aa, Homo Sapiens
IRNKRLQLK

SEQ ID NO: 809692 - protein, 9 aa, Homo Sapiens
ELGSEEVWK

SEQ ID NO: 809693 - protein, 9 aa, Homo Sapiens
LKFASQIND

SEQ ID NO: 809694 - protein, 9 aa, Homo Sapiens
LLDIRNKRL

SEQ ID NO: 809695 - protein, 9 aa, Homo Sapiens
LIFNILYWV

SEQ ID NO: 809696 - protein, 9 aa, Homo Sapiens
CRDSCDKVL

SEQ ID NO: 809697 - protein, 9 aa, Homo Sapiens
FGRKRTLPA

SEQ ID NO: 809698 - protein, 9 aa, Homo Sapiens
IPKVDFRTF

SEQ ID NO: 809699 - protein, 9 aa, Homo Sapiens
TNIVLTGTK

SEQ ID NO: 809700 - protein, 9 aa, Homo Sapiens
NNHFKFLGS

SEQ ID NO: 809701 - protein, 9 aa, Homo Sapiens
YGLVSFFND

SEQ ID NO: 809702 - protein, 9 aa, Homo Sapiens
AQTSDVNKL

SEQ ID NO: 809703 - protein, 9 aa, Homo Sapiens
RPLRIHTGE

SEQ ID NO: 809704 - protein, 9 aa, Homo Sapiens
SFHPGSASG

SEQ ID NO: 809705 - protein, 9 aa, Homo Sapiens
DIEEEVAEL

SEQ ID NO: 809706 - protein, 9 aa, Homo Sapiens
FLRFLANLF

SEQ ID NO: 809707 - protein, 9 aa, Homo Sapiens
SKVMGEPHL

SEQ ID NO: 809708 - protein, 9 aa, Homo Sapiens
VCQQRIQRQ

SEQ ID NO: 809709 - protein, 9 aa, Homo Sapiens
STEKTMIYF

SEQ ID NO: 809710 - protein, 9 aa, Homo Sapiens
VMTLNYLGF

SEQ ID NO: 809711 - protein, 9 aa, Homo Sapiens
DPNLLDSLG

SEQ ID NO: 809712 - protein, 9 aa, Homo Sapiens
YMAKQFAVS

SEQ ID NO: 809713 - protein, 9 aa, Homo Sapiens
DAAAAEAKA

SEQ ID NO: 809714 - protein, 9 aa, Homo Sapiens
KGLFKMYPL

SEQ ID NO: 809715 - protein, 9 aa, Homo Sapiens
VQKFCRIDT

SEQ ID NO: 809716 - protein, 9 aa, Homo Sapiens
IFLASIFHL

SEQ ID NO: 809717 - protein, 9 aa, Homo Sapiens
CLFVPRLLA

SEQ ID NO: 809718 - protein, 9 aa, Homo Sapiens
TKLPLKFRD

SEQ ID NO: 809719 - protein, 9 aa, Homo Sapiens
LNVSQLLKS

SEQ ID NO: 809720 - protein, 9 aa, Homo Sapiens
HTLSFQGLG

SEQ ID NO: 809721 - protein, 9 aa, Homo Sapiens
AFQLWLKKK

SEQ ID NO: 809722 - protein, 9 aa, Homo Sapiens
ELSGHINIF

SEQ ID NO: 809723 - protein, 9 aa, Homo Sapiens
PGPLASSPS

SEQ ID NO: 809724 - protein, 9 aa, Homo Sapiens
IIPLPGRLG

SEQ ID NO: 809725 - protein, 9 aa, Homo Sapiens
GKHKNKGKN

SEQ ID NO: 809726 - protein, 9 aa, Homo Sapiens
QILSSVLQT

SEQ ID NO: 809727 - protein, 9 aa, Homo Sapiens
NGAPLKVKR

SEQ ID NO: 809728 - protein, 9 aa, Homo Sapiens
VETPEETLL

SEQ ID NO: 809729 - protein, 9 aa, Homo Sapiens
PNPGKRHPG

SEQ ID NO: 809730 - protein, 9 aa, Homo Sapiens
GTSKPIFCL

SEQ ID NO: 809731 - protein, 9 aa, Homo Sapiens
GEIRVKYLK

SEQ ID NO: 809732 - protein, 9 aa, Homo Sapiens
QFQTQKVQD

SEQ ID NO: 809733 - protein, 9 aa, Homo Sapiens
PNYTGSACA

SEQ ID NO: 809734 - protein, 9 aa, Homo Sapiens
KDDTRVSTN

SEQ ID NO: 809735 - protein, 9 aa, Homo Sapiens
APSEHVIEN

SEQ ID NO: 809736 - protein, 9 aa, Homo Sapiens
VQQHKGSLQ

SEQ ID NO: 809737 - protein, 9 aa, Homo Sapiens
TLTWFVPLL

SEQ ID NO: 809738 - protein, 9 aa, Homo Sapiens
VSGCTISMI

SEQ ID NO: 809739 - protein, 9 aa, Homo Sapiens
RDQIQRRAE

SEQ ID NO: 809740 - protein, 9 aa, Homo Sapiens
RAGPSVGVK

SEQ ID NO: 809741 - protein, 9 aa, Homo Sapiens
WGFIPLVMY

SEQ ID NO: 809742 - protein, 9 aa, Homo Sapiens
QLKSLIQIN

SEQ ID NO: 809743 - protein, 9 aa, Homo Sapiens
KVISLFYSL

SEQ ID NO: 809744 - protein, 9 aa, Homo Sapiens
TVFCTLTAT

SEQ ID NO: 809745 - protein, 9 aa, Homo Sapiens
AAVFLSVDD

SEQ ID NO: 809746 - protein, 9 aa, Homo Sapiens
SDKENHIKT

SEQ ID NO: 809747 - protein, 9 aa, Homo Sapiens
QTCKGQVRS

SEQ ID NO: 809748 - protein, 9 aa, Homo Sapiens
KKKGKVKPE

SEQ ID NO: 809749 - protein, 9 aa, Homo Sapiens
EEAAVYRVF

SEQ ID NO: 809750 - protein, 9 aa, Homo Sapiens
DLREAFRAY

SEQ ID NO: 809751 - protein, 9 aa, Homo Sapiens
HRDRTAKKQ

SEQ ID NO: 809752 - protein, 9 aa, Homo Sapiens
EQKEVKPPA

SEQ ID NO: 809753 - protein, 9 aa, Homo Sapiens
TTDIKELFP

SEQ ID NO: 809754 - protein, 9 aa, Homo Sapiens
PAPPNIYFP

SEQ ID NO: 809755 - protein, 9 aa, Homo Sapiens
VKLGSCKRI

SEQ ID NO: 809756 - protein, 9 aa, Homo Sapiens
CGIHLSSGS

SEQ ID NO: 809757 - protein, 9 aa, Homo Sapiens
RVLEIHNEH

SEQ ID NO: 809758 - protein, 9 aa, Homo Sapiens
TSVAIEVIK

SEQ ID NO: 809759 - protein, 9 aa, Homo Sapiens
GPPKHCPVV

SEQ ID NO: 809760 - protein, 9 aa, Homo Sapiens
GIRGSVEAV

SEQ ID NO: 809761 - protein, 9 aa, Homo Sapiens
PLRICSLHS

SEQ ID NO: 809762 - protein, 9 aa, Homo Sapiens
PLKPLHTSI

SEQ ID NO: 809763 - protein, 9 aa, Homo Sapiens
PTDSTPALH

SEQ ID NO: 809764 - protein, 9 aa, Homo Sapiens
SIRRTADLQ

SEQ ID NO: 809765 - protein, 9 aa, Homo Sapiens
NHPKIQIKN

SEQ ID NO: 809766 - protein, 9 aa, Homo Sapiens
IIHSHVLRQ

SEQ ID NO: 809767 - protein, 9 aa, Homo Sapiens
GKVNGRKGL

SEQ ID NO: 809768 - protein, 9 aa, Homo Sapiens
SAGAAPRRR

SEQ ID NO: 809769 - protein, 9 aa, Homo Sapiens
RHEYLKLDK

SEQ ID NO: 809770 - protein, 9 aa, Homo Sapiens
QWLINNLTI

SEQ ID NO: 809771 - protein, 9 aa, Homo Sapiens
WEKLENNLS

SEQ ID NO: 809772 - protein, 9 aa, Homo Sapiens
SQTTISHLE

SEQ ID NO: 809773 - protein, 9 aa, Homo Sapiens
NKPGKPQKR

SEQ ID NO: 809774 - protein, 9 aa, Homo Sapiens
RNNFLNYLP

SEQ ID NO: 809775 - protein, 9 aa, Homo Sapiens
RLRTRGIFK

SEQ ID NO: 809776 - protein, 9 aa, Homo Sapiens
EDGYGDGDS

SEQ ID NO: 809777 - protein, 9 aa, Homo Sapiens
SLSADEEHL

SEQ ID NO: 809778 - protein, 9 aa, Homo Sapiens
LAHTERLQI

SEQ ID NO: 809779 - protein, 9 aa, Homo Sapiens
KQLREWGEN

SEQ ID NO: 809780 - protein, 9 aa, Homo Sapiens
KCPFNSENA

SEQ ID NO: 809781 - protein, 9 aa, Homo Sapiens
RRETGQAEC

SEQ ID NO: 809782 - protein, 9 aa, Homo Sapiens
TTVYGLRKR

SEQ ID NO: 809783 - protein, 9 aa, Homo Sapiens
APSRLDLTV

SEQ ID NO: 809784 - protein, 9 aa, Homo Sapiens
VLTLTGVYS

SEQ ID NO: 809785 - protein, 9 aa, Homo Sapiens
SPQKRSYSS

SEQ ID NO: 809786 - protein, 9 aa, Homo Sapiens
LLLFAYVLI

SEQ ID NO: 809787 - protein, 9 aa, Homo Sapiens
LSDISDNVP

SEQ ID NO: 809788 - protein, 9 aa, Homo Sapiens
MELKEKRSQ

SEQ ID NO: 809789 - protein, 9 aa, Homo Sapiens
FYIEETLWG

SEQ ID NO: 809790 - protein, 9 aa, Homo Sapiens
RCSWLYGVN

SEQ ID NO: 809791 - protein, 9 aa, Homo Sapiens
NQSILTPLN

SEQ ID NO: 809792 - protein, 9 aa, Homo Sapiens
PEDRIQNIR

SEQ ID NO: 809793 - protein, 9 aa, Homo Sapiens
FDSDYLRHY

SEQ ID NO: 809794 - protein, 9 aa, Homo Sapiens
SFYYFSCHV

SEQ ID NO: 809795 - protein, 9 aa, Homo Sapiens
SGNATDSPK

SEQ ID NO: 809796 - protein, 9 aa, Homo Sapiens
ALGGPPVSK

SEQ ID NO: 809797 - protein, 9 aa, Homo Sapiens
QVNPQNSKI

SEQ ID NO: 809798 - protein, 9 aa, Homo Sapiens
QKYKRWLDS

SEQ ID NO: 809799 - protein, 9 aa, Homo Sapiens
LSTEKTMIY

SEQ ID NO: 809800 - protein, 9 aa, Homo Sapiens
AELENSELR

SEQ ID NO: 809801 - protein, 9 aa, Homo Sapiens
MHYNQAVDI

SEQ ID NO: 809802 - protein, 9 aa, Homo Sapiens
NILETSEIK

SEQ ID NO: 809803 - protein, 9 aa, Homo Sapiens
FMKTCFWGT

SEQ ID NO: 809804 - protein, 9 aa, Homo Sapiens
EDGGLTTFE

SEQ ID NO: 809805 - protein, 9 aa, Homo Sapiens
VFCCEAPAK

SEQ ID NO: 809806 - protein, 9 aa, Homo Sapiens
VFYTMVILM

SEQ ID NO: 809807 - protein, 9 aa, Homo Sapiens
ESVERKKQD

SEQ ID NO: 809808 - protein, 9 aa, Homo Sapiens
SDLYDGFHI

SEQ ID NO: 809809 - protein, 9 aa, Homo Sapiens
RIALSRETE

SEQ ID NO: 809810 - protein, 9 aa, Homo Sapiens
NTSTAPNSL

SEQ ID NO: 809811 - protein, 9 aa, Homo Sapiens
YVGKEESLP

SEQ ID NO: 809812 - protein, 9 aa, Homo Sapiens
CWDLTLFLP

SEQ ID NO: 809813 - protein, 9 aa, Homo Sapiens
FTFHLVGVP

SEQ ID NO: 809814 - protein, 9 aa, Homo Sapiens
EAKDNFKNA

SEQ ID NO: 809815 - protein, 9 aa, Homo Sapiens
FCKQERAAA

SEQ ID NO: 809816 - protein, 9 aa, Homo Sapiens
APFYYKNTH

SEQ ID NO: 809817 - protein, 9 aa, Homo Sapiens
RQANTINML

SEQ ID NO: 809818 - protein, 9 aa, Homo Sapiens
QREPLSSNT

SEQ ID NO: 809819 - protein, 9 aa, Homo Sapiens
GHLPSSSED

SEQ ID NO: 809820 - protein, 9 aa, Homo Sapiens
SVCTEDSYT

SEQ ID NO: 809821 - protein, 9 aa, Homo Sapiens
LKLRYKVAH

SEQ ID NO: 809822 - protein, 9 aa, Homo Sapiens
SENTKDLSE

SEQ ID NO: 809823 - protein, 9 aa, Homo Sapiens
TSWPGHGVP

SEQ ID NO: 809824 - protein, 9 aa, Homo Sapiens
AALKTIDIR

SEQ ID NO: 809825 - protein, 9 aa, Homo Sapiens
SQIWNFVEI

SEQ ID NO: 809826 - protein, 9 aa, Homo Sapiens
YKFHKTLKE

SEQ ID NO: 809827 - protein, 9 aa, Homo Sapiens
KEAGGNTTA

SEQ ID NO: 809828 - protein, 9 aa, Homo Sapiens
GNKQRLHFA

SEQ ID NO: 809829 - protein, 9 aa, Homo Sapiens
ENNPSLGWG

SEQ ID NO: 809830 - protein, 9 aa, Homo Sapiens
YYPSQDNAR

SEQ ID NO: 809831 - protein, 9 aa, Homo Sapiens
PQLHARKAR

SEQ ID NO: 809832 - protein, 9 aa, Homo Sapiens
VVVNHDFFM

SEQ ID NO: 809833 - protein, 9 aa, Homo Sapiens
GTFAKVRRQ

SEQ ID NO: 809834 - protein, 9 aa, Homo Sapiens
CNDFWEGIK

SEQ ID NO: 809835 - protein, 9 aa, Homo Sapiens
GNIIHFQTK

SEQ ID NO: 809836 - protein, 9 aa, Homo Sapiens
LYSKIFFII

SEQ ID NO: 809837 - protein, 9 aa, Homo Sapiens
ADSLSLLKT

SEQ ID NO: 809838 - protein, 9 aa, Homo Sapiens
AGGSTEYLS

SEQ ID NO: 809839 - protein, 9 aa, Homo Sapiens
FHQRRHQSP

SEQ ID NO: 809840 - protein, 9 aa, Homo Sapiens
SITTDIIIT

SEQ ID NO: 809841 - protein, 9 aa, Homo Sapiens
WAQNAVQRA

SEQ ID NO: 809842 - protein, 9 aa, Homo Sapiens
TETTSTTLI

SEQ ID NO: 809843 - protein, 9 aa, Homo Sapiens
KGPPVLTQE

SEQ ID NO: 809844 - protein, 9 aa, Homo Sapiens
ELCVYHSSL

SEQ ID NO: 809845 - protein, 9 aa, Homo Sapiens
KVQDVKSTT

SEQ ID NO: 809846 - protein, 9 aa, Homo Sapiens
ICKAEGLGT

SEQ ID NO: 809847 - protein, 9 aa, Homo Sapiens
LKEEEASKS

SEQ ID NO: 809848 - protein, 9 aa, Homo Sapiens
MFAFFPDKF

SEQ ID NO: 809849 - protein, 9 aa, Homo Sapiens
LLQRLFKWQ

SEQ ID NO: 809850 - protein, 9 aa, Homo Sapiens
DGDIFRDQV

SEQ ID NO: 809851 - protein, 9 aa, Homo Sapiens
TLKAVDQDN

SEQ ID NO: 809852 - protein, 9 aa, Homo Sapiens
EKFTPEKII

SEQ ID NO: 809853 - protein, 9 aa, Homo Sapiens
VHVVRRQIG

SEQ ID NO: 809854 - protein, 9 aa, Homo Sapiens
KEELERQVV

SEQ ID NO: 809855 - protein, 9 aa, Homo Sapiens
IETEVKTRA

SEQ ID NO: 809856 - protein, 9 aa, Homo Sapiens
HWMEGDPDK

SEQ ID NO: 809857 - protein, 9 aa, Homo Sapiens
IRDKLQCTQ

SEQ ID NO: 809858 - protein, 9 aa, Homo Sapiens
SAVLIREEE

SEQ ID NO: 809859 - protein, 9 aa, Homo Sapiens
GKKPYKCPY

SEQ ID NO: 809860 - protein, 9 aa, Homo Sapiens
WEKENRTTV

SEQ ID NO: 809861 - protein, 9 aa, Homo Sapiens
ACQFEEGQD

SEQ ID NO: 809862 - protein, 9 aa, Homo Sapiens
TDYNDNCSL

SEQ ID NO: 809863 - protein, 9 aa, Homo Sapiens
GDDTNRWFD

SEQ ID NO: 809864 - protein, 9 aa, Homo Sapiens
KLNRSKCLE

SEQ ID NO: 809865 - protein, 9 aa, Homo Sapiens
DSNEGRKYP

SEQ ID NO: 809866 - protein, 9 aa, Homo Sapiens
SNYLRLHEI

SEQ ID NO: 809867 - protein, 9 aa, Homo Sapiens
KVGVQGGAF

SEQ ID NO: 809868 - protein, 9 aa, Homo Sapiens
KMLDNGNFR

SEQ ID NO: 809869 - protein, 9 aa, Homo Sapiens
TSLVAAPVE

SEQ ID NO: 809870 - protein, 9 aa, Homo Sapiens
TTWKIKFIN

SEQ ID NO: 809871 - protein, 9 aa, Homo Sapiens
LGVLSSYGI

SEQ ID NO: 809872 - protein, 9 aa, Homo Sapiens
SEEQNKPYY

SEQ ID NO: 809873 - protein, 9 aa, Homo Sapiens
KRADNPHVA

SEQ ID NO: 809874 - protein, 9 aa, Homo Sapiens
QAPDKVTLL

SEQ ID NO: 809875 - protein, 9 aa, Homo Sapiens
QISGGFDEP

SEQ ID NO: 809876 - protein, 9 aa, Homo Sapiens
YKCPDCGER

SEQ ID NO: 809877 - protein, 9 aa, Homo Sapiens
IINVDHILD

SEQ ID NO: 809878 - protein, 9 aa, Homo Sapiens
YFIAVEDDN

SEQ ID NO: 809879 - protein, 9 aa, Homo Sapiens
RQIYGKRSS

SEQ ID NO: 809880 - protein, 9 aa, Homo Sapiens
QHGLQVWLQ

SEQ ID NO: 809881 - protein, 9 aa, Homo Sapiens
HAYGNITEC

SEQ ID NO: 809882 - protein, 9 aa, Homo Sapiens
FILMNKMGI

SEQ ID NO: 809883 - protein, 9 aa, Homo Sapiens
HEHQLMLIR

SEQ ID NO: 809884 - protein, 9 aa, Homo Sapiens
ELENKLKAA

SEQ ID NO: 809885 - protein, 9 aa, Homo Sapiens
QSAAIQSGR

SEQ ID NO: 809886 - protein, 9 aa, Homo Sapiens
EDVKGMEDE

SEQ ID NO: 809887 - protein, 9 aa, Homo Sapiens
WIFIPQLCV

SEQ ID NO: 809888 - protein, 9 aa, Homo Sapiens
LEREARIRR

SEQ ID NO: 809889 - protein, 9 aa, Homo Sapiens
IMRPTDVPA

SEQ ID NO: 809890 - protein, 9 aa, Homo Sapiens
LLGKRADNP

SEQ ID NO: 809891 - protein, 9 aa, Homo Sapiens
AANQETSNI

SEQ ID NO: 809892 - protein, 9 aa, Homo Sapiens
WHRKSLGRN

SEQ ID NO: 809893 - protein, 9 aa, Homo Sapiens
ECFELLEET

SEQ ID NO: 809894 - protein, 9 aa, Homo Sapiens
PDSGRPTFR

SEQ ID NO: 809895 - protein, 9 aa, Homo Sapiens
CKLYSSQWH

SEQ ID NO: 809896 - protein, 9 aa, Homo Sapiens
RGNYGKVLL

SEQ ID NO: 809897 - protein, 9 aa, Homo Sapiens
CKVIAEKYH

SEQ ID NO: 809898 - protein, 9 aa, Homo Sapiens
FSGIFPGLV

SEQ ID NO: 809899 - protein, 9 aa, Homo Sapiens
RNIVSRNPS

SEQ ID NO: 809900 - protein, 9 aa, Homo Sapiens
IIRDQMQTI

SEQ ID NO: 809901 - protein, 9 aa, Homo Sapiens
KEKCIKHIA

SEQ ID NO: 809902 - protein, 9 aa, Homo Sapiens
EFILIKSEL

SEQ ID NO: 809903 - protein, 9 aa, Homo Sapiens
PAQAQSLRE

SEQ ID NO: 809904 - protein, 9 aa, Homo Sapiens
RVGIPDNAP

SEQ ID NO: 809905 - protein, 9 aa, Homo Sapiens
GFHDAFNLK

SEQ ID NO: 809906 - protein, 9 aa, Homo Sapiens
FQYSGKVAK

SEQ ID NO: 809907 - protein, 9 aa, Homo Sapiens
TTSTTLKYG

SEQ ID NO: 809908 - protein, 9 aa, Homo Sapiens
FGKYFEIEF

SEQ ID NO: 809909 - protein, 9 aa, Homo Sapiens
HKTVIQACR

SEQ ID NO: 809910 - protein, 9 aa, Homo Sapiens
EVKKAPEKT

SEQ ID NO: 809911 - protein, 9 aa, Homo Sapiens
YENDFLEAD

SEQ ID NO: 809912 - protein, 9 aa, Homo Sapiens
FSLFFFTEK

SEQ ID NO: 809913 - protein, 9 aa, Homo Sapiens
LISYDDEQR

SEQ ID NO: 809914 - protein, 9 aa, Homo Sapiens
SGDYADPPG

SEQ ID NO: 809915 - protein, 9 aa, Homo Sapiens
KVISSLEIN

SEQ ID NO: 809916 - protein, 9 aa, Homo Sapiens
LVKDLCVEL

SEQ ID NO: 809917 - protein, 9 aa, Homo Sapiens
NYIQALREG

SEQ ID NO: 809918 - protein, 9 aa, Homo Sapiens
NKLLIDGFP

SEQ ID NO: 809919 - protein, 9 aa, Homo Sapiens
RHFDFDLEE

SEQ ID NO: 809920 - protein, 9 aa, Homo Sapiens
LSDITLLHN

SEQ ID NO: 809921 - protein, 9 aa, Homo Sapiens
LFQNDQNSS

SEQ ID NO: 809922 - protein, 9 aa, Homo Sapiens
SAWSSMDEE

SEQ ID NO: 809923 - protein, 9 aa, Homo Sapiens
GDEDKIITY

SEQ ID NO: 809924 - protein, 9 aa, Homo Sapiens
KLLYTIQEN

SEQ ID NO: 809925 - protein, 9 aa, Homo Sapiens
LLSSIAYSP

SEQ ID NO: 809926 - protein, 9 aa, Homo Sapiens
LDDLQPWHY

SEQ ID NO: 809927 - protein, 9 aa, Homo Sapiens
NIYSKTWTK

SEQ ID NO: 809928 - protein, 9 aa, Homo Sapiens
EKAATHRQN

SEQ ID NO: 809929 - protein, 9 aa, Homo Sapiens
LGHWPQKEH

SEQ ID NO: 809930 - protein, 9 aa, Homo Sapiens
KYLVMPKEM

SEQ ID NO: 809931 - protein, 9 aa, Homo Sapiens
QDLKPRNIF

SEQ ID NO: 809932 - protein, 9 aa, Homo Sapiens
SLVAAVQDH

SEQ ID NO: 809933 - protein, 9 aa, Homo Sapiens
YGLLTLGMS

SEQ ID NO: 809934 - protein, 9 aa, Homo Sapiens
LHQVKQHIL

SEQ ID NO: 809935 - protein, 9 aa, Homo Sapiens
FGFQDAVNT

SEQ ID NO: 809936 - protein, 9 aa, Homo Sapiens
PKEHMFCKE

SEQ ID NO: 809937 - protein, 9 aa, Homo Sapiens
FLRDFVSIL

SEQ ID NO: 809938 - protein, 9 aa, Homo Sapiens
FSNHQSSYQ

SEQ ID NO: 809939 - protein, 9 aa, Homo Sapiens
WLVFRESSS

SEQ ID NO: 809940 - protein, 9 aa, Homo Sapiens
SIMEGHDYD

SEQ ID NO: 809941 - protein, 9 aa, Homo Sapiens
SGIISNYEL

SEQ ID NO: 809942 - protein, 9 aa, Homo Sapiens
SSYSVPCQR

SEQ ID NO: 809943 - protein, 9 aa, Homo Sapiens
PSRVCQNFH

SEQ ID NO: 809944 - protein, 9 aa, Homo Sapiens
HKLQEPMTL

SEQ ID NO: 809945 - protein, 9 aa, Homo Sapiens
SEKLEQIIR

SEQ ID NO: 809946 - protein, 9 aa, Homo Sapiens
VGNITSVQL

SEQ ID NO: 809947 - protein, 9 aa, Homo Sapiens
RESSSKGPQ

SEQ ID NO: 809948 - protein, 9 aa, Homo Sapiens
KWALHILAS

SEQ ID NO: 809949 - protein, 9 aa, Homo Sapiens
SIQSSKLGA

SEQ ID NO: 809950 - protein, 9 aa, Homo Sapiens
LVVGCVSCF

SEQ ID NO: 809951 - protein, 9 aa, Homo Sapiens
VIENNTTFL

SEQ ID NO: 809952 - protein, 9 aa, Homo Sapiens
LEDPQGNIG

SEQ ID NO: 809953 - protein, 9 aa, Homo Sapiens
EEKVVQPAG

SEQ ID NO: 809954 - protein, 9 aa, Homo Sapiens
RQAWVWATV

SEQ ID NO: 809955 - protein, 9 aa, Homo Sapiens
WLAVQYLKK

SEQ ID NO: 809956 - protein, 9 aa, Homo Sapiens
IIKIELEEA

SEQ ID NO: 809957 - protein, 9 aa, Homo Sapiens
DKKWNYCVR

SEQ ID NO: 809958 - protein, 9 aa, Homo Sapiens
QYLNYPPSP

SEQ ID NO: 809959 - protein, 9 aa, Homo Sapiens
YLGRPIPPT

SEQ ID NO: 809960 - protein, 9 aa, Homo Sapiens
SGLTKHVQI

SEQ ID NO: 809961 - protein, 9 aa, Homo Sapiens
RAGNTGGLM

SEQ ID NO: 809962 - protein, 9 aa, Homo Sapiens
NKAFKQLLY

SEQ ID NO: 809963 - protein, 9 aa, Homo Sapiens
VSVQYHYFK

SEQ ID NO: 809964 - protein, 9 aa, Homo Sapiens
RNKEFAYEQ

SEQ ID NO: 809965 - protein, 9 aa, Homo Sapiens
VKVKGPRNL

SEQ ID NO: 809966 - protein, 9 aa, Homo Sapiens
PNFVVKPRD

SEQ ID NO: 809967 - protein, 9 aa, Homo Sapiens
NKETLDNKL

SEQ ID NO: 809968 - protein, 9 aa, Homo Sapiens
CVQDTSKFW

SEQ ID NO: 809969 - protein, 9 aa, Homo Sapiens
GLDVYGHHH

SEQ ID NO: 809970 - protein, 9 aa, Homo Sapiens
EIMEFSGGG

SEQ ID NO: 809971 - protein, 9 aa, Homo Sapiens
LRELENKLK

SEQ ID NO: 809972 - protein, 9 aa, Homo Sapiens
SCGSALHGS

SEQ ID NO: 809973 - protein, 9 aa, Homo Sapiens
RSERNQEQE

SEQ ID NO: 809974 - protein, 9 aa, Homo Sapiens
FEEWGKIMR

SEQ ID NO: 809975 - protein, 9 aa, Homo Sapiens
HINIIYRDR

SEQ ID NO: 809976 - protein, 9 aa, Homo Sapiens
VTILVAVGL

SEQ ID NO: 809977 - protein, 9 aa, Homo Sapiens
NTTLYTVRG

SEQ ID NO: 809978 - protein, 9 aa, Homo Sapiens
TMKKKLSSY

SEQ ID NO: 809979 - protein, 9 aa, Homo Sapiens
HREVCKVKT

SEQ ID NO: 809980 - protein, 9 aa, Homo Sapiens
QGYDQDSEK

SEQ ID NO: 809981 - protein, 9 aa, Homo Sapiens
TGILCALLN

SEQ ID NO: 809982 - protein, 9 aa, Homo Sapiens
KNIKLFFSG

SEQ ID NO: 809983 - protein, 9 aa, Homo Sapiens
VLESEDTPN

SEQ ID NO: 809984 - protein, 9 aa, Homo Sapiens
DFSSWTPLK

SEQ ID NO: 809985 - protein, 9 aa, Homo Sapiens
DDPSIFGHV

SEQ ID NO: 809986 - protein, 9 aa, Homo Sapiens
YYLKYTKYT

SEQ ID NO: 809987 - protein, 9 aa, Homo Sapiens
NIKGEIHSD

SEQ ID NO: 809988 - protein, 9 aa, Homo Sapiens
RNAICSMIW

SEQ ID NO: 809989 - protein, 9 aa, Homo Sapiens
AAINNLWVD

SEQ ID NO: 809990 - protein, 9 aa, Homo Sapiens
FPRVELLKK

SEQ ID NO: 809991 - protein, 9 aa, Homo Sapiens
QNAQGYAWI

SEQ ID NO: 809992 - protein, 9 aa, Homo Sapiens
LQGAISKMD

SEQ ID NO: 809993 - protein, 9 aa, Homo Sapiens
DAMADTLGE

SEQ ID NO: 809994 - protein, 9 aa, Homo Sapiens
AEATITNIG

SEQ ID NO: 809995 - protein, 9 aa, Homo Sapiens
KVLRGKTIL

SEQ ID NO: 809996 - protein, 9 aa, Homo Sapiens
GFQGTVNTK

SEQ ID NO: 809997 - protein, 9 aa, Homo Sapiens
RELFDSNGN

SEQ ID NO: 809998 - protein, 9 aa, Homo Sapiens
ISTMGKALV

SEQ ID NO: 809999 - protein, 9 aa, Homo Sapiens
FLTNRGVIN

SEQ ID NO: 810000 - protein, 9 aa, Homo Sapiens
KGIMYKWLL

SEQ ID NO: 810001 - protein, 9 aa, Homo Sapiens
ESGLRVALE

SEQ ID NO: 810002 - protein, 9 aa, Homo Sapiens
RKHKTEPYW

SEQ ID NO: 810003 - protein, 9 aa, Homo Sapiens
HIQPVQKKY

SEQ ID NO: 810004 - protein, 9 aa, Homo Sapiens
LKRLIINFR

SEQ ID NO: 810005 - protein, 9 aa, Homo Sapiens
LYREPLASH

SEQ ID NO: 810006 - protein, 9 aa, Homo Sapiens
YVCFHIIEF

SEQ ID NO: 810007 - protein, 9 aa, Homo Sapiens
QKDLETRKK

SEQ ID NO: 810008 - protein, 9 aa, Homo Sapiens
ENMKRALND

SEQ ID NO: 810009 - protein, 9 aa, Homo Sapiens
RGIVIYFAR

SEQ ID NO: 810010 - protein, 9 aa, Homo Sapiens
PLEAARWKL

SEQ ID NO: 810011 - protein, 9 aa, Homo Sapiens
RDVAIELSQ

SEQ ID NO: 810012 - protein, 9 aa, Homo Sapiens
ICTCCSRCL

SEQ ID NO: 810013 - protein, 9 aa, Homo Sapiens
FECKQCGNT

SEQ ID NO: 810014 - protein, 9 aa, Homo Sapiens
KDEFNNTGS

SEQ ID NO: 810015 - protein, 9 aa, Homo Sapiens
PNSEFIQAL

SEQ ID NO: 810016 - protein, 9 aa, Homo Sapiens
RGPRTTEPP

SEQ ID NO: 810017 - protein, 9 aa, Homo Sapiens
KPPGYERTE

SEQ ID NO: 810018 - protein, 9 aa, Homo Sapiens
FMYDSFNNT

SEQ ID NO: 810019 - protein, 9 aa, Homo Sapiens
LEDLKEFSP

SEQ ID NO: 810020 - protein, 9 aa, Homo Sapiens
FPQSLPKYL

SEQ ID NO: 810021 - protein, 9 aa, Homo Sapiens
LCSGSSHFV

SEQ ID NO: 810022 - protein, 9 aa, Homo Sapiens
PHGVHVVLN

SEQ ID NO: 810023 - protein, 9 aa, Homo Sapiens
TSSWEKLEN

SEQ ID NO: 810024 - protein, 9 aa, Homo Sapiens
APGITDKAP

SEQ ID NO: 810025 - protein, 9 aa, Homo Sapiens
HALYLDITN

SEQ ID NO: 810026 - protein, 9 aa, Homo Sapiens
PLLEGYVGV

SEQ ID NO: 810027 - protein, 9 aa, Homo Sapiens
NKKYGELFP

SEQ ID NO: 810028 - protein, 9 aa, Homo Sapiens
NDMYLPLEE

SEQ ID NO: 810029 - protein, 9 aa, Homo Sapiens
SLNYLFRAI

SEQ ID NO: 810030 - protein, 9 aa, Homo Sapiens
RFDQLAHEH

SEQ ID NO: 810031 - protein, 9 aa, Homo Sapiens
REAVEEIQC

SEQ ID NO: 810032 - protein, 9 aa, Homo Sapiens
FEFMVYKVP

SEQ ID NO: 810033 - protein, 9 aa, Homo Sapiens
GGHSIESSL

SEQ ID NO: 810034 - protein, 9 aa, Homo Sapiens
WKYFGFNTN

SEQ ID NO: 810035 - protein, 9 aa, Homo Sapiens
SAATVLIYF

SEQ ID NO: 810036 - protein, 9 aa, Homo Sapiens
YGSQDIELY

SEQ ID NO: 810037 - protein, 9 aa, Homo Sapiens
AKDRINHCG

SEQ ID NO: 810038 - protein, 9 aa, Homo Sapiens
RIKLELGGD

SEQ ID NO: 810039 - protein, 9 aa, Homo Sapiens
KHQVPKLQP

SEQ ID NO: 810040 - protein, 9 aa, Homo Sapiens
SGRETLYSN

SEQ ID NO: 810041 - protein, 9 aa, Homo Sapiens
FKNKTRNES

SEQ ID NO: 810042 - protein, 9 aa, Homo Sapiens
CPSEAIRIP

SEQ ID NO: 810043 - protein, 9 aa, Homo Sapiens
ANNYFEHEE

SEQ ID NO: 810044 - protein, 9 aa, Homo Sapiens
LQQKFIDNR

SEQ ID NO: 810045 - protein, 9 aa, Homo Sapiens
QLEKFLART

SEQ ID NO: 810046 - protein, 9 aa, Homo Sapiens
SDSTLLVFM

SEQ ID NO: 810047 - protein, 9 aa, Homo Sapiens
SFPEHPKRW

SEQ ID NO: 810048 - protein, 9 aa, Homo Sapiens
VAEHFFCDA

SEQ ID NO: 810049 - protein, 9 aa, Homo Sapiens
KMNGMLLNE

SEQ ID NO: 810050 - protein, 9 aa, Homo Sapiens
ILWRSAKKY

SEQ ID NO: 810051 - protein, 9 aa, Homo Sapiens
IANAVVQEL

SEQ ID NO: 810052 - protein, 9 aa, Homo Sapiens
NISYFTQER

SEQ ID NO: 810053 - protein, 9 aa, Homo Sapiens
GLYPDPGLL

SEQ ID NO: 810054 - protein, 9 aa, Homo Sapiens
IANLKASLK

SEQ ID NO: 810055 - protein, 9 aa, Homo Sapiens
IELSQEEWK

SEQ ID NO: 810056 - protein, 9 aa, Homo Sapiens
CWMAGIPGH

SEQ ID NO: 810057 - protein, 9 aa, Homo Sapiens
PLIHLWEAG

SEQ ID NO: 810058 - protein, 9 aa, Homo Sapiens
CVLPTVMSC

SEQ ID NO: 810059 - protein, 9 aa, Homo Sapiens
KSEIRRSER

SEQ ID NO: 810060 - protein, 9 aa, Homo Sapiens
ENYHSHEAI

SEQ ID NO: 810061 - protein, 9 aa, Homo Sapiens
VYRNKYVIY

SEQ ID NO: 810062 - protein, 9 aa, Homo Sapiens
HKGRNFSLP

SEQ ID NO: 810063 - protein, 9 aa, Homo Sapiens
PNNDFEIVL

SEQ ID NO: 810064 - protein, 9 aa, Homo Sapiens
ATKYRSLRS

SEQ ID NO: 810065 - protein, 9 aa, Homo Sapiens
PCSKDALLN

SEQ ID NO: 810066 - protein, 9 aa, Homo Sapiens
LRYEESSKP

SEQ ID NO: 810067 - protein, 9 aa, Homo Sapiens
SSPNSLDPL

SEQ ID NO: 810068 - protein, 9 aa, Homo Sapiens
RVLYKKCPL

SEQ ID NO: 810069 - protein, 9 aa, Homo Sapiens
QKNKCVCDI

SEQ ID NO: 810070 - protein, 9 aa, Homo Sapiens
QSRPNAIIV

SEQ ID NO: 810071 - protein, 9 aa, Homo Sapiens
QNTVLETKW

SEQ ID NO: 810072 - protein, 9 aa, Homo Sapiens
GLLAAAYSL

SEQ ID NO: 810073 - protein, 9 aa, Homo Sapiens
HWFVLANQS

SEQ ID NO: 810074 - protein, 9 aa, Homo Sapiens
QTPLLTLYS

SEQ ID NO: 810075 - protein, 9 aa, Homo Sapiens
KVVLIEVVD

SEQ ID NO: 810076 - protein, 9 aa, Homo Sapiens
RTESASGEM

SEQ ID NO: 810077 - protein, 9 aa, Homo Sapiens
PHRNYVTHY

SEQ ID NO: 810078 - protein, 9 aa, Homo Sapiens
MAMHLLTHG

SEQ ID NO: 810079 - protein, 9 aa, Homo Sapiens
YFIKQMLLN

SEQ ID NO: 810080 - protein, 9 aa, Homo Sapiens
RWKQATKQH

SEQ ID NO: 810081 - protein, 9 aa, Homo Sapiens
RVITCFDSL

SEQ ID NO: 810082 - protein, 9 aa, Homo Sapiens
ICVVWGRYG

SEQ ID NO: 810083 - protein, 9 aa, Homo Sapiens
GEFRQDITK

SEQ ID NO: 810084 - protein, 9 aa, Homo Sapiens
NTGKAESRN

SEQ ID NO: 810085 - protein, 9 aa, Homo Sapiens
NINLYDSFE

SEQ ID NO: 810086 - protein, 9 aa, Homo Sapiens
PGPPGSPFN

SEQ ID NO: 810087 - protein, 9 aa, Homo Sapiens
IETQGDDLQ

SEQ ID NO: 810088 - protein, 9 aa, Homo Sapiens
IDYILEVVQ

SEQ ID NO: 810089 - protein, 9 aa, Homo Sapiens
VFIKDGFFY

SEQ ID NO: 810090 - protein, 9 aa, Homo Sapiens
TELVKATQI

SEQ ID NO: 810091 - protein, 9 aa, Homo Sapiens
LEPDYGTSS

SEQ ID NO: 810092 - protein, 9 aa, Homo Sapiens
RDKSYECPQ

SEQ ID NO: 810093 - protein, 9 aa, Homo Sapiens
ENSITLNIL

SEQ ID NO: 810094 - protein, 9 aa, Homo Sapiens
LKGVLINSK

SEQ ID NO: 810095 - protein, 9 aa, Homo Sapiens
SQAPDKVTL

SEQ ID NO: 810096 - protein, 9 aa, Homo Sapiens
NSLKHRRVK

SEQ ID NO: 810097 - protein, 9 aa, Homo Sapiens
ACVHNYPTQ

SEQ ID NO: 810098 - protein, 9 aa, Homo Sapiens
NKDVLIELY

SEQ ID NO: 810099 - protein, 9 aa, Homo Sapiens
ATNISRQNE

SEQ ID NO: 810100 - protein, 9 aa, Homo Sapiens
DIDIDTETE

SEQ ID NO: 810101 - protein, 9 aa, Homo Sapiens
KNSESQRSW

SEQ ID NO: 810102 - protein, 9 aa, Homo Sapiens
NYSTSGNEL

SEQ ID NO: 810103 - protein, 9 aa, Homo Sapiens
FIQALHPDP

SEQ ID NO: 810104 - protein, 9 aa, Homo Sapiens
QPYIQQSMH

SEQ ID NO: 810105 - protein, 9 aa, Homo Sapiens
HGSLILPHI

SEQ ID NO: 810106 - protein, 9 aa, Homo Sapiens
TRSWLQDGL

SEQ ID NO: 810107 - protein, 9 aa, Homo Sapiens
MAIRHNPQK

SEQ ID NO: 810108 - protein, 9 aa, Homo Sapiens
CDNTLLNEL

SEQ ID NO: 810109 - protein, 9 aa, Homo Sapiens
GIISNYELF

SEQ ID NO: 810110 - protein, 9 aa, Homo Sapiens
IELMESEEV

SEQ ID NO: 810111 - protein, 9 aa, Homo Sapiens
WNMGVVLYV

SEQ ID NO: 810112 - protein, 9 aa, Homo Sapiens
DVDANQIIN

SEQ ID NO: 810113 - protein, 9 aa, Homo Sapiens
CARLTCAPP

SEQ ID NO: 810114 - protein, 9 aa, Homo Sapiens
WPRAKLPNG

SEQ ID NO: 810115 - protein, 9 aa, Homo Sapiens
TTNGHDFQM

SEQ ID NO: 810116 - protein, 9 aa, Homo Sapiens
AESNLFLAE

SEQ ID NO: 810117 - protein, 9 aa, Homo Sapiens
YNYKQVNKA

SEQ ID NO: 810118 - protein, 9 aa, Homo Sapiens
LCYERQISE

SEQ ID NO: 810119 - protein, 9 aa, Homo Sapiens
FDNWSTFHP

SEQ ID NO: 810120 - protein, 9 aa, Homo Sapiens
NLHELGPLA

SEQ ID NO: 810121 - protein, 9 aa, Homo Sapiens
LDPLPTHFE

SEQ ID NO: 810122 - protein, 9 aa, Homo Sapiens
CYCCYLYAC

SEQ ID NO: 810123 - protein, 9 aa, Homo Sapiens
VACIDIIQT

SEQ ID NO: 810124 - protein, 9 aa, Homo Sapiens
LHTAGFFIA

SEQ ID NO: 810125 - protein, 9 aa, Homo Sapiens
LAATSIMPL

SEQ ID NO: 810126 - protein, 9 aa, Homo Sapiens
LKHLTDPFY

SEQ ID NO: 810127 - protein, 9 aa, Homo Sapiens
CERNSRWSN

SEQ ID NO: 810128 - protein, 9 aa, Homo Sapiens
DADYSYEQH

SEQ ID NO: 810129 - protein, 9 aa, Homo Sapiens
LPTNKLENQ

SEQ ID NO: 810130 - protein, 9 aa, Homo Sapiens
TLEREMAFH

SEQ ID NO: 810131 - protein, 9 aa, Homo Sapiens
IFSQVTRLL

SEQ ID NO: 810132 - protein, 9 aa, Homo Sapiens
IQDKTAVPY

SEQ ID NO: 810133 - protein, 9 aa, Homo Sapiens
GTVLLWANQ

SEQ ID NO: 810134 - protein, 9 aa, Homo Sapiens
YLYSCKYCN

SEQ ID NO: 810135 - protein, 9 aa, Homo Sapiens
KLCMNLPYN

SEQ ID NO: 810136 - protein, 9 aa, Homo Sapiens
LVNLKELCV

SEQ ID NO: 810137 - protein, 9 aa, Homo Sapiens
PEGQPLCEY

SEQ ID NO: 810138 - protein, 9 aa, Homo Sapiens
LSYMDVYLI

SEQ ID NO: 810139 - protein, 9 aa, Homo Sapiens
SILDYQVPL

SEQ ID NO: 810140 - protein, 9 aa, Homo Sapiens
ALLYGGPEL

SEQ ID NO: 810141 - protein, 9 aa, Homo Sapiens
NVPLSVNAN

SEQ ID NO: 810142 - protein, 9 aa, Homo Sapiens
IIEAHKRGS

SEQ ID NO: 810143 - protein, 9 aa, Homo Sapiens
CRPKFANTS

SEQ ID NO: 810144 - protein, 9 aa, Homo Sapiens
FDSDSFIAG

SEQ ID NO: 810145 - protein, 9 aa, Homo Sapiens
YPASASRVA

SEQ ID NO: 810146 - protein, 9 aa, Homo Sapiens
SLHSRNTIF

SEQ ID NO: 810147 - protein, 9 aa, Homo Sapiens
LNKELVPLA

SEQ ID NO: 810148 - protein, 9 aa, Homo Sapiens
QKINLGDRS

SEQ ID NO: 810149 - protein, 9 aa, Homo Sapiens
ARPFSDPFQ

SEQ ID NO: 810150 - protein, 9 aa, Homo Sapiens
EVTVNQSIL

SEQ ID NO: 810151 - protein, 9 aa, Homo Sapiens
HRNQLCYSE

SEQ ID NO: 810152 - protein, 9 aa, Homo Sapiens
SDKELHPNT

SEQ ID NO: 810153 - protein, 9 aa, Homo Sapiens
DPNILAHYM

SEQ ID NO: 810154 - protein, 9 aa, Homo Sapiens
LILPLCWTG

SEQ ID NO: 810155 - protein, 9 aa, Homo Sapiens
PCYSKTQNL

SEQ ID NO: 810156 - protein, 9 aa, Homo Sapiens
NGRLRNLIL

SEQ ID NO: 810157 - protein, 9 aa, Homo Sapiens
PPVLTQEER

SEQ ID NO: 810158 - protein, 9 aa, Homo Sapiens
CQYSEESMG

SEQ ID NO: 810159 - protein, 9 aa, Homo Sapiens
LLVEVLEDV

SEQ ID NO: 810160 - protein, 9 aa, Homo Sapiens
LGGEPRMLG

SEQ ID NO: 810161 - protein, 9 aa, Homo Sapiens
KRKYINTIE

SEQ ID NO: 810162 - protein, 9 aa, Homo Sapiens
KNLAVLDAI

SEQ ID NO: 810163 - protein, 9 aa, Homo Sapiens
NNWELTASA

SEQ ID NO: 810164 - protein, 9 aa, Homo Sapiens
EVHYLLQAA

SEQ ID NO: 810165 - protein, 9 aa, Homo Sapiens
DWLCGESQE

SEQ ID NO: 810166 - protein, 9 aa, Homo Sapiens
NHRHRAIIN

SEQ ID NO: 810167 - protein, 9 aa, Homo Sapiens
DELQRRIIQ

SEQ ID NO: 810168 - protein, 9 aa, Homo Sapiens
CQQEDIKTS

SEQ ID NO: 810169 - protein, 9 aa, Homo Sapiens
SSKEDCRVI

SEQ ID NO: 810170 - protein, 9 aa, Homo Sapiens
STLCSGSRL

SEQ ID NO: 810171 - protein, 9 aa, Homo Sapiens
NQLNDTLQG

SEQ ID NO: 810172 - protein, 9 aa, Homo Sapiens
HGELSYSFV

SEQ ID NO: 810173 - protein, 9 aa, Homo Sapiens
QNQDNKLLK

SEQ ID NO: 810174 - protein, 9 aa, Homo Sapiens
HVDQRSMPS

SEQ ID NO: 810175 - protein, 9 aa, Homo Sapiens
VLLRLLCLI

SEQ ID NO: 810176 - protein, 9 aa, Homo Sapiens
MYLGITPSM

SEQ ID NO: 810177 - protein, 9 aa, Homo Sapiens
ERQISELPI

SEQ ID NO: 810178 - protein, 9 aa, Homo Sapiens
KYAYEEQKK

SEQ ID NO: 810179 - protein, 9 aa, Homo Sapiens
IEFEDVIAE

SEQ ID NO: 810180 - protein, 9 aa, Homo Sapiens
SLPTFSVAT

SEQ ID NO: 810181 - protein, 9 aa, Homo Sapiens
DNSNTFGRP

SEQ ID NO: 810182 - protein, 9 aa, Homo Sapiens
GIIYRYLKP

SEQ ID NO: 810183 - protein, 9 aa, Homo Sapiens
VKCVQDTSK

SEQ ID NO: 810184 - protein, 9 aa, Homo Sapiens
YYSISIVLS

SEQ ID NO: 810185 - protein, 9 aa, Homo Sapiens
HVRAFKPLG

SEQ ID NO: 810186 - protein, 9 aa, Homo Sapiens
VYLGSQIDL

SEQ ID NO: 810187 - protein, 9 aa, Homo Sapiens
TVFSSVLST

SEQ ID NO: 810188 - protein, 9 aa, Homo Sapiens
GSYTCDTEF

SEQ ID NO: 810189 - protein, 9 aa, Homo Sapiens
STLLQQIAM

SEQ ID NO: 810190 - protein, 9 aa, Homo Sapiens
PNEELLMVM

SEQ ID NO: 810191 - protein, 9 aa, Homo Sapiens
GVAVFNTSV

SEQ ID NO: 810192 - protein, 9 aa, Homo Sapiens
SQMIVLTYF

SEQ ID NO: 810193 - protein, 9 aa, Homo Sapiens
RGHLPSSSE

SEQ ID NO: 810194 - protein, 9 aa, Homo Sapiens
TTDFVVPGP

SEQ ID NO: 810195 - protein, 9 aa, Homo Sapiens
ENQSQQLEQ

SEQ ID NO: 810196 - protein, 9 aa, Homo Sapiens
AKVWKMPET

SEQ ID NO: 810197 - protein, 9 aa, Homo Sapiens
NAATVCKGS

SEQ ID NO: 810198 - protein, 9 aa, Homo Sapiens
NKIPFKILL

SEQ ID NO: 810199 - protein, 9 aa, Homo Sapiens
NGSSFVSVR

SEQ ID NO: 810200 - protein, 9 aa, Homo Sapiens
SYMKLGRNV

SEQ ID NO: 810201 - protein, 9 aa, Homo Sapiens
QNSWTQKIL

SEQ ID NO: 810202 - protein, 9 aa, Homo Sapiens
KMLRMSKGL

SEQ ID NO: 810203 - protein, 9 aa, Homo Sapiens
NPNRVCMFG

SEQ ID NO: 810204 - protein, 9 aa, Homo Sapiens
DYFFNNFTL

SEQ ID NO: 810205 - protein, 9 aa, Homo Sapiens
QKLFFFLQR

SEQ ID NO: 810206 - protein, 9 aa, Homo Sapiens
RRTLHKAFT

SEQ ID NO: 810207 - protein, 9 aa, Homo Sapiens
VYNASVIYW

SEQ ID NO: 810208 - protein, 9 aa, Homo Sapiens
RKGQSPKSL

SEQ ID NO: 810209 - protein, 9 aa, Homo Sapiens
SQSSRYGNL

SEQ ID NO: 810210 - protein, 9 aa, Homo Sapiens
SIAHSSGSE

SEQ ID NO: 810211 - protein, 9 aa, Homo Sapiens
AKGVLVGCK

SEQ ID NO: 810212 - protein, 9 aa, Homo Sapiens
MVHRIDLDT

SEQ ID NO: 810213 - protein, 9 aa, Homo Sapiens
RNEFLDFTA

SEQ ID NO: 810214 - protein, 9 aa, Homo Sapiens
PIPITLNIG

SEQ ID NO: 810215 - protein, 9 aa, Homo Sapiens
DADINGLQQ

SEQ ID NO: 810216 - protein, 9 aa, Homo Sapiens
QDPAKRMAA

SEQ ID NO: 810217 - protein, 9 aa, Homo Sapiens
PSDLYDGFH

SEQ ID NO: 810218 - protein, 9 aa, Homo Sapiens
GYHSVTQNC

SEQ ID NO: 810219 - protein, 9 aa, Homo Sapiens
SSLIAHQII

SEQ ID NO: 810220 - protein, 9 aa, Homo Sapiens
QTYTYNSGI

SEQ ID NO: 810221 - protein, 9 aa, Homo Sapiens
MLKKAAHKS

SEQ ID NO: 810222 - protein, 9 aa, Homo Sapiens
DGAGLGFKQ

SEQ ID NO: 810223 - protein, 9 aa, Homo Sapiens
LARDVVSRT

SEQ ID NO: 810224 - protein, 9 aa, Homo Sapiens
QQIAPCHLR

SEQ ID NO: 810225 - protein, 9 aa, Homo Sapiens
ITNKDVQKR

SEQ ID NO: 810226 - protein, 9 aa, Homo Sapiens
YGDKPHKCK

SEQ ID NO: 810227 - protein, 9 aa, Homo Sapiens
SAVLPGVAH

SEQ ID NO: 810228 - protein, 9 aa, Homo Sapiens
YEGDDDESK

SEQ ID NO: 810229 - protein, 9 aa, Homo Sapiens
LFTKTEELN

SEQ ID NO: 810230 - protein, 9 aa, Homo Sapiens
TIQILTCQK

SEQ ID NO: 810231 - protein, 9 aa, Homo Sapiens
KQIRHQILL

SEQ ID NO: 810232 - protein, 9 aa, Homo Sapiens
KEMIGWIYL

SEQ ID NO: 810233 - protein, 9 aa, Homo Sapiens
PAGNAATVC

SEQ ID NO: 810234 - protein, 9 aa, Homo Sapiens
LLQQIAMLW

SEQ ID NO: 810235 - protein, 9 aa, Homo Sapiens
ISGVGKLDL

SEQ ID NO: 810236 - protein, 9 aa, Homo Sapiens
LRNNFLNYL

SEQ ID NO: 810237 - protein, 9 aa, Homo Sapiens
NLAVLDAIY

SEQ ID NO: 810238 - protein, 9 aa, Homo Sapiens
VNSVPMILQ

SEQ ID NO: 810239 - protein, 9 aa, Homo Sapiens
EVHTINEMY

SEQ ID NO: 810240 - protein, 9 aa, Homo Sapiens
DEPLYMSLF

SEQ ID NO: 810241 - protein, 9 aa, Homo Sapiens
LFKFLFTCL

SEQ ID NO: 810242 - protein, 9 aa, Homo Sapiens
FMHYQIYKA

SEQ ID NO: 810243 - protein, 9 aa, Homo Sapiens
EAVLRCFIK

SEQ ID NO: 810244 - protein, 9 aa, Homo Sapiens
IVFLFACSL

SEQ ID NO: 810245 - protein, 9 aa, Homo Sapiens
DISVGKEGT

SEQ ID NO: 810246 - protein, 9 aa, Homo Sapiens
ALIYRIWEP

SEQ ID NO: 810247 - protein, 9 aa, Homo Sapiens
IFWSNYHQV

SEQ ID NO: 810248 - protein, 9 aa, Homo Sapiens
IWKHNKFHN

SEQ ID NO: 810249 - protein, 9 aa, Homo Sapiens
RSWKSILST

SEQ ID NO: 810250 - protein, 9 aa, Homo Sapiens
RTQVQWQII

SEQ ID NO: 810251 - protein, 9 aa, Homo Sapiens
NARDAKAIA

SEQ ID NO: 810252 - protein, 9 aa, Homo Sapiens
GLCCPAYPQ

SEQ ID NO: 810253 - protein, 9 aa, Homo Sapiens
TKTEEHILK

SEQ ID NO: 810254 - protein, 9 aa, Homo Sapiens
GKNENGKGR

SEQ ID NO: 810255 - protein, 9 aa, Homo Sapiens
ASTNMDKVL

SEQ ID NO: 810256 - protein, 9 aa, Homo Sapiens
SQARRIWKE

SEQ ID NO: 810257 - protein, 9 aa, Homo Sapiens
QTFGREELF

SEQ ID NO: 810258 - protein, 9 aa, Homo Sapiens
TIFSAIEND

SEQ ID NO: 810259 - protein, 9 aa, Homo Sapiens
LTCAHTINS

SEQ ID NO: 810260 - protein, 9 aa, Homo Sapiens
RANRQLCYH

SEQ ID NO: 810261 - protein, 9 aa, Homo Sapiens
ALYLDITNG

SEQ ID NO: 810262 - protein, 9 aa, Homo Sapiens
HQALKDFTT

SEQ ID NO: 810263 - protein, 9 aa, Homo Sapiens
CDKTGIEEA

SEQ ID NO: 810264 - protein, 9 aa, Homo Sapiens
IFAHVKGIK

SEQ ID NO: 810265 - protein, 9 aa, Homo Sapiens
GCISYYMTY

SEQ ID NO: 810266 - protein, 9 aa, Homo Sapiens
QTQKVQDFR

SEQ ID NO: 810267 - protein, 9 aa, Homo Sapiens
LNLEELKAT

SEQ ID NO: 810268 - protein, 9 aa, Homo Sapiens
RCLDDVKDK

SEQ ID NO: 810269 - protein, 9 aa, Homo Sapiens
TGPELGSRR

SEQ ID NO: 810270 - protein, 9 aa, Homo Sapiens
RQIANANEL

SEQ ID NO: 810271 - protein, 9 aa, Homo Sapiens
LEFAELDQF

SEQ ID NO: 810272 - protein, 9 aa, Homo Sapiens
SGFFLVKEI

SEQ ID NO: 810273 - protein, 9 aa, Homo Sapiens
TTECPHKGR

SEQ ID NO: 810274 - protein, 9 aa, Homo Sapiens
ALAEATVVL

SEQ ID NO: 810275 - protein, 9 aa, Homo Sapiens
HQSYDNLDY

SEQ ID NO: 810276 - protein, 9 aa, Homo Sapiens
PHPIPANTL

SEQ ID NO: 810277 - protein, 9 aa, Homo Sapiens
QIQRAITGT

SEQ ID NO: 810278 - protein, 9 aa, Homo Sapiens
AIAFHRDQR

SEQ ID NO: 810279 - protein, 9 aa, Homo Sapiens
FICLDDPPG

SEQ ID NO: 810280 - protein, 9 aa, Homo Sapiens
FKEYFINYV

SEQ ID NO: 810281 - protein, 9 aa, Homo Sapiens
KELKSQSGE

SEQ ID NO: 810282 - protein, 9 aa, Homo Sapiens
PYTDSDKLN

SEQ ID NO: 810283 - protein, 9 aa, Homo Sapiens
SFYSRVLDN

SEQ ID NO: 810284 - protein, 9 aa, Homo Sapiens
LAARMTMYY

SEQ ID NO: 810285 - protein, 9 aa, Homo Sapiens
KNEIQPIDR

SEQ ID NO: 810286 - protein, 9 aa, Homo Sapiens
HKREAVIET

SEQ ID NO: 810287 - protein, 9 aa, Homo Sapiens
LRLFGDHVR

SEQ ID NO: 810288 - protein, 9 aa, Homo Sapiens
LLAAALQWE

SEQ ID NO: 810289 - protein, 9 aa, Homo Sapiens
NLPVQLLPP

SEQ ID NO: 810290 - protein, 9 aa, Homo Sapiens
GVGKRCDTP

SEQ ID NO: 810291 - protein, 9 aa, Homo Sapiens
LCSFALHTW

SEQ ID NO: 810292 - protein, 9 aa, Homo Sapiens
RYAEKDPNK

SEQ ID NO: 810293 - protein, 9 aa, Homo Sapiens
CEYKHRTGS

SEQ ID NO: 810294 - protein, 9 aa, Homo Sapiens
ISQPDEFEH

SEQ ID NO: 810295 - protein, 9 aa, Homo Sapiens
YFRYYLMDL

SEQ ID NO: 810296 - protein, 9 aa, Homo Sapiens
QRWIRGFIV

SEQ ID NO: 810297 - protein, 9 aa, Homo Sapiens
IDNLHRTFG

SEQ ID NO: 810298 - protein, 9 aa, Homo Sapiens
IDNLHRTFD

SEQ ID NO: 810299 - protein, 9 aa, Homo Sapiens
IDNLHRTFE

SEQ ID NO: 810300 - protein, 9 aa, Homo Sapiens
VWLTHKEME

SEQ ID NO: 810301 - protein, 9 aa, Homo Sapiens
IAGEAERHV

SEQ ID NO: 810302 - protein, 9 aa, Homo Sapiens
VAAPFCCEF

SEQ ID NO: 810303 - protein, 9 aa, Homo Sapiens
PVPKEPISF

SEQ ID NO: 810304 - protein, 9 aa, Homo Sapiens
TCSRASSLS

SEQ ID NO: 810305 - protein, 9 aa, Homo Sapiens
SSSEKGSHM

SEQ ID NO: 810306 - protein, 9 aa, Homo Sapiens
CGEEVAVKA

SEQ ID NO: 810307 - protein, 9 aa, Homo Sapiens
MMPQIVNVT

SEQ ID NO: 810308 - protein, 9 aa, Homo Sapiens
PSRNLQRYC

SEQ ID NO: 810309 - protein, 9 aa, Homo Sapiens
EAQAELQWL

SEQ ID NO: 810310 - protein, 9 aa, Homo Sapiens
RTVEVQGPS

SEQ ID NO: 810311 - protein, 9 aa, Homo Sapiens
VRLVALQRQ

SEQ ID NO: 810312 - protein, 9 aa, Homo Sapiens
VLRCFIKRV

SEQ ID NO: 810313 - protein, 9 aa, Homo Sapiens
APKVLRGKT

SEQ ID NO: 810314 - protein, 9 aa, Homo Sapiens
ILVSAPTFA

SEQ ID NO: 810315 - protein, 9 aa, Homo Sapiens
VITIEDLCE

SEQ ID NO: 810316 - protein, 9 aa, Homo Sapiens
INDATNVND

SEQ ID NO: 810317 - protein, 9 aa, Homo Sapiens
FQSSPERNH

SEQ ID NO: 810318 - protein, 9 aa, Homo Sapiens
RVYFNVPMK

SEQ ID NO: 810319 - protein, 9 aa, Homo Sapiens
LGRLRLPLG

SEQ ID NO: 810320 - protein, 9 aa, Homo Sapiens
MSGNTGDNF

SEQ ID NO: 810321 - protein, 9 aa, Homo Sapiens
ATWKREFGE

SEQ ID NO: 810322 - protein, 9 aa, Homo Sapiens
ALAENNLHL

SEQ ID NO: 810323 - protein, 9 aa, Homo Sapiens
HPGYLRSAG

SEQ ID NO: 810324 - protein, 9 aa, Homo Sapiens
WKMPETFSN

SEQ ID NO: 810325 - protein, 9 aa, Homo Sapiens
SLNNGVVLC

SEQ ID NO: 810326 - protein, 9 aa, Homo Sapiens
INHSRARSR

SEQ ID NO: 810327 - protein, 9 aa, Homo Sapiens
DFHTFYFEN

SEQ ID NO: 810328 - protein, 9 aa, Homo Sapiens
AIIKAGDTE

SEQ ID NO: 810329 - protein, 9 aa, Homo Sapiens
EGTSKPLPD

SEQ ID NO: 810330 - protein, 9 aa, Homo Sapiens
YISGFILQC

SEQ ID NO: 810331 - protein, 9 aa, Homo Sapiens
INKEILRVI

SEQ ID NO: 810332 - protein, 9 aa, Homo Sapiens
DTLFRKYNH

SEQ ID NO: 810333 - protein, 9 aa, Homo Sapiens
KLFEQENKL

SEQ ID NO: 810334 - protein, 9 aa, Homo Sapiens
ITIHNRKEF

SEQ ID NO: 810335 - protein, 9 aa, Homo Sapiens
AVVDVPFDE

SEQ ID NO: 810336 - protein, 9 aa, Homo Sapiens
TFKSGKRVG

SEQ ID NO: 810337 - protein, 9 aa, Homo Sapiens
KLENKTIRG

SEQ ID NO: 810338 - protein, 9 aa, Homo Sapiens
CRATDEMKA

SEQ ID NO: 810339 - protein, 9 aa, Homo Sapiens
KPQKRKKRD

SEQ ID NO: 810340 - protein, 9 aa, Homo Sapiens
KFFKVEDMA

SEQ ID NO: 810341 - protein, 9 aa, Homo Sapiens
VPVPKEPIS

SEQ ID NO: 810342 - protein, 9 aa, Homo Sapiens
HMRQLLMDS

SEQ ID NO: 810343 - protein, 9 aa, Homo Sapiens
HTMAFIEQE

SEQ ID NO: 810344 - protein, 9 aa, Homo Sapiens
EKSTMVYNK

SEQ ID NO: 810345 - protein, 9 aa, Homo Sapiens
LLHQEESQK

SEQ ID NO: 810346 - protein, 9 aa, Homo Sapiens
ACYLKKGNC

SEQ ID NO: 810347 - protein, 9 aa, Homo Sapiens
PASVSCWAK

SEQ ID NO: 810348 - protein, 9 aa, Homo Sapiens
NSSLWNNLI

SEQ ID NO: 810349 - protein, 9 aa, Homo Sapiens
MPMPVNQAK

SEQ ID NO: 810350 - protein, 9 aa, Homo Sapiens
GNLWDILIK

SEQ ID NO: 810351 - protein, 9 aa, Homo Sapiens
LIKPKQRLS

SEQ ID NO: 810352 - protein, 9 aa, Homo Sapiens
LQCGYYVVF

SEQ ID NO: 810353 - protein, 9 aa, Homo Sapiens
TTAALVEHV

SEQ ID NO: 810354 - protein, 9 aa, Homo Sapiens
AKEYARLCQ

SEQ ID NO: 810355 - protein, 9 aa, Homo Sapiens
HRSSSEPMR

SEQ ID NO: 810356 - protein, 9 aa, Homo Sapiens
QKQTNLNES

SEQ ID NO: 810357 - protein, 9 aa, Homo Sapiens
HKLWRNIEP

SEQ ID NO: 810358 - protein, 9 aa, Homo Sapiens
NLDGYLLKV

SEQ ID NO: 810359 - protein, 9 aa, Homo Sapiens
IKNRSSGKT

SEQ ID NO: 810360 - protein, 9 aa, Homo Sapiens
HLTDPFYGI

SEQ ID NO: 810361 - protein, 9 aa, Homo Sapiens
LKITDKYRT

SEQ ID NO: 810362 - protein, 9 aa, Homo Sapiens
NQNVYPSQR

SEQ ID NO: 810363 - protein, 9 aa, Homo Sapiens
QLPRPNVCL

SEQ ID NO: 810364 - protein, 9 aa, Homo Sapiens
SGTQIATIA

SEQ ID NO: 810365 - protein, 9 aa, Homo Sapiens
IVQIPLPCC

SEQ ID NO: 810366 - protein, 9 aa, Homo Sapiens
NKGKRKSET

SEQ ID NO: 810367 - protein, 9 aa, Homo Sapiens
LALLRALLG

SEQ ID NO: 810368 - protein, 9 aa, Homo Sapiens
VAVPHGKEK

SEQ ID NO: 810369 - protein, 9 aa, Homo Sapiens
DLACFLLLQ

SEQ ID NO: 810370 - protein, 9 aa, Homo Sapiens
VALGLLEDK

SEQ ID NO: 810371 - protein, 9 aa, Homo Sapiens
ALTAMMAQN

SEQ ID NO: 810372 - protein, 9 aa, Homo Sapiens
DILTFKEHS

SEQ ID NO: 810373 - protein, 9 aa, Homo Sapiens
LSSLNLQSR

SEQ ID NO: 810374 - protein, 9 aa, Homo Sapiens
RGHFDRTKN

SEQ ID NO: 810375 - protein, 9 aa, Homo Sapiens
MLRGDNNPL

SEQ ID NO: 810376 - protein, 9 aa, Homo Sapiens
DSHKKYSKS

SEQ ID NO: 810377 - protein, 9 aa, Homo Sapiens
EKPCECQQC

SEQ ID NO: 810378 - protein, 9 aa, Homo Sapiens
TCYYVLFHL

SEQ ID NO: 810379 - protein, 9 aa, Homo Sapiens
VRRDCNDFW

SEQ ID NO: 810380 - protein, 9 aa, Homo Sapiens
QINQLLQKE

SEQ ID NO: 810381 - protein, 9 aa, Homo Sapiens
QNIIEINVS

SEQ ID NO: 810382 - protein, 9 aa, Homo Sapiens
RPNQHNAVK

SEQ ID NO: 810383 - protein, 9 aa, Homo Sapiens
NKDKLIKDS

SEQ ID NO: 810384 - protein, 9 aa, Homo Sapiens
QLSAHQNTP

SEQ ID NO: 810385 - protein, 9 aa, Homo Sapiens
HQRINTGEK

SEQ ID NO: 810386 - protein, 9 aa, Homo Sapiens
SSSTSQNHS

SEQ ID NO: 810387 - protein, 9 aa, Homo Sapiens
HKIMKYLIK

SEQ ID NO: 810388 - protein, 9 aa, Homo Sapiens
KARFVAKSG

SEQ ID NO: 810389 - protein, 9 aa, Homo Sapiens
SLSLLKTMH

SEQ ID NO: 810390 - protein, 9 aa, Homo Sapiens
NILDSKILN

SEQ ID NO: 810391 - protein, 9 aa, Homo Sapiens
RAFTTILII

SEQ ID NO: 810392 - protein, 9 aa, Homo Sapiens
APFMLFRLA

SEQ ID NO: 810393 - protein, 9 aa, Homo Sapiens
ISKVLQKLQ

SEQ ID NO: 810394 - protein, 9 aa, Homo Sapiens
KVWKYFGFN

SEQ ID NO: 810395 - protein, 9 aa, Homo Sapiens
TARDVEVSL

SEQ ID NO: 810396 - protein, 9 aa, Homo Sapiens
NVLYAWCGK

SEQ ID NO: 810397 - protein, 9 aa, Homo Sapiens
SKKMKEKAK

SEQ ID NO: 810398 - protein, 9 aa, Homo Sapiens
QHSFIGSTS

SEQ ID NO: 810399 - protein, 9 aa, Homo Sapiens
NVAHTVIRS

SEQ ID NO: 810400 - protein, 9 aa, Homo Sapiens
PNILAHYMR

SEQ ID NO: 810401 - protein, 9 aa, Homo Sapiens
AAECASHLK

SEQ ID NO: 810402 - protein, 9 aa, Homo Sapiens
HPSLLSYMI

SEQ ID NO: 810403 - protein, 9 aa, Homo Sapiens
TLGGVIFQK

SEQ ID NO: 810404 - protein, 9 aa, Homo Sapiens
QDLFETQGN

SEQ ID NO: 810405 - protein, 9 aa, Homo Sapiens
KGACTCWMA

SEQ ID NO: 810406 - protein, 9 aa, Homo Sapiens
RVLHIARVL

SEQ ID NO: 810407 - protein, 9 aa, Homo Sapiens
KPTYCLCHQ

SEQ ID NO: 810408 - protein, 9 aa, Homo Sapiens
VSTFNNYYS

SEQ ID NO: 810409 - protein, 9 aa, Homo Sapiens
KIDFPRAAE

SEQ ID NO: 810410 - protein, 9 aa, Homo Sapiens
QSMIPCCLC

SEQ ID NO: 810411 - protein, 9 aa, Homo Sapiens
KVFLGTASP

SEQ ID NO: 810412 - protein, 9 aa, Homo Sapiens
VIVGLYRTG

SEQ ID NO: 810413 - protein, 9 aa, Homo Sapiens
EEDFEKALN

SEQ ID NO: 810414 - protein, 9 aa, Homo Sapiens
VGWDLGRLS

SEQ ID NO: 810415 - protein, 9 aa, Homo Sapiens
QFQRLGHLV

SEQ ID NO: 810416 - protein, 9 aa, Homo Sapiens
VQPAGASAD

SEQ ID NO: 810417 - protein, 9 aa, Homo Sapiens
CVLNNKKVG

SEQ ID NO: 810418 - protein, 9 aa, Homo Sapiens
TATAKFREQ

SEQ ID NO: 810419 - protein, 9 aa, Homo Sapiens
TLFLCSPQP

SEQ ID NO: 810420 - protein, 9 aa, Homo Sapiens
HHKLCDIIL

SEQ ID NO: 810421 - protein, 9 aa, Homo Sapiens
GIGLKHYAE

SEQ ID NO: 810422 - protein, 9 aa, Homo Sapiens
SNRSNHYSL

SEQ ID NO: 810423 - protein, 9 aa, Homo Sapiens
GLNACFDHQ

SEQ ID NO: 810424 - protein, 9 aa, Homo Sapiens
SFKVTKYWA

SEQ ID NO: 810425 - protein, 9 aa, Homo Sapiens
MAQNNLSPS

SEQ ID NO: 810426 - protein, 9 aa, Homo Sapiens
DQERRTPLR

SEQ ID NO: 810427 - protein, 9 aa, Homo Sapiens
QLVNSGYDS

SEQ ID NO: 810428 - protein, 9 aa, Homo Sapiens
TEVKTRAQG

SEQ ID NO: 810429 - protein, 9 aa, Homo Sapiens
FQLQSDLVR

SEQ ID NO: 810430 - protein, 9 aa, Homo Sapiens
PVKLAQCQS

SEQ ID NO: 810431 - protein, 9 aa, Homo Sapiens
ALRVSSQAE

SEQ ID NO: 810432 - protein, 9 aa, Homo Sapiens
LTEHSCSAE

SEQ ID NO: 810433 - protein, 9 aa, Homo Sapiens
WGENLKDDS

SEQ ID NO: 810434 - protein, 9 aa, Homo Sapiens
DGELHDFRA

SEQ ID NO: 810435 - protein, 9 aa, Homo Sapiens
MAQHFYNLV

SEQ ID NO: 810436 - protein, 9 aa, Homo Sapiens
TYVKEELSN

SEQ ID NO: 810437 - protein, 9 aa, Homo Sapiens
IEVIKDTKE

SEQ ID NO: 810438 - protein, 9 aa, Homo Sapiens
HSEDMDTHV

SEQ ID NO: 810439 - protein, 9 aa, Homo Sapiens
HKVFVGRFK

SEQ ID NO: 810440 - protein, 9 aa, Homo Sapiens
ATSQLPLKS

SEQ ID NO: 810441 - protein, 9 aa, Homo Sapiens
QGQVTGSAW

SEQ ID NO: 810442 - protein, 9 aa, Homo Sapiens
MPCKSSPPE

SEQ ID NO: 810443 - protein, 9 aa, Homo Sapiens
LRFHKAPVG

SEQ ID NO: 810444 - protein, 9 aa, Homo Sapiens
LPALLKQGH

SEQ ID NO: 810445 - protein, 9 aa, Homo Sapiens
GLSATQRSW

SEQ ID NO: 810446 - protein, 9 aa, Homo Sapiens
KNVAGGVKE

SEQ ID NO: 810447 - protein, 9 aa, Homo Sapiens
IKNVPILRV

SEQ ID NO: 810448 - protein, 9 aa, Homo Sapiens
EEDVHAERV

SEQ ID NO: 810449 - protein, 9 aa, Homo Sapiens
IMLLGAEAV

SEQ ID NO: 810450 - protein, 9 aa, Homo Sapiens
GIADRMQTE

SEQ ID NO: 810451 - protein, 9 aa, Homo Sapiens
IVSNLSHKL

SEQ ID NO: 810452 - protein, 9 aa, Homo Sapiens
WDLQFASSP

SEQ ID NO: 810453 - protein, 9 aa, Homo Sapiens
EISHKSSKG

SEQ ID NO: 810454 - protein, 9 aa, Homo Sapiens
IKEEIKKIK

SEQ ID NO: 810455 - protein, 9 aa, Homo Sapiens
ISHLENAIE

SEQ ID NO: 810456 - protein, 9 aa, Homo Sapiens
NRSSHLVKH

SEQ ID NO: 810457 - protein, 9 aa, Homo Sapiens
EDKKRKKLE

SEQ ID NO: 810458 - protein, 9 aa, Homo Sapiens
LDGRRIWVD

SEQ ID NO: 810459 - protein, 9 aa, Homo Sapiens
QDCIKTTPG

SEQ ID NO: 810460 - protein, 9 aa, Homo Sapiens
RIKSGKQSR

SEQ ID NO: 810461 - protein, 9 aa, Homo Sapiens
DKLPGQERL

SEQ ID NO: 810462 - protein, 9 aa, Homo Sapiens
HTQKFTHSR

SEQ ID NO: 810463 - protein, 9 aa, Homo Sapiens
AVRVARQRR

SEQ ID NO: 810464 - protein, 9 aa, Homo Sapiens
PVEGTSAKP

SEQ ID NO: 810465 - protein, 9 aa, Homo Sapiens
ATEPTKLPF

SEQ ID NO: 810466 - protein, 9 aa, Homo Sapiens
NSDLGVGSP

SEQ ID NO: 810467 - protein, 9 aa, Homo Sapiens
LIKQIRHQI

SEQ ID NO: 810468 - protein, 9 aa, Homo Sapiens
VGTNTSFYG

SEQ ID NO: 810469 - protein, 9 aa, Homo Sapiens
CLQWENVSA

SEQ ID NO: 810470 - protein, 9 aa, Homo Sapiens
VIRCQVSTF

SEQ ID NO: 810471 - protein, 9 aa, Homo Sapiens
DLAFNKEQQ

SEQ ID NO: 810472 - protein, 9 aa, Homo Sapiens
NKAITANLH

SEQ ID NO: 810473 - protein, 9 aa, Homo Sapiens
IDSVAAPFC

SEQ ID NO: 810474 - protein, 9 aa, Homo Sapiens
TNLFQYETQ

SEQ ID NO: 810475 - protein, 9 aa, Homo Sapiens
MMEAINKKM

SEQ ID NO: 810476 - protein, 9 aa, Homo Sapiens
VEITFTTKV

SEQ ID NO: 810477 - protein, 9 aa, Homo Sapiens
VLGQAPPKP

SEQ ID NO: 810478 - protein, 9 aa, Homo Sapiens
FSFLKVIFT

SEQ ID NO: 810479 - protein, 9 aa, Homo Sapiens
VICDTPQKT

SEQ ID NO: 810480 - protein, 9 aa, Homo Sapiens
PKFIQLYAV

SEQ ID NO: 810481 - protein, 9 aa, Homo Sapiens
RKEIFETPT

SEQ ID NO: 810482 - protein, 9 aa, Homo Sapiens
GMQALVELF

SEQ ID NO: 810483 - protein, 9 aa, Homo Sapiens
QLSEHQIIH

SEQ ID NO: 810484 - protein, 9 aa, Homo Sapiens
ITGSPLQNQ

SEQ ID NO: 810485 - protein, 9 aa, Homo Sapiens
VLYKEGERY

SEQ ID NO: 810486 - protein, 9 aa, Homo Sapiens
ATRRFNEQA

SEQ ID NO: 810487 - protein, 9 aa, Homo Sapiens
HFFRNALWL

SEQ ID NO: 810488 - protein, 9 aa, Homo Sapiens
LVVLHGIRN

SEQ ID NO: 810489 - protein, 9 aa, Homo Sapiens
LMLPKEAGP

SEQ ID NO: 810490 - protein, 9 aa, Homo Sapiens
HNNEKYCIF

SEQ ID NO: 810491 - protein, 9 aa, Homo Sapiens
KSLNWYEHN

SEQ ID NO: 810492 - protein, 9 aa, Homo Sapiens
GDGLIIGEA

SEQ ID NO: 810493 - protein, 9 aa, Homo Sapiens
GIFWYKQPS

SEQ ID NO: 810494 - protein, 9 aa, Homo Sapiens
LKHHDGQNN

SEQ ID NO: 810495 - protein, 9 aa, Homo Sapiens
SFMTSRKMI

SEQ ID NO: 810496 - protein, 9 aa, Homo Sapiens
TYWDAGFKE

SEQ ID NO: 810497 - protein, 9 aa, Homo Sapiens
HIEKLEQRQ

SEQ ID NO: 810498 - protein, 9 aa, Homo Sapiens
ESGKGVDIY

SEQ ID NO: 810499 - protein, 9 aa, Homo Sapiens
SQPRTTTGT

SEQ ID NO: 810500 - protein, 9 aa, Homo Sapiens
IIDENTVNM

SEQ ID NO: 810501 - protein, 9 aa, Homo Sapiens
VMADGHPLK

SEQ ID NO: 810502 - protein, 9 aa, Homo Sapiens
ELMAMVRPI

SEQ ID NO: 810503 - protein, 9 aa, Homo Sapiens
VSPPFAFLT

SEQ ID NO: 810504 - protein, 9 aa, Homo Sapiens
HTTITAGMG

SEQ ID NO: 810505 - protein, 9 aa, Homo Sapiens
NETMSKIVE

SEQ ID NO: 810506 - protein, 9 aa, Homo Sapiens
LSPAYPAAA

SEQ ID NO: 810507 - protein, 9 aa, Homo Sapiens
NLLAVLKVR

SEQ ID NO: 810508 - protein, 9 aa, Homo Sapiens
KDSGQYEND

SEQ ID NO: 810509 - protein, 9 aa, Homo Sapiens
VTARDVEVS

SEQ ID NO: 810510 - protein, 9 aa, Homo Sapiens
YLVHIGAKV

SEQ ID NO: 810511 - protein, 9 aa, Homo Sapiens
SGRPTFRVV

SEQ ID NO: 810512 - protein, 9 aa, Homo Sapiens
FRYSPNNYL

SEQ ID NO: 810513 - protein, 9 aa, Homo Sapiens
ASVSMPSEY

SEQ ID NO: 810514 - protein, 9 aa, Homo Sapiens
QRVRGHEAF

SEQ ID NO: 810515 - protein, 9 aa, Homo Sapiens
FDQLAHEHH

SEQ ID NO: 810516 - protein, 9 aa, Homo Sapiens
QDRVLYILK

SEQ ID NO: 810517 - protein, 9 aa, Homo Sapiens
INQGIQNLL

SEQ ID NO: 810518 - protein, 9 aa, Homo Sapiens
FTGNETFAG

SEQ ID NO: 810519 - protein, 9 aa, Homo Sapiens
SNGSTNLVL

SEQ ID NO: 810520 - protein, 9 aa, Homo Sapiens
ISLIALTQK

SEQ ID NO: 810521 - protein, 9 aa, Homo Sapiens
NECDVEPCK

SEQ ID NO: 810522 - protein, 9 aa, Homo Sapiens
NVNVSFNPE

SEQ ID NO: 810523 - protein, 9 aa, Homo Sapiens
TMISRPYST

SEQ ID NO: 810524 - protein, 9 aa, Homo Sapiens
YLMKMPVAY

SEQ ID NO: 810525 - protein, 9 aa, Homo Sapiens
SSDNESDIK

SEQ ID NO: 810526 - protein, 9 aa, Homo Sapiens
NNLESKKLI

SEQ ID NO: 810527 - protein, 9 aa, Homo Sapiens
AQVQTIQIL

SEQ ID NO: 810528 - protein, 9 aa, Homo Sapiens
GLALFSNHQ

SEQ ID NO: 810529 - protein, 9 aa, Homo Sapiens
APGADKSTQ

SEQ ID NO: 810530 - protein, 9 aa, Homo Sapiens
FPAGEFTFK

SEQ ID NO: 810531 - protein, 9 aa, Homo Sapiens
SRSLGLISH

SEQ ID NO: 810532 - protein, 9 aa, Homo Sapiens
HVALGLLED

SEQ ID NO: 810533 - protein, 9 aa, Homo Sapiens
FMLFRLAAV

SEQ ID NO: 810534 - protein, 9 aa, Homo Sapiens
QQPEVPIIY

SEQ ID NO: 810535 - protein, 9 aa, Homo Sapiens
PLLSNPGLM

SEQ ID NO: 810536 - protein, 9 aa, Homo Sapiens
FFNNFTLGV

SEQ ID NO: 810537 - protein, 9 aa, Homo Sapiens
APKLQFQVT

SEQ ID NO: 810538 - protein, 9 aa, Homo Sapiens
LEVQLCRAT

SEQ ID NO: 810539 - protein, 9 aa, Homo Sapiens
MKKTSFKRA

SEQ ID NO: 810540 - protein, 9 aa, Homo Sapiens
ARVRDITIA

SEQ ID NO: 810541 - protein, 9 aa, Homo Sapiens
IMKISNAQD

SEQ ID NO: 810542 - protein, 9 aa, Homo Sapiens
ITYNNLSDK

SEQ ID NO: 810543 - protein, 9 aa, Homo Sapiens
KRDGDKKNH

SEQ ID NO: 810544 - protein, 9 aa, Homo Sapiens
QTRPVWTAE

SEQ ID NO: 810545 - protein, 9 aa, Homo Sapiens
RLPQVIAHL

SEQ ID NO: 810546 - protein, 9 aa, Homo Sapiens
LPGSSDEDI

SEQ ID NO: 810547 - protein, 9 aa, Homo Sapiens
MMKNAQKKI

SEQ ID NO: 810548 - protein, 9 aa, Homo Sapiens
SFHLYCRLK

SEQ ID NO: 810549 - protein, 9 aa, Homo Sapiens
VLQIIFVSY

SEQ ID NO: 810550 - protein, 9 aa, Homo Sapiens
MLLLTVMAY

SEQ ID NO: 810551 - protein, 9 aa, Homo Sapiens
PFKCLEPTL

SEQ ID NO: 810552 - protein, 9 aa, Homo Sapiens
MLGAWGVGK

SEQ ID NO: 810553 - protein, 9 aa, Homo Sapiens
LNYPDRARR

SEQ ID NO: 810554 - protein, 9 aa, Homo Sapiens
EIFLVSIIL

SEQ ID NO: 810555 - protein, 9 aa, Homo Sapiens
RIGISCIFP

SEQ ID NO: 810556 - protein, 9 aa, Homo Sapiens
EIARFFCEL

SEQ ID NO: 810557 - protein, 9 aa, Homo Sapiens
SDLTNHKII

SEQ ID NO: 810558 - protein, 9 aa, Homo Sapiens
DEKNKSNFK

SEQ ID NO: 810559 - protein, 9 aa, Homo Sapiens
DLENVDGAA

SEQ ID NO: 810560 - protein, 9 aa, Homo Sapiens
CHTGKIPYE

SEQ ID NO: 810561 - protein, 9 aa, Homo Sapiens
VVSEPIKGH

SEQ ID NO: 810562 - protein, 9 aa, Homo Sapiens
DKLFVETGK

SEQ ID NO: 810563 - protein, 9 aa, Homo Sapiens
FIKHVEEFS

SEQ ID NO: 810564 - protein, 9 aa, Homo Sapiens
LWWVGLTEV

SEQ ID NO: 810565 - protein, 9 aa, Homo Sapiens
LFNESSADW

SEQ ID NO: 810566 - protein, 9 aa, Homo Sapiens
SGYGPGDGP

SEQ ID NO: 810567 - protein, 9 aa, Homo Sapiens
SLAKRKIIH

SEQ ID NO: 810568 - protein, 9 aa, Homo Sapiens
YLQAAIVCI

SEQ ID NO: 810569 - protein, 9 aa, Homo Sapiens
ADVEFTTHE

SEQ ID NO: 810570 - protein, 9 aa, Homo Sapiens
HEQLGMQAL

SEQ ID NO: 810571 - protein, 9 aa, Homo Sapiens
WHKEMVLKI

SEQ ID NO: 810572 - protein, 9 aa, Homo Sapiens
KAKQSHSEK

SEQ ID NO: 810573 - protein, 9 aa, Homo Sapiens
KDASIVGSF

SEQ ID NO: 810574 - protein, 9 aa, Homo Sapiens
QRGRCHVAS

SEQ ID NO: 810575 - protein, 9 aa, Homo Sapiens
QYITKMTAV

SEQ ID NO: 810576 - protein, 9 aa, Homo Sapiens
GWKKEAISD

SEQ ID NO: 810577 - protein, 9 aa, Homo Sapiens
RAFNGERLR

SEQ ID NO: 810578 - protein, 9 aa, Homo Sapiens
ALVHYYFSA

SEQ ID NO: 810579 - protein, 9 aa, Homo Sapiens
RQINEDNKR

SEQ ID NO: 810580 - protein, 9 aa, Homo Sapiens
YNFPIDELS

SEQ ID NO: 810581 - protein, 9 aa, Homo Sapiens
FNLEEIKDI

SEQ ID NO: 810582 - protein, 9 aa, Homo Sapiens
TSSCCAPRP

SEQ ID NO: 810583 - protein, 9 aa, Homo Sapiens
YGDTAILFT

SEQ ID NO: 810584 - protein, 9 aa, Homo Sapiens
FPGEIIMRM

SEQ ID NO: 810585 - protein, 9 aa, Homo Sapiens
DSEERSLDS

SEQ ID NO: 810586 - protein, 9 aa, Homo Sapiens
AVQASMPDK

SEQ ID NO: 810587 - protein, 9 aa, Homo Sapiens
ERKKRRREI

SEQ ID NO: 810588 - protein, 9 aa, Homo Sapiens
LSNIAAIDS

SEQ ID NO: 810589 - protein, 9 aa, Homo Sapiens
FLFLRLFAP

SEQ ID NO: 810590 - protein, 9 aa, Homo Sapiens
CNREAFNVY

SEQ ID NO: 810591 - protein, 9 aa, Homo Sapiens
CRRNNYGQL

SEQ ID NO: 810592 - protein, 9 aa, Homo Sapiens
FDFNIKFAE

SEQ ID NO: 810593 - protein, 9 aa, Homo Sapiens
KFYYTECLF

SEQ ID NO: 810594 - protein, 9 aa, Homo Sapiens
ISMPSDSHV

SEQ ID NO: 810595 - protein, 9 aa, Homo Sapiens
EPIPLTEDV

SEQ ID NO: 810596 - protein, 9 aa, Homo Sapiens
YNNLKFTIW

SEQ ID NO: 810597 - protein, 9 aa, Homo Sapiens
HAIMENAVQ

SEQ ID NO: 810598 - protein, 9 aa, Homo Sapiens
NSLRCISKM

SEQ ID NO: 810599 - protein, 9 aa, Homo Sapiens
FRDEKELEI

SEQ ID NO: 810600 - protein, 9 aa, Homo Sapiens
VNMSRVDVY

SEQ ID NO: 810601 - protein, 9 aa, Homo Sapiens
SDIVQWLIN

SEQ ID NO: 810602 - protein, 9 aa, Homo Sapiens
KEDCRVIPW

SEQ ID NO: 810603 - protein, 9 aa, Homo Sapiens
IPDNAPETV

SEQ ID NO: 810604 - protein, 9 aa, Homo Sapiens
KPLARAPYR

SEQ ID NO: 810605 - protein, 9 aa, Homo Sapiens
IGSSGFFLV

SEQ ID NO: 810606 - protein, 9 aa, Homo Sapiens
SELISFITS

SEQ ID NO: 810607 - protein, 9 aa, Homo Sapiens
LGGVIFQKF

SEQ ID NO: 810608 - protein, 9 aa, Homo Sapiens
YFFPGLGYG

SEQ ID NO: 810609 - protein, 9 aa, Homo Sapiens
NVETTKCVV

SEQ ID NO: 810610 - protein, 9 aa, Homo Sapiens
LHVDSLTEH

SEQ ID NO: 810611 - protein, 9 aa, Homo Sapiens
CQLLGAPRG

SEQ ID NO: 810612 - protein, 9 aa, Homo Sapiens
IQPLWRHYF

SEQ ID NO: 810613 - protein, 9 aa, Homo Sapiens
SIFPDFFVC

SEQ ID NO: 810614 - protein, 9 aa, Homo Sapiens
IFGTMLPAS

SEQ ID NO: 810615 - protein, 9 aa, Homo Sapiens
VWDAAIILS

SEQ ID NO: 810616 - protein, 9 aa, Homo Sapiens
INVYGFSAL

SEQ ID NO: 810617 - protein, 9 aa, Homo Sapiens
SVLESEDTP

SEQ ID NO: 810618 - protein, 9 aa, Homo Sapiens
HLNKHSYPN

SEQ ID NO: 810619 - protein, 9 aa, Homo Sapiens
AAFDERNAI

SEQ ID NO: 810620 - protein, 9 aa, Homo Sapiens
VIENYCDPV

SEQ ID NO: 810621 - protein, 9 aa, Homo Sapiens
SVRVLYKKC

SEQ ID NO: 810622 - protein, 9 aa, Homo Sapiens
LIATFQDVY

SEQ ID NO: 810623 - protein, 9 aa, Homo Sapiens
VHTINEMYA

SEQ ID NO: 810624 - protein, 9 aa, Homo Sapiens
HGRCHGCLK

SEQ ID NO: 810625 - protein, 9 aa, Homo Sapiens
DVPIYLSKK

SEQ ID NO: 810626 - protein, 9 aa, Homo Sapiens
REFDSDYLR

SEQ ID NO: 810627 - protein, 9 aa, Homo Sapiens
NHAAPFSNV

SEQ ID NO: 810628 - protein, 9 aa, Homo Sapiens
TISDNTSQE

SEQ ID NO: 810629 - protein, 9 aa, Homo Sapiens
NTTVLECAP

SEQ ID NO: 810630 - protein, 9 aa, Homo Sapiens
PPELAREYY

SEQ ID NO: 810631 - protein, 9 aa, Homo Sapiens
DREQLDTFI

SEQ ID NO: 810632 - protein, 9 aa, Homo Sapiens
VEVGWDLGR

SEQ ID NO: 810633 - protein, 9 aa, Homo Sapiens
LDYVKITLR

SEQ ID NO: 810634 - protein, 9 aa, Homo Sapiens
STDAVLNNR

SEQ ID NO: 810635 - protein, 9 aa, Homo Sapiens
FDFFGDHQE

SEQ ID NO: 810636 - protein, 9 aa, Homo Sapiens
PKWGREQLE

SEQ ID NO: 810637 - protein, 9 aa, Homo Sapiens
PPLQAQSPA

SEQ ID NO: 810638 - protein, 9 aa, Homo Sapiens
SLKWPTLVA

SEQ ID NO: 810639 - protein, 9 aa, Homo Sapiens
TFVFDAVTD

SEQ ID NO: 810640 - protein, 9 aa, Homo Sapiens
NESYVRSQL

SEQ ID NO: 810641 - protein, 9 aa, Homo Sapiens
LTLSGICTF

SEQ ID NO: 810642 - protein, 9 aa, Homo Sapiens
LVADTREDM

SEQ ID NO: 810643 - protein, 9 aa, Homo Sapiens
VEPLQTVEI

SEQ ID NO: 810644 - protein, 9 aa, Homo Sapiens
NRTTVERER

SEQ ID NO: 810645 - protein, 9 aa, Homo Sapiens
VQEYQEKFQ

SEQ ID NO: 810646 - protein, 9 aa, Homo Sapiens
AATLCAPKA

SEQ ID NO: 810647 - protein, 9 aa, Homo Sapiens
QDQEHLVLN

SEQ ID NO: 810648 - protein, 9 aa, Homo Sapiens
WQSVIKLNY

SEQ ID NO: 810649 - protein, 9 aa, Homo Sapiens
FFMYSQSNI

SEQ ID NO: 810650 - protein, 9 aa, Homo Sapiens
VPSAFDKQV

SEQ ID NO: 810651 - protein, 9 aa, Homo Sapiens
APVYDWPPQ

SEQ ID NO: 810652 - protein, 9 aa, Homo Sapiens
NRMLKYTSV

SEQ ID NO: 810653 - protein, 9 aa, Homo Sapiens
STEMRLIRF

SEQ ID NO: 810654 - protein, 9 aa, Homo Sapiens
DAVLNNRFI

SEQ ID NO: 810655 - protein, 9 aa, Homo Sapiens
GAAKHEIKA

SEQ ID NO: 810656 - protein, 9 aa, Homo Sapiens
MIIIKTNPR

SEQ ID NO: 810657 - protein, 9 aa, Homo Sapiens
PIKDGPKRS

SEQ ID NO: 810658 - protein, 9 aa, Homo Sapiens
GTKAFFFQD

SEQ ID NO: 810659 - protein, 9 aa, Homo Sapiens
ISNVQSKCG

SEQ ID NO: 810660 - protein, 9 aa, Homo Sapiens
DLDTEWNMF

SEQ ID NO: 810661 - protein, 9 aa, Homo Sapiens
NQSFENETE

SEQ ID NO: 810662 - protein, 9 aa, Homo Sapiens
LTFKPDTNK

SEQ ID NO: 810663 - protein, 9 aa, Homo Sapiens
HALRNEKPV

SEQ ID NO: 810664 - protein, 9 aa, Homo Sapiens
FQLAYLLRH

SEQ ID NO: 810665 - protein, 9 aa, Homo Sapiens
GYCQGMTFI

SEQ ID NO: 810666 - protein, 9 aa, Homo Sapiens
NIIHFQTKV

SEQ ID NO: 810667 - protein, 9 aa, Homo Sapiens
YDFVQAIIV

SEQ ID NO: 810668 - protein, 9 aa, Homo Sapiens
YIHCCVIGY

SEQ ID NO: 810669 - protein, 9 aa, Homo Sapiens
DKIITYEDS

SEQ ID NO: 810670 - protein, 9 aa, Homo Sapiens
FKVSAQVIT

SEQ ID NO: 810671 - protein, 9 aa, Homo Sapiens
EKNKSNFKK

SEQ ID NO: 810672 - protein, 9 aa, Homo Sapiens
KIQEHWTGA

SEQ ID NO: 810673 - protein, 9 aa, Homo Sapiens
TQKPHRTEH

SEQ ID NO: 810674 - protein, 9 aa, Homo Sapiens
EKELHENVI

SEQ ID NO: 810675 - protein, 9 aa, Homo Sapiens
FLISSNRSN

SEQ ID NO: 810676 - protein, 9 aa, Homo Sapiens
ILFSLFLSM

SEQ ID NO: 810677 - protein, 9 aa, Homo Sapiens
SRGLQSGSA

SEQ ID NO: 810678 - protein, 9 aa, Homo Sapiens
GMQDILLIG

SEQ ID NO: 810679 - protein, 9 aa, Homo Sapiens
DDELYNPDS

SEQ ID NO: 810680 - protein, 9 aa, Homo Sapiens
ATVCKGSST

SEQ ID NO: 810681 - protein, 9 aa, Homo Sapiens
ELRNGEATG

SEQ ID NO: 810682 - protein, 9 aa, Homo Sapiens
RQNGQTDPL

SEQ ID NO: 810683 - protein, 9 aa, Homo Sapiens
LDSIAHSSG

SEQ ID NO: 810684 - protein, 9 aa, Homo Sapiens
VDTMQEDLV

SEQ ID NO: 810685 - protein, 9 aa, Homo Sapiens
LRAEDNPMV

SEQ ID NO: 810686 - protein, 9 aa, Homo Sapiens
MHKRPLVYL

SEQ ID NO: 810687 - protein, 9 aa, Homo Sapiens
TLKAWLNGH

SEQ ID NO: 810688 - protein, 9 aa, Homo Sapiens
SKEGACIVR

SEQ ID NO: 810689 - protein, 9 aa, Homo Sapiens
KDLDVGQNN

SEQ ID NO: 810690 - protein, 9 aa, Homo Sapiens
DELVHGYIF

SEQ ID NO: 810691 - protein, 9 aa, Homo Sapiens
DGWHEMDAD

SEQ ID NO: 810692 - protein, 9 aa, Homo Sapiens
GCIFRFGRQ

SEQ ID NO: 810693 - protein, 9 aa, Homo Sapiens
NAVLHKNRD

SEQ ID NO: 810694 - protein, 9 aa, Homo Sapiens
SADKLYGVK

SEQ ID NO: 810695 - protein, 9 aa, Homo Sapiens
LIGTVPFHL

SEQ ID NO: 810696 - protein, 9 aa, Homo Sapiens
PGEIIMRML

SEQ ID NO: 810697 - protein, 9 aa, Homo Sapiens
GEPRMLGAV

SEQ ID NO: 810698 - protein, 9 aa, Homo Sapiens
YPFKPPQVA

SEQ ID NO: 810699 - protein, 9 aa, Homo Sapiens
ECCKRVVIN

SEQ ID NO: 810700 - protein, 9 aa, Homo Sapiens
NSKDILTFK

SEQ ID NO: 810701 - protein, 9 aa, Homo Sapiens
TNLVLIGAP

SEQ ID NO: 810702 - protein, 9 aa, Homo Sapiens
NYEQQQIII

SEQ ID NO: 810703 - protein, 9 aa, Homo Sapiens
VANNLAIQL

SEQ ID NO: 810704 - protein, 9 aa, Homo Sapiens
VGCTMAEMV

SEQ ID NO: 810705 - protein, 9 aa, Homo Sapiens
LQEEIDKMA

SEQ ID NO: 810706 - protein, 9 aa, Homo Sapiens
AEYGWLGLG

SEQ ID NO: 810707 - protein, 9 aa, Homo Sapiens
FLVKEIKDS

SEQ ID NO: 810708 - protein, 9 aa, Homo Sapiens
KSLLEHYLP

SEQ ID NO: 810709 - protein, 9 aa, Homo Sapiens
WTDPNRSCQ

SEQ ID NO: 810710 - protein, 9 aa, Homo Sapiens
HYFVEFIFH

SEQ ID NO: 810711 - protein, 9 aa, Homo Sapiens
IYGFFILFR

SEQ ID NO: 810712 - protein, 9 aa, Homo Sapiens
YSYGSSSGY

SEQ ID NO: 810713 - protein, 9 aa, Homo Sapiens
DPSLGIIAN

SEQ ID NO: 810714 - protein, 9 aa, Homo Sapiens
EWGSPKKCE

SEQ ID NO: 810715 - protein, 9 aa, Homo Sapiens
AGYGVEGTL

SEQ ID NO: 810716 - protein, 9 aa, Homo Sapiens
DGDKLELLK

SEQ ID NO: 810717 - protein, 9 aa, Homo Sapiens
NKIKYDFPL

SEQ ID NO: 810718 - protein, 9 aa, Homo Sapiens
ENNKPHTVL

SEQ ID NO: 810719 - protein, 9 aa, Homo Sapiens
TWVITMMAT

SEQ ID NO: 810720 - protein, 9 aa, Homo Sapiens
LQELSKEER

SEQ ID NO: 810721 - protein, 9 aa, Homo Sapiens
ISWPLWTTI

SEQ ID NO: 810722 - protein, 9 aa, Homo Sapiens
QGLVGFGIG

SEQ ID NO: 810723 - protein, 9 aa, Homo Sapiens
VLIALKSVL

SEQ ID NO: 810724 - protein, 9 aa, Homo Sapiens
LDGELPSVR

SEQ ID NO: 810725 - protein, 9 aa, Homo Sapiens
HVYVGMKTR

SEQ ID NO: 810726 - protein, 9 aa, Homo Sapiens
GGLSFETTK

SEQ ID NO: 810727 - protein, 9 aa, Homo Sapiens
IVYPFRSCT

SEQ ID NO: 810728 - protein, 9 aa, Homo Sapiens
RPTSSFLAN

SEQ ID NO: 810729 - protein, 9 aa, Homo Sapiens
AHEQGKDIN

SEQ ID NO: 810730 - protein, 9 aa, Homo Sapiens
VVVIVGLYR

SEQ ID NO: 810731 - protein, 8 aa, Homo Sapiens
CKSLRYCF

SEQ ID NO: 810732 - protein, 9 aa, Homo Sapiens
PEKHIPGYQ

SEQ ID NO: 810733 - protein, 9 aa, Homo Sapiens
TMKENSITL

SEQ ID NO: 810734 - protein, 9 aa, Homo Sapiens
DYHNRQGIF

SEQ ID NO: 810735 - protein, 9 aa, Homo Sapiens
KVGSGPGSV

SEQ ID NO: 810736 - protein, 9 aa, Homo Sapiens
GVHADPEKE

SEQ ID NO: 810737 - protein, 9 aa, Homo Sapiens
VDCCGEHDV

SEQ ID NO: 810738 - protein, 9 aa, Homo Sapiens
LQEYQKIMK

SEQ ID NO: 810739 - protein, 9 aa, Homo Sapiens
KYTSWIPPF

SEQ ID NO: 810740 - protein, 9 aa, Homo Sapiens
EIISKQYNN

SEQ ID NO: 810741 - protein, 9 aa, Homo Sapiens
HQSEFTVES

SEQ ID NO: 810742 - protein, 9 aa, Homo Sapiens
LQVENSKRV

SEQ ID NO: 810743 - protein, 9 aa, Homo Sapiens
ESIVKLYKE

SEQ ID NO: 810744 - protein, 9 aa, Homo Sapiens
FTFSSTINT

SEQ ID NO: 810745 - protein, 9 aa, Homo Sapiens
MITSVFYML

SEQ ID NO: 810746 - protein, 9 aa, Homo Sapiens
EKLSDLERL

SEQ ID NO: 810747 - protein, 9 aa, Homo Sapiens
VAIILAGIY

SEQ ID NO: 810748 - protein, 9 aa, Homo Sapiens
SHLSRHEII

SEQ ID NO: 810749 - protein, 9 aa, Homo Sapiens
ILALAAADI

SEQ ID NO: 810750 - protein, 9 aa, Homo Sapiens
AAPRRRWDR

SEQ ID NO: 810751 - protein, 9 aa, Homo Sapiens
IRLQSLHID

SEQ ID NO: 810752 - protein, 9 aa, Homo Sapiens
QFNSVQEMV

SEQ ID NO: 810753 - protein, 9 aa, Homo Sapiens
PLNTAGHPE

SEQ ID NO: 810754 - protein, 9 aa, Homo Sapiens
LSPSQKPQI

SEQ ID NO: 810755 - protein, 9 aa, Homo Sapiens
FFLFNYILV

SEQ ID NO: 810756 - protein, 9 aa, Homo Sapiens
KNIDESWIQ

SEQ ID NO: 810757 - protein, 9 aa, Homo Sapiens
FKKENTKED

SEQ ID NO: 810758 - protein, 9 aa, Homo Sapiens
TLSELLGTF

SEQ ID NO: 810759 - protein, 9 aa, Homo Sapiens
EKTKNILMC

SEQ ID NO: 810760 - protein, 9 aa, Homo Sapiens
LEWTLQTLQ

SEQ ID NO: 810761 - protein, 9 aa, Homo Sapiens
STPTFIILG

SEQ ID NO: 810762 - protein, 9 aa, Homo Sapiens
VLNNNKCPY

SEQ ID NO: 810763 - protein, 9 aa, Homo Sapiens
RRFKDLRFQ

SEQ ID NO: 810764 - protein, 9 aa, Homo Sapiens
GMCCYVLSA

SEQ ID NO: 810765 - protein, 9 aa, Homo Sapiens
LFGVALENN

SEQ ID NO: 810766 - protein, 9 aa, Homo Sapiens
RAAAYVGDV

SEQ ID NO: 810767 - protein, 9 aa, Homo Sapiens
DEDASGGEQ

SEQ ID NO: 810768 - protein, 9 aa, Homo Sapiens
QRYAWPLLE

SEQ ID NO: 810769 - protein, 9 aa, Homo Sapiens
EKASALNTN

SEQ ID NO: 810770 - protein, 9 aa, Homo Sapiens
FYLQYLTHW

SEQ ID NO: 810771 - protein, 9 aa, Homo Sapiens
RFVEDLLPN

SEQ ID NO: 810772 - protein, 9 aa, Homo Sapiens
SALPSTLRQ

SEQ ID NO: 810773 - protein, 9 aa, Homo Sapiens
VIIILMTIG

SEQ ID NO: 810774 - protein, 9 aa, Homo Sapiens
SVGCTMAEM

SEQ ID NO: 810775 - protein, 9 aa, Homo Sapiens
GHKFDFIHD

SEQ ID NO: 810776 - protein, 9 aa, Homo Sapiens
PRASSSRSS

SEQ ID NO: 810777 - protein, 9 aa, Homo Sapiens
YAARVNKKT

SEQ ID NO: 810778 - protein, 9 aa, Homo Sapiens
EETLHNLQA

SEQ ID NO: 810779 - protein, 9 aa, Homo Sapiens
GKIITISFQ

SEQ ID NO: 810780 - protein, 9 aa, Homo Sapiens
TAYNRCTFE

SEQ ID NO: 810781 - protein, 9 aa, Homo Sapiens
TVGSECLFS

SEQ ID NO: 810782 - protein, 9 aa, Homo Sapiens
CAHLSRHQI

SEQ ID NO: 810783 - protein, 9 aa, Homo Sapiens
LKCVNHTNI

SEQ ID NO: 810784 - protein, 9 aa, Homo Sapiens
QPQQSLATE

SEQ ID NO: 810785 - protein, 9 aa, Homo Sapiens
ATIIDFHVT

SEQ ID NO: 810786 - protein, 9 aa, Homo Sapiens
ILFNLAVLM

SEQ ID NO: 810787 - protein, 9 aa, Homo Sapiens
EEIQCYVRD

SEQ ID NO: 810788 - protein, 9 aa, Homo Sapiens
FKFKAESNL

SEQ ID NO: 810789 - protein, 9 aa, Homo Sapiens
DKGATWNVL

SEQ ID NO: 810790 - protein, 9 aa, Homo Sapiens
LIMYSLRNK

SEQ ID NO: 810791 - protein, 9 aa, Homo Sapiens
YDNTTTKGT

SEQ ID NO: 810792 - protein, 9 aa, Homo Sapiens
RKKYCFHKT

SEQ ID NO: 810793 - protein, 9 aa, Homo Sapiens
ARVCISYPS

SEQ ID NO: 810794 - protein, 9 aa, Homo Sapiens
PPICQVESL

SEQ ID NO: 810795 - protein, 9 aa, Homo Sapiens
LIGGGRKPQ

SEQ ID NO: 810796 - protein, 9 aa, Homo Sapiens
KDGKKRKGS

SEQ ID NO: 810797 - protein, 9 aa, Homo Sapiens
VRIVVSNAW

SEQ ID NO: 810798 - protein, 9 aa, Homo Sapiens
VAHRNSTHQ

SEQ ID NO: 810799 - protein, 9 aa, Homo Sapiens
SFLFITPPI

SEQ ID NO: 810800 - protein, 9 aa, Homo Sapiens
RQNAGKDRR

SEQ ID NO: 810801 - protein, 9 aa, Homo Sapiens
MLWRPQPCC

SEQ ID NO: 810802 - protein, 9 aa, Homo Sapiens
TTITVPPFY

SEQ ID NO: 810803 - protein, 9 aa, Homo Sapiens
RLFSSVYEH

SEQ ID NO: 810804 - protein, 9 aa, Homo Sapiens
GSSAFLDSH

SEQ ID NO: 810805 - protein, 9 aa, Homo Sapiens
EPSPAPPTQ

SEQ ID NO: 810806 - protein, 9 aa, Homo Sapiens
GRLSSWCLN

SEQ ID NO: 810807 - protein, 9 aa, Homo Sapiens
AKIEKVRKK

SEQ ID NO: 810808 - protein, 9 aa, Homo Sapiens
LAADSANGS

SEQ ID NO: 810809 - protein, 9 aa, Homo Sapiens
LKTELGNEK

SEQ ID NO: 810810 - protein, 9 aa, Homo Sapiens
QYETQQLQP

SEQ ID NO: 810811 - protein, 9 aa, Homo Sapiens
KACDKSFHL

SEQ ID NO: 810812 - protein, 9 aa, Homo Sapiens
TVHCMDPNN

SEQ ID NO: 810813 - protein, 9 aa, Homo Sapiens
RFQEEYSTL

SEQ ID NO: 810814 - protein, 9 aa, Homo Sapiens
NYQKQESLE

SEQ ID NO: 810815 - protein, 9 aa, Homo Sapiens
KKLQEKHKQ

SEQ ID NO: 810816 - protein, 9 aa, Homo Sapiens
RSQTRMATM

SEQ ID NO: 810817 - protein, 9 aa, Homo Sapiens
SSSSNSDVS

SEQ ID NO: 810818 - protein, 9 aa, Homo Sapiens
WKEFCSYLS

SEQ ID NO: 810819 - protein, 9 aa, Homo Sapiens
NLIMYSLRN

SEQ ID NO: 810820 - protein, 9 aa, Homo Sapiens
QYHKHHDKF

SEQ ID NO: 810821 - protein, 9 aa, Homo Sapiens
QLPLKSDAV

SEQ ID NO: 810822 - protein, 9 aa, Homo Sapiens
KKIKHCKVK

SEQ ID NO: 810823 - protein, 9 aa, Homo Sapiens
GGVSIYGDT

SEQ ID NO: 810824 - protein, 9 aa, Homo Sapiens
VHQALKDFT

SEQ ID NO: 810825 - protein, 9 aa, Homo Sapiens
DFCYVFTGE

SEQ ID NO: 810826 - protein, 9 aa, Homo Sapiens
LPPQCLLSG

SEQ ID NO: 810827 - protein, 9 aa, Homo Sapiens
KLAEATITN

SEQ ID NO: 810828 - protein, 9 aa, Homo Sapiens
LGTNEETLR

SEQ ID NO: 810829 - protein, 9 aa, Homo Sapiens
RFISYCLKC

SEQ ID NO: 810830 - protein, 9 aa, Homo Sapiens
LCLFVTEVC

SEQ ID NO: 810831 - protein, 9 aa, Homo Sapiens
TSVEHISRI

SEQ ID NO: 810832 - protein, 9 aa, Homo Sapiens
DYTLSKEFG

SEQ ID NO: 810833 - protein, 9 aa, Homo Sapiens
RDKKLALML

SEQ ID NO: 810834 - protein, 9 aa, Homo Sapiens
RRIALASRS

SEQ ID NO: 810835 - protein, 9 aa, Homo Sapiens
KVRLDLLSC

SEQ ID NO: 810836 - protein, 9 aa, Homo Sapiens
PFPAEIYRQ

SEQ ID NO: 810837 - protein, 9 aa, Homo Sapiens
QSLDESRGS

SEQ ID NO: 810838 - protein, 9 aa, Homo Sapiens
IILSAPNPD

SEQ ID NO: 810839 - protein, 9 aa, Homo Sapiens
GLGVRALNV

SEQ ID NO: 810840 - protein, 9 aa, Homo Sapiens
THTGDKLYP

SEQ ID NO: 810841 - protein, 9 aa, Homo Sapiens
PKIIYFIAP

SEQ ID NO: 810842 - protein, 9 aa, Homo Sapiens
SPEEPQTLV

SEQ ID NO: 810843 - protein, 9 aa, Homo Sapiens
KTLTDAQVV

SEQ ID NO: 810844 - protein, 9 aa, Homo Sapiens
EIISKSPDS

SEQ ID NO: 810845 - protein, 9 aa, Homo Sapiens
RGRLRDYIK

SEQ ID NO: 810846 - protein, 9 aa, Homo Sapiens
GLDCAGNTT

SEQ ID NO: 810847 - protein, 9 aa, Homo Sapiens
KGLLLRFPY

SEQ ID NO: 810848 - protein, 9 aa, Homo Sapiens
PQKTLVLIG

SEQ ID NO: 810849 - protein, 9 aa, Homo Sapiens
NNTIIDGSQ

SEQ ID NO: 810850 - protein, 9 aa, Homo Sapiens
RELAEAELV

SEQ ID NO: 810851 - protein, 9 aa, Homo Sapiens
LVTSIGDVI

SEQ ID NO: 810852 - protein, 9 aa, Homo Sapiens
QDSNNKVNQ

SEQ ID NO: 810853 - protein, 9 aa, Homo Sapiens
NMTLQWKSA

SEQ ID NO: 810854 - protein, 9 aa, Homo Sapiens
GVIKKSSSI

SEQ ID NO: 810855 - protein, 9 aa, Homo Sapiens
QDQVWNSYQ

SEQ ID NO: 810856 - protein, 9 aa, Homo Sapiens
LCQICQHPF

SEQ ID NO: 810857 - protein, 9 aa, Homo Sapiens
SKRLAILDN

SEQ ID NO: 810858 - protein, 9 aa, Homo Sapiens
FAKTEAPGG

SEQ ID NO: 810859 - protein, 9 aa, Homo Sapiens
WTKLPCTNF

SEQ ID NO: 810860 - protein, 9 aa, Homo Sapiens
SPRILNTHL

SEQ ID NO: 810861 - protein, 9 aa, Homo Sapiens
HCQERPSKY

SEQ ID NO: 810862 - protein, 9 aa, Homo Sapiens
TQNCRVTFE

SEQ ID NO: 810863 - protein, 9 aa, Homo Sapiens
SLGRAVSKP

SEQ ID NO: 810864 - protein, 9 aa, Homo Sapiens
SKPRYLRFT

SEQ ID NO: 810865 - protein, 9 aa, Homo Sapiens
KNKSSGSEY

SEQ ID NO: 810866 - protein, 9 aa, Homo Sapiens
GHPLKSDTF

SEQ ID NO: 810867 - protein, 9 aa, Homo Sapiens
QIQEPNREN

SEQ ID NO: 810868 - protein, 9 aa, Homo Sapiens
HKHRKYSHH

SEQ ID NO: 810869 - protein, 9 aa, Homo Sapiens
EILTSLVAA

SEQ ID NO: 810870 - protein, 9 aa, Homo Sapiens
HVDQDLMTY

SEQ ID NO: 810871 - protein, 9 aa, Homo Sapiens
TATMRYEPA

SEQ ID NO: 810872 - protein, 9 aa, Homo Sapiens
NDTSDVLLC

SEQ ID NO: 810873 - protein, 9 aa, Homo Sapiens
IGELKKMKK

SEQ ID NO: 810874 - protein, 9 aa, Homo Sapiens
LEEMELIIE

SEQ ID NO: 810875 - protein, 9 aa, Homo Sapiens
EVIQREGKS

SEQ ID NO: 810876 - protein, 9 aa, Homo Sapiens
NEGGESECS

SEQ ID NO: 810877 - protein, 9 aa, Homo Sapiens
KKICEQEKK

SEQ ID NO: 810878 - protein, 9 aa, Homo Sapiens
KDAETGAFT

SEQ ID NO: 810879 - protein, 9 aa, Homo Sapiens
GVDANDNPP

SEQ ID NO: 810880 - protein, 9 aa, Homo Sapiens
HYWVFQIIM

SEQ ID NO: 810881 - protein, 9 aa, Homo Sapiens
SFPQPLPWD

SEQ ID NO: 810882 - protein, 9 aa, Homo Sapiens
CPERQSGHQ

SEQ ID NO: 810883 - protein, 9 aa, Homo Sapiens
GLPSSGHRS

SEQ ID NO: 810884 - protein, 9 aa, Homo Sapiens
KLQEAANDI

SEQ ID NO: 810885 - protein, 9 aa, Homo Sapiens
IKLFFSGSA

SEQ ID NO: 810886 - protein, 9 aa, Homo Sapiens
HHEEVNSDI

SEQ ID NO: 810887 - protein, 9 aa, Homo Sapiens
IKGTSQKEV

SEQ ID NO: 810888 - protein, 9 aa, Homo Sapiens
LLNERKVFV

SEQ ID NO: 810889 - protein, 9 aa, Homo Sapiens
FYYIGPGYR

SEQ ID NO: 810890 - protein, 9 aa, Homo Sapiens
VCLSPLLFL

SEQ ID NO: 810891 - protein, 9 aa, Homo Sapiens
QSFSQSSTL

SEQ ID NO: 810892 - protein, 9 aa, Homo Sapiens
EIFAFKDLQ

SEQ ID NO: 810893 - protein, 9 aa, Homo Sapiens
KRSIQDIKA

SEQ ID NO: 810894 - protein, 9 aa, Homo Sapiens
DYNDEICQE

SEQ ID NO: 810895 - protein, 9 aa, Homo Sapiens
SYVLSAGFM

SEQ ID NO: 810896 - protein, 9 aa, Homo Sapiens
FNNEKFADQ

SEQ ID NO: 810897 - protein, 9 aa, Homo Sapiens
NFIEDQGGL

SEQ ID NO: 810898 - protein, 9 aa, Homo Sapiens
LVPLAVYSK

SEQ ID NO: 810899 - protein, 9 aa, Homo Sapiens
IKTKANLNA

SEQ ID NO: 810900 - protein, 9 aa, Homo Sapiens
AYYVARELD

SEQ ID NO: 810901 - protein, 9 aa, Homo Sapiens
EQDKDEEMD

SEQ ID NO: 810902 - protein, 9 aa, Homo Sapiens
SIIRVLTSR

SEQ ID NO: 810903 - protein, 9 aa, Homo Sapiens
LSSFSDADI

SEQ ID NO: 810904 - protein, 9 aa, Homo Sapiens
DLSKSGCSR

SEQ ID NO: 810905 - protein, 9 aa, Homo Sapiens
FCYKMDTVL

SEQ ID NO: 810906 - protein, 9 aa, Homo Sapiens
IDENTVNMS

SEQ ID NO: 810907 - protein, 9 aa, Homo Sapiens
VIIAGYGVE

SEQ ID NO: 810908 - protein, 9 aa, Homo Sapiens
VVFFFVFSI

SEQ ID NO: 810909 - protein, 9 aa, Homo Sapiens
KAFGQSSGF

SEQ ID NO: 810910 - protein, 9 aa, Homo Sapiens
LLDPRFKNS

SEQ ID NO: 810911 - protein, 9 aa, Homo Sapiens
YLTDPSQES

SEQ ID NO: 810912 - protein, 9 aa, Homo Sapiens
KDEDEEEDQ

SEQ ID NO: 810913 - protein, 9 aa, Homo Sapiens
LQYHFESKH

SEQ ID NO: 810914 - protein, 9 aa, Homo Sapiens
SSNAYHMSY

SEQ ID NO: 810915 - protein, 9 aa, Homo Sapiens
EGLPINDLS

SEQ ID NO: 810916 - protein, 9 aa, Homo Sapiens
YHGSITHGT

SEQ ID NO: 810917 - protein, 9 aa, Homo Sapiens
YTKSYHLKA

SEQ ID NO: 810918 - protein, 9 aa, Homo Sapiens
INDDYSFTT

SEQ ID NO: 810919 - protein, 9 aa, Homo Sapiens
KMMGIPIQK

SEQ ID NO: 810920 - protein, 9 aa, Homo Sapiens
MEENAYQMC

SEQ ID NO: 810921 - protein, 9 aa, Homo Sapiens
NNLPGSFRC

SEQ ID NO: 810922 - protein, 9 aa, Homo Sapiens
GGGEKGSHM

SEQ ID NO: 810923 - protein, 9 aa, Homo Sapiens
HFYLKQSVS

SEQ ID NO: 810924 - protein, 9 aa, Homo Sapiens
CQNFHPDSE

SEQ ID NO: 810925 - protein, 9 aa, Homo Sapiens
PEPSNLQSA

SEQ ID NO: 810926 - protein, 9 aa, Homo Sapiens
GTGFSGDGR

SEQ ID NO: 810927 - protein, 9 aa, Homo Sapiens
QTDSKIITG

SEQ ID NO: 810928 - protein, 9 aa, Homo Sapiens
RAQGPSRKR

SEQ ID NO: 810929 - protein, 9 aa, Homo Sapiens
EMIQTGIYP

SEQ ID NO: 810930 - protein, 9 aa, Homo Sapiens
SINDYAKFT

SEQ ID NO: 810931 - protein, 9 aa, Homo Sapiens
EELKGKNQL

SEQ ID NO: 810932 - protein, 9 aa, Homo Sapiens
YGTLEAGYT

SEQ ID NO: 810933 - protein, 9 aa, Homo Sapiens
SEAKENLIM

SEQ ID NO: 810934 - protein, 9 aa, Homo Sapiens
KPLKNYRQV

SEQ ID NO: 810935 - protein, 9 aa, Homo Sapiens
MSAKSEVSL

SEQ ID NO: 810936 - protein, 9 aa, Homo Sapiens
CQIEQPVTQ

SEQ ID NO: 810937 - protein, 9 aa, Homo Sapiens
AHGPPLQAQ

SEQ ID NO: 810938 - protein, 9 aa, Homo Sapiens
GHIIPQSLD

SEQ ID NO: 810939 - protein, 9 aa, Homo Sapiens
WLRRDISER

SEQ ID NO: 810940 - protein, 9 aa, Homo Sapiens
RSCYICYRQ

SEQ ID NO: 810941 - protein, 9 aa, Homo Sapiens
DPQDMDNNL

SEQ ID NO: 810942 - protein, 9 aa, Homo Sapiens
KEKQIKEEI

SEQ ID NO: 810943 - protein, 9 aa, Homo Sapiens
RNKYVIYIE

SEQ ID NO: 810944 - protein, 9 aa, Homo Sapiens
TVETYCSEN

SEQ ID NO: 810945 - protein, 9 aa, Homo Sapiens
LVHRDIKPS

SEQ ID NO: 810946 - protein, 9 aa, Homo Sapiens
AAHSAPPFP

SEQ ID NO: 810947 - protein, 9 aa, Homo Sapiens
VTIMGNILI

SEQ ID NO: 810948 - protein, 9 aa, Homo Sapiens
RLKSQTIQN

SEQ ID NO: 810949 - protein, 9 aa, Homo Sapiens
YCKEAHPKY

SEQ ID NO: 810950 - protein, 9 aa, Homo Sapiens
ASEEAHPSN

SEQ ID NO: 810951 - protein, 9 aa, Homo Sapiens
SSPQAIIMF

SEQ ID NO: 810952 - protein, 9 aa, Homo Sapiens
KIKALLEIT

SEQ ID NO: 810953 - protein, 9 aa, Homo Sapiens
LVLEILTRG

SEQ ID NO: 810954 - protein, 9 aa, Homo Sapiens
CYHKLDYLT

SEQ ID NO: 810955 - protein, 9 aa, Homo Sapiens
RHEHQLMLI

SEQ ID NO: 810956 - protein, 9 aa, Homo Sapiens
LTLGMSLWN

SEQ ID NO: 810957 - protein, 9 aa, Homo Sapiens
DANRRDVCS

SEQ ID NO: 810958 - protein, 9 aa, Homo Sapiens
NKSHECKEC

SEQ ID NO: 810959 - protein, 9 aa, Homo Sapiens
SWKINHSRA

SEQ ID NO: 810960 - protein, 9 aa, Homo Sapiens
KKEENNLVT

SEQ ID NO: 810961 - protein, 9 aa, Homo Sapiens
SQFQSNRMD

SEQ ID NO: 810962 - protein, 9 aa, Homo Sapiens
MGLSLFFSL

SEQ ID NO: 810963 - protein, 9 aa, Homo Sapiens
YRRFTEIYK

SEQ ID NO: 810964 - protein, 9 aa, Homo Sapiens
AGLSATQRS

SEQ ID NO: 810965 - protein, 9 aa, Homo Sapiens
PPRWEEGKA

SEQ ID NO: 810966 - protein, 9 aa, Homo Sapiens
ASNGVVDAI

SEQ ID NO: 810967 - protein, 9 aa, Homo Sapiens
PHGSSETSS

SEQ ID NO: 810968 - protein, 9 aa, Homo Sapiens
NELFARFDQ

SEQ ID NO: 810969 - protein, 9 aa, Homo Sapiens
STLLSDIGR

SEQ ID NO: 810970 - protein, 9 aa, Homo Sapiens
EEKYPPKSH

SEQ ID NO: 810971 - protein, 9 aa, Homo Sapiens
MYTGYTTRN

SEQ ID NO: 810972 - protein, 9 aa, Homo Sapiens
MMFQDAVAF

SEQ ID NO: 810973 - protein, 9 aa, Homo Sapiens
ETTEFQLLA

SEQ ID NO: 810974 - protein, 9 aa, Homo Sapiens
HPHLSTKKP

SEQ ID NO: 810975 - protein, 9 aa, Homo Sapiens
EQHARKKLR

SEQ ID NO: 810976 - protein, 9 aa, Homo Sapiens
ASPEVLSFS

SEQ ID NO: 810977 - protein, 9 aa, Homo Sapiens
HPDTGNIIM

SEQ ID NO: 810978 - protein, 9 aa, Homo Sapiens
NIFVTSYIK

SEQ ID NO: 810979 - protein, 9 aa, Homo Sapiens
YVLNTATKM

SEQ ID NO: 810980 - protein, 9 aa, Homo Sapiens
TLRYIIPIG

SEQ ID NO: 810981 - protein, 9 aa, Homo Sapiens
YLRHYSWAA

SEQ ID NO: 810982 - protein, 9 aa, Homo Sapiens
FRSNFEIHW

SEQ ID NO: 810983 - protein, 9 aa, Homo Sapiens
MNPLLYSIT

SEQ ID NO: 810984 - protein, 9 aa, Homo Sapiens
KELSCTVVE

SEQ ID NO: 810985 - protein, 9 aa, Homo Sapiens
KAFKRCVLL

SEQ ID NO: 810986 - protein, 9 aa, Homo Sapiens
QFEGERVTW

SEQ ID NO: 810987 - protein, 9 aa, Homo Sapiens
QHYPAFTRG

SEQ ID NO: 810988 - protein, 9 aa, Homo Sapiens
VWGRYGEYI

SEQ ID NO: 810989 - protein, 9 aa, Homo Sapiens
MKDMLYAVM

SEQ ID NO: 810990 - protein, 9 aa, Homo Sapiens
KTNYVDNLK

SEQ ID NO: 810991 - protein, 9 aa, Homo Sapiens
GLMFYVVHQ

SEQ ID NO: 810992 - protein, 9 aa, Homo Sapiens
RSKDHNKRL

SEQ ID NO: 810993 - protein, 9 aa, Homo Sapiens
LGYLGCYCQ

SEQ ID NO: 810994 - protein, 9 aa, Homo Sapiens
KSKGDQRRA

SEQ ID NO: 810995 - protein, 9 aa, Homo Sapiens
PELAHCPSP

SEQ ID NO: 810996 - protein, 9 aa, Homo Sapiens
DLFSTNPPK

SEQ ID NO: 810997 - protein, 9 aa, Homo Sapiens
AELDDESVC

SEQ ID NO: 810998 - protein, 9 aa, Homo Sapiens
KAEESANEM

SEQ ID NO: 810999 - protein, 9 aa, Homo Sapiens
FQGTVNTKN

SEQ ID NO: 811000 - protein, 9 aa, Homo Sapiens
CTSLSKLCS

SEQ ID NO: 811001 - protein, 9 aa, Homo Sapiens
HPGGKHKVR

SEQ ID NO: 811002 - protein, 9 aa, Homo Sapiens
PYFDVGASC

SEQ ID NO: 811003 - protein, 9 aa, Homo Sapiens
TAPSDKGAT

SEQ ID NO: 811004 - protein, 9 aa, Homo Sapiens
PPPSSLSLT

SEQ ID NO: 811005 - protein, 9 aa, Homo Sapiens
ESDNEDGGE

SEQ ID NO: 811006 - protein, 9 aa, Homo Sapiens
GIIHEKKEG

SEQ ID NO: 811007 - protein, 9 aa, Homo Sapiens
TEAPEFPCP

SEQ ID NO: 811008 - protein, 9 aa, Homo Sapiens
KEFVKEKEK

SEQ ID NO: 811009 - protein, 9 aa, Homo Sapiens
SPAAARRSK

SEQ ID NO: 811010 - protein, 9 aa, Homo Sapiens
KSEEELKGK

SEQ ID NO: 811011 - protein, 9 aa, Homo Sapiens
YHRHYRGEK

SEQ ID NO: 811012 - protein, 9 aa, Homo Sapiens
YERPNVETT

SEQ ID NO: 811013 - protein, 9 aa, Homo Sapiens
GISSQISWP

SEQ ID NO: 811014 - protein, 9 aa, Homo Sapiens
RKAAYWKAL

SEQ ID NO: 811015 - protein, 9 aa, Homo Sapiens
DGVNGEVTY

SEQ ID NO: 811016 - protein, 9 aa, Homo Sapiens
IPSPQTSSL

SEQ ID NO: 811017 - protein, 9 aa, Homo Sapiens
MPEYTVTST

SEQ ID NO: 811018 - protein, 9 aa, Homo Sapiens
SVGDITKED

SEQ ID NO: 811019 - protein, 9 aa, Homo Sapiens
SMRKLITDL

SEQ ID NO: 811020 - protein, 9 aa, Homo Sapiens
KYTTCETAR

SEQ ID NO: 811021 - protein, 9 aa, Homo Sapiens
EIKAAKTLG

SEQ ID NO: 811022 - protein, 9 aa, Homo Sapiens
LKRVCAQLN

SEQ ID NO: 811023 - protein, 9 aa, Homo Sapiens
LIIGNSSVD

SEQ ID NO: 811024 - protein, 9 aa, Homo Sapiens
SKAQCEQSH

SEQ ID NO: 811025 - protein, 9 aa, Homo Sapiens
LAPGSWVCG

SEQ ID NO: 811026 - protein, 9 aa, Homo Sapiens
YLIGKYITN

SEQ ID NO: 811027 - protein, 9 aa, Homo Sapiens
AANDIESPD

SEQ ID NO: 811028 - protein, 9 aa, Homo Sapiens
NDNCSLEKF

SEQ ID NO: 811029 - protein, 9 aa, Homo Sapiens
GFWKYVATR

SEQ ID NO: 811030 - protein, 9 aa, Homo Sapiens
NSETIKNYM

SEQ ID NO: 811031 - protein, 9 aa, Homo Sapiens
ECSIQLPKA

SEQ ID NO: 811032 - protein, 9 aa, Homo Sapiens
IFWYDIRSI

SEQ ID NO: 811033 - protein, 9 aa, Homo Sapiens
GNENGELYL

SEQ ID NO: 811034 - protein, 9 aa, Homo Sapiens
VFRNGLSGI

SEQ ID NO: 811035 - protein, 9 aa, Homo Sapiens
ARKMHADMD

SEQ ID NO: 811036 - protein, 9 aa, Homo Sapiens
NAWLSYCLL

SEQ ID NO: 811037 - protein, 9 aa, Homo Sapiens
ADKKRQSKI

SEQ ID NO: 811038 - protein, 9 aa, Homo Sapiens
HQIVISSAE

SEQ ID NO: 811039 - protein, 9 aa, Homo Sapiens
CGKAVIHLH

SEQ ID NO: 811040 - protein, 9 aa, Homo Sapiens
ARRHHQFIE

SEQ ID NO: 811041 - protein, 9 aa, Homo Sapiens
VNRGEHNNG

SEQ ID NO: 811042 - protein, 9 aa, Homo Sapiens
VVAILVVCL

SEQ ID NO: 811043 - protein, 9 aa, Homo Sapiens
RRWLTLKEQ

SEQ ID NO: 811044 - protein, 9 aa, Homo Sapiens
IFAMCLVRG

SEQ ID NO: 811045 - protein, 9 aa, Homo Sapiens
QKSRLLFFS

SEQ ID NO: 811046 - protein, 9 aa, Homo Sapiens
EGLGGESAG

SEQ ID NO: 811047 - protein, 9 aa, Homo Sapiens
EWGENLKDD

SEQ ID NO: 811048 - protein, 9 aa, Homo Sapiens
APYRLESQE

SEQ ID NO: 811049 - protein, 9 aa, Homo Sapiens
FHLDSLPSK

SEQ ID NO: 811050 - protein, 9 aa, Homo Sapiens
YVRQTALKV

SEQ ID NO: 811051 - protein, 9 aa, Homo Sapiens
GLGMCCYVL

SEQ ID NO: 811052 - protein, 9 aa, Homo Sapiens
ELHDEFGYN

SEQ ID NO: 811053 - protein, 9 aa, Homo Sapiens
GKDSKPRYL

SEQ ID NO: 811054 - protein, 9 aa, Homo Sapiens
LEFKPDSED

SEQ ID NO: 811055 - protein, 9 aa, Homo Sapiens
LKEHQKDLK

SEQ ID NO: 811056 - protein, 9 aa, Homo Sapiens
EEEEKVVQP

SEQ ID NO: 811057 - protein, 9 aa, Homo Sapiens
KPTIATWMK

SEQ ID NO: 811058 - protein, 9 aa, Homo Sapiens
STDTNKASI

SEQ ID NO: 811059 - protein, 9 aa, Homo Sapiens
EARALCLGV

SEQ ID NO: 811060 - protein, 9 aa, Homo Sapiens
IRDSLISLE

SEQ ID NO: 811061 - protein, 9 aa, Homo Sapiens
SIRSYCEKL

SEQ ID NO: 811062 - protein, 9 aa, Homo Sapiens
TAQETLAAA

SEQ ID NO: 811063 - protein, 9 aa, Homo Sapiens
NYWAKRRTS

SEQ ID NO: 811064 - protein, 9 aa, Homo Sapiens
VSKIICRYQ

SEQ ID NO: 811065 - protein, 9 aa, Homo Sapiens
AQVFVDDVT

SEQ ID NO: 811066 - protein, 9 aa, Homo Sapiens
GRCIPMQVP

SEQ ID NO: 811067 - protein, 9 aa, Homo Sapiens
PNAKECTNK

SEQ ID NO: 811068 - protein, 9 aa, Homo Sapiens
KATVRNYSE

SEQ ID NO: 811069 - protein, 9 aa, Homo Sapiens
YFYVHTVMT

SEQ ID NO: 811070 - protein, 9 aa, Homo Sapiens
LRHDCEEAS

SEQ ID NO: 811071 - protein, 9 aa, Homo Sapiens
VCTDTIKLI

SEQ ID NO: 811072 - protein, 9 aa, Homo Sapiens
RKHTLEMEK

SEQ ID NO: 811073 - protein, 9 aa, Homo Sapiens
VIGLCKEAF

SEQ ID NO: 811074 - protein, 9 aa, Homo Sapiens
LMQILTERG

SEQ ID NO: 811075 - protein, 9 aa, Homo Sapiens
RHFHYSRKI

SEQ ID NO: 811076 - protein, 9 aa, Homo Sapiens
SLNVGEHKE

SEQ ID NO: 811077 - protein, 9 aa, Homo Sapiens
KQDLLKEHQ

SEQ ID NO: 811078 - protein, 9 aa, Homo Sapiens
KLYSSQWHV

SEQ ID NO: 811079 - protein, 9 aa, Homo Sapiens
YHLKITSNM

SEQ ID NO: 811080 - protein, 9 aa, Homo Sapiens
RRRIHQCDV

SEQ ID NO: 811081 - protein, 9 aa, Homo Sapiens
DVVHCWYTA

SEQ ID NO: 811082 - protein, 9 aa, Homo Sapiens
SIGGGSVWG

SEQ ID NO: 811083 - protein, 9 aa, Homo Sapiens
KGNPGFIGS

SEQ ID NO: 811084 - protein, 9 aa, Homo Sapiens
RIRLAEDDD

SEQ ID NO: 811085 - protein, 9 aa, Homo Sapiens
WTTALLLIL

SEQ ID NO: 811086 - protein, 9 aa, Homo Sapiens
GLPQDLTFN

SEQ ID NO: 811087 - protein, 9 aa, Homo Sapiens
QAEKRQGDR

SEQ ID NO: 811088 - protein, 9 aa, Homo Sapiens
KPLSAMGRK

SEQ ID NO: 811089 - protein, 9 aa, Homo Sapiens
PHKSERHAH

SEQ ID NO: 811090 - protein, 9 aa, Homo Sapiens
YTNSFLNLN

SEQ ID NO: 811091 - protein, 9 aa, Homo Sapiens
LLTSFSVLG

SEQ ID NO: 811092 - protein, 9 aa, Homo Sapiens
EYFIKQMLL

SEQ ID NO: 811093 - protein, 9 aa, Homo Sapiens
LLDGGHGGC

SEQ ID NO: 811094 - protein, 9 aa, Homo Sapiens
SYQAIGEDN

SEQ ID NO: 811095 - protein, 9 aa, Homo Sapiens
DEPPVLTKV

SEQ ID NO: 811096 - protein, 9 aa, Homo Sapiens
KNIITVLRN

SEQ ID NO: 811097 - protein, 9 aa, Homo Sapiens
ESTKVGVQG

SEQ ID NO: 811098 - protein, 9 aa, Homo Sapiens
LKFRDAETD

SEQ ID NO: 811099 - protein, 9 aa, Homo Sapiens
NISEALKKC

SEQ ID NO: 811100 - protein, 9 aa, Homo Sapiens
QEAAKRTIT

SEQ ID NO: 811101 - protein, 9 aa, Homo Sapiens
MNAEAATNI

SEQ ID NO: 811102 - protein, 9 aa, Homo Sapiens
MDNILGLNL

SEQ ID NO: 811103 - protein, 9 aa, Homo Sapiens
VQCLQSASD

SEQ ID NO: 811104 - protein, 9 aa, Homo Sapiens
YLTVDRNCL

SEQ ID NO: 811105 - protein, 9 aa, Homo Sapiens
GKAPQCLQY

SEQ ID NO: 811106 - protein, 9 aa, Homo Sapiens
YLGCYCQDP

SEQ ID NO: 811107 - protein, 9 aa, Homo Sapiens
ALRKKELFN

SEQ ID NO: 811108 - protein, 9 aa, Homo Sapiens
GKEADKLLT

SEQ ID NO: 811109 - protein, 9 aa, Homo Sapiens
FVTDFLDNG

SEQ ID NO: 811110 - protein, 9 aa, Homo Sapiens
GWFCVEDNG

SEQ ID NO: 811111 - protein, 9 aa, Homo Sapiens
EKLAKYLDF

SEQ ID NO: 811112 - protein, 9 aa, Homo Sapiens
IDKSTQATE

SEQ ID NO: 811113 - protein, 9 aa, Homo Sapiens
QLVKEDEVV

SEQ ID NO: 811114 - protein, 9 aa, Homo Sapiens
YTGQVLAAH

SEQ ID NO: 811115 - protein, 9 aa, Homo Sapiens
SQLFATYCL

SEQ ID NO: 811116 - protein, 9 aa, Homo Sapiens
QGNIGSYAT

SEQ ID NO: 811117 - protein, 9 aa, Homo Sapiens
QCNGRSFHN

SEQ ID NO: 811118 - protein, 9 aa, Homo Sapiens
VFKAKNKVD

SEQ ID NO: 811119 - protein, 9 aa, Homo Sapiens
PREGGSGKG

SEQ ID NO: 811120 - protein, 9 aa, Homo Sapiens
NLLRAALLG

SEQ ID NO: 811121 - protein, 9 aa, Homo Sapiens
HPAQDDRVL

SEQ ID NO: 811122 - protein, 9 aa, Homo Sapiens
YGSNRLYDN

SEQ ID NO: 811123 - protein, 9 aa, Homo Sapiens
RSRSADGAN

SEQ ID NO: 811124 - protein, 9 aa, Homo Sapiens
LAAAVQGTA

SEQ ID NO: 811125 - protein, 9 aa, Homo Sapiens
SSDPKSKLF

SEQ ID NO: 811126 - protein, 9 aa, Homo Sapiens
NLPYRYQNE

SEQ ID NO: 811127 - protein, 9 aa, Homo Sapiens
TISMPSDSH

SEQ ID NO: 811128 - protein, 9 aa, Homo Sapiens
KVNLRNNYF

SEQ ID NO: 811129 - protein, 9 aa, Homo Sapiens
PRLQQLPKY

SEQ ID NO: 811130 - protein, 9 aa, Homo Sapiens
RNEKPVSLT

SEQ ID NO: 811131 - protein, 9 aa, Homo Sapiens
ILSIKSLPD

SEQ ID NO: 811132 - protein, 9 aa, Homo Sapiens
FLASLDGDK

SEQ ID NO: 811133 - protein, 9 aa, Homo Sapiens
HPTDPVAYI

SEQ ID NO: 811134 - protein, 9 aa, Homo Sapiens
KAIASHRAL

SEQ ID NO: 811135 - protein, 9 aa, Homo Sapiens
AVFSSLQRK

SEQ ID NO: 811136 - protein, 9 aa, Homo Sapiens
VPAEQKDEN

SEQ ID NO: 811137 - protein, 9 aa, Homo Sapiens
RILLCTDNC

SEQ ID NO: 811138 - protein, 9 aa, Homo Sapiens
AILISYDDE

SEQ ID NO: 811139 - protein, 9 aa, Homo Sapiens
KLQLPIIQL

SEQ ID NO: 811140 - protein, 9 aa, Homo Sapiens
QLKFASQIN

SEQ ID NO: 811141 - protein, 9 aa, Homo Sapiens
TTTNNNYSP

SEQ ID NO: 811142 - protein, 9 aa, Homo Sapiens
LSLVLVLDL

SEQ ID NO: 811143 - protein, 9 aa, Homo Sapiens
YGNYSLFTS

SEQ ID NO: 811144 - protein, 9 aa, Homo Sapiens
LMIRAEDAG

SEQ ID NO: 811145 - protein, 9 aa, Homo Sapiens
LQKFCQMRK

SEQ ID NO: 811146 - protein, 9 aa, Homo Sapiens
RIPQIRIET

SEQ ID NO: 811147 - protein, 9 aa, Homo Sapiens
TETASQEVM

SEQ ID NO: 811148 - protein, 9 aa, Homo Sapiens
GVDIYSKFD

SEQ ID NO: 811149 - protein, 9 aa, Homo Sapiens
LVHQRTHNG

SEQ ID NO: 811150 - protein, 9 aa, Homo Sapiens
EQLDTFIDQ

SEQ ID NO: 811151 - protein, 9 aa, Homo Sapiens
GSYDADTGI

SEQ ID NO: 811152 - protein, 9 aa, Homo Sapiens
LLDALFNES

SEQ ID NO: 811153 - protein, 9 aa, Homo Sapiens
AAKLEKPSR

SEQ ID NO: 811154 - protein, 9 aa, Homo Sapiens
ISESYSCPS

SEQ ID NO: 811155 - protein, 9 aa, Homo Sapiens
SFSRKRPFP

SEQ ID NO: 811156 - protein, 9 aa, Homo Sapiens
PIGMLNNPI

SEQ ID NO: 811157 - protein, 9 aa, Homo Sapiens
TSKLIYNFI

SEQ ID NO: 811158 - protein, 9 aa, Homo Sapiens
PHVPPRMSF

SEQ ID NO: 811159 - protein, 9 aa, Homo Sapiens
TMYGLEYLV

SEQ ID NO: 811160 - protein, 9 aa, Homo Sapiens
TSSTKHLKS

SEQ ID NO: 811161 - protein, 9 aa, Homo Sapiens
ISMKIKDND

SEQ ID NO: 811162 - protein, 9 aa, Homo Sapiens
HFDKKKEIN

SEQ ID NO: 811163 - protein, 9 aa, Homo Sapiens
EPAENSVDT

SEQ ID NO: 811164 - protein, 9 aa, Homo Sapiens
CINYYKLSS

SEQ ID NO: 811165 - protein, 9 aa, Homo Sapiens
DYLAALSSV

SEQ ID NO: 811166 - protein, 9 aa, Homo Sapiens
IANFPSGNV

SEQ ID NO: 811167 - protein, 9 aa, Homo Sapiens
LARRICGER

SEQ ID NO: 811168 - protein, 9 aa, Homo Sapiens
SDAESLESS

SEQ ID NO: 811169 - protein, 9 aa, Homo Sapiens
VRGTTHVLV

SEQ ID NO: 811170 - protein, 9 aa, Homo Sapiens
PPDNVQLVN

SEQ ID NO: 811171 - protein, 9 aa, Homo Sapiens
SWLLSPGTL

SEQ ID NO: 811172 - protein, 9 aa, Homo Sapiens
ADTSKVKLR

SEQ ID NO: 811173 - protein, 9 aa, Homo Sapiens
YGFFILFRG

SEQ ID NO: 811174 - protein, 9 aa, Homo Sapiens
FFNIFTLQC

SEQ ID NO: 811175 - protein, 9 aa, Homo Sapiens
AVKHSRPRR

SEQ ID NO: 811176 - protein, 9 aa, Homo Sapiens
SLWNCDVQG

SEQ ID NO: 811177 - protein, 9 aa, Homo Sapiens
VPIFKDNNT

SEQ ID NO: 811178 - protein, 9 aa, Homo Sapiens
ESWKNGILP

SEQ ID NO: 811179 - protein, 9 aa, Homo Sapiens
AVIEGHDFV

SEQ ID NO: 811180 - protein, 9 aa, Homo Sapiens
EERKKTMEM

SEQ ID NO: 811181 - protein, 9 aa, Homo Sapiens
HPYTNKVIT

SEQ ID NO: 811182 - protein, 9 aa, Homo Sapiens
KFAKRNVKL

SEQ ID NO: 811183 - protein, 9 aa, Homo Sapiens
DSSVAQIYH

SEQ ID NO: 811184 - protein, 9 aa, Homo Sapiens
VNNTKPGQP

SEQ ID NO: 811185 - protein, 9 aa, Homo Sapiens
LQTEICYQN

SEQ ID NO: 811186 - protein, 9 aa, Homo Sapiens
DSMYRKYDL

SEQ ID NO: 811187 - protein, 9 aa, Homo Sapiens
ATIAESEDS

SEQ ID NO: 811188 - protein, 9 aa, Homo Sapiens
INDEELETR

SEQ ID NO: 811189 - protein, 9 aa, Homo Sapiens
KFPSKHLSW

SEQ ID NO: 811190 - protein, 9 aa, Homo Sapiens
TGAVDSVVR

SEQ ID NO: 811191 - protein, 9 aa, Homo Sapiens
NAIKINIFW

SEQ ID NO: 811192 - protein, 9 aa, Homo Sapiens
VDEKISTMG

SEQ ID NO: 811193 - protein, 9 aa, Homo Sapiens
TSSRLDHGT

SEQ ID NO: 811194 - protein, 9 aa, Homo Sapiens
VSIYGDTFP

SEQ ID NO: 811195 - protein, 9 aa, Homo Sapiens
DPAAMVSSD

SEQ ID NO: 811196 - protein, 9 aa, Homo Sapiens
REDQVFPIN

SEQ ID NO: 811197 - protein, 9 aa, Homo Sapiens
SSVTVGTAE

SEQ ID NO: 811198 - protein, 9 aa, Homo Sapiens
YISKRPKSN

SEQ ID NO: 811199 - protein, 9 aa, Homo Sapiens
QLVLSVPLN

SEQ ID NO: 811200 - protein, 9 aa, Homo Sapiens
KMHADMDGK

SEQ ID NO: 811201 - protein, 9 aa, Homo Sapiens
VTDHLIYPR

SEQ ID NO: 811202 - protein, 9 aa, Homo Sapiens
NWPAGGEPD

SEQ ID NO: 811203 - protein, 9 aa, Homo Sapiens
VAIELSQEE

SEQ ID NO: 811204 - protein, 9 aa, Homo Sapiens
YKTLFARCI

SEQ ID NO: 811205 - protein, 9 aa, Homo Sapiens
NERNVNMSR

SEQ ID NO: 811206 - protein, 9 aa, Homo Sapiens
VLRSADTMQ

SEQ ID NO: 811207 - protein, 9 aa, Homo Sapiens
KKLEKRRAR

SEQ ID NO: 811208 - protein, 9 aa, Homo Sapiens
DINLNKVKT

SEQ ID NO: 811209 - protein, 9 aa, Homo Sapiens
QTEDGITPG

SEQ ID NO: 811210 - protein, 9 aa, Homo Sapiens
SYHLKITSN

SEQ ID NO: 811211 - protein, 9 aa, Homo Sapiens
DQSLSADEE

SEQ ID NO: 811212 - protein, 9 aa, Homo Sapiens
YSPIRRVGP

SEQ ID NO: 811213 - protein, 9 aa, Homo Sapiens
GPAPVIPPA

SEQ ID NO: 811214 - protein, 9 aa, Homo Sapiens
KIIYTGEEP

SEQ ID NO: 811215 - protein, 9 aa, Homo Sapiens
RLAEEEKLW

SEQ ID NO: 811216 - protein, 9 aa, Homo Sapiens
DKVVKSRSN

SEQ ID NO: 811217 - protein, 9 aa, Homo Sapiens
QLSKNFKKI

SEQ ID NO: 811218 - protein, 9 aa, Homo Sapiens
VSHNFQTTK

SEQ ID NO: 811219 - protein, 9 aa, Homo Sapiens
SPLKVVKKP

SEQ ID NO: 811220 - protein, 9 aa, Homo Sapiens
LVASCFPAC

SEQ ID NO: 811221 - protein, 9 aa, Homo Sapiens
KPMEPPMNK

SEQ ID NO: 811222 - protein, 9 aa, Homo Sapiens
TQTLSNKPE

SEQ ID NO: 811223 - protein, 9 aa, Homo Sapiens
WQITIRWEP

SEQ ID NO: 811224 - protein, 9 aa, Homo Sapiens
IDTQEDMEV

SEQ ID NO: 811225 - protein, 9 aa, Homo Sapiens
LREQLATEN

SEQ ID NO: 811226 - protein, 9 aa, Homo Sapiens
TDNLTRDLV

SEQ ID NO: 811227 - protein, 9 aa, Homo Sapiens
AWPRYRVVD

SEQ ID NO: 811228 - protein, 9 aa, Homo Sapiens
MLQCGYYVV

SEQ ID NO: 811229 - protein, 9 aa, Homo Sapiens
GIWKQWHED

SEQ ID NO: 811230 - protein, 9 aa, Homo Sapiens
TQQIISLNK

SEQ ID NO: 811231 - protein, 9 aa, Homo Sapiens
PKYNGLLHC

SEQ ID NO: 811232 - protein, 9 aa, Homo Sapiens
LRLDLCCLA

SEQ ID NO: 811233 - protein, 9 aa, Homo Sapiens
RPGLQTPLL

SEQ ID NO: 811234 - protein, 9 aa, Homo Sapiens
EEEIILNDN

SEQ ID NO: 811235 - protein, 9 aa, Homo Sapiens
GNDQLQTHT

SEQ ID NO: 811236 - protein, 9 aa, Homo Sapiens
LWDIPNSKD

SEQ ID NO: 811237 - protein, 9 aa, Homo Sapiens
RDVQYFGET

SEQ ID NO: 811238 - protein, 9 aa, Homo Sapiens
GCSKLVDNS

SEQ ID NO: 811239 - protein, 9 aa, Homo Sapiens
SSDAPETTH

SEQ ID NO: 811240 - protein, 9 aa, Homo Sapiens
SAKLAFAVE

SEQ ID NO: 811241 - protein, 9 aa, Homo Sapiens
RIWSLESLH

SEQ ID NO: 811242 - protein, 9 aa, Homo Sapiens
YSLRNGSMK

SEQ ID NO: 811243 - protein, 9 aa, Homo Sapiens
SDNDSDYAI

SEQ ID NO: 811244 - protein, 9 aa, Homo Sapiens
SPCSARFVT

SEQ ID NO: 811245 - protein, 9 aa, Homo Sapiens
LSDLERLAL

SEQ ID NO: 811246 - protein, 9 aa, Homo Sapiens
ALSLPLGPI

SEQ ID NO: 811247 - protein, 9 aa, Homo Sapiens
SDLTVINAF

SEQ ID NO: 811248 - protein, 9 aa, Homo Sapiens
TVCKGSSTV

SEQ ID NO: 811249 - protein, 9 aa, Homo Sapiens
FHILERASY

SEQ ID NO: 811250 - protein, 9 aa, Homo Sapiens
VDLDMLTFT

SEQ ID NO: 811251 - protein, 9 aa, Homo Sapiens
AFSEDQRKA

SEQ ID NO: 811252 - protein, 9 aa, Homo Sapiens
YFVFWETSK

SEQ ID NO: 811253 - protein, 9 aa, Homo Sapiens
AYTLDEGLV

SEQ ID NO: 811254 - protein, 9 aa, Homo Sapiens
QESREGLKQ

SEQ ID NO: 811255 - protein, 9 aa, Homo Sapiens
MSEVLQLCS

SEQ ID NO: 811256 - protein, 9 aa, Homo Sapiens
YYIPLEDDI

SEQ ID NO: 811257 - protein, 9 aa, Homo Sapiens
SCTVIFSNQ

SEQ ID NO: 811258 - protein, 9 aa, Homo Sapiens
KLVHRDIKP

SEQ ID NO: 811259 - protein, 9 aa, Homo Sapiens
SGCSEQQEA

SEQ ID NO: 811260 - protein, 9 aa, Homo Sapiens
EIQTAVHLL

SEQ ID NO: 811261 - protein, 9 aa, Homo Sapiens
PDNFDKSMD

SEQ ID NO: 811262 - protein, 9 aa, Homo Sapiens
VVVDHKGNV

SEQ ID NO: 811263 - protein, 9 aa, Homo Sapiens
AILVAPCLL

SEQ ID NO: 811264 - protein, 9 aa, Homo Sapiens
QECLIATFQ

SEQ ID NO: 811265 - protein, 9 aa, Homo Sapiens
VSIHLNKSL

SEQ ID NO: 811266 - protein, 9 aa, Homo Sapiens
DAMFSEYIS

SEQ ID NO: 811267 - protein, 9 aa, Homo Sapiens
EKISTMGKA

SEQ ID NO: 811268 - protein, 9 aa, Homo Sapiens
TIKNYMMEE

SEQ ID NO: 811269 - protein, 9 aa, Homo Sapiens
GNAPVETEL

SEQ ID NO: 811270 - protein, 9 aa, Homo Sapiens
DKLQKRPLM

SEQ ID NO: 811271 - protein, 9 aa, Homo Sapiens
CKKEINNSK

SEQ ID NO: 811272 - protein, 9 aa, Homo Sapiens
NTTVLYRLQ

SEQ ID NO: 811273 - protein, 9 aa, Homo Sapiens
AVYYAHYYQ

SEQ ID NO: 811274 - protein, 9 aa, Homo Sapiens
PLIAEKPLG

SEQ ID NO: 811275 - protein, 9 aa, Homo Sapiens
MKSQWMLSQ

SEQ ID NO: 811276 - protein, 9 aa, Homo Sapiens
VRALLPDEQ

SEQ ID NO: 811277 - protein, 9 aa, Homo Sapiens
PGPSVVDLV

SEQ ID NO: 811278 - protein, 9 aa, Homo Sapiens
GIGGLLVSL

SEQ ID NO: 811279 - protein, 9 aa, Homo Sapiens
KQLLANFSC

SEQ ID NO: 811280 - protein, 9 aa, Homo Sapiens
YYVGSNYRP

SEQ ID NO: 811281 - protein, 9 aa, Homo Sapiens
YSDIGNMPA

SEQ ID NO: 811282 - protein, 9 aa, Homo Sapiens
VCEGSIKHF

SEQ ID NO: 811283 - protein, 9 aa, Homo Sapiens
IFRDVLNRC

SEQ ID NO: 811284 - protein, 9 aa, Homo Sapiens
LHSKKQAKL

SEQ ID NO: 811285 - protein, 9 aa, Homo Sapiens
PQGSAGNPG

SEQ ID NO: 811286 - protein, 9 aa, Homo Sapiens
MGGNTTENI

SEQ ID NO: 811287 - protein, 9 aa, Homo Sapiens
VNNVLCNGI

SEQ ID NO: 811288 - protein, 9 aa, Homo Sapiens
LPLEEHSRF

SEQ ID NO: 811289 - protein, 9 aa, Homo Sapiens
RNKKCIAVN

SEQ ID NO: 811290 - protein, 9 aa, Homo Sapiens
KSKPKKPFF

SEQ ID NO: 811291 - protein, 9 aa, Homo Sapiens
LLMVMSSKK

SEQ ID NO: 811292 - protein, 9 aa, Homo Sapiens
VNFPTSIPV

SEQ ID NO: 811293 - protein, 9 aa, Homo Sapiens
ILYKFLVGC

SEQ ID NO: 811294 - protein, 9 aa, Homo Sapiens
TADLQAALE

SEQ ID NO: 811295 - protein, 9 aa, Homo Sapiens
MLPAFIETY

SEQ ID NO: 811296 - protein, 9 aa, Homo Sapiens
TSPIYHQGQ

SEQ ID NO: 811297 - protein, 9 aa, Homo Sapiens
TTYSPKMED

SEQ ID NO: 811298 - protein, 9 aa, Homo Sapiens
NLGGLSILV

SEQ ID NO: 811299 - protein, 9 aa, Homo Sapiens
KVNLAARMT

SEQ ID NO: 811300 - protein, 9 aa, Homo Sapiens
LRLHEITHL

SEQ ID NO: 811301 - protein, 9 aa, Homo Sapiens
ILLPDNLSN

SEQ ID NO: 811302 - protein, 9 aa, Homo Sapiens
HCNSCPSLC

SEQ ID NO: 811303 - protein, 9 aa, Homo Sapiens
PEEQLMSCG

SEQ ID NO: 811304 - protein, 9 aa, Homo Sapiens
MNLHNNIAG

SEQ ID NO: 811305 - protein, 9 aa, Homo Sapiens
CDFHKNVIQ

SEQ ID NO: 811306 - protein, 9 aa, Homo Sapiens
CTLSFHLNH

SEQ ID NO: 811307 - protein, 9 aa, Homo Sapiens
ANSSSAWSA

SEQ ID NO: 811308 - protein, 9 aa, Homo Sapiens
LDILVNWLH

SEQ ID NO: 811309 - protein, 9 aa, Homo Sapiens
EIESIILIF

SEQ ID NO: 811310 - protein, 9 aa, Homo Sapiens
VPEPSEYPT

SEQ ID NO: 811311 - protein, 9 aa, Homo Sapiens
AAAPVTEGR

SEQ ID NO: 811312 - protein, 9 aa, Homo Sapiens
GEPICVVWG

SEQ ID NO: 811313 - protein, 9 aa, Homo Sapiens
TVEITFTTK

SEQ ID NO: 811314 - protein, 9 aa, Homo Sapiens
FQSFLGCDE

SEQ ID NO: 811315 - protein, 9 aa, Homo Sapiens
QDNKLLKQH

SEQ ID NO: 811316 - protein, 9 aa, Homo Sapiens
LMNNASSGL

SEQ ID NO: 811317 - protein, 9 aa, Homo Sapiens
DTAETNVSC

SEQ ID NO: 811318 - protein, 9 aa, Homo Sapiens
ILFLNKTNI

SEQ ID NO: 811319 - protein, 9 aa, Homo Sapiens
RSAHIHYFP

SEQ ID NO: 811320 - protein, 9 aa, Homo Sapiens
VRVTTAAHI

SEQ ID NO: 811321 - protein, 9 aa, Homo Sapiens
TWLGYVNYL

SEQ ID NO: 811322 - protein, 9 aa, Homo Sapiens
ANIYLPSIS

SEQ ID NO: 811323 - protein, 9 aa, Homo Sapiens
CSTCQNMAC

SEQ ID NO: 811324 - protein, 9 aa, Homo Sapiens
SVDDDNDNA

SEQ ID NO: 811325 - protein, 9 aa, Homo Sapiens
CECQQCGKA

SEQ ID NO: 811326 - protein, 9 aa, Homo Sapiens
WDLHVSTGE

SEQ ID NO: 811327 - protein, 9 aa, Homo Sapiens
VFSIKQVGN

SEQ ID NO: 811328 - protein, 9 aa, Homo Sapiens
NMVTDEEGE

SEQ ID NO: 811329 - protein, 9 aa, Homo Sapiens
LDMKLIFLG

SEQ ID NO: 811330 - protein, 9 aa, Homo Sapiens
GIITNWDYM

SEQ ID NO: 811331 - protein, 9 aa, Homo Sapiens
MHNAKKSYQ

SEQ ID NO: 811332 - protein, 9 aa, Homo Sapiens
VIIHPHLST

SEQ ID NO: 811333 - protein, 9 aa, Homo Sapiens
LEHPSRTIF

SEQ ID NO: 811334 - protein, 9 aa, Homo Sapiens
NSAFQRSAI

SEQ ID NO: 811335 - protein, 9 aa, Homo Sapiens
STLGLQCRR

SEQ ID NO: 811336 - protein, 9 aa, Homo Sapiens
SAVSLSGSS

SEQ ID NO: 811337 - protein, 9 aa, Homo Sapiens
NKLTFVQSF

SEQ ID NO: 811338 - protein, 9 aa, Homo Sapiens
GDNDEDTTP

SEQ ID NO: 811339 - protein, 9 aa, Homo Sapiens
MQKVGQVIL

SEQ ID NO: 811340 - protein, 9 aa, Homo Sapiens
ITFFSPIMS

SEQ ID NO: 811341 - protein, 9 aa, Homo Sapiens
QKPYGCNKC

SEQ ID NO: 811342 - protein, 9 aa, Homo Sapiens
TRPGLQTPL

SEQ ID NO: 811343 - protein, 9 aa, Homo Sapiens
LVEEVVQEY

SEQ ID NO: 811344 - protein, 9 aa, Homo Sapiens
SMDVMVFIV

SEQ ID NO: 811345 - protein, 9 aa, Homo Sapiens
RATKVEDMM

SEQ ID NO: 811346 - protein, 9 aa, Homo Sapiens
RKVMQKIQM

SEQ ID NO: 811347 - protein, 9 aa, Homo Sapiens
KWLPYKTCN

SEQ ID NO: 811348 - protein, 9 aa, Homo Sapiens
NCSRWKCIS

SEQ ID NO: 811349 - protein, 9 aa, Homo Sapiens
ASSSKMKAP

SEQ ID NO: 811350 - protein, 9 aa, Homo Sapiens
TKANVKELT

SEQ ID NO: 811351 - protein, 9 aa, Homo Sapiens
RNIQGSIVA

SEQ ID NO: 811352 - protein, 9 aa, Homo Sapiens
TVVSTNWSD

SEQ ID NO: 811353 - protein, 9 aa, Homo Sapiens
LALTSRVCE

SEQ ID NO: 811354 - protein, 9 aa, Homo Sapiens
HSGFSSVSV

SEQ ID NO: 811355 - protein, 9 aa, Homo Sapiens
AALQCEEIA

SEQ ID NO: 811356 - protein, 9 aa, Homo Sapiens
EIHNGIEAC

SEQ ID NO: 811357 - protein, 9 aa, Homo Sapiens
QQPKLKRVM

SEQ ID NO: 811358 - protein, 9 aa, Homo Sapiens
RSLKGLTNY

SEQ ID NO: 811359 - protein, 9 aa, Homo Sapiens
PSAYQRTYY

SEQ ID NO: 811360 - protein, 9 aa, Homo Sapiens
SPIRRVGPF

SEQ ID NO: 811361 - protein, 9 aa, Homo Sapiens
NKEYAHTLT

SEQ ID NO: 811362 - protein, 9 aa, Homo Sapiens
QPYIPYILE

SEQ ID NO: 811363 - protein, 9 aa, Homo Sapiens
RGTLENYNS

SEQ ID NO: 811364 - protein, 9 aa, Homo Sapiens
PLLYSITQV

SEQ ID NO: 811365 - protein, 9 aa, Homo Sapiens
WVHAGGDPM

SEQ ID NO: 811366 - protein, 9 aa, Homo Sapiens
VHQITHTGE

SEQ ID NO: 811367 - protein, 9 aa, Homo Sapiens
INRIAQKTR

SEQ ID NO: 811368 - protein, 9 aa, Homo Sapiens
RSILGTTPI

SEQ ID NO: 811369 - protein, 9 aa, Homo Sapiens
EAEKSHRDK

SEQ ID NO: 811370 - protein, 9 aa, Homo Sapiens
VLDCDIIKN

SEQ ID NO: 811371 - protein, 9 aa, Homo Sapiens
DNEDLKLWT

SEQ ID NO: 811372 - protein, 9 aa, Homo Sapiens
DPVAYILEP

SEQ ID NO: 811373 - protein, 9 aa, Homo Sapiens
EANGNKCSH

SEQ ID NO: 811374 - protein, 9 aa, Homo Sapiens
GYVLLILLF

SEQ ID NO: 811375 - protein, 9 aa, Homo Sapiens
AQYPVVAVN

SEQ ID NO: 811376 - protein, 9 aa, Homo Sapiens
EGKAPQCLQ

SEQ ID NO: 811377 - protein, 9 aa, Homo Sapiens
PWLTQRYRE

SEQ ID NO: 811378 - protein, 9 aa, Homo Sapiens
ENDTYDSSS

SEQ ID NO: 811379 - protein, 9 aa, Homo Sapiens
LNDEQYQSF

SEQ ID NO: 811380 - protein, 9 aa, Homo Sapiens
HKRKKSRYR

SEQ ID NO: 811381 - protein, 9 aa, Homo Sapiens
MINLCGVDR

SEQ ID NO: 811382 - protein, 9 aa, Homo Sapiens
INNYIEERS

SEQ ID NO: 811383 - protein, 9 aa, Homo Sapiens
IKGPLFRFF

SEQ ID NO: 811384 - protein, 9 aa, Homo Sapiens
LPYKTCNIT

SEQ ID NO: 811385 - protein, 9 aa, Homo Sapiens
SINKWAAQT

SEQ ID NO: 811386 - protein, 9 aa, Homo Sapiens
WIANCQRQF

SEQ ID NO: 811387 - protein, 9 aa, Homo Sapiens
CNNMATKYG

SEQ ID NO: 811388 - protein, 9 aa, Homo Sapiens
AAQTFISDI

SEQ ID NO: 811389 - protein, 9 aa, Homo Sapiens
DEAHDDDLD

SEQ ID NO: 811390 - protein, 9 aa, Homo Sapiens
SKDTWPGVT

SEQ ID NO: 811391 - protein, 9 aa, Homo Sapiens
LYAAILGYD

SEQ ID NO: 811392 - protein, 9 aa, Homo Sapiens
AALPCGCLC

SEQ ID NO: 811393 - protein, 9 aa, Homo Sapiens
THYFIKTTM

SEQ ID NO: 811394 - protein, 9 aa, Homo Sapiens
VFVINSSES

SEQ ID NO: 811395 - protein, 9 aa, Homo Sapiens
DEEEEQDQH

SEQ ID NO: 811396 - protein, 9 aa, Homo Sapiens
PPSTAVEFH

SEQ ID NO: 811397 - protein, 9 aa, Homo Sapiens
IIRLDLAGR

SEQ ID NO: 811398 - protein, 9 aa, Homo Sapiens
QFITRSWLQ

SEQ ID NO: 811399 - protein, 9 aa, Homo Sapiens
IKYWAKRKF

SEQ ID NO: 811400 - protein, 9 aa, Homo Sapiens
QSPEIDKVC

SEQ ID NO: 811401 - protein, 9 aa, Homo Sapiens
KADVWSLSC

SEQ ID NO: 811402 - protein, 9 aa, Homo Sapiens
RYAIYRESD

SEQ ID NO: 811403 - protein, 9 aa, Homo Sapiens
ARLRFPGIR

SEQ ID NO: 811404 - protein, 9 aa, Homo Sapiens
TFEIFHKGS

SEQ ID NO: 811405 - protein, 9 aa, Homo Sapiens
NRGVINEFM

SEQ ID NO: 811406 - protein, 9 aa, Homo Sapiens
GADKSTQLT

SEQ ID NO: 811407 - protein, 9 aa, Homo Sapiens
QILSSTLSS

SEQ ID NO: 811408 - protein, 9 aa, Homo Sapiens
PLEGTSFIM

SEQ ID NO: 811409 - protein, 9 aa, Homo Sapiens
YLTDVLLQT

SEQ ID NO: 811410 - protein, 9 aa, Homo Sapiens
SFVQYSNQI

SEQ ID NO: 811411 - protein, 9 aa, Homo Sapiens
CRNVFEPAR

SEQ ID NO: 811412 - protein, 9 aa, Homo Sapiens
AQINRIFHE

SEQ ID NO: 811413 - protein, 9 aa, Homo Sapiens
ELNKLRQSE

SEQ ID NO: 811414 - protein, 9 aa, Homo Sapiens
HEDEREKQE

SEQ ID NO: 811415 - protein, 9 aa, Homo Sapiens
YKTCNITVF

SEQ ID NO: 811416 - protein, 9 aa, Homo Sapiens
QVPGMQDIL

SEQ ID NO: 811417 - protein, 9 aa, Homo Sapiens
PIKPDPPVS

SEQ ID NO: 811418 - protein, 9 aa, Homo Sapiens
VIEDPFYLN

SEQ ID NO: 811419 - protein, 9 aa, Homo Sapiens
NGTCSPING

SEQ ID NO: 811420 - protein, 9 aa, Homo Sapiens
PSPDQSGID

SEQ ID NO: 811421 - protein, 9 aa, Homo Sapiens
LRELSERGP

SEQ ID NO: 811422 - protein, 9 aa, Homo Sapiens
TEQTAPTGQ

SEQ ID NO: 811423 - protein, 9 aa, Homo Sapiens
HTQERRYKC

SEQ ID NO: 811424 - protein, 9 aa, Homo Sapiens
FNPCGYLMN

SEQ ID NO: 811425 - protein, 9 aa, Homo Sapiens
ARKFNEPES

SEQ ID NO: 811426 - protein, 9 aa, Homo Sapiens
TLIHNRTNT

SEQ ID NO: 811427 - protein, 9 aa, Homo Sapiens
MTFQSRVMN

SEQ ID NO: 811428 - protein, 9 aa, Homo Sapiens
REVCKVKTI

SEQ ID NO: 811429 - protein, 9 aa, Homo Sapiens
CPIKEAVLY

SEQ ID NO: 811430 - protein, 9 aa, Homo Sapiens
YKNRGVLHQ

SEQ ID NO: 811431 - protein, 9 aa, Homo Sapiens
VIKLLKILR

SEQ ID NO: 811432 - protein, 9 aa, Homo Sapiens
RYVSAEIFL

SEQ ID NO: 811433 - protein, 9 aa, Homo Sapiens
QCLVMAGAP

SEQ ID NO: 811434 - protein, 9 aa, Homo Sapiens
DHFVLFFFR

SEQ ID NO: 811435 - protein, 9 aa, Homo Sapiens
YMKLLYFLL

SEQ ID NO: 811436 - protein, 9 aa, Homo Sapiens
AVYSKNRVP

SEQ ID NO: 811437 - protein, 9 aa, Homo Sapiens
LFNVIKAYS

SEQ ID NO: 811438 - protein, 9 aa, Homo Sapiens
YEQLRTFKL

SEQ ID NO: 811439 - protein, 9 aa, Homo Sapiens
MPREVEEIR

SEQ ID NO: 811440 - protein, 9 aa, Homo Sapiens
GGVPAWGLV

SEQ ID NO: 811441 - protein, 9 aa, Homo Sapiens
TAQEMYDCV

SEQ ID NO: 811442 - protein, 9 aa, Homo Sapiens
RITGIYGLF

SEQ ID NO: 811443 - protein, 9 aa, Homo Sapiens
KANSQRPFN

SEQ ID NO: 811444 - protein, 9 aa, Homo Sapiens
SGFGHKYSS

SEQ ID NO: 811445 - protein, 9 aa, Homo Sapiens
SQCHPDAFC

SEQ ID NO: 811446 - protein, 9 aa, Homo Sapiens
FMILLGSGA

SEQ ID NO: 811447 - protein, 9 aa, Homo Sapiens
THKLWRNIE

SEQ ID NO: 811448 - protein, 9 aa, Homo Sapiens
RSGSGNEED

SEQ ID NO: 811449 - protein, 9 aa, Homo Sapiens
WLANKDNGT

SEQ ID NO: 811450 - protein, 9 aa, Homo Sapiens
RQALKEDFP

SEQ ID NO: 811451 - protein, 9 aa, Homo Sapiens
LLQIPSCLY

SEQ ID NO: 811452 - protein, 9 aa, Homo Sapiens
TPEDLKANV

SEQ ID NO: 811453 - protein, 9 aa, Homo Sapiens
EEIIILEPD

SEQ ID NO: 811454 - protein, 9 aa, Homo Sapiens
LGTTGRFMG

SEQ ID NO: 811455 - protein, 9 aa, Homo Sapiens
QTLSTEAPG

SEQ ID NO: 811456 - protein, 9 aa, Homo Sapiens
FRGCQVWAY

SEQ ID NO: 811457 - protein, 9 aa, Homo Sapiens
VNCSDRVFK

SEQ ID NO: 811458 - protein, 9 aa, Homo Sapiens
QNLFQIVSN

SEQ ID NO: 811459 - protein, 9 aa, Homo Sapiens
HKEMETLAA

SEQ ID NO: 811460 - protein, 9 aa, Homo Sapiens
RTVVCVWEL

SEQ ID NO: 811461 - protein, 9 aa, Homo Sapiens
AAAAETRER

SEQ ID NO: 811462 - protein, 9 aa, Homo Sapiens
RKFYIYYLC

SEQ ID NO: 811463 - protein, 9 aa, Homo Sapiens
FLQMKRPGE

SEQ ID NO: 811464 - protein, 9 aa, Homo Sapiens
IFLTIRMIM

SEQ ID NO: 811465 - protein, 9 aa, Homo Sapiens
KQQKRQNGQ

SEQ ID NO: 811466 - protein, 9 aa, Homo Sapiens
AITYHGSIT

SEQ ID NO: 811467 - protein, 9 aa, Homo Sapiens
AICQSRPNA

SEQ ID NO: 811468 - protein, 9 aa, Homo Sapiens
RHRESLMAA

SEQ ID NO: 811469 - protein, 9 aa, Homo Sapiens
GIGSGLSCA

SEQ ID NO: 811470 - protein, 9 aa, Homo Sapiens
LLFSDNAVL

SEQ ID NO: 811471 - protein, 9 aa, Homo Sapiens
ETSLVNFPT

SEQ ID NO: 811472 - protein, 9 aa, Homo Sapiens
ETESNVNYY

SEQ ID NO: 811473 - protein, 9 aa, Homo Sapiens
VQTIQILTC

SEQ ID NO: 811474 - protein, 9 aa, Homo Sapiens
EIEFKVKTE

SEQ ID NO: 811475 - protein, 9 aa, Homo Sapiens
KGLQRLMLI

SEQ ID NO: 811476 - protein, 9 aa, Homo Sapiens
PNSPMMCPQ

SEQ ID NO: 811477 - protein, 9 aa, Homo Sapiens
TGFGNVSFV

SEQ ID NO: 811478 - protein, 9 aa, Homo Sapiens
AILTVADME

SEQ ID NO: 811479 - protein, 9 aa, Homo Sapiens
LNLSQNQLS

SEQ ID NO: 811480 - protein, 9 aa, Homo Sapiens
LLCPSGHNN

SEQ ID NO: 811481 - protein, 9 aa, Homo Sapiens
IRKISESKS

SEQ ID NO: 811482 - protein, 9 aa, Homo Sapiens
GIKVEASQK

SEQ ID NO: 811483 - protein, 9 aa, Homo Sapiens
MLFWDELWK

SEQ ID NO: 811484 - protein, 9 aa, Homo Sapiens
HNDPHLETV

SEQ ID NO: 811485 - protein, 9 aa, Homo Sapiens
HSHFYLKKG

SEQ ID NO: 811486 - protein, 9 aa, Homo Sapiens
RDILAGLPA

SEQ ID NO: 811487 - protein, 9 aa, Homo Sapiens
EERDGVQFS

SEQ ID NO: 811488 - protein, 9 aa, Homo Sapiens
GDEYDGGYG

SEQ ID NO: 811489 - protein, 9 aa, Homo Sapiens
EKSEEPPER

SEQ ID NO: 811490 - protein, 9 aa, Homo Sapiens
TVNTKNKRK

SEQ ID NO: 811491 - protein, 9 aa, Homo Sapiens
EKEEVEVTQ

SEQ ID NO: 811492 - protein, 9 aa, Homo Sapiens
VIGVWYSEP

SEQ ID NO: 811493 - protein, 9 aa, Homo Sapiens
LPCCRSTCC

SEQ ID NO: 811494 - protein, 9 aa, Homo Sapiens
STFDVIKYD

SEQ ID NO: 811495 - protein, 9 aa, Homo Sapiens
NLKAEIHGG

SEQ ID NO: 811496 - protein, 9 aa, Homo Sapiens
GLLEDNNKL

SEQ ID NO: 811497 - protein, 9 aa, Homo Sapiens
GTRRQFSTS

SEQ ID NO: 811498 - protein, 9 aa, Homo Sapiens
LALNLLVKA

SEQ ID NO: 811499 - protein, 9 aa, Homo Sapiens
QMSQCTCEE

SEQ ID NO: 811500 - protein, 9 aa, Homo Sapiens
PSYTKLIMY

SEQ ID NO: 811501 - protein, 9 aa, Homo Sapiens
LAHGPDTLP

SEQ ID NO: 811502 - protein, 9 aa, Homo Sapiens
PKAPDETIQ

SEQ ID NO: 811503 - protein, 9 aa, Homo Sapiens
NVLLEFGAD

SEQ ID NO: 811504 - protein, 9 aa, Homo Sapiens
VIFGKVKKI

SEQ ID NO: 811505 - protein, 9 aa, Homo Sapiens
GQGENQIIT

SEQ ID NO: 811506 - protein, 9 aa, Homo Sapiens
LRIKLELGG

SEQ ID NO: 811507 - protein, 9 aa, Homo Sapiens
PATSMVSGF

SEQ ID NO: 811508 - protein, 9 aa, Homo Sapiens
THTSTKQVE

SEQ ID NO: 811509 - protein, 9 aa, Homo Sapiens
GNDSVCGLE

SEQ ID NO: 811510 - protein, 9 aa, Homo Sapiens
ISGQTGHNY

SEQ ID NO: 811511 - protein, 9 aa, Homo Sapiens
LYRLSTEDK

SEQ ID NO: 811512 - protein, 9 aa, Homo Sapiens
FKQFCLLLN

SEQ ID NO: 811513 - protein, 9 aa, Homo Sapiens
VHQDLKPRN

SEQ ID NO: 811514 - protein, 9 aa, Homo Sapiens
IHNFVRVHV

SEQ ID NO: 811515 - protein, 9 aa, Homo Sapiens
WQQVLAPAW

SEQ ID NO: 811516 - protein, 9 aa, Homo Sapiens
QKIEDTLCH

SEQ ID NO: 811517 - protein, 9 aa, Homo Sapiens
NDLSREKMD

SEQ ID NO: 811518 - protein, 9 aa, Homo Sapiens
KLATKNLHV

SEQ ID NO: 811519 - protein, 9 aa, Homo Sapiens
DKNKLVKAF

SEQ ID NO: 811520 - protein, 9 aa, Homo Sapiens
ISVSRLKTV

SEQ ID NO: 811521 - protein, 9 aa, Homo Sapiens
PLRIKLELG

SEQ ID NO: 811522 - protein, 9 aa, Homo Sapiens
AEKVCLAQK

SEQ ID NO: 811523 - protein, 9 aa, Homo Sapiens
EKIIAIANY

SEQ ID NO: 811524 - protein, 9 aa, Homo Sapiens
FMNVVDVLA

SEQ ID NO: 811525 - protein, 9 aa, Homo Sapiens
CIMPFWIVH

SEQ ID NO: 811526 - protein, 9 aa, Homo Sapiens
SRKNEQSVS

SEQ ID NO: 811527 - protein, 9 aa, Homo Sapiens
EGKLKREKK

SEQ ID NO: 811528 - protein, 9 aa, Homo Sapiens
CDEGHRLNN

SEQ ID NO: 811529 - protein, 9 aa, Homo Sapiens
LKDRESHQD

SEQ ID NO: 811530 - protein, 9 aa, Homo Sapiens
AYQPCLIAP

SEQ ID NO: 811531 - protein, 9 aa, Homo Sapiens
GFTNLDLND

SEQ ID NO: 811532 - protein, 9 aa, Homo Sapiens
FEYCDNTLL

SEQ ID NO: 811533 - protein, 9 aa, Homo Sapiens
HQLFRDMDD

SEQ ID NO: 811534 - protein, 9 aa, Homo Sapiens
PNNYSTSGN

SEQ ID NO: 811535 - protein, 9 aa, Homo Sapiens
VLGRCVIYK

SEQ ID NO: 811536 - protein, 9 aa, Homo Sapiens
PYKELFGGV

SEQ ID NO: 811537 - protein, 9 aa, Homo Sapiens
EKQEEGKGP

SEQ ID NO: 811538 - protein, 9 aa, Homo Sapiens
SGMLLGEEK

SEQ ID NO: 811539 - protein, 9 aa, Homo Sapiens
HLVKWVTVA

SEQ ID NO: 811540 - protein, 9 aa, Homo Sapiens
KELLNEKYG

SEQ ID NO: 811541 - protein, 9 aa, Homo Sapiens
VMAYDHYIA

SEQ ID NO: 811542 - protein, 9 aa, Homo Sapiens
HHRIHTGDK

SEQ ID NO: 811543 - protein, 9 aa, Homo Sapiens
GDAKGDKAT

SEQ ID NO: 811544 - protein, 9 aa, Homo Sapiens
NIKFAETKA

SEQ ID NO: 811545 - protein, 9 aa, Homo Sapiens
MGTLSCNST

SEQ ID NO: 811546 - protein, 9 aa, Homo Sapiens
ALPVKLAQC

SEQ ID NO: 811547 - protein, 9 aa, Homo Sapiens
NLKKFLKPY

SEQ ID NO: 811548 - protein, 9 aa, Homo Sapiens
GQASPVNTC

SEQ ID NO: 811549 - protein, 9 aa, Homo Sapiens
EKGGNIQVE

SEQ ID NO: 811550 - protein, 9 aa, Homo Sapiens
RAEELSEAQ

SEQ ID NO: 811551 - protein, 9 aa, Homo Sapiens
LEAARWKLL

SEQ ID NO: 811552 - protein, 9 aa, Homo Sapiens
LMGLSLFFS

SEQ ID NO: 811553 - protein, 9 aa, Homo Sapiens
IDVVQRQIH

SEQ ID NO: 811554 - protein, 9 aa, Homo Sapiens
KYLDFEKAK

SEQ ID NO: 811555 - protein, 9 aa, Homo Sapiens
TSGKHYWDV

SEQ ID NO: 811556 - protein, 9 aa, Homo Sapiens
GIFQVVISI

SEQ ID NO: 811557 - protein, 9 aa, Homo Sapiens
YGIFWYKQP

SEQ ID NO: 811558 - protein, 9 aa, Homo Sapiens
QALENSTQE

SEQ ID NO: 811559 - protein, 9 aa, Homo Sapiens
KYFILFTKK

SEQ ID NO: 811560 - protein, 9 aa, Homo Sapiens
RYFVIRIKD

SEQ ID NO: 811561 - protein, 9 aa, Homo Sapiens
SKGITFEIF

SEQ ID NO: 811562 - protein, 9 aa, Homo Sapiens
LVYHNGDPF

SEQ ID NO: 811563 - protein, 9 aa, Homo Sapiens
YPCACEVKG

SEQ ID NO: 811564 - protein, 9 aa, Homo Sapiens
VFLVAFVNM

SEQ ID NO: 811565 - protein, 9 aa, Homo Sapiens
GCGFPPLSY

SEQ ID NO: 811566 - protein, 9 aa, Homo Sapiens
ENYLESIED

SEQ ID NO: 811567 - protein, 9 aa, Homo Sapiens
IPITLNIGD

SEQ ID NO: 811568 - protein, 9 aa, Homo Sapiens
LAGAAKHEI

SEQ ID NO: 811569 - protein, 9 aa, Homo Sapiens
GQEIYQASL

SEQ ID NO: 811570 - protein, 9 aa, Homo Sapiens
IVPLCYVKF

SEQ ID NO: 811571 - protein, 9 aa, Homo Sapiens
GDKSAPIRT

SEQ ID NO: 811572 - protein, 9 aa, Homo Sapiens
TGCVYLTIT

SEQ ID NO: 811573 - protein, 9 aa, Homo Sapiens
LEKDMQAVR

SEQ ID NO: 811574 - protein, 9 aa, Homo Sapiens
LDTKRITPD

SEQ ID NO: 811575 - protein, 9 aa, Homo Sapiens
RSQLAIVPQ

SEQ ID NO: 811576 - protein, 9 aa, Homo Sapiens
ELRQKALEE

SEQ ID NO: 811577 - protein, 9 aa, Homo Sapiens
FTSDNNELW

SEQ ID NO: 811578 - protein, 9 aa, Homo Sapiens
TSSLARHWI

SEQ ID NO: 811579 - protein, 9 aa, Homo Sapiens
AESLTNFHE

SEQ ID NO: 811580 - protein, 9 aa, Homo Sapiens
NPVGQMSLS

SEQ ID NO: 811581 - protein, 9 aa, Homo Sapiens
CQLSISDRI

SEQ ID NO: 811582 - protein, 9 aa, Homo Sapiens
RATLRERYL

SEQ ID NO: 811583 - protein, 9 aa, Homo Sapiens
SHKTIASLR

SEQ ID NO: 811584 - protein, 9 aa, Homo Sapiens
CANAVLHKN

SEQ ID NO: 811585 - protein, 9 aa, Homo Sapiens
LKHRVKNSP

SEQ ID NO: 811586 - protein, 9 aa, Homo Sapiens
IVKEAEVLQ

SEQ ID NO: 811587 - protein, 9 aa, Homo Sapiens
GKERSIFLV

SEQ ID NO: 811588 - protein, 9 aa, Homo Sapiens
PSQKPQICD

SEQ ID NO: 811589 - protein, 9 aa, Homo Sapiens
PSLVAHQII

SEQ ID NO: 811590 - protein, 9 aa, Homo Sapiens
SGKTGRASD

SEQ ID NO: 811591 - protein, 9 aa, Homo Sapiens
PHSLSVSEA

SEQ ID NO: 811592 - protein, 9 aa, Homo Sapiens
VGQGENQII

SEQ ID NO: 811593 - protein, 9 aa, Homo Sapiens
IRSLQELLD

SEQ ID NO: 811594 - protein, 9 aa, Homo Sapiens
QFNSGNQLL

SEQ ID NO: 811595 - protein, 9 aa, Homo Sapiens
SVLQGYNNR

SEQ ID NO: 811596 - protein, 9 aa, Homo Sapiens
GIKGMVQVV

SEQ ID NO: 811597 - protein, 9 aa, Homo Sapiens
QFHFTSWPG

SEQ ID NO: 811598 - protein, 9 aa, Homo Sapiens
ENLKRCFRE

SEQ ID NO: 811599 - protein, 9 aa, Homo Sapiens
IRLEKEMSK

SEQ ID NO: 811600 - protein, 9 aa, Homo Sapiens
GSKTVIQHC

SEQ ID NO: 811601 - protein, 9 aa, Homo Sapiens
SLLSYMISL

SEQ ID NO: 811602 - protein, 9 aa, Homo Sapiens
GNQIEIIDQ

SEQ ID NO: 811603 - protein, 9 aa, Homo Sapiens
KEPVKNIFV

SEQ ID NO: 811604 - protein, 9 aa, Homo Sapiens
LETKVGTEP

SEQ ID NO: 811605 - protein, 9 aa, Homo Sapiens
MYLPLEETE

SEQ ID NO: 811606 - protein, 9 aa, Homo Sapiens
CAFHLTAIT

SEQ ID NO: 811607 - protein, 9 aa, Homo Sapiens
RQFHSHGWP

SEQ ID NO: 811608 - protein, 9 aa, Homo Sapiens
FASQINDIQ

SEQ ID NO: 811609 - protein, 9 aa, Homo Sapiens
FSRCLKADA

SEQ ID NO: 811610 - protein, 9 aa, Homo Sapiens
LSFETKIIS

SEQ ID NO: 811611 - protein, 9 aa, Homo Sapiens
TPSISKEDI

SEQ ID NO: 811612 - protein, 9 aa, Homo Sapiens
GGRQKYKRW

SEQ ID NO: 811613 - protein, 9 aa, Homo Sapiens
GLILISPHN

SEQ ID NO: 811614 - protein, 9 aa, Homo Sapiens
DDFSEPSNL

SEQ ID NO: 811615 - protein, 9 aa, Homo Sapiens
NEHTYSNRT

SEQ ID NO: 811616 - protein, 9 aa, Homo Sapiens
DVSSNKLKT

SEQ ID NO: 811617 - protein, 9 aa, Homo Sapiens
EPLKDEFNN

SEQ ID NO: 811618 - protein, 9 aa, Homo Sapiens
RARFGGWTS

SEQ ID NO: 811619 - protein, 9 aa, Homo Sapiens
QASIDGFDR

SEQ ID NO: 811620 - protein, 9 aa, Homo Sapiens
GPQIQIGQE

SEQ ID NO: 811621 - protein, 9 aa, Homo Sapiens
RSSHHRSQS

SEQ ID NO: 811622 - protein, 9 aa, Homo Sapiens
LKEPFPESM

SEQ ID NO: 811623 - protein, 9 aa, Homo Sapiens
SFRVFSNKV

SEQ ID NO: 811624 - protein, 9 aa, Homo Sapiens
NRYYVSNKL

SEQ ID NO: 811625 - protein, 9 aa, Homo Sapiens
VALCVTACP

SEQ ID NO: 811626 - protein, 9 aa, Homo Sapiens
IGGLKLNAF

SEQ ID NO: 811627 - protein, 9 aa, Homo Sapiens
SSPAISPLT

SEQ ID NO: 811628 - protein, 9 aa, Homo Sapiens
QAKYFGNYL

SEQ ID NO: 811629 - protein, 9 aa, Homo Sapiens
IIQHVDVIK

SEQ ID NO: 811630 - protein, 9 aa, Homo Sapiens
ASFGGNPGY

SEQ ID NO: 811631 - protein, 9 aa, Homo Sapiens
WRVAQGEMG

SEQ ID NO: 811632 - protein, 9 aa, Homo Sapiens
FDVGGQISE

SEQ ID NO: 811633 - protein, 9 aa, Homo Sapiens
QVDTGLECP

SEQ ID NO: 811634 - protein, 9 aa, Homo Sapiens
IYGKRSSPE

SEQ ID NO: 811635 - protein, 9 aa, Homo Sapiens
QSELFINTT

SEQ ID NO: 811636 - protein, 9 aa, Homo Sapiens
TRPVWTAED

SEQ ID NO: 811637 - protein, 9 aa, Homo Sapiens
NNNIINTQQ

SEQ ID NO: 811638 - protein, 9 aa, Homo Sapiens
GLREQLATE

SEQ ID NO: 811639 - protein, 9 aa, Homo Sapiens
ESPQGKVVQ

SEQ ID NO: 811640 - protein, 9 aa, Homo Sapiens
NFFLLNKTL

SEQ ID NO: 811641 - protein, 9 aa, Homo Sapiens
DIKEELEEL

SEQ ID NO: 811642 - protein, 9 aa, Homo Sapiens
EVCKENDFS

SEQ ID NO: 811643 - protein, 9 aa, Homo Sapiens
SIECSTFLT

SEQ ID NO: 811644 - protein, 9 aa, Homo Sapiens
LNEAQEILA

SEQ ID NO: 811645 - protein, 9 aa, Homo Sapiens
VLDMYQNYI

SEQ ID NO: 811646 - protein, 9 aa, Homo Sapiens
SYEQHNQQG

SEQ ID NO: 811647 - protein, 9 aa, Homo Sapiens
GRAAKLAPK

SEQ ID NO: 811648 - protein, 9 aa, Homo Sapiens
LLRALLGTL

SEQ ID NO: 811649 - protein, 9 aa, Homo Sapiens
HSKAVAIGP

SEQ ID NO: 811650 - protein, 9 aa, Homo Sapiens
TFSGLFSAL

SEQ ID NO: 811651 - protein, 9 aa, Homo Sapiens
SSYNYILAL

SEQ ID NO: 811652 - protein, 9 aa, Homo Sapiens
EAEPQGQPQ

SEQ ID NO: 811653 - protein, 9 aa, Homo Sapiens
DISSISICT

SEQ ID NO: 811654 - protein, 9 aa, Homo Sapiens
EKSVQEREV

SEQ ID NO: 811655 - protein, 9 aa, Homo Sapiens
ALENSTQEN

SEQ ID NO: 811656 - protein, 9 aa, Homo Sapiens
CGYAVISFG

SEQ ID NO: 811657 - protein, 9 aa, Homo Sapiens
TQKWEAEPV

SEQ ID NO: 811658 - protein, 9 aa, Homo Sapiens
KAVKFPNPL

SEQ ID NO: 811659 - protein, 9 aa, Homo Sapiens
MNLESDNED

SEQ ID NO: 811660 - protein, 9 aa, Homo Sapiens
SGLDKNKKT

SEQ ID NO: 811661 - protein, 9 aa, Homo Sapiens
LNILETSEI

SEQ ID NO: 811662 - protein, 9 aa, Homo Sapiens
FPLKTKGEL

SEQ ID NO: 811663 - protein, 9 aa, Homo Sapiens
LGEVSSDDD

SEQ ID NO: 811664 - protein, 9 aa, Homo Sapiens
PQKSRLLFF

SEQ ID NO: 811665 - protein, 9 aa, Homo Sapiens
GLIALWSEG

SEQ ID NO: 811666 - protein, 9 aa, Homo Sapiens
AMHRLDRIV

SEQ ID NO: 811667 - protein, 9 aa, Homo Sapiens
EYLSSLDEG

SEQ ID NO: 811668 - protein, 9 aa, Homo Sapiens
KMKGLQEQQ

SEQ ID NO: 811669 - protein, 9 aa, Homo Sapiens
LQLLADHAP

SEQ ID NO: 811670 - protein, 9 aa, Homo Sapiens
AVVHKEPTY

SEQ ID NO: 811671 - protein, 9 aa, Homo Sapiens
PDNWLQPTA

SEQ ID NO: 811672 - protein, 9 aa, Homo Sapiens
EQLHPKLLH

SEQ ID NO: 811673 - protein, 9 aa, Homo Sapiens
LFRTTYFCR

SEQ ID NO: 811674 - protein, 9 aa, Homo Sapiens
ILMCTGETE

SEQ ID NO: 811675 - protein, 9 aa, Homo Sapiens
LGEEKFSYG

SEQ ID NO: 811676 - protein, 9 aa, Homo Sapiens
QEIRVSPIF

SEQ ID NO: 811677 - protein, 9 aa, Homo Sapiens
PNPDGKIKE

SEQ ID NO: 811678 - protein, 9 aa, Homo Sapiens
AKELKSQSG

SEQ ID NO: 811679 - protein, 9 aa, Homo Sapiens
QQQIIIRQL

SEQ ID NO: 811680 - protein, 9 aa, Homo Sapiens
IHTILLGYL

SEQ ID NO: 811681 - protein, 9 aa, Homo Sapiens
TQGYNETDW

SEQ ID NO: 811682 - protein, 9 aa, Homo Sapiens
GLVLTPTQE

SEQ ID NO: 811683 - protein, 9 aa, Homo Sapiens
PYYYKKINT

SEQ ID NO: 811684 - protein, 9 aa, Homo Sapiens
VEHGKFIES

SEQ ID NO: 811685 - protein, 9 aa, Homo Sapiens
LASHSFTLS

SEQ ID NO: 811686 - protein, 9 aa, Homo Sapiens
GFLGVYQNG

SEQ ID NO: 811687 - protein, 9 aa, Homo Sapiens
FLRHEEQSG

SEQ ID NO: 811688 - protein, 9 aa, Homo Sapiens
PREPRQIVI

SEQ ID NO: 811689 - protein, 9 aa, Homo Sapiens
SSFAALPCG

SEQ ID NO: 811690 - protein, 9 aa, Homo Sapiens
KQEPGDNSE

SEQ ID NO: 811691 - protein, 9 aa, Homo Sapiens
TSIMPLGLL

SEQ ID NO: 811692 - protein, 9 aa, Homo Sapiens
LLIKMKGLQ

SEQ ID NO: 811693 - protein, 9 aa, Homo Sapiens
QEAVLAMSR

SEQ ID NO: 811694 - protein, 9 aa, Homo Sapiens
QEYHYPDSD

SEQ ID NO: 811695 - protein, 9 aa, Homo Sapiens
EKQYYSDPR

SEQ ID NO: 811696 - protein, 9 aa, Homo Sapiens
MGTYKTAAE

SEQ ID NO: 811697 - protein, 9 aa, Homo Sapiens
TKQLLANFS

SEQ ID NO: 811698 - protein, 9 aa, Homo Sapiens
PALARIADS

SEQ ID NO: 811699 - protein, 9 aa, Homo Sapiens
LGSRVAELT

SEQ ID NO: 811700 - protein, 9 aa, Homo Sapiens
PDKSVEVPK

SEQ ID NO: 811701 - protein, 9 aa, Homo Sapiens
IEEVKKLIT

SEQ ID NO: 811702 - protein, 9 aa, Homo Sapiens
FSVLGLELW

SEQ ID NO: 811703 - protein, 9 aa, Homo Sapiens
KHVFKDNVV

SEQ ID NO: 811704 - protein, 9 aa, Homo Sapiens
GRNPVMELN

SEQ ID NO: 811705 - protein, 9 aa, Homo Sapiens
IFCLFADNV

SEQ ID NO: 811706 - protein, 9 aa, Homo Sapiens
MRPTDVPAT

SEQ ID NO: 811707 - protein, 9 aa, Homo Sapiens
HEIGRQAEY

SEQ ID NO: 811708 - protein, 9 aa, Homo Sapiens
WDEYNGFWK

SEQ ID NO: 811709 - protein, 9 aa, Homo Sapiens
KRTALTKVV

SEQ ID NO: 811710 - protein, 9 aa, Homo Sapiens
YLYACGSAE

SEQ ID NO: 811711 - protein, 9 aa, Homo Sapiens
IAQSIAAQE

SEQ ID NO: 811712 - protein, 9 aa, Homo Sapiens
GHINIFVDV

SEQ ID NO: 811713 - protein, 9 aa, Homo Sapiens
ANKECSILL

SEQ ID NO: 811714 - protein, 9 aa, Homo Sapiens
RTCINPVHS

SEQ ID NO: 811715 - protein, 9 aa, Homo Sapiens
QEKEESKND

SEQ ID NO: 811716 - protein, 9 aa, Homo Sapiens
CVNVTDVND

SEQ ID NO: 811717 - protein, 9 aa, Homo Sapiens
GKTMTKMPS

SEQ ID NO: 811718 - protein, 9 aa, Homo Sapiens
TLLGQDKET

SEQ ID NO: 811719 - protein, 9 aa, Homo Sapiens
DVISVGSGL

SEQ ID NO: 811720 - protein, 9 aa, Homo Sapiens
SFNNTYQAT

SEQ ID NO: 811721 - protein, 9 aa, Homo Sapiens
RDLIQDKYS

SEQ ID NO: 811722 - protein, 9 aa, Homo Sapiens
YIYVGELLR

SEQ ID NO: 811723 - protein, 9 aa, Homo Sapiens
IILGFSEYP

SEQ ID NO: 811724 - protein, 9 aa, Homo Sapiens
TLFLTTLPL

SEQ ID NO: 811725 - protein, 9 aa, Homo Sapiens
SIFVWFICI

SEQ ID NO: 811726 - protein, 9 aa, Homo Sapiens
VTPTKAVRT

SEQ ID NO: 811727 - protein, 9 aa, Homo Sapiens
SQYTGIPLP

SEQ ID NO: 811728 - protein, 9 aa, Homo Sapiens
DFFPDGAHW

SEQ ID NO: 811729 - protein, 9 aa, Homo Sapiens
GWMKLDTNE

SEQ ID NO: 811730 - protein, 9 aa, Homo Sapiens
YLKVLAEVN

SEQ ID NO: 811731 - protein, 9 aa, Homo Sapiens
GAGKGKYDA

SEQ ID NO: 811732 - protein, 9 aa, Homo Sapiens
YGDLSLKEA

SEQ ID NO: 811733 - protein, 9 aa, Homo Sapiens
AISLLVTIE

SEQ ID NO: 811734 - protein, 9 aa, Homo Sapiens
ALFIIILTF

SEQ ID NO: 811735 - protein, 9 aa, Homo Sapiens
PIFYVSSIT

SEQ ID NO: 811736 - protein, 9 aa, Homo Sapiens
NMTTRGEYF

SEQ ID NO: 811737 - protein, 9 aa, Homo Sapiens
TGKIPYECI

SEQ ID NO: 811738 - protein, 9 aa, Homo Sapiens
CTQPRQISA

SEQ ID NO: 811739 - protein, 9 aa, Homo Sapiens
GTYFRNSSC

SEQ ID NO: 811740 - protein, 9 aa, Homo Sapiens
LLGVINAGK

SEQ ID NO: 811741 - protein, 9 aa, Homo Sapiens
KECGVAFSR

SEQ ID NO: 811742 - protein, 9 aa, Homo Sapiens
VHMHRFYMI

SEQ ID NO: 811743 - protein, 9 aa, Homo Sapiens
NENSTPDKT

SEQ ID NO: 811744 - protein, 9 aa, Homo Sapiens
LGPILGSEP

SEQ ID NO: 811745 - protein, 9 aa, Homo Sapiens
KIKQISRDI

SEQ ID NO: 811746 - protein, 9 aa, Homo Sapiens
YSDESEDGR

SEQ ID NO: 811747 - protein, 9 aa, Homo Sapiens
ILCFVLCVI

SEQ ID NO: 811748 - protein, 9 aa, Homo Sapiens
HTINSSAFG

SEQ ID NO: 811749 - protein, 9 aa, Homo Sapiens
GSEEHEDIS

SEQ ID NO: 811750 - protein, 9 aa, Homo Sapiens
CNSCPSLCS

SEQ ID NO: 811751 - protein, 9 aa, Homo Sapiens
MSFPYCGPY

SEQ ID NO: 811752 - protein, 9 aa, Homo Sapiens
QASLALDCK

SEQ ID NO: 811753 - protein, 9 aa, Homo Sapiens
YAEKIMLTE

SEQ ID NO: 811754 - protein, 9 aa, Homo Sapiens
EHTDITMKH

SEQ ID NO: 811755 - protein, 9 aa, Homo Sapiens
QLRHDCEEA

SEQ ID NO: 811756 - protein, 9 aa, Homo Sapiens
TGELERGPS

SEQ ID NO: 811757 - protein, 9 aa, Homo Sapiens
NTLVVLDTD

SEQ ID NO: 811758 - protein, 9 aa, Homo Sapiens
VNQNPIAQS

SEQ ID NO: 811759 - protein, 9 aa, Homo Sapiens
RKVQYDSSE

SEQ ID NO: 811760 - protein, 9 aa, Homo Sapiens
GPWNQYAPP

SEQ ID NO: 811761 - protein, 9 aa, Homo Sapiens
YECKDCRTS

SEQ ID NO: 811762 - protein, 9 aa, Homo Sapiens
TSTWNLALP

SEQ ID NO: 811763 - protein, 9 aa, Homo Sapiens
GMTKNIYGN

SEQ ID NO: 811764 - protein, 9 aa, Homo Sapiens
SLAQQPSYP

SEQ ID NO: 811765 - protein, 9 aa, Homo Sapiens
AQVKQESVG

SEQ ID NO: 811766 - protein, 9 aa, Homo Sapiens
KNKSEYTVK

SEQ ID NO: 811767 - protein, 9 aa, Homo Sapiens
KRNPRSYNP

SEQ ID NO: 811768 - protein, 9 aa, Homo Sapiens
PSSFQNHER

SEQ ID NO: 811769 - protein, 9 aa, Homo Sapiens
SKDESDSAV

SEQ ID NO: 811770 - protein, 9 aa, Homo Sapiens
EKRQQGLQH

SEQ ID NO: 811771 - protein, 9 aa, Homo Sapiens
EYSDLEDDS

SEQ ID NO: 811772 - protein, 9 aa, Homo Sapiens
QQLLRKVFE

SEQ ID NO: 811773 - protein, 9 aa, Homo Sapiens
KDLTYLGHN

SEQ ID NO: 811774 - protein, 9 aa, Homo Sapiens
MAGASVAVF

SEQ ID NO: 811775 - protein, 9 aa, Homo Sapiens
RKVQEPQGE

SEQ ID NO: 811776 - protein, 9 aa, Homo Sapiens
QECLEHDRI

SEQ ID NO: 811777 - protein, 9 aa, Homo Sapiens
VSVRVLYKK

SEQ ID NO: 811778 - protein, 9 aa, Homo Sapiens
TVIQTIHKY

SEQ ID NO: 811779 - protein, 9 aa, Homo Sapiens
LEKFLARTK

SEQ ID NO: 811780 - protein, 9 aa, Homo Sapiens
PEHPPICQV

SEQ ID NO: 811781 - protein, 9 aa, Homo Sapiens
CAIQNSRDV

SEQ ID NO: 811782 - protein, 9 aa, Homo Sapiens
NISAKHEKE

SEQ ID NO: 811783 - protein, 9 aa, Homo Sapiens
QESHLKDTP

SEQ ID NO: 811784 - protein, 9 aa, Homo Sapiens
ANIFHLRLE

SEQ ID NO: 811785 - protein, 9 aa, Homo Sapiens
INSLKLQAG

SEQ ID NO: 811786 - protein, 9 aa, Homo Sapiens
TGSEGLAQL

SEQ ID NO: 811787 - protein, 9 aa, Homo Sapiens
TTNLPSGEV

SEQ ID NO: 811788 - protein, 9 aa, Homo Sapiens
FGVCRLIGV

SEQ ID NO: 811789 - protein, 9 aa, Homo Sapiens
SCGVPGSQG

SEQ ID NO: 811790 - protein, 9 aa, Homo Sapiens
PDEFEHTPQ

SEQ ID NO: 811791 - protein, 9 aa, Homo Sapiens
VFQKFGKVR

SEQ ID NO: 811792 - protein, 9 aa, Homo Sapiens
YRGLGILAS

SEQ ID NO: 811793 - protein, 9 aa, Homo Sapiens
NVDGAATEP

SEQ ID NO: 811794 - protein, 9 aa, Homo Sapiens
HKKLATKNL

SEQ ID NO: 811795 - protein, 9 aa, Homo Sapiens
LMDVWGFSA

SEQ ID NO: 811796 - protein, 9 aa, Homo Sapiens
DKEPSVLRK

SEQ ID NO: 811797 - protein, 9 aa, Homo Sapiens
ENKNYVLNT

SEQ ID NO: 811798 - protein, 9 aa, Homo Sapiens
LYGQEIYQA

SEQ ID NO: 811799 - protein, 9 aa, Homo Sapiens
RKRKQLLVA

SEQ ID NO: 811800 - protein, 9 aa, Homo Sapiens
PDCVIYSSV

SEQ ID NO: 811801 - protein, 9 aa, Homo Sapiens
QDFGKVISA

SEQ ID NO: 811802 - protein, 9 aa, Homo Sapiens
PHWTKVVLT

SEQ ID NO: 811803 - protein, 9 aa, Homo Sapiens
CKDCRTSFR

SEQ ID NO: 811804 - protein, 9 aa, Homo Sapiens
IGILYIATP

SEQ ID NO: 811805 - protein, 9 aa, Homo Sapiens
KQAEQKVHR

SEQ ID NO: 811806 - protein, 9 aa, Homo Sapiens
LKKKRGRKC

SEQ ID NO: 811807 - protein, 9 aa, Homo Sapiens
ARINSLKLQ

SEQ ID NO: 811808 - protein, 9 aa, Homo Sapiens
EAIMHKRPL

SEQ ID NO: 811809 - protein, 9 aa, Homo Sapiens
LNLVQNNVS

SEQ ID NO: 811810 - protein, 9 aa, Homo Sapiens
LLRPSIAGL

SEQ ID NO: 811811 - protein, 9 aa, Homo Sapiens
PPVLTPLML

SEQ ID NO: 811812 - protein, 9 aa, Homo Sapiens
VPYVEPPKY

SEQ ID NO: 811813 - protein, 9 aa, Homo Sapiens
YFQKVLLRK

SEQ ID NO: 811814 - protein, 9 aa, Homo Sapiens
CHARDKDKR

SEQ ID NO: 811815 - protein, 9 aa, Homo Sapiens
RNQKRSKRR

SEQ ID NO: 811816 - protein, 9 aa, Homo Sapiens
VSRKRVLEI

SEQ ID NO: 811817 - protein, 9 aa, Homo Sapiens
KILNQSQDG

SEQ ID NO: 811818 - protein, 9 aa, Homo Sapiens
DQDTGYHSL

SEQ ID NO: 811819 - protein, 9 aa, Homo Sapiens
DATRKCYRM

SEQ ID NO: 811820 - protein, 9 aa, Homo Sapiens
CVVCGTYFR

SEQ ID NO: 811821 - protein, 9 aa, Homo Sapiens
HFIDHLNKH

SEQ ID NO: 811822 - protein, 9 aa, Homo Sapiens
AFGYLFDEA

SEQ ID NO: 811823 - protein, 9 aa, Homo Sapiens
SVSASQGAK

SEQ ID NO: 811824 - protein, 9 aa, Homo Sapiens
VSVGLCVHV

SEQ ID NO: 811825 - protein, 9 aa, Homo Sapiens
AKKYVIDQI

SEQ ID NO: 811826 - protein, 9 aa, Homo Sapiens
LNTHLSTQL

SEQ ID NO: 811827 - protein, 9 aa, Homo Sapiens
QGARPQPRA

SEQ ID NO: 811828 - protein, 9 aa, Homo Sapiens
VMHNYQISG

SEQ ID NO: 811829 - protein, 9 aa, Homo Sapiens
RAMCRRLNK

SEQ ID NO: 811830 - protein, 9 aa, Homo Sapiens
SGYFVLTIV

SEQ ID NO: 811831 - protein, 9 aa, Homo Sapiens
STTKKSKKA

SEQ ID NO: 811832 - protein, 9 aa, Homo Sapiens
SYGIRQLIK

SEQ ID NO: 811833 - protein, 9 aa, Homo Sapiens
QTYSRLQTL

SEQ ID NO: 811834 - protein, 9 aa, Homo Sapiens
HFTILSFYR

SEQ ID NO: 811835 - protein, 9 aa, Homo Sapiens
GQMFLGGLA

SEQ ID NO: 811836 - protein, 9 aa, Homo Sapiens
LKEGLMLKN

SEQ ID NO: 811837 - protein, 9 aa, Homo Sapiens
RYINFNMSP

SEQ ID NO: 811838 - protein, 9 aa, Homo Sapiens
IICRYQETG

SEQ ID NO: 811839 - protein, 9 aa, Homo Sapiens
EDVRVAASY

SEQ ID NO: 811840 - protein, 9 aa, Homo Sapiens
WKETDKFGQ

SEQ ID NO: 811841 - protein, 9 aa, Homo Sapiens
ANDRDKPEA

SEQ ID NO: 811842 - protein, 9 aa, Homo Sapiens
AAQLKKEAN

SEQ ID NO: 811843 - protein, 9 aa, Homo Sapiens
VYKVVVDRK

SEQ ID NO: 811844 - protein, 9 aa, Homo Sapiens
TFKNGRMVE

SEQ ID NO: 811845 - protein, 9 aa, Homo Sapiens
CCSLKKYSN

SEQ ID NO: 811846 - protein, 9 aa, Homo Sapiens
LWRRMSVMD

SEQ ID NO: 811847 - protein, 9 aa, Homo Sapiens
KTFRLSATS

SEQ ID NO: 811848 - protein, 9 aa, Homo Sapiens
DRINHCGIA

SEQ ID NO: 811849 - protein, 9 aa, Homo Sapiens
EALVHYYFS

SEQ ID NO: 811850 - protein, 9 aa, Homo Sapiens
LEDDSNYVL

SEQ ID NO: 811851 - protein, 9 aa, Homo Sapiens
VGSGSLDSL

SEQ ID NO: 811852 - protein, 9 aa, Homo Sapiens
ITLNGKTMT

SEQ ID NO: 811853 - protein, 9 aa, Homo Sapiens
DIHFNDACH

SEQ ID NO: 811854 - protein, 9 aa, Homo Sapiens
CKVIRCQVS

SEQ ID NO: 811855 - protein, 9 aa, Homo Sapiens
LQRRQDKAG

SEQ ID NO: 811856 - protein, 9 aa, Homo Sapiens
ELQPILFSL

SEQ ID NO: 811857 - protein, 9 aa, Homo Sapiens
MGRGIVIYF

SEQ ID NO: 811858 - protein, 9 aa, Homo Sapiens
WLEDPANQF

SEQ ID NO: 811859 - protein, 9 aa, Homo Sapiens
GIGLAMLVA

SEQ ID NO: 811860 - protein, 9 aa, Homo Sapiens
VTVNKTSCT

SEQ ID NO: 811861 - protein, 9 aa, Homo Sapiens
DSFRPKLEQ

SEQ ID NO: 811862 - protein, 9 aa, Homo Sapiens
RSYCEKLYL

SEQ ID NO: 811863 - protein, 9 aa, Homo Sapiens
VCTFKMASR

SEQ ID NO: 811864 - protein, 9 aa, Homo Sapiens
GDTGGINLH

SEQ ID NO: 811865 - protein, 9 aa, Homo Sapiens
HARKYNFPI

SEQ ID NO: 811866 - protein, 9 aa, Homo Sapiens
LIIYMLIPS

SEQ ID NO: 811867 - protein, 9 aa, Homo Sapiens
AKEKTPDEN

SEQ ID NO: 811868 - protein, 9 aa, Homo Sapiens
FFNISAKHE

SEQ ID NO: 811869 - protein, 9 aa, Homo Sapiens
PNIPLSAPR

SEQ ID NO: 811870 - protein, 9 aa, Homo Sapiens
GPVTNQKAS

SEQ ID NO: 811871 - protein, 9 aa, Homo Sapiens
FGAWHVYRN

SEQ ID NO: 811872 - protein, 9 aa, Homo Sapiens
VKFSEFVKK

SEQ ID NO: 811873 - protein, 9 aa, Homo Sapiens
LYLNDLKVV

SEQ ID NO: 811874 - protein, 9 aa, Homo Sapiens
SHNNMISLK

SEQ ID NO: 811875 - protein, 9 aa, Homo Sapiens
LDNSNTFGR

SEQ ID NO: 811876 - protein, 9 aa, Homo Sapiens
ICIKIADFG

SEQ ID NO: 811877 - protein, 9 aa, Homo Sapiens
RSNTCYCCY

SEQ ID NO: 811878 - protein, 9 aa, Homo Sapiens
SQWAFCMDN

SEQ ID NO: 811879 - protein, 9 aa, Homo Sapiens
LVELHWRLM

SEQ ID NO: 811880 - protein, 9 aa, Homo Sapiens
LQEGQDPFL

SEQ ID NO: 811881 - protein, 9 aa, Homo Sapiens
NAYLIALLY

SEQ ID NO: 811882 - protein, 9 aa, Homo Sapiens
GDGDGLIIG

SEQ ID NO: 811883 - protein, 9 aa, Homo Sapiens
QHLWLVFDE

SEQ ID NO: 811884 - protein, 9 aa, Homo Sapiens
KSTRNECTT

SEQ ID NO: 811885 - protein, 9 aa, Homo Sapiens
ICGCVDKYG

SEQ ID NO: 811886 - protein, 9 aa, Homo Sapiens
VWLGLSMSK

SEQ ID NO: 811887 - protein, 9 aa, Homo Sapiens
LSGNPIKVS

SEQ ID NO: 811888 - protein, 9 aa, Homo Sapiens
GKHYKGPGV

SEQ ID NO: 811889 - protein, 9 aa, Homo Sapiens
HILDWHFAN

SEQ ID NO: 811890 - protein, 9 aa, Homo Sapiens
CYAARVNKK

SEQ ID NO: 811891 - protein, 9 aa, Homo Sapiens
IWDTVSWIF

SEQ ID NO: 811892 - protein, 9 aa, Homo Sapiens
FKKKPISKK

SEQ ID NO: 811893 - protein, 9 aa, Homo Sapiens
PDQTVTDGQ

SEQ ID NO: 811894 - protein, 9 aa, Homo Sapiens
LVEFGTAID

SEQ ID NO: 811895 - protein, 9 aa, Homo Sapiens
TSDGDQSVS

SEQ ID NO: 811896 - protein, 9 aa, Homo Sapiens
QSRGCVARA

SEQ ID NO: 811897 - protein, 9 aa, Homo Sapiens
HMPEATPKY

SEQ ID NO: 811898 - protein, 9 aa, Homo Sapiens
ELEPMTDKM

SEQ ID NO: 811899 - protein, 9 aa, Homo Sapiens
GKRYVAVAI

SEQ ID NO: 811900 - protein, 9 aa, Homo Sapiens
HPSNVKMEK

SEQ ID NO: 811901 - protein, 9 aa, Homo Sapiens
VFDRNKQTF

SEQ ID NO: 811902 - protein, 9 aa, Homo Sapiens
GKSKKFSRL

SEQ ID NO: 811903 - protein, 9 aa, Homo Sapiens
DVWSLGCIS

SEQ ID NO: 811904 - protein, 9 aa, Homo Sapiens
NGVCTDTIK

SEQ ID NO: 811905 - protein, 9 aa, Homo Sapiens
KTWWRGLRL

SEQ ID NO: 811906 - protein, 9 aa, Homo Sapiens
KEITLELSC

SEQ ID NO: 811907 - protein, 9 aa, Homo Sapiens
PYLVSIWRG

SEQ ID NO: 811908 - protein, 9 aa, Homo Sapiens
IIHEAIIQS

SEQ ID NO: 811909 - protein, 9 aa, Homo Sapiens
KGVNMVLPL

SEQ ID NO: 811910 - protein, 9 aa, Homo Sapiens
EKQITQNYL

SEQ ID NO: 811911 - protein, 9 aa, Homo Sapiens
SIPQKSRLL

SEQ ID NO: 811912 - protein, 9 aa, Homo Sapiens
SQLQMPGGT

SEQ ID NO: 811913 - protein, 9 aa, Homo Sapiens
ENVHTGDPN

SEQ ID NO: 811914 - protein, 9 aa, Homo Sapiens
QEDSLFLIS

SEQ ID NO: 811915 - protein, 9 aa, Homo Sapiens
ECTTQSNVK

SEQ ID NO: 811916 - protein, 9 aa, Homo Sapiens
TTTAGVLLG

SEQ ID NO: 811917 - protein, 9 aa, Homo Sapiens
CQRCNCNGH

SEQ ID NO: 811918 - protein, 9 aa, Homo Sapiens
KNKIAAQRC

SEQ ID NO: 811919 - protein, 9 aa, Homo Sapiens
ELEYYDVSD

SEQ ID NO: 811920 - protein, 9 aa, Homo Sapiens
SLSGLLRKS

SEQ ID NO: 811921 - protein, 9 aa, Homo Sapiens
GEEMYCKSC

SEQ ID NO: 811922 - protein, 9 aa, Homo Sapiens
GKSFCWSTS

SEQ ID NO: 811923 - protein, 9 aa, Homo Sapiens
RRGSDSEER

SEQ ID NO: 811924 - protein, 9 aa, Homo Sapiens
TPLLMGKIL

SEQ ID NO: 811925 - protein, 9 aa, Homo Sapiens
CIGDLHRSP

SEQ ID NO: 811926 - protein, 9 aa, Homo Sapiens
SQGKALQKR

SEQ ID NO: 811927 - protein, 9 aa, Homo Sapiens
TCRNQTRHL

SEQ ID NO: 811928 - protein, 9 aa, Homo Sapiens
LRSEILFGT

SEQ ID NO: 811929 - protein, 9 aa, Homo Sapiens
RGLIPSTAR

SEQ ID NO: 811930 - protein, 9 aa, Homo Sapiens
FSTDDSSAA

SEQ ID NO: 811931 - protein, 9 aa, Homo Sapiens
ALTPPKMDI

SEQ ID NO: 811932 - protein, 9 aa, Homo Sapiens
RKGHMEYLV

SEQ ID NO: 811933 - protein, 9 aa, Homo Sapiens
KTSCTVIFS

SEQ ID NO: 811934 - protein, 9 aa, Homo Sapiens
TRDEWQHLG

SEQ ID NO: 811935 - protein, 9 aa, Homo Sapiens
YAPWLNLHE

SEQ ID NO: 811936 - protein, 9 aa, Homo Sapiens
VVQDQVWNS

SEQ ID NO: 811937 - protein, 9 aa, Homo Sapiens
LFNENFRRG

SEQ ID NO: 811938 - protein, 9 aa, Homo Sapiens
FRAAAAETR

SEQ ID NO: 811939 - protein, 9 aa, Homo Sapiens
SVKFSEFVK

SEQ ID NO: 811940 - protein, 9 aa, Homo Sapiens
YINELQTFM

SEQ ID NO: 811941 - protein, 9 aa, Homo Sapiens
DSTPALHSA

SEQ ID NO: 811942 - protein, 9 aa, Homo Sapiens
NIQVEIPDF

SEQ ID NO: 811943 - protein, 9 aa, Homo Sapiens
KTQNLSKIE

SEQ ID NO: 811944 - protein, 9 aa, Homo Sapiens
VRAKAGQAQ

SEQ ID NO: 811945 - protein, 9 aa, Homo Sapiens
CEEYKTIKS

SEQ ID NO: 811946 - protein, 9 aa, Homo Sapiens
PEGQLAATT

SEQ ID NO: 811947 - protein, 9 aa, Homo Sapiens
INISKNETD

SEQ ID NO: 811948 - protein, 9 aa, Homo Sapiens
GPRGSRGDL

SEQ ID NO: 811949 - protein, 9 aa, Homo Sapiens
QETSLLKNA

SEQ ID NO: 811950 - protein, 9 aa, Homo Sapiens
SSSARALGK

SEQ ID NO: 811951 - protein, 9 aa, Homo Sapiens
KTNDQHALR

SEQ ID NO: 811952 - protein, 9 aa, Homo Sapiens
VSDCRSMSD

SEQ ID NO: 811953 - protein, 9 aa, Homo Sapiens
ISRNSERCK

SEQ ID NO: 811954 - protein, 9 aa, Homo Sapiens
RQLIKKSPS

SEQ ID NO: 811955 - protein, 9 aa, Homo Sapiens
ETTDIKELF

SEQ ID NO: 811956 - protein, 9 aa, Homo Sapiens
DCATIRKCL

SEQ ID NO: 811957 - protein, 9 aa, Homo Sapiens
ATVSSSVLT

SEQ ID NO: 811958 - protein, 9 aa, Homo Sapiens
EGRHIEVMN

SEQ ID NO: 811959 - protein, 9 aa, Homo Sapiens
IQPFLGAHK

SEQ ID NO: 811960 - protein, 9 aa, Homo Sapiens
AMGTSSSLA

SEQ ID NO: 811961 - protein, 9 aa, Homo Sapiens
DRDKPEAKA

SEQ ID NO: 811962 - protein, 9 aa, Homo Sapiens
VQDVSFKYT

SEQ ID NO: 811963 - protein, 9 aa, Homo Sapiens
KQPLMDNNR

SEQ ID NO: 811964 - protein, 9 aa, Homo Sapiens
WVRDINLKE

SEQ ID NO: 811965 - protein, 9 aa, Homo Sapiens
MGCNVCTFQ

SEQ ID NO: 811966 - protein, 9 aa, Homo Sapiens
TECVLPTVM

SEQ ID NO: 811967 - protein, 9 aa, Homo Sapiens
AARRSKSQY

SEQ ID NO: 811968 - protein, 9 aa, Homo Sapiens
HFPIKPSLQ

SEQ ID NO: 811969 - protein, 9 aa, Homo Sapiens
MNLLAVLKV

SEQ ID NO: 811970 - protein, 9 aa, Homo Sapiens
WMRLHFPIK

SEQ ID NO: 811971 - protein, 9 aa, Homo Sapiens
SSQFSGAAQ

SEQ ID NO: 811972 - protein, 9 aa, Homo Sapiens
FSNSSSANE

SEQ ID NO: 811973 - protein, 9 aa, Homo Sapiens
FELYEGPFE

SEQ ID NO: 811974 - protein, 9 aa, Homo Sapiens
KQPPWDFLQ

SEQ ID NO: 811975 - protein, 9 aa, Homo Sapiens
KCYVHNDMF

SEQ ID NO: 811976 - protein, 9 aa, Homo Sapiens
RTLPAFLCL

SEQ ID NO: 811977 - protein, 9 aa, Homo Sapiens
CWYCRRQNG

SEQ ID NO: 811978 - protein, 9 aa, Homo Sapiens
CFKKTFDEC

SEQ ID NO: 811979 - protein, 9 aa, Homo Sapiens
CNHALYAMC

SEQ ID NO: 811980 - protein, 9 aa, Homo Sapiens
RFMSSHIKS

SEQ ID NO: 811981 - protein, 9 aa, Homo Sapiens
LGEEELTSY

SEQ ID NO: 811982 - protein, 9 aa, Homo Sapiens
ERLKLEPHK

SEQ ID NO: 811983 - protein, 9 aa, Homo Sapiens
KVNQQRQQC

SEQ ID NO: 811984 - protein, 9 aa, Homo Sapiens
LGQSLAAGP

SEQ ID NO: 811985 - protein, 9 aa, Homo Sapiens
TEPWLTQRY

SEQ ID NO: 811986 - protein, 9 aa, Homo Sapiens
QDKYVNIVQ

SEQ ID NO: 811987 - protein, 9 aa, Homo Sapiens
RYLGVSSPF

SEQ ID NO: 811988 - protein, 9 aa, Homo Sapiens
FEKKLRIQS

SEQ ID NO: 811989 - protein, 9 aa, Homo Sapiens
VPGPLPYFG

SEQ ID NO: 811990 - protein, 9 aa, Homo Sapiens
AHMASQPVM

SEQ ID NO: 811991 - protein, 9 aa, Homo Sapiens
EAPYTKEED

SEQ ID NO: 811992 - protein, 9 aa, Homo Sapiens
CQGMTFIAG

SEQ ID NO: 811993 - protein, 9 aa, Homo Sapiens
VFKDNVVLD

SEQ ID NO: 811994 - protein, 9 aa, Homo Sapiens
YHAEPPEKH

SEQ ID NO: 811995 - protein, 9 aa, Homo Sapiens
DYFVFWETS

SEQ ID NO: 811996 - protein, 9 aa, Homo Sapiens
ILTPLNLQI

SEQ ID NO: 811997 - protein, 9 aa, Homo Sapiens
DKRDARNKR

SEQ ID NO: 811998 - protein, 9 aa, Homo Sapiens
EHACHCSED

SEQ ID NO: 811999 - protein, 9 aa, Homo Sapiens
QRGATWKTL

SEQ ID NO: 812000 - protein, 9 aa, Homo Sapiens
HITDNSYQC

SEQ ID NO: 812001 - protein, 9 aa, Homo Sapiens
VQRIVTMPR

SEQ ID NO: 812002 - protein, 9 aa, Homo Sapiens
RHVNISVRF

SEQ ID NO: 812003 - protein, 9 aa, Homo Sapiens
SKGFGVFNA

SEQ ID NO: 812004 - protein, 9 aa, Homo Sapiens
SAMNEEESY

SEQ ID NO: 812005 - protein, 9 aa, Homo Sapiens
QAYVALYRA

SEQ ID NO: 812006 - protein, 9 aa, Homo Sapiens
ISMECYNIY

SEQ ID NO: 812007 - protein, 9 aa, Homo Sapiens
SLHNKHPQL

SEQ ID NO: 812008 - protein, 9 aa, Homo Sapiens
QLDKYLPAP

SEQ ID NO: 812009 - protein, 9 aa, Homo Sapiens
RNNMFEILD

SEQ ID NO: 812010 - protein, 9 aa, Homo Sapiens
VVPDGPWRQ

SEQ ID NO: 812011 - protein, 9 aa, Homo Sapiens
LKDRKEDVK

SEQ ID NO: 812012 - protein, 9 aa, Homo Sapiens
PFELANTVC

SEQ ID NO: 812013 - protein, 9 aa, Homo Sapiens
TKMTAVIFS

SEQ ID NO: 812014 - protein, 9 aa, Homo Sapiens
KMVLEIIRE

SEQ ID NO: 812015 - protein, 9 aa, Homo Sapiens
MDYTIMTGG

SEQ ID NO: 812016 - protein, 9 aa, Homo Sapiens
QWAQSFENV

SEQ ID NO: 812017 - protein, 9 aa, Homo Sapiens
DHDITSQRY

SEQ ID NO: 812018 - protein, 9 aa, Homo Sapiens
KEEEEENKA

SEQ ID NO: 812019 - protein, 9 aa, Homo Sapiens
MQETSVIES

SEQ ID NO: 812020 - protein, 9 aa, Homo Sapiens
LLVKEACKL

SEQ ID NO: 812021 - protein, 9 aa, Homo Sapiens
FSEEDLQLL

SEQ ID NO: 812022 - protein, 9 aa, Homo Sapiens
KIIHSHVLR

SEQ ID NO: 812023 - protein, 9 aa, Homo Sapiens
KCKINLEIP

SEQ ID NO: 812024 - protein, 9 aa, Homo Sapiens
RIHKEEEEI

SEQ ID NO: 812025 - protein, 9 aa, Homo Sapiens
SHLHKLSLR

SEQ ID NO: 812026 - protein, 9 aa, Homo Sapiens
RLLSQEEHT

SEQ ID NO: 812027 - protein, 9 aa, Homo Sapiens
VCSSDNLFK

SEQ ID NO: 812028 - protein, 9 aa, Homo Sapiens
PPMPAYRGS

SEQ ID NO: 812029 - protein, 9 aa, Homo Sapiens
AHIVIPLPC

SEQ ID NO: 812030 - protein, 9 aa, Homo Sapiens
ASLNPRAKH

SEQ ID NO: 812031 - protein, 9 aa, Homo Sapiens
DEPHEKHRK

SEQ ID NO: 812032 - protein, 9 aa, Homo Sapiens
TINPDVDHC

SEQ ID NO: 812033 - protein, 9 aa, Homo Sapiens
LLGRQQRKS

SEQ ID NO: 812034 - protein, 9 aa, Homo Sapiens
YWLEMFDNF

SEQ ID NO: 812035 - protein, 9 aa, Homo Sapiens
MELFRNIFG

SEQ ID NO: 812036 - protein, 9 aa, Homo Sapiens
HCQDSMDVM

SEQ ID NO: 812037 - protein, 9 aa, Homo Sapiens
SQRSWNVNL

SEQ ID NO: 812038 - protein, 9 aa, Homo Sapiens
KDPHSQVGA

SEQ ID NO: 812039 - protein, 9 aa, Homo Sapiens
FVDNRYGYP

SEQ ID NO: 812040 - protein, 9 aa, Homo Sapiens
LRIAFRSFP

SEQ ID NO: 812041 - protein, 9 aa, Homo Sapiens
IFDKEELLE

SEQ ID NO: 812042 - protein, 9 aa, Homo Sapiens
CLAQTTEWS

SEQ ID NO: 812043 - protein, 9 aa, Homo Sapiens
HLQFDQARG

SEQ ID NO: 812044 - protein, 9 aa, Homo Sapiens
VNLAARMTM

SEQ ID NO: 812045 - protein, 9 aa, Homo Sapiens
KGTSQKEVN

SEQ ID NO: 812046 - protein, 9 aa, Homo Sapiens
SSNPYHNPT

SEQ ID NO: 812047 - protein, 9 aa, Homo Sapiens
VESLMELLD

SEQ ID NO: 812048 - protein, 9 aa, Homo Sapiens
EAQECERIH

SEQ ID NO: 812049 - protein, 9 aa, Homo Sapiens
ARQGQDVVP

SEQ ID NO: 812050 - protein, 9 aa, Homo Sapiens
ENPETDSHV

SEQ ID NO: 812051 - protein, 9 aa, Homo Sapiens
DVTETVNLQ

SEQ ID NO: 812052 - protein, 9 aa, Homo Sapiens
VLLLQFVMG

SEQ ID NO: 812053 - protein, 9 aa, Homo Sapiens
VKNNLSIIR

SEQ ID NO: 812054 - protein, 9 aa, Homo Sapiens
STLRQQFSC

SEQ ID NO: 812055 - protein, 9 aa, Homo Sapiens
REGTPELHL

SEQ ID NO: 812056 - protein, 9 aa, Homo Sapiens
VREGLSASP

SEQ ID NO: 812057 - protein, 9 aa, Homo Sapiens
LSGLLSLRV

SEQ ID NO: 812058 - protein, 9 aa, Homo Sapiens
GNEKLKNTE

SEQ ID NO: 812059 - protein, 9 aa, Homo Sapiens
QMLQYFITV

SEQ ID NO: 812060 - protein, 9 aa, Homo Sapiens
TAVESRYAF

SEQ ID NO: 812061 - protein, 9 aa, Homo Sapiens
EILEEPNLG

SEQ ID NO: 812062 - protein, 9 aa, Homo Sapiens
DTGLECPVC

SEQ ID NO: 812063 - protein, 9 aa, Homo Sapiens
PIFKDNNTP

SEQ ID NO: 812064 - protein, 9 aa, Homo Sapiens
EKNQLLAEI

SEQ ID NO: 812065 - protein, 9 aa, Homo Sapiens
PGQRGKTLC

SEQ ID NO: 812066 - protein, 9 aa, Homo Sapiens
FVEEYGLVD

SEQ ID NO: 812067 - protein, 9 aa, Homo Sapiens
LAPWLGDGL

SEQ ID NO: 812068 - protein, 9 aa, Homo Sapiens
PHEKHRKKR

SEQ ID NO: 812069 - protein, 9 aa, Homo Sapiens
SMYDQRPSW

SEQ ID NO: 812070 - protein, 9 aa, Homo Sapiens
VLSREEQAK

SEQ ID NO: 812071 - protein, 9 aa, Homo Sapiens
SHSHEDDNP

SEQ ID NO: 812072 - protein, 9 aa, Homo Sapiens
SKYIILKYA

SEQ ID NO: 812073 - protein, 9 aa, Homo Sapiens
ECGKFFQMK

SEQ ID NO: 812074 - protein, 9 aa, Homo Sapiens
FTNVQSHMI

SEQ ID NO: 812075 - protein, 9 aa, Homo Sapiens
SHMSQSSRY

SEQ ID NO: 812076 - protein, 9 aa, Homo Sapiens
FVSHVIYPC

SEQ ID NO: 812077 - protein, 9 aa, Homo Sapiens
QPGHENFQN

SEQ ID NO: 812078 - protein, 9 aa, Homo Sapiens
TKIISLSGC

SEQ ID NO: 812079 - protein, 9 aa, Homo Sapiens
TDTNKASIL

SEQ ID NO: 812080 - protein, 9 aa, Homo Sapiens
AFMYITILP

SEQ ID NO: 812081 - protein, 9 aa, Homo Sapiens
GIPLPDQLM

SEQ ID NO: 812082 - protein, 9 aa, Homo Sapiens
GNALVILAI

SEQ ID NO: 812083 - protein, 9 aa, Homo Sapiens
VVAIPKSFN

SEQ ID NO: 812084 - protein, 9 aa, Homo Sapiens
FCQDLEVFY

SEQ ID NO: 812085 - protein, 9 aa, Homo Sapiens
DSARDVLRA

SEQ ID NO: 812086 - protein, 9 aa, Homo Sapiens
LKEFEQLWK

SEQ ID NO: 812087 - protein, 9 aa, Homo Sapiens
NTHVPDFIL

SEQ ID NO: 812088 - protein, 9 aa, Homo Sapiens
EEREIMLKD

SEQ ID NO: 812089 - protein, 9 aa, Homo Sapiens
SRSCAREQI

SEQ ID NO: 812090 - protein, 9 aa, Homo Sapiens
CGNCKTTLG

SEQ ID NO: 812091 - protein, 9 aa, Homo Sapiens
VVLAEMLEL

SEQ ID NO: 812092 - protein, 9 aa, Homo Sapiens
YAIYLAKQN

SEQ ID NO: 812093 - protein, 9 aa, Homo Sapiens
WTCLQTIHF

SEQ ID NO: 812094 - protein, 9 aa, Homo Sapiens
FSICFTDTA

SEQ ID NO: 812095 - protein, 9 aa, Homo Sapiens
FTPEENKEY

SEQ ID NO: 812096 - protein, 9 aa, Homo Sapiens
CCSGLHSLR

SEQ ID NO: 812097 - protein, 9 aa, Homo Sapiens
KSPAAARRS

SEQ ID NO: 812098 - protein, 9 aa, Homo Sapiens
DKIDFTTGD

SEQ ID NO: 812099 - protein, 9 aa, Homo Sapiens
NRYQKEMKN

SEQ ID NO: 812100 - protein, 9 aa, Homo Sapiens
FPSGNVAKH

SEQ ID NO: 812101 - protein, 9 aa, Homo Sapiens
KDELLCAVC

SEQ ID NO: 812102 - protein, 9 aa, Homo Sapiens
GLTGRDVLT

SEQ ID NO: 812103 - protein, 9 aa, Homo Sapiens
SLFEVVCIR

SEQ ID NO: 812104 - protein, 9 aa, Homo Sapiens
AVDFHMKGK

SEQ ID NO: 812105 - protein, 9 aa, Homo Sapiens
YFDMDKIVS

SEQ ID NO: 812106 - protein, 9 aa, Homo Sapiens
GHWPQKEHF

SEQ ID NO: 812107 - protein, 9 aa, Homo Sapiens
GFQHPSELR

SEQ ID NO: 812108 - protein, 9 aa, Homo Sapiens
NLVAILISY

SEQ ID NO: 812109 - protein, 9 aa, Homo Sapiens
IMNLLIALS

SEQ ID NO: 812110 - protein, 9 aa, Homo Sapiens
NLNKAITAN

SEQ ID NO: 812111 - protein, 9 aa, Homo Sapiens
PAHILNKAG

SEQ ID NO: 812112 - protein, 9 aa, Homo Sapiens
NVLARLQQQ

SEQ ID NO: 812113 - protein, 9 aa, Homo Sapiens
SFFRDSPAG

SEQ ID NO: 812114 - protein, 9 aa, Homo Sapiens
TLVAAVHRG

SEQ ID NO: 812115 - protein, 9 aa, Homo Sapiens
VFTANTAFS

SEQ ID NO: 812116 - protein, 9 aa, Homo Sapiens
GSLDRNKLE

SEQ ID NO: 812117 - protein, 9 aa, Homo Sapiens
PHNRYALIC

SEQ ID NO: 812118 - protein, 9 aa, Homo Sapiens
VIRNRMAPV

SEQ ID NO: 812119 - protein, 9 aa, Homo Sapiens
SKIFPVRDQ

SEQ ID NO: 812120 - protein, 9 aa, Homo Sapiens
LRLSQSNPK

SEQ ID NO: 812121 - protein, 9 aa, Homo Sapiens
QANRKKITN

SEQ ID NO: 812122 - protein, 9 aa, Homo Sapiens
VIEDIGNKI

SEQ ID NO: 812123 - protein, 9 aa, Homo Sapiens
ITEIVTKPI

SEQ ID NO: 812124 - protein, 9 aa, Homo Sapiens
HCPVVTVNH

SEQ ID NO: 812125 - protein, 9 aa, Homo Sapiens
SDKFYYTEC

SEQ ID NO: 812126 - protein, 9 aa, Homo Sapiens
LNYLPEEME

SEQ ID NO: 812127 - protein, 9 aa, Homo Sapiens
LNLHELGPL

SEQ ID NO: 812128 - protein, 9 aa, Homo Sapiens
AWRVAQGEM

SEQ ID NO: 812129 - protein, 9 aa, Homo Sapiens
IVETLSNAL

SEQ ID NO: 812130 - protein, 9 aa, Homo Sapiens
QSIIFICAG

SEQ ID NO: 812131 - protein, 9 aa, Homo Sapiens
QYMLWVTKS

SEQ ID NO: 812132 - protein, 9 aa, Homo Sapiens
EELSNIAAI

SEQ ID NO: 812133 - protein, 9 aa, Homo Sapiens
IEFKVKTEM

SEQ ID NO: 812134 - protein, 9 aa, Homo Sapiens
ELAWPPKEH

SEQ ID NO: 812135 - protein, 9 aa, Homo Sapiens
VYEGDDDDE

SEQ ID NO: 812136 - protein, 9 aa, Homo Sapiens
IQNLPKPIE

SEQ ID NO: 812137 - protein, 9 aa, Homo Sapiens
QIYFKKRLS

SEQ ID NO: 812138 - protein, 9 aa, Homo Sapiens
EKSICITAM

SEQ ID NO: 812139 - protein, 9 aa, Homo Sapiens
MPLHPSAAG

SEQ ID NO: 812140 - protein, 9 aa, Homo Sapiens
ITYSFILRR

SEQ ID NO: 812141 - protein, 9 aa, Homo Sapiens
SLCMFFEPL

SEQ ID NO: 812142 - protein, 9 aa, Homo Sapiens
YVGSQFSVD

SEQ ID NO: 812143 - protein, 9 aa, Homo Sapiens
STPASEPQY

SEQ ID NO: 812144 - protein, 9 aa, Homo Sapiens
CSLECWDEL

SEQ ID NO: 812145 - protein, 9 aa, Homo Sapiens
NELSEYVRN

SEQ ID NO: 812146 - protein, 9 aa, Homo Sapiens
EIDYSTQKQ

SEQ ID NO: 812147 - protein, 9 aa, Homo Sapiens
HFRLEQVVP

SEQ ID NO: 812148 - protein, 9 aa, Homo Sapiens
ISGDELINQ

SEQ ID NO: 812149 - protein, 9 aa, Homo Sapiens
NSAGNKFTQ

SEQ ID NO: 812150 - protein, 9 aa, Homo Sapiens
DIAFQFQLH

SEQ ID NO: 812151 - protein, 9 aa, Homo Sapiens
TDLIYADKE

SEQ ID NO: 812152 - protein, 9 aa, Homo Sapiens
GKIPYECIE

SEQ ID NO: 812153 - protein, 9 aa, Homo Sapiens
KPNSPMMCP

SEQ ID NO: 812154 - protein, 9 aa, Homo Sapiens
NDGSPITYE

SEQ ID NO: 812155 - protein, 9 aa, Homo Sapiens
NCDKKGFYT

SEQ ID NO: 812156 - protein, 9 aa, Homo Sapiens
DKTSFLFRY

SEQ ID NO: 812157 - protein, 9 aa, Homo Sapiens
IHTIEELSW

SEQ ID NO: 812158 - protein, 9 aa, Homo Sapiens
QQRKMEDDK

SEQ ID NO: 812159 - protein, 9 aa, Homo Sapiens
IFEIYGFFI

SEQ ID NO: 812160 - protein, 9 aa, Homo Sapiens
FLTNLSPVD

SEQ ID NO: 812161 - protein, 9 aa, Homo Sapiens
VSLLARLGC

SEQ ID NO: 812162 - protein, 9 aa, Homo Sapiens
FRLVDNEEL

SEQ ID NO: 812163 - protein, 9 aa, Homo Sapiens
QLLVNYPEP

SEQ ID NO: 812164 - protein, 9 aa, Homo Sapiens
HYRFARIAI

SEQ ID NO: 812165 - protein, 9 aa, Homo Sapiens
FWRRQVHLW

SEQ ID NO: 812166 - protein, 9 aa, Homo Sapiens
SGPNSLHLE

SEQ ID NO: 812167 - protein, 9 aa, Homo Sapiens
YNMNNAIFS

SEQ ID NO: 812168 - protein, 9 aa, Homo Sapiens
GLLQRLFKW

SEQ ID NO: 812169 - protein, 9 aa, Homo Sapiens
YLDTKRITP

SEQ ID NO: 812170 - protein, 9 aa, Homo Sapiens
KRVIMRVYF

SEQ ID NO: 812171 - protein, 9 aa, Homo Sapiens
IMFQNLAHE

SEQ ID NO: 812172 - protein, 9 aa, Homo Sapiens
GGQPVVERW

SEQ ID NO: 812173 - protein, 9 aa, Homo Sapiens
QMWDFPGQI

SEQ ID NO: 812174 - protein, 9 aa, Homo Sapiens
DLVREGLSA

SEQ ID NO: 812175 - protein, 9 aa, Homo Sapiens
LVATLHHCL

SEQ ID NO: 812176 - protein, 9 aa, Homo Sapiens
FLGCDELSF

SEQ ID NO: 812177 - protein, 9 aa, Homo Sapiens
AKIIVLSLF

SEQ ID NO: 812178 - protein, 9 aa, Homo Sapiens
EEYEQAAAH

SEQ ID NO: 812179 - protein, 9 aa, Homo Sapiens
QICDHCSAA

SEQ ID NO: 812180 - protein, 9 aa, Homo Sapiens
SWAGLSLAF

SEQ ID NO: 812181 - protein, 9 aa, Homo Sapiens
LSPVDVSYA

SEQ ID NO: 812182 - protein, 9 aa, Homo Sapiens
KFYLYAQTS

SEQ ID NO: 812183 - protein, 9 aa, Homo Sapiens
RQIVIHRGS

SEQ ID NO: 812184 - protein, 9 aa, Homo Sapiens
EQRVKSARA

SEQ ID NO: 812185 - protein, 9 aa, Homo Sapiens
KIFQEYHYP

SEQ ID NO: 812186 - protein, 9 aa, Homo Sapiens
NIDVVDARP

SEQ ID NO: 812187 - protein, 9 aa, Homo Sapiens
KFRTTFDSE

SEQ ID NO: 812188 - protein, 9 aa, Homo Sapiens
QLHARKARV

SEQ ID NO: 812189 - protein, 9 aa, Homo Sapiens
QSLSHLPVT

SEQ ID NO: 812190 - protein, 9 aa, Homo Sapiens
PSLGALCFV

SEQ ID NO: 812191 - protein, 9 aa, Homo Sapiens
TLQDWAGSR

SEQ ID NO: 812192 - protein, 9 aa, Homo Sapiens
SSQEKRRSA

SEQ ID NO: 812193 - protein, 9 aa, Homo Sapiens
RVATLVLAP

SEQ ID NO: 812194 - protein, 9 aa, Homo Sapiens
WYIELALTS

SEQ ID NO: 812195 - protein, 9 aa, Homo Sapiens
GPTQGDMEI

SEQ ID NO: 812196 - protein, 9 aa, Homo Sapiens
HFKLMRKIG

SEQ ID NO: 812197 - protein, 9 aa, Homo Sapiens
KPCECQQCG

SEQ ID NO: 812198 - protein, 9 aa, Homo Sapiens
YVGELLRKK

SEQ ID NO: 812199 - protein, 9 aa, Homo Sapiens
YIQEGSGKR

SEQ ID NO: 812200 - protein, 9 aa, Homo Sapiens
KNIIVTGSV

SEQ ID NO: 812201 - protein, 9 aa, Homo Sapiens
MMYATLLKR

SEQ ID NO: 812202 - protein, 9 aa, Homo Sapiens
KKMTLSEFY

SEQ ID NO: 812203 - protein, 9 aa, Homo Sapiens
LLGIHLGEG

SEQ ID NO: 812204 - protein, 9 aa, Homo Sapiens
HLKGLNSPV

SEQ ID NO: 812205 - protein, 9 aa, Homo Sapiens
GILKQRPNL

SEQ ID NO: 812206 - protein, 9 aa, Homo Sapiens
LSLEYLDIF

SEQ ID NO: 812207 - protein, 9 aa, Homo Sapiens
NGGTWDGFK

SEQ ID NO: 812208 - protein, 9 aa, Homo Sapiens
HVGRPWLLN

SEQ ID NO: 812209 - protein, 9 aa, Homo Sapiens
QHQLFHTGK

SEQ ID NO: 812210 - protein, 9 aa, Homo Sapiens
HQIIHSGDR

SEQ ID NO: 812211 - protein, 9 aa, Homo Sapiens
HLDSVGDIT

SEQ ID NO: 812212 - protein, 9 aa, Homo Sapiens
TSSSFSLSS

SEQ ID NO: 812213 - protein, 9 aa, Homo Sapiens
EGLYPDPGL

SEQ ID NO: 812214 - protein, 9 aa, Homo Sapiens
FKLRLNDDN

SEQ ID NO: 812215 - protein, 9 aa, Homo Sapiens
KKNKKEKGN

SEQ ID NO: 812216 - protein, 9 aa, Homo Sapiens
RKTIVVNLI

SEQ ID NO: 812217 - protein, 9 aa, Homo Sapiens
PLVVILIAY

SEQ ID NO: 812218 - protein, 9 aa, Homo Sapiens
GEAENGEQG

SEQ ID NO: 812219 - protein, 9 aa, Homo Sapiens
EMTDDIGGL

SEQ ID NO: 812220 - protein, 9 aa, Homo Sapiens
LWYNLIELP

SEQ ID NO: 812221 - protein, 9 aa, Homo Sapiens
VGSFSSLHQ

SEQ ID NO: 812222 - protein, 9 aa, Homo Sapiens
LISYIDNPL

SEQ ID NO: 812223 - protein, 9 aa, Homo Sapiens
TIKRPSPDE

SEQ ID NO: 812224 - protein, 9 aa, Homo Sapiens
ISIVKHLCH

SEQ ID NO: 812225 - protein, 9 aa, Homo Sapiens
FDYDWYNVP

SEQ ID NO: 812226 - protein, 9 aa, Homo Sapiens
QRSSPTHHR

SEQ ID NO: 812227 - protein, 9 aa, Homo Sapiens
IRDQLKTEP

SEQ ID NO: 812228 - protein, 9 aa, Homo Sapiens
SQDLFTAFL

SEQ ID NO: 812229 - protein, 9 aa, Homo Sapiens
ASPIHFHPE

SEQ ID NO: 812230 - protein, 9 aa, Homo Sapiens
IRNRMAPVL

SEQ ID NO: 812231 - protein, 9 aa, Homo Sapiens
LTIHGIIHT

SEQ ID NO: 812232 - protein, 9 aa, Homo Sapiens
ASEEPRKMR

SEQ ID NO: 812233 - protein, 9 aa, Homo Sapiens
GPGIKIISG

SEQ ID NO: 812234 - protein, 9 aa, Homo Sapiens
IDRLDDIIV

SEQ ID NO: 812235 - protein, 9 aa, Homo Sapiens
PFKLVSTFN

SEQ ID NO: 812236 - protein, 9 aa, Homo Sapiens
EDDPENIEE

SEQ ID NO: 812237 - protein, 9 aa, Homo Sapiens
DALKQSLVA

SEQ ID NO: 812238 - protein, 9 aa, Homo Sapiens
PFAPGITDK

SEQ ID NO: 812239 - protein, 9 aa, Homo Sapiens
ENIVMAIAV

SEQ ID NO: 812240 - protein, 9 aa, Homo Sapiens
QLLDDSHEV

SEQ ID NO: 812241 - protein, 9 aa, Homo Sapiens
NRLDWKVNK

SEQ ID NO: 812242 - protein, 9 aa, Homo Sapiens
SRPKAQQKA

SEQ ID NO: 812243 - protein, 9 aa, Homo Sapiens
LTFMYLQPK

SEQ ID NO: 812244 - protein, 9 aa, Homo Sapiens
GINLCDSTQ

SEQ ID NO: 812245 - protein, 9 aa, Homo Sapiens
GLPLGYMGE

SEQ ID NO: 812246 - protein, 9 aa, Homo Sapiens
NEPSSADIF

SEQ ID NO: 812247 - protein, 9 aa, Homo Sapiens
TPDLAIQLN

SEQ ID NO: 812248 - protein, 9 aa, Homo Sapiens
QYYDVMYLS

SEQ ID NO: 812249 - protein, 9 aa, Homo Sapiens
VQKYLERLT

SEQ ID NO: 812250 - protein, 9 aa, Homo Sapiens
RYGEFLNKY

SEQ ID NO: 812251 - protein, 9 aa, Homo Sapiens
GILASVPSN

SEQ ID NO: 812252 - protein, 9 aa, Homo Sapiens
IIMFPPDCP

SEQ ID NO: 812253 - protein, 9 aa, Homo Sapiens
DILERDING

SEQ ID NO: 812254 - protein, 9 aa, Homo Sapiens
SVINCFNVE

SEQ ID NO: 812255 - protein, 9 aa, Homo Sapiens
DTITNLNKA

SEQ ID NO: 812256 - protein, 9 aa, Homo Sapiens
YSFIECDTF

SEQ ID NO: 812257 - protein, 9 aa, Homo Sapiens
PYIMEAVRE

SEQ ID NO: 812258 - protein, 9 aa, Homo Sapiens
SGQFNSGNQ

SEQ ID NO: 812259 - protein, 9 aa, Homo Sapiens
YLKIHARGH

SEQ ID NO: 812260 - protein, 9 aa, Homo Sapiens
LDDSFSAFQ

SEQ ID NO: 812261 - protein, 9 aa, Homo Sapiens
QYLALFRVA

SEQ ID NO: 812262 - protein, 9 aa, Homo Sapiens
MLFMHYQIY

SEQ ID NO: 812263 - protein, 9 aa, Homo Sapiens
MANVLRGFE

SEQ ID NO: 812264 - protein, 9 aa, Homo Sapiens
YNVVLLYPP

SEQ ID NO: 812265 - protein, 9 aa, Homo Sapiens
ALQLYFRDL

SEQ ID NO: 812266 - protein, 9 aa, Homo Sapiens
HMTRSELYL

SEQ ID NO: 812267 - protein, 9 aa, Homo Sapiens
SCKAEVNSS

SEQ ID NO: 812268 - protein, 9 aa, Homo Sapiens
NSTPDKTDM

SEQ ID NO: 812269 - protein, 9 aa, Homo Sapiens
MIINHFFGT

SEQ ID NO: 812270 - protein, 9 aa, Homo Sapiens
LSSYLGNGF

SEQ ID NO: 812271 - protein, 9 aa, Homo Sapiens
PRVISPESL

SEQ ID NO: 812272 - protein, 9 aa, Homo Sapiens
PEENKEYAH

SEQ ID NO: 812273 - protein, 9 aa, Homo Sapiens
GDKVEIGPV

SEQ ID NO: 812274 - protein, 9 aa, Homo Sapiens
RHASSLLNH

SEQ ID NO: 812275 - protein, 9 aa, Homo Sapiens
MSVMLFMHY

SEQ ID NO: 812276 - protein, 9 aa, Homo Sapiens
KNYVLNTAT

SEQ ID NO: 812277 - protein, 9 aa, Homo Sapiens
MFQDAVAFE

SEQ ID NO: 812278 - protein, 9 aa, Homo Sapiens
KRNRMHGLN

SEQ ID NO: 812279 - protein, 9 aa, Homo Sapiens
IDVDKCLRP

SEQ ID NO: 812280 - protein, 9 aa, Homo Sapiens
IKKLEDKTL

SEQ ID NO: 812281 - protein, 9 aa, Homo Sapiens
KKACKVFIP

SEQ ID NO: 812282 - protein, 9 aa, Homo Sapiens
NHIEKLNSV

SEQ ID NO: 812283 - protein, 9 aa, Homo Sapiens
GLKLIAKER

SEQ ID NO: 812284 - protein, 9 aa, Homo Sapiens
QLQAKNREP

SEQ ID NO: 812285 - protein, 9 aa, Homo Sapiens
DIPRNGTKN

SEQ ID NO: 812286 - protein, 9 aa, Homo Sapiens
GYKIKFYFN

SEQ ID NO: 812287 - protein, 9 aa, Homo Sapiens
ETKGPEMEM

SEQ ID NO: 812288 - protein, 9 aa, Homo Sapiens
KFQEGVEML

SEQ ID NO: 812289 - protein, 9 aa, Homo Sapiens
NVKFTAQEM

SEQ ID NO: 812290 - protein, 9 aa, Homo Sapiens
ETGVLYVNK

SEQ ID NO: 812291 - protein, 9 aa, Homo Sapiens
KILNNLESK

SEQ ID NO: 812292 - protein, 9 aa, Homo Sapiens
YVSINSMLE

SEQ ID NO: 812293 - protein, 9 aa, Homo Sapiens
HFDFLKVPQ

SEQ ID NO: 812294 - protein, 9 aa, Homo Sapiens
ILQHTLQLQ

SEQ ID NO: 812295 - protein, 9 aa, Homo Sapiens
ALINFWDKV

SEQ ID NO: 812296 - protein, 9 aa, Homo Sapiens
SSTSQNHSC

SEQ ID NO: 812297 - protein, 9 aa, Homo Sapiens
PQTFSNYES

SEQ ID NO: 812298 - protein, 9 aa, Homo Sapiens
CNLVHGRNV

SEQ ID NO: 812299 - protein, 9 aa, Homo Sapiens
DADIQKRLK

SEQ ID NO: 812300 - protein, 9 aa, Homo Sapiens
RQLLKKTQV

SEQ ID NO: 812301 - protein, 9 aa, Homo Sapiens
ALSLINNFQ

SEQ ID NO: 812302 - protein, 9 aa, Homo Sapiens
VDGKSLLDK

SEQ ID NO: 812303 - protein, 9 aa, Homo Sapiens
EGTSLCCGG

SEQ ID NO: 812304 - protein, 9 aa, Homo Sapiens
QSVISGVGK

SEQ ID NO: 812305 - protein, 9 aa, Homo Sapiens
IAIDHNQML

SEQ ID NO: 812306 - protein, 9 aa, Homo Sapiens
GENPFQCPQ

SEQ ID NO: 812307 - protein, 9 aa, Homo Sapiens
RAISLLVTI

SEQ ID NO: 812308 - protein, 9 aa, Homo Sapiens
VTVTLLTLG

SEQ ID NO: 812309 - protein, 9 aa, Homo Sapiens
AIERYIAIC

SEQ ID NO: 812310 - protein, 9 aa, Homo Sapiens
RSSRRVQIH

SEQ ID NO: 812311 - protein, 9 aa, Homo Sapiens
KSHLYWLDS

SEQ ID NO: 812312 - protein, 9 aa, Homo Sapiens
NGKSFSLGY

SEQ ID NO: 812313 - protein, 9 aa, Homo Sapiens
FMITSVFYM

SEQ ID NO: 812314 - protein, 9 aa, Homo Sapiens
RDCGIPLCH

SEQ ID NO: 812315 - protein, 9 aa, Homo Sapiens
GQPPMDSAG

SEQ ID NO: 812316 - protein, 9 aa, Homo Sapiens
NNQLFLLSP

SEQ ID NO: 812317 - protein, 9 aa, Homo Sapiens
YVFFNYSQA

SEQ ID NO: 812318 - protein, 9 aa, Homo Sapiens
LESLDATVA

SEQ ID NO: 812319 - protein, 9 aa, Homo Sapiens
ERRRKFMER

SEQ ID NO: 812320 - protein, 9 aa, Homo Sapiens
KDNKCPCRV

SEQ ID NO: 812321 - protein, 9 aa, Homo Sapiens
NRLKALQLN

SEQ ID NO: 812322 - protein, 9 aa, Homo Sapiens
EDKIREQEE

SEQ ID NO: 812323 - protein, 9 aa, Homo Sapiens
VTEPWLTQR

SEQ ID NO: 812324 - protein, 9 aa, Homo Sapiens
CFIDYPEKE

SEQ ID NO: 812325 - protein, 9 aa, Homo Sapiens
RSRTIIFVI

SEQ ID NO: 812326 - protein, 9 aa, Homo Sapiens
LLHQATQAA

SEQ ID NO: 812327 - protein, 9 aa, Homo Sapiens
NESSPKECI

SEQ ID NO: 812328 - protein, 9 aa, Homo Sapiens
FHVLYLATD

SEQ ID NO: 812329 - protein, 9 aa, Homo Sapiens
NNLFFSRVR

SEQ ID NO: 812330 - protein, 9 aa, Homo Sapiens
GVILGITDN

SEQ ID NO: 812331 - protein, 9 aa, Homo Sapiens
LIILVANVT

SEQ ID NO: 812332 - protein, 9 aa, Homo Sapiens
ARPRIFKII

SEQ ID NO: 812333 - protein, 9 aa, Homo Sapiens
SYINELQTF

SEQ ID NO: 812334 - protein, 9 aa, Homo Sapiens
ETDEDKLFV

SEQ ID NO: 812335 - protein, 9 aa, Homo Sapiens
ARHRIIHTG

SEQ ID NO: 812336 - protein, 9 aa, Homo Sapiens
SDFGSTKPS

SEQ ID NO: 812337 - protein, 9 aa, Homo Sapiens
RIFEGEGHI

SEQ ID NO: 812338 - protein, 9 aa, Homo Sapiens
TFLQTYSQE

SEQ ID NO: 812339 - protein, 9 aa, Homo Sapiens
FVIGGSQGD

SEQ ID NO: 812340 - protein, 9 aa, Homo Sapiens
TPQMLFHSP

SEQ ID NO: 812341 - protein, 9 aa, Homo Sapiens
KEEDKEKEE

SEQ ID NO: 812342 - protein, 9 aa, Homo Sapiens
FKCLEPTLR

SEQ ID NO: 812343 - protein, 9 aa, Homo Sapiens
PQIIHFVLC

SEQ ID NO: 812344 - protein, 9 aa, Homo Sapiens
IRCLHYEIK

SEQ ID NO: 812345 - protein, 9 aa, Homo Sapiens
TDEKPYTCD

SEQ ID NO: 812346 - protein, 9 aa, Homo Sapiens
PCKSSPPES

SEQ ID NO: 812347 - protein, 9 aa, Homo Sapiens
PTCCCPSCC

SEQ ID NO: 812348 - protein, 9 aa, Homo Sapiens
NTAFSASEI

SEQ ID NO: 812349 - protein, 9 aa, Homo Sapiens
NGFEMKLDA

SEQ ID NO: 812350 - protein, 9 aa, Homo Sapiens
PQGAAASSF

SEQ ID NO: 812351 - protein, 9 aa, Homo Sapiens
ALYSLIQIL

SEQ ID NO: 812352 - protein, 9 aa, Homo Sapiens
LSQENGEKV

SEQ ID NO: 812353 - protein, 9 aa, Homo Sapiens
VMVECFGGK

SEQ ID NO: 812354 - protein, 9 aa, Homo Sapiens
SNRKIQEHW

SEQ ID NO: 812355 - protein, 9 aa, Homo Sapiens
VLFYLWGLF

SEQ ID NO: 812356 - protein, 9 aa, Homo Sapiens
TSPMSIGHP

SEQ ID NO: 812357 - protein, 9 aa, Homo Sapiens
AFREHSSLN

SEQ ID NO: 812358 - protein, 9 aa, Homo Sapiens
GTAKDKKER

SEQ ID NO: 812359 - protein, 9 aa, Homo Sapiens
PSGLDKNKK

SEQ ID NO: 812360 - protein, 9 aa, Homo Sapiens
SYSFVQYSN

SEQ ID NO: 812361 - protein, 9 aa, Homo Sapiens
FVIAYPSHI

SEQ ID NO: 812362 - protein, 9 aa, Homo Sapiens
CMLGYVTLL

SEQ ID NO: 812363 - protein, 9 aa, Homo Sapiens
KDILPQYVS

SEQ ID NO: 812364 - protein, 9 aa, Homo Sapiens
GELMHSLEG

SEQ ID NO: 812365 - protein, 9 aa, Homo Sapiens
RERCSAYFL

SEQ ID NO: 812366 - protein, 9 aa, Homo Sapiens
KNMKEIEFK

SEQ ID NO: 812367 - protein, 9 aa, Homo Sapiens
LHPDANPME

SEQ ID NO: 812368 - protein, 9 aa, Homo Sapiens
LLEGYVGVE

SEQ ID NO: 812369 - protein, 9 aa, Homo Sapiens
PEKDKIYLS

SEQ ID NO: 812370 - protein, 9 aa, Homo Sapiens
KNPTYVGKE

SEQ ID NO: 812371 - protein, 9 aa, Homo Sapiens
EQVLLIWDN

SEQ ID NO: 812372 - protein, 9 aa, Homo Sapiens
LAGAACLVI

SEQ ID NO: 812373 - protein, 9 aa, Homo Sapiens
HDLILNTID

SEQ ID NO: 812374 - protein, 9 aa, Homo Sapiens
PHRLRRTLW

SEQ ID NO: 812375 - protein, 9 aa, Homo Sapiens
SACVHFKPN

SEQ ID NO: 812376 - protein, 9 aa, Homo Sapiens
VVLPALLKQ

SEQ ID NO: 812377 - protein, 9 aa, Homo Sapiens
PVIMVQDVS

SEQ ID NO: 812378 - protein, 9 aa, Homo Sapiens
ELNKPFSIE

SEQ ID NO: 812379 - protein, 9 aa, Homo Sapiens
NSTAWQDLY

SEQ ID NO: 812380 - protein, 9 aa, Homo Sapiens
GPGMEITNC

SEQ ID NO: 812381 - protein, 9 aa, Homo Sapiens
SGDAFVSGS

SEQ ID NO: 812382 - protein, 9 aa, Homo Sapiens
VGTLQLLDA

SEQ ID NO: 812383 - protein, 9 aa, Homo Sapiens
PRARITIIC

SEQ ID NO: 812384 - protein, 9 aa, Homo Sapiens
SVGLPHNLS

SEQ ID NO: 812385 - protein, 9 aa, Homo Sapiens
DHKVFVGRF

SEQ ID NO: 812386 - protein, 9 aa, Homo Sapiens
RTMEKELKT

SEQ ID NO: 812387 - protein, 9 aa, Homo Sapiens
KDMLYAVMQ

SEQ ID NO: 812388 - protein, 9 aa, Homo Sapiens
LAMNYSTVE

SEQ ID NO: 812389 - protein, 9 aa, Homo Sapiens
EGVEMLLNP

SEQ ID NO: 812390 - protein, 9 aa, Homo Sapiens
GNPLNTATL

SEQ ID NO: 812391 - protein, 9 aa, Homo Sapiens
WLKLIISCL

SEQ ID NO: 812392 - protein, 9 aa, Homo Sapiens
IIGIIYILF

SEQ ID NO: 812393 - protein, 9 aa, Homo Sapiens
LYQNRVPLN

SEQ ID NO: 812394 - protein, 9 aa, Homo Sapiens
PARPRIFKI

SEQ ID NO: 812395 - protein, 9 aa, Homo Sapiens
LQENLGNPS

SEQ ID NO: 812396 - protein, 9 aa, Homo Sapiens
MKEIEFKVK

SEQ ID NO: 812397 - protein, 9 aa, Homo Sapiens
DLQPWHYFG

SEQ ID NO: 812398 - protein, 9 aa, Homo Sapiens
MFLETYGFS

SEQ ID NO: 812399 - protein, 9 aa, Homo Sapiens
GESTQSGYC

SEQ ID NO: 812400 - protein, 9 aa, Homo Sapiens
QQIIIRQLQ

SEQ ID NO: 812401 - protein, 9 aa, Homo Sapiens
PDTNPRPGS

SEQ ID NO: 812402 - protein, 9 aa, Homo Sapiens
MLWVTKSEP

SEQ ID NO: 812403 - protein, 9 aa, Homo Sapiens
VTDLLGRQQ

SEQ ID NO: 812404 - protein, 9 aa, Homo Sapiens
NKVLEKAFS

SEQ ID NO: 812405 - protein, 9 aa, Homo Sapiens
FETFISASK

SEQ ID NO: 812406 - protein, 9 aa, Homo Sapiens
IRQGFCFNI

SEQ ID NO: 812407 - protein, 9 aa, Homo Sapiens
SARALGKTR

SEQ ID NO: 812408 - protein, 9 aa, Homo Sapiens
VEKITRKYS

SEQ ID NO: 812409 - protein, 9 aa, Homo Sapiens
QSRDILAGL

SEQ ID NO: 812410 - protein, 9 aa, Homo Sapiens
DSAYQGFTS

SEQ ID NO: 812411 - protein, 9 aa, Homo Sapiens
HFKLEKHSA

SEQ ID NO: 812412 - protein, 9 aa, Homo Sapiens
KRDASLKNT

SEQ ID NO: 812413 - protein, 9 aa, Homo Sapiens
IDLIKVDDN

SEQ ID NO: 812414 - protein, 9 aa, Homo Sapiens
NSASWSDNL

SEQ ID NO: 812415 - protein, 9 aa, Homo Sapiens
PITYEKCLI

SEQ ID NO: 812416 - protein, 9 aa, Homo Sapiens
GRSFHNTCF

SEQ ID NO: 812417 - protein, 9 aa, Homo Sapiens
SNIRQSSTQ

SEQ ID NO: 812418 - protein, 9 aa, Homo Sapiens
ATTPSTGSS

SEQ ID NO: 812419 - protein, 9 aa, Homo Sapiens
CGKCFTQCS

SEQ ID NO: 812420 - protein, 9 aa, Homo Sapiens
LILAHKDCP

SEQ ID NO: 812421 - protein, 9 aa, Homo Sapiens
IEEQPQSPK

SEQ ID NO: 812422 - protein, 9 aa, Homo Sapiens
DVPVVQMYS

SEQ ID NO: 812423 - protein, 9 aa, Homo Sapiens
VVPRMHEGN

SEQ ID NO: 812424 - protein, 9 aa, Homo Sapiens
SMTRPASRH

SEQ ID NO: 812425 - protein, 9 aa, Homo Sapiens
SFETNTYFN

SEQ ID NO: 812426 - protein, 9 aa, Homo Sapiens
LKRNEIQKR

SEQ ID NO: 812427 - protein, 9 aa, Homo Sapiens
TLERITRDN

SEQ ID NO: 812428 - protein, 9 aa, Homo Sapiens
CIIGPPAVG

SEQ ID NO: 812429 - protein, 9 aa, Homo Sapiens
NSSLSVSPL

SEQ ID NO: 812430 - protein, 9 aa, Homo Sapiens
RIAPKVLRG

SEQ ID NO: 812431 - protein, 9 aa, Homo Sapiens
KPVTIKEEV

SEQ ID NO: 812432 - protein, 9 aa, Homo Sapiens
LENNLLLQH

SEQ ID NO: 812433 - protein, 9 aa, Homo Sapiens
TDVAKEASN

SEQ ID NO: 812434 - protein, 9 aa, Homo Sapiens
KKVYASQQM

SEQ ID NO: 812435 - protein, 9 aa, Homo Sapiens
KCKQRRIRT

SEQ ID NO: 812436 - protein, 9 aa, Homo Sapiens
LPSSEVVKC

SEQ ID NO: 812437 - protein, 9 aa, Homo Sapiens
HHDFGYFYG

SEQ ID NO: 812438 - protein, 9 aa, Homo Sapiens
QCVLGLDPN

SEQ ID NO: 812439 - protein, 9 aa, Homo Sapiens
LCHSAWPPT

SEQ ID NO: 812440 - protein, 9 aa, Homo Sapiens
VVFKLENFQ

SEQ ID NO: 812441 - protein, 9 aa, Homo Sapiens
ASDYLMKLS

SEQ ID NO: 812442 - protein, 9 aa, Homo Sapiens
LRFLQNNSS

SEQ ID NO: 812443 - protein, 9 aa, Homo Sapiens
ALHIVSRVL

SEQ ID NO: 812444 - protein, 9 aa, Homo Sapiens
RPKAQQKAK

SEQ ID NO: 812445 - protein, 9 aa, Homo Sapiens
LLDGISVNK

SEQ ID NO: 812446 - protein, 9 aa, Homo Sapiens
AYTSPLINM

SEQ ID NO: 812447 - protein, 9 aa, Homo Sapiens
LYEQPEINR

SEQ ID NO: 812448 - protein, 9 aa, Homo Sapiens
KGIHLDKND

SEQ ID NO: 812449 - protein, 9 aa, Homo Sapiens
DTFEWEKGY

SEQ ID NO: 812450 - protein, 9 aa, Homo Sapiens
IIIYFIFKH

SEQ ID NO: 812451 - protein, 9 aa, Homo Sapiens
NSVNLDSLG

SEQ ID NO: 812452 - protein, 9 aa, Homo Sapiens
HPGEKPFEC

SEQ ID NO: 812453 - protein, 9 aa, Homo Sapiens
FDTIHSTVR

SEQ ID NO: 812454 - protein, 9 aa, Homo Sapiens
LELDPWEHQ

SEQ ID NO: 812455 - protein, 9 aa, Homo Sapiens
LRSYQRTFN

SEQ ID NO: 812456 - protein, 9 aa, Homo Sapiens
TPPTDGEGA

SEQ ID NO: 812457 - protein, 9 aa, Homo Sapiens
FISGVEIKA

SEQ ID NO: 812458 - protein, 9 aa, Homo Sapiens
DISDEEGSG

SEQ ID NO: 812459 - protein, 9 aa, Homo Sapiens
IYVSLPDAA

SEQ ID NO: 812460 - protein, 9 aa, Homo Sapiens
QYPETELYA

SEQ ID NO: 812461 - protein, 9 aa, Homo Sapiens
TGALGGPPV

SEQ ID NO: 812462 - protein, 9 aa, Homo Sapiens
EAAKRADEE

SEQ ID NO: 812463 - protein, 9 aa, Homo Sapiens
QGVDANDNP

SEQ ID NO: 812464 - protein, 9 aa, Homo Sapiens
WCLCTVNET

SEQ ID NO: 812465 - protein, 9 aa, Homo Sapiens
TSGTRTVVC

SEQ ID NO: 812466 - protein, 9 aa, Homo Sapiens
PPDEDDPRL

SEQ ID NO: 812467 - protein, 9 aa, Homo Sapiens
SEDVSQEDS

SEQ ID NO: 812468 - protein, 9 aa, Homo Sapiens
RKYNFPIDE

SEQ ID NO: 812469 - protein, 9 aa, Homo Sapiens
LWRAHEALQ

SEQ ID NO: 812470 - protein, 9 aa, Homo Sapiens
QHMSTSLMQ

SEQ ID NO: 812471 - protein, 9 aa, Homo Sapiens
NSSSNQRAT

SEQ ID NO: 812472 - protein, 9 aa, Homo Sapiens
NFDFTELDA

SEQ ID NO: 812473 - protein, 9 aa, Homo Sapiens
YINLITRQI

SEQ ID NO: 812474 - protein, 9 aa, Homo Sapiens
RSKLQNQIA

SEQ ID NO: 812475 - protein, 9 aa, Homo Sapiens
RAYTEDQNS

SEQ ID NO: 812476 - protein, 9 aa, Homo Sapiens
KLNILDSKI

SEQ ID NO: 812477 - protein, 9 aa, Homo Sapiens
NKKLDISNV

SEQ ID NO: 812478 - protein, 9 aa, Homo Sapiens
SVLRSKCKI

SEQ ID NO: 812479 - protein, 9 aa, Homo Sapiens
DIFEIHFSQ

SEQ ID NO: 812480 - protein, 9 aa, Homo Sapiens
VLEGTIKQS

SEQ ID NO: 812481 - protein, 9 aa, Homo Sapiens
AWLMTSNTE

SEQ ID NO: 812482 - protein, 9 aa, Homo Sapiens
ELEKLASQK

SEQ ID NO: 812483 - protein, 9 aa, Homo Sapiens
IKKTGQAIN

SEQ ID NO: 812484 - protein, 9 aa, Homo Sapiens
DIEITIIKI

SEQ ID NO: 812485 - protein, 9 aa, Homo Sapiens
MEAINKKMQ

SEQ ID NO: 812486 - protein, 9 aa, Homo Sapiens
LIKYLRKLK

SEQ ID NO: 812487 - protein, 9 aa, Homo Sapiens
CPFVETTWK

SEQ ID NO: 812488 - protein, 9 aa, Homo Sapiens
FLRLFSSVY

SEQ ID NO: 812489 - protein, 9 aa, Homo Sapiens
VNRNVWSQI

SEQ ID NO: 812490 - protein, 9 aa, Homo Sapiens
LLQGIQNYH

SEQ ID NO: 812491 - protein, 9 aa, Homo Sapiens
GVLDWRIQK

SEQ ID NO: 812492 - protein, 9 aa, Homo Sapiens
RTASTSFMM

SEQ ID NO: 812493 - protein, 9 aa, Homo Sapiens
LKEKANIED

SEQ ID NO: 812494 - protein, 9 aa, Homo Sapiens
TETYVRTIQ

SEQ ID NO: 812495 - protein, 9 aa, Homo Sapiens
ALKKVALRW

SEQ ID NO: 812496 - protein, 9 aa, Homo Sapiens
IYQSSDMKG

SEQ ID NO: 812497 - protein, 9 aa, Homo Sapiens
YKLILGEIT

SEQ ID NO: 812498 - protein, 9 aa, Homo Sapiens
KAAYWKALK

SEQ ID NO: 812499 - protein, 9 aa, Homo Sapiens
QINARDAKA

SEQ ID NO: 812500 - protein, 9 aa, Homo Sapiens
KNNGKHNGW

SEQ ID NO: 812501 - protein, 9 aa, Homo Sapiens
RPRRVLNTV

SEQ ID NO: 812502 - protein, 9 aa, Homo Sapiens
SLAKVRYAM

SEQ ID NO: 812503 - protein, 9 aa, Homo Sapiens
LRIQQMKSQ

SEQ ID NO: 812504 - protein, 9 aa, Homo Sapiens
EECIEEEDQ

SEQ ID NO: 812505 - protein, 9 aa, Homo Sapiens
YLDKYEQFF

SEQ ID NO: 812506 - protein, 9 aa, Homo Sapiens
SAFTSPIPD

SEQ ID NO: 812507 - protein, 9 aa, Homo Sapiens
INYYKLSSK

SEQ ID NO: 812508 - protein, 9 aa, Homo Sapiens
QNRSNLETI

SEQ ID NO: 812509 - protein, 9 aa, Homo Sapiens
VQHWKPSFG

SEQ ID NO: 812510 - protein, 9 aa, Homo Sapiens
HKNPNAGQV

SEQ ID NO: 812511 - protein, 9 aa, Homo Sapiens
IDYFVFWET

SEQ ID NO: 812512 - protein, 9 aa, Homo Sapiens
QEQTTAFLD

SEQ ID NO: 812513 - protein, 9 aa, Homo Sapiens
MDAACFGEI

SEQ ID NO: 812514 - protein, 9 aa, Homo Sapiens
YIASTSYLI

SEQ ID NO: 812515 - protein, 9 aa, Homo Sapiens
DEVHYLLQA

SEQ ID NO: 812516 - protein, 9 aa, Homo Sapiens
TPQSVLLEL

SEQ ID NO: 812517 - protein, 9 aa, Homo Sapiens
CHVAVRKYE

SEQ ID NO: 812518 - protein, 9 aa, Homo Sapiens
SQNNLASLI

SEQ ID NO: 812519 - protein, 9 aa, Homo Sapiens
QVENGRVIT

SEQ ID NO: 812520 - protein, 9 aa, Homo Sapiens
LNYQVTLHS

SEQ ID NO: 812521 - protein, 9 aa, Homo Sapiens
NSFMWPNIT

SEQ ID NO: 812522 - protein, 9 aa, Homo Sapiens
ACHDLIKAA

SEQ ID NO: 812523 - protein, 9 aa, Homo Sapiens
VPKGTSESL

SEQ ID NO: 812524 - protein, 9 aa, Homo Sapiens
FVKQLEIHQ

SEQ ID NO: 812525 - protein, 9 aa, Homo Sapiens
DNCPHKFLQ

SEQ ID NO: 812526 - protein, 9 aa, Homo Sapiens
QDLKRTGLK

SEQ ID NO: 812527 - protein, 9 aa, Homo Sapiens
LGPQIQIGQ

SEQ ID NO: 812528 - protein, 9 aa, Homo Sapiens
VCVEGIVTT

SEQ ID NO: 812529 - protein, 9 aa, Homo Sapiens
RLQTLQSNG

SEQ ID NO: 812530 - protein, 9 aa, Homo Sapiens
AKIVKDLMP

SEQ ID NO: 812531 - protein, 9 aa, Homo Sapiens
PQIFPAMAK

SEQ ID NO: 812532 - protein, 9 aa, Homo Sapiens
YCEVDIYEC

SEQ ID NO: 812533 - protein, 9 aa, Homo Sapiens
GAWALPCFP

SEQ ID NO: 812534 - protein, 9 aa, Homo Sapiens
YKNRTNCDI

SEQ ID NO: 812535 - protein, 9 aa, Homo Sapiens
PKFLKTSPV

SEQ ID NO: 812536 - protein, 9 aa, Homo Sapiens
ISVPPQPPY

SEQ ID NO: 812537 - protein, 9 aa, Homo Sapiens
LLDPYSAFL

SEQ ID NO: 812538 - protein, 9 aa, Homo Sapiens
EEVQTFLQT

SEQ ID NO: 812539 - protein, 9 aa, Homo Sapiens
AKQKQLKSK

SEQ ID NO: 812540 - protein, 9 aa, Homo Sapiens
QSSTEIVNV

SEQ ID NO: 812541 - protein, 9 aa, Homo Sapiens
NEILVKRYL

SEQ ID NO: 812542 - protein, 9 aa, Homo Sapiens
IVITDTGQL

SEQ ID NO: 812543 - protein, 9 aa, Homo Sapiens
FVMEAIIMR

SEQ ID NO: 812544 - protein, 9 aa, Homo Sapiens
CCEYKHRTG

SEQ ID NO: 812545 - protein, 9 aa, Homo Sapiens
LRKQMWGDL

SEQ ID NO: 812546 - protein, 9 aa, Homo Sapiens
VSPGSSSPG

SEQ ID NO: 812547 - protein, 9 aa, Homo Sapiens
VIQSKGITF

SEQ ID NO: 812548 - protein, 9 aa, Homo Sapiens
RYIHSKDKP

SEQ ID NO: 812549 - protein, 9 aa, Homo Sapiens
SASGLPLGY

SEQ ID NO: 812550 - protein, 9 aa, Homo Sapiens
VQQLRENNF

SEQ ID NO: 812551 - protein, 9 aa, Homo Sapiens
SHESPPCLH

SEQ ID NO: 812552 - protein, 9 aa, Homo Sapiens
QKTRLTVNY

SEQ ID NO: 812553 - protein, 9 aa, Homo Sapiens
KAVDQDNTE

SEQ ID NO: 812554 - protein, 9 aa, Homo Sapiens
SQACKLLLA

SEQ ID NO: 812555 - protein, 9 aa, Homo Sapiens
NKIVETIEK

SEQ ID NO: 812556 - protein, 9 aa, Homo Sapiens
MCQPCECHG

SEQ ID NO: 812557 - protein, 9 aa, Homo Sapiens
LERYQNNNP

SEQ ID NO: 812558 - protein, 9 aa, Homo Sapiens
LTASFSVQQ

SEQ ID NO: 812559 - protein, 9 aa, Homo Sapiens
VFRHRNPPL

SEQ ID NO: 812560 - protein, 9 aa, Homo Sapiens
LPDRTGAPG

SEQ ID NO: 812561 - protein, 9 aa, Homo Sapiens
GSFSQVTVS

SEQ ID NO: 812562 - protein, 9 aa, Homo Sapiens
ITGEIWLRK

SEQ ID NO: 812563 - protein, 9 aa, Homo Sapiens
VECYMYRII

SEQ ID NO: 812564 - protein, 9 aa, Homo Sapiens
LEVVEVKSW

SEQ ID NO: 812565 - protein, 9 aa, Homo Sapiens
LPSRYHSLL

SEQ ID NO: 812566 - protein, 9 aa, Homo Sapiens
VRGNAIYGL

SEQ ID NO: 812567 - protein, 9 aa, Homo Sapiens
TWDGFKCQC

SEQ ID NO: 812568 - protein, 9 aa, Homo Sapiens
NNRIEERLN

SEQ ID NO: 812569 - protein, 9 aa, Homo Sapiens
GNPKSVILF

SEQ ID NO: 812570 - protein, 9 aa, Homo Sapiens
HKVSYLRSG

SEQ ID NO: 812571 - protein, 9 aa, Homo Sapiens
DRGVVSVFV

SEQ ID NO: 812572 - protein, 9 aa, Homo Sapiens
QSSGFGHKY

SEQ ID NO: 812573 - protein, 9 aa, Homo Sapiens
VKKAPGVAD

SEQ ID NO: 812574 - protein, 9 aa, Homo Sapiens
YMSTLLAEG

SEQ ID NO: 812575 - protein, 9 aa, Homo Sapiens
LLITIHNRK

SEQ ID NO: 812576 - protein, 9 aa, Homo Sapiens
TLSLERTNK

SEQ ID NO: 812577 - protein, 9 aa, Homo Sapiens
NQETSNILS

SEQ ID NO: 812578 - protein, 9 aa, Homo Sapiens
KNIFVGGLS

SEQ ID NO: 812579 - protein, 9 aa, Homo Sapiens
ASGLEKTTT

SEQ ID NO: 812580 - protein, 9 aa, Homo Sapiens
HLSSPAKNL

SEQ ID NO: 812581 - protein, 9 aa, Homo Sapiens
RIQYCIPSP

SEQ ID NO: 812582 - protein, 9 aa, Homo Sapiens
VLYTLSDYA

SEQ ID NO: 812583 - protein, 9 aa, Homo Sapiens
LAVGKHNGT

SEQ ID NO: 812584 - protein, 9 aa, Homo Sapiens
KMATNRTGQ

SEQ ID NO: 812585 - protein, 9 aa, Homo Sapiens
SAAAAAVVH

SEQ ID NO: 812586 - protein, 9 aa, Homo Sapiens
QGIPPFLAV

SEQ ID NO: 812587 - protein, 9 aa, Homo Sapiens
QYAAPGSLI

SEQ ID NO: 812588 - protein, 9 aa, Homo Sapiens
FNDTHKSIW

SEQ ID NO: 812589 - protein, 9 aa, Homo Sapiens
LNTAGHPEP

SEQ ID NO: 812590 - protein, 9 aa, Homo Sapiens
EEHMAENKE

SEQ ID NO: 812591 - protein, 9 aa, Homo Sapiens
HLTDLSHLI

SEQ ID NO: 812592 - protein, 9 aa, Homo Sapiens
TITNIGIQE

SEQ ID NO: 812593 - protein, 9 aa, Homo Sapiens
PVKPSILNV

SEQ ID NO: 812594 - protein, 9 aa, Homo Sapiens
QFFLLFLSF

SEQ ID NO: 812595 - protein, 9 aa, Homo Sapiens
MDKPFLIFD

SEQ ID NO: 812596 - protein, 9 aa, Homo Sapiens
VVEEWWSEF

SEQ ID NO: 812597 - protein, 9 aa, Homo Sapiens
YCNLEDKLA

SEQ ID NO: 812598 - protein, 9 aa, Homo Sapiens
SSHFVLANG

SEQ ID NO: 812599 - protein, 9 aa, Homo Sapiens
KALSKSCTM

SEQ ID NO: 812600 - protein, 9 aa, Homo Sapiens
RRFTEIYKF

SEQ ID NO: 812601 - protein, 9 aa, Homo Sapiens
IQMMTRGHL

SEQ ID NO: 812602 - protein, 9 aa, Homo Sapiens
RRFVHDQGC

SEQ ID NO: 812603 - protein, 9 aa, Homo Sapiens
DHMFQIYQT

SEQ ID NO: 812604 - protein, 9 aa, Homo Sapiens
MLLGEEKFS

SEQ ID NO: 812605 - protein, 9 aa, Homo Sapiens
TPEETLLTY

SEQ ID NO: 812606 - protein, 9 aa, Homo Sapiens
EYFFDRNSP

SEQ ID NO: 812607 - protein, 9 aa, Homo Sapiens
ALKVIKFLI

SEQ ID NO: 812608 - protein, 9 aa, Homo Sapiens
GREGAKRAL

SEQ ID NO: 812609 - protein, 9 aa, Homo Sapiens
RKHREVCKV

SEQ ID NO: 812610 - protein, 9 aa, Homo Sapiens
LEPLYFPIR

SEQ ID NO: 812611 - protein, 9 aa, Homo Sapiens
ERLAPGHFD

SEQ ID NO: 812612 - protein, 9 aa, Homo Sapiens
EFIQALHPD

SEQ ID NO: 812613 - protein, 9 aa, Homo Sapiens
LPTPACKNL

SEQ ID NO: 812614 - protein, 9 aa, Homo Sapiens
SAFLDSHPK

SEQ ID NO: 812615 - protein, 9 aa, Homo Sapiens
YLYLMKMPV

SEQ ID NO: 812616 - protein, 9 aa, Homo Sapiens
EETTTQNQG

SEQ ID NO: 812617 - protein, 9 aa, Homo Sapiens
PLVMTLNYL

SEQ ID NO: 812618 - protein, 9 aa, Homo Sapiens
TLPTYHLPP

SEQ ID NO: 812619 - protein, 9 aa, Homo Sapiens
ATKDTPIKI

SEQ ID NO: 812620 - protein, 9 aa, Homo Sapiens
CNGKPDSLF

SEQ ID NO: 812621 - protein, 9 aa, Homo Sapiens
NIEERKKSK

SEQ ID NO: 812622 - protein, 9 aa, Homo Sapiens
RERLIIWAV

SEQ ID NO: 812623 - protein, 9 aa, Homo Sapiens
DSELEPMTD

SEQ ID NO: 812624 - protein, 9 aa, Homo Sapiens
AHKICEGLG

SEQ ID NO: 812625 - protein, 9 aa, Homo Sapiens
TRFIFLGFP

SEQ ID NO: 812626 - protein, 9 aa, Homo Sapiens
WCKCKKVKP

SEQ ID NO: 812627 - protein, 9 aa, Homo Sapiens
IRDDMIPKE

SEQ ID NO: 812628 - protein, 9 aa, Homo Sapiens
DAMNNSTKE

SEQ ID NO: 812629 - protein, 9 aa, Homo Sapiens
ETSKIKVLE

SEQ ID NO: 812630 - protein, 9 aa, Homo Sapiens
NLAFAQLII

SEQ ID NO: 812631 - protein, 9 aa, Homo Sapiens
RAHAETSKI

SEQ ID NO: 812632 - protein, 9 aa, Homo Sapiens
GGDEYDGGY

SEQ ID NO: 812633 - protein, 9 aa, Homo Sapiens
LVSVRVYFN

SEQ ID NO: 812634 - protein, 9 aa, Homo Sapiens
TESVRWISQ

SEQ ID NO: 812635 - protein, 9 aa, Homo Sapiens
LDNNEAVIL

SEQ ID NO: 812636 - protein, 9 aa, Homo Sapiens
MTIRDDMIP

SEQ ID NO: 812637 - protein, 9 aa, Homo Sapiens
LTDKSYDDP

SEQ ID NO: 812638 - protein, 9 aa, Homo Sapiens
VIGGSQGDA

SEQ ID NO: 812639 - protein, 9 aa, Homo Sapiens
WGKVFPPAA

SEQ ID NO: 812640 - protein, 9 aa, Homo Sapiens
CGLNPVIYA

SEQ ID NO: 812641 - protein, 9 aa, Homo Sapiens
RLYVGAQDH

SEQ ID NO: 812642 - protein, 9 aa, Homo Sapiens
LKLHKSNAS

SEQ ID NO: 812643 - protein, 9 aa, Homo Sapiens
YLTPYTDSD

SEQ ID NO: 812644 - protein, 9 aa, Homo Sapiens
PKHCPVVTV

SEQ ID NO: 812645 - protein, 9 aa, Homo Sapiens
GACNNRTMK

SEQ ID NO: 812646 - protein, 9 aa, Homo Sapiens
ISMIFIKGS

SEQ ID NO: 812647 - protein, 9 aa, Homo Sapiens
SIFTHFHST

SEQ ID NO: 812648 - protein, 9 aa, Homo Sapiens
IKVSNRKIQ

SEQ ID NO: 812649 - protein, 9 aa, Homo Sapiens
MPKHLNSPN

SEQ ID NO: 812650 - protein, 9 aa, Homo Sapiens
ATFLDIPES

SEQ ID NO: 812651 - protein, 9 aa, Homo Sapiens
GAWACGYRG

SEQ ID NO: 812652 - protein, 9 aa, Homo Sapiens
ENAYQMCLT

SEQ ID NO: 812653 - protein, 9 aa, Homo Sapiens
TGKMELCAK

SEQ ID NO: 812654 - protein, 9 aa, Homo Sapiens
TTVSQYPET

SEQ ID NO: 812655 - protein, 9 aa, Homo Sapiens
NNPATEESG

SEQ ID NO: 812656 - protein, 9 aa, Homo Sapiens
SRITRNFSN

SEQ ID NO: 812657 - protein, 9 aa, Homo Sapiens
QLLAEITKE

SEQ ID NO: 812658 - protein, 9 aa, Homo Sapiens
ILKRLIINF

SEQ ID NO: 812659 - protein, 9 aa, Homo Sapiens
FQLCIVLGY

SEQ ID NO: 812660 - protein, 9 aa, Homo Sapiens
HPILSYFFG

SEQ ID NO: 812661 - protein, 9 aa, Homo Sapiens
REHIEKLEQ

SEQ ID NO: 812662 - protein, 9 aa, Homo Sapiens
TKVLEVPEM

SEQ ID NO: 812663 - protein, 9 aa, Homo Sapiens
GKLWSWGQN

SEQ ID NO: 812664 - protein, 9 aa, Homo Sapiens
SKSRTAEKT

SEQ ID NO: 812665 - protein, 9 aa, Homo Sapiens
WIPLLLVVG

SEQ ID NO: 812666 - protein, 9 aa, Homo Sapiens
TAADSGTEC

SEQ ID NO: 812667 - protein, 9 aa, Homo Sapiens
LPYYMLNLK

SEQ ID NO: 812668 - protein, 9 aa, Homo Sapiens
STNMDKVLL

SEQ ID NO: 812669 - protein, 9 aa, Homo Sapiens
TKYLGNEKR

SEQ ID NO: 812670 - protein, 9 aa, Homo Sapiens
IFTVEYLLC

SEQ ID NO: 812671 - protein, 9 aa, Homo Sapiens
DKSTEPKTK

SEQ ID NO: 812672 - protein, 9 aa, Homo Sapiens
VSVLEKTYP

SEQ ID NO: 812673 - protein, 9 aa, Homo Sapiens
TIGCIAFST

SEQ ID NO: 812674 - protein, 9 aa, Homo Sapiens
PENTLMMDA

SEQ ID NO: 812675 - protein, 9 aa, Homo Sapiens
PFHLWIRRN

SEQ ID NO: 812676 - protein, 9 aa, Homo Sapiens
ERGAFIGIS

SEQ ID NO: 812677 - protein, 9 aa, Homo Sapiens
PPKTYKSKN

SEQ ID NO: 812678 - protein, 9 aa, Homo Sapiens
AHRDHLQFD

SEQ ID NO: 812679 - protein, 9 aa, Homo Sapiens
SEEELKGKN

SEQ ID NO: 812680 - protein, 9 aa, Homo Sapiens
RQNKLQAEA

SEQ ID NO: 812681 - protein, 9 aa, Homo Sapiens
IANIMKTLT

SEQ ID NO: 812682 - protein, 9 aa, Homo Sapiens
LEVRIVVSN

SEQ ID NO: 812683 - protein, 9 aa, Homo Sapiens
HSVKQQNTI

SEQ ID NO: 812684 - protein, 9 aa, Homo Sapiens
HVSFKLFAD

SEQ ID NO: 812685 - protein, 9 aa, Homo Sapiens
CILLGFSDR

SEQ ID NO: 812686 - protein, 9 aa, Homo Sapiens
YSNSIRYHK

SEQ ID NO: 812687 - protein, 9 aa, Homo Sapiens
VVGYRKTLN

SEQ ID NO: 812688 - protein, 9 aa, Homo Sapiens
KNLVNNLQK

SEQ ID NO: 812689 - protein, 9 aa, Homo Sapiens
CVWLDSDAT

SEQ ID NO: 812690 - protein, 9 aa, Homo Sapiens
AGQAQVKQE

SEQ ID NO: 812691 - protein, 9 aa, Homo Sapiens
ISNIRQSST

SEQ ID NO: 812692 - protein, 9 aa, Homo Sapiens
QRAKRNTVL

SEQ ID NO: 812693 - protein, 9 aa, Homo Sapiens
FTIYEMLQN

SEQ ID NO: 812694 - protein, 9 aa, Homo Sapiens
EHILKRVRR

SEQ ID NO: 812695 - protein, 9 aa, Homo Sapiens
QNGDSGSLG

SEQ ID NO: 812696 - protein, 9 aa, Homo Sapiens
NLGKVHSIV

SEQ ID NO: 812697 - protein, 9 aa, Homo Sapiens
RPRGKTGSG

SEQ ID NO: 812698 - protein, 9 aa, Homo Sapiens
YQGIKVEAS

SEQ ID NO: 812699 - protein, 9 aa, Homo Sapiens
GKLSKRLTH

SEQ ID NO: 812700 - protein, 9 aa, Homo Sapiens
GPVISKGQQ

SEQ ID NO: 812701 - protein, 9 aa, Homo Sapiens
NNGSLFAFR

SEQ ID NO: 812702 - protein, 9 aa, Homo Sapiens
NLQDCLQAA

SEQ ID NO: 812703 - protein, 9 aa, Homo Sapiens
KLTFKPDTN

SEQ ID NO: 812704 - protein, 9 aa, Homo Sapiens
FVSGYRNEF

SEQ ID NO: 812705 - protein, 9 aa, Homo Sapiens
KGTAFLSIT

SEQ ID NO: 812706 - protein, 9 aa, Homo Sapiens
LGMTSMSLE

SEQ ID NO: 812707 - protein, 9 aa, Homo Sapiens
VPNEELLMV

SEQ ID NO: 812708 - protein, 9 aa, Homo Sapiens
RGKKGAVTK

SEQ ID NO: 812709 - protein, 9 aa, Homo Sapiens
SLFERLRSA

SEQ ID NO: 812710 - protein, 9 aa, Homo Sapiens
GRVALLLGG

SEQ ID NO: 812711 - protein, 9 aa, Homo Sapiens
SMQGAVAVT

SEQ ID NO: 812712 - protein, 9 aa, Homo Sapiens
KAINRTIFQ

SEQ ID NO: 812713 - protein, 9 aa, Homo Sapiens
KPYRCKKCE

SEQ ID NO: 812714 - protein, 9 aa, Homo Sapiens
FENESKILQ

SEQ ID NO: 812715 - protein, 9 aa, Homo Sapiens
HVDVKINNA

SEQ ID NO: 812716 - protein, 9 aa, Homo Sapiens
YKVAHSQGE

SEQ ID NO: 812717 - protein, 9 aa, Homo Sapiens
KSPTKKEKC

SEQ ID NO: 812718 - protein, 9 aa, Homo Sapiens
FRPHYMFLF

SEQ ID NO: 812719 - protein, 9 aa, Homo Sapiens
DKEELNKLR

SEQ ID NO: 812720 - protein, 9 aa, Homo Sapiens
KILKGSGVD

SEQ ID NO: 812721 - protein, 9 aa, Homo Sapiens
IVHKITHTG

SEQ ID NO: 812722 - protein, 9 aa, Homo Sapiens
FPLKDAETG

SEQ ID NO: 812723 - protein, 9 aa, Homo Sapiens
TGRFMGHRR

SEQ ID NO: 812724 - protein, 9 aa, Homo Sapiens
IGLAMLVAL

SEQ ID NO: 812725 - protein, 9 aa, Homo Sapiens
AENDTYDSS

SEQ ID NO: 812726 - protein, 9 aa, Homo Sapiens
ATYLQQRYL

SEQ ID NO: 812727 - protein, 9 aa, Homo Sapiens
EPLSSNTLQ

SEQ ID NO: 812728 - protein, 9 aa, Homo Sapiens
SVHILSWFH

SEQ ID NO: 812729 - protein, 9 aa, Homo Sapiens
DSLLLGKSL

SEQ ID NO: 812730 - protein, 9 aa, Homo Sapiens
LARIADSCA

SEQ ID NO: 812731 - protein, 9 aa, Homo Sapiens
YWWLCWKLV

SEQ ID NO: 812732 - protein, 9 aa, Homo Sapiens
SWGNPGFTC

SEQ ID NO: 812733 - protein, 9 aa, Homo Sapiens
KTTDFGLSK

SEQ ID NO: 812734 - protein, 9 aa, Homo Sapiens
SHNMTLQWK

SEQ ID NO: 812735 - protein, 9 aa, Homo Sapiens
VRELFFRVA

SEQ ID NO: 812736 - protein, 9 aa, Homo Sapiens
GDVWNMGVV

SEQ ID NO: 812737 - protein, 9 aa, Homo Sapiens
DLENLPATS

SEQ ID NO: 812738 - protein, 9 aa, Homo Sapiens
TFCGRPCHL

SEQ ID NO: 812739 - protein, 9 aa, Homo Sapiens
YFALLGDLT

SEQ ID NO: 812740 - protein, 9 aa, Homo Sapiens
TLKTNLPVQ

SEQ ID NO: 812741 - protein, 9 aa, Homo Sapiens
QNYLKVLAE

SEQ ID NO: 812742 - protein, 9 aa, Homo Sapiens
YYNYDSSSW

SEQ ID NO: 812743 - protein, 9 aa, Homo Sapiens
RIKALHAKL

SEQ ID NO: 812744 - protein, 9 aa, Homo Sapiens
IRNQLRYIN

SEQ ID NO: 812745 - protein, 9 aa, Homo Sapiens
EVVCIRWVY

SEQ ID NO: 812746 - protein, 9 aa, Homo Sapiens
NLDSLGGEP

SEQ ID NO: 812747 - protein, 9 aa, Homo Sapiens
GSLLNNAIQ

SEQ ID NO: 812748 - protein, 9 aa, Homo Sapiens
GLARTASTS

SEQ ID NO: 812749 - protein, 9 aa, Homo Sapiens
QVPENMSIG

SEQ ID NO: 812750 - protein, 9 aa, Homo Sapiens
LMREVIHPL

SEQ ID NO: 812751 - protein, 9 aa, Homo Sapiens
PSGPSLGAI

SEQ ID NO: 812752 - protein, 9 aa, Homo Sapiens
RICKAEGLG

SEQ ID NO: 812753 - protein, 9 aa, Homo Sapiens
AYDKRFPTC

SEQ ID NO: 812754 - protein, 9 aa, Homo Sapiens
YENMKRALN

SEQ ID NO: 812755 - protein, 9 aa, Homo Sapiens
LEDNNKLIS

SEQ ID NO: 812756 - protein, 9 aa, Homo Sapiens
GLYGTPDSI

SEQ ID NO: 812757 - protein, 9 aa, Homo Sapiens
AKYTTSAVL

SEQ ID NO: 812758 - protein, 9 aa, Homo Sapiens
SPGEILLIP

SEQ ID NO: 812759 - protein, 9 aa, Homo Sapiens
LSSNKICSL

SEQ ID NO: 812760 - protein, 9 aa, Homo Sapiens
FLNKYHKKK

SEQ ID NO: 812761 - protein, 9 aa, Homo Sapiens
LCSFTKDAH

SEQ ID NO: 812762 - protein, 9 aa, Homo Sapiens
AVPEPSEYP

SEQ ID NO: 812763 - protein, 9 aa, Homo Sapiens
PPRAGNTGG

SEQ ID NO: 812764 - protein, 9 aa, Homo Sapiens
HKLRREVED

SEQ ID NO: 812765 - protein, 9 aa, Homo Sapiens
IKYMTALHS

SEQ ID NO: 812766 - protein, 9 aa, Homo Sapiens
EERKHTLEM

SEQ ID NO: 812767 - protein, 9 aa, Homo Sapiens
RNQLCYSES

SEQ ID NO: 812768 - protein, 9 aa, Homo Sapiens
SSIVYLYKK

SEQ ID NO: 812769 - protein, 9 aa, Homo Sapiens
FRKDSVINI

SEQ ID NO: 812770 - protein, 9 aa, Homo Sapiens
RMIFAATLC

SEQ ID NO: 812771 - protein, 9 aa, Homo Sapiens
TDTSTDKEI

SEQ ID NO: 812772 - protein, 9 aa, Homo Sapiens
QCRQSLLLL

SEQ ID NO: 812773 - protein, 9 aa, Homo Sapiens
RRPTLQPEP

SEQ ID NO: 812774 - protein, 9 aa, Homo Sapiens
AHQKLFRHK

SEQ ID NO: 812775 - protein, 9 aa, Homo Sapiens
QTQGQVTGS

SEQ ID NO: 812776 - protein, 9 aa, Homo Sapiens
PVRLYEDAE

SEQ ID NO: 812777 - protein, 9 aa, Homo Sapiens
HLTVVAMHY

SEQ ID NO: 812778 - protein, 9 aa, Homo Sapiens
PPFCLGTGY

SEQ ID NO: 812779 - protein, 9 aa, Homo Sapiens
EYLGRPIPP

SEQ ID NO: 812780 - protein, 9 aa, Homo Sapiens
YLDEQEGVK

SEQ ID NO: 812781 - protein, 9 aa, Homo Sapiens
ASLAFISLA

SEQ ID NO: 812782 - protein, 9 aa, Homo Sapiens
LNLLVKAEP

SEQ ID NO: 812783 - protein, 9 aa, Homo Sapiens
VSTFEQCQE

SEQ ID NO: 812784 - protein, 9 aa, Homo Sapiens
KTKENPLKT

SEQ ID NO: 812785 - protein, 9 aa, Homo Sapiens
TRAEMTKNW

SEQ ID NO: 812786 - protein, 9 aa, Homo Sapiens
ADNPLHQPS

SEQ ID NO: 812787 - protein, 9 aa, Homo Sapiens
SNELFQGGP

SEQ ID NO: 812788 - protein, 9 aa, Homo Sapiens
NILSLMTRE

SEQ ID NO: 812789 - protein, 9 aa, Homo Sapiens
EQDQEERRW

SEQ ID NO: 812790 - protein, 9 aa, Homo Sapiens
CFTDTAVVA

SEQ ID NO: 812791 - protein, 9 aa, Homo Sapiens
TIEGMTVTV

SEQ ID NO: 812792 - protein, 9 aa, Homo Sapiens
CFQTHERPH

SEQ ID NO: 812793 - protein, 9 aa, Homo Sapiens
ALMNLHNNI

SEQ ID NO: 812794 - protein, 9 aa, Homo Sapiens
VLLVLMAYD

SEQ ID NO: 812795 - protein, 9 aa, Homo Sapiens
NLKLPLQFQ

SEQ ID NO: 812796 - protein, 9 aa, Homo Sapiens
AGPPGFPGD

SEQ ID NO: 812797 - protein, 9 aa, Homo Sapiens
ISSLPLPIL

SEQ ID NO: 812798 - protein, 9 aa, Homo Sapiens
WIPPFPKRS

SEQ ID NO: 812799 - protein, 9 aa, Homo Sapiens
PSSSVDLNR

SEQ ID NO: 812800 - protein, 9 aa, Homo Sapiens
DVDKCLRPD

SEQ ID NO: 812801 - protein, 9 aa, Homo Sapiens
SPQRVPQVR

SEQ ID NO: 812802 - protein, 9 aa, Homo Sapiens
GINLMRQKK

SEQ ID NO: 812803 - protein, 9 aa, Homo Sapiens
HVVACSVEP

SEQ ID NO: 812804 - protein, 9 aa, Homo Sapiens
QSQEASPQV

SEQ ID NO: 812805 - protein, 9 aa, Homo Sapiens
TDNEKMTYT

SEQ ID NO: 812806 - protein, 9 aa, Homo Sapiens
HWRLMALRE

SEQ ID NO: 812807 - protein, 9 aa, Homo Sapiens
YFVGCFAQM

SEQ ID NO: 812808 - protein, 9 aa, Homo Sapiens
DNEKMTYTP

SEQ ID NO: 812809 - protein, 9 aa, Homo Sapiens
NLKLLQLKL

SEQ ID NO: 812810 - protein, 9 aa, Homo Sapiens
HQRRHTGDK

SEQ ID NO: 812811 - protein, 9 aa, Homo Sapiens
CSTNFITYD

SEQ ID NO: 812812 - protein, 9 aa, Homo Sapiens
DEFMETKST

SEQ ID NO: 812813 - protein, 9 aa, Homo Sapiens
HGEFRQDIT

SEQ ID NO: 812814 - protein, 9 aa, Homo Sapiens
QEIKNKSSD

SEQ ID NO: 812815 - protein, 9 aa, Homo Sapiens
CSLIHVCLA

SEQ ID NO: 812816 - protein, 9 aa, Homo Sapiens
ESCLNTIAW

SEQ ID NO: 812817 - protein, 9 aa, Homo Sapiens
QQQQQIAPC

SEQ ID NO: 812818 - protein, 9 aa, Homo Sapiens
GIDSHISQS

SEQ ID NO: 812819 - protein, 9 aa, Homo Sapiens
NLQNIIRDQ

SEQ ID NO: 812820 - protein, 9 aa, Homo Sapiens
FMYITILPG

SEQ ID NO: 812821 - protein, 9 aa, Homo Sapiens
FRSKDHNKR

SEQ ID NO: 812822 - protein, 9 aa, Homo Sapiens
YTEFIDKFL

SEQ ID NO: 812823 - protein, 9 aa, Homo Sapiens
SKRVVSIYK

SEQ ID NO: 812824 - protein, 9 aa, Homo Sapiens
KSGILLDYE

SEQ ID NO: 812825 - protein, 9 aa, Homo Sapiens
LLIKCRFQF

SEQ ID NO: 812826 - protein, 9 aa, Homo Sapiens
TDKAPEEKK

SEQ ID NO: 812827 - protein, 9 aa, Homo Sapiens
KNFSRPKRK

SEQ ID NO: 812828 - protein, 9 aa, Homo Sapiens
CRDSREDVV

SEQ ID NO: 812829 - protein, 9 aa, Homo Sapiens
SDFVKDSQS

SEQ ID NO: 812830 - protein, 9 aa, Homo Sapiens
AHQDFSRLS

SEQ ID NO: 812831 - protein, 9 aa, Homo Sapiens
HTSLLLEGK

SEQ ID NO: 812832 - protein, 9 aa, Homo Sapiens
TNNKGVSNN

SEQ ID NO: 812833 - protein, 9 aa, Homo Sapiens
KIKVLEFLA

SEQ ID NO: 812834 - protein, 9 aa, Homo Sapiens
RGMSLEYYD

SEQ ID NO: 812835 - protein, 9 aa, Homo Sapiens
LDNSARFQP

SEQ ID NO: 812836 - protein, 9 aa, Homo Sapiens
WDSNAHTTE

SEQ ID NO: 812837 - protein, 9 aa, Homo Sapiens
NILLCNPKH

SEQ ID NO: 812838 - protein, 9 aa, Homo Sapiens
DDSHEVEKS

SEQ ID NO: 812839 - protein, 9 aa, Homo Sapiens
SLGEKAAAK

SEQ ID NO: 812840 - protein, 9 aa, Homo Sapiens
SLLNKELVP

SEQ ID NO: 812841 - protein, 9 aa, Homo Sapiens
SSSIGDVEI

SEQ ID NO: 812842 - protein, 9 aa, Homo Sapiens
KELYHEVHR

SEQ ID NO: 812843 - protein, 9 aa, Homo Sapiens
KVSRKRSSS

SEQ ID NO: 812844 - protein, 9 aa, Homo Sapiens
HNMLHGDDT

SEQ ID NO: 812845 - protein, 9 aa, Homo Sapiens
QVELDNVTR

SEQ ID NO: 812846 - protein, 9 aa, Homo Sapiens
LRAFSSFKN

SEQ ID NO: 812847 - protein, 9 aa, Homo Sapiens
ATLLDPRFK

SEQ ID NO: 812848 - protein, 9 aa, Homo Sapiens
STAWQDLYA

SEQ ID NO: 812849 - protein, 9 aa, Homo Sapiens
RRSKSPKNK

SEQ ID NO: 812850 - protein, 9 aa, Homo Sapiens
LLHPLESLA

SEQ ID NO: 812851 - protein, 9 aa, Homo Sapiens
TEVSQHAAK

SEQ ID NO: 812852 - protein, 9 aa, Homo Sapiens
YVDTDSKFL

SEQ ID NO: 812853 - protein, 9 aa, Homo Sapiens
YFVSNYSHT

SEQ ID NO: 812854 - protein, 9 aa, Homo Sapiens
LPKHESPSQ

SEQ ID NO: 812855 - protein, 9 aa, Homo Sapiens
LQASFLNNS

SEQ ID NO: 812856 - protein, 9 aa, Homo Sapiens
FSLNYLFRA

SEQ ID NO: 812857 - protein, 9 aa, Homo Sapiens
LNNFISMDP

SEQ ID NO: 812858 - protein, 9 aa, Homo Sapiens
ELPEQTTTA

SEQ ID NO: 812859 - protein, 9 aa, Homo Sapiens
GRNVCRVPG

SEQ ID NO: 812860 - protein, 9 aa, Homo Sapiens
VQPYIPYIL

SEQ ID NO: 812861 - protein, 9 aa, Homo Sapiens
SPFSKMPLH

SEQ ID NO: 812862 - protein, 9 aa, Homo Sapiens
QIQKRQMLS

SEQ ID NO: 812863 - protein, 9 aa, Homo Sapiens
GFVGLFRIV

SEQ ID NO: 812864 - protein, 9 aa, Homo Sapiens
IFVDVNKHL

SEQ ID NO: 812865 - protein, 9 aa, Homo Sapiens
FHCPIYYLM

SEQ ID NO: 812866 - protein, 9 aa, Homo Sapiens
TAEIFTTEI

SEQ ID NO: 812867 - protein, 9 aa, Homo Sapiens
PVANQDPVY

SEQ ID NO: 812868 - protein, 9 aa, Homo Sapiens
STLPMLAAP

SEQ ID NO: 812869 - protein, 9 aa, Homo Sapiens
GESECSNVM

SEQ ID NO: 812870 - protein, 9 aa, Homo Sapiens
EKANGPELG

SEQ ID NO: 812871 - protein, 9 aa, Homo Sapiens
PFPESMDNF

SEQ ID NO: 812872 - protein, 9 aa, Homo Sapiens
DAKINVDSN

SEQ ID NO: 812873 - protein, 9 aa, Homo Sapiens
RQKAFDWDV

SEQ ID NO: 812874 - protein, 9 aa, Homo Sapiens
QSSRYGNLH

SEQ ID NO: 812875 - protein, 9 aa, Homo Sapiens
ERTLQRLQA

SEQ ID NO: 812876 - protein, 9 aa, Homo Sapiens
NSSQSKTYS

SEQ ID NO: 812877 - protein, 9 aa, Homo Sapiens
KYVSINSML

SEQ ID NO: 812878 - protein, 9 aa, Homo Sapiens
FDVARPKLW

SEQ ID NO: 812879 - protein, 9 aa, Homo Sapiens
LSVNRNKKC

SEQ ID NO: 812880 - protein, 9 aa, Homo Sapiens
RRTEQTAPT

SEQ ID NO: 812881 - protein, 9 aa, Homo Sapiens
INKQIWDTV

SEQ ID NO: 812882 - protein, 9 aa, Homo Sapiens
AKRRYFILL

SEQ ID NO: 812883 - protein, 9 aa, Homo Sapiens
HGNWYIQAT

SEQ ID NO: 812884 - protein, 9 aa, Homo Sapiens
FLFTFHLDS

SEQ ID NO: 812885 - protein, 9 aa, Homo Sapiens
GKFTCGCNK

SEQ ID NO: 812886 - protein, 9 aa, Homo Sapiens
WIGLHYPKK

SEQ ID NO: 812887 - protein, 9 aa, Homo Sapiens
MISATRGLN

SEQ ID NO: 812888 - protein, 9 aa, Homo Sapiens
EINQYGEVM

SEQ ID NO: 812889 - protein, 9 aa, Homo Sapiens
TNLPSGEVL

SEQ ID NO: 812890 - protein, 9 aa, Homo Sapiens
NIYECNQSE

SEQ ID NO: 812891 - protein, 9 aa, Homo Sapiens
VLIEVVDKQ

SEQ ID NO: 812892 - protein, 9 aa, Homo Sapiens
QEEASYMTS

SEQ ID NO: 812893 - protein, 9 aa, Homo Sapiens
SLNSTQSHE

SEQ ID NO: 812894 - protein, 9 aa, Homo Sapiens
SVAAPFCCE

SEQ ID NO: 812895 - protein, 9 aa, Homo Sapiens
LIRRDLACF

SEQ ID NO: 812896 - protein, 9 aa, Homo Sapiens
VTIIGNALV

SEQ ID NO: 812897 - protein, 9 aa, Homo Sapiens
VDSCDNCST

SEQ ID NO: 812898 - protein, 9 aa, Homo Sapiens
TSFFRDSPA

SEQ ID NO: 812899 - protein, 9 aa, Homo Sapiens
AFLAYIVFL

SEQ ID NO: 812900 - protein, 9 aa, Homo Sapiens
QELPTALTQ

SEQ ID NO: 812901 - protein, 9 aa, Homo Sapiens
CRLIHNNNC

SEQ ID NO: 812902 - protein, 9 aa, Homo Sapiens
LQFDQARGV

SEQ ID NO: 812903 - protein, 9 aa, Homo Sapiens
TLQTGGDPG

SEQ ID NO: 812904 - protein, 9 aa, Homo Sapiens
SGSEKKLRQ

SEQ ID NO: 812905 - protein, 9 aa, Homo Sapiens
DQQKVKKTV

SEQ ID NO: 812906 - protein, 9 aa, Homo Sapiens
IIRTCSRDP

SEQ ID NO: 812907 - protein, 9 aa, Homo Sapiens
AWSSMDEEE

SEQ ID NO: 812908 - protein, 9 aa, Homo Sapiens
SKSDGEENI

SEQ ID NO: 812909 - protein, 9 aa, Homo Sapiens
TTQEDHMKL

SEQ ID NO: 812910 - protein, 9 aa, Homo Sapiens
FPVSYSSSS

SEQ ID NO: 812911 - protein, 9 aa, Homo Sapiens
DIDTETEQV

SEQ ID NO: 812912 - protein, 9 aa, Homo Sapiens
HVCLALRIP

SEQ ID NO: 812913 - protein, 9 aa, Homo Sapiens
IARIWSLES

SEQ ID NO: 812914 - protein, 9 aa, Homo Sapiens
ERRVASVLA

SEQ ID NO: 812915 - protein, 9 aa, Homo Sapiens
FNLFSTDDS

SEQ ID NO: 812916 - protein, 9 aa, Homo Sapiens
VLFITAAWS

SEQ ID NO: 812917 - protein, 9 aa, Homo Sapiens
TNGAPLVVE

SEQ ID NO: 812918 - protein, 9 aa, Homo Sapiens
LVWLGLSMS

SEQ ID NO: 812919 - protein, 9 aa, Homo Sapiens
FKNMIQPDA

SEQ ID NO: 812920 - protein, 9 aa, Homo Sapiens
DPKRNKKST

SEQ ID NO: 812921 - protein, 9 aa, Homo Sapiens
KEGRTLDAR

SEQ ID NO: 812922 - protein, 9 aa, Homo Sapiens
KAFVNCAEN

SEQ ID NO: 812923 - protein, 9 aa, Homo Sapiens
WNMFIDAML

SEQ ID NO: 812924 - protein, 9 aa, Homo Sapiens
IMAVVILSV

SEQ ID NO: 812925 - protein, 9 aa, Homo Sapiens
TSERRKIIK

SEQ ID NO: 812926 - protein, 9 aa, Homo Sapiens
LEIISKSPD

SEQ ID NO: 812927 - protein, 9 aa, Homo Sapiens
QTPPVRRNS

SEQ ID NO: 812928 - protein, 9 aa, Homo Sapiens
RRCGQKVDK

SEQ ID NO: 812929 - protein, 9 aa, Homo Sapiens
TVHAVWDSE

SEQ ID NO: 812930 - protein, 9 aa, Homo Sapiens
RITYKMPLG

SEQ ID NO: 812931 - protein, 9 aa, Homo Sapiens
DSLGRFRSM

SEQ ID NO: 812932 - protein, 9 aa, Homo Sapiens
KAVKLFQND

SEQ ID NO: 812933 - protein, 9 aa, Homo Sapiens
KTELGNEKL

SEQ ID NO: 812934 - protein, 9 aa, Homo Sapiens
PIKESEIIY

SEQ ID NO: 812935 - protein, 9 aa, Homo Sapiens
IKEPSKTWI

SEQ ID NO: 812936 - protein, 9 aa, Homo Sapiens
RDFFWSTVP

SEQ ID NO: 812937 - protein, 9 aa, Homo Sapiens
QDIKTLHGS

SEQ ID NO: 812938 - protein, 9 aa, Homo Sapiens
YRARVLELE

SEQ ID NO: 812939 - protein, 9 aa, Homo Sapiens
YDNLDYTLS

SEQ ID NO: 812940 - protein, 9 aa, Homo Sapiens
DKSSLDKRK

SEQ ID NO: 812941 - protein, 9 aa, Homo Sapiens
ILNDYEYRQ

SEQ ID NO: 812942 - protein, 9 aa, Homo Sapiens
AGVKGEAKI

SEQ ID NO: 812943 - protein, 9 aa, Homo Sapiens
AATPLLMGK

SEQ ID NO: 812944 - protein, 9 aa, Homo Sapiens
TNLPINPSM

SEQ ID NO: 812945 - protein, 9 aa, Homo Sapiens
CGYYVVFGS

SEQ ID NO: 812946 - protein, 9 aa, Homo Sapiens
LKITYLGNK

SEQ ID NO: 812947 - protein, 9 aa, Homo Sapiens
LSCGNIRIT

SEQ ID NO: 812948 - protein, 9 aa, Homo Sapiens
PDQVQGLIN

SEQ ID NO: 812949 - protein, 9 aa, Homo Sapiens
QFSAIQRQE

SEQ ID NO: 812950 - protein, 9 aa, Homo Sapiens
TNSFSPLES

SEQ ID NO: 812951 - protein, 9 aa, Homo Sapiens
IYVVQLPAN

SEQ ID NO: 812952 - protein, 9 aa, Homo Sapiens
TGQEYTPGN

SEQ ID NO: 812953 - protein, 9 aa, Homo Sapiens
HHIIHVGDK

SEQ ID NO: 812954 - protein, 9 aa, Homo Sapiens
QIATRRFNE

SEQ ID NO: 812955 - protein, 9 aa, Homo Sapiens
LCVTACPRQ

SEQ ID NO: 812956 - protein, 9 aa, Homo Sapiens
DLINFLKLL

SEQ ID NO: 812957 - protein, 9 aa, Homo Sapiens
ALIKTYYGT

SEQ ID NO: 812958 - protein, 9 aa, Homo Sapiens
EYKTIKSPS

SEQ ID NO: 812959 - protein, 9 aa, Homo Sapiens
QNSLERQIE

SEQ ID NO: 812960 - protein, 9 aa, Homo Sapiens
HLYAAILGY

SEQ ID NO: 812961 - protein, 9 aa, Homo Sapiens
PTLLNLKDS

SEQ ID NO: 812962 - protein, 9 aa, Homo Sapiens
PEASQYCGC

SEQ ID NO: 812963 - protein, 9 aa, Homo Sapiens
DLKLVDRPQ

SEQ ID NO: 812964 - protein, 9 aa, Homo Sapiens
FNILDPLKY

SEQ ID NO: 812965 - protein, 9 aa, Homo Sapiens
HASPQPLLQ

SEQ ID NO: 812966 - protein, 9 aa, Homo Sapiens
EYMIPIENM

SEQ ID NO: 812967 - protein, 9 aa, Homo Sapiens
GRLPKDLGT

SEQ ID NO: 812968 - protein, 9 aa, Homo Sapiens
IADNGDLRE

SEQ ID NO: 812969 - protein, 9 aa, Homo Sapiens
PKCPEKDIR

SEQ ID NO: 812970 - protein, 9 aa, Homo Sapiens
QASKINDDY

SEQ ID NO: 812971 - protein, 9 aa, Homo Sapiens
GTTPSYLTP

SEQ ID NO: 812972 - protein, 9 aa, Homo Sapiens
MSSRQPSSA

SEQ ID NO: 812973 - protein, 9 aa, Homo Sapiens
VTFLGLCSL

SEQ ID NO: 812974 - protein, 9 aa, Homo Sapiens
FTREFDSDY

SEQ ID NO: 812975 - protein, 9 aa, Homo Sapiens
YNVNVLTFI

SEQ ID NO: 812976 - protein, 9 aa, Homo Sapiens
LVFEYCDNT

SEQ ID NO: 812977 - protein, 9 aa, Homo Sapiens
PQDCLAQLC

SEQ ID NO: 812978 - protein, 9 aa, Homo Sapiens
NIQMMTRGH

SEQ ID NO: 812979 - protein, 9 aa, Homo Sapiens
FIKRTRLPQ

SEQ ID NO: 812980 - protein, 9 aa, Homo Sapiens
KSIIEGERY

SEQ ID NO: 812981 - protein, 9 aa, Homo Sapiens
SALSNVCAL

SEQ ID NO: 812982 - protein, 9 aa, Homo Sapiens
VDCYVSKKP

SEQ ID NO: 812983 - protein, 9 aa, Homo Sapiens
TFSFIITLL

SEQ ID NO: 812984 - protein, 9 aa, Homo Sapiens
RQYKHPDIC

SEQ ID NO: 812985 - protein, 9 aa, Homo Sapiens
GPDTNPRPG

SEQ ID NO: 812986 - protein, 9 aa, Homo Sapiens
LGFESDTQG

SEQ ID NO: 812987 - protein, 9 aa, Homo Sapiens
LVVLIITCV

SEQ ID NO: 812988 - protein, 9 aa, Homo Sapiens
VLYHVYSFH

SEQ ID NO: 812989 - protein, 9 aa, Homo Sapiens
HTHTVTHVH

SEQ ID NO: 812990 - protein, 9 aa, Homo Sapiens
VVSPTKRCM

SEQ ID NO: 812991 - protein, 9 aa, Homo Sapiens
EDAQPPGLK

SEQ ID NO: 812992 - protein, 9 aa, Homo Sapiens
GIFSYDKTK

SEQ ID NO: 812993 - protein, 9 aa, Homo Sapiens
QLMFGDPCF

SEQ ID NO: 812994 - protein, 9 aa, Homo Sapiens
PHNPLGDVY

SEQ ID NO: 812995 - protein, 9 aa, Homo Sapiens
NMKENPMTN

SEQ ID NO: 812996 - protein, 9 aa, Homo Sapiens
LMKHLNAIT

SEQ ID NO: 812997 - protein, 9 aa, Homo Sapiens
ELAFTDSRI

SEQ ID NO: 812998 - protein, 9 aa, Homo Sapiens
YFGAENLFN

SEQ ID NO: 812999 - protein, 9 aa, Homo Sapiens
KEHEKQKNE

SEQ ID NO: 813000 - protein, 9 aa, Homo Sapiens
FSDSWEAFW

SEQ ID NO: 813001 - protein, 9 aa, Homo Sapiens
EHIKEYTEI

SEQ ID NO: 813002 - protein, 9 aa, Homo Sapiens
DKLGENVAN

SEQ ID NO: 813003 - protein, 9 aa, Homo Sapiens
KEPDTSDQT

SEQ ID NO: 813004 - protein, 9 aa, Homo Sapiens
IEIYRVAGQ

SEQ ID NO: 813005 - protein, 9 aa, Homo Sapiens
KTGQNYFSL

SEQ ID NO: 813006 - protein, 9 aa, Homo Sapiens
RYYCKAENS

SEQ ID NO: 813007 - protein, 9 aa, Homo Sapiens
VCFHIIEFN

SEQ ID NO: 813008 - protein, 9 aa, Homo Sapiens
LKYLPELAL

SEQ ID NO: 813009 - protein, 9 aa, Homo Sapiens
MFNPIIYSL

SEQ ID NO: 813010 - protein, 9 aa, Homo Sapiens
LALAGVLLW

SEQ ID NO: 813011 - protein, 9 aa, Homo Sapiens
GLSGIKKPW

SEQ ID NO: 813012 - protein, 9 aa, Homo Sapiens
NQVASMHCY

SEQ ID NO: 813013 - protein, 9 aa, Homo Sapiens
LMNKMGIKS

SEQ ID NO: 813014 - protein, 9 aa, Homo Sapiens
LLGINLMRQ

SEQ ID NO: 813015 - protein, 9 aa, Homo Sapiens
VILTSSVTV

SEQ ID NO: 813016 - protein, 9 aa, Homo Sapiens
QDLEVFYPE

SEQ ID NO: 813017 - protein, 9 aa, Homo Sapiens
ICDDAYKSQ

SEQ ID NO: 813018 - protein, 9 aa, Homo Sapiens
YYDSFLPGL

SEQ ID NO: 813019 - protein, 9 aa, Homo Sapiens
LGYFGGVGS

SEQ ID NO: 813020 - protein, 9 aa, Homo Sapiens
IYWQMVRPF

SEQ ID NO: 813021 - protein, 9 aa, Homo Sapiens
PSTLPMLAA

SEQ ID NO: 813022 - protein, 9 aa, Homo Sapiens
LIAIMTGDI

SEQ ID NO: 813023 - protein, 9 aa, Homo Sapiens
LVVNTGNRT

SEQ ID NO: 813024 - protein, 9 aa, Homo Sapiens
RDLSELFHP

SEQ ID NO: 813025 - protein, 9 aa, Homo Sapiens
HQFLCSIET

SEQ ID NO: 813026 - protein, 9 aa, Homo Sapiens
SPKECILLG

SEQ ID NO: 813027 - protein, 9 aa, Homo Sapiens
QHNAVKLGA

SEQ ID NO: 813028 - protein, 9 aa, Homo Sapiens
DLDVERDED

SEQ ID NO: 813029 - protein, 9 aa, Homo Sapiens
DARNKRIKN

SEQ ID NO: 813030 - protein, 9 aa, Homo Sapiens
MQKLFPRIP

SEQ ID NO: 813031 - protein, 9 aa, Homo Sapiens
ASGTTWSPD

SEQ ID NO: 813032 - protein, 9 aa, Homo Sapiens
LGEEEDKAD

SEQ ID NO: 813033 - protein, 9 aa, Homo Sapiens
CLAYQTDNK

SEQ ID NO: 813034 - protein, 9 aa, Homo Sapiens
VVSVKHNPL

SEQ ID NO: 813035 - protein, 9 aa, Homo Sapiens
LAEATTKLY

SEQ ID NO: 813036 - protein, 9 aa, Homo Sapiens
NLESDNEDG

SEQ ID NO: 813037 - protein, 9 aa, Homo Sapiens
DIPREPRQI

SEQ ID NO: 813038 - protein, 9 aa, Homo Sapiens
GQECLKQLF

SEQ ID NO: 813039 - protein, 9 aa, Homo Sapiens
SPGPLASSP

SEQ ID NO: 813040 - protein, 9 aa, Homo Sapiens
MVNLGGKTS

SEQ ID NO: 813041 - protein, 9 aa, Homo Sapiens
YHYDKFKKM

SEQ ID NO: 813042 - protein, 9 aa, Homo Sapiens
KKADYQAVN

SEQ ID NO: 813043 - protein, 9 aa, Homo Sapiens
NNYLHFAQV

SEQ ID NO: 813044 - protein, 9 aa, Homo Sapiens
VIKGQTYEK

SEQ ID NO: 813045 - protein, 9 aa, Homo Sapiens
GWDINKDAG

SEQ ID NO: 813046 - protein, 9 aa, Homo Sapiens
CKEAFQHEV

SEQ ID NO: 813047 - protein, 9 aa, Homo Sapiens
DLAYTSYSD

SEQ ID NO: 813048 - protein, 9 aa, Homo Sapiens
IWDYRHPPP

SEQ ID NO: 813049 - protein, 9 aa, Homo Sapiens
AGKMNGRVS

SEQ ID NO: 813050 - protein, 9 aa, Homo Sapiens
EEGAYARDN

SEQ ID NO: 813051 - protein, 9 aa, Homo Sapiens
EYFLYKSSG

SEQ ID NO: 813052 - protein, 9 aa, Homo Sapiens
IPKLVQIIN

SEQ ID NO: 813053 - protein, 9 aa, Homo Sapiens
EDEIRLRRL

SEQ ID NO: 813054 - protein, 9 aa, Homo Sapiens
KQSSPPLSP

SEQ ID NO: 813055 - protein, 9 aa, Homo Sapiens
RGVIVFNND

SEQ ID NO: 813056 - protein, 9 aa, Homo Sapiens
QDGRDRRDA

SEQ ID NO: 813057 - protein, 9 aa, Homo Sapiens
KNGGTWDGF

SEQ ID NO: 813058 - protein, 9 aa, Homo Sapiens
QTGGDPGER

SEQ ID NO: 813059 - protein, 9 aa, Homo Sapiens
IYLSTVMHN

SEQ ID NO: 813060 - protein, 9 aa, Homo Sapiens
ALAYQGLGS

SEQ ID NO: 813061 - protein, 9 aa, Homo Sapiens
TLVENLYRR

SEQ ID NO: 813062 - protein, 9 aa, Homo Sapiens
QKIKINDVE

SEQ ID NO: 813063 - protein, 9 aa, Homo Sapiens
IQDKSKENS

SEQ ID NO: 813064 - protein, 9 aa, Homo Sapiens
GSGKGTTSE

SEQ ID NO: 813065 - protein, 9 aa, Homo Sapiens
TSRHNLEKL

SEQ ID NO: 813066 - protein, 9 aa, Homo Sapiens
YKSKNFETL

SEQ ID NO: 813067 - protein, 9 aa, Homo Sapiens
HIVIPLPCC

SEQ ID NO: 813068 - protein, 9 aa, Homo Sapiens
GQFNSGNQL

SEQ ID NO: 813069 - protein, 9 aa, Homo Sapiens
EANAPEELS

SEQ ID NO: 813070 - protein, 9 aa, Homo Sapiens
AETSKLIYN

SEQ ID NO: 813071 - protein, 9 aa, Homo Sapiens
ASQNVGQLT

SEQ ID NO: 813072 - protein, 9 aa, Homo Sapiens
IVLYILCTM

SEQ ID NO: 813073 - protein, 9 aa, Homo Sapiens
IHRGVHTGE

SEQ ID NO: 813074 - protein, 9 aa, Homo Sapiens
FVFESRKDI

SEQ ID NO: 813075 - protein, 9 aa, Homo Sapiens
KGVTFYGPR

SEQ ID NO: 813076 - protein, 9 aa, Homo Sapiens
LFEQSFQPE

SEQ ID NO: 813077 - protein, 9 aa, Homo Sapiens
PNIIKRKEI

SEQ ID NO: 813078 - protein, 9 aa, Homo Sapiens
AEAALQLFK

SEQ ID NO: 813079 - protein, 9 aa, Homo Sapiens
FGGEPKHPG

SEQ ID NO: 813080 - protein, 9 aa, Homo Sapiens
KTNILEEKI

SEQ ID NO: 813081 - protein, 9 aa, Homo Sapiens
IQLDKYLPA

SEQ ID NO: 813082 - protein, 9 aa, Homo Sapiens
QVPDLKDLD

SEQ ID NO: 813083 - protein, 9 aa, Homo Sapiens
PLINMFNNP

SEQ ID NO: 813084 - protein, 9 aa, Homo Sapiens
SKNTHGLTP

SEQ ID NO: 813085 - protein, 9 aa, Homo Sapiens
PPYLDKYEQ

SEQ ID NO: 813086 - protein, 9 aa, Homo Sapiens
AYCESEINS

SEQ ID NO: 813087 - protein, 9 aa, Homo Sapiens
EKYSSHSGR

SEQ ID NO: 813088 - protein, 9 aa, Homo Sapiens
NSCLYYWAL

SEQ ID NO: 813089 - protein, 9 aa, Homo Sapiens
LVWEEKACI

SEQ ID NO: 813090 - protein, 9 aa, Homo Sapiens
SELSTDAVD

SEQ ID NO: 813091 - protein, 9 aa, Homo Sapiens
ALWCGEEVA

SEQ ID NO: 813092 - protein, 9 aa, Homo Sapiens
RGTSKPIFC

SEQ ID NO: 813093 - protein, 9 aa, Homo Sapiens
QVIHSIKYC

SEQ ID NO: 813094 - protein, 9 aa, Homo Sapiens
HSMKKYLVM

SEQ ID NO: 813095 - protein, 9 aa, Homo Sapiens
DEFSPLNNA

SEQ ID NO: 813096 - protein, 9 aa, Homo Sapiens
NYRTKVLAQ

SEQ ID NO: 813097 - protein, 9 aa, Homo Sapiens
YLIGLGIKN

SEQ ID NO: 813098 - protein, 9 aa, Homo Sapiens
HPHLVLTAV

SEQ ID NO: 813099 - protein, 9 aa, Homo Sapiens
YKIADRGHL

SEQ ID NO: 813100 - protein, 9 aa, Homo Sapiens
QLPCKLRED

SEQ ID NO: 813101 - protein, 9 aa, Homo Sapiens
FQTHERPHT

SEQ ID NO: 813102 - protein, 9 aa, Homo Sapiens
WKIHTEDNA

SEQ ID NO: 813103 - protein, 9 aa, Homo Sapiens
KAHPDMEAG

SEQ ID NO: 813104 - protein, 9 aa, Homo Sapiens
EKQEKLKQD

SEQ ID NO: 813105 - protein, 9 aa, Homo Sapiens
AAAPVVPAM

SEQ ID NO: 813106 - protein, 9 aa, Homo Sapiens
KCHVFCCEA

SEQ ID NO: 813107 - protein, 9 aa, Homo Sapiens
CIAHDAELV

SEQ ID NO: 813108 - protein, 9 aa, Homo Sapiens
QRVPQVRIP

SEQ ID NO: 813109 - protein, 9 aa, Homo Sapiens
QLLRGNRAT

SEQ ID NO: 813110 - protein, 9 aa, Homo Sapiens
AGAGSSPEA

SEQ ID NO: 813111 - protein, 9 aa, Homo Sapiens
ASVVFLLLF

SEQ ID NO: 813112 - protein, 9 aa, Homo Sapiens
KKWLDLSRI

SEQ ID NO: 813113 - protein, 9 aa, Homo Sapiens
RTEKRIKAL

SEQ ID NO: 813114 - protein, 9 aa, Homo Sapiens
AVKFPNPLR

SEQ ID NO: 813115 - protein, 9 aa, Homo Sapiens
RFYRINRAQ

SEQ ID NO: 813116 - protein, 9 aa, Homo Sapiens
PEVTYPCAC

SEQ ID NO: 813117 - protein, 9 aa, Homo Sapiens
STFHPRTSS

SEQ ID NO: 813118 - protein, 9 aa, Homo Sapiens
SRLQTLELE

SEQ ID NO: 813119 - protein, 9 aa, Homo Sapiens
YGKSPELIM

SEQ ID NO: 813120 - protein, 9 aa, Homo Sapiens
ITLPVGFGA

SEQ ID NO: 813121 - protein, 9 aa, Homo Sapiens
LTAAEERDK

SEQ ID NO: 813122 - protein, 9 aa, Homo Sapiens
DKAGPSPSR

SEQ ID NO: 813123 - protein, 9 aa, Homo Sapiens
RTTVERERA

SEQ ID NO: 813124 - protein, 9 aa, Homo Sapiens
CLKNDIGGD

SEQ ID NO: 813125 - protein, 9 aa, Homo Sapiens
QARLEPLYF

SEQ ID NO: 813126 - protein, 9 aa, Homo Sapiens
ARQEIKNKS

SEQ ID NO: 813127 - protein, 9 aa, Homo Sapiens
GQCVLGLDP

SEQ ID NO: 813128 - protein, 9 aa, Homo Sapiens
KKNKGKRKS

SEQ ID NO: 813129 - protein, 9 aa, Homo Sapiens
VENIIWGMS

SEQ ID NO: 813130 - protein, 8 aa, Homo Sapiens
NRQVCKKS

SEQ ID NO: 813131 - protein, 9 aa, Homo Sapiens
LVEHVFRIK

SEQ ID NO: 813132 - protein, 9 aa, Homo Sapiens
IIITEHANQ

SEQ ID NO: 813133 - protein, 9 aa, Homo Sapiens
RQGDRGQGV

SEQ ID NO: 813134 - protein, 9 aa, Homo Sapiens
TCYSSKRRV

SEQ ID NO: 813135 - protein, 9 aa, Homo Sapiens
YNKTISPFF

SEQ ID NO: 813136 - protein, 9 aa, Homo Sapiens
VLALAGVLL

SEQ ID NO: 813137 - protein, 9 aa, Homo Sapiens
VLNRRSLTS

SEQ ID NO: 813138 - protein, 9 aa, Homo Sapiens
VTKSEPSVM

SEQ ID NO: 813139 - protein, 9 aa, Homo Sapiens
PPPPSSLSL

SEQ ID NO: 813140 - protein, 9 aa, Homo Sapiens
DILPEMRAY

SEQ ID NO: 813141 - protein, 9 aa, Homo Sapiens
SLNPRAKHL

SEQ ID NO: 813142 - protein, 9 aa, Homo Sapiens
DSPPASKRV

SEQ ID NO: 813143 - protein, 9 aa, Homo Sapiens
RRDTSGLEI

SEQ ID NO: 813144 - protein, 9 aa, Homo Sapiens
RPLCTLSFH

SEQ ID NO: 813145 - protein, 9 aa, Homo Sapiens
SVNPIIYGL

SEQ ID NO: 813146 - protein, 9 aa, Homo Sapiens
NMKKLFPKG

SEQ ID NO: 813147 - protein, 9 aa, Homo Sapiens
RCGLNPVIY

SEQ ID NO: 813148 - protein, 9 aa, Homo Sapiens
EKPQRNGDK

SEQ ID NO: 813149 - protein, 9 aa, Homo Sapiens
LALPVKLAQ

SEQ ID NO: 813150 - protein, 9 aa, Homo Sapiens
GPFLNQLEP

SEQ ID NO: 813151 - protein, 9 aa, Homo Sapiens
YEQMKARPD

SEQ ID NO: 813152 - protein, 9 aa, Homo Sapiens
FRDEGEHRM

SEQ ID NO: 813153 - protein, 9 aa, Homo Sapiens
YSFILRRLP

SEQ ID NO: 813154 - protein, 9 aa, Homo Sapiens
KHNFMMSVL

SEQ ID NO: 813155 - protein, 9 aa, Homo Sapiens
FFPDKFKPE

SEQ ID NO: 813156 - protein, 9 aa, Homo Sapiens
RAFAESHNQ

SEQ ID NO: 813157 - protein, 9 aa, Homo Sapiens
STDILERAI

SEQ ID NO: 813158 - protein, 9 aa, Homo Sapiens
SVKKPIHKQ

SEQ ID NO: 813159 - protein, 9 aa, Homo Sapiens
FFYKTAEEN

SEQ ID NO: 813160 - protein, 9 aa, Homo Sapiens
QEPQIDEKN

SEQ ID NO: 813161 - protein, 9 aa, Homo Sapiens
LDLLMKKIQ

SEQ ID NO: 813162 - protein, 9 aa, Homo Sapiens
AIQSLQKSL

SEQ ID NO: 813163 - protein, 9 aa, Homo Sapiens
AQHLIESSK

SEQ ID NO: 813164 - protein, 9 aa, Homo Sapiens
ANFTATAHS

SEQ ID NO: 813165 - protein, 9 aa, Homo Sapiens
LRFQEEYST

SEQ ID NO: 813166 - protein, 9 aa, Homo Sapiens
FIRDSLISL

SEQ ID NO: 813167 - protein, 9 aa, Homo Sapiens
NVLCNGIPD

SEQ ID NO: 813168 - protein, 9 aa, Homo Sapiens
LEIISNGPV

SEQ ID NO: 813169 - protein, 9 aa, Homo Sapiens
IPKLPLQSD

SEQ ID NO: 813170 - protein, 9 aa, Homo Sapiens
VTHYCQGPK

SEQ ID NO: 813171 - protein, 9 aa, Homo Sapiens
SYSLSDLNS

SEQ ID NO: 813172 - protein, 9 aa, Homo Sapiens
IIKYLDYED

SEQ ID NO: 813173 - protein, 9 aa, Homo Sapiens
QSVPSGSEM

SEQ ID NO: 813174 - protein, 9 aa, Homo Sapiens
VIPVPETES

SEQ ID NO: 813175 - protein, 9 aa, Homo Sapiens
SWESLKYAV

SEQ ID NO: 813176 - protein, 9 aa, Homo Sapiens
VRFNSDVGM

SEQ ID NO: 813177 - protein, 9 aa, Homo Sapiens
ETESKHLHN

SEQ ID NO: 813178 - protein, 9 aa, Homo Sapiens
NTINMLKEG

SEQ ID NO: 813179 - protein, 9 aa, Homo Sapiens
PGPLPYFGL

SEQ ID NO: 813180 - protein, 9 aa, Homo Sapiens
SSAASSYSL

SEQ ID NO: 813181 - protein, 9 aa, Homo Sapiens
CFHGNCSNT

SEQ ID NO: 813182 - protein, 9 aa, Homo Sapiens
LAGVLLWYF

SEQ ID NO: 813183 - protein, 9 aa, Homo Sapiens
NDAEYECQV

SEQ ID NO: 813184 - protein, 9 aa, Homo Sapiens
SNLSHKLIS

SEQ ID NO: 813185 - protein, 9 aa, Homo Sapiens
SYYGNQCND

SEQ ID NO: 813186 - protein, 9 aa, Homo Sapiens
TPGNIIVYL

SEQ ID NO: 813187 - protein, 9 aa, Homo Sapiens
RHHQFIEPA

SEQ ID NO: 813188 - protein, 9 aa, Homo Sapiens
MRVLHIARV

SEQ ID NO: 813189 - protein, 9 aa, Homo Sapiens
YGHTSTVHC

SEQ ID NO: 813190 - protein, 9 aa, Homo Sapiens
ESPYLYTLW

SEQ ID NO: 813191 - protein, 9 aa, Homo Sapiens
ESGKLPQSP

SEQ ID NO: 813192 - protein, 9 aa, Homo Sapiens
GITDGGDLP

SEQ ID NO: 813193 - protein, 9 aa, Homo Sapiens
TLDLIKSHL

SEQ ID NO: 813194 - protein, 9 aa, Homo Sapiens
TSSGKPSTK

SEQ ID NO: 813195 - protein, 9 aa, Homo Sapiens
AFTIYEMLQ

SEQ ID NO: 813196 - protein, 9 aa, Homo Sapiens
QCVGETQSR

SEQ ID NO: 813197 - protein, 9 aa, Homo Sapiens
ITYLGNKAI

SEQ ID NO: 813198 - protein, 9 aa, Homo Sapiens
KDRLIKILS

SEQ ID NO: 813199 - protein, 9 aa, Homo Sapiens
PLTNAVQSD

SEQ ID NO: 813200 - protein, 9 aa, Homo Sapiens
GRIRLAEDD

SEQ ID NO: 813201 - protein, 9 aa, Homo Sapiens
LNAKSICCC

SEQ ID NO: 813202 - protein, 9 aa, Homo Sapiens
WCGARPLSC

SEQ ID NO: 813203 - protein, 9 aa, Homo Sapiens
LDLSRILFY

SEQ ID NO: 813204 - protein, 9 aa, Homo Sapiens
APCNAACSS

SEQ ID NO: 813205 - protein, 9 aa, Homo Sapiens
SQPDEFEHT

SEQ ID NO: 813206 - protein, 9 aa, Homo Sapiens
LYLVMNDKG

SEQ ID NO: 813207 - protein, 9 aa, Homo Sapiens
LFLPVVLKD

SEQ ID NO: 813208 - protein, 9 aa, Homo Sapiens
DLPVNYEHV

SEQ ID NO: 813209 - protein, 9 aa, Homo Sapiens
DVPGEMLKK

SEQ ID NO: 813210 - protein, 9 aa, Homo Sapiens
QDLLKEHQK

SEQ ID NO: 813211 - protein, 9 aa, Homo Sapiens
KLMKIPGTC

SEQ ID NO: 813212 - protein, 9 aa, Homo Sapiens
LVNSGYDSM

SEQ ID NO: 813213 - protein, 9 aa, Homo Sapiens
SDGFWKYVA

SEQ ID NO: 813214 - protein, 9 aa, Homo Sapiens
SAKPLDNWL

SEQ ID NO: 813215 - protein, 9 aa, Homo Sapiens
REGWAVQDV

SEQ ID NO: 813216 - protein, 9 aa, Homo Sapiens
INTLLRNKD

SEQ ID NO: 813217 - protein, 9 aa, Homo Sapiens
PTWDIFKQL

SEQ ID NO: 813218 - protein, 9 aa, Homo Sapiens
VQELAETIK

SEQ ID NO: 813219 - protein, 9 aa, Homo Sapiens
VKAQEYERI

SEQ ID NO: 813220 - protein, 9 aa, Homo Sapiens
LEEAKIIGI

SEQ ID NO: 813221 - protein, 9 aa, Homo Sapiens
LLDSCVISN

SEQ ID NO: 813222 - protein, 9 aa, Homo Sapiens
DDKGGFIPG

SEQ ID NO: 813223 - protein, 9 aa, Homo Sapiens
QRNLYTDVM

SEQ ID NO: 813224 - protein, 9 aa, Homo Sapiens
HISIMEGHD

SEQ ID NO: 813225 - protein, 9 aa, Homo Sapiens
SKCSEEINN

SEQ ID NO: 813226 - protein, 9 aa, Homo Sapiens
QLLLLFLFW

SEQ ID NO: 813227 - protein, 9 aa, Homo Sapiens
IVYLYKKLE

SEQ ID NO: 813228 - protein, 9 aa, Homo Sapiens
PEMYMTWMK

SEQ ID NO: 813229 - protein, 9 aa, Homo Sapiens
IAALKTIDI

SEQ ID NO: 813230 - protein, 9 aa, Homo Sapiens
GLFHLKSYL

SEQ ID NO: 813231 - protein, 9 aa, Homo Sapiens
EKVIRAVVP

SEQ ID NO: 813232 - protein, 9 aa, Homo Sapiens
FNSDVGMFV

SEQ ID NO: 813233 - protein, 9 aa, Homo Sapiens
NQYAPPEWS

SEQ ID NO: 813234 - protein, 9 aa, Homo Sapiens
VLLGTVGNG

SEQ ID NO: 813235 - protein, 9 aa, Homo Sapiens
TGQVLAAHI

SEQ ID NO: 813236 - protein, 9 aa, Homo Sapiens
VVFALIVLL

SEQ ID NO: 813237 - protein, 9 aa, Homo Sapiens
EDGSFADTI

SEQ ID NO: 813238 - protein, 9 aa, Homo Sapiens
SELEAGNDL

SEQ ID NO: 813239 - protein, 9 aa, Homo Sapiens
LGKVHSIVR

SEQ ID NO: 813240 - protein, 9 aa, Homo Sapiens
KSSIVYLYK

SEQ ID NO: 813241 - protein, 9 aa, Homo Sapiens
IPAHTRHYQ

SEQ ID NO: 813242 - protein, 9 aa, Homo Sapiens
PFSLANKVM

SEQ ID NO: 813243 - protein, 9 aa, Homo Sapiens
RLVPSAFDK

SEQ ID NO: 813244 - protein, 9 aa, Homo Sapiens
SQEEINNMW

SEQ ID NO: 813245 - protein, 9 aa, Homo Sapiens
CRQAQQAGK

SEQ ID NO: 813246 - protein, 9 aa, Homo Sapiens
TMAFIEQEA

SEQ ID NO: 813247 - protein, 9 aa, Homo Sapiens
FVNCAENSR

SEQ ID NO: 813248 - protein, 9 aa, Homo Sapiens
VAENQQSQS

SEQ ID NO: 813249 - protein, 9 aa, Homo Sapiens
CSIQLPKAA

SEQ ID NO: 813250 - protein, 9 aa, Homo Sapiens
ANTINMLKE

SEQ ID NO: 813251 - protein, 9 aa, Homo Sapiens
KKAPGVADK

SEQ ID NO: 813252 - protein, 9 aa, Homo Sapiens
KREYGFIYQ

SEQ ID NO: 813253 - protein, 9 aa, Homo Sapiens
KLIRLQSLH

SEQ ID NO: 813254 - protein, 9 aa, Homo Sapiens
KSGLEDCAV

SEQ ID NO: 813255 - protein, 9 aa, Homo Sapiens
GMMGTFAKV

SEQ ID NO: 813256 - protein, 9 aa, Homo Sapiens
VAIQAGTTL

SEQ ID NO: 813257 - protein, 9 aa, Homo Sapiens
ITTKLCDVA

SEQ ID NO: 813258 - protein, 9 aa, Homo Sapiens
SNLHVKVKG

SEQ ID NO: 813259 - protein, 9 aa, Homo Sapiens
CEAYLQEEL

SEQ ID NO: 813260 - protein, 9 aa, Homo Sapiens
GELTIIKYL

SEQ ID NO: 813261 - protein, 9 aa, Homo Sapiens
AEDNPMVGA

SEQ ID NO: 813262 - protein, 9 aa, Homo Sapiens
QGIKVEASQ

SEQ ID NO: 813263 - protein, 9 aa, Homo Sapiens
IQSLQKSLE

SEQ ID NO: 813264 - protein, 9 aa, Homo Sapiens
IFQGEDEIR

SEQ ID NO: 813265 - protein, 9 aa, Homo Sapiens
QSQSTPKQI

SEQ ID NO: 813266 - protein, 9 aa, Homo Sapiens
EVVILLLLF

SEQ ID NO: 813267 - protein, 9 aa, Homo Sapiens
ITGYTLDVT

SEQ ID NO: 813268 - protein, 9 aa, Homo Sapiens
KNRDKKTKI

SEQ ID NO: 813269 - protein, 9 aa, Homo Sapiens
LDLTSNSLN

SEQ ID NO: 813270 - protein, 9 aa, Homo Sapiens
FSMVLTTAT

SEQ ID NO: 813271 - protein, 9 aa, Homo Sapiens
ISYFTKGEF

SEQ ID NO: 813272 - protein, 9 aa, Homo Sapiens
SLCSPTFRL

SEQ ID NO: 813273 - protein, 9 aa, Homo Sapiens
KFLIKTKAN

SEQ ID NO: 813274 - protein, 9 aa, Homo Sapiens
GSINPLKTT

SEQ ID NO: 813275 - protein, 9 aa, Homo Sapiens
QGPSSFYFT

SEQ ID NO: 813276 - protein, 9 aa, Homo Sapiens
FQIAMRILL

SEQ ID NO: 813277 - protein, 9 aa, Homo Sapiens
TTLPILSRL

SEQ ID NO: 813278 - protein, 9 aa, Homo Sapiens
YRTTGPELG

SEQ ID NO: 813279 - protein, 9 aa, Homo Sapiens
GGGALSAVT

SEQ ID NO: 813280 - protein, 9 aa, Homo Sapiens
FLVDSSWAI

SEQ ID NO: 813281 - protein, 9 aa, Homo Sapiens
VRYAIYRES

SEQ ID NO: 813282 - protein, 9 aa, Homo Sapiens
PHVNQNGFN

SEQ ID NO: 813283 - protein, 9 aa, Homo Sapiens
QIRKIDQRV

SEQ ID NO: 813284 - protein, 9 aa, Homo Sapiens
DLPILAEVI

SEQ ID NO: 813285 - protein, 9 aa, Homo Sapiens
NYLRLHEIT

SEQ ID NO: 813286 - protein, 9 aa, Homo Sapiens
SNDGPERAR

SEQ ID NO: 813287 - protein, 9 aa, Homo Sapiens
DGILKITYL

SEQ ID NO: 813288 - protein, 9 aa, Homo Sapiens
EAWINLNKE

SEQ ID NO: 813289 - protein, 9 aa, Homo Sapiens
KMIPTTTNN

SEQ ID NO: 813290 - protein, 9 aa, Homo Sapiens
NYQAQETTI

SEQ ID NO: 813291 - protein, 9 aa, Homo Sapiens
SYNKYVQGN

SEQ ID NO: 813292 - protein, 9 aa, Homo Sapiens
PSDSVHFEV

SEQ ID NO: 813293 - protein, 9 aa, Homo Sapiens
YLMGAIFGC

SEQ ID NO: 813294 - protein, 9 aa, Homo Sapiens
SPSKNYFIS

SEQ ID NO: 813295 - protein, 9 aa, Homo Sapiens
NQRLLLYQL

SEQ ID NO: 813296 - protein, 9 aa, Homo Sapiens
QKAKLARHH

SEQ ID NO: 813297 - protein, 9 aa, Homo Sapiens
NTFLTWVKE

SEQ ID NO: 813298 - protein, 9 aa, Homo Sapiens
GIPAHTAEE

SEQ ID NO: 813299 - protein, 9 aa, Homo Sapiens
TMRYEPANS

SEQ ID NO: 813300 - protein, 9 aa, Homo Sapiens
NDLNGSSHW

SEQ ID NO: 813301 - protein, 9 aa, Homo Sapiens
GGHGGCLLD

SEQ ID NO: 813302 - protein, 9 aa, Homo Sapiens
GLGLCSLFV

SEQ ID NO: 813303 - protein, 9 aa, Homo Sapiens
ILVGGIGLA

SEQ ID NO: 813304 - protein, 9 aa, Homo Sapiens
TPVYSMDYF

SEQ ID NO: 813305 - protein, 9 aa, Homo Sapiens
RTNVGIVKV

SEQ ID NO: 813306 - protein, 9 aa, Homo Sapiens
PTSALSNVC

SEQ ID NO: 813307 - protein, 9 aa, Homo Sapiens
MKKLDIKLR

SEQ ID NO: 813308 - protein, 9 aa, Homo Sapiens
ASISSEDLH

SEQ ID NO: 813309 - protein, 9 aa, Homo Sapiens
KTLQADFNK

SEQ ID NO: 813310 - protein, 9 aa, Homo Sapiens
GFFMKTCFW

SEQ ID NO: 813311 - protein, 9 aa, Homo Sapiens
GSDFVQKYL

SEQ ID NO: 813312 - protein, 9 aa, Homo Sapiens
QCGYYVVFG

SEQ ID NO: 813313 - protein, 9 aa, Homo Sapiens
SFETTKESL

SEQ ID NO: 813314 - protein, 9 aa, Homo Sapiens
CTNARRNRQ

SEQ ID NO: 813315 - protein, 9 aa, Homo Sapiens
CFSKHDIIG

SEQ ID NO: 813316 - protein, 9 aa, Homo Sapiens
CNQLLRCSD

SEQ ID NO: 813317 - protein, 9 aa, Homo Sapiens
LGLHSLRHG

SEQ ID NO: 813318 - protein, 9 aa, Homo Sapiens
IEDLTDDNI

SEQ ID NO: 813319 - protein, 9 aa, Homo Sapiens
DDTNRWFDK

SEQ ID NO: 813320 - protein, 9 aa, Homo Sapiens
SLGSWNPTS

SEQ ID NO: 813321 - protein, 9 aa, Homo Sapiens
LTYTSKENC

SEQ ID NO: 813322 - protein, 9 aa, Homo Sapiens
RARRDHSSI

SEQ ID NO: 813323 - protein, 9 aa, Homo Sapiens
SNPLVAATL

SEQ ID NO: 813324 - protein, 9 aa, Homo Sapiens
VQMPEYTVT

SEQ ID NO: 813325 - protein, 9 aa, Homo Sapiens
PCLTKIPGV

SEQ ID NO: 813326 - protein, 9 aa, Homo Sapiens
KLLQTRPLA

SEQ ID NO: 813327 - protein, 9 aa, Homo Sapiens
ADSNKTLDK

SEQ ID NO: 813328 - protein, 9 aa, Homo Sapiens
YQNGGYIFT

SEQ ID NO: 813329 - protein, 9 aa, Homo Sapiens
TEEPLVPTQ

SEQ ID NO: 813330 - protein, 9 aa, Homo Sapiens
RVAAQISRK

SEQ ID NO: 813331 - protein, 9 aa, Homo Sapiens
RDSTKSQRK

SEQ ID NO: 813332 - protein, 9 aa, Homo Sapiens
LYELDILFP

SEQ ID NO: 813333 - protein, 9 aa, Homo Sapiens
QVRVNYLTH

SEQ ID NO: 813334 - protein, 9 aa, Homo Sapiens
SPITYEKCL

SEQ ID NO: 813335 - protein, 9 aa, Homo Sapiens
FQFQLHFGH

SEQ ID NO: 813336 - protein, 9 aa, Homo Sapiens
YFLQRPGQQ

SEQ ID NO: 813337 - protein, 9 aa, Homo Sapiens
NSKSKPMTQ

SEQ ID NO: 813338 - protein, 9 aa, Homo Sapiens
LSKNFKKIR

SEQ ID NO: 813339 - protein, 9 aa, Homo Sapiens
GRTINKQIW

SEQ ID NO: 813340 - protein, 9 aa, Homo Sapiens
TSYWLQTTL

SEQ ID NO: 813341 - protein, 9 aa, Homo Sapiens
YHYTWKTSL

SEQ ID NO: 813342 - protein, 9 aa, Homo Sapiens
GLNKLFSEF

SEQ ID NO: 813343 - protein, 9 aa, Homo Sapiens
LGTHRMAKK

SEQ ID NO: 813344 - protein, 9 aa, Homo Sapiens
SVHLAHHQQ

SEQ ID NO: 813345 - protein, 9 aa, Homo Sapiens
MNEKTLDKL

SEQ ID NO: 813346 - protein, 9 aa, Homo Sapiens
QPAGAGSSP

SEQ ID NO: 813347 - protein, 9 aa, Homo Sapiens
GDSLRTSTI

SEQ ID NO: 813348 - protein, 9 aa, Homo Sapiens
SVTSVRDLA

SEQ ID NO: 813349 - protein, 9 aa, Homo Sapiens
YVVLLESLE

SEQ ID NO: 813350 - protein, 9 aa, Homo Sapiens
ASQDCIKTT

SEQ ID NO: 813351 - protein, 9 aa, Homo Sapiens
LKTMTDMFL

SEQ ID NO: 813352 - protein, 9 aa, Homo Sapiens
NKGVSNNVT

SEQ ID NO: 813353 - protein, 9 aa, Homo Sapiens
SAVRATLPI

SEQ ID NO: 813354 - protein, 9 aa, Homo Sapiens
LRDQCNTNC

SEQ ID NO: 813355 - protein, 9 aa, Homo Sapiens
EADKLLTEK

SEQ ID NO: 813356 - protein, 9 aa, Homo Sapiens
LKADRDYHI

SEQ ID NO: 813357 - protein, 9 aa, Homo Sapiens
HVTSTVNTG

SEQ ID NO: 813358 - protein, 9 aa, Homo Sapiens
KEVKQLLST

SEQ ID NO: 813359 - protein, 9 aa, Homo Sapiens
HPASLNGHL

SEQ ID NO: 813360 - protein, 9 aa, Homo Sapiens
PPLIQNLPK

SEQ ID NO: 813361 - protein, 9 aa, Homo Sapiens
EANKREKLE

SEQ ID NO: 813362 - protein, 9 aa, Homo Sapiens
GDVSLTIDN

SEQ ID NO: 813363 - protein, 9 aa, Homo Sapiens
LAKPVNKKN

SEQ ID NO: 813364 - protein, 9 aa, Homo Sapiens
MQWPFCGNN

SEQ ID NO: 813365 - protein, 9 aa, Homo Sapiens
SALHGSLVC

SEQ ID NO: 813366 - protein, 9 aa, Homo Sapiens
SFLLLSAAT

SEQ ID NO: 813367 - protein, 9 aa, Homo Sapiens
PEQLQNLII

SEQ ID NO: 813368 - protein, 9 aa, Homo Sapiens
LVKDNKCPC

SEQ ID NO: 813369 - protein, 9 aa, Homo Sapiens
YLSSLDEGP

SEQ ID NO: 813370 - protein, 9 aa, Homo Sapiens
DRARLDYMV

SEQ ID NO: 813371 - protein, 9 aa, Homo Sapiens
AFTFSSTIN

SEQ ID NO: 813372 - protein, 9 aa, Homo Sapiens
PYRCKKCEK

SEQ ID NO: 813373 - protein, 9 aa, Homo Sapiens
QDGRRWLTL

SEQ ID NO: 813374 - protein, 9 aa, Homo Sapiens
AIQNEMNVM

SEQ ID NO: 813375 - protein, 9 aa, Homo Sapiens
PWRCSYHKR

SEQ ID NO: 813376 - protein, 9 aa, Homo Sapiens
QNGIIKGYI

SEQ ID NO: 813377 - protein, 9 aa, Homo Sapiens
PEKIIAIAN

SEQ ID NO: 813378 - protein, 9 aa, Homo Sapiens
PIINLKREL

SEQ ID NO: 813379 - protein, 9 aa, Homo Sapiens
PQSVLLELD

SEQ ID NO: 813380 - protein, 9 aa, Homo Sapiens
PKCCGFVTN

SEQ ID NO: 813381 - protein, 9 aa, Homo Sapiens
GKTQQSQQE

SEQ ID NO: 813382 - protein, 9 aa, Homo Sapiens
CLISPDCCY

SEQ ID NO: 813383 - protein, 9 aa, Homo Sapiens
GQPQEAFQG

SEQ ID NO: 813384 - protein, 9 aa, Homo Sapiens
LPKQASIDG

SEQ ID NO: 813385 - protein, 9 aa, Homo Sapiens
RELFFRVAA

SEQ ID NO: 813386 - protein, 9 aa, Homo Sapiens
NKKRKALYE

SEQ ID NO: 813387 - protein, 9 aa, Homo Sapiens
QQTYTYNSG

SEQ ID NO: 813388 - protein, 9 aa, Homo Sapiens
QRESQILKA

SEQ ID NO: 813389 - protein, 9 aa, Homo Sapiens
FDWDVWEKN

SEQ ID NO: 813390 - protein, 9 aa, Homo Sapiens
PPVLTKVSY

SEQ ID NO: 813391 - protein, 9 aa, Homo Sapiens
IKLSIPVYI

SEQ ID NO: 813392 - protein, 9 aa, Homo Sapiens
ENHFSMAIR

SEQ ID NO: 813393 - protein, 9 aa, Homo Sapiens
RLQIYREKP

SEQ ID NO: 813394 - protein, 9 aa, Homo Sapiens
SFTPNQVAS

SEQ ID NO: 813395 - protein, 9 aa, Homo Sapiens
VDRNCLWYV

SEQ ID NO: 813396 - protein, 9 aa, Homo Sapiens
EEETRRQKI

SEQ ID NO: 813397 - protein, 9 aa, Homo Sapiens
LEYLHCQKL

SEQ ID NO: 813398 - protein, 9 aa, Homo Sapiens
HLYHWMHIC

SEQ ID NO: 813399 - protein, 9 aa, Homo Sapiens
ENSLGSPAI

SEQ ID NO: 813400 - protein, 9 aa, Homo Sapiens
YLCVIALRY

SEQ ID NO: 813401 - protein, 9 aa, Homo Sapiens
DSTKSQRKQ

SEQ ID NO: 813402 - protein, 9 aa, Homo Sapiens
KFTQDQMGI

SEQ ID NO: 813403 - protein, 9 aa, Homo Sapiens
ALLGLRKLV

SEQ ID NO: 813404 - protein, 9 aa, Homo Sapiens
SIPVDYIVL

SEQ ID NO: 813405 - protein, 9 aa, Homo Sapiens
WCGIEAFSN

SEQ ID NO: 813406 - protein, 9 aa, Homo Sapiens
KNIYWTDSH

SEQ ID NO: 813407 - protein, 9 aa, Homo Sapiens
EETSEEKRG

SEQ ID NO: 813408 - protein, 9 aa, Homo Sapiens
KSSPPESAD

SEQ ID NO: 813409 - protein, 9 aa, Homo Sapiens
TFILQNVMW

SEQ ID NO: 813410 - protein, 9 aa, Homo Sapiens
WAVYYAHYY

SEQ ID NO: 813411 - protein, 9 aa, Homo Sapiens
KARAAQSDL

SEQ ID NO: 813412 - protein, 9 aa, Homo Sapiens
AVLEVVQSG

SEQ ID NO: 813413 - protein, 9 aa, Homo Sapiens
SSSNSDVSV

SEQ ID NO: 813414 - protein, 9 aa, Homo Sapiens
LMENYQDAM

SEQ ID NO: 813415 - protein, 9 aa, Homo Sapiens
TVAVHGEEM

SEQ ID NO: 813416 - protein, 9 aa, Homo Sapiens
LATLPITFR

SEQ ID NO: 813417 - protein, 9 aa, Homo Sapiens
YMNSVIQVL

SEQ ID NO: 813418 - protein, 9 aa, Homo Sapiens
LKPAIKFAY

SEQ ID NO: 813419 - protein, 9 aa, Homo Sapiens
KVMNLFEEV

SEQ ID NO: 813420 - protein, 9 aa, Homo Sapiens
KPRISFNLF

SEQ ID NO: 813421 - protein, 9 aa, Homo Sapiens
YNYSENCGP

SEQ ID NO: 813422 - protein, 9 aa, Homo Sapiens
GDPRKDTGS

SEQ ID NO: 813423 - protein, 9 aa, Homo Sapiens
WGQNEKGQL

SEQ ID NO: 813424 - protein, 9 aa, Homo Sapiens
LTSLCKLWL

SEQ ID NO: 813425 - protein, 9 aa, Homo Sapiens
KIKEEIIKL

SEQ ID NO: 813426 - protein, 9 aa, Homo Sapiens
GDCFKHTNG

SEQ ID NO: 813427 - protein, 9 aa, Homo Sapiens
NSTISFGNV

SEQ ID NO: 813428 - protein, 9 aa, Homo Sapiens
TQGDMEIPF

SEQ ID NO: 813429 - protein, 9 aa, Homo Sapiens
RSAFARHRI

SEQ ID NO: 813430 - protein, 9 aa, Homo Sapiens
QQSTNQSHN

SEQ ID NO: 813431 - protein, 9 aa, Homo Sapiens
AWRLWRCQV

SEQ ID NO: 813432 - protein, 9 aa, Homo Sapiens
PLPPPPDLI

SEQ ID NO: 813433 - protein, 9 aa, Homo Sapiens
ATEEGMMGT

SEQ ID NO: 813434 - protein, 9 aa, Homo Sapiens
LQRYCYTDV

SEQ ID NO: 813435 - protein, 9 aa, Homo Sapiens
LALNGVCTD

SEQ ID NO: 813436 - protein, 9 aa, Homo Sapiens
SKAKGTGVP

SEQ ID NO: 813437 - protein, 9 aa, Homo Sapiens
LFSRQAKRP

SEQ ID NO: 813438 - protein, 9 aa, Homo Sapiens
NVQGQFLYA

SEQ ID NO: 813439 - protein, 9 aa, Homo Sapiens
VETYPSPYC

SEQ ID NO: 813440 - protein, 9 aa, Homo Sapiens
DAYLTEEDV

SEQ ID NO: 813441 - protein, 9 aa, Homo Sapiens
CIQQLTSEI

SEQ ID NO: 813442 - protein, 9 aa, Homo Sapiens
LQYFGRLSL

SEQ ID NO: 813443 - protein, 9 aa, Homo Sapiens
TLSGICTFI

SEQ ID NO: 813444 - protein, 9 aa, Homo Sapiens
PYNYDITLY

SEQ ID NO: 813445 - protein, 9 aa, Homo Sapiens
YMIYGKFRT

SEQ ID NO: 813446 - protein, 9 aa, Homo Sapiens
IMENAVQPL

SEQ ID NO: 813447 - protein, 9 aa, Homo Sapiens
HTQSYPTNS

SEQ ID NO: 813448 - protein, 9 aa, Homo Sapiens
LVLRHQYLR

SEQ ID NO: 813449 - protein, 9 aa, Homo Sapiens
AKQLVWRGV

SEQ ID NO: 813450 - protein, 9 aa, Homo Sapiens
DYQALQTSI

SEQ ID NO: 813451 - protein, 9 aa, Homo Sapiens
CPCTQHSLT

SEQ ID NO: 813452 - protein, 9 aa, Homo Sapiens
DESGINFLE

SEQ ID NO: 813453 - protein, 9 aa, Homo Sapiens
KQNIKKKGI

SEQ ID NO: 813454 - protein, 9 aa, Homo Sapiens
WAHGPGHIH

SEQ ID NO: 813455 - protein, 9 aa, Homo Sapiens
VSDKSNDLL

SEQ ID NO: 813456 - protein, 9 aa, Homo Sapiens
RQQRLLGSV

SEQ ID NO: 813457 - protein, 9 aa, Homo Sapiens
GRQTQWGLR

SEQ ID NO: 813458 - protein, 9 aa, Homo Sapiens
SGYYLDAEL

SEQ ID NO: 813459 - protein, 9 aa, Homo Sapiens
DAINKFVVT

SEQ ID NO: 813460 - protein, 9 aa, Homo Sapiens
VGTGRDMAS

SEQ ID NO: 813461 - protein, 9 aa, Homo Sapiens
LIISCLGRM

SEQ ID NO: 813462 - protein, 9 aa, Homo Sapiens
VAMHYSFAS

SEQ ID NO: 813463 - protein, 9 aa, Homo Sapiens
LQKEVENHY

SEQ ID NO: 813464 - protein, 9 aa, Homo Sapiens
TSFVLQELG

SEQ ID NO: 813465 - protein, 9 aa, Homo Sapiens
FKNDLLKKY

SEQ ID NO: 813466 - protein, 9 aa, Homo Sapiens
MRTTVFIAD

SEQ ID NO: 813467 - protein, 9 aa, Homo Sapiens
YRYPDIKEE

SEQ ID NO: 813468 - protein, 9 aa, Homo Sapiens
RFDPYGNNK

SEQ ID NO: 813469 - protein, 9 aa, Homo Sapiens
GGSIPASLS

SEQ ID NO: 813470 - protein, 9 aa, Homo Sapiens
YLATFDLKV

SEQ ID NO: 813471 - protein, 9 aa, Homo Sapiens
GMKPHDIFK

SEQ ID NO: 813472 - protein, 9 aa, Homo Sapiens
FDRPLVTFN

SEQ ID NO: 813473 - protein, 9 aa, Homo Sapiens
FQGGPIQNR

SEQ ID NO: 813474 - protein, 9 aa, Homo Sapiens
TYPTKCTVS

SEQ ID NO: 813475 - protein, 9 aa, Homo Sapiens
EEEDDVKLL

SEQ ID NO: 813476 - protein, 9 aa, Homo Sapiens
KFRVGASDR

SEQ ID NO: 813477 - protein, 9 aa, Homo Sapiens
GVLKMTIRD

SEQ ID NO: 813478 - protein, 9 aa, Homo Sapiens
RRKIIKTYR

SEQ ID NO: 813479 - protein, 9 aa, Homo Sapiens
KVDAVFIKD

SEQ ID NO: 813480 - protein, 9 aa, Homo Sapiens
TEISVSRLK

SEQ ID NO: 813481 - protein, 9 aa, Homo Sapiens
KPSDAESLE

SEQ ID NO: 813482 - protein, 9 aa, Homo Sapiens
TAAECASHL

SEQ ID NO: 813483 - protein, 9 aa, Homo Sapiens
RKDGTPFDE

SEQ ID NO: 813484 - protein, 9 aa, Homo Sapiens
DDEEEEEYN

SEQ ID NO: 813485 - protein, 9 aa, Homo Sapiens
AVLSFKCSQ

SEQ ID NO: 813486 - protein, 9 aa, Homo Sapiens
KNKFVSLIN

SEQ ID NO: 813487 - protein, 9 aa, Homo Sapiens
ECVELFRTT

SEQ ID NO: 813488 - protein, 9 aa, Homo Sapiens
GNYYWLLTH

SEQ ID NO: 813489 - protein, 9 aa, Homo Sapiens
HGSSETSSS

SEQ ID NO: 813490 - protein, 9 aa, Homo Sapiens
RLVNDLSKL

SEQ ID NO: 813491 - protein, 9 aa, Homo Sapiens
YTKKQCRPS

SEQ ID NO: 813492 - protein, 9 aa, Homo Sapiens
ARKIILCPL

SEQ ID NO: 813493 - protein, 9 aa, Homo Sapiens
SYLIDTVRS

SEQ ID NO: 813494 - protein, 9 aa, Homo Sapiens
WHVYRNFFN

SEQ ID NO: 813495 - protein, 9 aa, Homo Sapiens
HKEVVILLL

SEQ ID NO: 813496 - protein, 9 aa, Homo Sapiens
ATLPHGRCH

SEQ ID NO: 813497 - protein, 9 aa, Homo Sapiens
LDVLCEMAV

SEQ ID NO: 813498 - protein, 9 aa, Homo Sapiens
APFCCEFDS

SEQ ID NO: 813499 - protein, 9 aa, Homo Sapiens
KTEFDFSEY

SEQ ID NO: 813500 - protein, 9 aa, Homo Sapiens
LQIALMASL

SEQ ID NO: 813501 - protein, 9 aa, Homo Sapiens
SRMDNTGVP

SEQ ID NO: 813502 - protein, 9 aa, Homo Sapiens
AINQNGEEL

SEQ ID NO: 813503 - protein, 9 aa, Homo Sapiens
SDFDAKSSV

SEQ ID NO: 813504 - protein, 9 aa, Homo Sapiens
LDCVQDVLC

SEQ ID NO: 813505 - protein, 9 aa, Homo Sapiens
CIVKRTKKR

SEQ ID NO: 813506 - protein, 9 aa, Homo Sapiens
SEISRIKTL

SEQ ID NO: 813507 - protein, 9 aa, Homo Sapiens
QWLLSKANA

SEQ ID NO: 813508 - protein, 9 aa, Homo Sapiens
NDRDKPEAK

SEQ ID NO: 813509 - protein, 9 aa, Homo Sapiens
KHRKYSHHD

SEQ ID NO: 813510 - protein, 9 aa, Homo Sapiens
SHSSSFQSH

SEQ ID NO: 813511 - protein, 9 aa, Homo Sapiens
GFCYKMDTV

SEQ ID NO: 813512 - protein, 9 aa, Homo Sapiens
ETDVINFDD

SEQ ID NO: 813513 - protein, 9 aa, Homo Sapiens
PHPPTAPTR

SEQ ID NO: 813514 - protein, 9 aa, Homo Sapiens
MGTSSSLAT

SEQ ID NO: 813515 - protein, 9 aa, Homo Sapiens
HFHINLDGY

SEQ ID NO: 813516 - protein, 9 aa, Homo Sapiens
RTLFKEYFI

SEQ ID NO: 813517 - protein, 9 aa, Homo Sapiens
PPDPHLLVS

SEQ ID NO: 813518 - protein, 9 aa, Homo Sapiens
IQFYFVHSA

SEQ ID NO: 813519 - protein, 9 aa, Homo Sapiens
FISDIKSEC

SEQ ID NO: 813520 - protein, 9 aa, Homo Sapiens
SCPGCQKPL

SEQ ID NO: 813521 - protein, 9 aa, Homo Sapiens
SINYTDCLT

SEQ ID NO: 813522 - protein, 9 aa, Homo Sapiens
LSMNLESDN

SEQ ID NO: 813523 - protein, 9 aa, Homo Sapiens
TFPLKNAKD

SEQ ID NO: 813524 - protein, 9 aa, Homo Sapiens
ERTNVGIVK

SEQ ID NO: 813525 - protein, 9 aa, Homo Sapiens
VLPGVAHGP

SEQ ID NO: 813526 - protein, 9 aa, Homo Sapiens
CVLLLFIIM

SEQ ID NO: 813527 - protein, 9 aa, Homo Sapiens
PDSNVSGLA

SEQ ID NO: 813528 - protein, 9 aa, Homo Sapiens
RIIWKRTAP

SEQ ID NO: 813529 - protein, 9 aa, Homo Sapiens
RSSFEINAF

SEQ ID NO: 813530 - protein, 9 aa, Homo Sapiens
RRIPKLVQI

SEQ ID NO: 813531 - protein, 9 aa, Homo Sapiens
GRWFSQKAS

SEQ ID NO: 813532 - protein, 9 aa, Homo Sapiens
FPSTFPHVS

SEQ ID NO: 813533 - protein, 9 aa, Homo Sapiens
EWWENQPAG

SEQ ID NO: 813534 - protein, 9 aa, Homo Sapiens
NFGSNFVSA

SEQ ID NO: 813535 - protein, 9 aa, Homo Sapiens
SCPSLCSRL

SEQ ID NO: 813536 - protein, 9 aa, Homo Sapiens
IDEHLFGVA

SEQ ID NO: 813537 - protein, 9 aa, Homo Sapiens
NALGVLSSY

SEQ ID NO: 813538 - protein, 9 aa, Homo Sapiens
KTAEENEKL

SEQ ID NO: 813539 - protein, 9 aa, Homo Sapiens
PYRGPRGGG

SEQ ID NO: 813540 - protein, 9 aa, Homo Sapiens
GNDFFINDS

SEQ ID NO: 813541 - protein, 9 aa, Homo Sapiens
DAELSLEEQ

SEQ ID NO: 813542 - protein, 9 aa, Homo Sapiens
LMLRSLGEK

SEQ ID NO: 813543 - protein, 9 aa, Homo Sapiens
LDPGSFVEN

SEQ ID NO: 813544 - protein, 9 aa, Homo Sapiens
HDEEPTVSI

SEQ ID NO: 813545 - protein, 9 aa, Homo Sapiens
LIDSFQRVD

SEQ ID NO: 813546 - protein, 9 aa, Homo Sapiens
SNPLEKEQI

SEQ ID NO: 813547 - protein, 9 aa, Homo Sapiens
RRLRISGLF

SEQ ID NO: 813548 - protein, 9 aa, Homo Sapiens
FNITKSLVY

SEQ ID NO: 813549 - protein, 9 aa, Homo Sapiens
EPAIEMQKY

SEQ ID NO: 813550 - protein, 9 aa, Homo Sapiens
LELAPDIVG

SEQ ID NO: 813551 - protein, 9 aa, Homo Sapiens
LILNTIDIP

SEQ ID NO: 813552 - protein, 9 aa, Homo Sapiens
KRQKRKNRQ

SEQ ID NO: 813553 - protein, 9 aa, Homo Sapiens
GADIESKNT

SEQ ID NO: 813554 - protein, 9 aa, Homo Sapiens
NFKSPVKMI

SEQ ID NO: 813555 - protein, 9 aa, Homo Sapiens
AGFIPLLEY

SEQ ID NO: 813556 - protein, 9 aa, Homo Sapiens
CKALSSCAS

SEQ ID NO: 813557 - protein, 9 aa, Homo Sapiens
LCEQGLVGF

SEQ ID NO: 813558 - protein, 9 aa, Homo Sapiens
GHSIVISSL

SEQ ID NO: 813559 - protein, 9 aa, Homo Sapiens
YVPSSPIIA

SEQ ID NO: 813560 - protein, 9 aa, Homo Sapiens
VQSQQIQRA

SEQ ID NO: 813561 - protein, 9 aa, Homo Sapiens
QAALLPSDE

SEQ ID NO: 813562 - protein, 9 aa, Homo Sapiens
RPNLRANPL

SEQ ID NO: 813563 - protein, 9 aa, Homo Sapiens
LNSDLVKGL

SEQ ID NO: 813564 - protein, 9 aa, Homo Sapiens
HDKIMFGFR

SEQ ID NO: 813565 - protein, 9 aa, Homo Sapiens
WKVNKDKEK

SEQ ID NO: 813566 - protein, 9 aa, Homo Sapiens
KCTYAIKCK

SEQ ID NO: 813567 - protein, 9 aa, Homo Sapiens
NAHVKKDVT

SEQ ID NO: 813568 - protein, 9 aa, Homo Sapiens
LGGRESYMS

SEQ ID NO: 813569 - protein, 9 aa, Homo Sapiens
ASVEASQPV

SEQ ID NO: 813570 - protein, 9 aa, Homo Sapiens
ELSTDAVDC

SEQ ID NO: 813571 - protein, 9 aa, Homo Sapiens
SIRKDLIQH

SEQ ID NO: 813572 - protein, 9 aa, Homo Sapiens
YIVVVAGNI

SEQ ID NO: 813573 - protein, 9 aa, Homo Sapiens
NNGYEIYES

SEQ ID NO: 813574 - protein, 9 aa, Homo Sapiens
MAVLGHWPQ

SEQ ID NO: 813575 - protein, 9 aa, Homo Sapiens
TLNINFLLR

SEQ ID NO: 813576 - protein, 9 aa, Homo Sapiens
CGCLCGMAG

SEQ ID NO: 813577 - protein, 9 aa, Homo Sapiens
RSPLRVSKR

SEQ ID NO: 813578 - protein, 9 aa, Homo Sapiens
DTREDMNEW

SEQ ID NO: 813579 - protein, 9 aa, Homo Sapiens
HGADNFIQH

SEQ ID NO: 813580 - protein, 9 aa, Homo Sapiens
KDMDIGGTS

SEQ ID NO: 813581 - protein, 9 aa, Homo Sapiens
KYNFPIDEL

SEQ ID NO: 813582 - protein, 9 aa, Homo Sapiens
GVGYRGTMV

SEQ ID NO: 813583 - protein, 9 aa, Homo Sapiens
LQSGNATDS

SEQ ID NO: 813584 - protein, 9 aa, Homo Sapiens
SWCANYICS

SEQ ID NO: 813585 - protein, 9 aa, Homo Sapiens
DCYGYRDFG

SEQ ID NO: 813586 - protein, 9 aa, Homo Sapiens
RPGHVVVEL

SEQ ID NO: 813587 - protein, 9 aa, Homo Sapiens
RAQYTFQNG

SEQ ID NO: 813588 - protein, 9 aa, Homo Sapiens
EDKEKEEKE

SEQ ID NO: 813589 - protein, 9 aa, Homo Sapiens
MVERWKQAT

SEQ ID NO: 813590 - protein, 9 aa, Homo Sapiens
VTRSWKSIL

SEQ ID NO: 813591 - protein, 9 aa, Homo Sapiens
YLDREGTPE

SEQ ID NO: 813592 - protein, 9 aa, Homo Sapiens
QKLFESLFA

SEQ ID NO: 813593 - protein, 9 aa, Homo Sapiens
NDGDLRNKR

SEQ ID NO: 813594 - protein, 9 aa, Homo Sapiens
ESDQSDSAK

SEQ ID NO: 813595 - protein, 9 aa, Homo Sapiens
KNKKEKGNG

SEQ ID NO: 813596 - protein, 9 aa, Homo Sapiens
SAEKLSHPT

SEQ ID NO: 813597 - protein, 9 aa, Homo Sapiens
HQAILGSVE

SEQ ID NO: 813598 - protein, 9 aa, Homo Sapiens
SNGSGCTLA

SEQ ID NO: 813599 - protein, 9 aa, Homo Sapiens
TRRFNEQAF

SEQ ID NO: 813600 - protein, 9 aa, Homo Sapiens
SKEIAITHH

SEQ ID NO: 813601 - protein, 9 aa, Homo Sapiens
LLCCQAGVH

SEQ ID NO: 813602 - protein, 9 aa, Homo Sapiens
RPLIKPKQR

SEQ ID NO: 813603 - protein, 9 aa, Homo Sapiens
IIYFIAPKQ

SEQ ID NO: 813604 - protein, 9 aa, Homo Sapiens
VTSVRDLAD

SEQ ID NO: 813605 - protein, 9 aa, Homo Sapiens
GFNTNAEGC

SEQ ID NO: 813606 - protein, 9 aa, Homo Sapiens
HLPCVQVLH

SEQ ID NO: 813607 - protein, 9 aa, Homo Sapiens
VNPQNSKIF

SEQ ID NO: 813608 - protein, 9 aa, Homo Sapiens
SVLNWLISD

SEQ ID NO: 813609 - protein, 9 aa, Homo Sapiens
KEGTYIIEM

SEQ ID NO: 813610 - protein, 9 aa, Homo Sapiens
ILVAPCLLL

SEQ ID NO: 813611 - protein, 9 aa, Homo Sapiens
RIKRVQLIS

SEQ ID NO: 813612 - protein, 9 aa, Homo Sapiens
KFMERNRAA

SEQ ID NO: 813613 - protein, 9 aa, Homo Sapiens
LLTVLSWLP

SEQ ID NO: 813614 - protein, 9 aa, Homo Sapiens
IVTTVDASG

SEQ ID NO: 813615 - protein, 9 aa, Homo Sapiens
EVTARDVEV

SEQ ID NO: 813616 - protein, 9 aa, Homo Sapiens
MPHSLRSPS

SEQ ID NO: 813617 - protein, 9 aa, Homo Sapiens
DGQITMDKT

SEQ ID NO: 813618 - protein, 9 aa, Homo Sapiens
LQFQVTEGL

SEQ ID NO: 813619 - protein, 9 aa, Homo Sapiens
NFLPPSWRE

SEQ ID NO: 813620 - protein, 9 aa, Homo Sapiens
FSEYVYKVV

SEQ ID NO: 813621 - protein, 9 aa, Homo Sapiens
NPTSQENNE

SEQ ID NO: 813622 - protein, 9 aa, Homo Sapiens
FTPNQVASM

SEQ ID NO: 813623 - protein, 9 aa, Homo Sapiens
EGGACSVDI

SEQ ID NO: 813624 - protein, 9 aa, Homo Sapiens
NSCSNNEID

SEQ ID NO: 813625 - protein, 9 aa, Homo Sapiens
MMAQNNLSP

SEQ ID NO: 813626 - protein, 9 aa, Homo Sapiens
PQDLTFNLR

SEQ ID NO: 813627 - protein, 9 aa, Homo Sapiens
KQRVKAAMA

SEQ ID NO: 813628 - protein, 9 aa, Homo Sapiens
LLVLVAVAL

SEQ ID NO: 813629 - protein, 9 aa, Homo Sapiens
TLRQIAHGA

SEQ ID NO: 813630 - protein, 9 aa, Homo Sapiens
TPNHAPMAG

SEQ ID NO: 813631 - protein, 9 aa, Homo Sapiens
VYKQVIEAP

SEQ ID NO: 813632 - protein, 9 aa, Homo Sapiens
VEYHYLVSQ

SEQ ID NO: 813633 - protein, 9 aa, Homo Sapiens
LLFYSLKNP

SEQ ID NO: 813634 - protein, 9 aa, Homo Sapiens
SQSSTNQTG

SEQ ID NO: 813635 - protein, 9 aa, Homo Sapiens
KQSRTSKLL

SEQ ID NO: 813636 - protein, 9 aa, Homo Sapiens
LRMRVRNSL

SEQ ID NO: 813637 - protein, 9 aa, Homo Sapiens
LLPSYPVAP

SEQ ID NO: 813638 - protein, 9 aa, Homo Sapiens
NTCRDHTSD

SEQ ID NO: 813639 - protein, 9 aa, Homo Sapiens
ALDHFVLFF

SEQ ID NO: 813640 - protein, 9 aa, Homo Sapiens
PRTTEPPTK

SEQ ID NO: 813641 - protein, 9 aa, Homo Sapiens
NEVSHNFQT

SEQ ID NO: 813642 - protein, 9 aa, Homo Sapiens
EEIQSARRH

SEQ ID NO: 813643 - protein, 9 aa, Homo Sapiens
LSIYLKGMY

SEQ ID NO: 813644 - protein, 9 aa, Homo Sapiens
FDPAAQITT

SEQ ID NO: 813645 - protein, 9 aa, Homo Sapiens
RKLVAHKPL

SEQ ID NO: 813646 - protein, 9 aa, Homo Sapiens
PQGSYMLVD

SEQ ID NO: 813647 - protein, 9 aa, Homo Sapiens
QKAQDEPSS

SEQ ID NO: 813648 - protein, 9 aa, Homo Sapiens
VWSLSCTVV

SEQ ID NO: 813649 - protein, 9 aa, Homo Sapiens
RAWLCLALM

SEQ ID NO: 813650 - protein, 9 aa, Homo Sapiens
NAVAHRNST

SEQ ID NO: 813651 - protein, 9 aa, Homo Sapiens
RVLIFSQVT

SEQ ID NO: 813652 - protein, 9 aa, Homo Sapiens
IQRTHGKNY

SEQ ID NO: 813653 - protein, 9 aa, Homo Sapiens
KGKNQLLEA

SEQ ID NO: 813654 - protein, 9 aa, Homo Sapiens
LVCNAMRAV

SEQ ID NO: 813655 - protein, 9 aa, Homo Sapiens
GGKLMKIPG

SEQ ID NO: 813656 - protein, 9 aa, Homo Sapiens
HNNIAGRKA

SEQ ID NO: 813657 - protein, 9 aa, Homo Sapiens
TFGIDSHIS

SEQ ID NO: 813658 - protein, 9 aa, Homo Sapiens
NEKSVQKSI

SEQ ID NO: 813659 - protein, 9 aa, Homo Sapiens
IKALKYAIS

SEQ ID NO: 813660 - protein, 9 aa, Homo Sapiens
ARLVKGEIT

SEQ ID NO: 813661 - protein, 9 aa, Homo Sapiens
FHTFYFENL

SEQ ID NO: 813662 - protein, 9 aa, Homo Sapiens
DRNKLEQLY

SEQ ID NO: 813663 - protein, 9 aa, Homo Sapiens
PYNHIDDLS

SEQ ID NO: 813664 - protein, 9 aa, Homo Sapiens
PNRSCQIEQ

SEQ ID NO: 813665 - protein, 9 aa, Homo Sapiens
GMGVIPRIV

SEQ ID NO: 813666 - protein, 9 aa, Homo Sapiens
YGVRTKEIN

SEQ ID NO: 813667 - protein, 9 aa, Homo Sapiens
SQKAIIFKC

SEQ ID NO: 813668 - protein, 9 aa, Homo Sapiens
PHTQKFTHS

SEQ ID NO: 813669 - protein, 9 aa, Homo Sapiens
NTFRDSLED

SEQ ID NO: 813670 - protein, 9 aa, Homo Sapiens
STPAFLWPW

SEQ ID NO: 813671 - protein, 9 aa, Homo Sapiens
EPIFHCQQE

SEQ ID NO: 813672 - protein, 9 aa, Homo Sapiens
EKIELPSST

SEQ ID NO: 813673 - protein, 9 aa, Homo Sapiens
LCLDKKKVE

SEQ ID NO: 813674 - protein, 9 aa, Homo Sapiens
GLKLLCRYK

SEQ ID NO: 813675 - protein, 9 aa, Homo Sapiens
LATYYKIKR

SEQ ID NO: 813676 - protein, 9 aa, Homo Sapiens
QRRLIEEQL

SEQ ID NO: 813677 - protein, 9 aa, Homo Sapiens
VKYGFFHES

SEQ ID NO: 813678 - protein, 9 aa, Homo Sapiens
LQEAANDIE

SEQ ID NO: 813679 - protein, 9 aa, Homo Sapiens
VPQSEKSKS

SEQ ID NO: 813680 - protein, 9 aa, Homo Sapiens
EEQINARDA

SEQ ID NO: 813681 - protein, 9 aa, Homo Sapiens
LTSLFSLNA

SEQ ID NO: 813682 - protein, 9 aa, Homo Sapiens
NKTVDTFRV

SEQ ID NO: 813683 - protein, 9 aa, Homo Sapiens
VGKLDLDKG

SEQ ID NO: 813684 - protein, 9 aa, Homo Sapiens
RMFPEGKSF

SEQ ID NO: 813685 - protein, 9 aa, Homo Sapiens
SADYNKIVE

SEQ ID NO: 813686 - protein, 9 aa, Homo Sapiens
RDQQQNEIL

SEQ ID NO: 813687 - protein, 9 aa, Homo Sapiens
NWRTMSSSD

SEQ ID NO: 813688 - protein, 9 aa, Homo Sapiens
VRCSHFPAG

SEQ ID NO: 813689 - protein, 9 aa, Homo Sapiens
VKYYMRSLH

SEQ ID NO: 813690 - protein, 9 aa, Homo Sapiens
GTSGKTVLH

SEQ ID NO: 813691 - protein, 9 aa, Homo Sapiens
MTLQWKSAN

SEQ ID NO: 813692 - protein, 9 aa, Homo Sapiens
TLPGSSDED

SEQ ID NO: 813693 - protein, 9 aa, Homo Sapiens
LRVALEDSG

SEQ ID NO: 813694 - protein, 9 aa, Homo Sapiens
CDQRVIIVR

SEQ ID NO: 813695 - protein, 9 aa, Homo Sapiens
EGDHVFCAV

SEQ ID NO: 813696 - protein, 9 aa, Homo Sapiens
LEEPNLGKK

SEQ ID NO: 813697 - protein, 9 aa, Homo Sapiens
FLLLGLSKS

SEQ ID NO: 813698 - protein, 9 aa, Homo Sapiens
TVNLVGKDS

SEQ ID NO: 813699 - protein, 9 aa, Homo Sapiens
NKNYYVGSQ

SEQ ID NO: 813700 - protein, 9 aa, Homo Sapiens
TLDEFIESC

SEQ ID NO: 813701 - protein, 9 aa, Homo Sapiens
EAHKKFNIK

SEQ ID NO: 813702 - protein, 9 aa, Homo Sapiens
HIRENYYRC

SEQ ID NO: 813703 - protein, 9 aa, Homo Sapiens
IGKYLDFEK

SEQ ID NO: 813704 - protein, 9 aa, Homo Sapiens
LQTHCYRAA

SEQ ID NO: 813705 - protein, 9 aa, Homo Sapiens
IISLEFKNK

SEQ ID NO: 813706 - protein, 9 aa, Homo Sapiens
FLKSSLNNG

SEQ ID NO: 813707 - protein, 9 aa, Homo Sapiens
KTKDNVEKE

SEQ ID NO: 813708 - protein, 9 aa, Homo Sapiens
EKINSEGTC

SEQ ID NO: 813709 - protein, 9 aa, Homo Sapiens
VCCNYSLHV

SEQ ID NO: 813710 - protein, 9 aa, Homo Sapiens
RLQEDKSLN

SEQ ID NO: 813711 - protein, 9 aa, Homo Sapiens
GDITKEDLI

SEQ ID NO: 813712 - protein, 9 aa, Homo Sapiens
LARKIIIRC

SEQ ID NO: 813713 - protein, 9 aa, Homo Sapiens
GFDSVVSSA

SEQ ID NO: 813714 - protein, 9 aa, Homo Sapiens
PVNHSYPKC

SEQ ID NO: 813715 - protein, 9 aa, Homo Sapiens
LGAESPSRT

SEQ ID NO: 813716 - protein, 9 aa, Homo Sapiens
IMGDHNRNL

SEQ ID NO: 813717 - protein, 9 aa, Homo Sapiens
LELYPVPLE

SEQ ID NO: 813718 - protein, 9 aa, Homo Sapiens
VKWHYNKQS

SEQ ID NO: 813719 - protein, 9 aa, Homo Sapiens
PARPRDSLL

SEQ ID NO: 813720 - protein, 9 aa, Homo Sapiens
TLGVSILYQ

SEQ ID NO: 813721 - protein, 9 aa, Homo Sapiens
VTIKSWVDT

SEQ ID NO: 813722 - protein, 9 aa, Homo Sapiens
AMAVEDIIY

SEQ ID NO: 813723 - protein, 9 aa, Homo Sapiens
PVWPAKEDN

SEQ ID NO: 813724 - protein, 9 aa, Homo Sapiens
IYRCYYRSP

SEQ ID NO: 813725 - protein, 9 aa, Homo Sapiens
GSGSHEGPQ

SEQ ID NO: 813726 - protein, 9 aa, Homo Sapiens
EKLGNGALL

SEQ ID NO: 813727 - protein, 9 aa, Homo Sapiens
FVAVLTQES

SEQ ID NO: 813728 - protein, 9 aa, Homo Sapiens
STVFPIMNL

SEQ ID NO: 813729 - protein, 9 aa, Homo Sapiens
NQTGSEGLA

SEQ ID NO: 813730 - protein, 9 aa, Homo Sapiens
WCVDDKGGF

SEQ ID NO: 813731 - protein, 9 aa, Homo Sapiens
ERVVDYIVS

SEQ ID NO: 813732 - protein, 9 aa, Homo Sapiens
VEWKPFKTI

SEQ ID NO: 813733 - protein, 9 aa, Homo Sapiens
DRRRMPGGG

SEQ ID NO: 813734 - protein, 9 aa, Homo Sapiens
GKFIESHAL

SEQ ID NO: 813735 - protein, 9 aa, Homo Sapiens
RAVRVFECG

SEQ ID NO: 813736 - protein, 9 aa, Homo Sapiens
SMFLSVTLV

SEQ ID NO: 813737 - protein, 9 aa, Homo Sapiens
KKHEDEREK

SEQ ID NO: 813738 - protein, 9 aa, Homo Sapiens
LEGLMKHLN

SEQ ID NO: 813739 - protein, 9 aa, Homo Sapiens
ELSNIAAID

SEQ ID NO: 813740 - protein, 9 aa, Homo Sapiens
PTNNENTYG

SEQ ID NO: 813741 - protein, 9 aa, Homo Sapiens
PGASHFEHL

SEQ ID NO: 813742 - protein, 9 aa, Homo Sapiens
LHGFWMDIG

SEQ ID NO: 813743 - protein, 9 aa, Homo Sapiens
NDVLAEYKI

SEQ ID NO: 813744 - protein, 9 aa, Homo Sapiens
RNCIGQAFT

SEQ ID NO: 813745 - protein, 9 aa, Homo Sapiens
HLGVKVKGP

SEQ ID NO: 813746 - protein, 9 aa, Homo Sapiens
NVPTEEQRP

SEQ ID NO: 813747 - protein, 9 aa, Homo Sapiens
TPPEKGSHM

SEQ ID NO: 813748 - protein, 9 aa, Homo Sapiens
ICSGTLVMI

SEQ ID NO: 813749 - protein, 9 aa, Homo Sapiens
RRLKQNLAL

SEQ ID NO: 813750 - protein, 9 aa, Homo Sapiens
LGGLPSIAN

SEQ ID NO: 813751 - protein, 9 aa, Homo Sapiens
PERLAPGHF

SEQ ID NO: 813752 - protein, 9 aa, Homo Sapiens
PFQMRIVLI

SEQ ID NO: 813753 - protein, 9 aa, Homo Sapiens
YKKLQEKHK

SEQ ID NO: 813754 - protein, 9 aa, Homo Sapiens
LGPPGPPGA

SEQ ID NO: 813755 - protein, 9 aa, Homo Sapiens
KKPYKCPYC

SEQ ID NO: 813756 - protein, 9 aa, Homo Sapiens
DVIENYCDP

SEQ ID NO: 813757 - protein, 9 aa, Homo Sapiens
TAMGVVYAL

SEQ ID NO: 813758 - protein, 9 aa, Homo Sapiens
PLKKLCFDI

SEQ ID NO: 813759 - protein, 9 aa, Homo Sapiens
ILCALLNLL

SEQ ID NO: 813760 - protein, 9 aa, Homo Sapiens
TAVHVQDSG

SEQ ID NO: 813761 - protein, 9 aa, Homo Sapiens
FQLTASFDS

SEQ ID NO: 813762 - protein, 9 aa, Homo Sapiens
DYEGDDDES

SEQ ID NO: 813763 - protein, 9 aa, Homo Sapiens
SHLNDHWRI

SEQ ID NO: 813764 - protein, 9 aa, Homo Sapiens
CCRSTCCQT

SEQ ID NO: 813765 - protein, 9 aa, Homo Sapiens
RYGGQQEPG

SEQ ID NO: 813766 - protein, 9 aa, Homo Sapiens
KKVTSSKCF

SEQ ID NO: 813767 - protein, 9 aa, Homo Sapiens
TLKGKMRAR

SEQ ID NO: 813768 - protein, 9 aa, Homo Sapiens
MWVVRGVDW

SEQ ID NO: 813769 - protein, 9 aa, Homo Sapiens
HITMKKLKG

SEQ ID NO: 813770 - protein, 9 aa, Homo Sapiens
ANGDGAIDF

SEQ ID NO: 813771 - protein, 9 aa, Homo Sapiens
FNKRKEQGL

SEQ ID NO: 813772 - protein, 9 aa, Homo Sapiens
IYDAPPNIL

SEQ ID NO: 813773 - protein, 9 aa, Homo Sapiens
LQESREGLK

SEQ ID NO: 813774 - protein, 9 aa, Homo Sapiens
QAQSCAKVR

SEQ ID NO: 813775 - protein, 9 aa, Homo Sapiens
INSLSYYQV

SEQ ID NO: 813776 - protein, 9 aa, Homo Sapiens
AFNKDSGIV

SEQ ID NO: 813777 - protein, 9 aa, Homo Sapiens
IAVVILLFV

SEQ ID NO: 813778 - protein, 9 aa, Homo Sapiens
LVSAIRRSD

SEQ ID NO: 813779 - protein, 9 aa, Homo Sapiens
KDSVINILI

SEQ ID NO: 813780 - protein, 9 aa, Homo Sapiens
REVPRGLRE

SEQ ID NO: 813781 - protein, 9 aa, Homo Sapiens
ERGRFWSGN

SEQ ID NO: 813782 - protein, 9 aa, Homo Sapiens
HREPQLRPN

SEQ ID NO: 813783 - protein, 9 aa, Homo Sapiens
QNKLECLKE

SEQ ID NO: 813784 - protein, 9 aa, Homo Sapiens
FIDDKGVLF

SEQ ID NO: 813785 - protein, 9 aa, Homo Sapiens
LHPMKQPAV

SEQ ID NO: 813786 - protein, 9 aa, Homo Sapiens
KLEEIYESS

SEQ ID NO: 813787 - protein, 9 aa, Homo Sapiens
EKDRELIHK

SEQ ID NO: 813788 - protein, 9 aa, Homo Sapiens
DYFSEISNP

SEQ ID NO: 813789 - protein, 9 aa, Homo Sapiens
ELQQKFIDN

SEQ ID NO: 813790 - protein, 9 aa, Homo Sapiens
RVLGPVRGE

SEQ ID NO: 813791 - protein, 9 aa, Homo Sapiens
KPTRIIWKR

SEQ ID NO: 813792 - protein, 9 aa, Homo Sapiens
EWWSEFKTL

SEQ ID NO: 813793 - protein, 9 aa, Homo Sapiens
AHITTPEQL

SEQ ID NO: 813794 - protein, 9 aa, Homo Sapiens
LKSSLNNGV

SEQ ID NO: 813795 - protein, 9 aa, Homo Sapiens
LCLAYQTDN

SEQ ID NO: 813796 - protein, 9 aa, Homo Sapiens
LNEIYAGVC

SEQ ID NO: 813797 - protein, 9 aa, Homo Sapiens
RTSTFSGFE

SEQ ID NO: 813798 - protein, 9 aa, Homo Sapiens
AAPFCCEFD

SEQ ID NO: 813799 - protein, 9 aa, Homo Sapiens
NPTHSADVL

SEQ ID NO: 813800 - protein, 9 aa, Homo Sapiens
PFYVPHAET

SEQ ID NO: 813801 - protein, 9 aa, Homo Sapiens
APEHPPICQ

SEQ ID NO: 813802 - protein, 9 aa, Homo Sapiens
IAERISERQ

SEQ ID NO: 813803 - protein, 9 aa, Homo Sapiens
LVLKIFFES

SEQ ID NO: 813804 - protein, 9 aa, Homo Sapiens
YDRVVAISC

SEQ ID NO: 813805 - protein, 9 aa, Homo Sapiens
NKEIIKAIN

SEQ ID NO: 813806 - protein, 9 aa, Homo Sapiens
VVSQIDAVC

SEQ ID NO: 813807 - protein, 9 aa, Homo Sapiens
AVVILSVLF

SEQ ID NO: 813808 - protein, 9 aa, Homo Sapiens
LPCQPFYQV

SEQ ID NO: 813809 - protein, 9 aa, Homo Sapiens
RMPSSVSLR

SEQ ID NO: 813810 - protein, 9 aa, Homo Sapiens
SKAPSRTQR

SEQ ID NO: 813811 - protein, 9 aa, Homo Sapiens
VFAKQVRAK

SEQ ID NO: 813812 - protein, 9 aa, Homo Sapiens
DHRLKSQTI

SEQ ID NO: 813813 - protein, 9 aa, Homo Sapiens
SKFITKDKR

SEQ ID NO: 813814 - protein, 9 aa, Homo Sapiens
EAFYDISQI

SEQ ID NO: 813815 - protein, 9 aa, Homo Sapiens
NGMLLNERK

SEQ ID NO: 813816 - protein, 9 aa, Homo Sapiens
KYIHLPDGS

SEQ ID NO: 813817 - protein, 9 aa, Homo Sapiens
QRLMLINNA

SEQ ID NO: 813818 - protein, 9 aa, Homo Sapiens
GKSFINYRF

SEQ ID NO: 813819 - protein, 9 aa, Homo Sapiens
SPNKKAHPD

SEQ ID NO: 813820 - protein, 9 aa, Homo Sapiens
SHSQQKKTF

SEQ ID NO: 813821 - protein, 9 aa, Homo Sapiens
KGSYEILQD

SEQ ID NO: 813822 - protein, 9 aa, Homo Sapiens
YVPKEHTLQ

SEQ ID NO: 813823 - protein, 9 aa, Homo Sapiens
GPFPVTSHQ

SEQ ID NO: 813824 - protein, 9 aa, Homo Sapiens
VRLKPAIKF

SEQ ID NO: 813825 - protein, 9 aa, Homo Sapiens
HKNLNLVWE

SEQ ID NO: 813826 - protein, 9 aa, Homo Sapiens
AIYIIPPYM

SEQ ID NO: 813827 - protein, 9 aa, Homo Sapiens
MLAELTAQG

SEQ ID NO: 813828 - protein, 9 aa, Homo Sapiens
GCMHVAENV

SEQ ID NO: 813829 - protein, 9 aa, Homo Sapiens
YDKDNNGRL

SEQ ID NO: 813830 - protein, 9 aa, Homo Sapiens
ARQISCKAE

SEQ ID NO: 813831 - protein, 9 aa, Homo Sapiens
IQALREGDH

SEQ ID NO: 813832 - protein, 9 aa, Homo Sapiens
RLVLKIADI

SEQ ID NO: 813833 - protein, 9 aa, Homo Sapiens
AGYTKEFFR

SEQ ID NO: 813834 - protein, 9 aa, Homo Sapiens
THKNPNAGQ

SEQ ID NO: 813835 - protein, 9 aa, Homo Sapiens
ALQWESWAH

SEQ ID NO: 813836 - protein, 9 aa, Homo Sapiens
LRGQTCGIC

SEQ ID NO: 813837 - protein, 9 aa, Homo Sapiens
MYLWAQKKH

SEQ ID NO: 813838 - protein, 9 aa, Homo Sapiens
PSFNKLYRV

SEQ ID NO: 813839 - protein, 9 aa, Homo Sapiens
DAETGAFTF

SEQ ID NO: 813840 - protein, 9 aa, Homo Sapiens
DFLKVIGRG

SEQ ID NO: 813841 - protein, 9 aa, Homo Sapiens
KSGKDKSPK

SEQ ID NO: 813842 - protein, 9 aa, Homo Sapiens
FYLIRKSGY

SEQ ID NO: 813843 - protein, 9 aa, Homo Sapiens
NDEQYQSFK

SEQ ID NO: 813844 - protein, 9 aa, Homo Sapiens
SEERSLDSR

SEQ ID NO: 813845 - protein, 9 aa, Homo Sapiens
ENNLLLQHN

SEQ ID NO: 813846 - protein, 9 aa, Homo Sapiens
NYTVIAPKM

SEQ ID NO: 813847 - protein, 9 aa, Homo Sapiens
VNTFLTWVK

SEQ ID NO: 813848 - protein, 9 aa, Homo Sapiens
PVKITKPNK

SEQ ID NO: 813849 - protein, 9 aa, Homo Sapiens
TFEGHFDGG

SEQ ID NO: 813850 - protein, 9 aa, Homo Sapiens
TSGPNSLHL

SEQ ID NO: 813851 - protein, 9 aa, Homo Sapiens
LNYCNLEDK

SEQ ID NO: 813852 - protein, 9 aa, Homo Sapiens
HTLQVLGIS

SEQ ID NO: 813853 - protein, 9 aa, Homo Sapiens
HTGKIPYEC

SEQ ID NO: 813854 - protein, 9 aa, Homo Sapiens
AFILLIIKG

SEQ ID NO: 813855 - protein, 9 aa, Homo Sapiens
SWKKQASKT

SEQ ID NO: 813856 - protein, 9 aa, Homo Sapiens
VATQISKII

SEQ ID NO: 813857 - protein, 9 aa, Homo Sapiens
HRPRLFHQR

SEQ ID NO: 813858 - protein, 9 aa, Homo Sapiens
PYTFPHPHE

SEQ ID NO: 813859 - protein, 9 aa, Homo Sapiens
NPNKATPCL

SEQ ID NO: 813860 - protein, 9 aa, Homo Sapiens
ALGSNLHVK

SEQ ID NO: 813861 - protein, 9 aa, Homo Sapiens
RDPEHRAGL

SEQ ID NO: 813862 - protein, 9 aa, Homo Sapiens
PVYAKVKRV

SEQ ID NO: 813863 - protein, 9 aa, Homo Sapiens
NETSPEIVE

SEQ ID NO: 813864 - protein, 9 aa, Homo Sapiens
EYHYLVSQG

SEQ ID NO: 813865 - protein, 9 aa, Homo Sapiens
TNERTPYIM

SEQ ID NO: 813866 - protein, 9 aa, Homo Sapiens
TGSRLGGKR

SEQ ID NO: 813867 - protein, 9 aa, Homo Sapiens
VLHIAALYD

SEQ ID NO: 813868 - protein, 9 aa, Homo Sapiens
KLYGVKFRN

SEQ ID NO: 813869 - protein, 9 aa, Homo Sapiens
RQPCFIVYS

SEQ ID NO: 813870 - protein, 9 aa, Homo Sapiens
FLRQLCTYL

SEQ ID NO: 813871 - protein, 9 aa, Homo Sapiens
PDSSPSNNS

SEQ ID NO: 813872 - protein, 9 aa, Homo Sapiens
KGVDTVVAL

SEQ ID NO: 813873 - protein, 9 aa, Homo Sapiens
YLILRNNSE

SEQ ID NO: 813874 - protein, 9 aa, Homo Sapiens
PLVNSEGGS

SEQ ID NO: 813875 - protein, 9 aa, Homo Sapiens
LQQLRHDCE

SEQ ID NO: 813876 - protein, 9 aa, Homo Sapiens
KDQPPNSVD

SEQ ID NO: 813877 - protein, 9 aa, Homo Sapiens
MYLLIGNLA

SEQ ID NO: 813878 - protein, 9 aa, Homo Sapiens
LAAHILKAR

SEQ ID NO: 813879 - protein, 9 aa, Homo Sapiens
NILTDKSYD

SEQ ID NO: 813880 - protein, 9 aa, Homo Sapiens
SHQNGIIKG

SEQ ID NO: 813881 - protein, 9 aa, Homo Sapiens
RMIYNHAFF

SEQ ID NO: 813882 - protein, 9 aa, Homo Sapiens
GYAKIKEEI

SEQ ID NO: 813883 - protein, 9 aa, Homo Sapiens
GAPIKPDPP

SEQ ID NO: 813884 - protein, 9 aa, Homo Sapiens
TKHQRINTD

SEQ ID NO: 813885 - protein, 9 aa, Homo Sapiens
TYCRAPNCS

SEQ ID NO: 813886 - protein, 9 aa, Homo Sapiens
EIDDLSEVR

SEQ ID NO: 813887 - protein, 9 aa, Homo Sapiens
QKTSIVWVG

SEQ ID NO: 813888 - protein, 9 aa, Homo Sapiens
RRYEVARAL

SEQ ID NO: 813889 - protein, 9 aa, Homo Sapiens
VVEPTLTIK

SEQ ID NO: 813890 - protein, 9 aa, Homo Sapiens
DYDKDNNGR

SEQ ID NO: 813891 - protein, 9 aa, Homo Sapiens
DRLPRDITQ

SEQ ID NO: 813892 - protein, 9 aa, Homo Sapiens
CYNVLNNTI

SEQ ID NO: 813893 - protein, 9 aa, Homo Sapiens
WLEITPGLE

SEQ ID NO: 813894 - protein, 9 aa, Homo Sapiens
RIYDMTNVL

SEQ ID NO: 813895 - protein, 9 aa, Homo Sapiens
DESSGVQHV

SEQ ID NO: 813896 - protein, 9 aa, Homo Sapiens
YLAELMVHG

SEQ ID NO: 813897 - protein, 9 aa, Homo Sapiens
IFNYFGAEN

SEQ ID NO: 813898 - protein, 9 aa, Homo Sapiens
VNQQRQQCQ

SEQ ID NO: 813899 - protein, 9 aa, Homo Sapiens
TVLDNLGNG

SEQ ID NO: 813900 - protein, 9 aa, Homo Sapiens
WDKNWPAGG

SEQ ID NO: 813901 - protein, 9 aa, Homo Sapiens
SGEDDPENI

SEQ ID NO: 813902 - protein, 9 aa, Homo Sapiens
NRNTFESED

SEQ ID NO: 813903 - protein, 9 aa, Homo Sapiens
YFHKPCASI

SEQ ID NO: 813904 - protein, 9 aa, Homo Sapiens
DVLTPFPGL

SEQ ID NO: 813905 - protein, 9 aa, Homo Sapiens
QKQESLEIS

SEQ ID NO: 813906 - protein, 9 aa, Homo Sapiens
NCYKVPEWC

SEQ ID NO: 813907 - protein, 9 aa, Homo Sapiens
RWWLNGPLV

SEQ ID NO: 813908 - protein, 9 aa, Homo Sapiens
CNHSESSGE

SEQ ID NO: 813909 - protein, 9 aa, Homo Sapiens
QEERLCEQD

SEQ ID NO: 813910 - protein, 9 aa, Homo Sapiens
QVGMWVVRG

SEQ ID NO: 813911 - protein, 9 aa, Homo Sapiens
LCIFLFFET

SEQ ID NO: 813912 - protein, 9 aa, Homo Sapiens
EEINNYIEE

SEQ ID NO: 813913 - protein, 9 aa, Homo Sapiens
PHMEPICKQ

SEQ ID NO: 813914 - protein, 9 aa, Homo Sapiens
QNAGKDRRH

SEQ ID NO: 813915 - protein, 9 aa, Homo Sapiens
HLDVPNIII

SEQ ID NO: 813916 - protein, 9 aa, Homo Sapiens
PAKRMAAHI

SEQ ID NO: 813917 - protein, 9 aa, Homo Sapiens
GADGDVFND

SEQ ID NO: 813918 - protein, 9 aa, Homo Sapiens
SDSFIQEMP

SEQ ID NO: 813919 - protein, 9 aa, Homo Sapiens
MTASAVVAL

SEQ ID NO: 813920 - protein, 9 aa, Homo Sapiens
NLKSWNGED

SEQ ID NO: 813921 - protein, 9 aa, Homo Sapiens
MRCQCEMVL

SEQ ID NO: 813922 - protein, 9 aa, Homo Sapiens
KEINQGIQN

SEQ ID NO: 813923 - protein, 9 aa, Homo Sapiens
TFLSSLKGG

SEQ ID NO: 813924 - protein, 9 aa, Homo Sapiens
KIFFIILLT

SEQ ID NO: 813925 - protein, 9 aa, Homo Sapiens
RYLERQRVR

SEQ ID NO: 813926 - protein, 9 aa, Homo Sapiens
GTWDGFKCQ

SEQ ID NO: 813927 - protein, 9 aa, Homo Sapiens
QLSISDRIR

SEQ ID NO: 813928 - protein, 9 aa, Homo Sapiens
INTPAVSAA

SEQ ID NO: 813929 - protein, 9 aa, Homo Sapiens
MQAFSQGFN

SEQ ID NO: 813930 - protein, 9 aa, Homo Sapiens
KTQVSTDQA

SEQ ID NO: 813931 - protein, 9 aa, Homo Sapiens
GSHMPEATP

SEQ ID NO: 813932 - protein, 9 aa, Homo Sapiens
CLTIFLDDS

SEQ ID NO: 813933 - protein, 9 aa, Homo Sapiens
ILEQAFYLE

SEQ ID NO: 813934 - protein, 9 aa, Homo Sapiens
KEFIYCLAL

SEQ ID NO: 813935 - protein, 9 aa, Homo Sapiens
VFQGKWERA

SEQ ID NO: 813936 - protein, 9 aa, Homo Sapiens
GGQVMTINS

SEQ ID NO: 813937 - protein, 9 aa, Homo Sapiens
FCGKYAYVT

SEQ ID NO: 813938 - protein, 9 aa, Homo Sapiens
LKKYQAVLS

SEQ ID NO: 813939 - protein, 9 aa, Homo Sapiens
YPPFCLGTG

SEQ ID NO: 813940 - protein, 9 aa, Homo Sapiens
DVNKRDSIG

SEQ ID NO: 813941 - protein, 9 aa, Homo Sapiens
IVIYFARAR

SEQ ID NO: 813942 - protein, 9 aa, Homo Sapiens
GKSFCHEQC

SEQ ID NO: 813943 - protein, 9 aa, Homo Sapiens
KLPRVLSVY

SEQ ID NO: 813944 - protein, 9 aa, Homo Sapiens
QSVQELTIV

SEQ ID NO: 813945 - protein, 9 aa, Homo Sapiens
QFQAFGYLF

SEQ ID NO: 813946 - protein, 9 aa, Homo Sapiens
IIYKPTTKE

SEQ ID NO: 813947 - protein, 9 aa, Homo Sapiens
CLKADALGV

SEQ ID NO: 813948 - protein, 9 aa, Homo Sapiens
TYWLNRDRH

SEQ ID NO: 813949 - protein, 9 aa, Homo Sapiens
LRYVAPLVM

SEQ ID NO: 813950 - protein, 9 aa, Homo Sapiens
DQGNQKDSI

SEQ ID NO: 813951 - protein, 9 aa, Homo Sapiens
CSKDALLNR

SEQ ID NO: 813952 - protein, 9 aa, Homo Sapiens
VFNLNEIKI

SEQ ID NO: 813953 - protein, 9 aa, Homo Sapiens
LTVLSWLPK

SEQ ID NO: 813954 - protein, 9 aa, Homo Sapiens
PANILTADN

SEQ ID NO: 813955 - protein, 9 aa, Homo Sapiens
QDQVCRLCG

SEQ ID NO: 813956 - protein, 9 aa, Homo Sapiens
DESLKQLQI

SEQ ID NO: 813957 - protein, 9 aa, Homo Sapiens
SPMKPLPLV

SEQ ID NO: 813958 - protein, 9 aa, Homo Sapiens
QENTVLNSE

SEQ ID NO: 813959 - protein, 9 aa, Homo Sapiens
ATENDFKAF

SEQ ID NO: 813960 - protein, 9 aa, Homo Sapiens
QKRQNGQTD

SEQ ID NO: 813961 - protein, 9 aa, Homo Sapiens
FSNLQRQAT

SEQ ID NO: 813962 - protein, 9 aa, Homo Sapiens
SHLKDTPSL

SEQ ID NO: 813963 - protein, 9 aa, Homo Sapiens
SDGEQTTHE

SEQ ID NO: 813964 - protein, 9 aa, Homo Sapiens
LSASAVPCT

SEQ ID NO: 813965 - protein, 9 aa, Homo Sapiens
CVKAFHTFS

SEQ ID NO: 813966 - protein, 9 aa, Homo Sapiens
EELEMTPMV

SEQ ID NO: 813967 - protein, 9 aa, Homo Sapiens
LSKLAQGRG

SEQ ID NO: 813968 - protein, 9 aa, Homo Sapiens
RYAWPLLET

SEQ ID NO: 813969 - protein, 9 aa, Homo Sapiens
NDRCQKMCD

SEQ ID NO: 813970 - protein, 9 aa, Homo Sapiens
CKLWLMHAQ

SEQ ID NO: 813971 - protein, 9 aa, Homo Sapiens
IVLLGTVGN

SEQ ID NO: 813972 - protein, 9 aa, Homo Sapiens
EKYPPKSHP

SEQ ID NO: 813973 - protein, 9 aa, Homo Sapiens
KDLSAIQAD

SEQ ID NO: 813974 - protein, 9 aa, Homo Sapiens
LLFTTGNSR

SEQ ID NO: 813975 - protein, 9 aa, Homo Sapiens
CVSQYLEPL

SEQ ID NO: 813976 - protein, 9 aa, Homo Sapiens
MWIPSCSHD

SEQ ID NO: 813977 - protein, 9 aa, Homo Sapiens
VKAVNYTVH

SEQ ID NO: 813978 - protein, 9 aa, Homo Sapiens
LGGSEGPGS

SEQ ID NO: 813979 - protein, 9 aa, Homo Sapiens
SSRMDNTGV

SEQ ID NO: 813980 - protein, 9 aa, Homo Sapiens
QFTVAKNNT

SEQ ID NO: 813981 - protein, 9 aa, Homo Sapiens
DQYRTTDFV

SEQ ID NO: 813982 - protein, 9 aa, Homo Sapiens
QQGLQHFLE

SEQ ID NO: 813983 - protein, 9 aa, Homo Sapiens
ALRSYILGK

SEQ ID NO: 813984 - protein, 9 aa, Homo Sapiens
ILNFLNKSR

SEQ ID NO: 813985 - protein, 9 aa, Homo Sapiens
TSVGLPHNL

SEQ ID NO: 813986 - protein, 9 aa, Homo Sapiens
PAENSVDTG

SEQ ID NO: 813987 - protein, 9 aa, Homo Sapiens
PGIGSGLSC

SEQ ID NO: 813988 - protein, 9 aa, Homo Sapiens
LMGEGSYTC

SEQ ID NO: 813989 - protein, 9 aa, Homo Sapiens
LTNLSPVDV

SEQ ID NO: 813990 - protein, 9 aa, Homo Sapiens
CSNTTSNSF

SEQ ID NO: 813991 - protein, 9 aa, Homo Sapiens
ADTGIFTIR

SEQ ID NO: 813992 - protein, 9 aa, Homo Sapiens
EDEMYKIIL

SEQ ID NO: 813993 - protein, 9 aa, Homo Sapiens
RLFKVTPPP

SEQ ID NO: 813994 - protein, 9 aa, Homo Sapiens
TAFSKLSGD

SEQ ID NO: 813995 - protein, 9 aa, Homo Sapiens
HRDQRSLYF

SEQ ID NO: 813996 - protein, 9 aa, Homo Sapiens
INSLPTFPT

SEQ ID NO: 813997 - protein, 9 aa, Homo Sapiens
PVNSSSSPI

SEQ ID NO: 813998 - protein, 9 aa, Homo Sapiens
YFRCLGLHL

SEQ ID NO: 813999 - protein, 9 aa, Homo Sapiens
SVATVSSSV

SEQ ID NO: 814000 - protein, 9 aa, Homo Sapiens
SVVQWCDCC

SEQ ID NO: 814001 - protein, 9 aa, Homo Sapiens
QKPLVLGAM

SEQ ID NO: 814002 - protein, 9 aa, Homo Sapiens
LLRQAQEKS

SEQ ID NO: 814003 - protein, 9 aa, Homo Sapiens
SQTTANNWE

SEQ ID NO: 814004 - protein, 9 aa, Homo Sapiens
RKLQGRLGW

SEQ ID NO: 814005 - protein, 9 aa, Homo Sapiens
TCLKLIRLD

SEQ ID NO: 814006 - protein, 9 aa, Homo Sapiens
TPLVSITTR

SEQ ID NO: 814007 - protein, 9 aa, Homo Sapiens
IIICLDLKD

SEQ ID NO: 814008 - protein, 9 aa, Homo Sapiens
RKADVWSLS

SEQ ID NO: 814009 - protein, 9 aa, Homo Sapiens
QLQNLIISA

SEQ ID NO: 814010 - protein, 9 aa, Homo Sapiens
YSSSSARRP

SEQ ID NO: 814011 - protein, 9 aa, Homo Sapiens
HCIRQNVAD

SEQ ID NO: 814012 - protein, 9 aa, Homo Sapiens
NNTYWCLCT

SEQ ID NO: 814013 - protein, 9 aa, Homo Sapiens
AEKLARCVA

SEQ ID NO: 814014 - protein, 9 aa, Homo Sapiens
VKAYTSAGT

SEQ ID NO: 814015 - protein, 9 aa, Homo Sapiens
WIRGFIVRK

SEQ ID NO: 814016 - protein, 9 aa, Homo Sapiens
KTNIDEHLF

SEQ ID NO: 814017 - protein, 9 aa, Homo Sapiens
GEKISATWK

SEQ ID NO: 814018 - protein, 9 aa, Homo Sapiens
QFIHLFYKF

SEQ ID NO: 814019 - protein, 9 aa, Homo Sapiens
ISSKAMSII

SEQ ID NO: 814020 - protein, 9 aa, Homo Sapiens
LNSTQSHER

SEQ ID NO: 814021 - protein, 9 aa, Homo Sapiens
LVFLVAFVN

SEQ ID NO: 814022 - protein, 9 aa, Homo Sapiens
GNKFTQDQM

SEQ ID NO: 814023 - protein, 9 aa, Homo Sapiens
RESQILKAL

SEQ ID NO: 814024 - protein, 9 aa, Homo Sapiens
HKARENTFI

SEQ ID NO: 814025 - protein, 9 aa, Homo Sapiens
LAEHFSPFC

SEQ ID NO: 814026 - protein, 9 aa, Homo Sapiens
APFLLFFLY

SEQ ID NO: 814027 - protein, 9 aa, Homo Sapiens
AAAHNLVLI

SEQ ID NO: 814028 - protein, 9 aa, Homo Sapiens
AFQPRNIQG

SEQ ID NO: 814029 - protein, 9 aa, Homo Sapiens
VLAKQTGRS

SEQ ID NO: 814030 - protein, 9 aa, Homo Sapiens
KTIVVNLIG

SEQ ID NO: 814031 - protein, 9 aa, Homo Sapiens
AHEEERRRQ

SEQ ID NO: 814032 - protein, 9 aa, Homo Sapiens
LMGTYNDGA

SEQ ID NO: 814033 - protein, 9 aa, Homo Sapiens
NWNRDKVEL

SEQ ID NO: 814034 - protein, 9 aa, Homo Sapiens
VERKKQDKK

SEQ ID NO: 814035 - protein, 9 aa, Homo Sapiens
RHHSSGSIL

SEQ ID NO: 814036 - protein, 9 aa, Homo Sapiens
VADWFYYSI

SEQ ID NO: 814037 - protein, 9 aa, Homo Sapiens
LLCLAAAPS

SEQ ID NO: 814038 - protein, 9 aa, Homo Sapiens
QQRLGKTQK

SEQ ID NO: 814039 - protein, 9 aa, Homo Sapiens
IVYSIVSSF

SEQ ID NO: 814040 - protein, 9 aa, Homo Sapiens
GFSILDYQV

SEQ ID NO: 814041 - protein, 9 aa, Homo Sapiens
CNLPRLCIR

SEQ ID NO: 814042 - protein, 9 aa, Homo Sapiens
RKMIPERKN

SEQ ID NO: 814043 - protein, 9 aa, Homo Sapiens
LSRLPLGGW

SEQ ID NO: 814044 - protein, 9 aa, Homo Sapiens
LLVGDLRAE

SEQ ID NO: 814045 - protein, 9 aa, Homo Sapiens
EHQGDKLEI

SEQ ID NO: 814046 - protein, 9 aa, Homo Sapiens
VNMAQKARI

SEQ ID NO: 814047 - protein, 9 aa, Homo Sapiens
IICTQPRQI

SEQ ID NO: 814048 - protein, 9 aa, Homo Sapiens
FAFFPDKFK

SEQ ID NO: 814049 - protein, 9 aa, Homo Sapiens
EYYRWQWTS

SEQ ID NO: 814050 - protein, 9 aa, Homo Sapiens
AYQMCLTSD

SEQ ID NO: 814051 - protein, 9 aa, Homo Sapiens
AFSLDEMAT

SEQ ID NO: 814052 - protein, 9 aa, Homo Sapiens
MKPHDIFKA

SEQ ID NO: 814053 - protein, 9 aa, Homo Sapiens
YLFLMFGDL

SEQ ID NO: 814054 - protein, 9 aa, Homo Sapiens
DKPEEEVQL

SEQ ID NO: 814055 - protein, 9 aa, Homo Sapiens
VALGQYAIS

SEQ ID NO: 814056 - protein, 9 aa, Homo Sapiens
ESHQNGIIK

SEQ ID NO: 814057 - protein, 9 aa, Homo Sapiens
AAELEACRC

SEQ ID NO: 814058 - protein, 9 aa, Homo Sapiens
QKLRINAKE

SEQ ID NO: 814059 - protein, 9 aa, Homo Sapiens
IPSIKTPLG

SEQ ID NO: 814060 - protein, 9 aa, Homo Sapiens
MYDSFNNTY

SEQ ID NO: 814061 - protein, 9 aa, Homo Sapiens
DSIDIYIPE

SEQ ID NO: 814062 - protein, 9 aa, Homo Sapiens
ETSSICTEC

SEQ ID NO: 814063 - protein, 9 aa, Homo Sapiens
YFAFPGEII

SEQ ID NO: 814064 - protein, 9 aa, Homo Sapiens
QPTCCCPSC

SEQ ID NO: 814065 - protein, 9 aa, Homo Sapiens
SIQRIENVV

SEQ ID NO: 814066 - protein, 9 aa, Homo Sapiens
SYMTSDRTY

SEQ ID NO: 814067 - protein, 9 aa, Homo Sapiens
IKCNSYNNA

SEQ ID NO: 814068 - protein, 9 aa, Homo Sapiens
VALYRARSL

SEQ ID NO: 814069 - protein, 9 aa, Homo Sapiens
LRYINNLVK

SEQ ID NO: 814070 - protein, 9 aa, Homo Sapiens
AIFIILLLV

SEQ ID NO: 814071 - protein, 9 aa, Homo Sapiens
GVITIEDLC

SEQ ID NO: 814072 - protein, 9 aa, Homo Sapiens
RAQQYVLQS

SEQ ID NO: 814073 - protein, 9 aa, Homo Sapiens
ACKKFNSPS

SEQ ID NO: 814074 - protein, 9 aa, Homo Sapiens
ITHIISIHA

SEQ ID NO: 814075 - protein, 9 aa, Homo Sapiens
SYPEVFVLL

SEQ ID NO: 814076 - protein, 9 aa, Homo Sapiens
DNTPEIAIR

SEQ ID NO: 814077 - protein, 9 aa, Homo Sapiens
DVVLAHLGG

SEQ ID NO: 814078 - protein, 9 aa, Homo Sapiens
VILARILYL

SEQ ID NO: 814079 - protein, 9 aa, Homo Sapiens
VITLTDNQR

SEQ ID NO: 814080 - protein, 9 aa, Homo Sapiens
ATRLNLFKR

SEQ ID NO: 814081 - protein, 9 aa, Homo Sapiens
LAVVLLFYI

SEQ ID NO: 814082 - protein, 9 aa, Homo Sapiens
RAEDNPMVG

SEQ ID NO: 814083 - protein, 9 aa, Homo Sapiens
NLTRVETFG

SEQ ID NO: 814084 - protein, 9 aa, Homo Sapiens
VYFDNTQKS

SEQ ID NO: 814085 - protein, 9 aa, Homo Sapiens
KTIDMLHIE

SEQ ID NO: 814086 - protein, 9 aa, Homo Sapiens
SCIFLLLIN

SEQ ID NO: 814087 - protein, 9 aa, Homo Sapiens
ALFDNRLTT

SEQ ID NO: 814088 - protein, 9 aa, Homo Sapiens
APYTKEEDE

SEQ ID NO: 814089 - protein, 9 aa, Homo Sapiens
AKQSHSEKK

SEQ ID NO: 814090 - protein, 9 aa, Homo Sapiens
TESINERTA

SEQ ID NO: 814091 - protein, 9 aa, Homo Sapiens
KVLAGLYNS

SEQ ID NO: 814092 - protein, 9 aa, Homo Sapiens
AEESANEMI

SEQ ID NO: 814093 - protein, 9 aa, Homo Sapiens
GYPPDISDE

SEQ ID NO: 814094 - protein, 9 aa, Homo Sapiens
FSKLTQHQI

SEQ ID NO: 814095 - protein, 9 aa, Homo Sapiens
SGNVAKHIS

SEQ ID NO: 814096 - protein, 9 aa, Homo Sapiens
KQALENSTQ

SEQ ID NO: 814097 - protein, 9 aa, Homo Sapiens
DRSCYICYR

SEQ ID NO: 814098 - protein, 9 aa, Homo Sapiens
DTMTTTERH

SEQ ID NO: 814099 - protein, 9 aa, Homo Sapiens
PEPAIHWIY

SEQ ID NO: 814100 - protein, 9 aa, Homo Sapiens
TISESYSCP

SEQ ID NO: 814101 - protein, 9 aa, Homo Sapiens
KHKALKMIL

SEQ ID NO: 814102 - protein, 9 aa, Homo Sapiens
LQIQYSSDV

SEQ ID NO: 814103 - protein, 9 aa, Homo Sapiens
LRRHFNSNC

SEQ ID NO: 814104 - protein, 9 aa, Homo Sapiens
KECILLGFS

SEQ ID NO: 814105 - protein, 9 aa, Homo Sapiens
QVWNSYQLC

SEQ ID NO: 814106 - protein, 9 aa, Homo Sapiens
AVKVKISSS

SEQ ID NO: 814107 - protein, 9 aa, Homo Sapiens
ELQFKRKAI

SEQ ID NO: 814108 - protein, 9 aa, Homo Sapiens
ILHQKTHTG

SEQ ID NO: 814109 - protein, 9 aa, Homo Sapiens
ICLRHRRSR

SEQ ID NO: 814110 - protein, 9 aa, Homo Sapiens
QLIKAQKGT

SEQ ID NO: 814111 - protein, 9 aa, Homo Sapiens
ERHAHLHTP

SEQ ID NO: 814112 - protein, 9 aa, Homo Sapiens
SYRRNSDIF

SEQ ID NO: 814113 - protein, 9 aa, Homo Sapiens
CNVDSVSAR

SEQ ID NO: 814114 - protein, 9 aa, Homo Sapiens
RARLVKGEI

SEQ ID NO: 814115 - protein, 9 aa, Homo Sapiens
RRFNEQAFP

SEQ ID NO: 814116 - protein, 9 aa, Homo Sapiens
RVPSHLSRL

SEQ ID NO: 814117 - protein, 9 aa, Homo Sapiens
VLQAALGVP

SEQ ID NO: 814118 - protein, 9 aa, Homo Sapiens
CLCTVNETH

SEQ ID NO: 814119 - protein, 9 aa, Homo Sapiens
QFLPKGTKT

SEQ ID NO: 814120 - protein, 9 aa, Homo Sapiens
SHMPEATPK

SEQ ID NO: 814121 - protein, 9 aa, Homo Sapiens
KQFLPTMSP

SEQ ID NO: 814122 - protein, 9 aa, Homo Sapiens
HRLKSQTIQ

SEQ ID NO: 814123 - protein, 9 aa, Homo Sapiens
MGGDTELSA

SEQ ID NO: 814124 - protein, 9 aa, Homo Sapiens
ELFTDKFCK

SEQ ID NO: 814125 - protein, 9 aa, Homo Sapiens
RTTGQSVYM

SEQ ID NO: 814126 - protein, 9 aa, Homo Sapiens
IGSYAPAEY

SEQ ID NO: 814127 - protein, 9 aa, Homo Sapiens
EQLKILNLH

SEQ ID NO: 814128 - protein, 9 aa, Homo Sapiens
YLVYICFQN

SEQ ID NO: 814129 - protein, 9 aa, Homo Sapiens
CGEYLSKQE

SEQ ID NO: 814130 - protein, 9 aa, Homo Sapiens
AETYGEDND

SEQ ID NO: 814131 - protein, 9 aa, Homo Sapiens
THADFANEC

SEQ ID NO: 814132 - protein, 9 aa, Homo Sapiens
HVFCCEAPA

SEQ ID NO: 814133 - protein, 9 aa, Homo Sapiens
KQFCITCQK

SEQ ID NO: 814134 - protein, 9 aa, Homo Sapiens
LDFILMNKM

SEQ ID NO: 814135 - protein, 9 aa, Homo Sapiens
VGLCCPAYP

SEQ ID NO: 814136 - protein, 9 aa, Homo Sapiens
ERIEEPIKG

SEQ ID NO: 814137 - protein, 9 aa, Homo Sapiens
RMLGTPSKD

SEQ ID NO: 814138 - protein, 9 aa, Homo Sapiens
IQGEEGAYA

SEQ ID NO: 814139 - protein, 9 aa, Homo Sapiens
RGRDRSSKK

SEQ ID NO: 814140 - protein, 9 aa, Homo Sapiens
AFFKALQEE

SEQ ID NO: 814141 - protein, 9 aa, Homo Sapiens
QIVRAQKYY

SEQ ID NO: 814142 - protein, 9 aa, Homo Sapiens
KKGDKKKVV

SEQ ID NO: 814143 - protein, 9 aa, Homo Sapiens
EEAKIIGIK

SEQ ID NO: 814144 - protein, 9 aa, Homo Sapiens
NSTNLPINP

SEQ ID NO: 814145 - protein, 9 aa, Homo Sapiens
NKHSKRFLL

SEQ ID NO: 814146 - protein, 9 aa, Homo Sapiens
ERNDKVFVA

SEQ ID NO: 814147 - protein, 9 aa, Homo Sapiens
RKLPPRSES

SEQ ID NO: 814148 - protein, 9 aa, Homo Sapiens
GHDYDPLQF

SEQ ID NO: 814149 - protein, 9 aa, Homo Sapiens
AHNLVLIPL

SEQ ID NO: 814150 - protein, 9 aa, Homo Sapiens
TLALFDNRL

SEQ ID NO: 814151 - protein, 9 aa, Homo Sapiens
PYKQVVKAK

SEQ ID NO: 814152 - protein, 9 aa, Homo Sapiens
GVKVCTCTS

SEQ ID NO: 814153 - protein, 9 aa, Homo Sapiens
KFLRLFSSV

SEQ ID NO: 814154 - protein, 9 aa, Homo Sapiens
SACQHMSTS

SEQ ID NO: 814155 - protein, 9 aa, Homo Sapiens
LANVLARLQ

SEQ ID NO: 814156 - protein, 9 aa, Homo Sapiens
GLLSSLGHT

SEQ ID NO: 814157 - protein, 9 aa, Homo Sapiens
QTEITALAP

SEQ ID NO: 814158 - protein, 9 aa, Homo Sapiens
EMVLLVLMA

SEQ ID NO: 814159 - protein, 9 aa, Homo Sapiens
PMLNTFIYS

SEQ ID NO: 814160 - protein, 9 aa, Homo Sapiens
AKAVDVLER

SEQ ID NO: 814161 - protein, 9 aa, Homo Sapiens
GGNIQVEIP

SEQ ID NO: 814162 - protein, 9 aa, Homo Sapiens
IVHILMVDI

SEQ ID NO: 814163 - protein, 9 aa, Homo Sapiens
QPLWRHYFQ

SEQ ID NO: 814164 - protein, 9 aa, Homo Sapiens
AKSWTQRSQ

SEQ ID NO: 814165 - protein, 9 aa, Homo Sapiens
PHFHINLDG

SEQ ID NO: 814166 - protein, 9 aa, Homo Sapiens
TLCAPKAVS

SEQ ID NO: 814167 - protein, 9 aa, Homo Sapiens
PVSCSENTS

SEQ ID NO: 814168 - protein, 9 aa, Homo Sapiens
AQEKSGKDK

SEQ ID NO: 814169 - protein, 9 aa, Homo Sapiens
IAQRFCDNI

SEQ ID NO: 814170 - protein, 9 aa, Homo Sapiens
DMALCQNAR

SEQ ID NO: 814171 - protein, 9 aa, Homo Sapiens
ELVELHFKL

SEQ ID NO: 814172 - protein, 9 aa, Homo Sapiens
RLRDSHKTI

SEQ ID NO: 814173 - protein, 9 aa, Homo Sapiens
EVAKELKSQ

SEQ ID NO: 814174 - protein, 9 aa, Homo Sapiens
SLFFGTYFC

SEQ ID NO: 814175 - protein, 9 aa, Homo Sapiens
KVATQISKI

SEQ ID NO: 814176 - protein, 9 aa, Homo Sapiens
IKNIGFEWN

SEQ ID NO: 814177 - protein, 9 aa, Homo Sapiens
GLNKFRWYR

SEQ ID NO: 814178 - protein, 9 aa, Homo Sapiens
EFILKKVND

SEQ ID NO: 814179 - protein, 9 aa, Homo Sapiens
INSAGKATS

SEQ ID NO: 814180 - protein, 9 aa, Homo Sapiens
LAQSSLNSS

SEQ ID NO: 814181 - protein, 9 aa, Homo Sapiens
NEIEAQLIG

SEQ ID NO: 814182 - protein, 9 aa, Homo Sapiens
RRAFNGERL

SEQ ID NO: 814183 - protein, 9 aa, Homo Sapiens
KCFTQCSSL

SEQ ID NO: 814184 - protein, 9 aa, Homo Sapiens
AISGQSRWS

SEQ ID NO: 814185 - protein, 9 aa, Homo Sapiens
ERFLYMFME

SEQ ID NO: 814186 - protein, 9 aa, Homo Sapiens
KLVDCYVSK

SEQ ID NO: 814187 - protein, 9 aa, Homo Sapiens
MKAQHLLKL

SEQ ID NO: 814188 - protein, 9 aa, Homo Sapiens
KRTKGMGKF

SEQ ID NO: 814189 - protein, 9 aa, Homo Sapiens
CKFWIDQQI

SEQ ID NO: 814190 - protein, 9 aa, Homo Sapiens
LKFITEKSD

SEQ ID NO: 814191 - protein, 9 aa, Homo Sapiens
QTHCYRAAL

SEQ ID NO: 814192 - protein, 9 aa, Homo Sapiens
RTTGFQYEM

SEQ ID NO: 814193 - protein, 9 aa, Homo Sapiens
LTVAEEKSI

SEQ ID NO: 814194 - protein, 9 aa, Homo Sapiens
KHVQIHTGE

SEQ ID NO: 814195 - protein, 9 aa, Homo Sapiens
SQDCIKTTP

SEQ ID NO: 814196 - protein, 9 aa, Homo Sapiens
EAVPFASVA

SEQ ID NO: 814197 - protein, 9 aa, Homo Sapiens
KPTTKETRE

SEQ ID NO: 814198 - protein, 9 aa, Homo Sapiens
STFWNKPSS

SEQ ID NO: 814199 - protein, 9 aa, Homo Sapiens
VWAQLNRYM

SEQ ID NO: 814200 - protein, 9 aa, Homo Sapiens
DYLMKLSAA

SEQ ID NO: 814201 - protein, 9 aa, Homo Sapiens
VEKEVKQLL

SEQ ID NO: 814202 - protein, 9 aa, Homo Sapiens
QAQDQQVLQ

SEQ ID NO: 814203 - protein, 9 aa, Homo Sapiens
KLVDNSACR

SEQ ID NO: 814204 - protein, 9 aa, Homo Sapiens
YNCYKVPEW

SEQ ID NO: 814205 - protein, 9 aa, Homo Sapiens
SQGPGKYPM

SEQ ID NO: 814206 - protein, 9 aa, Homo Sapiens
KRSFSAKSF

SEQ ID NO: 814207 - protein, 9 aa, Homo Sapiens
TIKEEVLSE

SEQ ID NO: 814208 - protein, 9 aa, Homo Sapiens
LSQEAQIIV

SEQ ID NO: 814209 - protein, 9 aa, Homo Sapiens
KNYYVGSQF

SEQ ID NO: 814210 - protein, 9 aa, Homo Sapiens
KGNGFEMKL

SEQ ID NO: 814211 - protein, 9 aa, Homo Sapiens
IPMMPMPVN

SEQ ID NO: 814212 - protein, 9 aa, Homo Sapiens
LKEKRSQTQ

SEQ ID NO: 814213 - protein, 9 aa, Homo Sapiens
FMFPEHAVQ

SEQ ID NO: 814214 - protein, 9 aa, Homo Sapiens
LNGVCTDTI

SEQ ID NO: 814215 - protein, 9 aa, Homo Sapiens
AQDVFNPSW

SEQ ID NO: 814216 - protein, 9 aa, Homo Sapiens
GLGVQALGI

SEQ ID NO: 814217 - protein, 9 aa, Homo Sapiens
RKYKSSGLS

SEQ ID NO: 814218 - protein, 9 aa, Homo Sapiens
EKKPKNGER

SEQ ID NO: 814219 - protein, 9 aa, Homo Sapiens
LGIIYRYLK

SEQ ID NO: 814220 - protein, 9 aa, Homo Sapiens
AWRCHVAVR

SEQ ID NO: 814221 - protein, 9 aa, Homo Sapiens
GFSSDGDLV

SEQ ID NO: 814222 - protein, 9 aa, Homo Sapiens
ENKLEFKPD

SEQ ID NO: 814223 - protein, 9 aa, Homo Sapiens
KMAETTELM

SEQ ID NO: 814224 - protein, 9 aa, Homo Sapiens
GRHGDALRN

SEQ ID NO: 814225 - protein, 9 aa, Homo Sapiens
IAGRKAVKR

SEQ ID NO: 814226 - protein, 9 aa, Homo Sapiens
LVNLCIFLF

SEQ ID NO: 814227 - protein, 9 aa, Homo Sapiens
VSSRMDNTG

SEQ ID NO: 814228 - protein, 9 aa, Homo Sapiens
RQNGHVIYK

SEQ ID NO: 814229 - protein, 9 aa, Homo Sapiens
GLQETCYWD

SEQ ID NO: 814230 - protein, 9 aa, Homo Sapiens
DKLIRQQIY

SEQ ID NO: 814231 - protein, 9 aa, Homo Sapiens
NNQQVKPLG

SEQ ID NO: 814232 - protein, 9 aa, Homo Sapiens
RQPHLPWVL

SEQ ID NO: 814233 - protein, 9 aa, Homo Sapiens
KEEKTKWKD

SEQ ID NO: 814234 - protein, 9 aa, Homo Sapiens
MNEKSVLLW

SEQ ID NO: 814235 - protein, 9 aa, Homo Sapiens
TCYPGFYGE

SEQ ID NO: 814236 - protein, 9 aa, Homo Sapiens
KSQSGESKS

SEQ ID NO: 814237 - protein, 9 aa, Homo Sapiens
CIKTTPGAQ

SEQ ID NO: 814238 - protein, 9 aa, Homo Sapiens
SEALKKCGI

SEQ ID NO: 814239 - protein, 9 aa, Homo Sapiens
CISQALLTF

SEQ ID NO: 814240 - protein, 9 aa, Homo Sapiens
SFRGHITMK

SEQ ID NO: 814241 - protein, 9 aa, Homo Sapiens
CPLLPVRGF

SEQ ID NO: 814242 - protein, 9 aa, Homo Sapiens
TVNTGLMTS

SEQ ID NO: 814243 - protein, 9 aa, Homo Sapiens
ICSLPAELG

SEQ ID NO: 814244 - protein, 9 aa, Homo Sapiens
PRTSAPTRA

SEQ ID NO: 814245 - protein, 9 aa, Homo Sapiens
FEQLSKSAK

SEQ ID NO: 814246 - protein, 9 aa, Homo Sapiens
QLPQAQSCA

SEQ ID NO: 814247 - protein, 9 aa, Homo Sapiens
GCSEFCFND

SEQ ID NO: 814248 - protein, 9 aa, Homo Sapiens
VGLTIRDVL

SEQ ID NO: 814249 - protein, 9 aa, Homo Sapiens
ICNKSFLAT

SEQ ID NO: 814250 - protein, 9 aa, Homo Sapiens
SNKKKLEDA

SEQ ID NO: 814251 - protein, 9 aa, Homo Sapiens
YSRDYKIKY

SEQ ID NO: 814252 - protein, 9 aa, Homo Sapiens
GLYYNFWCG

SEQ ID NO: 814253 - protein, 9 aa, Homo Sapiens
YECQSSPCV

SEQ ID NO: 814254 - protein, 9 aa, Homo Sapiens
SQGKIIFED

SEQ ID NO: 814255 - protein, 9 aa, Homo Sapiens
EDVYAGICL

SEQ ID NO: 814256 - protein, 9 aa, Homo Sapiens
AVISFGCAS

SEQ ID NO: 814257 - protein, 9 aa, Homo Sapiens
NYDFVQAII

SEQ ID NO: 814258 - protein, 9 aa, Homo Sapiens
KCLFDDDLV

SEQ ID NO: 814259 - protein, 9 aa, Homo Sapiens
QTAVHLLLP

SEQ ID NO: 814260 - protein, 9 aa, Homo Sapiens
PFFHSANGV

SEQ ID NO: 814261 - protein, 9 aa, Homo Sapiens
TPHKSERHA

SEQ ID NO: 814262 - protein, 9 aa, Homo Sapiens
SISKHNLFQ

SEQ ID NO: 814263 - protein, 9 aa, Homo Sapiens
DFIVNETNR

SEQ ID NO: 814264 - protein, 9 aa, Homo Sapiens
FIPLVMYLG

SEQ ID NO: 814265 - protein, 9 aa, Homo Sapiens
DRIICFCGL

SEQ ID NO: 814266 - protein, 9 aa, Homo Sapiens
ILIFKVIFG

SEQ ID NO: 814267 - protein, 9 aa, Homo Sapiens
SWRELMSDP

SEQ ID NO: 814268 - protein, 9 aa, Homo Sapiens
GDNQIMPNT

SEQ ID NO: 814269 - protein, 9 aa, Homo Sapiens
EPQGQPQEA

SEQ ID NO: 814270 - protein, 9 aa, Homo Sapiens
EPIPCEVMA

SEQ ID NO: 814271 - protein, 9 aa, Homo Sapiens
PRTRAHLGA

SEQ ID NO: 814272 - protein, 9 aa, Homo Sapiens
YNAFVKKSK

SEQ ID NO: 814273 - protein, 9 aa, Homo Sapiens
MIRAEDAGF

SEQ ID NO: 814274 - protein, 9 aa, Homo Sapiens
EYEGRDVFN

SEQ ID NO: 814275 - protein, 9 aa, Homo Sapiens
TIHNVPEGF

SEQ ID NO: 814276 - protein, 9 aa, Homo Sapiens
CSKYIILKY

SEQ ID NO: 814277 - protein, 9 aa, Homo Sapiens
SWGALGSGR

SEQ ID NO: 814278 - protein, 9 aa, Homo Sapiens
TYDYAKNIL

SEQ ID NO: 814279 - protein, 9 aa, Homo Sapiens
KTLPDSLTF

SEQ ID NO: 814280 - protein, 9 aa, Homo Sapiens
ITTQKWEAE

SEQ ID NO: 814281 - protein, 9 aa, Homo Sapiens
IMPFWIVHC

SEQ ID NO: 814282 - protein, 9 aa, Homo Sapiens
VKTSVEHIS

SEQ ID NO: 814283 - protein, 9 aa, Homo Sapiens
DNRKWMREN

SEQ ID NO: 814284 - protein, 9 aa, Homo Sapiens
GIAQSIAAQ

SEQ ID NO: 814285 - protein, 9 aa, Homo Sapiens
GKLRAEIDN

SEQ ID NO: 814286 - protein, 9 aa, Homo Sapiens
RLVYKDILA

SEQ ID NO: 814287 - protein, 9 aa, Homo Sapiens
EFAHYTVIT

SEQ ID NO: 814288 - protein, 9 aa, Homo Sapiens
FAFGPFATD

SEQ ID NO: 814289 - protein, 9 aa, Homo Sapiens
TDPINGLSA

SEQ ID NO: 814290 - protein, 9 aa, Homo Sapiens
LGSQKSDKL

SEQ ID NO: 814291 - protein, 9 aa, Homo Sapiens
KYQNWRTMS

SEQ ID NO: 814292 - protein, 9 aa, Homo Sapiens
HILRINRGN

SEQ ID NO: 814293 - protein, 9 aa, Homo Sapiens
NGTKAFFFQ

SEQ ID NO: 814294 - protein, 9 aa, Homo Sapiens
CQHPFCEPV

SEQ ID NO: 814295 - protein, 9 aa, Homo Sapiens
PIFSKKGYL

SEQ ID NO: 814296 - protein, 9 aa, Homo Sapiens
AGKTLTDAQ

SEQ ID NO: 814297 - protein, 9 aa, Homo Sapiens
AIILSTYLE

SEQ ID NO: 814298 - protein, 9 aa, Homo Sapiens
TDYVNDLQG

SEQ ID NO: 814299 - protein, 9 aa, Homo Sapiens
TTIGFGDIV

SEQ ID NO: 814300 - protein, 9 aa, Homo Sapiens
QRKHLNMKK

SEQ ID NO: 814301 - protein, 9 aa, Homo Sapiens
IKHLRKDLD

SEQ ID NO: 814302 - protein, 9 aa, Homo Sapiens
GLFPSQCQR

SEQ ID NO: 814303 - protein, 9 aa, Homo Sapiens
AEQLAQLYG

SEQ ID NO: 814304 - protein, 9 aa, Homo Sapiens
PIERKYYIV

SEQ ID NO: 814305 - protein, 9 aa, Homo Sapiens
GLVGRRQRA

SEQ ID NO: 814306 - protein, 9 aa, Homo Sapiens
FAFVAGPRL

SEQ ID NO: 814307 - protein, 9 aa, Homo Sapiens
ESQQCEPAS

SEQ ID NO: 814308 - protein, 9 aa, Homo Sapiens
ADSPGTPLL

SEQ ID NO: 814309 - protein, 9 aa, Homo Sapiens
GRTVEVQGP

SEQ ID NO: 814310 - protein, 9 aa, Homo Sapiens
LVAEAKNKL

SEQ ID NO: 814311 - protein, 9 aa, Homo Sapiens
DRITLISWT

SEQ ID NO: 814312 - protein, 9 aa, Homo Sapiens
MWLIHSFQV

SEQ ID NO: 814313 - protein, 9 aa, Homo Sapiens
SLEPQKQAL

SEQ ID NO: 814314 - protein, 9 aa, Homo Sapiens
SPYATDVAR

SEQ ID NO: 814315 - protein, 9 aa, Homo Sapiens
PIISLYFRM

SEQ ID NO: 814316 - protein, 9 aa, Homo Sapiens
SQRDNLRLF

SEQ ID NO: 814317 - protein, 9 aa, Homo Sapiens
TPQPGVFNS

SEQ ID NO: 814318 - protein, 9 aa, Homo Sapiens
IDKFDISDN

SEQ ID NO: 814319 - protein, 9 aa, Homo Sapiens
SASWSDNLR

SEQ ID NO: 814320 - protein, 9 aa, Homo Sapiens
QQIISLNKE

SEQ ID NO: 814321 - protein, 9 aa, Homo Sapiens
MDYLWGPGA

SEQ ID NO: 814322 - protein, 9 aa, Homo Sapiens
EGIYSIIVA

SEQ ID NO: 814323 - protein, 9 aa, Homo Sapiens
FIKDGSFNS

SEQ ID NO: 814324 - protein, 9 aa, Homo Sapiens
SLSGCFLQF

SEQ ID NO: 814325 - protein, 9 aa, Homo Sapiens
QVDIQPEEK

SEQ ID NO: 814326 - protein, 9 aa, Homo Sapiens
LFFFLQREG

SEQ ID NO: 814327 - protein, 9 aa, Homo Sapiens
NTSRKSLLK

SEQ ID NO: 814328 - protein, 9 aa, Homo Sapiens
EEDYQALQT

SEQ ID NO: 814329 - protein, 9 aa, Homo Sapiens
TSMTILYWR

SEQ ID NO: 814330 - protein, 9 aa, Homo Sapiens
AERISERQR

SEQ ID NO: 814331 - protein, 9 aa, Homo Sapiens
YTLILSIHS

SEQ ID NO: 814332 - protein, 9 aa, Homo Sapiens
GKVVSLLLE

SEQ ID NO: 814333 - protein, 9 aa, Homo Sapiens
LHILASLFE

SEQ ID NO: 814334 - protein, 9 aa, Homo Sapiens
LDEGLVEFG

SEQ ID NO: 814335 - protein, 9 aa, Homo Sapiens
PMSKQEDSM

SEQ ID NO: 814336 - protein, 9 aa, Homo Sapiens
RDNSYKCEE

SEQ ID NO: 814337 - protein, 9 aa, Homo Sapiens
KSSSTRESG

SEQ ID NO: 814338 - protein, 9 aa, Homo Sapiens
KGEFILLGG

SEQ ID NO: 814339 - protein, 9 aa, Homo Sapiens
HQRCDDFAD

SEQ ID NO: 814340 - protein, 9 aa, Homo Sapiens
ILEQSLDES

SEQ ID NO: 814341 - protein, 9 aa, Homo Sapiens
LEPVCFEMT

SEQ ID NO: 814342 - protein, 9 aa, Homo Sapiens
NIGSYATYN

SEQ ID NO: 814343 - protein, 9 aa, Homo Sapiens
RSKQDTILA

SEQ ID NO: 814344 - protein, 9 aa, Homo Sapiens
VVANKKFWR

SEQ ID NO: 814345 - protein, 9 aa, Homo Sapiens
LRLEREKQA

SEQ ID NO: 814346 - protein, 9 aa, Homo Sapiens
KFKQFCLLL

SEQ ID NO: 814347 - protein, 9 aa, Homo Sapiens
HQKCKEETC

SEQ ID NO: 814348 - protein, 9 aa, Homo Sapiens
PHEREVAGT

SEQ ID NO: 814349 - protein, 9 aa, Homo Sapiens
KEVQTCLKL

SEQ ID NO: 814350 - protein, 9 aa, Homo Sapiens
KTIFSAIEN

SEQ ID NO: 814351 - protein, 9 aa, Homo Sapiens
ELTHKTMPH

SEQ ID NO: 814352 - protein, 9 aa, Homo Sapiens
KSWVDTMQE

SEQ ID NO: 814353 - protein, 9 aa, Homo Sapiens
CKQCGNTYT

SEQ ID NO: 814354 - protein, 9 aa, Homo Sapiens
RDEQRPGNI

SEQ ID NO: 814355 - protein, 9 aa, Homo Sapiens
TTKPLRAST

SEQ ID NO: 814356 - protein, 9 aa, Homo Sapiens
LAGEEDVLL

SEQ ID NO: 814357 - protein, 9 aa, Homo Sapiens
CTICGQAFY

SEQ ID NO: 814358 - protein, 9 aa, Homo Sapiens
QETSFENMK

SEQ ID NO: 814359 - protein, 9 aa, Homo Sapiens
SPPSSPLPG

SEQ ID NO: 814360 - protein, 9 aa, Homo Sapiens
GYLSPSIIV

SEQ ID NO: 814361 - protein, 9 aa, Homo Sapiens
LLILASQVL

SEQ ID NO: 814362 - protein, 9 aa, Homo Sapiens
QPQSSYSVP

SEQ ID NO: 814363 - protein, 9 aa, Homo Sapiens
QPTYTDYIF

SEQ ID NO: 814364 - protein, 9 aa, Homo Sapiens
LCHLQVDGG

SEQ ID NO: 814365 - protein, 9 aa, Homo Sapiens
PHVVACSVE

SEQ ID NO: 814366 - protein, 9 aa, Homo Sapiens
STRSSHIPP

SEQ ID NO: 814367 - protein, 9 aa, Homo Sapiens
RNKKSTFED

SEQ ID NO: 814368 - protein, 9 aa, Homo Sapiens
CEFNITKSL

SEQ ID NO: 814369 - protein, 9 aa, Homo Sapiens
IRGQSSVCH

SEQ ID NO: 814370 - protein, 9 aa, Homo Sapiens
KAKIEDLSL

SEQ ID NO: 814371 - protein, 9 aa, Homo Sapiens
NENRIVEHT

SEQ ID NO: 814372 - protein, 9 aa, Homo Sapiens
RPVDLSKLP

SEQ ID NO: 814373 - protein, 9 aa, Homo Sapiens
LQINISLQL

SEQ ID NO: 814374 - protein, 9 aa, Homo Sapiens
AVKIWKGQA

SEQ ID NO: 814375 - protein, 9 aa, Homo Sapiens
AEGGKLMKI

SEQ ID NO: 814376 - protein, 9 aa, Homo Sapiens
LNAQKLERD

SEQ ID NO: 814377 - protein, 9 aa, Homo Sapiens
EMAEHEAFL

SEQ ID NO: 814378 - protein, 9 aa, Homo Sapiens
YPDIKEELE

SEQ ID NO: 814379 - protein, 9 aa, Homo Sapiens
LLKKANVHR

SEQ ID NO: 814380 - protein, 9 aa, Homo Sapiens
YCVQAITGF

SEQ ID NO: 814381 - protein, 9 aa, Homo Sapiens
HKGFSVDYD

SEQ ID NO: 814382 - protein, 9 aa, Homo Sapiens
QEDKSLNLA

SEQ ID NO: 814383 - protein, 9 aa, Homo Sapiens
RFSQSFNLI

SEQ ID NO: 814384 - protein, 9 aa, Homo Sapiens
HNPAFGKDT

SEQ ID NO: 814385 - protein, 9 aa, Homo Sapiens
TNLNKAITA

SEQ ID NO: 814386 - protein, 9 aa, Homo Sapiens
ARFDQLAHE

SEQ ID NO: 814387 - protein, 9 aa, Homo Sapiens
QLAIVPQEP

SEQ ID NO: 814388 - protein, 9 aa, Homo Sapiens
EPFTIQFYF

SEQ ID NO: 814389 - protein, 9 aa, Homo Sapiens
QLEQPFAGK

SEQ ID NO: 814390 - protein, 9 aa, Homo Sapiens
LRSEATPQY

SEQ ID NO: 814391 - protein, 9 aa, Homo Sapiens
QGVLCGAVK

SEQ ID NO: 814392 - protein, 9 aa, Homo Sapiens
EHEMNRADE

SEQ ID NO: 814393 - protein, 9 aa, Homo Sapiens
TASRFYRIN

SEQ ID NO: 814394 - protein, 9 aa, Homo Sapiens
RIKSYNKYV

SEQ ID NO: 814395 - protein, 9 aa, Homo Sapiens
FALVEDKVL

SEQ ID NO: 814396 - protein, 9 aa, Homo Sapiens
VGMYLAHNY

SEQ ID NO: 814397 - protein, 9 aa, Homo Sapiens
MAYDHYIAI

SEQ ID NO: 814398 - protein, 9 aa, Homo Sapiens
IQQSMHGRP

SEQ ID NO: 814399 - protein, 9 aa, Homo Sapiens
YALVTSFME

SEQ ID NO: 814400 - protein, 9 aa, Homo Sapiens
MHQIVISSA

SEQ ID NO: 814401 - protein, 9 aa, Homo Sapiens
AYGALSLIN

SEQ ID NO: 814402 - protein, 9 aa, Homo Sapiens
TLSTVEHMT

SEQ ID NO: 814403 - protein, 9 aa, Homo Sapiens
DVVSVTNGS

SEQ ID NO: 814404 - protein, 9 aa, Homo Sapiens
GLRELSERG

SEQ ID NO: 814405 - protein, 9 aa, Homo Sapiens
VVKCGRNSN

SEQ ID NO: 814406 - protein, 9 aa, Homo Sapiens
KKSSPEKNK

SEQ ID NO: 814407 - protein, 9 aa, Homo Sapiens
QKNNKDYHS

SEQ ID NO: 814408 - protein, 9 aa, Homo Sapiens
WLCPIKEVI

SEQ ID NO: 814409 - protein, 9 aa, Homo Sapiens
RKTLNCHLP

SEQ ID NO: 814410 - protein, 9 aa, Homo Sapiens
KKVISYRSG

SEQ ID NO: 814411 - protein, 9 aa, Homo Sapiens
ESLEISLSV

SEQ ID NO: 814412 - protein, 9 aa, Homo Sapiens
YKCNEGGKA

SEQ ID NO: 814413 - protein, 9 aa, Homo Sapiens
VQAAEAQRG

SEQ ID NO: 814414 - protein, 9 aa, Homo Sapiens
RRSDLNRFW

SEQ ID NO: 814415 - protein, 9 aa, Homo Sapiens
IFFYYLGCH

SEQ ID NO: 814416 - protein, 9 aa, Homo Sapiens
GLHSLRHGN

SEQ ID NO: 814417 - protein, 9 aa, Homo Sapiens
FEEKNQYTI

SEQ ID NO: 814418 - protein, 9 aa, Homo Sapiens
EKYYVTYSS

SEQ ID NO: 814419 - protein, 9 aa, Homo Sapiens
TSSHRYGQY

SEQ ID NO: 814420 - protein, 9 aa, Homo Sapiens
ACADTSVFK

SEQ ID NO: 814421 - protein, 9 aa, Homo Sapiens
ISQPKKRVE

SEQ ID NO: 814422 - protein, 9 aa, Homo Sapiens
QSLAAEINT

SEQ ID NO: 814423 - protein, 9 aa, Homo Sapiens
IRKGYRRIT

SEQ ID NO: 814424 - protein, 9 aa, Homo Sapiens
KLFLLFLAY

SEQ ID NO: 814425 - protein, 9 aa, Homo Sapiens
NMGKTIEGM

SEQ ID NO: 814426 - protein, 9 aa, Homo Sapiens
SENQHPGHF

SEQ ID NO: 814427 - protein, 9 aa, Homo Sapiens
SDDEGMPGS

SEQ ID NO: 814428 - protein, 9 aa, Homo Sapiens
LGGASRDVW

SEQ ID NO: 814429 - protein, 9 aa, Homo Sapiens
KHPEYGDTA

SEQ ID NO: 814430 - protein, 9 aa, Homo Sapiens
SGGFDEPST

SEQ ID NO: 814431 - protein, 9 aa, Homo Sapiens
RLPEKNWQM

SEQ ID NO: 814432 - protein, 9 aa, Homo Sapiens
HILERASYQ

SEQ ID NO: 814433 - protein, 9 aa, Homo Sapiens
LRGLDRTHS

SEQ ID NO: 814434 - protein, 9 aa, Homo Sapiens
KQILKLLDA

SEQ ID NO: 814435 - protein, 9 aa, Homo Sapiens
AYFEFVSAL

SEQ ID NO: 814436 - protein, 9 aa, Homo Sapiens
LDKNKKTSK

SEQ ID NO: 814437 - protein, 9 aa, Homo Sapiens
QPIRLQNIP

SEQ ID NO: 814438 - protein, 9 aa, Homo Sapiens
AEDSLRREN

SEQ ID NO: 814439 - protein, 9 aa, Homo Sapiens
RPHLQNIEN

SEQ ID NO: 814440 - protein, 9 aa, Homo Sapiens
IQIVTTVDA

SEQ ID NO: 814441 - protein, 9 aa, Homo Sapiens
INELQTFMI

SEQ ID NO: 814442 - protein, 9 aa, Homo Sapiens
KFMSASQNL

SEQ ID NO: 814443 - protein, 9 aa, Homo Sapiens
ISAGRIYIR

SEQ ID NO: 814444 - protein, 9 aa, Homo Sapiens
IYLDTPFSG

SEQ ID NO: 814445 - protein, 9 aa, Homo Sapiens
SLIAHQIIH

SEQ ID NO: 814446 - protein, 9 aa, Homo Sapiens
CLLLGWLHW

SEQ ID NO: 814447 - protein, 9 aa, Homo Sapiens
IEATNMYDN

SEQ ID NO: 814448 - protein, 9 aa, Homo Sapiens
PRAANNVPR

SEQ ID NO: 814449 - protein, 9 aa, Homo Sapiens
DFAIQYGEY

SEQ ID NO: 814450 - protein, 9 aa, Homo Sapiens
YIIEIVSYF

SEQ ID NO: 814451 - protein, 9 aa, Homo Sapiens
LLQQAHQII

SEQ ID NO: 814452 - protein, 9 aa, Homo Sapiens
VVVCCKGIN

SEQ ID NO: 814453 - protein, 9 aa, Homo Sapiens
DNLHRTFES

SEQ ID NO: 814454 - protein, 9 aa, Homo Sapiens
CRLCAKVFG

SEQ ID NO: 814455 - protein, 9 aa, Homo Sapiens
QTPYAGIKN

SEQ ID NO: 814456 - protein, 9 aa, Homo Sapiens
NPGQGLGDL

SEQ ID NO: 814457 - protein, 9 aa, Homo Sapiens
FSAFRMLSS

SEQ ID NO: 814458 - protein, 9 aa, Homo Sapiens
MAVEDIIYR

SEQ ID NO: 814459 - protein, 9 aa, Homo Sapiens
SADSKGVDT

SEQ ID NO: 814460 - protein, 9 aa, Homo Sapiens
PDNLSNIDV

SEQ ID NO: 814461 - protein, 9 aa, Homo Sapiens
RRKYEEAQK

SEQ ID NO: 814462 - protein, 9 aa, Homo Sapiens
CPDKCALFN

SEQ ID NO: 814463 - protein, 9 aa, Homo Sapiens
EAIQNEMNV

SEQ ID NO: 814464 - protein, 9 aa, Homo Sapiens
NRVAHMMPN

SEQ ID NO: 814465 - protein, 9 aa, Homo Sapiens
LQIVGFDPR

SEQ ID NO: 814466 - protein, 9 aa, Homo Sapiens
IIEQLRKKR

SEQ ID NO: 814467 - protein, 9 aa, Homo Sapiens
VFAADAMAH

SEQ ID NO: 814468 - protein, 9 aa, Homo Sapiens
GVFNALDLM

SEQ ID NO: 814469 - protein, 9 aa, Homo Sapiens
IQKRQMLSP

SEQ ID NO: 814470 - protein, 9 aa, Homo Sapiens
MEAVREGLQ

SEQ ID NO: 814471 - protein, 9 aa, Homo Sapiens
AAAHSAPPF

SEQ ID NO: 814472 - protein, 9 aa, Homo Sapiens
TELSACSAY

SEQ ID NO: 814473 - protein, 9 aa, Homo Sapiens
CALWDIKTG

SEQ ID NO: 814474 - protein, 9 aa, Homo Sapiens
REFEIDVAG

SEQ ID NO: 814475 - protein, 9 aa, Homo Sapiens
DKTSKQMAL

SEQ ID NO: 814476 - protein, 9 aa, Homo Sapiens
NTSRHNLEK

SEQ ID NO: 814477 - protein, 9 aa, Homo Sapiens
NTQKSGLDS

SEQ ID NO: 814478 - protein, 9 aa, Homo Sapiens
HFLRKEYGT

SEQ ID NO: 814479 - protein, 9 aa, Homo Sapiens
AQDEPSSRP

SEQ ID NO: 814480 - protein, 9 aa, Homo Sapiens
HPPTAPTRP

SEQ ID NO: 814481 - protein, 9 aa, Homo Sapiens
QQQLSSSSA

SEQ ID NO: 814482 - protein, 9 aa, Homo Sapiens
AEHEAFLLA

SEQ ID NO: 814483 - protein, 9 aa, Homo Sapiens
LIPSTSKQI

SEQ ID NO: 814484 - protein, 9 aa, Homo Sapiens
FLDTMPEYP

SEQ ID NO: 814485 - protein, 9 aa, Homo Sapiens
YFGFNTNAE

SEQ ID NO: 814486 - protein, 9 aa, Homo Sapiens
IVIPLPCCT

SEQ ID NO: 814487 - protein, 9 aa, Homo Sapiens
EILWVTEWL

SEQ ID NO: 814488 - protein, 9 aa, Homo Sapiens
LLQIEKEEL

SEQ ID NO: 814489 - protein, 9 aa, Homo Sapiens
TKYRSLRSQ

SEQ ID NO: 814490 - protein, 9 aa, Homo Sapiens
SLSYLAATH

SEQ ID NO: 814491 - protein, 9 aa, Homo Sapiens
GVFNSTSSP

SEQ ID NO: 814492 - protein, 9 aa, Homo Sapiens
CIRWVYGAD

SEQ ID NO: 814493 - protein, 9 aa, Homo Sapiens
LIHVCLALR

SEQ ID NO: 814494 - protein, 9 aa, Homo Sapiens
SDDEEKNHS

SEQ ID NO: 814495 - protein, 9 aa, Homo Sapiens
ITLSDFGFC

SEQ ID NO: 814496 - protein, 9 aa, Homo Sapiens
GNCPENCSI

SEQ ID NO: 814497 - protein, 9 aa, Homo Sapiens
HTFKNGRMV

SEQ ID NO: 814498 - protein, 9 aa, Homo Sapiens
RGEIARIWS

SEQ ID NO: 814499 - protein, 9 aa, Homo Sapiens
EKPTDDTPS

SEQ ID NO: 814500 - protein, 9 aa, Homo Sapiens
TSTFSGFEA

SEQ ID NO: 814501 - protein, 9 aa, Homo Sapiens
NYSGESGDE

SEQ ID NO: 814502 - protein, 9 aa, Homo Sapiens
QHRKFVRPG

SEQ ID NO: 814503 - protein, 9 aa, Homo Sapiens
YLLIGNLAF

SEQ ID NO: 814504 - protein, 9 aa, Homo Sapiens
LDLKLVDRP

SEQ ID NO: 814505 - protein, 9 aa, Homo Sapiens
EIEHLQNEL

SEQ ID NO: 814506 - protein, 9 aa, Homo Sapiens
IPAHCKVII

SEQ ID NO: 814507 - protein, 9 aa, Homo Sapiens
TKKRLRKAI

SEQ ID NO: 814508 - protein, 9 aa, Homo Sapiens
HLRLHSGEN

SEQ ID NO: 814509 - protein, 9 aa, Homo Sapiens
FEVKLAGLE

SEQ ID NO: 814510 - protein, 9 aa, Homo Sapiens
GDTPLHWAC

SEQ ID NO: 814511 - protein, 9 aa, Homo Sapiens
SQRTYRIWA

SEQ ID NO: 814512 - protein, 9 aa, Homo Sapiens
VFSYFAHAQ

SEQ ID NO: 814513 - protein, 9 aa, Homo Sapiens
NSLSVIEDD

SEQ ID NO: 814514 - protein, 9 aa, Homo Sapiens
KIMKSIGEA

SEQ ID NO: 814515 - protein, 9 aa, Homo Sapiens
GTNEETLRE

SEQ ID NO: 814516 - protein, 9 aa, Homo Sapiens
GCPAIIQAF

SEQ ID NO: 814517 - protein, 9 aa, Homo Sapiens
LNKAITANL

SEQ ID NO: 814518 - protein, 9 aa, Homo Sapiens
PATLPHGRC

SEQ ID NO: 814519 - protein, 9 aa, Homo Sapiens
FTNLDLNDQ

SEQ ID NO: 814520 - protein, 9 aa, Homo Sapiens
FDEPQKNAV

SEQ ID NO: 814521 - protein, 9 aa, Homo Sapiens
LQWRVTAEG

SEQ ID NO: 814522 - protein, 9 aa, Homo Sapiens
RSAIKIQMA

SEQ ID NO: 814523 - protein, 9 aa, Homo Sapiens
ELAPDIVGD

SEQ ID NO: 814524 - protein, 9 aa, Homo Sapiens
EIFDEDYKK

SEQ ID NO: 814525 - protein, 9 aa, Homo Sapiens
PGDPASDAG

SEQ ID NO: 814526 - protein, 9 aa, Homo Sapiens
SPAYPAAAA

SEQ ID NO: 814527 - protein, 9 aa, Homo Sapiens
FMGHRRASP

SEQ ID NO: 814528 - protein, 9 aa, Homo Sapiens
RKSPVVSDE

SEQ ID NO: 814529 - protein, 9 aa, Homo Sapiens
KRRIRKGHM

SEQ ID NO: 814530 - protein, 9 aa, Homo Sapiens
GHCLFVPRL

SEQ ID NO: 814531 - protein, 9 aa, Homo Sapiens
SGKKTPPRS

SEQ ID NO: 814532 - protein, 9 aa, Homo Sapiens
CLIATFQDV

SEQ ID NO: 814533 - protein, 9 aa, Homo Sapiens
KIAWRAATP

SEQ ID NO: 814534 - protein, 9 aa, Homo Sapiens
NPRSLETLE

SEQ ID NO: 814535 - protein, 9 aa, Homo Sapiens
RLYLLQGIQ

SEQ ID NO: 814536 - protein, 9 aa, Homo Sapiens
TLFWWEQDE

SEQ ID NO: 814537 - protein, 9 aa, Homo Sapiens
RFCSVSDKS

SEQ ID NO: 814538 - protein, 9 aa, Homo Sapiens
QKQHFCGQR

SEQ ID NO: 814539 - protein, 9 aa, Homo Sapiens
NNLASLIQA

SEQ ID NO: 814540 - protein, 9 aa, Homo Sapiens
FRSFPENEE

SEQ ID NO: 814541 - protein, 9 aa, Homo Sapiens
ELINFLIGI

SEQ ID NO: 814542 - protein, 9 aa, Homo Sapiens
YSAAVSPYY

SEQ ID NO: 814543 - protein, 9 aa, Homo Sapiens
ACHPQPLLH

SEQ ID NO: 814544 - protein, 9 aa, Homo Sapiens
DEINRPRRV

SEQ ID NO: 814545 - protein, 9 aa, Homo Sapiens
SQCIDSLNR

SEQ ID NO: 814546 - protein, 9 aa, Homo Sapiens
ISHDPHNRK

SEQ ID NO: 814547 - protein, 9 aa, Homo Sapiens
SEAPTFWQM

SEQ ID NO: 814548 - protein, 9 aa, Homo Sapiens
NCSKYIILK

SEQ ID NO: 814549 - protein, 9 aa, Homo Sapiens
SSSETSTLS

SEQ ID NO: 814550 - protein, 9 aa, Homo Sapiens
AWTTGPFCV

SEQ ID NO: 814551 - protein, 9 aa, Homo Sapiens
YRVACFACG

SEQ ID NO: 814552 - protein, 9 aa, Homo Sapiens
MFKKIKYFE

SEQ ID NO: 814553 - protein, 9 aa, Homo Sapiens
VSRTPRLPA

SEQ ID NO: 814554 - protein, 9 aa, Homo Sapiens
YSGRSSSES

SEQ ID NO: 814555 - protein, 9 aa, Homo Sapiens
QDDDARTGA

SEQ ID NO: 814556 - protein, 9 aa, Homo Sapiens
MNGMLLNDH

SEQ ID NO: 814557 - protein, 9 aa, Homo Sapiens
QPGTSQSST

SEQ ID NO: 814558 - protein, 9 aa, Homo Sapiens
KAAVLWELN

SEQ ID NO: 814559 - protein, 9 aa, Homo Sapiens
GTENAFEPA

SEQ ID NO: 814560 - protein, 9 aa, Homo Sapiens
HMSYTMKPN

SEQ ID NO: 814561 - protein, 9 aa, Homo Sapiens
FPRIGDKNK

SEQ ID NO: 814562 - protein, 9 aa, Homo Sapiens
PDGKIKEEL

SEQ ID NO: 814563 - protein, 9 aa, Homo Sapiens
KEASNIILT

SEQ ID NO: 814564 - protein, 9 aa, Homo Sapiens
YITKMTAVI

SEQ ID NO: 814565 - protein, 9 aa, Homo Sapiens
QLEEKKTCH

SEQ ID NO: 814566 - protein, 9 aa, Homo Sapiens
CWLVFRESS

SEQ ID NO: 814567 - protein, 9 aa, Homo Sapiens
NQGFDSDSF

SEQ ID NO: 814568 - protein, 9 aa, Homo Sapiens
MELSLNLDA

SEQ ID NO: 814569 - protein, 9 aa, Homo Sapiens
SFDFGSGIN

SEQ ID NO: 814570 - protein, 9 aa, Homo Sapiens
DSFLHENLL

SEQ ID NO: 814571 - protein, 9 aa, Homo Sapiens
LLLKLSTDL

SEQ ID NO: 814572 - protein, 9 aa, Homo Sapiens
KEINNSKDI

SEQ ID NO: 814573 - protein, 9 aa, Homo Sapiens
EAFLLALQM

SEQ ID NO: 814574 - protein, 9 aa, Homo Sapiens
HNPTHSADV

SEQ ID NO: 814575 - protein, 9 aa, Homo Sapiens
KLDTTNEYN

SEQ ID NO: 814576 - protein, 9 aa, Homo Sapiens
DNVFGKTLN

SEQ ID NO: 814577 - protein, 9 aa, Homo Sapiens
ERQSGHQES

SEQ ID NO: 814578 - protein, 9 aa, Homo Sapiens
FDKSMDPFK

SEQ ID NO: 814579 - protein, 9 aa, Homo Sapiens
YQTYMTHTI

SEQ ID NO: 814580 - protein, 9 aa, Homo Sapiens
KMYPLPEDP

SEQ ID NO: 814581 - protein, 9 aa, Homo Sapiens
QKAENHFSM

SEQ ID NO: 814582 - protein, 9 aa, Homo Sapiens
RPAGSTPTT

SEQ ID NO: 814583 - protein, 9 aa, Homo Sapiens
MKMPVAYQV

SEQ ID NO: 814584 - protein, 9 aa, Homo Sapiens
LPSTLRQQF

SEQ ID NO: 814585 - protein, 9 aa, Homo Sapiens
ILLSEFWSK

SEQ ID NO: 814586 - protein, 9 aa, Homo Sapiens
PDSCSTDFD

SEQ ID NO: 814587 - protein, 9 aa, Homo Sapiens
IVEWKPFKT

SEQ ID NO: 814588 - protein, 9 aa, Homo Sapiens
KETEFVSSL

SEQ ID NO: 814589 - protein, 9 aa, Homo Sapiens
TRGASLLTL

SEQ ID NO: 814590 - protein, 9 aa, Homo Sapiens
WTHHNMKPH

SEQ ID NO: 814591 - protein, 9 aa, Homo Sapiens
LEILEKCKR

SEQ ID NO: 814592 - protein, 9 aa, Homo Sapiens
LTIDNVTPA

SEQ ID NO: 814593 - protein, 9 aa, Homo Sapiens
SQDEQDELL

SEQ ID NO: 814594 - protein, 9 aa, Homo Sapiens
VTRRETGQA

SEQ ID NO: 814595 - protein, 9 aa, Homo Sapiens
EKIHPGEKP

SEQ ID NO: 814596 - protein, 9 aa, Homo Sapiens
KPNIPLSAP

SEQ ID NO: 814597 - protein, 9 aa, Homo Sapiens
FSIAGTVKW

SEQ ID NO: 814598 - protein, 9 aa, Homo Sapiens
GLNSRLYKW

SEQ ID NO: 814599 - protein, 9 aa, Homo Sapiens
QNVLDYYKR

SEQ ID NO: 814600 - protein, 9 aa, Homo Sapiens
ESNFPRGCK

SEQ ID NO: 814601 - protein, 9 aa, Homo Sapiens
SSVDLNRPE

SEQ ID NO: 814602 - protein, 9 aa, Homo Sapiens
YQAIGEDNV

SEQ ID NO: 814603 - protein, 9 aa, Homo Sapiens
NVKYFYRTL

SEQ ID NO: 814604 - protein, 9 aa, Homo Sapiens
KLQEPMTLN

SEQ ID NO: 814605 - protein, 9 aa, Homo Sapiens
DDGLDEAFL

SEQ ID NO: 814606 - protein, 9 aa, Homo Sapiens
YGRFSGKMC

SEQ ID NO: 814607 - protein, 9 aa, Homo Sapiens
VSSIQMISV

SEQ ID NO: 814608 - protein, 9 aa, Homo Sapiens
GAISGQSRW

SEQ ID NO: 814609 - protein, 9 aa, Homo Sapiens
ELQEELSGD

SEQ ID NO: 814610 - protein, 9 aa, Homo Sapiens
VRIFEGEGH

SEQ ID NO: 814611 - protein, 9 aa, Homo Sapiens
PAFIETYNV

SEQ ID NO: 814612 - protein, 9 aa, Homo Sapiens
KVANNLAIQ

SEQ ID NO: 814613 - protein, 9 aa, Homo Sapiens
PGVELTLLA

SEQ ID NO: 814614 - protein, 9 aa, Homo Sapiens
LDSPREDEQ

SEQ ID NO: 814615 - protein, 9 aa, Homo Sapiens
VSQHAAKCI

SEQ ID NO: 814616 - protein, 9 aa, Homo Sapiens
ILAEVIPDP

SEQ ID NO: 814617 - protein, 9 aa, Homo Sapiens
TPAFLWPWW

SEQ ID NO: 814618 - protein, 9 aa, Homo Sapiens
CRIDTSRKL

SEQ ID NO: 814619 - protein, 9 aa, Homo Sapiens
DQLVNRSIR

SEQ ID NO: 814620 - protein, 9 aa, Homo Sapiens
NGRMVNLGG

SEQ ID NO: 814621 - protein, 9 aa, Homo Sapiens
FDPGTSMKY

SEQ ID NO: 814622 - protein, 9 aa, Homo Sapiens
AKLDKFSSA

SEQ ID NO: 814623 - protein, 9 aa, Homo Sapiens
ISHHHPEPP

SEQ ID NO: 814624 - protein, 9 aa, Homo Sapiens
PGEFNELFN

SEQ ID NO: 814625 - protein, 9 aa, Homo Sapiens
AGDSEDKPE

SEQ ID NO: 814626 - protein, 9 aa, Homo Sapiens
SSLIIHQRN

SEQ ID NO: 814627 - protein, 9 aa, Homo Sapiens
LKSILEIIS

SEQ ID NO: 814628 - protein, 9 aa, Homo Sapiens
NKPFSIEEV

SEQ ID NO: 814629 - protein, 9 aa, Homo Sapiens
FWEIEEKYS

SEQ ID NO: 814630 - protein, 9 aa, Homo Sapiens
PNLPTHLPN

SEQ ID NO: 814631 - protein, 9 aa, Homo Sapiens
DYYHCYSPK

SEQ ID NO: 814632 - protein, 9 aa, Homo Sapiens
RGMAVREFN

SEQ ID NO: 814633 - protein, 9 aa, Homo Sapiens
RAVSKPDVI

SEQ ID NO: 814634 - protein, 9 aa, Homo Sapiens
KSWNGEDRL

SEQ ID NO: 814635 - protein, 9 aa, Homo Sapiens
RVFRSRCQK

SEQ ID NO: 814636 - protein, 9 aa, Homo Sapiens
ARDVHNQIV

SEQ ID NO: 814637 - protein, 9 aa, Homo Sapiens
PQTEDGITP

SEQ ID NO: 814638 - protein, 9 aa, Homo Sapiens
MQALVELFE

SEQ ID NO: 814639 - protein, 9 aa, Homo Sapiens
SSLAEATTK

SEQ ID NO: 814640 - protein, 9 aa, Homo Sapiens
GVTFYGPRS

SEQ ID NO: 814641 - protein, 9 aa, Homo Sapiens
QVITLTDNQ

SEQ ID NO: 814642 - protein, 9 aa, Homo Sapiens
EISDCYVFF

SEQ ID NO: 814643 - protein, 9 aa, Homo Sapiens
NPLLYSITQ

SEQ ID NO: 814644 - protein, 9 aa, Homo Sapiens
VVTVVSTVM

SEQ ID NO: 814645 - protein, 9 aa, Homo Sapiens
PRDIHTLGF

SEQ ID NO: 814646 - protein, 9 aa, Homo Sapiens
VLFPGIEGH

SEQ ID NO: 814647 - protein, 9 aa, Homo Sapiens
EGNTCKTQT

SEQ ID NO: 814648 - protein, 9 aa, Homo Sapiens
NHYLTPQSV

SEQ ID NO: 814649 - protein, 9 aa, Homo Sapiens
QDQQVLQQQ

SEQ ID NO: 814650 - protein, 9 aa, Homo Sapiens
NKYMHLKVL

SEQ ID NO: 814651 - protein, 9 aa, Homo Sapiens
RTPENHENI

SEQ ID NO: 814652 - protein, 9 aa, Homo Sapiens
MYKELKQIY

SEQ ID NO: 814653 - protein, 9 aa, Homo Sapiens
NRKKITNVL

SEQ ID NO: 814654 - protein, 9 aa, Homo Sapiens
SLGLISHHR

SEQ ID NO: 814655 - protein, 9 aa, Homo Sapiens
SIFHLAMWT

SEQ ID NO: 814656 - protein, 9 aa, Homo Sapiens
FPCPTGSKP

SEQ ID NO: 814657 - protein, 9 aa, Homo Sapiens
LVPELCNHS

SEQ ID NO: 814658 - protein, 9 aa, Homo Sapiens
VPWYPSDLL

SEQ ID NO: 814659 - protein, 9 aa, Homo Sapiens
CLKHNIRNI

SEQ ID NO: 814660 - protein, 9 aa, Homo Sapiens
SGFLPPARP

SEQ ID NO: 814661 - protein, 9 aa, Homo Sapiens
QTLTDYDIQ

SEQ ID NO: 814662 - protein, 9 aa, Homo Sapiens
LQQNSALPA

SEQ ID NO: 814663 - protein, 9 aa, Homo Sapiens
INISLQLMS

SEQ ID NO: 814664 - protein, 9 aa, Homo Sapiens
DNKLLKQHE

SEQ ID NO: 814665 - protein, 9 aa, Homo Sapiens
KSRRDPSEE

SEQ ID NO: 814666 - protein, 9 aa, Homo Sapiens
KLGQEPVLA

SEQ ID NO: 814667 - protein, 9 aa, Homo Sapiens
HNKHPQLKI

SEQ ID NO: 814668 - protein, 9 aa, Homo Sapiens
EEDPPAKSK

SEQ ID NO: 814669 - protein, 9 aa, Homo Sapiens
GFGDIVLEH

SEQ ID NO: 814670 - protein, 9 aa, Homo Sapiens
APSCTGFLF

SEQ ID NO: 814671 - protein, 9 aa, Homo Sapiens
SSSKIALHD

SEQ ID NO: 814672 - protein, 9 aa, Homo Sapiens
LTNLTDNGL

SEQ ID NO: 814673 - protein, 9 aa, Homo Sapiens
FVGLHWMEG

SEQ ID NO: 814674 - protein, 9 aa, Homo Sapiens
KEKSVQERE

SEQ ID NO: 814675 - protein, 9 aa, Homo Sapiens
LNAEYYRWQ

SEQ ID NO: 814676 - protein, 9 aa, Homo Sapiens
TPNNYSTSG

SEQ ID NO: 814677 - protein, 9 aa, Homo Sapiens
VDQRSMPSM

SEQ ID NO: 814678 - protein, 9 aa, Homo Sapiens
PRSATVTLH

SEQ ID NO: 814679 - protein, 9 aa, Homo Sapiens
NTPNWYFHN

SEQ ID NO: 814680 - protein, 9 aa, Homo Sapiens
KENSSQSKT

SEQ ID NO: 814681 - protein, 9 aa, Homo Sapiens
KEANKREKL

SEQ ID NO: 814682 - protein, 9 aa, Homo Sapiens
IHGIIHTGE

SEQ ID NO: 814683 - protein, 9 aa, Homo Sapiens
LALMFLHDK

SEQ ID NO: 814684 - protein, 9 aa, Homo Sapiens
PSNPLEKEQ

SEQ ID NO: 814685 - protein, 9 aa, Homo Sapiens
SSKRYTEDA

SEQ ID NO: 814686 - protein, 9 aa, Homo Sapiens
LKYEATIAA

SEQ ID NO: 814687 - protein, 9 aa, Homo Sapiens
TRDLIQDKY

SEQ ID NO: 814688 - protein, 9 aa, Homo Sapiens
TNIDEHLFG

SEQ ID NO: 814689 - protein, 9 aa, Homo Sapiens
LIQPCILII

SEQ ID NO: 814690 - protein, 9 aa, Homo Sapiens
AEIILALMF

SEQ ID NO: 814691 - protein, 9 aa, Homo Sapiens
VYSFHGLVH

SEQ ID NO: 814692 - protein, 9 aa, Homo Sapiens
NHHMQCLEK

SEQ ID NO: 814693 - protein, 9 aa, Homo Sapiens
AKVWSRTAY

SEQ ID NO: 814694 - protein, 9 aa, Homo Sapiens
GRNELIGRY

SEQ ID NO: 814695 - protein, 9 aa, Homo Sapiens
PEAWSDALS

SEQ ID NO: 814696 - protein, 9 aa, Homo Sapiens
VLTPTQELA

SEQ ID NO: 814697 - protein, 9 aa, Homo Sapiens
SEYISYFGY

SEQ ID NO: 814698 - protein, 9 aa, Homo Sapiens
YNLIELPYH

SEQ ID NO: 814699 - protein, 9 aa, Homo Sapiens
VNLASLIYS

SEQ ID NO: 814700 - protein, 9 aa, Homo Sapiens
KLAEVKRGQ

SEQ ID NO: 814701 - protein, 9 aa, Homo Sapiens
EVQTNIFEE

SEQ ID NO: 814702 - protein, 9 aa, Homo Sapiens
AADEISLSS

SEQ ID NO: 814703 - protein, 9 aa, Homo Sapiens
YLVKLICLS

SEQ ID NO: 814704 - protein, 9 aa, Homo Sapiens
FYHAEPPEK

SEQ ID NO: 814705 - protein, 9 aa, Homo Sapiens
NILVAANGT

SEQ ID NO: 814706 - protein, 9 aa, Homo Sapiens
ASLQFDGAL

SEQ ID NO: 814707 - protein, 9 aa, Homo Sapiens
FKQNFEYLH

SEQ ID NO: 814708 - protein, 9 aa, Homo Sapiens
QKENSGAQL

SEQ ID NO: 814709 - protein, 9 aa, Homo Sapiens
MTDPTRRLF

SEQ ID NO: 814710 - protein, 9 aa, Homo Sapiens
IINYIIVIF

SEQ ID NO: 814711 - protein, 9 aa, Homo Sapiens
LLLNVDMWD

SEQ ID NO: 814712 - protein, 9 aa, Homo Sapiens
IKEANLFGS

SEQ ID NO: 814713 - protein, 9 aa, Homo Sapiens
LFELIQGTE

SEQ ID NO: 814714 - protein, 9 aa, Homo Sapiens
DGDVFNDCK

SEQ ID NO: 814715 - protein, 9 aa, Homo Sapiens
YRIIHEAII

SEQ ID NO: 814716 - protein, 9 aa, Homo Sapiens
DFFGDHQEA

SEQ ID NO: 814717 - protein, 9 aa, Homo Sapiens
KGKDYCILY

SEQ ID NO: 814718 - protein, 9 aa, Homo Sapiens
IQLTAKYIL

SEQ ID NO: 814719 - protein, 9 aa, Homo Sapiens
VLYLATDRG

SEQ ID NO: 814720 - protein, 9 aa, Homo Sapiens
LEVKRVAAT

SEQ ID NO: 814721 - protein, 9 aa, Homo Sapiens
QAMKKICDD

SEQ ID NO: 814722 - protein, 9 aa, Homo Sapiens
LSVDGIWLL

SEQ ID NO: 814723 - protein, 9 aa, Homo Sapiens
HDGQNNGDA

SEQ ID NO: 814724 - protein, 9 aa, Homo Sapiens
YNQAVDIWS

SEQ ID NO: 814725 - protein, 9 aa, Homo Sapiens
AVIQSKDTT

SEQ ID NO: 814726 - protein, 9 aa, Homo Sapiens
DKLEIAREK

SEQ ID NO: 814727 - protein, 9 aa, Homo Sapiens
ENNLVKKKE

SEQ ID NO: 814728 - protein, 9 aa, Homo Sapiens
FLSVKKIIS

SEQ ID NO: 814729 - protein, 9 aa, Homo Sapiens
EGLTALHLA

SEQ ID NO: 814730 - protein, 9 aa, Homo Sapiens
QLVNLKELC

SEQ ID NO: 814731 - protein, 9 aa, Homo Sapiens
IVTSALRMP

SEQ ID NO: 814732 - protein, 9 aa, Homo Sapiens
DSHTPSLLR

SEQ ID NO: 814733 - protein, 9 aa, Homo Sapiens
TRCAPFLPE

SEQ ID NO: 814734 - protein, 9 aa, Homo Sapiens
TEVVLTIIR

SEQ ID NO: 814735 - protein, 9 aa, Homo Sapiens
HHVGQSGAK

SEQ ID NO: 814736 - protein, 9 aa, Homo Sapiens
TVGFNVEHL

SEQ ID NO: 814737 - protein, 9 aa, Homo Sapiens
MKKAQNDEY

SEQ ID NO: 814738 - protein, 9 aa, Homo Sapiens
DEPSSRPQT

SEQ ID NO: 814739 - protein, 9 aa, Homo Sapiens
NKLEQLYNR

SEQ ID NO: 814740 - protein, 9 aa, Homo Sapiens
VLCVITVLI

SEQ ID NO: 814741 - protein, 9 aa, Homo Sapiens
SQYPETELY

SEQ ID NO: 814742 - protein, 9 aa, Homo Sapiens
CSEQAQVFV

SEQ ID NO: 814743 - protein, 9 aa, Homo Sapiens
DFPDTTQCA

SEQ ID NO: 814744 - protein, 9 aa, Homo Sapiens
LFFMRQLFQ

SEQ ID NO: 814745 - protein, 9 aa, Homo Sapiens
TMNDFNYLK

SEQ ID NO: 814746 - protein, 9 aa, Homo Sapiens
QIGLLFKKS

SEQ ID NO: 814747 - protein, 9 aa, Homo Sapiens
SPFHDHAEV

SEQ ID NO: 814748 - protein, 9 aa, Homo Sapiens
KEELNKLRQ

SEQ ID NO: 814749 - protein, 9 aa, Homo Sapiens
FWKEHKPGG

SEQ ID NO: 814750 - protein, 9 aa, Homo Sapiens
HPALKANSQ

SEQ ID NO: 814751 - protein, 9 aa, Homo Sapiens
RKRKMCSKK

SEQ ID NO: 814752 - protein, 9 aa, Homo Sapiens
LVILAIITD

SEQ ID NO: 814753 - protein, 9 aa, Homo Sapiens
NVFHQCSNS

SEQ ID NO: 814754 - protein, 9 aa, Homo Sapiens
ARPLIQTKD

SEQ ID NO: 814755 - protein, 9 aa, Homo Sapiens
LLQFNAIRV

SEQ ID NO: 814756 - protein, 9 aa, Homo Sapiens
DFKLHVLCK

SEQ ID NO: 814757 - protein, 9 aa, Homo Sapiens
TLESTHASL

SEQ ID NO: 814758 - protein, 9 aa, Homo Sapiens
AISASTVLI

SEQ ID NO: 814759 - protein, 9 aa, Homo Sapiens
ETALLIQAL

SEQ ID NO: 814760 - protein, 9 aa, Homo Sapiens
LQIEKEELD

SEQ ID NO: 814761 - protein, 9 aa, Homo Sapiens
DTGSRYVAQ

SEQ ID NO: 814762 - protein, 9 aa, Homo Sapiens
KPFLIFDHL

SEQ ID NO: 814763 - protein, 9 aa, Homo Sapiens
TNGHDFQMF

SEQ ID NO: 814764 - protein, 9 aa, Homo Sapiens
GSVRRLMLS

SEQ ID NO: 814765 - protein, 9 aa, Homo Sapiens
VESGWIRYL

SEQ ID NO: 814766 - protein, 9 aa, Homo Sapiens
DPENKLEFK

SEQ ID NO: 814767 - protein, 9 aa, Homo Sapiens
DPLFLDLLK

SEQ ID NO: 814768 - protein, 9 aa, Homo Sapiens
RQFSTEITL

SEQ ID NO: 814769 - protein, 9 aa, Homo Sapiens
PKQRLSAAR

SEQ ID NO: 814770 - protein, 9 aa, Homo Sapiens
ENHIQVPES

SEQ ID NO: 814771 - protein, 9 aa, Homo Sapiens
FSLDSTMRI

SEQ ID NO: 814772 - protein, 9 aa, Homo Sapiens
FIHLFYKFY

SEQ ID NO: 814773 - protein, 9 aa, Homo Sapiens
KGRVALLLG

SEQ ID NO: 814774 - protein, 9 aa, Homo Sapiens
VSPKFSTQF

SEQ ID NO: 814775 - protein, 9 aa, Homo Sapiens
QGWMKLDTN

SEQ ID NO: 814776 - protein, 9 aa, Homo Sapiens
QALRGTLTP

SEQ ID NO: 814777 - protein, 9 aa, Homo Sapiens
GKVFNQKAK

SEQ ID NO: 814778 - protein, 9 aa, Homo Sapiens
FTIQFYFVH

SEQ ID NO: 814779 - protein, 9 aa, Homo Sapiens
GRLLDWALC

SEQ ID NO: 814780 - protein, 9 aa, Homo Sapiens
KAKDLPKLA

SEQ ID NO: 814781 - protein, 9 aa, Homo Sapiens
TKSQAFVLN

SEQ ID NO: 814782 - protein, 9 aa, Homo Sapiens
QTSLAMQWP

SEQ ID NO: 814783 - protein, 9 aa, Homo Sapiens
PQSSLSAFP

SEQ ID NO: 814784 - protein, 9 aa, Homo Sapiens
MLRSLGEKA

SEQ ID NO: 814785 - protein, 9 aa, Homo Sapiens
VEELMLLAN

SEQ ID NO: 814786 - protein, 9 aa, Homo Sapiens
TEVVAGAFS

SEQ ID NO: 814787 - protein, 9 aa, Homo Sapiens
RPNKSTGGE

SEQ ID NO: 814788 - protein, 9 aa, Homo Sapiens
RYRGLGILA

SEQ ID NO: 814789 - protein, 9 aa, Homo Sapiens
ANQLNDTLQ

SEQ ID NO: 814790 - protein, 9 aa, Homo Sapiens
KTTMPESDL

SEQ ID NO: 814791 - protein, 9 aa, Homo Sapiens
VMTAIISLP

SEQ ID NO: 814792 - protein, 9 aa, Homo Sapiens
TVLQHVVKV

SEQ ID NO: 814793 - protein, 9 aa, Homo Sapiens
TVEYLLCLA

SEQ ID NO: 814794 - protein, 9 aa, Homo Sapiens
HKEEEEILM

SEQ ID NO: 814795 - protein, 9 aa, Homo Sapiens
SEAFQKRNR

SEQ ID NO: 814796 - protein, 9 aa, Homo Sapiens
KDNKVDFNE

SEQ ID NO: 814797 - protein, 9 aa, Homo Sapiens
ATNRTGQWV

SEQ ID NO: 814798 - protein, 9 aa, Homo Sapiens
KYETLEDDS

SEQ ID NO: 814799 - protein, 9 aa, Homo Sapiens
VPEVDTIDL

SEQ ID NO: 814800 - protein, 9 aa, Homo Sapiens
KAECSIQLP

SEQ ID NO: 814801 - protein, 9 aa, Homo Sapiens
TLTNHKIIH

SEQ ID NO: 814802 - protein, 9 aa, Homo Sapiens
AYPAAAASE

SEQ ID NO: 814803 - protein, 9 aa, Homo Sapiens
LRCFIKRVY

SEQ ID NO: 814804 - protein, 9 aa, Homo Sapiens
YAGIYRCYY

SEQ ID NO: 814805 - protein, 9 aa, Homo Sapiens
PSAKHEYKK

SEQ ID NO: 814806 - protein, 9 aa, Homo Sapiens
HTAGFFIAF

SEQ ID NO: 814807 - protein, 9 aa, Homo Sapiens
ENMVNPRAL

SEQ ID NO: 814808 - protein, 9 aa, Homo Sapiens
SLNEAQEIL

SEQ ID NO: 814809 - protein, 9 aa, Homo Sapiens
PLRPKLRKD

SEQ ID NO: 814810 - protein, 9 aa, Homo Sapiens
DPFLYDYKR

SEQ ID NO: 814811 - protein, 9 aa, Homo Sapiens
SVQEMVQHY

SEQ ID NO: 814812 - protein, 9 aa, Homo Sapiens
QSTNQSHNP

SEQ ID NO: 814813 - protein, 9 aa, Homo Sapiens
SQKKNVFMY

SEQ ID NO: 814814 - protein, 9 aa, Homo Sapiens
KSKKFSRLD

SEQ ID NO: 814815 - protein, 9 aa, Homo Sapiens
LASQGLNII

SEQ ID NO: 814816 - protein, 9 aa, Homo Sapiens
KVVKFLIEA

SEQ ID NO: 814817 - protein, 9 aa, Homo Sapiens
LAVYEMIQC

SEQ ID NO: 814818 - protein, 9 aa, Homo Sapiens
QGKTQQSQQ

SEQ ID NO: 814819 - protein, 9 aa, Homo Sapiens
RGFIVRKNL

SEQ ID NO: 814820 - protein, 9 aa, Homo Sapiens
NKFYAVLKG

SEQ ID NO: 814821 - protein, 9 aa, Homo Sapiens
TIKTDVFSY

SEQ ID NO: 814822 - protein, 9 aa, Homo Sapiens
KDKPFKCQE

SEQ ID NO: 814823 - protein, 9 aa, Homo Sapiens
VDNEELNLE

SEQ ID NO: 814824 - protein, 9 aa, Homo Sapiens
NEGDDVDKY

SEQ ID NO: 814825 - protein, 9 aa, Homo Sapiens
SDYPSRSPK

SEQ ID NO: 814826 - protein, 9 aa, Homo Sapiens
KSKCIFMSE

SEQ ID NO: 814827 - protein, 9 aa, Homo Sapiens
QLKHCSRYM

SEQ ID NO: 814828 - protein, 9 aa, Homo Sapiens
EGACIVRDS

SEQ ID NO: 814829 - protein, 9 aa, Homo Sapiens
QLINLKPSV

SEQ ID NO: 814830 - protein, 9 aa, Homo Sapiens
STQIYLKRP

SEQ ID NO: 814831 - protein, 9 aa, Homo Sapiens
GQSLAAGPQ

SEQ ID NO: 814832 - protein, 9 aa, Homo Sapiens
EVAKSTHYA

SEQ ID NO: 814833 - protein, 9 aa, Homo Sapiens
IKEAVLYVK

SEQ ID NO: 814834 - protein, 9 aa, Homo Sapiens
ETPGYIYYS

SEQ ID NO: 814835 - protein, 9 aa, Homo Sapiens
AAWAVYYAH

SEQ ID NO: 814836 - protein, 9 aa, Homo Sapiens
PDLDAVLIC

SEQ ID NO: 814837 - protein, 9 aa, Homo Sapiens
IFLFKFLFT

SEQ ID NO: 814838 - protein, 9 aa, Homo Sapiens
TLLSELVPF

SEQ ID NO: 814839 - protein, 9 aa, Homo Sapiens
LLTTTAEHQ

SEQ ID NO: 814840 - protein, 9 aa, Homo Sapiens
PQLPAPPNI

SEQ ID NO: 814841 - protein, 9 aa, Homo Sapiens
SVPAVTEEA

SEQ ID NO: 814842 - protein, 9 aa, Homo Sapiens
NDNYLSRTP

SEQ ID NO: 814843 - protein, 9 aa, Homo Sapiens
ASLHVRQNN

SEQ ID NO: 814844 - protein, 9 aa, Homo Sapiens
EDYLTNILK

SEQ ID NO: 814845 - protein, 9 aa, Homo Sapiens
ALQTSINTA

SEQ ID NO: 814846 - protein, 9 aa, Homo Sapiens
CTLVATIWF

SEQ ID NO: 814847 - protein, 9 aa, Homo Sapiens
ASDGEQTTH

SEQ ID NO: 814848 - protein, 9 aa, Homo Sapiens
LEAVPFASV

SEQ ID NO: 814849 - protein, 9 aa, Homo Sapiens
KIQFSRITY

SEQ ID NO: 814850 - protein, 9 aa, Homo Sapiens
EADNNENIQ

SEQ ID NO: 814851 - protein, 9 aa, Homo Sapiens
KQLKSKLLD

SEQ ID NO: 814852 - protein, 9 aa, Homo Sapiens
VDGYRYTSL

SEQ ID NO: 814853 - protein, 9 aa, Homo Sapiens
PINSVNLDS

SEQ ID NO: 814854 - protein, 9 aa, Homo Sapiens
YNYDSSSWP

SEQ ID NO: 814855 - protein, 9 aa, Homo Sapiens
LSILLTPLF

SEQ ID NO: 814856 - protein, 9 aa, Homo Sapiens
MQFLACIII

SEQ ID NO: 814857 - protein, 9 aa, Homo Sapiens
TKFKLPKEL

SEQ ID NO: 814858 - protein, 9 aa, Homo Sapiens
LSDLNSTRG

SEQ ID NO: 814859 - protein, 9 aa, Homo Sapiens
ETCDKLRVH

SEQ ID NO: 814860 - protein, 9 aa, Homo Sapiens
LFQYASTNM

SEQ ID NO: 814861 - protein, 9 aa, Homo Sapiens
CSTQREILK

SEQ ID NO: 814862 - protein, 9 aa, Homo Sapiens
LVFLSTGDQ

SEQ ID NO: 814863 - protein, 9 aa, Homo Sapiens
NCIGQAFTM

SEQ ID NO: 814864 - protein, 9 aa, Homo Sapiens
QIIKSQERE

SEQ ID NO: 814865 - protein, 9 aa, Homo Sapiens
LRSICMHTN

SEQ ID NO: 814866 - protein, 9 aa, Homo Sapiens
KSTLLQQIA

SEQ ID NO: 814867 - protein, 9 aa, Homo Sapiens
LVILFSALH

SEQ ID NO: 814868 - protein, 9 aa, Homo Sapiens
TTIGCIAFS

SEQ ID NO: 814869 - protein, 9 aa, Homo Sapiens
QIWNFVEIN

SEQ ID NO: 814870 - protein, 9 aa, Homo Sapiens
AQLYGPEPA

SEQ ID NO: 814871 - protein, 9 aa, Homo Sapiens
IILHFAIQD

SEQ ID NO: 814872 - protein, 9 aa, Homo Sapiens
IMNSIKKKL

SEQ ID NO: 814873 - protein, 9 aa, Homo Sapiens
NEELLMVMS

SEQ ID NO: 814874 - protein, 9 aa, Homo Sapiens
LTQMYLFLM

SEQ ID NO: 814875 - protein, 9 aa, Homo Sapiens
VAENVSKKE

SEQ ID NO: 814876 - protein, 9 aa, Homo Sapiens
CTDHGSDHH

SEQ ID NO: 814877 - protein, 9 aa, Homo Sapiens
VHLVGLLSG

SEQ ID NO: 814878 - protein, 9 aa, Homo Sapiens
FLRFGKTKS

SEQ ID NO: 814879 - protein, 9 aa, Homo Sapiens
TMPEYPALS

SEQ ID NO: 814880 - protein, 9 aa, Homo Sapiens
RHERIHMRD

SEQ ID NO: 814881 - protein, 9 aa, Homo Sapiens
YVNIVQFYT

SEQ ID NO: 814882 - protein, 9 aa, Homo Sapiens
KNYQVHQSR

SEQ ID NO: 814883 - protein, 9 aa, Homo Sapiens
ATMYNVLAY

SEQ ID NO: 814884 - protein, 9 aa, Homo Sapiens
KVLKYFYVH

SEQ ID NO: 814885 - protein, 9 aa, Homo Sapiens
KDLMLRSLG

SEQ ID NO: 814886 - protein, 9 aa, Homo Sapiens
SSTRDYQTN

SEQ ID NO: 814887 - protein, 9 aa, Homo Sapiens
SQSGESKSS

SEQ ID NO: 814888 - protein, 9 aa, Homo Sapiens
ELWIYQQEW

SEQ ID NO: 814889 - protein, 9 aa, Homo Sapiens
LKVRTEGNE

SEQ ID NO: 814890 - protein, 9 aa, Homo Sapiens
LKREYEVKR

SEQ ID NO: 814891 - protein, 9 aa, Homo Sapiens
KDRTIKQTD

SEQ ID NO: 814892 - protein, 9 aa, Homo Sapiens
LKTSMYAGA

SEQ ID NO: 814893 - protein, 9 aa, Homo Sapiens
LKWVRDINL

SEQ ID NO: 814894 - protein, 9 aa, Homo Sapiens
MWLCPIKEV

SEQ ID NO: 814895 - protein, 9 aa, Homo Sapiens
ILHFATEND

SEQ ID NO: 814896 - protein, 9 aa, Homo Sapiens
GGIAQSIAA

SEQ ID NO: 814897 - protein, 9 aa, Homo Sapiens
FNVFTKGEN

SEQ ID NO: 814898 - protein, 9 aa, Homo Sapiens
QALLGINLM

SEQ ID NO: 814899 - protein, 9 aa, Homo Sapiens
NHSLDSKPT

SEQ ID NO: 814900 - protein, 9 aa, Homo Sapiens
QEEIDKMAE

SEQ ID NO: 814901 - protein, 9 aa, Homo Sapiens
LSDKTSKQM

SEQ ID NO: 814902 - protein, 9 aa, Homo Sapiens
EIMRMCKNH

SEQ ID NO: 814903 - protein, 9 aa, Homo Sapiens
PSRNWRERA

SEQ ID NO: 814904 - protein, 9 aa, Homo Sapiens
LVHGKPKYQ

SEQ ID NO: 814905 - protein, 9 aa, Homo Sapiens
PNNYFTLDA

SEQ ID NO: 814906 - protein, 9 aa, Homo Sapiens
NHFKFLGSS

SEQ ID NO: 814907 - protein, 9 aa, Homo Sapiens
NFSQSQYLI

SEQ ID NO: 814908 - protein, 9 aa, Homo Sapiens
ISKRQFKNS

SEQ ID NO: 814909 - protein, 9 aa, Homo Sapiens
LSCIVKRTK

SEQ ID NO: 814910 - protein, 9 aa, Homo Sapiens
GTTPQNKLE

SEQ ID NO: 814911 - protein, 9 aa, Homo Sapiens
LRDAFRESD

SEQ ID NO: 814912 - protein, 9 aa, Homo Sapiens
VTGSAWVSS

SEQ ID NO: 814913 - protein, 9 aa, Homo Sapiens
LVQQSQLVV

SEQ ID NO: 814914 - protein, 9 aa, Homo Sapiens
LLPALNYKF

SEQ ID NO: 814915 - protein, 9 aa, Homo Sapiens
VRLNKKQQH

SEQ ID NO: 814916 - protein, 9 aa, Homo Sapiens
RRVLNTVIP

SEQ ID NO: 814917 - protein, 9 aa, Homo Sapiens
KIFWKNLAV

SEQ ID NO: 814918 - protein, 9 aa, Homo Sapiens
GLLTLGMSL

SEQ ID NO: 814919 - protein, 9 aa, Homo Sapiens
ANGNKCSHF

SEQ ID NO: 814920 - protein, 9 aa, Homo Sapiens
IPWKQGLED

SEQ ID NO: 814921 - protein, 9 aa, Homo Sapiens
GYKPMHDFL

SEQ ID NO: 814922 - protein, 9 aa, Homo Sapiens
LSKKVECRE

SEQ ID NO: 814923 - protein, 9 aa, Homo Sapiens
WISQVLYSC

SEQ ID NO: 814924 - protein, 9 aa, Homo Sapiens
LRHPKRILL

SEQ ID NO: 814925 - protein, 9 aa, Homo Sapiens
TGRDVVLAT

SEQ ID NO: 814926 - protein, 9 aa, Homo Sapiens
KQEAICEVD

SEQ ID NO: 814927 - protein, 9 aa, Homo Sapiens
KRHRNKLYV

SEQ ID NO: 814928 - protein, 9 aa, Homo Sapiens
QTGDNLQCG

SEQ ID NO: 814929 - protein, 9 aa, Homo Sapiens
ALEADLKHQ

SEQ ID NO: 814930 - protein, 9 aa, Homo Sapiens
ITNCSRNGG

SEQ ID NO: 814931 - protein, 9 aa, Homo Sapiens
LKGEEQNNE

SEQ ID NO: 814932 - protein, 9 aa, Homo Sapiens
VIRMSHKNF

SEQ ID NO: 814933 - protein, 9 aa, Homo Sapiens
SAAGAILQA

SEQ ID NO: 814934 - protein, 9 aa, Homo Sapiens
LHARKARVE

SEQ ID NO: 814935 - protein, 9 aa, Homo Sapiens
HIHYWVFQI

SEQ ID NO: 814936 - protein, 9 aa, Homo Sapiens
KDCRTSFRQ

SEQ ID NO: 814937 - protein, 9 aa, Homo Sapiens
ANKRKLEDE

SEQ ID NO: 814938 - protein, 9 aa, Homo Sapiens
EPGSSLPET

SEQ ID NO: 814939 - protein, 9 aa, Homo Sapiens
EIGMKRWII

SEQ ID NO: 814940 - protein, 9 aa, Homo Sapiens
SYWRVFHTL

SEQ ID NO: 814941 - protein, 9 aa, Homo Sapiens
VEEVQTFLQ

SEQ ID NO: 814942 - protein, 9 aa, Homo Sapiens
RDKELSCTV

SEQ ID NO: 814943 - protein, 9 aa, Homo Sapiens
VITPCRTLI

SEQ ID NO: 814944 - protein, 9 aa, Homo Sapiens
RDHSSIERA

SEQ ID NO: 814945 - protein, 9 aa, Homo Sapiens
ERIMEISAP

SEQ ID NO: 814946 - protein, 9 aa, Homo Sapiens
TPRKQLQFE

SEQ ID NO: 814947 - protein, 9 aa, Homo Sapiens
LIRQDLMRR

SEQ ID NO: 814948 - protein, 9 aa, Homo Sapiens
IVISSLKIF

SEQ ID NO: 814949 - protein, 9 aa, Homo Sapiens
QTDPPSVPM

SEQ ID NO: 814950 - protein, 9 aa, Homo Sapiens
EMNVRSAFT

SEQ ID NO: 814951 - protein, 9 aa, Homo Sapiens
VALEVPFIW

SEQ ID NO: 814952 - protein, 9 aa, Homo Sapiens
SDRSQESLA

SEQ ID NO: 814953 - protein, 9 aa, Homo Sapiens
EAKKIKCFL

SEQ ID NO: 814954 - protein, 9 aa, Homo Sapiens
MEFEEIDYS

SEQ ID NO: 814955 - protein, 9 aa, Homo Sapiens
KEIGSKYSE

SEQ ID NO: 814956 - protein, 9 aa, Homo Sapiens
SWKSILSTM

SEQ ID NO: 814957 - protein, 9 aa, Homo Sapiens
KMPLHPSAA

SEQ ID NO: 814958 - protein, 9 aa, Homo Sapiens
SFSPLESNV

SEQ ID NO: 814959 - protein, 9 aa, Homo Sapiens
LYPVPLECL

SEQ ID NO: 814960 - protein, 9 aa, Homo Sapiens
DTCGQNTEN

SEQ ID NO: 814961 - protein, 9 aa, Homo Sapiens
EERWSQQGP

SEQ ID NO: 814962 - protein, 9 aa, Homo Sapiens
FPRCYKEIC

SEQ ID NO: 814963 - protein, 9 aa, Homo Sapiens
TLFTYTMPH

SEQ ID NO: 814964 - protein, 9 aa, Homo Sapiens
DSQGPGKYP

SEQ ID NO: 814965 - protein, 9 aa, Homo Sapiens
TIDNVTPAD

SEQ ID NO: 814966 - protein, 9 aa, Homo Sapiens
PLKSDAVEC

SEQ ID NO: 814967 - protein, 9 aa, Homo Sapiens
YLRSPPAKA

SEQ ID NO: 814968 - protein, 9 aa, Homo Sapiens
EFSFHPVCK

SEQ ID NO: 814969 - protein, 9 aa, Homo Sapiens
TPITPTPFK

SEQ ID NO: 814970 - protein, 9 aa, Homo Sapiens
PPPPYKQVV

SEQ ID NO: 814971 - protein, 9 aa, Homo Sapiens
INEFMGHKQ

SEQ ID NO: 814972 - protein, 9 aa, Homo Sapiens
DVINFDDIA

SEQ ID NO: 814973 - protein, 9 aa, Homo Sapiens
QKPHRTEHQ

SEQ ID NO: 814974 - protein, 9 aa, Homo Sapiens
PRAVPSAEP

SEQ ID NO: 814975 - protein, 9 aa, Homo Sapiens
LHDFRAPAE

SEQ ID NO: 814976 - protein, 9 aa, Homo Sapiens
DEDEEEDQD

SEQ ID NO: 814977 - protein, 9 aa, Homo Sapiens
LIDTRLFKP

SEQ ID NO: 814978 - protein, 9 aa, Homo Sapiens
PGPAGRWKR

SEQ ID NO: 814979 - protein, 9 aa, Homo Sapiens
TKGELLLNE

SEQ ID NO: 814980 - protein, 9 aa, Homo Sapiens
LYATETGKL

SEQ ID NO: 814981 - protein, 9 aa, Homo Sapiens
KKCGISAND

SEQ ID NO: 814982 - protein, 9 aa, Homo Sapiens
PSRKRRQSS

SEQ ID NO: 814983 - protein, 9 aa, Homo Sapiens
KALRSYILG

SEQ ID NO: 814984 - protein, 9 aa, Homo Sapiens
DASAARVTL

SEQ ID NO: 814985 - protein, 9 aa, Homo Sapiens
FEEVQSNAF

SEQ ID NO: 814986 - protein, 9 aa, Homo Sapiens
GELYLRQTS

SEQ ID NO: 814987 - protein, 9 aa, Homo Sapiens
PHKGLLLRF

SEQ ID NO: 814988 - protein, 9 aa, Homo Sapiens
TIVLMGTYN

SEQ ID NO: 814989 - protein, 9 aa, Homo Sapiens
KVHRAFEAS

SEQ ID NO: 814990 - protein, 9 aa, Homo Sapiens
VLSSYGIGM

SEQ ID NO: 814991 - protein, 9 aa, Homo Sapiens
VQCLPSRLW

SEQ ID NO: 814992 - protein, 9 aa, Homo Sapiens
LVPPSTAVE

SEQ ID NO: 814993 - protein, 9 aa, Homo Sapiens
IRLRRLGSS

SEQ ID NO: 814994 - protein, 9 aa, Homo Sapiens
LYTLSDYAT

SEQ ID NO: 814995 - protein, 9 aa, Homo Sapiens
DASRPQTTQ

SEQ ID NO: 814996 - protein, 9 aa, Homo Sapiens
CDVEPCKNG

SEQ ID NO: 814997 - protein, 9 aa, Homo Sapiens
MGINLCDST

SEQ ID NO: 814998 - protein, 9 aa, Homo Sapiens
RAMALPPLD

SEQ ID NO: 814999 - protein, 9 aa, Homo Sapiens
MQRRKQKQT

SEQ ID NO: 815000 - protein, 9 aa, Homo Sapiens
PENIEERKK

SEQ ID NO: 815001 - protein, 9 aa, Homo Sapiens
FKKSLDREE

SEQ ID NO: 815002 - protein, 9 aa, Homo Sapiens
DFSVIFSVE

SEQ ID NO: 815003 - protein, 9 aa, Homo Sapiens
HMNIHIGEK

SEQ ID NO: 815004 - protein, 9 aa, Homo Sapiens
NLPCNHMRF

SEQ ID NO: 815005 - protein, 9 aa, Homo Sapiens
KELMVKLQK

SEQ ID NO: 815006 - protein, 9 aa, Homo Sapiens
YRHISALED

SEQ ID NO: 815007 - protein, 9 aa, Homo Sapiens
VAFWIIKLS

SEQ ID NO: 815008 - protein, 9 aa, Homo Sapiens
ASTVLIALK

SEQ ID NO: 815009 - protein, 9 aa, Homo Sapiens
STLANHKII

SEQ ID NO: 815010 - protein, 9 aa, Homo Sapiens
KAKNKVDDC

SEQ ID NO: 815011 - protein, 9 aa, Homo Sapiens
LGWICLCFS

SEQ ID NO: 815012 - protein, 9 aa, Homo Sapiens
RAYMKKLTR

SEQ ID NO: 815013 - protein, 9 aa, Homo Sapiens
QKASSIVYT

SEQ ID NO: 815014 - protein, 9 aa, Homo Sapiens
NMPNTLVVL

SEQ ID NO: 815015 - protein, 9 aa, Homo Sapiens
LRMAAKNKE

SEQ ID NO: 815016 - protein, 9 aa, Homo Sapiens
QNHARKYNF

SEQ ID NO: 815017 - protein, 9 aa, Homo Sapiens
YPPSPGVED

SEQ ID NO: 815018 - protein, 9 aa, Homo Sapiens
DIYLDTPFS

SEQ ID NO: 815019 - protein, 9 aa, Homo Sapiens
TEETVYGLN

SEQ ID NO: 815020 - protein, 9 aa, Homo Sapiens
RADANNNAR

SEQ ID NO: 815021 - protein, 9 aa, Homo Sapiens
QNCSTITLQ

SEQ ID NO: 815022 - protein, 9 aa, Homo Sapiens
IADLILYAL

SEQ ID NO: 815023 - protein, 9 aa, Homo Sapiens
SKRFLLVCQ

SEQ ID NO: 815024 - protein, 9 aa, Homo Sapiens
FWYQPQHNV

SEQ ID NO: 815025 - protein, 9 aa, Homo Sapiens
KAFSTCAFH

SEQ ID NO: 815026 - protein, 9 aa, Homo Sapiens
TTLSLLHRA

SEQ ID NO: 815027 - protein, 9 aa, Homo Sapiens
KKQKKGAKE

SEQ ID NO: 815028 - protein, 9 aa, Homo Sapiens
AMMAQNNLS

SEQ ID NO: 815029 - protein, 9 aa, Homo Sapiens
DVDSNGSTN

SEQ ID NO: 815030 - protein, 9 aa, Homo Sapiens
IASPAPAAE

SEQ ID NO: 815031 - protein, 9 aa, Homo Sapiens
DNNKLISEL

SEQ ID NO: 815032 - protein, 9 aa, Homo Sapiens
AQMPETFLP

SEQ ID NO: 815033 - protein, 9 aa, Homo Sapiens
GTVKWADIK

SEQ ID NO: 815034 - protein, 9 aa, Homo Sapiens
GLGGESAGG

SEQ ID NO: 815035 - protein, 9 aa, Homo Sapiens
YPALSLQDF

SEQ ID NO: 815036 - protein, 9 aa, Homo Sapiens
KSQKELVNI

SEQ ID NO: 815037 - protein, 9 aa, Homo Sapiens
KFWIDQQIQ

SEQ ID NO: 815038 - protein, 9 aa, Homo Sapiens
QIEKEELDM

SEQ ID NO: 815039 - protein, 9 aa, Homo Sapiens
LTEEDVFRH

SEQ ID NO: 815040 - protein, 9 aa, Homo Sapiens
NKTSCTVIF

SEQ ID NO: 815041 - protein, 9 aa, Homo Sapiens
TIHTGEKPF

SEQ ID NO: 815042 - protein, 9 aa, Homo Sapiens
LQVHDNNIP

SEQ ID NO: 815043 - protein, 9 aa, Homo Sapiens
QRSAILVTD

SEQ ID NO: 815044 - protein, 9 aa, Homo Sapiens
RNDTKDDIG

SEQ ID NO: 815045 - protein, 9 aa, Homo Sapiens
LRYCNSILR

SEQ ID NO: 815046 - protein, 9 aa, Homo Sapiens
NEPAGTWVI

SEQ ID NO: 815047 - protein, 9 aa, Homo Sapiens
ICTMMTQLK

SEQ ID NO: 815048 - protein, 9 aa, Homo Sapiens
NSTQENLEK

SEQ ID NO: 815049 - protein, 9 aa, Homo Sapiens
CFTCGIGND

SEQ ID NO: 815050 - protein, 9 aa, Homo Sapiens
MTTASMSLM

SEQ ID NO: 815051 - protein, 9 aa, Homo Sapiens
MSIGHPVTI

SEQ ID NO: 815052 - protein, 9 aa, Homo Sapiens
MPGPGCYNV

SEQ ID NO: 815053 - protein, 9 aa, Homo Sapiens
DTSKVKLRI

SEQ ID NO: 815054 - protein, 9 aa, Homo Sapiens
GGKAFRVFV

SEQ ID NO: 815055 - protein, 9 aa, Homo Sapiens
YKYQGGHSG

SEQ ID NO: 815056 - protein, 9 aa, Homo Sapiens
DEDPNDEGA

SEQ ID NO: 815057 - protein, 9 aa, Homo Sapiens
TSTIDDPSI

SEQ ID NO: 815058 - protein, 9 aa, Homo Sapiens
GARRSKAKY

SEQ ID NO: 815059 - protein, 9 aa, Homo Sapiens
ISFGNVDCD

SEQ ID NO: 815060 - protein, 9 aa, Homo Sapiens
KPRKNVNVS

SEQ ID NO: 815061 - protein, 9 aa, Homo Sapiens
DHWRIHTGE

SEQ ID NO: 815062 - protein, 9 aa, Homo Sapiens
FGRKVMDIL

SEQ ID NO: 815063 - protein, 9 aa, Homo Sapiens
EHAKKMDNL

SEQ ID NO: 815064 - protein, 9 aa, Homo Sapiens
LFTGFKPVQ

SEQ ID NO: 815065 - protein, 9 aa, Homo Sapiens
ASKFITKDK

SEQ ID NO: 815066 - protein, 9 aa, Homo Sapiens
LCALLNLLE

SEQ ID NO: 815067 - protein, 9 aa, Homo Sapiens
YLQDRIDRL

SEQ ID NO: 815068 - protein, 9 aa, Homo Sapiens
KHLTLHQES

SEQ ID NO: 815069 - protein, 9 aa, Homo Sapiens
VSDEDSDLD

SEQ ID NO: 815070 - protein, 9 aa, Homo Sapiens
DRCQKMCDQ

SEQ ID NO: 815071 - protein, 9 aa, Homo Sapiens
SYGIDKEKP

SEQ ID NO: 815072 - protein, 9 aa, Homo Sapiens
LGAICDIIV

SEQ ID NO: 815073 - protein, 9 aa, Homo Sapiens
LECYPKVAL

SEQ ID NO: 815074 - protein, 9 aa, Homo Sapiens
RKPQAGLKE

SEQ ID NO: 815075 - protein, 9 aa, Homo Sapiens
EQKVHRAFE

SEQ ID NO: 815076 - protein, 9 aa, Homo Sapiens
ILLNINGIM

SEQ ID NO: 815077 - protein, 9 aa, Homo Sapiens
VKLKEIYSK

SEQ ID NO: 815078 - protein, 9 aa, Homo Sapiens
PFTDRALAL

SEQ ID NO: 815079 - protein, 9 aa, Homo Sapiens
DNFLRNKPI

SEQ ID NO: 815080 - protein, 9 aa, Homo Sapiens
TYLSDQILE

SEQ ID NO: 815081 - protein, 9 aa, Homo Sapiens
PILRDLFLS

SEQ ID NO: 815082 - protein, 9 aa, Homo Sapiens
RTRAHLGAN

SEQ ID NO: 815083 - protein, 9 aa, Homo Sapiens
SYNYILALA

SEQ ID NO: 815084 - protein, 9 aa, Homo Sapiens
GRLGPWRVG

SEQ ID NO: 815085 - protein, 9 aa, Homo Sapiens
NIFIHEGLT

SEQ ID NO: 815086 - protein, 9 aa, Homo Sapiens
GAAVSCVPI

SEQ ID NO: 815087 - protein, 9 aa, Homo Sapiens
AVREMLASR

SEQ ID NO: 815088 - protein, 9 aa, Homo Sapiens
SDSVHFEVD

SEQ ID NO: 815089 - protein, 9 aa, Homo Sapiens
VQLRKGCKS

SEQ ID NO: 815090 - protein, 9 aa, Homo Sapiens
QAVNYGELR

SEQ ID NO: 815091 - protein, 9 aa, Homo Sapiens
YSERHSSSD

SEQ ID NO: 815092 - protein, 9 aa, Homo Sapiens
GILRRAAFS

SEQ ID NO: 815093 - protein, 9 aa, Homo Sapiens
VVVVCCKGI

SEQ ID NO: 815094 - protein, 9 aa, Homo Sapiens
ITMLENVGM

SEQ ID NO: 815095 - protein, 9 aa, Homo Sapiens
YFTEAGLNE

SEQ ID NO: 815096 - protein, 9 aa, Homo Sapiens
TLFCQDLEV

SEQ ID NO: 815097 - protein, 9 aa, Homo Sapiens
RQVGKAQMQ

SEQ ID NO: 815098 - protein, 9 aa, Homo Sapiens
DPVLVKRAK

SEQ ID NO: 815099 - protein, 9 aa, Homo Sapiens
LFFRVAALT

SEQ ID NO: 815100 - protein, 9 aa, Homo Sapiens
LFQIVSNLL

SEQ ID NO: 815101 - protein, 9 aa, Homo Sapiens
STRDYQTNI

SEQ ID NO: 815102 - protein, 9 aa, Homo Sapiens
RTYWDAGFK

SEQ ID NO: 815103 - protein, 9 aa, Homo Sapiens
GRRGKKGAV

SEQ ID NO: 815104 - protein, 9 aa, Homo Sapiens
TVKVDVNKT

SEQ ID NO: 815105 - protein, 9 aa, Homo Sapiens
SIDLGYAKE

SEQ ID NO: 815106 - protein, 9 aa, Homo Sapiens
PTPTNATAA

SEQ ID NO: 815107 - protein, 9 aa, Homo Sapiens
DTEQDKDEE

SEQ ID NO: 815108 - protein, 9 aa, Homo Sapiens
FNIQRGVVA

SEQ ID NO: 815109 - protein, 9 aa, Homo Sapiens
RINRGNCWI

SEQ ID NO: 815110 - protein, 9 aa, Homo Sapiens
KYIILKYAP

SEQ ID NO: 815111 - protein, 9 aa, Homo Sapiens
SPRGVLRYG

SEQ ID NO: 815112 - protein, 9 aa, Homo Sapiens
KKYLVMPKE

SEQ ID NO: 815113 - protein, 9 aa, Homo Sapiens
YLAKQNIKK

SEQ ID NO: 815114 - protein, 9 aa, Homo Sapiens
ADEEHLEVL

SEQ ID NO: 815115 - protein, 9 aa, Homo Sapiens
KTLLHMCDG

SEQ ID NO: 815116 - protein, 9 aa, Homo Sapiens
KKIDLDTIL

SEQ ID NO: 815117 - protein, 9 aa, Homo Sapiens
GVLRYGGQQ

SEQ ID NO: 815118 - protein, 9 aa, Homo Sapiens
AGVVLFNFG

SEQ ID NO: 815119 - protein, 9 aa, Homo Sapiens
AKRMAAHIT

SEQ ID NO: 815120 - protein, 9 aa, Homo Sapiens
QDKDEEMDV

SEQ ID NO: 815121 - protein, 9 aa, Homo Sapiens
PNIYFPIRD

SEQ ID NO: 815122 - protein, 9 aa, Homo Sapiens
ATGALGGPP

SEQ ID NO: 815123 - protein, 9 aa, Homo Sapiens
SSVSSTSLG

SEQ ID NO: 815124 - protein, 9 aa, Homo Sapiens
SCSENCLSA

SEQ ID NO: 815125 - protein, 9 aa, Homo Sapiens
IQIFTIQAR

SEQ ID NO: 815126 - protein, 9 aa, Homo Sapiens
SGRSYPHLS

SEQ ID NO: 815127 - protein, 9 aa, Homo Sapiens
GNITECRNP

SEQ ID NO: 815128 - protein, 9 aa, Homo Sapiens
RDVCSCKAE

SEQ ID NO: 815129 - protein, 9 aa, Homo Sapiens
GLDRITLIS

SEQ ID NO: 815130 - protein, 9 aa, Homo Sapiens
YLIVHCKTH

SEQ ID NO: 815131 - protein, 9 aa, Homo Sapiens
FIPLKPTMK

SEQ ID NO: 815132 - protein, 9 aa, Homo Sapiens
MISLSYSQI

SEQ ID NO: 815133 - protein, 9 aa, Homo Sapiens
CQNMACIIY

SEQ ID NO: 815134 - protein, 9 aa, Homo Sapiens
RSASQDCIK

SEQ ID NO: 815135 - protein, 9 aa, Homo Sapiens
ALGAPFWLE

SEQ ID NO: 815136 - protein, 9 aa, Homo Sapiens
KKQNKPREK

SEQ ID NO: 815137 - protein, 9 aa, Homo Sapiens
MLASGNSSS

SEQ ID NO: 815138 - protein, 9 aa, Homo Sapiens
KQKEANQLN

SEQ ID NO: 815139 - protein, 9 aa, Homo Sapiens
SLPDIQLEE

SEQ ID NO: 815140 - protein, 9 aa, Homo Sapiens
EHRAGLLTA

SEQ ID NO: 815141 - protein, 9 aa, Homo Sapiens
KVQGQWGTV

SEQ ID NO: 815142 - protein, 9 aa, Homo Sapiens
LHQAKYFGN

SEQ ID NO: 815143 - protein, 9 aa, Homo Sapiens
FQLFQEAVP

SEQ ID NO: 815144 - protein, 9 aa, Homo Sapiens
TMYYPGIVT

SEQ ID NO: 815145 - protein, 9 aa, Homo Sapiens
KPQICDHCS

SEQ ID NO: 815146 - protein, 9 aa, Homo Sapiens
QKVSQAFKQ

SEQ ID NO: 815147 - protein, 9 aa, Homo Sapiens
LKLSNMYVV

SEQ ID NO: 815148 - protein, 9 aa, Homo Sapiens
PQQSLATEP

SEQ ID NO: 815149 - protein, 9 aa, Homo Sapiens
VCVNVTDVN

SEQ ID NO: 815150 - protein, 9 aa, Homo Sapiens
PYTGQVLAA

SEQ ID NO: 815151 - protein, 9 aa, Homo Sapiens
PARDNTDVR

SEQ ID NO: 815152 - protein, 9 aa, Homo Sapiens
KTYSTKIEN

SEQ ID NO: 815153 - protein, 9 aa, Homo Sapiens
VMPHELGHV

SEQ ID NO: 815154 - protein, 9 aa, Homo Sapiens
ILHFEMPAS

SEQ ID NO: 815155 - protein, 9 aa, Homo Sapiens
GSSTDNPKH

SEQ ID NO: 815156 - protein, 9 aa, Homo Sapiens
QSIDGTGWA

SEQ ID NO: 815157 - protein, 9 aa, Homo Sapiens
RNIYEPPRY

SEQ ID NO: 815158 - protein, 9 aa, Homo Sapiens
ENIQSIFEN

SEQ ID NO: 815159 - protein, 9 aa, Homo Sapiens
PTENYFTLD

SEQ ID NO: 815160 - protein, 9 aa, Homo Sapiens
NAGLFIDVV

SEQ ID NO: 815161 - protein, 9 aa, Homo Sapiens
AEGLTALHL

SEQ ID NO: 815162 - protein, 9 aa, Homo Sapiens
ARRIWKEPP

SEQ ID NO: 815163 - protein, 9 aa, Homo Sapiens
KFVSLINCS

SEQ ID NO: 815164 - protein, 9 aa, Homo Sapiens
SSKCFLPIK

SEQ ID NO: 815165 - protein, 9 aa, Homo Sapiens
VYSFHNVQQ

SEQ ID NO: 815166 - protein, 9 aa, Homo Sapiens
CTTIQVQSS

SEQ ID NO: 815167 - protein, 9 aa, Homo Sapiens
QVVISIICM

SEQ ID NO: 815168 - protein, 9 aa, Homo Sapiens
GNYLGLQPK

SEQ ID NO: 815169 - protein, 9 aa, Homo Sapiens
NHDFFMYSQ

SEQ ID NO: 815170 - protein, 9 aa, Homo Sapiens
QSDLAAIFN

SEQ ID NO: 815171 - protein, 9 aa, Homo Sapiens
SRINDEELE

SEQ ID NO: 815172 - protein, 9 aa, Homo Sapiens
IHKYIDSKS

SEQ ID NO: 815173 - protein, 9 aa, Homo Sapiens
DALSLDVAS

SEQ ID NO: 815174 - protein, 9 aa, Homo Sapiens
PNVLLGRWA

SEQ ID NO: 815175 - protein, 9 aa, Homo Sapiens
QIDNFVPVL

SEQ ID NO: 815176 - protein, 9 aa, Homo Sapiens
GGDPGLRGA

SEQ ID NO: 815177 - protein, 9 aa, Homo Sapiens
NFQRTLNIQ

SEQ ID NO: 815178 - protein, 9 aa, Homo Sapiens
HTLFIDLSF

SEQ ID NO: 815179 - protein, 9 aa, Homo Sapiens
VGDGGPFSG

SEQ ID NO: 815180 - protein, 9 aa, Homo Sapiens
KRGIYSRHH

SEQ ID NO: 815181 - protein, 9 aa, Homo Sapiens
DKMFLITRE

SEQ ID NO: 815182 - protein, 9 aa, Homo Sapiens
NLTLRYIIP

SEQ ID NO: 815183 - protein, 9 aa, Homo Sapiens
GIFGAFFSG

SEQ ID NO: 815184 - protein, 9 aa, Homo Sapiens
LLSDLNKQV

SEQ ID NO: 815185 - protein, 9 aa, Homo Sapiens
PEPPPSWTG

SEQ ID NO: 815186 - protein, 9 aa, Homo Sapiens
LTAGLSKRW

SEQ ID NO: 815187 - protein, 9 aa, Homo Sapiens
IIILMTIGG

SEQ ID NO: 815188 - protein, 9 aa, Homo Sapiens
RILLCENYH

SEQ ID NO: 815189 - protein, 9 aa, Homo Sapiens
SEGLGHSAK

SEQ ID NO: 815190 - protein, 9 aa, Homo Sapiens
RFHITDNSY

SEQ ID NO: 815191 - protein, 9 aa, Homo Sapiens
LCLLIPPDT

SEQ ID NO: 815192 - protein, 9 aa, Homo Sapiens
GNYTVIAPK

SEQ ID NO: 815193 - protein, 9 aa, Homo Sapiens
ANRIFLADS

SEQ ID NO: 815194 - protein, 9 aa, Homo Sapiens
PYHNPTHSA

SEQ ID NO: 815195 - protein, 9 aa, Homo Sapiens
IEIPAEKVC

SEQ ID NO: 815196 - protein, 9 aa, Homo Sapiens
ERKKTMEMT

SEQ ID NO: 815197 - protein, 9 aa, Homo Sapiens
ENRTTVERE

SEQ ID NO: 815198 - protein, 9 aa, Homo Sapiens
STKKVKKRN

SEQ ID NO: 815199 - protein, 9 aa, Homo Sapiens
SGHKHRKYS

SEQ ID NO: 815200 - protein, 9 aa, Homo Sapiens
TALLLILAS

SEQ ID NO: 815201 - protein, 9 aa, Homo Sapiens
RKRSSISKH

SEQ ID NO: 815202 - protein, 9 aa, Homo Sapiens
NRAQEHLNY

SEQ ID NO: 815203 - protein, 9 aa, Homo Sapiens
KDLTSRLMI

SEQ ID NO: 815204 - protein, 9 aa, Homo Sapiens
TVHQIHTQN

SEQ ID NO: 815205 - protein, 9 aa, Homo Sapiens
VPIDWDPQP

SEQ ID NO: 815206 - protein, 9 aa, Homo Sapiens
LIISAQQEQ

SEQ ID NO: 815207 - protein, 9 aa, Homo Sapiens
IGGRYGSSC

SEQ ID NO: 815208 - protein, 9 aa, Homo Sapiens
HQLQLIKQI

SEQ ID NO: 815209 - protein, 9 aa, Homo Sapiens
KDTIDKLKE

SEQ ID NO: 815210 - protein, 9 aa, Homo Sapiens
LFLMFGDLD

SEQ ID NO: 815211 - protein, 9 aa, Homo Sapiens
EAWLEITPG

SEQ ID NO: 815212 - protein, 9 aa, Homo Sapiens
GSAGLSATQ

SEQ ID NO: 815213 - protein, 9 aa, Homo Sapiens
VRFLFSIRK

SEQ ID NO: 815214 - protein, 9 aa, Homo Sapiens
KKSRYRSQS

SEQ ID NO: 815215 - protein, 9 aa, Homo Sapiens
YGWFHTSLL

SEQ ID NO: 815216 - protein, 9 aa, Homo Sapiens
IFMDAILLY

SEQ ID NO: 815217 - protein, 9 aa, Homo Sapiens
AASPYFCQN

SEQ ID NO: 815218 - protein, 9 aa, Homo Sapiens
YFTYYYIQE

SEQ ID NO: 815219 - protein, 9 aa, Homo Sapiens
YNNNIETHL

SEQ ID NO: 815220 - protein, 9 aa, Homo Sapiens
KLYQYLLQP

SEQ ID NO: 815221 - protein, 9 aa, Homo Sapiens
AIYGTPHNN

SEQ ID NO: 815222 - protein, 9 aa, Homo Sapiens
IPLSVVLAS

SEQ ID NO: 815223 - protein, 9 aa, Homo Sapiens
HSEAVMSVA

SEQ ID NO: 815224 - protein, 9 aa, Homo Sapiens
CQHMSTSLM

SEQ ID NO: 815225 - protein, 9 aa, Homo Sapiens
ILFPDSKKE

SEQ ID NO: 815226 - protein, 9 aa, Homo Sapiens
ESKLHGKLC

SEQ ID NO: 815227 - protein, 9 aa, Homo Sapiens
RFHENHCGL

SEQ ID NO: 815228 - protein, 9 aa, Homo Sapiens
VVVYDQSTW

SEQ ID NO: 815229 - protein, 9 aa, Homo Sapiens
NEAVILREK

SEQ ID NO: 815230 - protein, 9 aa, Homo Sapiens
ATKALCAFQ

SEQ ID NO: 815231 - protein, 9 aa, Homo Sapiens
VTTDFSKSL

SEQ ID NO: 815232 - protein, 9 aa, Homo Sapiens
QDHGFMLYQ

SEQ ID NO: 815233 - protein, 9 aa, Homo Sapiens
CACLARCWD

SEQ ID NO: 815234 - protein, 9 aa, Homo Sapiens
STAVEFHQE

SEQ ID NO: 815235 - protein, 9 aa, Homo Sapiens
WLNRDRHGH

SEQ ID NO: 815236 - protein, 9 aa, Homo Sapiens
ECLEHDRIA

SEQ ID NO: 815237 - protein, 9 aa, Homo Sapiens
ELHGRCLGN

SEQ ID NO: 815238 - protein, 9 aa, Homo Sapiens
AYYQAVALD

SEQ ID NO: 815239 - protein, 9 aa, Homo Sapiens
THQRTHMKD

SEQ ID NO: 815240 - protein, 9 aa, Homo Sapiens
VFNKALPAL

SEQ ID NO: 815241 - protein, 9 aa, Homo Sapiens
RHMILHFAT

SEQ ID NO: 815242 - protein, 9 aa, Homo Sapiens
LDVHAELDK

SEQ ID NO: 815243 - protein, 9 aa, Homo Sapiens
ATREKKTIR

SEQ ID NO: 815244 - protein, 9 aa, Homo Sapiens
DDPENIEER

SEQ ID NO: 815245 - protein, 9 aa, Homo Sapiens
AWATLQLLC

SEQ ID NO: 815246 - protein, 9 aa, Homo Sapiens
QGSERKKWI

SEQ ID NO: 815247 - protein, 9 aa, Homo Sapiens
PFLLTSFSV

SEQ ID NO: 815248 - protein, 9 aa, Homo Sapiens
RKLRTLWGP

SEQ ID NO: 815249 - protein, 9 aa, Homo Sapiens
LQDTDEDTA

SEQ ID NO: 815250 - protein, 9 aa, Homo Sapiens
ENVLSCTSL

SEQ ID NO: 815251 - protein, 9 aa, Homo Sapiens
GKPFDKTIC

SEQ ID NO: 815252 - protein, 9 aa, Homo Sapiens
AIHTYQSIT

SEQ ID NO: 815253 - protein, 9 aa, Homo Sapiens
GSWSRAAFL

SEQ ID NO: 815254 - protein, 9 aa, Homo Sapiens
QRGVVAIPK

SEQ ID NO: 815255 - protein, 9 aa, Homo Sapiens
YWIKETDLE

SEQ ID NO: 815256 - protein, 9 aa, Homo Sapiens
QNGFNRSYA

SEQ ID NO: 815257 - protein, 9 aa, Homo Sapiens
LDLDPDFFI

SEQ ID NO: 815258 - protein, 9 aa, Homo Sapiens
EDTFFSQEK

SEQ ID NO: 815259 - protein, 9 aa, Homo Sapiens
GSGLAGDHL

SEQ ID NO: 815260 - protein, 9 aa, Homo Sapiens
LQRVRKNHC

SEQ ID NO: 815261 - protein, 9 aa, Homo Sapiens
EITSDLTVI

SEQ ID NO: 815262 - protein, 9 aa, Homo Sapiens
KLQENLGNP

SEQ ID NO: 815263 - protein, 9 aa, Homo Sapiens
HGGILRMFP

SEQ ID NO: 815264 - protein, 9 aa, Homo Sapiens
PADASGTEN

SEQ ID NO: 815265 - protein, 9 aa, Homo Sapiens
LALLVLVAV

SEQ ID NO: 815266 - protein, 9 aa, Homo Sapiens
GQIPLSAFN

SEQ ID NO: 815267 - protein, 9 aa, Homo Sapiens
DEREKQEKE

SEQ ID NO: 815268 - protein, 9 aa, Homo Sapiens
FIWTEGLLQ

SEQ ID NO: 815269 - protein, 9 aa, Homo Sapiens
TEQDKDEEM

SEQ ID NO: 815270 - protein, 9 aa, Homo Sapiens
RFLGDKSLP

SEQ ID NO: 815271 - protein, 9 aa, Homo Sapiens
EYTGANEYN

SEQ ID NO: 815272 - protein, 9 aa, Homo Sapiens
IRAGYEVRQ

SEQ ID NO: 815273 - protein, 9 aa, Homo Sapiens
SSPPPVQRG

SEQ ID NO: 815274 - protein, 9 aa, Homo Sapiens
ENKVSKRSR

SEQ ID NO: 815275 - protein, 9 aa, Homo Sapiens
NFCKVFLIS

SEQ ID NO: 815276 - protein, 9 aa, Homo Sapiens
QGPNTPGYL

SEQ ID NO: 815277 - protein, 9 aa, Homo Sapiens
SSGNLLPPL

SEQ ID NO: 815278 - protein, 9 aa, Homo Sapiens
EIDKFDISD

SEQ ID NO: 815279 - protein, 9 aa, Homo Sapiens
VQKVAHLEI

SEQ ID NO: 815280 - protein, 9 aa, Homo Sapiens
ISGNETQHY

SEQ ID NO: 815281 - protein, 9 aa, Homo Sapiens
YFTKGEFIL

SEQ ID NO: 815282 - protein, 9 aa, Homo Sapiens
GLHTAGFFI

SEQ ID NO: 815283 - protein, 9 aa, Homo Sapiens
DKLRVHPLF

SEQ ID NO: 815284 - protein, 9 aa, Homo Sapiens
HFCKLRKIM

SEQ ID NO: 815285 - protein, 9 aa, Homo Sapiens
VDNIMLENH

SEQ ID NO: 815286 - protein, 9 aa, Homo Sapiens
PCHRILHSG

SEQ ID NO: 815287 - protein, 9 aa, Homo Sapiens
LQNLIISAQ

SEQ ID NO: 815288 - protein, 9 aa, Homo Sapiens
IVGKWSQVA

SEQ ID NO: 815289 - protein, 9 aa, Homo Sapiens
GPSRNLQRY

SEQ ID NO: 815290 - protein, 9 aa, Homo Sapiens
FSSITILDK

SEQ ID NO: 815291 - protein, 9 aa, Homo Sapiens
TPKTKERSE

SEQ ID NO: 815292 - protein, 9 aa, Homo Sapiens
MYEIYVDTC

SEQ ID NO: 815293 - protein, 9 aa, Homo Sapiens
APSRAEHLA

SEQ ID NO: 815294 - protein, 9 aa, Homo Sapiens
VMMPPWRKG

SEQ ID NO: 815295 - protein, 9 aa, Homo Sapiens
SCLSYLHVL

SEQ ID NO: 815296 - protein, 9 aa, Homo Sapiens
KWTQIEKGI

SEQ ID NO: 815297 - protein, 9 aa, Homo Sapiens
RGLLSSLGH

SEQ ID NO: 815298 - protein, 9 aa, Homo Sapiens
VFKSIIEGE

SEQ ID NO: 815299 - protein, 9 aa, Homo Sapiens
FNAILIKTP

SEQ ID NO: 815300 - protein, 9 aa, Homo Sapiens
YSVALSTPI

SEQ ID NO: 815301 - protein, 9 aa, Homo Sapiens
GYLGDPKIN

SEQ ID NO: 815302 - protein, 9 aa, Homo Sapiens
TEIELPEKL

SEQ ID NO: 815303 - protein, 9 aa, Homo Sapiens
DGVGTLQLL

SEQ ID NO: 815304 - protein, 9 aa, Homo Sapiens
TGDKLYECK

SEQ ID NO: 815305 - protein, 9 aa, Homo Sapiens
TELPDSCST

SEQ ID NO: 815306 - protein, 9 aa, Homo Sapiens
KDILPEMRA

SEQ ID NO: 815307 - protein, 9 aa, Homo Sapiens
GPLVILFSA

SEQ ID NO: 815308 - protein, 9 aa, Homo Sapiens
NLLHQEESQ

SEQ ID NO: 815309 - protein, 9 aa, Homo Sapiens
ETGVWCWDR

SEQ ID NO: 815310 - protein, 9 aa, Homo Sapiens
WLEMFDNFA

SEQ ID NO: 815311 - protein, 9 aa, Homo Sapiens
QQQQQQHQE

SEQ ID NO: 815312 - protein, 9 aa, Homo Sapiens
VGLRLTTSF

SEQ ID NO: 815313 - protein, 9 aa, Homo Sapiens
DNCQRNASL

SEQ ID NO: 815314 - protein, 9 aa, Homo Sapiens
CYMNSVIQV

SEQ ID NO: 815315 - protein, 9 aa, Homo Sapiens
YAYLKVIIF

SEQ ID NO: 815316 - protein, 9 aa, Homo Sapiens
QYYTQNLPS

SEQ ID NO: 815317 - protein, 9 aa, Homo Sapiens
QVVDQIKSQ

SEQ ID NO: 815318 - protein, 9 aa, Homo Sapiens
DFYHAEPPE

SEQ ID NO: 815319 - protein, 9 aa, Homo Sapiens
LHHEEVNSD

SEQ ID NO: 815320 - protein, 9 aa, Homo Sapiens
SSDRTDGDR

SEQ ID NO: 815321 - protein, 9 aa, Homo Sapiens
CDLREGRQL

SEQ ID NO: 815322 - protein, 9 aa, Homo Sapiens
GAKRALKAQ

SEQ ID NO: 815323 - protein, 9 aa, Homo Sapiens
SPTLITVYS

SEQ ID NO: 815324 - protein, 9 aa, Homo Sapiens
ICYGLSGKE

SEQ ID NO: 815325 - protein, 9 aa, Homo Sapiens
TKWIIGVCS

SEQ ID NO: 815326 - protein, 9 aa, Homo Sapiens
KQLEIHQYG

SEQ ID NO: 815327 - protein, 9 aa, Homo Sapiens
VLQSLLLPL

SEQ ID NO: 815328 - protein, 9 aa, Homo Sapiens
FAGCLHPWN

SEQ ID NO: 815329 - protein, 9 aa, Homo Sapiens
YMTFNVQSK

SEQ ID NO: 815330 - protein, 9 aa, Homo Sapiens
HIIIYEQHW

SEQ ID NO: 815331 - protein, 9 aa, Homo Sapiens
QPPNSVDGL

SEQ ID NO: 815332 - protein, 9 aa, Homo Sapiens
EDLKEFSPD

SEQ ID NO: 815333 - protein, 9 aa, Homo Sapiens
DPENMSLFD

SEQ ID NO: 815334 - protein, 9 aa, Homo Sapiens
ENNLRENLD

SEQ ID NO: 815335 - protein, 9 aa, Homo Sapiens
GCQKPLPRC

SEQ ID NO: 815336 - protein, 9 aa, Homo Sapiens
LRKLVDVLV

SEQ ID NO: 815337 - protein, 9 aa, Homo Sapiens
DLEPYMDDN

SEQ ID NO: 815338 - protein, 9 aa, Homo Sapiens
DNGRGFAHQ

SEQ ID NO: 815339 - protein, 9 aa, Homo Sapiens
GQSRWSNLE

SEQ ID NO: 815340 - protein, 9 aa, Homo Sapiens
YFGETGLGT

SEQ ID NO: 815341 - protein, 9 aa, Homo Sapiens
LLGSQKSDK

SEQ ID NO: 815342 - protein, 9 aa, Homo Sapiens
MLDNPLNST

SEQ ID NO: 815343 - protein, 9 aa, Homo Sapiens
CLMESVVVS

SEQ ID NO: 815344 - protein, 9 aa, Homo Sapiens
IQQRKSYRR

SEQ ID NO: 815345 - protein, 9 aa, Homo Sapiens
DVSDAGTYT

SEQ ID NO: 815346 - protein, 9 aa, Homo Sapiens
MYCKSCYGK

SEQ ID NO: 815347 - protein, 9 aa, Homo Sapiens
RAKIFWRDQ

SEQ ID NO: 815348 - protein, 9 aa, Homo Sapiens
SFGNVDCDF

SEQ ID NO: 815349 - protein, 9 aa, Homo Sapiens
QAASVFYTI

SEQ ID NO: 815350 - protein, 9 aa, Homo Sapiens
QQLTSEIFD

SEQ ID NO: 815351 - protein, 9 aa, Homo Sapiens
ITIKEGSKP

SEQ ID NO: 815352 - protein, 9 aa, Homo Sapiens
GAWGVGKSA

SEQ ID NO: 815353 - protein, 9 aa, Homo Sapiens
ERFSQSFNL

SEQ ID NO: 815354 - protein, 9 aa, Homo Sapiens
EAMMHILQA

SEQ ID NO: 815355 - protein, 9 aa, Homo Sapiens
KIIEEQPQS

SEQ ID NO: 815356 - protein, 9 aa, Homo Sapiens
GFGSNTKNN

SEQ ID NO: 815357 - protein, 9 aa, Homo Sapiens
LRVTNEPTA

SEQ ID NO: 815358 - protein, 9 aa, Homo Sapiens
NYHAPEFIT

SEQ ID NO: 815359 - protein, 9 aa, Homo Sapiens
ITTKPTKSE

SEQ ID NO: 815360 - protein, 9 aa, Homo Sapiens
HDRIAKFSK

SEQ ID NO: 815361 - protein, 9 aa, Homo Sapiens
SIKLMDVWG

SEQ ID NO: 815362 - protein, 9 aa, Homo Sapiens
VAGPRLRNM

SEQ ID NO: 815363 - protein, 9 aa, Homo Sapiens
VGKWSQVAP

SEQ ID NO: 815364 - protein, 9 aa, Homo Sapiens
NLYPKEWTL

SEQ ID NO: 815365 - protein, 9 aa, Homo Sapiens
ARGPRSSLA

SEQ ID NO: 815366 - protein, 9 aa, Homo Sapiens
ISDVLNNAI

SEQ ID NO: 815367 - protein, 9 aa, Homo Sapiens
CWSPVLSGG

SEQ ID NO: 815368 - protein, 9 aa, Homo Sapiens
KCQNSWGED

SEQ ID NO: 815369 - protein, 9 aa, Homo Sapiens
APHFHINLD

SEQ ID NO: 815370 - protein, 9 aa, Homo Sapiens
IYKPTTKET

SEQ ID NO: 815371 - protein, 9 aa, Homo Sapiens
IKKEVNVYK

SEQ ID NO: 815372 - protein, 9 aa, Homo Sapiens
RHIYNRYQK

SEQ ID NO: 815373 - protein, 9 aa, Homo Sapiens
LWRCQVARS

SEQ ID NO: 815374 - protein, 9 aa, Homo Sapiens
HRLPEKNWQ

SEQ ID NO: 815375 - protein, 9 aa, Homo Sapiens
QRFPQLTTR

SEQ ID NO: 815376 - protein, 9 aa, Homo Sapiens
CAANTVDNF

SEQ ID NO: 815377 - protein, 9 aa, Homo Sapiens
IIRVLTSRK

SEQ ID NO: 815378 - protein, 9 aa, Homo Sapiens
GKTIEGMTV

SEQ ID NO: 815379 - protein, 9 aa, Homo Sapiens
KILGTNEET

SEQ ID NO: 815380 - protein, 9 aa, Homo Sapiens
LDESRGSRQ

SEQ ID NO: 815381 - protein, 9 aa, Homo Sapiens
VNKKIDREQ

SEQ ID NO: 815382 - protein, 9 aa, Homo Sapiens
GDKFYKCEE

SEQ ID NO: 815383 - protein, 9 aa, Homo Sapiens
RRLRDSHKT

SEQ ID NO: 815384 - protein, 9 aa, Homo Sapiens
IYPCHFYIR

SEQ ID NO: 815385 - protein, 9 aa, Homo Sapiens
QINPIPQPR

SEQ ID NO: 815386 - protein, 9 aa, Homo Sapiens
SERYSLTLC

SEQ ID NO: 815387 - protein, 9 aa, Homo Sapiens
QVLLIWDNK

SEQ ID NO: 815388 - protein, 9 aa, Homo Sapiens
SSKNIFIGE

SEQ ID NO: 815389 - protein, 9 aa, Homo Sapiens
GDKFYKCEV

SEQ ID NO: 815390 - protein, 9 aa, Homo Sapiens
KMELCAKTD

SEQ ID NO: 815391 - protein, 9 aa, Homo Sapiens
NLCIFLFFE

SEQ ID NO: 815392 - protein, 9 aa, Homo Sapiens
KRPLMPFHH

SEQ ID NO: 815393 - protein, 9 aa, Homo Sapiens
SHYTFSKPV

SEQ ID NO: 815394 - protein, 9 aa, Homo Sapiens
DKLTCQGSS

SEQ ID NO: 815395 - protein, 9 aa, Homo Sapiens
LQGLFALSR

SEQ ID NO: 815396 - protein, 9 aa, Homo Sapiens
QELMFWGLH

SEQ ID NO: 815397 - protein, 9 aa, Homo Sapiens
YNFWCGITP

SEQ ID NO: 815398 - protein, 9 aa, Homo Sapiens
KVFHLNCLT

SEQ ID NO: 815399 - protein, 9 aa, Homo Sapiens
EGEHRMTTV

SEQ ID NO: 815400 - protein, 9 aa, Homo Sapiens
LTLRYIIPI

SEQ ID NO: 815401 - protein, 9 aa, Homo Sapiens
DEEDNLHIA

SEQ ID NO: 815402 - protein, 9 aa, Homo Sapiens
QSSISFQTE

SEQ ID NO: 815403 - protein, 9 aa, Homo Sapiens
QAGTTLYQL

SEQ ID NO: 815404 - protein, 9 aa, Homo Sapiens
GVSCCIKYF

SEQ ID NO: 815405 - protein, 9 aa, Homo Sapiens
INELNRLRQ

SEQ ID NO: 815406 - protein, 9 aa, Homo Sapiens
YLPYYMLNL

SEQ ID NO: 815407 - protein, 9 aa, Homo Sapiens
TAEALTAFT

SEQ ID NO: 815408 - protein, 9 aa, Homo Sapiens
PLQFQRLGH

SEQ ID NO: 815409 - protein, 9 aa, Homo Sapiens
SYMSTLLAE

SEQ ID NO: 815410 - protein, 9 aa, Homo Sapiens
TTALLLILA

SEQ ID NO: 815411 - protein, 9 aa, Homo Sapiens
ETYKNNFDN

SEQ ID NO: 815412 - protein, 9 aa, Homo Sapiens
KSKQKMNAR

SEQ ID NO: 815413 - protein, 9 aa, Homo Sapiens
RGSSPGSLD

SEQ ID NO: 815414 - protein, 9 aa, Homo Sapiens
PKEKMNKEA

SEQ ID NO: 815415 - protein, 9 aa, Homo Sapiens
QSCPPQHCQ

SEQ ID NO: 815416 - protein, 9 aa, Homo Sapiens
IFIGEKAAK

SEQ ID NO: 815417 - protein, 9 aa, Homo Sapiens
NFIGRLQSL

SEQ ID NO: 815418 - protein, 9 aa, Homo Sapiens
HRFQPTALK

SEQ ID NO: 815419 - protein, 9 aa, Homo Sapiens
ITDNLTRDL

SEQ ID NO: 815420 - protein, 9 aa, Homo Sapiens
GKDSTITRK

SEQ ID NO: 815421 - protein, 9 aa, Homo Sapiens
NYVTHYCQG

SEQ ID NO: 815422 - protein, 9 aa, Homo Sapiens
AVREFNMNL

SEQ ID NO: 815423 - protein, 9 aa, Homo Sapiens
LEREEDISE

SEQ ID NO: 815424 - protein, 9 aa, Homo Sapiens
FYEDHGDTL

SEQ ID NO: 815425 - protein, 9 aa, Homo Sapiens
ELARKIIIR

SEQ ID NO: 815426 - protein, 9 aa, Homo Sapiens
QTNFDPRLH

SEQ ID NO: 815427 - protein, 9 aa, Homo Sapiens
RENTFIVRD

SEQ ID NO: 815428 - protein, 9 aa, Homo Sapiens
KSFTPKTNT

SEQ ID NO: 815429 - protein, 9 aa, Homo Sapiens
MMKTTEHTR

SEQ ID NO: 815430 - protein, 9 aa, Homo Sapiens
LVYCALDKE

SEQ ID NO: 815431 - protein, 9 aa, Homo Sapiens
PFWNEEIFP

SEQ ID NO: 815432 - protein, 9 aa, Homo Sapiens
SQNQLSALP

SEQ ID NO: 815433 - protein, 9 aa, Homo Sapiens
DDEGAPQIS

SEQ ID NO: 815434 - protein, 9 aa, Homo Sapiens
RENNLEEAK

SEQ ID NO: 815435 - protein, 9 aa, Homo Sapiens
VQEMTSQLE

SEQ ID NO: 815436 - protein, 9 aa, Homo Sapiens
DTGYHSLEE

SEQ ID NO: 815437 - protein, 9 aa, Homo Sapiens
SHEGPQLPQ

SEQ ID NO: 815438 - protein, 9 aa, Homo Sapiens
LFYINMYVS

SEQ ID NO: 815439 - protein, 9 aa, Homo Sapiens
FWDNYDTIY

SEQ ID NO: 815440 - protein, 9 aa, Homo Sapiens
QTSESGRVF

SEQ ID NO: 815441 - protein, 9 aa, Homo Sapiens
MDCSWKITL

SEQ ID NO: 815442 - protein, 9 aa, Homo Sapiens
RLKTVISSI

SEQ ID NO: 815443 - protein, 9 aa, Homo Sapiens
FYGSSYLTN

SEQ ID NO: 815444 - protein, 9 aa, Homo Sapiens
YYKSQTRCA

SEQ ID NO: 815445 - protein, 9 aa, Homo Sapiens
ILHNILRDD

SEQ ID NO: 815446 - protein, 9 aa, Homo Sapiens
EGSLNILGL

SEQ ID NO: 815447 - protein, 9 aa, Homo Sapiens
LGCISYYMT

SEQ ID NO: 815448 - protein, 9 aa, Homo Sapiens
KARIRYFPV

SEQ ID NO: 815449 - protein, 9 aa, Homo Sapiens
IYTEDIPGD

SEQ ID NO: 815450 - protein, 9 aa, Homo Sapiens
GGYYYDKIE

SEQ ID NO: 815451 - protein, 9 aa, Homo Sapiens
NRFTTNLPS

SEQ ID NO: 815452 - protein, 9 aa, Homo Sapiens
SQQMRAGKG

SEQ ID NO: 815453 - protein, 9 aa, Homo Sapiens
NKSLVNDNK

SEQ ID NO: 815454 - protein, 9 aa, Homo Sapiens
QMTVKYYMR

SEQ ID NO: 815455 - protein, 9 aa, Homo Sapiens
ASVRSKQDT

SEQ ID NO: 815456 - protein, 9 aa, Homo Sapiens
RPALLDIAH

SEQ ID NO: 815457 - protein, 9 aa, Homo Sapiens
FPQLLCVFF

SEQ ID NO: 815458 - protein, 9 aa, Homo Sapiens
DLNCVDFAN

SEQ ID NO: 815459 - protein, 9 aa, Homo Sapiens
DFVGHQVLQ

SEQ ID NO: 815460 - protein, 9 aa, Homo Sapiens
FDVQEQDIK

SEQ ID NO: 815461 - protein, 9 aa, Homo Sapiens
GLVSFFNDV

SEQ ID NO: 815462 - protein, 9 aa, Homo Sapiens
FSRQAKRPA

SEQ ID NO: 815463 - protein, 9 aa, Homo Sapiens
INKWAAQTT

SEQ ID NO: 815464 - protein, 9 aa, Homo Sapiens
GGTRGCHPS

SEQ ID NO: 815465 - protein, 9 aa, Homo Sapiens
ENFLEACIK

SEQ ID NO: 815466 - protein, 9 aa, Homo Sapiens
SDLPYNEME

SEQ ID NO: 815467 - protein, 9 aa, Homo Sapiens
SVPHRHGER

SEQ ID NO: 815468 - protein, 9 aa, Homo Sapiens
YKLNNEDND

SEQ ID NO: 815469 - protein, 9 aa, Homo Sapiens
WADLVYSFH

SEQ ID NO: 815470 - protein, 9 aa, Homo Sapiens
SLIYYKSYM

SEQ ID NO: 815471 - protein, 9 aa, Homo Sapiens
PHKIKFMKI

SEQ ID NO: 815472 - protein, 9 aa, Homo Sapiens
DVAGCSKVY

SEQ ID NO: 815473 - protein, 9 aa, Homo Sapiens
TSLLLEGKN

SEQ ID NO: 815474 - protein, 9 aa, Homo Sapiens
EEGQASPVN

SEQ ID NO: 815475 - protein, 9 aa, Homo Sapiens
VLSCTSLDT

SEQ ID NO: 815476 - protein, 9 aa, Homo Sapiens
SDLERLALK

SEQ ID NO: 815477 - protein, 9 aa, Homo Sapiens
RDANRRDVC

SEQ ID NO: 815478 - protein, 9 aa, Homo Sapiens
AGVRTHSVV

SEQ ID NO: 815479 - protein, 9 aa, Homo Sapiens
RGGCSEFCF

SEQ ID NO: 815480 - protein, 9 aa, Homo Sapiens
TVSIHLNKS

SEQ ID NO: 815481 - protein, 9 aa, Homo Sapiens
RARMQQQLG

SEQ ID NO: 815482 - protein, 9 aa, Homo Sapiens
VHNQIVIRG

SEQ ID NO: 815483 - protein, 9 aa, Homo Sapiens
DLCVELEAV

SEQ ID NO: 815484 - protein, 9 aa, Homo Sapiens
NNNTNSKDE

SEQ ID NO: 815485 - protein, 9 aa, Homo Sapiens
LFPGIEGHP

SEQ ID NO: 815486 - protein, 9 aa, Homo Sapiens
PILFSLFLS

SEQ ID NO: 815487 - protein, 9 aa, Homo Sapiens
QCFFYIIKA

SEQ ID NO: 815488 - protein, 9 aa, Homo Sapiens
RHQIIHTSD

SEQ ID NO: 815489 - protein, 9 aa, Homo Sapiens
FTEIYKFHK

SEQ ID NO: 815490 - protein, 9 aa, Homo Sapiens
DMDCNEFDQ

SEQ ID NO: 815491 - protein, 9 aa, Homo Sapiens
HSMTDYPPT

SEQ ID NO: 815492 - protein, 9 aa, Homo Sapiens
QIKNTNRKA

SEQ ID NO: 815493 - protein, 9 aa, Homo Sapiens
PQGLMNSGK

SEQ ID NO: 815494 - protein, 9 aa, Homo Sapiens
SFLHANHEQ

SEQ ID NO: 815495 - protein, 9 aa, Homo Sapiens
KVAHLEIEN

SEQ ID NO: 815496 - protein, 9 aa, Homo Sapiens
VMGHQQSFG

SEQ ID NO: 815497 - protein, 9 aa, Homo Sapiens
LRGTLTPRD

SEQ ID NO: 815498 - protein, 9 aa, Homo Sapiens
LQPAQGCMG

SEQ ID NO: 815499 - protein, 9 aa, Homo Sapiens
KFTQQDINE

SEQ ID NO: 815500 - protein, 9 aa, Homo Sapiens
EQLAQLYGP

SEQ ID NO: 815501 - protein, 9 aa, Homo Sapiens
DEICQEQLR

SEQ ID NO: 815502 - protein, 9 aa, Homo Sapiens
KIFDLCIVD

SEQ ID NO: 815503 - protein, 9 aa, Homo Sapiens
DCAVALNLF

SEQ ID NO: 815504 - protein, 9 aa, Homo Sapiens
AVNPIWKIY

SEQ ID NO: 815505 - protein, 9 aa, Homo Sapiens
ANCLAQTTE

SEQ ID NO: 815506 - protein, 9 aa, Homo Sapiens
SRNSERCKE

SEQ ID NO: 815507 - protein, 9 aa, Homo Sapiens
QTVANHVNT

SEQ ID NO: 815508 - protein, 9 aa, Homo Sapiens
YPNQDGDIF

SEQ ID NO: 815509 - protein, 9 aa, Homo Sapiens
PDKELGFES

SEQ ID NO: 815510 - protein, 9 aa, Homo Sapiens
SLINNFQEE

SEQ ID NO: 815511 - protein, 9 aa, Homo Sapiens
YMFMEYVPG

SEQ ID NO: 815512 - protein, 9 aa, Homo Sapiens
SFPKMSVPM

SEQ ID NO: 815513 - protein, 9 aa, Homo Sapiens
LVDQLSHMC

SEQ ID NO: 815514 - protein, 9 aa, Homo Sapiens
IILLTLMLV

SEQ ID NO: 815515 - protein, 9 aa, Homo Sapiens
LTVVVLLFV

SEQ ID NO: 815516 - protein, 9 aa, Homo Sapiens
YNKIVETIE

SEQ ID NO: 815517 - protein, 9 aa, Homo Sapiens
KTDVFSYAL

SEQ ID NO: 815518 - protein, 9 aa, Homo Sapiens
IQVPGASHF

SEQ ID NO: 815519 - protein, 9 aa, Homo Sapiens
TLQQLRHDC

SEQ ID NO: 815520 - protein, 9 aa, Homo Sapiens
VVLIITCVL

SEQ ID NO: 815521 - protein, 9 aa, Homo Sapiens
IQAGTTLYQ

SEQ ID NO: 815522 - protein, 9 aa, Homo Sapiens
LVGGVRSMP

SEQ ID NO: 815523 - protein, 9 aa, Homo Sapiens
WLQYRYLDL

SEQ ID NO: 815524 - protein, 9 aa, Homo Sapiens
RTRAEMTKN

SEQ ID NO: 815525 - protein, 9 aa, Homo Sapiens
QKLPSVRPF

SEQ ID NO: 815526 - protein, 9 aa, Homo Sapiens
VSHVIYPCH

SEQ ID NO: 815527 - protein, 9 aa, Homo Sapiens
DSLNRRIFI

SEQ ID NO: 815528 - protein, 9 aa, Homo Sapiens
CYSSKRRVT

SEQ ID NO: 815529 - protein, 9 aa, Homo Sapiens
SYGLPAVPF

SEQ ID NO: 815530 - protein, 9 aa, Homo Sapiens
SEGTTYSPK

SEQ ID NO: 815531 - protein, 9 aa, Homo Sapiens
VKIIDKSRR

SEQ ID NO: 815532 - protein, 9 aa, Homo Sapiens
EKGANGEAG

SEQ ID NO: 815533 - protein, 9 aa, Homo Sapiens
TMKYKPDHS

SEQ ID NO: 815534 - protein, 9 aa, Homo Sapiens
ESANEMIEA

SEQ ID NO: 815535 - protein, 9 aa, Homo Sapiens
PLTNVALNN

SEQ ID NO: 815536 - protein, 9 aa, Homo Sapiens
QMRIVLIIY

SEQ ID NO: 815537 - protein, 9 aa, Homo Sapiens
SAHHDKRLN

SEQ ID NO: 815538 - protein, 9 aa, Homo Sapiens
TIGVEAHQA

SEQ ID NO: 815539 - protein, 9 aa, Homo Sapiens
CLRIINQNK

SEQ ID NO: 815540 - protein, 9 aa, Homo Sapiens
TSNSLNRDV

SEQ ID NO: 815541 - protein, 9 aa, Homo Sapiens
IYGLLILMK

SEQ ID NO: 815542 - protein, 9 aa, Homo Sapiens
RALLLQTPV

SEQ ID NO: 815543 - protein, 9 aa, Homo Sapiens
EFSPLNNAD

SEQ ID NO: 815544 - protein, 9 aa, Homo Sapiens
IFDLCIVDE

SEQ ID NO: 815545 - protein, 9 aa, Homo Sapiens
QRPSLYWWL

SEQ ID NO: 815546 - protein, 9 aa, Homo Sapiens
FNWHQSAMA

SEQ ID NO: 815547 - protein, 9 aa, Homo Sapiens
LLVSLTSRM

SEQ ID NO: 815548 - protein, 9 aa, Homo Sapiens
SHTTILCLS

SEQ ID NO: 815549 - protein, 9 aa, Homo Sapiens
LSDWSSFNA

SEQ ID NO: 815550 - protein, 9 aa, Homo Sapiens
PPVIMVQDV

SEQ ID NO: 815551 - protein, 9 aa, Homo Sapiens
KYSDEDNLP

SEQ ID NO: 815552 - protein, 9 aa, Homo Sapiens
SPLTVLTFT

SEQ ID NO: 815553 - protein, 9 aa, Homo Sapiens
GLCGRGACN

SEQ ID NO: 815554 - protein, 9 aa, Homo Sapiens
FMETEVKPM

SEQ ID NO: 815555 - protein, 9 aa, Homo Sapiens
WLTHKEMET

SEQ ID NO: 815556 - protein, 9 aa, Homo Sapiens
KIPKVDFRT

SEQ ID NO: 815557 - protein, 9 aa, Homo Sapiens
SRKSKHFES

SEQ ID NO: 815558 - protein, 9 aa, Homo Sapiens
SSKIALHDC

SEQ ID NO: 815559 - protein, 9 aa, Homo Sapiens
VIHLHHLKM

SEQ ID NO: 815560 - protein, 9 aa, Homo Sapiens
SFGTGNYCG

SEQ ID NO: 815561 - protein, 9 aa, Homo Sapiens
FIIKVLFIK

SEQ ID NO: 815562 - protein, 9 aa, Homo Sapiens
INYTDPING

SEQ ID NO: 815563 - protein, 9 aa, Homo Sapiens
NKPEIPTFE

SEQ ID NO: 815564 - protein, 9 aa, Homo Sapiens
HKTMPHIND

SEQ ID NO: 815565 - protein, 9 aa, Homo Sapiens
TPQKTLVLI

SEQ ID NO: 815566 - protein, 9 aa, Homo Sapiens
FGNLKVHEI

SEQ ID NO: 815567 - protein, 9 aa, Homo Sapiens
LALIKTYYG

SEQ ID NO: 815568 - protein, 9 aa, Homo Sapiens
QPPWKVLSG

SEQ ID NO: 815569 - protein, 9 aa, Homo Sapiens
LAGGAGCSG

SEQ ID NO: 815570 - protein, 9 aa, Homo Sapiens
DRPLVTFNL

SEQ ID NO: 815571 - protein, 9 aa, Homo Sapiens
VQGPAYLRD

SEQ ID NO: 815572 - protein, 9 aa, Homo Sapiens
SEFYQWICD

SEQ ID NO: 815573 - protein, 9 aa, Homo Sapiens
SLKVKAMQS

SEQ ID NO: 815574 - protein, 9 aa, Homo Sapiens
NTLLGQDKE

SEQ ID NO: 815575 - protein, 9 aa, Homo Sapiens
KQALVEFED

SEQ ID NO: 815576 - protein, 9 aa, Homo Sapiens
TRGHLAKAQ

SEQ ID NO: 815577 - protein, 9 aa, Homo Sapiens
FNELFNDVR

SEQ ID NO: 815578 - protein, 9 aa, Homo Sapiens
FIVLYILCT

SEQ ID NO: 815579 - protein, 9 aa, Homo Sapiens
NGSNGYSVT

SEQ ID NO: 815580 - protein, 9 aa, Homo Sapiens
FTIPYWDWW

SEQ ID NO: 815581 - protein, 9 aa, Homo Sapiens
QCEAYLQEE

SEQ ID NO: 815582 - protein, 9 aa, Homo Sapiens
QISPDGPVL

SEQ ID NO: 815583 - protein, 9 aa, Homo Sapiens
QGPRTRAHL

SEQ ID NO: 815584 - protein, 9 aa, Homo Sapiens
YIPLEDDII

SEQ ID NO: 815585 - protein, 9 aa, Homo Sapiens
MYNVLAYIK

SEQ ID NO: 815586 - protein, 9 aa, Homo Sapiens
VQSENSCLL

SEQ ID NO: 815587 - protein, 9 aa, Homo Sapiens
ETTIFLAAT

SEQ ID NO: 815588 - protein, 9 aa, Homo Sapiens
HTQEGAQDG

SEQ ID NO: 815589 - protein, 9 aa, Homo Sapiens
AILVVCLLC

SEQ ID NO: 815590 - protein, 9 aa, Homo Sapiens
TESVGLALV

SEQ ID NO: 815591 - protein, 9 aa, Homo Sapiens
QAQVFVDDV

SEQ ID NO: 815592 - protein, 9 aa, Homo Sapiens
EKNQQIIGQ

SEQ ID NO: 815593 - protein, 9 aa, Homo Sapiens
INKGKEFGF

SEQ ID NO: 815594 - protein, 9 aa, Homo Sapiens
ADLRAYCES

SEQ ID NO: 815595 - protein, 9 aa, Homo Sapiens
GEQRLIHKS

SEQ ID NO: 815596 - protein, 9 aa, Homo Sapiens
TKNALLRWR

SEQ ID NO: 815597 - protein, 9 aa, Homo Sapiens
PRGVLRYGG

SEQ ID NO: 815598 - protein, 9 aa, Homo Sapiens
VAATLLNIP

SEQ ID NO: 815599 - protein, 9 aa, Homo Sapiens
RKPQGLAEK

SEQ ID NO: 815600 - protein, 9 aa, Homo Sapiens
TNTKTSSPG

SEQ ID NO: 815601 - protein, 9 aa, Homo Sapiens
FSRKIFDLC

SEQ ID NO: 815602 - protein, 9 aa, Homo Sapiens
ELMSKMRDM

SEQ ID NO: 815603 - protein, 9 aa, Homo Sapiens
KSVLLWDKI

SEQ ID NO: 815604 - protein, 9 aa, Homo Sapiens
FLKPTIATW

SEQ ID NO: 815605 - protein, 9 aa, Homo Sapiens
IGNLAFVDA

SEQ ID NO: 815606 - protein, 9 aa, Homo Sapiens
LHYPKKNRR

SEQ ID NO: 815607 - protein, 9 aa, Homo Sapiens
AKIAHKITR

SEQ ID NO: 815608 - protein, 9 aa, Homo Sapiens
FICMEKLWD

SEQ ID NO: 815609 - protein, 9 aa, Homo Sapiens
DEEPTVSIH

SEQ ID NO: 815610 - protein, 9 aa, Homo Sapiens
AKEPDTSDQ

SEQ ID NO: 815611 - protein, 9 aa, Homo Sapiens
TFNLLGEDQ

SEQ ID NO: 815612 - protein, 9 aa, Homo Sapiens
LHKAFTGSI

SEQ ID NO: 815613 - protein, 9 aa, Homo Sapiens
LVSLAGHSI

SEQ ID NO: 815614 - protein, 9 aa, Homo Sapiens
MLFHSPTEA

SEQ ID NO: 815615 - protein, 9 aa, Homo Sapiens
KLNILETSE

SEQ ID NO: 815616 - protein, 9 aa, Homo Sapiens
EKAGCHLLT

SEQ ID NO: 815617 - protein, 9 aa, Homo Sapiens
VPTEEQRPN

SEQ ID NO: 815618 - protein, 9 aa, Homo Sapiens
VNNTIIDGS

SEQ ID NO: 815619 - protein, 9 aa, Homo Sapiens
KLYISDLWK

SEQ ID NO: 815620 - protein, 9 aa, Homo Sapiens
NTPEKGSHM

SEQ ID NO: 815621 - protein, 9 aa, Homo Sapiens
KKDVTVGSL

SEQ ID NO: 815622 - protein, 9 aa, Homo Sapiens
LQEYRLVVL

SEQ ID NO: 815623 - protein, 9 aa, Homo Sapiens
EIIQPILDM

SEQ ID NO: 815624 - protein, 9 aa, Homo Sapiens
NCEVKASEQ

SEQ ID NO: 815625 - protein, 9 aa, Homo Sapiens
VSVYQYTIR

SEQ ID NO: 815626 - protein, 9 aa, Homo Sapiens
ITGREYFPK

SEQ ID NO: 815627 - protein, 9 aa, Homo Sapiens
KKPKNGERQ

SEQ ID NO: 815628 - protein, 9 aa, Homo Sapiens
FSFVSGCTI

SEQ ID NO: 815629 - protein, 9 aa, Homo Sapiens
LFEVVCIRW

SEQ ID NO: 815630 - protein, 9 aa, Homo Sapiens
TILACAPLY

SEQ ID NO: 815631 - protein, 9 aa, Homo Sapiens
GMVRVASAI

SEQ ID NO: 815632 - protein, 9 aa, Homo Sapiens
LLLPLAVLP

SEQ ID NO: 815633 - protein, 9 aa, Homo Sapiens
VPIEVADVN

SEQ ID NO: 815634 - protein, 9 aa, Homo Sapiens
TIITAESLF

SEQ ID NO: 815635 - protein, 9 aa, Homo Sapiens
RSTTIRIRC

SEQ ID NO: 815636 - protein, 9 aa, Homo Sapiens
SSTSDGDQS

SEQ ID NO: 815637 - protein, 9 aa, Homo Sapiens
LVSLSKQNL

SEQ ID NO: 815638 - protein, 9 aa, Homo Sapiens
LKINDATQE

SEQ ID NO: 815639 - protein, 9 aa, Homo Sapiens
ICEGLGPKV

SEQ ID NO: 815640 - protein, 9 aa, Homo Sapiens
HSKAQITGP

SEQ ID NO: 815641 - protein, 9 aa, Homo Sapiens
TKGPDKSVE

SEQ ID NO: 815642 - protein, 9 aa, Homo Sapiens
AVTYAAVKH

SEQ ID NO: 815643 - protein, 9 aa, Homo Sapiens
SQIICSGKM

SEQ ID NO: 815644 - protein, 9 aa, Homo Sapiens
WLPYNTLSE

SEQ ID NO: 815645 - protein, 9 aa, Homo Sapiens
SSSVYRDAF

SEQ ID NO: 815646 - protein, 9 aa, Homo Sapiens
EDPHLTSVL

SEQ ID NO: 815647 - protein, 9 aa, Homo Sapiens
DYLREAPDD

SEQ ID NO: 815648 - protein, 9 aa, Homo Sapiens
ILHSGEKPY

SEQ ID NO: 815649 - protein, 9 aa, Homo Sapiens
ERTVRLTWI

SEQ ID NO: 815650 - protein, 9 aa, Homo Sapiens
QPILFSLFL

SEQ ID NO: 815651 - protein, 9 aa, Homo Sapiens
VSRTISCDQ

SEQ ID NO: 815652 - protein, 9 aa, Homo Sapiens
MSSTTVYSE

SEQ ID NO: 815653 - protein, 9 aa, Homo Sapiens
NQVKVEGSK

SEQ ID NO: 815654 - protein, 9 aa, Homo Sapiens
REGLEETLH

SEQ ID NO: 815655 - protein, 9 aa, Homo Sapiens
QSSHYIKSQ

SEQ ID NO: 815656 - protein, 9 aa, Homo Sapiens
QSHGIGTDS

SEQ ID NO: 815657 - protein, 9 aa, Homo Sapiens
HASSLLNHR

SEQ ID NO: 815658 - protein, 9 aa, Homo Sapiens
PETTKTPAG

SEQ ID NO: 815659 - protein, 9 aa, Homo Sapiens
YSRLQTLEL

SEQ ID NO: 815660 - protein, 9 aa, Homo Sapiens
KIRITQSGN

SEQ ID NO: 815661 - protein, 9 aa, Homo Sapiens
IRWVYGADR

SEQ ID NO: 815662 - protein, 9 aa, Homo Sapiens
LVYWYCTRL

SEQ ID NO: 815663 - protein, 9 aa, Homo Sapiens
FKDNQGDTP

SEQ ID NO: 815664 - protein, 9 aa, Homo Sapiens
TPNSEFIQA

SEQ ID NO: 815665 - protein, 9 aa, Homo Sapiens
TAEENEKLV

SEQ ID NO: 815666 - protein, 9 aa, Homo Sapiens
YHYPDSDKR

SEQ ID NO: 815667 - protein, 9 aa, Homo Sapiens
PPRHQNTGP

SEQ ID NO: 815668 - protein, 9 aa, Homo Sapiens
HAILQQEIG

SEQ ID NO: 815669 - protein, 9 aa, Homo Sapiens
SSWLSTFCG

SEQ ID NO: 815670 - protein, 9 aa, Homo Sapiens
FLLLYLIIL

SEQ ID NO: 815671 - protein, 9 aa, Homo Sapiens
QDIEIWKES

SEQ ID NO: 815672 - protein, 9 aa, Homo Sapiens
QNAREMTLQ

SEQ ID NO: 815673 - protein, 9 aa, Homo Sapiens
PFMTSIPVN

SEQ ID NO: 815674 - protein, 9 aa, Homo Sapiens
TLDLFPGVK

SEQ ID NO: 815675 - protein, 9 aa, Homo Sapiens
EVAVTDINY

SEQ ID NO: 815676 - protein, 9 aa, Homo Sapiens
NYNKILATK

SEQ ID NO: 815677 - protein, 9 aa, Homo Sapiens
SYFAHAQVS

SEQ ID NO: 815678 - protein, 9 aa, Homo Sapiens
RHIEVMNSF

SEQ ID NO: 815679 - protein, 9 aa, Homo Sapiens
YRYTSLLCK

SEQ ID NO: 815680 - protein, 9 aa, Homo Sapiens
ETYPSPYCI

SEQ ID NO: 815681 - protein, 9 aa, Homo Sapiens
GKYLDFEKA

SEQ ID NO: 815682 - protein, 9 aa, Homo Sapiens
HGQFFDLMT

SEQ ID NO: 815683 - protein, 9 aa, Homo Sapiens
KESWVNTVN

SEQ ID NO: 815684 - protein, 9 aa, Homo Sapiens
LGQDGRRWL

SEQ ID NO: 815685 - protein, 9 aa, Homo Sapiens
DTSDVLLCG

SEQ ID NO: 815686 - protein, 9 aa, Homo Sapiens
DTNGDGDIT

SEQ ID NO: 815687 - protein, 9 aa, Homo Sapiens
HQATQAAEI

SEQ ID NO: 815688 - protein, 9 aa, Homo Sapiens
LFRAISLWP

SEQ ID NO: 815689 - protein, 9 aa, Homo Sapiens
PAMSSYLQN

SEQ ID NO: 815690 - protein, 9 aa, Homo Sapiens
RGRQTQWGL

SEQ ID NO: 815691 - protein, 9 aa, Homo Sapiens
SMIKMAHIG

SEQ ID NO: 815692 - protein, 9 aa, Homo Sapiens
GFIYQTLQE

SEQ ID NO: 815693 - protein, 9 aa, Homo Sapiens
IRQCISGDC

SEQ ID NO: 815694 - protein, 9 aa, Homo Sapiens
LSHMCLHDY

SEQ ID NO: 815695 - protein, 9 aa, Homo Sapiens
LVSRYLGVS

SEQ ID NO: 815696 - protein, 9 aa, Homo Sapiens
EDKLQPQRS

SEQ ID NO: 815697 - protein, 9 aa, Homo Sapiens
NNEWQTSES

SEQ ID NO: 815698 - protein, 9 aa, Homo Sapiens
QQQLPKQFL

SEQ ID NO: 815699 - protein, 9 aa, Homo Sapiens
LEAATFLDI

SEQ ID NO: 815700 - protein, 9 aa, Homo Sapiens
PAMAIFKLL

SEQ ID NO: 815701 - protein, 9 aa, Homo Sapiens
IYNFIEDQG

SEQ ID NO: 815702 - protein, 9 aa, Homo Sapiens
FKTVIQTIH

SEQ ID NO: 815703 - protein, 9 aa, Homo Sapiens
DIGGDGNNI

SEQ ID NO: 815704 - protein, 9 aa, Homo Sapiens
IPYILEALM

SEQ ID NO: 815705 - protein, 9 aa, Homo Sapiens
NGGGVPAWG

SEQ ID NO: 815706 - protein, 9 aa, Homo Sapiens
LLQRKQNVL

SEQ ID NO: 815707 - protein, 9 aa, Homo Sapiens
SSYLIQHKI

SEQ ID NO: 815708 - protein, 9 aa, Homo Sapiens
EHRGLPPRQ

SEQ ID NO: 815709 - protein, 9 aa, Homo Sapiens
FYDIDIDTE

SEQ ID NO: 815710 - protein, 9 aa, Homo Sapiens
FGMMGTFAK

SEQ ID NO: 815711 - protein, 9 aa, Homo Sapiens
AEDKENYNK

SEQ ID NO: 815712 - protein, 9 aa, Homo Sapiens
PKPLKKLCF

SEQ ID NO: 815713 - protein, 9 aa, Homo Sapiens
KNQIIKLEI

SEQ ID NO: 815714 - protein, 9 aa, Homo Sapiens
GITPSMTNW

SEQ ID NO: 815715 - protein, 9 aa, Homo Sapiens
CAVHLHSGE

SEQ ID NO: 815716 - protein, 9 aa, Homo Sapiens
RVSQIICSG

SEQ ID NO: 815717 - protein, 9 aa, Homo Sapiens
LMTLFEVGG

SEQ ID NO: 815718 - protein, 9 aa, Homo Sapiens
KVIFTTVCI

SEQ ID NO: 815719 - protein, 9 aa, Homo Sapiens
VLSDKENHI

SEQ ID NO: 815720 - protein, 9 aa, Homo Sapiens
DIKALKYAI

SEQ ID NO: 815721 - protein, 9 aa, Homo Sapiens
LTVHCKVHM

SEQ ID NO: 815722 - protein, 9 aa, Homo Sapiens
YPIQNMDRL

SEQ ID NO: 815723 - protein, 9 aa, Homo Sapiens
QKVKKTVEA

SEQ ID NO: 815724 - protein, 9 aa, Homo Sapiens
PTVSIHLNK

SEQ ID NO: 815725 - protein, 9 aa, Homo Sapiens
DQAASVFYT

SEQ ID NO: 815726 - protein, 9 aa, Homo Sapiens
SEDARLFTS

SEQ ID NO: 815727 - protein, 9 aa, Homo Sapiens
SLDNFLRNK

SEQ ID NO: 815728 - protein, 9 aa, Homo Sapiens
NAVKLGAFQ

SEQ ID NO: 815729 - protein, 9 aa, Homo Sapiens
SPRLSPAYP

SEQ ID NO: 815730 - protein, 9 aa, Homo Sapiens
IHTLQDWAG

SEQ ID NO: 815731 - protein, 9 aa, Homo Sapiens
SDLTQTANK

SEQ ID NO: 815732 - protein, 9 aa, Homo Sapiens
TWQKYYLDG

SEQ ID NO: 815733 - protein, 9 aa, Homo Sapiens
VNNLQKEKS

SEQ ID NO: 815734 - protein, 9 aa, Homo Sapiens
LSVVLASYA

SEQ ID NO: 815735 - protein, 9 aa, Homo Sapiens
GIIYKPTTK

SEQ ID NO: 815736 - protein, 9 aa, Homo Sapiens
TGLPHLDHP

SEQ ID NO: 815737 - protein, 9 aa, Homo Sapiens
PLRPAHGRR

SEQ ID NO: 815738 - protein, 9 aa, Homo Sapiens
LTLLHQATQ

SEQ ID NO: 815739 - protein, 9 aa, Homo Sapiens
DSHQYDQIY

SEQ ID NO: 815740 - protein, 9 aa, Homo Sapiens
QLLDAVKTC

SEQ ID NO: 815741 - protein, 9 aa, Homo Sapiens
GIAVQYAED

SEQ ID NO: 815742 - protein, 9 aa, Homo Sapiens
LQWESWAHF

SEQ ID NO: 815743 - protein, 9 aa, Homo Sapiens
QTPNHNQQN

SEQ ID NO: 815744 - protein, 9 aa, Homo Sapiens
EYFPKKLLR

SEQ ID NO: 815745 - protein, 9 aa, Homo Sapiens
TVENIKGPL

SEQ ID NO: 815746 - protein, 9 aa, Homo Sapiens
AILQANSSQ

SEQ ID NO: 815747 - protein, 9 aa, Homo Sapiens
EEKINSEKE

SEQ ID NO: 815748 - protein, 9 aa, Homo Sapiens
SDRDLVCSN

SEQ ID NO: 815749 - protein, 9 aa, Homo Sapiens
KLTEELLRE

SEQ ID NO: 815750 - protein, 9 aa, Homo Sapiens
LKDVIMQYF

SEQ ID NO: 815751 - protein, 9 aa, Homo Sapiens
ARAPYRLES

SEQ ID NO: 815752 - protein, 9 aa, Homo Sapiens
INQEELIAI

SEQ ID NO: 815753 - protein, 9 aa, Homo Sapiens
WRGVNVNMK

SEQ ID NO: 815754 - protein, 9 aa, Homo Sapiens
PNPLRPFVT

SEQ ID NO: 815755 - protein, 9 aa, Homo Sapiens
CFVKQLEIH

SEQ ID NO: 815756 - protein, 9 aa, Homo Sapiens
IYECLTVHC

SEQ ID NO: 815757 - protein, 9 aa, Homo Sapiens
LWGRGDRIK

SEQ ID NO: 815758 - protein, 9 aa, Homo Sapiens
EIYQASLLV

SEQ ID NO: 815759 - protein, 9 aa, Homo Sapiens
LLVLALAGV

SEQ ID NO: 815760 - protein, 9 aa, Homo Sapiens
WSTVSFPKM

SEQ ID NO: 815761 - protein, 9 aa, Homo Sapiens
LARQGQDVV

SEQ ID NO: 815762 - protein, 9 aa, Homo Sapiens
GITLDLFPG

SEQ ID NO: 815763 - protein, 9 aa, Homo Sapiens
PAGKIYLLS

SEQ ID NO: 815764 - protein, 9 aa, Homo Sapiens
GICGNFNSI

SEQ ID NO: 815765 - protein, 9 aa, Homo Sapiens
YYPNRTYIF

SEQ ID NO: 815766 - protein, 9 aa, Homo Sapiens
RDRIICFCG

SEQ ID NO: 815767 - protein, 9 aa, Homo Sapiens
YMWRDGKGQ

SEQ ID NO: 815768 - protein, 9 aa, Homo Sapiens
SARRPSLDS

SEQ ID NO: 815769 - protein, 9 aa, Homo Sapiens
HNCLISSGN

SEQ ID NO: 815770 - protein, 9 aa, Homo Sapiens
GHPVLRELE

SEQ ID NO: 815771 - protein, 9 aa, Homo Sapiens
YGDNEKQKK

SEQ ID NO: 815772 - protein, 9 aa, Homo Sapiens
VQRGASSSP

SEQ ID NO: 815773 - protein, 9 aa, Homo Sapiens
CGKSFINYR

SEQ ID NO: 815774 - protein, 9 aa, Homo Sapiens
NIQYTCLHE

SEQ ID NO: 815775 - protein, 9 aa, Homo Sapiens
HENLLHQEE

SEQ ID NO: 815776 - protein, 9 aa, Homo Sapiens
SFHLFGGFR

SEQ ID NO: 815777 - protein, 9 aa, Homo Sapiens
VVYDQSTWD

SEQ ID NO: 815778 - protein, 9 aa, Homo Sapiens
PHKGPGGGM

SEQ ID NO: 815779 - protein, 9 aa, Homo Sapiens
VGPVMSKSS

SEQ ID NO: 815780 - protein, 9 aa, Homo Sapiens
GAVTKMAAV

SEQ ID NO: 815781 - protein, 9 aa, Homo Sapiens
HVMRDKHPE

SEQ ID NO: 815782 - protein, 9 aa, Homo Sapiens
AMLPFHHRN

SEQ ID NO: 815783 - protein, 9 aa, Homo Sapiens
VAMKQNKLL

SEQ ID NO: 815784 - protein, 9 aa, Homo Sapiens
EHLSKKAKE

SEQ ID NO: 815785 - protein, 9 aa, Homo Sapiens
SKSRIRSTF

SEQ ID NO: 815786 - protein, 9 aa, Homo Sapiens
PDNGWDEST

SEQ ID NO: 815787 - protein, 9 aa, Homo Sapiens
VEKPYRCKK

SEQ ID NO: 815788 - protein, 9 aa, Homo Sapiens
GPYNYDITL

SEQ ID NO: 815789 - protein, 9 aa, Homo Sapiens
PLKELDVLE

SEQ ID NO: 815790 - protein, 9 aa, Homo Sapiens
TKKVKKRNP

SEQ ID NO: 815791 - protein, 9 aa, Homo Sapiens
SSPATNYSH

SEQ ID NO: 815792 - protein, 9 aa, Homo Sapiens
HILCAILNI

SEQ ID NO: 815793 - protein, 9 aa, Homo Sapiens
LRQNQNYMN

SEQ ID NO: 815794 - protein, 9 aa, Homo Sapiens
CEGFEYINP

SEQ ID NO: 815795 - protein, 9 aa, Homo Sapiens
FYGTLTFMY

SEQ ID NO: 815796 - protein, 9 aa, Homo Sapiens
GGWRCSCWA

SEQ ID NO: 815797 - protein, 9 aa, Homo Sapiens
LPEKIDVVY

SEQ ID NO: 815798 - protein, 9 aa, Homo Sapiens
PQKQPPWDF

SEQ ID NO: 815799 - protein, 9 aa, Homo Sapiens
PKCLTKAHW

SEQ ID NO: 815800 - protein, 9 aa, Homo Sapiens
SPDQSGIDI

SEQ ID NO: 815801 - protein, 9 aa, Homo Sapiens
GEAHNLIPM

SEQ ID NO: 815802 - protein, 9 aa, Homo Sapiens
HFESKHPTC

SEQ ID NO: 815803 - protein, 9 aa, Homo Sapiens
EVAARSIPP

SEQ ID NO: 815804 - protein, 9 aa, Homo Sapiens
EDEEEEKVV

SEQ ID NO: 815805 - protein, 9 aa, Homo Sapiens
SKSPTISDN

SEQ ID NO: 815806 - protein, 9 aa, Homo Sapiens
FAISAPFLL

SEQ ID NO: 815807 - protein, 9 aa, Homo Sapiens
SVLHHCCDL

SEQ ID NO: 815808 - protein, 9 aa, Homo Sapiens
WTKGPDKSV

SEQ ID NO: 815809 - protein, 9 aa, Homo Sapiens
LAQLCLAQE

SEQ ID NO: 815810 - protein, 9 aa, Homo Sapiens
MCVETMELC

SEQ ID NO: 815811 - protein, 9 aa, Homo Sapiens
QRERRQKSE

SEQ ID NO: 815812 - protein, 9 aa, Homo Sapiens
GWLEDLLMG

SEQ ID NO: 815813 - protein, 9 aa, Homo Sapiens
FGAENLFNK

SEQ ID NO: 815814 - protein, 9 aa, Homo Sapiens
DYLWGPGAG

SEQ ID NO: 815815 - protein, 9 aa, Homo Sapiens
KHSLTIHGI

SEQ ID NO: 815816 - protein, 9 aa, Homo Sapiens
SWSGQPPMD

SEQ ID NO: 815817 - protein, 9 aa, Homo Sapiens
CGFPPLSYG

SEQ ID NO: 815818 - protein, 9 aa, Homo Sapiens
MYLFLRNFS

SEQ ID NO: 815819 - protein, 9 aa, Homo Sapiens
MKTSRHKEL

SEQ ID NO: 815820 - protein, 9 aa, Homo Sapiens
IFAVVFSIF

SEQ ID NO: 815821 - protein, 9 aa, Homo Sapiens
KLLHYQPSA

SEQ ID NO: 815822 - protein, 9 aa, Homo Sapiens
RTVRLTWIP

SEQ ID NO: 815823 - protein, 9 aa, Homo Sapiens
AAFSLIQDN

SEQ ID NO: 815824 - protein, 9 aa, Homo Sapiens
WLKVTEPLA

SEQ ID NO: 815825 - protein, 9 aa, Homo Sapiens
GNYCGISGI

SEQ ID NO: 815826 - protein, 9 aa, Homo Sapiens
IDKFCDPQM

SEQ ID NO: 815827 - protein, 9 aa, Homo Sapiens
DYNDNCSLE

SEQ ID NO: 815828 - protein, 9 aa, Homo Sapiens
TFEKLGICS

SEQ ID NO: 815829 - protein, 9 aa, Homo Sapiens
TRSKAKQER

SEQ ID NO: 815830 - protein, 9 aa, Homo Sapiens
DYPFKPPQV

SEQ ID NO: 815831 - protein, 9 aa, Homo Sapiens
FLTEINYTV

SEQ ID NO: 815832 - protein, 9 aa, Homo Sapiens
PWYPSDLLD

SEQ ID NO: 815833 - protein, 9 aa, Homo Sapiens
FQTHYRFTA

SEQ ID NO: 815834 - protein, 9 aa, Homo Sapiens
NKPVTIKEE

SEQ ID NO: 815835 - protein, 9 aa, Homo Sapiens
LTVKVDVNK

SEQ ID NO: 815836 - protein, 9 aa, Homo Sapiens
YAIKCKFYH

SEQ ID NO: 815837 - protein, 9 aa, Homo Sapiens
ISLFSCLED

SEQ ID NO: 815838 - protein, 9 aa, Homo Sapiens
RVAATSRSQ

SEQ ID NO: 815839 - protein, 9 aa, Homo Sapiens
SKATNDDIF

SEQ ID NO: 815840 - protein, 9 aa, Homo Sapiens
KSAVDFHMK

SEQ ID NO: 815841 - protein, 9 aa, Homo Sapiens
FMVYKVPGQ

SEQ ID NO: 815842 - protein, 9 aa, Homo Sapiens
VREWLQLTM

SEQ ID NO: 815843 - protein, 9 aa, Homo Sapiens
NRRGSDSEE

SEQ ID NO: 815844 - protein, 9 aa, Homo Sapiens
MGLALFSNH

SEQ ID NO: 815845 - protein, 9 aa, Homo Sapiens
QSLDLLGLE

SEQ ID NO: 815846 - protein, 9 aa, Homo Sapiens
SNHPKIQIK

SEQ ID NO: 815847 - protein, 9 aa, Homo Sapiens
GDQMDNAKH

SEQ ID NO: 815848 - protein, 9 aa, Homo Sapiens
ILKTLLWCR

SEQ ID NO: 815849 - protein, 9 aa, Homo Sapiens
IIIDRYVAV

SEQ ID NO: 815850 - protein, 9 aa, Homo Sapiens
VSGQVGYRS

SEQ ID NO: 815851 - protein, 9 aa, Homo Sapiens
KSGICKIHP

SEQ ID NO: 815852 - protein, 9 aa, Homo Sapiens
PYWDWWDAE

SEQ ID NO: 815853 - protein, 9 aa, Homo Sapiens
GILDGMMTT

SEQ ID NO: 815854 - protein, 9 aa, Homo Sapiens
WALPCFPET

SEQ ID NO: 815855 - protein, 9 aa, Homo Sapiens
AIQNSRDVI

SEQ ID NO: 815856 - protein, 9 aa, Homo Sapiens
AFKQLCLLQ

SEQ ID NO: 815857 - protein, 9 aa, Homo Sapiens
CFLELAPDI

SEQ ID NO: 815858 - protein, 9 aa, Homo Sapiens
GACNVLSPI

SEQ ID NO: 815859 - protein, 9 aa, Homo Sapiens
FQTPPIVES

SEQ ID NO: 815860 - protein, 9 aa, Homo Sapiens
DEFSPMKDG

SEQ ID NO: 815861 - protein, 9 aa, Homo Sapiens
GNPGYVTIF

SEQ ID NO: 815862 - protein, 9 aa, Homo Sapiens
QKHDIPEDI

SEQ ID NO: 815863 - protein, 9 aa, Homo Sapiens
EEATPHKLQ

SEQ ID NO: 815864 - protein, 9 aa, Homo Sapiens
KIIKTYREI

SEQ ID NO: 815865 - protein, 9 aa, Homo Sapiens
FGEGTEAVN

SEQ ID NO: 815866 - protein, 9 aa, Homo Sapiens
QIPSYTKLI

SEQ ID NO: 815867 - protein, 9 aa, Homo Sapiens
YHPEEFQLI

SEQ ID NO: 815868 - protein, 9 aa, Homo Sapiens
DVLAEYKIL

SEQ ID NO: 815869 - protein, 9 aa, Homo Sapiens
PDTIRRQLE

SEQ ID NO: 815870 - protein, 9 aa, Homo Sapiens
GVGSQSETS

SEQ ID NO: 815871 - protein, 9 aa, Homo Sapiens
PRSSSKIAL

SEQ ID NO: 815872 - protein, 9 aa, Homo Sapiens
QTQWGLRSF

SEQ ID NO: 815873 - protein, 9 aa, Homo Sapiens
NNLESFPRV

SEQ ID NO: 815874 - protein, 9 aa, Homo Sapiens
FKRFVTTSY

SEQ ID NO: 815875 - protein, 9 aa, Homo Sapiens
IVQPAAAPN

SEQ ID NO: 815876 - protein, 9 aa, Homo Sapiens
SVKMASDYL

SEQ ID NO: 815877 - protein, 9 aa, Homo Sapiens
LAHHQQIHT

SEQ ID NO: 815878 - protein, 9 aa, Homo Sapiens
GRKRKMCSK

SEQ ID NO: 815879 - protein, 9 aa, Homo Sapiens
WLRKALDFE

SEQ ID NO: 815880 - protein, 9 aa, Homo Sapiens
FDLMTLFEV

SEQ ID NO: 815881 - protein, 9 aa, Homo Sapiens
QSSDMKGWP

SEQ ID NO: 815882 - protein, 9 aa, Homo Sapiens
TFAWHTKDM

SEQ ID NO: 815883 - protein, 9 aa, Homo Sapiens
DRGQIRYNK

SEQ ID NO: 815884 - protein, 9 aa, Homo Sapiens
RVPYVEPPK

SEQ ID NO: 815885 - protein, 9 aa, Homo Sapiens
NKYGQLGTG

SEQ ID NO: 815886 - protein, 9 aa, Homo Sapiens
DQVWNSYQL

SEQ ID NO: 815887 - protein, 9 aa, Homo Sapiens
QLEEGAMED

SEQ ID NO: 815888 - protein, 9 aa, Homo Sapiens
TDLAVYEMI

SEQ ID NO: 815889 - protein, 9 aa, Homo Sapiens
STGRVSQEV

SEQ ID NO: 815890 - protein, 9 aa, Homo Sapiens
LLNHPTPII

SEQ ID NO: 815891 - protein, 9 aa, Homo Sapiens
QDKNPEGDG

SEQ ID NO: 815892 - protein, 9 aa, Homo Sapiens
WAGPCPPRG

SEQ ID NO: 815893 - protein, 9 aa, Homo Sapiens
QPPGPVLLP

SEQ ID NO: 815894 - protein, 9 aa, Homo Sapiens
VRTLKSFSN

SEQ ID NO: 815895 - protein, 9 aa, Homo Sapiens
YQVEKLAKY

SEQ ID NO: 815896 - protein, 9 aa, Homo Sapiens
FQGKWERAF

SEQ ID NO: 815897 - protein, 9 aa, Homo Sapiens
YQASLLVIL

SEQ ID NO: 815898 - protein, 9 aa, Homo Sapiens
VTDVDTSWK

SEQ ID NO: 815899 - protein, 9 aa, Homo Sapiens
ELVNILHKA

SEQ ID NO: 815900 - protein, 9 aa, Homo Sapiens
IDYPEKEDY

SEQ ID NO: 815901 - protein, 9 aa, Homo Sapiens
GAPLKVKRS

SEQ ID NO: 815902 - protein, 9 aa, Homo Sapiens
GDNNPLRIT

SEQ ID NO: 815903 - protein, 9 aa, Homo Sapiens
ANNNARNDF

SEQ ID NO: 815904 - protein, 9 aa, Homo Sapiens
VHTNGADID

SEQ ID NO: 815905 - protein, 9 aa, Homo Sapiens
FPLVNFCVT

SEQ ID NO: 815906 - protein, 9 aa, Homo Sapiens
VQSWYIRSL

SEQ ID NO: 815907 - protein, 9 aa, Homo Sapiens
WKILNEIYA

SEQ ID NO: 815908 - protein, 9 aa, Homo Sapiens
IVHQAILGS

SEQ ID NO: 815909 - protein, 9 aa, Homo Sapiens
VAPDFLDST

SEQ ID NO: 815910 - protein, 9 aa, Homo Sapiens
RGLDIEELE

SEQ ID NO: 815911 - protein, 9 aa, Homo Sapiens
SETSYWKVH

SEQ ID NO: 815912 - protein, 9 aa, Homo Sapiens
EESCVEAQD

SEQ ID NO: 815913 - protein, 9 aa, Homo Sapiens
AFRQAQRQD

SEQ ID NO: 815914 - protein, 9 aa, Homo Sapiens
LCQYYDVMY

SEQ ID NO: 815915 - protein, 9 aa, Homo Sapiens
MDVMVFIVT

SEQ ID NO: 815916 - protein, 9 aa, Homo Sapiens
LVCGEYGRA

SEQ ID NO: 815917 - protein, 9 aa, Homo Sapiens
QMMTRGHLA

SEQ ID NO: 815918 - protein, 9 aa, Homo Sapiens
KFAGCGGRH

SEQ ID NO: 815919 - protein, 9 aa, Homo Sapiens
CWQRGEIWD

SEQ ID NO: 815920 - protein, 9 aa, Homo Sapiens
DNLPEKLTA

SEQ ID NO: 815921 - protein, 9 aa, Homo Sapiens
TAQQVFEEL

SEQ ID NO: 815922 - protein, 9 aa, Homo Sapiens
VAEGTYKEK

SEQ ID NO: 815923 - protein, 9 aa, Homo Sapiens
DPRLQTNFD

SEQ ID NO: 815924 - protein, 9 aa, Homo Sapiens
HFTHLIMTC

SEQ ID NO: 815925 - protein, 9 aa, Homo Sapiens
PLMDNNRIE

SEQ ID NO: 815926 - protein, 9 aa, Homo Sapiens
ELFENQYIH

SEQ ID NO: 815927 - protein, 9 aa, Homo Sapiens
DLNPLVILG

SEQ ID NO: 815928 - protein, 9 aa, Homo Sapiens
KLEAAHFDK

SEQ ID NO: 815929 - protein, 9 aa, Homo Sapiens
AMNEEESYP

SEQ ID NO: 815930 - protein, 9 aa, Homo Sapiens
GCWYCRRQN

SEQ ID NO: 815931 - protein, 9 aa, Homo Sapiens
DLAAIFNLH

SEQ ID NO: 815932 - protein, 9 aa, Homo Sapiens
LISQACKLL

SEQ ID NO: 815933 - protein, 9 aa, Homo Sapiens
EIEITPPTN

SEQ ID NO: 815934 - protein, 9 aa, Homo Sapiens
YYTECLFFG

SEQ ID NO: 815935 - protein, 9 aa, Homo Sapiens
YKCDKCDKL

SEQ ID NO: 815936 - protein, 9 aa, Homo Sapiens
PKFVRVRSY

SEQ ID NO: 815937 - protein, 9 aa, Homo Sapiens
IECDTFIQK

SEQ ID NO: 815938 - protein, 9 aa, Homo Sapiens
FLLPSKINT

SEQ ID NO: 815939 - protein, 9 aa, Homo Sapiens
GFQAMDGRF

SEQ ID NO: 815940 - protein, 9 aa, Homo Sapiens
TDKFGQGVH

SEQ ID NO: 815941 - protein, 9 aa, Homo Sapiens
DNFVPVLVE

SEQ ID NO: 815942 - protein, 9 aa, Homo Sapiens
PLPYFGLEE

SEQ ID NO: 815943 - protein, 9 aa, Homo Sapiens
SRRITKNCA

SEQ ID NO: 815944 - protein, 9 aa, Homo Sapiens
EWPLAEVAE

SEQ ID NO: 815945 - protein, 9 aa, Homo Sapiens
TSHQCHHKQ

SEQ ID NO: 815946 - protein, 9 aa, Homo Sapiens
FVYSAKRKA

SEQ ID NO: 815947 - protein, 9 aa, Homo Sapiens
VVLADSSRH

SEQ ID NO: 815948 - protein, 9 aa, Homo Sapiens
LTCPFGTKY

SEQ ID NO: 815949 - protein, 9 aa, Homo Sapiens
REPLSLIED

SEQ ID NO: 815950 - protein, 9 aa, Homo Sapiens
EDILEVATA

SEQ ID NO: 815951 - protein, 9 aa, Homo Sapiens
ELIAIMTGD

SEQ ID NO: 815952 - protein, 9 aa, Homo Sapiens
GHLSGKEAD

SEQ ID NO: 815953 - protein, 9 aa, Homo Sapiens
KHTLEMEKQ

SEQ ID NO: 815954 - protein, 9 aa, Homo Sapiens
ISDNVPTLR

SEQ ID NO: 815955 - protein, 9 aa, Homo Sapiens
VNYQAQETT

SEQ ID NO: 815956 - protein, 9 aa, Homo Sapiens
WIIKLSRRR

SEQ ID NO: 815957 - protein, 9 aa, Homo Sapiens
VCKENDFSP

SEQ ID NO: 815958 - protein, 9 aa, Homo Sapiens
RGRRGWNKF

SEQ ID NO: 815959 - protein, 9 aa, Homo Sapiens
PTNKLENQL

SEQ ID NO: 815960 - protein, 9 aa, Homo Sapiens
YTFPHPHET

SEQ ID NO: 815961 - protein, 9 aa, Homo Sapiens
SQHRDLKII

SEQ ID NO: 815962 - protein, 9 aa, Homo Sapiens
VMKLIVIHF

SEQ ID NO: 815963 - protein, 9 aa, Homo Sapiens
KVWKNRKKL

SEQ ID NO: 815964 - protein, 9 aa, Homo Sapiens
ILGQMDKPF

SEQ ID NO: 815965 - protein, 9 aa, Homo Sapiens
TPENHENIF

SEQ ID NO: 815966 - protein, 9 aa, Homo Sapiens
GRDRSSKKA

SEQ ID NO: 815967 - protein, 9 aa, Homo Sapiens
GISSSLDRA

SEQ ID NO: 815968 - protein, 9 aa, Homo Sapiens
IQALHPDPS

SEQ ID NO: 815969 - protein, 9 aa, Homo Sapiens
FPEHAVQAY

SEQ ID NO: 815970 - protein, 9 aa, Homo Sapiens
VKEKITFQE

SEQ ID NO: 815971 - protein, 9 aa, Homo Sapiens
VLRYGGQQE

SEQ ID NO: 815972 - protein, 9 aa, Homo Sapiens
WKQRVKAAM

SEQ ID NO: 815973 - protein, 9 aa, Homo Sapiens
IWKQWHEDI

SEQ ID NO: 815974 - protein, 9 aa, Homo Sapiens
MIFAATLCA

SEQ ID NO: 815975 - protein, 9 aa, Homo Sapiens
RRTMEKELK

SEQ ID NO: 815976 - protein, 9 aa, Homo Sapiens
YVIYHDALQ

SEQ ID NO: 815977 - protein, 9 aa, Homo Sapiens
WENTFKIDL

SEQ ID NO: 815978 - protein, 9 aa, Homo Sapiens
DGPKAGQTV

SEQ ID NO: 815979 - protein, 9 aa, Homo Sapiens
APIMNQWWR

SEQ ID NO: 815980 - protein, 9 aa, Homo Sapiens
GDIGLPGPQ

SEQ ID NO: 815981 - protein, 9 aa, Homo Sapiens
KEKPIHLTL

SEQ ID NO: 815982 - protein, 9 aa, Homo Sapiens
RASNYSMEL

SEQ ID NO: 815983 - protein, 9 aa, Homo Sapiens
TDISSISIC

SEQ ID NO: 815984 - protein, 9 aa, Homo Sapiens
SFCRSNVAE

SEQ ID NO: 815985 - protein, 9 aa, Homo Sapiens
YAITAQSTF

SEQ ID NO: 815986 - protein, 9 aa, Homo Sapiens
VQTQGQVTG

SEQ ID NO: 815987 - protein, 9 aa, Homo Sapiens
EDRSGSGNE

SEQ ID NO: 815988 - protein, 9 aa, Homo Sapiens
VSSQAESSI

SEQ ID NO: 815989 - protein, 9 aa, Homo Sapiens
GSHFFFTLG

SEQ ID NO: 815990 - protein, 9 aa, Homo Sapiens
KEPISFSKF

SEQ ID NO: 815991 - protein, 9 aa, Homo Sapiens
VKCSVTRIK

SEQ ID NO: 815992 - protein, 9 aa, Homo Sapiens
MLTHATTVA

SEQ ID NO: 815993 - protein, 9 aa, Homo Sapiens
RYVITTTTL

SEQ ID NO: 815994 - protein, 9 aa, Homo Sapiens
MANCNSLRM

SEQ ID NO: 815995 - protein, 9 aa, Homo Sapiens
QNLKVLFVF

SEQ ID NO: 815996 - protein, 9 aa, Homo Sapiens
AQEAIENGI

SEQ ID NO: 815997 - protein, 9 aa, Homo Sapiens
PLVILFSAL

SEQ ID NO: 815998 - protein, 9 aa, Homo Sapiens
QMTMDDSKN

SEQ ID NO: 815999 - protein, 9 aa, Homo Sapiens
DNEYLFQAK

SEQ ID NO: 816000 - protein, 9 aa, Homo Sapiens
RLHTQEGAQ

SEQ ID NO: 816001 - protein, 9 aa, Homo Sapiens
SEDVRVAAS

SEQ ID NO: 816002 - protein, 9 aa, Homo Sapiens
HSLLNKELV

SEQ ID NO: 816003 - protein, 9 aa, Homo Sapiens
SRLDLDVSL

SEQ ID NO: 816004 - protein, 9 aa, Homo Sapiens
ISHVRLWVL

SEQ ID NO: 816005 - protein, 9 aa, Homo Sapiens
VQTPVPSHP

SEQ ID NO: 816006 - protein, 9 aa, Homo Sapiens
INWWVMARV

SEQ ID NO: 816007 - protein, 9 aa, Homo Sapiens
NLRENKINI

SEQ ID NO: 816008 - protein, 9 aa, Homo Sapiens
IEDKARIIY

SEQ ID NO: 816009 - protein, 9 aa, Homo Sapiens
ESDVRGIAG

SEQ ID NO: 816010 - protein, 9 aa, Homo Sapiens
RALNDVFHH

SEQ ID NO: 816011 - protein, 9 aa, Homo Sapiens
TEFIDKFLS

SEQ ID NO: 816012 - protein, 9 aa, Homo Sapiens
KRSSHHRSQ

SEQ ID NO: 816013 - protein, 9 aa, Homo Sapiens
DGPWRQSSS

SEQ ID NO: 816014 - protein, 9 aa, Homo Sapiens
DELSKKEHN

SEQ ID NO: 816015 - protein, 9 aa, Homo Sapiens
KIAHKITRY

SEQ ID NO: 816016 - protein, 9 aa, Homo Sapiens
YCTLGGLTA

SEQ ID NO: 816017 - protein, 9 aa, Homo Sapiens
ELLNEKYGE

SEQ ID NO: 816018 - protein, 9 aa, Homo Sapiens
LFSALHIVS

SEQ ID NO: 816019 - protein, 9 aa, Homo Sapiens
PRRLIDRIQ

SEQ ID NO: 816020 - protein, 9 aa, Homo Sapiens
FQDIQDEGW

SEQ ID NO: 816021 - protein, 9 aa, Homo Sapiens
GPEKVKQLC

SEQ ID NO: 816022 - protein, 9 aa, Homo Sapiens
ILKMKVKKS

SEQ ID NO: 816023 - protein, 9 aa, Homo Sapiens
DLRNNFLNY

SEQ ID NO: 816024 - protein, 9 aa, Homo Sapiens
VLLMLNMFV

SEQ ID NO: 816025 - protein, 9 aa, Homo Sapiens
HKFILRNAN

SEQ ID NO: 816026 - protein, 9 aa, Homo Sapiens
SIVYLYKKL

SEQ ID NO: 816027 - protein, 9 aa, Homo Sapiens
RPVWTAEDQ

SEQ ID NO: 816028 - protein, 9 aa, Homo Sapiens
IPVYIMKIK

SEQ ID NO: 816029 - protein, 9 aa, Homo Sapiens
IRSCKAKQQ

SEQ ID NO: 816030 - protein, 9 aa, Homo Sapiens
QRCHTGKIP

SEQ ID NO: 816031 - protein, 9 aa, Homo Sapiens
LSKAQCEQS

SEQ ID NO: 816032 - protein, 9 aa, Homo Sapiens
KNSSKCEEC

SEQ ID NO: 816033 - protein, 9 aa, Homo Sapiens
VFKCHIRKY

SEQ ID NO: 816034 - protein, 9 aa, Homo Sapiens
TIIYKWNGN

SEQ ID NO: 816035 - protein, 9 aa, Homo Sapiens
KCEDLFMSG

SEQ ID NO: 816036 - protein, 9 aa, Homo Sapiens
GNLCHVATS

SEQ ID NO: 816037 - protein, 9 aa, Homo Sapiens
LEGLANQFF

SEQ ID NO: 816038 - protein, 9 aa, Homo Sapiens
KAFFFQDTP

SEQ ID NO: 816039 - protein, 9 aa, Homo Sapiens
LILSIHSCY

SEQ ID NO: 816040 - protein, 9 aa, Homo Sapiens
KEKGNGMKN

SEQ ID NO: 816041 - protein, 9 aa, Homo Sapiens
VPVFIQVPV

SEQ ID NO: 816042 - protein, 9 aa, Homo Sapiens
QKNLTVLNP

SEQ ID NO: 816043 - protein, 9 aa, Homo Sapiens
LRTSGGDGL

SEQ ID NO: 816044 - protein, 9 aa, Homo Sapiens
SQRKPQAGL

SEQ ID NO: 816045 - protein, 9 aa, Homo Sapiens
GKFDKLLEE

SEQ ID NO: 816046 - protein, 9 aa, Homo Sapiens
VILFLNKTN

SEQ ID NO: 816047 - protein, 9 aa, Homo Sapiens
IDCCVNLIN

SEQ ID NO: 816048 - protein, 9 aa, Homo Sapiens
QKTLVLIGN

SEQ ID NO: 816049 - protein, 9 aa, Homo Sapiens
VHSKLFTVD

SEQ ID NO: 816050 - protein, 9 aa, Homo Sapiens
FFQMKMTLN

SEQ ID NO: 816051 - protein, 9 aa, Homo Sapiens
LYEDAEAVL

SEQ ID NO: 816052 - protein, 9 aa, Homo Sapiens
SDPKSKLFE

SEQ ID NO: 816053 - protein, 9 aa, Homo Sapiens
EKLWDHTQC

SEQ ID NO: 816054 - protein, 9 aa, Homo Sapiens
WRELMSDPD

SEQ ID NO: 816055 - protein, 9 aa, Homo Sapiens
ENVQVLDLS

SEQ ID NO: 816056 - protein, 9 aa, Homo Sapiens
VTDVIRITG

SEQ ID NO: 816057 - protein, 9 aa, Homo Sapiens
DKYWLQFFI

SEQ ID NO: 816058 - protein, 9 aa, Homo Sapiens
RSQGNIMSY

SEQ ID NO: 816059 - protein, 9 aa, Homo Sapiens
RMARSSPYA

SEQ ID NO: 816060 - protein, 9 aa, Homo Sapiens
DKATVKDEP

SEQ ID NO: 816061 - protein, 9 aa, Homo Sapiens
TQRAKRDLP

SEQ ID NO: 816062 - protein, 9 aa, Homo Sapiens
RLPKARFVA

SEQ ID NO: 816063 - protein, 9 aa, Homo Sapiens
PPKFSNTPK

SEQ ID NO: 816064 - protein, 9 aa, Homo Sapiens
KKNTILYYE

SEQ ID NO: 816065 - protein, 9 aa, Homo Sapiens
VNVQNILHE

SEQ ID NO: 816066 - protein, 9 aa, Homo Sapiens
VIDQMKKFG

SEQ ID NO: 816067 - protein, 9 aa, Homo Sapiens
ICSTNFITY

SEQ ID NO: 816068 - protein, 9 aa, Homo Sapiens
FHVMRDKHP

SEQ ID NO: 816069 - protein, 9 aa, Homo Sapiens
QGKVVQIIV

SEQ ID NO: 816070 - protein, 9 aa, Homo Sapiens
KKLEDKTLE

SEQ ID NO: 816071 - protein, 9 aa, Homo Sapiens
RPDQTRGLL

SEQ ID NO: 816072 - protein, 9 aa, Homo Sapiens
SVGLALVSR

SEQ ID NO: 816073 - protein, 9 aa, Homo Sapiens
MSTTTVTVN

SEQ ID NO: 816074 - protein, 9 aa, Homo Sapiens
KKTRAMCRR

SEQ ID NO: 816075 - protein, 9 aa, Homo Sapiens
MDMEESIQR

SEQ ID NO: 816076 - protein, 9 aa, Homo Sapiens
VVIQQRKSY

SEQ ID NO: 816077 - protein, 9 aa, Homo Sapiens
TMHQIVISS

SEQ ID NO: 816078 - protein, 9 aa, Homo Sapiens
RCKELTPNY

SEQ ID NO: 816079 - protein, 9 aa, Homo Sapiens
SFSNAWLLV

SEQ ID NO: 816080 - protein, 9 aa, Homo Sapiens
RACPNNCRC

SEQ ID NO: 816081 - protein, 9 aa, Homo Sapiens
FSETDFVAK

SEQ ID NO: 816082 - protein, 9 aa, Homo Sapiens
DAFGIYLKW

SEQ ID NO: 816083 - protein, 9 aa, Homo Sapiens
GHVSFKLFA

SEQ ID NO: 816084 - protein, 9 aa, Homo Sapiens
YQHLFEACR

SEQ ID NO: 816085 - protein, 9 aa, Homo Sapiens
KHDEDRRFM

SEQ ID NO: 816086 - protein, 9 aa, Homo Sapiens
NEFMGHKQN

SEQ ID NO: 816087 - protein, 9 aa, Homo Sapiens
QMGEDGNYI

SEQ ID NO: 816088 - protein, 9 aa, Homo Sapiens
EWKPFKTII

SEQ ID NO: 816089 - protein, 9 aa, Homo Sapiens
PKIPKSTRQ

SEQ ID NO: 816090 - protein, 9 aa, Homo Sapiens
LRAGTGFSG

SEQ ID NO: 816091 - protein, 9 aa, Homo Sapiens
LKANSQRPF

SEQ ID NO: 816092 - protein, 9 aa, Homo Sapiens
QLPAPPNIY

SEQ ID NO: 816093 - protein, 9 aa, Homo Sapiens
IDINGIKPE

SEQ ID NO: 816094 - protein, 9 aa, Homo Sapiens
SRDRWRNPR

SEQ ID NO: 816095 - protein, 9 aa, Homo Sapiens
NTFKANSSS

SEQ ID NO: 816096 - protein, 9 aa, Homo Sapiens
VRAFLQTYF

SEQ ID NO: 816097 - protein, 9 aa, Homo Sapiens
AEQPYKCNE

SEQ ID NO: 816098 - protein, 9 aa, Homo Sapiens
VVMVSLFMG

SEQ ID NO: 816099 - protein, 9 aa, Homo Sapiens
SEVSLVREA

SEQ ID NO: 816100 - protein, 9 aa, Homo Sapiens
VCVYGDSCD

SEQ ID NO: 816101 - protein, 9 aa, Homo Sapiens
FPSGQPPHL

SEQ ID NO: 816102 - protein, 9 aa, Homo Sapiens
RAPFAMINV

SEQ ID NO: 816103 - protein, 9 aa, Homo Sapiens
ISGFNMGQS

SEQ ID NO: 816104 - protein, 9 aa, Homo Sapiens
DPIFYVSSI

SEQ ID NO: 816105 - protein, 9 aa, Homo Sapiens
KGDVSLTID

SEQ ID NO: 816106 - protein, 9 aa, Homo Sapiens
SFLKVIFTT

SEQ ID NO: 816107 - protein, 9 aa, Homo Sapiens
LSIIPNYRT

SEQ ID NO: 816108 - protein, 9 aa, Homo Sapiens
DVHNQIVIR

SEQ ID NO: 816109 - protein, 9 aa, Homo Sapiens
KISRNYVVL

SEQ ID NO: 816110 - protein, 9 aa, Homo Sapiens
TTQKWEAEP

SEQ ID NO: 816111 - protein, 9 aa, Homo Sapiens
FPTSIPVSG

SEQ ID NO: 816112 - protein, 9 aa, Homo Sapiens
RVKCSVTRI

SEQ ID NO: 816113 - protein, 9 aa, Homo Sapiens
YRVRGGSSG

SEQ ID NO: 816114 - protein, 9 aa, Homo Sapiens
GRYVCENCK

SEQ ID NO: 816115 - protein, 9 aa, Homo Sapiens
SGRFVIGGS

SEQ ID NO: 816116 - protein, 9 aa, Homo Sapiens
VLLKKANVH

SEQ ID NO: 816117 - protein, 9 aa, Homo Sapiens
HNKFHNRMY

SEQ ID NO: 816118 - protein, 9 aa, Homo Sapiens
KFLFTCLNF

SEQ ID NO: 816119 - protein, 9 aa, Homo Sapiens
ASAVVALIL

SEQ ID NO: 816120 - protein, 9 aa, Homo Sapiens
GYVGVEDLV

SEQ ID NO: 816121 - protein, 9 aa, Homo Sapiens
CKGSSTVCS

SEQ ID NO: 816122 - protein, 9 aa, Homo Sapiens
KPNEGSDGS

SEQ ID NO: 816123 - protein, 9 aa, Homo Sapiens
GHNECIGET

SEQ ID NO: 816124 - protein, 9 aa, Homo Sapiens
ERNPAKAFK

SEQ ID NO: 816125 - protein, 9 aa, Homo Sapiens
LPPGLPQNV

SEQ ID NO: 816126 - protein, 9 aa, Homo Sapiens
DTFAFCCAL

SEQ ID NO: 816127 - protein, 9 aa, Homo Sapiens
AEQQPSDKS

SEQ ID NO: 816128 - protein, 9 aa, Homo Sapiens
KDVLVQFKG

SEQ ID NO: 816129 - protein, 9 aa, Homo Sapiens
FLHYLVSAH

SEQ ID NO: 816130 - protein, 9 aa, Homo Sapiens
LHEITHLAG

SEQ ID NO: 816131 - protein, 9 aa, Homo Sapiens
TQGNDRLKL

SEQ ID NO: 816132 - protein, 9 aa, Homo Sapiens
SGNQLLGTF

SEQ ID NO: 816133 - protein, 9 aa, Homo Sapiens
EEMNEKTLD

SEQ ID NO: 816134 - protein, 9 aa, Homo Sapiens
YTIQENMRY

SEQ ID NO: 816135 - protein, 9 aa, Homo Sapiens
ASVTASGLE

SEQ ID NO: 816136 - protein, 9 aa, Homo Sapiens
EKAKKQGEG

SEQ ID NO: 816137 - protein, 9 aa, Homo Sapiens
KNRAFSICF

SEQ ID NO: 816138 - protein, 9 aa, Homo Sapiens
NKIIAATID

SEQ ID NO: 816139 - protein, 9 aa, Homo Sapiens
TVTDVDTSW

SEQ ID NO: 816140 - protein, 9 aa, Homo Sapiens
LPLPACLQW

SEQ ID NO: 816141 - protein, 9 aa, Homo Sapiens
GFNVEHLKA

SEQ ID NO: 816142 - protein, 9 aa, Homo Sapiens
CDVAEGTYK

SEQ ID NO: 816143 - protein, 9 aa, Homo Sapiens
VFCAVHLHS

SEQ ID NO: 816144 - protein, 9 aa, Homo Sapiens
EEDKADEGP

SEQ ID NO: 816145 - protein, 9 aa, Homo Sapiens
CRLCGNYNG

SEQ ID NO: 816146 - protein, 9 aa, Homo Sapiens
RVLEIKRRY

SEQ ID NO: 816147 - protein, 9 aa, Homo Sapiens
KALHAKLDT

SEQ ID NO: 816148 - protein, 9 aa, Homo Sapiens
IAGTVKWAD

SEQ ID NO: 816149 - protein, 9 aa, Homo Sapiens
MVLTMSTII

SEQ ID NO: 816150 - protein, 9 aa, Homo Sapiens
SKDKAATPI

SEQ ID NO: 816151 - protein, 9 aa, Homo Sapiens
ENLCSFTKD

SEQ ID NO: 816152 - protein, 9 aa, Homo Sapiens
EPLPSLEYL

SEQ ID NO: 816153 - protein, 9 aa, Homo Sapiens
SPVTPCSSR

SEQ ID NO: 816154 - protein, 9 aa, Homo Sapiens
IQLPKAAKT

SEQ ID NO: 816155 - protein, 9 aa, Homo Sapiens
TVDYYPNRT

SEQ ID NO: 816156 - protein, 9 aa, Homo Sapiens
TIAKAKQSH

SEQ ID NO: 816157 - protein, 9 aa, Homo Sapiens
DCNDFWEGI

SEQ ID NO: 816158 - protein, 9 aa, Homo Sapiens
INRLGKKGE

SEQ ID NO: 816159 - protein, 9 aa, Homo Sapiens
LLLLFLFWV

SEQ ID NO: 816160 - protein, 9 aa, Homo Sapiens
CPHKGRNFS

SEQ ID NO: 816161 - protein, 9 aa, Homo Sapiens
CIFRFGRQD

SEQ ID NO: 816162 - protein, 9 aa, Homo Sapiens
KFEDVYAGI

SEQ ID NO: 816163 - protein, 9 aa, Homo Sapiens
KNLNLVWEE

SEQ ID NO: 816164 - protein, 9 aa, Homo Sapiens
NFVDNRYGY

SEQ ID NO: 816165 - protein, 9 aa, Homo Sapiens
YFKKAVKAR

SEQ ID NO: 816166 - protein, 9 aa, Homo Sapiens
DRVIKGQTY

SEQ ID NO: 816167 - protein, 9 aa, Homo Sapiens
AICSMIWGA

SEQ ID NO: 816168 - protein, 9 aa, Homo Sapiens
RIAALKTID

SEQ ID NO: 816169 - protein, 9 aa, Homo Sapiens
ALGKHTERI

SEQ ID NO: 816170 - protein, 9 aa, Homo Sapiens
ACARLTCAP

SEQ ID NO: 816171 - protein, 9 aa, Homo Sapiens
VDDDNDNAP

SEQ ID NO: 816172 - protein, 9 aa, Homo Sapiens
IKISNPTEL

SEQ ID NO: 816173 - protein, 9 aa, Homo Sapiens
RLEGLANQF

SEQ ID NO: 816174 - protein, 9 aa, Homo Sapiens
KADYQAVND

SEQ ID NO: 816175 - protein, 9 aa, Homo Sapiens
SGTENAFEP

SEQ ID NO: 816176 - protein, 9 aa, Homo Sapiens
ENVVPNNRV

SEQ ID NO: 816177 - protein, 9 aa, Homo Sapiens
AECMILGTM

SEQ ID NO: 816178 - protein, 9 aa, Homo Sapiens
EIKNLKHNT

SEQ ID NO: 816179 - protein, 9 aa, Homo Sapiens
NGIIKGYII

SEQ ID NO: 816180 - protein, 9 aa, Homo Sapiens
YGKLLDPQE

SEQ ID NO: 816181 - protein, 9 aa, Homo Sapiens
AVVTEPWLT

SEQ ID NO: 816182 - protein, 9 aa, Homo Sapiens
VLKMTIRDD

SEQ ID NO: 816183 - protein, 9 aa, Homo Sapiens
RQLLMDSGL

SEQ ID NO: 816184 - protein, 9 aa, Homo Sapiens
QLRETVRNK

SEQ ID NO: 816185 - protein, 9 aa, Homo Sapiens
PYVEPPKYE

SEQ ID NO: 816186 - protein, 9 aa, Homo Sapiens
YGSSCLKSM

SEQ ID NO: 816187 - protein, 9 aa, Homo Sapiens
DSKEKRDLI

SEQ ID NO: 816188 - protein, 9 aa, Homo Sapiens
DCAQRNLYT

SEQ ID NO: 816189 - protein, 9 aa, Homo Sapiens
HKGHFIYNN

SEQ ID NO: 816190 - protein, 9 aa, Homo Sapiens
LLTVYLCDT

SEQ ID NO: 816191 - protein, 9 aa, Homo Sapiens
LEITGYTLD

SEQ ID NO: 816192 - protein, 9 aa, Homo Sapiens
DNLLFWLAC

SEQ ID NO: 816193 - protein, 9 aa, Homo Sapiens
RDVTMFFQN

SEQ ID NO: 816194 - protein, 9 aa, Homo Sapiens
FDGCGWNFP

SEQ ID NO: 816195 - protein, 9 aa, Homo Sapiens
LRSKCKINL

SEQ ID NO: 816196 - protein, 9 aa, Homo Sapiens
RSRCQKVEL

SEQ ID NO: 816197 - protein, 9 aa, Homo Sapiens
SETSRYNFH

SEQ ID NO: 816198 - protein, 9 aa, Homo Sapiens
RTPEKDKIY

SEQ ID NO: 816199 - protein, 9 aa, Homo Sapiens
YLQLRETVR

SEQ ID NO: 816200 - protein, 9 aa, Homo Sapiens
VPGYSFSPR

SEQ ID NO: 816201 - protein, 9 aa, Homo Sapiens
KCDKYILSK

SEQ ID NO: 816202 - protein, 9 aa, Homo Sapiens
EELFKQALK

SEQ ID NO: 816203 - protein, 9 aa, Homo Sapiens
LALWSILVN

SEQ ID NO: 816204 - protein, 9 aa, Homo Sapiens
FTATAHSAL

SEQ ID NO: 816205 - protein, 9 aa, Homo Sapiens
PQKRKKRDS

SEQ ID NO: 816206 - protein, 9 aa, Homo Sapiens
GNIIVYLYT

SEQ ID NO: 816207 - protein, 9 aa, Homo Sapiens
MASQLGKRY

SEQ ID NO: 816208 - protein, 9 aa, Homo Sapiens
NKTKENPLK

SEQ ID NO: 816209 - protein, 9 aa, Homo Sapiens
SSMVLRYRT

SEQ ID NO: 816210 - protein, 9 aa, Homo Sapiens
SVLGLELWS

SEQ ID NO: 816211 - protein, 9 aa, Homo Sapiens
KYFFPGLGY

SEQ ID NO: 816212 - protein, 9 aa, Homo Sapiens
AKHYLSTLG

SEQ ID NO: 816213 - protein, 9 aa, Homo Sapiens
MFPLKDAET

SEQ ID NO: 816214 - protein, 9 aa, Homo Sapiens
YTLRTESIN

SEQ ID NO: 816215 - protein, 9 aa, Homo Sapiens
IYSALMIRA

SEQ ID NO: 816216 - protein, 9 aa, Homo Sapiens
VTAYGDIKE

SEQ ID NO: 816217 - protein, 9 aa, Homo Sapiens
DINEFDPEE

SEQ ID NO: 816218 - protein, 9 aa, Homo Sapiens
RTIPSDNAV

SEQ ID NO: 816219 - protein, 9 aa, Homo Sapiens
VQEDAQPPG

SEQ ID NO: 816220 - protein, 9 aa, Homo Sapiens
LAKETLSEL

SEQ ID NO: 816221 - protein, 9 aa, Homo Sapiens
KDLRENGEV

SEQ ID NO: 816222 - protein, 9 aa, Homo Sapiens
HKIKFMKIG

SEQ ID NO: 816223 - protein, 9 aa, Homo Sapiens
WRAATPLLM

SEQ ID NO: 816224 - protein, 9 aa, Homo Sapiens
KNILRGFVS

SEQ ID NO: 816225 - protein, 9 aa, Homo Sapiens
QLPVRTFKL

SEQ ID NO: 816226 - protein, 9 aa, Homo Sapiens
EAINKKMQM

SEQ ID NO: 816227 - protein, 9 aa, Homo Sapiens
KLLEERAKA

SEQ ID NO: 816228 - protein, 9 aa, Homo Sapiens
PSTTGIWKQ

SEQ ID NO: 816229 - protein, 9 aa, Homo Sapiens
EENAYQMCL

SEQ ID NO: 816230 - protein, 9 aa, Homo Sapiens
DQCNTNCCQ

SEQ ID NO: 816231 - protein, 9 aa, Homo Sapiens
KYFGNYLFN

SEQ ID NO: 816232 - protein, 9 aa, Homo Sapiens
EKIQSRETS

SEQ ID NO: 816233 - protein, 9 aa, Homo Sapiens
VALACFLHS

SEQ ID NO: 816234 - protein, 9 aa, Homo Sapiens
PTYDLSKSG

SEQ ID NO: 816235 - protein, 9 aa, Homo Sapiens
IAVEDDNIL

SEQ ID NO: 816236 - protein, 9 aa, Homo Sapiens
TSLGGVTFL

SEQ ID NO: 816237 - protein, 9 aa, Homo Sapiens
TFESEDYCM

SEQ ID NO: 816238 - protein, 9 aa, Homo Sapiens
QRMRKMLQE

SEQ ID NO: 816239 - protein, 9 aa, Homo Sapiens
KRTGLKVDW

SEQ ID NO: 816240 - protein, 9 aa, Homo Sapiens
FKVIFGKVK

SEQ ID NO: 816241 - protein, 9 aa, Homo Sapiens
LEQSLDESR

SEQ ID NO: 816242 - protein, 9 aa, Homo Sapiens
RHNFARQDL

SEQ ID NO: 816243 - protein, 9 aa, Homo Sapiens
DRCTLPKHE

SEQ ID NO: 816244 - protein, 9 aa, Homo Sapiens
KTYYWDNAQ

SEQ ID NO: 816245 - protein, 9 aa, Homo Sapiens
VYGFLIDDI

SEQ ID NO: 816246 - protein, 9 aa, Homo Sapiens
YPLGICAEL

SEQ ID NO: 816247 - protein, 9 aa, Homo Sapiens
EASEPGEGL

SEQ ID NO: 816248 - protein, 9 aa, Homo Sapiens
ESIILIFAA

SEQ ID NO: 816249 - protein, 9 aa, Homo Sapiens
LLFAYVLIM

SEQ ID NO: 816250 - protein, 9 aa, Homo Sapiens
SSQLSTLSH

SEQ ID NO: 816251 - protein, 9 aa, Homo Sapiens
SEWSDKSEE

SEQ ID NO: 816252 - protein, 9 aa, Homo Sapiens
AQDQQVLQQ

SEQ ID NO: 816253 - protein, 9 aa, Homo Sapiens
VLLGNDTRT

SEQ ID NO: 816254 - protein, 9 aa, Homo Sapiens
LTDNGLMCP

SEQ ID NO: 816255 - protein, 9 aa, Homo Sapiens
VFGDIDTKP

SEQ ID NO: 816256 - protein, 9 aa, Homo Sapiens
HPKLLHCGH

SEQ ID NO: 816257 - protein, 9 aa, Homo Sapiens
RKSFHLFGG

SEQ ID NO: 816258 - protein, 9 aa, Homo Sapiens
YNVPDQADL

SEQ ID NO: 816259 - protein, 9 aa, Homo Sapiens
RIYIIQQPQ

SEQ ID NO: 816260 - protein, 9 aa, Homo Sapiens
PINDVLAEY

SEQ ID NO: 816261 - protein, 9 aa, Homo Sapiens
KNKVPAPCP

SEQ ID NO: 816262 - protein, 9 aa, Homo Sapiens
IKMKGLQEQ

SEQ ID NO: 816263 - protein, 9 aa, Homo Sapiens
SYCLAQQQL

SEQ ID NO: 816264 - protein, 9 aa, Homo Sapiens
KDGHLVNLN

SEQ ID NO: 816265 - protein, 9 aa, Homo Sapiens
VLAMSRRSW

SEQ ID NO: 816266 - protein, 9 aa, Homo Sapiens
KDDVEEDNN

SEQ ID NO: 816267 - protein, 9 aa, Homo Sapiens
KKGELMENY

SEQ ID NO: 816268 - protein, 9 aa, Homo Sapiens
NSYAQHSYV

SEQ ID NO: 816269 - protein, 9 aa, Homo Sapiens
MALSAQLLQ

SEQ ID NO: 816270 - protein, 9 aa, Homo Sapiens
VRGEPVWEP

SEQ ID NO: 816271 - protein, 9 aa, Homo Sapiens
LGGDSHILE

SEQ ID NO: 816272 - protein, 9 aa, Homo Sapiens
PRQISAISV

SEQ ID NO: 816273 - protein, 9 aa, Homo Sapiens
VNTSLQSAV

SEQ ID NO: 816274 - protein, 9 aa, Homo Sapiens
CRVIPWKQG

SEQ ID NO: 816275 - protein, 9 aa, Homo Sapiens
FVVYFDNTQ

SEQ ID NO: 816276 - protein, 9 aa, Homo Sapiens
EERTLETLL

SEQ ID NO: 816277 - protein, 9 aa, Homo Sapiens
PEEIVFLRA

SEQ ID NO: 816278 - protein, 9 aa, Homo Sapiens
ENHATFINE

SEQ ID NO: 816279 - protein, 9 aa, Homo Sapiens
APETTKTPA

SEQ ID NO: 816280 - protein, 9 aa, Homo Sapiens
PDQDTGYHS

SEQ ID NO: 816281 - protein, 9 aa, Homo Sapiens
GLSVGLGNI

SEQ ID NO: 816282 - protein, 9 aa, Homo Sapiens
VSAEIFLKL

SEQ ID NO: 816283 - protein, 9 aa, Homo Sapiens
MHTRMRPYT

SEQ ID NO: 816284 - protein, 9 aa, Homo Sapiens
KEDAAFTIY

SEQ ID NO: 816285 - protein, 9 aa, Homo Sapiens
KTEPYWSPA

SEQ ID NO: 816286 - protein, 9 aa, Homo Sapiens
YKITSTIDD

SEQ ID NO: 816287 - protein, 9 aa, Homo Sapiens
YTVADVISV

SEQ ID NO: 816288 - protein, 9 aa, Homo Sapiens
TLAFKLQHG

SEQ ID NO: 816289 - protein, 9 aa, Homo Sapiens
KQNKLLEPN

SEQ ID NO: 816290 - protein, 9 aa, Homo Sapiens
SPTLLSREL

SEQ ID NO: 816291 - protein, 9 aa, Homo Sapiens
SRGTTRPNG

SEQ ID NO: 816292 - protein, 9 aa, Homo Sapiens
SSKKLDFHL

SEQ ID NO: 816293 - protein, 9 aa, Homo Sapiens
HFYNDFVNI

SEQ ID NO: 816294 - protein, 9 aa, Homo Sapiens
KGSAGKMNG

SEQ ID NO: 816295 - protein, 9 aa, Homo Sapiens
RQYLWLKDC

SEQ ID NO: 816296 - protein, 9 aa, Homo Sapiens
MAVVILSVL

SEQ ID NO: 816297 - protein, 9 aa, Homo Sapiens
TLPCLSPDT

SEQ ID NO: 816298 - protein, 9 aa, Homo Sapiens
TPTLNYLIY

SEQ ID NO: 816299 - protein, 9 aa, Homo Sapiens
VLIQPLNRR

SEQ ID NO: 816300 - protein, 9 aa, Homo Sapiens
GVPVVVHKH

SEQ ID NO: 816301 - protein, 9 aa, Homo Sapiens
VKLVDCYVS

SEQ ID NO: 816302 - protein, 9 aa, Homo Sapiens
DLAWLYFKI

SEQ ID NO: 816303 - protein, 9 aa, Homo Sapiens
AEVLQAALG

SEQ ID NO: 816304 - protein, 9 aa, Homo Sapiens
FFLSETCTY

SEQ ID NO: 816305 - protein, 9 aa, Homo Sapiens
LTHIIAIVF

SEQ ID NO: 816306 - protein, 9 aa, Homo Sapiens
VSEDARLFT

SEQ ID NO: 816307 - protein, 9 aa, Homo Sapiens
RDRDRDRGR

SEQ ID NO: 816308 - protein, 9 aa, Homo Sapiens
GILFPDSKK

SEQ ID NO: 816309 - protein, 9 aa, Homo Sapiens
QTLCGSLCS

SEQ ID NO: 816310 - protein, 9 aa, Homo Sapiens
IYIRANRQL

SEQ ID NO: 816311 - protein, 9 aa, Homo Sapiens
ERNVNMSRV

SEQ ID NO: 816312 - protein, 9 aa, Homo Sapiens
IKDRLIKIL

SEQ ID NO: 816313 - protein, 9 aa, Homo Sapiens
CIDCNPAEK

SEQ ID NO: 816314 - protein, 9 aa, Homo Sapiens
DTLKEVDAT

SEQ ID NO: 816315 - protein, 9 aa, Homo Sapiens
KPLATDYND

SEQ ID NO: 816316 - protein, 9 aa, Homo Sapiens
PEQSFKKTK

SEQ ID NO: 816317 - protein, 9 aa, Homo Sapiens
AWCHQPPSH

SEQ ID NO: 816318 - protein, 9 aa, Homo Sapiens
NYDKWEMEH

SEQ ID NO: 816319 - protein, 9 aa, Homo Sapiens
HMWQSAGIS

SEQ ID NO: 816320 - protein, 9 aa, Homo Sapiens
KPYECHKCG

SEQ ID NO: 816321 - protein, 9 aa, Homo Sapiens
HLSRHEIIH

SEQ ID NO: 816322 - protein, 9 aa, Homo Sapiens
SGVSTFWNK

SEQ ID NO: 816323 - protein, 9 aa, Homo Sapiens
NSTQSHERT

SEQ ID NO: 816324 - protein, 9 aa, Homo Sapiens
QSKINEGYF

SEQ ID NO: 816325 - protein, 9 aa, Homo Sapiens
YLCPECGRW

SEQ ID NO: 816326 - protein, 9 aa, Homo Sapiens
QEYTPGNPP

SEQ ID NO: 816327 - protein, 9 aa, Homo Sapiens
YKHRTGSRL

SEQ ID NO: 816328 - protein, 9 aa, Homo Sapiens
DVKYAIGIS

SEQ ID NO: 816329 - protein, 9 aa, Homo Sapiens
HNMTAVVRL

SEQ ID NO: 816330 - protein, 9 aa, Homo Sapiens
IKALHAKLD

SEQ ID NO: 816331 - protein, 9 aa, Homo Sapiens
PPPVQRGAS

SEQ ID NO: 816332 - protein, 9 aa, Homo Sapiens
VSGGGATSQ

SEQ ID NO: 816333 - protein, 9 aa, Homo Sapiens
VFWMTGLFN

SEQ ID NO: 816334 - protein, 9 aa, Homo Sapiens
TLTNVNDNP

SEQ ID NO: 816335 - protein, 9 aa, Homo Sapiens
LESKNELEK

SEQ ID NO: 816336 - protein, 9 aa, Homo Sapiens
DSELESSIQ

SEQ ID NO: 816337 - protein, 9 aa, Homo Sapiens
KYLSNKAMP

SEQ ID NO: 816338 - protein, 9 aa, Homo Sapiens
TAAIAHIIA

SEQ ID NO: 816339 - protein, 9 aa, Homo Sapiens
QVEVQKVYE

SEQ ID NO: 816340 - protein, 9 aa, Homo Sapiens
EQRCTDHGS

SEQ ID NO: 816341 - protein, 9 aa, Homo Sapiens
GVYGFLIDD

SEQ ID NO: 816342 - protein, 9 aa, Homo Sapiens
AALFTLYNN

SEQ ID NO: 816343 - protein, 9 aa, Homo Sapiens
AVHVKAQEY

SEQ ID NO: 816344 - protein, 9 aa, Homo Sapiens
ADYNKIVET

SEQ ID NO: 816345 - protein, 9 aa, Homo Sapiens
HRFHVMRDK

SEQ ID NO: 816346 - protein, 9 aa, Homo Sapiens
YCLKRNPRS

SEQ ID NO: 816347 - protein, 9 aa, Homo Sapiens
DDLTRQKAK

SEQ ID NO: 816348 - protein, 9 aa, Homo Sapiens
DACWIIEDT

SEQ ID NO: 816349 - protein, 9 aa, Homo Sapiens
DNLGLLVSD

SEQ ID NO: 816350 - protein, 9 aa, Homo Sapiens
NLHFLGKLL

SEQ ID NO: 816351 - protein, 9 aa, Homo Sapiens
GSRSSSSSA

SEQ ID NO: 816352 - protein, 9 aa, Homo Sapiens
HIARKFVPF

SEQ ID NO: 816353 - protein, 9 aa, Homo Sapiens
RYGNYSLFT

SEQ ID NO: 816354 - protein, 9 aa, Homo Sapiens
LHWCIMPFW

SEQ ID NO: 816355 - protein, 9 aa, Homo Sapiens
RLTGLLTQH

SEQ ID NO: 816356 - protein, 9 aa, Homo Sapiens
VELQFKRKA

SEQ ID NO: 816357 - protein, 9 aa, Homo Sapiens
LLAKLKGLH

SEQ ID NO: 816358 - protein, 9 aa, Homo Sapiens
ERRSEKYSS

SEQ ID NO: 816359 - protein, 9 aa, Homo Sapiens
DAVCSKLKM

SEQ ID NO: 816360 - protein, 9 aa, Homo Sapiens
CGCNKGFTG

SEQ ID NO: 816361 - protein, 9 aa, Homo Sapiens
MEPNHPFYS

SEQ ID NO: 816362 - protein, 9 aa, Homo Sapiens
EDADEWQAS

SEQ ID NO: 816363 - protein, 9 aa, Homo Sapiens
KPSFVPGST

SEQ ID NO: 816364 - protein, 9 aa, Homo Sapiens
IHPGEKPFE

SEQ ID NO: 816365 - protein, 9 aa, Homo Sapiens
GLNISFVDC

SEQ ID NO: 816366 - protein, 9 aa, Homo Sapiens
TIGFGDIVL

SEQ ID NO: 816367 - protein, 9 aa, Homo Sapiens
PPRMSFPYC

SEQ ID NO: 816368 - protein, 9 aa, Homo Sapiens
HLKKIYTVQ

SEQ ID NO: 816369 - protein, 9 aa, Homo Sapiens
ANINRTLET

SEQ ID NO: 816370 - protein, 9 aa, Homo Sapiens
VLLDAIRFC

SEQ ID NO: 816371 - protein, 9 aa, Homo Sapiens
VDNLDEIIP

SEQ ID NO: 816372 - protein, 9 aa, Homo Sapiens
PEYTVADVI

SEQ ID NO: 816373 - protein, 9 aa, Homo Sapiens
EQLLKFITE

SEQ ID NO: 816374 - protein, 9 aa, Homo Sapiens
GKGTQVWKN

SEQ ID NO: 816375 - protein, 9 aa, Homo Sapiens
FYLYAQTSA

SEQ ID NO: 816376 - protein, 9 aa, Homo Sapiens
HQTIPRIRN

SEQ ID NO: 816377 - protein, 9 aa, Homo Sapiens
RSAEQQPSD

SEQ ID NO: 816378 - protein, 9 aa, Homo Sapiens
PMKPLPLVG

SEQ ID NO: 816379 - protein, 9 aa, Homo Sapiens
GRNIYEPPR

SEQ ID NO: 816380 - protein, 9 aa, Homo Sapiens
HMRFWAPGR

SEQ ID NO: 816381 - protein, 9 aa, Homo Sapiens
DGYYRTIQG

SEQ ID NO: 816382 - protein, 9 aa, Homo Sapiens
IITVKQVYF

SEQ ID NO: 816383 - protein, 9 aa, Homo Sapiens
LLMQLVLSC

SEQ ID NO: 816384 - protein, 9 aa, Homo Sapiens
DNLFRSCHA

SEQ ID NO: 816385 - protein, 9 aa, Homo Sapiens
RPASYWAQP

SEQ ID NO: 816386 - protein, 9 aa, Homo Sapiens
KKIDKILAK

SEQ ID NO: 816387 - protein, 9 aa, Homo Sapiens
LGATLSSTW

SEQ ID NO: 816388 - protein, 9 aa, Homo Sapiens
KGLSERVVD

SEQ ID NO: 816389 - protein, 9 aa, Homo Sapiens
HKQLVNSGY

SEQ ID NO: 816390 - protein, 9 aa, Homo Sapiens
EVQRYDNSA

SEQ ID NO: 816391 - protein, 9 aa, Homo Sapiens
VRRFKDLRF

SEQ ID NO: 816392 - protein, 9 aa, Homo Sapiens
IESSKVKLL

SEQ ID NO: 816393 - protein, 9 aa, Homo Sapiens
FIKDGFFYF

SEQ ID NO: 816394 - protein, 9 aa, Homo Sapiens
SSPSDSVHF

SEQ ID NO: 816395 - protein, 9 aa, Homo Sapiens
DTLFCQDLE

SEQ ID NO: 816396 - protein, 9 aa, Homo Sapiens
ISAQQEQTE

SEQ ID NO: 816397 - protein, 9 aa, Homo Sapiens
FKANSSSAW

SEQ ID NO: 816398 - protein, 9 aa, Homo Sapiens
LGMGLALFS

SEQ ID NO: 816399 - protein, 9 aa, Homo Sapiens
KFRDAETDQ

SEQ ID NO: 816400 - protein, 9 aa, Homo Sapiens
PLEPDYGTS

SEQ ID NO: 816401 - protein, 9 aa, Homo Sapiens
HMVPVSQPF

SEQ ID NO: 816402 - protein, 9 aa, Homo Sapiens
IALLVAKNI

SEQ ID NO: 816403 - protein, 9 aa, Homo Sapiens
AQNEIFDED

SEQ ID NO: 816404 - protein, 9 aa, Homo Sapiens
PGIEGHPVL

SEQ ID NO: 816405 - protein, 9 aa, Homo Sapiens
IQEFANLTR

SEQ ID NO: 816406 - protein, 9 aa, Homo Sapiens
FGTYFCVDF

SEQ ID NO: 816407 - protein, 9 aa, Homo Sapiens
NESKILQKD

SEQ ID NO: 816408 - protein, 9 aa, Homo Sapiens
ALVDDLTRQ

SEQ ID NO: 816409 - protein, 9 aa, Homo Sapiens
PACWDLTLF

SEQ ID NO: 816410 - protein, 9 aa, Homo Sapiens
DAPKMHTLQ

SEQ ID NO: 816411 - protein, 9 aa, Homo Sapiens
TVRQHHRQN

SEQ ID NO: 816412 - protein, 9 aa, Homo Sapiens
QIWDTVSWI

SEQ ID NO: 816413 - protein, 9 aa, Homo Sapiens
GEEQNNEEN

SEQ ID NO: 816414 - protein, 9 aa, Homo Sapiens
QKSNKKMVA

SEQ ID NO: 816415 - protein, 9 aa, Homo Sapiens
GAPGAAPGR

SEQ ID NO: 816416 - protein, 9 aa, Homo Sapiens
DISGQTGHN

SEQ ID NO: 816417 - protein, 9 aa, Homo Sapiens
PNGKSFCHE

SEQ ID NO: 816418 - protein, 9 aa, Homo Sapiens
DKGHAKHWF

SEQ ID NO: 816419 - protein, 9 aa, Homo Sapiens
NQYSYGSSS

SEQ ID NO: 816420 - protein, 9 aa, Homo Sapiens
FQNRRAKFC

SEQ ID NO: 816421 - protein, 9 aa, Homo Sapiens
NELFQGGPN

SEQ ID NO: 816422 - protein, 9 aa, Homo Sapiens
CAKRKKHLY

SEQ ID NO: 816423 - protein, 9 aa, Homo Sapiens
MDRLQGEEE

SEQ ID NO: 816424 - protein, 9 aa, Homo Sapiens
NELHPKIHY

SEQ ID NO: 816425 - protein, 9 aa, Homo Sapiens
TQKLTFYRP

SEQ ID NO: 816426 - protein, 9 aa, Homo Sapiens
PHGRCHGCL

SEQ ID NO: 816427 - protein, 9 aa, Homo Sapiens
GLLDGVRGV

SEQ ID NO: 816428 - protein, 9 aa, Homo Sapiens
PFTNLINLF

SEQ ID NO: 816429 - protein, 9 aa, Homo Sapiens
YTVITIAHR

SEQ ID NO: 816430 - protein, 9 aa, Homo Sapiens
ESFHPGSAS

SEQ ID NO: 816431 - protein, 9 aa, Homo Sapiens
DQIGSYLAE

SEQ ID NO: 816432 - protein, 9 aa, Homo Sapiens
HYKVYKDVL

SEQ ID NO: 816433 - protein, 9 aa, Homo Sapiens
IESKNTHGL

SEQ ID NO: 816434 - protein, 9 aa, Homo Sapiens
SSGGTRGCH

SEQ ID NO: 816435 - protein, 9 aa, Homo Sapiens
GIQRLNISI

SEQ ID NO: 816436 - protein, 9 aa, Homo Sapiens
DSQNPDPAV

SEQ ID NO: 816437 - protein, 9 aa, Homo Sapiens
DDPTNIQGK

SEQ ID NO: 816438 - protein, 9 aa, Homo Sapiens
NRSWGALGS

SEQ ID NO: 816439 - protein, 9 aa, Homo Sapiens
LELGGDSHI

SEQ ID NO: 816440 - protein, 9 aa, Homo Sapiens
ATTSVPIEV

SEQ ID NO: 816441 - protein, 9 aa, Homo Sapiens
SSVQSHERT

SEQ ID NO: 816442 - protein, 9 aa, Homo Sapiens
IRVHSSPAS

SEQ ID NO: 816443 - protein, 9 aa, Homo Sapiens
HDYLREAPD

SEQ ID NO: 816444 - protein, 9 aa, Homo Sapiens
EQQNTVLET

SEQ ID NO: 816445 - protein, 9 aa, Homo Sapiens
KLKNVDVNV

SEQ ID NO: 816446 - protein, 9 aa, Homo Sapiens
GNAGVVLFN

SEQ ID NO: 816447 - protein, 9 aa, Homo Sapiens
QTSDVNKLT

SEQ ID NO: 816448 - protein, 9 aa, Homo Sapiens
YIVQDSKLQ

SEQ ID NO: 816449 - protein, 9 aa, Homo Sapiens
FISLLQHNM

SEQ ID NO: 816450 - protein, 9 aa, Homo Sapiens
LLSYMISLT

SEQ ID NO: 816451 - protein, 9 aa, Homo Sapiens
SGATYVIYH

SEQ ID NO: 816452 - protein, 9 aa, Homo Sapiens
HACHCSEDC

SEQ ID NO: 816453 - protein, 9 aa, Homo Sapiens
HNINECDVE

SEQ ID NO: 816454 - protein, 9 aa, Homo Sapiens
VDIDDISVG

SEQ ID NO: 816455 - protein, 9 aa, Homo Sapiens
RTYVHVLTV

SEQ ID NO: 816456 - protein, 9 aa, Homo Sapiens
LRYYKAANI

SEQ ID NO: 816457 - protein, 9 aa, Homo Sapiens
PNVQKYLER

SEQ ID NO: 816458 - protein, 9 aa, Homo Sapiens
RKCCSNGCG

SEQ ID NO: 816459 - protein, 9 aa, Homo Sapiens
TPALHSATV

SEQ ID NO: 816460 - protein, 9 aa, Homo Sapiens
LQDLVDLVR

SEQ ID NO: 816461 - protein, 9 aa, Homo Sapiens
PALKIYKYH

SEQ ID NO: 816462 - protein, 9 aa, Homo Sapiens
YDDPTNIQG

SEQ ID NO: 816463 - protein, 9 aa, Homo Sapiens
VRGSLNVHN

SEQ ID NO: 816464 - protein, 9 aa, Homo Sapiens
IKIGVPQDN

SEQ ID NO: 816465 - protein, 9 aa, Homo Sapiens
AESLESSDD

SEQ ID NO: 816466 - protein, 9 aa, Homo Sapiens
QDSAPNSDE

SEQ ID NO: 816467 - protein, 9 aa, Homo Sapiens
VRWCDIQDG

SEQ ID NO: 816468 - protein, 9 aa, Homo Sapiens
LRKILLQKF

SEQ ID NO: 816469 - protein, 9 aa, Homo Sapiens
RIRRLLKHP

SEQ ID NO: 816470 - protein, 9 aa, Homo Sapiens
YLVKLESKG

SEQ ID NO: 816471 - protein, 9 aa, Homo Sapiens
IPNYRTKVL

SEQ ID NO: 816472 - protein, 9 aa, Homo Sapiens
SGTKQLLAN

SEQ ID NO: 816473 - protein, 9 aa, Homo Sapiens
LFPKGATWD

SEQ ID NO: 816474 - protein, 9 aa, Homo Sapiens
RAKLPNGSS

SEQ ID NO: 816475 - protein, 9 aa, Homo Sapiens
NSENRISTF

SEQ ID NO: 816476 - protein, 9 aa, Homo Sapiens
TCGNVAHTV

SEQ ID NO: 816477 - protein, 9 aa, Homo Sapiens
LLILIISMI

SEQ ID NO: 816478 - protein, 9 aa, Homo Sapiens
QKYYDDYRV

SEQ ID NO: 816479 - protein, 9 aa, Homo Sapiens
VRFAGCLHP

SEQ ID NO: 816480 - protein, 9 aa, Homo Sapiens
INPVHSKLF

SEQ ID NO: 816481 - protein, 9 aa, Homo Sapiens
DILERAIRA

SEQ ID NO: 816482 - protein, 9 aa, Homo Sapiens
PEVLSMESL

SEQ ID NO: 816483 - protein, 9 aa, Homo Sapiens
HKITRYTTE

SEQ ID NO: 816484 - protein, 9 aa, Homo Sapiens
TSVKGVSKK

SEQ ID NO: 816485 - protein, 9 aa, Homo Sapiens
YLMQILTER

SEQ ID NO: 816486 - protein, 9 aa, Homo Sapiens
WASFRRRRT

SEQ ID NO: 816487 - protein, 9 aa, Homo Sapiens
APDFLDSTS

SEQ ID NO: 816488 - protein, 9 aa, Homo Sapiens
SSPGSLDIP

SEQ ID NO: 816489 - protein, 9 aa, Homo Sapiens
QRGTLENYN

SEQ ID NO: 816490 - protein, 9 aa, Homo Sapiens
AEDATVEVS

SEQ ID NO: 816491 - protein, 9 aa, Homo Sapiens
HASRPTPAS

SEQ ID NO: 816492 - protein, 9 aa, Homo Sapiens
KKANVHRKA

SEQ ID NO: 816493 - protein, 9 aa, Homo Sapiens
RDLFLSDRH

SEQ ID NO: 816494 - protein, 9 aa, Homo Sapiens
SMEDYFQKV

SEQ ID NO: 816495 - protein, 9 aa, Homo Sapiens
PFLGAHKLY

SEQ ID NO: 816496 - protein, 9 aa, Homo Sapiens
RRNAPLAAG

SEQ ID NO: 816497 - protein, 9 aa, Homo Sapiens
IHFVLCVVF

SEQ ID NO: 816498 - protein, 9 aa, Homo Sapiens
KNYFISYSR

SEQ ID NO: 816499 - protein, 9 aa, Homo Sapiens
QGLGQSLAA

SEQ ID NO: 816500 - protein, 9 aa, Homo Sapiens
KGVASSQFL

SEQ ID NO: 816501 - protein, 9 aa, Homo Sapiens
YKEICNAFT

SEQ ID NO: 816502 - protein, 9 aa, Homo Sapiens
KRRIYDMTN

SEQ ID NO: 816503 - protein, 9 aa, Homo Sapiens
TTSTTLIYG

SEQ ID NO: 816504 - protein, 9 aa, Homo Sapiens
STISFGNVD

SEQ ID NO: 816505 - protein, 9 aa, Homo Sapiens
PEHAVQAYS

SEQ ID NO: 816506 - protein, 9 aa, Homo Sapiens
KLKYGWKKE

SEQ ID NO: 816507 - protein, 9 aa, Homo Sapiens
LLYLNDLKV

SEQ ID NO: 816508 - protein, 9 aa, Homo Sapiens
EIILNDNDL

SEQ ID NO: 816509 - protein, 9 aa, Homo Sapiens
DQMDNAKHM

SEQ ID NO: 816510 - protein, 9 aa, Homo Sapiens
YAHKVLLNI

SEQ ID NO: 816511 - protein, 9 aa, Homo Sapiens
IKTELLVQM

SEQ ID NO: 816512 - protein, 9 aa, Homo Sapiens
VHDNNIPGE

SEQ ID NO: 816513 - protein, 9 aa, Homo Sapiens
KLILGEITC

SEQ ID NO: 816514 - protein, 9 aa, Homo Sapiens
EWLITLKNI

SEQ ID NO: 816515 - protein, 9 aa, Homo Sapiens
APDIVGDIL

SEQ ID NO: 816516 - protein, 9 aa, Homo Sapiens
TYYWDNAQV

SEQ ID NO: 816517 - protein, 9 aa, Homo Sapiens
LFYVPKGTS

SEQ ID NO: 816518 - protein, 9 aa, Homo Sapiens
TILYYECMV

SEQ ID NO: 816519 - protein, 9 aa, Homo Sapiens
TSKTQTLPY

SEQ ID NO: 816520 - protein, 9 aa, Homo Sapiens
RLVVGYRKT

SEQ ID NO: 816521 - protein, 9 aa, Homo Sapiens
HGSKVQEQH

SEQ ID NO: 816522 - protein, 9 aa, Homo Sapiens
GLFAATFSA

SEQ ID NO: 816523 - protein, 9 aa, Homo Sapiens
ELSACSAYK

SEQ ID NO: 816524 - protein, 9 aa, Homo Sapiens
PLLKITDKY

SEQ ID NO: 816525 - protein, 9 aa, Homo Sapiens
PEMILKIKK

SEQ ID NO: 816526 - protein, 9 aa, Homo Sapiens
QRLIHKSID

SEQ ID NO: 816527 - protein, 9 aa, Homo Sapiens
LHEERGRFW

SEQ ID NO: 816528 - protein, 9 aa, Homo Sapiens
DVLNSRKLF

SEQ ID NO: 816529 - protein, 9 aa, Homo Sapiens
KHKAKPQND

SEQ ID NO: 816530 - protein, 9 aa, Homo Sapiens
LFCLYLVSR

SEQ ID NO: 816531 - protein, 9 aa, Homo Sapiens
NTSFEEWGK

SEQ ID NO: 816532 - protein, 9 aa, Homo Sapiens
IRTYWDAGF

SEQ ID NO: 816533 - protein, 9 aa, Homo Sapiens
PQLNVSQLL

SEQ ID NO: 816534 - protein, 9 aa, Homo Sapiens
IPVDYIVLI

SEQ ID NO: 816535 - protein, 9 aa, Homo Sapiens
YRRPLWVLR

SEQ ID NO: 816536 - protein, 9 aa, Homo Sapiens
ERASLQYEL

SEQ ID NO: 816537 - protein, 9 aa, Homo Sapiens
KSLIQVIGK

SEQ ID NO: 816538 - protein, 9 aa, Homo Sapiens
KDLGTEHSS

SEQ ID NO: 816539 - protein, 9 aa, Homo Sapiens
MQDKYVNIV

SEQ ID NO: 816540 - protein, 9 aa, Homo Sapiens
TSMDASSSK

SEQ ID NO: 816541 - protein, 9 aa, Homo Sapiens
QKVHRAFEA

SEQ ID NO: 816542 - protein, 9 aa, Homo Sapiens
NLSGTKNNF

SEQ ID NO: 816543 - protein, 9 aa, Homo Sapiens
IFAATLCAP

SEQ ID NO: 816544 - protein, 9 aa, Homo Sapiens
WKGQAVTLM

SEQ ID NO: 816545 - protein, 9 aa, Homo Sapiens
EDKFWMNKS

SEQ ID NO: 816546 - protein, 9 aa, Homo Sapiens
RCILTAGWR

SEQ ID NO: 816547 - protein, 9 aa, Homo Sapiens
FLGVAETAA

SEQ ID NO: 816548 - protein, 9 aa, Homo Sapiens
IMKDMLYAV

SEQ ID NO: 816549 - protein, 9 aa, Homo Sapiens
ILFGESAGA

SEQ ID NO: 816550 - protein, 9 aa, Homo Sapiens
PIFQANMNT

SEQ ID NO: 816551 - protein, 9 aa, Homo Sapiens
NAFWTIPGY

SEQ ID NO: 816552 - protein, 9 aa, Homo Sapiens
IRITGIYGL

SEQ ID NO: 816553 - protein, 9 aa, Homo Sapiens
YWDNAQVIL

SEQ ID NO: 816554 - protein, 9 aa, Homo Sapiens
PCKLREDCA

SEQ ID NO: 816555 - protein, 9 aa, Homo Sapiens
YVSSRAPQA

SEQ ID NO: 816556 - protein, 9 aa, Homo Sapiens
VCTVWYFPS

SEQ ID NO: 816557 - protein, 9 aa, Homo Sapiens
RTKGDIMID

SEQ ID NO: 816558 - protein, 9 aa, Homo Sapiens
SELRAFSSF

SEQ ID NO: 816559 - protein, 9 aa, Homo Sapiens
ESKVEQQDN

SEQ ID NO: 816560 - protein, 9 aa, Homo Sapiens
FIGWNINND

SEQ ID NO: 816561 - protein, 9 aa, Homo Sapiens
TAIISLPPG

SEQ ID NO: 816562 - protein, 9 aa, Homo Sapiens
MLRECIQHE

SEQ ID NO: 816563 - protein, 9 aa, Homo Sapiens
TASLQFDGA

SEQ ID NO: 816564 - protein, 9 aa, Homo Sapiens
TSYALFVRD

SEQ ID NO: 816565 - protein, 9 aa, Homo Sapiens
QAFTMAEMK

SEQ ID NO: 816566 - protein, 9 aa, Homo Sapiens
MTPTASGTM

SEQ ID NO: 816567 - protein, 9 aa, Homo Sapiens
IEKRQQGLQ

SEQ ID NO: 816568 - protein, 9 aa, Homo Sapiens
AQKNNKKRK

SEQ ID NO: 816569 - protein, 9 aa, Homo Sapiens
YQVPLDPTR

SEQ ID NO: 816570 - protein, 9 aa, Homo Sapiens
QATFPDNAV

SEQ ID NO: 816571 - protein, 9 aa, Homo Sapiens
TTPSTGSST

SEQ ID NO: 816572 - protein, 9 aa, Homo Sapiens
IPMLNLIMY

SEQ ID NO: 816573 - protein, 9 aa, Homo Sapiens
SHSPDAKED

SEQ ID NO: 816574 - protein, 9 aa, Homo Sapiens
IYKTGDIVD

SEQ ID NO: 816575 - protein, 9 aa, Homo Sapiens
EGFSSDGDL

SEQ ID NO: 816576 - protein, 9 aa, Homo Sapiens
EEENKAPTP

SEQ ID NO: 816577 - protein, 9 aa, Homo Sapiens
TVFPIMNLL

SEQ ID NO: 816578 - protein, 9 aa, Homo Sapiens
FSAFQELPA

SEQ ID NO: 816579 - protein, 9 aa, Homo Sapiens
PAPNNDFEI

SEQ ID NO: 816580 - protein, 9 aa, Homo Sapiens
MRLHFPIKP

SEQ ID NO: 816581 - protein, 9 aa, Homo Sapiens
QDTILACAP

SEQ ID NO: 816582 - protein, 9 aa, Homo Sapiens
GGTKVLLLL

SEQ ID NO: 816583 - protein, 9 aa, Homo Sapiens
MEQLKVSYT

SEQ ID NO: 816584 - protein, 9 aa, Homo Sapiens
HKSIWKAKF

SEQ ID NO: 816585 - protein, 9 aa, Homo Sapiens
AEELDNEDL

SEQ ID NO: 816586 - protein, 9 aa, Homo Sapiens
HQFTRQEWD

SEQ ID NO: 816587 - protein, 9 aa, Homo Sapiens
DKTDTLEHK

SEQ ID NO: 816588 - protein, 9 aa, Homo Sapiens
ELKVYEIDD

SEQ ID NO: 816589 - protein, 9 aa, Homo Sapiens
VSNNVTQMI

SEQ ID NO: 816590 - protein, 9 aa, Homo Sapiens
TSEENNLVK

SEQ ID NO: 816591 - protein, 9 aa, Homo Sapiens
LSQEEWKCL

SEQ ID NO: 816592 - protein, 9 aa, Homo Sapiens
NCMAIDKLS

SEQ ID NO: 816593 - protein, 9 aa, Homo Sapiens
PLELFAVVM

SEQ ID NO: 816594 - protein, 9 aa, Homo Sapiens
SQMLRGEKN

SEQ ID NO: 816595 - protein, 9 aa, Homo Sapiens
TRSELYLQD

SEQ ID NO: 816596 - protein, 9 aa, Homo Sapiens
DLHLYVLVS

SEQ ID NO: 816597 - protein, 9 aa, Homo Sapiens
KTLQITDVR

SEQ ID NO: 816598 - protein, 9 aa, Homo Sapiens
VLFGALAIF

SEQ ID NO: 816599 - protein, 9 aa, Homo Sapiens
LSRHQIIHT

SEQ ID NO: 816600 - protein, 9 aa, Homo Sapiens
IPLVMYLGF

SEQ ID NO: 816601 - protein, 9 aa, Homo Sapiens
FDDLFPVEP

SEQ ID NO: 816602 - protein, 9 aa, Homo Sapiens
GRVYLIMNS

SEQ ID NO: 816603 - protein, 9 aa, Homo Sapiens
ITCLIQLLN

SEQ ID NO: 816604 - protein, 9 aa, Homo Sapiens
SCIFPASWH

SEQ ID NO: 816605 - protein, 9 aa, Homo Sapiens
SYSQISLAD

SEQ ID NO: 816606 - protein, 9 aa, Homo Sapiens
PDMLIKIHI

SEQ ID NO: 816607 - protein, 9 aa, Homo Sapiens
VIYWQMVRP

SEQ ID NO: 816608 - protein, 9 aa, Homo Sapiens
PLALGGFYP

SEQ ID NO: 816609 - protein, 9 aa, Homo Sapiens
SWSSYLSLP

SEQ ID NO: 816610 - protein, 9 aa, Homo Sapiens
SLNSDVNNL

SEQ ID NO: 816611 - protein, 9 aa, Homo Sapiens
TEAVNKSLE

SEQ ID NO: 816612 - protein, 9 aa, Homo Sapiens
VHTRPSQRC

SEQ ID NO: 816613 - protein, 9 aa, Homo Sapiens
PASLSTFQQ

SEQ ID NO: 816614 - protein, 9 aa, Homo Sapiens
NATATINSL

SEQ ID NO: 816615 - protein, 9 aa, Homo Sapiens
VAAPGTADN

SEQ ID NO: 816616 - protein, 9 aa, Homo Sapiens
LQHTLQLQI

SEQ ID NO: 816617 - protein, 9 aa, Homo Sapiens
EYQKNNKDY

SEQ ID NO: 816618 - protein, 9 aa, Homo Sapiens
SVEKPYRCK

SEQ ID NO: 816619 - protein, 9 aa, Homo Sapiens
SFEINAFKL

SEQ ID NO: 816620 - protein, 9 aa, Homo Sapiens
AVTRISTED

SEQ ID NO: 816621 - protein, 9 aa, Homo Sapiens
HSEKQCRSK

SEQ ID NO: 816622 - protein, 9 aa, Homo Sapiens
NKVSKRSRK

SEQ ID NO: 816623 - protein, 9 aa, Homo Sapiens
EGAVLSFKC

SEQ ID NO: 816624 - protein, 9 aa, Homo Sapiens
LAQTTEWSA

SEQ ID NO: 816625 - protein, 9 aa, Homo Sapiens
REQHEDKPG

SEQ ID NO: 816626 - protein, 9 aa, Homo Sapiens
QRLGMIDAF

SEQ ID NO: 816627 - protein, 9 aa, Homo Sapiens
GREKKPRQH

SEQ ID NO: 816628 - protein, 9 aa, Homo Sapiens
SYFGLTGRD

SEQ ID NO: 816629 - protein, 9 aa, Homo Sapiens
SNAWLLVKN

SEQ ID NO: 816630 - protein, 9 aa, Homo Sapiens
LFCLPGFVF

SEQ ID NO: 816631 - protein, 9 aa, Homo Sapiens
GFQGAWATL

SEQ ID NO: 816632 - protein, 9 aa, Homo Sapiens
FSYDKTKDN

SEQ ID NO: 816633 - protein, 9 aa, Homo Sapiens
FIHYLPGCQ

SEQ ID NO: 816634 - protein, 9 aa, Homo Sapiens
WNTHADFAN

SEQ ID NO: 816635 - protein, 9 aa, Homo Sapiens
ASGKTSVKG

SEQ ID NO: 816636 - protein, 9 aa, Homo Sapiens
SSDVQITLP

SEQ ID NO: 816637 - protein, 9 aa, Homo Sapiens
ETAQTEPVV

SEQ ID NO: 816638 - protein, 9 aa, Homo Sapiens
PCQPFYQVC

SEQ ID NO: 816639 - protein, 9 aa, Homo Sapiens
DEANQEDKG

SEQ ID NO: 816640 - protein, 9 aa, Homo Sapiens
TSQSSTNQT

SEQ ID NO: 816641 - protein, 9 aa, Homo Sapiens
RCSYHKRKK

SEQ ID NO: 816642 - protein, 9 aa, Homo Sapiens
SNSNIYKIR

SEQ ID NO: 816643 - protein, 9 aa, Homo Sapiens
SDSLLLGKS

SEQ ID NO: 816644 - protein, 9 aa, Homo Sapiens
SKIFFLYMA

SEQ ID NO: 816645 - protein, 9 aa, Homo Sapiens
GENRAHFLP

SEQ ID NO: 816646 - protein, 9 aa, Homo Sapiens
CCVIGYPYY

SEQ ID NO: 816647 - protein, 9 aa, Homo Sapiens
RPSNEELQN

SEQ ID NO: 816648 - protein, 9 aa, Homo Sapiens
HYLVSQGKP

SEQ ID NO: 816649 - protein, 9 aa, Homo Sapiens
SLIIHQRNH

SEQ ID NO: 816650 - protein, 9 aa, Homo Sapiens
IQALYFCRP

SEQ ID NO: 816651 - protein, 9 aa, Homo Sapiens
LFEWERTGL

SEQ ID NO: 816652 - protein, 9 aa, Homo Sapiens
EEDDVKLLS

SEQ ID NO: 816653 - protein, 9 aa, Homo Sapiens
CLTKAHWFE

SEQ ID NO: 816654 - protein, 9 aa, Homo Sapiens
IENDPLFAR

SEQ ID NO: 816655 - protein, 9 aa, Homo Sapiens
ENKAPTPQE

SEQ ID NO: 816656 - protein, 9 aa, Homo Sapiens
ACNATNQII

SEQ ID NO: 816657 - protein, 9 aa, Homo Sapiens
TDFKRFVTT

SEQ ID NO: 816658 - protein, 9 aa, Homo Sapiens
LPPARPRIF

SEQ ID NO: 816659 - protein, 9 aa, Homo Sapiens
PDCGERFSQ

SEQ ID NO: 816660 - protein, 9 aa, Homo Sapiens
DVAYSTVRS

SEQ ID NO: 816661 - protein, 9 aa, Homo Sapiens
ILSYFFGAA

SEQ ID NO: 816662 - protein, 9 aa, Homo Sapiens
FWGLHWVME

SEQ ID NO: 816663 - protein, 9 aa, Homo Sapiens
CLEEKNKIL

SEQ ID NO: 816664 - protein, 9 aa, Homo Sapiens
GGCSEFCFN

SEQ ID NO: 816665 - protein, 9 aa, Homo Sapiens
ITHLAGRSQ

SEQ ID NO: 816666 - protein, 9 aa, Homo Sapiens
KSVLTDPAE

SEQ ID NO: 816667 - protein, 9 aa, Homo Sapiens
SSEKKREIS

SEQ ID NO: 816668 - protein, 9 aa, Homo Sapiens
GKNQLLEAV

SEQ ID NO: 816669 - protein, 9 aa, Homo Sapiens
DRGQGVLHA

SEQ ID NO: 816670 - protein, 9 aa, Homo Sapiens
SGHRSSSEP

SEQ ID NO: 816671 - protein, 9 aa, Homo Sapiens
GEVLIDTRL

SEQ ID NO: 816672 - protein, 9 aa, Homo Sapiens
GLVEFGTAI

SEQ ID NO: 816673 - protein, 9 aa, Homo Sapiens
CDKKGFYTK

SEQ ID NO: 816674 - protein, 9 aa, Homo Sapiens
LSTSALKGL

SEQ ID NO: 816675 - protein, 9 aa, Homo Sapiens
ELLTEKESK

SEQ ID NO: 816676 - protein, 9 aa, Homo Sapiens
LLGDMDCNE

SEQ ID NO: 816677 - protein, 9 aa, Homo Sapiens
GQQAWVLQE

SEQ ID NO: 816678 - protein, 9 aa, Homo Sapiens
VMGINLCDS

SEQ ID NO: 816679 - protein, 9 aa, Homo Sapiens
FFGFYWPKM

SEQ ID NO: 816680 - protein, 9 aa, Homo Sapiens
YHTIIGGIV

SEQ ID NO: 816681 - protein, 9 aa, Homo Sapiens
AEEDGDTGG

SEQ ID NO: 816682 - protein, 9 aa, Homo Sapiens
KKDNKVTWG

SEQ ID NO: 816683 - protein, 9 aa, Homo Sapiens
LNQNEENIL

SEQ ID NO: 816684 - protein, 9 aa, Homo Sapiens
DLMDKELLR

SEQ ID NO: 816685 - protein, 9 aa, Homo Sapiens
QRGLDIEEL

SEQ ID NO: 816686 - protein, 9 aa, Homo Sapiens
FVKVKDTHK

SEQ ID NO: 816687 - protein, 9 aa, Homo Sapiens
DGQVENLRL

SEQ ID NO: 816688 - protein, 9 aa, Homo Sapiens
TQICASYFS

SEQ ID NO: 816689 - protein, 9 aa, Homo Sapiens
LFSSVYEHL

SEQ ID NO: 816690 - protein, 9 aa, Homo Sapiens
KVFNQKAKL

SEQ ID NO: 816691 - protein, 9 aa, Homo Sapiens
RGRKRGICG

SEQ ID NO: 816692 - protein, 9 aa, Homo Sapiens
AEELFKQAL

SEQ ID NO: 816693 - protein, 9 aa, Homo Sapiens
YDKNKLVKA

SEQ ID NO: 816694 - protein, 9 aa, Homo Sapiens
NALLKYNGM

SEQ ID NO: 816695 - protein, 9 aa, Homo Sapiens
ESQILVLTE

SEQ ID NO: 816696 - protein, 9 aa, Homo Sapiens
SYSALSLLK

SEQ ID NO: 816697 - protein, 9 aa, Homo Sapiens
DKVELLDRL

SEQ ID NO: 816698 - protein, 9 aa, Homo Sapiens
AKAKQSHSE

SEQ ID NO: 816699 - protein, 9 aa, Homo Sapiens
FILTGEQIQ

SEQ ID NO: 816700 - protein, 9 aa, Homo Sapiens
WDARLCPHC

SEQ ID NO: 816701 - protein, 9 aa, Homo Sapiens
GMGDALNHM

SEQ ID NO: 816702 - protein, 9 aa, Homo Sapiens
PQGLSAQWK

SEQ ID NO: 816703 - protein, 9 aa, Homo Sapiens
SIKLKREYE

SEQ ID NO: 816704 - protein, 9 aa, Homo Sapiens
LQEVIDVES

SEQ ID NO: 816705 - protein, 9 aa, Homo Sapiens
RREHDAHIV

SEQ ID NO: 816706 - protein, 9 aa, Homo Sapiens
EKEDCVQIW

SEQ ID NO: 816707 - protein, 9 aa, Homo Sapiens
CKRGTGVHR

SEQ ID NO: 816708 - protein, 9 aa, Homo Sapiens
VHTESWSLR

SEQ ID NO: 816709 - protein, 9 aa, Homo Sapiens
TCFWGTVRL

SEQ ID NO: 816710 - protein, 9 aa, Homo Sapiens
PPPDNVQLV

SEQ ID NO: 816711 - protein, 9 aa, Homo Sapiens
SKYKIIYTG

SEQ ID NO: 816712 - protein, 9 aa, Homo Sapiens
VTVAKLTLD

SEQ ID NO: 816713 - protein, 9 aa, Homo Sapiens
EKCHPDTGA

SEQ ID NO: 816714 - protein, 9 aa, Homo Sapiens
QVKQHILIS

SEQ ID NO: 816715 - protein, 9 aa, Homo Sapiens
KNHGCQHVK

SEQ ID NO: 816716 - protein, 9 aa, Homo Sapiens
QLLTLIFSY

SEQ ID NO: 816717 - protein, 9 aa, Homo Sapiens
LVEDKVLCR

SEQ ID NO: 816718 - protein, 9 aa, Homo Sapiens
CAKHNSYYV

SEQ ID NO: 816719 - protein, 9 aa, Homo Sapiens
PNHWEYYLK

SEQ ID NO: 816720 - protein, 9 aa, Homo Sapiens
TEGLCASSP

SEQ ID NO: 816721 - protein, 9 aa, Homo Sapiens
ECWLEKLSS

SEQ ID NO: 816722 - protein, 9 aa, Homo Sapiens
LLCVCIMMN

SEQ ID NO: 816723 - protein, 9 aa, Homo Sapiens
MPKAEKNGV

SEQ ID NO: 816724 - protein, 9 aa, Homo Sapiens
ITQSGNFYT

SEQ ID NO: 816725 - protein, 9 aa, Homo Sapiens
KTPPTPKTP

SEQ ID NO: 816726 - protein, 9 aa, Homo Sapiens
DARTGAVDS

SEQ ID NO: 816727 - protein, 9 aa, Homo Sapiens
EPLYFPIRS

SEQ ID NO: 816728 - protein, 9 aa, Homo Sapiens
VGDGPHNRY

SEQ ID NO: 816729 - protein, 9 aa, Homo Sapiens
YTGANEYNN

SEQ ID NO: 816730 - protein, 9 aa, Homo Sapiens
TVSLIIHQG

SEQ ID NO: 816731 - protein, 9 aa, Homo Sapiens
NNLKFTIWD

SEQ ID NO: 816732 - protein, 9 aa, Homo Sapiens
KRITENASE

SEQ ID NO: 816733 - protein, 9 aa, Homo Sapiens
GNSVNLKNL

SEQ ID NO: 816734 - protein, 9 aa, Homo Sapiens
GTPELHLLL

SEQ ID NO: 816735 - protein, 9 aa, Homo Sapiens
NSSFVNFQM

SEQ ID NO: 816736 - protein, 9 aa, Homo Sapiens
EILARNLNV

SEQ ID NO: 816737 - protein, 9 aa, Homo Sapiens
PQIQIGQET

SEQ ID NO: 816738 - protein, 9 aa, Homo Sapiens
REQLEVTCT

SEQ ID NO: 816739 - protein, 9 aa, Homo Sapiens
MVSVPVFIQ

SEQ ID NO: 816740 - protein, 9 aa, Homo Sapiens
RHKEAQFRF

SEQ ID NO: 816741 - protein, 9 aa, Homo Sapiens
SNWGNLWWV

SEQ ID NO: 816742 - protein, 9 aa, Homo Sapiens
DPVMGTHTS

SEQ ID NO: 816743 - protein, 9 aa, Homo Sapiens
ETLPEEQLM

SEQ ID NO: 816744 - protein, 9 aa, Homo Sapiens
TMRTLGMGT

SEQ ID NO: 816745 - protein, 9 aa, Homo Sapiens
YLTHMVVVV

SEQ ID NO: 816746 - protein, 9 aa, Homo Sapiens
YINFNMSPG

SEQ ID NO: 816747 - protein, 9 aa, Homo Sapiens
NYLKVLAEV

SEQ ID NO: 816748 - protein, 9 aa, Homo Sapiens
QVVCDTKCN

SEQ ID NO: 816749 - protein, 9 aa, Homo Sapiens
EERKSSALK

SEQ ID NO: 816750 - protein, 9 aa, Homo Sapiens
QIYYKTLTL

SEQ ID NO: 816751 - protein, 9 aa, Homo Sapiens
MLYLVTIMG

SEQ ID NO: 816752 - protein, 9 aa, Homo Sapiens
LACEAINQM

SEQ ID NO: 816753 - protein, 9 aa, Homo Sapiens
IYYKSYMDT

SEQ ID NO: 816754 - protein, 9 aa, Homo Sapiens
CELVSEEPF

SEQ ID NO: 816755 - protein, 9 aa, Homo Sapiens
DYLTYKIDE

SEQ ID NO: 816756 - protein, 9 aa, Homo Sapiens
FKDKENSEC

SEQ ID NO: 816757 - protein, 9 aa, Homo Sapiens
LLWGPAFMV

SEQ ID NO: 816758 - protein, 9 aa, Homo Sapiens
VIMAVVILS

SEQ ID NO: 816759 - protein, 9 aa, Homo Sapiens
HFESKFKGR

SEQ ID NO: 816760 - protein, 9 aa, Homo Sapiens
GKISKYLSI

SEQ ID NO: 816761 - protein, 9 aa, Homo Sapiens
ENKAFKQLL

SEQ ID NO: 816762 - protein, 9 aa, Homo Sapiens
DQIPLGSVV

SEQ ID NO: 816763 - protein, 9 aa, Homo Sapiens
SQLEKMAVE

SEQ ID NO: 816764 - protein, 9 aa, Homo Sapiens
DAFTDLNNG

SEQ ID NO: 816765 - protein, 9 aa, Homo Sapiens
WTIILHFAI

SEQ ID NO: 816766 - protein, 9 aa, Homo Sapiens
DDNILPLNS

SEQ ID NO: 816767 - protein, 9 aa, Homo Sapiens
QGRKEHTLF

SEQ ID NO: 816768 - protein, 9 aa, Homo Sapiens
SFFYHYMLT

SEQ ID NO: 816769 - protein, 9 aa, Homo Sapiens
SGATLIRDQ

SEQ ID NO: 816770 - protein, 9 aa, Homo Sapiens
VYLLQPAQG

SEQ ID NO: 816771 - protein, 9 aa, Homo Sapiens
MSALYSLIQ

SEQ ID NO: 816772 - protein, 9 aa, Homo Sapiens
VCCCHLPLM

SEQ ID NO: 816773 - protein, 9 aa, Homo Sapiens
SILIDKSTQ

SEQ ID NO: 816774 - protein, 9 aa, Homo Sapiens
STSALKGLT

SEQ ID NO: 816775 - protein, 9 aa, Homo Sapiens
KIIHKNLNL

SEQ ID NO: 816776 - protein, 9 aa, Homo Sapiens
SAPQTLEVI

SEQ ID NO: 816777 - protein, 9 aa, Homo Sapiens
TCAHTINSS

SEQ ID NO: 816778 - protein, 9 aa, Homo Sapiens
DQGCVQIIL

SEQ ID NO: 816779 - protein, 9 aa, Homo Sapiens
EPLDEAHDD

SEQ ID NO: 816780 - protein, 9 aa, Homo Sapiens
ANHEKLQEA

SEQ ID NO: 816781 - protein, 9 aa, Homo Sapiens
MAHIGVGIS

SEQ ID NO: 816782 - protein, 9 aa, Homo Sapiens
RKDEVSILS

SEQ ID NO: 816783 - protein, 9 aa, Homo Sapiens
YFKTPKEIT

SEQ ID NO: 816784 - protein, 9 aa, Homo Sapiens
NIIHTGEKP

SEQ ID NO: 816785 - protein, 9 aa, Homo Sapiens
RHKYVNVRV

SEQ ID NO: 816786 - protein, 9 aa, Homo Sapiens
EGITLDLFP

SEQ ID NO: 816787 - protein, 9 aa, Homo Sapiens
WRNPWRCSY

SEQ ID NO: 816788 - protein, 9 aa, Homo Sapiens
GVIVFNNDD

SEQ ID NO: 816789 - protein, 9 aa, Homo Sapiens
KLSTDLDRP

SEQ ID NO: 816790 - protein, 9 aa, Homo Sapiens
LSESFSSLF

SEQ ID NO: 816791 - protein, 9 aa, Homo Sapiens
TYTYNSGIH

SEQ ID NO: 816792 - protein, 9 aa, Homo Sapiens
IHGQVLYTD

SEQ ID NO: 816793 - protein, 9 aa, Homo Sapiens
LDNLKIKNT

SEQ ID NO: 816794 - protein, 9 aa, Homo Sapiens
LVTAYGDIK

SEQ ID NO: 816795 - protein, 9 aa, Homo Sapiens
THKSIWKAK

SEQ ID NO: 816796 - protein, 9 aa, Homo Sapiens
KVLDCDIIK

SEQ ID NO: 816797 - protein, 9 aa, Homo Sapiens
VGQMSLSRQ

SEQ ID NO: 816798 - protein, 9 aa, Homo Sapiens
ARNKRIKNQ

SEQ ID NO: 816799 - protein, 9 aa, Homo Sapiens
GEDNDEQGN

SEQ ID NO: 816800 - protein, 9 aa, Homo Sapiens
RDFGIWMLE

SEQ ID NO: 816801 - protein, 9 aa, Homo Sapiens
DSSEPADFK

SEQ ID NO: 816802 - protein, 9 aa, Homo Sapiens
KYLETRPTQ

SEQ ID NO: 816803 - protein, 9 aa, Homo Sapiens
SGKNKELSA

SEQ ID NO: 816804 - protein, 9 aa, Homo Sapiens
AIDDQDLNK

SEQ ID NO: 816805 - protein, 9 aa, Homo Sapiens
KEDILESSK

SEQ ID NO: 816806 - protein, 9 aa, Homo Sapiens
RRARMHERI

SEQ ID NO: 816807 - protein, 9 aa, Homo Sapiens
TSRKMIPER

SEQ ID NO: 816808 - protein, 9 aa, Homo Sapiens
DKVLCRVHY

SEQ ID NO: 816809 - protein, 9 aa, Homo Sapiens
LLFVPCIFL

SEQ ID NO: 816810 - protein, 9 aa, Homo Sapiens
GELKKMKKN

SEQ ID NO: 816811 - protein, 9 aa, Homo Sapiens
EDIDEPPVL

SEQ ID NO: 816812 - protein, 9 aa, Homo Sapiens
LLFVPCIFV

SEQ ID NO: 816813 - protein, 9 aa, Homo Sapiens
KVVRLKPAI

SEQ ID NO: 816814 - protein, 9 aa, Homo Sapiens
FKDEVAKST

SEQ ID NO: 816815 - protein, 9 aa, Homo Sapiens
KKFWGKIRI

SEQ ID NO: 816816 - protein, 9 aa, Homo Sapiens
SNAFNGTTL

SEQ ID NO: 816817 - protein, 9 aa, Homo Sapiens
THIIAIVFF

SEQ ID NO: 816818 - protein, 9 aa, Homo Sapiens
PYKCTECEQ

SEQ ID NO: 816819 - protein, 9 aa, Homo Sapiens
LAEEEKLWK

SEQ ID NO: 816820 - protein, 9 aa, Homo Sapiens
CNATNQIIS

SEQ ID NO: 816821 - protein, 9 aa, Homo Sapiens
TYSQASELS

SEQ ID NO: 816822 - protein, 9 aa, Homo Sapiens
KELFLLQKT

SEQ ID NO: 816823 - protein, 9 aa, Homo Sapiens
YTWKTSLWN

SEQ ID NO: 816824 - protein, 9 aa, Homo Sapiens
EFGKQCNLS

SEQ ID NO: 816825 - protein, 9 aa, Homo Sapiens
RYPDIKEEL

SEQ ID NO: 816826 - protein, 9 aa, Homo Sapiens
PGLMNNASS

SEQ ID NO: 816827 - protein, 9 aa, Homo Sapiens
GPGMVADAE

SEQ ID NO: 816828 - protein, 9 aa, Homo Sapiens
YVKIINYII

SEQ ID NO: 816829 - protein, 9 aa, Homo Sapiens
PQNLPLSTF

SEQ ID NO: 816830 - protein, 9 aa, Homo Sapiens
LSLLEEVMM

SEQ ID NO: 816831 - protein, 9 aa, Homo Sapiens
SKIKHLRKD

SEQ ID NO: 816832 - protein, 9 aa, Homo Sapiens
LVNRWLNEN

SEQ ID NO: 816833 - protein, 9 aa, Homo Sapiens
LRDAVQVNL

SEQ ID NO: 816834 - protein, 9 aa, Homo Sapiens
PWFPSDLYD

SEQ ID NO: 816835 - protein, 9 aa, Homo Sapiens
IEDNKVRQY

SEQ ID NO: 816836 - protein, 9 aa, Homo Sapiens
KHIHDRTIL

SEQ ID NO: 816837 - protein, 9 aa, Homo Sapiens
RYMIVSFWF

SEQ ID NO: 816838 - protein, 9 aa, Homo Sapiens
FQTEGNIYE

SEQ ID NO: 816839 - protein, 9 aa, Homo Sapiens
LEWRGEGKA

SEQ ID NO: 816840 - protein, 9 aa, Homo Sapiens
RKSPTKKEK

SEQ ID NO: 816841 - protein, 9 aa, Homo Sapiens
PEFSLDSTM

SEQ ID NO: 816842 - protein, 9 aa, Homo Sapiens
MKRGHLPSS

SEQ ID NO: 816843 - protein, 9 aa, Homo Sapiens
YSKSSTYSA

SEQ ID NO: 816844 - protein, 9 aa, Homo Sapiens
YKNKDVPKK

SEQ ID NO: 816845 - protein, 9 aa, Homo Sapiens
EDNKRWETN

SEQ ID NO: 816846 - protein, 9 aa, Homo Sapiens
PRYIKWTQI

SEQ ID NO: 816847 - protein, 9 aa, Homo Sapiens
HDCEEASKA

SEQ ID NO: 816848 - protein, 9 aa, Homo Sapiens
KLAFAVEPS

SEQ ID NO: 816849 - protein, 9 aa, Homo Sapiens
QCNFDELNA

SEQ ID NO: 816850 - protein, 9 aa, Homo Sapiens
NKKSTFEDS

SEQ ID NO: 816851 - protein, 9 aa, Homo Sapiens
ACSLDTSTC

SEQ ID NO: 816852 - protein, 9 aa, Homo Sapiens
IPEDRIQNI

SEQ ID NO: 816853 - protein, 9 aa, Homo Sapiens
DNLHRTFVF

SEQ ID NO: 816854 - protein, 9 aa, Homo Sapiens
FFPDGAHWQ

SEQ ID NO: 816855 - protein, 9 aa, Homo Sapiens
LNTAYTYAT

SEQ ID NO: 816856 - protein, 9 aa, Homo Sapiens
HDQVPDLKD

SEQ ID NO: 816857 - protein, 9 aa, Homo Sapiens
ECREKRREE

SEQ ID NO: 816858 - protein, 9 aa, Homo Sapiens
PDIIPPGPD

SEQ ID NO: 816859 - protein, 9 aa, Homo Sapiens
WEHQWNVVA

SEQ ID NO: 816860 - protein, 9 aa, Homo Sapiens
SHLETTKMN

SEQ ID NO: 816861 - protein, 9 aa, Homo Sapiens
LLEEVMMKS

SEQ ID NO: 816862 - protein, 9 aa, Homo Sapiens
RDAFRESDT

SEQ ID NO: 816863 - protein, 9 aa, Homo Sapiens
FDKTICHYL

SEQ ID NO: 816864 - protein, 9 aa, Homo Sapiens
DIKAIDGLD

SEQ ID NO: 816865 - protein, 9 aa, Homo Sapiens
LGTTPITPT

SEQ ID NO: 816866 - protein, 9 aa, Homo Sapiens
EKMNVNIPE

SEQ ID NO: 816867 - protein, 9 aa, Homo Sapiens
FSPRDVSSL

SEQ ID NO: 816868 - protein, 9 aa, Homo Sapiens
ETLTKQLSD

SEQ ID NO: 816869 - protein, 9 aa, Homo Sapiens
LSREKMDLT

SEQ ID NO: 816870 - protein, 9 aa, Homo Sapiens
TAAHIALLV

SEQ ID NO: 816871 - protein, 9 aa, Homo Sapiens
TQSQGRVPC

SEQ ID NO: 816872 - protein, 9 aa, Homo Sapiens
GANNYFEHE

SEQ ID NO: 816873 - protein, 9 aa, Homo Sapiens
SPNSLDPLK

SEQ ID NO: 816874 - protein, 9 aa, Homo Sapiens
LSNNSTSKR

SEQ ID NO: 816875 - protein, 9 aa, Homo Sapiens
LVLGAMVHR

SEQ ID NO: 816876 - protein, 9 aa, Homo Sapiens
DFANECPKP

SEQ ID NO: 816877 - protein, 9 aa, Homo Sapiens
TMAEMKVVL

SEQ ID NO: 816878 - protein, 9 aa, Homo Sapiens
ALVFLFTLL

SEQ ID NO: 816879 - protein, 9 aa, Homo Sapiens
FIWRRDVQW

SEQ ID NO: 816880 - protein, 9 aa, Homo Sapiens
CEPFKCLEP

SEQ ID NO: 816881 - protein, 9 aa, Homo Sapiens
EEEQDQHMV

SEQ ID NO: 816882 - protein, 9 aa, Homo Sapiens
TSSRARSFS

SEQ ID NO: 816883 - protein, 9 aa, Homo Sapiens
RENKINISK

SEQ ID NO: 816884 - protein, 9 aa, Homo Sapiens
QIGSYLAER

SEQ ID NO: 816885 - protein, 9 aa, Homo Sapiens
FKPVQVQQY

SEQ ID NO: 816886 - protein, 9 aa, Homo Sapiens
WDTIPPDWV

SEQ ID NO: 816887 - protein, 9 aa, Homo Sapiens
VRNYSEAKS

SEQ ID NO: 816888 - protein, 9 aa, Homo Sapiens
IMKYLIKVA

SEQ ID NO: 816889 - protein, 9 aa, Homo Sapiens
NRLESQGVR

SEQ ID NO: 816890 - protein, 9 aa, Homo Sapiens
GFLFAIFII

SEQ ID NO: 816891 - protein, 9 aa, Homo Sapiens
IFAVFIVCW

SEQ ID NO: 816892 - protein, 9 aa, Homo Sapiens
QHVDVKINN

SEQ ID NO: 816893 - protein, 9 aa, Homo Sapiens
QGEDEIRLR

SEQ ID NO: 816894 - protein, 9 aa, Homo Sapiens
KLASNARTE

SEQ ID NO: 816895 - protein, 9 aa, Homo Sapiens
RGNTFECDC

SEQ ID NO: 816896 - protein, 9 aa, Homo Sapiens
GSLLFSTSK

SEQ ID NO: 816897 - protein, 9 aa, Homo Sapiens
NSWNSYSAL

SEQ ID NO: 816898 - protein, 9 aa, Homo Sapiens
LQNVMWFLL

SEQ ID NO: 816899 - protein, 9 aa, Homo Sapiens
VKVQGQWGT

SEQ ID NO: 816900 - protein, 9 aa, Homo Sapiens
PPSWRELMS

SEQ ID NO: 816901 - protein, 9 aa, Homo Sapiens
QLRKEHEKQ

SEQ ID NO: 816902 - protein, 9 aa, Homo Sapiens
GYFGGVGSQ

SEQ ID NO: 816903 - protein, 9 aa, Homo Sapiens
NSVDGLLNA

SEQ ID NO: 816904 - protein, 9 aa, Homo Sapiens
APLVVEPTL

SEQ ID NO: 816905 - protein, 9 aa, Homo Sapiens
QHVKYGQCW

SEQ ID NO: 816906 - protein, 9 aa, Homo Sapiens
QQTQQELQR

SEQ ID NO: 816907 - protein, 9 aa, Homo Sapiens
SMDYFPPPP

SEQ ID NO: 816908 - protein, 9 aa, Homo Sapiens
DSGGIAEAG

SEQ ID NO: 816909 - protein, 9 aa, Homo Sapiens
LRPSIAGLD

SEQ ID NO: 816910 - protein, 9 aa, Homo Sapiens
NNEIDIDAF

SEQ ID NO: 816911 - protein, 9 aa, Homo Sapiens
AFVSGSDDA

SEQ ID NO: 816912 - protein, 9 aa, Homo Sapiens
QSYGIFWYK

SEQ ID NO: 816913 - protein, 9 aa, Homo Sapiens
HRSGRSYPH

SEQ ID NO: 816914 - protein, 9 aa, Homo Sapiens
HSPSPGLSH

SEQ ID NO: 816915 - protein, 9 aa, Homo Sapiens
YQGFTSGNL

SEQ ID NO: 816916 - protein, 9 aa, Homo Sapiens
RVLLLQFVM

SEQ ID NO: 816917 - protein, 9 aa, Homo Sapiens
EERCNMPLT

SEQ ID NO: 816918 - protein, 9 aa, Homo Sapiens
NLHVKVKGY

SEQ ID NO: 816919 - protein, 9 aa, Homo Sapiens
GDITLVELQ

SEQ ID NO: 816920 - protein, 9 aa, Homo Sapiens
SDQREALSN

SEQ ID NO: 816921 - protein, 9 aa, Homo Sapiens
HIYKYQGGH

SEQ ID NO: 816922 - protein, 9 aa, Homo Sapiens
SFMWPNITP

SEQ ID NO: 816923 - protein, 9 aa, Homo Sapiens
SRCCVPVCC

SEQ ID NO: 816924 - protein, 9 aa, Homo Sapiens
NQIHAANVT

SEQ ID NO: 816925 - protein, 9 aa, Homo Sapiens
SIVRLKTSM

SEQ ID NO: 816926 - protein, 9 aa, Homo Sapiens
ELEYTCAKC

SEQ ID NO: 816927 - protein, 9 aa, Homo Sapiens
GHFDYIGHS

SEQ ID NO: 816928 - protein, 9 aa, Homo Sapiens
EADKMFLIT

SEQ ID NO: 816929 - protein, 9 aa, Homo Sapiens
SLMGVLLQW

SEQ ID NO: 816930 - protein, 9 aa, Homo Sapiens
LHNDPHLET

SEQ ID NO: 816931 - protein, 9 aa, Homo Sapiens
MTTEVTSKV

SEQ ID NO: 816932 - protein, 9 aa, Homo Sapiens
SNLPLYISI

SEQ ID NO: 816933 - protein, 9 aa, Homo Sapiens
ILDEFSFLQ

SEQ ID NO: 816934 - protein, 9 aa, Homo Sapiens
SQMVLLPSY

SEQ ID NO: 816935 - protein, 9 aa, Homo Sapiens
HLQTPMYLF

SEQ ID NO: 816936 - protein, 9 aa, Homo Sapiens
ALIVLLGTV

SEQ ID NO: 816937 - protein, 9 aa, Homo Sapiens
TYAAVKHSR

SEQ ID NO: 816938 - protein, 9 aa, Homo Sapiens
DEKISTMGK

SEQ ID NO: 816939 - protein, 9 aa, Homo Sapiens
RRFIIRWCL

SEQ ID NO: 816940 - protein, 9 aa, Homo Sapiens
ENKEYAHTL

SEQ ID NO: 816941 - protein, 9 aa, Homo Sapiens
LEKLIELEN

SEQ ID NO: 816942 - protein, 9 aa, Homo Sapiens
ATSDPCAMN

SEQ ID NO: 816943 - protein, 9 aa, Homo Sapiens
VDLSKLPSM

SEQ ID NO: 816944 - protein, 9 aa, Homo Sapiens
LGLELYPVP

SEQ ID NO: 816945 - protein, 9 aa, Homo Sapiens
QRAMSTTEL

SEQ ID NO: 816946 - protein, 9 aa, Homo Sapiens
SAFARHRII

SEQ ID NO: 816947 - protein, 9 aa, Homo Sapiens
FSNSGFSRF

SEQ ID NO: 816948 - protein, 9 aa, Homo Sapiens
ARDNQHQDE

SEQ ID NO: 816949 - protein, 9 aa, Homo Sapiens
HTTEILRLF

SEQ ID NO: 816950 - protein, 9 aa, Homo Sapiens
TSGDLYNVL

SEQ ID NO: 816951 - protein, 9 aa, Homo Sapiens
ILSNWGNLW

SEQ ID NO: 816952 - protein, 9 aa, Homo Sapiens
DIYEFIWTE

SEQ ID NO: 816953 - protein, 9 aa, Homo Sapiens
KNKINNGTS

SEQ ID NO: 816954 - protein, 9 aa, Homo Sapiens
FLATTSNSL

SEQ ID NO: 816955 - protein, 9 aa, Homo Sapiens
CSHDSYNRA

SEQ ID NO: 816956 - protein, 9 aa, Homo Sapiens
PISHVRLWV

SEQ ID NO: 816957 - protein, 9 aa, Homo Sapiens
WTLLFTSEG

SEQ ID NO: 816958 - protein, 9 aa, Homo Sapiens
LHWEDFNVF

SEQ ID NO: 816959 - protein, 9 aa, Homo Sapiens
NRKCKKEEL

SEQ ID NO: 816960 - protein, 9 aa, Homo Sapiens
SLRRRATAL

SEQ ID NO: 816961 - protein, 9 aa, Homo Sapiens
NVAYSLLKT

SEQ ID NO: 816962 - protein, 9 aa, Homo Sapiens
IGGGRKPQG

SEQ ID NO: 816963 - protein, 9 aa, Homo Sapiens
FPVFDLSYL

SEQ ID NO: 816964 - protein, 9 aa, Homo Sapiens
SEVDCCGEH

SEQ ID NO: 816965 - protein, 9 aa, Homo Sapiens
KLTYLPYYM

SEQ ID NO: 816966 - protein, 9 aa, Homo Sapiens
IYKIRHTKK

SEQ ID NO: 816967 - protein, 9 aa, Homo Sapiens
RQGQDVVPP

SEQ ID NO: 816968 - protein, 9 aa, Homo Sapiens
TPACKNLDT

SEQ ID NO: 816969 - protein, 9 aa, Homo Sapiens
DFDDRRGVL

SEQ ID NO: 816970 - protein, 9 aa, Homo Sapiens
AAFILDHHC

SEQ ID NO: 816971 - protein, 9 aa, Homo Sapiens
AIAVSSSFL

SEQ ID NO: 816972 - protein, 9 aa, Homo Sapiens
PRSCSEQAQ

SEQ ID NO: 816973 - protein, 9 aa, Homo Sapiens
LGSYAIIVS

SEQ ID NO: 816974 - protein, 9 aa, Homo Sapiens
SVLVYHNGD

SEQ ID NO: 816975 - protein, 9 aa, Homo Sapiens
FTCYYVLFH

SEQ ID NO: 816976 - protein, 9 aa, Homo Sapiens
KVKEIRDQI

SEQ ID NO: 816977 - protein, 9 aa, Homo Sapiens
VMDSIPAPS

SEQ ID NO: 816978 - protein, 9 aa, Homo Sapiens
DSDDIKENP

SEQ ID NO: 816979 - protein, 9 aa, Homo Sapiens
PGLTIWQID

SEQ ID NO: 816980 - protein, 9 aa, Homo Sapiens
PKFISNQRI

SEQ ID NO: 816981 - protein, 9 aa, Homo Sapiens
GNGSNGYSV

SEQ ID NO: 816982 - protein, 9 aa, Homo Sapiens
QLTQMTRCP

SEQ ID NO: 816983 - protein, 9 aa, Homo Sapiens
DFEKGMAAY

SEQ ID NO: 816984 - protein, 9 aa, Homo Sapiens
LPYNTLSEL

SEQ ID NO: 816985 - protein, 9 aa, Homo Sapiens
TRHILLPKN

SEQ ID NO: 816986 - protein, 9 aa, Homo Sapiens
GLGFKQAAF

SEQ ID NO: 816987 - protein, 9 aa, Homo Sapiens
LLYMSTEIS

SEQ ID NO: 816988 - protein, 9 aa, Homo Sapiens
IKHLRVLFI

SEQ ID NO: 816989 - protein, 9 aa, Homo Sapiens
QYYSDPRFL

SEQ ID NO: 816990 - protein, 9 aa, Homo Sapiens
ALILQGLRS

SEQ ID NO: 816991 - protein, 9 aa, Homo Sapiens
DVVSPKLPS

SEQ ID NO: 816992 - protein, 9 aa, Homo Sapiens
SSGFFLVKE

SEQ ID NO: 816993 - protein, 9 aa, Homo Sapiens
RMVNLGGKT

SEQ ID NO: 816994 - protein, 9 aa, Homo Sapiens
LLKDVIMQY

SEQ ID NO: 816995 - protein, 9 aa, Homo Sapiens
PKVDFRTFL

SEQ ID NO: 816996 - protein, 9 aa, Homo Sapiens
SLSVWHRKS

SEQ ID NO: 816997 - protein, 9 aa, Homo Sapiens
GADLKSILS

SEQ ID NO: 816998 - protein, 9 aa, Homo Sapiens
SDNLFKKVE

SEQ ID NO: 816999 - protein, 9 aa, Homo Sapiens
IPVSGVGDA

SEQ ID NO: 817000 - protein, 9 aa, Homo Sapiens
ESPTQYSLS

SEQ ID NO: 817001 - protein, 9 aa, Homo Sapiens
GCIHSLSNV

SEQ ID NO: 817002 - protein, 9 aa, Homo Sapiens
TQPQIYPWM

SEQ ID NO: 817003 - protein, 9 aa, Homo Sapiens
SRPLHYPVA

SEQ ID NO: 817004 - protein, 9 aa, Homo Sapiens
LLGAKLYST

SEQ ID NO: 817005 - protein, 9 aa, Homo Sapiens
SLPAMAIFK

SEQ ID NO: 817006 - protein, 9 aa, Homo Sapiens
IRAEDAGFV

SEQ ID NO: 817007 - protein, 9 aa, Homo Sapiens
YWELLIYLS

SEQ ID NO: 817008 - protein, 9 aa, Homo Sapiens
IHLYEQPEI

SEQ ID NO: 817009 - protein, 9 aa, Homo Sapiens
KIPKAPGFN

SEQ ID NO: 817010 - protein, 9 aa, Homo Sapiens
MPESDLGTL

SEQ ID NO: 817011 - protein, 9 aa, Homo Sapiens
SDLLDALHL

SEQ ID NO: 817012 - protein, 9 aa, Homo Sapiens
SGQTFGREE

SEQ ID NO: 817013 - protein, 9 aa, Homo Sapiens
PHAIYLLRD

SEQ ID NO: 817014 - protein, 9 aa, Homo Sapiens
AGEEQKIDR

SEQ ID NO: 817015 - protein, 9 aa, Homo Sapiens
KRNKKSTFE

SEQ ID NO: 817016 - protein, 9 aa, Homo Sapiens
AAHFDKKKE

SEQ ID NO: 817017 - protein, 9 aa, Homo Sapiens
KAPKRMIMA

SEQ ID NO: 817018 - protein, 9 aa, Homo Sapiens
HEEAAVYRV

SEQ ID NO: 817019 - protein, 9 aa, Homo Sapiens
QANMNTGDP

SEQ ID NO: 817020 - protein, 9 aa, Homo Sapiens
HTLTYPILQ

SEQ ID NO: 817021 - protein, 9 aa, Homo Sapiens
LFVTAPKNV

SEQ ID NO: 817022 - protein, 9 aa, Homo Sapiens
PNKRGPKPK

SEQ ID NO: 817023 - protein, 9 aa, Homo Sapiens
TLQRLQARE

SEQ ID NO: 817024 - protein, 9 aa, Homo Sapiens
RVLNTVIPH

SEQ ID NO: 817025 - protein, 9 aa, Homo Sapiens
QRQLAREKK

SEQ ID NO: 817026 - protein, 9 aa, Homo Sapiens
ARMQQQLGE

SEQ ID NO: 817027 - protein, 9 aa, Homo Sapiens
KDATQKIAK

SEQ ID NO: 817028 - protein, 9 aa, Homo Sapiens
PMQAMWLGY

SEQ ID NO: 817029 - protein, 9 aa, Homo Sapiens
PQLLDDSHE

SEQ ID NO: 817030 - protein, 9 aa, Homo Sapiens
GPEIETEVK

SEQ ID NO: 817031 - protein, 9 aa, Homo Sapiens
PFPRHGHSG

SEQ ID NO: 817032 - protein, 9 aa, Homo Sapiens
LKYLETPTK

SEQ ID NO: 817033 - protein, 9 aa, Homo Sapiens
MGKNNVFVF

SEQ ID NO: 817034 - protein, 9 aa, Homo Sapiens
PFPLLITAL

SEQ ID NO: 817035 - protein, 9 aa, Homo Sapiens
AAEINTASR

SEQ ID NO: 817036 - protein, 9 aa, Homo Sapiens
DNYQLQIVI

SEQ ID NO: 817037 - protein, 9 aa, Homo Sapiens
YAEKTHGSL

SEQ ID NO: 817038 - protein, 9 aa, Homo Sapiens
NLGLYTDQA

SEQ ID NO: 817039 - protein, 9 aa, Homo Sapiens
MDTFRMLFQ

SEQ ID NO: 817040 - protein, 9 aa, Homo Sapiens
QECGEYLSK

SEQ ID NO: 817041 - protein, 9 aa, Homo Sapiens
AVDEQLEHC

SEQ ID NO: 817042 - protein, 9 aa, Homo Sapiens
VVHCWYTAH

SEQ ID NO: 817043 - protein, 9 aa, Homo Sapiens
VGFSNYKLF

SEQ ID NO: 817044 - protein, 9 aa, Homo Sapiens
MQPHGKVFK

SEQ ID NO: 817045 - protein, 9 aa, Homo Sapiens
SYLHVLLDA

SEQ ID NO: 817046 - protein, 9 aa, Homo Sapiens
VRGIRGRWD

SEQ ID NO: 817047 - protein, 9 aa, Homo Sapiens
VILHSHKTQ

SEQ ID NO: 817048 - protein, 9 aa, Homo Sapiens
LVDLNTNFK

SEQ ID NO: 817049 - protein, 9 aa, Homo Sapiens
IAFRSFPEN

SEQ ID NO: 817050 - protein, 9 aa, Homo Sapiens
EITEQLHRQ

SEQ ID NO: 817051 - protein, 9 aa, Homo Sapiens
AAETGMEVS

SEQ ID NO: 817052 - protein, 9 aa, Homo Sapiens
TEQVQHSET

SEQ ID NO: 817053 - protein, 9 aa, Homo Sapiens
QEYQKIMKK

SEQ ID NO: 817054 - protein, 9 aa, Homo Sapiens
NTFESEDYC

SEQ ID NO: 817055 - protein, 9 aa, Homo Sapiens
REIRWGHRF

SEQ ID NO: 817056 - protein, 9 aa, Homo Sapiens
PTVVSHHLA

SEQ ID NO: 817057 - protein, 9 aa, Homo Sapiens
WDRFFVMEA

SEQ ID NO: 817058 - protein, 9 aa, Homo Sapiens
HSSPQAIIM

SEQ ID NO: 817059 - protein, 9 aa, Homo Sapiens
YLSAPAKKI

SEQ ID NO: 817060 - protein, 9 aa, Homo Sapiens
RMILLFSKC

SEQ ID NO: 817061 - protein, 9 aa, Homo Sapiens
KEILTSLVA

SEQ ID NO: 817062 - protein, 9 aa, Homo Sapiens
GEHNNGVLE

SEQ ID NO: 817063 - protein, 9 aa, Homo Sapiens
YHLKAHRRT

SEQ ID NO: 817064 - protein, 9 aa, Homo Sapiens
LIILDILEY

SEQ ID NO: 817065 - protein, 9 aa, Homo Sapiens
TMRKVMQIQ

SEQ ID NO: 817066 - protein, 9 aa, Homo Sapiens
STSFMMTPY

SEQ ID NO: 817067 - protein, 9 aa, Homo Sapiens
LILALLIQV

SEQ ID NO: 817068 - protein, 9 aa, Homo Sapiens
ESILIFKVI

SEQ ID NO: 817069 - protein, 9 aa, Homo Sapiens
VSGICIKIA

SEQ ID NO: 817070 - protein, 9 aa, Homo Sapiens
ITIEDLCEV

SEQ ID NO: 817071 - protein, 9 aa, Homo Sapiens
GFLVGNAFI

SEQ ID NO: 817072 - protein, 9 aa, Homo Sapiens
VIKAYSLVD

SEQ ID NO: 817073 - protein, 9 aa, Homo Sapiens
MLTKDLQNG

SEQ ID NO: 817074 - protein, 9 aa, Homo Sapiens
LALIQGYAE

SEQ ID NO: 817075 - protein, 9 aa, Homo Sapiens
EKVAQAVCF

SEQ ID NO: 817076 - protein, 9 aa, Homo Sapiens
EDVFQKFGK

SEQ ID NO: 817077 - protein, 9 aa, Homo Sapiens
FSDNAVLKS

SEQ ID NO: 817078 - protein, 9 aa, Homo Sapiens
LLSCVYHAK

SEQ ID NO: 817079 - protein, 9 aa, Homo Sapiens
LERQQRLLG

SEQ ID NO: 817080 - protein, 9 aa, Homo Sapiens
SIPVYIMKI

SEQ ID NO: 817081 - protein, 9 aa, Homo Sapiens
LFTGVDRGQ

SEQ ID NO: 817082 - protein, 9 aa, Homo Sapiens
ELPVKLLLG

SEQ ID NO: 817083 - protein, 9 aa, Homo Sapiens
SSYDIINGD

SEQ ID NO: 817084 - protein, 9 aa, Homo Sapiens
KCDKCDKLF

SEQ ID NO: 817085 - protein, 9 aa, Homo Sapiens
LMSQKFQQC

SEQ ID NO: 817086 - protein, 9 aa, Homo Sapiens
KWDFTALIN

SEQ ID NO: 817087 - protein, 9 aa, Homo Sapiens
QRCDDFADC

SEQ ID NO: 817088 - protein, 9 aa, Homo Sapiens
QGDKLEIAR

SEQ ID NO: 817089 - protein, 9 aa, Homo Sapiens
KEKIYVLLC

SEQ ID NO: 817090 - protein, 9 aa, Homo Sapiens
THPAFPGLI

SEQ ID NO: 817091 - protein, 9 aa, Homo Sapiens
KIELQAQHN

SEQ ID NO: 817092 - protein, 9 aa, Homo Sapiens
MTYTPETLL

SEQ ID NO: 817093 - protein, 9 aa, Homo Sapiens
EFTRPEEIV

SEQ ID NO: 817094 - protein, 9 aa, Homo Sapiens
DQEGRVFQG

SEQ ID NO: 817095 - protein, 9 aa, Homo Sapiens
SKPDSVLKM

SEQ ID NO: 817096 - protein, 9 aa, Homo Sapiens
MIYGKFRTT

SEQ ID NO: 817097 - protein, 9 aa, Homo Sapiens
YEKQICDTL

SEQ ID NO: 817098 - protein, 9 aa, Homo Sapiens
QEFCPNAKG

SEQ ID NO: 817099 - protein, 9 aa, Homo Sapiens
PHNSATESA

SEQ ID NO: 817100 - protein, 9 aa, Homo Sapiens
EAHPKYPDC

SEQ ID NO: 817101 - protein, 9 aa, Homo Sapiens
PSPQTSSLP

SEQ ID NO: 817102 - protein, 9 aa, Homo Sapiens
RSSYYFDMD

SEQ ID NO: 817103 - protein, 9 aa, Homo Sapiens
VKARTTINF

SEQ ID NO: 817104 - protein, 9 aa, Homo Sapiens
DMLYAVMQE

SEQ ID NO: 817105 - protein, 9 aa, Homo Sapiens
AKLGQEPVL

SEQ ID NO: 817106 - protein, 9 aa, Homo Sapiens
NCLAVREFI

SEQ ID NO: 817107 - protein, 9 aa, Homo Sapiens
TRPEEIVFL

SEQ ID NO: 817108 - protein, 9 aa, Homo Sapiens
HQKEKCIKH

SEQ ID NO: 817109 - protein, 9 aa, Homo Sapiens
WNKLSEEQN

SEQ ID NO: 817110 - protein, 9 aa, Homo Sapiens
NKAKKREVL

SEQ ID NO: 817111 - protein, 9 aa, Homo Sapiens
AAAQGPNTP

SEQ ID NO: 817112 - protein, 9 aa, Homo Sapiens
KLASQNTDK

SEQ ID NO: 817113 - protein, 9 aa, Homo Sapiens
SGLDLHSVV

SEQ ID NO: 817114 - protein, 9 aa, Homo Sapiens
GGYVAKEKY

SEQ ID NO: 817115 - protein, 9 aa, Homo Sapiens
RAHEALQTQ

SEQ ID NO: 817116 - protein, 9 aa, Homo Sapiens
TPSAPNLAE

SEQ ID NO: 817117 - protein, 9 aa, Homo Sapiens
RIGVANVDM

SEQ ID NO: 817118 - protein, 9 aa, Homo Sapiens
LVSVRVLYK

SEQ ID NO: 817119 - protein, 9 aa, Homo Sapiens
VAQLKQLIL

SEQ ID NO: 817120 - protein, 9 aa, Homo Sapiens
FCLYRGLIA

SEQ ID NO: 817121 - protein, 9 aa, Homo Sapiens
GIIGAKHSR

SEQ ID NO: 817122 - protein, 9 aa, Homo Sapiens
IAPPRYVIT

SEQ ID NO: 817123 - protein, 9 aa, Homo Sapiens
DEAFPISHV

SEQ ID NO: 817124 - protein, 9 aa, Homo Sapiens
YREGVIRTA

SEQ ID NO: 817125 - protein, 9 aa, Homo Sapiens
GAILQANSS

SEQ ID NO: 817126 - protein, 9 aa, Homo Sapiens
ITTTGIMNK

SEQ ID NO: 817127 - protein, 9 aa, Homo Sapiens
AGGQVMTIN

SEQ ID NO: 817128 - protein, 9 aa, Homo Sapiens
LCSCGWHHC

SEQ ID NO: 817129 - protein, 9 aa, Homo Sapiens
GRLLNANSG

SEQ ID NO: 817130 - protein, 9 aa, Homo Sapiens
DEEEEKVVQ

SEQ ID NO: 817131 - protein, 9 aa, Homo Sapiens
RIHKEVKPY

SEQ ID NO: 817132 - protein, 9 aa, Homo Sapiens
FGETGLGTP

SEQ ID NO: 817133 - protein, 9 aa, Homo Sapiens
KEAIHAMNF

SEQ ID NO: 817134 - protein, 9 aa, Homo Sapiens
NPKELYHEV

SEQ ID NO: 817135 - protein, 9 aa, Homo Sapiens
HFAIQDISV

SEQ ID NO: 817136 - protein, 9 aa, Homo Sapiens
ISVETRVQT

SEQ ID NO: 817137 - protein, 9 aa, Homo Sapiens
PGVADKKIH

SEQ ID NO: 817138 - protein, 9 aa, Homo Sapiens
RDKSSLDKR

SEQ ID NO: 817139 - protein, 9 aa, Homo Sapiens
YDITLYLVV

SEQ ID NO: 817140 - protein, 9 aa, Homo Sapiens
DEWQHLGPV

SEQ ID NO: 817141 - protein, 9 aa, Homo Sapiens
RDVQWVYVE

SEQ ID NO: 817142 - protein, 9 aa, Homo Sapiens
VSLYQYFEN

SEQ ID NO: 817143 - protein, 9 aa, Homo Sapiens
LLQMAKSVH

SEQ ID NO: 817144 - protein, 9 aa, Homo Sapiens
NNEENVDLT

SEQ ID NO: 817145 - protein, 9 aa, Homo Sapiens
FPGLIFAVV

SEQ ID NO: 817146 - protein, 9 aa, Homo Sapiens
TKSLDSPRE

SEQ ID NO: 817147 - protein, 9 aa, Homo Sapiens
KFCKVCGVM

SEQ ID NO: 817148 - protein, 9 aa, Homo Sapiens
EQERERRWR

SEQ ID NO: 817149 - protein, 9 aa, Homo Sapiens
LETPTKSLL

SEQ ID NO: 817150 - protein, 9 aa, Homo Sapiens
CSKKEDSSD

SEQ ID NO: 817151 - protein, 9 aa, Homo Sapiens
LGGALQGCD

SEQ ID NO: 817152 - protein, 9 aa, Homo Sapiens
EETLLTYQG

SEQ ID NO: 817153 - protein, 9 aa, Homo Sapiens
DWFDGKELS

SEQ ID NO: 817154 - protein, 9 aa, Homo Sapiens
KSHRDKLTK

SEQ ID NO: 817155 - protein, 9 aa, Homo Sapiens
SNAEHLEDA

SEQ ID NO: 817156 - protein, 9 aa, Homo Sapiens
AETGAFTFF

SEQ ID NO: 817157 - protein, 9 aa, Homo Sapiens
KKTIFSAIE

SEQ ID NO: 817158 - protein, 9 aa, Homo Sapiens
INYLVTEGF

SEQ ID NO: 817159 - protein, 9 aa, Homo Sapiens
KGLVQELWR

SEQ ID NO: 817160 - protein, 9 aa, Homo Sapiens
GPRSSLAAF

SEQ ID NO: 817161 - protein, 9 aa, Homo Sapiens
TSTKQVELT

SEQ ID NO: 817162 - protein, 9 aa, Homo Sapiens
QSITSQNNL

SEQ ID NO: 817163 - protein, 9 aa, Homo Sapiens
NITSVQLIW

SEQ ID NO: 817164 - protein, 9 aa, Homo Sapiens
AAERRRMHL

SEQ ID NO: 817165 - protein, 9 aa, Homo Sapiens
LLFLGATLS

SEQ ID NO: 817166 - protein, 9 aa, Homo Sapiens
ACDEAIYQR

SEQ ID NO: 817167 - protein, 9 aa, Homo Sapiens
LSLHEPIQI

SEQ ID NO: 817168 - protein, 9 aa, Homo Sapiens
LAPGAPGAA

SEQ ID NO: 817169 - protein, 9 aa, Homo Sapiens
NLSNIDVLE

SEQ ID NO: 817170 - protein, 9 aa, Homo Sapiens
VIPRIVQDI

SEQ ID NO: 817171 - protein, 9 aa, Homo Sapiens
GIIKLNVRE

SEQ ID NO: 817172 - protein, 9 aa, Homo Sapiens
FLTTLPLPV

SEQ ID NO: 817173 - protein, 9 aa, Homo Sapiens
KYYMLICLV

SEQ ID NO: 817174 - protein, 9 aa, Homo Sapiens
GRLRLPLGA

SEQ ID NO: 817175 - protein, 9 aa, Homo Sapiens
KTLLRNLGL

SEQ ID NO: 817176 - protein, 9 aa, Homo Sapiens
DIPKAPDET

SEQ ID NO: 817177 - protein, 9 aa, Homo Sapiens
LEMFDNFAA

SEQ ID NO: 817178 - protein, 9 aa, Homo Sapiens
YFNFIGYFF

SEQ ID NO: 817179 - protein, 9 aa, Homo Sapiens
FLEQQNTVL

SEQ ID NO: 817180 - protein, 9 aa, Homo Sapiens
LLGGHAAIC

SEQ ID NO: 817181 - protein, 9 aa, Homo Sapiens
ADVVSPKLP

SEQ ID NO: 817182 - protein, 9 aa, Homo Sapiens
LVNNLQKEK

SEQ ID NO: 817183 - protein, 9 aa, Homo Sapiens
PPPQIPNYH

SEQ ID NO: 817184 - protein, 9 aa, Homo Sapiens
GRLSIKGHL

SEQ ID NO: 817185 - protein, 9 aa, Homo Sapiens
HPLGMRLPL

SEQ ID NO: 817186 - protein, 9 aa, Homo Sapiens
FQVEGKTNA

SEQ ID NO: 817187 - protein, 9 aa, Homo Sapiens
GQDIHVTRY

SEQ ID NO: 817188 - protein, 9 aa, Homo Sapiens
FLFGSGTSG

SEQ ID NO: 817189 - protein, 9 aa, Homo Sapiens
TIQYTCSPG

SEQ ID NO: 817190 - protein, 9 aa, Homo Sapiens
AEEDKIPNK

SEQ ID NO: 817191 - protein, 9 aa, Homo Sapiens
LCRKPALIS

SEQ ID NO: 817192 - protein, 9 aa, Homo Sapiens
TYFDPDFYA

SEQ ID NO: 817193 - protein, 9 aa, Homo Sapiens
YLGVQDAVP

SEQ ID NO: 817194 - protein, 9 aa, Homo Sapiens
LVACIDIIQ

SEQ ID NO: 817195 - protein, 9 aa, Homo Sapiens
VHGEEMYCK

SEQ ID NO: 817196 - protein, 9 aa, Homo Sapiens
EVVCEAIQN

SEQ ID NO: 817197 - protein, 9 aa, Homo Sapiens
YNYYIKMSI

SEQ ID NO: 817198 - protein, 9 aa, Homo Sapiens
ISLFYSLFN

SEQ ID NO: 817199 - protein, 9 aa, Homo Sapiens
HMQLIKYKK

SEQ ID NO: 817200 - protein, 9 aa, Homo Sapiens
QDKSKENSS

SEQ ID NO: 817201 - protein, 9 aa, Homo Sapiens
LLRNKEKRG

SEQ ID NO: 817202 - protein, 9 aa, Homo Sapiens
KSLIQINLH

SEQ ID NO: 817203 - protein, 9 aa, Homo Sapiens
TQLTVWPDS

SEQ ID NO: 817204 - protein, 9 aa, Homo Sapiens
VINQSCCVY

SEQ ID NO: 817205 - protein, 9 aa, Homo Sapiens
TRIRDIACG

SEQ ID NO: 817206 - protein, 9 aa, Homo Sapiens
DLQDEFDCR

SEQ ID NO: 817207 - protein, 9 aa, Homo Sapiens
LNPQQFDVL

SEQ ID NO: 817208 - protein, 9 aa, Homo Sapiens
NPLEKEQIQ

SEQ ID NO: 817209 - protein, 9 aa, Homo Sapiens
QPVFEQLED

SEQ ID NO: 817210 - protein, 9 aa, Homo Sapiens
VKEINEDFI

SEQ ID NO: 817211 - protein, 9 aa, Homo Sapiens
RITGSGRST

SEQ ID NO: 817212 - protein, 9 aa, Homo Sapiens
VKVFDFFGD

SEQ ID NO: 817213 - protein, 9 aa, Homo Sapiens
GEYFLYKSS

SEQ ID NO: 817214 - protein, 9 aa, Homo Sapiens
IIFGRLERT

SEQ ID NO: 817215 - protein, 9 aa, Homo Sapiens
FNAYQRAQM

SEQ ID NO: 817216 - protein, 9 aa, Homo Sapiens
VEKEILLNI

SEQ ID NO: 817217 - protein, 9 aa, Homo Sapiens
TVDSTKDSY

SEQ ID NO: 817218 - protein, 9 aa, Homo Sapiens
ADVPGEMLK

SEQ ID NO: 817219 - protein, 9 aa, Homo Sapiens
YPSHRSFTN

SEQ ID NO: 817220 - protein, 9 aa, Homo Sapiens
RLSSFSDAD

SEQ ID NO: 817221 - protein, 9 aa, Homo Sapiens
LLIVVSYGN

SEQ ID NO: 817222 - protein, 9 aa, Homo Sapiens
TTLTLRLPS

SEQ ID NO: 817223 - protein, 9 aa, Homo Sapiens
PSIAGLDYL

SEQ ID NO: 817224 - protein, 9 aa, Homo Sapiens
EQERPRQQK

SEQ ID NO: 817225 - protein, 9 aa, Homo Sapiens
FEKGMAAYL

SEQ ID NO: 817226 - protein, 9 aa, Homo Sapiens
ASQSTSQQP

SEQ ID NO: 817227 - protein, 9 aa, Homo Sapiens
PSNSFPYNE

SEQ ID NO: 817228 - protein, 9 aa, Homo Sapiens
PLETGVWCW

SEQ ID NO: 817229 - protein, 9 aa, Homo Sapiens
LEDCAVALN

SEQ ID NO: 817230 - protein, 9 aa, Homo Sapiens
FINDSKLAS

SEQ ID NO: 817231 - protein, 9 aa, Homo Sapiens
DIPEDISDR

SEQ ID NO: 817232 - protein, 9 aa, Homo Sapiens
WLQDGLKPR

SEQ ID NO: 817233 - protein, 9 aa, Homo Sapiens
TIQNVVLMP

SEQ ID NO: 817234 - protein, 9 aa, Homo Sapiens
DFRLYCLWK

SEQ ID NO: 817235 - protein, 9 aa, Homo Sapiens
ELDEAVLRC

SEQ ID NO: 817236 - protein, 9 aa, Homo Sapiens
TQKPLVLGA

SEQ ID NO: 817237 - protein, 9 aa, Homo Sapiens
MKKNREKFC

SEQ ID NO: 817238 - protein, 9 aa, Homo Sapiens
DTVTDVDTS

SEQ ID NO: 817239 - protein, 9 aa, Homo Sapiens
QENINMLSE

SEQ ID NO: 817240 - protein, 9 aa, Homo Sapiens
DEFSFLQDP

SEQ ID NO: 817241 - protein, 9 aa, Homo Sapiens
EEPQTLVTP

SEQ ID NO: 817242 - protein, 9 aa, Homo Sapiens
ETLYSNASL

SEQ ID NO: 817243 - protein, 9 aa, Homo Sapiens
VVNLASLIY

SEQ ID NO: 817244 - protein, 9 aa, Homo Sapiens
GALFFIISY

SEQ ID NO: 817245 - protein, 9 aa, Homo Sapiens
LFKQNFEYL

SEQ ID NO: 817246 - protein, 9 aa, Homo Sapiens
AENKRMHIL

SEQ ID NO: 817247 - protein, 9 aa, Homo Sapiens
EKHKREQNY

SEQ ID NO: 817248 - protein, 9 aa, Homo Sapiens
DGCGWNFPS

SEQ ID NO: 817249 - protein, 9 aa, Homo Sapiens
ILKIKKNQL

SEQ ID NO: 817250 - protein, 9 aa, Homo Sapiens
KEESTVENP

SEQ ID NO: 817251 - protein, 9 aa, Homo Sapiens
AAFTIYEML

SEQ ID NO: 817252 - protein, 9 aa, Homo Sapiens
YQNWRTMSS

SEQ ID NO: 817253 - protein, 9 aa, Homo Sapiens
VIINSHSHE

SEQ ID NO: 817254 - protein, 9 aa, Homo Sapiens
LPAPNNDFE

SEQ ID NO: 817255 - protein, 9 aa, Homo Sapiens
GAPKIIYFI

SEQ ID NO: 817256 - protein, 9 aa, Homo Sapiens
LPCVQVLHQ

SEQ ID NO: 817257 - protein, 9 aa, Homo Sapiens
KFFQMKMTL

SEQ ID NO: 817258 - protein, 9 aa, Homo Sapiens
FYCADCGEA

SEQ ID NO: 817259 - protein, 9 aa, Homo Sapiens
TTEKTDEEA

SEQ ID NO: 817260 - protein, 9 aa, Homo Sapiens
YLYHLLHII

SEQ ID NO: 817261 - protein, 9 aa, Homo Sapiens
EKKLRQNQN

SEQ ID NO: 817262 - protein, 9 aa, Homo Sapiens
FIYCLALNP

SEQ ID NO: 817263 - protein, 9 aa, Homo Sapiens
AHQPKCPEK

SEQ ID NO: 817264 - protein, 9 aa, Homo Sapiens
KFKPEVKMV

SEQ ID NO: 817265 - protein, 9 aa, Homo Sapiens
AAAAAWCHQ

SEQ ID NO: 817266 - protein, 9 aa, Homo Sapiens
LEKEMSKLK

SEQ ID NO: 817267 - protein, 9 aa, Homo Sapiens
LRHDKIMFG

SEQ ID NO: 817268 - protein, 9 aa, Homo Sapiens
LLKKLVKDN

SEQ ID NO: 817269 - protein, 9 aa, Homo Sapiens
EQEDKIREQ

SEQ ID NO: 817270 - protein, 9 aa, Homo Sapiens
QTQEAKDIR

SEQ ID NO: 817271 - protein, 9 aa, Homo Sapiens
GGACSVDID

SEQ ID NO: 817272 - protein, 9 aa, Homo Sapiens
RRKQKQTNL

SEQ ID NO: 817273 - protein, 9 aa, Homo Sapiens
HSSLQKQVL

SEQ ID NO: 817274 - protein, 9 aa, Homo Sapiens
TLFIVLLHL

SEQ ID NO: 817275 - protein, 9 aa, Homo Sapiens
YLLFTTGNS

SEQ ID NO: 817276 - protein, 9 aa, Homo Sapiens
GAEEEEDAG

SEQ ID NO: 817277 - protein, 9 aa, Homo Sapiens
VGSQFSVDT

SEQ ID NO: 817278 - protein, 9 aa, Homo Sapiens
VPLSRLLKE

SEQ ID NO: 817279 - protein, 9 aa, Homo Sapiens
NKQTFSYYA

SEQ ID NO: 817280 - protein, 9 aa, Homo Sapiens
SYAISADLG

SEQ ID NO: 817281 - protein, 9 aa, Homo Sapiens
LGKFSEITF

SEQ ID NO: 817282 - protein, 9 aa, Homo Sapiens
NGRMVESAP

SEQ ID NO: 817283 - protein, 9 aa, Homo Sapiens
CDLLVTNNH

SEQ ID NO: 817284 - protein, 9 aa, Homo Sapiens
YYAGKNKVP

SEQ ID NO: 817285 - protein, 9 aa, Homo Sapiens
AKTLYGIYY

SEQ ID NO: 817286 - protein, 9 aa, Homo Sapiens
PIFDKFSSY

SEQ ID NO: 817287 - protein, 9 aa, Homo Sapiens
DTSLQEVID

SEQ ID NO: 817288 - protein, 9 aa, Homo Sapiens
AIVHMHRFY

SEQ ID NO: 817289 - protein, 9 aa, Homo Sapiens
QKFICASNQ

SEQ ID NO: 817290 - protein, 9 aa, Homo Sapiens
ATPQYSLEE

SEQ ID NO: 817291 - protein, 9 aa, Homo Sapiens
PVAVQVGIA

SEQ ID NO: 817292 - protein, 9 aa, Homo Sapiens
HYNQAVDIW

SEQ ID NO: 817293 - protein, 9 aa, Homo Sapiens
YLENVESIV

SEQ ID NO: 817294 - protein, 9 aa, Homo Sapiens
ETLIFDMHI

SEQ ID NO: 817295 - protein, 9 aa, Homo Sapiens
DSGIVTNGS

SEQ ID NO: 817296 - protein, 9 aa, Homo Sapiens
QEPGSSLPE

SEQ ID NO: 817297 - protein, 9 aa, Homo Sapiens
VIMNGRIYV

SEQ ID NO: 817298 - protein, 9 aa, Homo Sapiens
LNINGIMKP

SEQ ID NO: 817299 - protein, 9 aa, Homo Sapiens
QSKDTTIQE

SEQ ID NO: 817300 - protein, 9 aa, Homo Sapiens
QGQSRGCVA

SEQ ID NO: 817301 - protein, 9 aa, Homo Sapiens
PQQTEYCNK

SEQ ID NO: 817302 - protein, 9 aa, Homo Sapiens
ALTQKNQLI

SEQ ID NO: 817303 - protein, 9 aa, Homo Sapiens
CLSNSFQTL

SEQ ID NO: 817304 - protein, 9 aa, Homo Sapiens
CVNAGSRAV

SEQ ID NO: 817305 - protein, 9 aa, Homo Sapiens
QESMLRFPH

SEQ ID NO: 817306 - protein, 9 aa, Homo Sapiens
MAEDPAALT

SEQ ID NO: 817307 - protein, 9 aa, Homo Sapiens
FISNPYNKT

SEQ ID NO: 817308 - protein, 9 aa, Homo Sapiens
QKNSITRNL

SEQ ID NO: 817309 - protein, 9 aa, Homo Sapiens
QDEQDELLK

SEQ ID NO: 817310 - protein, 9 aa, Homo Sapiens
NIAYEKIAY

SEQ ID NO: 817311 - protein, 9 aa, Homo Sapiens
EAENGEQGP

SEQ ID NO: 817312 - protein, 9 aa, Homo Sapiens
HQCDPKTGE

SEQ ID NO: 817313 - protein, 9 aa, Homo Sapiens
PRPETGILD

SEQ ID NO: 817314 - protein, 9 aa, Homo Sapiens
NCSTQREIL

SEQ ID NO: 817315 - protein, 9 aa, Homo Sapiens
ISQRLLLKI

SEQ ID NO: 817316 - protein, 9 aa, Homo Sapiens
LSSHKISHT

SEQ ID NO: 817317 - protein, 9 aa, Homo Sapiens
KETHRGLYK

SEQ ID NO: 817318 - protein, 9 aa, Homo Sapiens
PVLISGNCP

SEQ ID NO: 817319 - protein, 9 aa, Homo Sapiens
VSMPSEYTY

SEQ ID NO: 817320 - protein, 9 aa, Homo Sapiens
APTPLCCDS

SEQ ID NO: 817321 - protein, 9 aa, Homo Sapiens
PYMDDNFIS

SEQ ID NO: 817322 - protein, 9 aa, Homo Sapiens
PRCVLNLIK

SEQ ID NO: 817323 - protein, 9 aa, Homo Sapiens
AFLRLAQSR

SEQ ID NO: 817324 - protein, 9 aa, Homo Sapiens
ILQKDIWDI

SEQ ID NO: 817325 - protein, 9 aa, Homo Sapiens
SDQNYNYKQ

SEQ ID NO: 817326 - protein, 9 aa, Homo Sapiens
LIQKHSTSN

SEQ ID NO: 817327 - protein, 9 aa, Homo Sapiens
EHKRLHTGV

SEQ ID NO: 817328 - protein, 9 aa, Homo Sapiens
FLECERKAS

SEQ ID NO: 817329 - protein, 9 aa, Homo Sapiens
TAGDSEDKP

SEQ ID NO: 817330 - protein, 9 aa, Homo Sapiens
LCYSESMKI

SEQ ID NO: 817331 - protein, 9 aa, Homo Sapiens
ESSPKECIL

SEQ ID NO: 817332 - protein, 9 aa, Homo Sapiens
RIICGSRKM

SEQ ID NO: 817333 - protein, 9 aa, Homo Sapiens
DCLTQICFV

SEQ ID NO: 817334 - protein, 9 aa, Homo Sapiens
RPSKYIATI

SEQ ID NO: 817335 - protein, 9 aa, Homo Sapiens
KYCNVDSVS

SEQ ID NO: 817336 - protein, 9 aa, Homo Sapiens
AQSQLTATS

SEQ ID NO: 817337 - protein, 9 aa, Homo Sapiens
PKSTRQKKE

SEQ ID NO: 817338 - protein, 9 aa, Homo Sapiens
WLNGHRKNP

SEQ ID NO: 817339 - protein, 9 aa, Homo Sapiens
CTEDVPTCR

SEQ ID NO: 817340 - protein, 9 aa, Homo Sapiens
LTWLGYVNY

SEQ ID NO: 817341 - protein, 9 aa, Homo Sapiens
RHNLEKLRV

SEQ ID NO: 817342 - protein, 9 aa, Homo Sapiens
NADVYYYHI

SEQ ID NO: 817343 - protein, 9 aa, Homo Sapiens
KEIIKAINR

SEQ ID NO: 817344 - protein, 9 aa, Homo Sapiens
SPVSRTPRL

SEQ ID NO: 817345 - protein, 9 aa, Homo Sapiens
TFRKIIHSH

SEQ ID NO: 817346 - protein, 9 aa, Homo Sapiens
PWIIHAYSS

SEQ ID NO: 817347 - protein, 9 aa, Homo Sapiens
NLANNFVLI

SEQ ID NO: 817348 - protein, 9 aa, Homo Sapiens
PIYSENDST

SEQ ID NO: 817349 - protein, 9 aa, Homo Sapiens
QREDGSFAD

SEQ ID NO: 817350 - protein, 9 aa, Homo Sapiens
IEGVHVHTC

SEQ ID NO: 817351 - protein, 9 aa, Homo Sapiens
CGYRGSSEA

SEQ ID NO: 817352 - protein, 9 aa, Homo Sapiens
YGLEYLVYH

SEQ ID NO: 817353 - protein, 9 aa, Homo Sapiens
TIIDFHVTV

SEQ ID NO: 817354 - protein, 9 aa, Homo Sapiens
MVEKHKREQ

SEQ ID NO: 817355 - protein, 9 aa, Homo Sapiens
QTVMKKVLV

SEQ ID NO: 817356 - protein, 9 aa, Homo Sapiens
EKLITVNLV

SEQ ID NO: 817357 - protein, 9 aa, Homo Sapiens
IIWKRTAPE

SEQ ID NO: 817358 - protein, 9 aa, Homo Sapiens
AFWTIPGYK

SEQ ID NO: 817359 - protein, 9 aa, Homo Sapiens
INVCPLRGF

SEQ ID NO: 817360 - protein, 9 aa, Homo Sapiens
LKEYETVSG

SEQ ID NO: 817361 - protein, 9 aa, Homo Sapiens
ICGQAFYFL

SEQ ID NO: 817362 - protein, 9 aa, Homo Sapiens
LLWANQFRF

SEQ ID NO: 817363 - protein, 9 aa, Homo Sapiens
LERQLRKEH

SEQ ID NO: 817364 - protein, 9 aa, Homo Sapiens
GNDKALKRA

SEQ ID NO: 817365 - protein, 9 aa, Homo Sapiens
SSLSLIQLV

SEQ ID NO: 817366 - protein, 9 aa, Homo Sapiens
MFKGVASSQ

SEQ ID NO: 817367 - protein, 9 aa, Homo Sapiens
LRLQEDKSL

SEQ ID NO: 817368 - protein, 9 aa, Homo Sapiens
AATTLDAKI

SEQ ID NO: 817369 - protein, 9 aa, Homo Sapiens
KSEWSDKSE

SEQ ID NO: 817370 - protein, 9 aa, Homo Sapiens
QSSHRAVED

SEQ ID NO: 817371 - protein, 9 aa, Homo Sapiens
SCRDSREDV

SEQ ID NO: 817372 - protein, 9 aa, Homo Sapiens
YGLNKFRWY

SEQ ID NO: 817373 - protein, 9 aa, Homo Sapiens
KLLSYFMFT

SEQ ID NO: 817374 - protein, 9 aa, Homo Sapiens
MMGIPIQKF

SEQ ID NO: 817375 - protein, 9 aa, Homo Sapiens
NRKKLKKKS

SEQ ID NO: 817376 - protein, 9 aa, Homo Sapiens
KAYDNACQI

SEQ ID NO: 817377 - protein, 9 aa, Homo Sapiens
VCSLIHVCL

SEQ ID NO: 817378 - protein, 9 aa, Homo Sapiens
IQERCPERQ

SEQ ID NO: 817379 - protein, 9 aa, Homo Sapiens
ELMVKLQKL

SEQ ID NO: 817380 - protein, 9 aa, Homo Sapiens
CFSSNISAN

SEQ ID NO: 817381 - protein, 9 aa, Homo Sapiens
DCVIYSSVV

SEQ ID NO: 817382 - protein, 9 aa, Homo Sapiens
IWLLGTTHA

SEQ ID NO: 817383 - protein, 9 aa, Homo Sapiens
YHQTIHTGE

SEQ ID NO: 817384 - protein, 9 aa, Homo Sapiens
NVQKTWQES

SEQ ID NO: 817385 - protein, 9 aa, Homo Sapiens
IIPPGPDVQ

SEQ ID NO: 817386 - protein, 9 aa, Homo Sapiens
EMLASRIVL

SEQ ID NO: 817387 - protein, 9 aa, Homo Sapiens
PGKSGNSKL

SEQ ID NO: 817388 - protein, 9 aa, Homo Sapiens
EEPKLDLKA

SEQ ID NO: 817389 - protein, 9 aa, Homo Sapiens
ITIIAVYFN

SEQ ID NO: 817390 - protein, 9 aa, Homo Sapiens
EIRVSPIFS

SEQ ID NO: 817391 - protein, 9 aa, Homo Sapiens
QLIIRPSNG

SEQ ID NO: 817392 - protein, 9 aa, Homo Sapiens
LSTVMHNYQ

SEQ ID NO: 817393 - protein, 9 aa, Homo Sapiens
SQFLPKGTK

SEQ ID NO: 817394 - protein, 9 aa, Homo Sapiens
RPPALARIA

SEQ ID NO: 817395 - protein, 9 aa, Homo Sapiens
VTGGAKNVN

SEQ ID NO: 817396 - protein, 9 aa, Homo Sapiens
NVWWQKLQI

SEQ ID NO: 817397 - protein, 9 aa, Homo Sapiens
KKDEMRKRD

SEQ ID NO: 817398 - protein, 9 aa, Homo Sapiens
GITPVLRRN

SEQ ID NO: 817399 - protein, 9 aa, Homo Sapiens
DKLLLFTTT

SEQ ID NO: 817400 - protein, 9 aa, Homo Sapiens
RTKKRLRKA

SEQ ID NO: 817401 - protein, 9 aa, Homo Sapiens
QTTQADIVR

SEQ ID NO: 817402 - protein, 9 aa, Homo Sapiens
SGGRWVEHR

SEQ ID NO: 817403 - protein, 9 aa, Homo Sapiens
FNNFTLGVD

SEQ ID NO: 817404 - protein, 9 aa, Homo Sapiens
ILEIKNNEI

SEQ ID NO: 817405 - protein, 9 aa, Homo Sapiens
KQAAVQCLQ

SEQ ID NO: 817406 - protein, 9 aa, Homo Sapiens
LRNNYFITH

SEQ ID NO: 817407 - protein, 9 aa, Homo Sapiens
EVNEVSHNF

SEQ ID NO: 817408 - protein, 9 aa, Homo Sapiens
DIQGRDIST

SEQ ID NO: 817409 - protein, 9 aa, Homo Sapiens
KFDPQDMDN

SEQ ID NO: 817410 - protein, 9 aa, Homo Sapiens
FFVKGTNTY

SEQ ID NO: 817411 - protein, 9 aa, Homo Sapiens
TPILRDLFL

SEQ ID NO: 817412 - protein, 9 aa, Homo Sapiens
GIPFIETST

SEQ ID NO: 817413 - protein, 9 aa, Homo Sapiens
NNSSKFHFR

SEQ ID NO: 817414 - protein, 9 aa, Homo Sapiens
DYLVVIMFQ

SEQ ID NO: 817415 - protein, 9 aa, Homo Sapiens
DTSWKELSN

SEQ ID NO: 817416 - protein, 9 aa, Homo Sapiens
AGDKLTGVC

SEQ ID NO: 817417 - protein, 9 aa, Homo Sapiens
CLTSDIYLE

SEQ ID NO: 817418 - protein, 9 aa, Homo Sapiens
VQELWRRMS

SEQ ID NO: 817419 - protein, 9 aa, Homo Sapiens
VYTKSYHLK

SEQ ID NO: 817420 - protein, 9 aa, Homo Sapiens
LQTYFQEFS

SEQ ID NO: 817421 - protein, 9 aa, Homo Sapiens
ASRIDSTGV

SEQ ID NO: 817422 - protein, 9 aa, Homo Sapiens
AYGNITECR

SEQ ID NO: 817423 - protein, 9 aa, Homo Sapiens
SLRRENNLE

SEQ ID NO: 817424 - protein, 9 aa, Homo Sapiens
IEACDLSND

SEQ ID NO: 817425 - protein, 9 aa, Homo Sapiens
DAENASCGL

SEQ ID NO: 817426 - protein, 9 aa, Homo Sapiens
VTILQATPS

SEQ ID NO: 817427 - protein, 9 aa, Homo Sapiens
EAANETYKN

SEQ ID NO: 817428 - protein, 9 aa, Homo Sapiens
NVLSCTSLD

SEQ ID NO: 817429 - protein, 9 aa, Homo Sapiens
YITNKLYSL

SEQ ID NO: 817430 - protein, 9 aa, Homo Sapiens
TIIKKNGDI

SEQ ID NO: 817431 - protein, 9 aa, Homo Sapiens
GGFDEPSTS

SEQ ID NO: 817432 - protein, 9 aa, Homo Sapiens
CCDSRASTV

SEQ ID NO: 817433 - protein, 9 aa, Homo Sapiens
KEEEASKSV

SEQ ID NO: 817434 - protein, 9 aa, Homo Sapiens
EHQWNVVAI

SEQ ID NO: 817435 - protein, 9 aa, Homo Sapiens
ITPGLEPHG

SEQ ID NO: 817436 - protein, 9 aa, Homo Sapiens
NMTHPEFII

SEQ ID NO: 817437 - protein, 9 aa, Homo Sapiens
PNTPQIFPA

SEQ ID NO: 817438 - protein, 9 aa, Homo Sapiens
GKPKYQNQV

SEQ ID NO: 817439 - protein, 9 aa, Homo Sapiens
DKYSVNMVT

SEQ ID NO: 817440 - protein, 9 aa, Homo Sapiens
GESPAWECV

SEQ ID NO: 817441 - protein, 9 aa, Homo Sapiens
FMLADRDNQ

SEQ ID NO: 817442 - protein, 9 aa, Homo Sapiens
ANCNSLRMS

SEQ ID NO: 817443 - protein, 9 aa, Homo Sapiens
KKEEKTKWK

SEQ ID NO: 817444 - protein, 9 aa, Homo Sapiens
NCLTCMMCN

SEQ ID NO: 817445 - protein, 9 aa, Homo Sapiens
RLQLKPQTV

SEQ ID NO: 817446 - protein, 9 aa, Homo Sapiens
DPFYGIPRE

SEQ ID NO: 817447 - protein, 9 aa, Homo Sapiens
HNPLPLLPE

SEQ ID NO: 817448 - protein, 9 aa, Homo Sapiens
HQGIYEHIS

SEQ ID NO: 817449 - protein, 9 aa, Homo Sapiens
TIIKYLDYE

SEQ ID NO: 817450 - protein, 9 aa, Homo Sapiens
CQRRLIPHP

SEQ ID NO: 817451 - protein, 9 aa, Homo Sapiens
LEISLSVGQ

SEQ ID NO: 817452 - protein, 9 aa, Homo Sapiens
SAASSYSLS

SEQ ID NO: 817453 - protein, 9 aa, Homo Sapiens
SISNPDCVI

SEQ ID NO: 817454 - protein, 9 aa, Homo Sapiens
IMAQIGSYA

SEQ ID NO: 817455 - protein, 9 aa, Homo Sapiens
CTDTIKLIV

SEQ ID NO: 817456 - protein, 9 aa, Homo Sapiens
IYAFLGLRF

SEQ ID NO: 817457 - protein, 9 aa, Homo Sapiens
KVKRVGDTV

SEQ ID NO: 817458 - protein, 9 aa, Homo Sapiens
DKCALFNSV

SEQ ID NO: 817459 - protein, 9 aa, Homo Sapiens
PVAYQVYSG

SEQ ID NO: 817460 - protein, 9 aa, Homo Sapiens
KLRKVIYCR

SEQ ID NO: 817461 - protein, 9 aa, Homo Sapiens
AARLRFPGI

SEQ ID NO: 817462 - protein, 9 aa, Homo Sapiens
THPGDTQDF

SEQ ID NO: 817463 - protein, 9 aa, Homo Sapiens
LRKDSAVCS

SEQ ID NO: 817464 - protein, 9 aa, Homo Sapiens
NELPETFPS

SEQ ID NO: 817465 - protein, 9 aa, Homo Sapiens
PLTNLTDNG

SEQ ID NO: 817466 - protein, 9 aa, Homo Sapiens
GLICLKHNI

SEQ ID NO: 817467 - protein, 9 aa, Homo Sapiens
YPVVAVNSY

SEQ ID NO: 817468 - protein, 9 aa, Homo Sapiens
THKEELEGQ

SEQ ID NO: 817469 - protein, 9 aa, Homo Sapiens
DIFRQIAEA

SEQ ID NO: 817470 - protein, 9 aa, Homo Sapiens
QRKWKKIKT

SEQ ID NO: 817471 - protein, 9 aa, Homo Sapiens
RSIDPMGGN

SEQ ID NO: 817472 - protein, 9 aa, Homo Sapiens
QSETSYWKV

SEQ ID NO: 817473 - protein, 9 aa, Homo Sapiens
VFDNQFGLD

SEQ ID NO: 817474 - protein, 9 aa, Homo Sapiens
TFPSLPRSP

SEQ ID NO: 817475 - protein, 9 aa, Homo Sapiens
RCSAYFLRY

SEQ ID NO: 817476 - protein, 9 aa, Homo Sapiens
RQEELESTK

SEQ ID NO: 817477 - protein, 9 aa, Homo Sapiens
SVALCVTAC

SEQ ID NO: 817478 - protein, 9 aa, Homo Sapiens
ELGESCLNT

SEQ ID NO: 817479 - protein, 9 aa, Homo Sapiens
EMLTLHTWL

SEQ ID NO: 817480 - protein, 9 aa, Homo Sapiens
QIEQDRGEW

SEQ ID NO: 817481 - protein, 9 aa, Homo Sapiens
KILVSAPTF

SEQ ID NO: 817482 - protein, 9 aa, Homo Sapiens
QAPGRYFKH

SEQ ID NO: 817483 - protein, 9 aa, Homo Sapiens
KLLPSVTKL

SEQ ID NO: 817484 - protein, 9 aa, Homo Sapiens
EQDQHMVQN

SEQ ID NO: 817485 - protein, 9 aa, Homo Sapiens
DAKIEKVRK

SEQ ID NO: 817486 - protein, 9 aa, Homo Sapiens
YQQEWQRFG

SEQ ID NO: 817487 - protein, 9 aa, Homo Sapiens
DNIFAIKYW

SEQ ID NO: 817488 - protein, 9 aa, Homo Sapiens
HSAVLPGVA

SEQ ID NO: 817489 - protein, 9 aa, Homo Sapiens
MLRMSKGLD

SEQ ID NO: 817490 - protein, 9 aa, Homo Sapiens
DAQVVMGNK

SEQ ID NO: 817491 - protein, 9 aa, Homo Sapiens
TSANSSFKP

SEQ ID NO: 817492 - protein, 9 aa, Homo Sapiens
SVDKTSFLF

SEQ ID NO: 817493 - protein, 9 aa, Homo Sapiens
KVAKTPTNK

SEQ ID NO: 817494 - protein, 9 aa, Homo Sapiens
AHRTCLEPH

SEQ ID NO: 817495 - protein, 9 aa, Homo Sapiens
FPALRKNTN

SEQ ID NO: 817496 - protein, 9 aa, Homo Sapiens
GMPGSHHDS

SEQ ID NO: 817497 - protein, 9 aa, Homo Sapiens
KQLCNSTYR

SEQ ID NO: 817498 - protein, 9 aa, Homo Sapiens
PYRRCYLFS

SEQ ID NO: 817499 - protein, 9 aa, Homo Sapiens
IKLELGGDS

SEQ ID NO: 817500 - protein, 9 aa, Homo Sapiens
VFHQCSNSN

SEQ ID NO: 817501 - protein, 9 aa, Homo Sapiens
FDLSICCGL

SEQ ID NO: 817502 - protein, 9 aa, Homo Sapiens
PTAQTFDWM

SEQ ID NO: 817503 - protein, 9 aa, Homo Sapiens
LAYLLRHPE

SEQ ID NO: 817504 - protein, 9 aa, Homo Sapiens
HYRGEKLTL

SEQ ID NO: 817505 - protein, 9 aa, Homo Sapiens
RGVLRYGGQ

SEQ ID NO: 817506 - protein, 9 aa, Homo Sapiens
IHAYGNITE

SEQ ID NO: 817507 - protein, 9 aa, Homo Sapiens
YSSCLTIFL

SEQ ID NO: 817508 - protein, 9 aa, Homo Sapiens
QKSSYNYIL

SEQ ID NO: 817509 - protein, 9 aa, Homo Sapiens
RLEKEMSKL

SEQ ID NO: 817510 - protein, 9 aa, Homo Sapiens
PSPNNSPKK

SEQ ID NO: 817511 - protein, 9 aa, Homo Sapiens
ESQRSWNVN

SEQ ID NO: 817512 - protein, 9 aa, Homo Sapiens
EDRVEDLWR

SEQ ID NO: 817513 - protein, 9 aa, Homo Sapiens
LPGKRYVAV

SEQ ID NO: 817514 - protein, 9 aa, Homo Sapiens
ANQLDAQKS

SEQ ID NO: 817515 - protein, 9 aa, Homo Sapiens
ANHRIIHTG

SEQ ID NO: 817516 - protein, 9 aa, Homo Sapiens
LERTLDDDD

SEQ ID NO: 817517 - protein, 9 aa, Homo Sapiens
LRLLGSSNY

SEQ ID NO: 817518 - protein, 9 aa, Homo Sapiens
YGKKHKKNA

SEQ ID NO: 817519 - protein, 9 aa, Homo Sapiens
DDRRRMPGG

SEQ ID NO: 817520 - protein, 9 aa, Homo Sapiens
PVEHGKFIE

SEQ ID NO: 817521 - protein, 9 aa, Homo Sapiens
SASQNLEPK

SEQ ID NO: 817522 - protein, 9 aa, Homo Sapiens
SSARALGKT

SEQ ID NO: 817523 - protein, 9 aa, Homo Sapiens
SDSVEAATN

SEQ ID NO: 817524 - protein, 9 aa, Homo Sapiens
APDIRRRLR

SEQ ID NO: 817525 - protein, 9 aa, Homo Sapiens
LDKTCHQCI

SEQ ID NO: 817526 - protein, 9 aa, Homo Sapiens
LPKYQAGEG

SEQ ID NO: 817527 - protein, 9 aa, Homo Sapiens
GVKVKGPRN

SEQ ID NO: 817528 - protein, 9 aa, Homo Sapiens
IIGAKHSRL

SEQ ID NO: 817529 - protein, 9 aa, Homo Sapiens
GTSELPLKL

SEQ ID NO: 817530 - protein, 9 aa, Homo Sapiens
AHLANHRII

SEQ ID NO: 817531 - protein, 9 aa, Homo Sapiens
PCVGGDGGP

SEQ ID NO: 817532 - protein, 9 aa, Homo Sapiens
GISYLIPST

SEQ ID NO: 817533 - protein, 9 aa, Homo Sapiens
GQLPIYSEN

SEQ ID NO: 817534 - protein, 9 aa, Homo Sapiens
EACIKIGVP

SEQ ID NO: 817535 - protein, 9 aa, Homo Sapiens
PLKPTMKML

SEQ ID NO: 817536 - protein, 9 aa, Homo Sapiens
GSSGFFLVK

SEQ ID NO: 817537 - protein, 9 aa, Homo Sapiens
PTRIIWKRT

SEQ ID NO: 817538 - protein, 9 aa, Homo Sapiens
GSLGSDMGG

SEQ ID NO: 817539 - protein, 9 aa, Homo Sapiens
DNYSHLISL

SEQ ID NO: 817540 - protein, 9 aa, Homo Sapiens
DPLHPDTWL

SEQ ID NO: 817541 - protein, 9 aa, Homo Sapiens
IINSFVTDI

SEQ ID NO: 817542 - protein, 9 aa, Homo Sapiens
EKGIYYIPL

SEQ ID NO: 817543 - protein, 9 aa, Homo Sapiens
PASKRVVSI

SEQ ID NO: 817544 - protein, 9 aa, Homo Sapiens
NENGKGRCP

SEQ ID NO: 817545 - protein, 9 aa, Homo Sapiens
KGPGGGMGN

SEQ ID NO: 817546 - protein, 9 aa, Homo Sapiens
SDSEFNQLR

SEQ ID NO: 817547 - protein, 9 aa, Homo Sapiens
KQQKQLQDQ

SEQ ID NO: 817548 - protein, 9 aa, Homo Sapiens
GKHSEIYNT

SEQ ID NO: 817549 - protein, 9 aa, Homo Sapiens
QIISEGIYA

SEQ ID NO: 817550 - protein, 9 aa, Homo Sapiens
DLAGCIHSL

SEQ ID NO: 817551 - protein, 9 aa, Homo Sapiens
SGDPFIKDG

SEQ ID NO: 817552 - protein, 9 aa, Homo Sapiens
YCYTDVALP

SEQ ID NO: 817553 - protein, 9 aa, Homo Sapiens
LGSSNYRAS

SEQ ID NO: 817554 - protein, 9 aa, Homo Sapiens
MTITGDDVS

SEQ ID NO: 817555 - protein, 9 aa, Homo Sapiens
PTECFSFWY

SEQ ID NO: 817556 - protein, 9 aa, Homo Sapiens
IIYHDVTSL

SEQ ID NO: 817557 - protein, 9 aa, Homo Sapiens
NRKIQEHWT

SEQ ID NO: 817558 - protein, 9 aa, Homo Sapiens
PKGKDYCIL

SEQ ID NO: 817559 - protein, 9 aa, Homo Sapiens
VRDITIATR

SEQ ID NO: 817560 - protein, 9 aa, Homo Sapiens
EVCTSLTQS

SEQ ID NO: 817561 - protein, 9 aa, Homo Sapiens
YNQINYVIK

SEQ ID NO: 817562 - protein, 9 aa, Homo Sapiens
DGDDDEDSN

SEQ ID NO: 817563 - protein, 9 aa, Homo Sapiens
VKHQPPPIK

SEQ ID NO: 817564 - protein, 9 aa, Homo Sapiens
HLQSSQFGN

SEQ ID NO: 817565 - protein, 9 aa, Homo Sapiens
FKKTFDECQ

SEQ ID NO: 817566 - protein, 9 aa, Homo Sapiens
NLQYHFESK

SEQ ID NO: 817567 - protein, 9 aa, Homo Sapiens
EPFANKECS

SEQ ID NO: 817568 - protein, 9 aa, Homo Sapiens
GQRSSPLHY

SEQ ID NO: 817569 - protein, 9 aa, Homo Sapiens
TLSHNNMIS

SEQ ID NO: 817570 - protein, 9 aa, Homo Sapiens
PSEPVSSLE

SEQ ID NO: 817571 - protein, 9 aa, Homo Sapiens
PGVFNSTSS

SEQ ID NO: 817572 - protein, 9 aa, Homo Sapiens
STFNLFEPL

SEQ ID NO: 817573 - protein, 9 aa, Homo Sapiens
LLVHKLPEK

SEQ ID NO: 817574 - protein, 9 aa, Homo Sapiens
GTDEEEEEC

SEQ ID NO: 817575 - protein, 9 aa, Homo Sapiens
VNLVGKDSY

SEQ ID NO: 817576 - protein, 9 aa, Homo Sapiens
SWSLAPQDS

SEQ ID NO: 817577 - protein, 9 aa, Homo Sapiens
FVTKVMNLF

SEQ ID NO: 817578 - protein, 9 aa, Homo Sapiens
FMRQLFQDY

SEQ ID NO: 817579 - protein, 9 aa, Homo Sapiens
LNIKDLLED

SEQ ID NO: 817580 - protein, 9 aa, Homo Sapiens
ILMVDIYLL

SEQ ID NO: 817581 - protein, 9 aa, Homo Sapiens
SMYRKYDLT

SEQ ID NO: 817582 - protein, 9 aa, Homo Sapiens
GLFKMYPLP

SEQ ID NO: 817583 - protein, 9 aa, Homo Sapiens
CTFMAVTEN

SEQ ID NO: 817584 - protein, 9 aa, Homo Sapiens
DEEVYSVLF

SEQ ID NO: 817585 - protein, 9 aa, Homo Sapiens
LLRLLCLIP

SEQ ID NO: 817586 - protein, 9 aa, Homo Sapiens
RKDSAVCST

SEQ ID NO: 817587 - protein, 9 aa, Homo Sapiens
NELEEMQQR

SEQ ID NO: 817588 - protein, 9 aa, Homo Sapiens
TGEPLHLIV

SEQ ID NO: 817589 - protein, 9 aa, Homo Sapiens
NEHLSPVVT

SEQ ID NO: 817590 - protein, 9 aa, Homo Sapiens
PLPQLLDDS

SEQ ID NO: 817591 - protein, 9 aa, Homo Sapiens
RHKELFSLF

SEQ ID NO: 817592 - protein, 9 aa, Homo Sapiens
TEGFSSDGD

SEQ ID NO: 817593 - protein, 9 aa, Homo Sapiens
LSPVAVQVG

SEQ ID NO: 817594 - protein, 9 aa, Homo Sapiens
AHPWQQVDK

SEQ ID NO: 817595 - protein, 9 aa, Homo Sapiens
AKEASNIIL

SEQ ID NO: 817596 - protein, 9 aa, Homo Sapiens
TSESLFELN

SEQ ID NO: 817597 - protein, 9 aa, Homo Sapiens
GTNQPDILD

SEQ ID NO: 817598 - protein, 9 aa, Homo Sapiens
RYLIGKYIT

SEQ ID NO: 817599 - protein, 9 aa, Homo Sapiens
VEDHVQIWE

SEQ ID NO: 817600 - protein, 9 aa, Homo Sapiens
SIHSKYKII

SEQ ID NO: 817601 - protein, 9 aa, Homo Sapiens
CAIYDFEAA

SEQ ID NO: 817602 - protein, 9 aa, Homo Sapiens
LLLCNQLLR

SEQ ID NO: 817603 - protein, 9 aa, Homo Sapiens
IKALLEITG

SEQ ID NO: 817604 - protein, 9 aa, Homo Sapiens
LSSSVVDTQ

SEQ ID NO: 817605 - protein, 9 aa, Homo Sapiens
LVAVALASA

SEQ ID NO: 817606 - protein, 9 aa, Homo Sapiens
IFKQLLWGP

SEQ ID NO: 817607 - protein, 9 aa, Homo Sapiens
IITPTLNYL

SEQ ID NO: 817608 - protein, 9 aa, Homo Sapiens
KITDKYRTY

SEQ ID NO: 817609 - protein, 9 aa, Homo Sapiens
ALTSTSNLA

SEQ ID NO: 817610 - protein, 9 aa, Homo Sapiens
YQNRVPLNE

SEQ ID NO: 817611 - protein, 9 aa, Homo Sapiens
GNGGDEWEQ

SEQ ID NO: 817612 - protein, 9 aa, Homo Sapiens
LTLPFWVHA

SEQ ID NO: 817613 - protein, 9 aa, Homo Sapiens
KKPISKKPT

SEQ ID NO: 817614 - protein, 9 aa, Homo Sapiens
AAAAAVVHK

SEQ ID NO: 817615 - protein, 9 aa, Homo Sapiens
LANQSLRYY

SEQ ID NO: 817616 - protein, 9 aa, Homo Sapiens
TRGIFKTKF

SEQ ID NO: 817617 - protein, 9 aa, Homo Sapiens
PKMLRMSKG

SEQ ID NO: 817618 - protein, 9 aa, Homo Sapiens
EKNKVPAPC

SEQ ID NO: 817619 - protein, 9 aa, Homo Sapiens
IFIYNIPPN

SEQ ID NO: 817620 - protein, 9 aa, Homo Sapiens
YGALSLINN

SEQ ID NO: 817621 - protein, 9 aa, Homo Sapiens
YNMVHRIDL

SEQ ID NO: 817622 - protein, 9 aa, Homo Sapiens
WNPTSQENN

SEQ ID NO: 817623 - protein, 9 aa, Homo Sapiens
HVAENVSKK

SEQ ID NO: 817624 - protein, 9 aa, Homo Sapiens
AEKPKPVQL

SEQ ID NO: 817625 - protein, 9 aa, Homo Sapiens
TNMKTADKV

SEQ ID NO: 817626 - protein, 9 aa, Homo Sapiens
IHASPQPLL

SEQ ID NO: 817627 - protein, 9 aa, Homo Sapiens
QLHSEAAYK

SEQ ID NO: 817628 - protein, 9 aa, Homo Sapiens
LFKNTGSKI

SEQ ID NO: 817629 - protein, 9 aa, Homo Sapiens
ENHICKLEE

SEQ ID NO: 817630 - protein, 9 aa, Homo Sapiens
INPPKYDKI

SEQ ID NO: 817631 - protein, 9 aa, Homo Sapiens
NLVKDLCVE

SEQ ID NO: 817632 - protein, 9 aa, Homo Sapiens
SSITILDKG

SEQ ID NO: 817633 - protein, 9 aa, Homo Sapiens
RYRSQSKSR

SEQ ID NO: 817634 - protein, 9 aa, Homo Sapiens
PQLHGHFEQ

SEQ ID NO: 817635 - protein, 9 aa, Homo Sapiens
INNYMKKYS

SEQ ID NO: 817636 - protein, 9 aa, Homo Sapiens
PRPPNSPLV

SEQ ID NO: 817637 - protein, 9 aa, Homo Sapiens
VPKEHTLQV

SEQ ID NO: 817638 - protein, 9 aa, Homo Sapiens
ENAGGQSDE

SEQ ID NO: 817639 - protein, 9 aa, Homo Sapiens
ILLERLQIY

SEQ ID NO: 817640 - protein, 9 aa, Homo Sapiens
SVLSGCSEQ

SEQ ID NO: 817641 - protein, 9 aa, Homo Sapiens
ATGFCLYRG

SEQ ID NO: 817642 - protein, 9 aa, Homo Sapiens
RGLQSGSAR

SEQ ID NO: 817643 - protein, 9 aa, Homo Sapiens
TPSQTTANN

SEQ ID NO: 817644 - protein, 9 aa, Homo Sapiens
VKLLLGATL

SEQ ID NO: 817645 - protein, 9 aa, Homo Sapiens
TATSEDYTL

SEQ ID NO: 817646 - protein, 9 aa, Homo Sapiens
PDSEQDKNE

SEQ ID NO: 817647 - protein, 9 aa, Homo Sapiens
YKEGERYFL

SEQ ID NO: 817648 - protein, 9 aa, Homo Sapiens
LIWDNKDYG

SEQ ID NO: 817649 - protein, 9 aa, Homo Sapiens
TRLTVNYEQ

SEQ ID NO: 817650 - protein, 9 aa, Homo Sapiens
VIDVESLVR

SEQ ID NO: 817651 - protein, 9 aa, Homo Sapiens
GGSTEYLSS

SEQ ID NO: 817652 - protein, 9 aa, Homo Sapiens
QTCGICGNF

SEQ ID NO: 817653 - protein, 9 aa, Homo Sapiens
PSYPGRAVP

SEQ ID NO: 817654 - protein, 9 aa, Homo Sapiens
YSRSLTPDY

SEQ ID NO: 817655 - protein, 9 aa, Homo Sapiens
FHLAMWTTA

SEQ ID NO: 817656 - protein, 9 aa, Homo Sapiens
VVQRGRELF

SEQ ID NO: 817657 - protein, 9 aa, Homo Sapiens
ILFYQRWPV

SEQ ID NO: 817658 - protein, 9 aa, Homo Sapiens
GSYAPAEYS

SEQ ID NO: 817659 - protein, 9 aa, Homo Sapiens
KIYNLCNGY

SEQ ID NO: 817660 - protein, 9 aa, Homo Sapiens
DVRLAQNIL

SEQ ID NO: 817661 - protein, 9 aa, Homo Sapiens
LRALKTIYV

SEQ ID NO: 817662 - protein, 9 aa, Homo Sapiens
IYKFHKTLK

SEQ ID NO: 817663 - protein, 9 aa, Homo Sapiens
NRSQGNIMS

SEQ ID NO: 817664 - protein, 9 aa, Homo Sapiens
FHPDTGNII

SEQ ID NO: 817665 - protein, 9 aa, Homo Sapiens
VPQIHWDLS

SEQ ID NO: 817666 - protein, 9 aa, Homo Sapiens
LVEAWLEIT

SEQ ID NO: 817667 - protein, 9 aa, Homo Sapiens
ALNVLFGAL

SEQ ID NO: 817668 - protein, 9 aa, Homo Sapiens
VESNLRKKA

SEQ ID NO: 817669 - protein, 9 aa, Homo Sapiens
SSRRVQIHN

SEQ ID NO: 817670 - protein, 9 aa, Homo Sapiens
GECWLEKLS

SEQ ID NO: 817671 - protein, 9 aa, Homo Sapiens
TPVEEKINS

SEQ ID NO: 817672 - protein, 9 aa, Homo Sapiens
TAIRTDIMD

SEQ ID NO: 817673 - protein, 9 aa, Homo Sapiens
KVTVNTPKE

SEQ ID NO: 817674 - protein, 9 aa, Homo Sapiens
LPNAKCEIH

SEQ ID NO: 817675 - protein, 9 aa, Homo Sapiens
LENSELRAF

SEQ ID NO: 817676 - protein, 9 aa, Homo Sapiens
GITFIKKRD

SEQ ID NO: 817677 - protein, 9 aa, Homo Sapiens
HFDGGPVIS

SEQ ID NO: 817678 - protein, 9 aa, Homo Sapiens
GREKRHRNK

SEQ ID NO: 817679 - protein, 9 aa, Homo Sapiens
KRHNLYNNP

SEQ ID NO: 817680 - protein, 9 aa, Homo Sapiens
VIRLLATNY

SEQ ID NO: 817681 - protein, 9 aa, Homo Sapiens
MTPTIQTQA

SEQ ID NO: 817682 - protein, 9 aa, Homo Sapiens
DDRIQGVLC

SEQ ID NO: 817683 - protein, 9 aa, Homo Sapiens
PGVFLSVCH

SEQ ID NO: 817684 - protein, 9 aa, Homo Sapiens
QDIEEEVAE

SEQ ID NO: 817685 - protein, 9 aa, Homo Sapiens
EFGEALFLS

SEQ ID NO: 817686 - protein, 9 aa, Homo Sapiens
SSITASLQF

SEQ ID NO: 817687 - protein, 9 aa, Homo Sapiens
GDHVQSENS

SEQ ID NO: 817688 - protein, 9 aa, Homo Sapiens
HFRTTGQSV

SEQ ID NO: 817689 - protein, 9 aa, Homo Sapiens
PIVHILMVD

SEQ ID NO: 817690 - protein, 9 aa, Homo Sapiens
NFHSLKSGS

SEQ ID NO: 817691 - protein, 9 aa, Homo Sapiens
AWPGRFLKQ

SEQ ID NO: 817692 - protein, 9 aa, Homo Sapiens
EATITNIGI

SEQ ID NO: 817693 - protein, 9 aa, Homo Sapiens
ILKEGLMLK

SEQ ID NO: 817694 - protein, 9 aa, Homo Sapiens
RKDTGSRYV

SEQ ID NO: 817695 - protein, 9 aa, Homo Sapiens
VGSWDNGKL

SEQ ID NO: 817696 - protein, 9 aa, Homo Sapiens
SWYIRSLQE

SEQ ID NO: 817697 - protein, 9 aa, Homo Sapiens
ALFFIISYL

SEQ ID NO: 817698 - protein, 9 aa, Homo Sapiens
TSGDDKLIG

SEQ ID NO: 817699 - protein, 9 aa, Homo Sapiens
TQKIAKAFA

SEQ ID NO: 817700 - protein, 9 aa, Homo Sapiens
YTGLGHSRD

SEQ ID NO: 817701 - protein, 9 aa, Homo Sapiens
KGSHMPEAT

SEQ ID NO: 817702 - protein, 9 aa, Homo Sapiens
IQIDNFRRN

SEQ ID NO: 817703 - protein, 9 aa, Homo Sapiens
NLHNNIAGR

SEQ ID NO: 817704 - protein, 9 aa, Homo Sapiens
GLPGPQGSA

SEQ ID NO: 817705 - protein, 9 aa, Homo Sapiens
PYISKAKGT

SEQ ID NO: 817706 - protein, 9 aa, Homo Sapiens
FKGDIKLSI

SEQ ID NO: 817707 - protein, 9 aa, Homo Sapiens
SGHATLHAE

SEQ ID NO: 817708 - protein, 9 aa, Homo Sapiens
DMEVLKRYA

SEQ ID NO: 817709 - protein, 9 aa, Homo Sapiens
KSSCNQNVH

SEQ ID NO: 817710 - protein, 9 aa, Homo Sapiens
PYVFKSIIE

SEQ ID NO: 817711 - protein, 9 aa, Homo Sapiens
EDLNNHFKF

SEQ ID NO: 817712 - protein, 9 aa, Homo Sapiens
SQPQQEWEN

SEQ ID NO: 817713 - protein, 9 aa, Homo Sapiens
YDYETRITE

SEQ ID NO: 817714 - protein, 9 aa, Homo Sapiens
YVNYLINPL

SEQ ID NO: 817715 - protein, 9 aa, Homo Sapiens
EEQGYDQDS

SEQ ID NO: 817716 - protein, 9 aa, Homo Sapiens
DTHKKSKKN

SEQ ID NO: 817717 - protein, 9 aa, Homo Sapiens
EKCIVETEH

SEQ ID NO: 817718 - protein, 9 aa, Homo Sapiens
TCFTLHLCS

SEQ ID NO: 817719 - protein, 9 aa, Homo Sapiens
QFIKEIVKS

SEQ ID NO: 817720 - protein, 9 aa, Homo Sapiens
KYVNIVQFY

SEQ ID NO: 817721 - protein, 9 aa, Homo Sapiens
GLEAFDDLF

SEQ ID NO: 817722 - protein, 9 aa, Homo Sapiens
NYVDNLKEK

SEQ ID NO: 817723 - protein, 9 aa, Homo Sapiens
VGTPVYISP

SEQ ID NO: 817724 - protein, 9 aa, Homo Sapiens
AQFIHLFYK

SEQ ID NO: 817725 - protein, 9 aa, Homo Sapiens
HGKPKYQNQ

SEQ ID NO: 817726 - protein, 9 aa, Homo Sapiens
ITIICLPQT

SEQ ID NO: 817727 - protein, 9 aa, Homo Sapiens
QRCLNPKLK

SEQ ID NO: 817728 - protein, 9 aa, Homo Sapiens
GNNKHSKRF

SEQ ID NO: 817729 - protein, 9 aa, Homo Sapiens
SRRPQNDRR

SEQ ID NO: 817730 - protein, 9 aa, Homo Sapiens
TTGPELGSR

SEQ ID NO: 817731 - protein, 9 aa, Homo Sapiens
ATTSNSLLV

SEQ ID NO: 817732 - protein, 9 aa, Homo Sapiens
SRKMIPERK

SEQ ID NO: 817733 - protein, 9 aa, Homo Sapiens
FFIRHHSSG

SEQ ID NO: 817734 - protein, 9 aa, Homo Sapiens
KLEDPQGNI

SEQ ID NO: 817735 - protein, 9 aa, Homo Sapiens
TSKVKLRIR

SEQ ID NO: 817736 - protein, 9 aa, Homo Sapiens
WRLICGIII

SEQ ID NO: 817737 - protein, 9 aa, Homo Sapiens
QHKLFSMVS

SEQ ID NO: 817738 - protein, 9 aa, Homo Sapiens
NANSGGRSP

SEQ ID NO: 817739 - protein, 9 aa, Homo Sapiens
IKRKEIFET

SEQ ID NO: 817740 - protein, 9 aa, Homo Sapiens
CHLQVDGGM

SEQ ID NO: 817741 - protein, 9 aa, Homo Sapiens
LVRTHNSWT

SEQ ID NO: 817742 - protein, 9 aa, Homo Sapiens
SQPSPPSSP

SEQ ID NO: 817743 - protein, 9 aa, Homo Sapiens
KGNLKLHIR

SEQ ID NO: 817744 - protein, 9 aa, Homo Sapiens
NILDPLKYH

SEQ ID NO: 817745 - protein, 9 aa, Homo Sapiens
YSLGRDQAA

SEQ ID NO: 817746 - protein, 9 aa, Homo Sapiens
YSPTSPDYS

SEQ ID NO: 817747 - protein, 9 aa, Homo Sapiens
MEYLDRNKD

SEQ ID NO: 817748 - protein, 9 aa, Homo Sapiens
MRFWAPGRS

SEQ ID NO: 817749 - protein, 9 aa, Homo Sapiens
TSVRRDCND

SEQ ID NO: 817750 - protein, 9 aa, Homo Sapiens
CGCLEYWNP

SEQ ID NO: 817751 - protein, 9 aa, Homo Sapiens
NSECSAKTL

SEQ ID NO: 817752 - protein, 9 aa, Homo Sapiens
QNPIAQSLA

SEQ ID NO: 817753 - protein, 9 aa, Homo Sapiens
TDSWNHSTT

SEQ ID NO: 817754 - protein, 9 aa, Homo Sapiens
ILSQAPDQI

SEQ ID NO: 817755 - protein, 9 aa, Homo Sapiens
PSDSQRMMY

SEQ ID NO: 817756 - protein, 9 aa, Homo Sapiens
VCAIYDFEA

SEQ ID NO: 817757 - protein, 9 aa, Homo Sapiens
DNNPLRITV

SEQ ID NO: 817758 - protein, 9 aa, Homo Sapiens
NIEHIPKFF

SEQ ID NO: 817759 - protein, 9 aa, Homo Sapiens
TFFVPYIFL

SEQ ID NO: 817760 - protein, 9 aa, Homo Sapiens
LSTKKPMDY

SEQ ID NO: 817761 - protein, 9 aa, Homo Sapiens
RKQLLVAMP

SEQ ID NO: 817762 - protein, 9 aa, Homo Sapiens
FQTEKLVEG

SEQ ID NO: 817763 - protein, 9 aa, Homo Sapiens
AYLAQHQIV

SEQ ID NO: 817764 - protein, 9 aa, Homo Sapiens
FSSPRTRTS

SEQ ID NO: 817765 - protein, 9 aa, Homo Sapiens
FLARKMHAD

SEQ ID NO: 817766 - protein, 9 aa, Homo Sapiens
AHLSRHQII

SEQ ID NO: 817767 - protein, 9 aa, Homo Sapiens
SGGEQDQEE

SEQ ID NO: 817768 - protein, 9 aa, Homo Sapiens
ELEEGITHE

SEQ ID NO: 817769 - protein, 9 aa, Homo Sapiens
VHGGDRDRM

SEQ ID NO: 817770 - protein, 9 aa, Homo Sapiens
QDLGEKHKA

SEQ ID NO: 817771 - protein, 9 aa, Homo Sapiens
HRIHTGDKP

SEQ ID NO: 817772 - protein, 9 aa, Homo Sapiens
TMESAASSQ

SEQ ID NO: 817773 - protein, 9 aa, Homo Sapiens
GTACGEIKT

SEQ ID NO: 817774 - protein, 9 aa, Homo Sapiens
SILLDMATH

SEQ ID NO: 817775 - protein, 9 aa, Homo Sapiens
QSLVAAVQD

SEQ ID NO: 817776 - protein, 9 aa, Homo Sapiens
CASSVQSHE

SEQ ID NO: 817777 - protein, 9 aa, Homo Sapiens
QPGVFNSTS

SEQ ID NO: 817778 - protein, 9 aa, Homo Sapiens
RYQNHSSTS

SEQ ID NO: 817779 - protein, 9 aa, Homo Sapiens
PHNRKQHIS

SEQ ID NO: 817780 - protein, 9 aa, Homo Sapiens
CDSHKKYSK

SEQ ID NO: 817781 - protein, 9 aa, Homo Sapiens
CSSPSELPV

SEQ ID NO: 817782 - protein, 9 aa, Homo Sapiens
HSSLAKRKI

SEQ ID NO: 817783 - protein, 9 aa, Homo Sapiens
SCHSPSPGL

SEQ ID NO: 817784 - protein, 9 aa, Homo Sapiens
ILSAPNPDG

SEQ ID NO: 817785 - protein, 9 aa, Homo Sapiens
LVVCLLCWT

SEQ ID NO: 817786 - protein, 9 aa, Homo Sapiens
NIIEDILER

SEQ ID NO: 817787 - protein, 9 aa, Homo Sapiens
YMPVTSMTI

SEQ ID NO: 817788 - protein, 9 aa, Homo Sapiens
VHQRTHNGE

SEQ ID NO: 817789 - protein, 9 aa, Homo Sapiens
HRNKLYVSP

SEQ ID NO: 817790 - protein, 9 aa, Homo Sapiens
PTLYRDVTK

SEQ ID NO: 817791 - protein, 9 aa, Homo Sapiens
KKGNCSGCI

SEQ ID NO: 817792 - protein, 9 aa, Homo Sapiens
ILTGEQIQT

SEQ ID NO: 817793 - protein, 9 aa, Homo Sapiens
LRASTASPC

SEQ ID NO: 817794 - protein, 9 aa, Homo Sapiens
SPIIAPVRS

SEQ ID NO: 817795 - protein, 9 aa, Homo Sapiens
RCVIYKKSV

SEQ ID NO: 817796 - protein, 9 aa, Homo Sapiens
PGKRYVAVA

SEQ ID NO: 817797 - protein, 9 aa, Homo Sapiens
FVETTWKIK

SEQ ID NO: 817798 - protein, 9 aa, Homo Sapiens
WCANYICSG

SEQ ID NO: 817799 - protein, 9 aa, Homo Sapiens
QAKNREPLK

SEQ ID NO: 817800 - protein, 9 aa, Homo Sapiens
LVVILIAYM

SEQ ID NO: 817801 - protein, 9 aa, Homo Sapiens
TFISDIAND

SEQ ID NO: 817802 - protein, 9 aa, Homo Sapiens
IKKMSLRSQ

SEQ ID NO: 817803 - protein, 9 aa, Homo Sapiens
KTIGSLHPM

SEQ ID NO: 817804 - protein, 9 aa, Homo Sapiens
HNSPFFHMT

SEQ ID NO: 817805 - protein, 9 aa, Homo Sapiens
PIHCGVCFG

SEQ ID NO: 817806 - protein, 9 aa, Homo Sapiens
PTDVPATGL

SEQ ID NO: 817807 - protein, 9 aa, Homo Sapiens
FWIDQQIQK

SEQ ID NO: 817808 - protein, 9 aa, Homo Sapiens
ENKRMHILH

SEQ ID NO: 817809 - protein, 9 aa, Homo Sapiens
EEGKILNQS

SEQ ID NO: 817810 - protein, 9 aa, Homo Sapiens
GHATLHAEN

SEQ ID NO: 817811 - protein, 9 aa, Homo Sapiens
IDLGAYSYR

SEQ ID NO: 817812 - protein, 9 aa, Homo Sapiens
KSSGLSCAG

SEQ ID NO: 817813 - protein, 9 aa, Homo Sapiens
LIVSERNEL

SEQ ID NO: 817814 - protein, 9 aa, Homo Sapiens
LPPSLVPLA

SEQ ID NO: 817815 - protein, 9 aa, Homo Sapiens
MALPPLDEH

SEQ ID NO: 817816 - protein, 9 aa, Homo Sapiens
QSSTLETTK

SEQ ID NO: 817817 - protein, 9 aa, Homo Sapiens
VVRGRIISG

SEQ ID NO: 817818 - protein, 9 aa, Homo Sapiens
VFPQQSLRH

SEQ ID NO: 817819 - protein, 9 aa, Homo Sapiens
LLTNLADRG

SEQ ID NO: 817820 - protein, 9 aa, Homo Sapiens
AAQISRKKQ

SEQ ID NO: 817821 - protein, 9 aa, Homo Sapiens
RITLISWTK

SEQ ID NO: 817822 - protein, 9 aa, Homo Sapiens
EKTSSSSPS

SEQ ID NO: 817823 - protein, 9 aa, Homo Sapiens
CNEGGKAFR

SEQ ID NO: 817824 - protein, 9 aa, Homo Sapiens
PFISGVEIK

SEQ ID NO: 817825 - protein, 9 aa, Homo Sapiens
ANVFHQCSN

SEQ ID NO: 817826 - protein, 9 aa, Homo Sapiens
AQPQLPPQC

SEQ ID NO: 817827 - protein, 9 aa, Homo Sapiens
NKRLCYIPL

SEQ ID NO: 817828 - protein, 9 aa, Homo Sapiens
IYIIPPYMI

SEQ ID NO: 817829 - protein, 9 aa, Homo Sapiens
GVLLCCQAG

SEQ ID NO: 817830 - protein, 9 aa, Homo Sapiens
TKRSSQTQD

SEQ ID NO: 817831 - protein, 9 aa, Homo Sapiens
SNPNGSWGK

SEQ ID NO: 817832 - protein, 9 aa, Homo Sapiens
DVESLMELL

SEQ ID NO: 817833 - protein, 9 aa, Homo Sapiens
YGDQYRTTD

SEQ ID NO: 817834 - protein, 9 aa, Homo Sapiens
VDDKGGFIP

SEQ ID NO: 817835 - protein, 9 aa, Homo Sapiens
YVDTCGQNT

SEQ ID NO: 817836 - protein, 9 aa, Homo Sapiens
NQKAKLARH

SEQ ID NO: 817837 - protein, 9 aa, Homo Sapiens
ALHSATVTP

SEQ ID NO: 817838 - protein, 9 aa, Homo Sapiens
AIADNVFLC

SEQ ID NO: 817839 - protein, 9 aa, Homo Sapiens
GSVQKSNKK

SEQ ID NO: 817840 - protein, 9 aa, Homo Sapiens
RINENRIVE

SEQ ID NO: 817841 - protein, 9 aa, Homo Sapiens
QRAAIIVGV

SEQ ID NO: 817842 - protein, 9 aa, Homo Sapiens
EFYEDHGDT

SEQ ID NO: 817843 - protein, 9 aa, Homo Sapiens
FILTPQITR

SEQ ID NO: 817844 - protein, 9 aa, Homo Sapiens
LDHFVLFFF

SEQ ID NO: 817845 - protein, 9 aa, Homo Sapiens
PSTLRQQFS

SEQ ID NO: 817846 - protein, 9 aa, Homo Sapiens
LAKILKGSG

SEQ ID NO: 817847 - protein, 9 aa, Homo Sapiens
TYRLDPNNY

SEQ ID NO: 817848 - protein, 9 aa, Homo Sapiens
VTYPCACEV

SEQ ID NO: 817849 - protein, 9 aa, Homo Sapiens
LHPKIHYMA

SEQ ID NO: 817850 - protein, 9 aa, Homo Sapiens
SRRSWLSYS

SEQ ID NO: 817851 - protein, 9 aa, Homo Sapiens
LRDSNEGRK

SEQ ID NO: 817852 - protein, 9 aa, Homo Sapiens
AAALQWESW

SEQ ID NO: 817853 - protein, 9 aa, Homo Sapiens
KRGICGCVD

SEQ ID NO: 817854 - protein, 9 aa, Homo Sapiens
SRDRLQYFT

SEQ ID NO: 817855 - protein, 9 aa, Homo Sapiens
VLKVRTEGN

SEQ ID NO: 817856 - protein, 9 aa, Homo Sapiens
YRVVDSADA

SEQ ID NO: 817857 - protein, 9 aa, Homo Sapiens
SGNTGDNFR

SEQ ID NO: 817858 - protein, 9 aa, Homo Sapiens
TNILEEKIP

SEQ ID NO: 817859 - protein, 9 aa, Homo Sapiens
IQNGTKLEP

SEQ ID NO: 817860 - protein, 9 aa, Homo Sapiens
LTNVALNNS

SEQ ID NO: 817861 - protein, 9 aa, Homo Sapiens
YAQHSYVGS

SEQ ID NO: 817862 - protein, 9 aa, Homo Sapiens
KLHKSNASK

SEQ ID NO: 817863 - protein, 9 aa, Homo Sapiens
RSAYFEFVS

SEQ ID NO: 817864 - protein, 9 aa, Homo Sapiens
IQVLSHLLI

SEQ ID NO: 817865 - protein, 9 aa, Homo Sapiens
FAMCLVRGI

SEQ ID NO: 817866 - protein, 9 aa, Homo Sapiens
NLCHVATSP

SEQ ID NO: 817867 - protein, 9 aa, Homo Sapiens
RNECTTQSN

SEQ ID NO: 817868 - protein, 9 aa, Homo Sapiens
YEQPEINRQ

SEQ ID NO: 817869 - protein, 9 aa, Homo Sapiens
LLSLAKGDQ

SEQ ID NO: 817870 - protein, 9 aa, Homo Sapiens
QSQHRKFVR

SEQ ID NO: 817871 - protein, 9 aa, Homo Sapiens
GGIYCLCHK

SEQ ID NO: 817872 - protein, 9 aa, Homo Sapiens
GEADVEFTT

SEQ ID NO: 817873 - protein, 9 aa, Homo Sapiens
QLVLEILTR

SEQ ID NO: 817874 - protein, 9 aa, Homo Sapiens
VLMFPATLP

SEQ ID NO: 817875 - protein, 9 aa, Homo Sapiens
ETHRGLYKS

SEQ ID NO: 817876 - protein, 9 aa, Homo Sapiens
FPNGKVCWT

SEQ ID NO: 817877 - protein, 9 aa, Homo Sapiens
AIKLKNVDV

SEQ ID NO: 817878 - protein, 9 aa, Homo Sapiens
DTKCNTLFV

SEQ ID NO: 817879 - protein, 9 aa, Homo Sapiens
GSAGGSILS

SEQ ID NO: 817880 - protein, 9 aa, Homo Sapiens
TKDRDSSVR

SEQ ID NO: 817881 - protein, 9 aa, Homo Sapiens
EWTSFVLQE

SEQ ID NO: 817882 - protein, 9 aa, Homo Sapiens
NHQIFHTGE

SEQ ID NO: 817883 - protein, 9 aa, Homo Sapiens
KQVRAKKPL

SEQ ID NO: 817884 - protein, 9 aa, Homo Sapiens
QLAEPQNLP

SEQ ID NO: 817885 - protein, 9 aa, Homo Sapiens
LRINFDVAR

SEQ ID NO: 817886 - protein, 9 aa, Homo Sapiens
ARSVDVSSK

SEQ ID NO: 817887 - protein, 9 aa, Homo Sapiens
KGNAIISNV

SEQ ID NO: 817888 - protein, 9 aa, Homo Sapiens
TLPAFLCLG

SEQ ID NO: 817889 - protein, 9 aa, Homo Sapiens
SQSTPKQID

SEQ ID NO: 817890 - protein, 9 aa, Homo Sapiens
FLGAHKLYF

SEQ ID NO: 817891 - protein, 9 aa, Homo Sapiens
TLPEEQLMS

SEQ ID NO: 817892 - protein, 9 aa, Homo Sapiens
NVLTFIGIN

SEQ ID NO: 817893 - protein, 9 aa, Homo Sapiens
VREDQVFPI

SEQ ID NO: 817894 - protein, 9 aa, Homo Sapiens
PQPLQSSRP

SEQ ID NO: 817895 - protein, 9 aa, Homo Sapiens
LRGNTFECD

SEQ ID NO: 817896 - protein, 9 aa, Homo Sapiens
YGFQYIYVG

SEQ ID NO: 817897 - protein, 9 aa, Homo Sapiens
DAKKYERIS

SEQ ID NO: 817898 - protein, 9 aa, Homo Sapiens
ALQSINKWA

SEQ ID NO: 817899 - protein, 9 aa, Homo Sapiens
ARYVTLENR

SEQ ID NO: 817900 - protein, 9 aa, Homo Sapiens
SPSLCIARF

SEQ ID NO: 817901 - protein, 9 aa, Homo Sapiens
ANNWELTAS

SEQ ID NO: 817902 - protein, 9 aa, Homo Sapiens
LGGKIHSKG

SEQ ID NO: 817903 - protein, 9 aa, Homo Sapiens
NSQNSLKHR

SEQ ID NO: 817904 - protein, 9 aa, Homo Sapiens
SQQWRELGE

SEQ ID NO: 817905 - protein, 9 aa, Homo Sapiens
EKPIHLTLK

SEQ ID NO: 817906 - protein, 9 aa, Homo Sapiens
HQALGTTVL

SEQ ID NO: 817907 - protein, 9 aa, Homo Sapiens
VPYVAFAMY

SEQ ID NO: 817908 - protein, 9 aa, Homo Sapiens
DESGKGVDI

SEQ ID NO: 817909 - protein, 9 aa, Homo Sapiens
LTVKEDREA

SEQ ID NO: 817910 - protein, 9 aa, Homo Sapiens
GSSTIRITG

SEQ ID NO: 817911 - protein, 9 aa, Homo Sapiens
DWWNNTEYR

SEQ ID NO: 817912 - protein, 9 aa, Homo Sapiens
NLHIAEDDG

SEQ ID NO: 817913 - protein, 9 aa, Homo Sapiens
LKKLLLVNN

SEQ ID NO: 817914 - protein, 9 aa, Homo Sapiens
GKVLQNLYS

SEQ ID NO: 817915 - protein, 9 aa, Homo Sapiens
NKLTPSNIA

SEQ ID NO: 817916 - protein, 9 aa, Homo Sapiens
WENEVNNEA

SEQ ID NO: 817917 - protein, 9 aa, Homo Sapiens
RELSERGPP

SEQ ID NO: 817918 - protein, 9 aa, Homo Sapiens
TQKYISPPE

SEQ ID NO: 817919 - protein, 9 aa, Homo Sapiens
KLAQGRGSQ

SEQ ID NO: 817920 - protein, 9 aa, Homo Sapiens
IAYSPKLER

SEQ ID NO: 817921 - protein, 9 aa, Homo Sapiens
AKCRALSKR

SEQ ID NO: 817922 - protein, 9 aa, Homo Sapiens
HFGHPDRAR

SEQ ID NO: 817923 - protein, 9 aa, Homo Sapiens
LLSVDGIWL

SEQ ID NO: 817924 - protein, 9 aa, Homo Sapiens
STWDASVLA

SEQ ID NO: 817925 - protein, 9 aa, Homo Sapiens
KLDTNERTP

SEQ ID NO: 817926 - protein, 9 aa, Homo Sapiens
SEKSTDAVL

SEQ ID NO: 817927 - protein, 9 aa, Homo Sapiens
SETAQQNNF

SEQ ID NO: 817928 - protein, 9 aa, Homo Sapiens
SPHGSSETS

SEQ ID NO: 817929 - protein, 9 aa, Homo Sapiens
EDPVCTPES

SEQ ID NO: 817930 - protein, 9 aa, Homo Sapiens
GTSVRKTLF

SEQ ID NO: 817931 - protein, 9 aa, Homo Sapiens
AVREFICLD

SEQ ID NO: 817932 - protein, 9 aa, Homo Sapiens
RYTTLSLLH

SEQ ID NO: 817933 - protein, 9 aa, Homo Sapiens
FFIGKQTVS

SEQ ID NO: 817934 - protein, 9 aa, Homo Sapiens
YSNVTEFVL

SEQ ID NO: 817935 - protein, 9 aa, Homo Sapiens
AQASAVNPL

SEQ ID NO: 817936 - protein, 9 aa, Homo Sapiens
RAHLGANEV

SEQ ID NO: 817937 - protein, 9 aa, Homo Sapiens
DDLQPWHYF

SEQ ID NO: 817938 - protein, 9 aa, Homo Sapiens
HRITAELKR

SEQ ID NO: 817939 - protein, 9 aa, Homo Sapiens
THPEFIILW

SEQ ID NO: 817940 - protein, 9 aa, Homo Sapiens
TPSKDTWPG

SEQ ID NO: 817941 - protein, 9 aa, Homo Sapiens
RREQLEKDM

SEQ ID NO: 817942 - protein, 9 aa, Homo Sapiens
RTLTYMSHQ

SEQ ID NO: 817943 - protein, 9 aa, Homo Sapiens
FQYETQQLQ

SEQ ID NO: 817944 - protein, 9 aa, Homo Sapiens
PLLKKKLWS

SEQ ID NO: 817945 - protein, 9 aa, Homo Sapiens
QIITREEFI

SEQ ID NO: 817946 - protein, 9 aa, Homo Sapiens
MNPDGNHSS

SEQ ID NO: 817947 - protein, 9 aa, Homo Sapiens
FSHLHKLSL

SEQ ID NO: 817948 - protein, 9 aa, Homo Sapiens
EICDHQAAQ

SEQ ID NO: 817949 - protein, 9 aa, Homo Sapiens
VTSGDDKLI

SEQ ID NO: 817950 - protein, 9 aa, Homo Sapiens
RFNEQAFPL

SEQ ID NO: 817951 - protein, 9 aa, Homo Sapiens
LEVNRSPSF

SEQ ID NO: 817952 - protein, 9 aa, Homo Sapiens
KGVVEEWWS

SEQ ID NO: 817953 - protein, 9 aa, Homo Sapiens
GQFTHESDE

SEQ ID NO: 817954 - protein, 9 aa, Homo Sapiens
GREDIAHSI

SEQ ID NO: 817955 - protein, 9 aa, Homo Sapiens
STRYKFYLY

SEQ ID NO: 817956 - protein, 9 aa, Homo Sapiens
LTNKLLTVY

SEQ ID NO: 817957 - protein, 9 aa, Homo Sapiens
CAVIEGHDF

SEQ ID NO: 817958 - protein, 9 aa, Homo Sapiens
GGVKTTDPK

SEQ ID NO: 817959 - protein, 9 aa, Homo Sapiens
GLPQNVHVL

SEQ ID NO: 817960 - protein, 9 aa, Homo Sapiens
LCASDGKAY

SEQ ID NO: 817961 - protein, 9 aa, Homo Sapiens
QIGHEVTVL

SEQ ID NO: 817962 - protein, 9 aa, Homo Sapiens
AVKDLMLRS

SEQ ID NO: 817963 - protein, 9 aa, Homo Sapiens
KYIVYPGIA

SEQ ID NO: 817964 - protein, 9 aa, Homo Sapiens
KSSALKAID

SEQ ID NO: 817965 - protein, 9 aa, Homo Sapiens
PPQIPNYHN

SEQ ID NO: 817966 - protein, 9 aa, Homo Sapiens
IPEGNDKAL

SEQ ID NO: 817967 - protein, 9 aa, Homo Sapiens
LDSDRDLVC

SEQ ID NO: 817968 - protein, 9 aa, Homo Sapiens
FFYHYMLTA

SEQ ID NO: 817969 - protein, 9 aa, Homo Sapiens
KISETAQQN

SEQ ID NO: 817970 - protein, 9 aa, Homo Sapiens
YNPVNFAFE

SEQ ID NO: 817971 - protein, 9 aa, Homo Sapiens
ELNILEIPG

SEQ ID NO: 817972 - protein, 9 aa, Homo Sapiens
MKGLYFAKL

SEQ ID NO: 817973 - protein, 9 aa, Homo Sapiens
ILNDPSQSK

SEQ ID NO: 817974 - protein, 9 aa, Homo Sapiens
AEDPAALTP

SEQ ID NO: 817975 - protein, 9 aa, Homo Sapiens
MLGGFLVSK

SEQ ID NO: 817976 - protein, 9 aa, Homo Sapiens
MSVAFSPTG

SEQ ID NO: 817977 - protein, 9 aa, Homo Sapiens
KISCGNVRG

SEQ ID NO: 817978 - protein, 9 aa, Homo Sapiens
QSGIDINGI

SEQ ID NO: 817979 - protein, 9 aa, Homo Sapiens
EAERVLQYL

SEQ ID NO: 817980 - protein, 9 aa, Homo Sapiens
MMTKRTKGM

SEQ ID NO: 817981 - protein, 9 aa, Homo Sapiens
EQLIQNLEE

SEQ ID NO: 817982 - protein, 9 aa, Homo Sapiens
MQTGDNLQC

SEQ ID NO: 817983 - protein, 9 aa, Homo Sapiens
NTYPPDLTS

SEQ ID NO: 817984 - protein, 9 aa, Homo Sapiens
WCVSWADLV

SEQ ID NO: 817985 - protein, 9 aa, Homo Sapiens
MPFLNDRLA

SEQ ID NO: 817986 - protein, 9 aa, Homo Sapiens
ELGTVERQG

SEQ ID NO: 817987 - protein, 9 aa, Homo Sapiens
AGEMAGASV

SEQ ID NO: 817988 - protein, 9 aa, Homo Sapiens
FGNYFTYYY

SEQ ID NO: 817989 - protein, 9 aa, Homo Sapiens
RTEQGFYVR

SEQ ID NO: 817990 - protein, 9 aa, Homo Sapiens
NTNIDNFLS

SEQ ID NO: 817991 - protein, 9 aa, Homo Sapiens
SHHRSQSSL

SEQ ID NO: 817992 - protein, 9 aa, Homo Sapiens
VKNSSHVDQ

SEQ ID NO: 817993 - protein, 9 aa, Homo Sapiens
CSKDIEFGG

SEQ ID NO: 817994 - protein, 9 aa, Homo Sapiens
ERTLETLLT

SEQ ID NO: 817995 - protein, 9 aa, Homo Sapiens
VFGLLTVLS

SEQ ID NO: 817996 - protein, 9 aa, Homo Sapiens
LYGTKIDYI

SEQ ID NO: 817997 - protein, 9 aa, Homo Sapiens
NGISRIQYC

SEQ ID NO: 817998 - protein, 9 aa, Homo Sapiens
GECGKTFIF

SEQ ID NO: 817999 - protein, 9 aa, Homo Sapiens
RSPALYFTH

SEQ ID NO: 818000 - protein, 9 aa, Homo Sapiens
IFKLLDYIV

SEQ ID NO: 818001 - protein, 9 aa, Homo Sapiens
TCQGSSQWD

SEQ ID NO: 818002 - protein, 9 aa, Homo Sapiens
QLLQGLFAL

SEQ ID NO: 818003 - protein, 9 aa, Homo Sapiens
QFFREAEET

SEQ ID NO: 818004 - protein, 9 aa, Homo Sapiens
EIVNVLLEF

SEQ ID NO: 818005 - protein, 9 aa, Homo Sapiens
DLNTNFKKI

SEQ ID NO: 818006 - protein, 9 aa, Homo Sapiens
QYFEVTQCN

SEQ ID NO: 818007 - protein, 9 aa, Homo Sapiens
YLAWRCCPG

SEQ ID NO: 818008 - protein, 9 aa, Homo Sapiens
PPPPQIPNY

SEQ ID NO: 818009 - protein, 9 aa, Homo Sapiens
VGVMPHELG

SEQ ID NO: 818010 - protein, 9 aa, Homo Sapiens
YFLLDSSEQ

SEQ ID NO: 818011 - protein, 9 aa, Homo Sapiens
EVPPDLAFN

SEQ ID NO: 818012 - protein, 9 aa, Homo Sapiens
QGQPQEAFQ

SEQ ID NO: 818013 - protein, 9 aa, Homo Sapiens
HLRFHKAPV

SEQ ID NO: 818014 - protein, 9 aa, Homo Sapiens
DARRPSNNC

SEQ ID NO: 818015 - protein, 9 aa, Homo Sapiens
GRQTYSRLQ

SEQ ID NO: 818016 - protein, 9 aa, Homo Sapiens
LFNAILIKT

SEQ ID NO: 818017 - protein, 9 aa, Homo Sapiens
GLKGLFNNN

SEQ ID NO: 818018 - protein, 9 aa, Homo Sapiens
RNISVNDSD

SEQ ID NO: 818019 - protein, 9 aa, Homo Sapiens
EAHPSNVKM

SEQ ID NO: 818020 - protein, 9 aa, Homo Sapiens
LRARLTYNL

SEQ ID NO: 818021 - protein, 9 aa, Homo Sapiens
YDISQIFYG

SEQ ID NO: 818022 - protein, 9 aa, Homo Sapiens
NSNTFGRPL

SEQ ID NO: 818023 - protein, 9 aa, Homo Sapiens
HNLAKYMFF

SEQ ID NO: 818024 - protein, 9 aa, Homo Sapiens
IALMASLAT

SEQ ID NO: 818025 - protein, 9 aa, Homo Sapiens
EAIYHGIPT

SEQ ID NO: 818026 - protein, 9 aa, Homo Sapiens
YYLCSGSSH

SEQ ID NO: 818027 - protein, 9 aa, Homo Sapiens
DHQGEIYVP

SEQ ID NO: 818028 - protein, 9 aa, Homo Sapiens
QLQKLCWEY

SEQ ID NO: 818029 - protein, 9 aa, Homo Sapiens
WGFQGTVNT

SEQ ID NO: 818030 - protein, 9 aa, Homo Sapiens
QAGGPKGKD

SEQ ID NO: 818031 - protein, 9 aa, Homo Sapiens
PHARYNMNN

SEQ ID NO: 818032 - protein, 9 aa, Homo Sapiens
SGLHSGGEG

SEQ ID NO: 818033 - protein, 9 aa, Homo Sapiens
ALCAEHQID

SEQ ID NO: 818034 - protein, 9 aa, Homo Sapiens
PGVQTQGQV

SEQ ID NO: 818035 - protein, 9 aa, Homo Sapiens
QFARVPGLV

SEQ ID NO: 818036 - protein, 9 aa, Homo Sapiens
VKKPIHKQG

SEQ ID NO: 818037 - protein, 9 aa, Homo Sapiens
ETEVKPMWP

SEQ ID NO: 818038 - protein, 9 aa, Homo Sapiens
GACTCWMAG

SEQ ID NO: 818039 - protein, 9 aa, Homo Sapiens
IGSQWILTA

SEQ ID NO: 818040 - protein, 9 aa, Homo Sapiens
NRLNNYLHF

SEQ ID NO: 818041 - protein, 9 aa, Homo Sapiens
TALPVRFLF

SEQ ID NO: 818042 - protein, 9 aa, Homo Sapiens
CIHIYKYQG

SEQ ID NO: 818043 - protein, 9 aa, Homo Sapiens
IPALVKVLL

SEQ ID NO: 818044 - protein, 9 aa, Homo Sapiens
LLCFPINVV

SEQ ID NO: 818045 - protein, 9 aa, Homo Sapiens
IIHAVEKPF

SEQ ID NO: 818046 - protein, 9 aa, Homo Sapiens
SVDYDNTTT

SEQ ID NO: 818047 - protein, 9 aa, Homo Sapiens
GPPKPLPND

SEQ ID NO: 818048 - protein, 9 aa, Homo Sapiens
PRSPALYFT

SEQ ID NO: 818049 - protein, 9 aa, Homo Sapiens
NCIAAEFNT

SEQ ID NO: 818050 - protein, 9 aa, Homo Sapiens
TGLYSKIFF

SEQ ID NO: 818051 - protein, 9 aa, Homo Sapiens
YYRTIQGFE

SEQ ID NO: 818052 - protein, 9 aa, Homo Sapiens
GDIVLEHPN

SEQ ID NO: 818053 - protein, 9 aa, Homo Sapiens
SASSKNKDK

SEQ ID NO: 818054 - protein, 9 aa, Homo Sapiens
ERVQTLLQY

SEQ ID NO: 818055 - protein, 9 aa, Homo Sapiens
VVNTGNRTI

SEQ ID NO: 818056 - protein, 9 aa, Homo Sapiens
VQLPANILT

SEQ ID NO: 818057 - protein, 9 aa, Homo Sapiens
LMFASVYIY

SEQ ID NO: 818058 - protein, 9 aa, Homo Sapiens
EVSSDDVNT

SEQ ID NO: 818059 - protein, 9 aa, Homo Sapiens
KQVYFHCLH

SEQ ID NO: 818060 - protein, 9 aa, Homo Sapiens
DVVQKLFES

SEQ ID NO: 818061 - protein, 9 aa, Homo Sapiens
EAQQLLHNG

SEQ ID NO: 818062 - protein, 9 aa, Homo Sapiens
DLKSMDEFI

SEQ ID NO: 818063 - protein, 9 aa, Homo Sapiens
RSVFPQQSL

SEQ ID NO: 818064 - protein, 9 aa, Homo Sapiens
CTLVLDTMA

SEQ ID NO: 818065 - protein, 9 aa, Homo Sapiens
VLQKLGADT

SEQ ID NO: 818066 - protein, 9 aa, Homo Sapiens
FIADLLIYI

SEQ ID NO: 818067 - protein, 9 aa, Homo Sapiens
GAPQISLAE

SEQ ID NO: 818068 - protein, 9 aa, Homo Sapiens
KYKNSESQR

SEQ ID NO: 818069 - protein, 9 aa, Homo Sapiens
RRHTQKMQH

SEQ ID NO: 818070 - protein, 9 aa, Homo Sapiens
AIDHNQMLQ

SEQ ID NO: 818071 - protein, 9 aa, Homo Sapiens
RDSHSQQWS

SEQ ID NO: 818072 - protein, 9 aa, Homo Sapiens
PALVAKCDE

SEQ ID NO: 818073 - protein, 9 aa, Homo Sapiens
KVGAPSHGA

SEQ ID NO: 818074 - protein, 9 aa, Homo Sapiens
LFHSPTEAG

SEQ ID NO: 818075 - protein, 9 aa, Homo Sapiens
RYSTFIVNK

SEQ ID NO: 818076 - protein, 9 aa, Homo Sapiens
KIAAQRCRK

SEQ ID NO: 818077 - protein, 9 aa, Homo Sapiens
DIVTILQAT

SEQ ID NO: 818078 - protein, 9 aa, Homo Sapiens
KKSAVVYML

SEQ ID NO: 818079 - protein, 9 aa, Homo Sapiens
SLRSQRLAA

SEQ ID NO: 818080 - protein, 9 aa, Homo Sapiens
IKNNEIEEL

SEQ ID NO: 818081 - protein, 9 aa, Homo Sapiens
VPSDGVAGK

SEQ ID NO: 818082 - protein, 9 aa, Homo Sapiens
KISESKSLP

SEQ ID NO: 818083 - protein, 9 aa, Homo Sapiens
LIYTCGGID

SEQ ID NO: 818084 - protein, 9 aa, Homo Sapiens
DASLKNTLK

SEQ ID NO: 818085 - protein, 9 aa, Homo Sapiens
AAAETRERK

SEQ ID NO: 818086 - protein, 9 aa, Homo Sapiens
PGLVGSPLA

SEQ ID NO: 818087 - protein, 9 aa, Homo Sapiens
KAVLKLRYK

SEQ ID NO: 818088 - protein, 9 aa, Homo Sapiens
CCHLPLMQV

SEQ ID NO: 818089 - protein, 9 aa, Homo Sapiens
WRVFHTLRG

SEQ ID NO: 818090 - protein, 9 aa, Homo Sapiens
PSQSKVMGE

SEQ ID NO: 818091 - protein, 9 aa, Homo Sapiens
HKQNLTKIP

SEQ ID NO: 818092 - protein, 9 aa, Homo Sapiens
LCRATDEMK

SEQ ID NO: 818093 - protein, 9 aa, Homo Sapiens
GYNSLEIIA

SEQ ID NO: 818094 - protein, 9 aa, Homo Sapiens
PQNVHVLKV

SEQ ID NO: 818095 - protein, 9 aa, Homo Sapiens
STLTRHRII

SEQ ID NO: 818096 - protein, 9 aa, Homo Sapiens
AKRNTVLDE

SEQ ID NO: 818097 - protein, 9 aa, Homo Sapiens
YKCSDQRGA

SEQ ID NO: 818098 - protein, 9 aa, Homo Sapiens
YLKAVKLFQ

SEQ ID NO: 818099 - protein, 9 aa, Homo Sapiens
FKKTIFSAI

SEQ ID NO: 818100 - protein, 9 aa, Homo Sapiens
QPVLNEHTF

SEQ ID NO: 818101 - protein, 9 aa, Homo Sapiens
RKRFPGKSG

SEQ ID NO: 818102 - protein, 9 aa, Homo Sapiens
ILLLLVLAN

SEQ ID NO: 818103 - protein, 9 aa, Homo Sapiens
SRSIFGTML

SEQ ID NO: 818104 - protein, 9 aa, Homo Sapiens
RTDNGIFYE

SEQ ID NO: 818105 - protein, 9 aa, Homo Sapiens
SKQSMINSL

SEQ ID NO: 818106 - protein, 9 aa, Homo Sapiens
LMLLANMAV

SEQ ID NO: 818107 - protein, 9 aa, Homo Sapiens
MAVYDFDCF

SEQ ID NO: 818108 - protein, 9 aa, Homo Sapiens
RLLSQSDSK

SEQ ID NO: 818109 - protein, 9 aa, Homo Sapiens
GKGFHDAFN

SEQ ID NO: 818110 - protein, 9 aa, Homo Sapiens
WSRTAYLFS

SEQ ID NO: 818111 - protein, 9 aa, Homo Sapiens
GNPQQTQQE

SEQ ID NO: 818112 - protein, 9 aa, Homo Sapiens
FKVEDMAEL

SEQ ID NO: 818113 - protein, 9 aa, Homo Sapiens
GAGNAKNNW

SEQ ID NO: 818114 - protein, 9 aa, Homo Sapiens
KLDFHLHVL

SEQ ID NO: 818115 - protein, 9 aa, Homo Sapiens
FRLYCLWKS

SEQ ID NO: 818116 - protein, 9 aa, Homo Sapiens
VHVQDSGKL

SEQ ID NO: 818117 - protein, 9 aa, Homo Sapiens
LTFVQSFDR

SEQ ID NO: 818118 - protein, 9 aa, Homo Sapiens
IPSSHLRFH

SEQ ID NO: 818119 - protein, 9 aa, Homo Sapiens
LGQAVVITV

SEQ ID NO: 818120 - protein, 9 aa, Homo Sapiens
TQPLLKLSC

SEQ ID NO: 818121 - protein, 9 aa, Homo Sapiens
FHQSQHRKF

SEQ ID NO: 818122 - protein, 9 aa, Homo Sapiens
YYKKINTFI

SEQ ID NO: 818123 - protein, 9 aa, Homo Sapiens
LVVEPTLTI

SEQ ID NO: 818124 - protein, 9 aa, Homo Sapiens
YFCQNIARD

SEQ ID NO: 818125 - protein, 9 aa, Homo Sapiens
NNSVLTDEE

SEQ ID NO: 818126 - protein, 9 aa, Homo Sapiens
TFKERVRSH

SEQ ID NO: 818127 - protein, 9 aa, Homo Sapiens
ELSDQQYQA

SEQ ID NO: 818128 - protein, 9 aa, Homo Sapiens
CHRKLHTGE

SEQ ID NO: 818129 - protein, 9 aa, Homo Sapiens
VLQLCSYVR

SEQ ID NO: 818130 - protein, 9 aa, Homo Sapiens
QLPKYILLE

SEQ ID NO: 818131 - protein, 9 aa, Homo Sapiens
YVLQVHDNN

SEQ ID NO: 818132 - protein, 9 aa, Homo Sapiens
GNITSVQLI

SEQ ID NO: 818133 - protein, 9 aa, Homo Sapiens
IYLLSSAYV

SEQ ID NO: 818134 - protein, 9 aa, Homo Sapiens
ESQILKALH

SEQ ID NO: 818135 - protein, 9 aa, Homo Sapiens
AAFRAGLPQ

SEQ ID NO: 818136 - protein, 9 aa, Homo Sapiens
FLADSGRKI

SEQ ID NO: 818137 - protein, 9 aa, Homo Sapiens
CFEMTDDIG

SEQ ID NO: 818138 - protein, 9 aa, Homo Sapiens
MGSKRGIYS

SEQ ID NO: 818139 - protein, 9 aa, Homo Sapiens
SVAVDLPVP

SEQ ID NO: 818140 - protein, 9 aa, Homo Sapiens
TVSQYPETE

SEQ ID NO: 818141 - protein, 9 aa, Homo Sapiens
PKNKLGVSV

SEQ ID NO: 818142 - protein, 9 aa, Homo Sapiens
KPDTLGLNS

SEQ ID NO: 818143 - protein, 9 aa, Homo Sapiens
YTPAGPGAQ

SEQ ID NO: 818144 - protein, 9 aa, Homo Sapiens
SGLSCAFGG

SEQ ID NO: 818145 - protein, 9 aa, Homo Sapiens
LDSRPRSPA

SEQ ID NO: 818146 - protein, 9 aa, Homo Sapiens
VVRLKPAIK

SEQ ID NO: 818147 - protein, 9 aa, Homo Sapiens
TQQMFDANN

SEQ ID NO: 818148 - protein, 9 aa, Homo Sapiens
SIMNKRDGT

SEQ ID NO: 818149 - protein, 9 aa, Homo Sapiens
VKNIFVGGL

SEQ ID NO: 818150 - protein, 9 aa, Homo Sapiens
MAAFAINYK

SEQ ID NO: 818151 - protein, 9 aa, Homo Sapiens
TKERYQLLS

SEQ ID NO: 818152 - protein, 9 aa, Homo Sapiens
SADGANNYF

SEQ ID NO: 818153 - protein, 9 aa, Homo Sapiens
RPGPRPPNS

SEQ ID NO: 818154 - protein, 9 aa, Homo Sapiens
PGEGLGGES

SEQ ID NO: 818155 - protein, 9 aa, Homo Sapiens
VSFSGLFAI

SEQ ID NO: 818156 - protein, 9 aa, Homo Sapiens
TVLIYFGAV

SEQ ID NO: 818157 - protein, 9 aa, Homo Sapiens
VQEQDIKTL

SEQ ID NO: 818158 - protein, 9 aa, Homo Sapiens
VNYSRLSEH

SEQ ID NO: 818159 - protein, 9 aa, Homo Sapiens
VWKKSCGRV

SEQ ID NO: 818160 - protein, 9 aa, Homo Sapiens
TLNAKSICC

SEQ ID NO: 818161 - protein, 9 aa, Homo Sapiens
PQNDWKCSH

SEQ ID NO: 818162 - protein, 9 aa, Homo Sapiens
SYSPIRRVG

SEQ ID NO: 818163 - protein, 9 aa, Homo Sapiens
ECIYAIKRS

SEQ ID NO: 818164 - protein, 9 aa, Homo Sapiens
QLIIGIPEQ

SEQ ID NO: 818165 - protein, 9 aa, Homo Sapiens
AFRNRLNNY

SEQ ID NO: 818166 - protein, 9 aa, Homo Sapiens
SNKLFMADL

SEQ ID NO: 818167 - protein, 9 aa, Homo Sapiens
RTCMMEYPS

SEQ ID NO: 818168 - protein, 9 aa, Homo Sapiens
RAISSSAIL

SEQ ID NO: 818169 - protein, 9 aa, Homo Sapiens
TLFIFNEAE

SEQ ID NO: 818170 - protein, 9 aa, Homo Sapiens
LIFKVIFGK

SEQ ID NO: 818171 - protein, 9 aa, Homo Sapiens
CNFDELNAP

SEQ ID NO: 818172 - protein, 9 aa, Homo Sapiens
NQQIIGQLS

SEQ ID NO: 818173 - protein, 9 aa, Homo Sapiens
SRLMIFSVG

SEQ ID NO: 818174 - protein, 9 aa, Homo Sapiens
LAILLCVYE

SEQ ID NO: 818175 - protein, 9 aa, Homo Sapiens
LQSLHIDQF

SEQ ID NO: 818176 - protein, 9 aa, Homo Sapiens
YGQQRYTQS

SEQ ID NO: 818177 - protein, 9 aa, Homo Sapiens
DEGMPGSHH

SEQ ID NO: 818178 - protein, 9 aa, Homo Sapiens
EFNMNLLSC

SEQ ID NO: 818179 - protein, 9 aa, Homo Sapiens
EEVSSKEIA

SEQ ID NO: 818180 - protein, 9 aa, Homo Sapiens
EEVKLKEIY

SEQ ID NO: 818181 - protein, 9 aa, Homo Sapiens
KELPARIFV

SEQ ID NO: 818182 - protein, 9 aa, Homo Sapiens
RGQDPAKRM

SEQ ID NO: 818183 - protein, 9 aa, Homo Sapiens
FKLLDYIVK

SEQ ID NO: 818184 - protein, 9 aa, Homo Sapiens
NTYWCLCTV

SEQ ID NO: 818185 - protein, 9 aa, Homo Sapiens
HLYVLVSTY

SEQ ID NO: 818186 - protein, 9 aa, Homo Sapiens
LRLFSSVYE

SEQ ID NO: 818187 - protein, 9 aa, Homo Sapiens
VKSYLYQLL

SEQ ID NO: 818188 - protein, 9 aa, Homo Sapiens
IVSYQAIGE

SEQ ID NO: 818189 - protein, 9 aa, Homo Sapiens
KLCQICQHP

SEQ ID NO: 818190 - protein, 9 aa, Homo Sapiens
FLHCIRQNV

SEQ ID NO: 818191 - protein, 9 aa, Homo Sapiens
RQREVEYLS

SEQ ID NO: 818192 - protein, 9 aa, Homo Sapiens
VIKLNYFFV

SEQ ID NO: 818193 - protein, 9 aa, Homo Sapiens
QIRSAYFEF

SEQ ID NO: 818194 - protein, 9 aa, Homo Sapiens
VKLEDEDGQ

SEQ ID NO: 818195 - protein, 9 aa, Homo Sapiens
KRALKAQQR

SEQ ID NO: 818196 - protein, 9 aa, Homo Sapiens
FDSVVSSAE

SEQ ID NO: 818197 - protein, 9 aa, Homo Sapiens
PSSADIFRQ

SEQ ID NO: 818198 - protein, 9 aa, Homo Sapiens
NVLESVTIL

SEQ ID NO: 818199 - protein, 9 aa, Homo Sapiens
MGIPIQKFI

SEQ ID NO: 818200 - protein, 9 aa, Homo Sapiens
DGISVNKAP

SEQ ID NO: 818201 - protein, 9 aa, Homo Sapiens
LAYTSYSDE

SEQ ID NO: 818202 - protein, 9 aa, Homo Sapiens
KKNDFEQGK

SEQ ID NO: 818203 - protein, 9 aa, Homo Sapiens
ELEAGNDLY

SEQ ID NO: 818204 - protein, 9 aa, Homo Sapiens
NRIKARIEL

SEQ ID NO: 818205 - protein, 9 aa, Homo Sapiens
SKEDILESS

SEQ ID NO: 818206 - protein, 9 aa, Homo Sapiens
GTDEDTIIS

SEQ ID NO: 818207 - protein, 9 aa, Homo Sapiens
CFKEKSCSV

SEQ ID NO: 818208 - protein, 9 aa, Homo Sapiens
FRSACQYVY

SEQ ID NO: 818209 - protein, 9 aa, Homo Sapiens
VVMEYLGPP

SEQ ID NO: 818210 - protein, 9 aa, Homo Sapiens
NISFVDCSK

SEQ ID NO: 818211 - protein, 9 aa, Homo Sapiens
GGRTVEVQG

SEQ ID NO: 818212 - protein, 9 aa, Homo Sapiens
FQKEDAAFT

SEQ ID NO: 818213 - protein, 9 aa, Homo Sapiens
KREISKRQF

SEQ ID NO: 818214 - protein, 9 aa, Homo Sapiens
MYPIQNMDR

SEQ ID NO: 818215 - protein, 9 aa, Homo Sapiens
PASSPSVSG

SEQ ID NO: 818216 - protein, 9 aa, Homo Sapiens
LNWCAWFLQ

SEQ ID NO: 818217 - protein, 9 aa, Homo Sapiens
KLRFRASEH

SEQ ID NO: 818218 - protein, 9 aa, Homo Sapiens
VSSKQSPGE

SEQ ID NO: 818219 - protein, 9 aa, Homo Sapiens
RMSHKNFHA

SEQ ID NO: 818220 - protein, 9 aa, Homo Sapiens
DGDPRKDTG

SEQ ID NO: 818221 - protein, 9 aa, Homo Sapiens
RIKKDEDEE

SEQ ID NO: 818222 - protein, 9 aa, Homo Sapiens
AFDERNAIC

SEQ ID NO: 818223 - protein, 9 aa, Homo Sapiens
DGTSELPLK

SEQ ID NO: 818224 - protein, 9 aa, Homo Sapiens
EVRSDRDKL

SEQ ID NO: 818225 - protein, 9 aa, Homo Sapiens
TDLECKYIT

SEQ ID NO: 818226 - protein, 9 aa, Homo Sapiens
EGDKYIEEA

SEQ ID NO: 818227 - protein, 9 aa, Homo Sapiens
VIHLYQALA

SEQ ID NO: 818228 - protein, 9 aa, Homo Sapiens
GPEGQPTAS

SEQ ID NO: 818229 - protein, 9 aa, Homo Sapiens
VRAANSKVT

SEQ ID NO: 818230 - protein, 9 aa, Homo Sapiens
YEALQAFKF

SEQ ID NO: 818231 - protein, 9 aa, Homo Sapiens
KYAELAGLE

SEQ ID NO: 818232 - protein, 9 aa, Homo Sapiens
ADQTALRVS

SEQ ID NO: 818233 - protein, 9 aa, Homo Sapiens
RRLRMLALG

SEQ ID NO: 818234 - protein, 9 aa, Homo Sapiens
SHRGSSSPQ

SEQ ID NO: 818235 - protein, 9 aa, Homo Sapiens
NYSYGQQRY

SEQ ID NO: 818236 - protein, 9 aa, Homo Sapiens
PGCYNVLNN

SEQ ID NO: 818237 - protein, 9 aa, Homo Sapiens
SVAIEVIKD

SEQ ID NO: 818238 - protein, 9 aa, Homo Sapiens
LGITDNLTR

SEQ ID NO: 818239 - protein, 9 aa, Homo Sapiens
VGEIITQMQ

SEQ ID NO: 818240 - protein, 9 aa, Homo Sapiens
YNRCTFETA

SEQ ID NO: 818241 - protein, 9 aa, Homo Sapiens
YHSELDKYE

SEQ ID NO: 818242 - protein, 9 aa, Homo Sapiens
INLAAAAHS

SEQ ID NO: 818243 - protein, 9 aa, Homo Sapiens
PGLFDGLLT

SEQ ID NO: 818244 - protein, 9 aa, Homo Sapiens
VNAIHLLVH

SEQ ID NO: 818245 - protein, 9 aa, Homo Sapiens
IVLIVEKGM

SEQ ID NO: 818246 - protein, 9 aa, Homo Sapiens
NLKNMEIPS

SEQ ID NO: 818247 - protein, 9 aa, Homo Sapiens
TRPSQRCVT

SEQ ID NO: 818248 - protein, 9 aa, Homo Sapiens
HMHRFYMIQ

SEQ ID NO: 818249 - protein, 9 aa, Homo Sapiens
AFSLIQDNE

SEQ ID NO: 818250 - protein, 9 aa, Homo Sapiens
TGNLAMNYS

SEQ ID NO: 818251 - protein, 9 aa, Homo Sapiens
DGDITLVEL

SEQ ID NO: 818252 - protein, 9 aa, Homo Sapiens
NEQQDLPIL

SEQ ID NO: 818253 - protein, 9 aa, Homo Sapiens
NSKIFFLYM

SEQ ID NO: 818254 - protein, 9 aa, Homo Sapiens
HDDDLDELM

SEQ ID NO: 818255 - protein, 9 aa, Homo Sapiens
PSVPMCDLY

SEQ ID NO: 818256 - protein, 9 aa, Homo Sapiens
FVSVRPERA

SEQ ID NO: 818257 - protein, 9 aa, Homo Sapiens
TDNPKHSTR

SEQ ID NO: 818258 - protein, 9 aa, Homo Sapiens
FHCNSCPSL

SEQ ID NO: 818259 - protein, 9 aa, Homo Sapiens
SGIGGLLVS

SEQ ID NO: 818260 - protein, 9 aa, Homo Sapiens
ESTELVPLV

SEQ ID NO: 818261 - protein, 9 aa, Homo Sapiens
VRISTSTFF

SEQ ID NO: 818262 - protein, 9 aa, Homo Sapiens
SRAIIKAGD

SEQ ID NO: 818263 - protein, 9 aa, Homo Sapiens
LVDVLVDYG

SEQ ID NO: 818264 - protein, 9 aa, Homo Sapiens
SFSLILHQK

SEQ ID NO: 818265 - protein, 9 aa, Homo Sapiens
NNEDNDIAI

SEQ ID NO: 818266 - protein, 9 aa, Homo Sapiens
LPIIVLLMH

SEQ ID NO: 818267 - protein, 9 aa, Homo Sapiens
YKVLIQPLN

SEQ ID NO: 818268 - protein, 9 aa, Homo Sapiens
ETVKNRMGR

SEQ ID NO: 818269 - protein, 9 aa, Homo Sapiens
IPDYPGLFP

SEQ ID NO: 818270 - protein, 9 aa, Homo Sapiens
IFPAMAKKI

SEQ ID NO: 818271 - protein, 9 aa, Homo Sapiens
MLAAPQIPS

SEQ ID NO: 818272 - protein, 9 aa, Homo Sapiens
HSKLLFLKT

SEQ ID NO: 818273 - protein, 9 aa, Homo Sapiens
PGLPQNVHV

SEQ ID NO: 818274 - protein, 9 aa, Homo Sapiens
DRPRFKRVL

SEQ ID NO: 818275 - protein, 9 aa, Homo Sapiens
CGVAFSRSK

SEQ ID NO: 818276 - protein, 9 aa, Homo Sapiens
NDYFFNNFT

SEQ ID NO: 818277 - protein, 9 aa, Homo Sapiens
ESIQRGQFV

SEQ ID NO: 818278 - protein, 9 aa, Homo Sapiens
PQKRSYSSS

SEQ ID NO: 818279 - protein, 9 aa, Homo Sapiens
TFHLDSLPS

SEQ ID NO: 818280 - protein, 9 aa, Homo Sapiens
SVEVIITAY

SEQ ID NO: 818281 - protein, 9 aa, Homo Sapiens
ALRNEKPVS

SEQ ID NO: 818282 - protein, 9 aa, Homo Sapiens
FPKYSTNKA

SEQ ID NO: 818283 - protein, 9 aa, Homo Sapiens
IPYWDWWDA

SEQ ID NO: 818284 - protein, 9 aa, Homo Sapiens
FELLEETTV

SEQ ID NO: 818285 - protein, 9 aa, Homo Sapiens
LPSSTSTDV

SEQ ID NO: 818286 - protein, 9 aa, Homo Sapiens
GNYRLVVFK

SEQ ID NO: 818287 - protein, 9 aa, Homo Sapiens
LQGYVPVIG

SEQ ID NO: 818288 - protein, 9 aa, Homo Sapiens
DFKIQRTEP

SEQ ID NO: 818289 - protein, 9 aa, Homo Sapiens
KWLEANAEY

SEQ ID NO: 818290 - protein, 9 aa, Homo Sapiens
KAVGKSRGK

SEQ ID NO: 818291 - protein, 9 aa, Homo Sapiens
NKTQNVSSI

SEQ ID NO: 818292 - protein, 9 aa, Homo Sapiens
PFPLRKPQK

SEQ ID NO: 818293 - protein, 9 aa, Homo Sapiens
AIHLLVHKL

SEQ ID NO: 818294 - protein, 9 aa, Homo Sapiens
ANKVMGYWY

SEQ ID NO: 818295 - protein, 9 aa, Homo Sapiens
LPYKYTSWI

SEQ ID NO: 818296 - protein, 9 aa, Homo Sapiens
DGHGNSPLF

SEQ ID NO: 818297 - protein, 9 aa, Homo Sapiens
EYTKQLIIS

SEQ ID NO: 818298 - protein, 9 aa, Homo Sapiens
SLIIHQGAQ

SEQ ID NO: 818299 - protein, 9 aa, Homo Sapiens
NRTYIFTFL

SEQ ID NO: 818300 - protein, 9 aa, Homo Sapiens
LIHKSIDLG

SEQ ID NO: 818301 - protein, 9 aa, Homo Sapiens
ATRKCYRMV

SEQ ID NO: 818302 - protein, 9 aa, Homo Sapiens
TRTHSGEKP

SEQ ID NO: 818303 - protein, 9 aa, Homo Sapiens
RRGGDEYDG

SEQ ID NO: 818304 - protein, 9 aa, Homo Sapiens
QAAPDIRRR

SEQ ID NO: 818305 - protein, 9 aa, Homo Sapiens
ACDQRVIIV

SEQ ID NO: 818306 - protein, 9 aa, Homo Sapiens
KYAVPFVSP

SEQ ID NO: 818307 - protein, 9 aa, Homo Sapiens
YHQGQPQTT

SEQ ID NO: 818308 - protein, 9 aa, Homo Sapiens
TKSYHLKAH

SEQ ID NO: 818309 - protein, 9 aa, Homo Sapiens
KYSKSSTYS

SEQ ID NO: 818310 - protein, 9 aa, Homo Sapiens
NKNIQHINI

SEQ ID NO: 818311 - protein, 9 aa, Homo Sapiens
AGLYNSGDG

SEQ ID NO: 818312 - protein, 9 aa, Homo Sapiens
VTGTSLGGV

SEQ ID NO: 818313 - protein, 9 aa, Homo Sapiens
LIRQQIYYK

SEQ ID NO: 818314 - protein, 9 aa, Homo Sapiens
DNGWDESTL

SEQ ID NO: 818315 - protein, 9 aa, Homo Sapiens
GQMLGGFLV

SEQ ID NO: 818316 - protein, 9 aa, Homo Sapiens
GLQTPLLTL

SEQ ID NO: 818317 - protein, 9 aa, Homo Sapiens
PPGLPGPLG

SEQ ID NO: 818318 - protein, 9 aa, Homo Sapiens
LQKQHALYL

SEQ ID NO: 818319 - protein, 9 aa, Homo Sapiens
LITDFKRFV

SEQ ID NO: 818320 - protein, 9 aa, Homo Sapiens
HQVTESKGV

SEQ ID NO: 818321 - protein, 9 aa, Homo Sapiens
ASAELKILV

SEQ ID NO: 818322 - protein, 9 aa, Homo Sapiens
NKCPARVAY

SEQ ID NO: 818323 - protein, 9 aa, Homo Sapiens
ECSTFLTSY

SEQ ID NO: 818324 - protein, 9 aa, Homo Sapiens
ECSLWGSWL

SEQ ID NO: 818325 - protein, 9 aa, Homo Sapiens
TLSKLSHDA

SEQ ID NO: 818326 - protein, 9 aa, Homo Sapiens
LLRGSAGAA

SEQ ID NO: 818327 - protein, 9 aa, Homo Sapiens
KTMYLQQYV

SEQ ID NO: 818328 - protein, 9 aa, Homo Sapiens
YCLLKASEP

SEQ ID NO: 818329 - protein, 9 aa, Homo Sapiens
PEIDKVCFV

SEQ ID NO: 818330 - protein, 9 aa, Homo Sapiens
MKMLERSNH

SEQ ID NO: 818331 - protein, 9 aa, Homo Sapiens
CTAIRTDIM

SEQ ID NO: 818332 - protein, 9 aa, Homo Sapiens
TCVHQALKD

SEQ ID NO: 818333 - protein, 9 aa, Homo Sapiens
LCVCIMMNE

SEQ ID NO: 818334 - protein, 9 aa, Homo Sapiens
NSPLFFLKS

SEQ ID NO: 818335 - protein, 9 aa, Homo Sapiens
CKAEGLGTG

SEQ ID NO: 818336 - protein, 9 aa, Homo Sapiens
DKYYMLICL

SEQ ID NO: 818337 - protein, 9 aa, Homo Sapiens
KHEIKAAKT

SEQ ID NO: 818338 - protein, 9 aa, Homo Sapiens
HFIRCIYNL

SEQ ID NO: 818339 - protein, 9 aa, Homo Sapiens
FRDAETDQI

SEQ ID NO: 818340 - protein, 9 aa, Homo Sapiens
KVEIGPVTN

SEQ ID NO: 818341 - protein, 9 aa, Homo Sapiens
ALGTHRMAK

SEQ ID NO: 818342 - protein, 9 aa, Homo Sapiens
NDFNYLKLL

SEQ ID NO: 818343 - protein, 9 aa, Homo Sapiens
LRDLFLSDR

SEQ ID NO: 818344 - protein, 9 aa, Homo Sapiens
LFNYILVYG

SEQ ID NO: 818345 - protein, 9 aa, Homo Sapiens
YTGVKPCEC

SEQ ID NO: 818346 - protein, 9 aa, Homo Sapiens
VASFSNKIQ

SEQ ID NO: 818347 - protein, 9 aa, Homo Sapiens
DRSGSGNEE

SEQ ID NO: 818348 - protein, 9 aa, Homo Sapiens
KYLAELMVH

SEQ ID NO: 818349 - protein, 9 aa, Homo Sapiens
AYARDNQHQ

SEQ ID NO: 818350 - protein, 9 aa, Homo Sapiens
HARYNMNNA

SEQ ID NO: 818351 - protein, 9 aa, Homo Sapiens
LLIRKNGRM

SEQ ID NO: 818352 - protein, 9 aa, Homo Sapiens
LTPLFEELG

SEQ ID NO: 818353 - protein, 9 aa, Homo Sapiens
GFTSGNLER

SEQ ID NO: 818354 - protein, 9 aa, Homo Sapiens
LDNLALLTS

SEQ ID NO: 818355 - protein, 9 aa, Homo Sapiens
SLPRVISPE

SEQ ID NO: 818356 - protein, 9 aa, Homo Sapiens
VREPGHSGV

SEQ ID NO: 818357 - protein, 9 aa, Homo Sapiens
TREFDSDYL

SEQ ID NO: 818358 - protein, 9 aa, Homo Sapiens
INNLWVDPC

SEQ ID NO: 818359 - protein, 9 aa, Homo Sapiens
FALHTWSKM

SEQ ID NO: 818360 - protein, 9 aa, Homo Sapiens
PMYFSLSNL

SEQ ID NO: 818361 - protein, 9 aa, Homo Sapiens
IHIRENYYR

SEQ ID NO: 818362 - protein, 9 aa, Homo Sapiens
ISIMEGHDY

SEQ ID NO: 818363 - protein, 9 aa, Homo Sapiens
NPDGNHSSD

SEQ ID NO: 818364 - protein, 9 aa, Homo Sapiens
LEAPIKLVF

SEQ ID NO: 818365 - protein, 9 aa, Homo Sapiens
NLPLYISIL

SEQ ID NO: 818366 - protein, 9 aa, Homo Sapiens
RKRRRDSLS

SEQ ID NO: 818367 - protein, 9 aa, Homo Sapiens
ADTLFWWEQ

SEQ ID NO: 818368 - protein, 9 aa, Homo Sapiens
VLIIEAHKR

SEQ ID NO: 818369 - protein, 9 aa, Homo Sapiens
RNCLWYVPR

SEQ ID NO: 818370 - protein, 9 aa, Homo Sapiens
SITAFAIER

SEQ ID NO: 818371 - protein, 9 aa, Homo Sapiens
RVCAQLNKS

SEQ ID NO: 818372 - protein, 9 aa, Homo Sapiens
PNNCRCDGK

SEQ ID NO: 818373 - protein, 9 aa, Homo Sapiens
ECFSFWYHL

SEQ ID NO: 818374 - protein, 9 aa, Homo Sapiens
FNVRPPWVS

SEQ ID NO: 818375 - protein, 9 aa, Homo Sapiens
LGRSSTLNY

SEQ ID NO: 818376 - protein, 9 aa, Homo Sapiens
EPLNTSDLS

SEQ ID NO: 818377 - protein, 9 aa, Homo Sapiens
VTTLTLRLP

SEQ ID NO: 818378 - protein, 9 aa, Homo Sapiens
FSECFFQNF

SEQ ID NO: 818379 - protein, 9 aa, Homo Sapiens
DEDTIISVL

SEQ ID NO: 818380 - protein, 9 aa, Homo Sapiens
QAFKFRVGA

SEQ ID NO: 818381 - protein, 9 aa, Homo Sapiens
ISLNKEFLN

SEQ ID NO: 818382 - protein, 9 aa, Homo Sapiens
IGKIFGPFD

SEQ ID NO: 818383 - protein, 9 aa, Homo Sapiens
SDKRDGDKK

SEQ ID NO: 818384 - protein, 9 aa, Homo Sapiens
RSSRSPRAS

SEQ ID NO: 818385 - protein, 9 aa, Homo Sapiens
SECSAKTLY

SEQ ID NO: 818386 - protein, 9 aa, Homo Sapiens
LGDNQIMPN

SEQ ID NO: 818387 - protein, 9 aa, Homo Sapiens
ITKMEISVK

SEQ ID NO: 818388 - protein, 9 aa, Homo Sapiens
KNHAAPFSN

SEQ ID NO: 818389 - protein, 9 aa, Homo Sapiens
IAGYGVEGT

SEQ ID NO: 818390 - protein, 9 aa, Homo Sapiens
VNARVCISY

SEQ ID NO: 818391 - protein, 9 aa, Homo Sapiens
YTDSDKLND

SEQ ID NO: 818392 - protein, 9 aa, Homo Sapiens
GSSYLTNSS

SEQ ID NO: 818393 - protein, 9 aa, Homo Sapiens
ELAGLEFPP

SEQ ID NO: 818394 - protein, 9 aa, Homo Sapiens
PSDSVEAAT

SEQ ID NO: 818395 - protein, 9 aa, Homo Sapiens
VSGIGGLLV

SEQ ID NO: 818396 - protein, 9 aa, Homo Sapiens
VSMYYIPAG

SEQ ID NO: 818397 - protein, 9 aa, Homo Sapiens
YGDTINRQI

SEQ ID NO: 818398 - protein, 9 aa, Homo Sapiens
CELCDGNGN

SEQ ID NO: 818399 - protein, 9 aa, Homo Sapiens
PLDSRPRSP

SEQ ID NO: 818400 - protein, 9 aa, Homo Sapiens
SVAVFLLAM

SEQ ID NO: 818401 - protein, 9 aa, Homo Sapiens
VADTSKVKL

SEQ ID NO: 818402 - protein, 9 aa, Homo Sapiens
TREVQGVRE

SEQ ID NO: 818403 - protein, 9 aa, Homo Sapiens
NFLIGILYI

SEQ ID NO: 818404 - protein, 9 aa, Homo Sapiens
FQTCKGQVR

SEQ ID NO: 818405 - protein, 9 aa, Homo Sapiens
QGTYVLQYN

SEQ ID NO: 818406 - protein, 9 aa, Homo Sapiens
PRLQLKPQT

SEQ ID NO: 818407 - protein, 9 aa, Homo Sapiens
PMSGNTGDN

SEQ ID NO: 818408 - protein, 9 aa, Homo Sapiens
IIEINVSDC

SEQ ID NO: 818409 - protein, 9 aa, Homo Sapiens
SRYRSQSKS

SEQ ID NO: 818410 - protein, 9 aa, Homo Sapiens
TLGITTVLT

SEQ ID NO: 818411 - protein, 9 aa, Homo Sapiens
KLEARLNIF

SEQ ID NO: 818412 - protein, 9 aa, Homo Sapiens
QIRRLGEPE

SEQ ID NO: 818413 - protein, 9 aa, Homo Sapiens
ADYVSSRAP

SEQ ID NO: 818414 - protein, 9 aa, Homo Sapiens
DLQDEKIIY

SEQ ID NO: 818415 - protein, 9 aa, Homo Sapiens
AFLLCVCIM

SEQ ID NO: 818416 - protein, 9 aa, Homo Sapiens
HENVIDKEL

SEQ ID NO: 818417 - protein, 9 aa, Homo Sapiens
YPQLHARKA

SEQ ID NO: 818418 - protein, 9 aa, Homo Sapiens
ELYHEVHRP

SEQ ID NO: 818419 - protein, 9 aa, Homo Sapiens
IQHVDVIKN

SEQ ID NO: 818420 - protein, 9 aa, Homo Sapiens
PCACEVKGE

SEQ ID NO: 818421 - protein, 9 aa, Homo Sapiens
CKAMENFMQ

SEQ ID NO: 818422 - protein, 9 aa, Homo Sapiens
DFNIKFAET

SEQ ID NO: 818423 - protein, 9 aa, Homo Sapiens
HEEELRLAQ

SEQ ID NO: 818424 - protein, 9 aa, Homo Sapiens
LQKLGADTV

SEQ ID NO: 818425 - protein, 9 aa, Homo Sapiens
MADGHPLKS

SEQ ID NO: 818426 - protein, 9 aa, Homo Sapiens
RRHCPRTYR

SEQ ID NO: 818427 - protein, 9 aa, Homo Sapiens
ERQDKSDTN

SEQ ID NO: 818428 - protein, 9 aa, Homo Sapiens
YTEDQNSLE

SEQ ID NO: 818429 - protein, 9 aa, Homo Sapiens
SSLFPPGYQ

SEQ ID NO: 818430 - protein, 9 aa, Homo Sapiens
EGNYLICLR

SEQ ID NO: 818431 - protein, 9 aa, Homo Sapiens
SVPSNFIGR

SEQ ID NO: 818432 - protein, 9 aa, Homo Sapiens
TTLFTYTMP

SEQ ID NO: 818433 - protein, 9 aa, Homo Sapiens
PMKAQHLLK

SEQ ID NO: 818434 - protein, 9 aa, Homo Sapiens
TGAFTFFAS

SEQ ID NO: 818435 - protein, 9 aa, Homo Sapiens
SGLINHQII

SEQ ID NO: 818436 - protein, 9 aa, Homo Sapiens
LSYLHVLLD

SEQ ID NO: 818437 - protein, 9 aa, Homo Sapiens
SHQNSRTNI

SEQ ID NO: 818438 - protein, 9 aa, Homo Sapiens
TPPARDNTD

SEQ ID NO: 818439 - protein, 9 aa, Homo Sapiens
LMAPFILRF

SEQ ID NO: 818440 - protein, 9 aa, Homo Sapiens
GSESGPSSR

SEQ ID NO: 818441 - protein, 9 aa, Homo Sapiens
LKIIDPNYR

SEQ ID NO: 818442 - protein, 9 aa, Homo Sapiens
DSTSIPQKS

SEQ ID NO: 818443 - protein, 9 aa, Homo Sapiens
PNAVDPVLN

SEQ ID NO: 818444 - protein, 9 aa, Homo Sapiens
IKRYFELYE

SEQ ID NO: 818445 - protein, 9 aa, Homo Sapiens
FKDLQTLLN

SEQ ID NO: 818446 - protein, 9 aa, Homo Sapiens
AVMVILLIE

SEQ ID NO: 818447 - protein, 9 aa, Homo Sapiens
FTHPSGVGK

SEQ ID NO: 818448 - protein, 9 aa, Homo Sapiens
GLYSKIFFI

SEQ ID NO: 818449 - protein, 9 aa, Homo Sapiens
SKRGIYSRH

SEQ ID NO: 818450 - protein, 9 aa, Homo Sapiens
CSLHSNLYR

SEQ ID NO: 818451 - protein, 9 aa, Homo Sapiens
SGFRRALQQ

SEQ ID NO: 818452 - protein, 9 aa, Homo Sapiens
NVVPNNRVQ

SEQ ID NO: 818453 - protein, 9 aa, Homo Sapiens
TYPCACEVK

SEQ ID NO: 818454 - protein, 9 aa, Homo Sapiens
TFSSPGNLQ

SEQ ID NO: 818455 - protein, 9 aa, Homo Sapiens
LTNITFGVR

SEQ ID NO: 818456 - protein, 9 aa, Homo Sapiens
YKDLLENAM

SEQ ID NO: 818457 - protein, 9 aa, Homo Sapiens
GGDHTLTYP

SEQ ID NO: 818458 - protein, 9 aa, Homo Sapiens
YVEKITRKY

SEQ ID NO: 818459 - protein, 9 aa, Homo Sapiens
LLEHPSRTI

SEQ ID NO: 818460 - protein, 9 aa, Homo Sapiens
SCAHTQVKQ

SEQ ID NO: 818461 - protein, 9 aa, Homo Sapiens
KADDSQEAN

SEQ ID NO: 818462 - protein, 9 aa, Homo Sapiens
LFRNIFGNS

SEQ ID NO: 818463 - protein, 9 aa, Homo Sapiens
ITCTNPEPR

SEQ ID NO: 818464 - protein, 9 aa, Homo Sapiens
QDNEDRNSE

SEQ ID NO: 818465 - protein, 9 aa, Homo Sapiens
TVPEVINGK

SEQ ID NO: 818466 - protein, 9 aa, Homo Sapiens
RHGHSGGYP

SEQ ID NO: 818467 - protein, 9 aa, Homo Sapiens
DEDILEVAT

SEQ ID NO: 818468 - protein, 9 aa, Homo Sapiens
WEKVNKYFD

SEQ ID NO: 818469 - protein, 9 aa, Homo Sapiens
EVSGDKSFQ

SEQ ID NO: 818470 - protein, 9 aa, Homo Sapiens
SNLQSAVSI

SEQ ID NO: 818471 - protein, 9 aa, Homo Sapiens
IFILYQNRV

SEQ ID NO: 818472 - protein, 9 aa, Homo Sapiens
MSLEVCQLC

SEQ ID NO: 818473 - protein, 9 aa, Homo Sapiens
LQPLPPGLK

SEQ ID NO: 818474 - protein, 9 aa, Homo Sapiens
DVGIYANIF

SEQ ID NO: 818475 - protein, 9 aa, Homo Sapiens
IIMLLKISC

SEQ ID NO: 818476 - protein, 9 aa, Homo Sapiens
QASPVNTCR

SEQ ID NO: 818477 - protein, 9 aa, Homo Sapiens
NAPKEYDYE

SEQ ID NO: 818478 - protein, 9 aa, Homo Sapiens
EIYVDTCGQ

SEQ ID NO: 818479 - protein, 9 aa, Homo Sapiens
FSVTWGLTT

SEQ ID NO: 818480 - protein, 9 aa, Homo Sapiens
ASRLSSTSC

SEQ ID NO: 818481 - protein, 9 aa, Homo Sapiens
EIVCDINKR

SEQ ID NO: 818482 - protein, 9 aa, Homo Sapiens
PQQAFQLWL

SEQ ID NO: 818483 - protein, 9 aa, Homo Sapiens
VYSYSGLKQ

SEQ ID NO: 818484 - protein, 9 aa, Homo Sapiens
LNRIKARIE

SEQ ID NO: 818485 - protein, 9 aa, Homo Sapiens
VDYIVLIVE

SEQ ID NO: 818486 - protein, 9 aa, Homo Sapiens
EMFAQGHPE

SEQ ID NO: 818487 - protein, 9 aa, Homo Sapiens
PGSWVCGFV

SEQ ID NO: 818488 - protein, 9 aa, Homo Sapiens
QCEPASTML

SEQ ID NO: 818489 - protein, 9 aa, Homo Sapiens
VIEGHDFVL

SEQ ID NO: 818490 - protein, 9 aa, Homo Sapiens
GIAGVDLFG

SEQ ID NO: 818491 - protein, 9 aa, Homo Sapiens
IRNPQEWHC

SEQ ID NO: 818492 - protein, 9 aa, Homo Sapiens
NAHPWQQVD

SEQ ID NO: 818493 - protein, 9 aa, Homo Sapiens
SGPPKPLPN

SEQ ID NO: 818494 - protein, 9 aa, Homo Sapiens
KLRKCIGMQ

SEQ ID NO: 818495 - protein, 9 aa, Homo Sapiens
GEKLWDHTQ

SEQ ID NO: 818496 - protein, 9 aa, Homo Sapiens
NIIMEFRHA

SEQ ID NO: 818497 - protein, 9 aa, Homo Sapiens
SSSEASFIS

SEQ ID NO: 818498 - protein, 9 aa, Homo Sapiens
LSCLPASDY

SEQ ID NO: 818499 - protein, 9 aa, Homo Sapiens
LKYAVPFVS

SEQ ID NO: 818500 - protein, 9 aa, Homo Sapiens
SMIELNKHF

SEQ ID NO: 818501 - protein, 9 aa, Homo Sapiens
FPSMSKLLR

SEQ ID NO: 818502 - protein, 9 aa, Homo Sapiens
FANKECSIL

SEQ ID NO: 818503 - protein, 9 aa, Homo Sapiens
GFAHQKLFR

SEQ ID NO: 818504 - protein, 9 aa, Homo Sapiens
SLSGSSNFG

SEQ ID NO: 818505 - protein, 9 aa, Homo Sapiens
RTTVFIADL

SEQ ID NO: 818506 - protein, 9 aa, Homo Sapiens
ANKTSYLTE

SEQ ID NO: 818507 - protein, 9 aa, Homo Sapiens
YILLKGKWL

SEQ ID NO: 818508 - protein, 9 aa, Homo Sapiens
NGADIDALC

SEQ ID NO: 818509 - protein, 9 aa, Homo Sapiens
YMKGQWPEG

SEQ ID NO: 818510 - protein, 9 aa, Homo Sapiens
RCQKVELNK

SEQ ID NO: 818511 - protein, 9 aa, Homo Sapiens
LAIDYGIKL

SEQ ID NO: 818512 - protein, 9 aa, Homo Sapiens
LAEVAEGVF

SEQ ID NO: 818513 - protein, 9 aa, Homo Sapiens
KAPGFNQRL

SEQ ID NO: 818514 - protein, 9 aa, Homo Sapiens
TIICLPQTK

SEQ ID NO: 818515 - protein, 9 aa, Homo Sapiens
FGLTGRDVL

SEQ ID NO: 818516 - protein, 9 aa, Homo Sapiens
KLIVIHFPH

SEQ ID NO: 818517 - protein, 9 aa, Homo Sapiens
MSFVAVLTQ

SEQ ID NO: 818518 - protein, 9 aa, Homo Sapiens
RNWFTDLEC

SEQ ID NO: 818519 - protein, 9 aa, Homo Sapiens
VNRGQRSSP

SEQ ID NO: 818520 - protein, 9 aa, Homo Sapiens
LLGIKNIGF

SEQ ID NO: 818521 - protein, 9 aa, Homo Sapiens
IEEYVPSIL

SEQ ID NO: 818522 - protein, 9 aa, Homo Sapiens
HTKHDRNVE

SEQ ID NO: 818523 - protein, 9 aa, Homo Sapiens
LIQAGGTKV

SEQ ID NO: 818524 - protein, 9 aa, Homo Sapiens
ELQNKIKLA

SEQ ID NO: 818525 - protein, 9 aa, Homo Sapiens
AQKTRLTVN

SEQ ID NO: 818526 - protein, 9 aa, Homo Sapiens
KETLDNKLQ

SEQ ID NO: 818527 - protein, 9 aa, Homo Sapiens
YARDNQHQD

SEQ ID NO: 818528 - protein, 9 aa, Homo Sapiens
STMVYNKFK

SEQ ID NO: 818529 - protein, 9 aa, Homo Sapiens
AYDCFIAIC

SEQ ID NO: 818530 - protein, 9 aa, Homo Sapiens
KIKFNTIAA

SEQ ID NO: 818531 - protein, 9 aa, Homo Sapiens
NIGNISYVV

SEQ ID NO: 818532 - protein, 9 aa, Homo Sapiens
LGVINAGKA

SEQ ID NO: 818533 - protein, 9 aa, Homo Sapiens
YSTFIVNKT

SEQ ID NO: 818534 - protein, 9 aa, Homo Sapiens
RNPVMELNE

SEQ ID NO: 818535 - protein, 9 aa, Homo Sapiens
QSVLLFPLI

SEQ ID NO: 818536 - protein, 9 aa, Homo Sapiens
NRKADFHGD

SEQ ID NO: 818537 - protein, 9 aa, Homo Sapiens
TFLVEEVVQ

SEQ ID NO: 818538 - protein, 9 aa, Homo Sapiens
MGVVLYAPP

SEQ ID NO: 818539 - protein, 9 aa, Homo Sapiens
TVAVQVPQH

SEQ ID NO: 818540 - protein, 9 aa, Homo Sapiens
GALGAPFWL

SEQ ID NO: 818541 - protein, 9 aa, Homo Sapiens
VDLPVPSGV

SEQ ID NO: 818542 - protein, 9 aa, Homo Sapiens
FKHECKIKY

SEQ ID NO: 818543 - protein, 9 aa, Homo Sapiens
QSLQSQIGI

SEQ ID NO: 818544 - protein, 9 aa, Homo Sapiens
YLLCLAAAP

SEQ ID NO: 818545 - protein, 9 aa, Homo Sapiens
EGQDPFLYD

SEQ ID NO: 818546 - protein, 9 aa, Homo Sapiens
TQVWKNKGA

SEQ ID NO: 818547 - protein, 9 aa, Homo Sapiens
LFIIMFIFC

SEQ ID NO: 818548 - protein, 9 aa, Homo Sapiens
INLDGYLLK

SEQ ID NO: 818549 - protein, 9 aa, Homo Sapiens
YCFYGYLVN

SEQ ID NO: 818550 - protein, 9 aa, Homo Sapiens
NQIVIRGLN

SEQ ID NO: 818551 - protein, 9 aa, Homo Sapiens
DNKVRQYDS

SEQ ID NO: 818552 - protein, 9 aa, Homo Sapiens
VIYCRKKVH

SEQ ID NO: 818553 - protein, 9 aa, Homo Sapiens
REAVIETLN

SEQ ID NO: 818554 - protein, 9 aa, Homo Sapiens
NTYTTGSKL

SEQ ID NO: 818555 - protein, 9 aa, Homo Sapiens
IFLLLINVD

SEQ ID NO: 818556 - protein, 9 aa, Homo Sapiens
LDLNFNQIA

SEQ ID NO: 818557 - protein, 9 aa, Homo Sapiens
GGRYGSSCL

SEQ ID NO: 818558 - protein, 9 aa, Homo Sapiens
RLERTLDDD

SEQ ID NO: 818559 - protein, 9 aa, Homo Sapiens
DQFGFNNEK

SEQ ID NO: 818560 - protein, 9 aa, Homo Sapiens
SLSNLSLVD

SEQ ID NO: 818561 - protein, 9 aa, Homo Sapiens
TFSLFGLRT

SEQ ID NO: 818562 - protein, 9 aa, Homo Sapiens
KLFPEFRPG

SEQ ID NO: 818563 - protein, 9 aa, Homo Sapiens
MCNYNKILA

SEQ ID NO: 818564 - protein, 9 aa, Homo Sapiens
LEANGACNV

SEQ ID NO: 818565 - protein, 9 aa, Homo Sapiens
CPALLYKAI

SEQ ID NO: 818566 - protein, 9 aa, Homo Sapiens
VAESQFNKL

SEQ ID NO: 818567 - protein, 9 aa, Homo Sapiens
QNAWLSYCL

SEQ ID NO: 818568 - protein, 9 aa, Homo Sapiens
PAERATKVE

SEQ ID NO: 818569 - protein, 9 aa, Homo Sapiens
YQSLSWIWK

SEQ ID NO: 818570 - protein, 9 aa, Homo Sapiens
KKRVETLMF

SEQ ID NO: 818571 - protein, 9 aa, Homo Sapiens
VQACHDLIK

SEQ ID NO: 818572 - protein, 9 aa, Homo Sapiens
IDEKNKSNF

SEQ ID NO: 818573 - protein, 9 aa, Homo Sapiens
TFLYTLMRE

SEQ ID NO: 818574 - protein, 9 aa, Homo Sapiens
HVGSRINYY

SEQ ID NO: 818575 - protein, 9 aa, Homo Sapiens
ELYLRQTSP

SEQ ID NO: 818576 - protein, 9 aa, Homo Sapiens
EELPKDDAN

SEQ ID NO: 818577 - protein, 9 aa, Homo Sapiens
KLEREARIR

SEQ ID NO: 818578 - protein, 9 aa, Homo Sapiens
AYTTSIPRP

SEQ ID NO: 818579 - protein, 9 aa, Homo Sapiens
VIKAPRDKY

SEQ ID NO: 818580 - protein, 9 aa, Homo Sapiens
IGYFFSIYC

SEQ ID NO: 818581 - protein, 9 aa, Homo Sapiens
FWSNYHQVT

SEQ ID NO: 818582 - protein, 9 aa, Homo Sapiens
KVVQKEKNV

SEQ ID NO: 818583 - protein, 9 aa, Homo Sapiens
PTHLPNASF

SEQ ID NO: 818584 - protein, 9 aa, Homo Sapiens
FYCDTQPLL

SEQ ID NO: 818585 - protein, 9 aa, Homo Sapiens
SENSECSAK

SEQ ID NO: 818586 - protein, 9 aa, Homo Sapiens
RGLALLRAL

SEQ ID NO: 818587 - protein, 9 aa, Homo Sapiens
MLGTPSKDT

SEQ ID NO: 818588 - protein, 9 aa, Homo Sapiens
SIQDKSKEN

SEQ ID NO: 818589 - protein, 9 aa, Homo Sapiens
EEAESLTNF

SEQ ID NO: 818590 - protein, 9 aa, Homo Sapiens
INNATITQY

SEQ ID NO: 818591 - protein, 9 aa, Homo Sapiens
NASISKTST

SEQ ID NO: 818592 - protein, 9 aa, Homo Sapiens
YLLGIHLGE

SEQ ID NO: 818593 - protein, 9 aa, Homo Sapiens
MPGGGYPHG

SEQ ID NO: 818594 - protein, 9 aa, Homo Sapiens
GVINEFMGH

SEQ ID NO: 818595 - protein, 9 aa, Homo Sapiens
SAYAKRNIS

SEQ ID NO: 818596 - protein, 9 aa, Homo Sapiens
EAVLLKRLD

SEQ ID NO: 818597 - protein, 9 aa, Homo Sapiens
INSEKEVSS

SEQ ID NO: 818598 - protein, 9 aa, Homo Sapiens
SIATDDEID

SEQ ID NO: 818599 - protein, 9 aa, Homo Sapiens
LQAWTDNER

SEQ ID NO: 818600 - protein, 9 aa, Homo Sapiens
KYVPNKALE

SEQ ID NO: 818601 - protein, 9 aa, Homo Sapiens
DYLGKVTVV

SEQ ID NO: 818602 - protein, 9 aa, Homo Sapiens
HQRINTDDK

SEQ ID NO: 818603 - protein, 9 aa, Homo Sapiens
LHWGPAGAQ

SEQ ID NO: 818604 - protein, 9 aa, Homo Sapiens
SQQCEPAST

SEQ ID NO: 818605 - protein, 9 aa, Homo Sapiens
EQLEDKLCE

SEQ ID NO: 818606 - protein, 9 aa, Homo Sapiens
RESYMSTLL

SEQ ID NO: 818607 - protein, 9 aa, Homo Sapiens
YYKSYMDTK

SEQ ID NO: 818608 - protein, 9 aa, Homo Sapiens
DYGKSFKNI

SEQ ID NO: 818609 - protein, 9 aa, Homo Sapiens
QPFRDEGEH

SEQ ID NO: 818610 - protein, 9 aa, Homo Sapiens
KDKLIKDSS

SEQ ID NO: 818611 - protein, 9 aa, Homo Sapiens
HVLYLATDR

SEQ ID NO: 818612 - protein, 9 aa, Homo Sapiens
ITIPNALIG

SEQ ID NO: 818613 - protein, 9 aa, Homo Sapiens
YKLLSTFDV

SEQ ID NO: 818614 - protein, 9 aa, Homo Sapiens
GQKTMYLQQ

SEQ ID NO: 818615 - protein, 9 aa, Homo Sapiens
DVFCKHEDY

SEQ ID NO: 818616 - protein, 9 aa, Homo Sapiens
GLEAGVNPS

SEQ ID NO: 818617 - protein, 9 aa, Homo Sapiens
RLIINYLVT

SEQ ID NO: 818618 - protein, 9 aa, Homo Sapiens
SLSEEKANG

SEQ ID NO: 818619 - protein, 9 aa, Homo Sapiens
LCALTQVVS

SEQ ID NO: 818620 - protein, 9 aa, Homo Sapiens
CSKTSDIEP

SEQ ID NO: 818621 - protein, 9 aa, Homo Sapiens
VEGGHSIES

SEQ ID NO: 818622 - protein, 9 aa, Homo Sapiens
RECIQHEPL

SEQ ID NO: 818623 - protein, 9 aa, Homo Sapiens
LTDPFDTPS

SEQ ID NO: 818624 - protein, 9 aa, Homo Sapiens
IEAFSNSGF

SEQ ID NO: 818625 - protein, 9 aa, Homo Sapiens
SILSIKSLP

SEQ ID NO: 818626 - protein, 9 aa, Homo Sapiens
FLSVCHLFT

SEQ ID NO: 818627 - protein, 9 aa, Homo Sapiens
WVEAACQAV

SEQ ID NO: 818628 - protein, 9 aa, Homo Sapiens
RSCAREQIN

SEQ ID NO: 818629 - protein, 9 aa, Homo Sapiens
LYATKTLQK

SEQ ID NO: 818630 - protein, 9 aa, Homo Sapiens
MGAAECMIL

SEQ ID NO: 818631 - protein, 9 aa, Homo Sapiens
LMEVCKEND

SEQ ID NO: 818632 - protein, 9 aa, Homo Sapiens
STTIPNMIA

SEQ ID NO: 818633 - protein, 9 aa, Homo Sapiens
WHSSLAKRK

SEQ ID NO: 818634 - protein, 9 aa, Homo Sapiens
VALDECASR

SEQ ID NO: 818635 - protein, 9 aa, Homo Sapiens
RAYQCAGRS

SEQ ID NO: 818636 - protein, 9 aa, Homo Sapiens
KRYEDRYAL

SEQ ID NO: 818637 - protein, 9 aa, Homo Sapiens
KHNSYYVHQ

SEQ ID NO: 818638 - protein, 9 aa, Homo Sapiens
LFLRLFAPA

SEQ ID NO: 818639 - protein, 9 aa, Homo Sapiens
PIQNMDRLQ

SEQ ID NO: 818640 - protein, 9 aa, Homo Sapiens
PLPSCRKSF

SEQ ID NO: 818641 - protein, 9 aa, Homo Sapiens
ALSAVTATK

SEQ ID NO: 818642 - protein, 9 aa, Homo Sapiens
EHGKFIESH

SEQ ID NO: 818643 - protein, 9 aa, Homo Sapiens
YWASTQKKI

SEQ ID NO: 818644 - protein, 9 aa, Homo Sapiens
KTVLQLSLI

SEQ ID NO: 818645 - protein, 9 aa, Homo Sapiens
FYSQWEGAT

SEQ ID NO: 818646 - protein, 9 aa, Homo Sapiens
ASNIILTDD

SEQ ID NO: 818647 - protein, 9 aa, Homo Sapiens
LLSLVDLNT

SEQ ID NO: 818648 - protein, 9 aa, Homo Sapiens
IMFENHMYI

SEQ ID NO: 818649 - protein, 9 aa, Homo Sapiens
EAGTAKDKK

SEQ ID NO: 818650 - protein, 9 aa, Homo Sapiens
LRACFVWFM

SEQ ID NO: 818651 - protein, 9 aa, Homo Sapiens
SGGHHIEGV

SEQ ID NO: 818652 - protein, 9 aa, Homo Sapiens
QLMSCGASD

SEQ ID NO: 818653 - protein, 9 aa, Homo Sapiens
CVVLLIYAD

SEQ ID NO: 818654 - protein, 9 aa, Homo Sapiens
MFMYLQPSS

SEQ ID NO: 818655 - protein, 9 aa, Homo Sapiens
SHFPAGEFT

SEQ ID NO: 818656 - protein, 9 aa, Homo Sapiens
MVADAERSI

SEQ ID NO: 818657 - protein, 9 aa, Homo Sapiens
QDKVVKSRS

SEQ ID NO: 818658 - protein, 9 aa, Homo Sapiens
TGSNGSGCT

SEQ ID NO: 818659 - protein, 9 aa, Homo Sapiens
GAKESWVNT

SEQ ID NO: 818660 - protein, 9 aa, Homo Sapiens
IECSTFLTS

SEQ ID NO: 818661 - protein, 9 aa, Homo Sapiens
RKKLGNACD

SEQ ID NO: 818662 - protein, 9 aa, Homo Sapiens
ELQECLEHD

SEQ ID NO: 818663 - protein, 9 aa, Homo Sapiens
ISYLIPSTS

SEQ ID NO: 818664 - protein, 9 aa, Homo Sapiens
SPFLWKKAQ

SEQ ID NO: 818665 - protein, 9 aa, Homo Sapiens
LTENVEVKL

SEQ ID NO: 818666 - protein, 9 aa, Homo Sapiens
DVWNMGVVL

SEQ ID NO: 818667 - protein, 9 aa, Homo Sapiens
RKDSVINIL

SEQ ID NO: 818668 - protein, 9 aa, Homo Sapiens
TVNLQNNPG

SEQ ID NO: 818669 - protein, 9 aa, Homo Sapiens
IQINLHDNP

SEQ ID NO: 818670 - protein, 9 aa, Homo Sapiens
NRYSHNELE

SEQ ID NO: 818671 - protein, 9 aa, Homo Sapiens
DKSKENSSK

SEQ ID NO: 818672 - protein, 9 aa, Homo Sapiens
WRRQVHLWT

SEQ ID NO: 818673 - protein, 9 aa, Homo Sapiens
LPQDIHKEM

SEQ ID NO: 818674 - protein, 9 aa, Homo Sapiens
HIVHIAMEA

SEQ ID NO: 818675 - protein, 9 aa, Homo Sapiens
SKRSSHHRS

SEQ ID NO: 818676 - protein, 9 aa, Homo Sapiens
IKIDQAWKI

SEQ ID NO: 818677 - protein, 9 aa, Homo Sapiens
REYYIIVCE

SEQ ID NO: 818678 - protein, 9 aa, Homo Sapiens
CIPICGEIE

SEQ ID NO: 818679 - protein, 9 aa, Homo Sapiens
EYMEKEKKT

SEQ ID NO: 818680 - protein, 9 aa, Homo Sapiens
KIISLSGCF

SEQ ID NO: 818681 - protein, 9 aa, Homo Sapiens
LKRRCLRII

SEQ ID NO: 818682 - protein, 9 aa, Homo Sapiens
CVGAYTILQ

SEQ ID NO: 818683 - protein, 9 aa, Homo Sapiens
AKAGQAQVK

SEQ ID NO: 818684 - protein, 9 aa, Homo Sapiens
AVLNDEQYQ

SEQ ID NO: 818685 - protein, 9 aa, Homo Sapiens
FQDIEEEVA

SEQ ID NO: 818686 - protein, 9 aa, Homo Sapiens
GFHHVGLWL

SEQ ID NO: 818687 - protein, 9 aa, Homo Sapiens
KEAGPSQRH

SEQ ID NO: 818688 - protein, 9 aa, Homo Sapiens
YLSDQILEN

SEQ ID NO: 818689 - protein, 9 aa, Homo Sapiens
TYHLTETGN

SEQ ID NO: 818690 - protein, 9 aa, Homo Sapiens
CSKAPLYGQ

SEQ ID NO: 818691 - protein, 9 aa, Homo Sapiens
EFHEASTAM

SEQ ID NO: 818692 - protein, 9 aa, Homo Sapiens
NNADSQNGK

SEQ ID NO: 818693 - protein, 9 aa, Homo Sapiens
QIVNVTSLA

SEQ ID NO: 818694 - protein, 9 aa, Homo Sapiens
GSIPASLST

SEQ ID NO: 818695 - protein, 9 aa, Homo Sapiens
QALEIQSSL

SEQ ID NO: 818696 - protein, 9 aa, Homo Sapiens
LLVFMSHGI

SEQ ID NO: 818697 - protein, 9 aa, Homo Sapiens
SVHFEVDTS

SEQ ID NO: 818698 - protein, 9 aa, Homo Sapiens
NPRSYNPQY

SEQ ID NO: 818699 - protein, 9 aa, Homo Sapiens
APAAEPSAS

SEQ ID NO: 818700 - protein, 9 aa, Homo Sapiens
DDASQPRTT

SEQ ID NO: 818701 - protein, 9 aa, Homo Sapiens
EEASYMTSD

SEQ ID NO: 818702 - protein, 9 aa, Homo Sapiens
DYFSLIQQE

SEQ ID NO: 818703 - protein, 9 aa, Homo Sapiens
NCLLILIIS

SEQ ID NO: 818704 - protein, 9 aa, Homo Sapiens
ATVPPTPQP

SEQ ID NO: 818705 - protein, 9 aa, Homo Sapiens
EEEEEYNEV

SEQ ID NO: 818706 - protein, 9 aa, Homo Sapiens
NRDAILALM

SEQ ID NO: 818707 - protein, 9 aa, Homo Sapiens
HDITSQRYA

SEQ ID NO: 818708 - protein, 9 aa, Homo Sapiens
KYYNLVVRM

SEQ ID NO: 818709 - protein, 9 aa, Homo Sapiens
FIHFQRKKP

SEQ ID NO: 818710 - protein, 9 aa, Homo Sapiens
RSSSRTPLT

SEQ ID NO: 818711 - protein, 9 aa, Homo Sapiens
VKQLEIHQY

SEQ ID NO: 818712 - protein, 9 aa, Homo Sapiens
KELSGNPIK

SEQ ID NO: 818713 - protein, 9 aa, Homo Sapiens
VCMVTVCAE

SEQ ID NO: 818714 - protein, 9 aa, Homo Sapiens
HRQLGERCL

SEQ ID NO: 818715 - protein, 9 aa, Homo Sapiens
PFDKTICHY

SEQ ID NO: 818716 - protein, 9 aa, Homo Sapiens
EDQYIKMTV

SEQ ID NO: 818717 - protein, 9 aa, Homo Sapiens
GILFGGMCQ

SEQ ID NO: 818718 - protein, 9 aa, Homo Sapiens
QQVIGKYLA

SEQ ID NO: 818719 - protein, 9 aa, Homo Sapiens
DNNGEGGAC

SEQ ID NO: 818720 - protein, 9 aa, Homo Sapiens
GRKFDLHLY

SEQ ID NO: 818721 - protein, 9 aa, Homo Sapiens
KTCNITVFR

SEQ ID NO: 818722 - protein, 9 aa, Homo Sapiens
IIEDKARII

SEQ ID NO: 818723 - protein, 9 aa, Homo Sapiens
NWMHYNQAV

SEQ ID NO: 818724 - protein, 9 aa, Homo Sapiens
YSQVFCGLS

SEQ ID NO: 818725 - protein, 9 aa, Homo Sapiens
LTPTQELAV

SEQ ID NO: 818726 - protein, 9 aa, Homo Sapiens
DSINPMYRV

SEQ ID NO: 818727 - protein, 9 aa, Homo Sapiens
NTNLTLIPN

SEQ ID NO: 818728 - protein, 9 aa, Homo Sapiens
LYHLLHIII

SEQ ID NO: 818729 - protein, 9 aa, Homo Sapiens
WLLEVNRSP

SEQ ID NO: 818730 - protein, 9 aa, Homo Sapiens
PTDDTPSSL

SEQ ID NO: 818731 - protein, 9 aa, Homo Sapiens
FKLQHGVIA

SEQ ID NO: 818732 - protein, 9 aa, Homo Sapiens
PMEPNHPFY

SEQ ID NO: 818733 - protein, 9 aa, Homo Sapiens
DIDSPPASK

SEQ ID NO: 818734 - protein, 9 aa, Homo Sapiens
GPKGNDGKL

SEQ ID NO: 818735 - protein, 9 aa, Homo Sapiens
KKVYEGEVT

SEQ ID NO: 818736 - protein, 9 aa, Homo Sapiens
HPPICQVES

SEQ ID NO: 818737 - protein, 9 aa, Homo Sapiens
SYTKLIMYS

SEQ ID NO: 818738 - protein, 9 aa, Homo Sapiens
LSNVCALAN

SEQ ID NO: 818739 - protein, 9 aa, Homo Sapiens
FPYCGPYSL

SEQ ID NO: 818740 - protein, 9 aa, Homo Sapiens
LPGKNVVTP

SEQ ID NO: 818741 - protein, 9 aa, Homo Sapiens
QGDEEANIG

SEQ ID NO: 818742 - protein, 9 aa, Homo Sapiens
YGYLGDPKI

SEQ ID NO: 818743 - protein, 9 aa, Homo Sapiens
NYGELRAFD

SEQ ID NO: 818744 - protein, 9 aa, Homo Sapiens
HKKRLIEHQ

SEQ ID NO: 818745 - protein, 9 aa, Homo Sapiens
FELRLYLCG

SEQ ID NO: 818746 - protein, 9 aa, Homo Sapiens
IQIIDKSQL

SEQ ID NO: 818747 - protein, 9 aa, Homo Sapiens
KELHENVID

SEQ ID NO: 818748 - protein, 9 aa, Homo Sapiens
ALNGVCTDT

SEQ ID NO: 818749 - protein, 9 aa, Homo Sapiens
EKEDKEEDK

SEQ ID NO: 818750 - protein, 9 aa, Homo Sapiens
QIHLKKKSG

SEQ ID NO: 818751 - protein, 9 aa, Homo Sapiens
NYRQVEVSW

SEQ ID NO: 818752 - protein, 9 aa, Homo Sapiens
IGWLFLIIL

SEQ ID NO: 818753 - protein, 9 aa, Homo Sapiens
LATNISRQN

SEQ ID NO: 818754 - protein, 9 aa, Homo Sapiens
AEAATNILT

SEQ ID NO: 818755 - protein, 9 aa, Homo Sapiens
AKHKKKGKV

SEQ ID NO: 818756 - protein, 9 aa, Homo Sapiens
PAGFLYLQG

SEQ ID NO: 818757 - protein, 9 aa, Homo Sapiens
WHPFEPNTF

SEQ ID NO: 818758 - protein, 9 aa, Homo Sapiens
SQQTILDRY

SEQ ID NO: 818759 - protein, 9 aa, Homo Sapiens
EINRQKSKY

SEQ ID NO: 818760 - protein, 9 aa, Homo Sapiens
LKCAEYNSD

SEQ ID NO: 818761 - protein, 9 aa, Homo Sapiens
SSLREDQLL

SEQ ID NO: 818762 - protein, 9 aa, Homo Sapiens
WQASEENVE

SEQ ID NO: 818763 - protein, 9 aa, Homo Sapiens
SQEAQIIVE

SEQ ID NO: 818764 - protein, 9 aa, Homo Sapiens
VDIYLLLPP

SEQ ID NO: 818765 - protein, 9 aa, Homo Sapiens
AMADTLGEA

SEQ ID NO: 818766 - protein, 9 aa, Homo Sapiens
SLHYELLED

SEQ ID NO: 818767 - protein, 9 aa, Homo Sapiens
IDSQTVSER

SEQ ID NO: 818768 - protein, 9 aa, Homo Sapiens
LILYALERA

SEQ ID NO: 818769 - protein, 9 aa, Homo Sapiens
LAAQTFISD

SEQ ID NO: 818770 - protein, 9 aa, Homo Sapiens
DKNPEGDGL

SEQ ID NO: 818771 - protein, 9 aa, Homo Sapiens
CEHQCDPKT

SEQ ID NO: 818772 - protein, 9 aa, Homo Sapiens
TQMYLFLMF

SEQ ID NO: 818773 - protein, 9 aa, Homo Sapiens
MRGNGKKQY

SEQ ID NO: 818774 - protein, 9 aa, Homo Sapiens
FYFNRNPYF

SEQ ID NO: 818775 - protein, 9 aa, Homo Sapiens
QMKMTLNNH

SEQ ID NO: 818776 - protein, 9 aa, Homo Sapiens
LWGAINGEV

SEQ ID NO: 818777 - protein, 9 aa, Homo Sapiens
LLTASFSVQ

SEQ ID NO: 818778 - protein, 9 aa, Homo Sapiens
NALRAACLQ

SEQ ID NO: 818779 - protein, 9 aa, Homo Sapiens
LIALTQKNQ

SEQ ID NO: 818780 - protein, 9 aa, Homo Sapiens
VTASGLEKT

SEQ ID NO: 818781 - protein, 9 aa, Homo Sapiens
DENREEEKE

SEQ ID NO: 818782 - protein, 9 aa, Homo Sapiens
LYKLNNEDN

SEQ ID NO: 818783 - protein, 9 aa, Homo Sapiens
SWQITIRWE

SEQ ID NO: 818784 - protein, 9 aa, Homo Sapiens
GITLINWWV

SEQ ID NO: 818785 - protein, 9 aa, Homo Sapiens
TASTPMNVQ

SEQ ID NO: 818786 - protein, 9 aa, Homo Sapiens
PTFIILGFS

SEQ ID NO: 818787 - protein, 9 aa, Homo Sapiens
FKVRQLFFY

SEQ ID NO: 818788 - protein, 9 aa, Homo Sapiens
AEGDKYIEE

SEQ ID NO: 818789 - protein, 9 aa, Homo Sapiens
EEGKGPEGQ

SEQ ID NO: 818790 - protein, 9 aa, Homo Sapiens
NIDESWIQK

SEQ ID NO: 818791 - protein, 9 aa, Homo Sapiens
RRCNTLITF

SEQ ID NO: 818792 - protein, 9 aa, Homo Sapiens
YITILPGFQ

SEQ ID NO: 818793 - protein, 9 aa, Homo Sapiens
AAVPYTEES

SEQ ID NO: 818794 - protein, 9 aa, Homo Sapiens
KYLDFINLL

SEQ ID NO: 818795 - protein, 9 aa, Homo Sapiens
TFSVATVSS

SEQ ID NO: 818796 - protein, 9 aa, Homo Sapiens
HRPSLRQNH

SEQ ID NO: 818797 - protein, 9 aa, Homo Sapiens
SMTILYWRI

SEQ ID NO: 818798 - protein, 9 aa, Homo Sapiens
FGLDEAEND

SEQ ID NO: 818799 - protein, 9 aa, Homo Sapiens
TEEIVQNFQ

SEQ ID NO: 818800 - protein, 9 aa, Homo Sapiens
VPIIYHDVT

SEQ ID NO: 818801 - protein, 9 aa, Homo Sapiens
INTDDKPYE

SEQ ID NO: 818802 - protein, 9 aa, Homo Sapiens
CSVSIKIRI

SEQ ID NO: 818803 - protein, 9 aa, Homo Sapiens
HFTVAQNEI

SEQ ID NO: 818804 - protein, 9 aa, Homo Sapiens
QSMLKSEWD

SEQ ID NO: 818805 - protein, 9 aa, Homo Sapiens
HKYIDSKSL

SEQ ID NO: 818806 - protein, 9 aa, Homo Sapiens
TAVVTNHWA

SEQ ID NO: 818807 - protein, 9 aa, Homo Sapiens
SYSQLDANT

SEQ ID NO: 818808 - protein, 9 aa, Homo Sapiens
HFINTNAAD

SEQ ID NO: 818809 - protein, 9 aa, Homo Sapiens
KFSNTPKEL

SEQ ID NO: 818810 - protein, 9 aa, Homo Sapiens
SLRTSTIRK

SEQ ID NO: 818811 - protein, 9 aa, Homo Sapiens
YSSGNKKDG

SEQ ID NO: 818812 - protein, 9 aa, Homo Sapiens
TLVATIWFP

SEQ ID NO: 818813 - protein, 9 aa, Homo Sapiens
LMFQIAMRI

SEQ ID NO: 818814 - protein, 9 aa, Homo Sapiens
PSYLTPDDS

SEQ ID NO: 818815 - protein, 9 aa, Homo Sapiens
SVGVKAGRG

SEQ ID NO: 818816 - protein, 9 aa, Homo Sapiens
RVLYILKLY

SEQ ID NO: 818817 - protein, 9 aa, Homo Sapiens
TDGIVNELY

SEQ ID NO: 818818 - protein, 9 aa, Homo Sapiens
AQQPSYPGR

SEQ ID NO: 818819 - protein, 9 aa, Homo Sapiens
GFLYLQGLS

SEQ ID NO: 818820 - protein, 9 aa, Homo Sapiens
KLLLSSEKS

SEQ ID NO: 818821 - protein, 9 aa, Homo Sapiens
ENVCVYGDS

SEQ ID NO: 818822 - protein, 9 aa, Homo Sapiens
ILTQGQIHS

SEQ ID NO: 818823 - protein, 9 aa, Homo Sapiens
YYCCEECTF

SEQ ID NO: 818824 - protein, 9 aa, Homo Sapiens
LSPSIIVIS

SEQ ID NO: 818825 - protein, 9 aa, Homo Sapiens
GLDTMLRGD

SEQ ID NO: 818826 - protein, 9 aa, Homo Sapiens
KVSYSERHS

SEQ ID NO: 818827 - protein, 9 aa, Homo Sapiens
YILVYGNIV

SEQ ID NO: 818828 - protein, 9 aa, Homo Sapiens
ELHDFRAPA

SEQ ID NO: 818829 - protein, 9 aa, Homo Sapiens
AANYTNGNF

SEQ ID NO: 818830 - protein, 9 aa, Homo Sapiens
SSCLSDHFQ

SEQ ID NO: 818831 - protein, 9 aa, Homo Sapiens
TQKRYLVKL

SEQ ID NO: 818832 - protein, 9 aa, Homo Sapiens
KSQLTVHQI

SEQ ID NO: 818833 - protein, 9 aa, Homo Sapiens
LPIFDKEEL

SEQ ID NO: 818834 - protein, 9 aa, Homo Sapiens
EDLTDDNIN

SEQ ID NO: 818835 - protein, 9 aa, Homo Sapiens
SEASFISAQ

SEQ ID NO: 818836 - protein, 9 aa, Homo Sapiens
WITVSALCS

SEQ ID NO: 818837 - protein, 9 aa, Homo Sapiens
TGRDVLTPF

SEQ ID NO: 818838 - protein, 9 aa, Homo Sapiens
ASKRVVSIY

SEQ ID NO: 818839 - protein, 9 aa, Homo Sapiens
GEEGAYARD

SEQ ID NO: 818840 - protein, 9 aa, Homo Sapiens
KVKQLCNST

SEQ ID NO: 818841 - protein, 9 aa, Homo Sapiens
VILMTTKNY

SEQ ID NO: 818842 - protein, 9 aa, Homo Sapiens
SNRGKYHCA

SEQ ID NO: 818843 - protein, 9 aa, Homo Sapiens
MASRGTTRP

SEQ ID NO: 818844 - protein, 9 aa, Homo Sapiens
MSLMAPTPV

SEQ ID NO: 818845 - protein, 9 aa, Homo Sapiens
GPSPEEKDL

SEQ ID NO: 818846 - protein, 9 aa, Homo Sapiens
LRQDHPASK

SEQ ID NO: 818847 - protein, 9 aa, Homo Sapiens
DWVEAACQA

SEQ ID NO: 818848 - protein, 9 aa, Homo Sapiens
QSQVKEINE

SEQ ID NO: 818849 - protein, 9 aa, Homo Sapiens
PKEIDIPRN

SEQ ID NO: 818850 - protein, 9 aa, Homo Sapiens
ERYDSHVLW

SEQ ID NO: 818851 - protein, 9 aa, Homo Sapiens
PLILKVHGS

SEQ ID NO: 818852 - protein, 9 aa, Homo Sapiens
EFILLGGSD

SEQ ID NO: 818853 - protein, 9 aa, Homo Sapiens
LCREGDQLV

SEQ ID NO: 818854 - protein, 9 aa, Homo Sapiens
VCKVKTIVM

SEQ ID NO: 818855 - protein, 9 aa, Homo Sapiens
IIQPPSTTP

SEQ ID NO: 818856 - protein, 9 aa, Homo Sapiens
VSLFMGVIQ

SEQ ID NO: 818857 - protein, 9 aa, Homo Sapiens
LFEEVFIYI

SEQ ID NO: 818858 - protein, 9 aa, Homo Sapiens
HLSWEDIVR

SEQ ID NO: 818859 - protein, 9 aa, Homo Sapiens
GNRTIIGRI

SEQ ID NO: 818860 - protein, 9 aa, Homo Sapiens
DYHNQVWGK

SEQ ID NO: 818861 - protein, 9 aa, Homo Sapiens
GSLFKLCGS

SEQ ID NO: 818862 - protein, 9 aa, Homo Sapiens
ARKVMQKIQ

SEQ ID NO: 818863 - protein, 9 aa, Homo Sapiens
QNFFSFFFY

SEQ ID NO: 818864 - protein, 9 aa, Homo Sapiens
IIVPVLNPF

SEQ ID NO: 818865 - protein, 9 aa, Homo Sapiens
GQYGNEEMG

SEQ ID NO: 818866 - protein, 9 aa, Homo Sapiens
IYLPGQMAG

SEQ ID NO: 818867 - protein, 9 aa, Homo Sapiens
MVSLFMGVI

SEQ ID NO: 818868 - protein, 9 aa, Homo Sapiens
NTIDINNVD

SEQ ID NO: 818869 - protein, 9 aa, Homo Sapiens
ESPSRTVAS

SEQ ID NO: 818870 - protein, 9 aa, Homo Sapiens
YMLWVTKSE

SEQ ID NO: 818871 - protein, 9 aa, Homo Sapiens
GTTHKNPNA

SEQ ID NO: 818872 - protein, 9 aa, Homo Sapiens
MVRAMEGKL

SEQ ID NO: 818873 - protein, 9 aa, Homo Sapiens
RWHVLSREE

SEQ ID NO: 818874 - protein, 9 aa, Homo Sapiens
NIFYYIPWI

SEQ ID NO: 818875 - protein, 9 aa, Homo Sapiens
SPHPVTPLS

SEQ ID NO: 818876 - protein, 9 aa, Homo Sapiens
NAYQMCLTS

SEQ ID NO: 818877 - protein, 9 aa, Homo Sapiens
VEDIIYRVR

SEQ ID NO: 818878 - protein, 9 aa, Homo Sapiens
LFEENIKLQ

SEQ ID NO: 818879 - protein, 9 aa, Homo Sapiens
LFSNSSIMS

SEQ ID NO: 818880 - protein, 9 aa, Homo Sapiens
VTNYVCLKY

SEQ ID NO: 818881 - protein, 9 aa, Homo Sapiens
KRVETLMFS

SEQ ID NO: 818882 - protein, 9 aa, Homo Sapiens
IKLSRRRSH

SEQ ID NO: 818883 - protein, 9 aa, Homo Sapiens
IQEYFRKFN

SEQ ID NO: 818884 - protein, 9 aa, Homo Sapiens
LRGTWECSQ

SEQ ID NO: 818885 - protein, 9 aa, Homo Sapiens
TAEVVGPPR

SEQ ID NO: 818886 - protein, 9 aa, Homo Sapiens
GACSVDIDG

SEQ ID NO: 818887 - protein, 9 aa, Homo Sapiens
GELMENYQD

SEQ ID NO: 818888 - protein, 9 aa, Homo Sapiens
GIRDGDKMY

SEQ ID NO: 818889 - protein, 9 aa, Homo Sapiens
ALILQYDML

SEQ ID NO: 818890 - protein, 9 aa, Homo Sapiens
IFGNTFEQP

SEQ ID NO: 818891 - protein, 9 aa, Homo Sapiens
HGKLCGAEV

SEQ ID NO: 818892 - protein, 9 aa, Homo Sapiens
RITQSGNFY

SEQ ID NO: 818893 - protein, 9 aa, Homo Sapiens
PEEKQLTED

SEQ ID NO: 818894 - protein, 9 aa, Homo Sapiens
TVYAGTFSK

SEQ ID NO: 818895 - protein, 9 aa, Homo Sapiens
SEDPHLTSV

SEQ ID NO: 818896 - protein, 9 aa, Homo Sapiens
EIRLRRLGS

SEQ ID NO: 818897 - protein, 9 aa, Homo Sapiens
SVVTKREHS

SEQ ID NO: 818898 - protein, 9 aa, Homo Sapiens
NLKIKNTRR

SEQ ID NO: 818899 - protein, 9 aa, Homo Sapiens
NSLALLVLP

SEQ ID NO: 818900 - protein, 9 aa, Homo Sapiens
SEIFDSPAE

SEQ ID NO: 818901 - protein, 9 aa, Homo Sapiens
DLKHQFTRQ

SEQ ID NO: 818902 - protein, 9 aa, Homo Sapiens
DPVCTPESM

SEQ ID NO: 818903 - protein, 9 aa, Homo Sapiens
EQRPVNHSY

SEQ ID NO: 818904 - protein, 9 aa, Homo Sapiens
KRVLGPCSE

SEQ ID NO: 818905 - protein, 9 aa, Homo Sapiens
KIDLDTILL

SEQ ID NO: 818906 - protein, 9 aa, Homo Sapiens
ILCDWMYKH

SEQ ID NO: 818907 - protein, 9 aa, Homo Sapiens
EMATYDLPA

SEQ ID NO: 818908 - protein, 9 aa, Homo Sapiens
WFPSDLYDG

SEQ ID NO: 818909 - protein, 9 aa, Homo Sapiens
RESDTNGDG

SEQ ID NO: 818910 - protein, 9 aa, Homo Sapiens
LLEHREKEC

SEQ ID NO: 818911 - protein, 9 aa, Homo Sapiens
FNKKYGELF

SEQ ID NO: 818912 - protein, 9 aa, Homo Sapiens
RPDIKVATQ

SEQ ID NO: 818913 - protein, 9 aa, Homo Sapiens
GLMKHLNAI

SEQ ID NO: 818914 - protein, 9 aa, Homo Sapiens
GVEMLLNPE

SEQ ID NO: 818915 - protein, 9 aa, Homo Sapiens
QQLLTRVLV

SEQ ID NO: 818916 - protein, 9 aa, Homo Sapiens
FWQMQCSEF

SEQ ID NO: 818917 - protein, 9 aa, Homo Sapiens
VKAMQSNGI

SEQ ID NO: 818918 - protein, 9 aa, Homo Sapiens
TNDQHALRN

SEQ ID NO: 818919 - protein, 9 aa, Homo Sapiens
NENIQETCK

SEQ ID NO: 818920 - protein, 9 aa, Homo Sapiens
DYPASASRV

SEQ ID NO: 818921 - protein, 9 aa, Homo Sapiens
AVYHEQHLF

SEQ ID NO: 818922 - protein, 9 aa, Homo Sapiens
EAWNNEVKE

SEQ ID NO: 818923 - protein, 9 aa, Homo Sapiens
PPSCCSGLH

SEQ ID NO: 818924 - protein, 9 aa, Homo Sapiens
TVWPDSQNP

SEQ ID NO: 818925 - protein, 9 aa, Homo Sapiens
AIQKMKKID

SEQ ID NO: 818926 - protein, 9 aa, Homo Sapiens
SNSDVSVKK

SEQ ID NO: 818927 - protein, 9 aa, Homo Sapiens
FYFSQSFPQ

SEQ ID NO: 818928 - protein, 9 aa, Homo Sapiens
HRNPGIVGL

SEQ ID NO: 818929 - protein, 9 aa, Homo Sapiens
AEGRWNLFL

SEQ ID NO: 818930 - protein, 9 aa, Homo Sapiens
SLLLEGKNY

SEQ ID NO: 818931 - protein, 9 aa, Homo Sapiens
CEDLFMSGQ

SEQ ID NO: 818932 - protein, 9 aa, Homo Sapiens
LPSLLRPGT

SEQ ID NO: 818933 - protein, 9 aa, Homo Sapiens
FLCLWEQFS

SEQ ID NO: 818934 - protein, 9 aa, Homo Sapiens
EDLGNVIRS

SEQ ID NO: 818935 - protein, 9 aa, Homo Sapiens
FKDNVVLDV

SEQ ID NO: 818936 - protein, 9 aa, Homo Sapiens
WKEHKPGGD

SEQ ID NO: 818937 - protein, 9 aa, Homo Sapiens
DSEAESTEL

SEQ ID NO: 818938 - protein, 9 aa, Homo Sapiens
HCKVIIKVL

SEQ ID NO: 818939 - protein, 9 aa, Homo Sapiens
RRRHKTDPS

SEQ ID NO: 818940 - protein, 9 aa, Homo Sapiens
MNSIKKKLP

SEQ ID NO: 818941 - protein, 9 aa, Homo Sapiens
EQGYDQDSE

SEQ ID NO: 818942 - protein, 9 aa, Homo Sapiens
RRICKAEGL

SEQ ID NO: 818943 - protein, 9 aa, Homo Sapiens
EAQIIVEKL

SEQ ID NO: 818944 - protein, 9 aa, Homo Sapiens
DKVCKFDVT

SEQ ID NO: 818945 - protein, 9 aa, Homo Sapiens
WAWGVEVGW

SEQ ID NO: 818946 - protein, 9 aa, Homo Sapiens
THNSWTQDG

SEQ ID NO: 818947 - protein, 9 aa, Homo Sapiens
KKRIHQQGQ

SEQ ID NO: 818948 - protein, 9 aa, Homo Sapiens
QTTSWLQDC

SEQ ID NO: 818949 - protein, 9 aa, Homo Sapiens
ASFSNKIQN

SEQ ID NO: 818950 - protein, 9 aa, Homo Sapiens
LPPVIRGQS

SEQ ID NO: 818951 - protein, 9 aa, Homo Sapiens
LSNQIISFY

SEQ ID NO: 818952 - protein, 9 aa, Homo Sapiens
ISPPERKRL

SEQ ID NO: 818953 - protein, 9 aa, Homo Sapiens
MISLKPVLQ

SEQ ID NO: 818954 - protein, 9 aa, Homo Sapiens
CGGPEVLKL

SEQ ID NO: 818955 - protein, 9 aa, Homo Sapiens
QVTVSSFSL

SEQ ID NO: 818956 - protein, 9 aa, Homo Sapiens
YLSIAVQMM

SEQ ID NO: 818957 - protein, 9 aa, Homo Sapiens
EYFKGLTKL

SEQ ID NO: 818958 - protein, 9 aa, Homo Sapiens
ERPKRNVIQ

SEQ ID NO: 818959 - protein, 9 aa, Homo Sapiens
IEWLEPKIY

SEQ ID NO: 818960 - protein, 9 aa, Homo Sapiens
IDARFYWNV

SEQ ID NO: 818961 - protein, 9 aa, Homo Sapiens
RGLREQLAT

SEQ ID NO: 818962 - protein, 9 aa, Homo Sapiens
QDLRLNGCH

SEQ ID NO: 818963 - protein, 9 aa, Homo Sapiens
SRDYPASAS

SEQ ID NO: 818964 - protein, 9 aa, Homo Sapiens
PHLVLTAVD

SEQ ID NO: 818965 - protein, 9 aa, Homo Sapiens
HQRSHTAEQ

SEQ ID NO: 818966 - protein, 9 aa, Homo Sapiens
LIKSHLYWL

SEQ ID NO: 818967 - protein, 9 aa, Homo Sapiens
KRVVSIYKY

SEQ ID NO: 818968 - protein, 9 aa, Homo Sapiens
VLTKVSYLI

SEQ ID NO: 818969 - protein, 9 aa, Homo Sapiens
YQGGHSGER

SEQ ID NO: 818970 - protein, 9 aa, Homo Sapiens
CETSGSIWQ

SEQ ID NO: 818971 - protein, 9 aa, Homo Sapiens
PEFPCPTGS

SEQ ID NO: 818972 - protein, 9 aa, Homo Sapiens
DDVNTFLTW

SEQ ID NO: 818973 - protein, 9 aa, Homo Sapiens
LRSADTMQS

SEQ ID NO: 818974 - protein, 9 aa, Homo Sapiens
CCSTPGVEL

SEQ ID NO: 818975 - protein, 9 aa, Homo Sapiens
LDLLSCLLR

SEQ ID NO: 818976 - protein, 9 aa, Homo Sapiens
ITENLEAAK

SEQ ID NO: 818977 - protein, 9 aa, Homo Sapiens
EAARWKLLR

SEQ ID NO: 818978 - protein, 9 aa, Homo Sapiens
IQLEEGAME

SEQ ID NO: 818979 - protein, 9 aa, Homo Sapiens
GDHAHGLLQ

SEQ ID NO: 818980 - protein, 9 aa, Homo Sapiens
NKPLKLDET

SEQ ID NO: 818981 - protein, 9 aa, Homo Sapiens
CTCEEDFYF

SEQ ID NO: 818982 - protein, 9 aa, Homo Sapiens
MISYAISAD

SEQ ID NO: 818983 - protein, 9 aa, Homo Sapiens
WDEASFQTE

SEQ ID NO: 818984 - protein, 9 aa, Homo Sapiens
ITSPLLEEE

SEQ ID NO: 818985 - protein, 9 aa, Homo Sapiens
EVAQLKQLI

SEQ ID NO: 818986 - protein, 9 aa, Homo Sapiens
TPMNVQSSR

SEQ ID NO: 818987 - protein, 9 aa, Homo Sapiens
AELDQFMKL

SEQ ID NO: 818988 - protein, 9 aa, Homo Sapiens
VLTDPAELK

SEQ ID NO: 818989 - protein, 9 aa, Homo Sapiens
NSKNYYLKY

SEQ ID NO: 818990 - protein, 9 aa, Homo Sapiens
FVGGIAQSI

SEQ ID NO: 818991 - protein, 9 aa, Homo Sapiens
RVQTLLQYH

SEQ ID NO: 818992 - protein, 9 aa, Homo Sapiens
LRYRKCPFN

SEQ ID NO: 818993 - protein, 9 aa, Homo Sapiens
PWQGLLITT

SEQ ID NO: 818994 - protein, 9 aa, Homo Sapiens
IIELSHIWE

SEQ ID NO: 818995 - protein, 9 aa, Homo Sapiens
RPNVLLGRW

SEQ ID NO: 818996 - protein, 9 aa, Homo Sapiens
RFSSRRPQN

SEQ ID NO: 818997 - protein, 9 aa, Homo Sapiens
QSYRDSGIP

SEQ ID NO: 818998 - protein, 9 aa, Homo Sapiens
WSSYLSLPN

SEQ ID NO: 818999 - protein, 9 aa, Homo Sapiens
PNSPLVPQL

SEQ ID NO: 819000 - protein, 9 aa, Homo Sapiens
YKNSESQRS

SEQ ID NO: 819001 - protein, 9 aa, Homo Sapiens
EENFPNGKV

SEQ ID NO: 819002 - protein, 9 aa, Homo Sapiens
VFLCLMESV

SEQ ID NO: 819003 - protein, 9 aa, Homo Sapiens
VLGYKDPAA

SEQ ID NO: 819004 - protein, 9 aa, Homo Sapiens
KKINTFIVL

SEQ ID NO: 819005 - protein, 9 aa, Homo Sapiens
LNRCPFGVV

SEQ ID NO: 819006 - protein, 9 aa, Homo Sapiens
VEGMDFHTF

SEQ ID NO: 819007 - protein, 9 aa, Homo Sapiens
EMDDGPSRI

SEQ ID NO: 819008 - protein, 9 aa, Homo Sapiens
NGHVIYKHR

SEQ ID NO: 819009 - protein, 9 aa, Homo Sapiens
GAPFWLEDP

SEQ ID NO: 819010 - protein, 9 aa, Homo Sapiens
LREGAPIKP

SEQ ID NO: 819011 - protein, 9 aa, Homo Sapiens
LKADEGNKE

SEQ ID NO: 819012 - protein, 9 aa, Homo Sapiens
QLCTYLPLL

SEQ ID NO: 819013 - protein, 9 aa, Homo Sapiens
LTVQEPPNF

SEQ ID NO: 819014 - protein, 9 aa, Homo Sapiens
PELYRCSIG

SEQ ID NO: 819015 - protein, 9 aa, Homo Sapiens
GKIRITQSG

SEQ ID NO: 819016 - protein, 9 aa, Homo Sapiens
GKLKREKKP

SEQ ID NO: 819017 - protein, 9 aa, Homo Sapiens
HYWRFPNNS

SEQ ID NO: 819018 - protein, 9 aa, Homo Sapiens
TPKTNTKTS

SEQ ID NO: 819019 - protein, 9 aa, Homo Sapiens
KLLCSFALH

SEQ ID NO: 819020 - protein, 9 aa, Homo Sapiens
SMPAGTKVL

SEQ ID NO: 819021 - protein, 9 aa, Homo Sapiens
AANVTQTVH

SEQ ID NO: 819022 - protein, 9 aa, Homo Sapiens
NVGYRLPLP

SEQ ID NO: 819023 - protein, 9 aa, Homo Sapiens
EIPVNIRFC

SEQ ID NO: 819024 - protein, 9 aa, Homo Sapiens
PFSFKWWIM

SEQ ID NO: 819025 - protein, 9 aa, Homo Sapiens
AACAATDDP

SEQ ID NO: 819026 - protein, 9 aa, Homo Sapiens
PDSDDIKEN

SEQ ID NO: 819027 - protein, 9 aa, Homo Sapiens
KLISIWNRN

SEQ ID NO: 819028 - protein, 9 aa, Homo Sapiens
GAETALLIQ

SEQ ID NO: 819029 - protein, 9 aa, Homo Sapiens
AKVMFVAGM

SEQ ID NO: 819030 - protein, 9 aa, Homo Sapiens
FCKYVVSNK

SEQ ID NO: 819031 - protein, 9 aa, Homo Sapiens
YQAHAGHIT

SEQ ID NO: 819032 - protein, 9 aa, Homo Sapiens
SMDASSSKM

SEQ ID NO: 819033 - protein, 9 aa, Homo Sapiens
KLHYLIGLG

SEQ ID NO: 819034 - protein, 9 aa, Homo Sapiens
AYIAKQKQL

SEQ ID NO: 819035 - protein, 9 aa, Homo Sapiens
EDISDEEGS

SEQ ID NO: 819036 - protein, 9 aa, Homo Sapiens
LQKRLGRNK

SEQ ID NO: 819037 - protein, 9 aa, Homo Sapiens
KFTVGVDFA

SEQ ID NO: 819038 - protein, 9 aa, Homo Sapiens
PECNCPSMY

SEQ ID NO: 819039 - protein, 9 aa, Homo Sapiens
RQVVDQIKS

SEQ ID NO: 819040 - protein, 9 aa, Homo Sapiens
KATDDYHYD

SEQ ID NO: 819041 - protein, 9 aa, Homo Sapiens
KIFPVRDQV

SEQ ID NO: 819042 - protein, 9 aa, Homo Sapiens
AGGAGCSGP

SEQ ID NO: 819043 - protein, 9 aa, Homo Sapiens
DVDKLADEL

SEQ ID NO: 819044 - protein, 9 aa, Homo Sapiens
RKSLGRNIF

SEQ ID NO: 819045 - protein, 9 aa, Homo Sapiens
DYKKRYEDE

SEQ ID NO: 819046 - protein, 9 aa, Homo Sapiens
SISAGSVSV

SEQ ID NO: 819047 - protein, 9 aa, Homo Sapiens
ILYWVIYKI

SEQ ID NO: 819048 - protein, 9 aa, Homo Sapiens
TIQNEFAHY

SEQ ID NO: 819049 - protein, 9 aa, Homo Sapiens
KLFRRLSTL

SEQ ID NO: 819050 - protein, 9 aa, Homo Sapiens
IYEFIWTEG

SEQ ID NO: 819051 - protein, 9 aa, Homo Sapiens
VPGSQVPTC

SEQ ID NO: 819052 - protein, 9 aa, Homo Sapiens
LLPGYEAPA

SEQ ID NO: 819053 - protein, 9 aa, Homo Sapiens
HVFRIKDDI

SEQ ID NO: 819054 - protein, 9 aa, Homo Sapiens
KMNKSNLNY

SEQ ID NO: 819055 - protein, 9 aa, Homo Sapiens
MKMSLFERL

SEQ ID NO: 819056 - protein, 9 aa, Homo Sapiens
VRKAPNNRY

SEQ ID NO: 819057 - protein, 9 aa, Homo Sapiens
EEDNLHIAE

SEQ ID NO: 819058 - protein, 9 aa, Homo Sapiens
PILKLTGPK

SEQ ID NO: 819059 - protein, 9 aa, Homo Sapiens
QLIKYKKAA

SEQ ID NO: 819060 - protein, 9 aa, Homo Sapiens
AEQKVHRAF

SEQ ID NO: 819061 - protein, 9 aa, Homo Sapiens
TGVGSQSET

SEQ ID NO: 819062 - protein, 9 aa, Homo Sapiens
SPSEDVRVA

SEQ ID NO: 819063 - protein, 9 aa, Homo Sapiens
CLDMEGSVP

SEQ ID NO: 819064 - protein, 9 aa, Homo Sapiens
SFVSVRPER

SEQ ID NO: 819065 - protein, 9 aa, Homo Sapiens
VFSYDAILY

SEQ ID NO: 819066 - protein, 9 aa, Homo Sapiens
DILPRLQQL

SEQ ID NO: 819067 - protein, 9 aa, Homo Sapiens
DYRGNAGVV

SEQ ID NO: 819068 - protein, 9 aa, Homo Sapiens
IPEKLDLRT

SEQ ID NO: 819069 - protein, 9 aa, Homo Sapiens
TGDKPYKCT

SEQ ID NO: 819070 - protein, 9 aa, Homo Sapiens
NFWTIWCGA

SEQ ID NO: 819071 - protein, 9 aa, Homo Sapiens
VVHKHALHD

SEQ ID NO: 819072 - protein, 9 aa, Homo Sapiens
WLCLALMQK

SEQ ID NO: 819073 - protein, 9 aa, Homo Sapiens
YTMPHSLRS

SEQ ID NO: 819074 - protein, 9 aa, Homo Sapiens
LQPYISIGK

SEQ ID NO: 819075 - protein, 9 aa, Homo Sapiens
NLRHPKFIQ

SEQ ID NO: 819076 - protein, 9 aa, Homo Sapiens
SQVYDAMAD

SEQ ID NO: 819077 - protein, 9 aa, Homo Sapiens
DSEQVWYEH

SEQ ID NO: 819078 - protein, 9 aa, Homo Sapiens
AGKNNNKFV

SEQ ID NO: 819079 - protein, 9 aa, Homo Sapiens
YFDWNLKNG

SEQ ID NO: 819080 - protein, 9 aa, Homo Sapiens
ADGTQGPPG

SEQ ID NO: 819081 - protein, 9 aa, Homo Sapiens
YCTTGHRLI

SEQ ID NO: 819082 - protein, 9 aa, Homo Sapiens
LTVLTFTLC

SEQ ID NO: 819083 - protein, 9 aa, Homo Sapiens
RAGDITELN

SEQ ID NO: 819084 - protein, 9 aa, Homo Sapiens
KEVFSYFAH

SEQ ID NO: 819085 - protein, 9 aa, Homo Sapiens
WSSMDEEEL

SEQ ID NO: 819086 - protein, 9 aa, Homo Sapiens
EEEGLYPDP

SEQ ID NO: 819087 - protein, 9 aa, Homo Sapiens
CCPSCCETT

SEQ ID NO: 819088 - protein, 9 aa, Homo Sapiens
AVTDLLGRQ

SEQ ID NO: 819089 - protein, 9 aa, Homo Sapiens
LYLMKMPVA

SEQ ID NO: 819090 - protein, 9 aa, Homo Sapiens
RRAGGKVVS

SEQ ID NO: 819091 - protein, 9 aa, Homo Sapiens
RNYWRGLFA

SEQ ID NO: 819092 - protein, 9 aa, Homo Sapiens
TTLTFPFRI

SEQ ID NO: 819093 - protein, 9 aa, Homo Sapiens
QNVSSILIA

SEQ ID NO: 819094 - protein, 9 aa, Homo Sapiens
GFIFTGLDV

SEQ ID NO: 819095 - protein, 9 aa, Homo Sapiens
LFNPQGFLT

SEQ ID NO: 819096 - protein, 9 aa, Homo Sapiens
EKANIEDEK

SEQ ID NO: 819097 - protein, 9 aa, Homo Sapiens
SLGRDQAAS

SEQ ID NO: 819098 - protein, 9 aa, Homo Sapiens
RKRNRMHGL

SEQ ID NO: 819099 - protein, 9 aa, Homo Sapiens
TLSAWSSMD

SEQ ID NO: 819100 - protein, 9 aa, Homo Sapiens
AQISRKKQT

SEQ ID NO: 819101 - protein, 9 aa, Homo Sapiens
RLPRDITQE

SEQ ID NO: 819102 - protein, 9 aa, Homo Sapiens
CSQQSFECS

SEQ ID NO: 819103 - protein, 9 aa, Homo Sapiens
GRFSNSSSA

SEQ ID NO: 819104 - protein, 9 aa, Homo Sapiens
QSESMPDRN

SEQ ID NO: 819105 - protein, 9 aa, Homo Sapiens
ESQVCTPSF

SEQ ID NO: 819106 - protein, 9 aa, Homo Sapiens
AAPQIPSYR

SEQ ID NO: 819107 - protein, 9 aa, Homo Sapiens
GELPTPACK

SEQ ID NO: 819108 - protein, 9 aa, Homo Sapiens
AQLSRTSLK

SEQ ID NO: 819109 - protein, 9 aa, Homo Sapiens
AAAYLSVQR

SEQ ID NO: 819110 - protein, 9 aa, Homo Sapiens
KGQKLHKMG

SEQ ID NO: 819111 - protein, 9 aa, Homo Sapiens
ILLYLTRKV

SEQ ID NO: 819112 - protein, 9 aa, Homo Sapiens
RDEWQHLGP

SEQ ID NO: 819113 - protein, 9 aa, Homo Sapiens
QPRNIQGSI

SEQ ID NO: 819114 - protein, 9 aa, Homo Sapiens
GFNQRLLLY

SEQ ID NO: 819115 - protein, 9 aa, Homo Sapiens
EQQGPIACD

SEQ ID NO: 819116 - protein, 9 aa, Homo Sapiens
YWALILQGL

SEQ ID NO: 819117 - protein, 9 aa, Homo Sapiens
SSIAYSPKL

SEQ ID NO: 819118 - protein, 9 aa, Homo Sapiens
LGGRTVEVQ

SEQ ID NO: 819119 - protein, 9 aa, Homo Sapiens
GLTDNYQLQ

SEQ ID NO: 819120 - protein, 9 aa, Homo Sapiens
LGTLNKLSS

SEQ ID NO: 819121 - protein, 9 aa, Homo Sapiens
AVNITSPMS

SEQ ID NO: 819122 - protein, 9 aa, Homo Sapiens
VFKNAMYIC

SEQ ID NO: 819123 - protein, 9 aa, Homo Sapiens
QCNNMATKY

SEQ ID NO: 819124 - protein, 9 aa, Homo Sapiens
VTGSGLAGD

SEQ ID NO: 819125 - protein, 9 aa, Homo Sapiens
DSMDVMVFI

SEQ ID NO: 819126 - protein, 9 aa, Homo Sapiens
FDERNAICS

SEQ ID NO: 819127 - protein, 9 aa, Homo Sapiens
PTDNTKFMI

SEQ ID NO: 819128 - protein, 9 aa, Homo Sapiens
NPLLRSVAN

SEQ ID NO: 819129 - protein, 9 aa, Homo Sapiens
CEQSFSQSS

SEQ ID NO: 819130 - protein, 9 aa, Homo Sapiens
VKFMVEMEK

SEQ ID NO: 819131 - protein, 9 aa, Homo Sapiens
PLMQIFRDS

SEQ ID NO: 819132 - protein, 9 aa, Homo Sapiens
ELIMFIHDL

SEQ ID NO: 819133 - protein, 9 aa, Homo Sapiens
PVQSQQIQR

SEQ ID NO: 819134 - protein, 9 aa, Homo Sapiens
HHVIISEAA

SEQ ID NO: 819135 - protein, 9 aa, Homo Sapiens
AGSVSVPGG

SEQ ID NO: 819136 - protein, 9 aa, Homo Sapiens
DGFKEAVCY

SEQ ID NO: 819137 - protein, 9 aa, Homo Sapiens
HIEGVHVHT

SEQ ID NO: 819138 - protein, 9 aa, Homo Sapiens
NNMISLKPV

SEQ ID NO: 819139 - protein, 9 aa, Homo Sapiens
SHRRHNSSD

SEQ ID NO: 819140 - protein, 9 aa, Homo Sapiens
TPTKAVRTT

SEQ ID NO: 819141 - protein, 9 aa, Homo Sapiens
FLIQLRKEL

SEQ ID NO: 819142 - protein, 9 aa, Homo Sapiens
WKPFKTIIL

SEQ ID NO: 819143 - protein, 9 aa, Homo Sapiens
DAKIASSLP

SEQ ID NO: 819144 - protein, 9 aa, Homo Sapiens
KQAAFDVGR

SEQ ID NO: 819145 - protein, 9 aa, Homo Sapiens
SILYQKPNG

SEQ ID NO: 819146 - protein, 9 aa, Homo Sapiens
SLKGLTNYY

SEQ ID NO: 819147 - protein, 9 aa, Homo Sapiens
KAEEAHKIC

SEQ ID NO: 819148 - protein, 9 aa, Homo Sapiens
LCPAHILNK

SEQ ID NO: 819149 - protein, 9 aa, Homo Sapiens
KEIDIPRNG

SEQ ID NO: 819150 - protein, 9 aa, Homo Sapiens
NVVGMYLAH

SEQ ID NO: 819151 - protein, 9 aa, Homo Sapiens
YLVSGIQTP

SEQ ID NO: 819152 - protein, 9 aa, Homo Sapiens
AVITNKDVQ

SEQ ID NO: 819153 - protein, 9 aa, Homo Sapiens
TLQYLQQDA

SEQ ID NO: 819154 - protein, 9 aa, Homo Sapiens
KSWSSYLSL

SEQ ID NO: 819155 - protein, 9 aa, Homo Sapiens
TAIKYIPHN

SEQ ID NO: 819156 - protein, 9 aa, Homo Sapiens
SNARTEKEE

SEQ ID NO: 819157 - protein, 9 aa, Homo Sapiens
PTLQPEPLS

SEQ ID NO: 819158 - protein, 9 aa, Homo Sapiens
SASCFRGKL

SEQ ID NO: 819159 - protein, 9 aa, Homo Sapiens
EMLQEICTM

SEQ ID NO: 819160 - protein, 9 aa, Homo Sapiens
LAVQASMPD

SEQ ID NO: 819161 - protein, 9 aa, Homo Sapiens
RIQSSFVAP

SEQ ID NO: 819162 - protein, 9 aa, Homo Sapiens
GKILNQSQD

SEQ ID NO: 819163 - protein, 9 aa, Homo Sapiens
LDKSVEKIQ

SEQ ID NO: 819164 - protein, 9 aa, Homo Sapiens
CKRIEEVMI

SEQ ID NO: 819165 - protein, 9 aa, Homo Sapiens
SFERFCVVY

SEQ ID NO: 819166 - protein, 9 aa, Homo Sapiens
DCSLQKHDI

SEQ ID NO: 819167 - protein, 9 aa, Homo Sapiens
EPISFSKFA

SEQ ID NO: 819168 - protein, 9 aa, Homo Sapiens
AWGENHLCV

SEQ ID NO: 819169 - protein, 9 aa, Homo Sapiens
GAASFGVCR

SEQ ID NO: 819170 - protein, 9 aa, Homo Sapiens
NFFSFFFYF

SEQ ID NO: 819171 - protein, 9 aa, Homo Sapiens
NKKKTGSQT

SEQ ID NO: 819172 - protein, 9 aa, Homo Sapiens
CSAKTLYGI

SEQ ID NO: 819173 - protein, 9 aa, Homo Sapiens
LQVCCCHLP

SEQ ID NO: 819174 - protein, 9 aa, Homo Sapiens
GIVHQDLKP

SEQ ID NO: 819175 - protein, 9 aa, Homo Sapiens
GININAYLI

SEQ ID NO: 819176 - protein, 9 aa, Homo Sapiens
CDPQMCFDI

SEQ ID NO: 819177 - protein, 9 aa, Homo Sapiens
CYHYTWKTS

SEQ ID NO: 819178 - protein, 9 aa, Homo Sapiens
DSEDPHLTS

SEQ ID NO: 819179 - protein, 9 aa, Homo Sapiens
AICEVDSSE

SEQ ID NO: 819180 - protein, 9 aa, Homo Sapiens
RKAINLQTV

SEQ ID NO: 819181 - protein, 9 aa, Homo Sapiens
SKAVAIGPR

SEQ ID NO: 819182 - protein, 9 aa, Homo Sapiens
SKPIFCLFA

SEQ ID NO: 819183 - protein, 9 aa, Homo Sapiens
VLLALHDQA

SEQ ID NO: 819184 - protein, 9 aa, Homo Sapiens
GEKKDQQIA

SEQ ID NO: 819185 - protein, 9 aa, Homo Sapiens
ASPCCVSQY

SEQ ID NO: 819186 - protein, 9 aa, Homo Sapiens
LVQIGHEVT

SEQ ID NO: 819187 - protein, 9 aa, Homo Sapiens
FLYDYKRFL

SEQ ID NO: 819188 - protein, 9 aa, Homo Sapiens
GAVDSVVRD

SEQ ID NO: 819189 - protein, 9 aa, Homo Sapiens
DRELIHKVQ

SEQ ID NO: 819190 - protein, 9 aa, Homo Sapiens
TSTSNLAAH

SEQ ID NO: 819191 - protein, 9 aa, Homo Sapiens
LLGLRKLVD

SEQ ID NO: 819192 - protein, 9 aa, Homo Sapiens
EKPFQREEC

SEQ ID NO: 819193 - protein, 9 aa, Homo Sapiens
TQERRYKCA

SEQ ID NO: 819194 - protein, 9 aa, Homo Sapiens
SATFAWSHE

SEQ ID NO: 819195 - protein, 9 aa, Homo Sapiens
EAATNILTE

SEQ ID NO: 819196 - protein, 9 aa, Homo Sapiens
GHRVREITE

SEQ ID NO: 819197 - protein, 9 aa, Homo Sapiens
AHLFLSHFG

SEQ ID NO: 819198 - protein, 9 aa, Homo Sapiens
RRLSSSVVD

SEQ ID NO: 819199 - protein, 9 aa, Homo Sapiens
VESRYAFVV

SEQ ID NO: 819200 - protein, 9 aa, Homo Sapiens
ANNLGFNCT

SEQ ID NO: 819201 - protein, 9 aa, Homo Sapiens
VKPAITTLV

SEQ ID NO: 819202 - protein, 9 aa, Homo Sapiens
LFCQDLEVF

SEQ ID NO: 819203 - protein, 9 aa, Homo Sapiens
TPAVSAAHV

SEQ ID NO: 819204 - protein, 9 aa, Homo Sapiens
SEQRTPSYT

SEQ ID NO: 819205 - protein, 9 aa, Homo Sapiens
RFNDELDKL

SEQ ID NO: 819206 - protein, 9 aa, Homo Sapiens
HWIGLKMAT

SEQ ID NO: 819207 - protein, 9 aa, Homo Sapiens
ALTDHLRLH

SEQ ID NO: 819208 - protein, 9 aa, Homo Sapiens
QRYTQSPMY

SEQ ID NO: 819209 - protein, 9 aa, Homo Sapiens
EAICEVDSS

SEQ ID NO: 819210 - protein, 9 aa, Homo Sapiens
LQREGMRQY

SEQ ID NO: 819211 - protein, 9 aa, Homo Sapiens
FTQKPHRTE

SEQ ID NO: 819212 - protein, 9 aa, Homo Sapiens
DSDFGSTKP

SEQ ID NO: 819213 - protein, 9 aa, Homo Sapiens
LSSTSCMSE

SEQ ID NO: 819214 - protein, 9 aa, Homo Sapiens
LNHPTPIIP

SEQ ID NO: 819215 - protein, 9 aa, Homo Sapiens
IGNALVILA

SEQ ID NO: 819216 - protein, 9 aa, Homo Sapiens
EKYGYSTVT

SEQ ID NO: 819217 - protein, 9 aa, Homo Sapiens
TVEVQGPSL

SEQ ID NO: 819218 - protein, 9 aa, Homo Sapiens
FIMDQANRP

SEQ ID NO: 819219 - protein, 9 aa, Homo Sapiens
RGEIWDACA

SEQ ID NO: 819220 - protein, 9 aa, Homo Sapiens
LDYWWCTYV

SEQ ID NO: 819221 - protein, 9 aa, Homo Sapiens
YCFKEKSCS

SEQ ID NO: 819222 - protein, 9 aa, Homo Sapiens
GKMAGQLFS

SEQ ID NO: 819223 - protein, 9 aa, Homo Sapiens
RDSLLRQTI

SEQ ID NO: 819224 - protein, 9 aa, Homo Sapiens
AALVEHVFR

SEQ ID NO: 819225 - protein, 9 aa, Homo Sapiens
SVDVSSKQS

SEQ ID NO: 819226 - protein, 9 aa, Homo Sapiens
CKYCNFRSH

SEQ ID NO: 819227 - protein, 9 aa, Homo Sapiens
VKYYSSKPN

SEQ ID NO: 819228 - protein, 9 aa, Homo Sapiens
WRDGKGQVY

SEQ ID NO: 819229 - protein, 9 aa, Homo Sapiens
LTAETVKNR

SEQ ID NO: 819230 - protein, 9 aa, Homo Sapiens
DRHRESLMA

SEQ ID NO: 819231 - protein, 9 aa, Homo Sapiens
FLACIIIDR

SEQ ID NO: 819232 - protein, 9 aa, Homo Sapiens
FYYFSCHVE

SEQ ID NO: 819233 - protein, 9 aa, Homo Sapiens
KGNCSGCIQ

SEQ ID NO: 819234 - protein, 9 aa, Homo Sapiens
ICTPLRYNC

SEQ ID NO: 819235 - protein, 9 aa, Homo Sapiens
RVFECGGPE

SEQ ID NO: 819236 - protein, 9 aa, Homo Sapiens
TDCYGYRDF

SEQ ID NO: 819237 - protein, 9 aa, Homo Sapiens
LIQHKIIHT

SEQ ID NO: 819238 - protein, 9 aa, Homo Sapiens
NEKYEQFLS

SEQ ID NO: 819239 - protein, 9 aa, Homo Sapiens
VEKDRELIH

SEQ ID NO: 819240 - protein, 9 aa, Homo Sapiens
QYLPNSNGA

SEQ ID NO: 819241 - protein, 9 aa, Homo Sapiens
IDGEAENGE

SEQ ID NO: 819242 - protein, 9 aa, Homo Sapiens
QCLQSASDE

SEQ ID NO: 819243 - protein, 9 aa, Homo Sapiens
YVDSTTMYG

SEQ ID NO: 819244 - protein, 9 aa, Homo Sapiens
QGAPGCTLV

SEQ ID NO: 819245 - protein, 9 aa, Homo Sapiens
RCRPRSLIY

SEQ ID NO: 819246 - protein, 9 aa, Homo Sapiens
FQEFSLTAD

SEQ ID NO: 819247 - protein, 9 aa, Homo Sapiens
HGRCLGNKC

SEQ ID NO: 819248 - protein, 9 aa, Homo Sapiens
DDTQCVWLD

SEQ ID NO: 819249 - protein, 9 aa, Homo Sapiens
ILEITDNPF

SEQ ID NO: 819250 - protein, 9 aa, Homo Sapiens
ILEKKFYFP

SEQ ID NO: 819251 - protein, 9 aa, Homo Sapiens
YEDAEAVLS

SEQ ID NO: 819252 - protein, 9 aa, Homo Sapiens
KRPLTAYNH

SEQ ID NO: 819253 - protein, 9 aa, Homo Sapiens
CKIHPPADW

SEQ ID NO: 819254 - protein, 9 aa, Homo Sapiens
QSFENETEE

SEQ ID NO: 819255 - protein, 9 aa, Homo Sapiens
DDRVLLGND

SEQ ID NO: 819256 - protein, 9 aa, Homo Sapiens
FIKGQKLHK

SEQ ID NO: 819257 - protein, 9 aa, Homo Sapiens
IYPEGKLIS

SEQ ID NO: 819258 - protein, 9 aa, Homo Sapiens
KSLELHDEF

SEQ ID NO: 819259 - protein, 9 aa, Homo Sapiens
ACNVLSPIA

SEQ ID NO: 819260 - protein, 9 aa, Homo Sapiens
FNEQQQQQS

SEQ ID NO: 819261 - protein, 9 aa, Homo Sapiens
VKEHAHQIQ

SEQ ID NO: 819262 - protein, 9 aa, Homo Sapiens
QKKLADHLK

SEQ ID NO: 819263 - protein, 9 aa, Homo Sapiens
LSFETTKES

SEQ ID NO: 819264 - protein, 9 aa, Homo Sapiens
RKGYGMMSK

SEQ ID NO: 819265 - protein, 9 aa, Homo Sapiens
ILVDIDDIS

SEQ ID NO: 819266 - protein, 9 aa, Homo Sapiens
HEIESIILI

SEQ ID NO: 819267 - protein, 9 aa, Homo Sapiens
QTDEEGKDV

SEQ ID NO: 819268 - protein, 9 aa, Homo Sapiens
SKVTFSAVR

SEQ ID NO: 819269 - protein, 9 aa, Homo Sapiens
RIRKQILKL

SEQ ID NO: 819270 - protein, 9 aa, Homo Sapiens
FTHESDEEQ

SEQ ID NO: 819271 - protein, 9 aa, Homo Sapiens
SAKPSDCPH

SEQ ID NO: 819272 - protein, 9 aa, Homo Sapiens
EENNIEHIP

SEQ ID NO: 819273 - protein, 9 aa, Homo Sapiens
DVDALFCPR

SEQ ID NO: 819274 - protein, 9 aa, Homo Sapiens
GKFMSASQN

SEQ ID NO: 819275 - protein, 9 aa, Homo Sapiens
HINLNQVRR

SEQ ID NO: 819276 - protein, 9 aa, Homo Sapiens
RQCISGDCD

SEQ ID NO: 819277 - protein, 9 aa, Homo Sapiens
LRNNGLNDR

SEQ ID NO: 819278 - protein, 9 aa, Homo Sapiens
DIAYGADGD

SEQ ID NO: 819279 - protein, 9 aa, Homo Sapiens
FLIFDHLYL

SEQ ID NO: 819280 - protein, 9 aa, Homo Sapiens
EHLESFTDV

SEQ ID NO: 819281 - protein, 9 aa, Homo Sapiens
LAQNKSLNL

SEQ ID NO: 819282 - protein, 9 aa, Homo Sapiens
VKDATQKIA

SEQ ID NO: 819283 - protein, 9 aa, Homo Sapiens
AVMDSIPAP

SEQ ID NO: 819284 - protein, 9 aa, Homo Sapiens
QSGSARATG

SEQ ID NO: 819285 - protein, 9 aa, Homo Sapiens
CLDNLKIKN

SEQ ID NO: 819286 - protein, 9 aa, Homo Sapiens
GHSMRKLIT

SEQ ID NO: 819287 - protein, 9 aa, Homo Sapiens
KILLQKFCQ

SEQ ID NO: 819288 - protein, 9 aa, Homo Sapiens
SSPASSPSV

SEQ ID NO: 819289 - protein, 9 aa, Homo Sapiens
ACYENMKRA

SEQ ID NO: 819290 - protein, 9 aa, Homo Sapiens
DKDEEMDVG

SEQ ID NO: 819291 - protein, 9 aa, Homo Sapiens
RRTPPARDN

SEQ ID NO: 819292 - protein, 9 aa, Homo Sapiens
RVVGAETAL

SEQ ID NO: 819293 - protein, 9 aa, Homo Sapiens
CKQLIQSHM

SEQ ID NO: 819294 - protein, 9 aa, Homo Sapiens
RKKKEKKQS

SEQ ID NO: 819295 - protein, 9 aa, Homo Sapiens
VSPEEPQTL

SEQ ID NO: 819296 - protein, 9 aa, Homo Sapiens
HTPELAHCP

SEQ ID NO: 819297 - protein, 9 aa, Homo Sapiens
QRLTVLLNT

SEQ ID NO: 819298 - protein, 9 aa, Homo Sapiens
NTSMALLFE

SEQ ID NO: 819299 - protein, 9 aa, Homo Sapiens
EKHLQSSQF

SEQ ID NO: 819300 - protein, 9 aa, Homo Sapiens
QELLHQAKY

SEQ ID NO: 819301 - protein, 9 aa, Homo Sapiens
SNKPVTIKE

SEQ ID NO: 819302 - protein, 9 aa, Homo Sapiens
WRSWQSRHS

SEQ ID NO: 819303 - protein, 9 aa, Homo Sapiens
PALTISKVI

SEQ ID NO: 819304 - protein, 9 aa, Homo Sapiens
DPASDAGDG

SEQ ID NO: 819305 - protein, 9 aa, Homo Sapiens
ENKSSTKLR

SEQ ID NO: 819306 - protein, 9 aa, Homo Sapiens
LLAVPGSSG

SEQ ID NO: 819307 - protein, 9 aa, Homo Sapiens
RVAQGEMGL

SEQ ID NO: 819308 - protein, 9 aa, Homo Sapiens
PAIHWIYPE

SEQ ID NO: 819309 - protein, 9 aa, Homo Sapiens
RRGWNKFYA

SEQ ID NO: 819310 - protein, 9 aa, Homo Sapiens
NYQGLPVCC

SEQ ID NO: 819311 - protein, 9 aa, Homo Sapiens
ASRPGHVVV

SEQ ID NO: 819312 - protein, 9 aa, Homo Sapiens
EKLEQIIRT

SEQ ID NO: 819313 - protein, 9 aa, Homo Sapiens
MLLIPLSVV

SEQ ID NO: 819314 - protein, 9 aa, Homo Sapiens
STIITAESL

SEQ ID NO: 819315 - protein, 9 aa, Homo Sapiens
IGEPPINGS

SEQ ID NO: 819316 - protein, 9 aa, Homo Sapiens
VENLQIYWL

SEQ ID NO: 819317 - protein, 9 aa, Homo Sapiens
PDFLDSTSS

SEQ ID NO: 819318 - protein, 9 aa, Homo Sapiens
TPDQDTGYH

SEQ ID NO: 819319 - protein, 9 aa, Homo Sapiens
ALAPGAPGA

SEQ ID NO: 819320 - protein, 9 aa, Homo Sapiens
SNLQNIIRD

SEQ ID NO: 819321 - protein, 9 aa, Homo Sapiens
SPAWECVGQ

SEQ ID NO: 819322 - protein, 9 aa, Homo Sapiens
QRCVTFHLP

SEQ ID NO: 819323 - protein, 9 aa, Homo Sapiens
LSRYRGLGI

SEQ ID NO: 819324 - protein, 9 aa, Homo Sapiens
CKELTPNYN

SEQ ID NO: 819325 - protein, 9 aa, Homo Sapiens
PELPEKIDV

SEQ ID NO: 819326 - protein, 9 aa, Homo Sapiens
DLSRHEQRY

SEQ ID NO: 819327 - protein, 9 aa, Homo Sapiens
RADTYWEYT

SEQ ID NO: 819328 - protein, 9 aa, Homo Sapiens
PNVFWMTGL

SEQ ID NO: 819329 - protein, 9 aa, Homo Sapiens
EHVFRIKDD

SEQ ID NO: 819330 - protein, 9 aa, Homo Sapiens
GQEQRMNID

SEQ ID NO: 819331 - protein, 9 aa, Homo Sapiens
LNPVIYAFL

SEQ ID NO: 819332 - protein, 9 aa, Homo Sapiens
MVCRLPVSN

SEQ ID NO: 819333 - protein, 9 aa, Homo Sapiens
RVHKLTIDN

SEQ ID NO: 819334 - protein, 9 aa, Homo Sapiens
IIVRWCDIQ

SEQ ID NO: 819335 - protein, 9 aa, Homo Sapiens
MQNVACSNV

SEQ ID NO: 819336 - protein, 9 aa, Homo Sapiens
NARLDTLWI

SEQ ID NO: 819337 - protein, 9 aa, Homo Sapiens
KPYKCNEGG

SEQ ID NO: 819338 - protein, 9 aa, Homo Sapiens
SREMLEAGP

SEQ ID NO: 819339 - protein, 9 aa, Homo Sapiens
NTPPPPYKQ

SEQ ID NO: 819340 - protein, 9 aa, Homo Sapiens
DPVKIVQCH

SEQ ID NO: 819341 - protein, 9 aa, Homo Sapiens
PIQKFICAS

SEQ ID NO: 819342 - protein, 9 aa, Homo Sapiens
SIGDVEIAE

SEQ ID NO: 819343 - protein, 9 aa, Homo Sapiens
SKLQLPIIQ

SEQ ID NO: 819344 - protein, 9 aa, Homo Sapiens
ETLWKAMKG

SEQ ID NO: 819345 - protein, 9 aa, Homo Sapiens
VRALSHPYS

SEQ ID NO: 819346 - protein, 9 aa, Homo Sapiens
FKLALRLQT

SEQ ID NO: 819347 - protein, 9 aa, Homo Sapiens
ILSCNDTST

SEQ ID NO: 819348 - protein, 9 aa, Homo Sapiens
SPSDDEGMP

SEQ ID NO: 819349 - protein, 9 aa, Homo Sapiens
WRRSKSPKN

SEQ ID NO: 819350 - protein, 9 aa, Homo Sapiens
ISEELQINI

SEQ ID NO: 819351 - protein, 9 aa, Homo Sapiens
IILSTYLEM

SEQ ID NO: 819352 - protein, 9 aa, Homo Sapiens
QDILLIGFY

SEQ ID NO: 819353 - protein, 9 aa, Homo Sapiens
SLHVRFAGC

SEQ ID NO: 819354 - protein, 9 aa, Homo Sapiens
CLPYKLELG

SEQ ID NO: 819355 - protein, 9 aa, Homo Sapiens
ISTVEGGQD

SEQ ID NO: 819356 - protein, 9 aa, Homo Sapiens
AIIQAFKVQ

SEQ ID NO: 819357 - protein, 9 aa, Homo Sapiens
LQLANPKEL

SEQ ID NO: 819358 - protein, 9 aa, Homo Sapiens
KSKKMKEKA

SEQ ID NO: 819359 - protein, 9 aa, Homo Sapiens
EEQGAKKHV

SEQ ID NO: 819360 - protein, 9 aa, Homo Sapiens
KWDFSPVPW

SEQ ID NO: 819361 - protein, 9 aa, Homo Sapiens
LYLEVAARS

SEQ ID NO: 819362 - protein, 9 aa, Homo Sapiens
SCTVVEMLT

SEQ ID NO: 819363 - protein, 9 aa, Homo Sapiens
KFVGGIAQS

SEQ ID NO: 819364 - protein, 9 aa, Homo Sapiens
DPLDWSKTE

SEQ ID NO: 819365 - protein, 9 aa, Homo Sapiens
GATLGEEEL

SEQ ID NO: 819366 - protein, 9 aa, Homo Sapiens
QSEASGKTS

SEQ ID NO: 819367 - protein, 9 aa, Homo Sapiens
TIFYGTLTF

SEQ ID NO: 819368 - protein, 9 aa, Homo Sapiens
KDKNKKSKP

SEQ ID NO: 819369 - protein, 9 aa, Homo Sapiens
LSKLPSMSR

SEQ ID NO: 819370 - protein, 9 aa, Homo Sapiens
DVAIELSQE

SEQ ID NO: 819371 - protein, 9 aa, Homo Sapiens
LLLRILCFV

SEQ ID NO: 819372 - protein, 9 aa, Homo Sapiens
EAQLWSESF

SEQ ID NO: 819373 - protein, 9 aa, Homo Sapiens
CWDAAKYLK

SEQ ID NO: 819374 - protein, 9 aa, Homo Sapiens
EQSNLRALR

SEQ ID NO: 819375 - protein, 9 aa, Homo Sapiens
PFGEDDDDV

SEQ ID NO: 819376 - protein, 9 aa, Homo Sapiens
QPFELANTV

SEQ ID NO: 819377 - protein, 9 aa, Homo Sapiens
PLPPGLKRF

SEQ ID NO: 819378 - protein, 9 aa, Homo Sapiens
LSANLHGGY

SEQ ID NO: 819379 - protein, 9 aa, Homo Sapiens
IRKLGGLPS

SEQ ID NO: 819380 - protein, 9 aa, Homo Sapiens
YAIGGRYGS

SEQ ID NO: 819381 - protein, 9 aa, Homo Sapiens
KIINLKSDE

SEQ ID NO: 819382 - protein, 9 aa, Homo Sapiens
WIIEDTACL

SEQ ID NO: 819383 - protein, 9 aa, Homo Sapiens
KLRKDSAVC

SEQ ID NO: 819384 - protein, 9 aa, Homo Sapiens
IPASLSTFQ

SEQ ID NO: 819385 - protein, 9 aa, Homo Sapiens
LLLPHWTKV

SEQ ID NO: 819386 - protein, 9 aa, Homo Sapiens
PIGLITSSW

SEQ ID NO: 819387 - protein, 9 aa, Homo Sapiens
RDDHALVTR

SEQ ID NO: 819388 - protein, 9 aa, Homo Sapiens
KDFQPSPDI

SEQ ID NO: 819389 - protein, 9 aa, Homo Sapiens
FVEYAHAGD

SEQ ID NO: 819390 - protein, 9 aa, Homo Sapiens
FNIFTLQCE

SEQ ID NO: 819391 - protein, 9 aa, Homo Sapiens
KIADIFESK

SEQ ID NO: 819392 - protein, 9 aa, Homo Sapiens
SYLFDNPRR

SEQ ID NO: 819393 - protein, 9 aa, Homo Sapiens
AIIVLMLAC

SEQ ID NO: 819394 - protein, 9 aa, Homo Sapiens
MKQISSGSS

SEQ ID NO: 819395 - protein, 9 aa, Homo Sapiens
DFQVEGKTN

SEQ ID NO: 819396 - protein, 9 aa, Homo Sapiens
AETFMEKLG

SEQ ID NO: 819397 - protein, 9 aa, Homo Sapiens
KCLDYKPIQ

SEQ ID NO: 819398 - protein, 9 aa, Homo Sapiens
FEIEFSPGG

SEQ ID NO: 819399 - protein, 9 aa, Homo Sapiens
SQKSDKLPS

SEQ ID NO: 819400 - protein, 9 aa, Homo Sapiens
TKEVAHRIT

SEQ ID NO: 819401 - protein, 9 aa, Homo Sapiens
QFASSPLRV

SEQ ID NO: 819402 - protein, 9 aa, Homo Sapiens
QPLPPGLKR

SEQ ID NO: 819403 - protein, 9 aa, Homo Sapiens
RLLNANSGG

SEQ ID NO: 819404 - protein, 9 aa, Homo Sapiens
EHSKVPYIV

SEQ ID NO: 819405 - protein, 9 aa, Homo Sapiens
YPFITYSFI

SEQ ID NO: 819406 - protein, 9 aa, Homo Sapiens
VCRLIGVTE

SEQ ID NO: 819407 - protein, 9 aa, Homo Sapiens
NKLKAAYMN

SEQ ID NO: 819408 - protein, 9 aa, Homo Sapiens
CNKCGKSFC

SEQ ID NO: 819409 - protein, 9 aa, Homo Sapiens
FLRKQMWGD

SEQ ID NO: 819410 - protein, 9 aa, Homo Sapiens
GDQFEEGQD

SEQ ID NO: 819411 - protein, 9 aa, Homo Sapiens
ANISCYLNE

SEQ ID NO: 819412 - protein, 9 aa, Homo Sapiens
MPDKEPSVL

SEQ ID NO: 819413 - protein, 9 aa, Homo Sapiens
ALSNGQNPL

SEQ ID NO: 819414 - protein, 9 aa, Homo Sapiens
HTSTVHCMH

SEQ ID NO: 819415 - protein, 9 aa, Homo Sapiens
KIPGVPNLP

SEQ ID NO: 819416 - protein, 9 aa, Homo Sapiens
KWYQDNALL

SEQ ID NO: 819417 - protein, 9 aa, Homo Sapiens
SWPGHGVPD

SEQ ID NO: 819418 - protein, 9 aa, Homo Sapiens
FTGVDRGQP

SEQ ID NO: 819419 - protein, 9 aa, Homo Sapiens
PLVMYLGFK

SEQ ID NO: 819420 - protein, 9 aa, Homo Sapiens
LLNINGIMK

SEQ ID NO: 819421 - protein, 9 aa, Homo Sapiens
QTNIFEENV

SEQ ID NO: 819422 - protein, 9 aa, Homo Sapiens
FSAKSFKNK

SEQ ID NO: 819423 - protein, 9 aa, Homo Sapiens
ITRSWLQDG

SEQ ID NO: 819424 - protein, 9 aa, Homo Sapiens
IHNGIEACY

SEQ ID NO: 819425 - protein, 9 aa, Homo Sapiens
KYLKEPQCP

SEQ ID NO: 819426 - protein, 9 aa, Homo Sapiens
GPIADVVRE

SEQ ID NO: 819427 - protein, 9 aa, Homo Sapiens
GGFSFDNCQ

SEQ ID NO: 819428 - protein, 9 aa, Homo Sapiens
DADNPLHQP

SEQ ID NO: 819429 - protein, 9 aa, Homo Sapiens
EAKATVEEE

SEQ ID NO: 819430 - protein, 9 aa, Homo Sapiens
HLLTHGLRH

SEQ ID NO: 819431 - protein, 9 aa, Homo Sapiens
HPWQQVDKA

SEQ ID NO: 819432 - protein, 9 aa, Homo Sapiens
YLYKNEIQP

SEQ ID NO: 819433 - protein, 9 aa, Homo Sapiens
HQLLLLFLF

SEQ ID NO: 819434 - protein, 9 aa, Homo Sapiens
KILNEIYAG

SEQ ID NO: 819435 - protein, 9 aa, Homo Sapiens
AEYKILEGT

SEQ ID NO: 819436 - protein, 9 aa, Homo Sapiens
LTNRGVINE

SEQ ID NO: 819437 - protein, 9 aa, Homo Sapiens
QLVGPSSDT

SEQ ID NO: 819438 - protein, 9 aa, Homo Sapiens
TEHTRKLYQ

SEQ ID NO: 819439 - protein, 9 aa, Homo Sapiens
SDLVKGLKS

SEQ ID NO: 819440 - protein, 9 aa, Homo Sapiens
PDEDETING

SEQ ID NO: 819441 - protein, 9 aa, Homo Sapiens
SPSELPVKL

SEQ ID NO: 819442 - protein, 9 aa, Homo Sapiens
MERNSSLWN

SEQ ID NO: 819443 - protein, 9 aa, Homo Sapiens
INQSCCVYV

SEQ ID NO: 819444 - protein, 9 aa, Homo Sapiens
DPDTIRRQL

SEQ ID NO: 819445 - protein, 9 aa, Homo Sapiens
YTKFSDHVT

SEQ ID NO: 819446 - protein, 9 aa, Homo Sapiens
IPNGYLVLY

SEQ ID NO: 819447 - protein, 9 aa, Homo Sapiens
GSSRNVPAE

SEQ ID NO: 819448 - protein, 9 aa, Homo Sapiens
INAVTTKFV

SEQ ID NO: 819449 - protein, 9 aa, Homo Sapiens
PAEQKDENK

SEQ ID NO: 819450 - protein, 9 aa, Homo Sapiens
RAPYRLESQ

SEQ ID NO: 819451 - protein, 9 aa, Homo Sapiens
TGNYCGISG

SEQ ID NO: 819452 - protein, 9 aa, Homo Sapiens
PPFNTQRAY

SEQ ID NO: 819453 - protein, 9 aa, Homo Sapiens
PQQTFPARE

SEQ ID NO: 819454 - protein, 9 aa, Homo Sapiens
FMDAILLYL

SEQ ID NO: 819455 - protein, 9 aa, Homo Sapiens
CKVIGSFLT

SEQ ID NO: 819456 - protein, 9 aa, Homo Sapiens
KQFCLLLNV

SEQ ID NO: 819457 - protein, 9 aa, Homo Sapiens
DKTLELEGI

SEQ ID NO: 819458 - protein, 9 aa, Homo Sapiens
HCSATPTPP

SEQ ID NO: 819459 - protein, 9 aa, Homo Sapiens
VELFRTTYF

SEQ ID NO: 819460 - protein, 9 aa, Homo Sapiens
ENKLKAAYM

SEQ ID NO: 819461 - protein, 9 aa, Homo Sapiens
TTLIYGLLI

SEQ ID NO: 819462 - protein, 9 aa, Homo Sapiens
TLVFLVAFV

SEQ ID NO: 819463 - protein, 9 aa, Homo Sapiens
RNKNVAEIP

SEQ ID NO: 819464 - protein, 9 aa, Homo Sapiens
HWLVEDHVQ

SEQ ID NO: 819465 - protein, 9 aa, Homo Sapiens
QFENSVYEG

SEQ ID NO: 819466 - protein, 9 aa, Homo Sapiens
YTDLFLSLV

SEQ ID NO: 819467 - protein, 9 aa, Homo Sapiens
PVGTGRDMA

SEQ ID NO: 819468 - protein, 9 aa, Homo Sapiens
GLIFAVVFS

SEQ ID NO: 819469 - protein, 9 aa, Homo Sapiens
SVDWIMEAV

SEQ ID NO: 819470 - protein, 9 aa, Homo Sapiens
SHLPTCYNY

SEQ ID NO: 819471 - protein, 9 aa, Homo Sapiens
QEMTSQLEK

SEQ ID NO: 819472 - protein, 9 aa, Homo Sapiens
LIFLGSRVA

SEQ ID NO: 819473 - protein, 9 aa, Homo Sapiens
AGSPVSPPP

SEQ ID NO: 819474 - protein, 9 aa, Homo Sapiens
NTQEGGINK

SEQ ID NO: 819475 - protein, 9 aa, Homo Sapiens
GVVYALKRQ

SEQ ID NO: 819476 - protein, 9 aa, Homo Sapiens
NYYCTTGHR

SEQ ID NO: 819477 - protein, 9 aa, Homo Sapiens
REFGAVFRR

SEQ ID NO: 819478 - protein, 9 aa, Homo Sapiens
RESFTAYES

SEQ ID NO: 819479 - protein, 9 aa, Homo Sapiens
RHLLHKSCV

SEQ ID NO: 819480 - protein, 9 aa, Homo Sapiens
MKRALNDVF

SEQ ID NO: 819481 - protein, 9 aa, Homo Sapiens
TFNVQSKKR

SEQ ID NO: 819482 - protein, 9 aa, Homo Sapiens
TQREILKQR

SEQ ID NO: 819483 - protein, 9 aa, Homo Sapiens
SSQISWPLW

SEQ ID NO: 819484 - protein, 9 aa, Homo Sapiens
VSYQAIGED

SEQ ID NO: 819485 - protein, 9 aa, Homo Sapiens
LFPKYSTNK

SEQ ID NO: 819486 - protein, 9 aa, Homo Sapiens
LIGRYIKLR

SEQ ID NO: 819487 - protein, 9 aa, Homo Sapiens
FRYVEKITR

SEQ ID NO: 819488 - protein, 9 aa, Homo Sapiens
YSGLKQIPI

SEQ ID NO: 819489 - protein, 9 aa, Homo Sapiens
RLGQSHRRQ

SEQ ID NO: 819490 - protein, 9 aa, Homo Sapiens
IEFSFHPVC

SEQ ID NO: 819491 - protein, 9 aa, Homo Sapiens
VCALANHAP

SEQ ID NO: 819492 - protein, 9 aa, Homo Sapiens
ALYQNNGLY

SEQ ID NO: 819493 - protein, 9 aa, Homo Sapiens
ASEEAVSFC

SEQ ID NO: 819494 - protein, 9 aa, Homo Sapiens
MLIIVRWCD

SEQ ID NO: 819495 - protein, 9 aa, Homo Sapiens
HIEAILLKW

SEQ ID NO: 819496 - protein, 9 aa, Homo Sapiens
EICQEQLRE

SEQ ID NO: 819497 - protein, 9 aa, Homo Sapiens
DNREEHTEF

SEQ ID NO: 819498 - protein, 9 aa, Homo Sapiens
IQFSRITYK

SEQ ID NO: 819499 - protein, 9 aa, Homo Sapiens
LQNCKWYQD

SEQ ID NO: 819500 - protein, 9 aa, Homo Sapiens
SNYKLFLLF

SEQ ID NO: 819501 - protein, 9 aa, Homo Sapiens
FGDIDTKPS

SEQ ID NO: 819502 - protein, 9 aa, Homo Sapiens
KINLGDRSQ

SEQ ID NO: 819503 - protein, 9 aa, Homo Sapiens
VQPPPDPHL

SEQ ID NO: 819504 - protein, 9 aa, Homo Sapiens
AASTVFPIM

SEQ ID NO: 819505 - protein, 9 aa, Homo Sapiens
RDKVILFSF

SEQ ID NO: 819506 - protein, 9 aa, Homo Sapiens
STDRNASVG

SEQ ID NO: 819507 - protein, 9 aa, Homo Sapiens
WRCSYHKRK

SEQ ID NO: 819508 - protein, 9 aa, Homo Sapiens
RSCSEQAQV

SEQ ID NO: 819509 - protein, 9 aa, Homo Sapiens
WRIHTGERP

SEQ ID NO: 819510 - protein, 9 aa, Homo Sapiens
QHAAKCIPA

SEQ ID NO: 819511 - protein, 9 aa, Homo Sapiens
VVILSVLFT

SEQ ID NO: 819512 - protein, 9 aa, Homo Sapiens
YVPVIGANV

SEQ ID NO: 819513 - protein, 9 aa, Homo Sapiens
DADTGIFTI

SEQ ID NO: 819514 - protein, 9 aa, Homo Sapiens
DILKGEHLS

SEQ ID NO: 819515 - protein, 9 aa, Homo Sapiens
AEHFFCDAP

SEQ ID NO: 819516 - protein, 9 aa, Homo Sapiens
MVQLFSLVT

SEQ ID NO: 819517 - protein, 9 aa, Homo Sapiens
VYSVLFGSL

SEQ ID NO: 819518 - protein, 9 aa, Homo Sapiens
GKLPQSPSF

SEQ ID NO: 819519 - protein, 9 aa, Homo Sapiens
LLFKKSLDR

SEQ ID NO: 819520 - protein, 9 aa, Homo Sapiens
QQFLRFGKT

SEQ ID NO: 819521 - protein, 9 aa, Homo Sapiens
RRRSKRKDE

SEQ ID NO: 819522 - protein, 9 aa, Homo Sapiens
LPTPDQDTG

SEQ ID NO: 819523 - protein, 9 aa, Homo Sapiens
EMRCQCEMV

SEQ ID NO: 819524 - protein, 9 aa, Homo Sapiens
DVTERKLRT

SEQ ID NO: 819525 - protein, 9 aa, Homo Sapiens
KPKFLKTSP

SEQ ID NO: 819526 - protein, 9 aa, Homo Sapiens
PYVCFHIIE

SEQ ID NO: 819527 - protein, 9 aa, Homo Sapiens
ALILLRAGT

SEQ ID NO: 819528 - protein, 9 aa, Homo Sapiens
KSFKNISDK

SEQ ID NO: 819529 - protein, 9 aa, Homo Sapiens
IYCRKKVHH

SEQ ID NO: 819530 - protein, 9 aa, Homo Sapiens
TNGRGCTDY

SEQ ID NO: 819531 - protein, 9 aa, Homo Sapiens
LLEYYQNKM

SEQ ID NO: 819532 - protein, 9 aa, Homo Sapiens
FIQHQIIHT

SEQ ID NO: 819533 - protein, 9 aa, Homo Sapiens
EELERQVVD

SEQ ID NO: 819534 - protein, 9 aa, Homo Sapiens
LSKYDATRQ

SEQ ID NO: 819535 - protein, 9 aa, Homo Sapiens
PPEPKKSHR

SEQ ID NO: 819536 - protein, 9 aa, Homo Sapiens
YSTQKQSSY

SEQ ID NO: 819537 - protein, 9 aa, Homo Sapiens
CYVKFQNVN

SEQ ID NO: 819538 - protein, 9 aa, Homo Sapiens
KETGYFFIH

SEQ ID NO: 819539 - protein, 9 aa, Homo Sapiens
CSVRAIRID

SEQ ID NO: 819540 - protein, 9 aa, Homo Sapiens
RGNPSERLG

SEQ ID NO: 819541 - protein, 9 aa, Homo Sapiens
EEGPFDHMF

SEQ ID NO: 819542 - protein, 9 aa, Homo Sapiens
CCVSQYLEP

SEQ ID NO: 819543 - protein, 9 aa, Homo Sapiens
PSGSTGFGN

SEQ ID NO: 819544 - protein, 9 aa, Homo Sapiens
PDGPWRQSS

SEQ ID NO: 819545 - protein, 9 aa, Homo Sapiens
IGNLNIPDS

SEQ ID NO: 819546 - protein, 9 aa, Homo Sapiens
QEVVNLGGL

SEQ ID NO: 819547 - protein, 9 aa, Homo Sapiens
LLIQTSILR

SEQ ID NO: 819548 - protein, 9 aa, Homo Sapiens
EIFDSPAEE

SEQ ID NO: 819549 - protein, 9 aa, Homo Sapiens
KLASQKLRI

SEQ ID NO: 819550 - protein, 9 aa, Homo Sapiens
RQLFQDYEI

SEQ ID NO: 819551 - protein, 9 aa, Homo Sapiens
FSHQSKMEK

SEQ ID NO: 819552 - protein, 9 aa, Homo Sapiens
HCSRYMHDL

SEQ ID NO: 819553 - protein, 9 aa, Homo Sapiens
KLPPRSESS

SEQ ID NO: 819554 - protein, 9 aa, Homo Sapiens
TSVQLIWKK

SEQ ID NO: 819555 - protein, 9 aa, Homo Sapiens
ASSSLFHPE

SEQ ID NO: 819556 - protein, 9 aa, Homo Sapiens
VIGRGNYGK

SEQ ID NO: 819557 - protein, 9 aa, Homo Sapiens
QLLCQLKEL

SEQ ID NO: 819558 - protein, 9 aa, Homo Sapiens
VQKNGVNEA

SEQ ID NO: 819559 - protein, 9 aa, Homo Sapiens
APGSWVCGF

SEQ ID NO: 819560 - protein, 9 aa, Homo Sapiens
EEPFPAEIY

SEQ ID NO: 819561 - protein, 9 aa, Homo Sapiens
ALHSGMDYT

SEQ ID NO: 819562 - protein, 9 aa, Homo Sapiens
TKHNFMMSV

SEQ ID NO: 819563 - protein, 9 aa, Homo Sapiens
SITGSPLQN

SEQ ID NO: 819564 - protein, 9 aa, Homo Sapiens
FNFIGYFFS

SEQ ID NO: 819565 - protein, 9 aa, Homo Sapiens
TGKLQAYAK

SEQ ID NO: 819566 - protein, 9 aa, Homo Sapiens
FGDPCFKTP

SEQ ID NO: 819567 - protein, 9 aa, Homo Sapiens
DQIQRRAEE

SEQ ID NO: 819568 - protein, 9 aa, Homo Sapiens
ILAFSLHSL

SEQ ID NO: 819569 - protein, 9 aa, Homo Sapiens
QQNEILVKR

SEQ ID NO: 819570 - protein, 9 aa, Homo Sapiens
VCRALEERW

SEQ ID NO: 819571 - protein, 9 aa, Homo Sapiens
SISSQMHHL

SEQ ID NO: 819572 - protein, 9 aa, Homo Sapiens
LHHARCCNV

SEQ ID NO: 819573 - protein, 9 aa, Homo Sapiens
KLQAYAKTL

SEQ ID NO: 819574 - protein, 9 aa, Homo Sapiens
NQNEENILN

SEQ ID NO: 819575 - protein, 9 aa, Homo Sapiens
YLLVACTTP

SEQ ID NO: 819576 - protein, 9 aa, Homo Sapiens
RSWQSRHSG

SEQ ID NO: 819577 - protein, 9 aa, Homo Sapiens
NKTFKCHRT

SEQ ID NO: 819578 - protein, 9 aa, Homo Sapiens
SWGKRKLQG

SEQ ID NO: 819579 - protein, 9 aa, Homo Sapiens
GVGNTVFPV

SEQ ID NO: 819580 - protein, 9 aa, Homo Sapiens
VTMLFPDIV

SEQ ID NO: 819581 - protein, 9 aa, Homo Sapiens
PAHIVQIPL

SEQ ID NO: 819582 - protein, 9 aa, Homo Sapiens
APYNIQYTC

SEQ ID NO: 819583 - protein, 9 aa, Homo Sapiens
YVVEAIPEF

SEQ ID NO: 819584 - protein, 9 aa, Homo Sapiens
FFSRVRNAF

SEQ ID NO: 819585 - protein, 9 aa, Homo Sapiens
SLLMFKDLK

SEQ ID NO: 819586 - protein, 9 aa, Homo Sapiens
LDLSSNKIC

SEQ ID NO: 819587 - protein, 9 aa, Homo Sapiens
VCRLPVSNK

SEQ ID NO: 819588 - protein, 9 aa, Homo Sapiens
CHIRKYSHL

SEQ ID NO: 819589 - protein, 9 aa, Homo Sapiens
LCTYLPLLT

SEQ ID NO: 819590 - protein, 9 aa, Homo Sapiens
AYAKRNISV

SEQ ID NO: 819591 - protein, 9 aa, Homo Sapiens
ITQGAQRSS

SEQ ID NO: 819592 - protein, 9 aa, Homo Sapiens
ISIRARFGG

SEQ ID NO: 819593 - protein, 9 aa, Homo Sapiens
QSFENVMAT

SEQ ID NO: 819594 - protein, 9 aa, Homo Sapiens
MKGFIKGQK

SEQ ID NO: 819595 - protein, 9 aa, Homo Sapiens
NRKEFAKFE

SEQ ID NO: 819596 - protein, 9 aa, Homo Sapiens
CKTQTTSWL

SEQ ID NO: 819597 - protein, 9 aa, Homo Sapiens
EENNDMNNK

SEQ ID NO: 819598 - protein, 9 aa, Homo Sapiens
ALFSNHQSS

SEQ ID NO: 819599 - protein, 9 aa, Homo Sapiens
GILKNASDL

SEQ ID NO: 819600 - protein, 9 aa, Homo Sapiens
YNDGATKLN

SEQ ID NO: 819601 - protein, 9 aa, Homo Sapiens
NQQNGDSGS

SEQ ID NO: 819602 - protein, 9 aa, Homo Sapiens
LIEALKTTR

SEQ ID NO: 819603 - protein, 9 aa, Homo Sapiens
VSAPLEAAR

SEQ ID NO: 819604 - protein, 9 aa, Homo Sapiens
ECIQHEPLA

SEQ ID NO: 819605 - protein, 9 aa, Homo Sapiens
SCAVSREHG

SEQ ID NO: 819606 - protein, 9 aa, Homo Sapiens
QLSVVKGIY

SEQ ID NO: 819607 - protein, 9 aa, Homo Sapiens
YEMIQCFWV

SEQ ID NO: 819608 - protein, 9 aa, Homo Sapiens
QIAPCHLRA

SEQ ID NO: 819609 - protein, 9 aa, Homo Sapiens
ELLVQMQGV

SEQ ID NO: 819610 - protein, 9 aa, Homo Sapiens
LGGGSGHEP

SEQ ID NO: 819611 - protein, 9 aa, Homo Sapiens
IRCSPQKTV

SEQ ID NO: 819612 - protein, 9 aa, Homo Sapiens
LKGLTKVNI

SEQ ID NO: 819613 - protein, 9 aa, Homo Sapiens
GHRKTSSRL

SEQ ID NO: 819614 - protein, 9 aa, Homo Sapiens
LTAVESRYA

SEQ ID NO: 819615 - protein, 9 aa, Homo Sapiens
VRRLMLSER

SEQ ID NO: 819616 - protein, 9 aa, Homo Sapiens
LAREYYIIV

SEQ ID NO: 819617 - protein, 9 aa, Homo Sapiens
CTPESMGSE

SEQ ID NO: 819618 - protein, 9 aa, Homo Sapiens
DRAQQYVLQ

SEQ ID NO: 819619 - protein, 9 aa, Homo Sapiens
SSHLVKHQK

SEQ ID NO: 819620 - protein, 9 aa, Homo Sapiens
KQLIQSHMA

SEQ ID NO: 819621 - protein, 9 aa, Homo Sapiens
YTTSAVLIQ

SEQ ID NO: 819622 - protein, 9 aa, Homo Sapiens
ECEGFEYIN

SEQ ID NO: 819623 - protein, 9 aa, Homo Sapiens
FEIDVAGTD

SEQ ID NO: 819624 - protein, 9 aa, Homo Sapiens
HFVLFFFRR

SEQ ID NO: 819625 - protein, 9 aa, Homo Sapiens
RNFSFLKVI

SEQ ID NO: 819626 - protein, 9 aa, Homo Sapiens
YKDRGQIRY

SEQ ID NO: 819627 - protein, 9 aa, Homo Sapiens
FIFHISRLF

SEQ ID NO: 819628 - protein, 9 aa, Homo Sapiens
KLNYFFVEI

SEQ ID NO: 819629 - protein, 9 aa, Homo Sapiens
FWTIPGYKP

SEQ ID NO: 819630 - protein, 9 aa, Homo Sapiens
KPAIKFAYL

SEQ ID NO: 819631 - protein, 9 aa, Homo Sapiens
RTKFKLPKE

SEQ ID NO: 819632 - protein, 9 aa, Homo Sapiens
KDEEMDVGT

SEQ ID NO: 819633 - protein, 9 aa, Homo Sapiens
TVRSCDLRE

SEQ ID NO: 819634 - protein, 9 aa, Homo Sapiens
SKTQNLSKI

SEQ ID NO: 819635 - protein, 9 aa, Homo Sapiens
NLYGLTKAI

SEQ ID NO: 819636 - protein, 9 aa, Homo Sapiens
HRAVEDQLK

SEQ ID NO: 819637 - protein, 9 aa, Homo Sapiens
DYSFTTFFS

SEQ ID NO: 819638 - protein, 9 aa, Homo Sapiens
SLEDLKEFS

SEQ ID NO: 819639 - protein, 9 aa, Homo Sapiens
ICTQPRQIS

SEQ ID NO: 819640 - protein, 9 aa, Homo Sapiens
FTDRALALN

SEQ ID NO: 819641 - protein, 9 aa, Homo Sapiens
ESITYIRAD

SEQ ID NO: 819642 - protein, 9 aa, Homo Sapiens
APMAGGDKD

SEQ ID NO: 819643 - protein, 9 aa, Homo Sapiens
IWSVGCTMA

SEQ ID NO: 819644 - protein, 9 aa, Homo Sapiens
LHREIEIQA

SEQ ID NO: 819645 - protein, 9 aa, Homo Sapiens
RFFFNIFTL

SEQ ID NO: 819646 - protein, 9 aa, Homo Sapiens
SSQPEVSRS

SEQ ID NO: 819647 - protein, 9 aa, Homo Sapiens
LTYLGHNEN

SEQ ID NO: 819648 - protein, 9 aa, Homo Sapiens
TEITALAPS

SEQ ID NO: 819649 - protein, 9 aa, Homo Sapiens
FKDMDTFSG

SEQ ID NO: 819650 - protein, 9 aa, Homo Sapiens
GSALHGSLV

SEQ ID NO: 819651 - protein, 9 aa, Homo Sapiens
IREQQTRPV

SEQ ID NO: 819652 - protein, 9 aa, Homo Sapiens
TAAHCGHPI

SEQ ID NO: 819653 - protein, 9 aa, Homo Sapiens
YKIKYEFFR

SEQ ID NO: 819654 - protein, 9 aa, Homo Sapiens
LKPQSLQSQ

SEQ ID NO: 819655 - protein, 9 aa, Homo Sapiens
RTRGIFKTK

SEQ ID NO: 819656 - protein, 9 aa, Homo Sapiens
RLNMALGLM

SEQ ID NO: 819657 - protein, 9 aa, Homo Sapiens
FFHMTAETL

SEQ ID NO: 819658 - protein, 9 aa, Homo Sapiens
PINPPKYDK

SEQ ID NO: 819659 - protein, 9 aa, Homo Sapiens
LRKNTNIDN

SEQ ID NO: 819660 - protein, 9 aa, Homo Sapiens
HKGNVAAAV

SEQ ID NO: 819661 - protein, 9 aa, Homo Sapiens
VVEKLSDLE

SEQ ID NO: 819662 - protein, 9 aa, Homo Sapiens
AGLSLAFSG

SEQ ID NO: 819663 - protein, 9 aa, Homo Sapiens
YGPLENEQS

SEQ ID NO: 819664 - protein, 9 aa, Homo Sapiens
PTYPVYRGS

SEQ ID NO: 819665 - protein, 9 aa, Homo Sapiens
AQSSYDIIN

SEQ ID NO: 819666 - protein, 9 aa, Homo Sapiens
PEIFKEMSN

SEQ ID NO: 819667 - protein, 9 aa, Homo Sapiens
RITIICLPQ

SEQ ID NO: 819668 - protein, 9 aa, Homo Sapiens
ACAATDDPT

SEQ ID NO: 819669 - protein, 9 aa, Homo Sapiens
HQCSNSNRH

SEQ ID NO: 819670 - protein, 9 aa, Homo Sapiens
HSATVTPQK

SEQ ID NO: 819671 - protein, 9 aa, Homo Sapiens
LAEATVVLA

SEQ ID NO: 819672 - protein, 9 aa, Homo Sapiens
VIYSLRNGS

SEQ ID NO: 819673 - protein, 9 aa, Homo Sapiens
SGCTISMIK

SEQ ID NO: 819674 - protein, 9 aa, Homo Sapiens
LISHKIVHL

SEQ ID NO: 819675 - protein, 9 aa, Homo Sapiens
DEDRRFMCP

SEQ ID NO: 819676 - protein, 9 aa, Homo Sapiens
HNLVLIPLH

SEQ ID NO: 819677 - protein, 9 aa, Homo Sapiens
SELPHKRYV

SEQ ID NO: 819678 - protein, 9 aa, Homo Sapiens
EHKKQVSKN

SEQ ID NO: 819679 - protein, 9 aa, Homo Sapiens
IKKNIFHMV

SEQ ID NO: 819680 - protein, 9 aa, Homo Sapiens
HVLSREEQA

SEQ ID NO: 819681 - protein, 9 aa, Homo Sapiens
DKEKTDPQY

SEQ ID NO: 819682 - protein, 9 aa, Homo Sapiens
EKEESKNDR

SEQ ID NO: 819683 - protein, 9 aa, Homo Sapiens
ECKDCWITF

SEQ ID NO: 819684 - protein, 9 aa, Homo Sapiens
NEDGGEAEK

SEQ ID NO: 819685 - protein, 9 aa, Homo Sapiens
DENFWTIWC

SEQ ID NO: 819686 - protein, 9 aa, Homo Sapiens
EDDKLEARL

SEQ ID NO: 819687 - protein, 9 aa, Homo Sapiens
LCAEHQIDL

SEQ ID NO: 819688 - protein, 9 aa, Homo Sapiens
LLVACTTPY

SEQ ID NO: 819689 - protein, 9 aa, Homo Sapiens
TKIDYILEV

SEQ ID NO: 819690 - protein, 9 aa, Homo Sapiens
PQDGESTQS

SEQ ID NO: 819691 - protein, 9 aa, Homo Sapiens
CGGLIKYIK

SEQ ID NO: 819692 - protein, 9 aa, Homo Sapiens
SHDNGSHFF

SEQ ID NO: 819693 - protein, 9 aa, Homo Sapiens
ASSIVYTKE

SEQ ID NO: 819694 - protein, 9 aa, Homo Sapiens
LPYVFKSII

SEQ ID NO: 819695 - protein, 9 aa, Homo Sapiens
NNNYSPTAA

SEQ ID NO: 819696 - protein, 9 aa, Homo Sapiens
DVSSDLQKE

SEQ ID NO: 819697 - protein, 9 aa, Homo Sapiens
LMEEIISPR

SEQ ID NO: 819698 - protein, 9 aa, Homo Sapiens
TYFNIHPKG

SEQ ID NO: 819699 - protein, 9 aa, Homo Sapiens
TKCFTCGIG

SEQ ID NO: 819700 - protein, 9 aa, Homo Sapiens
SLLFSTSKI

SEQ ID NO: 819701 - protein, 9 aa, Homo Sapiens
ANTGVTASP

SEQ ID NO: 819702 - protein, 9 aa, Homo Sapiens
DLIDLMQLR

SEQ ID NO: 819703 - protein, 9 aa, Homo Sapiens
AFGKDTKDR

SEQ ID NO: 819704 - protein, 9 aa, Homo Sapiens
PECGRWFSQ

SEQ ID NO: 819705 - protein, 9 aa, Homo Sapiens
YNDPKCCGF

SEQ ID NO: 819706 - protein, 9 aa, Homo Sapiens
NREAFNVYL

SEQ ID NO: 819707 - protein, 9 aa, Homo Sapiens
QNKLQAEAK

SEQ ID NO: 819708 - protein, 9 aa, Homo Sapiens
QSFSRKRPF

SEQ ID NO: 819709 - protein, 9 aa, Homo Sapiens
IISDPDSQF

SEQ ID NO: 819710 - protein, 9 aa, Homo Sapiens
KQQRRSDLN

SEQ ID NO: 819711 - protein, 9 aa, Homo Sapiens
GTLEAGYTK

SEQ ID NO: 819712 - protein, 9 aa, Homo Sapiens
SCCKSCCSS

SEQ ID NO: 819713 - protein, 9 aa, Homo Sapiens
DFDGGNFDF

SEQ ID NO: 819714 - protein, 9 aa, Homo Sapiens
TFNFQGIVK

SEQ ID NO: 819715 - protein, 9 aa, Homo Sapiens
YGILKQRPN

SEQ ID NO: 819716 - protein, 9 aa, Homo Sapiens
QDHIFSFDL

SEQ ID NO: 819717 - protein, 9 aa, Homo Sapiens
MIMAAVPVA

SEQ ID NO: 819718 - protein, 9 aa, Homo Sapiens
EEKLWKEMS

SEQ ID NO: 819719 - protein, 9 aa, Homo Sapiens
YWMRLHFPI

SEQ ID NO: 819720 - protein, 9 aa, Homo Sapiens
AGLKEVSPQ

SEQ ID NO: 819721 - protein, 9 aa, Homo Sapiens
QIILFINNC

SEQ ID NO: 819722 - protein, 9 aa, Homo Sapiens
ELISFITSE

SEQ ID NO: 819723 - protein, 9 aa, Homo Sapiens
TQIITTRPD

SEQ ID NO: 819724 - protein, 9 aa, Homo Sapiens
LGKKFKIYF

SEQ ID NO: 819725 - protein, 9 aa, Homo Sapiens
VSQYLEPLT

SEQ ID NO: 819726 - protein, 9 aa, Homo Sapiens
WCAWFLQMK

SEQ ID NO: 819727 - protein, 9 aa, Homo Sapiens
SQVDKLVEL

SEQ ID NO: 819728 - protein, 9 aa, Homo Sapiens
NKLRQSEVV

SEQ ID NO: 819729 - protein, 9 aa, Homo Sapiens
YEQREYGNL

SEQ ID NO: 819730 - protein, 9 aa, Homo Sapiens
FHITDNSYQ

SEQ ID NO: 819731 - protein, 9 aa, Homo Sapiens
VATLVKEVI

SEQ ID NO: 819732 - protein, 9 aa, Homo Sapiens
VLLNRICRI

SEQ ID NO: 819733 - protein, 9 aa, Homo Sapiens
LVGDGPHNR

SEQ ID NO: 819734 - protein, 9 aa, Homo Sapiens
FFDIQLPYK

SEQ ID NO: 819735 - protein, 9 aa, Homo Sapiens
ANTAFSASE

SEQ ID NO: 819736 - protein, 9 aa, Homo Sapiens
LDALSPFLW

SEQ ID NO: 819737 - protein, 9 aa, Homo Sapiens
GYALPHAII

SEQ ID NO: 819738 - protein, 9 aa, Homo Sapiens
VDYGKLLDP

SEQ ID NO: 819739 - protein, 9 aa, Homo Sapiens
LEVSEQMKI

SEQ ID NO: 819740 - protein, 9 aa, Homo Sapiens
LYTLMREVI

SEQ ID NO: 819741 - protein, 9 aa, Homo Sapiens
ECKDCRTSF

SEQ ID NO: 819742 - protein, 9 aa, Homo Sapiens
RGGDEYDGG

SEQ ID NO: 819743 - protein, 9 aa, Homo Sapiens
EFKAHKGEI

SEQ ID NO: 819744 - protein, 9 aa, Homo Sapiens
GRQKYKRWL

SEQ ID NO: 819745 - protein, 9 aa, Homo Sapiens
LLSQVDKLV

SEQ ID NO: 819746 - protein, 9 aa, Homo Sapiens
LLYPNIAER

SEQ ID NO: 819747 - protein, 9 aa, Homo Sapiens
SILLLLVLA

SEQ ID NO: 819748 - protein, 9 aa, Homo Sapiens
WITIKEGSK

SEQ ID NO: 819749 - protein, 9 aa, Homo Sapiens
RPFPDETHE

SEQ ID NO: 819750 - protein, 9 aa, Homo Sapiens
LLDWALCQE

SEQ ID NO: 819751 - protein, 9 aa, Homo Sapiens
NEMVIYLMG

SEQ ID NO: 819752 - protein, 9 aa, Homo Sapiens
DNTLLNELE

SEQ ID NO: 819753 - protein, 9 aa, Homo Sapiens
TILLGYLAM

SEQ ID NO: 819754 - protein, 9 aa, Homo Sapiens
NYLGVQDAV

SEQ ID NO: 819755 - protein, 9 aa, Homo Sapiens
SKNYYLKYT

SEQ ID NO: 819756 - protein, 9 aa, Homo Sapiens
RILSGGALK

SEQ ID NO: 819757 - protein, 9 aa, Homo Sapiens
TTAGISSSL

SEQ ID NO: 819758 - protein, 9 aa, Homo Sapiens
DASTGRVSQ

SEQ ID NO: 819759 - protein, 9 aa, Homo Sapiens
NKLQAEAKM

SEQ ID NO: 819760 - protein, 9 aa, Homo Sapiens
CQNSWGEDG

SEQ ID NO: 819761 - protein, 9 aa, Homo Sapiens
EEIPTPSNK

SEQ ID NO: 819762 - protein, 9 aa, Homo Sapiens
GFYNYPELQ

SEQ ID NO: 819763 - protein, 9 aa, Homo Sapiens
RWTLGSCPS

SEQ ID NO: 819764 - protein, 9 aa, Homo Sapiens
GCVYLTITN

SEQ ID NO: 819765 - protein, 9 aa, Homo Sapiens
MVESAPKQH

SEQ ID NO: 819766 - protein, 9 aa, Homo Sapiens
PLDGEELLV

SEQ ID NO: 819767 - protein, 9 aa, Homo Sapiens
LQKAGPGLQ

SEQ ID NO: 819768 - protein, 9 aa, Homo Sapiens
YALPHAIIR

SEQ ID NO: 819769 - protein, 9 aa, Homo Sapiens
FQDAVNTIL

SEQ ID NO: 819770 - protein, 9 aa, Homo Sapiens
RSLEPPEKL

SEQ ID NO: 819771 - protein, 9 aa, Homo Sapiens
EVQGVRELP

SEQ ID NO: 819772 - protein, 9 aa, Homo Sapiens
ESNVKPRKL

SEQ ID NO: 819773 - protein, 9 aa, Homo Sapiens
NQSRVKCGR

SEQ ID NO: 819774 - protein, 9 aa, Homo Sapiens
SNGKTFENF

SEQ ID NO: 819775 - protein, 9 aa, Homo Sapiens
NLGQHQIIH

SEQ ID NO: 819776 - protein, 9 aa, Homo Sapiens
DLRPLFSPA

SEQ ID NO: 819777 - protein, 9 aa, Homo Sapiens
NTGAPHQDN

SEQ ID NO: 819778 - protein, 9 aa, Homo Sapiens
SARLPGVSH

SEQ ID NO: 819779 - protein, 9 aa, Homo Sapiens
LVFVINSSE

SEQ ID NO: 819780 - protein, 9 aa, Homo Sapiens
NTAIEMNIN

SEQ ID NO: 819781 - protein, 9 aa, Homo Sapiens
TVKPRETRV

SEQ ID NO: 819782 - protein, 9 aa, Homo Sapiens
YFQEFSLTA

SEQ ID NO: 819783 - protein, 9 aa, Homo Sapiens
NTFIVRDFQ

SEQ ID NO: 819784 - protein, 9 aa, Homo Sapiens
LNKLFSEFV

SEQ ID NO: 819785 - protein, 9 aa, Homo Sapiens
LTLHQESPT

SEQ ID NO: 819786 - protein, 9 aa, Homo Sapiens
TLIRDQLKT

SEQ ID NO: 819787 - protein, 9 aa, Homo Sapiens
IQCFWVKSG

SEQ ID NO: 819788 - protein, 9 aa, Homo Sapiens
GCVARAGEP

SEQ ID NO: 819789 - protein, 9 aa, Homo Sapiens
FLLFFLYSW

SEQ ID NO: 819790 - protein, 9 aa, Homo Sapiens
MGVLLQWRV

SEQ ID NO: 819791 - protein, 9 aa, Homo Sapiens
KEFEQLWKV

SEQ ID NO: 819792 - protein, 9 aa, Homo Sapiens
AKFREQILR

SEQ ID NO: 819793 - protein, 9 aa, Homo Sapiens
PNDEGAVLS

SEQ ID NO: 819794 - protein, 9 aa, Homo Sapiens
NFAFEVTQD

SEQ ID NO: 819795 - protein, 9 aa, Homo Sapiens
KKSDPLAWG

SEQ ID NO: 819796 - protein, 9 aa, Homo Sapiens
MDALLEFNV

SEQ ID NO: 819797 - protein, 9 aa, Homo Sapiens
PLPAAAHNL

SEQ ID NO: 819798 - protein, 9 aa, Homo Sapiens
LTLLTNTGA

SEQ ID NO: 819799 - protein, 9 aa, Homo Sapiens
RLEREKQAR

SEQ ID NO: 819800 - protein, 9 aa, Homo Sapiens
KRFWYIKGI

SEQ ID NO: 819801 - protein, 9 aa, Homo Sapiens
WNERIAPKV

SEQ ID NO: 819802 - protein, 9 aa, Homo Sapiens
DMPEEMCVE

SEQ ID NO: 819803 - protein, 9 aa, Homo Sapiens
LPYTFPHPH

SEQ ID NO: 819804 - protein, 9 aa, Homo Sapiens
FYGIPREQQ

SEQ ID NO: 819805 - protein, 9 aa, Homo Sapiens
DELLKMQLQ

SEQ ID NO: 819806 - protein, 9 aa, Homo Sapiens
RCVLNLIKI

SEQ ID NO: 819807 - protein, 9 aa, Homo Sapiens
HCQKLVHRD

SEQ ID NO: 819808 - protein, 9 aa, Homo Sapiens
TCWQRGEIW

SEQ ID NO: 819809 - protein, 9 aa, Homo Sapiens
AVCSKLKML

SEQ ID NO: 819810 - protein, 9 aa, Homo Sapiens
YSISIVLSE

SEQ ID NO: 819811 - protein, 9 aa, Homo Sapiens
RKHQHDFQK

SEQ ID NO: 819812 - protein, 9 aa, Homo Sapiens
ENALYFDQK

SEQ ID NO: 819813 - protein, 9 aa, Homo Sapiens
SLSYSQISL

SEQ ID NO: 819814 - protein, 9 aa, Homo Sapiens
QDTGYHSLE

SEQ ID NO: 819815 - protein, 9 aa, Homo Sapiens
PARSVDVSS

SEQ ID NO: 819816 - protein, 9 aa, Homo Sapiens
LKILRVTNE

SEQ ID NO: 819817 - protein, 9 aa, Homo Sapiens
DSEFGWINV

SEQ ID NO: 819818 - protein, 9 aa, Homo Sapiens
DTAATRAVL

SEQ ID NO: 819819 - protein, 9 aa, Homo Sapiens
AQESKALVT

SEQ ID NO: 819820 - protein, 9 aa, Homo Sapiens
PIIYGLFNE

SEQ ID NO: 819821 - protein, 9 aa, Homo Sapiens
ACDPALPSY

SEQ ID NO: 819822 - protein, 9 aa, Homo Sapiens
WQHQNNSKS

SEQ ID NO: 819823 - protein, 9 aa, Homo Sapiens
ELDSEQVWY

SEQ ID NO: 819824 - protein, 9 aa, Homo Sapiens
PVLENILFG

SEQ ID NO: 819825 - protein, 9 aa, Homo Sapiens
KLGNACDND

SEQ ID NO: 819826 - protein, 9 aa, Homo Sapiens
GRDKKLALM

SEQ ID NO: 819827 - protein, 9 aa, Homo Sapiens
TCGHTSVIR

SEQ ID NO: 819828 - protein, 9 aa, Homo Sapiens
PNDTVYLAS

SEQ ID NO: 819829 - protein, 9 aa, Homo Sapiens
IKIGVPQEQ

SEQ ID NO: 819830 - protein, 9 aa, Homo Sapiens
TTWVPYPGC

SEQ ID NO: 819831 - protein, 9 aa, Homo Sapiens
RVNKKTIPS

SEQ ID NO: 819832 - protein, 9 aa, Homo Sapiens
GGAHREKKE

SEQ ID NO: 819833 - protein, 9 aa, Homo Sapiens
ASCGSALHG

SEQ ID NO: 819834 - protein, 9 aa, Homo Sapiens
VENGRVITC

SEQ ID NO: 819835 - protein, 9 aa, Homo Sapiens
PSTQKPLVL

SEQ ID NO: 819836 - protein, 9 aa, Homo Sapiens
NEWKRTCSI

SEQ ID NO: 819837 - protein, 9 aa, Homo Sapiens
FSDRVPSDG

SEQ ID NO: 819838 - protein, 9 aa, Homo Sapiens
PPTQPQIYP

SEQ ID NO: 819839 - protein, 9 aa, Homo Sapiens
EDWHYMQKE

SEQ ID NO: 819840 - protein, 9 aa, Homo Sapiens
PRLAGGAGC

SEQ ID NO: 819841 - protein, 9 aa, Homo Sapiens
LEHGEHGCR

SEQ ID NO: 819842 - protein, 9 aa, Homo Sapiens
SGKYDDEEF

SEQ ID NO: 819843 - protein, 9 aa, Homo Sapiens
AEATVVLAE

SEQ ID NO: 819844 - protein, 9 aa, Homo Sapiens
TKKTITTTG

SEQ ID NO: 819845 - protein, 9 aa, Homo Sapiens
GEEATSSHR

SEQ ID NO: 819846 - protein, 9 aa, Homo Sapiens
HDALCLAYQ

SEQ ID NO: 819847 - protein, 9 aa, Homo Sapiens
YLDGVSNEM

SEQ ID NO: 819848 - protein, 9 aa, Homo Sapiens
FSILDYQVP

SEQ ID NO: 819849 - protein, 9 aa, Homo Sapiens
KIEDSKEAE

SEQ ID NO: 819850 - protein, 9 aa, Homo Sapiens
SNYVHRELL

SEQ ID NO: 819851 - protein, 9 aa, Homo Sapiens
DAGLFRSWA

SEQ ID NO: 819852 - protein, 9 aa, Homo Sapiens
IGMLNNPIN

SEQ ID NO: 819853 - protein, 9 aa, Homo Sapiens
IFHISRLFY

SEQ ID NO: 819854 - protein, 9 aa, Homo Sapiens
HEPIQIVIT

SEQ ID NO: 819855 - protein, 9 aa, Homo Sapiens
DEDETINGN

SEQ ID NO: 819856 - protein, 9 aa, Homo Sapiens
IKHTVLMQE

SEQ ID NO: 819857 - protein, 9 aa, Homo Sapiens
RNTYSDRSG

SEQ ID NO: 819858 - protein, 9 aa, Homo Sapiens
GMQAFSQGF

SEQ ID NO: 819859 - protein, 9 aa, Homo Sapiens
ASQDDPLRA

SEQ ID NO: 819860 - protein, 9 aa, Homo Sapiens
GVKAGRGTV

SEQ ID NO: 819861 - protein, 9 aa, Homo Sapiens
LTIIKYLDY

SEQ ID NO: 819862 - protein, 9 aa, Homo Sapiens
GPFDHMFQI

SEQ ID NO: 819863 - protein, 9 aa, Homo Sapiens
VGEAHNLIP

SEQ ID NO: 819864 - protein, 9 aa, Homo Sapiens
IIHQQTHTG

SEQ ID NO: 819865 - protein, 9 aa, Homo Sapiens
YAKVKRVGD

SEQ ID NO: 819866 - protein, 9 aa, Homo Sapiens
CLTREVQGV

SEQ ID NO: 819867 - protein, 9 aa, Homo Sapiens
THLKLIALT

SEQ ID NO: 819868 - protein, 9 aa, Homo Sapiens
FDEEPQALL

SEQ ID NO: 819869 - protein, 9 aa, Homo Sapiens
KEANLFGSN

SEQ ID NO: 819870 - protein, 9 aa, Homo Sapiens
ANIDVVDAR

SEQ ID NO: 819871 - protein, 9 aa, Homo Sapiens
NIIRDQMQT

SEQ ID NO: 819872 - protein, 9 aa, Homo Sapiens
HKHEFKRFI

SEQ ID NO: 819873 - protein, 9 aa, Homo Sapiens
VALYNPVNF

SEQ ID NO: 819874 - protein, 9 aa, Homo Sapiens
PEVRQSYFA

SEQ ID NO: 819875 - protein, 9 aa, Homo Sapiens
VQHGLQVWL

SEQ ID NO: 819876 - protein, 9 aa, Homo Sapiens
KCHIRKYSH

SEQ ID NO: 819877 - protein, 9 aa, Homo Sapiens
YLDFINLLS

SEQ ID NO: 819878 - protein, 9 aa, Homo Sapiens
YSEESMGSN

SEQ ID NO: 819879 - protein, 9 aa, Homo Sapiens
TKEEDEQQR

SEQ ID NO: 819880 - protein, 9 aa, Homo Sapiens
MLVDFLSVK

SEQ ID NO: 819881 - protein, 9 aa, Homo Sapiens
EVHAKSLQQ

SEQ ID NO: 819882 - protein, 9 aa, Homo Sapiens
TTNEHTYSN

SEQ ID NO: 819883 - protein, 9 aa, Homo Sapiens
DLIKYLRKL

SEQ ID NO: 819884 - protein, 9 aa, Homo Sapiens
ALKTIYVIP

SEQ ID NO: 819885 - protein, 9 aa, Homo Sapiens
IVRWCDIQD

SEQ ID NO: 819886 - protein, 9 aa, Homo Sapiens
QNWRTMSSS

SEQ ID NO: 819887 - protein, 9 aa, Homo Sapiens
YGLEVRIVV

SEQ ID NO: 819888 - protein, 9 aa, Homo Sapiens
LQNDSVLDM

SEQ ID NO: 819889 - protein, 9 aa, Homo Sapiens
VGTAAIAHI

SEQ ID NO: 819890 - protein, 9 aa, Homo Sapiens
EMAPLKGAQ

SEQ ID NO: 819891 - protein, 9 aa, Homo Sapiens
MQGPRTRAH

SEQ ID NO: 819892 - protein, 9 aa, Homo Sapiens
PLSRLLKEA

SEQ ID NO: 819893 - protein, 9 aa, Homo Sapiens
PAIEMQKYV

SEQ ID NO: 819894 - protein, 9 aa, Homo Sapiens
NGNHIKKEK

SEQ ID NO: 819895 - protein, 9 aa, Homo Sapiens
QTKVLSQCV

SEQ ID NO: 819896 - protein, 9 aa, Homo Sapiens
NPGKIITIS

SEQ ID NO: 819897 - protein, 9 aa, Homo Sapiens
ALPLLSVSV

SEQ ID NO: 819898 - protein, 9 aa, Homo Sapiens
SLDYWWCTY

SEQ ID NO: 819899 - protein, 9 aa, Homo Sapiens
LGFKQAAFD

SEQ ID NO: 819900 - protein, 9 aa, Homo Sapiens
LLSQFQSNR

SEQ ID NO: 819901 - protein, 9 aa, Homo Sapiens
LGRQQRKSE

SEQ ID NO: 819902 - protein, 9 aa, Homo Sapiens
FYGNVGYRL

SEQ ID NO: 819903 - protein, 9 aa, Homo Sapiens
GKRFMFQFP

SEQ ID NO: 819904 - protein, 9 aa, Homo Sapiens
LLLSKATLV

SEQ ID NO: 819905 - protein, 9 aa, Homo Sapiens
RPQPRAHFQ

SEQ ID NO: 819906 - protein, 9 aa, Homo Sapiens
WGTVRLYNR

SEQ ID NO: 819907 - protein, 9 aa, Homo Sapiens
RTAKKQSVI

SEQ ID NO: 819908 - protein, 9 aa, Homo Sapiens
HTQSITSQN

SEQ ID NO: 819909 - protein, 9 aa, Homo Sapiens
YTRDNSYKC

SEQ ID NO: 819910 - protein, 9 aa, Homo Sapiens
NEYQAHAGH

SEQ ID NO: 819911 - protein, 9 aa, Homo Sapiens
HLYTDGPLM

SEQ ID NO: 819912 - protein, 9 aa, Homo Sapiens
DILILPGKL

SEQ ID NO: 819913 - protein, 9 aa, Homo Sapiens
QEWHCKQMD

SEQ ID NO: 819914 - protein, 9 aa, Homo Sapiens
GDTLRTLSL

SEQ ID NO: 819915 - protein, 9 aa, Homo Sapiens
NKQSLHESL

SEQ ID NO: 819916 - protein, 9 aa, Homo Sapiens
DVVPINNQV

SEQ ID NO: 819917 - protein, 9 aa, Homo Sapiens
YAMYVRQTA

SEQ ID NO: 819918 - protein, 9 aa, Homo Sapiens
TTVPEVING

SEQ ID NO: 819919 - protein, 9 aa, Homo Sapiens
AVCERKDLS

SEQ ID NO: 819920 - protein, 9 aa, Homo Sapiens
QESPTQYSL

SEQ ID NO: 819921 - protein, 9 aa, Homo Sapiens
HVQSENSCL

SEQ ID NO: 819922 - protein, 9 aa, Homo Sapiens
HVRISTSTF

SEQ ID NO: 819923 - protein, 9 aa, Homo Sapiens
QLEKDMQAV

SEQ ID NO: 819924 - protein, 9 aa, Homo Sapiens
VCKRMKICM

SEQ ID NO: 819925 - protein, 9 aa, Homo Sapiens
KQVIEICSC

SEQ ID NO: 819926 - protein, 9 aa, Homo Sapiens
YPNINVITG

SEQ ID NO: 819927 - protein, 9 aa, Homo Sapiens
TKVGVQGGA

SEQ ID NO: 819928 - protein, 9 aa, Homo Sapiens
TSKPIFCLF

SEQ ID NO: 819929 - protein, 9 aa, Homo Sapiens
TSSKCFLPI

SEQ ID NO: 819930 - protein, 9 aa, Homo Sapiens
YVEPPKYEF

SEQ ID NO: 819931 - protein, 9 aa, Homo Sapiens
VMPCWVPQV

SEQ ID NO: 819932 - protein, 9 aa, Homo Sapiens
DGQDSPASL

SEQ ID NO: 819933 - protein, 9 aa, Homo Sapiens
SILSTMLTL

SEQ ID NO: 819934 - protein, 9 aa, Homo Sapiens
KCYIHEVQE

SEQ ID NO: 819935 - protein, 9 aa, Homo Sapiens
TAPNSLLNA

SEQ ID NO: 819936 - protein, 9 aa, Homo Sapiens
STFEEVIFI

SEQ ID NO: 819937 - protein, 9 aa, Homo Sapiens
PKTNTKTSS

SEQ ID NO: 819938 - protein, 9 aa, Homo Sapiens
CPSTFQNKK

SEQ ID NO: 819939 - protein, 9 aa, Homo Sapiens
DHVQIWEVL

SEQ ID NO: 819940 - protein, 9 aa, Homo Sapiens
RQELERQQR

SEQ ID NO: 819941 - protein, 9 aa, Homo Sapiens
GRELFDSNG

SEQ ID NO: 819942 - protein, 9 aa, Homo Sapiens
VKMAKDRIN

SEQ ID NO: 819943 - protein, 9 aa, Homo Sapiens
NAVQSDSAV

SEQ ID NO: 819944 - protein, 9 aa, Homo Sapiens
LIAIWKHNK

SEQ ID NO: 819945 - protein, 9 aa, Homo Sapiens
GLETTFPKT

SEQ ID NO: 819946 - protein, 9 aa, Homo Sapiens
SPLANQSIL

SEQ ID NO: 819947 - protein, 9 aa, Homo Sapiens
HGFWMDIGQ

SEQ ID NO: 819948 - protein, 9 aa, Homo Sapiens
EVLKRYAGT

SEQ ID NO: 819949 - protein, 9 aa, Homo Sapiens
LGKCILDPR

SEQ ID NO: 819950 - protein, 9 aa, Homo Sapiens
KTVTFLGVM

SEQ ID NO: 819951 - protein, 9 aa, Homo Sapiens
PGDNSEILP

SEQ ID NO: 819952 - protein, 9 aa, Homo Sapiens
GTPGPAGRW

SEQ ID NO: 819953 - protein, 9 aa, Homo Sapiens
QHWKPSFGR

SEQ ID NO: 819954 - protein, 9 aa, Homo Sapiens
LVVTVVSTV

SEQ ID NO: 819955 - protein, 9 aa, Homo Sapiens
NILKFMAKI

SEQ ID NO: 819956 - protein, 9 aa, Homo Sapiens
EEFLKSSLN

SEQ ID NO: 819957 - protein, 9 aa, Homo Sapiens
PLSAMGRKP

SEQ ID NO: 819958 - protein, 9 aa, Homo Sapiens
GIRTEQGFY

SEQ ID NO: 819959 - protein, 9 aa, Homo Sapiens
LLPSDEWER

SEQ ID NO: 819960 - protein, 9 aa, Homo Sapiens
LQAAIVCIM

SEQ ID NO: 819961 - protein, 9 aa, Homo Sapiens
YVHRIIHTG

SEQ ID NO: 819962 - protein, 9 aa, Homo Sapiens
HTGPGNPEA

SEQ ID NO: 819963 - protein, 9 aa, Homo Sapiens
TNHARERLE

SEQ ID NO: 819964 - protein, 9 aa, Homo Sapiens
VHGSAKLYI

SEQ ID NO: 819965 - protein, 9 aa, Homo Sapiens
GLKEVSPQK

SEQ ID NO: 819966 - protein, 9 aa, Homo Sapiens
WSPCSARFV

SEQ ID NO: 819967 - protein, 9 aa, Homo Sapiens
YSNPMVICQ

SEQ ID NO: 819968 - protein, 9 aa, Homo Sapiens
RTKGMGKFS

SEQ ID NO: 819969 - protein, 9 aa, Homo Sapiens
SDGKAYDNA

SEQ ID NO: 819970 - protein, 9 aa, Homo Sapiens
VEAWLEITP

SEQ ID NO: 819971 - protein, 9 aa, Homo Sapiens
RLEDLEQDK

SEQ ID NO: 819972 - protein, 9 aa, Homo Sapiens
PWKVLSGFA

SEQ ID NO: 819973 - protein, 9 aa, Homo Sapiens
KSSVDDEIE

SEQ ID NO: 819974 - protein, 9 aa, Homo Sapiens
QQRADQLAD

SEQ ID NO: 819975 - protein, 9 aa, Homo Sapiens
KIIMLLGAE

SEQ ID NO: 819976 - protein, 9 aa, Homo Sapiens
DTIVFPTDW

SEQ ID NO: 819977 - protein, 9 aa, Homo Sapiens
ETWRLFLEC

SEQ ID NO: 819978 - protein, 9 aa, Homo Sapiens
EGGPVGTQV

SEQ ID NO: 819979 - protein, 9 aa, Homo Sapiens
SIASALGMV

SEQ ID NO: 819980 - protein, 9 aa, Homo Sapiens
NSVPMILQL

SEQ ID NO: 819981 - protein, 9 aa, Homo Sapiens
KINVRVLKI

SEQ ID NO: 819982 - protein, 9 aa, Homo Sapiens
ARFGGWTSP

SEQ ID NO: 819983 - protein, 9 aa, Homo Sapiens
SVRFVQLQH

SEQ ID NO: 819984 - protein, 9 aa, Homo Sapiens
LTTPRLTIS

SEQ ID NO: 819985 - protein, 9 aa, Homo Sapiens
KHLRAYMKK

SEQ ID NO: 819986 - protein, 9 aa, Homo Sapiens
NHEFNLLDV

SEQ ID NO: 819987 - protein, 9 aa, Homo Sapiens
EEDGDTGGI

SEQ ID NO: 819988 - protein, 9 aa, Homo Sapiens
ELLNQLDEC

SEQ ID NO: 819989 - protein, 9 aa, Homo Sapiens
HPMKQPAVY

SEQ ID NO: 819990 - protein, 9 aa, Homo Sapiens
SPGNLQRHM

SEQ ID NO: 819991 - protein, 9 aa, Homo Sapiens
RKDSGQYEN

SEQ ID NO: 819992 - protein, 9 aa, Homo Sapiens
QLWKVNPAA

SEQ ID NO: 819993 - protein, 9 aa, Homo Sapiens
EKNIKLFFS

SEQ ID NO: 819994 - protein, 9 aa, Homo Sapiens
SSCHRVRQN

SEQ ID NO: 819995 - protein, 9 aa, Homo Sapiens
AVPAAVCHH

SEQ ID NO: 819996 - protein, 9 aa, Homo Sapiens
LGDMDCNEF

SEQ ID NO: 819997 - protein, 9 aa, Homo Sapiens
TEFQLLASA

SEQ ID NO: 819998 - protein, 9 aa, Homo Sapiens
NKRDGTPGA

SEQ ID NO: 819999 - protein, 9 aa, Homo Sapiens
CAGAINHIS

SEQ ID NO: 820000 - protein, 9 aa, Homo Sapiens
FSFFPAGGD

SEQ ID NO: 820001 - protein, 9 aa, Homo Sapiens
ATTKLYQYL

SEQ ID NO: 820002 - protein, 9 aa, Homo Sapiens
IILNDYEYR

SEQ ID NO: 820003 - protein, 9 aa, Homo Sapiens
FSRKRPFPD

SEQ ID NO: 820004 - protein, 9 aa, Homo Sapiens
YNASVIYWQ

SEQ ID NO: 820005 - protein, 9 aa, Homo Sapiens
PPQIQGIIF

SEQ ID NO: 820006 - protein, 9 aa, Homo Sapiens
SHNFQTTKD

SEQ ID NO: 820007 - protein, 9 aa, Homo Sapiens
PNFTEAIDE

SEQ ID NO: 820008 - protein, 9 aa, Homo Sapiens
GSRPDGCNN

SEQ ID NO: 820009 - protein, 9 aa, Homo Sapiens
SLDCVLKVI

SEQ ID NO: 820010 - protein, 9 aa, Homo Sapiens
SHLVKHQKL

SEQ ID NO: 820011 - protein, 9 aa, Homo Sapiens
KMKEKAKKQ

SEQ ID NO: 820012 - protein, 9 aa, Homo Sapiens
NDGATKLND

SEQ ID NO: 820013 - protein, 9 aa, Homo Sapiens
VYPSLVQGR

SEQ ID NO: 820014 - protein, 9 aa, Homo Sapiens
PDGSNQTVF

SEQ ID NO: 820015 - protein, 9 aa, Homo Sapiens
LLLIVSAGM

SEQ ID NO: 820016 - protein, 9 aa, Homo Sapiens
LENVDGAAT

SEQ ID NO: 820017 - protein, 9 aa, Homo Sapiens
NDEDTTPSL

SEQ ID NO: 820018 - protein, 9 aa, Homo Sapiens
GSKRSFGDD

SEQ ID NO: 820019 - protein, 9 aa, Homo Sapiens
ITEKSDIDL

SEQ ID NO: 820020 - protein, 9 aa, Homo Sapiens
SRTVASQAY

SEQ ID NO: 820021 - protein, 9 aa, Homo Sapiens
EPVATWQII

SEQ ID NO: 820022 - protein, 9 aa, Homo Sapiens
LKSVKKDDT

SEQ ID NO: 820023 - protein, 9 aa, Homo Sapiens
HARCCNVTI

SEQ ID NO: 820024 - protein, 9 aa, Homo Sapiens
RSEEYEQAA

SEQ ID NO: 820025 - protein, 9 aa, Homo Sapiens
LLRPPASLH

SEQ ID NO: 820026 - protein, 9 aa, Homo Sapiens
PSLEYLDNT

SEQ ID NO: 820027 - protein, 9 aa, Homo Sapiens
YSVVEENGE

SEQ ID NO: 820028 - protein, 9 aa, Homo Sapiens
NSITPEALI

SEQ ID NO: 820029 - protein, 9 aa, Homo Sapiens
PVGDKAKYT

SEQ ID NO: 820030 - protein, 9 aa, Homo Sapiens
GGRHKCRLC

SEQ ID NO: 820031 - protein, 9 aa, Homo Sapiens
VEFIDAQCE

SEQ ID NO: 820032 - protein, 9 aa, Homo Sapiens
KVTADVVLA

SEQ ID NO: 820033 - protein, 9 aa, Homo Sapiens
GIQIEFINE

SEQ ID NO: 820034 - protein, 9 aa, Homo Sapiens
TTWKVISSL

SEQ ID NO: 820035 - protein, 9 aa, Homo Sapiens
TAADQDKNP

SEQ ID NO: 820036 - protein, 9 aa, Homo Sapiens
RREITFPPA

SEQ ID NO: 820037 - protein, 9 aa, Homo Sapiens
YYQAVALDE

SEQ ID NO: 820038 - protein, 9 aa, Homo Sapiens
EDHLHPYMP

SEQ ID NO: 820039 - protein, 9 aa, Homo Sapiens
VALEDSGLS

SEQ ID NO: 820040 - protein, 9 aa, Homo Sapiens
LPLPVATRV

SEQ ID NO: 820041 - protein, 9 aa, Homo Sapiens
SKKKLFQVD

SEQ ID NO: 820042 - protein, 9 aa, Homo Sapiens
DKASEKVYL

SEQ ID NO: 820043 - protein, 9 aa, Homo Sapiens
SLLREQSID

SEQ ID NO: 820044 - protein, 9 aa, Homo Sapiens
IFGSINPLK

SEQ ID NO: 820045 - protein, 9 aa, Homo Sapiens
HSGKTGRAS

SEQ ID NO: 820046 - protein, 9 aa, Homo Sapiens
NKMAECEAE

SEQ ID NO: 820047 - protein, 9 aa, Homo Sapiens
FSLPQVFSF

SEQ ID NO: 820048 - protein, 9 aa, Homo Sapiens
PRYLGDCYK

SEQ ID NO: 820049 - protein, 9 aa, Homo Sapiens
RGFAHQKLF

SEQ ID NO: 820050 - protein, 9 aa, Homo Sapiens
QVVLPALLK

SEQ ID NO: 820051 - protein, 9 aa, Homo Sapiens
QLEDYLTNI

SEQ ID NO: 820052 - protein, 9 aa, Homo Sapiens
NTPLQSTHR

SEQ ID NO: 820053 - protein, 9 aa, Homo Sapiens
TKNKRKLFP

SEQ ID NO: 820054 - protein, 9 aa, Homo Sapiens
NNTTFLNIK

SEQ ID NO: 820055 - protein, 9 aa, Homo Sapiens
SRSMTFQSR

SEQ ID NO: 820056 - protein, 9 aa, Homo Sapiens
NTHLRTHTR

SEQ ID NO: 820057 - protein, 9 aa, Homo Sapiens
RVVAISCPL

SEQ ID NO: 820058 - protein, 9 aa, Homo Sapiens
MQMKDPLPS

SEQ ID NO: 820059 - protein, 9 aa, Homo Sapiens
TQCAYIHLV

SEQ ID NO: 820060 - protein, 9 aa, Homo Sapiens
FLKQVIEIC

SEQ ID NO: 820061 - protein, 9 aa, Homo Sapiens
RFWYIKGIM

SEQ ID NO: 820062 - protein, 9 aa, Homo Sapiens
LAKQNIKKK

SEQ ID NO: 820063 - protein, 9 aa, Homo Sapiens
QVGDSLRTS

SEQ ID NO: 820064 - protein, 9 aa, Homo Sapiens
VSQAGGPKG

SEQ ID NO: 820065 - protein, 9 aa, Homo Sapiens
ICELCSCGW

SEQ ID NO: 820066 - protein, 9 aa, Homo Sapiens
TTKMNECVM

SEQ ID NO: 820067 - protein, 9 aa, Homo Sapiens
EASNKKKLE

SEQ ID NO: 820068 - protein, 9 aa, Homo Sapiens
DGPSSSVDL

SEQ ID NO: 820069 - protein, 9 aa, Homo Sapiens
ERSLDSRGE

SEQ ID NO: 820070 - protein, 9 aa, Homo Sapiens
DVKATVRNY

SEQ ID NO: 820071 - protein, 9 aa, Homo Sapiens
RGNGKKQYQ

SEQ ID NO: 820072 - protein, 9 aa, Homo Sapiens
IQSSKLGAL

SEQ ID NO: 820073 - protein, 9 aa, Homo Sapiens
LDNFYSNLI

SEQ ID NO: 820074 - protein, 9 aa, Homo Sapiens
SDDVNTFLT

SEQ ID NO: 820075 - protein, 9 aa, Homo Sapiens
QKRKNRQKN

SEQ ID NO: 820076 - protein, 9 aa, Homo Sapiens
FAICFSIAS

SEQ ID NO: 820077 - protein, 9 aa, Homo Sapiens
EFNITKSLV

SEQ ID NO: 820078 - protein, 9 aa, Homo Sapiens
YGKLWTISM

SEQ ID NO: 820079 - protein, 9 aa, Homo Sapiens
RLCAKVFGS

SEQ ID NO: 820080 - protein, 9 aa, Homo Sapiens
KHNHQSEFT

SEQ ID NO: 820081 - protein, 9 aa, Homo Sapiens
NNFDEFSKH

SEQ ID NO: 820082 - protein, 9 aa, Homo Sapiens
CSPINGSCQ

SEQ ID NO: 820083 - protein, 9 aa, Homo Sapiens
VYRALWCGE

SEQ ID NO: 820084 - protein, 9 aa, Homo Sapiens
IPFIETSTK

SEQ ID NO: 820085 - protein, 9 aa, Homo Sapiens
KLLCRYKIR

SEQ ID NO: 820086 - protein, 9 aa, Homo Sapiens
SNIAAIDSL

SEQ ID NO: 820087 - protein, 9 aa, Homo Sapiens
GTHSEKQCR

SEQ ID NO: 820088 - protein, 9 aa, Homo Sapiens
VENNYTNSP

SEQ ID NO: 820089 - protein, 9 aa, Homo Sapiens
LFVPCIFVY

SEQ ID NO: 820090 - protein, 9 aa, Homo Sapiens
SYFALLGDL

SEQ ID NO: 820091 - protein, 9 aa, Homo Sapiens
KSKLNILET

SEQ ID NO: 820092 - protein, 9 aa, Homo Sapiens
DNMLAELTA

SEQ ID NO: 820093 - protein, 9 aa, Homo Sapiens
FSHLSYLKH

SEQ ID NO: 820094 - protein, 9 aa, Homo Sapiens
FKDALRTSG

SEQ ID NO: 820095 - protein, 9 aa, Homo Sapiens
YLVLYLSMQ

SEQ ID NO: 820096 - protein, 9 aa, Homo Sapiens
EAERHVGRP

SEQ ID NO: 820097 - protein, 9 aa, Homo Sapiens
DDEEKNHSK

SEQ ID NO: 820098 - protein, 9 aa, Homo Sapiens
FTDLECKYI

SEQ ID NO: 820099 - protein, 9 aa, Homo Sapiens
GEPTTGLDC

SEQ ID NO: 820100 - protein, 9 aa, Homo Sapiens
NYTRMELFR

SEQ ID NO: 820101 - protein, 9 aa, Homo Sapiens
THPSGVGKR

SEQ ID NO: 820102 - protein, 9 aa, Homo Sapiens
KLLKKAQKD

SEQ ID NO: 820103 - protein, 9 aa, Homo Sapiens
KPYGCILCG

SEQ ID NO: 820104 - protein, 9 aa, Homo Sapiens
VSGIQTPPV

SEQ ID NO: 820105 - protein, 9 aa, Homo Sapiens
ERNDQKGNQ

SEQ ID NO: 820106 - protein, 9 aa, Homo Sapiens
LKYAYEEQK

SEQ ID NO: 820107 - protein, 9 aa, Homo Sapiens
RENYYRCEE

SEQ ID NO: 820108 - protein, 9 aa, Homo Sapiens
ILLIIKGKY

SEQ ID NO: 820109 - protein, 9 aa, Homo Sapiens
GYFFIHGQV

SEQ ID NO: 820110 - protein, 9 aa, Homo Sapiens
LDIEQLSVV

SEQ ID NO: 820111 - protein, 9 aa, Homo Sapiens
LRLNLYPKE

SEQ ID NO: 820112 - protein, 9 aa, Homo Sapiens
KFWGKIRIT

SEQ ID NO: 820113 - protein, 9 aa, Homo Sapiens
CLIAPGTKL

SEQ ID NO: 820114 - protein, 9 aa, Homo Sapiens
SITILDKGH

SEQ ID NO: 820115 - protein, 9 aa, Homo Sapiens
EFLMGAANQ

SEQ ID NO: 820116 - protein, 9 aa, Homo Sapiens
IQSRETSSI

SEQ ID NO: 820117 - protein, 9 aa, Homo Sapiens
PFAMINVCP

SEQ ID NO: 820118 - protein, 9 aa, Homo Sapiens
YLYAQTSAG

SEQ ID NO: 820119 - protein, 9 aa, Homo Sapiens
SLQTEICYQ

SEQ ID NO: 820120 - protein, 9 aa, Homo Sapiens
NKRMHILHA

SEQ ID NO: 820121 - protein, 9 aa, Homo Sapiens
LHNSSGRDG

SEQ ID NO: 820122 - protein, 9 aa, Homo Sapiens
GCGRSNKRS

SEQ ID NO: 820123 - protein, 9 aa, Homo Sapiens
KPCASIWLQ

SEQ ID NO: 820124 - protein, 9 aa, Homo Sapiens
EKKKKSDDP

SEQ ID NO: 820125 - protein, 9 aa, Homo Sapiens
CALTQVVSK

SEQ ID NO: 820126 - protein, 9 aa, Homo Sapiens
IYFRCLGLH

SEQ ID NO: 820127 - protein, 9 aa, Homo Sapiens
AGLLGRLRL

SEQ ID NO: 820128 - protein, 9 aa, Homo Sapiens
HQITHTQEK

SEQ ID NO: 820129 - protein, 9 aa, Homo Sapiens
PIEPLNNLS

SEQ ID NO: 820130 - protein, 9 aa, Homo Sapiens
FSRSLGLIS

SEQ ID NO: 820131 - protein, 9 aa, Homo Sapiens
SRYGNLHSH

SEQ ID NO: 820132 - protein, 9 aa, Homo Sapiens
PDKGLISRM

SEQ ID NO: 820133 - protein, 9 aa, Homo Sapiens
LEAAAAAWC

SEQ ID NO: 820134 - protein, 9 aa, Homo Sapiens
SILFNLAVL

SEQ ID NO: 820135 - protein, 9 aa, Homo Sapiens
LTELSTFLL

SEQ ID NO: 820136 - protein, 9 aa, Homo Sapiens
PVLTQEERY

SEQ ID NO: 820137 - protein, 9 aa, Homo Sapiens
TKLSPVAVQ

SEQ ID NO: 820138 - protein, 9 aa, Homo Sapiens
GQLAATTLR

SEQ ID NO: 820139 - protein, 9 aa, Homo Sapiens
LYWACVHNY

SEQ ID NO: 820140 - protein, 9 aa, Homo Sapiens
PSASVTASG

SEQ ID NO: 820141 - protein, 9 aa, Homo Sapiens
KTLDKMEKH

SEQ ID NO: 820142 - protein, 9 aa, Homo Sapiens
ALLASHTIQ

SEQ ID NO: 820143 - protein, 9 aa, Homo Sapiens
QQRAEELSE

SEQ ID NO: 820144 - protein, 9 aa, Homo Sapiens
LLSTFDVIK

SEQ ID NO: 820145 - protein, 9 aa, Homo Sapiens
PRAKLPNGS

SEQ ID NO: 820146 - protein, 9 aa, Homo Sapiens
LGGLTAVVW

SEQ ID NO: 820147 - protein, 9 aa, Homo Sapiens
VGIIYKPTT

SEQ ID NO: 820148 - protein, 9 aa, Homo Sapiens
YLIQHKIIH

SEQ ID NO: 820149 - protein, 9 aa, Homo Sapiens
QFIKHVEEF

SEQ ID NO: 820150 - protein, 9 aa, Homo Sapiens
CERKASDPN

SEQ ID NO: 820151 - protein, 9 aa, Homo Sapiens
RRTADLQAA

SEQ ID NO: 820152 - protein, 9 aa, Homo Sapiens
SNISANQRA

SEQ ID NO: 820153 - protein, 9 aa, Homo Sapiens
PRVEYMEKE

SEQ ID NO: 820154 - protein, 9 aa, Homo Sapiens
CKVFIPDDL

SEQ ID NO: 820155 - protein, 9 aa, Homo Sapiens
LQKFSPPLI

SEQ ID NO: 820156 - protein, 9 aa, Homo Sapiens
KHLRRYTYN

SEQ ID NO: 820157 - protein, 9 aa, Homo Sapiens
CKYVVSNKK

SEQ ID NO: 820158 - protein, 9 aa, Homo Sapiens
GVRPAPSLG

SEQ ID NO: 820159 - protein, 9 aa, Homo Sapiens
GFFLVKEIK

SEQ ID NO: 820160 - protein, 9 aa, Homo Sapiens
VEEVVQEYQ

SEQ ID NO: 820161 - protein, 9 aa, Homo Sapiens
VSAPTFALN

SEQ ID NO: 820162 - protein, 9 aa, Homo Sapiens
SFLNLNNAV

SEQ ID NO: 820163 - protein, 9 aa, Homo Sapiens
GCVGEIITQ

SEQ ID NO: 820164 - protein, 9 aa, Homo Sapiens
GEDPPMPAY

SEQ ID NO: 820165 - protein, 9 aa, Homo Sapiens
PSCIPICGE

SEQ ID NO: 820166 - protein, 9 aa, Homo Sapiens
RLIKILSMQ

SEQ ID NO: 820167 - protein, 9 aa, Homo Sapiens
KFKSTRNEC

SEQ ID NO: 820168 - protein, 9 aa, Homo Sapiens
EVKVQGQWG

SEQ ID NO: 820169 - protein, 9 aa, Homo Sapiens
DFETMSLYD

SEQ ID NO: 820170 - protein, 9 aa, Homo Sapiens
ITSCCSTPG

SEQ ID NO: 820171 - protein, 9 aa, Homo Sapiens
ARFQPHQDA

SEQ ID NO: 820172 - protein, 9 aa, Homo Sapiens
LTSEISDCY

SEQ ID NO: 820173 - protein, 9 aa, Homo Sapiens
FSCHVEKLA

SEQ ID NO: 820174 - protein, 9 aa, Homo Sapiens
AVQSDSAVI

SEQ ID NO: 820175 - protein, 9 aa, Homo Sapiens
AIIRLDLAG

SEQ ID NO: 820176 - protein, 9 aa, Homo Sapiens
AEINEITFD

SEQ ID NO: 820177 - protein, 9 aa, Homo Sapiens
DHNRNLLNK

SEQ ID NO: 820178 - protein, 9 aa, Homo Sapiens
GHITMKKLK

SEQ ID NO: 820179 - protein, 9 aa, Homo Sapiens
TLLQYHKHH

SEQ ID NO: 820180 - protein, 9 aa, Homo Sapiens
ADKLLTEKG

SEQ ID NO: 820181 - protein, 9 aa, Homo Sapiens
YTGHNNEKY

SEQ ID NO: 820182 - protein, 9 aa, Homo Sapiens
GRTLDARMP

SEQ ID NO: 820183 - protein, 9 aa, Homo Sapiens
GWRCTTNEH

SEQ ID NO: 820184 - protein, 9 aa, Homo Sapiens
QTIIFPGST

SEQ ID NO: 820185 - protein, 9 aa, Homo Sapiens
TPGARSPDP

SEQ ID NO: 820186 - protein, 9 aa, Homo Sapiens
QLSAKTWWR

SEQ ID NO: 820187 - protein, 9 aa, Homo Sapiens
EVQDYASVE

SEQ ID NO: 820188 - protein, 9 aa, Homo Sapiens
TAKDKKERP

SEQ ID NO: 820189 - protein, 9 aa, Homo Sapiens
PSTGSSTNK

SEQ ID NO: 820190 - protein, 9 aa, Homo Sapiens
VEGLPINDL

SEQ ID NO: 820191 - protein, 9 aa, Homo Sapiens
LVVGYRKTL

SEQ ID NO: 820192 - protein, 9 aa, Homo Sapiens
RCPFVETTW

SEQ ID NO: 820193 - protein, 9 aa, Homo Sapiens
FAIQYGEYL

SEQ ID NO: 820194 - protein, 9 aa, Homo Sapiens
MVECFGGKE

SEQ ID NO: 820195 - protein, 9 aa, Homo Sapiens
FTYEDTNFQ

SEQ ID NO: 820196 - protein, 9 aa, Homo Sapiens
QANDDLARL

SEQ ID NO: 820197 - protein, 9 aa, Homo Sapiens
ASDGFWKYV

SEQ ID NO: 820198 - protein, 9 aa, Homo Sapiens
SILIFKVIF

SEQ ID NO: 820199 - protein, 9 aa, Homo Sapiens
SFPNAHVKK

SEQ ID NO: 820200 - protein, 9 aa, Homo Sapiens
TDQQLIETS

SEQ ID NO: 820201 - protein, 9 aa, Homo Sapiens
IADNVFLCL

SEQ ID NO: 820202 - protein, 9 aa, Homo Sapiens
SEEEEIIIL

SEQ ID NO: 820203 - protein, 9 aa, Homo Sapiens
HGSDGHGRL

SEQ ID NO: 820204 - protein, 9 aa, Homo Sapiens
VGKAQMQSP

SEQ ID NO: 820205 - protein, 9 aa, Homo Sapiens
CPSGHNNSP

SEQ ID NO: 820206 - protein, 9 aa, Homo Sapiens
LKTVQGIGW

SEQ ID NO: 820207 - protein, 9 aa, Homo Sapiens
EGERYFLQR

SEQ ID NO: 820208 - protein, 9 aa, Homo Sapiens
KNQEFLQAH

SEQ ID NO: 820209 - protein, 9 aa, Homo Sapiens
IDSDNLKDM

SEQ ID NO: 820210 - protein, 9 aa, Homo Sapiens
DFLRKQMWG

SEQ ID NO: 820211 - protein, 9 aa, Homo Sapiens
NDNESWYLD

SEQ ID NO: 820212 - protein, 9 aa, Homo Sapiens
EFENIQKDL

SEQ ID NO: 820213 - protein, 9 aa, Homo Sapiens
VLLWANQFR

SEQ ID NO: 820214 - protein, 9 aa, Homo Sapiens
ENVQNNTRV

SEQ ID NO: 820215 - protein, 9 aa, Homo Sapiens
LVGVMPHEL

SEQ ID NO: 820216 - protein, 9 aa, Homo Sapiens
PKSVILFGE

SEQ ID NO: 820217 - protein, 9 aa, Homo Sapiens
VLAYIKHLD

SEQ ID NO: 820218 - protein, 9 aa, Homo Sapiens
ICFTDTAVV

SEQ ID NO: 820219 - protein, 9 aa, Homo Sapiens
MECTDRNYT

SEQ ID NO: 820220 - protein, 9 aa, Homo Sapiens
EDMEVLKRY

SEQ ID NO: 820221 - protein, 9 aa, Homo Sapiens
KKLLLSSEK

SEQ ID NO: 820222 - protein, 9 aa, Homo Sapiens
LSCAFGGSS

SEQ ID NO: 820223 - protein, 9 aa, Homo Sapiens
ALYREGMRM

SEQ ID NO: 820224 - protein, 9 aa, Homo Sapiens
CPQSCPPQH

SEQ ID NO: 820225 - protein, 9 aa, Homo Sapiens
LNGPLVHVK

SEQ ID NO: 820226 - protein, 9 aa, Homo Sapiens
AQNDEYENL

SEQ ID NO: 820227 - protein, 9 aa, Homo Sapiens
LTPQITRNK

SEQ ID NO: 820228 - protein, 9 aa, Homo Sapiens
FKGLSCAHT

SEQ ID NO: 820229 - protein, 9 aa, Homo Sapiens
YIILKYAPF

SEQ ID NO: 820230 - protein, 9 aa, Homo Sapiens
IYEHISLAY

SEQ ID NO: 820231 - protein, 9 aa, Homo Sapiens
DTCFTLHLC

SEQ ID NO: 820232 - protein, 9 aa, Homo Sapiens
LRLQTLQSN

SEQ ID NO: 820233 - protein, 9 aa, Homo Sapiens
QEFLKGCAC

SEQ ID NO: 820234 - protein, 9 aa, Homo Sapiens
NKKQTQVLI

SEQ ID NO: 820235 - protein, 9 aa, Homo Sapiens
RMQTEITAL

SEQ ID NO: 820236 - protein, 9 aa, Homo Sapiens
ACGKGFTQI

SEQ ID NO: 820237 - protein, 9 aa, Homo Sapiens
DVEKIITKK

SEQ ID NO: 820238 - protein, 9 aa, Homo Sapiens
HLRYCNSIL

SEQ ID NO: 820239 - protein, 9 aa, Homo Sapiens
AGGNTTAGG

SEQ ID NO: 820240 - protein, 9 aa, Homo Sapiens
DKMYVESKT

SEQ ID NO: 820241 - protein, 9 aa, Homo Sapiens
RKDLDELME

SEQ ID NO: 820242 - protein, 9 aa, Homo Sapiens
PSELSLLHN

SEQ ID NO: 820243 - protein, 9 aa, Homo Sapiens
TKLNDLKIT

SEQ ID NO: 820244 - protein, 9 aa, Homo Sapiens
PGPRGSRGD

SEQ ID NO: 820245 - protein, 9 aa, Homo Sapiens
LENKRFTEE

SEQ ID NO: 820246 - protein, 9 aa, Homo Sapiens
VGGYTCEDN

SEQ ID NO: 820247 - protein, 9 aa, Homo Sapiens
AVKLGAFQA

SEQ ID NO: 820248 - protein, 9 aa, Homo Sapiens
KTDTGCPAI

SEQ ID NO: 820249 - protein, 9 aa, Homo Sapiens
QNQLRRNLT

SEQ ID NO: 820250 - protein, 9 aa, Homo Sapiens
ASLFERYGS

SEQ ID NO: 820251 - protein, 9 aa, Homo Sapiens
GAYARDNQH

SEQ ID NO: 820252 - protein, 9 aa, Homo Sapiens
EYVPSILIL

SEQ ID NO: 820253 - protein, 9 aa, Homo Sapiens
MESGGTVVS

SEQ ID NO: 820254 - protein, 9 aa, Homo Sapiens
EVEYLSKAT

SEQ ID NO: 820255 - protein, 9 aa, Homo Sapiens
NTVLDEANN

SEQ ID NO: 820256 - protein, 9 aa, Homo Sapiens
FEIHWKIHT

SEQ ID NO: 820257 - protein, 9 aa, Homo Sapiens
FSLDCVLKV

SEQ ID NO: 820258 - protein, 9 aa, Homo Sapiens
LCVLRSILE

SEQ ID NO: 820259 - protein, 9 aa, Homo Sapiens
NCIDVDKCL

SEQ ID NO: 820260 - protein, 9 aa, Homo Sapiens
NYNKFYEAF

SEQ ID NO: 820261 - protein, 9 aa, Homo Sapiens
RLQSLHIDQ

SEQ ID NO: 820262 - protein, 9 aa, Homo Sapiens
QLLVAMPLL

SEQ ID NO: 820263 - protein, 9 aa, Homo Sapiens
RKERLGMCF

SEQ ID NO: 820264 - protein, 9 aa, Homo Sapiens
DKSYDDPTN

SEQ ID NO: 820265 - protein, 9 aa, Homo Sapiens
QFVACEELP

SEQ ID NO: 820266 - protein, 9 aa, Homo Sapiens
KQLVWRGVN

SEQ ID NO: 820267 - protein, 9 aa, Homo Sapiens
YARDMIMKI

SEQ ID NO: 820268 - protein, 9 aa, Homo Sapiens
TPQSDQQDS

SEQ ID NO: 820269 - protein, 9 aa, Homo Sapiens
LRENGEVTC

SEQ ID NO: 820270 - protein, 9 aa, Homo Sapiens
VHGKERSIF

SEQ ID NO: 820271 - protein, 9 aa, Homo Sapiens
YQENIEAQV

SEQ ID NO: 820272 - protein, 9 aa, Homo Sapiens
PPFKDEVAK

SEQ ID NO: 820273 - protein, 9 aa, Homo Sapiens
LILPHISTA

SEQ ID NO: 820274 - protein, 9 aa, Homo Sapiens
MLTSVCCRS

SEQ ID NO: 820275 - protein, 9 aa, Homo Sapiens
HEKHRKKRS

SEQ ID NO: 820276 - protein, 9 aa, Homo Sapiens
EPDPSLDMK

SEQ ID NO: 820277 - protein, 9 aa, Homo Sapiens
IVQPLHFLT

SEQ ID NO: 820278 - protein, 9 aa, Homo Sapiens
QIQIGQETV

SEQ ID NO: 820279 - protein, 9 aa, Homo Sapiens
AFHTFSNSN

SEQ ID NO: 820280 - protein, 9 aa, Homo Sapiens
AYSGRETLY

SEQ ID NO: 820281 - protein, 9 aa, Homo Sapiens
QLEDKLCEW

SEQ ID NO: 820282 - protein, 9 aa, Homo Sapiens
CEKSFHQLS

SEQ ID NO: 820283 - protein, 9 aa, Homo Sapiens
AAEMLTLHT

SEQ ID NO: 820284 - protein, 9 aa, Homo Sapiens
TGLDRITLI

SEQ ID NO: 820285 - protein, 9 aa, Homo Sapiens
ELSTFLLLG

SEQ ID NO: 820286 - protein, 9 aa, Homo Sapiens
PLNSDLVKG

SEQ ID NO: 820287 - protein, 9 aa, Homo Sapiens
FDKFSSYDT

SEQ ID NO: 820288 - protein, 9 aa, Homo Sapiens
KPVIELYKN

SEQ ID NO: 820289 - protein, 9 aa, Homo Sapiens
AQDDRVLLG

SEQ ID NO: 820290 - protein, 9 aa, Homo Sapiens
PPPPDLIPK

SEQ ID NO: 820291 - protein, 9 aa, Homo Sapiens
TPTASGTMF

SEQ ID NO: 820292 - protein, 9 aa, Homo Sapiens
SQGDAGVTG

SEQ ID NO: 820293 - protein, 9 aa, Homo Sapiens
YRALWCGEE

SEQ ID NO: 820294 - protein, 9 aa, Homo Sapiens
KERLANTEQ

SEQ ID NO: 820295 - protein, 9 aa, Homo Sapiens
MTSRKMIPE

SEQ ID NO: 820296 - protein, 9 aa, Homo Sapiens
AILAWISQV

SEQ ID NO: 820297 - protein, 9 aa, Homo Sapiens
LLPDNLSNI

SEQ ID NO: 820298 - protein, 9 aa, Homo Sapiens
LHLPKMAEK

SEQ ID NO: 820299 - protein, 9 aa, Homo Sapiens
FGGNPGYVT

SEQ ID NO: 820300 - protein, 9 aa, Homo Sapiens
EANARKRNR

SEQ ID NO: 820301 - protein, 9 aa, Homo Sapiens
VVSEFLLLG

SEQ ID NO: 820302 - protein, 9 aa, Homo Sapiens
VGGDGGPSL

SEQ ID NO: 820303 - protein, 9 aa, Homo Sapiens
LSLRVNALL

SEQ ID NO: 820304 - protein, 9 aa, Homo Sapiens
DYYKSQTRC

SEQ ID NO: 820305 - protein, 9 aa, Homo Sapiens
MVYNKFKNM

SEQ ID NO: 820306 - protein, 9 aa, Homo Sapiens
LSVDDDNDN

SEQ ID NO: 820307 - protein, 9 aa, Homo Sapiens
EKTLFERQM

SEQ ID NO: 820308 - protein, 9 aa, Homo Sapiens
SLPDAATRR

SEQ ID NO: 820309 - protein, 9 aa, Homo Sapiens
CNEFDQYLN

SEQ ID NO: 820310 - protein, 9 aa, Homo Sapiens
TRLAAEGYL

SEQ ID NO: 820311 - protein, 9 aa, Homo Sapiens
PGSRVEGAD

SEQ ID NO: 820312 - protein, 9 aa, Homo Sapiens
VENDMFVEH

SEQ ID NO: 820313 - protein, 9 aa, Homo Sapiens
FLFNYILVY

SEQ ID NO: 820314 - protein, 9 aa, Homo Sapiens
KSGRSRNEE

SEQ ID NO: 820315 - protein, 9 aa, Homo Sapiens
NVQSHMIRH

SEQ ID NO: 820316 - protein, 9 aa, Homo Sapiens
PETFLPTNK

SEQ ID NO: 820317 - protein, 9 aa, Homo Sapiens
NDLIGQGYC

SEQ ID NO: 820318 - protein, 9 aa, Homo Sapiens
LILHQKTHT

SEQ ID NO: 820319 - protein, 9 aa, Homo Sapiens
LFLGVAETA

SEQ ID NO: 820320 - protein, 9 aa, Homo Sapiens
QINRAYQCA

SEQ ID NO: 820321 - protein, 9 aa, Homo Sapiens
DVTKNALLR

SEQ ID NO: 820322 - protein, 9 aa, Homo Sapiens
GHLVTTLTL

SEQ ID NO: 820323 - protein, 9 aa, Homo Sapiens
QMLQGAISK

SEQ ID NO: 820324 - protein, 9 aa, Homo Sapiens
LTALHLAAG

SEQ ID NO: 820325 - protein, 9 aa, Homo Sapiens
SSKFPVADY

SEQ ID NO: 820326 - protein, 9 aa, Homo Sapiens
PEIMEFSGG

SEQ ID NO: 820327 - protein, 9 aa, Homo Sapiens
KMPQEINCK

SEQ ID NO: 820328 - protein, 9 aa, Homo Sapiens
QEIEAILAN

SEQ ID NO: 820329 - protein, 9 aa, Homo Sapiens
GILVFLSTG

SEQ ID NO: 820330 - protein, 9 aa, Homo Sapiens
TVAKSLEAP

SEQ ID NO: 820331 - protein, 9 aa, Homo Sapiens
GSRRRRQQR

SEQ ID NO: 820332 - protein, 9 aa, Homo Sapiens
TAYNHFFKE

SEQ ID NO: 820333 - protein, 9 aa, Homo Sapiens
FDFVTKTPL

SEQ ID NO: 820334 - protein, 9 aa, Homo Sapiens
LYSVPHNHN

SEQ ID NO: 820335 - protein, 9 aa, Homo Sapiens
PKAGQTVKH

SEQ ID NO: 820336 - protein, 9 aa, Homo Sapiens
STECVLPTV

SEQ ID NO: 820337 - protein, 9 aa, Homo Sapiens
ANQSLRYYR

SEQ ID NO: 820338 - protein, 9 aa, Homo Sapiens
WNKTVRKER

SEQ ID NO: 820339 - protein, 9 aa, Homo Sapiens
TGSLNAYLH

SEQ ID NO: 820340 - protein, 9 aa, Homo Sapiens
LGVRALNVL

SEQ ID NO: 820341 - protein, 9 aa, Homo Sapiens
LLLFHLLEF

SEQ ID NO: 820342 - protein, 9 aa, Homo Sapiens
LKQAEVFQD

SEQ ID NO: 820343 - protein, 9 aa, Homo Sapiens
TFNLFEPLA

SEQ ID NO: 820344 - protein, 9 aa, Homo Sapiens
EFQLITSGT

SEQ ID NO: 820345 - protein, 9 aa, Homo Sapiens
QELVKRDER

SEQ ID NO: 820346 - protein, 9 aa, Homo Sapiens
VGLLSGLQA

SEQ ID NO: 820347 - protein, 9 aa, Homo Sapiens
MVTDEEGET

SEQ ID NO: 820348 - protein, 9 aa, Homo Sapiens
SPAISPLTF

SEQ ID NO: 820349 - protein, 9 aa, Homo Sapiens
KPLPNDGYD

SEQ ID NO: 820350 - protein, 9 aa, Homo Sapiens
LNSALMGHQ

SEQ ID NO: 820351 - protein, 9 aa, Homo Sapiens
IDEQLLCQL

SEQ ID NO: 820352 - protein, 9 aa, Homo Sapiens
IDQFQTQKV

SEQ ID NO: 820353 - protein, 9 aa, Homo Sapiens
RSQTQEAKD

SEQ ID NO: 820354 - protein, 9 aa, Homo Sapiens
RRRDSLSHL

SEQ ID NO: 820355 - protein, 9 aa, Homo Sapiens
PEIMDGPNQ

SEQ ID NO: 820356 - protein, 9 aa, Homo Sapiens
TSILRDALS

SEQ ID NO: 820357 - protein, 9 aa, Homo Sapiens
WMKLDTNER

SEQ ID NO: 820358 - protein, 9 aa, Homo Sapiens
AGCSGPVDE

SEQ ID NO: 820359 - protein, 9 aa, Homo Sapiens
IMRVYFNVP

SEQ ID NO: 820360 - protein, 9 aa, Homo Sapiens
TEILRLFGS

SEQ ID NO: 820361 - protein, 9 aa, Homo Sapiens
RGDKSAPIR

SEQ ID NO: 820362 - protein, 9 aa, Homo Sapiens
LEERWSQQG

SEQ ID NO: 820363 - protein, 9 aa, Homo Sapiens
KNVAEIPFN

SEQ ID NO: 820364 - protein, 9 aa, Homo Sapiens
RYVLLFAKF

SEQ ID NO: 820365 - protein, 9 aa, Homo Sapiens
YMLNLKKLT

SEQ ID NO: 820366 - protein, 9 aa, Homo Sapiens
LQDTENETM

SEQ ID NO: 820367 - protein, 9 aa, Homo Sapiens
RINSSSSSS

SEQ ID NO: 820368 - protein, 9 aa, Homo Sapiens
LAVYSKNRV

SEQ ID NO: 820369 - protein, 9 aa, Homo Sapiens
FNSGNQLLG

SEQ ID NO: 820370 - protein, 9 aa, Homo Sapiens
LIHLDDMHS

SEQ ID NO: 820371 - protein, 9 aa, Homo Sapiens
WLEDGFPNQ

SEQ ID NO: 820372 - protein, 9 aa, Homo Sapiens
LSSRDRHIL

SEQ ID NO: 820373 - protein, 9 aa, Homo Sapiens
EQINARDAK

SEQ ID NO: 820374 - protein, 9 aa, Homo Sapiens
IKKELIRQQ

SEQ ID NO: 820375 - protein, 9 aa, Homo Sapiens
SIGTHLSQE

SEQ ID NO: 820376 - protein, 9 aa, Homo Sapiens
IFPGSTGHI

SEQ ID NO: 820377 - protein, 9 aa, Homo Sapiens
KYAPFYFPT

SEQ ID NO: 820378 - protein, 9 aa, Homo Sapiens
TTVHAVWDS

SEQ ID NO: 820379 - protein, 9 aa, Homo Sapiens
TLSDYATCL

SEQ ID NO: 820380 - protein, 9 aa, Homo Sapiens
SAQCLPPTS

SEQ ID NO: 820381 - protein, 9 aa, Homo Sapiens
SRDVWMSSN

SEQ ID NO: 820382 - protein, 9 aa, Homo Sapiens
FRLSATSGE

SEQ ID NO: 820383 - protein, 9 aa, Homo Sapiens
YFFGAAIHI

SEQ ID NO: 820384 - protein, 9 aa, Homo Sapiens
GRSFTLALT

SEQ ID NO: 820385 - protein, 9 aa, Homo Sapiens
CSFIVLYIL

SEQ ID NO: 820386 - protein, 9 aa, Homo Sapiens
NHRPKLTDI

SEQ ID NO: 820387 - protein, 9 aa, Homo Sapiens
QKQQKQLQD

SEQ ID NO: 820388 - protein, 9 aa, Homo Sapiens
MLIKIHIGS

SEQ ID NO: 820389 - protein, 9 aa, Homo Sapiens
PTTIIKKNG

SEQ ID NO: 820390 - protein, 9 aa, Homo Sapiens
TELGNEKLK

SEQ ID NO: 820391 - protein, 9 aa, Homo Sapiens
IIIYEQHWK

SEQ ID NO: 820392 - protein, 9 aa, Homo Sapiens
CVECGKGFQ

SEQ ID NO: 820393 - protein, 9 aa, Homo Sapiens
RNSKIDISE

SEQ ID NO: 820394 - protein, 9 aa, Homo Sapiens
GAHDTLNAT

SEQ ID NO: 820395 - protein, 9 aa, Homo Sapiens
VKGMEDEGQ

SEQ ID NO: 820396 - protein, 9 aa, Homo Sapiens
VVFQTPPIV

SEQ ID NO: 820397 - protein, 9 aa, Homo Sapiens
YDWYNVPDQ

SEQ ID NO: 820398 - protein, 9 aa, Homo Sapiens
MAEIAVNAI

SEQ ID NO: 820399 - protein, 9 aa, Homo Sapiens
SDRIILQPD

SEQ ID NO: 820400 - protein, 9 aa, Homo Sapiens
NRYSTFIVN

SEQ ID NO: 820401 - protein, 9 aa, Homo Sapiens
PEGTSKPLP

SEQ ID NO: 820402 - protein, 9 aa, Homo Sapiens
STDDQIIVS

SEQ ID NO: 820403 - protein, 9 aa, Homo Sapiens
NVLFGALAI

SEQ ID NO: 820404 - protein, 9 aa, Homo Sapiens
GYLMNGMKS

SEQ ID NO: 820405 - protein, 9 aa, Homo Sapiens
LIELYAPWC

SEQ ID NO: 820406 - protein, 9 aa, Homo Sapiens
ITVNLVGKD

SEQ ID NO: 820407 - protein, 9 aa, Homo Sapiens
EKTLGETLS

SEQ ID NO: 820408 - protein, 9 aa, Homo Sapiens
GLPSIANMI

SEQ ID NO: 820409 - protein, 9 aa, Homo Sapiens
ATKTLQKKD

SEQ ID NO: 820410 - protein, 9 aa, Homo Sapiens
RVRNTVQGP

SEQ ID NO: 820411 - protein, 9 aa, Homo Sapiens
LRYIIPIGS

SEQ ID NO: 820412 - protein, 9 aa, Homo Sapiens
GFGNVSFVV

SEQ ID NO: 820413 - protein, 9 aa, Homo Sapiens
YYWLLTHRT

SEQ ID NO: 820414 - protein, 9 aa, Homo Sapiens
VQFYSMTRP

SEQ ID NO: 820415 - protein, 9 aa, Homo Sapiens
RTLEYRDSH

SEQ ID NO: 820416 - protein, 9 aa, Homo Sapiens
YIQGVDAND

SEQ ID NO: 820417 - protein, 9 aa, Homo Sapiens
KNWPAGGEP

SEQ ID NO: 820418 - protein, 9 aa, Homo Sapiens
LTISKVILS

SEQ ID NO: 820419 - protein, 9 aa, Homo Sapiens
ISFTNVQSH

SEQ ID NO: 820420 - protein, 9 aa, Homo Sapiens
YYYIQEGSG

SEQ ID NO: 820421 - protein, 9 aa, Homo Sapiens
NMGAWTLPS

SEQ ID NO: 820422 - protein, 9 aa, Homo Sapiens
FTVAQNEIF

SEQ ID NO: 820423 - protein, 9 aa, Homo Sapiens
LKLLDAEKD

SEQ ID NO: 820424 - protein, 9 aa, Homo Sapiens
PSVRVEGDC

SEQ ID NO: 820425 - protein, 9 aa, Homo Sapiens
LFLAREGWA

SEQ ID NO: 820426 - protein, 9 aa, Homo Sapiens
KLSNMYVVD

SEQ ID NO: 820427 - protein, 9 aa, Homo Sapiens
ENNLHLPKM

SEQ ID NO: 820428 - protein, 9 aa, Homo Sapiens
NRKFYIYYL

SEQ ID NO: 820429 - protein, 9 aa, Homo Sapiens
VHPAVVIQQ

SEQ ID NO: 820430 - protein, 9 aa, Homo Sapiens
QMAKSVHIL

SEQ ID NO: 820431 - protein, 9 aa, Homo Sapiens
KSMLIIHQQ

SEQ ID NO: 820432 - protein, 9 aa, Homo Sapiens
DIWSVGCTM

SEQ ID NO: 820433 - protein, 9 aa, Homo Sapiens
QVWKNKGAI

SEQ ID NO: 820434 - protein, 9 aa, Homo Sapiens
LMAVEITEQ

SEQ ID NO: 820435 - protein, 9 aa, Homo Sapiens
AKHLESPQL

SEQ ID NO: 820436 - protein, 9 aa, Homo Sapiens
NTPLVSITT

SEQ ID NO: 820437 - protein, 9 aa, Homo Sapiens
EEQPHPHLV

SEQ ID NO: 820438 - protein, 9 aa, Homo Sapiens
ARRSAIKIQ

SEQ ID NO: 820439 - protein, 9 aa, Homo Sapiens
TPVPSHPYG

SEQ ID NO: 820440 - protein, 9 aa, Homo Sapiens
KIKCFLERV

SEQ ID NO: 820441 - protein, 9 aa, Homo Sapiens
DVLIELYAP

SEQ ID NO: 820442 - protein, 9 aa, Homo Sapiens
TNNENTYGN

SEQ ID NO: 820443 - protein, 9 aa, Homo Sapiens
PLSLIEDLQ

SEQ ID NO: 820444 - protein, 9 aa, Homo Sapiens
SSPEDLIVE

SEQ ID NO: 820445 - protein, 9 aa, Homo Sapiens
EEKLADQLK

SEQ ID NO: 820446 - protein, 9 aa, Homo Sapiens
GTWECSQRR

SEQ ID NO: 820447 - protein, 9 aa, Homo Sapiens
GFQDAVNTI

SEQ ID NO: 820448 - protein, 9 aa, Homo Sapiens
FWGKIRITQ

SEQ ID NO: 820449 - protein, 9 aa, Homo Sapiens
KNILMCTGE

SEQ ID NO: 820450 - protein, 9 aa, Homo Sapiens
DYLTNILKM

SEQ ID NO: 820451 - protein, 9 aa, Homo Sapiens
GKGKYDAVN

SEQ ID NO: 820452 - protein, 9 aa, Homo Sapiens
IPQLPAPPN

SEQ ID NO: 820453 - protein, 9 aa, Homo Sapiens
MATIILRHL

SEQ ID NO: 820454 - protein, 9 aa, Homo Sapiens
AIIPCFGAK

SEQ ID NO: 820455 - protein, 9 aa, Homo Sapiens
TPSYLTPDD

SEQ ID NO: 820456 - protein, 9 aa, Homo Sapiens
SDAGTYTCE

SEQ ID NO: 820457 - protein, 9 aa, Homo Sapiens
LIIHTRTHS

SEQ ID NO: 820458 - protein, 9 aa, Homo Sapiens
AESIKLKRE

SEQ ID NO: 820459 - protein, 9 aa, Homo Sapiens
QQIQTVMKK

SEQ ID NO: 820460 - protein, 9 aa, Homo Sapiens
VNSDIFLCE

SEQ ID NO: 820461 - protein, 9 aa, Homo Sapiens
SGLAGDHLS

SEQ ID NO: 820462 - protein, 9 aa, Homo Sapiens
KGKSTLLQQ

SEQ ID NO: 820463 - protein, 9 aa, Homo Sapiens
LGADLKSIL

SEQ ID NO: 820464 - protein, 9 aa, Homo Sapiens
TAAEMVDLY

SEQ ID NO: 820465 - protein, 9 aa, Homo Sapiens
WKKLDRNYL

SEQ ID NO: 820466 - protein, 9 aa, Homo Sapiens
QCHPDAFCY

SEQ ID NO: 820467 - protein, 9 aa, Homo Sapiens
IAVSSSFLE

SEQ ID NO: 820468 - protein, 9 aa, Homo Sapiens
SIPKSNIVL

SEQ ID NO: 820469 - protein, 9 aa, Homo Sapiens
ESSSNQSYR

SEQ ID NO: 820470 - protein, 9 aa, Homo Sapiens
LLLLAVFNK

SEQ ID NO: 820471 - protein, 9 aa, Homo Sapiens
SNVAEHFFC

SEQ ID NO: 820472 - protein, 9 aa, Homo Sapiens
PLSTQVNFL

SEQ ID NO: 820473 - protein, 9 aa, Homo Sapiens
RSPSLNVLQ

SEQ ID NO: 820474 - protein, 9 aa, Homo Sapiens
INSSESVGP

SEQ ID NO: 820475 - protein, 9 aa, Homo Sapiens
DDVEEDNNE

SEQ ID NO: 820476 - protein, 9 aa, Homo Sapiens
CKADAKIAS

SEQ ID NO: 820477 - protein, 9 aa, Homo Sapiens
ESECSNVMI

SEQ ID NO: 820478 - protein, 9 aa, Homo Sapiens
DLILNTIDI

SEQ ID NO: 820479 - protein, 9 aa, Homo Sapiens
RQQLCEITE

SEQ ID NO: 820480 - protein, 9 aa, Homo Sapiens
EANQEDKGN

SEQ ID NO: 820481 - protein, 9 aa, Homo Sapiens
DMETKCFTC

SEQ ID NO: 820482 - protein, 9 aa, Homo Sapiens
LTKDTESIT

SEQ ID NO: 820483 - protein, 9 aa, Homo Sapiens
GVVQMPEYT

SEQ ID NO: 820484 - protein, 9 aa, Homo Sapiens
RLELSNPIP

SEQ ID NO: 820485 - protein, 9 aa, Homo Sapiens
FNNTYQATI

SEQ ID NO: 820486 - protein, 9 aa, Homo Sapiens
AVEEIQCYV

SEQ ID NO: 820487 - protein, 9 aa, Homo Sapiens
FIGEKAAKW

SEQ ID NO: 820488 - protein, 9 aa, Homo Sapiens
LHIRIKHSG

SEQ ID NO: 820489 - protein, 9 aa, Homo Sapiens
LLFPLIPAL

SEQ ID NO: 820490 - protein, 9 aa, Homo Sapiens
KAVAIGPRG

SEQ ID NO: 820491 - protein, 9 aa, Homo Sapiens
IIVRRNLLD

SEQ ID NO: 820492 - protein, 9 aa, Homo Sapiens
SSDGSDSSD

SEQ ID NO: 820493 - protein, 9 aa, Homo Sapiens
ITTPEQLYA

SEQ ID NO: 820494 - protein, 9 aa, Homo Sapiens
LVIEDNKVR

SEQ ID NO: 820495 - protein, 9 aa, Homo Sapiens
VNVSFNPES

SEQ ID NO: 820496 - protein, 9 aa, Homo Sapiens
ARKLDIYCV

SEQ ID NO: 820497 - protein, 9 aa, Homo Sapiens
YNSGIHSGA

SEQ ID NO: 820498 - protein, 9 aa, Homo Sapiens
TEEDVFRHR

SEQ ID NO: 820499 - protein, 9 aa, Homo Sapiens
VKKIISYRG

SEQ ID NO: 820500 - protein, 9 aa, Homo Sapiens
ALNRVLKNL

SEQ ID NO: 820501 - protein, 9 aa, Homo Sapiens
GHIEAILLK

SEQ ID NO: 820502 - protein, 9 aa, Homo Sapiens
ITQNYLKVL

SEQ ID NO: 820503 - protein, 9 aa, Homo Sapiens
QQANDDLAR

SEQ ID NO: 820504 - protein, 9 aa, Homo Sapiens
YRGSYHLDW

SEQ ID NO: 820505 - protein, 9 aa, Homo Sapiens
EFLQAHTPT

SEQ ID NO: 820506 - protein, 9 aa, Homo Sapiens
HLLTVHGRT

SEQ ID NO: 820507 - protein, 9 aa, Homo Sapiens
FSDLYYFRN

SEQ ID NO: 820508 - protein, 9 aa, Homo Sapiens
RLLEALCRD

SEQ ID NO: 820509 - protein, 9 aa, Homo Sapiens
GNDDRIQGV

SEQ ID NO: 820510 - protein, 9 aa, Homo Sapiens
AKLRTRVHK

SEQ ID NO: 820511 - protein, 9 aa, Homo Sapiens
TSKRIIKKV

SEQ ID NO: 820512 - protein, 9 aa, Homo Sapiens
QGAWKKLDR

SEQ ID NO: 820513 - protein, 9 aa, Homo Sapiens
PTLFGPQLN

SEQ ID NO: 820514 - protein, 9 aa, Homo Sapiens
DKLLEERAK

SEQ ID NO: 820515 - protein, 9 aa, Homo Sapiens
SKYEAIMCI

SEQ ID NO: 820516 - protein, 9 aa, Homo Sapiens
AGPSVGVKA

SEQ ID NO: 820517 - protein, 9 aa, Homo Sapiens
CNDYFFNNF

SEQ ID NO: 820518 - protein, 9 aa, Homo Sapiens
KTDTFHPEI

SEQ ID NO: 820519 - protein, 9 aa, Homo Sapiens
ANKETLDNK

SEQ ID NO: 820520 - protein, 9 aa, Homo Sapiens
TNVALNNSG

SEQ ID NO: 820521 - protein, 9 aa, Homo Sapiens
INKKLDISN

SEQ ID NO: 820522 - protein, 9 aa, Homo Sapiens
LCDSTQAAN

SEQ ID NO: 820523 - protein, 9 aa, Homo Sapiens
AACSLQPDI

SEQ ID NO: 820524 - protein, 9 aa, Homo Sapiens
QSKKVGTYN

SEQ ID NO: 820525 - protein, 9 aa, Homo Sapiens
PVNFAFEVT

SEQ ID NO: 820526 - protein, 9 aa, Homo Sapiens
TTRFIFLGF

SEQ ID NO: 820527 - protein, 9 aa, Homo Sapiens
ALVTSFMET

SEQ ID NO: 820528 - protein, 9 aa, Homo Sapiens
TPPIVESLG

SEQ ID NO: 820529 - protein, 9 aa, Homo Sapiens
RFEVSSYLI

SEQ ID NO: 820530 - protein, 9 aa, Homo Sapiens
PFVETTWKI

SEQ ID NO: 820531 - protein, 9 aa, Homo Sapiens
DFFAHGPPL

SEQ ID NO: 820532 - protein, 9 aa, Homo Sapiens
VVNQVKVEG

SEQ ID NO: 820533 - protein, 9 aa, Homo Sapiens
RQIIPRDLA

SEQ ID NO: 820534 - protein, 9 aa, Homo Sapiens
MMVLIENKA

SEQ ID NO: 820535 - protein, 9 aa, Homo Sapiens
IERKYYIVE

SEQ ID NO: 820536 - protein, 9 aa, Homo Sapiens
ILQGYVPVI

SEQ ID NO: 820537 - protein, 9 aa, Homo Sapiens
LVTMPGPSS

SEQ ID NO: 820538 - protein, 9 aa, Homo Sapiens
LSYKSICYL

SEQ ID NO: 820539 - protein, 9 aa, Homo Sapiens
ERLAKDSDK

SEQ ID NO: 820540 - protein, 9 aa, Homo Sapiens
SRTPRLPAV

SEQ ID NO: 820541 - protein, 9 aa, Homo Sapiens
NAHLANHRI

SEQ ID NO: 820542 - protein, 9 aa, Homo Sapiens
MLECPLILY

SEQ ID NO: 820543 - protein, 9 aa, Homo Sapiens
LSLIDYFVF

SEQ ID NO: 820544 - protein, 9 aa, Homo Sapiens
GHFIYNNVS

SEQ ID NO: 820545 - protein, 9 aa, Homo Sapiens
DLCQYYDVM

SEQ ID NO: 820546 - protein, 9 aa, Homo Sapiens
RDVEQGELV

SEQ ID NO: 820547 - protein, 9 aa, Homo Sapiens
QPESFRAQY

SEQ ID NO: 820548 - protein, 9 aa, Homo Sapiens
QLILALLIQ

SEQ ID NO: 820549 - protein, 9 aa, Homo Sapiens
GFNERNVNM

SEQ ID NO: 820550 - protein, 9 aa, Homo Sapiens
TFSKPVLQS

SEQ ID NO: 820551 - protein, 9 aa, Homo Sapiens
AKAPVYDWP

SEQ ID NO: 820552 - protein, 9 aa, Homo Sapiens
PSTPPSNLR

SEQ ID NO: 820553 - protein, 9 aa, Homo Sapiens
TFRMLFQHF

SEQ ID NO: 820554 - protein, 9 aa, Homo Sapiens
GKAKLGQEP

SEQ ID NO: 820555 - protein, 9 aa, Homo Sapiens
YLETLSEVL

SEQ ID NO: 820556 - protein, 9 aa, Homo Sapiens
PQKAHKYLR

SEQ ID NO: 820557 - protein, 9 aa, Homo Sapiens
SADHQTLDK

SEQ ID NO: 820558 - protein, 9 aa, Homo Sapiens
YTECLFFGA

SEQ ID NO: 820559 - protein, 9 aa, Homo Sapiens
AENSVDTGG

SEQ ID NO: 820560 - protein, 9 aa, Homo Sapiens
TIDMLHIEF

SEQ ID NO: 820561 - protein, 9 aa, Homo Sapiens
ENQHPGHFS

SEQ ID NO: 820562 - protein, 9 aa, Homo Sapiens
IPPPLPTEH

SEQ ID NO: 820563 - protein, 9 aa, Homo Sapiens
GDFLSSKIK

SEQ ID NO: 820564 - protein, 9 aa, Homo Sapiens
VLLIWDNKD

SEQ ID NO: 820565 - protein, 9 aa, Homo Sapiens
GNKTITEFV

SEQ ID NO: 820566 - protein, 9 aa, Homo Sapiens
ADFANECPK

SEQ ID NO: 820567 - protein, 9 aa, Homo Sapiens
QCAKHNSYY

SEQ ID NO: 820568 - protein, 9 aa, Homo Sapiens
RHPDMLIKI

SEQ ID NO: 820569 - protein, 9 aa, Homo Sapiens
ACLPLPGHR

SEQ ID NO: 820570 - protein, 9 aa, Homo Sapiens
MIPTTTNNN

SEQ ID NO: 820571 - protein, 9 aa, Homo Sapiens
EFEEIDYST

SEQ ID NO: 820572 - protein, 9 aa, Homo Sapiens
KARFYYEQQ

SEQ ID NO: 820573 - protein, 9 aa, Homo Sapiens
IHKVQAAKE

SEQ ID NO: 820574 - protein, 9 aa, Homo Sapiens
FLMNKHQVP

SEQ ID NO: 820575 - protein, 9 aa, Homo Sapiens
EFVSGYRNE

SEQ ID NO: 820576 - protein, 9 aa, Homo Sapiens
ILFYDRVCS

SEQ ID NO: 820577 - protein, 9 aa, Homo Sapiens
EIANVSYPE

SEQ ID NO: 820578 - protein, 9 aa, Homo Sapiens
GKNNGKHNG

SEQ ID NO: 820579 - protein, 9 aa, Homo Sapiens
EIDLENVDG

SEQ ID NO: 820580 - protein, 9 aa, Homo Sapiens
DELHNSSGR

SEQ ID NO: 820581 - protein, 9 aa, Homo Sapiens
PYEQTIIFP

SEQ ID NO: 820582 - protein, 9 aa, Homo Sapiens
EAHDDDLDE

SEQ ID NO: 820583 - protein, 9 aa, Homo Sapiens
PGSSLPETP

SEQ ID NO: 820584 - protein, 9 aa, Homo Sapiens
AQQVFEELI

SEQ ID NO: 820585 - protein, 9 aa, Homo Sapiens
LFMMPQIVN

SEQ ID NO: 820586 - protein, 9 aa, Homo Sapiens
FSILNFLNK

SEQ ID NO: 820587 - protein, 9 aa, Homo Sapiens
QVDKASPGV

SEQ ID NO: 820588 - protein, 9 aa, Homo Sapiens
KSKEARTYI

SEQ ID NO: 820589 - protein, 9 aa, Homo Sapiens
RDNAAICTT

SEQ ID NO: 820590 - protein, 9 aa, Homo Sapiens
PSVRPLPHI

SEQ ID NO: 820591 - protein, 9 aa, Homo Sapiens
HPVTPLSAA

SEQ ID NO: 820592 - protein, 9 aa, Homo Sapiens
IPSYTKLIM

SEQ ID NO: 820593 - protein, 9 aa, Homo Sapiens
VPEVINGKT

SEQ ID NO: 820594 - protein, 9 aa, Homo Sapiens
HWIYPEGKL

SEQ ID NO: 820595 - protein, 9 aa, Homo Sapiens
LKYFYVHTV

SEQ ID NO: 820596 - protein, 9 aa, Homo Sapiens
KKKLEDALS

SEQ ID NO: 820597 - protein, 9 aa, Homo Sapiens
EQQRSSPTH

SEQ ID NO: 820598 - protein, 9 aa, Homo Sapiens
FLSVYKQVI

SEQ ID NO: 820599 - protein, 9 aa, Homo Sapiens
HQVLQISVA

SEQ ID NO: 820600 - protein, 9 aa, Homo Sapiens
FTALLTGPL

SEQ ID NO: 820601 - protein, 9 aa, Homo Sapiens
MQYLPNSNG

SEQ ID NO: 820602 - protein, 9 aa, Homo Sapiens
AINVNHEFN

SEQ ID NO: 820603 - protein, 9 aa, Homo Sapiens
DFLVPKVGF

SEQ ID NO: 820604 - protein, 9 aa, Homo Sapiens
VNKKGIAAK

SEQ ID NO: 820605 - protein, 9 aa, Homo Sapiens
TTYRGPDTN

SEQ ID NO: 820606 - protein, 9 aa, Homo Sapiens
DAHLRHDKI

SEQ ID NO: 820607 - protein, 9 aa, Homo Sapiens
PVYVRKERR

SEQ ID NO: 820608 - protein, 9 aa, Homo Sapiens
HKLYFPERV

SEQ ID NO: 820609 - protein, 9 aa, Homo Sapiens
AAAWCHQPP

SEQ ID NO: 820610 - protein, 9 aa, Homo Sapiens
KVKDTHKKS

SEQ ID NO: 820611 - protein, 9 aa, Homo Sapiens
KQTDEEGKD

SEQ ID NO: 820612 - protein, 9 aa, Homo Sapiens
AVVNANSTP

SEQ ID NO: 820613 - protein, 9 aa, Homo Sapiens
STISSLFPP

SEQ ID NO: 820614 - protein, 9 aa, Homo Sapiens
GDKLYPCNQ

SEQ ID NO: 820615 - protein, 9 aa, Homo Sapiens
MAQDGLDSE

SEQ ID NO: 820616 - protein, 9 aa, Homo Sapiens
LSMIKCLDY

SEQ ID NO: 820617 - protein, 9 aa, Homo Sapiens
YECMVQLFF

SEQ ID NO: 820618 - protein, 9 aa, Homo Sapiens
VETTWKIKF

SEQ ID NO: 820619 - protein, 9 aa, Homo Sapiens
YAVPFVSPL

SEQ ID NO: 820620 - protein, 9 aa, Homo Sapiens
GKLDLDKGP

SEQ ID NO: 820621 - protein, 9 aa, Homo Sapiens
SHCTVHITD

SEQ ID NO: 820622 - protein, 9 aa, Homo Sapiens
NEQSVSATE

SEQ ID NO: 820623 - protein, 9 aa, Homo Sapiens
NPYHNPTHS

SEQ ID NO: 820624 - protein, 9 aa, Homo Sapiens
QGEMGLQRK

SEQ ID NO: 820625 - protein, 9 aa, Homo Sapiens
MRLKRPETP

SEQ ID NO: 820626 - protein, 9 aa, Homo Sapiens
LVPYIMEAV

SEQ ID NO: 820627 - protein, 9 aa, Homo Sapiens
PLATLGVSL

SEQ ID NO: 820628 - protein, 9 aa, Homo Sapiens
VAQGADRVS

SEQ ID NO: 820629 - protein, 9 aa, Homo Sapiens
DCAGNTTVL

SEQ ID NO: 820630 - protein, 9 aa, Homo Sapiens
SIVIIILMT

SEQ ID NO: 820631 - protein, 9 aa, Homo Sapiens
RLLGSSNYR

SEQ ID NO: 820632 - protein, 9 aa, Homo Sapiens
GKAVIHLHH

SEQ ID NO: 820633 - protein, 9 aa, Homo Sapiens
LIYTLSLER

SEQ ID NO: 820634 - protein, 9 aa, Homo Sapiens
LLLQFVMGS

SEQ ID NO: 820635 - protein, 9 aa, Homo Sapiens
MRLEDESFD

SEQ ID NO: 820636 - protein, 9 aa, Homo Sapiens
TCVCVCMSI

SEQ ID NO: 820637 - protein, 9 aa, Homo Sapiens
MMKSLKYCN

SEQ ID NO: 820638 - protein, 9 aa, Homo Sapiens
KTVLHLAVE

SEQ ID NO: 820639 - protein, 9 aa, Homo Sapiens
PTEHASRPT

SEQ ID NO: 820640 - protein, 9 aa, Homo Sapiens
PFHDHAEVV

SEQ ID NO: 820641 - protein, 9 aa, Homo Sapiens
SRHKELFSL

SEQ ID NO: 820642 - protein, 9 aa, Homo Sapiens
DQVEEVTYN

SEQ ID NO: 820643 - protein, 9 aa, Homo Sapiens
FCMDNILGL

SEQ ID NO: 820644 - protein, 9 aa, Homo Sapiens
SLANKVMGY

SEQ ID NO: 820645 - protein, 9 aa, Homo Sapiens
KSTDAVLAA

SEQ ID NO: 820646 - protein, 9 aa, Homo Sapiens
VADILKGEH

SEQ ID NO: 820647 - protein, 9 aa, Homo Sapiens
ILLSHQIIH

SEQ ID NO: 820648 - protein, 9 aa, Homo Sapiens
KRTRLPQYY

SEQ ID NO: 820649 - protein, 9 aa, Homo Sapiens
IVFTGNETF

SEQ ID NO: 820650 - protein, 9 aa, Homo Sapiens
FIKKTGQAI

SEQ ID NO: 820651 - protein, 9 aa, Homo Sapiens
FNRNPYFQN

SEQ ID NO: 820652 - protein, 9 aa, Homo Sapiens
DVIINSHSH

SEQ ID NO: 820653 - protein, 9 aa, Homo Sapiens
LQAALGVPA

SEQ ID NO: 820654 - protein, 9 aa, Homo Sapiens
GLTKAIASH

SEQ ID NO: 820655 - protein, 9 aa, Homo Sapiens
KSVECYNSR

SEQ ID NO: 820656 - protein, 9 aa, Homo Sapiens
QGTVNTKNK

SEQ ID NO: 820657 - protein, 9 aa, Homo Sapiens
IEDHLHPYM

SEQ ID NO: 820658 - protein, 9 aa, Homo Sapiens
IVQACHDLI

SEQ ID NO: 820659 - protein, 9 aa, Homo Sapiens
EEVLNHVEQ

SEQ ID NO: 820660 - protein, 9 aa, Homo Sapiens
KINDDYSFT

SEQ ID NO: 820661 - protein, 9 aa, Homo Sapiens
DTGECWLEK

SEQ ID NO: 820662 - protein, 9 aa, Homo Sapiens
LLCVGAYTI

SEQ ID NO: 820663 - protein, 9 aa, Homo Sapiens
SKRMIYNHA

SEQ ID NO: 820664 - protein, 9 aa, Homo Sapiens
ENRNNRTIQ

SEQ ID NO: 820665 - protein, 9 aa, Homo Sapiens
DLDGELPSV

SEQ ID NO: 820666 - protein, 9 aa, Homo Sapiens
EMIQCFWVK

SEQ ID NO: 820667 - protein, 9 aa, Homo Sapiens
ISFQDRYKK

SEQ ID NO: 820668 - protein, 9 aa, Homo Sapiens
KEHLTESLL

SEQ ID NO: 820669 - protein, 9 aa, Homo Sapiens
EHAKIEENQ

SEQ ID NO: 820670 - protein, 9 aa, Homo Sapiens
TQREPNAVD

SEQ ID NO: 820671 - protein, 9 aa, Homo Sapiens
TYLPDHMSL

SEQ ID NO: 820672 - protein, 9 aa, Homo Sapiens
RILHSGEKP

SEQ ID NO: 820673 - protein, 9 aa, Homo Sapiens
TKTVQEKDN

SEQ ID NO: 820674 - protein, 9 aa, Homo Sapiens
VIFQLKADR

SEQ ID NO: 820675 - protein, 9 aa, Homo Sapiens
WGFNVRGIR

SEQ ID NO: 820676 - protein, 9 aa, Homo Sapiens
RLVTEEVIS

SEQ ID NO: 820677 - protein, 9 aa, Homo Sapiens
EVTYPCACE

SEQ ID NO: 820678 - protein, 9 aa, Homo Sapiens
KYSTNKAKK

SEQ ID NO: 820679 - protein, 9 aa, Homo Sapiens
QFMGQSDIE

SEQ ID NO: 820680 - protein, 9 aa, Homo Sapiens
VHQAQVELN

SEQ ID NO: 820681 - protein, 9 aa, Homo Sapiens
GGCLLDAPA

SEQ ID NO: 820682 - protein, 9 aa, Homo Sapiens
AGLKILRVT

SEQ ID NO: 820683 - protein, 9 aa, Homo Sapiens
INQLLQKEP

SEQ ID NO: 820684 - protein, 9 aa, Homo Sapiens
PSDDEGMPG

SEQ ID NO: 820685 - protein, 9 aa, Homo Sapiens
VHAKSLQQK

SEQ ID NO: 820686 - protein, 9 aa, Homo Sapiens
LEGHSEAVM

SEQ ID NO: 820687 - protein, 9 aa, Homo Sapiens
ELESTKVGV

SEQ ID NO: 820688 - protein, 9 aa, Homo Sapiens
GQDKQRNRF

SEQ ID NO: 820689 - protein, 9 aa, Homo Sapiens
ERRRHKTDP

SEQ ID NO: 820690 - protein, 9 aa, Homo Sapiens
RKHIEFSFH

SEQ ID NO: 820691 - protein, 9 aa, Homo Sapiens
WWENQPAGA

SEQ ID NO: 820692 - protein, 9 aa, Homo Sapiens
IIQAFKVQT

SEQ ID NO: 820693 - protein, 9 aa, Homo Sapiens
CQPRKKGRK

SEQ ID NO: 820694 - protein, 9 aa, Homo Sapiens
KTDTTGGQE

SEQ ID NO: 820695 - protein, 9 aa, Homo Sapiens
GAKYKVKAN

SEQ ID NO: 820696 - protein, 9 aa, Homo Sapiens
KHTMAFIEQ

SEQ ID NO: 820697 - protein, 9 aa, Homo Sapiens
AGNASKDES

SEQ ID NO: 820698 - protein, 9 aa, Homo Sapiens
DSTLRYFCG

SEQ ID NO: 820699 - protein, 9 aa, Homo Sapiens
IYVNRRFHC

SEQ ID NO: 820700 - protein, 9 aa, Homo Sapiens
LFESLFACN

SEQ ID NO: 820701 - protein, 9 aa, Homo Sapiens
EFCPNAKGV

SEQ ID NO: 820702 - protein, 9 aa, Homo Sapiens
KGDQLEIIS

SEQ ID NO: 820703 - protein, 9 aa, Homo Sapiens
DKIPNKSSV

SEQ ID NO: 820704 - protein, 9 aa, Homo Sapiens
HTDEKPYTC

SEQ ID NO: 820705 - protein, 9 aa, Homo Sapiens
EIKAAVKAA

SEQ ID NO: 820706 - protein, 9 aa, Homo Sapiens
SILSGLVLS

SEQ ID NO: 820707 - protein, 9 aa, Homo Sapiens
MLQLLEKLI

SEQ ID NO: 820708 - protein, 9 aa, Homo Sapiens
RPAPSLGAL

SEQ ID NO: 820709 - protein, 9 aa, Homo Sapiens
QVSQFVACE

SEQ ID NO: 820710 - protein, 9 aa, Homo Sapiens
VVVVDGKNK

SEQ ID NO: 820711 - protein, 9 aa, Homo Sapiens
PPGLPQNVH

SEQ ID NO: 820712 - protein, 9 aa, Homo Sapiens
WKYVVMVID

SEQ ID NO: 820713 - protein, 9 aa, Homo Sapiens
QWVYVELKF

SEQ ID NO: 820714 - protein, 9 aa, Homo Sapiens
QQLEQPFAG

SEQ ID NO: 820715 - protein, 9 aa, Homo Sapiens
DTMLITVSY

SEQ ID NO: 820716 - protein, 9 aa, Homo Sapiens
QDKLPGQER

SEQ ID NO: 820717 - protein, 9 aa, Homo Sapiens
SKPVLFQGN

SEQ ID NO: 820718 - protein, 9 aa, Homo Sapiens
HYNLVTRLV

SEQ ID NO: 820719 - protein, 9 aa, Homo Sapiens
SGKLPQSPS

SEQ ID NO: 820720 - protein, 9 aa, Homo Sapiens
RIESEVRWD

SEQ ID NO: 820721 - protein, 9 aa, Homo Sapiens
EVRHFSKIR

SEQ ID NO: 820722 - protein, 9 aa, Homo Sapiens
LSADYNKIV

SEQ ID NO: 820723 - protein, 9 aa, Homo Sapiens
AGEPILTQN

SEQ ID NO: 820724 - protein, 9 aa, Homo Sapiens
LQLRKDFGQ

SEQ ID NO: 820725 - protein, 9 aa, Homo Sapiens
YSHHDKHED

SEQ ID NO: 820726 - protein, 9 aa, Homo Sapiens
EKHIPGYQQ

SEQ ID NO: 820727 - protein, 9 aa, Homo Sapiens
ENIEAQVKP

SEQ ID NO: 820728 - protein, 9 aa, Homo Sapiens
SLRLKPHGL

SEQ ID NO: 820729 - protein, 9 aa, Homo Sapiens
NNLRENLDS

SEQ ID NO: 820730 - protein, 9 aa, Homo Sapiens
SVGSTAADS

SEQ ID NO: 820731 - protein, 9 aa, Homo Sapiens
ALQQPDDRI

SEQ ID NO: 820732 - protein, 9 aa, Homo Sapiens
DIRPHGVHV

SEQ ID NO: 820733 - protein, 9 aa, Homo Sapiens
QRKRADTYW

SEQ ID NO: 820734 - protein, 9 aa, Homo Sapiens
PNGKTYFFC

SEQ ID NO: 820735 - protein, 9 aa, Homo Sapiens
PRVPLKDKL

SEQ ID NO: 820736 - protein, 9 aa, Homo Sapiens
TRESGDSDN

SEQ ID NO: 820737 - protein, 9 aa, Homo Sapiens
RETRVRAEP

SEQ ID NO: 820738 - protein, 9 aa, Homo Sapiens
TGNWLSACF

SEQ ID NO: 820739 - protein, 9 aa, Homo Sapiens
EHNNYKALF

SEQ ID NO: 820740 - protein, 9 aa, Homo Sapiens
KDLLENAML

SEQ ID NO: 820741 - protein, 9 aa, Homo Sapiens
PELINYTDP

SEQ ID NO: 820742 - protein, 9 aa, Homo Sapiens
WGDLFTQQQ

SEQ ID NO: 820743 - protein, 9 aa, Homo Sapiens
DLSPRNQFN

SEQ ID NO: 820744 - protein, 9 aa, Homo Sapiens
PDYSPTSPN

SEQ ID NO: 820745 - protein, 9 aa, Homo Sapiens
GDNSEILPT

SEQ ID NO: 820746 - protein, 9 aa, Homo Sapiens
NSLNRDVSL

SEQ ID NO: 820747 - protein, 9 aa, Homo Sapiens
LKTMHRTQM

SEQ ID NO: 820748 - protein, 9 aa, Homo Sapiens
MPDSGRPTF

SEQ ID NO: 820749 - protein, 9 aa, Homo Sapiens
QSVGSTAAD

SEQ ID NO: 820750 - protein, 9 aa, Homo Sapiens
MLKTSMYAG

SEQ ID NO: 820751 - protein, 9 aa, Homo Sapiens
QWKILNEIY

SEQ ID NO: 820752 - protein, 9 aa, Homo Sapiens
TIHNRKEFA

SEQ ID NO: 820753 - protein, 9 aa, Homo Sapiens
DLKLSYMDV

SEQ ID NO: 820754 - protein, 9 aa, Homo Sapiens
KQNKPREKT

SEQ ID NO: 820755 - protein, 9 aa, Homo Sapiens
YHCFRPILK

SEQ ID NO: 820756 - protein, 9 aa, Homo Sapiens
FFVLTLLTN

SEQ ID NO: 820757 - protein, 9 aa, Homo Sapiens
EPKSAVYFL

SEQ ID NO: 820758 - protein, 9 aa, Homo Sapiens
ITRNLSYFA

SEQ ID NO: 820759 - protein, 9 aa, Homo Sapiens
SLTNFHEEP

SEQ ID NO: 820760 - protein, 9 aa, Homo Sapiens
PYIQQSMHG

SEQ ID NO: 820761 - protein, 9 aa, Homo Sapiens
EREVAGTLM

SEQ ID NO: 820762 - protein, 9 aa, Homo Sapiens
DSSKKLDFH

SEQ ID NO: 820763 - protein, 9 aa, Homo Sapiens
GDKATVKDE

SEQ ID NO: 820764 - protein, 9 aa, Homo Sapiens
MWYKHKGDL

SEQ ID NO: 820765 - protein, 9 aa, Homo Sapiens
GGYIASTSY

SEQ ID NO: 820766 - protein, 9 aa, Homo Sapiens
PYNTLSELN

SEQ ID NO: 820767 - protein, 9 aa, Homo Sapiens
YSTVKDNQV

SEQ ID NO: 820768 - protein, 9 aa, Homo Sapiens
EGLEHQLHR

SEQ ID NO: 820769 - protein, 9 aa, Homo Sapiens
SPAKNLFKK

SEQ ID NO: 820770 - protein, 9 aa, Homo Sapiens
DNEDGGEAE

SEQ ID NO: 820771 - protein, 9 aa, Homo Sapiens
KVTLGRVDN

SEQ ID NO: 820772 - protein, 9 aa, Homo Sapiens
ELRKDISTN

SEQ ID NO: 820773 - protein, 9 aa, Homo Sapiens
GLQVLGHTL

SEQ ID NO: 820774 - protein, 9 aa, Homo Sapiens
SLNLDAKKY

SEQ ID NO: 820775 - protein, 9 aa, Homo Sapiens
TAEPLVPEP

SEQ ID NO: 820776 - protein, 9 aa, Homo Sapiens
TQLFFFCLF

SEQ ID NO: 820777 - protein, 9 aa, Homo Sapiens
DGSSAFLDS

SEQ ID NO: 820778 - protein, 9 aa, Homo Sapiens
LTKLEELPK

SEQ ID NO: 820779 - protein, 9 aa, Homo Sapiens
LHSGKTGRA

SEQ ID NO: 820780 - protein, 9 aa, Homo Sapiens
TMAEMVLHK

SEQ ID NO: 820781 - protein, 9 aa, Homo Sapiens
HPLKSDTFF

SEQ ID NO: 820782 - protein, 9 aa, Homo Sapiens
QGSYDADTG

SEQ ID NO: 820783 - protein, 9 aa, Homo Sapiens
LPHAIIRLD

SEQ ID NO: 820784 - protein, 9 aa, Homo Sapiens
HEDKPGRMN

SEQ ID NO: 820785 - protein, 9 aa, Homo Sapiens
IKGIIELLD

SEQ ID NO: 820786 - protein, 9 aa, Homo Sapiens
LVYSFHGLV

SEQ ID NO: 820787 - protein, 9 aa, Homo Sapiens
AASFGVCRL

SEQ ID NO: 820788 - protein, 9 aa, Homo Sapiens
LKANVEYIK

SEQ ID NO: 820789 - protein, 9 aa, Homo Sapiens
THKEMETLA

SEQ ID NO: 820790 - protein, 9 aa, Homo Sapiens
TIPAGSFSN

SEQ ID NO: 820791 - protein, 9 aa, Homo Sapiens
LRNKEKRGS

SEQ ID NO: 820792 - protein, 9 aa, Homo Sapiens
KGDPLIAEK

SEQ ID NO: 820793 - protein, 9 aa, Homo Sapiens
VKHSSPRRK

SEQ ID NO: 820794 - protein, 9 aa, Homo Sapiens
DMLHIEFKC

SEQ ID NO: 820795 - protein, 9 aa, Homo Sapiens
EESANEMIE

SEQ ID NO: 820796 - protein, 9 aa, Homo Sapiens
VCAVINQSC

SEQ ID NO: 820797 - protein, 9 aa, Homo Sapiens
LELLFTLLS

SEQ ID NO: 820798 - protein, 9 aa, Homo Sapiens
LLSLMGVLL

SEQ ID NO: 820799 - protein, 9 aa, Homo Sapiens
LFWENEVNN

SEQ ID NO: 820800 - protein, 9 aa, Homo Sapiens
KYLGNEKRR

SEQ ID NO: 820801 - protein, 9 aa, Homo Sapiens
VDKCLRPDV

SEQ ID NO: 820802 - protein, 9 aa, Homo Sapiens
TDHDQEVIP

SEQ ID NO: 820803 - protein, 9 aa, Homo Sapiens
FQLCQFVMD

SEQ ID NO: 820804 - protein, 9 aa, Homo Sapiens
EDSLLKSTN

SEQ ID NO: 820805 - protein, 9 aa, Homo Sapiens
AKMYVQPFW

SEQ ID NO: 820806 - protein, 9 aa, Homo Sapiens
ESKNTHGLT

SEQ ID NO: 820807 - protein, 9 aa, Homo Sapiens
NLLEGEVDD

SEQ ID NO: 820808 - protein, 9 aa, Homo Sapiens
ETTKESLRN

SEQ ID NO: 820809 - protein, 9 aa, Homo Sapiens
KVSQAFKQL

SEQ ID NO: 820810 - protein, 9 aa, Homo Sapiens
ALLNAEDEN

SEQ ID NO: 820811 - protein, 9 aa, Homo Sapiens
GFVALQTSI

SEQ ID NO: 820812 - protein, 9 aa, Homo Sapiens
FGVSHRRHN

SEQ ID NO: 820813 - protein, 9 aa, Homo Sapiens
LDANKDNKV

SEQ ID NO: 820814 - protein, 9 aa, Homo Sapiens
TQRSYSWFQ

SEQ ID NO: 820815 - protein, 9 aa, Homo Sapiens
IQMISVQPD

SEQ ID NO: 820816 - protein, 9 aa, Homo Sapiens
LGINSHKRT

SEQ ID NO: 820817 - protein, 9 aa, Homo Sapiens
MQKYLAEIN

SEQ ID NO: 820818 - protein, 9 aa, Homo Sapiens
KHKREQNYM

SEQ ID NO: 820819 - protein, 9 aa, Homo Sapiens
EQLHTYQEG

SEQ ID NO: 820820 - protein, 9 aa, Homo Sapiens
DLLLNVDMW

SEQ ID NO: 820821 - protein, 9 aa, Homo Sapiens
WRFPNNSIK

SEQ ID NO: 820822 - protein, 9 aa, Homo Sapiens
AAQLAVTRI

SEQ ID NO: 820823 - protein, 9 aa, Homo Sapiens
KAATHRQNY

SEQ ID NO: 820824 - protein, 9 aa, Homo Sapiens
ENMYLTDAR

SEQ ID NO: 820825 - protein, 9 aa, Homo Sapiens
MRERNKNVA

SEQ ID NO: 820826 - protein, 9 aa, Homo Sapiens
SLEYLDLNF

SEQ ID NO: 820827 - protein, 9 aa, Homo Sapiens
GNVWWQKLQ

SEQ ID NO: 820828 - protein, 9 aa, Homo Sapiens
RYYVSNKLF

SEQ ID NO: 820829 - protein, 9 aa, Homo Sapiens
YTCICSGAF

SEQ ID NO: 820830 - protein, 9 aa, Homo Sapiens
KVQDLSYGV

SEQ ID NO: 820831 - protein, 9 aa, Homo Sapiens
TCETARTPR

SEQ ID NO: 820832 - protein, 9 aa, Homo Sapiens
MHERTHTGD

SEQ ID NO: 820833 - protein, 9 aa, Homo Sapiens
DEDLPVHGD

SEQ ID NO: 820834 - protein, 9 aa, Homo Sapiens
CGVIYVVYS

SEQ ID NO: 820835 - protein, 9 aa, Homo Sapiens
DYHSLTTNI

SEQ ID NO: 820836 - protein, 9 aa, Homo Sapiens
RIGAHITTP

SEQ ID NO: 820837 - protein, 9 aa, Homo Sapiens
KGTQCNNMA

SEQ ID NO: 820838 - protein, 9 aa, Homo Sapiens
FSVIFSVEK

SEQ ID NO: 820839 - protein, 9 aa, Homo Sapiens
RHIYHSELD

SEQ ID NO: 820840 - protein, 9 aa, Homo Sapiens
QEPKSAVYF

SEQ ID NO: 820841 - protein, 9 aa, Homo Sapiens
TINTTDGST

SEQ ID NO: 820842 - protein, 9 aa, Homo Sapiens
LQRQATKDA

SEQ ID NO: 820843 - protein, 9 aa, Homo Sapiens
QKKDVLLRN

SEQ ID NO: 820844 - protein, 9 aa, Homo Sapiens
QKIDRFFCI

SEQ ID NO: 820845 - protein, 9 aa, Homo Sapiens
SGYRNEFLD

SEQ ID NO: 820846 - protein, 9 aa, Homo Sapiens
KDIEFGGMV

SEQ ID NO: 820847 - protein, 9 aa, Homo Sapiens
KRDQYLQVQ

SEQ ID NO: 820848 - protein, 9 aa, Homo Sapiens
MPTKENLCS

SEQ ID NO: 820849 - protein, 9 aa, Homo Sapiens
SFLHENLLH

SEQ ID NO: 820850 - protein, 9 aa, Homo Sapiens
VPDTVLHSQ

SEQ ID NO: 820851 - protein, 9 aa, Homo Sapiens
QRKKKEKKQ

SEQ ID NO: 820852 - protein, 9 aa, Homo Sapiens
EQEAEKPQR

SEQ ID NO: 820853 - protein, 9 aa, Homo Sapiens
LLAKKVDSH

SEQ ID NO: 820854 - protein, 9 aa, Homo Sapiens
LDMPVDPNK

SEQ ID NO: 820855 - protein, 9 aa, Homo Sapiens
NKTLLCSFQ

SEQ ID NO: 820856 - protein, 9 aa, Homo Sapiens
LFPFPRHGH

SEQ ID NO: 820857 - protein, 9 aa, Homo Sapiens
LKIFFESLE

SEQ ID NO: 820858 - protein, 9 aa, Homo Sapiens
GQSRGCVAR

SEQ ID NO: 820859 - protein, 9 aa, Homo Sapiens
QGEKGANGE

SEQ ID NO: 820860 - protein, 9 aa, Homo Sapiens
YAAEIILAL

SEQ ID NO: 820861 - protein, 9 aa, Homo Sapiens
IKQVGNGSH

SEQ ID NO: 820862 - protein, 9 aa, Homo Sapiens
EQSIDGTGW

SEQ ID NO: 820863 - protein, 9 aa, Homo Sapiens
SYLYDVTRN

SEQ ID NO: 820864 - protein, 9 aa, Homo Sapiens
RLNHNKIRN

SEQ ID NO: 820865 - protein, 9 aa, Homo Sapiens
ATFLDIIDA

SEQ ID NO: 820866 - protein, 9 aa, Homo Sapiens
NDGKLGATG

SEQ ID NO: 820867 - protein, 9 aa, Homo Sapiens
EEFALVEDK

SEQ ID NO: 820868 - protein, 9 aa, Homo Sapiens
SKRHFKLEK

SEQ ID NO: 820869 - protein, 9 aa, Homo Sapiens
CHKCGKTFS

SEQ ID NO: 820870 - protein, 9 aa, Homo Sapiens
EATVVLAEM

SEQ ID NO: 820871 - protein, 9 aa, Homo Sapiens
NTQNAIAFH

SEQ ID NO: 820872 - protein, 9 aa, Homo Sapiens
ESLFYKGVY

SEQ ID NO: 820873 - protein, 9 aa, Homo Sapiens
LNHVEQLRV

SEQ ID NO: 820874 - protein, 9 aa, Homo Sapiens
SLVPLAVYS

SEQ ID NO: 820875 - protein, 9 aa, Homo Sapiens
VRATLPIFD

SEQ ID NO: 820876 - protein, 9 aa, Homo Sapiens
KGFGVFNAL

SEQ ID NO: 820877 - protein, 9 aa, Homo Sapiens
KKPLFSSNP

SEQ ID NO: 820878 - protein, 9 aa, Homo Sapiens
KEKTDPQYL

SEQ ID NO: 820879 - protein, 9 aa, Homo Sapiens
TVTDGQDSP

SEQ ID NO: 820880 - protein, 9 aa, Homo Sapiens
KIIFEDGNI

SEQ ID NO: 820881 - protein, 9 aa, Homo Sapiens
LHNKHPQLK

SEQ ID NO: 820882 - protein, 9 aa, Homo Sapiens
QVWGKVFPP

SEQ ID NO: 820883 - protein, 9 aa, Homo Sapiens
ELHPKIHYM

SEQ ID NO: 820884 - protein, 9 aa, Homo Sapiens
RAVCCSLIK

SEQ ID NO: 820885 - protein, 9 aa, Homo Sapiens
DEKMQNTGD

SEQ ID NO: 820886 - protein, 9 aa, Homo Sapiens
SATSGELLL

SEQ ID NO: 820887 - protein, 9 aa, Homo Sapiens
RKYLDREGT

SEQ ID NO: 820888 - protein, 9 aa, Homo Sapiens
NKKYPDYYQ

SEQ ID NO: 820889 - protein, 9 aa, Homo Sapiens
MKNAQKKIN

SEQ ID NO: 820890 - protein, 9 aa, Homo Sapiens
RGMLLFYSL

SEQ ID NO: 820891 - protein, 9 aa, Homo Sapiens
GHKEVDHLF

SEQ ID NO: 820892 - protein, 9 aa, Homo Sapiens
GPNGADGTQ

SEQ ID NO: 820893 - protein, 9 aa, Homo Sapiens
LFGTPLPNY

SEQ ID NO: 820894 - protein, 9 aa, Homo Sapiens
GPHRLRRTL

SEQ ID NO: 820895 - protein, 9 aa, Homo Sapiens
PEGSVPNKC

SEQ ID NO: 820896 - protein, 9 aa, Homo Sapiens
LTYQGASVI

SEQ ID NO: 820897 - protein, 9 aa, Homo Sapiens
SQEDSLFLI

SEQ ID NO: 820898 - protein, 9 aa, Homo Sapiens
CGKGFTQIS

SEQ ID NO: 820899 - protein, 9 aa, Homo Sapiens
HRHYRGEKL

SEQ ID NO: 820900 - protein, 9 aa, Homo Sapiens
TYKNNFDNL

SEQ ID NO: 820901 - protein, 9 aa, Homo Sapiens
LLEFNVNSN

SEQ ID NO: 820902 - protein, 9 aa, Homo Sapiens
IKEGSKPVL

SEQ ID NO: 820903 - protein, 9 aa, Homo Sapiens
PSAESIKLK

SEQ ID NO: 820904 - protein, 9 aa, Homo Sapiens
EQLLCQLKE

SEQ ID NO: 820905 - protein, 9 aa, Homo Sapiens
ENDIFEIHF

SEQ ID NO: 820906 - protein, 9 aa, Homo Sapiens
EDPPMPAYR

SEQ ID NO: 820907 - protein, 9 aa, Homo Sapiens
IHEGLTVKI

SEQ ID NO: 820908 - protein, 9 aa, Homo Sapiens
FLAREGWAV

SEQ ID NO: 820909 - protein, 9 aa, Homo Sapiens
QYIILRSGF

SEQ ID NO: 820910 - protein, 9 aa, Homo Sapiens
KEKSCSVLR

SEQ ID NO: 820911 - protein, 9 aa, Homo Sapiens
EQTTAFLDG

SEQ ID NO: 820912 - protein, 9 aa, Homo Sapiens
EVDTIDLVI

SEQ ID NO: 820913 - protein, 9 aa, Homo Sapiens
TPADKRIPQ

SEQ ID NO: 820914 - protein, 9 aa, Homo Sapiens
VGELPTPAC

SEQ ID NO: 820915 - protein, 9 aa, Homo Sapiens
VLSYRRNSD

SEQ ID NO: 820916 - protein, 9 aa, Homo Sapiens
HCGKPVINV

SEQ ID NO: 820917 - protein, 9 aa, Homo Sapiens
TLIFDMHIP

SEQ ID NO: 820918 - protein, 9 aa, Homo Sapiens
SSPSNYVHR

SEQ ID NO: 820919 - protein, 9 aa, Homo Sapiens
PNHRHRAII

SEQ ID NO: 820920 - protein, 9 aa, Homo Sapiens
LKVNLRNNY

SEQ ID NO: 820921 - protein, 9 aa, Homo Sapiens
SVSLLIFLF

SEQ ID NO: 820922 - protein, 9 aa, Homo Sapiens
TASAVVALI

SEQ ID NO: 820923 - protein, 9 aa, Homo Sapiens
EEADNNENI

SEQ ID NO: 820924 - protein, 9 aa, Homo Sapiens
QRAPPWQEG

SEQ ID NO: 820925 - protein, 9 aa, Homo Sapiens
SSVYRDAFN

SEQ ID NO: 820926 - protein, 9 aa, Homo Sapiens
SLILHQKTH

SEQ ID NO: 820927 - protein, 9 aa, Homo Sapiens
LRNGSMKAA

SEQ ID NO: 820928 - protein, 9 aa, Homo Sapiens
VLMAYDRYV

SEQ ID NO: 820929 - protein, 9 aa, Homo Sapiens
ADTMQSALA

SEQ ID NO: 820930 - protein, 9 aa, Homo Sapiens
YLDYEDATF

SEQ ID NO: 820931 - protein, 9 aa, Homo Sapiens
KSKSAKKKT

SEQ ID NO: 820932 - protein, 9 aa, Homo Sapiens
RCTLPKHES

SEQ ID NO: 820933 - protein, 9 aa, Homo Sapiens
RLFTSVLRV

SEQ ID NO: 820934 - protein, 9 aa, Homo Sapiens
LQQFLRFGK

SEQ ID NO: 820935 - protein, 9 aa, Homo Sapiens
QPTGANRRA

SEQ ID NO: 820936 - protein, 9 aa, Homo Sapiens
FMWPNITPV

SEQ ID NO: 820937 - protein, 9 aa, Homo Sapiens
LLKEAMLQA

SEQ ID NO: 820938 - protein, 9 aa, Homo Sapiens
YPEAVLLKR

SEQ ID NO: 820939 - protein, 9 aa, Homo Sapiens
MHLVYADTI

SEQ ID NO: 820940 - protein, 9 aa, Homo Sapiens
ATLPPSTSS

SEQ ID NO: 820941 - protein, 9 aa, Homo Sapiens
PMIPDYPGL

SEQ ID NO: 820942 - protein, 9 aa, Homo Sapiens
QLWLPYNTL

SEQ ID NO: 820943 - protein, 9 aa, Homo Sapiens
QRKKYAPKP

SEQ ID NO: 820944 - protein, 9 aa, Homo Sapiens
QRDSLVQQS

SEQ ID NO: 820945 - protein, 9 aa, Homo Sapiens
PRYVITTTT

SEQ ID NO: 820946 - protein, 9 aa, Homo Sapiens
GSYFTKKAS

SEQ ID NO: 820947 - protein, 9 aa, Homo Sapiens
VLVHDVALE

SEQ ID NO: 820948 - protein, 9 aa, Homo Sapiens
SHQYDQIYC

SEQ ID NO: 820949 - protein, 9 aa, Homo Sapiens
LYYLRIHML

SEQ ID NO: 820950 - protein, 9 aa, Homo Sapiens
RTIQKAWRC

SEQ ID NO: 820951 - protein, 9 aa, Homo Sapiens
GLPDRTGAP

SEQ ID NO: 820952 - protein, 9 aa, Homo Sapiens
KDTYDSTSE

SEQ ID NO: 820953 - protein, 9 aa, Homo Sapiens
KDLKTKLNS

SEQ ID NO: 820954 - protein, 9 aa, Homo Sapiens
GKLRFRASE

SEQ ID NO: 820955 - protein, 9 aa, Homo Sapiens
CIKHIALKT

SEQ ID NO: 820956 - protein, 9 aa, Homo Sapiens
SLEELTCLA

SEQ ID NO: 820957 - protein, 9 aa, Homo Sapiens
WLANKLRGN

SEQ ID NO: 820958 - protein, 9 aa, Homo Sapiens
LATTSNSLL

SEQ ID NO: 820959 - protein, 9 aa, Homo Sapiens
NEEIFPQIK

SEQ ID NO: 820960 - protein, 9 aa, Homo Sapiens
YALQSFNHE

SEQ ID NO: 820961 - protein, 9 aa, Homo Sapiens
KHRTGSRLG

SEQ ID NO: 820962 - protein, 9 aa, Homo Sapiens
PVDSTLRYF

SEQ ID NO: 820963 - protein, 9 aa, Homo Sapiens
EIGVSSVTD

SEQ ID NO: 820964 - protein, 9 aa, Homo Sapiens
LHKIIHSGQ

SEQ ID NO: 820965 - protein, 9 aa, Homo Sapiens
SASQDCIKT

SEQ ID NO: 820966 - protein, 9 aa, Homo Sapiens
PPPDLIPKM

SEQ ID NO: 820967 - protein, 9 aa, Homo Sapiens
MGKTIEGMT

SEQ ID NO: 820968 - protein, 9 aa, Homo Sapiens
ELMENYQDA

SEQ ID NO: 820969 - protein, 9 aa, Homo Sapiens
RPPPRHQNT

SEQ ID NO: 820970 - protein, 9 aa, Homo Sapiens
CYICYRQML

SEQ ID NO: 820971 - protein, 9 aa, Homo Sapiens
LEPKIYLSN

SEQ ID NO: 820972 - protein, 9 aa, Homo Sapiens
VRSYLLVAC

SEQ ID NO: 820973 - protein, 9 aa, Homo Sapiens
EDNGNHIKK

SEQ ID NO: 820974 - protein, 9 aa, Homo Sapiens
PKVCCNYSL

SEQ ID NO: 820975 - protein, 9 aa, Homo Sapiens
NNVFVFPGG

SEQ ID NO: 820976 - protein, 9 aa, Homo Sapiens
RLLKKQFFN

SEQ ID NO: 820977 - protein, 9 aa, Homo Sapiens
ETLREFLKL

SEQ ID NO: 820978 - protein, 9 aa, Homo Sapiens
VILMMLRYH

SEQ ID NO: 820979 - protein, 9 aa, Homo Sapiens
LLADHAPGV

SEQ ID NO: 820980 - protein, 9 aa, Homo Sapiens
LFQSSPERN

SEQ ID NO: 820981 - protein, 9 aa, Homo Sapiens
PFLLFFLYS

SEQ ID NO: 820982 - protein, 9 aa, Homo Sapiens
FHDFSVIFS

SEQ ID NO: 820983 - protein, 9 aa, Homo Sapiens
AYTEDQNSL

SEQ ID NO: 820984 - protein, 9 aa, Homo Sapiens
QTWRRKGSF

SEQ ID NO: 820985 - protein, 9 aa, Homo Sapiens
EVYHLSYLH

SEQ ID NO: 820986 - protein, 9 aa, Homo Sapiens
TCINLLKLP

SEQ ID NO: 820987 - protein, 9 aa, Homo Sapiens
TTKPTKSEF

SEQ ID NO: 820988 - protein, 9 aa, Homo Sapiens
LKQACLPSG

SEQ ID NO: 820989 - protein, 9 aa, Homo Sapiens
NSGNQLLGT

SEQ ID NO: 820990 - protein, 9 aa, Homo Sapiens
IVNSVPMIL

SEQ ID NO: 820991 - protein, 9 aa, Homo Sapiens
SLGHTSIRR

SEQ ID NO: 820992 - protein, 9 aa, Homo Sapiens
WSRAAFLPL

SEQ ID NO: 820993 - protein, 9 aa, Homo Sapiens
IYTSENDLN

SEQ ID NO: 820994 - protein, 9 aa, Homo Sapiens
MIERGLIPS

SEQ ID NO: 820995 - protein, 9 aa, Homo Sapiens
EKDWCDWTM

SEQ ID NO: 820996 - protein, 9 aa, Homo Sapiens
CPQPCRCPA

SEQ ID NO: 820997 - protein, 9 aa, Homo Sapiens
GSQTGRKQH

SEQ ID NO: 820998 - protein, 9 aa, Homo Sapiens
SKYDSVINH

SEQ ID NO: 820999 - protein, 9 aa, Homo Sapiens
GRAAATSMF

SEQ ID NO: 821000 - protein, 9 aa, Homo Sapiens
DLYDGSYDD

SEQ ID NO: 821001 - protein, 9 aa, Homo Sapiens
PIRLQNIPF

SEQ ID NO: 821002 - protein, 9 aa, Homo Sapiens
KLEDWARWA

SEQ ID NO: 821003 - protein, 9 aa, Homo Sapiens
PIMYSFRNK

SEQ ID NO: 821004 - protein, 9 aa, Homo Sapiens
ETSTLSSKS

SEQ ID NO: 821005 - protein, 9 aa, Homo Sapiens
DDLFGMGKE

SEQ ID NO: 821006 - protein, 9 aa, Homo Sapiens
CEGLGPKVE

SEQ ID NO: 821007 - protein, 9 aa, Homo Sapiens
AMPTHKNLC

SEQ ID NO: 821008 - protein, 9 aa, Homo Sapiens
SPSQKPQIC

SEQ ID NO: 821009 - protein, 9 aa, Homo Sapiens
YNQYSYGSS

SEQ ID NO: 821010 - protein, 9 aa, Homo Sapiens
SEHAKIEEN

SEQ ID NO: 821011 - protein, 9 aa, Homo Sapiens
LEILQICQR

SEQ ID NO: 821012 - protein, 9 aa, Homo Sapiens
LLFYITIIA

SEQ ID NO: 821013 - protein, 9 aa, Homo Sapiens
QEKSGKDKS

SEQ ID NO: 821014 - protein, 9 aa, Homo Sapiens
DKLEARLNI

SEQ ID NO: 821015 - protein, 9 aa, Homo Sapiens
VSSKEIAIT

SEQ ID NO: 821016 - protein, 9 aa, Homo Sapiens
SVYPEATQI

SEQ ID NO: 821017 - protein, 9 aa, Homo Sapiens
MYLSWNPGL

SEQ ID NO: 821018 - protein, 9 aa, Homo Sapiens
AELAGLEFP

SEQ ID NO: 821019 - protein, 9 aa, Homo Sapiens
RITMLNRKC

SEQ ID NO: 821020 - protein, 9 aa, Homo Sapiens
AADQDKNPE

SEQ ID NO: 821021 - protein, 9 aa, Homo Sapiens
KYLDREGTP

SEQ ID NO: 821022 - protein, 9 aa, Homo Sapiens
AYESQGAVP

SEQ ID NO: 821023 - protein, 9 aa, Homo Sapiens
SVLTDPAEL

SEQ ID NO: 821024 - protein, 9 aa, Homo Sapiens
WIIGVCSES

SEQ ID NO: 821025 - protein, 9 aa, Homo Sapiens
ESVKKPIHK

SEQ ID NO: 821026 - protein, 9 aa, Homo Sapiens
DLMTYLDKA

SEQ ID NO: 821027 - protein, 9 aa, Homo Sapiens
GQITNLKAE

SEQ ID NO: 821028 - protein, 9 aa, Homo Sapiens
EDEFSPLNN

SEQ ID NO: 821029 - protein, 9 aa, Homo Sapiens
PVEVRPRKC

SEQ ID NO: 821030 - protein, 9 aa, Homo Sapiens
SSLPLPILA

SEQ ID NO: 821031 - protein, 9 aa, Homo Sapiens
RAKFCKQER

SEQ ID NO: 821032 - protein, 9 aa, Homo Sapiens
EGNIYECNQ

SEQ ID NO: 821033 - protein, 9 aa, Homo Sapiens
ESKHPTCPN

SEQ ID NO: 821034 - protein, 9 aa, Homo Sapiens
KKKSDPLAW

SEQ ID NO: 821035 - protein, 9 aa, Homo Sapiens
GQFTSSSIG

SEQ ID NO: 821036 - protein, 9 aa, Homo Sapiens
ENNIEHIPK

SEQ ID NO: 821037 - protein, 9 aa, Homo Sapiens
NLIPSIKTP

SEQ ID NO: 821038 - protein, 9 aa, Homo Sapiens
EYVRQLLLT

SEQ ID NO: 821039 - protein, 9 aa, Homo Sapiens
VARLTREKE

SEQ ID NO: 821040 - protein, 9 aa, Homo Sapiens
VSWADLVYS

SEQ ID NO: 821041 - protein, 9 aa, Homo Sapiens
PEETSEEKR

SEQ ID NO: 821042 - protein, 9 aa, Homo Sapiens
TGDAGEMVR

SEQ ID NO: 821043 - protein, 9 aa, Homo Sapiens
FHTSLLLEG

SEQ ID NO: 821044 - protein, 9 aa, Homo Sapiens
RMIQRLMQQ

SEQ ID NO: 821045 - protein, 9 aa, Homo Sapiens
YSFFHDAEE

SEQ ID NO: 821046 - protein, 9 aa, Homo Sapiens
EVCRFLFLG

SEQ ID NO: 821047 - protein, 9 aa, Homo Sapiens
SNKPEIPTF

SEQ ID NO: 821048 - protein, 9 aa, Homo Sapiens
DTKENNGVL

SEQ ID NO: 821049 - protein, 9 aa, Homo Sapiens
YGDGDSDEG

SEQ ID NO: 821050 - protein, 9 aa, Homo Sapiens
KQIHLKKKS

SEQ ID NO: 821051 - protein, 9 aa, Homo Sapiens
DDGFPSNVL

SEQ ID NO: 821052 - protein, 9 aa, Homo Sapiens
SVLLWDKIH

SEQ ID NO: 821053 - protein, 9 aa, Homo Sapiens
SGFLARKMH

SEQ ID NO: 821054 - protein, 9 aa, Homo Sapiens
SATLLNYPD

SEQ ID NO: 821055 - protein, 9 aa, Homo Sapiens
AAVVHKEPT

SEQ ID NO: 821056 - protein, 9 aa, Homo Sapiens
SNNIFIHEG

SEQ ID NO: 821057 - protein, 9 aa, Homo Sapiens
LKHHRLHTQ

SEQ ID NO: 821058 - protein, 9 aa, Homo Sapiens
PEEPQTLVT

SEQ ID NO: 821059 - protein, 9 aa, Homo Sapiens
HKSEGNYLI

SEQ ID NO: 821060 - protein, 9 aa, Homo Sapiens
VTAPYKYPS

SEQ ID NO: 821061 - protein, 9 aa, Homo Sapiens
PRAHSSPVT

SEQ ID NO: 821062 - protein, 9 aa, Homo Sapiens
SINGIIISV

SEQ ID NO: 821063 - protein, 9 aa, Homo Sapiens
ESSSETSTL

SEQ ID NO: 821064 - protein, 9 aa, Homo Sapiens
YYVSNKLFM

SEQ ID NO: 821065 - protein, 9 aa, Homo Sapiens
HIHLPYWRQ

SEQ ID NO: 821066 - protein, 9 aa, Homo Sapiens
QSVLLELDN

SEQ ID NO: 821067 - protein, 9 aa, Homo Sapiens
IGWLEDLLM

SEQ ID NO: 821068 - protein, 9 aa, Homo Sapiens
RYINNLVKH

SEQ ID NO: 821069 - protein, 9 aa, Homo Sapiens
TYTGHNNEK

SEQ ID NO: 821070 - protein, 9 aa, Homo Sapiens
LYHVYSFHN

SEQ ID NO: 821071 - protein, 9 aa, Homo Sapiens
AWGVGKSAM

SEQ ID NO: 821072 - protein, 9 aa, Homo Sapiens
EQENKLQNT

SEQ ID NO: 821073 - protein, 9 aa, Homo Sapiens
KIDYILEVV

SEQ ID NO: 821074 - protein, 9 aa, Homo Sapiens
DWWDAEKCD

SEQ ID NO: 821075 - protein, 9 aa, Homo Sapiens
KCKEETCTY

SEQ ID NO: 821076 - protein, 9 aa, Homo Sapiens
ELEPFRLFI

SEQ ID NO: 821077 - protein, 9 aa, Homo Sapiens
DRVPSDGVA

SEQ ID NO: 821078 - protein, 9 aa, Homo Sapiens
ASDSINPMY

SEQ ID NO: 821079 - protein, 9 aa, Homo Sapiens
LKPLHTSIP

SEQ ID NO: 821080 - protein, 9 aa, Homo Sapiens
KKTHASAPV

SEQ ID NO: 821081 - protein, 9 aa, Homo Sapiens
KMKAPVLPE

SEQ ID NO: 821082 - protein, 9 aa, Homo Sapiens
ELERQQRLL

SEQ ID NO: 821083 - protein, 9 aa, Homo Sapiens
HILKRVRRK

SEQ ID NO: 821084 - protein, 9 aa, Homo Sapiens
IHNVPEGFA

SEQ ID NO: 821085 - protein, 9 aa, Homo Sapiens
ADGANNYFE

SEQ ID NO: 821086 - protein, 9 aa, Homo Sapiens
QETDHDQEV

SEQ ID NO: 821087 - protein, 9 aa, Homo Sapiens
WATTSVPIE

SEQ ID NO: 821088 - protein, 9 aa, Homo Sapiens
YLKQSVSIR

SEQ ID NO: 821089 - protein, 9 aa, Homo Sapiens
CYTKFSDHV

SEQ ID NO: 821090 - protein, 9 aa, Homo Sapiens
RAEDAGFVV

SEQ ID NO: 821091 - protein, 9 aa, Homo Sapiens
MAIDKLSWG

SEQ ID NO: 821092 - protein, 9 aa, Homo Sapiens
NNGNANILV

SEQ ID NO: 821093 - protein, 9 aa, Homo Sapiens
LSTGLDTML

SEQ ID NO: 821094 - protein, 9 aa, Homo Sapiens
APRAKIFWR

SEQ ID NO: 821095 - protein, 9 aa, Homo Sapiens
EEGLGFNSM

SEQ ID NO: 821096 - protein, 9 aa, Homo Sapiens
LIKYIKRKA

SEQ ID NO: 821097 - protein, 9 aa, Homo Sapiens
GRFLKQVIE

SEQ ID NO: 821098 - protein, 9 aa, Homo Sapiens
QNHSSTSSG

SEQ ID NO: 821099 - protein, 9 aa, Homo Sapiens
KDYHSLTTN

SEQ ID NO: 821100 - protein, 9 aa, Homo Sapiens
VTNEPTAAA

SEQ ID NO: 821101 - protein, 9 aa, Homo Sapiens
ERFQHVIET

SEQ ID NO: 821102 - protein, 9 aa, Homo Sapiens
SGICTFISG

SEQ ID NO: 821103 - protein, 9 aa, Homo Sapiens
NPDVDHCCK

SEQ ID NO: 821104 - protein, 9 aa, Homo Sapiens
RSPPAKAEK

SEQ ID NO: 821105 - protein, 9 aa, Homo Sapiens
TVSERNDQK

SEQ ID NO: 821106 - protein, 9 aa, Homo Sapiens
LGKHLQFPG

SEQ ID NO: 821107 - protein, 9 aa, Homo Sapiens
TETVEEVAA

SEQ ID NO: 821108 - protein, 9 aa, Homo Sapiens
QFFNRALKV

SEQ ID NO: 821109 - protein, 9 aa, Homo Sapiens
QNKPREKTV

SEQ ID NO: 821110 - protein, 9 aa, Homo Sapiens
NSIFSNMGA

SEQ ID NO: 821111 - protein, 9 aa, Homo Sapiens
QNEKNVSIE

SEQ ID NO: 821112 - protein, 9 aa, Homo Sapiens
IKWIYDEPQ

SEQ ID NO: 821113 - protein, 9 aa, Homo Sapiens
VPDGPWRQS

SEQ ID NO: 821114 - protein, 9 aa, Homo Sapiens
QVSGNLLRK

SEQ ID NO: 821115 - protein, 9 aa, Homo Sapiens
ISKAKGTGV

SEQ ID NO: 821116 - protein, 9 aa, Homo Sapiens
HNRQGIFVD

SEQ ID NO: 821117 - protein, 9 aa, Homo Sapiens
TGDHVQSEN

SEQ ID NO: 821118 - protein, 9 aa, Homo Sapiens
SCAREQINS

SEQ ID NO: 821119 - protein, 9 aa, Homo Sapiens
GRHCVTRRE

SEQ ID NO: 821120 - protein, 9 aa, Homo Sapiens
KYQAVLSQP

SEQ ID NO: 821121 - protein, 9 aa, Homo Sapiens
NKRLQLKQA

SEQ ID NO: 821122 - protein, 9 aa, Homo Sapiens
MRMLYDLHS

SEQ ID NO: 821123 - protein, 9 aa, Homo Sapiens
STSLIRHAI

SEQ ID NO: 821124 - protein, 9 aa, Homo Sapiens
CDPKTGECL

SEQ ID NO: 821125 - protein, 9 aa, Homo Sapiens
DALRTSGGD

SEQ ID NO: 821126 - protein, 9 aa, Homo Sapiens
DNWSTFHPR

SEQ ID NO: 821127 - protein, 9 aa, Homo Sapiens
NKQHKRKLK

SEQ ID NO: 821128 - protein, 9 aa, Homo Sapiens
LSHTKHDRN

SEQ ID NO: 821129 - protein, 9 aa, Homo Sapiens
ASEMLLLTV

SEQ ID NO: 821130 - protein, 9 aa, Homo Sapiens
DKISLHFQL

SEQ ID NO: 821131 - protein, 9 aa, Homo Sapiens
KYPSKVAFV

SEQ ID NO: 821132 - protein, 9 aa, Homo Sapiens
GLIPSTARI

SEQ ID NO: 821133 - protein, 9 aa, Homo Sapiens
IGSLLGIAV

SEQ ID NO: 821134 - protein, 9 aa, Homo Sapiens
GHGNSPLFF

SEQ ID NO: 821135 - protein, 9 aa, Homo Sapiens
DGKNKSEYT

SEQ ID NO: 821136 - protein, 9 aa, Homo Sapiens
PQAVTYAAV

SEQ ID NO: 821137 - protein, 9 aa, Homo Sapiens
FNCRIYLIQ

SEQ ID NO: 821138 - protein, 9 aa, Homo Sapiens
LVNRSIRQG

SEQ ID NO: 821139 - protein, 9 aa, Homo Sapiens
ILNVFCCPH

SEQ ID NO: 821140 - protein, 9 aa, Homo Sapiens
QFYYSAKAV

SEQ ID NO: 821141 - protein, 9 aa, Homo Sapiens
WFPYCQSHV

SEQ ID NO: 821142 - protein, 9 aa, Homo Sapiens
QNKLLEPNS

SEQ ID NO: 821143 - protein, 9 aa, Homo Sapiens
FLGVVDLTT

SEQ ID NO: 821144 - protein, 9 aa, Homo Sapiens
IPGYKPMHD

SEQ ID NO: 821145 - protein, 9 aa, Homo Sapiens
KRNLIVHQI

SEQ ID NO: 821146 - protein, 9 aa, Homo Sapiens
HRESLMAAL

SEQ ID NO: 821147 - protein, 9 aa, Homo Sapiens
MLFRLAAVW

SEQ ID NO: 821148 - protein, 9 aa, Homo Sapiens
PSDINEFDP

SEQ ID NO: 821149 - protein, 9 aa, Homo Sapiens
KHFEKINSE

SEQ ID NO: 821150 - protein, 9 aa, Homo Sapiens
AVAERVGTH

SEQ ID NO: 821151 - protein, 9 aa, Homo Sapiens
IQTGIYPID

SEQ ID NO: 821152 - protein, 9 aa, Homo Sapiens
VKLLYTIQE

SEQ ID NO: 821153 - protein, 9 aa, Homo Sapiens
PETFDFNIK

SEQ ID NO: 821154 - protein, 9 aa, Homo Sapiens
VLADSSRHS

SEQ ID NO: 821155 - protein, 9 aa, Homo Sapiens
MMGTFAKVR

SEQ ID NO: 821156 - protein, 9 aa, Homo Sapiens
PDSQFPAWR

SEQ ID NO: 821157 - protein, 9 aa, Homo Sapiens
FKDELLCAV

SEQ ID NO: 821158 - protein, 9 aa, Homo Sapiens
DFISGFNMG

SEQ ID NO: 821159 - protein, 9 aa, Homo Sapiens
LKELCVYHS

SEQ ID NO: 821160 - protein, 9 aa, Homo Sapiens
IGSTSNHVV

SEQ ID NO: 821161 - protein, 9 aa, Homo Sapiens
EIRNCWSPV

SEQ ID NO: 821162 - protein, 9 aa, Homo Sapiens
QEEGKGPEG

SEQ ID NO: 821163 - protein, 9 aa, Homo Sapiens
NRVLEIHNE

SEQ ID NO: 821164 - protein, 9 aa, Homo Sapiens
EEMQQRADQ

SEQ ID NO: 821165 - protein, 9 aa, Homo Sapiens
TVNMSWAKP

SEQ ID NO: 821166 - protein, 9 aa, Homo Sapiens
YLWAQKKHK

SEQ ID NO: 821167 - protein, 9 aa, Homo Sapiens
ESDSAVKML

SEQ ID NO: 821168 - protein, 9 aa, Homo Sapiens
VDLNRPEDV

SEQ ID NO: 821169 - protein, 9 aa, Homo Sapiens
NIGLPISPF

SEQ ID NO: 821170 - protein, 9 aa, Homo Sapiens
ARIGAHITT

SEQ ID NO: 821171 - protein, 9 aa, Homo Sapiens
ICLVLRQSF

SEQ ID NO: 821172 - protein, 9 aa, Homo Sapiens
NRKVQEPQG

SEQ ID NO: 821173 - protein, 9 aa, Homo Sapiens
EMAFHTEMG

SEQ ID NO: 821174 - protein, 9 aa, Homo Sapiens
SRGLVLKIF

SEQ ID NO: 821175 - protein, 9 aa, Homo Sapiens
FLSANALGK

SEQ ID NO: 821176 - protein, 9 aa, Homo Sapiens
ATVVVPCLS

SEQ ID NO: 821177 - protein, 9 aa, Homo Sapiens
GLGACLGPQ

SEQ ID NO: 821178 - protein, 9 aa, Homo Sapiens
ICGSRKMPL

SEQ ID NO: 821179 - protein, 9 aa, Homo Sapiens
SHCFQTHER

SEQ ID NO: 821180 - protein, 9 aa, Homo Sapiens
GLITSSWGG

SEQ ID NO: 821181 - protein, 9 aa, Homo Sapiens
LLQFVMGSS

SEQ ID NO: 821182 - protein, 9 aa, Homo Sapiens
SRPQTTQAD

SEQ ID NO: 821183 - protein, 9 aa, Homo Sapiens
FMALSAQLL

SEQ ID NO: 821184 - protein, 9 aa, Homo Sapiens
APEQSFKKT

SEQ ID NO: 821185 - protein, 9 aa, Homo Sapiens
AGVDFELVG

SEQ ID NO: 821186 - protein, 9 aa, Homo Sapiens
AYVKNNLSI

SEQ ID NO: 821187 - protein, 9 aa, Homo Sapiens
KIELPSSTS

SEQ ID NO: 821188 - protein, 9 aa, Homo Sapiens
LLRNNGLND

SEQ ID NO: 821189 - protein, 9 aa, Homo Sapiens
QFILGRAPY

SEQ ID NO: 821190 - protein, 9 aa, Homo Sapiens
TEQGFYVRL

SEQ ID NO: 821191 - protein, 9 aa, Homo Sapiens
PSQRCVTFH

SEQ ID NO: 821192 - protein, 9 aa, Homo Sapiens
GAYPIGTTA

SEQ ID NO: 821193 - protein, 9 aa, Homo Sapiens
CKTFRPAAM

SEQ ID NO: 821194 - protein, 9 aa, Homo Sapiens
RSTCCQTTC

SEQ ID NO: 821195 - protein, 9 aa, Homo Sapiens
ARPAGPVDN

SEQ ID NO: 821196 - protein, 9 aa, Homo Sapiens
DSKGVDTVV

SEQ ID NO: 821197 - protein, 9 aa, Homo Sapiens
EEVQSNAFN

SEQ ID NO: 821198 - protein, 9 aa, Homo Sapiens
LEKARKIFR

SEQ ID NO: 821199 - protein, 9 aa, Homo Sapiens
PGSLDIPKD

SEQ ID NO: 821200 - protein, 9 aa, Homo Sapiens
GAEPDKMGG

SEQ ID NO: 821201 - protein, 9 aa, Homo Sapiens
SRTVLFEWE

SEQ ID NO: 821202 - protein, 9 aa, Homo Sapiens
SVQQHKGSL

SEQ ID NO: 821203 - protein, 9 aa, Homo Sapiens
DTLPQGSAP

SEQ ID NO: 821204 - protein, 9 aa, Homo Sapiens
SIIVGIDYN

SEQ ID NO: 821205 - protein, 9 aa, Homo Sapiens
RVDNLFRSC

SEQ ID NO: 821206 - protein, 9 aa, Homo Sapiens
ISVVTKREH

SEQ ID NO: 821207 - protein, 9 aa, Homo Sapiens
EMDLAYTSY

SEQ ID NO: 821208 - protein, 9 aa, Homo Sapiens
KTHDKDLRE

SEQ ID NO: 821209 - protein, 9 aa, Homo Sapiens
AKLPNGSSS

SEQ ID NO: 821210 - protein, 9 aa, Homo Sapiens
TPYTDSDKL

SEQ ID NO: 821211 - protein, 9 aa, Homo Sapiens
SNQQRLGKT

SEQ ID NO: 821212 - protein, 9 aa, Homo Sapiens
KQNFEYLHC

SEQ ID NO: 821213 - protein, 9 aa, Homo Sapiens
KENDFSPEA

SEQ ID NO: 821214 - protein, 9 aa, Homo Sapiens
ENGELYLRQ

SEQ ID NO: 821215 - protein, 9 aa, Homo Sapiens
DTVRALSHP

SEQ ID NO: 821216 - protein, 9 aa, Homo Sapiens
FHLDRIMDF

SEQ ID NO: 821217 - protein, 9 aa, Homo Sapiens
KISDSISKF

SEQ ID NO: 821218 - protein, 9 aa, Homo Sapiens
KFAEWCLEH

SEQ ID NO: 821219 - protein, 9 aa, Homo Sapiens
TEIDILNKR

SEQ ID NO: 821220 - protein, 9 aa, Homo Sapiens
VYPEATQII

SEQ ID NO: 821221 - protein, 9 aa, Homo Sapiens
NVQVLDLSE

SEQ ID NO: 821222 - protein, 9 aa, Homo Sapiens
RLDLDVSLQ

SEQ ID NO: 821223 - protein, 9 aa, Homo Sapiens
NTFLRQLCT

SEQ ID NO: 821224 - protein, 9 aa, Homo Sapiens
SKIKVLEFL

SEQ ID NO: 821225 - protein, 9 aa, Homo Sapiens
VHLAHHQQI

SEQ ID NO: 821226 - protein, 9 aa, Homo Sapiens
EFPCPTGSK

SEQ ID NO: 821227 - protein, 9 aa, Homo Sapiens
GKTSVKGVS

SEQ ID NO: 821228 - protein, 9 aa, Homo Sapiens
VSYAKWSYF

SEQ ID NO: 821229 - protein, 9 aa, Homo Sapiens
ISALCIFKI

SEQ ID NO: 821230 - protein, 9 aa, Homo Sapiens
LSICCGLDR

SEQ ID NO: 821231 - protein, 9 aa, Homo Sapiens
ILLKDAKED

SEQ ID NO: 821232 - protein, 9 aa, Homo Sapiens
VHLGADLKS

SEQ ID NO: 821233 - protein, 9 aa, Homo Sapiens
PGARLTCHI

SEQ ID NO: 821234 - protein, 9 aa, Homo Sapiens
LCAPKAVSA

SEQ ID NO: 821235 - protein, 9 aa, Homo Sapiens
LEYWMRLHF

SEQ ID NO: 821236 - protein, 9 aa, Homo Sapiens
VRESENSPG

SEQ ID NO: 821237 - protein, 9 aa, Homo Sapiens
EMKMSLFER

SEQ ID NO: 821238 - protein, 9 aa, Homo Sapiens
QDKASRKRQ

SEQ ID NO: 821239 - protein, 9 aa, Homo Sapiens
LISNKACGK

SEQ ID NO: 821240 - protein, 9 aa, Homo Sapiens
CKEETCTYA

SEQ ID NO: 821241 - protein, 9 aa, Homo Sapiens
YRGSSEAGA

SEQ ID NO: 821242 - protein, 9 aa, Homo Sapiens
KINLEIPGK

SEQ ID NO: 821243 - protein, 9 aa, Homo Sapiens
INSFVTDIF

SEQ ID NO: 821244 - protein, 9 aa, Homo Sapiens
LVTSTDFAY

SEQ ID NO: 821245 - protein, 9 aa, Homo Sapiens
RSEATPQYS

SEQ ID NO: 821246 - protein, 9 aa, Homo Sapiens
QQRSSPTHH

SEQ ID NO: 821247 - protein, 9 aa, Homo Sapiens
LNPYRYPDI

SEQ ID NO: 821248 - protein, 9 aa, Homo Sapiens
WDDRRRMPG

SEQ ID NO: 821249 - protein, 9 aa, Homo Sapiens
FPLKNAKDL

SEQ ID NO: 821250 - protein, 9 aa, Homo Sapiens
VFEKKLRIQ

SEQ ID NO: 821251 - protein, 9 aa, Homo Sapiens
NHSKLLFLK

SEQ ID NO: 821252 - protein, 9 aa, Homo Sapiens
CANYICSGT

SEQ ID NO: 821253 - protein, 9 aa, Homo Sapiens
PKCKLQVIG

SEQ ID NO: 821254 - protein, 9 aa, Homo Sapiens
VSRSGLYHS

SEQ ID NO: 821255 - protein, 9 aa, Homo Sapiens
VAVHGEEMY

SEQ ID NO: 821256 - protein, 9 aa, Homo Sapiens
NSVNLKNLK

SEQ ID NO: 821257 - protein, 9 aa, Homo Sapiens
IYLPSISLD

SEQ ID NO: 821258 - protein, 9 aa, Homo Sapiens
TSSSIGDVE

SEQ ID NO: 821259 - protein, 9 aa, Homo Sapiens
RRQDKAGPS

SEQ ID NO: 821260 - protein, 9 aa, Homo Sapiens
SHPSSFQNH

SEQ ID NO: 821261 - protein, 9 aa, Homo Sapiens
GTYKEKGIP

SEQ ID NO: 821262 - protein, 9 aa, Homo Sapiens
LQILSQLLL

SEQ ID NO: 821263 - protein, 9 aa, Homo Sapiens
LEEDLVSAI

SEQ ID NO: 821264 - protein, 9 aa, Homo Sapiens
ELASQGLNI

SEQ ID NO: 821265 - protein, 9 aa, Homo Sapiens
QAHAQEFLL

SEQ ID NO: 821266 - protein, 9 aa, Homo Sapiens
VNDLSKLAQ

SEQ ID NO: 821267 - protein, 9 aa, Homo Sapiens
QINYVIKEI

SEQ ID NO: 821268 - protein, 9 aa, Homo Sapiens
GMVQVVRLI

SEQ ID NO: 821269 - protein, 9 aa, Homo Sapiens
FAARPFSDP

SEQ ID NO: 821270 - protein, 9 aa, Homo Sapiens
KSFHLFGGF

SEQ ID NO: 821271 - protein, 9 aa, Homo Sapiens
DCSQLMALV

SEQ ID NO: 821272 - protein, 9 aa, Homo Sapiens
RDITQERMH

SEQ ID NO: 821273 - protein, 9 aa, Homo Sapiens
WNQYAPPEW

SEQ ID NO: 821274 - protein, 9 aa, Homo Sapiens
TGDANFTAT

SEQ ID NO: 821275 - protein, 9 aa, Homo Sapiens
DIVPLIQLS

SEQ ID NO: 821276 - protein, 9 aa, Homo Sapiens
MTNWSPAGD

SEQ ID NO: 821277 - protein, 9 aa, Homo Sapiens
LDARMPRKR

SEQ ID NO: 821278 - protein, 9 aa, Homo Sapiens
HLQLFKENI

SEQ ID NO: 821279 - protein, 9 aa, Homo Sapiens
ELTNITFGV

SEQ ID NO: 821280 - protein, 9 aa, Homo Sapiens
AGPGLQTHC

SEQ ID NO: 821281 - protein, 9 aa, Homo Sapiens
AISPLTFLS

SEQ ID NO: 821282 - protein, 9 aa, Homo Sapiens
FLGGLAFAI

SEQ ID NO: 821283 - protein, 9 aa, Homo Sapiens
SGICIKIAD

SEQ ID NO: 821284 - protein, 9 aa, Homo Sapiens
AFVKKSKQK

SEQ ID NO: 821285 - protein, 9 aa, Homo Sapiens
THFLRKEYG

SEQ ID NO: 821286 - protein, 9 aa, Homo Sapiens
GASDSNVYA

SEQ ID NO: 821287 - protein, 9 aa, Homo Sapiens
IAREKHQAS

SEQ ID NO: 821288 - protein, 9 aa, Homo Sapiens
HVSGIGGLL

SEQ ID NO: 821289 - protein, 9 aa, Homo Sapiens
SKSCTMHSL

SEQ ID NO: 821290 - protein, 9 aa, Homo Sapiens
SPKRNLFSR

SEQ ID NO: 821291 - protein, 9 aa, Homo Sapiens
VGLSLSAPF

SEQ ID NO: 821292 - protein, 9 aa, Homo Sapiens
LSNSSLSVS

SEQ ID NO: 821293 - protein, 9 aa, Homo Sapiens
TALLLIVSA

SEQ ID NO: 821294 - protein, 9 aa, Homo Sapiens
YVPNKALEL

SEQ ID NO: 821295 - protein, 9 aa, Homo Sapiens
PSLKWILSL

SEQ ID NO: 821296 - protein, 9 aa, Homo Sapiens
GSLDIPKDL

SEQ ID NO: 821297 - protein, 9 aa, Homo Sapiens
LFILTCMLG

SEQ ID NO: 821298 - protein, 9 aa, Homo Sapiens
KIAFEDSKV

SEQ ID NO: 821299 - protein, 9 aa, Homo Sapiens
LNGQEQRMN

SEQ ID NO: 821300 - protein, 9 aa, Homo Sapiens
PRIGDKNKV

SEQ ID NO: 821301 - protein, 9 aa, Homo Sapiens
IYSIFILYQ

SEQ ID NO: 821302 - protein, 9 aa, Homo Sapiens
PECINYYKL

SEQ ID NO: 821303 - protein, 9 aa, Homo Sapiens
STRITLLVH

SEQ ID NO: 821304 - protein, 9 aa, Homo Sapiens
FVSGITEIV

SEQ ID NO: 821305 - protein, 9 aa, Homo Sapiens
QLRIAFRSF

SEQ ID NO: 821306 - protein, 9 aa, Homo Sapiens
QRAITGTIS

SEQ ID NO: 821307 - protein, 9 aa, Homo Sapiens
VCFGAGCGM

SEQ ID NO: 821308 - protein, 9 aa, Homo Sapiens
TAIYAMVEG

SEQ ID NO: 821309 - protein, 9 aa, Homo Sapiens
RVGSGSLDS

SEQ ID NO: 821310 - protein, 9 aa, Homo Sapiens
PLGICAELT

SEQ ID NO: 821311 - protein, 9 aa, Homo Sapiens
YHLTETGNN

SEQ ID NO: 821312 - protein, 9 aa, Homo Sapiens
WYDIRSISF

SEQ ID NO: 821313 - protein, 9 aa, Homo Sapiens
GCLQDLRLN

SEQ ID NO: 821314 - protein, 9 aa, Homo Sapiens
TMKGNLKLH

SEQ ID NO: 821315 - protein, 9 aa, Homo Sapiens
EVTSKVEKS

SEQ ID NO: 821316 - protein, 9 aa, Homo Sapiens
NTILYYECM

SEQ ID NO: 821317 - protein, 9 aa, Homo Sapiens
TRGAPLISA

SEQ ID NO: 821318 - protein, 9 aa, Homo Sapiens
DTSRQISGG

SEQ ID NO: 821319 - protein, 9 aa, Homo Sapiens
KGKNNGKHN

SEQ ID NO: 821320 - protein, 9 aa, Homo Sapiens
RSILIDKST

SEQ ID NO: 821321 - protein, 9 aa, Homo Sapiens
LVKVLLYSL

SEQ ID NO: 821322 - protein, 9 aa, Homo Sapiens
SYYSLLIDG

SEQ ID NO: 821323 - protein, 9 aa, Homo Sapiens
IQELLAKLK

SEQ ID NO: 821324 - protein, 9 aa, Homo Sapiens
PLQTVEIET

SEQ ID NO: 821325 - protein, 9 aa, Homo Sapiens
DKYLAGQDA

SEQ ID NO: 821326 - protein, 9 aa, Homo Sapiens
AGQLGVELF

SEQ ID NO: 821327 - protein, 9 aa, Homo Sapiens
RDVRPNVLL

SEQ ID NO: 821328 - protein, 9 aa, Homo Sapiens
HASLYFAED

SEQ ID NO: 821329 - protein, 9 aa, Homo Sapiens
KAPDETIQS

SEQ ID NO: 821330 - protein, 9 aa, Homo Sapiens
WFSLASVVF

SEQ ID NO: 821331 - protein, 9 aa, Homo Sapiens
KWLDLSRIL

SEQ ID NO: 821332 - protein, 9 aa, Homo Sapiens
LEPLPSLEY

SEQ ID NO: 821333 - protein, 9 aa, Homo Sapiens
IWGMSHSPS

SEQ ID NO: 821334 - protein, 9 aa, Homo Sapiens
EITSEDMAD

SEQ ID NO: 821335 - protein, 9 aa, Homo Sapiens
IQLVGPSSD

SEQ ID NO: 821336 - protein, 9 aa, Homo Sapiens
EPLLVSFPE

SEQ ID NO: 821337 - protein, 9 aa, Homo Sapiens
GFYTKKQCR

SEQ ID NO: 821338 - protein, 9 aa, Homo Sapiens
YLVSRYLGV

SEQ ID NO: 821339 - protein, 9 aa, Homo Sapiens
CVTACPRQE

SEQ ID NO: 821340 - protein, 9 aa, Homo Sapiens
FMTSIPVNA

SEQ ID NO: 821341 - protein, 9 aa, Homo Sapiens
GCDVAYSTV

SEQ ID NO: 821342 - protein, 9 aa, Homo Sapiens
TPLRAAAYV

SEQ ID NO: 821343 - protein, 9 aa, Homo Sapiens
VINCSISDN

SEQ ID NO: 821344 - protein, 9 aa, Homo Sapiens
WEKKHRDRT

SEQ ID NO: 821345 - protein, 9 aa, Homo Sapiens
AGLNELSEY

SEQ ID NO: 821346 - protein, 9 aa, Homo Sapiens
VIRIKDGNG

SEQ ID NO: 821347 - protein, 9 aa, Homo Sapiens
ESASGEMWR

SEQ ID NO: 821348 - protein, 9 aa, Homo Sapiens
LSYSQISLA

SEQ ID NO: 821349 - protein, 9 aa, Homo Sapiens
LSRTPPDIA

SEQ ID NO: 821350 - protein, 9 aa, Homo Sapiens
KTSAVNNTK

SEQ ID NO: 821351 - protein, 9 aa, Homo Sapiens
PGYGEIGVS

SEQ ID NO: 821352 - protein, 9 aa, Homo Sapiens
DLDDNDDRE

SEQ ID NO: 821353 - protein, 9 aa, Homo Sapiens
INFSLSYSS

SEQ ID NO: 821354 - protein, 9 aa, Homo Sapiens
GSSLSGLLR

SEQ ID NO: 821355 - protein, 9 aa, Homo Sapiens
KLDLDKGPV

SEQ ID NO: 821356 - protein, 9 aa, Homo Sapiens
VYGHHHSQD

SEQ ID NO: 821357 - protein, 9 aa, Homo Sapiens
TCYWDSGNI

SEQ ID NO: 821358 - protein, 9 aa, Homo Sapiens
RISRIRAEY

SEQ ID NO: 821359 - protein, 9 aa, Homo Sapiens
LRCQELLDE

SEQ ID NO: 821360 - protein, 9 aa, Homo Sapiens
RLIEALKTT

SEQ ID NO: 821361 - protein, 9 aa, Homo Sapiens
KYSNSNIYK

SEQ ID NO: 821362 - protein, 9 aa, Homo Sapiens
HKAPVGQHL

SEQ ID NO: 821363 - protein, 9 aa, Homo Sapiens
SCPPQHCQQ

SEQ ID NO: 821364 - protein, 9 aa, Homo Sapiens
MKIKDNDII

SEQ ID NO: 821365 - protein, 9 aa, Homo Sapiens
LSLINNFQE

SEQ ID NO: 821366 - protein, 9 aa, Homo Sapiens
SMSLMAPTP

SEQ ID NO: 821367 - protein, 9 aa, Homo Sapiens
GVSDSLLLG

SEQ ID NO: 821368 - protein, 9 aa, Homo Sapiens
YRTTDFVVP

SEQ ID NO: 821369 - protein, 9 aa, Homo Sapiens
LIVGCDVAY

SEQ ID NO: 821370 - protein, 9 aa, Homo Sapiens
TIHQLLLLF

SEQ ID NO: 821371 - protein, 9 aa, Homo Sapiens
SGKAFGQSS

SEQ ID NO: 821372 - protein, 9 aa, Homo Sapiens
TKIAWRAAT

SEQ ID NO: 821373 - protein, 9 aa, Homo Sapiens
GHENFQNWL

SEQ ID NO: 821374 - protein, 9 aa, Homo Sapiens
SLEVSEQMK

SEQ ID NO: 821375 - protein, 9 aa, Homo Sapiens
YCGSREIAR

SEQ ID NO: 821376 - protein, 9 aa, Homo Sapiens
GVLAGLRGL

SEQ ID NO: 821377 - protein, 9 aa, Homo Sapiens
VVQCREDEC

SEQ ID NO: 821378 - protein, 9 aa, Homo Sapiens
FHYSRKIIH

SEQ ID NO: 821379 - protein, 9 aa, Homo Sapiens
TVVQDQVWN

SEQ ID NO: 821380 - protein, 9 aa, Homo Sapiens
PQSQSTPKQ

SEQ ID NO: 821381 - protein, 9 aa, Homo Sapiens
DALTEKFRT

SEQ ID NO: 821382 - protein, 9 aa, Homo Sapiens
CKVKKKSKE

SEQ ID NO: 821383 - protein, 9 aa, Homo Sapiens
VEEALSYTG

SEQ ID NO: 821384 - protein, 9 aa, Homo Sapiens
DYASVEYLP

SEQ ID NO: 821385 - protein, 9 aa, Homo Sapiens
MFASVYIYR

SEQ ID NO: 821386 - protein, 9 aa, Homo Sapiens
IILLTGLDN

SEQ ID NO: 821387 - protein, 9 aa, Homo Sapiens
VWHRKSLGR

SEQ ID NO: 821388 - protein, 9 aa, Homo Sapiens
KTWRNPWRC

SEQ ID NO: 821389 - protein, 9 aa, Homo Sapiens
AVEYSDLED

SEQ ID NO: 821390 - protein, 9 aa, Homo Sapiens
EISTVYAGT

SEQ ID NO: 821391 - protein, 9 aa, Homo Sapiens
KMPVAYQVY

SEQ ID NO: 821392 - protein, 9 aa, Homo Sapiens
HILNKAGET

SEQ ID NO: 821393 - protein, 9 aa, Homo Sapiens
GLGVPCVGG

SEQ ID NO: 821394 - protein, 9 aa, Homo Sapiens
AGTVKWADI

SEQ ID NO: 821395 - protein, 9 aa, Homo Sapiens
EGTSAKPSD

SEQ ID NO: 821396 - protein, 9 aa, Homo Sapiens
ILIERQDKS

SEQ ID NO: 821397 - protein, 9 aa, Homo Sapiens
NPAKELMVK

SEQ ID NO: 821398 - protein, 9 aa, Homo Sapiens
GHKLFRKII

SEQ ID NO: 821399 - protein, 9 aa, Homo Sapiens
ADVVQKLFE

SEQ ID NO: 821400 - protein, 9 aa, Homo Sapiens
VPEMFTKKS

SEQ ID NO: 821401 - protein, 9 aa, Homo Sapiens
AIELSQEEW

SEQ ID NO: 821402 - protein, 9 aa, Homo Sapiens
FLFRFIVLF

SEQ ID NO: 821403 - protein, 9 aa, Homo Sapiens
ELLSQVDKL

SEQ ID NO: 821404 - protein, 9 aa, Homo Sapiens
YLSKKCLSQ

SEQ ID NO: 821405 - protein, 9 aa, Homo Sapiens
AYNRCTFET

SEQ ID NO: 821406 - protein, 9 aa, Homo Sapiens
VLEERKSSA

SEQ ID NO: 821407 - protein, 9 aa, Homo Sapiens
DKDGHGNSP

SEQ ID NO: 821408 - protein, 9 aa, Homo Sapiens
YHEQLGMQA

SEQ ID NO: 821409 - protein, 9 aa, Homo Sapiens
QLKPLKNYR

SEQ ID NO: 821410 - protein, 9 aa, Homo Sapiens
GLLDPYSAF

SEQ ID NO: 821411 - protein, 9 aa, Homo Sapiens
DYLRELSQK

SEQ ID NO: 821412 - protein, 9 aa, Homo Sapiens
QNNTFPPSL

SEQ ID NO: 821413 - protein, 9 aa, Homo Sapiens
NLCKAMENF

SEQ ID NO: 821414 - protein, 9 aa, Homo Sapiens
NLYVHRIIH

SEQ ID NO: 821415 - protein, 9 aa, Homo Sapiens
IMRMCKNHS

SEQ ID NO: 821416 - protein, 9 aa, Homo Sapiens
HSLKHRVKN

SEQ ID NO: 821417 - protein, 9 aa, Homo Sapiens
RGITDGGDL

SEQ ID NO: 821418 - protein, 9 aa, Homo Sapiens
VFFGNNLNF

SEQ ID NO: 821419 - protein, 9 aa, Homo Sapiens
DRIIYVSLP

SEQ ID NO: 821420 - protein, 9 aa, Homo Sapiens
VLAAHILKA

SEQ ID NO: 821421 - protein, 9 aa, Homo Sapiens
DALLLQIPS

SEQ ID NO: 821422 - protein, 9 aa, Homo Sapiens
GYSFFHDAE

SEQ ID NO: 821423 - protein, 9 aa, Homo Sapiens
MNDQGLYSW

SEQ ID NO: 821424 - protein, 9 aa, Homo Sapiens
SQLQILSSV

SEQ ID NO: 821425 - protein, 9 aa, Homo Sapiens
LIQILMVVR

SEQ ID NO: 821426 - protein, 9 aa, Homo Sapiens
VKAVKFPNP

SEQ ID NO: 821427 - protein, 9 aa, Homo Sapiens
ILGTNEETL

SEQ ID NO: 821428 - protein, 9 aa, Homo Sapiens
APPSEPVSS

SEQ ID NO: 821429 - protein, 9 aa, Homo Sapiens
IHLSINFFL

SEQ ID NO: 821430 - protein, 9 aa, Homo Sapiens
RHQNTGPCL

SEQ ID NO: 821431 - protein, 9 aa, Homo Sapiens
MDYFPPPPP

SEQ ID NO: 821432 - protein, 9 aa, Homo Sapiens
VELDNVTRL

SEQ ID NO: 821433 - protein, 9 aa, Homo Sapiens
VCAILVFQF

SEQ ID NO: 821434 - protein, 9 aa, Homo Sapiens
ELFCEVDED

SEQ ID NO: 821435 - protein, 9 aa, Homo Sapiens
QEMAIYIIP

SEQ ID NO: 821436 - protein, 9 aa, Homo Sapiens
GCQIILFIN

SEQ ID NO: 821437 - protein, 9 aa, Homo Sapiens
KINNATITQ

SEQ ID NO: 821438 - protein, 9 aa, Homo Sapiens
TNGDGDITL

SEQ ID NO: 821439 - protein, 9 aa, Homo Sapiens
VLHGIRNTF

SEQ ID NO: 821440 - protein, 9 aa, Homo Sapiens
KKGKVKPEQ

SEQ ID NO: 821441 - protein, 9 aa, Homo Sapiens
DVPFDEGLP

SEQ ID NO: 821442 - protein, 9 aa, Homo Sapiens
EPSSRPQTL

SEQ ID NO: 821443 - protein, 9 aa, Homo Sapiens
ASQLGKRYN

SEQ ID NO: 821444 - protein, 9 aa, Homo Sapiens
EIGIAVQYA

SEQ ID NO: 821445 - protein, 9 aa, Homo Sapiens
FYISGFILQ

SEQ ID NO: 821446 - protein, 9 aa, Homo Sapiens
VINGKTHTA

SEQ ID NO: 821447 - protein, 9 aa, Homo Sapiens
ETDFVAKFY

SEQ ID NO: 821448 - protein, 9 aa, Homo Sapiens
KKDYLGKVT

SEQ ID NO: 821449 - protein, 9 aa, Homo Sapiens
LISAKPLDN

SEQ ID NO: 821450 - protein, 9 aa, Homo Sapiens
RRIWVDYSI

SEQ ID NO: 821451 - protein, 9 aa, Homo Sapiens
DSDYLRHYS

SEQ ID NO: 821452 - protein, 9 aa, Homo Sapiens
EPFEEKVAQ

SEQ ID NO: 821453 - protein, 9 aa, Homo Sapiens
ENQDLLGLP

SEQ ID NO: 821454 - protein, 9 aa, Homo Sapiens
TCSPINGSC

SEQ ID NO: 821455 - protein, 9 aa, Homo Sapiens
EFETAGLNK

SEQ ID NO: 821456 - protein, 9 aa, Homo Sapiens
CSLWGSWLP

SEQ ID NO: 821457 - protein, 9 aa, Homo Sapiens
LQPILFSLF

SEQ ID NO: 821458 - protein, 9 aa, Homo Sapiens
LYEGPFEYN

SEQ ID NO: 821459 - protein, 9 aa, Homo Sapiens
ASYMTSDRT

SEQ ID NO: 821460 - protein, 9 aa, Homo Sapiens
LTSEIFDSP

SEQ ID NO: 821461 - protein, 9 aa, Homo Sapiens
SPVTSIPFS

SEQ ID NO: 821462 - protein, 9 aa, Homo Sapiens
DIIITEHAN

SEQ ID NO: 821463 - protein, 9 aa, Homo Sapiens
DENKDEIEK

SEQ ID NO: 821464 - protein, 9 aa, Homo Sapiens
VAVCVSSPG

SEQ ID NO: 821465 - protein, 9 aa, Homo Sapiens
SEHCQDSMD

SEQ ID NO: 821466 - protein, 9 aa, Homo Sapiens
SVTGGAKNV

SEQ ID NO: 821467 - protein, 9 aa, Homo Sapiens
DKKGFYTKK

SEQ ID NO: 821468 - protein, 9 aa, Homo Sapiens
FARVPGLVG

SEQ ID NO: 821469 - protein, 9 aa, Homo Sapiens
ASSVQSHER

SEQ ID NO: 821470 - protein, 9 aa, Homo Sapiens
VTALIGWLF

SEQ ID NO: 821471 - protein, 9 aa, Homo Sapiens
SISDNKSEY

SEQ ID NO: 821472 - protein, 9 aa, Homo Sapiens
ACSCQRCTE

SEQ ID NO: 821473 - protein, 9 aa, Homo Sapiens
GVGYCQGMT

SEQ ID NO: 821474 - protein, 9 aa, Homo Sapiens
PSNQNVYPS

SEQ ID NO: 821475 - protein, 9 aa, Homo Sapiens
ENVDYVTLK

SEQ ID NO: 821476 - protein, 9 aa, Homo Sapiens
ATATAPTGQ

SEQ ID NO: 821477 - protein, 9 aa, Homo Sapiens
ALPTLTWFV

SEQ ID NO: 821478 - protein, 9 aa, Homo Sapiens
NYLINPLLY

SEQ ID NO: 821479 - protein, 9 aa, Homo Sapiens
KKQAKLEEI

SEQ ID NO: 821480 - protein, 9 aa, Homo Sapiens
MDTVLRSFD

SEQ ID NO: 821481 - protein, 9 aa, Homo Sapiens
EDKEEEEEN

SEQ ID NO: 821482 - protein, 9 aa, Homo Sapiens
CLHSKAVAI

SEQ ID NO: 821483 - protein, 9 aa, Homo Sapiens
NVAGGVKEE

SEQ ID NO: 821484 - protein, 9 aa, Homo Sapiens
SLVQAAEAQ

SEQ ID NO: 821485 - protein, 9 aa, Homo Sapiens
DFDEEPQAL

SEQ ID NO: 821486 - protein, 9 aa, Homo Sapiens
VAQAVCFLL

SEQ ID NO: 821487 - protein, 9 aa, Homo Sapiens
PPAPEQRKI

SEQ ID NO: 821488 - protein, 9 aa, Homo Sapiens
VVLDYISPG

SEQ ID NO: 821489 - protein, 9 aa, Homo Sapiens
PTPVEKKNK

SEQ ID NO: 821490 - protein, 9 aa, Homo Sapiens
GKKCTYAIK

SEQ ID NO: 821491 - protein, 9 aa, Homo Sapiens
VVLNQQGRP

SEQ ID NO: 821492 - protein, 9 aa, Homo Sapiens
DENPDFREI

SEQ ID NO: 821493 - protein, 9 aa, Homo Sapiens
THGLRHKCG

SEQ ID NO: 821494 - protein, 9 aa, Homo Sapiens
IVFPTDWMN

SEQ ID NO: 821495 - protein, 9 aa, Homo Sapiens
GAPGCTLVL

SEQ ID NO: 821496 - protein, 9 aa, Homo Sapiens
PFNKNNTFN

SEQ ID NO: 821497 - protein, 9 aa, Homo Sapiens
KMPEVRQSY

SEQ ID NO: 821498 - protein, 9 aa, Homo Sapiens
PIKEAVLYV

SEQ ID NO: 821499 - protein, 9 aa, Homo Sapiens
MATMGILLR

SEQ ID NO: 821500 - protein, 9 aa, Homo Sapiens
AKSKCIFMS

SEQ ID NO: 821501 - protein, 9 aa, Homo Sapiens
LAMQWPFCG

SEQ ID NO: 821502 - protein, 9 aa, Homo Sapiens
STDNFFLGL

SEQ ID NO: 821503 - protein, 9 aa, Homo Sapiens
AHNYDIPNL

SEQ ID NO: 821504 - protein, 9 aa, Homo Sapiens
YAWIFIAWS

SEQ ID NO: 821505 - protein, 9 aa, Homo Sapiens
SVDGIWLLG

SEQ ID NO: 821506 - protein, 9 aa, Homo Sapiens
EEARRAFNG

SEQ ID NO: 821507 - protein, 9 aa, Homo Sapiens
LAPAWHLLF

SEQ ID NO: 821508 - protein, 9 aa, Homo Sapiens
LPLTEGNAN

SEQ ID NO: 821509 - protein, 9 aa, Homo Sapiens
TSLAEILLS

SEQ ID NO: 821510 - protein, 9 aa, Homo Sapiens
MLSERLIEP

SEQ ID NO: 821511 - protein, 9 aa, Homo Sapiens
GKTTKMPCK

SEQ ID NO: 821512 - protein, 9 aa, Homo Sapiens
FIKKVAKTP

SEQ ID NO: 821513 - protein, 9 aa, Homo Sapiens
VTITLTNVN

SEQ ID NO: 821514 - protein, 9 aa, Homo Sapiens
VEKLSDLER

SEQ ID NO: 821515 - protein, 9 aa, Homo Sapiens
QFTHESDEE

SEQ ID NO: 821516 - protein, 9 aa, Homo Sapiens
SLDHPHCLP

SEQ ID NO: 821517 - protein, 9 aa, Homo Sapiens
VLGKGVKHQ

SEQ ID NO: 821518 - protein, 9 aa, Homo Sapiens
RIKKLEDKT

SEQ ID NO: 821519 - protein, 9 aa, Homo Sapiens
HHKGHFIYN

SEQ ID NO: 821520 - protein, 9 aa, Homo Sapiens
VNLKNLKQA

SEQ ID NO: 821521 - protein, 9 aa, Homo Sapiens
VSILYQKPN

SEQ ID NO: 821522 - protein, 9 aa, Homo Sapiens
HLKAPGHVS

SEQ ID NO: 821523 - protein, 9 aa, Homo Sapiens
LWSGTAYCR

SEQ ID NO: 821524 - protein, 9 aa, Homo Sapiens
FNREVDMYT

SEQ ID NO: 821525 - protein, 9 aa, Homo Sapiens
PLVLEAATF

SEQ ID NO: 821526 - protein, 9 aa, Homo Sapiens
FGAEELEYT

SEQ ID NO: 821527 - protein, 9 aa, Homo Sapiens
NNYFEHEEL

SEQ ID NO: 821528 - protein, 9 aa, Homo Sapiens
NLFSTDDSS

SEQ ID NO: 821529 - protein, 9 aa, Homo Sapiens
ISLNEAQEI

SEQ ID NO: 821530 - protein, 9 aa, Homo Sapiens
LEDKTLELE

SEQ ID NO: 821531 - protein, 9 aa, Homo Sapiens
HTGLYSKIF

SEQ ID NO: 821532 - protein, 9 aa, Homo Sapiens
YLAALSSVP

SEQ ID NO: 821533 - protein, 9 aa, Homo Sapiens
PSEAVFGNS

SEQ ID NO: 821534 - protein, 9 aa, Homo Sapiens
GTFGATYLQ

SEQ ID NO: 821535 - protein, 9 aa, Homo Sapiens
GQIFLDSED

SEQ ID NO: 821536 - protein, 9 aa, Homo Sapiens
YQKPNGTNP

SEQ ID NO: 821537 - protein, 9 aa, Homo Sapiens
SEVVKCGRN

SEQ ID NO: 821538 - protein, 9 aa, Homo Sapiens
DCLQWENVS

SEQ ID NO: 821539 - protein, 9 aa, Homo Sapiens
KAIRDKLQC

SEQ ID NO: 821540 - protein, 9 aa, Homo Sapiens
PQPGVFNST

SEQ ID NO: 821541 - protein, 9 aa, Homo Sapiens
NGSMKAALR

SEQ ID NO: 821542 - protein, 9 aa, Homo Sapiens
SADSIDIYI

SEQ ID NO: 821543 - protein, 9 aa, Homo Sapiens
AYLLRHPEE

SEQ ID NO: 821544 - protein, 9 aa, Homo Sapiens
LIQHQLFHT

SEQ ID NO: 821545 - protein, 9 aa, Homo Sapiens
GDCKCNVCK

SEQ ID NO: 821546 - protein, 9 aa, Homo Sapiens
SLKPVLQAW

SEQ ID NO: 821547 - protein, 9 aa, Homo Sapiens
ESKALVTMP

SEQ ID NO: 821548 - protein, 9 aa, Homo Sapiens
MVNKKGIAA

SEQ ID NO: 821549 - protein, 9 aa, Homo Sapiens
YHKHHDKFT

SEQ ID NO: 821550 - protein, 9 aa, Homo Sapiens
RLVRWLRRD

SEQ ID NO: 821551 - protein, 9 aa, Homo Sapiens
DKLIGNCLP

SEQ ID NO: 821552 - protein, 9 aa, Homo Sapiens
VTDSDEDIL

SEQ ID NO: 821553 - protein, 9 aa, Homo Sapiens
KEFSPDLGK

SEQ ID NO: 821554 - protein, 9 aa, Homo Sapiens
SQESLAVLN

SEQ ID NO: 821555 - protein, 9 aa, Homo Sapiens
RITEEERRV

SEQ ID NO: 821556 - protein, 9 aa, Homo Sapiens
AFRMLSSLP

SEQ ID NO: 821557 - protein, 9 aa, Homo Sapiens
IITKKKSDP

SEQ ID NO: 821558 - protein, 9 aa, Homo Sapiens
VQVPQHKLF

SEQ ID NO: 821559 - protein, 9 aa, Homo Sapiens
QESNAVHDS

SEQ ID NO: 821560 - protein, 9 aa, Homo Sapiens
WIQNGTKLE

SEQ ID NO: 821561 - protein, 9 aa, Homo Sapiens
MQCLEKEEN

SEQ ID NO: 821562 - protein, 9 aa, Homo Sapiens
TVPPKKSGI

SEQ ID NO: 821563 - protein, 9 aa, Homo Sapiens
SPPLGLGNK

SEQ ID NO: 821564 - protein, 9 aa, Homo Sapiens
HDERFLYMF

SEQ ID NO: 821565 - protein, 9 aa, Homo Sapiens
ALPSTLRQQ

SEQ ID NO: 821566 - protein, 9 aa, Homo Sapiens
CARRITRVQ

SEQ ID NO: 821567 - protein, 9 aa, Homo Sapiens
LYAMELHGF

SEQ ID NO: 821568 - protein, 9 aa, Homo Sapiens
TPTPGLYMG

SEQ ID NO: 821569 - protein, 9 aa, Homo Sapiens
KGQTYEKRI

SEQ ID NO: 821570 - protein, 9 aa, Homo Sapiens
AVNIVNSKA

SEQ ID NO: 821571 - protein, 9 aa, Homo Sapiens
SHTIQGTLS

SEQ ID NO: 821572 - protein, 9 aa, Homo Sapiens
LYWWLCWKL

SEQ ID NO: 821573 - protein, 9 aa, Homo Sapiens
SPAHIVIPL

SEQ ID NO: 821574 - protein, 9 aa, Homo Sapiens
RGRAWLCLA

SEQ ID NO: 821575 - protein, 9 aa, Homo Sapiens
IYPENATTN

SEQ ID NO: 821576 - protein, 9 aa, Homo Sapiens
YYCTTGHRL

SEQ ID NO: 821577 - protein, 9 aa, Homo Sapiens
TESLTRGAS

SEQ ID NO: 821578 - protein, 9 aa, Homo Sapiens
TGQLDCFKR

SEQ ID NO: 821579 - protein, 9 aa, Homo Sapiens
SPVRTLQSF

SEQ ID NO: 821580 - protein, 9 aa, Homo Sapiens
AHLDLSGNV

SEQ ID NO: 821581 - protein, 9 aa, Homo Sapiens
LRQQLCEIT

SEQ ID NO: 821582 - protein, 9 aa, Homo Sapiens
ECLTVHCMD

SEQ ID NO: 821583 - protein, 9 aa, Homo Sapiens
GTNDERAAQ

SEQ ID NO: 821584 - protein, 9 aa, Homo Sapiens
GYDFWYQPQ

SEQ ID NO: 821585 - protein, 9 aa, Homo Sapiens
KGNENGHFE

SEQ ID NO: 821586 - protein, 9 aa, Homo Sapiens
QFSTEITLD

SEQ ID NO: 821587 - protein, 9 aa, Homo Sapiens
GTHRPPALA

SEQ ID NO: 821588 - protein, 9 aa, Homo Sapiens
VATVPPTPQ

SEQ ID NO: 821589 - protein, 9 aa, Homo Sapiens
STTPNHAPM

SEQ ID NO: 821590 - protein, 9 aa, Homo Sapiens
LARHRRIHA

SEQ ID NO: 821591 - protein, 9 aa, Homo Sapiens
ISDCYVFFN

SEQ ID NO: 821592 - protein, 9 aa, Homo Sapiens
PDMEAGPPE

SEQ ID NO: 821593 - protein, 9 aa, Homo Sapiens
RRLLKHPNI

SEQ ID NO: 821594 - protein, 9 aa, Homo Sapiens
QPEWGSPKK

SEQ ID NO: 821595 - protein, 9 aa, Homo Sapiens
FLSRKRRQN

SEQ ID NO: 821596 - protein, 9 aa, Homo Sapiens
GSSFQKHSN

SEQ ID NO: 821597 - protein, 9 aa, Homo Sapiens
NHSYPKCFS

SEQ ID NO: 821598 - protein, 9 aa, Homo Sapiens
GVWVTTGIT

SEQ ID NO: 821599 - protein, 9 aa, Homo Sapiens
DEQRPGNIY

SEQ ID NO: 821600 - protein, 9 aa, Homo Sapiens
FCQEVVNLG

SEQ ID NO: 821601 - protein, 9 aa, Homo Sapiens
TMHRTQMKG

SEQ ID NO: 821602 - protein, 9 aa, Homo Sapiens
RNVTSKFPR

SEQ ID NO: 821603 - protein, 9 aa, Homo Sapiens
ITPKQNGLY

SEQ ID NO: 821604 - protein, 9 aa, Homo Sapiens
PCILSQAPD

SEQ ID NO: 821605 - protein, 9 aa, Homo Sapiens
MDIEEVKKL

SEQ ID NO: 821606 - protein, 9 aa, Homo Sapiens
ISVNKAPLE

SEQ ID NO: 821607 - protein, 9 aa, Homo Sapiens
HLYCRLKVH

SEQ ID NO: 821608 - protein, 9 aa, Homo Sapiens
KSEPTFAAR

SEQ ID NO: 821609 - protein, 9 aa, Homo Sapiens
VHSSPQAII

SEQ ID NO: 821610 - protein, 9 aa, Homo Sapiens
THRRMTITG

SEQ ID NO: 821611 - protein, 9 aa, Homo Sapiens
YNPKYFDWN

SEQ ID NO: 821612 - protein, 9 aa, Homo Sapiens
DNLALLTSL

SEQ ID NO: 821613 - protein, 9 aa, Homo Sapiens
LWEVMWTKL

SEQ ID NO: 821614 - protein, 9 aa, Homo Sapiens
TNILKMPMY

SEQ ID NO: 821615 - protein, 9 aa, Homo Sapiens
WRIKLGFTQ

SEQ ID NO: 821616 - protein, 9 aa, Homo Sapiens
IKQIRHQIL

SEQ ID NO: 821617 - protein, 9 aa, Homo Sapiens
GKVVQVYRN

SEQ ID NO: 821618 - protein, 9 aa, Homo Sapiens
RVARQRRHE

SEQ ID NO: 821619 - protein, 9 aa, Homo Sapiens
LACIIIDRY

SEQ ID NO: 821620 - protein, 9 aa, Homo Sapiens
DEPVVQGPD

SEQ ID NO: 821621 - protein, 9 aa, Homo Sapiens
RYYSDIGNM

SEQ ID NO: 821622 - protein, 9 aa, Homo Sapiens
PKIFWKNLA

SEQ ID NO: 821623 - protein, 9 aa, Homo Sapiens
LAAAAHSAP

SEQ ID NO: 821624 - protein, 9 aa, Homo Sapiens
CSAAGAILQ

SEQ ID NO: 821625 - protein, 9 aa, Homo Sapiens
HTMDCFEMC

SEQ ID NO: 821626 - protein, 9 aa, Homo Sapiens
KAKIKGYQC

SEQ ID NO: 821627 - protein, 9 aa, Homo Sapiens
RRQVGKAQM

SEQ ID NO: 821628 - protein, 9 aa, Homo Sapiens
GKKIVSYQA

SEQ ID NO: 821629 - protein, 9 aa, Homo Sapiens
NILRDDHAL

SEQ ID NO: 821630 - protein, 9 aa, Homo Sapiens
EHIDLGAYS

SEQ ID NO: 821631 - protein, 9 aa, Homo Sapiens
ERQVVDQIK

SEQ ID NO: 821632 - protein, 9 aa, Homo Sapiens
DKVEIGPVT

SEQ ID NO: 821633 - protein, 9 aa, Homo Sapiens
QIVLAVHYC

SEQ ID NO: 821634 - protein, 9 aa, Homo Sapiens
EEKFSYGYS

SEQ ID NO: 821635 - protein, 9 aa, Homo Sapiens
ALKTTRIRD

SEQ ID NO: 821636 - protein, 9 aa, Homo Sapiens
TMKMLERSN

SEQ ID NO: 821637 - protein, 9 aa, Homo Sapiens
FLDLLKQCL

SEQ ID NO: 821638 - protein, 9 aa, Homo Sapiens
GIQYFYSTF

SEQ ID NO: 821639 - protein, 9 aa, Homo Sapiens
NKSNLNYLD

SEQ ID NO: 821640 - protein, 9 aa, Homo Sapiens
MEQEKHNHQ

SEQ ID NO: 821641 - protein, 9 aa, Homo Sapiens
YDHYIAISQ

SEQ ID NO: 821642 - protein, 9 aa, Homo Sapiens
TDDNINPPA

SEQ ID NO: 821643 - protein, 9 aa, Homo Sapiens
RKHTGKKPY

SEQ ID NO: 821644 - protein, 9 aa, Homo Sapiens
RAEMTKNWS

SEQ ID NO: 821645 - protein, 9 aa, Homo Sapiens
QAVSPSQIW

SEQ ID NO: 821646 - protein, 9 aa, Homo Sapiens
IVTGSVIRK

SEQ ID NO: 821647 - protein, 9 aa, Homo Sapiens
AVCTTIQVQ

SEQ ID NO: 821648 - protein, 9 aa, Homo Sapiens
HLLCCCLSR

SEQ ID NO: 821649 - protein, 9 aa, Homo Sapiens
EYLGPPNHH

SEQ ID NO: 821650 - protein, 9 aa, Homo Sapiens
QQQHQEYQE

SEQ ID NO: 821651 - protein, 9 aa, Homo Sapiens
SVARLTREK

SEQ ID NO: 821652 - protein, 9 aa, Homo Sapiens
INEDNKRWE

SEQ ID NO: 821653 - protein, 9 aa, Homo Sapiens
FGDLSGLHS

SEQ ID NO: 821654 - protein, 9 aa, Homo Sapiens
RKNHCSRLT

SEQ ID NO: 821655 - protein, 9 aa, Homo Sapiens
KQKAQDEPS

SEQ ID NO: 821656 - protein, 9 aa, Homo Sapiens
QDNKGRPFV

SEQ ID NO: 821657 - protein, 9 aa, Homo Sapiens
RRHDIQNQL

SEQ ID NO: 821658 - protein, 9 aa, Homo Sapiens
TCDKLRVHP

SEQ ID NO: 821659 - protein, 9 aa, Homo Sapiens
SSIGYRALQ

SEQ ID NO: 821660 - protein, 9 aa, Homo Sapiens
SSFSDADIQ

SEQ ID NO: 821661 - protein, 9 aa, Homo Sapiens
GLLGLPAPN

SEQ ID NO: 821662 - protein, 9 aa, Homo Sapiens
NFQEEQINA

SEQ ID NO: 821663 - protein, 9 aa, Homo Sapiens
LLILVLISI

SEQ ID NO: 821664 - protein, 9 aa, Homo Sapiens
NVPILRVLN

SEQ ID NO: 821665 - protein, 9 aa, Homo Sapiens
SSAILRAVS

SEQ ID NO: 821666 - protein, 9 aa, Homo Sapiens
SWSSLGRVP

SEQ ID NO: 821667 - protein, 9 aa, Homo Sapiens
TWDIFKQLL

SEQ ID NO: 821668 - protein, 9 aa, Homo Sapiens
AVSAAHVIK

SEQ ID NO: 821669 - protein, 9 aa, Homo Sapiens
SRERTKGDI

SEQ ID NO: 821670 - protein, 9 aa, Homo Sapiens
DEFIEKRQQ

SEQ ID NO: 821671 - protein, 9 aa, Homo Sapiens
AGFKYYNLV

SEQ ID NO: 821672 - protein, 9 aa, Homo Sapiens
LGTTVLGSN

SEQ ID NO: 821673 - protein, 9 aa, Homo Sapiens
SITRNLSYF

SEQ ID NO: 821674 - protein, 9 aa, Homo Sapiens
PGDVDRAQQ

SEQ ID NO: 821675 - protein, 9 aa, Homo Sapiens
VTMFFQNIS

SEQ ID NO: 821676 - protein, 9 aa, Homo Sapiens
LVDDLTRQK

SEQ ID NO: 821677 - protein, 9 aa, Homo Sapiens
PAEAPSPPP

SEQ ID NO: 821678 - protein, 9 aa, Homo Sapiens
KVAFPGPQG

SEQ ID NO: 821679 - protein, 9 aa, Homo Sapiens
LQESKLDVL

SEQ ID NO: 821680 - protein, 9 aa, Homo Sapiens
GCCSLCVEH

SEQ ID NO: 821681 - protein, 9 aa, Homo Sapiens
YMRIYKTGD

SEQ ID NO: 821682 - protein, 9 aa, Homo Sapiens
EAVKSALPT

SEQ ID NO: 821683 - protein, 9 aa, Homo Sapiens
GEPVWEPLQ

SEQ ID NO: 821684 - protein, 9 aa, Homo Sapiens
LQIILEKVA

SEQ ID NO: 821685 - protein, 9 aa, Homo Sapiens
YVVHQAQVE

SEQ ID NO: 821686 - protein, 9 aa, Homo Sapiens
AGKGKYDAV

SEQ ID NO: 821687 - protein, 9 aa, Homo Sapiens
GKKQYQDSP

SEQ ID NO: 821688 - protein, 9 aa, Homo Sapiens
MFNPIMYSF

SEQ ID NO: 821689 - protein, 9 aa, Homo Sapiens
LQLHERGLT

SEQ ID NO: 821690 - protein, 9 aa, Homo Sapiens
EDLSLAFLV

SEQ ID NO: 821691 - protein, 9 aa, Homo Sapiens
SLSTAPSDK

SEQ ID NO: 821692 - protein, 9 aa, Homo Sapiens
NPPKFFKVE

SEQ ID NO: 821693 - protein, 9 aa, Homo Sapiens
VLLEFGADI

SEQ ID NO: 821694 - protein, 9 aa, Homo Sapiens
ISIVRLKTS

SEQ ID NO: 821695 - protein, 9 aa, Homo Sapiens
FVLNSPKLF

SEQ ID NO: 821696 - protein, 9 aa, Homo Sapiens
GLEGQLIIR

SEQ ID NO: 821697 - protein, 9 aa, Homo Sapiens
YLHQFMLQQ

SEQ ID NO: 821698 - protein, 9 aa, Homo Sapiens
DQNRLDWKV

SEQ ID NO: 821699 - protein, 9 aa, Homo Sapiens
GIIICLDLK

SEQ ID NO: 821700 - protein, 9 aa, Homo Sapiens
ISSCHRVRQ

SEQ ID NO: 821701 - protein, 9 aa, Homo Sapiens
QRREQLEKD

SEQ ID NO: 821702 - protein, 9 aa, Homo Sapiens
LNSPKLFCP

SEQ ID NO: 821703 - protein, 9 aa, Homo Sapiens
PTSIPVSGT

SEQ ID NO: 821704 - protein, 9 aa, Homo Sapiens
KEVKPYVCH

SEQ ID NO: 821705 - protein, 9 aa, Homo Sapiens
VINWFMFFG

SEQ ID NO: 821706 - protein, 9 aa, Homo Sapiens
LDFHLHVLR

SEQ ID NO: 821707 - protein, 9 aa, Homo Sapiens
EMSKLKQQN

SEQ ID NO: 821708 - protein, 9 aa, Homo Sapiens
LDVERDEDA

SEQ ID NO: 821709 - protein, 9 aa, Homo Sapiens
KRAATTLDA

SEQ ID NO: 821710 - protein, 9 aa, Homo Sapiens
PLMQTGDNL

SEQ ID NO: 821711 - protein, 9 aa, Homo Sapiens
ALKLARRIA

SEQ ID NO: 821712 - protein, 9 aa, Homo Sapiens
SSPRLSPAY

SEQ ID NO: 821713 - protein, 9 aa, Homo Sapiens
RTQGYSFFH

SEQ ID NO: 821714 - protein, 9 aa, Homo Sapiens
NRNNRTIQA

SEQ ID NO: 821715 - protein, 9 aa, Homo Sapiens
WQIIQAAGT

SEQ ID NO: 821716 - protein, 9 aa, Homo Sapiens
HAKNIIVTG

SEQ ID NO: 821717 - protein, 9 aa, Homo Sapiens
PCVHPCILS

SEQ ID NO: 821718 - protein, 9 aa, Homo Sapiens
ESFPRVELL

SEQ ID NO: 821719 - protein, 9 aa, Homo Sapiens
ISSSLDRAT

SEQ ID NO: 821720 - protein, 9 aa, Homo Sapiens
FIIMFIFCS

SEQ ID NO: 821721 - protein, 9 aa, Homo Sapiens
VMTEERGII

SEQ ID NO: 821722 - protein, 9 aa, Homo Sapiens
TVKYYMRSL

SEQ ID NO: 821723 - protein, 9 aa, Homo Sapiens
LNTHLRTHT

SEQ ID NO: 821724 - protein, 9 aa, Homo Sapiens
PGVCYPVLT

SEQ ID NO: 821725 - protein, 9 aa, Homo Sapiens
TPLCEQGLV

SEQ ID NO: 821726 - protein, 9 aa, Homo Sapiens
KLQEKHKQE

SEQ ID NO: 821727 - protein, 9 aa, Homo Sapiens
MVHQITHTG

SEQ ID NO: 821728 - protein, 9 aa, Homo Sapiens
ETSPEIVEK

SEQ ID NO: 821729 - protein, 9 aa, Homo Sapiens
GSITKETTT

SEQ ID NO: 821730 - protein, 9 aa, Homo Sapiens
MKSADVDKL

SEQ ID NO: 821731 - protein, 9 aa, Homo Sapiens
IDPKRNKKS

SEQ ID NO: 821732 - protein, 9 aa, Homo Sapiens
DATRQKRKF

SEQ ID NO: 821733 - protein, 9 aa, Homo Sapiens
CVVWGRYGE

SEQ ID NO: 821734 - protein, 9 aa, Homo Sapiens
TVEQHNRKV

SEQ ID NO: 821735 - protein, 9 aa, Homo Sapiens
ALLYKAINS

SEQ ID NO: 821736 - protein, 9 aa, Homo Sapiens
LVPLQIILE

SEQ ID NO: 821737 - protein, 9 aa, Homo Sapiens
FVFGRKYRV

SEQ ID NO: 821738 - protein, 9 aa, Homo Sapiens
GKCILDPRG

SEQ ID NO: 821739 - protein, 9 aa, Homo Sapiens
LDLHHVTVA

SEQ ID NO: 821740 - protein, 9 aa, Homo Sapiens
QTQPFRDEG

SEQ ID NO: 821741 - protein, 9 aa, Homo Sapiens
MGHPLENNP

SEQ ID NO: 821742 - protein, 9 aa, Homo Sapiens
DSASEANAP

SEQ ID NO: 821743 - protein, 9 aa, Homo Sapiens
SLHFPHKSL

SEQ ID NO: 821744 - protein, 9 aa, Homo Sapiens
QRTLNIQSV

SEQ ID NO: 821745 - protein, 9 aa, Homo Sapiens
ENKLQNTMK

SEQ ID NO: 821746 - protein, 9 aa, Homo Sapiens
RRSVFPQQS

SEQ ID NO: 821747 - protein, 9 aa, Homo Sapiens
LTAVVWTDA

SEQ ID NO: 821748 - protein, 9 aa, Homo Sapiens
LGNACDNDM

SEQ ID NO: 821749 - protein, 9 aa, Homo Sapiens
ECLAQSSLN

SEQ ID NO: 821750 - protein, 9 aa, Homo Sapiens
WSDALSLDV

SEQ ID NO: 821751 - protein, 9 aa, Homo Sapiens
MWPKGWMQA

SEQ ID NO: 821752 - protein, 9 aa, Homo Sapiens
RKREEKLCK

SEQ ID NO: 821753 - protein, 9 aa, Homo Sapiens
LNDNYLSRT

SEQ ID NO: 821754 - protein, 9 aa, Homo Sapiens
ANQSILLLL

SEQ ID NO: 821755 - protein, 9 aa, Homo Sapiens
IFWYKQPSS

SEQ ID NO: 821756 - protein, 9 aa, Homo Sapiens
KDKYQALCS

SEQ ID NO: 821757 - protein, 9 aa, Homo Sapiens
EVPRGLREQ

SEQ ID NO: 821758 - protein, 9 aa, Homo Sapiens
QKRYLVKLI

SEQ ID NO: 821759 - protein, 9 aa, Homo Sapiens
FKNGRMVES

SEQ ID NO: 821760 - protein, 9 aa, Homo Sapiens
AGLEVLCTH

SEQ ID NO: 821761 - protein, 9 aa, Homo Sapiens
MNKSNLNYL

SEQ ID NO: 821762 - protein, 9 aa, Homo Sapiens
LVPEPPAGP

SEQ ID NO: 821763 - protein, 9 aa, Homo Sapiens
AGHITKMLL

SEQ ID NO: 821764 - protein, 9 aa, Homo Sapiens
ISASTVLIA

SEQ ID NO: 821765 - protein, 9 aa, Homo Sapiens
DKLYECKQC

SEQ ID NO: 821766 - protein, 9 aa, Homo Sapiens
LEDDSEFDE

SEQ ID NO: 821767 - protein, 9 aa, Homo Sapiens
KLLITIHNR

SEQ ID NO: 821768 - protein, 9 aa, Homo Sapiens
ANRNNVTGF

SEQ ID NO: 821769 - protein, 9 aa, Homo Sapiens
LFPDSKKEE

SEQ ID NO: 821770 - protein, 9 aa, Homo Sapiens
FLPFEKNCG

SEQ ID NO: 821771 - protein, 9 aa, Homo Sapiens
AKPIHSSDF

SEQ ID NO: 821772 - protein, 9 aa, Homo Sapiens
YALPRSSYY

SEQ ID NO: 821773 - protein, 9 aa, Homo Sapiens
QELQRCLRD

SEQ ID NO: 821774 - protein, 9 aa, Homo Sapiens
TKTPLEGDF

SEQ ID NO: 821775 - protein, 9 aa, Homo Sapiens
KQHALYLDI

SEQ ID NO: 821776 - protein, 9 aa, Homo Sapiens
QDILHFEMP

SEQ ID NO: 821777 - protein, 9 aa, Homo Sapiens
VQSHERTHT

SEQ ID NO: 821778 - protein, 9 aa, Homo Sapiens
FYYSAKAVD

SEQ ID NO: 821779 - protein, 9 aa, Homo Sapiens
KDRFAFVAG

SEQ ID NO: 821780 - protein, 9 aa, Homo Sapiens
SGKLDTTNE

SEQ ID NO: 821781 - protein, 9 aa, Homo Sapiens
EEMAPLKGA

SEQ ID NO: 821782 - protein, 9 aa, Homo Sapiens
QGNNKYGQL

SEQ ID NO: 821783 - protein, 9 aa, Homo Sapiens
NTSKKVTRA

SEQ ID NO: 821784 - protein, 9 aa, Homo Sapiens
EKKQSGRYS

SEQ ID NO: 821785 - protein, 9 aa, Homo Sapiens
VTVLQPTWG

SEQ ID NO: 821786 - protein, 9 aa, Homo Sapiens
FSHSGSLQI

SEQ ID NO: 821787 - protein, 9 aa, Homo Sapiens
SGLESPQQT

SEQ ID NO: 821788 - protein, 9 aa, Homo Sapiens
DRSQESLAV

SEQ ID NO: 821789 - protein, 9 aa, Homo Sapiens
ANVEYIKMA

SEQ ID NO: 821790 - protein, 9 aa, Homo Sapiens
MSVPMRIYI

SEQ ID NO: 821791 - protein, 9 aa, Homo Sapiens
CETKLEAIA

SEQ ID NO: 821792 - protein, 9 aa, Homo Sapiens
EYAHAGDSK

SEQ ID NO: 821793 - protein, 9 aa, Homo Sapiens
LKNQKLFDE

SEQ ID NO: 821794 - protein, 9 aa, Homo Sapiens
INAPKEYDY

SEQ ID NO: 821795 - protein, 9 aa, Homo Sapiens
AENLTELST

SEQ ID NO: 821796 - protein, 9 aa, Homo Sapiens
SASTVLIAL

SEQ ID NO: 821797 - protein, 9 aa, Homo Sapiens
QLHTAIKFP

SEQ ID NO: 821798 - protein, 9 aa, Homo Sapiens
LVAMPLLPV

SEQ ID NO: 821799 - protein, 9 aa, Homo Sapiens
FTHFHSTMF

SEQ ID NO: 821800 - protein, 9 aa, Homo Sapiens
AIMQTMAQK

SEQ ID NO: 821801 - protein, 9 aa, Homo Sapiens
QKKQNKPRE

SEQ ID NO: 821802 - protein, 9 aa, Homo Sapiens
THTHTHTVT

SEQ ID NO: 821803 - protein, 9 aa, Homo Sapiens
TLPPSTSSQ

SEQ ID NO: 821804 - protein, 9 aa, Homo Sapiens
QIVISSAEL

SEQ ID NO: 821805 - protein, 9 aa, Homo Sapiens
KEPSTPAFL

SEQ ID NO: 821806 - protein, 9 aa, Homo Sapiens
QFGRPVAVP

SEQ ID NO: 821807 - protein, 9 aa, Homo Sapiens
DGLLTLRSL

SEQ ID NO: 821808 - protein, 9 aa, Homo Sapiens
ENNQGVVSQ

SEQ ID NO: 821809 - protein, 9 aa, Homo Sapiens
YRGRLLNAN

SEQ ID NO: 821810 - protein, 9 aa, Homo Sapiens
QRRQVGKAQ

SEQ ID NO: 821811 - protein, 9 aa, Homo Sapiens
AWHTKDMDL

SEQ ID NO: 821812 - protein, 9 aa, Homo Sapiens
NRTIIGRIA

SEQ ID NO: 821813 - protein, 9 aa, Homo Sapiens
PQLLCVFFV

SEQ ID NO: 821814 - protein, 9 aa, Homo Sapiens
RGISDLRTF

SEQ ID NO: 821815 - protein, 9 aa, Homo Sapiens
VHDQGCVQI

SEQ ID NO: 821816 - protein, 9 aa, Homo Sapiens
VGAPQTLPQ

SEQ ID NO: 821817 - protein, 9 aa, Homo Sapiens
QNSHNAPAK

SEQ ID NO: 821818 - protein, 9 aa, Homo Sapiens
KIHSKGIFK

SEQ ID NO: 821819 - protein, 9 aa, Homo Sapiens
HTIEELSWL

SEQ ID NO: 821820 - protein, 9 aa, Homo Sapiens
LRINENRIV

SEQ ID NO: 821821 - protein, 9 aa, Homo Sapiens
RLFHAEQDK

SEQ ID NO: 821822 - protein, 9 aa, Homo Sapiens
ATSFSNLVH

SEQ ID NO: 821823 - protein, 9 aa, Homo Sapiens
TISLPCQPF

SEQ ID NO: 821824 - protein, 9 aa, Homo Sapiens
LYKDYDMPH

SEQ ID NO: 821825 - protein, 9 aa, Homo Sapiens
GICGCVDKY

SEQ ID NO: 821826 - protein, 9 aa, Homo Sapiens
PEGLLTSYS

SEQ ID NO: 821827 - protein, 9 aa, Homo Sapiens
TEKLVEGKS

SEQ ID NO: 821828 - protein, 9 aa, Homo Sapiens
KHLNSPNGV

SEQ ID NO: 821829 - protein, 9 aa, Homo Sapiens
VIKDRRHHP

SEQ ID NO: 821830 - protein, 9 aa, Homo Sapiens
EQEDKMQEQ

SEQ ID NO: 821831 - protein, 9 aa, Homo Sapiens
VASRIDSTG

SEQ ID NO: 821832 - protein, 9 aa, Homo Sapiens
DADAMFSEY

SEQ ID NO: 821833 - protein, 9 aa, Homo Sapiens
RDEPQKLYP

SEQ ID NO: 821834 - protein, 9 aa, Homo Sapiens
DYLMQILTE

SEQ ID NO: 821835 - protein, 9 aa, Homo Sapiens
TLMESVTEA

SEQ ID NO: 821836 - protein, 9 aa, Homo Sapiens
AEINTASRD

SEQ ID NO: 821837 - protein, 9 aa, Homo Sapiens
SEPIFHCQQ

SEQ ID NO: 821838 - protein, 9 aa, Homo Sapiens
AEHQLRHAD

SEQ ID NO: 821839 - protein, 9 aa, Homo Sapiens
QGPPMLQED

SEQ ID NO: 821840 - protein, 9 aa, Homo Sapiens
EKNQYTIDY

SEQ ID NO: 821841 - protein, 9 aa, Homo Sapiens
LIEEQLTNK

SEQ ID NO: 821842 - protein, 9 aa, Homo Sapiens
TKRNTLFGT

SEQ ID NO: 821843 - protein, 9 aa, Homo Sapiens
FTVSTFEGC

SEQ ID NO: 821844 - protein, 9 aa, Homo Sapiens
KKKNDNRLK

SEQ ID NO: 821845 - protein, 9 aa, Homo Sapiens
LFKKVEYTK

SEQ ID NO: 821846 - protein, 9 aa, Homo Sapiens
PGTSQSSTN

SEQ ID NO: 821847 - protein, 9 aa, Homo Sapiens
TLPMLAAPQ

SEQ ID NO: 821848 - protein, 9 aa, Homo Sapiens
STNLPINPS

SEQ ID NO: 821849 - protein, 9 aa, Homo Sapiens
AGTLFLMLV

SEQ ID NO: 821850 - protein, 9 aa, Homo Sapiens
RNKRIKNQL

SEQ ID NO: 821851 - protein, 9 aa, Homo Sapiens
KAMSIINSF

SEQ ID NO: 821852 - protein, 9 aa, Homo Sapiens
VYGQIPLSA

SEQ ID NO: 821853 - protein, 9 aa, Homo Sapiens
TDFSKSLQS

SEQ ID NO: 821854 - protein, 9 aa, Homo Sapiens
DEGYYDSFL

SEQ ID NO: 821855 - protein, 9 aa, Homo Sapiens
SWDNGKLKM

SEQ ID NO: 821856 - protein, 9 aa, Homo Sapiens
LSPTKDGEG

SEQ ID NO: 821857 - protein, 9 aa, Homo Sapiens
TNIFEENVT

SEQ ID NO: 821858 - protein, 9 aa, Homo Sapiens
IQDLKRTGL

SEQ ID NO: 821859 - protein, 9 aa, Homo Sapiens
VEKVTKEKT

SEQ ID NO: 821860 - protein, 9 aa, Homo Sapiens
SCQIEQPVT

SEQ ID NO: 821861 - protein, 9 aa, Homo Sapiens
MCTGETEAT

SEQ ID NO: 821862 - protein, 9 aa, Homo Sapiens
CHRVRQNVS

SEQ ID NO: 821863 - protein, 9 aa, Homo Sapiens
AQFNMFASV

SEQ ID NO: 821864 - protein, 9 aa, Homo Sapiens
KKKLFQVDI

SEQ ID NO: 821865 - protein, 9 aa, Homo Sapiens
AAGPSRVCQ

SEQ ID NO: 821866 - protein, 9 aa, Homo Sapiens
AGAACLVII

SEQ ID NO: 821867 - protein, 9 aa, Homo Sapiens
DEGAPQISL

SEQ ID NO: 821868 - protein, 9 aa, Homo Sapiens
ENNLVTEPT

SEQ ID NO: 821869 - protein, 9 aa, Homo Sapiens
WIPSCSHDS

SEQ ID NO: 821870 - protein, 9 aa, Homo Sapiens
ACIKLIEKP

SEQ ID NO: 821871 - protein, 9 aa, Homo Sapiens
ALFLSWFAG

SEQ ID NO: 821872 - protein, 9 aa, Homo Sapiens
WLGLSMSKP

SEQ ID NO: 821873 - protein, 9 aa, Homo Sapiens
QGAWATLQL

SEQ ID NO: 821874 - protein, 9 aa, Homo Sapiens
LKSPLETLT

SEQ ID NO: 821875 - protein, 9 aa, Homo Sapiens
GFSHQSKME

SEQ ID NO: 821876 - protein, 9 aa, Homo Sapiens
ISYVPPSCC

SEQ ID NO: 821877 - protein, 9 aa, Homo Sapiens
SRHNLEKLR

SEQ ID NO: 821878 - protein, 9 aa, Homo Sapiens
NILNMTTPN

SEQ ID NO: 821879 - protein, 9 aa, Homo Sapiens
GAAPRRRWD

SEQ ID NO: 821880 - protein, 9 aa, Homo Sapiens
ATAVMGINL

SEQ ID NO: 821881 - protein, 9 aa, Homo Sapiens
VKYFYRTLI

SEQ ID NO: 821882 - protein, 9 aa, Homo Sapiens
FGRQFDYRD

SEQ ID NO: 821883 - protein, 9 aa, Homo Sapiens
LSDSEFNQL

SEQ ID NO: 821884 - protein, 9 aa, Homo Sapiens
NGIFYEDSG

SEQ ID NO: 821885 - protein, 9 aa, Homo Sapiens
KISKYLSIA

SEQ ID NO: 821886 - protein, 9 aa, Homo Sapiens
IEEHSEDMD

SEQ ID NO: 821887 - protein, 9 aa, Homo Sapiens
LWDIKTGQQ

SEQ ID NO: 821888 - protein, 9 aa, Homo Sapiens
SPLRHARHA

SEQ ID NO: 821889 - protein, 9 aa, Homo Sapiens
LDYTLSKEF

SEQ ID NO: 821890 - protein, 9 aa, Homo Sapiens
LQKITGREY

SEQ ID NO: 821891 - protein, 9 aa, Homo Sapiens
AMVRPIISL

SEQ ID NO: 821892 - protein, 9 aa, Homo Sapiens
SQAGEFLCL

SEQ ID NO: 821893 - protein, 9 aa, Homo Sapiens
LKRDLDAQA

SEQ ID NO: 821894 - protein, 9 aa, Homo Sapiens
QLLEREEDI

SEQ ID NO: 821895 - protein, 9 aa, Homo Sapiens
QSGAKVMSE

SEQ ID NO: 821896 - protein, 9 aa, Homo Sapiens
GSRKESYSV

SEQ ID NO: 821897 - protein, 9 aa, Homo Sapiens
NECIGETRF

SEQ ID NO: 821898 - protein, 9 aa, Homo Sapiens
IVGSFDDSF

SEQ ID NO: 821899 - protein, 9 aa, Homo Sapiens
DSWEAFWRF

SEQ ID NO: 821900 - protein, 9 aa, Homo Sapiens
DKTKWIIGV

SEQ ID NO: 821901 - protein, 9 aa, Homo Sapiens
QILNKRKDH

SEQ ID NO: 821902 - protein, 9 aa, Homo Sapiens
PLIQNLPKP

SEQ ID NO: 821903 - protein, 9 aa, Homo Sapiens
LRDTCTYAT

SEQ ID NO: 821904 - protein, 9 aa, Homo Sapiens
AEEHQETQL

SEQ ID NO: 821905 - protein, 9 aa, Homo Sapiens
RPRDSLLRQ

SEQ ID NO: 821906 - protein, 9 aa, Homo Sapiens
EEGEVGEEL

SEQ ID NO: 821907 - protein, 9 aa, Homo Sapiens
GFSFVSGCT

SEQ ID NO: 821908 - protein, 9 aa, Homo Sapiens
NTFGRPLNI

SEQ ID NO: 821909 - protein, 9 aa, Homo Sapiens
MVCKAPIKE

SEQ ID NO: 821910 - protein, 9 aa, Homo Sapiens
MFGQGSYFT

SEQ ID NO: 821911 - protein, 9 aa, Homo Sapiens
ATSIMPLGL

SEQ ID NO: 821912 - protein, 9 aa, Homo Sapiens
GLSQSPEID

SEQ ID NO: 821913 - protein, 9 aa, Homo Sapiens
CGSSFQKHS

SEQ ID NO: 821914 - protein, 9 aa, Homo Sapiens
VSGNLLRKF

SEQ ID NO: 821915 - protein, 9 aa, Homo Sapiens
TRFMYDSFN

SEQ ID NO: 821916 - protein, 9 aa, Homo Sapiens
NIIEDKARI

SEQ ID NO: 821917 - protein, 9 aa, Homo Sapiens
KKAKERDKS

SEQ ID NO: 821918 - protein, 9 aa, Homo Sapiens
DRTDGDREV

SEQ ID NO: 821919 - protein, 9 aa, Homo Sapiens
EPGKLDKLE

SEQ ID NO: 821920 - protein, 9 aa, Homo Sapiens
PDRKKLGNA

SEQ ID NO: 821921 - protein, 9 aa, Homo Sapiens
DKSRRDPSE

SEQ ID NO: 821922 - protein, 9 aa, Homo Sapiens
GPPGPQGST

SEQ ID NO: 821923 - protein, 9 aa, Homo Sapiens
YTSVFEFNH

SEQ ID NO: 821924 - protein, 9 aa, Homo Sapiens
MHGRPNYPG

SEQ ID NO: 821925 - protein, 9 aa, Homo Sapiens
LSHPKEKMN

SEQ ID NO: 821926 - protein, 9 aa, Homo Sapiens
ISIASALGM

SEQ ID NO: 821927 - protein, 9 aa, Homo Sapiens
LLLLAAEQL

SEQ ID NO: 821928 - protein, 9 aa, Homo Sapiens
EARRSAIKI

SEQ ID NO: 821929 - protein, 9 aa, Homo Sapiens
DTDSKFLKL

SEQ ID NO: 821930 - protein, 9 aa, Homo Sapiens
LGIHLGEGS

SEQ ID NO: 821931 - protein, 9 aa, Homo Sapiens
DLDIKIDFP

SEQ ID NO: 821932 - protein, 9 aa, Homo Sapiens
QIFSSQPHQ

SEQ ID NO: 821933 - protein, 9 aa, Homo Sapiens
SEHLRYCNS

SEQ ID NO: 821934 - protein, 9 aa, Homo Sapiens
PIHKQGDKS

SEQ ID NO: 821935 - protein, 9 aa, Homo Sapiens
TQCRKILSY

SEQ ID NO: 821936 - protein, 9 aa, Homo Sapiens
ISVGKEGTR

SEQ ID NO: 821937 - protein, 9 aa, Homo Sapiens
MISVQPDTK

SEQ ID NO: 821938 - protein, 9 aa, Homo Sapiens
SEFSPQLFH

SEQ ID NO: 821939 - protein, 9 aa, Homo Sapiens
LSPGEILLI

SEQ ID NO: 821940 - protein, 9 aa, Homo Sapiens
KSERSSRLG

SEQ ID NO: 821941 - protein, 9 aa, Homo Sapiens
KVWPNEENN

SEQ ID NO: 821942 - protein, 9 aa, Homo Sapiens
IVTMPREVE

SEQ ID NO: 821943 - protein, 9 aa, Homo Sapiens
EFEVKLAGL

SEQ ID NO: 821944 - protein, 9 aa, Homo Sapiens
NNSWNSYSA

SEQ ID NO: 821945 - protein, 9 aa, Homo Sapiens
PFCVQHMDL

SEQ ID NO: 821946 - protein, 9 aa, Homo Sapiens
ELPTPACKN

SEQ ID NO: 821947 - protein, 9 aa, Homo Sapiens
LANFSCNKF

SEQ ID NO: 821948 - protein, 9 aa, Homo Sapiens
ENIFQEHRG

SEQ ID NO: 821949 - protein, 9 aa, Homo Sapiens
KFIRQFIPI

SEQ ID NO: 821950 - protein, 9 aa, Homo Sapiens
DLSGLHSGG

SEQ ID NO: 821951 - protein, 9 aa, Homo Sapiens
PASPIHFHP

SEQ ID NO: 821952 - protein, 9 aa, Homo Sapiens
VKLAGLEFP

SEQ ID NO: 821953 - protein, 9 aa, Homo Sapiens
YKIKRTKQE

SEQ ID NO: 821954 - protein, 9 aa, Homo Sapiens
RPRIFKIIV

SEQ ID NO: 821955 - protein, 9 aa, Homo Sapiens
ELRDAFRES

SEQ ID NO: 821956 - protein, 9 aa, Homo Sapiens
SRRVQIHNS

SEQ ID NO: 821957 - protein, 9 aa, Homo Sapiens
WDFTALINF

SEQ ID NO: 821958 - protein, 9 aa, Homo Sapiens
GQYTISMPS

SEQ ID NO: 821959 - protein, 9 aa, Homo Sapiens
GQQRYTQSP

SEQ ID NO: 821960 - protein, 9 aa, Homo Sapiens
FHMTAETLL

SEQ ID NO: 821961 - protein, 9 aa, Homo Sapiens
KRKNNAPKE

SEQ ID NO: 821962 - protein, 9 aa, Homo Sapiens
FFLQREGMR

SEQ ID NO: 821963 - protein, 9 aa, Homo Sapiens
GEKHCCPIF

SEQ ID NO: 821964 - protein, 9 aa, Homo Sapiens
LTMHQIVIS

SEQ ID NO: 821965 - protein, 9 aa, Homo Sapiens
VHVKAQEYE

SEQ ID NO: 821966 - protein, 9 aa, Homo Sapiens
QAGGRDAER

SEQ ID NO: 821967 - protein, 9 aa, Homo Sapiens
ISYDDEQRT

SEQ ID NO: 821968 - protein, 9 aa, Homo Sapiens
KMRYKHIDH

SEQ ID NO: 821969 - protein, 9 aa, Homo Sapiens
CLDGKDCAI

SEQ ID NO: 821970 - protein, 9 aa, Homo Sapiens
KALESLDTS

SEQ ID NO: 821971 - protein, 9 aa, Homo Sapiens
GESKSSSTR

SEQ ID NO: 821972 - protein, 9 aa, Homo Sapiens
DTCTYATAL

SEQ ID NO: 821973 - protein, 9 aa, Homo Sapiens
KLSDLERLA

SEQ ID NO: 821974 - protein, 9 aa, Homo Sapiens
KLARCVAQV

SEQ ID NO: 821975 - protein, 9 aa, Homo Sapiens
KYSKIKHLR

SEQ ID NO: 821976 - protein, 9 aa, Homo Sapiens
IVKDLMPKA

SEQ ID NO: 821977 - protein, 9 aa, Homo Sapiens
PPEPIIDDN

SEQ ID NO: 821978 - protein, 9 aa, Homo Sapiens
DCQLSISDR

SEQ ID NO: 821979 - protein, 9 aa, Homo Sapiens
LLPSKINTL

SEQ ID NO: 821980 - protein, 9 aa, Homo Sapiens
FNMNLLSCP

SEQ ID NO: 821981 - protein, 9 aa, Homo Sapiens
QILAGREDI

SEQ ID NO: 821982 - protein, 9 aa, Homo Sapiens
IREEKNSSK

SEQ ID NO: 821983 - protein, 9 aa, Homo Sapiens
ANDIESPDR

SEQ ID NO: 821984 - protein, 9 aa, Homo Sapiens
WQKNLTVLN

SEQ ID NO: 821985 - protein, 9 aa, Homo Sapiens
LPEQTTTAL

SEQ ID NO: 821986 - protein, 9 aa, Homo Sapiens
GYGDGDSDE

SEQ ID NO: 821987 - protein, 9 aa, Homo Sapiens
SALETLGGD

SEQ ID NO: 821988 - protein, 9 aa, Homo Sapiens
LQQVLSVMS

SEQ ID NO: 821989 - protein, 9 aa, Homo Sapiens
SVGVWGQYG

SEQ ID NO: 821990 - protein, 9 aa, Homo Sapiens
FEESGQDIE

SEQ ID NO: 821991 - protein, 9 aa, Homo Sapiens
SLIYSTNTK

SEQ ID NO: 821992 - protein, 9 aa, Homo Sapiens
YLYTLWNSR

SEQ ID NO: 821993 - protein, 9 aa, Homo Sapiens
SKVILSICS

SEQ ID NO: 821994 - protein, 9 aa, Homo Sapiens
YSQARGRQT

SEQ ID NO: 821995 - protein, 9 aa, Homo Sapiens
LKATIHENI

SEQ ID NO: 821996 - protein, 9 aa, Homo Sapiens
VADKKIHLV

SEQ ID NO: 821997 - protein, 9 aa, Homo Sapiens
SIVALVVLI

SEQ ID NO: 821998 - protein, 9 aa, Homo Sapiens
TCDKCGKGF

SEQ ID NO: 821999 - protein, 9 aa, Homo Sapiens
GAGKYLAEL

SEQ ID NO: 822000 - protein, 9 aa, Homo Sapiens
TMAQKNEWP

SEQ ID NO: 822001 - protein, 9 aa, Homo Sapiens
EPTKLPFPL

SEQ ID NO: 822002 - protein, 9 aa, Homo Sapiens
NAVPAAVCH

SEQ ID NO: 822003 - protein, 9 aa, Homo Sapiens
FRTIPSDNA

SEQ ID NO: 822004 - protein, 9 aa, Homo Sapiens
RFIVLFYLW

SEQ ID NO: 822005 - protein, 9 aa, Homo Sapiens
TMYAMKYMN

SEQ ID NO: 822006 - protein, 9 aa, Homo Sapiens
QRYCYTDVA

SEQ ID NO: 822007 - protein, 9 aa, Homo Sapiens
INHFFGTVL

SEQ ID NO: 822008 - protein, 9 aa, Homo Sapiens
KTRLTVNYE

SEQ ID NO: 822009 - protein, 9 aa, Homo Sapiens
QGIVKHLRL

SEQ ID NO: 822010 - protein, 9 aa, Homo Sapiens
SINTAIIEI

SEQ ID NO: 822011 - protein, 9 aa, Homo Sapiens
TVQGIGWYL

SEQ ID NO: 822012 - protein, 9 aa, Homo Sapiens
YAFHIFRDP

SEQ ID NO: 822013 - protein, 9 aa, Homo Sapiens
NLNKEEREA

SEQ ID NO: 822014 - protein, 9 aa, Homo Sapiens
FQHFMHQTL

SEQ ID NO: 822015 - protein, 9 aa, Homo Sapiens
PSTLGLQCR

SEQ ID NO: 822016 - protein, 9 aa, Homo Sapiens
NKILATKKN

SEQ ID NO: 822017 - protein, 9 aa, Homo Sapiens
SEDQETSLP

SEQ ID NO: 822018 - protein, 9 aa, Homo Sapiens
EHVDQDLMT

SEQ ID NO: 822019 - protein, 9 aa, Homo Sapiens
SCGWHHCPH

SEQ ID NO: 822020 - protein, 9 aa, Homo Sapiens
KDSGIVTNG

SEQ ID NO: 822021 - protein, 9 aa, Homo Sapiens
QTMAQKNEW

SEQ ID NO: 822022 - protein, 9 aa, Homo Sapiens
LDECIYAIK

SEQ ID NO: 822023 - protein, 9 aa, Homo Sapiens
RPEVTYPCA

SEQ ID NO: 822024 - protein, 9 aa, Homo Sapiens
LAEDDDPQI

SEQ ID NO: 822025 - protein, 9 aa, Homo Sapiens
ERGLTLHQT

SEQ ID NO: 822026 - protein, 9 aa, Homo Sapiens
VRQTALKVI

SEQ ID NO: 822027 - protein, 9 aa, Homo Sapiens
LKDRVNKQC

SEQ ID NO: 822028 - protein, 9 aa, Homo Sapiens
NGMQLPCKL

SEQ ID NO: 822029 - protein, 9 aa, Homo Sapiens
ILATLLDPR

SEQ ID NO: 822030 - protein, 9 aa, Homo Sapiens
SRVNRNVWS

SEQ ID NO: 822031 - protein, 9 aa, Homo Sapiens
KLFPNGLRY

SEQ ID NO: 822032 - protein, 9 aa, Homo Sapiens
SQVLYSCLE

SEQ ID NO: 822033 - protein, 9 aa, Homo Sapiens
TTIIKKNGD

SEQ ID NO: 822034 - protein, 9 aa, Homo Sapiens
GNIMSYKRR

SEQ ID NO: 822035 - protein, 9 aa, Homo Sapiens
DKCDKLFRR

SEQ ID NO: 822036 - protein, 9 aa, Homo Sapiens
NGKRKVQYD

SEQ ID NO: 822037 - protein, 9 aa, Homo Sapiens
VEIEQKCKA

SEQ ID NO: 822038 - protein, 9 aa, Homo Sapiens
TNTGAPHQD

SEQ ID NO: 822039 - protein, 9 aa, Homo Sapiens
IQFSGMNIK

SEQ ID NO: 822040 - protein, 9 aa, Homo Sapiens
VAHLEIENK

SEQ ID NO: 822041 - protein, 9 aa, Homo Sapiens
INHFYCDTQ

SEQ ID NO: 822042 - protein, 9 aa, Homo Sapiens
ENTFKANSS

SEQ ID NO: 822043 - protein, 9 aa, Homo Sapiens
LKHCSRYMH

SEQ ID NO: 822044 - protein, 9 aa, Homo Sapiens
LDSSKKNLL

SEQ ID NO: 822045 - protein, 9 aa, Homo Sapiens
GLIEKNIKL

SEQ ID NO: 822046 - protein, 9 aa, Homo Sapiens
AVQIGIIDG

SEQ ID NO: 822047 - protein, 9 aa, Homo Sapiens
PDQNAPPIC

SEQ ID NO: 822048 - protein, 9 aa, Homo Sapiens
PPHCGRCIP

SEQ ID NO: 822049 - protein, 9 aa, Homo Sapiens
AIANAVVQE

SEQ ID NO: 822050 - protein, 9 aa, Homo Sapiens
RQEHERMSR

SEQ ID NO: 822051 - protein, 9 aa, Homo Sapiens
RKERRRHKT

SEQ ID NO: 822052 - protein, 9 aa, Homo Sapiens
VVEKLYIQQ

SEQ ID NO: 822053 - protein, 9 aa, Homo Sapiens
GDSGGIAEA

SEQ ID NO: 822054 - protein, 9 aa, Homo Sapiens
GPCFQLRYR

SEQ ID NO: 822055 - protein, 9 aa, Homo Sapiens
KVQEPQGEG

SEQ ID NO: 822056 - protein, 9 aa, Homo Sapiens
AGQLFSNSS

SEQ ID NO: 822057 - protein, 9 aa, Homo Sapiens
VVLHGIRNT

SEQ ID NO: 822058 - protein, 9 aa, Homo Sapiens
VVEENLKLL

SEQ ID NO: 822059 - protein, 9 aa, Homo Sapiens
KSEPSVMWL

SEQ ID NO: 822060 - protein, 9 aa, Homo Sapiens
LLESLEFYY

SEQ ID NO: 822061 - protein, 9 aa, Homo Sapiens
PKHESPSQD

SEQ ID NO: 822062 - protein, 9 aa, Homo Sapiens
RNLKDMDIG

SEQ ID NO: 822063 - protein, 9 aa, Homo Sapiens
ALHDQAPQL

SEQ ID NO: 822064 - protein, 9 aa, Homo Sapiens
LSADEEHLE

SEQ ID NO: 822065 - protein, 9 aa, Homo Sapiens
IEHLQNELR

SEQ ID NO: 822066 - protein, 9 aa, Homo Sapiens
QRIVTMPRE

SEQ ID NO: 822067 - protein, 9 aa, Homo Sapiens
EHQIIHTGE

SEQ ID NO: 822068 - protein, 9 aa, Homo Sapiens
PQTSSLPLQ

SEQ ID NO: 822069 - protein, 9 aa, Homo Sapiens
VTPCSSRPL

SEQ ID NO: 822070 - protein, 9 aa, Homo Sapiens
GAYQPCLIA

SEQ ID NO: 822071 - protein, 9 aa, Homo Sapiens
FYWRSKSKE

SEQ ID NO: 822072 - protein, 9 aa, Homo Sapiens
RRILRRPAS

SEQ ID NO: 822073 - protein, 9 aa, Homo Sapiens
KKAEESANE

SEQ ID NO: 822074 - protein, 9 aa, Homo Sapiens
LKSLYFKLQ

SEQ ID NO: 822075 - protein, 9 aa, Homo Sapiens
GWICLCFSF

SEQ ID NO: 822076 - protein, 9 aa, Homo Sapiens
ERYAEKDPN

SEQ ID NO: 822077 - protein, 9 aa, Homo Sapiens
VLNEHTFCA

SEQ ID NO: 822078 - protein, 9 aa, Homo Sapiens
SLMAALRRG

SEQ ID NO: 822079 - protein, 9 aa, Homo Sapiens
ELWAGPCPP

SEQ ID NO: 822080 - protein, 9 aa, Homo Sapiens
VMRDKHPEK

SEQ ID NO: 822081 - protein, 9 aa, Homo Sapiens
LDPNFSIPQ

SEQ ID NO: 822082 - protein, 9 aa, Homo Sapiens
EGKQTWRRK

SEQ ID NO: 822083 - protein, 9 aa, Homo Sapiens
IYPGVVEVW

SEQ ID NO: 822084 - protein, 9 aa, Homo Sapiens
SSFRKLFKN

SEQ ID NO: 822085 - protein, 9 aa, Homo Sapiens
TLDNKLQEE

SEQ ID NO: 822086 - protein, 9 aa, Homo Sapiens
PVINVRIGM

SEQ ID NO: 822087 - protein, 9 aa, Homo Sapiens
SDVVEKSLE

SEQ ID NO: 822088 - protein, 9 aa, Homo Sapiens
FSQLQKLCW

SEQ ID NO: 822089 - protein, 9 aa, Homo Sapiens
QAWTDNERS

SEQ ID NO: 822090 - protein, 9 aa, Homo Sapiens
FYDISQIFY

SEQ ID NO: 822091 - protein, 9 aa, Homo Sapiens
ELPSSTSTD

SEQ ID NO: 822092 - protein, 9 aa, Homo Sapiens
LLESADKLY

SEQ ID NO: 822093 - protein, 9 aa, Homo Sapiens
LSVIYPGVV

SEQ ID NO: 822094 - protein, 9 aa, Homo Sapiens
MPKKKQALV

SEQ ID NO: 822095 - protein, 9 aa, Homo Sapiens
YTQSPMYRM

SEQ ID NO: 822096 - protein, 9 aa, Homo Sapiens
TPQYSLEEE

SEQ ID NO: 822097 - protein, 9 aa, Homo Sapiens
TKEPVKNIF

SEQ ID NO: 822098 - protein, 9 aa, Homo Sapiens
GFALQSDID

SEQ ID NO: 822099 - protein, 9 aa, Homo Sapiens
IAVNAILTV

SEQ ID NO: 822100 - protein, 9 aa, Homo Sapiens
ICQHPFCEP

SEQ ID NO: 822101 - protein, 9 aa, Homo Sapiens
ILLGFYNYP

SEQ ID NO: 822102 - protein, 9 aa, Homo Sapiens
EQILSSTLS

SEQ ID NO: 822103 - protein, 9 aa, Homo Sapiens
SETSTLSSK

SEQ ID NO: 822104 - protein, 9 aa, Homo Sapiens
SGNIKTDTT

SEQ ID NO: 822105 - protein, 9 aa, Homo Sapiens
PNVCLPASS

SEQ ID NO: 822106 - protein, 9 aa, Homo Sapiens
DDARTGAVD

SEQ ID NO: 822107 - protein, 9 aa, Homo Sapiens
IIFAVFIVC

SEQ ID NO: 822108 - protein, 9 aa, Homo Sapiens
KILNLHFLG

SEQ ID NO: 822109 - protein, 9 aa, Homo Sapiens
EEEIWSLLL

SEQ ID NO: 822110 - protein, 9 aa, Homo Sapiens
YVSNKLFMA

SEQ ID NO: 822111 - protein, 9 aa, Homo Sapiens
KFCRIDTSR

SEQ ID NO: 822112 - protein, 9 aa, Homo Sapiens
ITLLVKSSF

SEQ ID NO: 822113 - protein, 9 aa, Homo Sapiens
FLLLTYMAK

SEQ ID NO: 822114 - protein, 9 aa, Homo Sapiens
SKTSDIEPK

SEQ ID NO: 822115 - protein, 9 aa, Homo Sapiens
QLTSEIFDS

SEQ ID NO: 822116 - protein, 9 aa, Homo Sapiens
LEQPPHGSD

SEQ ID NO: 822117 - protein, 9 aa, Homo Sapiens
EHHLEAHMR

SEQ ID NO: 822118 - protein, 9 aa, Homo Sapiens
TYATVLTFC

SEQ ID NO: 822119 - protein, 9 aa, Homo Sapiens
IWEPQTSHC

SEQ ID NO: 822120 - protein, 9 aa, Homo Sapiens
INNTFQSFL

SEQ ID NO: 822121 - protein, 9 aa, Homo Sapiens
DHSSIERAQ

SEQ ID NO: 822122 - protein, 9 aa, Homo Sapiens
YTDMRLTKL

SEQ ID NO: 822123 - protein, 9 aa, Homo Sapiens
DGTGPTQGD

SEQ ID NO: 822124 - protein, 9 aa, Homo Sapiens
VQKILEIKN

SEQ ID NO: 822125 - protein, 9 aa, Homo Sapiens
IEPPEIMEF

SEQ ID NO: 822126 - protein, 9 aa, Homo Sapiens
LKDLPVNYE

SEQ ID NO: 822127 - protein, 9 aa, Homo Sapiens
KNTHGLTPL

SEQ ID NO: 822128 - protein, 9 aa, Homo Sapiens
DKARIIYED

SEQ ID NO: 822129 - protein, 9 aa, Homo Sapiens
VTSTVNTGL

SEQ ID NO: 822130 - protein, 9 aa, Homo Sapiens
KARPDKSVN

SEQ ID NO: 822131 - protein, 9 aa, Homo Sapiens
QESLEISLS

SEQ ID NO: 822132 - protein, 9 aa, Homo Sapiens
DIKVATQIS

SEQ ID NO: 822133 - protein, 9 aa, Homo Sapiens
LFSHCSTPG

SEQ ID NO: 822134 - protein, 9 aa, Homo Sapiens
PQDMDNNLN

SEQ ID NO: 822135 - protein, 9 aa, Homo Sapiens
NVQKYLERL

SEQ ID NO: 822136 - protein, 9 aa, Homo Sapiens
MEKEKKTWG

SEQ ID NO: 822137 - protein, 9 aa, Homo Sapiens
LIGNCLPTV

SEQ ID NO: 822138 - protein, 9 aa, Homo Sapiens
AIYQRGLDI

SEQ ID NO: 822139 - protein, 9 aa, Homo Sapiens
ADGHPLKSD

SEQ ID NO: 822140 - protein, 9 aa, Homo Sapiens
ITQERMHHD

SEQ ID NO: 822141 - protein, 9 aa, Homo Sapiens
FHKEEREGL

SEQ ID NO: 822142 - protein, 9 aa, Homo Sapiens
QVKGFVQKN

SEQ ID NO: 822143 - protein, 9 aa, Homo Sapiens
VSSNKLKTV

SEQ ID NO: 822144 - protein, 9 aa, Homo Sapiens
TTTTAQETL

SEQ ID NO: 822145 - protein, 9 aa, Homo Sapiens
IYLSKGTQH

SEQ ID NO: 822146 - protein, 9 aa, Homo Sapiens
ASEGDTNSN

SEQ ID NO: 822147 - protein, 9 aa, Homo Sapiens
DTALEGSTE

SEQ ID NO: 822148 - protein, 9 aa, Homo Sapiens
DEGLVEFGT

SEQ ID NO: 822149 - protein, 9 aa, Homo Sapiens
INEGYFCKN

SEQ ID NO: 822150 - protein, 9 aa, Homo Sapiens
ESKYKEIIL

SEQ ID NO: 822151 - protein, 9 aa, Homo Sapiens
NNLSDRLGE

SEQ ID NO: 822152 - protein, 9 aa, Homo Sapiens
QYLQVQKDI

SEQ ID NO: 822153 - protein, 9 aa, Homo Sapiens
LDQLIEQRT

SEQ ID NO: 822154 - protein, 9 aa, Homo Sapiens
PPCPYEMCS

SEQ ID NO: 822155 - protein, 9 aa, Homo Sapiens
KLEEVCTSL

SEQ ID NO: 822156 - protein, 9 aa, Homo Sapiens
SLDPLKHVR

SEQ ID NO: 822157 - protein, 9 aa, Homo Sapiens
ETASQEVMG

SEQ ID NO: 822158 - protein, 9 aa, Homo Sapiens
TPGLPAPEL

SEQ ID NO: 822159 - protein, 9 aa, Homo Sapiens
SDSAVKMLV

SEQ ID NO: 822160 - protein, 9 aa, Homo Sapiens
NDVSMIKMA

SEQ ID NO: 822161 - protein, 9 aa, Homo Sapiens
IATLLLQIE

SEQ ID NO: 822162 - protein, 9 aa, Homo Sapiens
LSTTPNHAP

SEQ ID NO: 822163 - protein, 9 aa, Homo Sapiens
AKQTGRSEV

SEQ ID NO: 822164 - protein, 9 aa, Homo Sapiens
EKELEILQI

SEQ ID NO: 822165 - protein, 9 aa, Homo Sapiens
STQENLEKA

SEQ ID NO: 822166 - protein, 9 aa, Homo Sapiens
SLFRRCQRR

SEQ ID NO: 822167 - protein, 9 aa, Homo Sapiens
IFKDNNTPS

SEQ ID NO: 822168 - protein, 9 aa, Homo Sapiens
QQFLVIEDN

SEQ ID NO: 822169 - protein, 9 aa, Homo Sapiens
DLRGISDLR

SEQ ID NO: 822170 - protein, 9 aa, Homo Sapiens
IKCRDMTRM

SEQ ID NO: 822171 - protein, 9 aa, Homo Sapiens
LTETGNNWI

SEQ ID NO: 822172 - protein, 9 aa, Homo Sapiens
LIPALVKVL

SEQ ID NO: 822173 - protein, 9 aa, Homo Sapiens
QTGVDTTNI

SEQ ID NO: 822174 - protein, 9 aa, Homo Sapiens
VSVRPERAL

SEQ ID NO: 822175 - protein, 9 aa, Homo Sapiens
NIIEINVSD

SEQ ID NO: 822176 - protein, 9 aa, Homo Sapiens
SFALHTWSK

SEQ ID NO: 822177 - protein, 9 aa, Homo Sapiens
KAEASSRIR

SEQ ID NO: 822178 - protein, 9 aa, Homo Sapiens
HGRNVTSKF

SEQ ID NO: 822179 - protein, 9 aa, Homo Sapiens
PSDLLDALH

SEQ ID NO: 822180 - protein, 9 aa, Homo Sapiens
GSMVPPPVG

SEQ ID NO: 822181 - protein, 9 aa, Homo Sapiens
LNKKQQHKL

SEQ ID NO: 822182 - protein, 9 aa, Homo Sapiens
SSTPTFIIL

SEQ ID NO: 822183 - protein, 9 aa, Homo Sapiens
DLSREKMDL

SEQ ID NO: 822184 - protein, 9 aa, Homo Sapiens
CNVLSPIAA

SEQ ID NO: 822185 - protein, 9 aa, Homo Sapiens
TSSWGGTPI

SEQ ID NO: 822186 - protein, 9 aa, Homo Sapiens
EQGDEEANI

SEQ ID NO: 822187 - protein, 9 aa, Homo Sapiens
RDYVHRKFR

SEQ ID NO: 822188 - protein, 9 aa, Homo Sapiens
GLMLKNCNS

SEQ ID NO: 822189 - protein, 9 aa, Homo Sapiens
INKQVIDSF

SEQ ID NO: 822190 - protein, 9 aa, Homo Sapiens
TLPLMQIFR

SEQ ID NO: 822191 - protein, 9 aa, Homo Sapiens
LISYGIRQL

SEQ ID NO: 822192 - protein, 9 aa, Homo Sapiens
NLIKVLKWY

SEQ ID NO: 822193 - protein, 9 aa, Homo Sapiens
FFVFSIKQV

SEQ ID NO: 822194 - protein, 9 aa, Homo Sapiens
LRPAPMQAM

SEQ ID NO: 822195 - protein, 9 aa, Homo Sapiens
RYSPNNYLL

SEQ ID NO: 822196 - protein, 9 aa, Homo Sapiens
SFRKLFKNK

SEQ ID NO: 822197 - protein, 9 aa, Homo Sapiens
WIMMNIPPV

SEQ ID NO: 822198 - protein, 9 aa, Homo Sapiens
KVQYDSSEP

SEQ ID NO: 822199 - protein, 9 aa, Homo Sapiens
VSMIKMAHI

SEQ ID NO: 822200 - protein, 9 aa, Homo Sapiens
LEAFDDLFP

SEQ ID NO: 822201 - protein, 9 aa, Homo Sapiens
SNTCYCCYL

SEQ ID NO: 822202 - protein, 9 aa, Homo Sapiens
QLSPAGKIY

SEQ ID NO: 822203 - protein, 9 aa, Homo Sapiens
FYMPVTSMT

SEQ ID NO: 822204 - protein, 9 aa, Homo Sapiens
TLEQAKKES

SEQ ID NO: 822205 - protein, 9 aa, Homo Sapiens
SVLNLGKVH

SEQ ID NO: 822206 - protein, 9 aa, Homo Sapiens
YLGDCYKFY

SEQ ID NO: 822207 - protein, 9 aa, Homo Sapiens
SSQSKTYST

SEQ ID NO: 822208 - protein, 9 aa, Homo Sapiens
QSYIAAISV

SEQ ID NO: 822209 - protein, 9 aa, Homo Sapiens
HAELDKITR

SEQ ID NO: 822210 - protein, 9 aa, Homo Sapiens
QSLNSDVNN

SEQ ID NO: 822211 - protein, 9 aa, Homo Sapiens
IKQTDEEGK

SEQ ID NO: 822212 - protein, 9 aa, Homo Sapiens
VAYEMVKYG

SEQ ID NO: 822213 - protein, 9 aa, Homo Sapiens
PDKTDMTPS

SEQ ID NO: 822214 - protein, 9 aa, Homo Sapiens
QEAEKPQRN

SEQ ID NO: 822215 - protein, 9 aa, Homo Sapiens
AFWRFPAFG

SEQ ID NO: 822216 - protein, 9 aa, Homo Sapiens
FRIVAIVSP

SEQ ID NO: 822217 - protein, 9 aa, Homo Sapiens
PQQTQQELQ

SEQ ID NO: 822218 - protein, 9 aa, Homo Sapiens
GDGPSYGRY

SEQ ID NO: 822219 - protein, 9 aa, Homo Sapiens
VIIIQPPST

SEQ ID NO: 822220 - protein, 9 aa, Homo Sapiens
PSISLDLTS

SEQ ID NO: 822221 - protein, 9 aa, Homo Sapiens
DFRAPAEPQ

SEQ ID NO: 822222 - protein, 9 aa, Homo Sapiens
INQNGEELY

SEQ ID NO: 822223 - protein, 9 aa, Homo Sapiens
SIVISSLKI

SEQ ID NO: 822224 - protein, 9 aa, Homo Sapiens
PSWRELMSD

SEQ ID NO: 822225 - protein, 9 aa, Homo Sapiens
LKELDVLEE

SEQ ID NO: 822226 - protein, 9 aa, Homo Sapiens
PEPSEYPTS

SEQ ID NO: 822227 - protein, 9 aa, Homo Sapiens
TNITFGVRT

SEQ ID NO: 822228 - protein, 9 aa, Homo Sapiens
SDADLDAFL

SEQ ID NO: 822229 - protein, 9 aa, Homo Sapiens
LDSLGGEPS

SEQ ID NO: 822230 - protein, 9 aa, Homo Sapiens
KVIVTRYEQ

SEQ ID NO: 822231 - protein, 9 aa, Homo Sapiens
HIDQFKRLQ

SEQ ID NO: 822232 - protein, 9 aa, Homo Sapiens
KENEEHKKQ

SEQ ID NO: 822233 - protein, 9 aa, Homo Sapiens
VQIHNSFSP

SEQ ID NO: 822234 - protein, 9 aa, Homo Sapiens
AVNKPLSAM

SEQ ID NO: 822235 - protein, 9 aa, Homo Sapiens
VIYAFLGLR

SEQ ID NO: 822236 - protein, 9 aa, Homo Sapiens
MFQIAMRIL

SEQ ID NO: 822237 - protein, 9 aa, Homo Sapiens
VGGIAQSIA

SEQ ID NO: 822238 - protein, 9 aa, Homo Sapiens
ELIQAGGTK

SEQ ID NO: 822239 - protein, 9 aa, Homo Sapiens
SIPGNTLGY

SEQ ID NO: 822240 - protein, 9 aa, Homo Sapiens
QGKDLQLLE

SEQ ID NO: 822241 - protein, 9 aa, Homo Sapiens
LKDTVRLNK

SEQ ID NO: 822242 - protein, 9 aa, Homo Sapiens
DLQQEMAIA

SEQ ID NO: 822243 - protein, 9 aa, Homo Sapiens
AVSREHGSG

SEQ ID NO: 822244 - protein, 9 aa, Homo Sapiens
RRIIVQPMI

SEQ ID NO: 822245 - protein, 9 aa, Homo Sapiens
ATAHSALED

SEQ ID NO: 822246 - protein, 9 aa, Homo Sapiens
HPSGVGKRC

SEQ ID NO: 822247 - protein, 9 aa, Homo Sapiens
LGYKDPAAI

SEQ ID NO: 822248 - protein, 9 aa, Homo Sapiens
CKVIIKVLD

SEQ ID NO: 822249 - protein, 9 aa, Homo Sapiens
ASRFYRINR

SEQ ID NO: 822250 - protein, 9 aa, Homo Sapiens
RSHIMHLEE

SEQ ID NO: 822251 - protein, 9 aa, Homo Sapiens
TMSVCFSAC

SEQ ID NO: 822252 - protein, 9 aa, Homo Sapiens
EDYPMRMLY

SEQ ID NO: 822253 - protein, 9 aa, Homo Sapiens
KLRGQTCGI

SEQ ID NO: 822254 - protein, 9 aa, Homo Sapiens
KEIEFKVKT

SEQ ID NO: 822255 - protein, 9 aa, Homo Sapiens
CKCNVCKSC

SEQ ID NO: 822256 - protein, 9 aa, Homo Sapiens
NCLSAQGDS

SEQ ID NO: 822257 - protein, 9 aa, Homo Sapiens
DKKLALMLS

SEQ ID NO: 822258 - protein, 9 aa, Homo Sapiens
YCTRLKTMT

SEQ ID NO: 822259 - protein, 9 aa, Homo Sapiens
THQTIPRIR

SEQ ID NO: 822260 - protein, 9 aa, Homo Sapiens
FICVVLLIY

SEQ ID NO: 822261 - protein, 9 aa, Homo Sapiens
PEILENNSS

SEQ ID NO: 822262 - protein, 9 aa, Homo Sapiens
CMEKLWDAR

SEQ ID NO: 822263 - protein, 9 aa, Homo Sapiens
HPAGQNLQG

SEQ ID NO: 822264 - protein, 9 aa, Homo Sapiens
SQQINSIKL

SEQ ID NO: 822265 - protein, 9 aa, Homo Sapiens
YEIYVDTCG

SEQ ID NO: 822266 - protein, 9 aa, Homo Sapiens
YGTSSAADG

SEQ ID NO: 822267 - protein, 9 aa, Homo Sapiens
EKTSVARLT

SEQ ID NO: 822268 - protein, 9 aa, Homo Sapiens
RVLAVLSVT

SEQ ID NO: 822269 - protein, 9 aa, Homo Sapiens
EPGARLTCH

SEQ ID NO: 822270 - protein, 9 aa, Homo Sapiens
GQHNAIISP

SEQ ID NO: 822271 - protein, 9 aa, Homo Sapiens
SENAGGQSD

SEQ ID NO: 822272 - protein, 9 aa, Homo Sapiens
QLMALVRYI

SEQ ID NO: 822273 - protein, 9 aa, Homo Sapiens
TEYSEDNLL

SEQ ID NO: 822274 - protein, 9 aa, Homo Sapiens
LGYMGENLP

SEQ ID NO: 822275 - protein, 9 aa, Homo Sapiens
WWDAEKCDI

SEQ ID NO: 822276 - protein, 9 aa, Homo Sapiens
ASFDSYYSL

SEQ ID NO: 822277 - protein, 9 aa, Homo Sapiens
YHNQIHAAN

SEQ ID NO: 822278 - protein, 9 aa, Homo Sapiens
NNTLQFTGL

SEQ ID NO: 822279 - protein, 9 aa, Homo Sapiens
TAAVFLSVD

SEQ ID NO: 822280 - protein, 9 aa, Homo Sapiens
VGMKPLSYS

SEQ ID NO: 822281 - protein, 9 aa, Homo Sapiens
VSNRKIQEH

SEQ ID NO: 822282 - protein, 9 aa, Homo Sapiens
VSPAGVGFH

SEQ ID NO: 822283 - protein, 9 aa, Homo Sapiens
QIHTLQDWA

SEQ ID NO: 822284 - protein, 9 aa, Homo Sapiens
EERGRFWSG

SEQ ID NO: 822285 - protein, 9 aa, Homo Sapiens
VLEYWMRLH

SEQ ID NO: 822286 - protein, 9 aa, Homo Sapiens
PQALYQNNG

SEQ ID NO: 822287 - protein, 9 aa, Homo Sapiens
MRTLGMGTS

SEQ ID NO: 822288 - protein, 9 aa, Homo Sapiens
TNKLLAYTN

SEQ ID NO: 822289 - protein, 9 aa, Homo Sapiens
GRCHVASLL

SEQ ID NO: 822290 - protein, 9 aa, Homo Sapiens
KHYWDVDVT

SEQ ID NO: 822291 - protein, 9 aa, Homo Sapiens
LQLLEKLIE

SEQ ID NO: 822292 - protein, 9 aa, Homo Sapiens
GIVNELYEQ

SEQ ID NO: 822293 - protein, 9 aa, Homo Sapiens
GIDINGIKP

SEQ ID NO: 822294 - protein, 9 aa, Homo Sapiens
TDVMLENYR

SEQ ID NO: 822295 - protein, 9 aa, Homo Sapiens
MVRFYMEKE

SEQ ID NO: 822296 - protein, 9 aa, Homo Sapiens
LRGSAGAAP

SEQ ID NO: 822297 - protein, 9 aa, Homo Sapiens
HWKPSFGRK

SEQ ID NO: 822298 - protein, 9 aa, Homo Sapiens
LYHWMHICS

SEQ ID NO: 822299 - protein, 9 aa, Homo Sapiens
HVLLDAIRF

SEQ ID NO: 822300 - protein, 9 aa, Homo Sapiens
GYGLVSFFN

SEQ ID NO: 822301 - protein, 9 aa, Homo Sapiens
PAHIVIPLP

SEQ ID NO: 822302 - protein, 9 aa, Homo Sapiens
IIVSYLWIR

SEQ ID NO: 822303 - protein, 9 aa, Homo Sapiens
GDKLVIVKC

SEQ ID NO: 822304 - protein, 9 aa, Homo Sapiens
ILWGQHFVP

SEQ ID NO: 822305 - protein, 9 aa, Homo Sapiens
ANYLLACEF

SEQ ID NO: 822306 - protein, 9 aa, Homo Sapiens
LHINHNSLD

SEQ ID NO: 822307 - protein, 9 aa, Homo Sapiens
AELMVHGYP

SEQ ID NO: 822308 - protein, 9 aa, Homo Sapiens
EELQINISL

SEQ ID NO: 822309 - protein, 9 aa, Homo Sapiens
RLSPRNTYS

SEQ ID NO: 822310 - protein, 9 aa, Homo Sapiens
VGMLYGSTA

SEQ ID NO: 822311 - protein, 9 aa, Homo Sapiens
SKRFWYIKG

SEQ ID NO: 822312 - protein, 9 aa, Homo Sapiens
HVNISVRFG

SEQ ID NO: 822313 - protein, 9 aa, Homo Sapiens
DPQGLMNSG

SEQ ID NO: 822314 - protein, 9 aa, Homo Sapiens
MTYDLASDV

SEQ ID NO: 822315 - protein, 9 aa, Homo Sapiens
MSIQMYLWA

SEQ ID NO: 822316 - protein, 9 aa, Homo Sapiens
WYNLWKEFC

SEQ ID NO: 822317 - protein, 9 aa, Homo Sapiens
HKRYVLLFA

SEQ ID NO: 822318 - protein, 9 aa, Homo Sapiens
LSFFWDKNW

SEQ ID NO: 822319 - protein, 9 aa, Homo Sapiens
FKQWRIKLG

SEQ ID NO: 822320 - protein, 9 aa, Homo Sapiens
ATNRWDLMD

SEQ ID NO: 822321 - protein, 9 aa, Homo Sapiens
SKEKRDLIN

SEQ ID NO: 822322 - protein, 9 aa, Homo Sapiens
FELEAIMHK

SEQ ID NO: 822323 - protein, 9 aa, Homo Sapiens
PAVCNMQNN

SEQ ID NO: 822324 - protein, 9 aa, Homo Sapiens
RNQFNLIVF

SEQ ID NO: 822325 - protein, 9 aa, Homo Sapiens
FPVFLGTEA

SEQ ID NO: 822326 - protein, 9 aa, Homo Sapiens
NPAYEDVNN

SEQ ID NO: 822327 - protein, 9 aa, Homo Sapiens
AFVLNSPKL

SEQ ID NO: 822328 - protein, 9 aa, Homo Sapiens
QDDELYNPD

SEQ ID NO: 822329 - protein, 9 aa, Homo Sapiens
VPTQMSFIF

SEQ ID NO: 822330 - protein, 9 aa, Homo Sapiens
LLIPPDTLP

SEQ ID NO: 822331 - protein, 9 aa, Homo Sapiens
DEGAVLSFK

SEQ ID NO: 822332 - protein, 9 aa, Homo Sapiens
NNYTNSPEE

SEQ ID NO: 822333 - protein, 9 aa, Homo Sapiens
YKGTPGPAG

SEQ ID NO: 822334 - protein, 9 aa, Homo Sapiens
GHATKEEST

SEQ ID NO: 822335 - protein, 9 aa, Homo Sapiens
PSPEEKDLL

SEQ ID NO: 822336 - protein, 9 aa, Homo Sapiens
SQNPDPAVY

SEQ ID NO: 822337 - protein, 9 aa, Homo Sapiens
IAQKTRLTV

SEQ ID NO: 822338 - protein, 9 aa, Homo Sapiens
LLPLEEHSR

SEQ ID NO: 822339 - protein, 9 aa, Homo Sapiens
THEPVLKAM

SEQ ID NO: 822340 - protein, 9 aa, Homo Sapiens
NSSFKPVKS

SEQ ID NO: 822341 - protein, 9 aa, Homo Sapiens
HVLVGIQYF

SEQ ID NO: 822342 - protein, 9 aa, Homo Sapiens
TVERIEEPI

SEQ ID NO: 822343 - protein, 9 aa, Homo Sapiens
PTFWQMQCS

SEQ ID NO: 822344 - protein, 9 aa, Homo Sapiens
YYDIEADDN

SEQ ID NO: 822345 - protein, 9 aa, Homo Sapiens
IKLKREYEV

SEQ ID NO: 822346 - protein, 9 aa, Homo Sapiens
LRKEYGTFS

SEQ ID NO: 822347 - protein, 9 aa, Homo Sapiens
HMFFEGLRL

SEQ ID NO: 822348 - protein, 9 aa, Homo Sapiens
YNISYFTQE

SEQ ID NO: 822349 - protein, 9 aa, Homo Sapiens
GKKSNNSFL

SEQ ID NO: 822350 - protein, 9 aa, Homo Sapiens
ERNHSTFEG

SEQ ID NO: 822351 - protein, 9 aa, Homo Sapiens
DPVGEEFHP

SEQ ID NO: 822352 - protein, 9 aa, Homo Sapiens
MEQHNIKGE

SEQ ID NO: 822353 - protein, 9 aa, Homo Sapiens
RCQELLDEW

SEQ ID NO: 822354 - protein, 9 aa, Homo Sapiens
TQVLINGAW

SEQ ID NO: 822355 - protein, 9 aa, Homo Sapiens
DLQHGSLLF

SEQ ID NO: 822356 - protein, 9 aa, Homo Sapiens
EIYQITNDL

SEQ ID NO: 822357 - protein, 9 aa, Homo Sapiens
ALAPLPPST

SEQ ID NO: 822358 - protein, 9 aa, Homo Sapiens
TRLDLGKCI

SEQ ID NO: 822359 - protein, 9 aa, Homo Sapiens
PIPAHCKVI

SEQ ID NO: 822360 - protein, 9 aa, Homo Sapiens
TAMGTSSSL

SEQ ID NO: 822361 - protein, 9 aa, Homo Sapiens
LGNYLGLQP

SEQ ID NO: 822362 - protein, 9 aa, Homo Sapiens
CLGKQLKLR

SEQ ID NO: 822363 - protein, 9 aa, Homo Sapiens
GSKVIRQYL

SEQ ID NO: 822364 - protein, 9 aa, Homo Sapiens
WAVMDSIPA

SEQ ID NO: 822365 - protein, 9 aa, Homo Sapiens
KHLCHSAWP

SEQ ID NO: 822366 - protein, 9 aa, Homo Sapiens
LKSGLEDCA

SEQ ID NO: 822367 - protein, 9 aa, Homo Sapiens
PFQGLMELG

SEQ ID NO: 822368 - protein, 9 aa, Homo Sapiens
GCGSRCCVP

SEQ ID NO: 822369 - protein, 9 aa, Homo Sapiens
PFSITSNTY

SEQ ID NO: 822370 - protein, 9 aa, Homo Sapiens
YRISHMWQS

SEQ ID NO: 822371 - protein, 9 aa, Homo Sapiens
SEYFIKQML

SEQ ID NO: 822372 - protein, 9 aa, Homo Sapiens
KYIKRKAPF

SEQ ID NO: 822373 - protein, 9 aa, Homo Sapiens
KCFPEPHQE

SEQ ID NO: 822374 - protein, 9 aa, Homo Sapiens
RRPLWVLRA

SEQ ID NO: 822375 - protein, 9 aa, Homo Sapiens
IRHKYVNVR

SEQ ID NO: 822376 - protein, 9 aa, Homo Sapiens
HLAKVTADV

SEQ ID NO: 822377 - protein, 9 aa, Homo Sapiens
KLECPDPNI

SEQ ID NO: 822378 - protein, 9 aa, Homo Sapiens
EFVTKVMNL

SEQ ID NO: 822379 - protein, 9 aa, Homo Sapiens
PDEQKEVKP

SEQ ID NO: 822380 - protein, 9 aa, Homo Sapiens
ITALAALTL

SEQ ID NO: 822381 - protein, 9 aa, Homo Sapiens
ISIICMAIP

SEQ ID NO: 822382 - protein, 9 aa, Homo Sapiens
QAEVFQDTV

SEQ ID NO: 822383 - protein, 9 aa, Homo Sapiens
KFSDHVTFS

SEQ ID NO: 822384 - protein, 9 aa, Homo Sapiens
RVLLGNDTR

SEQ ID NO: 822385 - protein, 9 aa, Homo Sapiens
KRSGRSCEK

SEQ ID NO: 822386 - protein, 9 aa, Homo Sapiens
KAQDEPSSR

SEQ ID NO: 822387 - protein, 9 aa, Homo Sapiens
THRQNYEEK

SEQ ID NO: 822388 - protein, 9 aa, Homo Sapiens
NHEQLHTAI

SEQ ID NO: 822389 - protein, 9 aa, Homo Sapiens
NLSHKLISQ

SEQ ID NO: 822390 - protein, 9 aa, Homo Sapiens
EQRPGNIYS

SEQ ID NO: 822391 - protein, 9 aa, Homo Sapiens
DLSKLAQGR

SEQ ID NO: 822392 - protein, 9 aa, Homo Sapiens
KRKKRKYIN

SEQ ID NO: 822393 - protein, 9 aa, Homo Sapiens
RLWRVARSI

SEQ ID NO: 822394 - protein, 9 aa, Homo Sapiens
TENDFKAFF

SEQ ID NO: 822395 - protein, 9 aa, Homo Sapiens
TNHLYAAIL

SEQ ID NO: 822396 - protein, 9 aa, Homo Sapiens
RWKQQNLNK

SEQ ID NO: 822397 - protein, 9 aa, Homo Sapiens
GHMPEKEML

SEQ ID NO: 822398 - protein, 9 aa, Homo Sapiens
PVGAVQIGI

SEQ ID NO: 822399 - protein, 9 aa, Homo Sapiens
GEHSLKCMI

SEQ ID NO: 822400 - protein, 9 aa, Homo Sapiens
RGKLRAEID

SEQ ID NO: 822401 - protein, 9 aa, Homo Sapiens
CVGGDGGPS

SEQ ID NO: 822402 - protein, 9 aa, Homo Sapiens
RNILVENNY

SEQ ID NO: 822403 - protein, 9 aa, Homo Sapiens
YYGKSPELI

SEQ ID NO: 822404 - protein, 9 aa, Homo Sapiens
SRERRLKQN

SEQ ID NO: 822405 - protein, 9 aa, Homo Sapiens
SNTFGRPLN

SEQ ID NO: 822406 - protein, 9 aa, Homo Sapiens
CCFKDNQGD

SEQ ID NO: 822407 - protein, 9 aa, Homo Sapiens
TEEERRVAS

SEQ ID NO: 822408 - protein, 9 aa, Homo Sapiens
TLFKEYFIN

SEQ ID NO: 822409 - protein, 9 aa, Homo Sapiens
NPMYRVLSP

SEQ ID NO: 822410 - protein, 9 aa, Homo Sapiens
NSPSFDAIL

SEQ ID NO: 822411 - protein, 9 aa, Homo Sapiens
PQTTQADIV

SEQ ID NO: 822412 - protein, 9 aa, Homo Sapiens
VQHSEGYRH

SEQ ID NO: 822413 - protein, 9 aa, Homo Sapiens
DDLSYCWLL

SEQ ID NO: 822414 - protein, 9 aa, Homo Sapiens
DWCDWTMIS

SEQ ID NO: 822415 - protein, 9 aa, Homo Sapiens
TDPAELKKL

SEQ ID NO: 822416 - protein, 9 aa, Homo Sapiens
RELYGPNKR

SEQ ID NO: 822417 - protein, 9 aa, Homo Sapiens
LAAGPQGPK

SEQ ID NO: 822418 - protein, 9 aa, Homo Sapiens
VRDINLKEY

SEQ ID NO: 822419 - protein, 9 aa, Homo Sapiens
IQELRKCCD

SEQ ID NO: 822420 - protein, 9 aa, Homo Sapiens
GTRKAYFRW

SEQ ID NO: 822421 - protein, 9 aa, Homo Sapiens
SLDATVAQV

SEQ ID NO: 822422 - protein, 9 aa, Homo Sapiens
KLDMARGKN

SEQ ID NO: 822423 - protein, 9 aa, Homo Sapiens
TQVIHSIKY

SEQ ID NO: 822424 - protein, 9 aa, Homo Sapiens
GGRALLLQT

SEQ ID NO: 822425 - protein, 9 aa, Homo Sapiens
QAVTVSYLY

SEQ ID NO: 822426 - protein, 9 aa, Homo Sapiens
MKGLQEQQE

SEQ ID NO: 822427 - protein, 9 aa, Homo Sapiens
SVSCWAKGL

SEQ ID NO: 822428 - protein, 9 aa, Homo Sapiens
AAGERTLQR

SEQ ID NO: 822429 - protein, 9 aa, Homo Sapiens
KIKVSYSER

SEQ ID NO: 822430 - protein, 9 aa, Homo Sapiens
NKEFKSAIR

SEQ ID NO: 822431 - protein, 9 aa, Homo Sapiens
LSSDSSESS

SEQ ID NO: 822432 - protein, 9 aa, Homo Sapiens
ISDTCLANV

SEQ ID NO: 822433 - protein, 9 aa, Homo Sapiens
APLKVKRSP

SEQ ID NO: 822434 - protein, 9 aa, Homo Sapiens
KHIDHTFEI

SEQ ID NO: 822435 - protein, 9 aa, Homo Sapiens
NKEKRGSQP

SEQ ID NO: 822436 - protein, 9 aa, Homo Sapiens
LKDRTIKQT

SEQ ID NO: 822437 - protein, 9 aa, Homo Sapiens
KCPLLPVRG

SEQ ID NO: 822438 - protein, 9 aa, Homo Sapiens
RLKTMTDMF

SEQ ID NO: 822439 - protein, 9 aa, Homo Sapiens
IANVSYPEV

SEQ ID NO: 822440 - protein, 9 aa, Homo Sapiens
CITCQKSYN

SEQ ID NO: 822441 - protein, 9 aa, Homo Sapiens
EQQLLRKVF

SEQ ID NO: 822442 - protein, 9 aa, Homo Sapiens
MAVAQVHLL

SEQ ID NO: 822443 - protein, 9 aa, Homo Sapiens
QLQSDLVRV

SEQ ID NO: 822444 - protein, 9 aa, Homo Sapiens
ETKGSAGKM

SEQ ID NO: 822445 - protein, 9 aa, Homo Sapiens
LIAKERQKQ

SEQ ID NO: 822446 - protein, 9 aa, Homo Sapiens
EELLSQVDK

SEQ ID NO: 822447 - protein, 9 aa, Homo Sapiens
SFTAQFNMF

SEQ ID NO: 822448 - protein, 9 aa, Homo Sapiens
VQKVREHLH

SEQ ID NO: 822449 - protein, 9 aa, Homo Sapiens
KKQRSRIND

SEQ ID NO: 822450 - protein, 9 aa, Homo Sapiens
TQQQNLNKK

SEQ ID NO: 822451 - protein, 9 aa, Homo Sapiens
NFNCSTIVI

SEQ ID NO: 822452 - protein, 9 aa, Homo Sapiens
TFHPEILEN

SEQ ID NO: 822453 - protein, 9 aa, Homo Sapiens
NRISTFKRK

SEQ ID NO: 822454 - protein, 9 aa, Homo Sapiens
HALTDHLRL

SEQ ID NO: 822455 - protein, 9 aa, Homo Sapiens
KANGPELGS

SEQ ID NO: 822456 - protein, 9 aa, Homo Sapiens
VCAYSPGGD

SEQ ID NO: 822457 - protein, 9 aa, Homo Sapiens
RVGLILPLC

SEQ ID NO: 822458 - protein, 9 aa, Homo Sapiens
QQMESGYES

SEQ ID NO: 822459 - protein, 9 aa, Homo Sapiens
EMAIAVSSS

SEQ ID NO: 822460 - protein, 9 aa, Homo Sapiens
KKITKDIMK

SEQ ID NO: 822461 - protein, 9 aa, Homo Sapiens
RMLSSLPVI

SEQ ID NO: 822462 - protein, 9 aa, Homo Sapiens
IKVGSGPGS

SEQ ID NO: 822463 - protein, 9 aa, Homo Sapiens
MVCKVGKDY

SEQ ID NO: 822464 - protein, 9 aa, Homo Sapiens
ASAHFSQPT

SEQ ID NO: 822465 - protein, 9 aa, Homo Sapiens
ELNPRSSSK

SEQ ID NO: 822466 - protein, 9 aa, Homo Sapiens
SGIDINGIK

SEQ ID NO: 822467 - protein, 9 aa, Homo Sapiens
EQRLIHKSI

SEQ ID NO: 822468 - protein, 9 aa, Homo Sapiens
VAVVFSEED

SEQ ID NO: 822469 - protein, 9 aa, Homo Sapiens
VFKLRLNDD

SEQ ID NO: 822470 - protein, 9 aa, Homo Sapiens
TLAILLCVY

SEQ ID NO: 822471 - protein, 9 aa, Homo Sapiens
FKMPQEINC

SEQ ID NO: 822472 - protein, 9 aa, Homo Sapiens
QNLANTNQH

SEQ ID NO: 822473 - protein, 9 aa, Homo Sapiens
LGGPGMVAD

SEQ ID NO: 822474 - protein, 9 aa, Homo Sapiens
DWYNVPDQA

SEQ ID NO: 822475 - protein, 9 aa, Homo Sapiens
DNTSQERDR

SEQ ID NO: 822476 - protein, 9 aa, Homo Sapiens
ENHMYIFKT

SEQ ID NO: 822477 - protein, 9 aa, Homo Sapiens
WKVISSLEI

SEQ ID NO: 822478 - protein, 9 aa, Homo Sapiens
LVLYLSMQE

SEQ ID NO: 822479 - protein, 9 aa, Homo Sapiens
SDTVYHNSQ

SEQ ID NO: 822480 - protein, 9 aa, Homo Sapiens
QMDALLEFN

SEQ ID NO: 822481 - protein, 9 aa, Homo Sapiens
VPYTEESYM

SEQ ID NO: 822482 - protein, 9 aa, Homo Sapiens
LDPNLLDSL

SEQ ID NO: 822483 - protein, 9 aa, Homo Sapiens
ISSSLGGRT

SEQ ID NO: 822484 - protein, 9 aa, Homo Sapiens
FNIHKKLAT

SEQ ID NO: 822485 - protein, 9 aa, Homo Sapiens
PEVINGKTH

SEQ ID NO: 822486 - protein, 9 aa, Homo Sapiens
NCSDRVFKA

SEQ ID NO: 822487 - protein, 9 aa, Homo Sapiens
ERLCEQDKL

SEQ ID NO: 822488 - protein, 9 aa, Homo Sapiens
ENKELQEEN

SEQ ID NO: 822489 - protein, 9 aa, Homo Sapiens
AEIDNLHRT

SEQ ID NO: 822490 - protein, 9 aa, Homo Sapiens
VLMQEYEEQ

SEQ ID NO: 822491 - protein, 9 aa, Homo Sapiens
SPSPGLSHL

SEQ ID NO: 822492 - protein, 9 aa, Homo Sapiens
NSMLESCEL

SEQ ID NO: 822493 - protein, 9 aa, Homo Sapiens
ARLTCHILL

SEQ ID NO: 822494 - protein, 9 aa, Homo Sapiens
SAVQLQERL

SEQ ID NO: 822495 - protein, 9 aa, Homo Sapiens
PEKNESKRM

SEQ ID NO: 822496 - protein, 9 aa, Homo Sapiens
SNSHANILY

SEQ ID NO: 822497 - protein, 9 aa, Homo Sapiens
QSSSQDEER

SEQ ID NO: 822498 - protein, 9 aa, Homo Sapiens
GEKPYECHK

SEQ ID NO: 822499 - protein, 9 aa, Homo Sapiens
CGDKVNLLS

SEQ ID NO: 822500 - protein, 9 aa, Homo Sapiens
VVISIICMA

SEQ ID NO: 822501 - protein, 9 aa, Homo Sapiens
WVDYSITKR

SEQ ID NO: 822502 - protein, 9 aa, Homo Sapiens
NLFLRGGVV

SEQ ID NO: 822503 - protein, 9 aa, Homo Sapiens
LMIFSVGKR

SEQ ID NO: 822504 - protein, 9 aa, Homo Sapiens
KWRRKAAYW

SEQ ID NO: 822505 - protein, 9 aa, Homo Sapiens
DSNYPPFCL

SEQ ID NO: 822506 - protein, 9 aa, Homo Sapiens
VCYPVLTPN

SEQ ID NO: 822507 - protein, 9 aa, Homo Sapiens
LILPGKLSL

SEQ ID NO: 822508 - protein, 9 aa, Homo Sapiens
SGHYFDEKH

SEQ ID NO: 822509 - protein, 9 aa, Homo Sapiens
LMKKIQGKD

SEQ ID NO: 822510 - protein, 9 aa, Homo Sapiens
RRRLKKDNK

SEQ ID NO: 822511 - protein, 9 aa, Homo Sapiens
PRSRQIIPR

SEQ ID NO: 822512 - protein, 9 aa, Homo Sapiens
LELVVTVVS

SEQ ID NO: 822513 - protein, 9 aa, Homo Sapiens
CVAVCVSSP

SEQ ID NO: 822514 - protein, 9 aa, Homo Sapiens
FLNQLEPDP

SEQ ID NO: 822515 - protein, 9 aa, Homo Sapiens
EIKKIKYKS

SEQ ID NO: 822516 - protein, 9 aa, Homo Sapiens
FQSDAAMQK

SEQ ID NO: 822517 - protein, 9 aa, Homo Sapiens
FCLFADNVD

SEQ ID NO: 822518 - protein, 9 aa, Homo Sapiens
EHKSTFSIL

SEQ ID NO: 822519 - protein, 9 aa, Homo Sapiens
IQILTCQKT

SEQ ID NO: 822520 - protein, 9 aa, Homo Sapiens
ERITRDNAA

SEQ ID NO: 822521 - protein, 9 aa, Homo Sapiens
QKLEEQFQS

SEQ ID NO: 822522 - protein, 9 aa, Homo Sapiens
PGTLGEIWS

SEQ ID NO: 822523 - protein, 9 aa, Homo Sapiens
MPMSGNTGD

SEQ ID NO: 822524 - protein, 9 aa, Homo Sapiens
GDYFSLIQQ

SEQ ID NO: 822525 - protein, 9 aa, Homo Sapiens
ATTLRKVLS

SEQ ID NO: 822526 - protein, 9 aa, Homo Sapiens
KEQEHIHRE

SEQ ID NO: 822527 - protein, 9 aa, Homo Sapiens
LLIYLSKGT

SEQ ID NO: 822528 - protein, 9 aa, Homo Sapiens
LKPDITWFQ

SEQ ID NO: 822529 - protein, 9 aa, Homo Sapiens
NNMMAACDP

SEQ ID NO: 822530 - protein, 9 aa, Homo Sapiens
LQDPWNWLD

SEQ ID NO: 822531 - protein, 9 aa, Homo Sapiens
LCTKAIVET

SEQ ID NO: 822532 - protein, 9 aa, Homo Sapiens
LQRLFKWQH

SEQ ID NO: 822533 - protein, 9 aa, Homo Sapiens
ESPLKYLET

SEQ ID NO: 822534 - protein, 9 aa, Homo Sapiens
AKEELERQV

SEQ ID NO: 822535 - protein, 9 aa, Homo Sapiens
IRRQSRTDN

SEQ ID NO: 822536 - protein, 9 aa, Homo Sapiens
WAANTGVTA

SEQ ID NO: 822537 - protein, 9 aa, Homo Sapiens
SNLRKKAFE

SEQ ID NO: 822538 - protein, 9 aa, Homo Sapiens
KQLCLLQEV

SEQ ID NO: 822539 - protein, 9 aa, Homo Sapiens
PQGKVVQII

SEQ ID NO: 822540 - protein, 9 aa, Homo Sapiens
RHFVGEIFE

SEQ ID NO: 822541 - protein, 9 aa, Homo Sapiens
MTNVLEGIG

SEQ ID NO: 822542 - protein, 9 aa, Homo Sapiens
NNLEEAKKI

SEQ ID NO: 822543 - protein, 9 aa, Homo Sapiens
PVLVKRAKK

SEQ ID NO: 822544 - protein, 9 aa, Homo Sapiens
LRSYILGKT

SEQ ID NO: 822545 - protein, 9 aa, Homo Sapiens
AQLIGEPPI

SEQ ID NO: 822546 - protein, 9 aa, Homo Sapiens
VVSNAWAVT

SEQ ID NO: 822547 - protein, 9 aa, Homo Sapiens
ANLKSVKKD

SEQ ID NO: 822548 - protein, 9 aa, Homo Sapiens
PSQTTANNW

SEQ ID NO: 822549 - protein, 9 aa, Homo Sapiens
FVSALCQRI

SEQ ID NO: 822550 - protein, 9 aa, Homo Sapiens
KMYSFKHQR

SEQ ID NO: 822551 - protein, 9 aa, Homo Sapiens
KNDIGGDGN

SEQ ID NO: 822552 - protein, 9 aa, Homo Sapiens
IIVISTPNS

SEQ ID NO: 822553 - protein, 9 aa, Homo Sapiens
RQQIVRAQK

SEQ ID NO: 822554 - protein, 9 aa, Homo Sapiens
GTPVYISPE

SEQ ID NO: 822555 - protein, 9 aa, Homo Sapiens
SVERRSEKY

SEQ ID NO: 822556 - protein, 9 aa, Homo Sapiens
RYLPKLTSL

SEQ ID NO: 822557 - protein, 9 aa, Homo Sapiens
VKISASRQT

SEQ ID NO: 822558 - protein, 9 aa, Homo Sapiens
NAIHLLVHK

SEQ ID NO: 822559 - protein, 9 aa, Homo Sapiens
KRYVAVAIK

SEQ ID NO: 822560 - protein, 9 aa, Homo Sapiens
WYCTRLKTM

SEQ ID NO: 822561 - protein, 9 aa, Homo Sapiens
QEDEFRYQM

SEQ ID NO: 822562 - protein, 9 aa, Homo Sapiens
PPETAQTEP

SEQ ID NO: 822563 - protein, 9 aa, Homo Sapiens
EGSTLAGVD

SEQ ID NO: 822564 - protein, 9 aa, Homo Sapiens
NIEAQVKPC

SEQ ID NO: 822565 - protein, 9 aa, Homo Sapiens
TNTYFNIHP

SEQ ID NO: 822566 - protein, 9 aa, Homo Sapiens
QELKTMRKV

SEQ ID NO: 822567 - protein, 9 aa, Homo Sapiens
PAQGCMGYC

SEQ ID NO: 822568 - protein, 9 aa, Homo Sapiens
IQNIRLLKK

SEQ ID NO: 822569 - protein, 9 aa, Homo Sapiens
LSSMFLSVT

SEQ ID NO: 822570 - protein, 9 aa, Homo Sapiens
SSRYGNLHS

SEQ ID NO: 822571 - protein, 9 aa, Homo Sapiens
VSLLIFLFA

SEQ ID NO: 822572 - protein, 9 aa, Homo Sapiens
HKHNQNENV

SEQ ID NO: 822573 - protein, 9 aa, Homo Sapiens
IHAANVTQT

SEQ ID NO: 822574 - protein, 9 aa, Homo Sapiens
HAGDKFYKC

SEQ ID NO: 822575 - protein, 9 aa, Homo Sapiens
GGFYPFPQG

SEQ ID NO: 822576 - protein, 9 aa, Homo Sapiens
RYPVLIIEA

SEQ ID NO: 822577 - protein, 9 aa, Homo Sapiens
TIKQTDEEG

SEQ ID NO: 822578 - protein, 9 aa, Homo Sapiens
PSHIGSIIN

SEQ ID NO: 822579 - protein, 9 aa, Homo Sapiens
SRKRVLEIK

SEQ ID NO: 822580 - protein, 9 aa, Homo Sapiens
TTKQTTSLL

SEQ ID NO: 822581 - protein, 9 aa, Homo Sapiens
DEGNKETSP

SEQ ID NO: 822582 - protein, 9 aa, Homo Sapiens
VAVTMLLGV

SEQ ID NO: 822583 - protein, 9 aa, Homo Sapiens
NKKGIAAKS

SEQ ID NO: 822584 - protein, 9 aa, Homo Sapiens
TCMMEYPSG

SEQ ID NO: 822585 - protein, 9 aa, Homo Sapiens
ESLDATVAQ

SEQ ID NO: 822586 - protein, 9 aa, Homo Sapiens
KITYLGNKA

SEQ ID NO: 822587 - protein, 9 aa, Homo Sapiens
TDGVLLCCQ

SEQ ID NO: 822588 - protein, 9 aa, Homo Sapiens
FSILEILFT

SEQ ID NO: 822589 - protein, 9 aa, Homo Sapiens
DNLHIAEDD

SEQ ID NO: 822590 - protein, 9 aa, Homo Sapiens
YMLICLVLR

SEQ ID NO: 822591 - protein, 9 aa, Homo Sapiens
HNKRTEVVL

SEQ ID NO: 822592 - protein, 9 aa, Homo Sapiens
IIIRQLQEQ

SEQ ID NO: 822593 - protein, 9 aa, Homo Sapiens
TKKNKINNG

SEQ ID NO: 822594 - protein, 9 aa, Homo Sapiens
LRQKRINSA

SEQ ID NO: 822595 - protein, 9 aa, Homo Sapiens
KSKSAEFLT

SEQ ID NO: 822596 - protein, 9 aa, Homo Sapiens
FQLHFGHPA

SEQ ID NO: 822597 - protein, 9 aa, Homo Sapiens
LPTVMSCDR

SEQ ID NO: 822598 - protein, 9 aa, Homo Sapiens
VYRQANTIN

SEQ ID NO: 822599 - protein, 9 aa, Homo Sapiens
LDVESLMEL

SEQ ID NO: 822600 - protein, 9 aa, Homo Sapiens
CYGLSGKEV

SEQ ID NO: 822601 - protein, 9 aa, Homo Sapiens
LQAYAKTLC

SEQ ID NO: 822602 - protein, 9 aa, Homo Sapiens
PHMKIFLFM

SEQ ID NO: 822603 - protein, 9 aa, Homo Sapiens
CGRSNKRSS

SEQ ID NO: 822604 - protein, 9 aa, Homo Sapiens
VKKVDAQSL

SEQ ID NO: 822605 - protein, 9 aa, Homo Sapiens
NDGDDDEDS

SEQ ID NO: 822606 - protein, 9 aa, Homo Sapiens
YLIVSILYL

SEQ ID NO: 822607 - protein, 9 aa, Homo Sapiens
VLTTLKEYE

SEQ ID NO: 822608 - protein, 9 aa, Homo Sapiens
AEHFSPFCV

SEQ ID NO: 822609 - protein, 9 aa, Homo Sapiens
FSEFKDLIG

SEQ ID NO: 822610 - protein, 9 aa, Homo Sapiens
LITLAFPSP

SEQ ID NO: 822611 - protein, 9 aa, Homo Sapiens
AALLFRSAC

SEQ ID NO: 822612 - protein, 9 aa, Homo Sapiens
WRQQKERIA

SEQ ID NO: 822613 - protein, 9 aa, Homo Sapiens
PRNQFNLIV

SEQ ID NO: 822614 - protein, 9 aa, Homo Sapiens
LSKQNLVDC

SEQ ID NO: 822615 - protein, 9 aa, Homo Sapiens
FTSSSIGDV

SEQ ID NO: 822616 - protein, 9 aa, Homo Sapiens
IGLEFILKS

SEQ ID NO: 822617 - protein, 9 aa, Homo Sapiens
ALIGSDVVD

SEQ ID NO: 822618 - protein, 9 aa, Homo Sapiens
YLVMPKEMV

SEQ ID NO: 822619 - protein, 9 aa, Homo Sapiens
YGCILCGKA

SEQ ID NO: 822620 - protein, 9 aa, Homo Sapiens
PEKVKQLCN

SEQ ID NO: 822621 - protein, 9 aa, Homo Sapiens
SPVDVSYAT

SEQ ID NO: 822622 - protein, 9 aa, Homo Sapiens
SVTILVAVG

SEQ ID NO: 822623 - protein, 9 aa, Homo Sapiens
FKYFFYIIS

SEQ ID NO: 822624 - protein, 9 aa, Homo Sapiens
TSTFNLFEP

SEQ ID NO: 822625 - protein, 9 aa, Homo Sapiens
INIPLVHIL

SEQ ID NO: 822626 - protein, 9 aa, Homo Sapiens
TVFPVLQTN

SEQ ID NO: 822627 - protein, 9 aa, Homo Sapiens
EDPGQGLSM

SEQ ID NO: 822628 - protein, 9 aa, Homo Sapiens
GKSNIQFSG

SEQ ID NO: 822629 - protein, 9 aa, Homo Sapiens
KLAEEIPTP

SEQ ID NO: 822630 - protein, 9 aa, Homo Sapiens
YGLLPWTNC

SEQ ID NO: 822631 - protein, 9 aa, Homo Sapiens
KNKLGVSVS

SEQ ID NO: 822632 - protein, 9 aa, Homo Sapiens
SGDELINQS

SEQ ID NO: 822633 - protein, 9 aa, Homo Sapiens
DERASLQYE

SEQ ID NO: 822634 - protein, 9 aa, Homo Sapiens
LIQDKYSVN

SEQ ID NO: 822635 - protein, 9 aa, Homo Sapiens
FLEKIVCNP

SEQ ID NO: 822636 - protein, 9 aa, Homo Sapiens
YAGTFSKNC

SEQ ID NO: 822637 - protein, 9 aa, Homo Sapiens
VHAGGDPMC

SEQ ID NO: 822638 - protein, 9 aa, Homo Sapiens
CKVHMGEKH

SEQ ID NO: 822639 - protein, 9 aa, Homo Sapiens
RMELFRNIF

SEQ ID NO: 822640 - protein, 9 aa, Homo Sapiens
RGCVARAGE

SEQ ID NO: 822641 - protein, 9 aa, Homo Sapiens
QHEPLAKII

SEQ ID NO: 822642 - protein, 9 aa, Homo Sapiens
AMSCSENCL

SEQ ID NO: 822643 - protein, 9 aa, Homo Sapiens
SVYIFSFLD

SEQ ID NO: 822644 - protein, 9 aa, Homo Sapiens
NLTELSTFL

SEQ ID NO: 822645 - protein, 9 aa, Homo Sapiens
AFTDSRITR

SEQ ID NO: 822646 - protein, 9 aa, Homo Sapiens
INHCGIASA

SEQ ID NO: 822647 - protein, 9 aa, Homo Sapiens
DSIDHVQQV

SEQ ID NO: 822648 - protein, 9 aa, Homo Sapiens
KIFFLYMAP

SEQ ID NO: 822649 - protein, 9 aa, Homo Sapiens
VPNKCYVHN

SEQ ID NO: 822650 - protein, 9 aa, Homo Sapiens
LSHSITQGA

SEQ ID NO: 822651 - protein, 9 aa, Homo Sapiens
QADDLSNPV

SEQ ID NO: 822652 - protein, 9 aa, Homo Sapiens
VNKRDSIGT

SEQ ID NO: 822653 - protein, 9 aa, Homo Sapiens
KLQEEIDTV

SEQ ID NO: 822654 - protein, 9 aa, Homo Sapiens
HYPKKNRRW

SEQ ID NO: 822655 - protein, 9 aa, Homo Sapiens
ISYIDNPLD

SEQ ID NO: 822656 - protein, 9 aa, Homo Sapiens
VEKIITKKK

SEQ ID NO: 822657 - protein, 9 aa, Homo Sapiens
VIQVLSHLL

SEQ ID NO: 822658 - protein, 9 aa, Homo Sapiens
LCTLSFHLN

SEQ ID NO: 822659 - protein, 9 aa, Homo Sapiens
THRPPRAGN

SEQ ID NO: 822660 - protein, 9 aa, Homo Sapiens
DQTVTDGQD

SEQ ID NO: 822661 - protein, 9 aa, Homo Sapiens
QFKIPEVEL

SEQ ID NO: 822662 - protein, 9 aa, Homo Sapiens
VPYKDLKTK

SEQ ID NO: 822663 - protein, 9 aa, Homo Sapiens
NNSFMWPNI

SEQ ID NO: 822664 - protein, 9 aa, Homo Sapiens
ATVRNYSEA

SEQ ID NO: 822665 - protein, 9 aa, Homo Sapiens
KKLDQLIEQ

SEQ ID NO: 822666 - protein, 9 aa, Homo Sapiens
AFFVQETDH

SEQ ID NO: 822667 - protein, 9 aa, Homo Sapiens
RDYRYDRVI

SEQ ID NO: 822668 - protein, 9 aa, Homo Sapiens
AFTFGIDSH

SEQ ID NO: 822669 - protein, 9 aa, Homo Sapiens
MGLMFASVY

SEQ ID NO: 822670 - protein, 9 aa, Homo Sapiens
TPLPNYYSV

SEQ ID NO: 822671 - protein, 9 aa, Homo Sapiens
ASMPDKEPS

SEQ ID NO: 822672 - protein, 9 aa, Homo Sapiens
RANYLQDRI

SEQ ID NO: 822673 - protein, 9 aa, Homo Sapiens
VPREIRWGH

SEQ ID NO: 822674 - protein, 9 aa, Homo Sapiens
WEIEEKYSI

SEQ ID NO: 822675 - protein, 9 aa, Homo Sapiens
IMNKRDGTP

SEQ ID NO: 822676 - protein, 9 aa, Homo Sapiens
KKRLRKAIR

SEQ ID NO: 822677 - protein, 9 aa, Homo Sapiens
KARSTTKKS

SEQ ID NO: 822678 - protein, 9 aa, Homo Sapiens
YFHKEEREG

SEQ ID NO: 822679 - protein, 9 aa, Homo Sapiens
GQNNGDAIV

SEQ ID NO: 822680 - protein, 9 aa, Homo Sapiens
NPPPDNVQL

SEQ ID NO: 822681 - protein, 9 aa, Homo Sapiens
KTSSYTLIL

SEQ ID NO: 822682 - protein, 9 aa, Homo Sapiens
GRPQPGHEN

SEQ ID NO: 822683 - protein, 9 aa, Homo Sapiens
IVILSLPKY

SEQ ID NO: 822684 - protein, 9 aa, Homo Sapiens
KNASDLLRK

SEQ ID NO: 822685 - protein, 9 aa, Homo Sapiens
YLQNDSVLD

SEQ ID NO: 822686 - protein, 9 aa, Homo Sapiens
KVSDLTQTA

SEQ ID NO: 822687 - protein, 9 aa, Homo Sapiens
KYKVKANLN

SEQ ID NO: 822688 - protein, 9 aa, Homo Sapiens
AVEITEQLH

SEQ ID NO: 822689 - protein, 9 aa, Homo Sapiens
GDKAKYTTS

SEQ ID NO: 822690 - protein, 9 aa, Homo Sapiens
IKVATQISK

SEQ ID NO: 822691 - protein, 9 aa, Homo Sapiens
NGRLDPQEL

SEQ ID NO: 822692 - protein, 9 aa, Homo Sapiens
GLEFPPKKL

SEQ ID NO: 822693 - protein, 9 aa, Homo Sapiens
NAKNNWQRI

SEQ ID NO: 822694 - protein, 9 aa, Homo Sapiens
PKLTDIVSF

SEQ ID NO: 822695 - protein, 9 aa, Homo Sapiens
NQKLFDELR

SEQ ID NO: 822696 - protein, 9 aa, Homo Sapiens
PPEPEAKTD

SEQ ID NO: 822697 - protein, 9 aa, Homo Sapiens
IINFRKGYR

SEQ ID NO: 822698 - protein, 9 aa, Homo Sapiens
QGGVEDEAT

SEQ ID NO: 822699 - protein, 9 aa, Homo Sapiens
SDGSDSSDS

SEQ ID NO: 822700 - protein, 9 aa, Homo Sapiens
PWLLEVNRS

SEQ ID NO: 822701 - protein, 9 aa, Homo Sapiens
LKVQDVKST

SEQ ID NO: 822702 - protein, 9 aa, Homo Sapiens
EHLVLNEVY

SEQ ID NO: 822703 - protein, 9 aa, Homo Sapiens
FIAICTPLR

SEQ ID NO: 822704 - protein, 9 aa, Homo Sapiens
TAPSKLESP

SEQ ID NO: 822705 - protein, 9 aa, Homo Sapiens
NDQLQTHTV

SEQ ID NO: 822706 - protein, 9 aa, Homo Sapiens
AMAMQMAAF

SEQ ID NO: 822707 - protein, 9 aa, Homo Sapiens
MFCKEAKLE

SEQ ID NO: 822708 - protein, 9 aa, Homo Sapiens
DANFTATAH

SEQ ID NO: 822709 - protein, 9 aa, Homo Sapiens
AKYFGNYLF

SEQ ID NO: 822710 - protein, 9 aa, Homo Sapiens
PSVNYQAQE

SEQ ID NO: 822711 - protein, 9 aa, Homo Sapiens
MVTVAKSLE

SEQ ID NO: 822712 - protein, 9 aa, Homo Sapiens
KEGSLKDKK

SEQ ID NO: 822713 - protein, 9 aa, Homo Sapiens
NDDIFSILK

SEQ ID NO: 822714 - protein, 9 aa, Homo Sapiens
GNVDCDFCP

SEQ ID NO: 822715 - protein, 9 aa, Homo Sapiens
SLFMGVIQC

SEQ ID NO: 822716 - protein, 9 aa, Homo Sapiens
KIITGHGHT

SEQ ID NO: 822717 - protein, 9 aa, Homo Sapiens
CGTYFRNSS

SEQ ID NO: 822718 - protein, 9 aa, Homo Sapiens
LLHNGKSGR

SEQ ID NO: 822719 - protein, 9 aa, Homo Sapiens
REIPEGNDK

SEQ ID NO: 822720 - protein, 9 aa, Homo Sapiens
INNFQEEQA

SEQ ID NO: 822721 - protein, 9 aa, Homo Sapiens
LFRSHSSPP

SEQ ID NO: 822722 - protein, 9 aa, Homo Sapiens
KNLLEGEVD

SEQ ID NO: 822723 - protein, 9 aa, Homo Sapiens
HCFSGHATL

SEQ ID NO: 822724 - protein, 9 aa, Homo Sapiens
YDIEADDNP

SEQ ID NO: 822725 - protein, 9 aa, Homo Sapiens
IKEEIIKLE

SEQ ID NO: 822726 - protein, 9 aa, Homo Sapiens
SQQTGILCA

SEQ ID NO: 822727 - protein, 9 aa, Homo Sapiens
KEPITSALH

SEQ ID NO: 822728 - protein, 9 aa, Homo Sapiens
VSCVPISTE

SEQ ID NO: 822729 - protein, 9 aa, Homo Sapiens
ERSIFLVTG

SEQ ID NO: 822730 - protein, 9 aa, Homo Sapiens
SQCTCEEDF

SEQ ID NO: 822731 - protein, 9 aa, Homo Sapiens
GYTGLGHSR

SEQ ID NO: 822732 - protein, 9 aa, Homo Sapiens
RAKKPLFSS

SEQ ID NO: 822733 - protein, 9 aa, Homo Sapiens
FQMKMTLNN

SEQ ID NO: 822734 - protein, 9 aa, Homo Sapiens
YDSFNNTYQ

SEQ ID NO: 822735 - protein, 9 aa, Homo Sapiens
LLLRGSAGA

SEQ ID NO: 822736 - protein, 9 aa, Homo Sapiens
CGGNRNTFE

SEQ ID NO: 822737 - protein, 9 aa, Homo Sapiens
LKGSGVDAK

SEQ ID NO: 822738 - protein, 9 aa, Homo Sapiens
TGGVSIYGD

SEQ ID NO: 822739 - protein, 9 aa, Homo Sapiens
GVVDEINQG

SEQ ID NO: 822740 - protein, 9 aa, Homo Sapiens
YLPEEMESL

SEQ ID NO: 822741 - protein, 9 aa, Homo Sapiens
LAGQLGVEL

SEQ ID NO: 822742 - protein, 9 aa, Homo Sapiens
TDIAQLLDM

SEQ ID NO: 822743 - protein, 9 aa, Homo Sapiens
LKSGLDLHS

SEQ ID NO: 822744 - protein, 9 aa, Homo Sapiens
VPCSLECWD

SEQ ID NO: 822745 - protein, 9 aa, Homo Sapiens
RYEQREYGN

SEQ ID NO: 822746 - protein, 9 aa, Homo Sapiens
ASKRGMEQD

SEQ ID NO: 822747 - protein, 9 aa, Homo Sapiens
QSLAGLEVL

SEQ ID NO: 822748 - protein, 9 aa, Homo Sapiens
VDRVIKGQT

SEQ ID NO: 822749 - protein, 9 aa, Homo Sapiens
SAEQQPSDK

SEQ ID NO: 822750 - protein, 9 aa, Homo Sapiens
QFSCDMHPL

SEQ ID NO: 822751 - protein, 9 aa, Homo Sapiens
WNLALPLLS

SEQ ID NO: 822752 - protein, 9 aa, Homo Sapiens
AILISYIDN

SEQ ID NO: 822753 - protein, 9 aa, Homo Sapiens
EEHACHCSE

SEQ ID NO: 822754 - protein, 9 aa, Homo Sapiens
ALQSFNHEQ

SEQ ID NO: 822755 - protein, 9 aa, Homo Sapiens
SRATRGIKN

SEQ ID NO: 822756 - protein, 9 aa, Homo Sapiens
FKDNNTPSP

SEQ ID NO: 822757 - protein, 9 aa, Homo Sapiens
VPSILILMV

SEQ ID NO: 822758 - protein, 9 aa, Homo Sapiens
MYEKQICDT

SEQ ID NO: 822759 - protein, 9 aa, Homo Sapiens
NNTNSKDEQ

SEQ ID NO: 822760 - protein, 9 aa, Homo Sapiens
TLYGQEIYQ

SEQ ID NO: 822761 - protein, 9 aa, Homo Sapiens
KTRQYLNYP

SEQ ID NO: 822762 - protein, 9 aa, Homo Sapiens
AAHNLVLIP

SEQ ID NO: 822763 - protein, 9 aa, Homo Sapiens
LLDDSHEVE

SEQ ID NO: 822764 - protein, 9 aa, Homo Sapiens
KVIKLLKIL

SEQ ID NO: 822765 - protein, 9 aa, Homo Sapiens
EQDELLKMQ

SEQ ID NO: 822766 - protein, 9 aa, Homo Sapiens
IVALMAGKA

SEQ ID NO: 822767 - protein, 9 aa, Homo Sapiens
IKTVESITY

SEQ ID NO: 822768 - protein, 9 aa, Homo Sapiens
FIYLGVEWD

SEQ ID NO: 822769 - protein, 9 aa, Homo Sapiens
KGSLDRNKL

SEQ ID NO: 822770 - protein, 9 aa, Homo Sapiens
VSNELFQGG

SEQ ID NO: 822771 - protein, 9 aa, Homo Sapiens
PEDQGIPPF

SEQ ID NO: 822772 - protein, 9 aa, Homo Sapiens
LAVLTTLKE

SEQ ID NO: 822773 - protein, 9 aa, Homo Sapiens
IVPRHLFQI

SEQ ID NO: 822774 - protein, 9 aa, Homo Sapiens
MEITNCSRN

SEQ ID NO: 822775 - protein, 9 aa, Homo Sapiens
NISVLLMLN

SEQ ID NO: 822776 - protein, 9 aa, Homo Sapiens
LARILYLNE

SEQ ID NO: 822777 - protein, 9 aa, Homo Sapiens
DQCLKSWHR

SEQ ID NO: 822778 - protein, 9 aa, Homo Sapiens
FRNGLSGIK

SEQ ID NO: 822779 - protein, 9 aa, Homo Sapiens
WSCPSTFQN

SEQ ID NO: 822780 - protein, 9 aa, Homo Sapiens
LSPDTQPPN

SEQ ID NO: 822781 - protein, 9 aa, Homo Sapiens
LITCLQSGI

SEQ ID NO: 822782 - protein, 9 aa, Homo Sapiens
LIKTPLAPF

SEQ ID NO: 822783 - protein, 9 aa, Homo Sapiens
LQIRRLGEP

SEQ ID NO: 822784 - protein, 9 aa, Homo Sapiens
LEENHIQVP

SEQ ID NO: 822785 - protein, 9 aa, Homo Sapiens
KFSEITFFS

SEQ ID NO: 822786 - protein, 9 aa, Homo Sapiens
CVVCYKKCV

SEQ ID NO: 822787 - protein, 9 aa, Homo Sapiens
PFLLPSKIN

SEQ ID NO: 822788 - protein, 9 aa, Homo Sapiens
GIQSGKHFI

SEQ ID NO: 822789 - protein, 9 aa, Homo Sapiens
NYPPFCLGT

SEQ ID NO: 822790 - protein, 9 aa, Homo Sapiens
MHQTLGIAY

SEQ ID NO: 822791 - protein, 9 aa, Homo Sapiens
LADSSRHSG

SEQ ID NO: 822792 - protein, 9 aa, Homo Sapiens
NYQVTLHSI

SEQ ID NO: 822793 - protein, 9 aa, Homo Sapiens
WALAYQGLG

SEQ ID NO: 822794 - protein, 9 aa, Homo Sapiens
TLAHLDLSG

SEQ ID NO: 822795 - protein, 9 aa, Homo Sapiens
NKLVEELML

SEQ ID NO: 822796 - protein, 9 aa, Homo Sapiens
VLHLAVETQ

SEQ ID NO: 822797 - protein, 9 aa, Homo Sapiens
LGAWGVGKS

SEQ ID NO: 822798 - protein, 9 aa, Homo Sapiens
LPRKYIIEI

SEQ ID NO: 822799 - protein, 9 aa, Homo Sapiens
ISLSSNSSF

SEQ ID NO: 822800 - protein, 9 aa, Homo Sapiens
TLFARCILT

SEQ ID NO: 822801 - protein, 9 aa, Homo Sapiens
QTLFIFNEA

SEQ ID NO: 822802 - protein, 9 aa, Homo Sapiens
CINHEKMHN

SEQ ID NO: 822803 - protein, 9 aa, Homo Sapiens
LIVIHFPHP

SEQ ID NO: 822804 - protein, 9 aa, Homo Sapiens
ALLVLVAVA

SEQ ID NO: 822805 - protein, 9 aa, Homo Sapiens
RPHGVHVVL

SEQ ID NO: 822806 - protein, 9 aa, Homo Sapiens
VRDNNSPAL

SEQ ID NO: 822807 - protein, 9 aa, Homo Sapiens
GLVVNTGNR

SEQ ID NO: 822808 - protein, 9 aa, Homo Sapiens
GIMLRECIQ

SEQ ID NO: 822809 - protein, 9 aa, Homo Sapiens
IKESINKTL

SEQ ID NO: 822810 - protein, 9 aa, Homo Sapiens
EKVICLVRQ

SEQ ID NO: 822811 - protein, 9 aa, Homo Sapiens
GKNNVFVFP

SEQ ID NO: 822812 - protein, 9 aa, Homo Sapiens
DSKIKKIVY

SEQ ID NO: 822813 - protein, 9 aa, Homo Sapiens
PKEKSVQER

SEQ ID NO: 822814 - protein, 9 aa, Homo Sapiens
FPGLVGITF

SEQ ID NO: 822815 - protein, 9 aa, Homo Sapiens
VRDDGIQKL

SEQ ID NO: 822816 - protein, 9 aa, Homo Sapiens
EHASDLQVE

SEQ ID NO: 822817 - protein, 9 aa, Homo Sapiens
VSLSKQNLV

SEQ ID NO: 822818 - protein, 9 aa, Homo Sapiens
HYLPGCQDI

SEQ ID NO: 822819 - protein, 9 aa, Homo Sapiens
ILVVCLLCW

SEQ ID NO: 822820 - protein, 9 aa, Homo Sapiens
QPPHLEELH

SEQ ID NO: 822821 - protein, 9 aa, Homo Sapiens
SIDPMGGNT

SEQ ID NO: 822822 - protein, 9 aa, Homo Sapiens
LPALEPFIY

SEQ ID NO: 822823 - protein, 9 aa, Homo Sapiens
FCRSNVAEH

SEQ ID NO: 822824 - protein, 9 aa, Homo Sapiens
PAVSAAHVI

SEQ ID NO: 822825 - protein, 9 aa, Homo Sapiens
EKIFQEYHY

SEQ ID NO: 822826 - protein, 9 aa, Homo Sapiens
RYCPKKNKL

SEQ ID NO: 822827 - protein, 9 aa, Homo Sapiens
HTYFYAPEL

SEQ ID NO: 822828 - protein, 9 aa, Homo Sapiens
FTNSDLRND

SEQ ID NO: 822829 - protein, 9 aa, Homo Sapiens
GYRVACFAC

SEQ ID NO: 822830 - protein, 9 aa, Homo Sapiens
TVEIKLESF

SEQ ID NO: 822831 - protein, 9 aa, Homo Sapiens
GIYQQKFIK

SEQ ID NO: 822832 - protein, 9 aa, Homo Sapiens
QYLEPLTIL

SEQ ID NO: 822833 - protein, 9 aa, Homo Sapiens
IQHLKGLNS

SEQ ID NO: 822834 - protein, 9 aa, Homo Sapiens
SKNFKKIRN

SEQ ID NO: 822835 - protein, 9 aa, Homo Sapiens
PCTQHSLTW

SEQ ID NO: 822836 - protein, 9 aa, Homo Sapiens
KGDIMIDSR

SEQ ID NO: 822837 - protein, 9 aa, Homo Sapiens
TPDSIDIWI

SEQ ID NO: 822838 - protein, 9 aa, Homo Sapiens
DIIKPSFVP

SEQ ID NO: 822839 - protein, 9 aa, Homo Sapiens
IHFHPESRS

SEQ ID NO: 822840 - protein, 9 aa, Homo Sapiens
ANKDNGTGV

SEQ ID NO: 822841 - protein, 9 aa, Homo Sapiens
PSLLKKYQA

SEQ ID NO: 822842 - protein, 9 aa, Homo Sapiens
NSIQVVPRM

SEQ ID NO: 822843 - protein, 9 aa, Homo Sapiens
DKSLPHKKT

SEQ ID NO: 822844 - protein, 9 aa, Homo Sapiens
SGKHYKGPG

SEQ ID NO: 822845 - protein, 9 aa, Homo Sapiens
SRGVQEQTT

SEQ ID NO: 822846 - protein, 9 aa, Homo Sapiens
PNNNLKKNY

SEQ ID NO: 822847 - protein, 9 aa, Homo Sapiens
MTAVIFSDY

SEQ ID NO: 822848 - protein, 9 aa, Homo Sapiens
GDHVFCAVH

SEQ ID NO: 822849 - protein, 9 aa, Homo Sapiens
LSYSQLDAN

SEQ ID NO: 822850 - protein, 9 aa, Homo Sapiens
SMFETIDRK

SEQ ID NO: 822851 - protein, 9 aa, Homo Sapiens
NQDPVYPSL

SEQ ID NO: 822852 - protein, 9 aa, Homo Sapiens
WKEGNIIHF

SEQ ID NO: 822853 - protein, 9 aa, Homo Sapiens
KCKLQVIGL

SEQ ID NO: 822854 - protein, 9 aa, Homo Sapiens
AFSNSGFSR

SEQ ID NO: 822855 - protein, 9 aa, Homo Sapiens
PPHGSDTPN

SEQ ID NO: 822856 - protein, 9 aa, Homo Sapiens
LLIQALSTQ

SEQ ID NO: 822857 - protein, 9 aa, Homo Sapiens
DHPNVQKYL

SEQ ID NO: 822858 - protein, 9 aa, Homo Sapiens
AFLPFEKNC

SEQ ID NO: 822859 - protein, 9 aa, Homo Sapiens
WSHSYMLWY

SEQ ID NO: 822860 - protein, 9 aa, Homo Sapiens
PMAYMDAAC

SEQ ID NO: 822861 - protein, 9 aa, Homo Sapiens
GIFKTKFLS

SEQ ID NO: 822862 - protein, 9 aa, Homo Sapiens
CLEMDVPIY

SEQ ID NO: 822863 - protein, 9 aa, Homo Sapiens
EDNLLFWLA

SEQ ID NO: 822864 - protein, 9 aa, Homo Sapiens
MVKLAEATI

SEQ ID NO: 822865 - protein, 9 aa, Homo Sapiens
DEQLLCQLK

SEQ ID NO: 822866 - protein, 9 aa, Homo Sapiens
CPRVAKNDQ

SEQ ID NO: 822867 - protein, 9 aa, Homo Sapiens
SWEEREIML

SEQ ID NO: 822868 - protein, 9 aa, Homo Sapiens
FIEDLTDDN

SEQ ID NO: 822869 - protein, 9 aa, Homo Sapiens
LVAANGTKR

SEQ ID NO: 822870 - protein, 9 aa, Homo Sapiens
KNKLTFVQS

SEQ ID NO: 822871 - protein, 9 aa, Homo Sapiens
LRHARHAQI

SEQ ID NO: 822872 - protein, 9 aa, Homo Sapiens
QCHEHIEIL

SEQ ID NO: 822873 - protein, 9 aa, Homo Sapiens
WYQDTARLM

SEQ ID NO: 822874 - protein, 9 aa, Homo Sapiens
MMLQLLEKL

SEQ ID NO: 822875 - protein, 9 aa, Homo Sapiens
SFKPVKSHL

SEQ ID NO: 822876 - protein, 9 aa, Homo Sapiens
EFQLTAEDI

SEQ ID NO: 822877 - protein, 9 aa, Homo Sapiens
EDRHDFGFP

SEQ ID NO: 822878 - protein, 9 aa, Homo Sapiens
ATFYHRYYH

SEQ ID NO: 822879 - protein, 9 aa, Homo Sapiens
HLLLQMAKS

SEQ ID NO: 822880 - protein, 9 aa, Homo Sapiens
RNEEHACHC

SEQ ID NO: 822881 - protein, 9 aa, Homo Sapiens
ALILATNIS

SEQ ID NO: 822882 - protein, 9 aa, Homo Sapiens
APKPKFLKT

SEQ ID NO: 822883 - protein, 9 aa, Homo Sapiens
IIYMLIPSN

SEQ ID NO: 822884 - protein, 9 aa, Homo Sapiens
RIQNIRLLK

SEQ ID NO: 822885 - protein, 9 aa, Homo Sapiens
DDDIQGRDI

SEQ ID NO: 822886 - protein, 9 aa, Homo Sapiens
CLYYWALAY

SEQ ID NO: 822887 - protein, 9 aa, Homo Sapiens
LESKGLEKV

SEQ ID NO: 822888 - protein, 9 aa, Homo Sapiens
TQCHSLEPQ

SEQ ID NO: 822889 - protein, 9 aa, Homo Sapiens
IGDFKRPFS

SEQ ID NO: 822890 - protein, 9 aa, Homo Sapiens
QECERIHFF

SEQ ID NO: 822891 - protein, 9 aa, Homo Sapiens
RTRNIRDGS

SEQ ID NO: 822892 - protein, 9 aa, Homo Sapiens
DARPAGPVD

SEQ ID NO: 822893 - protein, 9 aa, Homo Sapiens
EGHIIPQSL

SEQ ID NO: 822894 - protein, 9 aa, Homo Sapiens
TDSIEILGK

SEQ ID NO: 822895 - protein, 9 aa, Homo Sapiens
KYKSSGLSC

SEQ ID NO: 822896 - protein, 9 aa, Homo Sapiens
TKNIYGNIE

SEQ ID NO: 822897 - protein, 9 aa, Homo Sapiens
IEGPEKVKQ

SEQ ID NO: 822898 - protein, 9 aa, Homo Sapiens
NDEICQEQL

SEQ ID NO: 822899 - protein, 9 aa, Homo Sapiens
MWLQSRDIL

SEQ ID NO: 822900 - protein, 9 aa, Homo Sapiens
DEAIYQRGL

SEQ ID NO: 822901 - protein, 9 aa, Homo Sapiens
ITPTLNYLI

SEQ ID NO: 822902 - protein, 9 aa, Homo Sapiens
DYHYDKFKK

SEQ ID NO: 822903 - protein, 9 aa, Homo Sapiens
TPTIQTQAQ

SEQ ID NO: 822904 - protein, 9 aa, Homo Sapiens
RLRHVGIFL

SEQ ID NO: 822905 - protein, 9 aa, Homo Sapiens
QLSGYQQQD

SEQ ID NO: 822906 - protein, 9 aa, Homo Sapiens
CLEKVHVVI

SEQ ID NO: 822907 - protein, 9 aa, Homo Sapiens
HNMKPHEIP

SEQ ID NO: 822908 - protein, 9 aa, Homo Sapiens
AWFLQMKRP

SEQ ID NO: 822909 - protein, 9 aa, Homo Sapiens
YMVLLIMKL

SEQ ID NO: 822910 - protein, 9 aa, Homo Sapiens
YQAIETSIL

SEQ ID NO: 822911 - protein, 9 aa, Homo Sapiens
KKLRVFLGR

SEQ ID NO: 822912 - protein, 9 aa, Homo Sapiens
QFPCEPFKC

SEQ ID NO: 822913 - protein, 9 aa, Homo Sapiens
YLKESYFDA

SEQ ID NO: 822914 - protein, 9 aa, Homo Sapiens
HNLQARYEE

SEQ ID NO: 822915 - protein, 9 aa, Homo Sapiens
LSIHQIKRT

SEQ ID NO: 822916 - protein, 9 aa, Homo Sapiens
GLINVTLLD

SEQ ID NO: 822917 - protein, 9 aa, Homo Sapiens
MGEDGNYIK

SEQ ID NO: 822918 - protein, 9 aa, Homo Sapiens
NTHLSTQLL

SEQ ID NO: 822919 - protein, 9 aa, Homo Sapiens
RNFSILEIL

SEQ ID NO: 822920 - protein, 9 aa, Homo Sapiens
LDTPFSGTR

SEQ ID NO: 822921 - protein, 9 aa, Homo Sapiens
VCSQQSFEC

SEQ ID NO: 822922 - protein, 9 aa, Homo Sapiens
DINKRLCYI

SEQ ID NO: 822923 - protein, 9 aa, Homo Sapiens
QFQYQNCIA

SEQ ID NO: 822924 - protein, 9 aa, Homo Sapiens
TVEEVAARL

SEQ ID NO: 822925 - protein, 9 aa, Homo Sapiens
NNTVISVNP

SEQ ID NO: 822926 - protein, 9 aa, Homo Sapiens
TNAVQSDSA

SEQ ID NO: 822927 - protein, 9 aa, Homo Sapiens
KMEQEKHNH

SEQ ID NO: 822928 - protein, 9 aa, Homo Sapiens
NLNKKVYTG

SEQ ID NO: 822929 - protein, 9 aa, Homo Sapiens
DTKDRDSSV

SEQ ID NO: 822930 - protein, 9 aa, Homo Sapiens
KLFKCNECG

SEQ ID NO: 822931 - protein, 9 aa, Homo Sapiens
ELEAIMHKR

SEQ ID NO: 822932 - protein, 9 aa, Homo Sapiens
ALCTLVATI

SEQ ID NO: 822933 - protein, 9 aa, Homo Sapiens
YLKRPRHRS

SEQ ID NO: 822934 - protein, 9 aa, Homo Sapiens
AHEIYQITN

SEQ ID NO: 822935 - protein, 9 aa, Homo Sapiens
MKARPDKSV

SEQ ID NO: 822936 - protein, 9 aa, Homo Sapiens
IIRSCKAKQ

SEQ ID NO: 822937 - protein, 9 aa, Homo Sapiens
NIFHLRLEN

SEQ ID NO: 822938 - protein, 9 aa, Homo Sapiens
SAKKKTRSK

SEQ ID NO: 822939 - protein, 9 aa, Homo Sapiens
CLSDHFQIH

SEQ ID NO: 822940 - protein, 9 aa, Homo Sapiens
DKLLHYQPS

SEQ ID NO: 822941 - protein, 9 aa, Homo Sapiens
LSGSHRLLC

SEQ ID NO: 822942 - protein, 9 aa, Homo Sapiens
SEVRWDLHV

SEQ ID NO: 822943 - protein, 9 aa, Homo Sapiens
SQLGKRYNL

SEQ ID NO: 822944 - protein, 9 aa, Homo Sapiens
LENVQVLDL

SEQ ID NO: 822945 - protein, 9 aa, Homo Sapiens
LVDCYVSKK

SEQ ID NO: 822946 - protein, 9 aa, Homo Sapiens
QPSTTGIWK

SEQ ID NO: 822947 - protein, 9 aa, Homo Sapiens
SHKLISQML

SEQ ID NO: 822948 - protein, 9 aa, Homo Sapiens
CVCTCVCVC

SEQ ID NO: 822949 - protein, 9 aa, Homo Sapiens
KGLEGERSA

SEQ ID NO: 822950 - protein, 9 aa, Homo Sapiens
CPSLCSRLS

SEQ ID NO: 822951 - protein, 9 aa, Homo Sapiens
SKKFSRLDP

SEQ ID NO: 822952 - protein, 9 aa, Homo Sapiens
EKEQIQNAG

SEQ ID NO: 822953 - protein, 9 aa, Homo Sapiens
SQSTSQQPK

SEQ ID NO: 822954 - protein, 9 aa, Homo Sapiens
ITFQEEMPP

SEQ ID NO: 822955 - protein, 9 aa, Homo Sapiens
AVQAYSEVD

SEQ ID NO: 822956 - protein, 9 aa, Homo Sapiens
QICQHPFCE

SEQ ID NO: 822957 - protein, 9 aa, Homo Sapiens
QIAMLWGSG

SEQ ID NO: 822958 - protein, 9 aa, Homo Sapiens
SPSRPKAQQ

SEQ ID NO: 822959 - protein, 9 aa, Homo Sapiens
TMSDVVEKS

SEQ ID NO: 822960 - protein, 9 aa, Homo Sapiens
IGRGNYGKV

SEQ ID NO: 822961 - protein, 9 aa, Homo Sapiens
RALNVLFGA

SEQ ID NO: 822962 - protein, 9 aa, Homo Sapiens
VYNDSAHGV

SEQ ID NO: 822963 - protein, 9 aa, Homo Sapiens
AEEIPTPSN

SEQ ID NO: 822964 - protein, 9 aa, Homo Sapiens
LSCSKAPLY

SEQ ID NO: 822965 - protein, 9 aa, Homo Sapiens
QMKRPGEDK

SEQ ID NO: 822966 - protein, 9 aa, Homo Sapiens
FYYSISIVL

SEQ ID NO: 822967 - protein, 9 aa, Homo Sapiens
TEHNLKSWN

SEQ ID NO: 822968 - protein, 9 aa, Homo Sapiens
LLCLIPTGL

SEQ ID NO: 822969 - protein, 9 aa, Homo Sapiens
GSWGKKVQP

SEQ ID NO: 822970 - protein, 9 aa, Homo Sapiens
VGDKAKYTT

SEQ ID NO: 822971 - protein, 9 aa, Homo Sapiens
LEAGPEAER

SEQ ID NO: 822972 - protein, 9 aa, Homo Sapiens
SIIEGERYP

SEQ ID NO: 822973 - protein, 9 aa, Homo Sapiens
FFEVFTPVC

SEQ ID NO: 822974 - protein, 9 aa, Homo Sapiens
PSLQERVPI

SEQ ID NO: 822975 - protein, 9 aa, Homo Sapiens
MSSLSYLAA

SEQ ID NO: 822976 - protein, 9 aa, Homo Sapiens
ILGPEKNIP

SEQ ID NO: 822977 - protein, 9 aa, Homo Sapiens
TDSHVNPKK

SEQ ID NO: 822978 - protein, 9 aa, Homo Sapiens
SHRAVEDQL

SEQ ID NO: 822979 - protein, 9 aa, Homo Sapiens
GNKCPARVA

SEQ ID NO: 822980 - protein, 9 aa, Homo Sapiens
GSSHFVLAN

SEQ ID NO: 822981 - protein, 9 aa, Homo Sapiens
GYKGNGLWC

SEQ ID NO: 822982 - protein, 9 aa, Homo Sapiens
RKIIHSHVL

SEQ ID NO: 822983 - protein, 9 aa, Homo Sapiens
DLMQLRRQE

SEQ ID NO: 822984 - protein, 9 aa, Homo Sapiens
VVLWLICVA

SEQ ID NO: 822985 - protein, 9 aa, Homo Sapiens
EGYYDSFLP

SEQ ID NO: 822986 - protein, 9 aa, Homo Sapiens
VVFWQDQEH

SEQ ID NO: 822987 - protein, 9 aa, Homo Sapiens
FKPIFGSIN

SEQ ID NO: 822988 - protein, 9 aa, Homo Sapiens
VRHFSKIRN

SEQ ID NO: 822989 - protein, 9 aa, Homo Sapiens
DYQAVNDEI

SEQ ID NO: 822990 - protein, 9 aa, Homo Sapiens
LKVLKSLPG

SEQ ID NO: 822991 - protein, 9 aa, Homo Sapiens
NDKHLDVPN

SEQ ID NO: 822992 - protein, 9 aa, Homo Sapiens
AFSHSGSLQ

SEQ ID NO: 822993 - protein, 9 aa, Homo Sapiens
IDVVYEAPQ

SEQ ID NO: 822994 - protein, 9 aa, Homo Sapiens
TFWKEHKPG

SEQ ID NO: 822995 - protein, 9 aa, Homo Sapiens
FNVSQGRLA

SEQ ID NO: 822996 - protein, 9 aa, Homo Sapiens
WGNLWWVGL

SEQ ID NO: 822997 - protein, 9 aa, Homo Sapiens
TGGAKNVNM

SEQ ID NO: 822998 - protein, 9 aa, Homo Sapiens
QATKYRSLR

SEQ ID NO: 822999 - protein, 9 aa, Homo Sapiens
LNLKNMEIP

SEQ ID NO: 823000 - protein, 9 aa, Homo Sapiens
YRDYVHRKF

SEQ ID NO: 823001 - protein, 9 aa, Homo Sapiens
TTTLAFKLQ

SEQ ID NO: 823002 - protein, 9 aa, Homo Sapiens
VCKGSSTVC

SEQ ID NO: 823003 - protein, 9 aa, Homo Sapiens
FQGEDEIRL

SEQ ID NO: 823004 - protein, 9 aa, Homo Sapiens
EPQNLPLST

SEQ ID NO: 823005 - protein, 9 aa, Homo Sapiens
RDGVQFSWN

SEQ ID NO: 823006 - protein, 9 aa, Homo Sapiens
QQIHTGESS

SEQ ID NO: 823007 - protein, 9 aa, Homo Sapiens
KAKVPTGVI

SEQ ID NO: 823008 - protein, 9 aa, Homo Sapiens
GKVGITSAF

SEQ ID NO: 823009 - protein, 9 aa, Homo Sapiens
HRAFEASEE

SEQ ID NO: 823010 - protein, 9 aa, Homo Sapiens
ENNLSDRLG

SEQ ID NO: 823011 - protein, 9 aa, Homo Sapiens
HSSSQPEVS

SEQ ID NO: 823012 - protein, 9 aa, Homo Sapiens
LLFEQSFQP

SEQ ID NO: 823013 - protein, 9 aa, Homo Sapiens
DKIERTTKS

SEQ ID NO: 823014 - protein, 9 aa, Homo Sapiens
AANEDNRKW

SEQ ID NO: 823015 - protein, 9 aa, Homo Sapiens
SLSLIQLVG

SEQ ID NO: 823016 - protein, 9 aa, Homo Sapiens
PHPSLLSYM

SEQ ID NO: 823017 - protein, 9 aa, Homo Sapiens
KVLFIKKTG

SEQ ID NO: 823018 - protein, 9 aa, Homo Sapiens
HNPATTNQT

SEQ ID NO: 823019 - protein, 9 aa, Homo Sapiens
RSKQHLWLV

SEQ ID NO: 823020 - protein, 9 aa, Homo Sapiens
FVTSYIKIK

SEQ ID NO: 823021 - protein, 9 aa, Homo Sapiens
LDYMVLLIM

SEQ ID NO: 823022 - protein, 9 aa, Homo Sapiens
KFHCNSCPS

SEQ ID NO: 823023 - protein, 9 aa, Homo Sapiens
INCKEAFQH

SEQ ID NO: 823024 - protein, 9 aa, Homo Sapiens
LGKSVFPYC

SEQ ID NO: 823025 - protein, 9 aa, Homo Sapiens
SYPHPIPAN

SEQ ID NO: 823026 - protein, 9 aa, Homo Sapiens
VKRLMFQIA

SEQ ID NO: 823027 - protein, 9 aa, Homo Sapiens
DHLKVLIDN

SEQ ID NO: 823028 - protein, 9 aa, Homo Sapiens
GTFVVNKKP

SEQ ID NO: 823029 - protein, 9 aa, Homo Sapiens
VWAFIHYLP

SEQ ID NO: 823030 - protein, 9 aa, Homo Sapiens
GMVQMTVKY

SEQ ID NO: 823031 - protein, 9 aa, Homo Sapiens
IMNGRIYVT

SEQ ID NO: 823032 - protein, 9 aa, Homo Sapiens
RSLGLISHH

SEQ ID NO: 823033 - protein, 9 aa, Homo Sapiens
CDVAYSTVR

SEQ ID NO: 823034 - protein, 9 aa, Homo Sapiens
IIDGISQGP

SEQ ID NO: 823035 - protein, 9 aa, Homo Sapiens
PVVQMYSSR

SEQ ID NO: 823036 - protein, 9 aa, Homo Sapiens
FHHRNPGIV

SEQ ID NO: 823037 - protein, 9 aa, Homo Sapiens
NSYIKAFFE

SEQ ID NO: 823038 - protein, 9 aa, Homo Sapiens
DLQVEVQKV

SEQ ID NO: 823039 - protein, 9 aa, Homo Sapiens
ALFTNLFQY

SEQ ID NO: 823040 - protein, 9 aa, Homo Sapiens
KERTRAEMT

SEQ ID NO: 823041 - protein, 9 aa, Homo Sapiens
QDIIYGMAV

SEQ ID NO: 823042 - protein, 9 aa, Homo Sapiens
LWSILVNIL

SEQ ID NO: 823043 - protein, 9 aa, Homo Sapiens
CYKQIIKSQ

SEQ ID NO: 823044 - protein, 9 aa, Homo Sapiens
NDSAHGVQR

SEQ ID NO: 823045 - protein, 9 aa, Homo Sapiens
LKRIIPLRF

SEQ ID NO: 823046 - protein, 9 aa, Homo Sapiens
IMGTYKTAA

SEQ ID NO: 823047 - protein, 9 aa, Homo Sapiens
VRLQNYFKK

SEQ ID NO: 823048 - protein, 9 aa, Homo Sapiens
LVDTLASHS

SEQ ID NO: 823049 - protein, 9 aa, Homo Sapiens
DKDNFWMTQ

SEQ ID NO: 823050 - protein, 9 aa, Homo Sapiens
APSGGEGLW

SEQ ID NO: 823051 - protein, 9 aa, Homo Sapiens
NRWDLMDKE

SEQ ID NO: 823052 - protein, 9 aa, Homo Sapiens
IVVNLIGLI

SEQ ID NO: 823053 - protein, 9 aa, Homo Sapiens
LEAIWNNIF

SEQ ID NO: 823054 - protein, 9 aa, Homo Sapiens
INSPQALKQ

SEQ ID NO: 823055 - protein, 9 aa, Homo Sapiens
DGSEDGLPK

SEQ ID NO: 823056 - protein, 9 aa, Homo Sapiens
QLLNSSGEE

SEQ ID NO: 823057 - protein, 9 aa, Homo Sapiens
DLNNGSLFA

SEQ ID NO: 823058 - protein, 9 aa, Homo Sapiens
KDLPVNYEH

SEQ ID NO: 823059 - protein, 9 aa, Homo Sapiens
NLAKYMFFL

SEQ ID NO: 823060 - protein, 9 aa, Homo Sapiens
NSNGENIGP

SEQ ID NO: 823061 - protein, 9 aa, Homo Sapiens
TISELDDII

SEQ ID NO: 823062 - protein, 9 aa, Homo Sapiens
PLEEHSRFH

SEQ ID NO: 823063 - protein, 9 aa, Homo Sapiens
SLNKQNVFN

SEQ ID NO: 823064 - protein, 9 aa, Homo Sapiens
SAQRSKDPH

SEQ ID NO: 823065 - protein, 9 aa, Homo Sapiens
EYYDIEADD

SEQ ID NO: 823066 - protein, 9 aa, Homo Sapiens
ITHKGENIE

SEQ ID NO: 823067 - protein, 9 aa, Homo Sapiens
HKEVKPYVC

SEQ ID NO: 823068 - protein, 9 aa, Homo Sapiens
RIAFRSFPE

SEQ ID NO: 823069 - protein, 9 aa, Homo Sapiens
LLWCVLLCV

SEQ ID NO: 823070 - protein, 9 aa, Homo Sapiens
EQAQVFVDD

SEQ ID NO: 823071 - protein, 9 aa, Homo Sapiens
GLVGSPLAA

SEQ ID NO: 823072 - protein, 9 aa, Homo Sapiens
YWWCTYVVL

SEQ ID NO: 823073 - protein, 9 aa, Homo Sapiens
EAVRDYYHC

SEQ ID NO: 823074 - protein, 9 aa, Homo Sapiens
VYGSNRLYD

SEQ ID NO: 823075 - protein, 9 aa, Homo Sapiens
MDNTGVPDR

SEQ ID NO: 823076 - protein, 9 aa, Homo Sapiens
IHMQLIKYK

SEQ ID NO: 823077 - protein, 9 aa, Homo Sapiens
LTVYLCDTN

SEQ ID NO: 823078 - protein, 9 aa, Homo Sapiens
ADVSSDLQK

SEQ ID NO: 823079 - protein, 9 aa, Homo Sapiens
KGFTQISYL

SEQ ID NO: 823080 - protein, 9 aa, Homo Sapiens
HILMVDIYL

SEQ ID NO: 823081 - protein, 9 aa, Homo Sapiens
INPQIESSS

SEQ ID NO: 823082 - protein, 9 aa, Homo Sapiens
MASEEAAIT

SEQ ID NO: 823083 - protein, 9 aa, Homo Sapiens
DVSQEDSLF

SEQ ID NO: 823084 - protein, 9 aa, Homo Sapiens
NAKGVLVGC

SEQ ID NO: 823085 - protein, 9 aa, Homo Sapiens
AYGADGDVF

SEQ ID NO: 823086 - protein, 9 aa, Homo Sapiens
KNKDKLIKD

SEQ ID NO: 823087 - protein, 9 aa, Homo Sapiens
RSLNEHMNI

SEQ ID NO: 823088 - protein, 9 aa, Homo Sapiens
LYWVIYKIL

SEQ ID NO: 823089 - protein, 9 aa, Homo Sapiens
YGFIYQTLQ

SEQ ID NO: 823090 - protein, 9 aa, Homo Sapiens
ASTQKKISH

SEQ ID NO: 823091 - protein, 9 aa, Homo Sapiens
AYIVFLVVY

SEQ ID NO: 823092 - protein, 9 aa, Homo Sapiens
IVNVLLEFG

SEQ ID NO: 823093 - protein, 9 aa, Homo Sapiens
FNVYLDICD

SEQ ID NO: 823094 - protein, 9 aa, Homo Sapiens
QLIISCLLN

SEQ ID NO: 823095 - protein, 9 aa, Homo Sapiens
HDKRLNATH

SEQ ID NO: 823096 - protein, 9 aa, Homo Sapiens
RDVMLDNYS

SEQ ID NO: 823097 - protein, 9 aa, Homo Sapiens
LSAQGDSLQ

SEQ ID NO: 823098 - protein, 9 aa, Homo Sapiens
PEDTAGSQT

SEQ ID NO: 823099 - protein, 9 aa, Homo Sapiens
SKIDISELN

SEQ ID NO: 823100 - protein, 9 aa, Homo Sapiens
HFLPRPVDL

SEQ ID NO: 823101 - protein, 9 aa, Homo Sapiens
TKERSEKDI

SEQ ID NO: 823102 - protein, 9 aa, Homo Sapiens
YVYKVVVDR

SEQ ID NO: 823103 - protein, 9 aa, Homo Sapiens
THVLVHDVA

SEQ ID NO: 823104 - protein, 9 aa, Homo Sapiens
VEEKINSEK

SEQ ID NO: 823105 - protein, 9 aa, Homo Sapiens
LNRAMANCN

SEQ ID NO: 823106 - protein, 9 aa, Homo Sapiens
GKLIYTLSL

SEQ ID NO: 823107 - protein, 9 aa, Homo Sapiens
MIGIFGAFF

SEQ ID NO: 823108 - protein, 9 aa, Homo Sapiens
LEKRRAREH

SEQ ID NO: 823109 - protein, 9 aa, Homo Sapiens
NKLETLPDE

SEQ ID NO: 823110 - protein, 9 aa, Homo Sapiens
AIFWYDIRS

SEQ ID NO: 823111 - protein, 9 aa, Homo Sapiens
MKKIDKILA

SEQ ID NO: 823112 - protein, 9 aa, Homo Sapiens
LASLAFISL

SEQ ID NO: 823113 - protein, 9 aa, Homo Sapiens
RYVTLENRL

SEQ ID NO: 823114 - protein, 9 aa, Homo Sapiens
IWSLESLHL

SEQ ID NO: 823115 - protein, 9 aa, Homo Sapiens
TVKDPVSNT

SEQ ID NO: 823116 - protein, 9 aa, Homo Sapiens
DVMEKIEDS

SEQ ID NO: 823117 - protein, 9 aa, Homo Sapiens
FSPPLIGKG

SEQ ID NO: 823118 - protein, 9 aa, Homo Sapiens
SAKKYVIDQ

SEQ ID NO: 823119 - protein, 9 aa, Homo Sapiens
TKLEPPAPQ

SEQ ID NO: 823120 - protein, 9 aa, Homo Sapiens
VRMDVVSVT

SEQ ID NO: 823121 - protein, 9 aa, Homo Sapiens
KNKDVPKKC

SEQ ID NO: 823122 - protein, 9 aa, Homo Sapiens
GEFDKIIHR

SEQ ID NO: 823123 - protein, 9 aa, Homo Sapiens
IKGIMYKWL

SEQ ID NO: 823124 - protein, 9 aa, Homo Sapiens
TVRALSHPY

SEQ ID NO: 823125 - protein, 9 aa, Homo Sapiens
TELNILEIP

SEQ ID NO: 823126 - protein, 9 aa, Homo Sapiens
AETAVLKWI

SEQ ID NO: 823127 - protein, 9 aa, Homo Sapiens
KNNKNKFVS

SEQ ID NO: 823128 - protein, 9 aa, Homo Sapiens
SLDSPREDE

SEQ ID NO: 823129 - protein, 9 aa, Homo Sapiens
LSDTMTTTE

SEQ ID NO: 823130 - protein, 9 aa, Homo Sapiens
DLQNPSQMD

SEQ ID NO: 823131 - protein, 9 aa, Homo Sapiens
PGANNRLES

SEQ ID NO: 823132 - protein, 9 aa, Homo Sapiens
KQFFLLFLS

SEQ ID NO: 823133 - protein, 9 aa, Homo Sapiens
PSHFSISTI

SEQ ID NO: 823134 - protein, 9 aa, Homo Sapiens
QTEICYQNK

SEQ ID NO: 823135 - protein, 9 aa, Homo Sapiens
SSPSNNSSL

SEQ ID NO: 823136 - protein, 9 aa, Homo Sapiens
RDNNSPALH

SEQ ID NO: 823137 - protein, 9 aa, Homo Sapiens
KRFHITDNS

SEQ ID NO: 823138 - protein, 9 aa, Homo Sapiens
RVRKQTCHF

SEQ ID NO: 823139 - protein, 9 aa, Homo Sapiens
WATVRGPCS

SEQ ID NO: 823140 - protein, 9 aa, Homo Sapiens
FLTRQNKLQ

SEQ ID NO: 823141 - protein, 9 aa, Homo Sapiens
VPLAVYSKN

SEQ ID NO: 823142 - protein, 9 aa, Homo Sapiens
GKRKLQGRL

SEQ ID NO: 823143 - protein, 9 aa, Homo Sapiens
CGECGHCFG

SEQ ID NO: 823144 - protein, 9 aa, Homo Sapiens
RVSAVLFYI

SEQ ID NO: 823145 - protein, 9 aa, Homo Sapiens
STRESGDSD

SEQ ID NO: 823146 - protein, 9 aa, Homo Sapiens
QISLADIAQ

SEQ ID NO: 823147 - protein, 9 aa, Homo Sapiens
GQAYVALYR

SEQ ID NO: 823148 - protein, 9 aa, Homo Sapiens
QSMHGRPNY

SEQ ID NO: 823149 - protein, 9 aa, Homo Sapiens
HVNTTLYTV

SEQ ID NO: 823150 - protein, 9 aa, Homo Sapiens
RSATVTLHV

SEQ ID NO: 823151 - protein, 9 aa, Homo Sapiens
MIKKACKVF

SEQ ID NO: 823152 - protein, 9 aa, Homo Sapiens
RNHSTFEGF

SEQ ID NO: 823153 - protein, 9 aa, Homo Sapiens
TNQPDILDP

SEQ ID NO: 823154 - protein, 9 aa, Homo Sapiens
GNIYECNQS

SEQ ID NO: 823155 - protein, 9 aa, Homo Sapiens
VETELLLAL

SEQ ID NO: 823156 - protein, 9 aa, Homo Sapiens
LPPLDEHVF

SEQ ID NO: 823157 - protein, 9 aa, Homo Sapiens
VQVGMWVVR

SEQ ID NO: 823158 - protein, 9 aa, Homo Sapiens
MAYMDAACF

SEQ ID NO: 823159 - protein, 9 aa, Homo Sapiens
TCSPGFVLE

SEQ ID NO: 823160 - protein, 9 aa, Homo Sapiens
EECNGKPDS

SEQ ID NO: 823161 - protein, 9 aa, Homo Sapiens
MKKLFPKGA

SEQ ID NO: 823162 - protein, 9 aa, Homo Sapiens
KVKGPRNLE

SEQ ID NO: 823163 - protein, 9 aa, Homo Sapiens
PVQRGASSS

SEQ ID NO: 823164 - protein, 9 aa, Homo Sapiens
GVLVGCKLD

SEQ ID NO: 823165 - protein, 9 aa, Homo Sapiens
AGASVAVFL

SEQ ID NO: 823166 - protein, 9 aa, Homo Sapiens
FLLIPEKLD

SEQ ID NO: 823167 - protein, 9 aa, Homo Sapiens
EALQTQLEG

SEQ ID NO: 823168 - protein, 9 aa, Homo Sapiens
DPKVCCNYS

SEQ ID NO: 823169 - protein, 9 aa, Homo Sapiens
EDLIVEGAK

SEQ ID NO: 823170 - protein, 9 aa, Homo Sapiens
FEMTDDIGG

SEQ ID NO: 823171 - protein, 9 aa, Homo Sapiens
LTVHCMDPN

SEQ ID NO: 823172 - protein, 9 aa, Homo Sapiens
ADTVGMSTV

SEQ ID NO: 823173 - protein, 9 aa, Homo Sapiens
GLKILRVTN

SEQ ID NO: 823174 - protein, 9 aa, Homo Sapiens
GPSVPTGMN

SEQ ID NO: 823175 - protein, 9 aa, Homo Sapiens
MKTCFWGTV

SEQ ID NO: 823176 - protein, 9 aa, Homo Sapiens
VYTCICSGA

SEQ ID NO: 823177 - protein, 9 aa, Homo Sapiens
DKETDDRKC

SEQ ID NO: 823178 - protein, 9 aa, Homo Sapiens
EHLEDAANK

SEQ ID NO: 823179 - protein, 9 aa, Homo Sapiens
YLGSQIDLQ

SEQ ID NO: 823180 - protein, 9 aa, Homo Sapiens
GKSKSGRSR

SEQ ID NO: 823181 - protein, 9 aa, Homo Sapiens
QKALYREGM

SEQ ID NO: 823182 - protein, 9 aa, Homo Sapiens
AWLQHQKKH

SEQ ID NO: 823183 - protein, 9 aa, Homo Sapiens
APAKLQGIP

SEQ ID NO: 823184 - protein, 9 aa, Homo Sapiens
PASYWAQPQ

SEQ ID NO: 823185 - protein, 9 aa, Homo Sapiens
PANTLNPVS

SEQ ID NO: 823186 - protein, 9 aa, Homo Sapiens
VVPAMAAQV

SEQ ID NO: 823187 - protein, 9 aa, Homo Sapiens
VEVKLVDFG

SEQ ID NO: 823188 - protein, 9 aa, Homo Sapiens
SKAGMVNKK

SEQ ID NO: 823189 - protein, 9 aa, Homo Sapiens
VLYAPPLAL

SEQ ID NO: 823190 - protein, 9 aa, Homo Sapiens
MTSYYGNQC

SEQ ID NO: 823191 - protein, 9 aa, Homo Sapiens
AEKIKTKRN

SEQ ID NO: 823192 - protein, 9 aa, Homo Sapiens
RPTWKPWRT

SEQ ID NO: 823193 - protein, 9 aa, Homo Sapiens
TLQAYVTPI

SEQ ID NO: 823194 - protein, 9 aa, Homo Sapiens
LLDKVCKFD

SEQ ID NO: 823195 - protein, 9 aa, Homo Sapiens
NNEKFADQD

SEQ ID NO: 823196 - protein, 9 aa, Homo Sapiens
GSVSVPGGH

SEQ ID NO: 823197 - protein, 9 aa, Homo Sapiens
TWKCPENFN

SEQ ID NO: 823198 - protein, 9 aa, Homo Sapiens
DLAEQLAQL

SEQ ID NO: 823199 - protein, 9 aa, Homo Sapiens
LANLNTLAL

SEQ ID NO: 823200 - protein, 9 aa, Homo Sapiens
KCTICGQAF

SEQ ID NO: 823201 - protein, 9 aa, Homo Sapiens
LAINQNGEE

SEQ ID NO: 823202 - protein, 9 aa, Homo Sapiens
GTEEQKAKD

SEQ ID NO: 823203 - protein, 9 aa, Homo Sapiens
ERGSWRAVA

SEQ ID NO: 823204 - protein, 9 aa, Homo Sapiens
SLAGLSAYQ

SEQ ID NO: 823205 - protein, 9 aa, Homo Sapiens
YVIPGLKTI

SEQ ID NO: 823206 - protein, 9 aa, Homo Sapiens
LTAYNHFFK

SEQ ID NO: 823207 - protein, 9 aa, Homo Sapiens
DDGVNGEVT

SEQ ID NO: 823208 - protein, 9 aa, Homo Sapiens
AWHVYRNFF

SEQ ID NO: 823209 - protein, 9 aa, Homo Sapiens
EDIPREPRQ

SEQ ID NO: 823210 - protein, 9 aa, Homo Sapiens
PAGGDPGLR

SEQ ID NO: 823211 - protein, 9 aa, Homo Sapiens
SSAEKLSHP

SEQ ID NO: 823212 - protein, 9 aa, Homo Sapiens
TGLGTPPQN

SEQ ID NO: 823213 - protein, 9 aa, Homo Sapiens
DESRGSRQE

SEQ ID NO: 823214 - protein, 9 aa, Homo Sapiens
YVDNLKEKS

SEQ ID NO: 823215 - protein, 9 aa, Homo Sapiens
GAVLSFKCS

SEQ ID NO: 823216 - protein, 9 aa, Homo Sapiens
NKFYEAFSK

SEQ ID NO: 823217 - protein, 9 aa, Homo Sapiens
KSKLNRSKC

SEQ ID NO: 823218 - protein, 9 aa, Homo Sapiens
KGAVTKMAA

SEQ ID NO: 823219 - protein, 9 aa, Homo Sapiens
LIFSQVTRL

SEQ ID NO: 823220 - protein, 9 aa, Homo Sapiens
IKPNIPLSA

SEQ ID NO: 823221 - protein, 9 aa, Homo Sapiens
DLMLRSLGE

SEQ ID NO: 823222 - protein, 9 aa, Homo Sapiens
IQQALVNRW

SEQ ID NO: 823223 - protein, 9 aa, Homo Sapiens
KLTIDNVTP

SEQ ID NO: 823224 - protein, 9 aa, Homo Sapiens
MVVLLMGLM

SEQ ID NO: 823225 - protein, 9 aa, Homo Sapiens
HYTVITIAH

SEQ ID NO: 823226 - protein, 9 aa, Homo Sapiens
TNYVDNLKE

SEQ ID NO: 823227 - protein, 9 aa, Homo Sapiens
EKKFYFPQC

SEQ ID NO: 823228 - protein, 9 aa, Homo Sapiens
PKKRQNGHV

SEQ ID NO: 823229 - protein, 9 aa, Homo Sapiens
NQQRLGKTQ

SEQ ID NO: 823230 - protein, 9 aa, Homo Sapiens
LISGNCPEN

SEQ ID NO: 823231 - protein, 9 aa, Homo Sapiens
FILAAMGFD

SEQ ID NO: 823232 - protein, 9 aa, Homo Sapiens
LQIEYRGNS

SEQ ID NO: 823233 - protein, 9 aa, Homo Sapiens
DKTKSGRIN

SEQ ID NO: 823234 - protein, 9 aa, Homo Sapiens
QFQSDAAMQ

SEQ ID NO: 823235 - protein, 9 aa, Homo Sapiens
QEQKAKLDK

SEQ ID NO: 823236 - protein, 9 aa, Homo Sapiens
RQDKAGPSP

SEQ ID NO: 823237 - protein, 9 aa, Homo Sapiens
TIAEAEELF

SEQ ID NO: 823238 - protein, 9 aa, Homo Sapiens
LHIARVLKL

SEQ ID NO: 823239 - protein, 9 aa, Homo Sapiens
KIISVFIQT

SEQ ID NO: 823240 - protein, 9 aa, Homo Sapiens
KYSHHDKHE

SEQ ID NO: 823241 - protein, 9 aa, Homo Sapiens
AARGTNDER

SEQ ID NO: 823242 - protein, 9 aa, Homo Sapiens
VTVTTTQSH

SEQ ID NO: 823243 - protein, 9 aa, Homo Sapiens
NHSTFEGFP

SEQ ID NO: 823244 - protein, 9 aa, Homo Sapiens
NTFQSFLGC

SEQ ID NO: 823245 - protein, 9 aa, Homo Sapiens
GGVVMVSLF

SEQ ID NO: 823246 - protein, 9 aa, Homo Sapiens
IKKKSRMTF

SEQ ID NO: 823247 - protein, 9 aa, Homo Sapiens
TTAEHQLRH

SEQ ID NO: 823248 - protein, 9 aa, Homo Sapiens
FIDQFGFNN

SEQ ID NO: 823249 - protein, 9 aa, Homo Sapiens
EKSGKDKSP

SEQ ID NO: 823250 - protein, 9 aa, Homo Sapiens
TGPGNPEAE

SEQ ID NO: 823251 - protein, 9 aa, Homo Sapiens
IAAHTNLTL

SEQ ID NO: 823252 - protein, 9 aa, Homo Sapiens
AIYFLGNYL

SEQ ID NO: 823253 - protein, 9 aa, Homo Sapiens
TILTPMFNP

SEQ ID NO: 823254 - protein, 9 aa, Homo Sapiens
DFVSLYQYF

SEQ ID NO: 823255 - protein, 9 aa, Homo Sapiens
YLGFSFGHG

SEQ ID NO: 823256 - protein, 9 aa, Homo Sapiens
RTHMKDKLY

SEQ ID NO: 823257 - protein, 9 aa, Homo Sapiens
VGQSGAKVM

SEQ ID NO: 823258 - protein, 9 aa, Homo Sapiens
RKEHTLFID

SEQ ID NO: 823259 - protein, 9 aa, Homo Sapiens
LDKVANNLA

SEQ ID NO: 823260 - protein, 9 aa, Homo Sapiens
KAEGRWNLF

SEQ ID NO: 823261 - protein, 9 aa, Homo Sapiens
SAMSTTTVT

SEQ ID NO: 823262 - protein, 9 aa, Homo Sapiens
QACKLLLAH

SEQ ID NO: 823263 - protein, 9 aa, Homo Sapiens
YYWDNAQVI

SEQ ID NO: 823264 - protein, 9 aa, Homo Sapiens
YKLFLLFLA

SEQ ID NO: 823265 - protein, 9 aa, Homo Sapiens
KTTAIIQLA

SEQ ID NO: 823266 - protein, 9 aa, Homo Sapiens
LKADALGVW

SEQ ID NO: 823267 - protein, 9 aa, Homo Sapiens
NQNSQNSLK

SEQ ID NO: 823268 - protein, 9 aa, Homo Sapiens
QPRSLLIQA

SEQ ID NO: 823269 - protein, 9 aa, Homo Sapiens
KAEKLAILS

SEQ ID NO: 823270 - protein, 9 aa, Homo Sapiens
ALPLSTQVN

SEQ ID NO: 823271 - protein, 9 aa, Homo Sapiens
SPFFHMTAE

SEQ ID NO: 823272 - protein, 9 aa, Homo Sapiens
ALQLQELRY

SEQ ID NO: 823273 - protein, 9 aa, Homo Sapiens
YKNLYYAAV

SEQ ID NO: 823274 - protein, 9 aa, Homo Sapiens
NQESDQSDS

SEQ ID NO: 823275 - protein, 9 aa, Homo Sapiens
QEALVHYYF

SEQ ID NO: 823276 - protein, 9 aa, Homo Sapiens
TNIDNFLSR

SEQ ID NO: 823277 - protein, 9 aa, Homo Sapiens
GRGDRIKSL

SEQ ID NO: 823278 - protein, 9 aa, Homo Sapiens
SGELTIIKY

SEQ ID NO: 823279 - protein, 9 aa, Homo Sapiens
RFYMEKETH

SEQ ID NO: 823280 - protein, 9 aa, Homo Sapiens
LLASENQHP

SEQ ID NO: 823281 - protein, 9 aa, Homo Sapiens
ILLSHHANI

SEQ ID NO: 823282 - protein, 9 aa, Homo Sapiens
QIIHLGEKR

SEQ ID NO: 823283 - protein, 9 aa, Homo Sapiens
RDERLGMKK

SEQ ID NO: 823284 - protein, 9 aa, Homo Sapiens
KKQSGRYSS

SEQ ID NO: 823285 - protein, 9 aa, Homo Sapiens
HNMGIVHQD

SEQ ID NO: 823286 - protein, 9 aa, Homo Sapiens
DKGVVFVTK

SEQ ID NO: 823287 - protein, 9 aa, Homo Sapiens
AKSEVSLVR

SEQ ID NO: 823288 - protein, 9 aa, Homo Sapiens
DCKRLSPDW

SEQ ID NO: 823289 - protein, 9 aa, Homo Sapiens
FFMRQLFQD

SEQ ID NO: 823290 - protein, 9 aa, Homo Sapiens
PLEGLPPFS

SEQ ID NO: 823291 - protein, 9 aa, Homo Sapiens
INEDFIEIA

SEQ ID NO: 823292 - protein, 9 aa, Homo Sapiens
GTSMKYSCN

SEQ ID NO: 823293 - protein, 9 aa, Homo Sapiens
YKYMVDPKK

SEQ ID NO: 823294 - protein, 9 aa, Homo Sapiens
TKPTTIIKK

SEQ ID NO: 823295 - protein, 9 aa, Homo Sapiens
QGLSLIDYF

SEQ ID NO: 823296 - protein, 9 aa, Homo Sapiens
EKENRTTVE

SEQ ID NO: 823297 - protein, 9 aa, Homo Sapiens
KNIFYIVNQ

SEQ ID NO: 823298 - protein, 9 aa, Homo Sapiens
NYHSHEAII

SEQ ID NO: 823299 - protein, 9 aa, Homo Sapiens
ILSLILALP

SEQ ID NO: 823300 - protein, 9 aa, Homo Sapiens
PGLIFAIVF

SEQ ID NO: 823301 - protein, 9 aa, Homo Sapiens
SDTLDNNEA

SEQ ID NO: 823302 - protein, 9 aa, Homo Sapiens
ASLNGHLPH

SEQ ID NO: 823303 - protein, 9 aa, Homo Sapiens
SNFEIHWKI

SEQ ID NO: 823304 - protein, 9 aa, Homo Sapiens
TPKMLRMSK

SEQ ID NO: 823305 - protein, 9 aa, Homo Sapiens
EFRQDITKC

SEQ ID NO: 823306 - protein, 9 aa, Homo Sapiens
IAGLDYLCR

SEQ ID NO: 823307 - protein, 9 aa, Homo Sapiens
IRDPEHRAG

SEQ ID NO: 823308 - protein, 9 aa, Homo Sapiens
QVEEWWAQN

SEQ ID NO: 823309 - protein, 9 aa, Homo Sapiens
PPIINLKRE

SEQ ID NO: 823310 - protein, 9 aa, Homo Sapiens
HTPTPGLYM

SEQ ID NO: 823311 - protein, 9 aa, Homo Sapiens
NLPFPLLIT

SEQ ID NO: 823312 - protein, 9 aa, Homo Sapiens
LQCEEIATQ

SEQ ID NO: 823313 - protein, 9 aa, Homo Sapiens
EKGSHMPEA

SEQ ID NO: 823314 - protein, 9 aa, Homo Sapiens
RYLTINSMF

SEQ ID NO: 823315 - protein, 9 aa, Homo Sapiens
KINTLLRNK

SEQ ID NO: 823316 - protein, 9 aa, Homo Sapiens
LKTYTGHNN

SEQ ID NO: 823317 - protein, 9 aa, Homo Sapiens
KAKPQNDWK

SEQ ID NO: 823318 - protein, 9 aa, Homo Sapiens
KVVVFQTPP

SEQ ID NO: 823319 - protein, 9 aa, Homo Sapiens
AAEEQGYDQ

SEQ ID NO: 823320 - protein, 9 aa, Homo Sapiens
FKCHIRKYS

SEQ ID NO: 823321 - protein, 9 aa, Homo Sapiens
FHDAFNLKR

SEQ ID NO: 823322 - protein, 9 aa, Homo Sapiens
AVALYNPVN

SEQ ID NO: 823323 - protein, 9 aa, Homo Sapiens
WITFLNQSS

SEQ ID NO: 823324 - protein, 9 aa, Homo Sapiens
ERHPDMLIK

SEQ ID NO: 823325 - protein, 9 aa, Homo Sapiens
KVVKKPKSM

SEQ ID NO: 823326 - protein, 9 aa, Homo Sapiens
AIRNPQEWH

SEQ ID NO: 823327 - protein, 9 aa, Homo Sapiens
LEDRHDFGF

SEQ ID NO: 823328 - protein, 9 aa, Homo Sapiens
PKRILLCTD

SEQ ID NO: 823329 - protein, 9 aa, Homo Sapiens
QIINKKLDI

SEQ ID NO: 823330 - protein, 9 aa, Homo Sapiens
LRADANNNA

SEQ ID NO: 823331 - protein, 9 aa, Homo Sapiens
LVKRDERLG

SEQ ID NO: 823332 - protein, 9 aa, Homo Sapiens
RCCNKTRIE

SEQ ID NO: 823333 - protein, 9 aa, Homo Sapiens
QDGDIFRDQ

SEQ ID NO: 823334 - protein, 9 aa, Homo Sapiens
CDTQPLLKL

SEQ ID NO: 823335 - protein, 9 aa, Homo Sapiens
ENQVSGNLL

SEQ ID NO: 823336 - protein, 9 aa, Homo Sapiens
LLSEFSPQL

SEQ ID NO: 823337 - protein, 9 aa, Homo Sapiens
NSVILQVFQ

SEQ ID NO: 823338 - protein, 9 aa, Homo Sapiens
LLCRLVYKD

SEQ ID NO: 823339 - protein, 9 aa, Homo Sapiens
LENHTVADR

SEQ ID NO: 823340 - protein, 9 aa, Homo Sapiens
FLSDISDNV

SEQ ID NO: 823341 - protein, 9 aa, Homo Sapiens
WAKRRTSTF

SEQ ID NO: 823342 - protein, 9 aa, Homo Sapiens
TSVPIEVAD

SEQ ID NO: 823343 - protein, 9 aa, Homo Sapiens
HLLPVPPTQ

SEQ ID NO: 823344 - protein, 9 aa, Homo Sapiens
STQSGYCAM

SEQ ID NO: 823345 - protein, 9 aa, Homo Sapiens
YVTTSFLSI

SEQ ID NO: 823346 - protein, 9 aa, Homo Sapiens
DTFFSQEKY

SEQ ID NO: 823347 - protein, 9 aa, Homo Sapiens
SEKYSSHSG

SEQ ID NO: 823348 - protein, 9 aa, Homo Sapiens
DEQKEVKPP

SEQ ID NO: 823349 - protein, 9 aa, Homo Sapiens
VLTELMSKM

SEQ ID NO: 823350 - protein, 9 aa, Homo Sapiens
ICRYQETGS

SEQ ID NO: 823351 - protein, 9 aa, Homo Sapiens
DTGINPQIE

SEQ ID NO: 823352 - protein, 9 aa, Homo Sapiens
DDIQGRDIS

SEQ ID NO: 823353 - protein, 9 aa, Homo Sapiens
KVHGSKVQE

SEQ ID NO: 823354 - protein, 9 aa, Homo Sapiens
AGISSSLDR

SEQ ID NO: 823355 - protein, 9 aa, Homo Sapiens
KFQQCYWLC

SEQ ID NO: 823356 - protein, 9 aa, Homo Sapiens
LKRNLYSAL

SEQ ID NO: 823357 - protein, 9 aa, Homo Sapiens
RWLDSESSP

SEQ ID NO: 823358 - protein, 9 aa, Homo Sapiens
IGLPISPFM

SEQ ID NO: 823359 - protein, 9 aa, Homo Sapiens
INGSEEHED

SEQ ID NO: 823360 - protein, 9 aa, Homo Sapiens
NTVRSCDLR

SEQ ID NO: 823361 - protein, 9 aa, Homo Sapiens
MSLWRGFLN

SEQ ID NO: 823362 - protein, 9 aa, Homo Sapiens
SSCGLPREY

SEQ ID NO: 823363 - protein, 9 aa, Homo Sapiens
KSICITAMD

SEQ ID NO: 823364 - protein, 9 aa, Homo Sapiens
LAIAYFTGN

SEQ ID NO: 823365 - protein, 9 aa, Homo Sapiens
VQIIVWGDY

SEQ ID NO: 823366 - protein, 9 aa, Homo Sapiens
VRVLYKKCP

SEQ ID NO: 823367 - protein, 9 aa, Homo Sapiens
DVRSYLLVA

SEQ ID NO: 823368 - protein, 9 aa, Homo Sapiens
FPKTNHHMQ

SEQ ID NO: 823369 - protein, 9 aa, Homo Sapiens
GCTMAPEAR

SEQ ID NO: 823370 - protein, 9 aa, Homo Sapiens
QHTLQLQIS

SEQ ID NO: 823371 - protein, 9 aa, Homo Sapiens
HCSGTRVPS

SEQ ID NO: 823372 - protein, 9 aa, Homo Sapiens
FKAHKGEIE

SEQ ID NO: 823373 - protein, 9 aa, Homo Sapiens
QILTERGYS

SEQ ID NO: 823374 - protein, 9 aa, Homo Sapiens
VPETESNVN

SEQ ID NO: 823375 - protein, 9 aa, Homo Sapiens
SAPSEHVIE

SEQ ID NO: 823376 - protein, 9 aa, Homo Sapiens
NSSHVDQRS

SEQ ID NO: 823377 - protein, 9 aa, Homo Sapiens
EPDKMGGAG

SEQ ID NO: 823378 - protein, 9 aa, Homo Sapiens
HERIYTRDN

SEQ ID NO: 823379 - protein, 9 aa, Homo Sapiens
TITFHLDLF

SEQ ID NO: 823380 - protein, 9 aa, Homo Sapiens
KISPVPYKD

SEQ ID NO: 823381 - protein, 9 aa, Homo Sapiens
INFLLRMDR

SEQ ID NO: 823382 - protein, 9 aa, Homo Sapiens
LHFKLMRKI

SEQ ID NO: 823383 - protein, 9 aa, Homo Sapiens
KLLIDGFPR

SEQ ID NO: 823384 - protein, 9 aa, Homo Sapiens
EISVSRLKT

SEQ ID NO: 823385 - protein, 9 aa, Homo Sapiens
MVLRYRTPH

SEQ ID NO: 823386 - protein, 9 aa, Homo Sapiens
ILRMFPEGK

SEQ ID NO: 823387 - protein, 9 aa, Homo Sapiens
LCVYHSSLV

SEQ ID NO: 823388 - protein, 9 aa, Homo Sapiens
IKKLCRGNP

SEQ ID NO: 823389 - protein, 9 aa, Homo Sapiens
LNLQKYLET

SEQ ID NO: 823390 - protein, 9 aa, Homo Sapiens
MGTHTSTKQ

SEQ ID NO: 823391 - protein, 9 aa, Homo Sapiens
LDRGDKSAP

SEQ ID NO: 823392 - protein, 9 aa, Homo Sapiens
LNRSAPQTL

SEQ ID NO: 823393 - protein, 9 aa, Homo Sapiens
KLSGDYADP

SEQ ID NO: 823394 - protein, 9 aa, Homo Sapiens
RTLNIQSVN

SEQ ID NO: 823395 - protein, 9 aa, Homo Sapiens
LCNGYTSGK

SEQ ID NO: 823396 - protein, 9 aa, Homo Sapiens
YKFYLYAQT

SEQ ID NO: 823397 - protein, 9 aa, Homo Sapiens
YDIMSKKYR

SEQ ID NO: 823398 - protein, 9 aa, Homo Sapiens
SRLSSTSCM

SEQ ID NO: 823399 - protein, 9 aa, Homo Sapiens
RRDVQWVYV

SEQ ID NO: 823400 - protein, 9 aa, Homo Sapiens
IKKDEDEEE

SEQ ID NO: 823401 - protein, 9 aa, Homo Sapiens
RKQKENSGA

SEQ ID NO: 823402 - protein, 9 aa, Homo Sapiens
CNFSATDFQ

SEQ ID NO: 823403 - protein, 9 aa, Homo Sapiens
QQTQMAVAQ

SEQ ID NO: 823404 - protein, 9 aa, Homo Sapiens
FHSRTLGKS

SEQ ID NO: 823405 - protein, 9 aa, Homo Sapiens
LLDAIRFCF

SEQ ID NO: 823406 - protein, 9 aa, Homo Sapiens
QKAKIIVLS

SEQ ID NO: 823407 - protein, 9 aa, Homo Sapiens
LYLVTIMGN

SEQ ID NO: 823408 - protein, 9 aa, Homo Sapiens
TNRTGQWVD

SEQ ID NO: 823409 - protein, 9 aa, Homo Sapiens
SNVKYFYRT

SEQ ID NO: 823410 - protein, 9 aa, Homo Sapiens
DCSMTSYYG

SEQ ID NO: 823411 - protein, 9 aa, Homo Sapiens
AGLLTAVEL

SEQ ID NO: 823412 - protein, 9 aa, Homo Sapiens
TQMKKLDIK

SEQ ID NO: 823413 - protein, 9 aa, Homo Sapiens
GDGPHNRYA

SEQ ID NO: 823414 - protein, 9 aa, Homo Sapiens
KATSDPCAM

SEQ ID NO: 823415 - protein, 9 aa, Homo Sapiens
YKEIILLTG

SEQ ID NO: 823416 - protein, 9 aa, Homo Sapiens
DEWQCTACK

SEQ ID NO: 823417 - protein, 9 aa, Homo Sapiens
ANFPSGNVA

SEQ ID NO: 823418 - protein, 9 aa, Homo Sapiens
ESMDNCPHK

SEQ ID NO: 823419 - protein, 9 aa, Homo Sapiens
ILNKAMLLG

SEQ ID NO: 823420 - protein, 9 aa, Homo Sapiens
IAHIIAAVK

SEQ ID NO: 823421 - protein, 9 aa, Homo Sapiens
QDFINLFTF

SEQ ID NO: 823422 - protein, 9 aa, Homo Sapiens
LEELKATIH

SEQ ID NO: 823423 - protein, 9 aa, Homo Sapiens
LREPFANKE

SEQ ID NO: 823424 - protein, 9 aa, Homo Sapiens
EQLKVSYTK

SEQ ID NO: 823425 - protein, 9 aa, Homo Sapiens
FHPEILENN

SEQ ID NO: 823426 - protein, 9 aa, Homo Sapiens
QKAYAPSFI

SEQ ID NO: 823427 - protein, 9 aa, Homo Sapiens
PGGLDKTCH

SEQ ID NO: 823428 - protein, 9 aa, Homo Sapiens
NFVCSQQSF

SEQ ID NO: 823429 - protein, 9 aa, Homo Sapiens
AFQELPASS

SEQ ID NO: 823430 - protein, 9 aa, Homo Sapiens
WDIFKQLLW

SEQ ID NO: 823431 - protein, 9 aa, Homo Sapiens
DRVSEANPS

SEQ ID NO: 823432 - protein, 9 aa, Homo Sapiens
PETTLSPEE

SEQ ID NO: 823433 - protein, 9 aa, Homo Sapiens
DNSLPYQVS

SEQ ID NO: 823434 - protein, 9 aa, Homo Sapiens
VTQRLQPEW

SEQ ID NO: 823435 - protein, 9 aa, Homo Sapiens
LDCDIIKNY

SEQ ID NO: 823436 - protein, 9 aa, Homo Sapiens
PVLHRASPC

SEQ ID NO: 823437 - protein, 9 aa, Homo Sapiens
INHQIIHTG

SEQ ID NO: 823438 - protein, 9 aa, Homo Sapiens
HHRSQSSLT

SEQ ID NO: 823439 - protein, 9 aa, Homo Sapiens
YCIALSLAL

SEQ ID NO: 823440 - protein, 9 aa, Homo Sapiens
PHPVTPLSA

SEQ ID NO: 823441 - protein, 9 aa, Homo Sapiens
CNQNVHEET

SEQ ID NO: 823442 - protein, 9 aa, Homo Sapiens
VSEQMKIVD

SEQ ID NO: 823443 - protein, 9 aa, Homo Sapiens
ARHRRINTG

SEQ ID NO: 823444 - protein, 9 aa, Homo Sapiens
TDGDDSLER

SEQ ID NO: 823445 - protein, 9 aa, Homo Sapiens
APPRYVITT

SEQ ID NO: 823446 - protein, 9 aa, Homo Sapiens
RRQINEDNK

SEQ ID NO: 823447 - protein, 9 aa, Homo Sapiens
LTYSNLKVP

SEQ ID NO: 823448 - protein, 9 aa, Homo Sapiens
NKTSYLTEL

SEQ ID NO: 823449 - protein, 9 aa, Homo Sapiens
EFKDALRTS

SEQ ID NO: 823450 - protein, 9 aa, Homo Sapiens
FLNKTNILE

SEQ ID NO: 823451 - protein, 9 aa, Homo Sapiens
RKHLNMKKT

SEQ ID NO: 823452 - protein, 9 aa, Homo Sapiens
QPHGKVFKK

SEQ ID NO: 823453 - protein, 9 aa, Homo Sapiens
ENEQSINLL

SEQ ID NO: 823454 - protein, 9 aa, Homo Sapiens
EFNMLCYTP

SEQ ID NO: 823455 - protein, 9 aa, Homo Sapiens
SSYSLSDLN

SEQ ID NO: 823456 - protein, 9 aa, Homo Sapiens
GKYALLTSA

SEQ ID NO: 823457 - protein, 9 aa, Homo Sapiens
MDFRRVPPT

SEQ ID NO: 823458 - protein, 9 aa, Homo Sapiens
LNLNNAVSI

SEQ ID NO: 823459 - protein, 9 aa, Homo Sapiens
SQGLNIILI

SEQ ID NO: 823460 - protein, 9 aa, Homo Sapiens
FSSNISANQ

SEQ ID NO: 823461 - protein, 9 aa, Homo Sapiens
KLRYKVAHS

SEQ ID NO: 823462 - protein, 9 aa, Homo Sapiens
PVCERNSRW

SEQ ID NO: 823463 - protein, 9 aa, Homo Sapiens
GCTMAEMVL

SEQ ID NO: 823464 - protein, 9 aa, Homo Sapiens
KRGFIHEDE

SEQ ID NO: 823465 - protein, 9 aa, Homo Sapiens
GEIIMRMLK

SEQ ID NO: 823466 - protein, 9 aa, Homo Sapiens
QHNQQGSMS

SEQ ID NO: 823467 - protein, 9 aa, Homo Sapiens
ISKSVQTPV

SEQ ID NO: 823468 - protein, 9 aa, Homo Sapiens
AFSTCAFHL

SEQ ID NO: 823469 - protein, 9 aa, Homo Sapiens
FLTGVMLGS

SEQ ID NO: 823470 - protein, 9 aa, Homo Sapiens
EMNRADEVE

SEQ ID NO: 823471 - protein, 9 aa, Homo Sapiens
RLPGVSHSG

SEQ ID NO: 823472 - protein, 9 aa, Homo Sapiens
GLIDKEDLK

SEQ ID NO: 823473 - protein, 9 aa, Homo Sapiens
EIDIPRNGT

SEQ ID NO: 823474 - protein, 9 aa, Homo Sapiens
RLTYNQINY

SEQ ID NO: 823475 - protein, 9 aa, Homo Sapiens
ACDKSFHLY

SEQ ID NO: 823476 - protein, 9 aa, Homo Sapiens
SEPNTPTAQ

SEQ ID NO: 823477 - protein, 9 aa, Homo Sapiens
PPPVIMVQD

SEQ ID NO: 823478 - protein, 9 aa, Homo Sapiens
ADVFIVFTG

SEQ ID NO: 823479 - protein, 9 aa, Homo Sapiens
VQQDGELHD

SEQ ID NO: 823480 - protein, 9 aa, Homo Sapiens
DREEQPHPH

SEQ ID NO: 823481 - protein, 9 aa, Homo Sapiens
KTPEPIPLT

SEQ ID NO: 823482 - protein, 9 aa, Homo Sapiens
FIYNNVSED

SEQ ID NO: 823483 - protein, 9 aa, Homo Sapiens
GPLPYFGLE

SEQ ID NO: 823484 - protein, 9 aa, Homo Sapiens
VDSLHTGPG

SEQ ID NO: 823485 - protein, 9 aa, Homo Sapiens
KLEKHSAPS

SEQ ID NO: 823486 - protein, 9 aa, Homo Sapiens
DGGPFSGGE

SEQ ID NO: 823487 - protein, 9 aa, Homo Sapiens
YLTYKIDEC

SEQ ID NO: 823488 - protein, 9 aa, Homo Sapiens
YQHEALRRE

SEQ ID NO: 823489 - protein, 9 aa, Homo Sapiens
TPLSAAPVE

SEQ ID NO: 823490 - protein, 9 aa, Homo Sapiens
ELYQGIKVE

SEQ ID NO: 823491 - protein, 9 aa, Homo Sapiens
IRPLDTVRA

SEQ ID NO: 823492 - protein, 9 aa, Homo Sapiens
LTEGNANVT

SEQ ID NO: 823493 - protein, 9 aa, Homo Sapiens
IQLPYKLAI

SEQ ID NO: 823494 - protein, 9 aa, Homo Sapiens
LRGHRYLHQ

SEQ ID NO: 823495 - protein, 9 aa, Homo Sapiens
SVINSIFTH

SEQ ID NO: 823496 - protein, 9 aa, Homo Sapiens
QGSLFKLCG

SEQ ID NO: 823497 - protein, 9 aa, Homo Sapiens
LAKLQANHE

SEQ ID NO: 823498 - protein, 9 aa, Homo Sapiens
KDISAANRN

SEQ ID NO: 823499 - protein, 9 aa, Homo Sapiens
TLPGPRGSR

SEQ ID NO: 823500 - protein, 9 aa, Homo Sapiens
INVVTDHLI

SEQ ID NO: 823501 - protein, 9 aa, Homo Sapiens
FAFLLCVCI

SEQ ID NO: 823502 - protein, 9 aa, Homo Sapiens
SFFLSETCT

SEQ ID NO: 823503 - protein, 9 aa, Homo Sapiens
SGLFAIIVL

SEQ ID NO: 823504 - protein, 9 aa, Homo Sapiens
KRLQLRLNL

SEQ ID NO: 823505 - protein, 9 aa, Homo Sapiens
IYLKRPRHR

SEQ ID NO: 823506 - protein, 9 aa, Homo Sapiens
NQKDSIKAQ

SEQ ID NO: 823507 - protein, 9 aa, Homo Sapiens
LLYLTRKVK

SEQ ID NO: 823508 - protein, 9 aa, Homo Sapiens
WYNNRERLL

SEQ ID NO: 823509 - protein, 9 aa, Homo Sapiens
MGDALNHMG

SEQ ID NO: 823510 - protein, 9 aa, Homo Sapiens
QKCKEETCT

SEQ ID NO: 823511 - protein, 9 aa, Homo Sapiens
IRPHGVHVV

SEQ ID NO: 823512 - protein, 9 aa, Homo Sapiens
ENEPAGTWV

SEQ ID NO: 823513 - protein, 9 aa, Homo Sapiens
QNTGPCLEK

SEQ ID NO: 823514 - protein, 9 aa, Homo Sapiens
TAEHQLRHA

SEQ ID NO: 823515 - protein, 9 aa, Homo Sapiens
IDYSTQKQS

SEQ ID NO: 823516 - protein, 9 aa, Homo Sapiens
LHSRNTIFT

SEQ ID NO: 823517 - protein, 9 aa, Homo Sapiens
QVSTFEQCQ

SEQ ID NO: 823518 - protein, 9 aa, Homo Sapiens
AINHISIRQ

SEQ ID NO: 823519 - protein, 9 aa, Homo Sapiens
NTKEDKFWM

SEQ ID NO: 823520 - protein, 9 aa, Homo Sapiens
QTNLNESHY

SEQ ID NO: 823521 - protein, 9 aa, Homo Sapiens
LSNIDVLEA

SEQ ID NO: 823522 - protein, 9 aa, Homo Sapiens
EFEDVIAEP

SEQ ID NO: 823523 - protein, 9 aa, Homo Sapiens
NTEQETLLQ

SEQ ID NO: 823524 - protein, 9 aa, Homo Sapiens
CMVTVCAES

SEQ ID NO: 823525 - protein, 9 aa, Homo Sapiens
RPQCPVGLI

SEQ ID NO: 823526 - protein, 9 aa, Homo Sapiens
QYFGETGLG

SEQ ID NO: 823527 - protein, 9 aa, Homo Sapiens
VVDESGKGV

SEQ ID NO: 823528 - protein, 9 aa, Homo Sapiens
QVMLTMHQI

SEQ ID NO: 823529 - protein, 9 aa, Homo Sapiens
LYVGREKTL

SEQ ID NO: 823530 - protein, 9 aa, Homo Sapiens
GIIYYRHFV

SEQ ID NO: 823531 - protein, 9 aa, Homo Sapiens
FQRDSLVQQ

SEQ ID NO: 823532 - protein, 9 aa, Homo Sapiens
WRCTTNEHT

SEQ ID NO: 823533 - protein, 9 aa, Homo Sapiens
ASTGRVSQE

SEQ ID NO: 823534 - protein, 9 aa, Homo Sapiens
ALKKKIHRF

SEQ ID NO: 823535 - protein, 9 aa, Homo Sapiens
EPLKQAAAL

SEQ ID NO: 823536 - protein, 9 aa, Homo Sapiens
DFFWSTVPG

SEQ ID NO: 823537 - protein, 9 aa, Homo Sapiens
GLRGLPELL

SEQ ID NO: 823538 - protein, 9 aa, Homo Sapiens
SPHNPLGDV

SEQ ID NO: 823539 - protein, 9 aa, Homo Sapiens
YNDLESLDA

SEQ ID NO: 823540 - protein, 9 aa, Homo Sapiens
FIWNMEESY

SEQ ID NO: 823541 - protein, 9 aa, Homo Sapiens
ATPTPPPGR

SEQ ID NO: 823542 - protein, 9 aa, Homo Sapiens
NIKTDTTGG

SEQ ID NO: 823543 - protein, 9 aa, Homo Sapiens
TNSSSNQRA

SEQ ID NO: 823544 - protein, 9 aa, Homo Sapiens
VAEAALQLF

SEQ ID NO: 823545 - protein, 9 aa, Homo Sapiens
QDFLSFTNS

SEQ ID NO: 823546 - protein, 9 aa, Homo Sapiens
GVHASKISR

SEQ ID NO: 823547 - protein, 9 aa, Homo Sapiens
TFISGRFPY

SEQ ID NO: 823548 - protein, 9 aa, Homo Sapiens
DCHVLTYTS

SEQ ID NO: 823549 - protein, 9 aa, Homo Sapiens
GYVPVIGAN

SEQ ID NO: 823550 - protein, 9 aa, Homo Sapiens
SVITKLRKL

SEQ ID NO: 823551 - protein, 9 aa, Homo Sapiens
SLTLCQAAS

SEQ ID NO: 823552 - protein, 9 aa, Homo Sapiens
NTVIHLYQA

SEQ ID NO: 823553 - protein, 9 aa, Homo Sapiens
WPLPSCRKS

SEQ ID NO: 823554 - protein, 9 aa, Homo Sapiens
NYLKPVTLH

SEQ ID NO: 823555 - protein, 9 aa, Homo Sapiens
RRSGYGPGD

SEQ ID NO: 823556 - protein, 9 aa, Homo Sapiens
KPFDKTICH

SEQ ID NO: 823557 - protein, 9 aa, Homo Sapiens
PIDWDPQPL

SEQ ID NO: 823558 - protein, 9 aa, Homo Sapiens
ELWRRMSVM

SEQ ID NO: 823559 - protein, 9 aa, Homo Sapiens
RDKYWLQFF

SEQ ID NO: 823560 - protein, 9 aa, Homo Sapiens
KAKEPDTSD

SEQ ID NO: 823561 - protein, 9 aa, Homo Sapiens
LTAHEVWNG

SEQ ID NO: 823562 - protein, 9 aa, Homo Sapiens
LDEPEVPEM

SEQ ID NO: 823563 - protein, 9 aa, Homo Sapiens
GHGGCLLDA

SEQ ID NO: 823564 - protein, 9 aa, Homo Sapiens
IYLRMIKDN

SEQ ID NO: 823565 - protein, 9 aa, Homo Sapiens
NMAQKARIR

SEQ ID NO: 823566 - protein, 9 aa, Homo Sapiens
VLEIMKEWK

SEQ ID NO: 823567 - protein, 9 aa, Homo Sapiens
LHSFLLNTN

SEQ ID NO: 823568 - protein, 9 aa, Homo Sapiens
YLELLFTLL

SEQ ID NO: 823569 - protein, 9 aa, Homo Sapiens
KQDVRLAQN

SEQ ID NO: 823570 - protein, 9 aa, Homo Sapiens
TDIVFARTS

SEQ ID NO: 823571 - protein, 9 aa, Homo Sapiens
VVRQLVAGY

SEQ ID NO: 823572 - protein, 9 aa, Homo Sapiens
AAWLLFLFM

SEQ ID NO: 823573 - protein, 9 aa, Homo Sapiens
GAEDATVEV

SEQ ID NO: 823574 - protein, 9 aa, Homo Sapiens
QPTSADKSV

SEQ ID NO: 823575 - protein, 9 aa, Homo Sapiens
NKLSGSHRL

SEQ ID NO: 823576 - protein, 9 aa, Homo Sapiens
IPLPCCTQG

SEQ ID NO: 823577 - protein, 9 aa, Homo Sapiens
GMEQDNKGR

SEQ ID NO: 823578 - protein, 9 aa, Homo Sapiens
SGSESGPSS

SEQ ID NO: 823579 - protein, 9 aa, Homo Sapiens
NTWLLARPS

SEQ ID NO: 823580 - protein, 9 aa, Homo Sapiens
QCHSLEPQK

SEQ ID NO: 823581 - protein, 9 aa, Homo Sapiens
DNKLQEEEE

SEQ ID NO: 823582 - protein, 9 aa, Homo Sapiens
RDQECLGKQ

SEQ ID NO: 823583 - protein, 9 aa, Homo Sapiens
VPLSVNANV

SEQ ID NO: 823584 - protein, 9 aa, Homo Sapiens
PEAPMLTHA

SEQ ID NO: 823585 - protein, 9 aa, Homo Sapiens
GSLKDKKSA

SEQ ID NO: 823586 - protein, 9 aa, Homo Sapiens
ECKQCGNTY

SEQ ID NO: 823587 - protein, 9 aa, Homo Sapiens
INDVLAEYK

SEQ ID NO: 823588 - protein, 9 aa, Homo Sapiens
RERELYGPN

SEQ ID NO: 823589 - protein, 9 aa, Homo Sapiens
GWLFLIILS

SEQ ID NO: 823590 - protein, 9 aa, Homo Sapiens
AHRQLGERC

SEQ ID NO: 823591 - protein, 9 aa, Homo Sapiens
QWKHDYVGE

SEQ ID NO: 823592 - protein, 9 aa, Homo Sapiens
APMGIYHKQ

SEQ ID NO: 823593 - protein, 9 aa, Homo Sapiens
KTCFWGTVR

SEQ ID NO: 823594 - protein, 9 aa, Homo Sapiens
IGDVINHDP

SEQ ID NO: 823595 - protein, 9 aa, Homo Sapiens
NTAVCERKD

SEQ ID NO: 823596 - protein, 9 aa, Homo Sapiens
KVGITSAFS

SEQ ID NO: 823597 - protein, 9 aa, Homo Sapiens
LNKAMLLGA

SEQ ID NO: 823598 - protein, 9 aa, Homo Sapiens
YLCSGSSHF

SEQ ID NO: 823599 - protein, 9 aa, Homo Sapiens
SCLGSSSLT

SEQ ID NO: 823600 - protein, 9 aa, Homo Sapiens
LSLILALPL

SEQ ID NO: 823601 - protein, 9 aa, Homo Sapiens
NVIRSEEPE

SEQ ID NO: 823602 - protein, 9 aa, Homo Sapiens
NLYSALKNL

SEQ ID NO: 823603 - protein, 9 aa, Homo Sapiens
KMIEASKES

SEQ ID NO: 823604 - protein, 9 aa, Homo Sapiens
LDTTNEYNS

SEQ ID NO: 823605 - protein, 9 aa, Homo Sapiens
FNTNAEGCI

SEQ ID NO: 823606 - protein, 9 aa, Homo Sapiens
GKAKIEDLS

SEQ ID NO: 823607 - protein, 9 aa, Homo Sapiens
ATETGKLQA

SEQ ID NO: 823608 - protein, 9 aa, Homo Sapiens
VFGGIYCLC

SEQ ID NO: 823609 - protein, 9 aa, Homo Sapiens
PQRADTPRI

SEQ ID NO: 823610 - protein, 9 aa, Homo Sapiens
IFSRKIFDL

SEQ ID NO: 823611 - protein, 9 aa, Homo Sapiens
PDKVTLLVD

SEQ ID NO: 823612 - protein, 9 aa, Homo Sapiens
HRSPHQAFR

SEQ ID NO: 823613 - protein, 9 aa, Homo Sapiens
YPRVSEDVG

SEQ ID NO: 823614 - protein, 9 aa, Homo Sapiens
APPELCLLI

SEQ ID NO: 823615 - protein, 9 aa, Homo Sapiens
RSINGIIIS

SEQ ID NO: 823616 - protein, 9 aa, Homo Sapiens
LFRKYNHMR

SEQ ID NO: 823617 - protein, 9 aa, Homo Sapiens
VHMEVPGAD

SEQ ID NO: 823618 - protein, 9 aa, Homo Sapiens
MDKELLRLR

SEQ ID NO: 823619 - protein, 9 aa, Homo Sapiens
KDRVNKQCV

SEQ ID NO: 823620 - protein, 9 aa, Homo Sapiens
GQLSDVVEK

SEQ ID NO: 823621 - protein, 9 aa, Homo Sapiens
TNIRALQGS

SEQ ID NO: 823622 - protein, 9 aa, Homo Sapiens
PRAGSPVSP

SEQ ID NO: 823623 - protein, 9 aa, Homo Sapiens
LRLNHNKIR

SEQ ID NO: 823624 - protein, 9 aa, Homo Sapiens
NKCYVHNDM

SEQ ID NO: 823625 - protein, 9 aa, Homo Sapiens
SKIIMLLGA

SEQ ID NO: 823626 - protein, 9 aa, Homo Sapiens
LNPEQLNKL

SEQ ID NO: 823627 - protein, 9 aa, Homo Sapiens
LGLISHHRV

SEQ ID NO: 823628 - protein, 9 aa, Homo Sapiens
ELEVQRQKG

SEQ ID NO: 823629 - protein, 9 aa, Homo Sapiens
ATPCLELEF

SEQ ID NO: 823630 - protein, 9 aa, Homo Sapiens
TYSNLKVPE

SEQ ID NO: 823631 - protein, 9 aa, Homo Sapiens
THSIKKMSL

SEQ ID NO: 823632 - protein, 9 aa, Homo Sapiens
AKPEMNVRS

SEQ ID NO: 823633 - protein, 9 aa, Homo Sapiens
PQDGAQTLH

SEQ ID NO: 823634 - protein, 9 aa, Homo Sapiens
LTRLKKLLL

SEQ ID NO: 823635 - protein, 9 aa, Homo Sapiens
TVDRNCLWY

SEQ ID NO: 823636 - protein, 9 aa, Homo Sapiens
LLLAKKVDS

SEQ ID NO: 823637 - protein, 9 aa, Homo Sapiens
FGSSLSGLL

SEQ ID NO: 823638 - protein, 9 aa, Homo Sapiens
LMVHGYPSE

SEQ ID NO: 823639 - protein, 9 aa, Homo Sapiens
VREFNMNLL

SEQ ID NO: 823640 - protein, 9 aa, Homo Sapiens
SLFYHAHMA

SEQ ID NO: 823641 - protein, 9 aa, Homo Sapiens
EREEDISEL

SEQ ID NO: 823642 - protein, 9 aa, Homo Sapiens
HEDGYGDGD

SEQ ID NO: 823643 - protein, 9 aa, Homo Sapiens
IKPDNLLLG

SEQ ID NO: 823644 - protein, 9 aa, Homo Sapiens
KQEKLKQDE

SEQ ID NO: 823645 - protein, 9 aa, Homo Sapiens
ASAYEHHLE

SEQ ID NO: 823646 - protein, 9 aa, Homo Sapiens
STPTTFSTS

SEQ ID NO: 823647 - protein, 9 aa, Homo Sapiens
NSHKRTCQL

SEQ ID NO: 823648 - protein, 9 aa, Homo Sapiens
FSKYDSVIN

SEQ ID NO: 823649 - protein, 9 aa, Homo Sapiens
HNETALEKN

SEQ ID NO: 823650 - protein, 9 aa, Homo Sapiens
TYLNLSQNQ

SEQ ID NO: 823651 - protein, 9 aa, Homo Sapiens
HSWRSWQSR

SEQ ID NO: 823652 - protein, 9 aa, Homo Sapiens
TLWNSRLLP

SEQ ID NO: 823653 - protein, 9 aa, Homo Sapiens
IFEGEGHIN

SEQ ID NO: 823654 - protein, 9 aa, Homo Sapiens
FYCTLGGLT

SEQ ID NO: 823655 - protein, 9 aa, Homo Sapiens
GIYHKQNLT

SEQ ID NO: 823656 - protein, 9 aa, Homo Sapiens
RDSCDKVLE

SEQ ID NO: 823657 - protein, 9 aa, Homo Sapiens
TAHSALEDV

SEQ ID NO: 823658 - protein, 9 aa, Homo Sapiens
RTFKRFTPR

SEQ ID NO: 823659 - protein, 9 aa, Homo Sapiens
INEVITENL

SEQ ID NO: 823660 - protein, 9 aa, Homo Sapiens
KTKEPVKNI

SEQ ID NO: 823661 - protein, 9 aa, Homo Sapiens
VIDFISGFN

SEQ ID NO: 823662 - protein, 9 aa, Homo Sapiens
PRQKSMKGL

SEQ ID NO: 823663 - protein, 9 aa, Homo Sapiens
YPHPIPANT

SEQ ID NO: 823664 - protein, 9 aa, Homo Sapiens
DSFGSGDCK

SEQ ID NO: 823665 - protein, 9 aa, Homo Sapiens
GQLILPGLA

SEQ ID NO: 823666 - protein, 9 aa, Homo Sapiens
IERGLIPST

SEQ ID NO: 823667 - protein, 9 aa, Homo Sapiens
SIQMYLWAQ

SEQ ID NO: 823668 - protein, 9 aa, Homo Sapiens
EQRPNKSTG

SEQ ID NO: 823669 - protein, 9 aa, Homo Sapiens
QVLWVDRAY

SEQ ID NO: 823670 - protein, 9 aa, Homo Sapiens
ANTSMALLF

SEQ ID NO: 823671 - protein, 9 aa, Homo Sapiens
EQLEKDMQA

SEQ ID NO: 823672 - protein, 9 aa, Homo Sapiens
GLMNNASSG

SEQ ID NO: 823673 - protein, 9 aa, Homo Sapiens
LTPEAKAAK

SEQ ID NO: 823674 - protein, 9 aa, Homo Sapiens
AILQLPQAQ

SEQ ID NO: 823675 - protein, 9 aa, Homo Sapiens
PRWEEGKAA

SEQ ID NO: 823676 - protein, 9 aa, Homo Sapiens
THKRYFSEI

SEQ ID NO: 823677 - protein, 9 aa, Homo Sapiens
RDYKSPTLI

SEQ ID NO: 823678 - protein, 9 aa, Homo Sapiens
GSEGKNCEL

SEQ ID NO: 823679 - protein, 9 aa, Homo Sapiens
MVQMTVKYY

SEQ ID NO: 823680 - protein, 9 aa, Homo Sapiens
WCPFGSEGK

SEQ ID NO: 823681 - protein, 9 aa, Homo Sapiens
SFQISTDNF

SEQ ID NO: 823682 - protein, 9 aa, Homo Sapiens
SWSLLDTFE

SEQ ID NO: 823683 - protein, 9 aa, Homo Sapiens
WSPAMAGGL

SEQ ID NO: 823684 - protein, 9 aa, Homo Sapiens
GIGTDSWNH

SEQ ID NO: 823685 - protein, 9 aa, Homo Sapiens
ALPRKYIIE

SEQ ID NO: 823686 - protein, 9 aa, Homo Sapiens
PSKFPNNNL

SEQ ID NO: 823687 - protein, 9 aa, Homo Sapiens
EKAKAEGRW

SEQ ID NO: 823688 - protein, 9 aa, Homo Sapiens
LFLECERKA

SEQ ID NO: 823689 - protein, 9 aa, Homo Sapiens
DDIQDLMDI

SEQ ID NO: 823690 - protein, 9 aa, Homo Sapiens
SRSPSLNVL

SEQ ID NO: 823691 - protein, 9 aa, Homo Sapiens
GYYDSFLPG

SEQ ID NO: 823692 - protein, 9 aa, Homo Sapiens
RRIHQCDVA

SEQ ID NO: 823693 - protein, 9 aa, Homo Sapiens
HYLVSAHGE

SEQ ID NO: 823694 - protein, 9 aa, Homo Sapiens
NRIAQKTRL

SEQ ID NO: 823695 - protein, 9 aa, Homo Sapiens
ADEELLLHD

SEQ ID NO: 823696 - protein, 9 aa, Homo Sapiens
ATYMRIYKT

SEQ ID NO: 823697 - protein, 9 aa, Homo Sapiens
KDKWDKSAL

SEQ ID NO: 823698 - protein, 9 aa, Homo Sapiens
CLPLPGHRV

SEQ ID NO: 823699 - protein, 9 aa, Homo Sapiens
SFAPIMNQW

SEQ ID NO: 823700 - protein, 9 aa, Homo Sapiens
YYRIYVTVK

SEQ ID NO: 823701 - protein, 9 aa, Homo Sapiens
FSLANKVMG

SEQ ID NO: 823702 - protein, 9 aa, Homo Sapiens
LWAWGVEVG

SEQ ID NO: 823703 - protein, 9 aa, Homo Sapiens
FDLFNTAIE

SEQ ID NO: 823704 - protein, 9 aa, Homo Sapiens
SITKRITEN

SEQ ID NO: 823705 - protein, 9 aa, Homo Sapiens
ATDRGTIHK

SEQ ID NO: 823706 - protein, 9 aa, Homo Sapiens
DNGLMCPAC

SEQ ID NO: 823707 - protein, 9 aa, Homo Sapiens
ESWVNTVNK

SEQ ID NO: 823708 - protein, 9 aa, Homo Sapiens
PEAMPTHKN

SEQ ID NO: 823709 - protein, 9 aa, Homo Sapiens
ITNWDYMEK

SEQ ID NO: 823710 - protein, 9 aa, Homo Sapiens
CCEFDSQAS

SEQ ID NO: 823711 - protein, 9 aa, Homo Sapiens
KKEKKQSGR

SEQ ID NO: 823712 - protein, 9 aa, Homo Sapiens
PLKGAQEQQ

SEQ ID NO: 823713 - protein, 9 aa, Homo Sapiens
DKLVIVKCV

SEQ ID NO: 823714 - protein, 9 aa, Homo Sapiens
LRKKSITNT

SEQ ID NO: 823715 - protein, 9 aa, Homo Sapiens
KIKGYQCLI

SEQ ID NO: 823716 - protein, 9 aa, Homo Sapiens
AMSRRSWLS

SEQ ID NO: 823717 - protein, 9 aa, Homo Sapiens
FLFAIFIIL

SEQ ID NO: 823718 - protein, 9 aa, Homo Sapiens
RRMHLVYAD

SEQ ID NO: 823719 - protein, 9 aa, Homo Sapiens
NRFKDKENS

SEQ ID NO: 823720 - protein, 9 aa, Homo Sapiens
VAVQVGIAP

SEQ ID NO: 823721 - protein, 9 aa, Homo Sapiens
KLTGVCYVG

SEQ ID NO: 823722 - protein, 9 aa, Homo Sapiens
NIRALQGSL

SEQ ID NO: 823723 - protein, 9 aa, Homo Sapiens
LDKLTGYKT

SEQ ID NO: 823724 - protein, 9 aa, Homo Sapiens
THTVTHVHM

SEQ ID NO: 823725 - protein, 9 aa, Homo Sapiens
FNTQRAYTS

SEQ ID NO: 823726 - protein, 9 aa, Homo Sapiens
HRTCLEPHN

SEQ ID NO: 823727 - protein, 9 aa, Homo Sapiens
TTEDLGNVI

SEQ ID NO: 823728 - protein, 9 aa, Homo Sapiens
QFGLDEAEN

SEQ ID NO: 823729 - protein, 9 aa, Homo Sapiens
MAKNILRGF

SEQ ID NO: 823730 - protein, 9 aa, Homo Sapiens
GSKPVLFQG

SEQ ID NO: 823731 - protein, 9 aa, Homo Sapiens
EMHHLQQEL

SEQ ID NO: 823732 - protein, 9 aa, Homo Sapiens
LDAKIEKVR

SEQ ID NO: 823733 - protein, 9 aa, Homo Sapiens
TGMKKTSFK

SEQ ID NO: 823734 - protein, 9 aa, Homo Sapiens
SNQIISFYD

SEQ ID NO: 823735 - protein, 9 aa, Homo Sapiens
LVNILHKAL

SEQ ID NO: 823736 - protein, 9 aa, Homo Sapiens
CHVLTYTSK

SEQ ID NO: 823737 - protein, 9 aa, Homo Sapiens
KKTEALWLQ

SEQ ID NO: 823738 - protein, 9 aa, Homo Sapiens
ALQQANDDL

SEQ ID NO: 823739 - protein, 9 aa, Homo Sapiens
MYVRQTALK

SEQ ID NO: 823740 - protein, 9 aa, Homo Sapiens
KAPTVKPRE

SEQ ID NO: 823741 - protein, 9 aa, Homo Sapiens
KYDDVTETV

SEQ ID NO: 823742 - protein, 9 aa, Homo Sapiens
SIDIYIPEA

SEQ ID NO: 823743 - protein, 9 aa, Homo Sapiens
DMYLPLEET

SEQ ID NO: 823744 - protein, 9 aa, Homo Sapiens
VLYVNKKID

SEQ ID NO: 823745 - protein, 9 aa, Homo Sapiens
VVVLLFVPC

SEQ ID NO: 823746 - protein, 9 aa, Homo Sapiens
PKATEEVGE

SEQ ID NO: 823747 - protein, 9 aa, Homo Sapiens
PTHKNLCSL

SEQ ID NO: 823748 - protein, 9 aa, Homo Sapiens
SPPAKAEKL

SEQ ID NO: 823749 - protein, 9 aa, Homo Sapiens
GNAKNNWQR

SEQ ID NO: 823750 - protein, 9 aa, Homo Sapiens
VPPDFQGAQ

SEQ ID NO: 823751 - protein, 9 aa, Homo Sapiens
QGAAASSFV

SEQ ID NO: 823752 - protein, 9 aa, Homo Sapiens
GTVTENMYL

SEQ ID NO: 823753 - protein, 9 aa, Homo Sapiens
EIPRQNIWD

SEQ ID NO: 823754 - protein, 9 aa, Homo Sapiens
GWRCSCWAW

SEQ ID NO: 823755 - protein, 9 aa, Homo Sapiens
SVCRDRIIC

SEQ ID NO: 823756 - protein, 9 aa, Homo Sapiens
HARKARVED

SEQ ID NO: 823757 - protein, 9 aa, Homo Sapiens
ELMSDPDSS

SEQ ID NO: 823758 - protein, 9 aa, Homo Sapiens
SKINDDYSF

SEQ ID NO: 823759 - protein, 9 aa, Homo Sapiens
IRRSERNQE

SEQ ID NO: 823760 - protein, 9 aa, Homo Sapiens
HQYGYRNNV

SEQ ID NO: 823761 - protein, 9 aa, Homo Sapiens
GEAHQDFSR

SEQ ID NO: 823762 - protein, 9 aa, Homo Sapiens
YLDKGICEL

SEQ ID NO: 823763 - protein, 9 aa, Homo Sapiens
RSLMPVSGA

SEQ ID NO: 823764 - protein, 9 aa, Homo Sapiens
QAFSQGFNE

SEQ ID NO: 823765 - protein, 9 aa, Homo Sapiens
KVRRSTSID

SEQ ID NO: 823766 - protein, 9 aa, Homo Sapiens
FHQCSNSNR

SEQ ID NO: 823767 - protein, 9 aa, Homo Sapiens
PASTMLTAA

SEQ ID NO: 823768 - protein, 9 aa, Homo Sapiens
KLWDARLCP

SEQ ID NO: 823769 - protein, 9 aa, Homo Sapiens
HDIQNQLRR

SEQ ID NO: 823770 - protein, 9 aa, Homo Sapiens
ASEKVYLGS

SEQ ID NO: 823771 - protein, 9 aa, Homo Sapiens
KVILFSFST

SEQ ID NO: 823772 - protein, 9 aa, Homo Sapiens
LLCSFALHT

SEQ ID NO: 823773 - protein, 9 aa, Homo Sapiens
YTFMFDEKL

SEQ ID NO: 823774 - protein, 9 aa, Homo Sapiens
KDFTTKGVT

SEQ ID NO: 823775 - protein, 9 aa, Homo Sapiens
SGREHAGCI

SEQ ID NO: 823776 - protein, 9 aa, Homo Sapiens
QVLSTEKTA

SEQ ID NO: 823777 - protein, 9 aa, Homo Sapiens
RTQRAKRDL

SEQ ID NO: 823778 - protein, 9 aa, Homo Sapiens
YDQDSEKSK

SEQ ID NO: 823779 - protein, 9 aa, Homo Sapiens
GSRPLHYPV

SEQ ID NO: 823780 - protein, 9 aa, Homo Sapiens
HRPPRAGNT

SEQ ID NO: 823781 - protein, 9 aa, Homo Sapiens
SKFPNNNLK

SEQ ID NO: 823782 - protein, 9 aa, Homo Sapiens
SSTLSSHKI

SEQ ID NO: 823783 - protein, 9 aa, Homo Sapiens
LLMLVMVEC

SEQ ID NO: 823784 - protein, 9 aa, Homo Sapiens
DHNKRLKQL

SEQ ID NO: 823785 - protein, 9 aa, Homo Sapiens
KKTGQAINI

SEQ ID NO: 823786 - protein, 9 aa, Homo Sapiens
IIPASQEEE

SEQ ID NO: 823787 - protein, 9 aa, Homo Sapiens
QHRPRGKTG

SEQ ID NO: 823788 - protein, 9 aa, Homo Sapiens
GDLYSLLSK

SEQ ID NO: 823789 - protein, 9 aa, Homo Sapiens
TDFISNPYN

SEQ ID NO: 823790 - protein, 9 aa, Homo Sapiens
HCAGLLEDN

SEQ ID NO: 823791 - protein, 9 aa, Homo Sapiens
VFECGGPEV

SEQ ID NO: 823792 - protein, 9 aa, Homo Sapiens
QIIIRQLQE

SEQ ID NO: 823793 - protein, 9 aa, Homo Sapiens
EAHQDFSRL

SEQ ID NO: 823794 - protein, 9 aa, Homo Sapiens
LKMKVKKSA

SEQ ID NO: 823795 - protein, 9 aa, Homo Sapiens
NSATESASA

SEQ ID NO: 823796 - protein, 9 aa, Homo Sapiens
VILGGNKES

SEQ ID NO: 823797 - protein, 9 aa, Homo Sapiens
EGECPDPVG

SEQ ID NO: 823798 - protein, 9 aa, Homo Sapiens
KSLQSSNIE

SEQ ID NO: 823799 - protein, 9 aa, Homo Sapiens
HWGPAGAQQ

SEQ ID NO: 823800 - protein, 9 aa, Homo Sapiens
DFISNPYNK

SEQ ID NO: 823801 - protein, 9 aa, Homo Sapiens
DKPHKCKEC

SEQ ID NO: 823802 - protein, 9 aa, Homo Sapiens
LELLGMGHC

SEQ ID NO: 823803 - protein, 9 aa, Homo Sapiens
GGDWEVNGK

SEQ ID NO: 823804 - protein, 9 aa, Homo Sapiens
EPNTPTAQT

SEQ ID NO: 823805 - protein, 9 aa, Homo Sapiens
RWNFDFVTK

SEQ ID NO: 823806 - protein, 9 aa, Homo Sapiens
YYRHNFARQ

SEQ ID NO: 823807 - protein, 9 aa, Homo Sapiens
TEHSCSAES

SEQ ID NO: 823808 - protein, 9 aa, Homo Sapiens
YMLLQPIRK

SEQ ID NO: 823809 - protein, 9 aa, Homo Sapiens
PNGSWGKKV

SEQ ID NO: 823810 - protein, 9 aa, Homo Sapiens
EAKIIGIKK

SEQ ID NO: 823811 - protein, 9 aa, Homo Sapiens
RLFKPCCSN

SEQ ID NO: 823812 - protein, 9 aa, Homo Sapiens
QTQMAVAQV

SEQ ID NO: 823813 - protein, 9 aa, Homo Sapiens
IEYEELPTS

SEQ ID NO: 823814 - protein, 9 aa, Homo Sapiens
QRTEKRIKA

SEQ ID NO: 823815 - protein, 9 aa, Homo Sapiens
SKLCSKLRH

SEQ ID NO: 823816 - protein, 9 aa, Homo Sapiens
LYPCNQCGK

SEQ ID NO: 823817 - protein, 9 aa, Homo Sapiens
SYDDPTNIQ

SEQ ID NO: 823818 - protein, 9 aa, Homo Sapiens
RPFSDRVPS

SEQ ID NO: 823819 - protein, 9 aa, Homo Sapiens
PNSEENFPN

SEQ ID NO: 823820 - protein, 9 aa, Homo Sapiens
GNVRGNAIY

SEQ ID NO: 823821 - protein, 9 aa, Homo Sapiens
APVANIFHL

SEQ ID NO: 823822 - protein, 9 aa, Homo Sapiens
CHVLLSLLD

SEQ ID NO: 823823 - protein, 9 aa, Homo Sapiens
KVGKDYFGN

SEQ ID NO: 823824 - protein, 9 aa, Homo Sapiens
FRPILKLTG

SEQ ID NO: 823825 - protein, 9 aa, Homo Sapiens
FPLEEVWGP

SEQ ID NO: 823826 - protein, 9 aa, Homo Sapiens
TAISVVEEN

SEQ ID NO: 823827 - protein, 9 aa, Homo Sapiens
APFISGVEI

SEQ ID NO: 823828 - protein, 9 aa, Homo Sapiens
VREHLHNLE

SEQ ID NO: 823829 - protein, 9 aa, Homo Sapiens
ELFINTTRA

SEQ ID NO: 823830 - protein, 9 aa, Homo Sapiens
GFYWPKMLK

SEQ ID NO: 823831 - protein, 9 aa, Homo Sapiens
IHSKYKIIY

SEQ ID NO: 823832 - protein, 9 aa, Homo Sapiens
IAKQKQLKS

SEQ ID NO: 823833 - protein, 9 aa, Homo Sapiens
QFQLHFGHP

SEQ ID NO: 823834 - protein, 9 aa, Homo Sapiens
SCGLCGLTI

SEQ ID NO: 823835 - protein, 9 aa, Homo Sapiens
EKQLMEDKK

SEQ ID NO: 823836 - protein, 9 aa, Homo Sapiens
VYQNGGYIF

SEQ ID NO: 823837 - protein, 9 aa, Homo Sapiens
SLCAGCKCS

SEQ ID NO: 823838 - protein, 9 aa, Homo Sapiens
HFVLANGHI

SEQ ID NO: 823839 - protein, 9 aa, Homo Sapiens
VGPVEHGKF

SEQ ID NO: 823840 - protein, 9 aa, Homo Sapiens
ASELSTDAV

SEQ ID NO: 823841 - protein, 9 aa, Homo Sapiens
IEDLSLAFL

SEQ ID NO: 823842 - protein, 9 aa, Homo Sapiens
MKYLIKVAI

SEQ ID NO: 823843 - protein, 9 aa, Homo Sapiens
PPAKSKCIF

SEQ ID NO: 823844 - protein, 9 aa, Homo Sapiens
EVTYNVAQY

SEQ ID NO: 823845 - protein, 9 aa, Homo Sapiens
VADTREDMN

SEQ ID NO: 823846 - protein, 9 aa, Homo Sapiens
ESLKADEGN

SEQ ID NO: 823847 - protein, 9 aa, Homo Sapiens
INFLEKRAL

SEQ ID NO: 823848 - protein, 9 aa, Homo Sapiens
TDNLQSLTE

SEQ ID NO: 823849 - protein, 9 aa, Homo Sapiens
QLVDKSGEL

SEQ ID NO: 823850 - protein, 9 aa, Homo Sapiens
DKLGFQGAW

SEQ ID NO: 823851 - protein, 9 aa, Homo Sapiens
KCILDPRGI

SEQ ID NO: 823852 - protein, 9 aa, Homo Sapiens
PSLLRPGTP

SEQ ID NO: 823853 - protein, 9 aa, Homo Sapiens
AGGPKGKDY

SEQ ID NO: 823854 - protein, 9 aa, Homo Sapiens
TGLLTQHGI

SEQ ID NO: 823855 - protein, 9 aa, Homo Sapiens
HTLQDWAGS

SEQ ID NO: 823856 - protein, 9 aa, Homo Sapiens
KQRPTSSFL

SEQ ID NO: 823857 - protein, 9 aa, Homo Sapiens
QNYNYKQVN

SEQ ID NO: 823858 - protein, 9 aa, Homo Sapiens
SPQVNHLKI

SEQ ID NO: 823859 - protein, 9 aa, Homo Sapiens
KDNDIIGDI

SEQ ID NO: 823860 - protein, 9 aa, Homo Sapiens
LIIWAVMDS

SEQ ID NO: 823861 - protein, 9 aa, Homo Sapiens
VADYLVVIM

SEQ ID NO: 823862 - protein, 9 aa, Homo Sapiens
NIIEATNMY

SEQ ID NO: 823863 - protein, 9 aa, Homo Sapiens
PNFPRRSKS

SEQ ID NO: 823864 - protein, 9 aa, Homo Sapiens
PGPKGNDGK

SEQ ID NO: 823865 - protein, 9 aa, Homo Sapiens
LTYMAKQFA

SEQ ID NO: 823866 - protein, 9 aa, Homo Sapiens
HYLNVPLSV

SEQ ID NO: 823867 - protein, 9 aa, Homo Sapiens
GNYSLFTSF

SEQ ID NO: 823868 - protein, 9 aa, Homo Sapiens
DYYACARLT

SEQ ID NO: 823869 - protein, 9 aa, Homo Sapiens
GILKSIMNK

SEQ ID NO: 823870 - protein, 9 aa, Homo Sapiens
EDVPTCRDS

SEQ ID NO: 823871 - protein, 9 aa, Homo Sapiens
NYMMEEPNI

SEQ ID NO: 823872 - protein, 9 aa, Homo Sapiens
LLHSFLLNT

SEQ ID NO: 823873 - protein, 9 aa, Homo Sapiens
GQHQIIHTG

SEQ ID NO: 823874 - protein, 9 aa, Homo Sapiens
FNRSSYLIQ

SEQ ID NO: 823875 - protein, 9 aa, Homo Sapiens
SNLIRHQII

SEQ ID NO: 823876 - protein, 9 aa, Homo Sapiens
HGGCLLDAP

SEQ ID NO: 823877 - protein, 9 aa, Homo Sapiens
TTFAWHTKD

SEQ ID NO: 823878 - protein, 9 aa, Homo Sapiens
HQTLGIAYA

SEQ ID NO: 823879 - protein, 9 aa, Homo Sapiens
LSGKLDTTN

SEQ ID NO: 823880 - protein, 9 aa, Homo Sapiens
YSFSPRDVS

SEQ ID NO: 823881 - protein, 9 aa, Homo Sapiens
LYRARSLQG

SEQ ID NO: 823882 - protein, 9 aa, Homo Sapiens
GYRKTLNCH

SEQ ID NO: 823883 - protein, 9 aa, Homo Sapiens
LPSVRPLPH

SEQ ID NO: 823884 - protein, 9 aa, Homo Sapiens
LLGMGHCLF

SEQ ID NO: 823885 - protein, 9 aa, Homo Sapiens
HSTSGLNKE

SEQ ID NO: 823886 - protein, 9 aa, Homo Sapiens
HNSATESAS

SEQ ID NO: 823887 - protein, 9 aa, Homo Sapiens
VEFTRDEWQ

SEQ ID NO: 823888 - protein, 9 aa, Homo Sapiens
GVSKGYGLV

SEQ ID NO: 823889 - protein, 9 aa, Homo Sapiens
PIEVADVND

SEQ ID NO: 823890 - protein, 9 aa, Homo Sapiens
GKTEQVQHS

SEQ ID NO: 823891 - protein, 9 aa, Homo Sapiens
GDLYNVLED

SEQ ID NO: 823892 - protein, 9 aa, Homo Sapiens
LHFATENDF

SEQ ID NO: 823893 - protein, 9 aa, Homo Sapiens
TTWSPDNWL

SEQ ID NO: 823894 - protein, 9 aa, Homo Sapiens
RCFRVDLVQ

SEQ ID NO: 823895 - protein, 9 aa, Homo Sapiens
YQCYLIVYY

SEQ ID NO: 823896 - protein, 9 aa, Homo Sapiens
EDKMQEQEE

SEQ ID NO: 823897 - protein, 9 aa, Homo Sapiens
KYLERLTQE

SEQ ID NO: 823898 - protein, 9 aa, Homo Sapiens
TLIGLEFIL

SEQ ID NO: 823899 - protein, 9 aa, Homo Sapiens
PTPITKMEI

SEQ ID NO: 823900 - protein, 9 aa, Homo Sapiens
FDVIKYDFQ

SEQ ID NO: 823901 - protein, 9 aa, Homo Sapiens
GDKTLEDRL

SEQ ID NO: 823902 - protein, 9 aa, Homo Sapiens
HRDDREPQD

SEQ ID NO: 823903 - protein, 9 aa, Homo Sapiens
ALLGINLMR

SEQ ID NO: 823904 - protein, 9 aa, Homo Sapiens
IGRLLKEGC

SEQ ID NO: 823905 - protein, 9 aa, Homo Sapiens
SQANRTVLD

SEQ ID NO: 823906 - protein, 9 aa, Homo Sapiens
HAETSKIKV

SEQ ID NO: 823907 - protein, 9 aa, Homo Sapiens
LNVPYNHID

SEQ ID NO: 823908 - protein, 9 aa, Homo Sapiens
STVYAGTFS

SEQ ID NO: 823909 - protein, 9 aa, Homo Sapiens
GLRTTTQMG

SEQ ID NO: 823910 - protein, 9 aa, Homo Sapiens
SNEGRKYPE

SEQ ID NO: 823911 - protein, 9 aa, Homo Sapiens
PSPPEVASH

SEQ ID NO: 823912 - protein, 9 aa, Homo Sapiens
MHTNKRVSS

SEQ ID NO: 823913 - protein, 9 aa, Homo Sapiens
MVRYELPHF

SEQ ID NO: 823914 - protein, 9 aa, Homo Sapiens
SNVYALLKD

SEQ ID NO: 823915 - protein, 9 aa, Homo Sapiens
TIESHCSII

SEQ ID NO: 823916 - protein, 9 aa, Homo Sapiens
FNYLKLLGK

SEQ ID NO: 823917 - protein, 9 aa, Homo Sapiens
ISVVEENLK

SEQ ID NO: 823918 - protein, 9 aa, Homo Sapiens
TFKLPRLTQ

SEQ ID NO: 823919 - protein, 9 aa, Homo Sapiens
TIGSLHPMK

SEQ ID NO: 823920 - protein, 9 aa, Homo Sapiens
PQDGRDRRD

SEQ ID NO: 823921 - protein, 9 aa, Homo Sapiens
LADQLKQAE

SEQ ID NO: 823922 - protein, 9 aa, Homo Sapiens
YMSHQNSRT

SEQ ID NO: 823923 - protein, 9 aa, Homo Sapiens
DNFFCDVSP

SEQ ID NO: 823924 - protein, 9 aa, Homo Sapiens
ATVVLAEML

SEQ ID NO: 823925 - protein, 9 aa, Homo Sapiens
KSPKNKLGV

SEQ ID NO: 823926 - protein, 9 aa, Homo Sapiens
GCSGPVDEG

SEQ ID NO: 823927 - protein, 9 aa, Homo Sapiens
LQLRLNLYP

SEQ ID NO: 823928 - protein, 9 aa, Homo Sapiens
PQPGHENFQ

SEQ ID NO: 823929 - protein, 9 aa, Homo Sapiens
KKLDFHLHV

SEQ ID NO: 823930 - protein, 9 aa, Homo Sapiens
KGNVAAAVS

SEQ ID NO: 823931 - protein, 9 aa, Homo Sapiens
CNSYNNAGM

SEQ ID NO: 823932 - protein, 9 aa, Homo Sapiens
AEAKNKLSG

SEQ ID NO: 823933 - protein, 9 aa, Homo Sapiens
KKTSFKRAK

SEQ ID NO: 823934 - protein, 9 aa, Homo Sapiens
VCLPASSLN

SEQ ID NO: 823935 - protein, 9 aa, Homo Sapiens
GQGLSMARM

SEQ ID NO: 823936 - protein, 9 aa, Homo Sapiens
QNCRVTFEE

SEQ ID NO: 823937 - protein, 9 aa, Homo Sapiens
YEQQLLRKV

SEQ ID NO: 823938 - protein, 9 aa, Homo Sapiens
AWQDLYAWT

SEQ ID NO: 823939 - protein, 9 aa, Homo Sapiens
KEIMYGTNE

SEQ ID NO: 823940 - protein, 9 aa, Homo Sapiens
VLCTVEYVR

SEQ ID NO: 823941 - protein, 9 aa, Homo Sapiens
KLESFEESG

SEQ ID NO: 823942 - protein, 9 aa, Homo Sapiens
IMEGHDYDP

SEQ ID NO: 823943 - protein, 9 aa, Homo Sapiens
KPLDLSDQF

SEQ ID NO: 823944 - protein, 9 aa, Homo Sapiens
RIAQKTRLT

SEQ ID NO: 823945 - protein, 9 aa, Homo Sapiens
QEHRGLPPR

SEQ ID NO: 823946 - protein, 9 aa, Homo Sapiens
VIQSVRNKR

SEQ ID NO: 823947 - protein, 9 aa, Homo Sapiens
NRSCQIEQP

SEQ ID NO: 823948 - protein, 9 aa, Homo Sapiens
TLTDYDIQF

SEQ ID NO: 823949 - protein, 9 aa, Homo Sapiens
QNSLKHRRV

SEQ ID NO: 823950 - protein, 9 aa, Homo Sapiens
ECGAGVRTH

SEQ ID NO: 823951 - protein, 9 aa, Homo Sapiens
ASPGPDGDL

SEQ ID NO: 823952 - protein, 9 aa, Homo Sapiens
LSNKPEIPT

SEQ ID NO: 823953 - protein, 9 aa, Homo Sapiens
DVIKYDFQK

SEQ ID NO: 823954 - protein, 9 aa, Homo Sapiens
FQGAQEPAA

SEQ ID NO: 823955 - protein, 9 aa, Homo Sapiens
THCLHSKAV

SEQ ID NO: 823956 - protein, 9 aa, Homo Sapiens
KVSAEEAGE

SEQ ID NO: 823957 - protein, 9 aa, Homo Sapiens
INLGDRSQK

SEQ ID NO: 823958 - protein, 9 aa, Homo Sapiens
DITELNILE

SEQ ID NO: 823959 - protein, 9 aa, Homo Sapiens
VIFLLLYLI

SEQ ID NO: 823960 - protein, 9 aa, Homo Sapiens
PDEEKKYLS

SEQ ID NO: 823961 - protein, 9 aa, Homo Sapiens
EDKFGHNEC

SEQ ID NO: 823962 - protein, 9 aa, Homo Sapiens
RPSTPPSNL

SEQ ID NO: 823963 - protein, 9 aa, Homo Sapiens
REGAKRALK

SEQ ID NO: 823964 - protein, 9 aa, Homo Sapiens
LNEQQRSSP

SEQ ID NO: 823965 - protein, 9 aa, Homo Sapiens
TGDPNKKLI

SEQ ID NO: 823966 - protein, 9 aa, Homo Sapiens
VHQGTHTGE

SEQ ID NO: 823967 - protein, 9 aa, Homo Sapiens
SQMHHLNLL

SEQ ID NO: 823968 - protein, 9 aa, Homo Sapiens
VFPVLQTNN

SEQ ID NO: 823969 - protein, 9 aa, Homo Sapiens
LPVLRNQRE

SEQ ID NO: 823970 - protein, 9 aa, Homo Sapiens
TVNKTSCTV

SEQ ID NO: 823971 - protein, 9 aa, Homo Sapiens
GLPHLDHPG

SEQ ID NO: 823972 - protein, 9 aa, Homo Sapiens
MFDANNMMA

SEQ ID NO: 823973 - protein, 9 aa, Homo Sapiens
TGVMLGSIF

SEQ ID NO: 823974 - protein, 9 aa, Homo Sapiens
AARVTLGIT

SEQ ID NO: 823975 - protein, 9 aa, Homo Sapiens
HDGIQRVFF

SEQ ID NO: 823976 - protein, 9 aa, Homo Sapiens
VVEVYGLLT

SEQ ID NO: 823977 - protein, 9 aa, Homo Sapiens
NEDEMYKII

SEQ ID NO: 823978 - protein, 9 aa, Homo Sapiens
ANNLAIQLA

SEQ ID NO: 823979 - protein, 9 aa, Homo Sapiens
TLPLPVATR

SEQ ID NO: 823980 - protein, 9 aa, Homo Sapiens
ELGNDQLQT

SEQ ID NO: 823981 - protein, 9 aa, Homo Sapiens
SKIISFKSM

SEQ ID NO: 823982 - protein, 9 aa, Homo Sapiens
LWLPYNTLS

SEQ ID NO: 823983 - protein, 9 aa, Homo Sapiens
QESMSASLN

SEQ ID NO: 823984 - protein, 9 aa, Homo Sapiens
LIFIMAGID

SEQ ID NO: 823985 - protein, 9 aa, Homo Sapiens
LKSEWDALF

SEQ ID NO: 823986 - protein, 9 aa, Homo Sapiens
GTDEAEDPE

SEQ ID NO: 823987 - protein, 9 aa, Homo Sapiens
FEDYPMRML

SEQ ID NO: 823988 - protein, 9 aa, Homo Sapiens
EDDTNDGDD

SEQ ID NO: 823989 - protein, 9 aa, Homo Sapiens
LIPSIKTPL

SEQ ID NO: 823990 - protein, 9 aa, Homo Sapiens
MEHKEVVIL

SEQ ID NO: 823991 - protein, 9 aa, Homo Sapiens
KQEQTTETA

SEQ ID NO: 823992 - protein, 9 aa, Homo Sapiens
DRTAKKQSV

SEQ ID NO: 823993 - protein, 9 aa, Homo Sapiens
LTSTSNLAA

SEQ ID NO: 823994 - protein, 9 aa, Homo Sapiens
KTITTTGIM

SEQ ID NO: 823995 - protein, 9 aa, Homo Sapiens
DCGNGGDEW

SEQ ID NO: 823996 - protein, 9 aa, Homo Sapiens
HLKRYSFSN

SEQ ID NO: 823997 - protein, 9 aa, Homo Sapiens
DKQRKHLNM

SEQ ID NO: 823998 - protein, 9 aa, Homo Sapiens
DRARRAQNP

SEQ ID NO: 823999 - protein, 9 aa, Homo Sapiens
SGEKPFQRE

SEQ ID NO: 824000 - protein, 9 aa, Homo Sapiens
GYLAMVIEG

SEQ ID NO: 824001 - protein, 9 aa, Homo Sapiens
RPSHLYTDG

SEQ ID NO: 824002 - protein, 9 aa, Homo Sapiens
PYLDKYEQF

SEQ ID NO: 824003 - protein, 9 aa, Homo Sapiens
DRGDKSAPI

SEQ ID NO: 824004 - protein, 9 aa, Homo Sapiens
KLRQNQNYM

SEQ ID NO: 824005 - protein, 9 aa, Homo Sapiens
QYQLSKNFK

SEQ ID NO: 824006 - protein, 9 aa, Homo Sapiens
QPNRTTSFP

SEQ ID NO: 824007 - protein, 9 aa, Homo Sapiens
VIRTASEPY

SEQ ID NO: 824008 - protein, 9 aa, Homo Sapiens
EYVYKVVVD

SEQ ID NO: 824009 - protein, 9 aa, Homo Sapiens
MLVGGVRSM

SEQ ID NO: 824010 - protein, 9 aa, Homo Sapiens
NVFLCLMES

SEQ ID NO: 824011 - protein, 9 aa, Homo Sapiens
MLEKAGCHL

SEQ ID NO: 824012 - protein, 9 aa, Homo Sapiens
IHAKNIIVT

SEQ ID NO: 824013 - protein, 9 aa, Homo Sapiens
GTKLEPPAP

SEQ ID NO: 824014 - protein, 9 aa, Homo Sapiens
MESLNSTQS

SEQ ID NO: 824015 - protein, 9 aa, Homo Sapiens
DDEIDEDCT

SEQ ID NO: 824016 - protein, 9 aa, Homo Sapiens
FEQGKLYLR

SEQ ID NO: 824017 - protein, 9 aa, Homo Sapiens
KERYAEKDP

SEQ ID NO: 824018 - protein, 9 aa, Homo Sapiens
KLARDVVSR

SEQ ID NO: 824019 - protein, 9 aa, Homo Sapiens
FLVTVVDYG

SEQ ID NO: 824020 - protein, 9 aa, Homo Sapiens
VRKITCTNP

SEQ ID NO: 824021 - protein, 9 aa, Homo Sapiens
IDDLSEVRG

SEQ ID NO: 824022 - protein, 9 aa, Homo Sapiens
GKTVLHLAV

SEQ ID NO: 824023 - protein, 9 aa, Homo Sapiens
DMKSNNIFI

SEQ ID NO: 824024 - protein, 9 aa, Homo Sapiens
VGSDFVQKY

SEQ ID NO: 824025 - protein, 9 aa, Homo Sapiens
LFCEVDEDY

SEQ ID NO: 824026 - protein, 9 aa, Homo Sapiens
SKLHGKLCG

SEQ ID NO: 824027 - protein, 9 aa, Homo Sapiens
KTPDENKDE

SEQ ID NO: 824028 - protein, 9 aa, Homo Sapiens
CDKSHLLRH

SEQ ID NO: 824029 - protein, 9 aa, Homo Sapiens
FFGNNLNFW

SEQ ID NO: 824030 - protein, 9 aa, Homo Sapiens
SKKTHASAP

SEQ ID NO: 824031 - protein, 9 aa, Homo Sapiens
VDVTQGYNE

SEQ ID NO: 824032 - protein, 9 aa, Homo Sapiens
LWPGTIQRE

SEQ ID NO: 824033 - protein, 9 aa, Homo Sapiens
AQGTWSWEW

SEQ ID NO: 824034 - protein, 9 aa, Homo Sapiens
QNIRLLKKK

SEQ ID NO: 824035 - protein, 9 aa, Homo Sapiens
CFFQNFVPE

SEQ ID NO: 824036 - protein, 9 aa, Homo Sapiens
NLLRGDNSR

SEQ ID NO: 824037 - protein, 9 aa, Homo Sapiens
EVLNHVEQL

SEQ ID NO: 824038 - protein, 9 aa, Homo Sapiens
NGCHLPFFP

SEQ ID NO: 824039 - protein, 9 aa, Homo Sapiens
PDTGACVCP

SEQ ID NO: 824040 - protein, 9 aa, Homo Sapiens
QNPSQMDRN

SEQ ID NO: 824041 - protein, 9 aa, Homo Sapiens
IKRVQLISN

SEQ ID NO: 824042 - protein, 9 aa, Homo Sapiens
ELLYPNIAE

SEQ ID NO: 824043 - protein, 9 aa, Homo Sapiens
APLITDFKR

SEQ ID NO: 824044 - protein, 9 aa, Homo Sapiens
EAVMSVAFS

SEQ ID NO: 824045 - protein, 9 aa, Homo Sapiens
TFIDKNFWS

SEQ ID NO: 824046 - protein, 9 aa, Homo Sapiens
EIKRLTGLL

SEQ ID NO: 824047 - protein, 9 aa, Homo Sapiens
ELRKSPVVS

SEQ ID NO: 824048 - protein, 9 aa, Homo Sapiens
ENVDGAATE

SEQ ID NO: 824049 - protein, 9 aa, Homo Sapiens
ENYYRCEEC

SEQ ID NO: 824050 - protein, 9 aa, Homo Sapiens
SGILLDYEH

SEQ ID NO: 824051 - protein, 9 aa, Homo Sapiens
NILRGFVSI

SEQ ID NO: 824052 - protein, 9 aa, Homo Sapiens
KGNDFFIND

SEQ ID NO: 824053 - protein, 9 aa, Homo Sapiens
GISCIFPAS

SEQ ID NO: 824054 - protein, 9 aa, Homo Sapiens
FNEDSLLKS

SEQ ID NO: 824055 - protein, 9 aa, Homo Sapiens
SLMAPTPVS

SEQ ID NO: 824056 - protein, 9 aa, Homo Sapiens
NRARKLHLY

SEQ ID NO: 824057 - protein, 9 aa, Homo Sapiens
LLKKLLLSS

SEQ ID NO: 824058 - protein, 9 aa, Homo Sapiens
HTDIVFART

SEQ ID NO: 824059 - protein, 9 aa, Homo Sapiens
CHVEKLART

SEQ ID NO: 824060 - protein, 9 aa, Homo Sapiens
GPILGSEPL

SEQ ID NO: 824061 - protein, 9 aa, Homo Sapiens
QGQRTLEYR

SEQ ID NO: 824062 - protein, 9 aa, Homo Sapiens
KKNDNRLKA

SEQ ID NO: 824063 - protein, 9 aa, Homo Sapiens
QSDAPKMHT

SEQ ID NO: 824064 - protein, 9 aa, Homo Sapiens
NGQNPLPIY

SEQ ID NO: 824065 - protein, 9 aa, Homo Sapiens
ALLLQTPVV

SEQ ID NO: 824066 - protein, 9 aa, Homo Sapiens
LATDYNDNC

SEQ ID NO: 824067 - protein, 9 aa, Homo Sapiens
THFNGNYIK

SEQ ID NO: 824068 - protein, 9 aa, Homo Sapiens
VLEVPEMSP

SEQ ID NO: 824069 - protein, 9 aa, Homo Sapiens
PSQIWNFVE

SEQ ID NO: 824070 - protein, 9 aa, Homo Sapiens
VLLGAKLYS

SEQ ID NO: 824071 - protein, 9 aa, Homo Sapiens
RKESLDSIA

SEQ ID NO: 824072 - protein, 9 aa, Homo Sapiens
PALESSEEV

SEQ ID NO: 824073 - protein, 9 aa, Homo Sapiens
TRYTIKTDV

SEQ ID NO: 824074 - protein, 9 aa, Homo Sapiens
FNFLLMTYF

SEQ ID NO: 824075 - protein, 9 aa, Homo Sapiens
VLPNDLFST

SEQ ID NO: 824076 - protein, 9 aa, Homo Sapiens
VSVLNWLIS

SEQ ID NO: 824077 - protein, 9 aa, Homo Sapiens
TKYTHLVDE

SEQ ID NO: 824078 - protein, 9 aa, Homo Sapiens
GYKYCDAKS

SEQ ID NO: 824079 - protein, 9 aa, Homo Sapiens
NIYEPPRYM

SEQ ID NO: 824080 - protein, 9 aa, Homo Sapiens
INTLQAIWM

SEQ ID NO: 824081 - protein, 9 aa, Homo Sapiens
EVSSDDDLF

SEQ ID NO: 824082 - protein, 9 aa, Homo Sapiens
PVTNTSSES

SEQ ID NO: 824083 - protein, 9 aa, Homo Sapiens
VPVVVHKHA

SEQ ID NO: 824084 - protein, 9 aa, Homo Sapiens
IVDLNLLIG

SEQ ID NO: 824085 - protein, 9 aa, Homo Sapiens
TVANHVNTT

SEQ ID NO: 824086 - protein, 9 aa, Homo Sapiens
VEIGDFKRP

SEQ ID NO: 824087 - protein, 9 aa, Homo Sapiens
FKQGHSIVI

SEQ ID NO: 824088 - protein, 9 aa, Homo Sapiens
LLQKTLEEM

SEQ ID NO: 824089 - protein, 9 aa, Homo Sapiens
VSNTPALVF

SEQ ID NO: 824090 - protein, 9 aa, Homo Sapiens
DSHPKLLHK

SEQ ID NO: 824091 - protein, 9 aa, Homo Sapiens
GFCDKSHLL

SEQ ID NO: 824092 - protein, 9 aa, Homo Sapiens
ESSLSADPL

SEQ ID NO: 824093 - protein, 9 aa, Homo Sapiens
CDTKCNTLF

SEQ ID NO: 824094 - protein, 9 aa, Homo Sapiens
QLTVWPDSQ

SEQ ID NO: 824095 - protein, 9 aa, Homo Sapiens
QYTPEMILK

SEQ ID NO: 824096 - protein, 9 aa, Homo Sapiens
SFFHDAEES

SEQ ID NO: 824097 - protein, 9 aa, Homo Sapiens
YFEHLNSDF

SEQ ID NO: 824098 - protein, 9 aa, Homo Sapiens
PPVIRGQSS

SEQ ID NO: 824099 - protein, 9 aa, Homo Sapiens
DSSPSNNSS

SEQ ID NO: 824100 - protein, 9 aa, Homo Sapiens
CSSCGREKK

SEQ ID NO: 824101 - protein, 9 aa, Homo Sapiens
AHTPTLAST

SEQ ID NO: 824102 - protein, 9 aa, Homo Sapiens
STPEEMSEV

SEQ ID NO: 824103 - protein, 9 aa, Homo Sapiens
KLEWPLAEV

SEQ ID NO: 824104 - protein, 9 aa, Homo Sapiens
NMKPHEIPQ

SEQ ID NO: 824105 - protein, 9 aa, Homo Sapiens
CGEAFRTKE

SEQ ID NO: 824106 - protein, 9 aa, Homo Sapiens
KLDKFSSAL

SEQ ID NO: 824107 - protein, 9 aa, Homo Sapiens
VNKYFDFSL

SEQ ID NO: 824108 - protein, 9 aa, Homo Sapiens
FQHLLGKRA

SEQ ID NO: 824109 - protein, 9 aa, Homo Sapiens
EESQILVLT

SEQ ID NO: 824110 - protein, 9 aa, Homo Sapiens
LRRYTYNYE

SEQ ID NO: 824111 - protein, 9 aa, Homo Sapiens
SNNKVNQWA

SEQ ID NO: 824112 - protein, 9 aa, Homo Sapiens
IERSSNFGK

SEQ ID NO: 824113 - protein, 9 aa, Homo Sapiens
PSHGALSPS

SEQ ID NO: 824114 - protein, 9 aa, Homo Sapiens
ETNNLSPKE

SEQ ID NO: 824115 - protein, 9 aa, Homo Sapiens
ELPEKLEET

SEQ ID NO: 824116 - protein, 9 aa, Homo Sapiens
VPWKQPKGI

SEQ ID NO: 824117 - protein, 9 aa, Homo Sapiens
EDTHPVVPA

SEQ ID NO: 824118 - protein, 9 aa, Homo Sapiens
SSYNDQLFG

SEQ ID NO: 824119 - protein, 9 aa, Homo Sapiens
ALCSIYGSI

SEQ ID NO: 824120 - protein, 9 aa, Homo Sapiens
QDEFDCRYK

SEQ ID NO: 824121 - protein, 9 aa, Homo Sapiens
TVSPFSKMP

SEQ ID NO: 824122 - protein, 9 aa, Homo Sapiens
KSVLQNQDN

SEQ ID NO: 824123 - protein, 9 aa, Homo Sapiens
DNSQNAPLV

SEQ ID NO: 824124 - protein, 9 aa, Homo Sapiens
RCSKRSSHH

SEQ ID NO: 824125 - protein, 9 aa, Homo Sapiens
NECPKPELL

SEQ ID NO: 824126 - protein, 9 aa, Homo Sapiens
LPYRYQNEK

SEQ ID NO: 824127 - protein, 9 aa, Homo Sapiens
SSPLANQSI

SEQ ID NO: 824128 - protein, 9 aa, Homo Sapiens
SQGHKLFRK

SEQ ID NO: 824129 - protein, 9 aa, Homo Sapiens
YYACARLTC

SEQ ID NO: 824130 - protein, 9 aa, Homo Sapiens
QSENSCLLF

SEQ ID NO: 824131 - protein, 9 aa, Homo Sapiens
LALFDNRLT

SEQ ID NO: 824132 - protein, 9 aa, Homo Sapiens
IHCCVIGYP

SEQ ID NO: 824133 - protein, 9 aa, Homo Sapiens
PDPQNIYLR

SEQ ID NO: 824134 - protein, 9 aa, Homo Sapiens
SVAYYVARE

SEQ ID NO: 824135 - protein, 9 aa, Homo Sapiens
KGDKKKVVD

SEQ ID NO: 824136 - protein, 9 aa, Homo Sapiens
KSDTFFRMH

SEQ ID NO: 824137 - protein, 9 aa, Homo Sapiens
RNKLEQLYN

SEQ ID NO: 824138 - protein, 9 aa, Homo Sapiens
PQQFDVLFR

SEQ ID NO: 824139 - protein, 9 aa, Homo Sapiens
EVVKCGRNS

SEQ ID NO: 824140 - protein, 9 aa, Homo Sapiens
VQKDLQNFL

SEQ ID NO: 824141 - protein, 9 aa, Homo Sapiens
WGRGDRIKS

SEQ ID NO: 824142 - protein, 9 aa, Homo Sapiens
YDLSKSGCS

SEQ ID NO: 824143 - protein, 9 aa, Homo Sapiens
NDKEKERYA

SEQ ID NO: 824144 - protein, 9 aa, Homo Sapiens
ICANAVLHK

SEQ ID NO: 824145 - protein, 9 aa, Homo Sapiens
DKDKRGKGR

SEQ ID NO: 824146 - protein, 9 aa, Homo Sapiens
NTLMESVTE

SEQ ID NO: 824147 - protein, 9 aa, Homo Sapiens
HYYGKKHKK

SEQ ID NO: 824148 - protein, 9 aa, Homo Sapiens
CSNNEIDID

SEQ ID NO: 824149 - protein, 9 aa, Homo Sapiens
YLLGVINAG

SEQ ID NO: 824150 - protein, 9 aa, Homo Sapiens
WLESLNVGE

SEQ ID NO: 824151 - protein, 9 aa, Homo Sapiens
GVVRESIIW

SEQ ID NO: 824152 - protein, 9 aa, Homo Sapiens
CLRFLQPYI

SEQ ID NO: 824153 - protein, 9 aa, Homo Sapiens
DIGNLNIPD

SEQ ID NO: 824154 - protein, 9 aa, Homo Sapiens
TKGNGFEMK

SEQ ID NO: 824155 - protein, 9 aa, Homo Sapiens
QWQIILEQA

SEQ ID NO: 824156 - protein, 9 aa, Homo Sapiens
FWRFPAFGH

SEQ ID NO: 824157 - protein, 9 aa, Homo Sapiens
PEATQIITT

SEQ ID NO: 824158 - protein, 9 aa, Homo Sapiens
KQSLVAAVQ

SEQ ID NO: 824159 - protein, 9 aa, Homo Sapiens
EEERKHTLE

SEQ ID NO: 824160 - protein, 9 aa, Homo Sapiens
VKELLNEKY

SEQ ID NO: 824161 - protein, 9 aa, Homo Sapiens
GPGKVLQNL

SEQ ID NO: 824162 - protein, 9 aa, Homo Sapiens
TPEKIIAIA

SEQ ID NO: 824163 - protein, 9 aa, Homo Sapiens
IGSVSTTDR

SEQ ID NO: 824164 - protein, 9 aa, Homo Sapiens
ENSCLAKLR

SEQ ID NO: 824165 - protein, 9 aa, Homo Sapiens
VNEQQDLPI

SEQ ID NO: 824166 - protein, 9 aa, Homo Sapiens
EFIESCQED

SEQ ID NO: 824167 - protein, 9 aa, Homo Sapiens
LTTIGKYLD

SEQ ID NO: 824168 - protein, 9 aa, Homo Sapiens
VGVFLRDFV

SEQ ID NO: 824169 - protein, 9 aa, Homo Sapiens
RAATTLDAK

SEQ ID NO: 824170 - protein, 9 aa, Homo Sapiens
NLKASLKQK

SEQ ID NO: 824171 - protein, 9 aa, Homo Sapiens
KISSSWGNP

SEQ ID NO: 824172 - protein, 9 aa, Homo Sapiens
SEDTPNQFI

SEQ ID NO: 824173 - protein, 9 aa, Homo Sapiens
HLPWVLIAF

SEQ ID NO: 824174 - protein, 9 aa, Homo Sapiens
RFQPPEPPP

SEQ ID NO: 824175 - protein, 9 aa, Homo Sapiens
NLANTNQHI

SEQ ID NO: 824176 - protein, 9 aa, Homo Sapiens
EEQSGMYVI

SEQ ID NO: 824177 - protein, 9 aa, Homo Sapiens
MLKEVIQRE

SEQ ID NO: 824178 - protein, 9 aa, Homo Sapiens
ELFAVVMGT

SEQ ID NO: 824179 - protein, 9 aa, Homo Sapiens
LAHISTNPR

SEQ ID NO: 824180 - protein, 9 aa, Homo Sapiens
HAVADIYCG

SEQ ID NO: 824181 - protein, 9 aa, Homo Sapiens
DEAFLRLAQ

SEQ ID NO: 824182 - protein, 9 aa, Homo Sapiens
ERKRMRNHI

SEQ ID NO: 824183 - protein, 9 aa, Homo Sapiens
METKSTQEG

SEQ ID NO: 824184 - protein, 9 aa, Homo Sapiens
RCSHFPAGE

SEQ ID NO: 824185 - protein, 9 aa, Homo Sapiens
LKLLCRYKI

SEQ ID NO: 824186 - protein, 9 aa, Homo Sapiens
HGNLTEKLK

SEQ ID NO: 824187 - protein, 9 aa, Homo Sapiens
ARDAKAIAA

SEQ ID NO: 824188 - protein, 9 aa, Homo Sapiens
AVLHKNRDK

SEQ ID NO: 824189 - protein, 9 aa, Homo Sapiens
YGPEGILGT

SEQ ID NO: 824190 - protein, 9 aa, Homo Sapiens
LKLIRLDLP

SEQ ID NO: 824191 - protein, 9 aa, Homo Sapiens
ILRGFVSIS

SEQ ID NO: 824192 - protein, 9 aa, Homo Sapiens
WWLCWKLVS

SEQ ID NO: 824193 - protein, 9 aa, Homo Sapiens
FQDRYKKLQ

SEQ ID NO: 824194 - protein, 9 aa, Homo Sapiens
KEGACIVRD

SEQ ID NO: 824195 - protein, 9 aa, Homo Sapiens
MVIYTSGTT

SEQ ID NO: 824196 - protein, 9 aa, Homo Sapiens
RISTFKRKD

SEQ ID NO: 824197 - protein, 9 aa, Homo Sapiens
SYIDNPLDK

SEQ ID NO: 824198 - protein, 9 aa, Homo Sapiens
QLPDMQMKD

SEQ ID NO: 824199 - protein, 9 aa, Homo Sapiens
GTAAIAHII

SEQ ID NO: 824200 - protein, 9 aa, Homo Sapiens
KRIGFYQIR

SEQ ID NO: 824201 - protein, 9 aa, Homo Sapiens
IELDLRGNT

SEQ ID NO: 824202 - protein, 9 aa, Homo Sapiens
STAKSQFIK

SEQ ID NO: 824203 - protein, 9 aa, Homo Sapiens
CHPSHEGRL

SEQ ID NO: 824204 - protein, 9 aa, Homo Sapiens
LTDPFYGIP

SEQ ID NO: 824205 - protein, 9 aa, Homo Sapiens
ILWVTEWLP

SEQ ID NO: 824206 - protein, 9 aa, Homo Sapiens
LCSSCGREK

SEQ ID NO: 824207 - protein, 9 aa, Homo Sapiens
LTTLKEYET

SEQ ID NO: 824208 - protein, 9 aa, Homo Sapiens
SIAGTVKWA

SEQ ID NO: 824209 - protein, 9 aa, Homo Sapiens
IAKDKVLKY

SEQ ID NO: 824210 - protein, 9 aa, Homo Sapiens
PQRQRHLEK

SEQ ID NO: 824211 - protein, 9 aa, Homo Sapiens
DYDMPHVVA

SEQ ID NO: 824212 - protein, 9 aa, Homo Sapiens
FMQGNNKYG

SEQ ID NO: 824213 - protein, 9 aa, Homo Sapiens
MYRMQLLYC

SEQ ID NO: 824214 - protein, 9 aa, Homo Sapiens
GDLVSLTVD

SEQ ID NO: 824215 - protein, 9 aa, Homo Sapiens
CTGPKGQGK

SEQ ID NO: 824216 - protein, 9 aa, Homo Sapiens
PLEETEKQA

SEQ ID NO: 824217 - protein, 9 aa, Homo Sapiens
QQEIGWFDI

SEQ ID NO: 824218 - protein, 9 aa, Homo Sapiens
RRHSWRSWQ

SEQ ID NO: 824219 - protein, 9 aa, Homo Sapiens
HNHQSEFTV

SEQ ID NO: 824220 - protein, 9 aa, Homo Sapiens
RGSWRAVAR

SEQ ID NO: 824221 - protein, 9 aa, Homo Sapiens
HAGDSKAAQ

SEQ ID NO: 824222 - protein, 9 aa, Homo Sapiens
LVQHGLQVW

SEQ ID NO: 824223 - protein, 9 aa, Homo Sapiens
QQQQQTQMA

SEQ ID NO: 824224 - protein, 9 aa, Homo Sapiens
LQEEASYMT

SEQ ID NO: 824225 - protein, 9 aa, Homo Sapiens
LLVQAGAWG

SEQ ID NO: 824226 - protein, 9 aa, Homo Sapiens
LNKTNILEE

SEQ ID NO: 824227 - protein, 9 aa, Homo Sapiens
ALNNSGSCF

SEQ ID NO: 824228 - protein, 9 aa, Homo Sapiens
VLLTAPFSL

SEQ ID NO: 824229 - protein, 9 aa, Homo Sapiens
YKESALDKS

SEQ ID NO: 824230 - protein, 9 aa, Homo Sapiens
SQPQQQQQI

SEQ ID NO: 824231 - protein, 9 aa, Homo Sapiens
TDMKLSMNN

SEQ ID NO: 824232 - protein, 9 aa, Homo Sapiens
KSEWDALFD

SEQ ID NO: 824233 - protein, 9 aa, Homo Sapiens
MSQCTCEED

SEQ ID NO: 824234 - protein, 9 aa, Homo Sapiens
RGTGVHRLE

SEQ ID NO: 824235 - protein, 9 aa, Homo Sapiens
YFPMPELKL

SEQ ID NO: 824236 - protein, 9 aa, Homo Sapiens
VQDQVWNSY

SEQ ID NO: 824237 - protein, 9 aa, Homo Sapiens
MTKNIYGNI

SEQ ID NO: 824238 - protein, 9 aa, Homo Sapiens
CIKMPYSPG

SEQ ID NO: 824239 - protein, 9 aa, Homo Sapiens
SDQSYGIFW

SEQ ID NO: 824240 - protein, 9 aa, Homo Sapiens
ALKGEEQNN

SEQ ID NO: 824241 - protein, 9 aa, Homo Sapiens
DQFEEGQDK

SEQ ID NO: 824242 - protein, 9 aa, Homo Sapiens
SGPEDQGIP

SEQ ID NO: 824243 - protein, 9 aa, Homo Sapiens
YYIKMSINP

SEQ ID NO: 824244 - protein, 9 aa, Homo Sapiens
CIKIADFGF

SEQ ID NO: 824245 - protein, 9 aa, Homo Sapiens
IIDRYVAVT

SEQ ID NO: 824246 - protein, 9 aa, Homo Sapiens
GEVGEELEM

SEQ ID NO: 824247 - protein, 9 aa, Homo Sapiens
KTKSIVELM

SEQ ID NO: 824248 - protein, 9 aa, Homo Sapiens
LDRHRESLM

SEQ ID NO: 824249 - protein, 9 aa, Homo Sapiens
VSLLMFKDL

SEQ ID NO: 824250 - protein, 9 aa, Homo Sapiens
GIFTPNNYS

SEQ ID NO: 824251 - protein, 9 aa, Homo Sapiens
LTEINYTVD

SEQ ID NO: 824252 - protein, 9 aa, Homo Sapiens
KEEKPRAQE

SEQ ID NO: 824253 - protein, 9 aa, Homo Sapiens
RSPCLDCPS

SEQ ID NO: 824254 - protein, 9 aa, Homo Sapiens
EYAHTLTCV

SEQ ID NO: 824255 - protein, 9 aa, Homo Sapiens
LLGLPTPPP

SEQ ID NO: 824256 - protein, 9 aa, Homo Sapiens
KAVGKFTKA

SEQ ID NO: 824257 - protein, 9 aa, Homo Sapiens
DSADAGQYN

SEQ ID NO: 824258 - protein, 9 aa, Homo Sapiens
CKYITKNLL

SEQ ID NO: 824259 - protein, 9 aa, Homo Sapiens
FFFQDTPRS

SEQ ID NO: 824260 - protein, 9 aa, Homo Sapiens
CTRLKTMTD

SEQ ID NO: 824261 - protein, 9 aa, Homo Sapiens
DTSSVAVDL

SEQ ID NO: 824262 - protein, 9 aa, Homo Sapiens
LCVHVCLCM

SEQ ID NO: 824263 - protein, 9 aa, Homo Sapiens
VDVNKTVDT

SEQ ID NO: 824264 - protein, 9 aa, Homo Sapiens
EKPKPVQLL

SEQ ID NO: 824265 - protein, 9 aa, Homo Sapiens
YIIQQPQKC

SEQ ID NO: 824266 - protein, 9 aa, Homo Sapiens
VSERNDQKG

SEQ ID NO: 824267 - protein, 9 aa, Homo Sapiens
NIQSIFENQ

SEQ ID NO: 824268 - protein, 9 aa, Homo Sapiens
SSRDRHILD

SEQ ID NO: 824269 - protein, 9 aa, Homo Sapiens
YIGQLLPGY

SEQ ID NO: 824270 - protein, 9 aa, Homo Sapiens
QILIDKLSA

SEQ ID NO: 824271 - protein, 9 aa, Homo Sapiens
ICVLLLFII

SEQ ID NO: 824272 - protein, 9 aa, Homo Sapiens
LQYPIGLIT

SEQ ID NO: 824273 - protein, 9 aa, Homo Sapiens
IGDVEIAEV

SEQ ID NO: 824274 - protein, 9 aa, Homo Sapiens
VVPNNRVQI

SEQ ID NO: 824275 - protein, 9 aa, Homo Sapiens
ESEIIYFFL

SEQ ID NO: 824276 - protein, 9 aa, Homo Sapiens
LPTALLLIV

SEQ ID NO: 824277 - protein, 9 aa, Homo Sapiens
DEEKVICLV

SEQ ID NO: 824278 - protein, 9 aa, Homo Sapiens
SRLFSRQAK

SEQ ID NO: 824279 - protein, 9 aa, Homo Sapiens
NATVGRQYL

SEQ ID NO: 824280 - protein, 9 aa, Homo Sapiens
WGWNLRWTV

SEQ ID NO: 824281 - protein, 9 aa, Homo Sapiens
MGRKPYVRS

SEQ ID NO: 824282 - protein, 9 aa, Homo Sapiens
DKEKPIHLT

SEQ ID NO: 824283 - protein, 9 aa, Homo Sapiens
LASNARTEK

SEQ ID NO: 824284 - protein, 9 aa, Homo Sapiens
AAVQDHGQP

SEQ ID NO: 824285 - protein, 9 aa, Homo Sapiens
EKMQNTGDE

SEQ ID NO: 824286 - protein, 9 aa, Homo Sapiens
VPGLVGSPL

SEQ ID NO: 824287 - protein, 9 aa, Homo Sapiens
YAKNILSLM

SEQ ID NO: 824288 - protein, 9 aa, Homo Sapiens
TCVAVCVSS

SEQ ID NO: 824289 - protein, 9 aa, Homo Sapiens
LVLLVRIIC

SEQ ID NO: 824290 - protein, 9 aa, Homo Sapiens
ADEWQASEE

SEQ ID NO: 824291 - protein, 9 aa, Homo Sapiens
RHGAPKIIY

SEQ ID NO: 824292 - protein, 9 aa, Homo Sapiens
IIHTSDKLY

SEQ ID NO: 824293 - protein, 9 aa, Homo Sapiens
KHWFVLANQ

SEQ ID NO: 824294 - protein, 9 aa, Homo Sapiens
VLNNKKVGV

SEQ ID NO: 824295 - protein, 9 aa, Homo Sapiens
QGFTSGNLE

SEQ ID NO: 824296 - protein, 9 aa, Homo Sapiens
GEFSNTVID

SEQ ID NO: 824297 - protein, 9 aa, Homo Sapiens
SDQQDSAPN

SEQ ID NO: 824298 - protein, 9 aa, Homo Sapiens
LLLFLGATL

SEQ ID NO: 824299 - protein, 9 aa, Homo Sapiens
MEPPMNKRL

SEQ ID NO: 824300 - protein, 9 aa, Homo Sapiens
YFRDKELSC

SEQ ID NO: 824301 - protein, 9 aa, Homo Sapiens
SAEVAKHYL

SEQ ID NO: 824302 - protein, 9 aa, Homo Sapiens
NMDFGVFIG

SEQ ID NO: 824303 - protein, 9 aa, Homo Sapiens
VGCCSLCVE

SEQ ID NO: 824304 - protein, 9 aa, Homo Sapiens
ADQDKNPEG

SEQ ID NO: 824305 - protein, 9 aa, Homo Sapiens
HYKFTVGVD

SEQ ID NO: 824306 - protein, 9 aa, Homo Sapiens
KRWETNRML

SEQ ID NO: 824307 - protein, 9 aa, Homo Sapiens
INKYEPSGI

SEQ ID NO: 824308 - protein, 9 aa, Homo Sapiens
FADEDLPVH

SEQ ID NO: 824309 - protein, 9 aa, Homo Sapiens
RCLGNKCVL

SEQ ID NO: 824310 - protein, 9 aa, Homo Sapiens
MAVNTELLG

SEQ ID NO: 824311 - protein, 9 aa, Homo Sapiens
HFSSDRTDG

SEQ ID NO: 824312 - protein, 9 aa, Homo Sapiens
PGLPDRTGA

SEQ ID NO: 824313 - protein, 9 aa, Homo Sapiens
RDRARLDYM

SEQ ID NO: 824314 - protein, 9 aa, Homo Sapiens
LLGPNQTGS

SEQ ID NO: 824315 - protein, 9 aa, Homo Sapiens
LLQRIKDIL

SEQ ID NO: 824316 - protein, 9 aa, Homo Sapiens
KDDIGNLNI

SEQ ID NO: 824317 - protein, 9 aa, Homo Sapiens
HPRLIQQME

SEQ ID NO: 824318 - protein, 9 aa, Homo Sapiens
SVDEAIKCI

SEQ ID NO: 824319 - protein, 9 aa, Homo Sapiens
LSFSTNLHK

SEQ ID NO: 824320 - protein, 9 aa, Homo Sapiens
SMVLTTATF

SEQ ID NO: 824321 - protein, 9 aa, Homo Sapiens
QIVITMSST

SEQ ID NO: 824322 - protein, 9 aa, Homo Sapiens
SHMWKKIPP

SEQ ID NO: 824323 - protein, 9 aa, Homo Sapiens
QSHVLSHAF

SEQ ID NO: 824324 - protein, 9 aa, Homo Sapiens
GRMVESAPK

SEQ ID NO: 824325 - protein, 9 aa, Homo Sapiens
LGSYSPIRR

SEQ ID NO: 824326 - protein, 9 aa, Homo Sapiens
PLSDSSKKL

SEQ ID NO: 824327 - protein, 9 aa, Homo Sapiens
VLRHFHYSR

SEQ ID NO: 824328 - protein, 9 aa, Homo Sapiens
EPPEKHIPG

SEQ ID NO: 824329 - protein, 9 aa, Homo Sapiens
EDPELQPIL

SEQ ID NO: 824330 - protein, 9 aa, Homo Sapiens
ANFSCNKFP

SEQ ID NO: 824331 - protein, 9 aa, Homo Sapiens
LGAMLGLLC

SEQ ID NO: 824332 - protein, 9 aa, Homo Sapiens
TTILIIFAV

SEQ ID NO: 824333 - protein, 9 aa, Homo Sapiens
AVTDINYHA

SEQ ID NO: 824334 - protein, 9 aa, Homo Sapiens
KQSQEASPQ

SEQ ID NO: 824335 - protein, 9 aa, Homo Sapiens
TTANNWELT

SEQ ID NO: 824336 - protein, 9 aa, Homo Sapiens
NSLHLEIRD

SEQ ID NO: 824337 - protein, 9 aa, Homo Sapiens
SRQDPLHPD

SEQ ID NO: 824338 - protein, 9 aa, Homo Sapiens
DAGGVRMDV

SEQ ID NO: 824339 - protein, 9 aa, Homo Sapiens
DRPSTPPSN

SEQ ID NO: 824340 - protein, 9 aa, Homo Sapiens
KDGHGNSPL

SEQ ID NO: 824341 - protein, 9 aa, Homo Sapiens
VCRFLFLGT

SEQ ID NO: 824342 - protein, 9 aa, Homo Sapiens
VCERKDLSD

SEQ ID NO: 824343 - protein, 9 aa, Homo Sapiens
SCGPIFQAN

SEQ ID NO: 824344 - protein, 9 aa, Homo Sapiens
LQKEKSKVA

SEQ ID NO: 824345 - protein, 9 aa, Homo Sapiens
WPKCLTKAH

SEQ ID NO: 824346 - protein, 9 aa, Homo Sapiens
LAAEINTAS

SEQ ID NO: 824347 - protein, 9 aa, Homo Sapiens
LLFSTSKIT

SEQ ID NO: 824348 - protein, 9 aa, Homo Sapiens
CYPVLTPNL

SEQ ID NO: 824349 - protein, 9 aa, Homo Sapiens
CNAMRAVME

SEQ ID NO: 824350 - protein, 9 aa, Homo Sapiens
SSLATLPIT

SEQ ID NO: 824351 - protein, 9 aa, Homo Sapiens
QDVKSTTIA

SEQ ID NO: 824352 - protein, 9 aa, Homo Sapiens
KGYQCLISP

SEQ ID NO: 824353 - protein, 9 aa, Homo Sapiens
KLNPQQFDV

SEQ ID NO: 824354 - protein, 9 aa, Homo Sapiens
LKSVECYNS

SEQ ID NO: 824355 - protein, 9 aa, Homo Sapiens
QLKQLILAH

SEQ ID NO: 824356 - protein, 9 aa, Homo Sapiens
PCGCLCGMA

SEQ ID NO: 824357 - protein, 9 aa, Homo Sapiens
EAFSNSGFS

SEQ ID NO: 824358 - protein, 9 aa, Homo Sapiens
TINMVTDEE

SEQ ID NO: 824359 - protein, 9 aa, Homo Sapiens
LFMSGQKKE

SEQ ID NO: 824360 - protein, 9 aa, Homo Sapiens
IPFFHSANG

SEQ ID NO: 824361 - protein, 9 aa, Homo Sapiens
FLRLHLEDR

SEQ ID NO: 824362 - protein, 9 aa, Homo Sapiens
LGPALKIYK

SEQ ID NO: 824363 - protein, 9 aa, Homo Sapiens
IPFSSSSTR

SEQ ID NO: 824364 - protein, 9 aa, Homo Sapiens
WAGRYRIIS

SEQ ID NO: 824365 - protein, 9 aa, Homo Sapiens
DEVSILSTF

SEQ ID NO: 824366 - protein, 9 aa, Homo Sapiens
CEMVLANNR

SEQ ID NO: 824367 - protein, 9 aa, Homo Sapiens
EEKNKILQG

SEQ ID NO: 824368 - protein, 9 aa, Homo Sapiens
LRECIQHEP

SEQ ID NO: 824369 - protein, 9 aa, Homo Sapiens
DKENIFQEH

SEQ ID NO: 824370 - protein, 9 aa, Homo Sapiens
LFLRGGVVL

SEQ ID NO: 824371 - protein, 9 aa, Homo Sapiens
GLMFASVYI

SEQ ID NO: 824372 - protein, 9 aa, Homo Sapiens
GRHTNPPPE

SEQ ID NO: 824373 - protein, 9 aa, Homo Sapiens
SSVAQIYHA

SEQ ID NO: 824374 - protein, 9 aa, Homo Sapiens
SKECVQKVE

SEQ ID NO: 824375 - protein, 9 aa, Homo Sapiens
AQCEAYLQE

SEQ ID NO: 824376 - protein, 9 aa, Homo Sapiens
LLLDLGGQP

SEQ ID NO: 824377 - protein, 9 aa, Homo Sapiens
VMARVIFEV

SEQ ID NO: 824378 - protein, 9 aa, Homo Sapiens
DAQSLAGEE

SEQ ID NO: 824379 - protein, 9 aa, Homo Sapiens
NVIQSVRNK

SEQ ID NO: 824380 - protein, 9 aa, Homo Sapiens
KARENTFIV

SEQ ID NO: 824381 - protein, 9 aa, Homo Sapiens
ISRIQYCIP

SEQ ID NO: 824382 - protein, 9 aa, Homo Sapiens
YSMDYFPPP

SEQ ID NO: 824383 - protein, 9 aa, Homo Sapiens
HAVWDSELA

SEQ ID NO: 824384 - protein, 9 aa, Homo Sapiens
DFIYHDQVP

SEQ ID NO: 824385 - protein, 9 aa, Homo Sapiens
QTIHKYAFM

SEQ ID NO: 824386 - protein, 9 aa, Homo Sapiens
MCPQAFNNQ

SEQ ID NO: 824387 - protein, 9 aa, Homo Sapiens
ARTKFKLPK

SEQ ID NO: 824388 - protein, 9 aa, Homo Sapiens
MRVFSQRTY

SEQ ID NO: 824389 - protein, 9 aa, Homo Sapiens
RIWVDYSIT

SEQ ID NO: 824390 - protein, 9 aa, Homo Sapiens
RGRLLNANS

SEQ ID NO: 824391 - protein, 9 aa, Homo Sapiens
LYEEPFPAE

SEQ ID NO: 824392 - protein, 9 aa, Homo Sapiens
INGSCQCFP

SEQ ID NO: 824393 - protein, 9 aa, Homo Sapiens
EEVWEVLTL

SEQ ID NO: 824394 - protein, 9 aa, Homo Sapiens
AQLLDMDGI

SEQ ID NO: 824395 - protein, 9 aa, Homo Sapiens
SDKSTEPKT

SEQ ID NO: 824396 - protein, 9 aa, Homo Sapiens
RPLVTFNLL

SEQ ID NO: 824397 - protein, 9 aa, Homo Sapiens
TVILMMLRY

SEQ ID NO: 824398 - protein, 9 aa, Homo Sapiens
TLAKPVNKK

SEQ ID NO: 824399 - protein, 9 aa, Homo Sapiens
GQHFVPIVA

SEQ ID NO: 824400 - protein, 9 aa, Homo Sapiens
GHQVLQISV

SEQ ID NO: 824401 - protein, 9 aa, Homo Sapiens
ALESLDTSL

SEQ ID NO: 824402 - protein, 9 aa, Homo Sapiens
HTVTTRFIF

SEQ ID NO: 824403 - protein, 9 aa, Homo Sapiens
VIFWGRILG

SEQ ID NO: 824404 - protein, 9 aa, Homo Sapiens
LVNLNGSKK

SEQ ID NO: 824405 - protein, 9 aa, Homo Sapiens
IPSCSHDSY

SEQ ID NO: 824406 - protein, 9 aa, Homo Sapiens
FDNTPEIAI

SEQ ID NO: 824407 - protein, 9 aa, Homo Sapiens
RPNIQQALV

SEQ ID NO: 824408 - protein, 9 aa, Homo Sapiens
PLQSGNATD

SEQ ID NO: 824409 - protein, 9 aa, Homo Sapiens
VSNKTLLCS

SEQ ID NO: 824410 - protein, 9 aa, Homo Sapiens
LINFWDKVL

SEQ ID NO: 824411 - protein, 9 aa, Homo Sapiens
ALISTVEGG

SEQ ID NO: 824412 - protein, 9 aa, Homo Sapiens
FLRLAQSRT

SEQ ID NO: 824413 - protein, 9 aa, Homo Sapiens
AQRGLCEPG

SEQ ID NO: 824414 - protein, 9 aa, Homo Sapiens
TLHHCLLPV

SEQ ID NO: 824415 - protein, 9 aa, Homo Sapiens
ACGEIKTTD

SEQ ID NO: 824416 - protein, 9 aa, Homo Sapiens
INFRKGYRR

SEQ ID NO: 824417 - protein, 9 aa, Homo Sapiens
HTGDPNKKL

SEQ ID NO: 824418 - protein, 9 aa, Homo Sapiens
DQLKQAEEL

SEQ ID NO: 824419 - protein, 9 aa, Homo Sapiens
QTFPARERI

SEQ ID NO: 824420 - protein, 9 aa, Homo Sapiens
LPPTSSCCA

SEQ ID NO: 824421 - protein, 9 aa, Homo Sapiens
GDANFTATA

SEQ ID NO: 824422 - protein, 9 aa, Homo Sapiens
HASYNISYF

SEQ ID NO: 824423 - protein, 9 aa, Homo Sapiens
GYNETDWSQ

SEQ ID NO: 824424 - protein, 9 aa, Homo Sapiens
VIVQFSCDM

SEQ ID NO: 824425 - protein, 9 aa, Homo Sapiens
TVRNKSTHL

SEQ ID NO: 824426 - protein, 9 aa, Homo Sapiens
YILEALMVP

SEQ ID NO: 824427 - protein, 9 aa, Homo Sapiens
GSHDNGSHF

SEQ ID NO: 824428 - protein, 9 aa, Homo Sapiens
SSVFRNGLS

SEQ ID NO: 824429 - protein, 9 aa, Homo Sapiens
TRAHEEERR

SEQ ID NO: 824430 - protein, 9 aa, Homo Sapiens
RTQIIRSCK

SEQ ID NO: 824431 - protein, 9 aa, Homo Sapiens
CQQRIQRQL

SEQ ID NO: 824432 - protein, 9 aa, Homo Sapiens
TEERGIISG

SEQ ID NO: 824433 - protein, 9 aa, Homo Sapiens
FFKVEDMAE

SEQ ID NO: 824434 - protein, 9 aa, Homo Sapiens
MHHLQQELE

SEQ ID NO: 824435 - protein, 9 aa, Homo Sapiens
DNKVDFNEF

SEQ ID NO: 824436 - protein, 9 aa, Homo Sapiens
NFNQIARLP

SEQ ID NO: 824437 - protein, 9 aa, Homo Sapiens
CNNRTMKYK

SEQ ID NO: 824438 - protein, 9 aa, Homo Sapiens
LPRVLSVYI

SEQ ID NO: 824439 - protein, 9 aa, Homo Sapiens
QNINLYDSF

SEQ ID NO: 824440 - protein, 9 aa, Homo Sapiens
SSLWNNLID

SEQ ID NO: 824441 - protein, 9 aa, Homo Sapiens
TILDELVQI

SEQ ID NO: 824442 - protein, 9 aa, Homo Sapiens
VVLLESLEF

SEQ ID NO: 824443 - protein, 9 aa, Homo Sapiens
KGKAKLGQE

SEQ ID NO: 824444 - protein, 9 aa, Homo Sapiens
KVTSCPGCQ

SEQ ID NO: 824445 - protein, 9 aa, Homo Sapiens
ILLCENYHS

SEQ ID NO: 824446 - protein, 9 aa, Homo Sapiens
TVLIALKSV

SEQ ID NO: 824447 - protein, 9 aa, Homo Sapiens
LEDKEEAII

SEQ ID NO: 824448 - protein, 9 aa, Homo Sapiens
IRTPNATLG

SEQ ID NO: 824449 - protein, 9 aa, Homo Sapiens
YSQASELST

SEQ ID NO: 824450 - protein, 9 aa, Homo Sapiens
SPVGNLCRQ

SEQ ID NO: 824451 - protein, 9 aa, Homo Sapiens
GTYNDGATK

SEQ ID NO: 824452 - protein, 9 aa, Homo Sapiens
PSLNVLQNK

SEQ ID NO: 824453 - protein, 9 aa, Homo Sapiens
DINKDAGLF

SEQ ID NO: 824454 - protein, 9 aa, Homo Sapiens
YDAILYYKI

SEQ ID NO: 824455 - protein, 9 aa, Homo Sapiens
LHGGYLVAN

SEQ ID NO: 824456 - protein, 9 aa, Homo Sapiens
ILIDKSTQA

SEQ ID NO: 824457 - protein, 9 aa, Homo Sapiens
ICFLEAIWN

SEQ ID NO: 824458 - protein, 9 aa, Homo Sapiens
VISIICMAI

SEQ ID NO: 824459 - protein, 9 aa, Homo Sapiens
CFLEAIWNN

SEQ ID NO: 824460 - protein, 9 aa, Homo Sapiens
YFSQSFPQP

SEQ ID NO: 824461 - protein, 9 aa, Homo Sapiens
PAIAPKPKF

SEQ ID NO: 824462 - protein, 9 aa, Homo Sapiens
DIDEPPVLT

SEQ ID NO: 824463 - protein, 9 aa, Homo Sapiens
IRQSSTQVR

SEQ ID NO: 824464 - protein, 9 aa, Homo Sapiens
DLTYLGHNE

SEQ ID NO: 824465 - protein, 9 aa, Homo Sapiens
VVKSVLVYH

SEQ ID NO: 824466 - protein, 9 aa, Homo Sapiens
LASLDGDKL

SEQ ID NO: 824467 - protein, 9 aa, Homo Sapiens
SIESSLGVL

SEQ ID NO: 824468 - protein, 9 aa, Homo Sapiens
KDKVLKYFY

SEQ ID NO: 824469 - protein, 9 aa, Homo Sapiens
SPYLVSIWR

SEQ ID NO: 824470 - protein, 9 aa, Homo Sapiens
LLFLVFNDN

SEQ ID NO: 824471 - protein, 9 aa, Homo Sapiens
EYQNSLLKM

SEQ ID NO: 824472 - protein, 9 aa, Homo Sapiens
EAKNLPSYS

SEQ ID NO: 824473 - protein, 9 aa, Homo Sapiens
YFHENNVST

SEQ ID NO: 824474 - protein, 9 aa, Homo Sapiens
GWEKTKGNG

SEQ ID NO: 824475 - protein, 9 aa, Homo Sapiens
RRMTITGDD

SEQ ID NO: 824476 - protein, 9 aa, Homo Sapiens
TASGLEKTT

SEQ ID NO: 824477 - protein, 9 aa, Homo Sapiens
QYGEYLEFK

SEQ ID NO: 824478 - protein, 9 aa, Homo Sapiens
MLNTFIYSL

SEQ ID NO: 824479 - protein, 9 aa, Homo Sapiens
RTHSSEGRC

SEQ ID NO: 824480 - protein, 9 aa, Homo Sapiens
NSVDTGGDG

SEQ ID NO: 824481 - protein, 9 aa, Homo Sapiens
INSMLESCE

SEQ ID NO: 824482 - protein, 9 aa, Homo Sapiens
RIQSFKLPE

SEQ ID NO: 824483 - protein, 9 aa, Homo Sapiens
HDFFRDPLD

SEQ ID NO: 824484 - protein, 9 aa, Homo Sapiens
VPVATLVKE

SEQ ID NO: 824485 - protein, 9 aa, Homo Sapiens
SRIRSTFQG

SEQ ID NO: 824486 - protein, 9 aa, Homo Sapiens
IFFESLEEI

SEQ ID NO: 824487 - protein, 9 aa, Homo Sapiens
TRRETGQAE

SEQ ID NO: 824488 - protein, 9 aa, Homo Sapiens
KPSALPSTL

SEQ ID NO: 824489 - protein, 9 aa, Homo Sapiens
NNFQEEQAA

SEQ ID NO: 824490 - protein, 9 aa, Homo Sapiens
CVTNPAYED

SEQ ID NO: 824491 - protein, 9 aa, Homo Sapiens
FPPLSYGSR

SEQ ID NO: 824492 - protein, 9 aa, Homo Sapiens
FLHENLLHQ

SEQ ID NO: 824493 - protein, 9 aa, Homo Sapiens
MKLDTNERT

SEQ ID NO: 824494 - protein, 9 aa, Homo Sapiens
GRPTFRVVD

SEQ ID NO: 824495 - protein, 9 aa, Homo Sapiens
LHPKLLHCG

SEQ ID NO: 824496 - protein, 9 aa, Homo Sapiens
LINRNISSL

SEQ ID NO: 824497 - protein, 9 aa, Homo Sapiens
DKLCQYDEF

SEQ ID NO: 824498 - protein, 9 aa, Homo Sapiens
GPSLRRVAT

SEQ ID NO: 824499 - protein, 9 aa, Homo Sapiens
ASVAVFLLA

SEQ ID NO: 824500 - protein, 9 aa, Homo Sapiens
GKGTQCNNM

SEQ ID NO: 824501 - protein, 9 aa, Homo Sapiens
TKALCAFQG

SEQ ID NO: 824502 - protein, 9 aa, Homo Sapiens
KNQLLAEIT

SEQ ID NO: 824503 - protein, 9 aa, Homo Sapiens
IGSTSGKNW

SEQ ID NO: 824504 - protein, 9 aa, Homo Sapiens
TNWDYMEKI

SEQ ID NO: 824505 - protein, 9 aa, Homo Sapiens
NIGFEWNYP

SEQ ID NO: 824506 - protein, 9 aa, Homo Sapiens
TSDVNKLTP

SEQ ID NO: 824507 - protein, 9 aa, Homo Sapiens
PGPHNFYSH

SEQ ID NO: 824508 - protein, 9 aa, Homo Sapiens
DNAKHMETK

SEQ ID NO: 824509 - protein, 9 aa, Homo Sapiens
IVKSHSPEE

SEQ ID NO: 824510 - protein, 9 aa, Homo Sapiens
LELARKIII

SEQ ID NO: 824511 - protein, 9 aa, Homo Sapiens
PSYSPTSPD

SEQ ID NO: 824512 - protein, 9 aa, Homo Sapiens
NYEKLWKWI

SEQ ID NO: 824513 - protein, 9 aa, Homo Sapiens
VEVKVQGQW

SEQ ID NO: 824514 - protein, 9 aa, Homo Sapiens
GYYFLRDTC

SEQ ID NO: 824515 - protein, 9 aa, Homo Sapiens
RDKDKRGKG

SEQ ID NO: 824516 - protein, 9 aa, Homo Sapiens
DGELPSVRP

SEQ ID NO: 824517 - protein, 9 aa, Homo Sapiens
YSTVTVTLL

SEQ ID NO: 824518 - protein, 9 aa, Homo Sapiens
LGLPTPPPP

SEQ ID NO: 824519 - protein, 9 aa, Homo Sapiens
MVKYGFFHE

SEQ ID NO: 824520 - protein, 9 aa, Homo Sapiens
FLQRLGMID

SEQ ID NO: 824521 - protein, 9 aa, Homo Sapiens
VWYSEPTSF

SEQ ID NO: 824522 - protein, 9 aa, Homo Sapiens
LSVTVLQPT

SEQ ID NO: 824523 - protein, 9 aa, Homo Sapiens
NASVIYWQM

SEQ ID NO: 824524 - protein, 9 aa, Homo Sapiens
CYHPEEFQL

SEQ ID NO: 824525 - protein, 9 aa, Homo Sapiens
DKEVFSYFA

SEQ ID NO: 824526 - protein, 9 aa, Homo Sapiens
PKLPKANMP

SEQ ID NO: 824527 - protein, 9 aa, Homo Sapiens
PALRKNTNI

SEQ ID NO: 824528 - protein, 9 aa, Homo Sapiens
CDNIIVSSK

SEQ ID NO: 824529 - protein, 9 aa, Homo Sapiens
FAFNQNLAE

SEQ ID NO: 824530 - protein, 9 aa, Homo Sapiens
NNTYQATIG

SEQ ID NO: 824531 - protein, 9 aa, Homo Sapiens
TALQSSHRA

SEQ ID NO: 824532 - protein, 9 aa, Homo Sapiens
FTWAGFKYY

SEQ ID NO: 824533 - protein, 9 aa, Homo Sapiens
EDNLPEKLT

SEQ ID NO: 824534 - protein, 9 aa, Homo Sapiens
ITRLDLGKC

SEQ ID NO: 824535 - protein, 9 aa, Homo Sapiens
SYLDTKRIT

SEQ ID NO: 824536 - protein, 9 aa, Homo Sapiens
AQITGPGIL

SEQ ID NO: 824537 - protein, 9 aa, Homo Sapiens
VLTATFPTS

SEQ ID NO: 824538 - protein, 9 aa, Homo Sapiens
LDNLGNGTS

SEQ ID NO: 824539 - protein, 9 aa, Homo Sapiens
KGFWDNYDT

SEQ ID NO: 824540 - protein, 9 aa, Homo Sapiens
ATVFWYNNR

SEQ ID NO: 824541 - protein, 9 aa, Homo Sapiens
PQRLFYGNV

SEQ ID NO: 824542 - protein, 9 aa, Homo Sapiens
QRVKAAMAG

SEQ ID NO: 824543 - protein, 9 aa, Homo Sapiens
RFLYMFMEY

SEQ ID NO: 824544 - protein, 9 aa, Homo Sapiens
LIIEAHKRG

SEQ ID NO: 824545 - protein, 9 aa, Homo Sapiens
VLSGVIKKS

SEQ ID NO: 824546 - protein, 9 aa, Homo Sapiens
NILHNILRD

SEQ ID NO: 824547 - protein, 9 aa, Homo Sapiens
NSKYQNWRT

SEQ ID NO: 824548 - protein, 9 aa, Homo Sapiens
VPNSKEQRV

SEQ ID NO: 824549 - protein, 9 aa, Homo Sapiens
LYQPICSTN

SEQ ID NO: 824550 - protein, 9 aa, Homo Sapiens
KTNLPVQLL

SEQ ID NO: 824551 - protein, 9 aa, Homo Sapiens
ISSTDAVLN

SEQ ID NO: 824552 - protein, 9 aa, Homo Sapiens
YEHVTVPPW

SEQ ID NO: 824553 - protein, 9 aa, Homo Sapiens
EQQKVISLF

SEQ ID NO: 824554 - protein, 9 aa, Homo Sapiens
IAPFMLFRL

SEQ ID NO: 824555 - protein, 9 aa, Homo Sapiens
NLSIIRIAA

SEQ ID NO: 824556 - protein, 9 aa, Homo Sapiens
ASTEMRLIR

SEQ ID NO: 824557 - protein, 9 aa, Homo Sapiens
VKKSKQKMN

SEQ ID NO: 824558 - protein, 9 aa, Homo Sapiens
TKGPEMEMD

SEQ ID NO: 824559 - protein, 9 aa, Homo Sapiens
LFHPEKLHF

SEQ ID NO: 824560 - protein, 9 aa, Homo Sapiens
GGLEAFDDL

SEQ ID NO: 824561 - protein, 9 aa, Homo Sapiens
LETLKAVDQ

SEQ ID NO: 824562 - protein, 9 aa, Homo Sapiens
TSYGTFQRV

SEQ ID NO: 824563 - protein, 9 aa, Homo Sapiens
LNHNKIRNI

SEQ ID NO: 824564 - protein, 9 aa, Homo Sapiens
TAGRHGDAL

SEQ ID NO: 824565 - protein, 9 aa, Homo Sapiens
FNPRSRQII

SEQ ID NO: 824566 - protein, 9 aa, Homo Sapiens
AKNREPLKQ

SEQ ID NO: 824567 - protein, 9 aa, Homo Sapiens
HPSSFQNHE

SEQ ID NO: 824568 - protein, 9 aa, Homo Sapiens
ERWKQATKQ

SEQ ID NO: 824569 - protein, 9 aa, Homo Sapiens
GFNEQQQQQ

SEQ ID NO: 824570 - protein, 9 aa, Homo Sapiens
ANYICSGTL

SEQ ID NO: 824571 - protein, 9 aa, Homo Sapiens
ICLVRQRTG

SEQ ID NO: 824572 - protein, 9 aa, Homo Sapiens
LKLLKCRLI

SEQ ID NO: 824573 - protein, 9 aa, Homo Sapiens
INLIQTIQG

SEQ ID NO: 824574 - protein, 9 aa, Homo Sapiens
LENVLSCTS

SEQ ID NO: 824575 - protein, 9 aa, Homo Sapiens
DLSIYLKGM

SEQ ID NO: 824576 - protein, 9 aa, Homo Sapiens
PVIYSLRNG

SEQ ID NO: 824577 - protein, 9 aa, Homo Sapiens
VQVVRLIAE

SEQ ID NO: 824578 - protein, 9 aa, Homo Sapiens
EINAELTAN

SEQ ID NO: 824579 - protein, 9 aa, Homo Sapiens
KLNMDEYNL

SEQ ID NO: 824580 - protein, 9 aa, Homo Sapiens
ESCWDEYNG

SEQ ID NO: 824581 - protein, 9 aa, Homo Sapiens
GTSGPNSLH

SEQ ID NO: 824582 - protein, 9 aa, Homo Sapiens
TFYHRYYHT

SEQ ID NO: 824583 - protein, 9 aa, Homo Sapiens
RTDGDREVQ

SEQ ID NO: 824584 - protein, 9 aa, Homo Sapiens
RDLLALIQG

SEQ ID NO: 824585 - protein, 9 aa, Homo Sapiens
THGLTPLLL

SEQ ID NO: 824586 - protein, 9 aa, Homo Sapiens
QATAADQDK

SEQ ID NO: 824587 - protein, 9 aa, Homo Sapiens
KTTPPNSME

SEQ ID NO: 824588 - protein, 9 aa, Homo Sapiens
GKQPNRTTS

SEQ ID NO: 824589 - protein, 9 aa, Homo Sapiens
CCALGRLGL

SEQ ID NO: 824590 - protein, 9 aa, Homo Sapiens
PATQNRESP

SEQ ID NO: 824591 - protein, 9 aa, Homo Sapiens
HVHMEVPGA

SEQ ID NO: 824592 - protein, 9 aa, Homo Sapiens
LNVDEFVKI

SEQ ID NO: 824593 - protein, 9 aa, Homo Sapiens
SGTPQRKLP

SEQ ID NO: 824594 - protein, 9 aa, Homo Sapiens
LRHELTHKT

SEQ ID NO: 824595 - protein, 9 aa, Homo Sapiens
VCKAPIKEK

SEQ ID NO: 824596 - protein, 9 aa, Homo Sapiens
FEHKGCQII

SEQ ID NO: 824597 - protein, 9 aa, Homo Sapiens
KTHGSLILP

SEQ ID NO: 824598 - protein, 9 aa, Homo Sapiens
GMKSKEART

SEQ ID NO: 824599 - protein, 9 aa, Homo Sapiens
GFGVVFKAK

SEQ ID NO: 824600 - protein, 9 aa, Homo Sapiens
HISALEDDL

SEQ ID NO: 824601 - protein, 9 aa, Homo Sapiens
STTKLGENL

SEQ ID NO: 824602 - protein, 9 aa, Homo Sapiens
PLPNDGYDL

SEQ ID NO: 824603 - protein, 9 aa, Homo Sapiens
TILPKQASI

SEQ ID NO: 824604 - protein, 9 aa, Homo Sapiens
PCLKNDIGG

SEQ ID NO: 824605 - protein, 9 aa, Homo Sapiens
MVYKVPGQD

SEQ ID NO: 824606 - protein, 9 aa, Homo Sapiens
KSPTISDNT

SEQ ID NO: 824607 - protein, 9 aa, Homo Sapiens
KRLHTGVKP

SEQ ID NO: 824608 - protein, 9 aa, Homo Sapiens
FIDAQCEAY

SEQ ID NO: 824609 - protein, 9 aa, Homo Sapiens
KVADWFYYS

SEQ ID NO: 824610 - protein, 9 aa, Homo Sapiens
MQLVLSCFS

SEQ ID NO: 824611 - protein, 9 aa, Homo Sapiens
SSIERAQQE

SEQ ID NO: 824612 - protein, 9 aa, Homo Sapiens
FHPGSASGT

SEQ ID NO: 824613 - protein, 9 aa, Homo Sapiens
SNLVSLGRA

SEQ ID NO: 824614 - protein, 9 aa, Homo Sapiens
NNLGFNCTT

SEQ ID NO: 824615 - protein, 9 aa, Homo Sapiens
TSMFEPSGP

SEQ ID NO: 824616 - protein, 9 aa, Homo Sapiens
PKIHYMASF

SEQ ID NO: 824617 - protein, 9 aa, Homo Sapiens
DNDFIYHDQ

SEQ ID NO: 824618 - protein, 9 aa, Homo Sapiens
QAALQQAND

SEQ ID NO: 824619 - protein, 9 aa, Homo Sapiens
TYMSHQNSR

SEQ ID NO: 824620 - protein, 9 aa, Homo Sapiens
DLSLKEAME

SEQ ID NO: 824621 - protein, 9 aa, Homo Sapiens
NALGGRESY

SEQ ID NO: 824622 - protein, 9 aa, Homo Sapiens
FPHKSLREW

SEQ ID NO: 824623 - protein, 9 aa, Homo Sapiens
HLQFPGCFS

SEQ ID NO: 824624 - protein, 9 aa, Homo Sapiens
LSPIFRDVL

SEQ ID NO: 824625 - protein, 9 aa, Homo Sapiens
KNVNVSFNP

SEQ ID NO: 824626 - protein, 9 aa, Homo Sapiens
LRFGFLQEL

SEQ ID NO: 824627 - protein, 8 aa, Homo Sapiens
NRFLLLMS

SEQ ID NO: 824628 - protein, 9 aa, Homo Sapiens
SESLFELNS

SEQ ID NO: 824629 - protein, 9 aa, Homo Sapiens
GQDVVPPPN

SEQ ID NO: 824630 - protein, 9 aa, Homo Sapiens
TRRQFSTSG

SEQ ID NO: 824631 - protein, 9 aa, Homo Sapiens
QIIVEKLEK

SEQ ID NO: 824632 - protein, 9 aa, Homo Sapiens
KCNVCKSCC

SEQ ID NO: 824633 - protein, 9 aa, Homo Sapiens
NRHWVHREC

SEQ ID NO: 824634 - protein, 9 aa, Homo Sapiens
FDTPSFNKL

SEQ ID NO: 824635 - protein, 9 aa, Homo Sapiens
YVIKEINKA

SEQ ID NO: 824636 - protein, 9 aa, Homo Sapiens
AGVGFHTLS

SEQ ID NO: 824637 - protein, 9 aa, Homo Sapiens
LGSCPSEAI

SEQ ID NO: 824638 - protein, 9 aa, Homo Sapiens
TDGSPNQAR

SEQ ID NO: 824639 - protein, 9 aa, Homo Sapiens
PLKDLPVNY

SEQ ID NO: 824640 - protein, 9 aa, Homo Sapiens
NIVNSKAIS

SEQ ID NO: 824641 - protein, 9 aa, Homo Sapiens
QDTINYSVV

SEQ ID NO: 824642 - protein, 9 aa, Homo Sapiens
AASSPGEDG

SEQ ID NO: 824643 - protein, 9 aa, Homo Sapiens
EKDLLKTVE

SEQ ID NO: 824644 - protein, 9 aa, Homo Sapiens
AYLSVQRDA

SEQ ID NO: 824645 - protein, 9 aa, Homo Sapiens
ETLNINFLL

SEQ ID NO: 824646 - protein, 9 aa, Homo Sapiens
TVRNYSEAK

SEQ ID NO: 824647 - protein, 9 aa, Homo Sapiens
SLKSGLDLH

SEQ ID NO: 824648 - protein, 9 aa, Homo Sapiens
VLSGFALQS

SEQ ID NO: 824649 - protein, 9 aa, Homo Sapiens
KSALQTIGV

SEQ ID NO: 824650 - protein, 9 aa, Homo Sapiens
KNGSQSVIT

SEQ ID NO: 824651 - protein, 9 aa, Homo Sapiens
SAGLSATQR

SEQ ID NO: 824652 - protein, 9 aa, Homo Sapiens
WAYIRHLNR

SEQ ID NO: 824653 - protein, 9 aa, Homo Sapiens
KACKVFIPD

SEQ ID NO: 824654 - protein, 9 aa, Homo Sapiens
MNGMLLNER

SEQ ID NO: 824655 - protein, 9 aa, Homo Sapiens
VDANQIINT

SEQ ID NO: 824656 - protein, 9 aa, Homo Sapiens
QSSKLGALF

SEQ ID NO: 824657 - protein, 9 aa, Homo Sapiens
HKRTCQLKC

SEQ ID NO: 824658 - protein, 9 aa, Homo Sapiens
TPTQELAVQ

SEQ ID NO: 824659 - protein, 9 aa, Homo Sapiens
NPAFNKDSG

SEQ ID NO: 824660 - protein, 9 aa, Homo Sapiens
KDHNKRLKQ

SEQ ID NO: 824661 - protein, 9 aa, Homo Sapiens
IVILIFIMA

SEQ ID NO: 824662 - protein, 9 aa, Homo Sapiens
EQDSVERHM

SEQ ID NO: 824663 - protein, 9 aa, Homo Sapiens
LDSTSSVSV

SEQ ID NO: 824664 - protein, 9 aa, Homo Sapiens
VKPRETRVR

SEQ ID NO: 824665 - protein, 9 aa, Homo Sapiens
DNFLTTLPE

SEQ ID NO: 824666 - protein, 9 aa, Homo Sapiens
ERKQKENSG

SEQ ID NO: 824667 - protein, 9 aa, Homo Sapiens
FHSPTEAGL

SEQ ID NO: 824668 - protein, 9 aa, Homo Sapiens
LNKPLKLDE

SEQ ID NO: 824669 - protein, 9 aa, Homo Sapiens
VSRLAHRTC

SEQ ID NO: 824670 - protein, 9 aa, Homo Sapiens
KVGFFCPIC

SEQ ID NO: 824671 - protein, 9 aa, Homo Sapiens
CGPIFQANM

SEQ ID NO: 824672 - protein, 9 aa, Homo Sapiens
QSLFQDVTD

SEQ ID NO: 824673 - protein, 9 aa, Homo Sapiens
LAGHSISKP

SEQ ID NO: 824674 - protein, 9 aa, Homo Sapiens
GLPPFSSLR

SEQ ID NO: 824675 - protein, 9 aa, Homo Sapiens
IRIMRVLHI

SEQ ID NO: 824676 - protein, 9 aa, Homo Sapiens
LMAQQHYYG

SEQ ID NO: 824677 - protein, 9 aa, Homo Sapiens
ITLKNIIQI

SEQ ID NO: 824678 - protein, 9 aa, Homo Sapiens
AFQRASYAA

SEQ ID NO: 824679 - protein, 9 aa, Homo Sapiens
MGRHDFGFP

SEQ ID NO: 824680 - protein, 9 aa, Homo Sapiens
LEGNDDRIQ

SEQ ID NO: 824681 - protein, 9 aa, Homo Sapiens
KIYLLSSAY

SEQ ID NO: 824682 - protein, 9 aa, Homo Sapiens
LARCWDTAE

SEQ ID NO: 824683 - protein, 9 aa, Homo Sapiens
PSTPAFLWP

SEQ ID NO: 824684 - protein, 9 aa, Homo Sapiens
SYLLVACTT

SEQ ID NO: 824685 - protein, 9 aa, Homo Sapiens
KSKATNDDI

SEQ ID NO: 824686 - protein, 9 aa, Homo Sapiens
TLLTYPMFQ

SEQ ID NO: 824687 - protein, 9 aa, Homo Sapiens
KYSNPMVIC

SEQ ID NO: 824688 - protein, 9 aa, Homo Sapiens
TADEVHYLL

SEQ ID NO: 824689 - protein, 9 aa, Homo Sapiens
LMFGDPCFK

SEQ ID NO: 824690 - protein, 9 aa, Homo Sapiens
NQMFQKEQS

SEQ ID NO: 824691 - protein, 9 aa, Homo Sapiens
YPFPQGPST

SEQ ID NO: 824692 - protein, 9 aa, Homo Sapiens
LTVSQVLLS

SEQ ID NO: 824693 - protein, 9 aa, Homo Sapiens
AKCEDLFMS

SEQ ID NO: 824694 - protein, 9 aa, Homo Sapiens
GASEMLLLT

SEQ ID NO: 824695 - protein, 9 aa, Homo Sapiens
LGKRIGFYQ

SEQ ID NO: 824696 - protein, 9 aa, Homo Sapiens
KYCDAKSWT

SEQ ID NO: 824697 - protein, 9 aa, Homo Sapiens
VMTTEVTSK

SEQ ID NO: 824698 - protein, 9 aa, Homo Sapiens
EPLYMSLFS

SEQ ID NO: 824699 - protein, 9 aa, Homo Sapiens
DEYFQDLFI

SEQ ID NO: 824700 - protein, 9 aa, Homo Sapiens
FNAIRVLLE

SEQ ID NO: 824701 - protein, 9 aa, Homo Sapiens
CFYNDLESL

SEQ ID NO: 824702 - protein, 9 aa, Homo Sapiens
TECLFFGAI

SEQ ID NO: 824703 - protein, 9 aa, Homo Sapiens
DLLGLPTPP

SEQ ID NO: 824704 - protein, 9 aa, Homo Sapiens
ALEKSSVLH

SEQ ID NO: 824705 - protein, 9 aa, Homo Sapiens
SGVQHVRRM

SEQ ID NO: 824706 - protein, 9 aa, Homo Sapiens
ENEKYEQFL

SEQ ID NO: 824707 - protein, 9 aa, Homo Sapiens
SAQEALVHY

SEQ ID NO: 824708 - protein, 9 aa, Homo Sapiens
SLNMWLCPI

SEQ ID NO: 824709 - protein, 9 aa, Homo Sapiens
IKRSRTIIF

SEQ ID NO: 824710 - protein, 9 aa, Homo Sapiens
EKALREQAR

SEQ ID NO: 824711 - protein, 9 aa, Homo Sapiens
KDDVEEALS

SEQ ID NO: 824712 - protein, 9 aa, Homo Sapiens
AGPEAERLE

SEQ ID NO: 824713 - protein, 9 aa, Homo Sapiens
PNTGFLIIV

SEQ ID NO: 824714 - protein, 9 aa, Homo Sapiens
NETEETTTQ

SEQ ID NO: 824715 - protein, 9 aa, Homo Sapiens
IEQDRGEWD

SEQ ID NO: 824716 - protein, 9 aa, Homo Sapiens
ELNLEDEDI

SEQ ID NO: 824717 - protein, 9 aa, Homo Sapiens
LEAANETYK

SEQ ID NO: 824718 - protein, 9 aa, Homo Sapiens
VLCAAVFLQ

SEQ ID NO: 824719 - protein, 9 aa, Homo Sapiens
NTVNKDAFL

SEQ ID NO: 824720 - protein, 9 aa, Homo Sapiens
SLHSNLYRR

SEQ ID NO: 824721 - protein, 9 aa, Homo Sapiens
EAIDESKKE

SEQ ID NO: 824722 - protein, 9 aa, Homo Sapiens
RVYKKVLLG

SEQ ID NO: 824723 - protein, 9 aa, Homo Sapiens
SITNTVQQA

SEQ ID NO: 824724 - protein, 9 aa, Homo Sapiens
DLGEKHKAL

SEQ ID NO: 824725 - protein, 9 aa, Homo Sapiens
YVMRLTRHS

SEQ ID NO: 824726 - protein, 9 aa, Homo Sapiens
TRPASRHTP

SEQ ID NO: 824727 - protein, 9 aa, Homo Sapiens
QPFLGAHKL

SEQ ID NO: 824728 - protein, 9 aa, Homo Sapiens
LGALCFVCR

SEQ ID NO: 824729 - protein, 9 aa, Homo Sapiens
KQCKNLTTG

SEQ ID NO: 824730 - protein, 9 aa, Homo Sapiens
FLPVNQPKE

SEQ ID NO: 824731 - protein, 9 aa, Homo Sapiens
NKGKNNGKH

SEQ ID NO: 824732 - protein, 9 aa, Homo Sapiens
ETPGCSVSI

SEQ ID NO: 824733 - protein, 9 aa, Homo Sapiens
TTTGTLSIE

SEQ ID NO: 824734 - protein, 9 aa, Homo Sapiens
LREQARLRL

SEQ ID NO: 824735 - protein, 9 aa, Homo Sapiens
CQICQHPFC

SEQ ID NO: 824736 - protein, 9 aa, Homo Sapiens
CPFGVVDEI

SEQ ID NO: 824737 - protein, 9 aa, Homo Sapiens
KKGAVTKMA

SEQ ID NO: 824738 - protein, 9 aa, Homo Sapiens
VHSRKKYCF

SEQ ID NO: 824739 - protein, 9 aa, Homo Sapiens
NINRTLETA

SEQ ID NO: 824740 - protein, 9 aa, Homo Sapiens
FDRNSPSFD

SEQ ID NO: 824741 - protein, 9 aa, Homo Sapiens
SWPQSRSVM

SEQ ID NO: 824742 - protein, 9 aa, Homo Sapiens
QSGKHFINT

SEQ ID NO: 824743 - protein, 9 aa, Homo Sapiens
KQEEGKGPE

SEQ ID NO: 824744 - protein, 9 aa, Homo Sapiens
LTLNAKSIC

SEQ ID NO: 824745 - protein, 9 aa, Homo Sapiens
PACKNLDTL

SEQ ID NO: 824746 - protein, 9 aa, Homo Sapiens
CDTPQKTLV

SEQ ID NO: 824747 - protein, 9 aa, Homo Sapiens
SDVVRIFNL

SEQ ID NO: 824748 - protein, 9 aa, Homo Sapiens
FNLFEPLAE

SEQ ID NO: 824749 - protein, 9 aa, Homo Sapiens
VDELVACID

SEQ ID NO: 824750 - protein, 9 aa, Homo Sapiens
LHIDQFKRL

SEQ ID NO: 824751 - protein, 9 aa, Homo Sapiens
PLATDYNDN

SEQ ID NO: 824752 - protein, 9 aa, Homo Sapiens
ERQMQEKTD

SEQ ID NO: 824753 - protein, 9 aa, Homo Sapiens
FRQPTYTDY

SEQ ID NO: 824754 - protein, 9 aa, Homo Sapiens
CWNHSDPEN

SEQ ID NO: 824755 - protein, 9 aa, Homo Sapiens
CNCNGHSET

SEQ ID NO: 824756 - protein, 9 aa, Homo Sapiens
LKEKFTPEK

SEQ ID NO: 824757 - protein, 9 aa, Homo Sapiens
SLAAGPQGP

SEQ ID NO: 824758 - protein, 9 aa, Homo Sapiens
VFFVKGTNT

SEQ ID NO: 824759 - protein, 9 aa, Homo Sapiens
WPGRFLKQV

SEQ ID NO: 824760 - protein, 9 aa, Homo Sapiens
VNKCDLSDI

SEQ ID NO: 824761 - protein, 9 aa, Homo Sapiens
YVERKQKEN

SEQ ID NO: 824762 - protein, 9 aa, Homo Sapiens
IGSGLSCAF

SEQ ID NO: 824763 - protein, 9 aa, Homo Sapiens
VRKTLFLCS

SEQ ID NO: 824764 - protein, 9 aa, Homo Sapiens
PGVAQSLNS

SEQ ID NO: 824765 - protein, 9 aa, Homo Sapiens
ITKSLVYGI

SEQ ID NO: 824766 - protein, 9 aa, Homo Sapiens
AVMPCWVPQ

SEQ ID NO: 824767 - protein, 9 aa, Homo Sapiens
KNLAEAVRD

SEQ ID NO: 824768 - protein, 9 aa, Homo Sapiens
GDPHNLSDV

SEQ ID NO: 824769 - protein, 9 aa, Homo Sapiens
AMTAVVTNH

SEQ ID NO: 824770 - protein, 9 aa, Homo Sapiens
EPEVPEMFT

SEQ ID NO: 824771 - protein, 9 aa, Homo Sapiens
LMPKAEKNG

SEQ ID NO: 824772 - protein, 9 aa, Homo Sapiens
FTEEQLHPK

SEQ ID NO: 824773 - protein, 9 aa, Homo Sapiens
MKYIHLPDG

SEQ ID NO: 824774 - protein, 9 aa, Homo Sapiens
VITNKDVQK

SEQ ID NO: 824775 - protein, 9 aa, Homo Sapiens
GLSDITLLH

SEQ ID NO: 824776 - protein, 9 aa, Homo Sapiens
YRYCKPLSS

SEQ ID NO: 824777 - protein, 9 aa, Homo Sapiens
SNAYMLLQP

SEQ ID NO: 824778 - protein, 9 aa, Homo Sapiens
FIQVEAAYC

SEQ ID NO: 824779 - protein, 9 aa, Homo Sapiens
YSNPLVAAT

SEQ ID NO: 824780 - protein, 9 aa, Homo Sapiens
IFTHFHSTM

SEQ ID NO: 824781 - protein, 9 aa, Homo Sapiens
QSEVSAVQL

SEQ ID NO: 824782 - protein, 9 aa, Homo Sapiens
LKMNYRVVG

SEQ ID NO: 824783 - protein, 9 aa, Homo Sapiens
PLVILGGNK

SEQ ID NO: 824784 - protein, 9 aa, Homo Sapiens
PVSPPPSSS

SEQ ID NO: 824785 - protein, 9 aa, Homo Sapiens
LDRLIGIYK

SEQ ID NO: 824786 - protein, 9 aa, Homo Sapiens
DAKERAELA

SEQ ID NO: 824787 - protein, 9 aa, Homo Sapiens
SDGATSTFN

SEQ ID NO: 824788 - protein, 9 aa, Homo Sapiens
KFGHNECIG

SEQ ID NO: 824789 - protein, 9 aa, Homo Sapiens
GDGAIDFRE

SEQ ID NO: 824790 - protein, 9 aa, Homo Sapiens
DIMKILNKK

SEQ ID NO: 824791 - protein, 9 aa, Homo Sapiens
GKPTFGIEP

SEQ ID NO: 824792 - protein, 9 aa, Homo Sapiens
SKESSWISD

SEQ ID NO: 824793 - protein, 9 aa, Homo Sapiens
ISLPCQPFY

SEQ ID NO: 824794 - protein, 9 aa, Homo Sapiens
SASRDTTIK

SEQ ID NO: 824795 - protein, 9 aa, Homo Sapiens
AATFLDIID

SEQ ID NO: 824796 - protein, 9 aa, Homo Sapiens
FAMGAAECM

SEQ ID NO: 824797 - protein, 9 aa, Homo Sapiens
DVDECQPSQ

SEQ ID NO: 824798 - protein, 9 aa, Homo Sapiens
YIKGIMYKW

SEQ ID NO: 824799 - protein, 9 aa, Homo Sapiens
QNDFGHPTL

SEQ ID NO: 824800 - protein, 9 aa, Homo Sapiens
LPLRICSLH

SEQ ID NO: 824801 - protein, 9 aa, Homo Sapiens
AISGNCFIM

SEQ ID NO: 824802 - protein, 9 aa, Homo Sapiens
SQDNARLDT

SEQ ID NO: 824803 - protein, 9 aa, Homo Sapiens
GSDYSGRSS

SEQ ID NO: 824804 - protein, 9 aa, Homo Sapiens
MSLYDLDIE

SEQ ID NO: 824805 - protein, 9 aa, Homo Sapiens
FPNNSIKTE

SEQ ID NO: 824806 - protein, 9 aa, Homo Sapiens
HFVGEIFED

SEQ ID NO: 824807 - protein, 9 aa, Homo Sapiens
YQPCLIAPG

SEQ ID NO: 824808 - protein, 9 aa, Homo Sapiens
HEALRREVI

SEQ ID NO: 824809 - protein, 9 aa, Homo Sapiens
RVLAPEQSF

SEQ ID NO: 824810 - protein, 9 aa, Homo Sapiens
YQEKPRLLE

SEQ ID NO: 824811 - protein, 9 aa, Homo Sapiens
VWLQLFKTQ

SEQ ID NO: 824812 - protein, 9 aa, Homo Sapiens
EEDVFRHRN

SEQ ID NO: 824813 - protein, 9 aa, Homo Sapiens
VTATKSPII

SEQ ID NO: 824814 - protein, 9 aa, Homo Sapiens
DIFRDQVLH

SEQ ID NO: 824815 - protein, 9 aa, Homo Sapiens
VATEILYTK

SEQ ID NO: 824816 - protein, 9 aa, Homo Sapiens
TINTAIVHM

SEQ ID NO: 824817 - protein, 9 aa, Homo Sapiens
LPALNYKFP

SEQ ID NO: 824818 - protein, 9 aa, Homo Sapiens
KKVVLIEVV

SEQ ID NO: 824819 - protein, 9 aa, Homo Sapiens
YPEATQIIT

SEQ ID NO: 824820 - protein, 9 aa, Homo Sapiens
TLVKEVISA

SEQ ID NO: 824821 - protein, 9 aa, Homo Sapiens
VYKDLLENA

SEQ ID NO: 824822 - protein, 9 aa, Homo Sapiens
AAAAWCHQP

SEQ ID NO: 824823 - protein, 9 aa, Homo Sapiens
SKNNFQNIT

SEQ ID NO: 824824 - protein, 9 aa, Homo Sapiens
FGTKYLGNE

SEQ ID NO: 824825 - protein, 9 aa, Homo Sapiens
QEFLQAHTP

SEQ ID NO: 824826 - protein, 9 aa, Homo Sapiens
FFLISSNRS

SEQ ID NO: 824827 - protein, 9 aa, Homo Sapiens
WGNNSHGQL

SEQ ID NO: 824828 - protein, 9 aa, Homo Sapiens
SRQIIPRDL

SEQ ID NO: 824829 - protein, 9 aa, Homo Sapiens
HDAELVDKS

SEQ ID NO: 824830 - protein, 9 aa, Homo Sapiens
IKNYMMEEP

SEQ ID NO: 824831 - protein, 9 aa, Homo Sapiens
SVRWISQGN

SEQ ID NO: 824832 - protein, 9 aa, Homo Sapiens
LQVPLKELD

SEQ ID NO: 824833 - protein, 9 aa, Homo Sapiens
QEDEMDIYG

SEQ ID NO: 824834 - protein, 9 aa, Homo Sapiens
SWGQNEKGQ

SEQ ID NO: 824835 - protein, 9 aa, Homo Sapiens
LCYKQIIKS

SEQ ID NO: 824836 - protein, 9 aa, Homo Sapiens
NHVIYGVRT

SEQ ID NO: 824837 - protein, 9 aa, Homo Sapiens
GGHLTIHLA

SEQ ID NO: 824838 - protein, 9 aa, Homo Sapiens
RICSLHSNL

SEQ ID NO: 824839 - protein, 9 aa, Homo Sapiens
ISYDVKYAI

SEQ ID NO: 824840 - protein, 9 aa, Homo Sapiens
YGLPAVPFE

SEQ ID NO: 824841 - protein, 9 aa, Homo Sapiens
FYNRKDGTP

SEQ ID NO: 824842 - protein, 9 aa, Homo Sapiens
SCTIRTRRN

SEQ ID NO: 824843 - protein, 9 aa, Homo Sapiens
KMAKDRINH

SEQ ID NO: 824844 - protein, 9 aa, Homo Sapiens
AQKNSITRN

SEQ ID NO: 824845 - protein, 9 aa, Homo Sapiens
LFSVCRDRI

SEQ ID NO: 824846 - protein, 9 aa, Homo Sapiens
ENTSSRARS

SEQ ID NO: 824847 - protein, 9 aa, Homo Sapiens
FFKGLSCAH

SEQ ID NO: 824848 - protein, 9 aa, Homo Sapiens
AVSKKASPK

SEQ ID NO: 824849 - protein, 9 aa, Homo Sapiens
VPGIGSGLS

SEQ ID NO: 824850 - protein, 9 aa, Homo Sapiens
KPDTLQTGG

SEQ ID NO: 824851 - protein, 9 aa, Homo Sapiens
TKLSLPGPS

SEQ ID NO: 824852 - protein, 9 aa, Homo Sapiens
FECSRKKRK

SEQ ID NO: 824853 - protein, 9 aa, Homo Sapiens
MSKSSPRLI

SEQ ID NO: 824854 - protein, 9 aa, Homo Sapiens
LFEGITLDL

SEQ ID NO: 824855 - protein, 9 aa, Homo Sapiens
VIVYDLIDL

SEQ ID NO: 824856 - protein, 9 aa, Homo Sapiens
CGNGGDEWE

SEQ ID NO: 824857 - protein, 9 aa, Homo Sapiens
DNKGRPFVI

SEQ ID NO: 824858 - protein, 9 aa, Homo Sapiens
YFSLLLMQL

SEQ ID NO: 824859 - protein, 9 aa, Homo Sapiens
KRSSSRTPL

SEQ ID NO: 824860 - protein, 9 aa, Homo Sapiens
NVQSNLIES

SEQ ID NO: 824861 - protein, 9 aa, Homo Sapiens
ASYSVSLPE

SEQ ID NO: 824862 - protein, 9 aa, Homo Sapiens
QAAEAQRGL

SEQ ID NO: 824863 - protein, 9 aa, Homo Sapiens
IFHLRLENN

SEQ ID NO: 824864 - protein, 9 aa, Homo Sapiens
ENFWTIWCG

SEQ ID NO: 824865 - protein, 9 aa, Homo Sapiens
NPGIVGLLT

SEQ ID NO: 824866 - protein, 9 aa, Homo Sapiens
VCFSACSDS

SEQ ID NO: 824867 - protein, 9 aa, Homo Sapiens
ILFTVAFAG

SEQ ID NO: 824868 - protein, 9 aa, Homo Sapiens
SLDRNKLEQ

SEQ ID NO: 824869 - protein, 9 aa, Homo Sapiens
PGGHLVTTL

SEQ ID NO: 824870 - protein, 9 aa, Homo Sapiens
CLCLAALSC

SEQ ID NO: 824871 - protein, 9 aa, Homo Sapiens
FEQENKLQN

SEQ ID NO: 824872 - protein, 9 aa, Homo Sapiens
TLDKMEKHR

SEQ ID NO: 824873 - protein, 9 aa, Homo Sapiens
LFELRLYLC

SEQ ID NO: 824874 - protein, 9 aa, Homo Sapiens
KNRGVLHQF

SEQ ID NO: 824875 - protein, 9 aa, Homo Sapiens
SLQKSLEAD

SEQ ID NO: 824876 - protein, 9 aa, Homo Sapiens
LLFIIMFIF

SEQ ID NO: 824877 - protein, 9 aa, Homo Sapiens
SFIGSTSNH

SEQ ID NO: 824878 - protein, 9 aa, Homo Sapiens
TEEERKHTL

SEQ ID NO: 824879 - protein, 9 aa, Homo Sapiens
EMDVPIYLS

SEQ ID NO: 824880 - protein, 9 aa, Homo Sapiens
QLGEYQELL

SEQ ID NO: 824881 - protein, 9 aa, Homo Sapiens
RSPIQRQSD

SEQ ID NO: 824882 - protein, 9 aa, Homo Sapiens
YLDIFGNTF

SEQ ID NO: 824883 - protein, 9 aa, Homo Sapiens
KYNLRVEDY

SEQ ID NO: 824884 - protein, 9 aa, Homo Sapiens
IDITTKLCD

SEQ ID NO: 824885 - protein, 9 aa, Homo Sapiens
RRRRTEQTA

SEQ ID NO: 824886 - protein, 9 aa, Homo Sapiens
NFPTSIPVS

SEQ ID NO: 824887 - protein, 9 aa, Homo Sapiens
FGKSGELLK

SEQ ID NO: 824888 - protein, 9 aa, Homo Sapiens
WVTTVGKHY

SEQ ID NO: 824889 - protein, 9 aa, Homo Sapiens
VDEQLEHCM

SEQ ID NO: 824890 - protein, 9 aa, Homo Sapiens
RSKCKINLE

SEQ ID NO: 824891 - protein, 9 aa, Homo Sapiens
TKVVSPGPD

SEQ ID NO: 824892 - protein, 9 aa, Homo Sapiens
YGLFNENFR

SEQ ID NO: 824893 - protein, 9 aa, Homo Sapiens
TSPSQNNLA

SEQ ID NO: 824894 - protein, 9 aa, Homo Sapiens
NFCHGLVIF

SEQ ID NO: 824895 - protein, 9 aa, Homo Sapiens
SIIHPVLGH

SEQ ID NO: 824896 - protein, 9 aa, Homo Sapiens
KQAVTVSYL

SEQ ID NO: 824897 - protein, 9 aa, Homo Sapiens
PRLSPAYPA

SEQ ID NO: 824898 - protein, 9 aa, Homo Sapiens
TTKLPLKFR

SEQ ID NO: 824899 - protein, 9 aa, Homo Sapiens
GKVVVFQTP

SEQ ID NO: 824900 - protein, 9 aa, Homo Sapiens
PHTPTPGLY

SEQ ID NO: 824901 - protein, 9 aa, Homo Sapiens
DFGQLSDVV

SEQ ID NO: 824902 - protein, 9 aa, Homo Sapiens
RYLKPENLI

SEQ ID NO: 824903 - protein, 9 aa, Homo Sapiens
LYHSPSMPE

SEQ ID NO: 824904 - protein, 9 aa, Homo Sapiens
TIDKLKEKK

SEQ ID NO: 824905 - protein, 9 aa, Homo Sapiens
FIRKPEIHG

SEQ ID NO: 824906 - protein, 9 aa, Homo Sapiens
QFMLADRDN

SEQ ID NO: 824907 - protein, 9 aa, Homo Sapiens
LYGEVEKLK

SEQ ID NO: 824908 - protein, 9 aa, Homo Sapiens
DRSVLDNHH

SEQ ID NO: 824909 - protein, 9 aa, Homo Sapiens
PVGNLCRQS

SEQ ID NO: 824910 - protein, 9 aa, Homo Sapiens
IIKLENMQK

SEQ ID NO: 824911 - protein, 9 aa, Homo Sapiens
MQRQGLTCS

SEQ ID NO: 824912 - protein, 9 aa, Homo Sapiens
YPCHFYIRK

SEQ ID NO: 824913 - protein, 9 aa, Homo Sapiens
GTAFLSITT

SEQ ID NO: 824914 - protein, 9 aa, Homo Sapiens
SEGPGSPLL

SEQ ID NO: 824915 - protein, 9 aa, Homo Sapiens
VNILHKALE

SEQ ID NO: 824916 - protein, 9 aa, Homo Sapiens
LKIPVSGVG

SEQ ID NO: 824917 - protein, 9 aa, Homo Sapiens
TIPNMIADT

SEQ ID NO: 824918 - protein, 9 aa, Homo Sapiens
DRGNGIKLI

SEQ ID NO: 824919 - protein, 9 aa, Homo Sapiens
ARIHKEEEE

SEQ ID NO: 824920 - protein, 9 aa, Homo Sapiens
DNEENPTNN

SEQ ID NO: 824921 - protein, 9 aa, Homo Sapiens
PTPPPGRVS

SEQ ID NO: 824922 - protein, 9 aa, Homo Sapiens
FSAATVLIY

SEQ ID NO: 824923 - protein, 9 aa, Homo Sapiens
AERVLQYLV

SEQ ID NO: 824924 - protein, 9 aa, Homo Sapiens
GDSARDVLR

SEQ ID NO: 824925 - protein, 9 aa, Homo Sapiens
LKLASQNTD

SEQ ID NO: 824926 - protein, 9 aa, Homo Sapiens
QITTQKWEA

SEQ ID NO: 824927 - protein, 9 aa, Homo Sapiens
IYGMAVLSV

SEQ ID NO: 824928 - protein, 9 aa, Homo Sapiens
HVIENNNTK

SEQ ID NO: 824929 - protein, 9 aa, Homo Sapiens
AVCVSSPGT

SEQ ID NO: 824930 - protein, 9 aa, Homo Sapiens
PIIVLLMHR

SEQ ID NO: 824931 - protein, 9 aa, Homo Sapiens
FVACEELPP

SEQ ID NO: 824932 - protein, 9 aa, Homo Sapiens
WCSAIPENS

SEQ ID NO: 824933 - protein, 9 aa, Homo Sapiens
YLVADTRED

SEQ ID NO: 824934 - protein, 9 aa, Homo Sapiens
IICFCGLFC

SEQ ID NO: 824935 - protein, 9 aa, Homo Sapiens
PTWEEVKQQ

SEQ ID NO: 824936 - protein, 9 aa, Homo Sapiens
KVQKQQKQL

SEQ ID NO: 824937 - protein, 9 aa, Homo Sapiens
KMPSNQNVY

SEQ ID NO: 824938 - protein, 9 aa, Homo Sapiens
NLIISAQQE

SEQ ID NO: 824939 - protein, 9 aa, Homo Sapiens
AVPYTEESY

SEQ ID NO: 824940 - protein, 9 aa, Homo Sapiens
QAQVELNAA

SEQ ID NO: 824941 - protein, 9 aa, Homo Sapiens
KVLIIVFLF

SEQ ID NO: 824942 - protein, 9 aa, Homo Sapiens
QIKEEIKKI

SEQ ID NO: 824943 - protein, 9 aa, Homo Sapiens
APISKFTCS

SEQ ID NO: 824944 - protein, 9 aa, Homo Sapiens
QIFRDSATA

SEQ ID NO: 824945 - protein, 9 aa, Homo Sapiens
LNDLKVVSV

SEQ ID NO: 824946 - protein, 9 aa, Homo Sapiens
VCRVPGSQV

SEQ ID NO: 824947 - protein, 9 aa, Homo Sapiens
GHSGVEGPH

SEQ ID NO: 824948 - protein, 9 aa, Homo Sapiens
DLWYNLIEL

SEQ ID NO: 824949 - protein, 9 aa, Homo Sapiens
IITAYNVWA

SEQ ID NO: 824950 - protein, 9 aa, Homo Sapiens
SKQGKTQQS

SEQ ID NO: 824951 - protein, 9 aa, Homo Sapiens
GPALKIYKY

SEQ ID NO: 824952 - protein, 9 aa, Homo Sapiens
QRQQCQAPV

SEQ ID NO: 824953 - protein, 9 aa, Homo Sapiens
RKNGRMVNL

SEQ ID NO: 824954 - protein, 9 aa, Homo Sapiens
PYKLELGSD

SEQ ID NO: 824955 - protein, 9 aa, Homo Sapiens
QGVSDSLLL

SEQ ID NO: 824956 - protein, 9 aa, Homo Sapiens
LSTEKTAIS

SEQ ID NO: 824957 - protein, 9 aa, Homo Sapiens
RKTFRLSAT

SEQ ID NO: 824958 - protein, 9 aa, Homo Sapiens
ISQGPHCFI

SEQ ID NO: 824959 - protein, 9 aa, Homo Sapiens
DDPRLKCKN

SEQ ID NO: 824960 - protein, 9 aa, Homo Sapiens
ECLFFGAII

SEQ ID NO: 824961 - protein, 9 aa, Homo Sapiens
DYNYLYHLL

SEQ ID NO: 824962 - protein, 9 aa, Homo Sapiens
LHTWSKMFD

SEQ ID NO: 824963 - protein, 9 aa, Homo Sapiens
VLNFLCCGC

SEQ ID NO: 824964 - protein, 9 aa, Homo Sapiens
VLIQKHSTS

SEQ ID NO: 824965 - protein, 9 aa, Homo Sapiens
PGSLIGVGT

SEQ ID NO: 824966 - protein, 9 aa, Homo Sapiens
PKINVRVLK

SEQ ID NO: 824967 - protein, 9 aa, Homo Sapiens
ENVESIVKL

SEQ ID NO: 824968 - protein, 9 aa, Homo Sapiens
QFQLFQEAV

SEQ ID NO: 824969 - protein, 9 aa, Homo Sapiens
VHTEDKFYK

SEQ ID NO: 824970 - protein, 9 aa, Homo Sapiens
GLFALSRGQ

SEQ ID NO: 824971 - protein, 9 aa, Homo Sapiens
WGPDASTGR

SEQ ID NO: 824972 - protein, 9 aa, Homo Sapiens
WLDSESSPY

SEQ ID NO: 824973 - protein, 9 aa, Homo Sapiens
ITDLQPNTE

SEQ ID NO: 824974 - protein, 9 aa, Homo Sapiens
PIPMMPMPV

SEQ ID NO: 824975 - protein, 9 aa, Homo Sapiens
HSILSIKSL

SEQ ID NO: 824976 - protein, 9 aa, Homo Sapiens
GKKFKIYFL

SEQ ID NO: 824977 - protein, 9 aa, Homo Sapiens
IKSLNWYEH

SEQ ID NO: 824978 - protein, 9 aa, Homo Sapiens
SLPGPSKSE

SEQ ID NO: 824979 - protein, 9 aa, Homo Sapiens
KTFIFKRNL

SEQ ID NO: 824980 - protein, 9 aa, Homo Sapiens
IKTLQITDV

SEQ ID NO: 824981 - protein, 9 aa, Homo Sapiens
CMIYELFTR

SEQ ID NO: 824982 - protein, 9 aa, Homo Sapiens
VVQVYRNKY

SEQ ID NO: 824983 - protein, 9 aa, Homo Sapiens
LITDLQPNT

SEQ ID NO: 824984 - protein, 9 aa, Homo Sapiens
TLDAKIEKV

SEQ ID NO: 824985 - protein, 9 aa, Homo Sapiens
GKEFGFIKL

SEQ ID NO: 824986 - protein, 9 aa, Homo Sapiens
NKQIGLLFK

SEQ ID NO: 824987 - protein, 9 aa, Homo Sapiens
GQWPEGQPL

SEQ ID NO: 824988 - protein, 9 aa, Homo Sapiens
EEDLGEEED

SEQ ID NO: 824989 - protein, 9 aa, Homo Sapiens
DLTRIKTEE

SEQ ID NO: 824990 - protein, 9 aa, Homo Sapiens
LRRRATALA

SEQ ID NO: 824991 - protein, 9 aa, Homo Sapiens
SHLYTDGPL

SEQ ID NO: 824992 - protein, 9 aa, Homo Sapiens
FWYRQYYGK

SEQ ID NO: 824993 - protein, 9 aa, Homo Sapiens
STGFGNVSF

SEQ ID NO: 824994 - protein, 9 aa, Homo Sapiens
ILRRAAFSE

SEQ ID NO: 824995 - protein, 9 aa, Homo Sapiens
PTPKTPPSS

SEQ ID NO: 824996 - protein, 9 aa, Homo Sapiens
SPEDTLVCC

SEQ ID NO: 824997 - protein, 9 aa, Homo Sapiens
RTDIMDDWL

SEQ ID NO: 824998 - protein, 9 aa, Homo Sapiens
HSYMLWYRQ

SEQ ID NO: 824999 - protein, 9 aa, Homo Sapiens
DCFKKTFDE

SEQ ID NO: 825000 - protein, 9 aa, Homo Sapiens
KCLTKAHWF

SEQ ID NO: 825001 - protein, 9 aa, Homo Sapiens
EMEEAKDNF

SEQ ID NO: 825002 - protein, 9 aa, Homo Sapiens
KEWIRKISE

SEQ ID NO: 825003 - protein, 9 aa, Homo Sapiens
GAHREKKES

SEQ ID NO: 825004 - protein, 9 aa, Homo Sapiens
RSYLLVACT

SEQ ID NO: 825005 - protein, 9 aa, Homo Sapiens
DLLKEHQKD

SEQ ID NO: 825006 - protein, 9 aa, Homo Sapiens
ELSERGPPT

SEQ ID NO: 825007 - protein, 9 aa, Homo Sapiens
EKLNLQKYL

SEQ ID NO: 825008 - protein, 9 aa, Homo Sapiens
LPIIELSHI

SEQ ID NO: 825009 - protein, 9 aa, Homo Sapiens
KYFEHLNSD

SEQ ID NO: 825010 - protein, 9 aa, Homo Sapiens
PEKIDVVYE

SEQ ID NO: 825011 - protein, 9 aa, Homo Sapiens
WDFSPVPWS

SEQ ID NO: 825012 - protein, 9 aa, Homo Sapiens
LTGLGHISD

SEQ ID NO: 825013 - protein, 9 aa, Homo Sapiens
EQGTRLAAE

SEQ ID NO: 825014 - protein, 9 aa, Homo Sapiens
GITFEIFHK

SEQ ID NO: 825015 - protein, 9 aa, Homo Sapiens
EYRLVVLHT

SEQ ID NO: 825016 - protein, 9 aa, Homo Sapiens
ASQPPGPVL

SEQ ID NO: 825017 - protein, 9 aa, Homo Sapiens
QELFPAPIP

SEQ ID NO: 825018 - protein, 9 aa, Homo Sapiens
ILGLDCAGN

SEQ ID NO: 825019 - protein, 9 aa, Homo Sapiens
LDSKLSLDE

SEQ ID NO: 825020 - protein, 9 aa, Homo Sapiens
NKWKQRVKA

SEQ ID NO: 825021 - protein, 9 aa, Homo Sapiens
TGPTQGDME

SEQ ID NO: 825022 - protein, 9 aa, Homo Sapiens
TSSSPPPVQ

SEQ ID NO: 825023 - protein, 9 aa, Homo Sapiens
RVGPFGPST

SEQ ID NO: 825024 - protein, 9 aa, Homo Sapiens
RMAQHFYNL

SEQ ID NO: 825025 - protein, 9 aa, Homo Sapiens
KNKLVKAFK

SEQ ID NO: 825026 - protein, 9 aa, Homo Sapiens
LLSQEEHTS

SEQ ID NO: 825027 - protein, 9 aa, Homo Sapiens
KQITQNYLK

SEQ ID NO: 825028 - protein, 9 aa, Homo Sapiens
YPIDVMNSI

SEQ ID NO: 825029 - protein, 9 aa, Homo Sapiens
TLCLLAAAL

SEQ ID NO: 825030 - protein, 9 aa, Homo Sapiens
SRIRAEYFK

SEQ ID NO: 825031 - protein, 9 aa, Homo Sapiens
DDILKYHTD

SEQ ID NO: 825032 - protein, 9 aa, Homo Sapiens
FLGSKRSFG

SEQ ID NO: 825033 - protein, 9 aa, Homo Sapiens
STIDDPSIF

SEQ ID NO: 825034 - protein, 9 aa, Homo Sapiens
VLTTATFYH

SEQ ID NO: 825035 - protein, 9 aa, Homo Sapiens
PDVVSKIAQ

SEQ ID NO: 825036 - protein, 9 aa, Homo Sapiens
EAIEAWINL

SEQ ID NO: 825037 - protein, 9 aa, Homo Sapiens
RLQTLELEK

SEQ ID NO: 825038 - protein, 9 aa, Homo Sapiens
GLFRSWAIH

SEQ ID NO: 825039 - protein, 9 aa, Homo Sapiens
SQRVMHRDI

SEQ ID NO: 825040 - protein, 9 aa, Homo Sapiens
IQMWDLQFA

SEQ ID NO: 825041 - protein, 9 aa, Homo Sapiens
KEICDHQAA

SEQ ID NO: 825042 - protein, 9 aa, Homo Sapiens
DSDNLKDMI

SEQ ID NO: 825043 - protein, 9 aa, Homo Sapiens
ICTLPTYHL

SEQ ID NO: 825044 - protein, 9 aa, Homo Sapiens
NWCAWFLQM

SEQ ID NO: 825045 - protein, 9 aa, Homo Sapiens
MCIAFELLD

SEQ ID NO: 825046 - protein, 9 aa, Homo Sapiens
RRSEKYSSH

SEQ ID NO: 825047 - protein, 9 aa, Homo Sapiens
SKQFQAFGY

SEQ ID NO: 825048 - protein, 9 aa, Homo Sapiens
YGSPLELYK

SEQ ID NO: 825049 - protein, 9 aa, Homo Sapiens
KCVNHTNII

SEQ ID NO: 825050 - protein, 9 aa, Homo Sapiens
KTVEAGGVT

SEQ ID NO: 825051 - protein, 9 aa, Homo Sapiens
EECIFYDYN

SEQ ID NO: 825052 - protein, 9 aa, Homo Sapiens
CIGWLEDLL

SEQ ID NO: 825053 - protein, 9 aa, Homo Sapiens
QRTFNEFLE

SEQ ID NO: 825054 - protein, 9 aa, Homo Sapiens
AMSSRQPSS

SEQ ID NO: 825055 - protein, 9 aa, Homo Sapiens
KFLTDYVND

SEQ ID NO: 825056 - protein, 9 aa, Homo Sapiens
LWTGIRPST

SEQ ID NO: 825057 - protein, 9 aa, Homo Sapiens
LKQGHTRQW

SEQ ID NO: 825058 - protein, 9 aa, Homo Sapiens
TLSCNSTPR

SEQ ID NO: 825059 - protein, 9 aa, Homo Sapiens
TLEEMELII

SEQ ID NO: 825060 - protein, 9 aa, Homo Sapiens
FYTKKQCRP

SEQ ID NO: 825061 - protein, 9 aa, Homo Sapiens
ISVKMASDY

SEQ ID NO: 825062 - protein, 9 aa, Homo Sapiens
IKTLQADFN

SEQ ID NO: 825063 - protein, 9 aa, Homo Sapiens
IQHEPLAKI

SEQ ID NO: 825064 - protein, 9 aa, Homo Sapiens
RDRTAKKQS

SEQ ID NO: 825065 - protein, 9 aa, Homo Sapiens
LARAQEDVF

SEQ ID NO: 825066 - protein, 9 aa, Homo Sapiens
GSERKKWIH

SEQ ID NO: 825067 - protein, 9 aa, Homo Sapiens
VYDAMADTL

SEQ ID NO: 825068 - protein, 9 aa, Homo Sapiens
PPGEFNELF

SEQ ID NO: 825069 - protein, 9 aa, Homo Sapiens
WDNGKLKMD

SEQ ID NO: 825070 - protein, 9 aa, Homo Sapiens
NATLGSLEN

SEQ ID NO: 825071 - protein, 9 aa, Homo Sapiens
GVQVGMWVV

SEQ ID NO: 825072 - protein, 9 aa, Homo Sapiens
GVDRGQPLS

SEQ ID NO: 825073 - protein, 9 aa, Homo Sapiens
HCLPYKLEL

SEQ ID NO: 825074 - protein, 9 aa, Homo Sapiens
MLVFILRNQ

SEQ ID NO: 825075 - protein, 9 aa, Homo Sapiens
ILARILYLN

SEQ ID NO: 825076 - protein, 9 aa, Homo Sapiens
SLAEATTKL

SEQ ID NO: 825077 - protein, 9 aa, Homo Sapiens
VVPPTEYFL

SEQ ID NO: 825078 - protein, 9 aa, Homo Sapiens
TGRVSQEVT

SEQ ID NO: 825079 - protein, 9 aa, Homo Sapiens
EGADDEEEE

SEQ ID NO: 825080 - protein, 9 aa, Homo Sapiens
YSKGAISGQ

SEQ ID NO: 825081 - protein, 9 aa, Homo Sapiens
EKLERYSSS

SEQ ID NO: 825082 - protein, 9 aa, Homo Sapiens
TKILHSLLN

SEQ ID NO: 825083 - protein, 9 aa, Homo Sapiens
LIFLCSSCG

SEQ ID NO: 825084 - protein, 9 aa, Homo Sapiens
INFNMSPGF

SEQ ID NO: 825085 - protein, 9 aa, Homo Sapiens
LHENVIDKE

SEQ ID NO: 825086 - protein, 9 aa, Homo Sapiens
IKPYIRHKY

SEQ ID NO: 825087 - protein, 9 aa, Homo Sapiens
DLDMLTFTI

SEQ ID NO: 825088 - protein, 9 aa, Homo Sapiens
GDCYKFYLE

SEQ ID NO: 825089 - protein, 9 aa, Homo Sapiens
EVVPTPPLP

SEQ ID NO: 825090 - protein, 9 aa, Homo Sapiens
RKKHLYDVN

SEQ ID NO: 825091 - protein, 9 aa, Homo Sapiens
QKMQHNGHS

SEQ ID NO: 825092 - protein, 9 aa, Homo Sapiens
GEELEMTPM

SEQ ID NO: 825093 - protein, 9 aa, Homo Sapiens
SPDTQPPNN

SEQ ID NO: 825094 - protein, 9 aa, Homo Sapiens
RDTKTMYAM

SEQ ID NO: 825095 - protein, 9 aa, Homo Sapiens
SNKTIYTYI

SEQ ID NO: 825096 - protein, 9 aa, Homo Sapiens
RSQSNYMAL

SEQ ID NO: 825097 - protein, 9 aa, Homo Sapiens
AKIFWRDQG

SEQ ID NO: 825098 - protein, 9 aa, Homo Sapiens
AHEFIMFTV

SEQ ID NO: 825099 - protein, 9 aa, Homo Sapiens
TAVNVQNIL

SEQ ID NO: 825100 - protein, 9 aa, Homo Sapiens
CNYNKILAT

SEQ ID NO: 825101 - protein, 9 aa, Homo Sapiens
PDNAVTKRV

SEQ ID NO: 825102 - protein, 9 aa, Homo Sapiens
VEGAKVTLH

SEQ ID NO: 825103 - protein, 9 aa, Homo Sapiens
PVTPLSAAP

SEQ ID NO: 825104 - protein, 9 aa, Homo Sapiens
CPIFSSQAL

SEQ ID NO: 825105 - protein, 9 aa, Homo Sapiens
AFEDSKVHA

SEQ ID NO: 825106 - protein, 9 aa, Homo Sapiens
IQETCKAET

SEQ ID NO: 825107 - protein, 9 aa, Homo Sapiens
QWEGKVNGR

SEQ ID NO: 825108 - protein, 9 aa, Homo Sapiens
SALGNGSLT

SEQ ID NO: 825109 - protein, 9 aa, Homo Sapiens
SGLEISHKS

SEQ ID NO: 825110 - protein, 9 aa, Homo Sapiens
ILLTGLDNI

SEQ ID NO: 825111 - protein, 9 aa, Homo Sapiens
GETMVRELV

SEQ ID NO: 825112 - protein, 9 aa, Homo Sapiens
LLGHNLGGL

SEQ ID NO: 825113 - protein, 9 aa, Homo Sapiens
LNILGLETI

SEQ ID NO: 825114 - protein, 9 aa, Homo Sapiens
KCPEKDIRS

SEQ ID NO: 825115 - protein, 9 aa, Homo Sapiens
LASKLKEFV

SEQ ID NO: 825116 - protein, 9 aa, Homo Sapiens
AQGCMGYCA

SEQ ID NO: 825117 - protein, 9 aa, Homo Sapiens
PTCRNQTRH

SEQ ID NO: 825118 - protein, 9 aa, Homo Sapiens
GHPILQVAL

SEQ ID NO: 825119 - protein, 9 aa, Homo Sapiens
LKQLEEETR

SEQ ID NO: 825120 - protein, 9 aa, Homo Sapiens
VMDNSQNAP

SEQ ID NO: 825121 - protein, 9 aa, Homo Sapiens
GGLDKTCHQ

SEQ ID NO: 825122 - protein, 9 aa, Homo Sapiens
YNRVLEIHN

SEQ ID NO: 825123 - protein, 9 aa, Homo Sapiens
VSNAWAVTN

SEQ ID NO: 825124 - protein, 9 aa, Homo Sapiens
LLFRSACQY

SEQ ID NO: 825125 - protein, 9 aa, Homo Sapiens
NLSQNQLSA

SEQ ID NO: 825126 - protein, 9 aa, Homo Sapiens
RIHQNLANT

SEQ ID NO: 825127 - protein, 9 aa, Homo Sapiens
IGISLVILP

SEQ ID NO: 825128 - protein, 9 aa, Homo Sapiens
ILYSVLTID

SEQ ID NO: 825129 - protein, 9 aa, Homo Sapiens
IGNMPAISD

SEQ ID NO: 825130 - protein, 9 aa, Homo Sapiens
SDKPLDGTT

SEQ ID NO: 825131 - protein, 9 aa, Homo Sapiens
QESWKNGIL

SEQ ID NO: 825132 - protein, 9 aa, Homo Sapiens
VEYAHAGDS

SEQ ID NO: 825133 - protein, 9 aa, Homo Sapiens
HPAFPGLIF

SEQ ID NO: 825134 - protein, 9 aa, Homo Sapiens
VTVWDSNAH

SEQ ID NO: 825135 - protein, 9 aa, Homo Sapiens
FILRFHENH

SEQ ID NO: 825136 - protein, 9 aa, Homo Sapiens
SPRDVSSLR

SEQ ID NO: 825137 - protein, 9 aa, Homo Sapiens
SNAYHMSYT

SEQ ID NO: 825138 - protein, 9 aa, Homo Sapiens
CMDAKINVD

SEQ ID NO: 825139 - protein, 9 aa, Homo Sapiens
AQLIIGIPE

SEQ ID NO: 825140 - protein, 9 aa, Homo Sapiens
RGQSLYVQI

SEQ ID NO: 825141 - protein, 9 aa, Homo Sapiens
SELENFSSK

SEQ ID NO: 825142 - protein, 9 aa, Homo Sapiens
NHFYCDTQP

SEQ ID NO: 825143 - protein, 9 aa, Homo Sapiens
KLPCTNFHL

SEQ ID NO: 825144 - protein, 9 aa, Homo Sapiens
GVAQSLNSD

SEQ ID NO: 825145 - protein, 9 aa, Homo Sapiens
EEVNSDIFL

SEQ ID NO: 825146 - protein, 9 aa, Homo Sapiens
SNIPTNLCV

SEQ ID NO: 825147 - protein, 9 aa, Homo Sapiens
RGSDSEERS

SEQ ID NO: 825148 - protein, 9 aa, Homo Sapiens
SASRQTLFE

SEQ ID NO: 825149 - protein, 9 aa, Homo Sapiens
LLVNNKISK

SEQ ID NO: 825150 - protein, 9 aa, Homo Sapiens
EVTQCNCRK

SEQ ID NO: 825151 - protein, 9 aa, Homo Sapiens
SVDGLLNAL

SEQ ID NO: 825152 - protein, 9 aa, Homo Sapiens
HRPHPKPET

SEQ ID NO: 825153 - protein, 9 aa, Homo Sapiens
QGLPSSGHR

SEQ ID NO: 825154 - protein, 9 aa, Homo Sapiens
ELFSECFFQ

SEQ ID NO: 825155 - protein, 9 aa, Homo Sapiens
ENGEQGPIW

SEQ ID NO: 825156 - protein, 9 aa, Homo Sapiens
RVPVNSSSS

SEQ ID NO: 825157 - protein, 9 aa, Homo Sapiens
DTHPVVPAL

SEQ ID NO: 825158 - protein, 9 aa, Homo Sapiens
GKALLHPLE

SEQ ID NO: 825159 - protein, 9 aa, Homo Sapiens
PNKKLICSV

SEQ ID NO: 825160 - protein, 9 aa, Homo Sapiens
KNFKKIRNS

SEQ ID NO: 825161 - protein, 9 aa, Homo Sapiens
SPDVSKHDF

SEQ ID NO: 825162 - protein, 9 aa, Homo Sapiens
QKSEEELKG

SEQ ID NO: 825163 - protein, 9 aa, Homo Sapiens
DSGLPVIPC

SEQ ID NO: 825164 - protein, 9 aa, Homo Sapiens
RLSPMKPLP

SEQ ID NO: 825165 - protein, 9 aa, Homo Sapiens
GTTTLAFKL

SEQ ID NO: 825166 - protein, 9 aa, Homo Sapiens
KKIQGKDLQ

SEQ ID NO: 825167 - protein, 9 aa, Homo Sapiens
MCLTSDIYL

SEQ ID NO: 825168 - protein, 9 aa, Homo Sapiens
LEVCQLCLE

SEQ ID NO: 825169 - protein, 9 aa, Homo Sapiens
GAAECMILG

SEQ ID NO: 825170 - protein, 9 aa, Homo Sapiens
AFEEIGKIF

SEQ ID NO: 825171 - protein, 9 aa, Homo Sapiens
TPRINSSSS

SEQ ID NO: 825172 - protein, 9 aa, Homo Sapiens
PRPVDLSKL

SEQ ID NO: 825173 - protein, 9 aa, Homo Sapiens
FSVCRDRII

SEQ ID NO: 825174 - protein, 9 aa, Homo Sapiens
ALLLIVSAG

SEQ ID NO: 825175 - protein, 9 aa, Homo Sapiens
LSGDPHNLS

SEQ ID NO: 825176 - protein, 9 aa, Homo Sapiens
QIRIETRQA

SEQ ID NO: 825177 - protein, 9 aa, Homo Sapiens
RKLVDVLVD

SEQ ID NO: 825178 - protein, 9 aa, Homo Sapiens
NRRSLTSGS

SEQ ID NO: 825179 - protein, 9 aa, Homo Sapiens
KTWKCPENF

SEQ ID NO: 825180 - protein, 9 aa, Homo Sapiens
GEMIDRIKY

SEQ ID NO: 825181 - protein, 9 aa, Homo Sapiens
IDKELEEND

SEQ ID NO: 825182 - protein, 9 aa, Homo Sapiens
FMLYLVTIM

SEQ ID NO: 825183 - protein, 9 aa, Homo Sapiens
CVSSPGTVH

SEQ ID NO: 825184 - protein, 9 aa, Homo Sapiens
PNWYFHNHE

SEQ ID NO: 825185 - protein, 9 aa, Homo Sapiens
LLGGFQAMD

SEQ ID NO: 825186 - protein, 9 aa, Homo Sapiens
SSGNKKDGR

SEQ ID NO: 825187 - protein, 9 aa, Homo Sapiens
NNGEGGACS

SEQ ID NO: 825188 - protein, 9 aa, Homo Sapiens
IAMPQLFME

SEQ ID NO: 825189 - protein, 9 aa, Homo Sapiens
EELKIKCSL

SEQ ID NO: 825190 - protein, 9 aa, Homo Sapiens
CIGQAFTMA

SEQ ID NO: 825191 - protein, 9 aa, Homo Sapiens
HSGVQPFEC

SEQ ID NO: 825192 - protein, 9 aa, Homo Sapiens
DPQAVTYAA

SEQ ID NO: 825193 - protein, 9 aa, Homo Sapiens
SLVCGEYGR

SEQ ID NO: 825194 - protein, 9 aa, Homo Sapiens
PLESLAKDH

SEQ ID NO: 825195 - protein, 9 aa, Homo Sapiens
DKIYNLCNG

SEQ ID NO: 825196 - protein, 9 aa, Homo Sapiens
IEEQEVVDK

SEQ ID NO: 825197 - protein, 9 aa, Homo Sapiens
SLDSLGRFR

SEQ ID NO: 825198 - protein, 9 aa, Homo Sapiens
NLITTFILQ

SEQ ID NO: 825199 - protein, 9 aa, Homo Sapiens
ENYNKFYEA

SEQ ID NO: 825200 - protein, 9 aa, Homo Sapiens
TINGNYNIM

SEQ ID NO: 825201 - protein, 9 aa, Homo Sapiens
SYDLEPFLQ

SEQ ID NO: 825202 - protein, 9 aa, Homo Sapiens
PQDSHGCCS

SEQ ID NO: 825203 - protein, 9 aa, Homo Sapiens
KYFEVVFND

SEQ ID NO: 825204 - protein, 9 aa, Homo Sapiens
HYLSTLGSA

SEQ ID NO: 825205 - protein, 9 aa, Homo Sapiens
PSTAKSQFI

SEQ ID NO: 825206 - protein, 9 aa, Homo Sapiens
NVCRVPGSQ

SEQ ID NO: 825207 - protein, 9 aa, Homo Sapiens
STLAGVDFE

SEQ ID NO: 825208 - protein, 9 aa, Homo Sapiens
PHHQPSGTG

SEQ ID NO: 825209 - protein, 9 aa, Homo Sapiens
VRVLFELAH

SEQ ID NO: 825210 - protein, 9 aa, Homo Sapiens
SDQFSAIQR

SEQ ID NO: 825211 - protein, 9 aa, Homo Sapiens
FIHEGLTVK

SEQ ID NO: 825212 - protein, 9 aa, Homo Sapiens
FRTPEFEEC

SEQ ID NO: 825213 - protein, 9 aa, Homo Sapiens
IVHQITHTQ

SEQ ID NO: 825214 - protein, 9 aa, Homo Sapiens
AQIYHAVAA

SEQ ID NO: 825215 - protein, 9 aa, Homo Sapiens
VLTHIIAIV

SEQ ID NO: 825216 - protein, 9 aa, Homo Sapiens
FNKENLPSH

SEQ ID NO: 825217 - protein, 9 aa, Homo Sapiens
DRVIFWGRI

SEQ ID NO: 825218 - protein, 9 aa, Homo Sapiens
EWQASEENV

SEQ ID NO: 825219 - protein, 9 aa, Homo Sapiens
KDYLRELSQ

SEQ ID NO: 825220 - protein, 9 aa, Homo Sapiens
SLTFNLDIV

SEQ ID NO: 825221 - protein, 9 aa, Homo Sapiens
PPTGVHASK

SEQ ID NO: 825222 - protein, 9 aa, Homo Sapiens
YAKWSYFPS

SEQ ID NO: 825223 - protein, 9 aa, Homo Sapiens
GRLDFILMN

SEQ ID NO: 825224 - protein, 9 aa, Homo Sapiens
QWYLDKGIC

SEQ ID NO: 825225 - protein, 9 aa, Homo Sapiens
KEAQKQLTQ

SEQ ID NO: 825226 - protein, 9 aa, Homo Sapiens
AIDYGIKLL

SEQ ID NO: 825227 - protein, 9 aa, Homo Sapiens
IFLLLYLII

SEQ ID NO: 825228 - protein, 9 aa, Homo Sapiens
PGPHHQPSG

SEQ ID NO: 825229 - protein, 9 aa, Homo Sapiens
LSASSKNKD

SEQ ID NO: 825230 - protein, 9 aa, Homo Sapiens
NLCQDMRGY

SEQ ID NO: 825231 - protein, 9 aa, Homo Sapiens
KDWCDWTMI

SEQ ID NO: 825232 - protein, 9 aa, Homo Sapiens
PVVFALIVL

SEQ ID NO: 825233 - protein, 9 aa, Homo Sapiens
VGSLPPSKI

SEQ ID NO: 825234 - protein, 9 aa, Homo Sapiens
YPELINYTD

SEQ ID NO: 825235 - protein, 9 aa, Homo Sapiens
GSLNILGLE

SEQ ID NO: 825236 - protein, 9 aa, Homo Sapiens
NYVDPIFYV

SEQ ID NO: 825237 - protein, 9 aa, Homo Sapiens
LPDEMGDMQ

SEQ ID NO: 825238 - protein, 9 aa, Homo Sapiens
GSFKIGNLF

SEQ ID NO: 825239 - protein, 9 aa, Homo Sapiens
LSHNNMISL

SEQ ID NO: 825240 - protein, 9 aa, Homo Sapiens
LGKKSNNSF

SEQ ID NO: 825241 - protein, 9 aa, Homo Sapiens
VTEPLARER

SEQ ID NO: 825242 - protein, 9 aa, Homo Sapiens
LQEHQIIHT

SEQ ID NO: 825243 - protein, 9 aa, Homo Sapiens
TSMFETIDR

SEQ ID NO: 825244 - protein, 9 aa, Homo Sapiens
DEEIDLENV

SEQ ID NO: 825245 - protein, 9 aa, Homo Sapiens
DLEYVKLAK

SEQ ID NO: 825246 - protein, 9 aa, Homo Sapiens
CSRLDASLS

SEQ ID NO: 825247 - protein, 9 aa, Homo Sapiens
MVNPRALDF

SEQ ID NO: 825248 - protein, 9 aa, Homo Sapiens
SGSFNWHQS

SEQ ID NO: 825249 - protein, 9 aa, Homo Sapiens
RGDNNPLRI

SEQ ID NO: 825250 - protein, 9 aa, Homo Sapiens
NLFTGVDRG

SEQ ID NO: 825251 - protein, 9 aa, Homo Sapiens
GSYRCSANV

SEQ ID NO: 825252 - protein, 9 aa, Homo Sapiens
PVIGANVTA

SEQ ID NO: 825253 - protein, 9 aa, Homo Sapiens
NYLICLRKK

SEQ ID NO: 825254 - protein, 9 aa, Homo Sapiens
ECSKHSHRL

SEQ ID NO: 825255 - protein, 9 aa, Homo Sapiens
WLHWGPAGA

SEQ ID NO: 825256 - protein, 9 aa, Homo Sapiens
EGLEETLHN

SEQ ID NO: 825257 - protein, 9 aa, Homo Sapiens
VAPTREGVD

SEQ ID NO: 825258 - protein, 9 aa, Homo Sapiens
DNEVLFTMC

SEQ ID NO: 825259 - protein, 9 aa, Homo Sapiens
LQRLGMIDA

SEQ ID NO: 825260 - protein, 9 aa, Homo Sapiens
KYYVTYSSM

SEQ ID NO: 825261 - protein, 9 aa, Homo Sapiens
QIAMRILLG

SEQ ID NO: 825262 - protein, 9 aa, Homo Sapiens
IYYSGKYDD

SEQ ID NO: 825263 - protein, 9 aa, Homo Sapiens
GSQSVITSS

SEQ ID NO: 825264 - protein, 9 aa, Homo Sapiens
RQKRKFSSF

SEQ ID NO: 825265 - protein, 9 aa, Homo Sapiens
KSERHAHLH

SEQ ID NO: 825266 - protein, 9 aa, Homo Sapiens
MRRGGDEYD

SEQ ID NO: 825267 - protein, 9 aa, Homo Sapiens
YENEPAGTW

SEQ ID NO: 825268 - protein, 9 aa, Homo Sapiens
LYLSMQEAL

SEQ ID NO: 825269 - protein, 9 aa, Homo Sapiens
ENAMLCAGI

SEQ ID NO: 825270 - protein, 9 aa, Homo Sapiens
LCKAMENFM

SEQ ID NO: 825271 - protein, 9 aa, Homo Sapiens
MKLSMNNNI

SEQ ID NO: 825272 - protein, 9 aa, Homo Sapiens
LLVVGCVSC

SEQ ID NO: 825273 - protein, 9 aa, Homo Sapiens
CAQLNKSLL

SEQ ID NO: 825274 - protein, 9 aa, Homo Sapiens
VVREKLARE

SEQ ID NO: 825275 - protein, 9 aa, Homo Sapiens
SEFGKQCNL

SEQ ID NO: 825276 - protein, 9 aa, Homo Sapiens
CGEIENITA

SEQ ID NO: 825277 - protein, 9 aa, Homo Sapiens
DYEALQAFK

SEQ ID NO: 825278 - protein, 9 aa, Homo Sapiens
NEELSLQKS

SEQ ID NO: 825279 - protein, 9 aa, Homo Sapiens
QQSQQELSP

SEQ ID NO: 825280 - protein, 9 aa, Homo Sapiens
VCAQLNKSL

SEQ ID NO: 825281 - protein, 9 aa, Homo Sapiens
AFNVYLDIC

SEQ ID NO: 825282 - protein, 9 aa, Homo Sapiens
QGELVAKEI

SEQ ID NO: 825283 - protein, 9 aa, Homo Sapiens
ERYQNNNPP

SEQ ID NO: 825284 - protein, 9 aa, Homo Sapiens
VNQLQNTTS

SEQ ID NO: 825285 - protein, 9 aa, Homo Sapiens
EKTKWKDLK

SEQ ID NO: 825286 - protein, 9 aa, Homo Sapiens
QKQVLSTEK

SEQ ID NO: 825287 - protein, 9 aa, Homo Sapiens
ESSSKGPQR

SEQ ID NO: 825288 - protein, 9 aa, Homo Sapiens
PRFKRVLGP

SEQ ID NO: 825289 - protein, 9 aa, Homo Sapiens
IDFISGFNM

SEQ ID NO: 825290 - protein, 9 aa, Homo Sapiens
KQLMEDKKR

SEQ ID NO: 825291 - protein, 9 aa, Homo Sapiens
PKEVRKNVQ

SEQ ID NO: 825292 - protein, 9 aa, Homo Sapiens
GVSHRRHNS

SEQ ID NO: 825293 - protein, 9 aa, Homo Sapiens
KYYLDGVSN

SEQ ID NO: 825294 - protein, 9 aa, Homo Sapiens
TNLWRCISE

SEQ ID NO: 825295 - protein, 9 aa, Homo Sapiens
YNLWKEFCS

SEQ ID NO: 825296 - protein, 9 aa, Homo Sapiens
SEKLFQRLI

SEQ ID NO: 825297 - protein, 9 aa, Homo Sapiens
PAHGRRPPP

SEQ ID NO: 825298 - protein, 9 aa, Homo Sapiens
LDLTVEHDS

SEQ ID NO: 825299 - protein, 9 aa, Homo Sapiens
EYERIVLVD

SEQ ID NO: 825300 - protein, 9 aa, Homo Sapiens
VKRYDLELI

SEQ ID NO: 825301 - protein, 9 aa, Homo Sapiens
LEDHRFDNT

SEQ ID NO: 825302 - protein, 9 aa, Homo Sapiens
NLKEYADNL

SEQ ID NO: 825303 - protein, 9 aa, Homo Sapiens
SPRLRHVGI

SEQ ID NO: 825304 - protein, 9 aa, Homo Sapiens
SLALDCKDS

SEQ ID NO: 825305 - protein, 9 aa, Homo Sapiens
VQDYASVEY

SEQ ID NO: 825306 - protein, 9 aa, Homo Sapiens
FINYAKVWK

SEQ ID NO: 825307 - protein, 9 aa, Homo Sapiens
EKKTCHARD

SEQ ID NO: 825308 - protein, 9 aa, Homo Sapiens
ESLMELLDP

SEQ ID NO: 825309 - protein, 9 aa, Homo Sapiens
MSQLFATYC

SEQ ID NO: 825310 - protein, 9 aa, Homo Sapiens
SLIPTHTTI

SEQ ID NO: 825311 - protein, 9 aa, Homo Sapiens
SGDLYNVLE

SEQ ID NO: 825312 - protein, 9 aa, Homo Sapiens
RQNYEEKGK

SEQ ID NO: 825313 - protein, 9 aa, Homo Sapiens
RVILARILY

SEQ ID NO: 825314 - protein, 9 aa, Homo Sapiens
EYRDSHSQQ

SEQ ID NO: 825315 - protein, 9 aa, Homo Sapiens
FAESHNQID

SEQ ID NO: 825316 - protein, 9 aa, Homo Sapiens
LTCMLGYVT

SEQ ID NO: 825317 - protein, 9 aa, Homo Sapiens
LSEDLYPNI

SEQ ID NO: 825318 - protein, 9 aa, Homo Sapiens
AVENQVSGN

SEQ ID NO: 825319 - protein, 9 aa, Homo Sapiens
CEERTLETL

SEQ ID NO: 825320 - protein, 9 aa, Homo Sapiens
PDGENRAHF

SEQ ID NO: 825321 - protein, 9 aa, Homo Sapiens
SRALLYRLW

SEQ ID NO: 825322 - protein, 9 aa, Homo Sapiens
VNHDFFMYS

SEQ ID NO: 825323 - protein, 9 aa, Homo Sapiens
LPPPPPHLS

SEQ ID NO: 825324 - protein, 9 aa, Homo Sapiens
EFRKLGFYN

SEQ ID NO: 825325 - protein, 9 aa, Homo Sapiens
YFGLEESGH

SEQ ID NO: 825326 - protein, 9 aa, Homo Sapiens
HGPGHIHLP

SEQ ID NO: 825327 - protein, 9 aa, Homo Sapiens
KTKEIARAE

SEQ ID NO: 825328 - protein, 9 aa, Homo Sapiens
KLCRYLVHS

SEQ ID NO: 825329 - protein, 9 aa, Homo Sapiens
YTGSACACS

SEQ ID NO: 825330 - protein, 9 aa, Homo Sapiens
PPQLINLKP

SEQ ID NO: 825331 - protein, 9 aa, Homo Sapiens
QLGGPGMVA

SEQ ID NO: 825332 - protein, 9 aa, Homo Sapiens
WYQPQHNVM

SEQ ID NO: 825333 - protein, 9 aa, Homo Sapiens
QEIHAKNII

SEQ ID NO: 825334 - protein, 9 aa, Homo Sapiens
TQNVSSILI

SEQ ID NO: 825335 - protein, 9 aa, Homo Sapiens
LFTYTMPHS

SEQ ID NO: 825336 - protein, 9 aa, Homo Sapiens
DLVEAIYGT

SEQ ID NO: 825337 - protein, 9 aa, Homo Sapiens
DIKDVFNSK

SEQ ID NO: 825338 - protein, 9 aa, Homo Sapiens
IIEAIKIQI

SEQ ID NO: 825339 - protein, 9 aa, Homo Sapiens
FPNGLRYYK

SEQ ID NO: 825340 - protein, 9 aa, Homo Sapiens
LRSHPHTQK

SEQ ID NO: 825341 - protein, 9 aa, Homo Sapiens
LDGVRGVLS

SEQ ID NO: 825342 - protein, 9 aa, Homo Sapiens
TVYAKVDNE

SEQ ID NO: 825343 - protein, 9 aa, Homo Sapiens
LNNNFSLSS

SEQ ID NO: 825344 - protein, 9 aa, Homo Sapiens
FALSFMNVV

SEQ ID NO: 825345 - protein, 9 aa, Homo Sapiens
VAASYALGR

SEQ ID NO: 825346 - protein, 9 aa, Homo Sapiens
VKPYLTDVL

SEQ ID NO: 825347 - protein, 9 aa, Homo Sapiens
KAVEFILIK

SEQ ID NO: 825348 - protein, 9 aa, Homo Sapiens
NYPPSPGVE

SEQ ID NO: 825349 - protein, 9 aa, Homo Sapiens
CLIPTGLPV

SEQ ID NO: 825350 - protein, 9 aa, Homo Sapiens
MMGPRMVGM

SEQ ID NO: 825351 - protein, 9 aa, Homo Sapiens
LAPKETNSS

SEQ ID NO: 825352 - protein, 9 aa, Homo Sapiens
QIGELKKMK

SEQ ID NO: 825353 - protein, 9 aa, Homo Sapiens
RAGLPQDLT

SEQ ID NO: 825354 - protein, 9 aa, Homo Sapiens
DLLMKKIQG

SEQ ID NO: 825355 - protein, 9 aa, Homo Sapiens
GPILTASGR

SEQ ID NO: 825356 - protein, 9 aa, Homo Sapiens
SALPATKLV

SEQ ID NO: 825357 - protein, 9 aa, Homo Sapiens
LFNTAVCER

SEQ ID NO: 825358 - protein, 9 aa, Homo Sapiens
EFCSYLSQP

SEQ ID NO: 825359 - protein, 9 aa, Homo Sapiens
NQKPGTDEA

SEQ ID NO: 825360 - protein, 9 aa, Homo Sapiens
LVGPSSDTC

SEQ ID NO: 825361 - protein, 9 aa, Homo Sapiens
AIEKQLGGK

SEQ ID NO: 825362 - protein, 9 aa, Homo Sapiens
AQRAAIIVG

SEQ ID NO: 825363 - protein, 9 aa, Homo Sapiens
QSYPTNSYG

SEQ ID NO: 825364 - protein, 9 aa, Homo Sapiens
AMALPPLDE

SEQ ID NO: 825365 - protein, 9 aa, Homo Sapiens
YYPSGDAFV

SEQ ID NO: 825366 - protein, 9 aa, Homo Sapiens
AACLPLPGH

SEQ ID NO: 825367 - protein, 9 aa, Homo Sapiens
IIYEQHWKP

SEQ ID NO: 825368 - protein, 9 aa, Homo Sapiens
WRERAELRP

SEQ ID NO: 825369 - protein, 9 aa, Homo Sapiens
GWKETDKFG

SEQ ID NO: 825370 - protein, 9 aa, Homo Sapiens
TALIGWLFL

SEQ ID NO: 825371 - protein, 9 aa, Homo Sapiens
DSDSFIAGT

SEQ ID NO: 825372 - protein, 9 aa, Homo Sapiens
VTFPSLPRS

SEQ ID NO: 825373 - protein, 9 aa, Homo Sapiens
APSLGALCF

SEQ ID NO: 825374 - protein, 9 aa, Homo Sapiens
FKNAMYICC

SEQ ID NO: 825375 - protein, 9 aa, Homo Sapiens
YPHLSPNMG

SEQ ID NO: 825376 - protein, 9 aa, Homo Sapiens
RYESQQNGA

SEQ ID NO: 825377 - protein, 9 aa, Homo Sapiens
HKTSDSTLL

SEQ ID NO: 825378 - protein, 9 aa, Homo Sapiens
NCNLPRLCI

SEQ ID NO: 825379 - protein, 9 aa, Homo Sapiens
TLKNIIQIN

SEQ ID NO: 825380 - protein, 9 aa, Homo Sapiens
QDTVLQHVV

SEQ ID NO: 825381 - protein, 9 aa, Homo Sapiens
TSYERYNCY

SEQ ID NO: 825382 - protein, 9 aa, Homo Sapiens
MTPEYFVRS

SEQ ID NO: 825383 - protein, 9 aa, Homo Sapiens
QEASNKKKL

SEQ ID NO: 825384 - protein, 9 aa, Homo Sapiens
MNEEESYPD

SEQ ID NO: 825385 - protein, 9 aa, Homo Sapiens
QFRIGVANV

SEQ ID NO: 825386 - protein, 9 aa, Homo Sapiens
YIHSKDKPF

SEQ ID NO: 825387 - protein, 9 aa, Homo Sapiens
PQSEKSKST

SEQ ID NO: 825388 - protein, 9 aa, Homo Sapiens
EKDEQVRRQ

SEQ ID NO: 825389 - protein, 9 aa, Homo Sapiens
RASGMTKNI

SEQ ID NO: 825390 - protein, 9 aa, Homo Sapiens
DCYVFFNYS

SEQ ID NO: 825391 - protein, 9 aa, Homo Sapiens
KILSMQGQI

SEQ ID NO: 825392 - protein, 9 aa, Homo Sapiens
KTIYVIPGL

SEQ ID NO: 825393 - protein, 9 aa, Homo Sapiens
AMYGEECIF

SEQ ID NO: 825394 - protein, 9 aa, Homo Sapiens
LRDSHKTIA

SEQ ID NO: 825395 - protein, 9 aa, Homo Sapiens
YHVYSFHNV

SEQ ID NO: 825396 - protein, 9 aa, Homo Sapiens
VQASMPDKE

SEQ ID NO: 825397 - protein, 9 aa, Homo Sapiens
NIQRGVVAI

SEQ ID NO: 825398 - protein, 9 aa, Homo Sapiens
ILYQILRGL

SEQ ID NO: 825399 - protein, 9 aa, Homo Sapiens
LLREGAPIK

SEQ ID NO: 825400 - protein, 9 aa, Homo Sapiens
QTTAFLDGF

SEQ ID NO: 825401 - protein, 9 aa, Homo Sapiens
KNYPSTRVM

SEQ ID NO: 825402 - protein, 9 aa, Homo Sapiens
DGHPLKSDT

SEQ ID NO: 825403 - protein, 9 aa, Homo Sapiens
GTHTSTKQV

SEQ ID NO: 825404 - protein, 9 aa, Homo Sapiens
RHGDALRNT

SEQ ID NO: 825405 - protein, 9 aa, Homo Sapiens
KEQKNPTYV

SEQ ID NO: 825406 - protein, 9 aa, Homo Sapiens
YFDFSLFKH

SEQ ID NO: 825407 - protein, 9 aa, Homo Sapiens
AGNNLETFT

SEQ ID NO: 825408 - protein, 9 aa, Homo Sapiens
VFYLKRVKK

SEQ ID NO: 825409 - protein, 9 aa, Homo Sapiens
IFIMAGIDL

SEQ ID NO: 825410 - protein, 9 aa, Homo Sapiens
LDESSGVQH

SEQ ID NO: 825411 - protein, 9 aa, Homo Sapiens
NPKEVFSEF

SEQ ID NO: 825412 - protein, 9 aa, Homo Sapiens
KSAEFLTVK

SEQ ID NO: 825413 - protein, 9 aa, Homo Sapiens
EVQRQIRRH

SEQ ID NO: 825414 - protein, 9 aa, Homo Sapiens
LFSECFFQN

SEQ ID NO: 825415 - protein, 9 aa, Homo Sapiens
DEEDACWII

SEQ ID NO: 825416 - protein, 9 aa, Homo Sapiens
LRIYIQGVD

SEQ ID NO: 825417 - protein, 9 aa, Homo Sapiens
VPFQDMHIT

SEQ ID NO: 825418 - protein, 9 aa, Homo Sapiens
DQPGQRGKT

SEQ ID NO: 825419 - protein, 9 aa, Homo Sapiens
FLVGNAFIP

SEQ ID NO: 825420 - protein, 9 aa, Homo Sapiens
YVKITLRNL

SEQ ID NO: 825421 - protein, 9 aa, Homo Sapiens
GKQRATFKS

SEQ ID NO: 825422 - protein, 9 aa, Homo Sapiens
CQSSCCKSC

SEQ ID NO: 825423 - protein, 9 aa, Homo Sapiens
CSRLTHLSL

SEQ ID NO: 825424 - protein, 9 aa, Homo Sapiens
KRKMCSKKE

SEQ ID NO: 825425 - protein, 9 aa, Homo Sapiens
KDGKTTQED

SEQ ID NO: 825426 - protein, 9 aa, Homo Sapiens
NNKLISELQ

SEQ ID NO: 825427 - protein, 9 aa, Homo Sapiens
RLWRDSKEK

SEQ ID NO: 825428 - protein, 9 aa, Homo Sapiens
FIFRLINII

SEQ ID NO: 825429 - protein, 9 aa, Homo Sapiens
MYDCVSQTE

SEQ ID NO: 825430 - protein, 9 aa, Homo Sapiens
VMQKHSSSL

SEQ ID NO: 825431 - protein, 9 aa, Homo Sapiens
CAPRARITI

SEQ ID NO: 825432 - protein, 9 aa, Homo Sapiens
YYYKKINTF

SEQ ID NO: 825433 - protein, 9 aa, Homo Sapiens
DFHMKGKEN

SEQ ID NO: 825434 - protein, 9 aa, Homo Sapiens
KQRSRINDE

SEQ ID NO: 825435 - protein, 9 aa, Homo Sapiens
IQQLTSEIF

SEQ ID NO: 825436 - protein, 9 aa, Homo Sapiens
KVKGYEDGG

SEQ ID NO: 825437 - protein, 9 aa, Homo Sapiens
FLFLFVGLH

SEQ ID NO: 825438 - protein, 9 aa, Homo Sapiens
CYKEICNAF

SEQ ID NO: 825439 - protein, 9 aa, Homo Sapiens
VVDQIKSQE

SEQ ID NO: 825440 - protein, 9 aa, Homo Sapiens
KTPTNKAPH

SEQ ID NO: 825441 - protein, 9 aa, Homo Sapiens
VDTVVALLA

SEQ ID NO: 825442 - protein, 9 aa, Homo Sapiens
IIKKNGDIL

SEQ ID NO: 825443 - protein, 9 aa, Homo Sapiens
STDDSSAAW

SEQ ID NO: 825444 - protein, 9 aa, Homo Sapiens
GDAVDVTQG

SEQ ID NO: 825445 - protein, 9 aa, Homo Sapiens
LAKGDQSED

SEQ ID NO: 825446 - protein, 9 aa, Homo Sapiens
VDKASPGVA

SEQ ID NO: 825447 - protein, 9 aa, Homo Sapiens
GKTFSQSSI

SEQ ID NO: 825448 - protein, 9 aa, Homo Sapiens
SIPQQLANL

SEQ ID NO: 825449 - protein, 9 aa, Homo Sapiens
GTAPEEKQL

SEQ ID NO: 825450 - protein, 9 aa, Homo Sapiens
LSESSSFLT

SEQ ID NO: 825451 - protein, 9 aa, Homo Sapiens
QGPNGADGT

SEQ ID NO: 825452 - protein, 9 aa, Homo Sapiens
TEEQKAKDL

SEQ ID NO: 825453 - protein, 9 aa, Homo Sapiens
RPLHYPVAG

SEQ ID NO: 825454 - protein, 9 aa, Homo Sapiens
NKFVSLINC

SEQ ID NO: 825455 - protein, 9 aa, Homo Sapiens
VRPERALWQ

SEQ ID NO: 825456 - protein, 9 aa, Homo Sapiens
ALRNTKQEI

SEQ ID NO: 825457 - protein, 9 aa, Homo Sapiens
SHSMKKYLV

SEQ ID NO: 825458 - protein, 9 aa, Homo Sapiens
QFCITCQKS

SEQ ID NO: 825459 - protein, 9 aa, Homo Sapiens
QIILEKVAA

SEQ ID NO: 825460 - protein, 9 aa, Homo Sapiens
GKRADNPHV

SEQ ID NO: 825461 - protein, 9 aa, Homo Sapiens
AQDHIFSFD

SEQ ID NO: 825462 - protein, 9 aa, Homo Sapiens
LKRSGKWLN

SEQ ID NO: 825463 - protein, 9 aa, Homo Sapiens
ILSGLVLSP

SEQ ID NO: 825464 - protein, 9 aa, Homo Sapiens
SPPPLGAAR

SEQ ID NO: 825465 - protein, 9 aa, Homo Sapiens
ECGKAVIHL

SEQ ID NO: 825466 - protein, 9 aa, Homo Sapiens
EIHPNHPFQ

SEQ ID NO: 825467 - protein, 9 aa, Homo Sapiens
CKRVVINIS

SEQ ID NO: 825468 - protein, 9 aa, Homo Sapiens
KLQSMIPCC

SEQ ID NO: 825469 - protein, 9 aa, Homo Sapiens
DKLKEKKLA

SEQ ID NO: 825470 - protein, 9 aa, Homo Sapiens
SALKNLDSR

SEQ ID NO: 825471 - protein, 9 aa, Homo Sapiens
LGRQHSAVL

SEQ ID NO: 825472 - protein, 9 aa, Homo Sapiens
DFSEPSNLP

SEQ ID NO: 825473 - protein, 9 aa, Homo Sapiens
SSDEEKVIC

SEQ ID NO: 825474 - protein, 9 aa, Homo Sapiens
LFKNMIQPD

SEQ ID NO: 825475 - protein, 9 aa, Homo Sapiens
EINRPRRVL

SEQ ID NO: 825476 - protein, 9 aa, Homo Sapiens
AVFMALSAQ

SEQ ID NO: 825477 - protein, 9 aa, Homo Sapiens
VINCFNVEE

SEQ ID NO: 825478 - protein, 9 aa, Homo Sapiens
ISYAISADL

SEQ ID NO: 825479 - protein, 9 aa, Homo Sapiens
AFPISHIHY

SEQ ID NO: 825480 - protein, 9 aa, Homo Sapiens
VSPKGMMKL

SEQ ID NO: 825481 - protein, 9 aa, Homo Sapiens
HQAAINNLW

SEQ ID NO: 825482 - protein, 9 aa, Homo Sapiens
HQKRDQYLQ

SEQ ID NO: 825483 - protein, 9 aa, Homo Sapiens
FVMDNSQNA

SEQ ID NO: 825484 - protein, 9 aa, Homo Sapiens
VHQITHTQE

SEQ ID NO: 825485 - protein, 9 aa, Homo Sapiens
QMKQISSGS

SEQ ID NO: 825486 - protein, 9 aa, Homo Sapiens
QAHTPTLAS

SEQ ID NO: 825487 - protein, 9 aa, Homo Sapiens
REAPDDIQD

SEQ ID NO: 825488 - protein, 9 aa, Homo Sapiens
KKFSRLDPN

SEQ ID NO: 825489 - protein, 9 aa, Homo Sapiens
VVQEYQEKF

SEQ ID NO: 825490 - protein, 9 aa, Homo Sapiens
CSHFPAGEF

SEQ ID NO: 825491 - protein, 9 aa, Homo Sapiens
TLGLNSRLY

SEQ ID NO: 825492 - protein, 9 aa, Homo Sapiens
AVEDDNILP

SEQ ID NO: 825493 - protein, 9 aa, Homo Sapiens
LDNTVRSCD

SEQ ID NO: 825494 - protein, 9 aa, Homo Sapiens
TWENFHFML

SEQ ID NO: 825495 - protein, 9 aa, Homo Sapiens
REDVKLEDE

SEQ ID NO: 825496 - protein, 9 aa, Homo Sapiens
FNKIVEVTL

SEQ ID NO: 825497 - protein, 9 aa, Homo Sapiens
IKFAYLGRL

SEQ ID NO: 825498 - protein, 9 aa, Homo Sapiens
SSCLMGRHD

SEQ ID NO: 825499 - protein, 9 aa, Homo Sapiens
FSEAFYDIS

SEQ ID NO: 825500 - protein, 9 aa, Homo Sapiens
EKTDSLTTL

SEQ ID NO: 825501 - protein, 9 aa, Homo Sapiens
VMNSRDFGI

SEQ ID NO: 825502 - protein, 9 aa, Homo Sapiens
RFQPHQDAN

SEQ ID NO: 825503 - protein, 9 aa, Homo Sapiens
GKMNGRVSI

SEQ ID NO: 825504 - protein, 9 aa, Homo Sapiens
IKRVTLHEK

SEQ ID NO: 825505 - protein, 9 aa, Homo Sapiens
GLVMLGKVG

SEQ ID NO: 825506 - protein, 9 aa, Homo Sapiens
QLVWRGVNV

SEQ ID NO: 825507 - protein, 9 aa, Homo Sapiens
FRRSAHLIQ

SEQ ID NO: 825508 - protein, 9 aa, Homo Sapiens
IFYMFVVEK

SEQ ID NO: 825509 - protein, 9 aa, Homo Sapiens
PSIISLEFK

SEQ ID NO: 825510 - protein, 9 aa, Homo Sapiens
CCCPSCCET

SEQ ID NO: 825511 - protein, 9 aa, Homo Sapiens
KKTPEPIPL

SEQ ID NO: 825512 - protein, 9 aa, Homo Sapiens
PGQPDNDID

SEQ ID NO: 825513 - protein, 9 aa, Homo Sapiens
SITQGAQRS

SEQ ID NO: 825514 - protein, 9 aa, Homo Sapiens
KVTKEKTSA

SEQ ID NO: 825515 - protein, 9 aa, Homo Sapiens
WYEHNNYKA

SEQ ID NO: 825516 - protein, 9 aa, Homo Sapiens
LMTPTASGT

SEQ ID NO: 825517 - protein, 9 aa, Homo Sapiens
KRKSEWSDK

SEQ ID NO: 825518 - protein, 9 aa, Homo Sapiens
IHFPHPNVF

SEQ ID NO: 825519 - protein, 9 aa, Homo Sapiens
LVKTAIYAM

SEQ ID NO: 825520 - protein, 9 aa, Homo Sapiens
IKQDISSLH

SEQ ID NO: 825521 - protein, 9 aa, Homo Sapiens
LHGDVWLWL

SEQ ID NO: 825522 - protein, 9 aa, Homo Sapiens
ICLSLLREQ

SEQ ID NO: 825523 - protein, 9 aa, Homo Sapiens
LLQAATPKE

SEQ ID NO: 825524 - protein, 9 aa, Homo Sapiens
KYEQFFREA

SEQ ID NO: 825525 - protein, 9 aa, Homo Sapiens
SREIQTAVH

SEQ ID NO: 825526 - protein, 9 aa, Homo Sapiens
SAKGDPLIA

SEQ ID NO: 825527 - protein, 9 aa, Homo Sapiens
GTTVLGSNS

SEQ ID NO: 825528 - protein, 9 aa, Homo Sapiens
NYSENCGPP

SEQ ID NO: 825529 - protein, 9 aa, Homo Sapiens
FLVVAILVV

SEQ ID NO: 825530 - protein, 9 aa, Homo Sapiens
LSVYLLTFL

SEQ ID NO: 825531 - protein, 9 aa, Homo Sapiens
PSTAVEFHQ

SEQ ID NO: 825532 - protein, 9 aa, Homo Sapiens
EDYTSPSEL

SEQ ID NO: 825533 - protein, 9 aa, Homo Sapiens
QVPDTVLHS

SEQ ID NO: 825534 - protein, 9 aa, Homo Sapiens
GKALESLDT

SEQ ID NO: 825535 - protein, 9 aa, Homo Sapiens
SALRMAAKN

SEQ ID NO: 825536 - protein, 9 aa, Homo Sapiens
ATTIAEAEE

SEQ ID NO: 825537 - protein, 9 aa, Homo Sapiens
VFSLNYLFR

SEQ ID NO: 825538 - protein, 9 aa, Homo Sapiens
PFSTFRRCN

SEQ ID NO: 825539 - protein, 9 aa, Homo Sapiens
LIVVSYGNI

SEQ ID NO: 825540 - protein, 9 aa, Homo Sapiens
CISKMNRLF

SEQ ID NO: 825541 - protein, 9 aa, Homo Sapiens
QNEERDGVQ

SEQ ID NO: 825542 - protein, 9 aa, Homo Sapiens
TGYHSLEEE

SEQ ID NO: 825543 - protein, 9 aa, Homo Sapiens
NPSQMDRNV

SEQ ID NO: 825544 - protein, 9 aa, Homo Sapiens
QGLVVNTGN

SEQ ID NO: 825545 - protein, 9 aa, Homo Sapiens
LNLQSRKDS

SEQ ID NO: 825546 - protein, 9 aa, Homo Sapiens
FGIRDGDKM

SEQ ID NO: 825547 - protein, 9 aa, Homo Sapiens
NIRAGYEVR

SEQ ID NO: 825548 - protein, 9 aa, Homo Sapiens
MLGAICDII

SEQ ID NO: 825549 - protein, 9 aa, Homo Sapiens
KQHKRKLKR

SEQ ID NO: 825550 - protein, 9 aa, Homo Sapiens
IMSIKLCPA

SEQ ID NO: 825551 - protein, 9 aa, Homo Sapiens
QYKEAIHAM

SEQ ID NO: 825552 - protein, 9 aa, Homo Sapiens
LNLVWEEKA

SEQ ID NO: 825553 - protein, 9 aa, Homo Sapiens
DALVDDLTR

SEQ ID NO: 825554 - protein, 9 aa, Homo Sapiens
ILTQNTHPR

SEQ ID NO: 825555 - protein, 9 aa, Homo Sapiens
PPLSRVVHL

SEQ ID NO: 825556 - protein, 9 aa, Homo Sapiens
QEAICEVDS

SEQ ID NO: 825557 - protein, 9 aa, Homo Sapiens
PGKLSLPCD

SEQ ID NO: 825558 - protein, 9 aa, Homo Sapiens
CGLCGLTIT

SEQ ID NO: 825559 - protein, 9 aa, Homo Sapiens
VTVAGFIPL

SEQ ID NO: 825560 - protein, 9 aa, Homo Sapiens
LRLHLEDRV

SEQ ID NO: 825561 - protein, 9 aa, Homo Sapiens
PSLRQNHSL

SEQ ID NO: 825562 - protein, 9 aa, Homo Sapiens
DSVEAATNA

SEQ ID NO: 825563 - protein, 9 aa, Homo Sapiens
NNTLLGQDK

SEQ ID NO: 825564 - protein, 9 aa, Homo Sapiens
LILATNISR

SEQ ID NO: 825565 - protein, 9 aa, Homo Sapiens
ARVPGLVGS

SEQ ID NO: 825566 - protein, 9 aa, Homo Sapiens
TCAKCEHKT

SEQ ID NO: 825567 - protein, 9 aa, Homo Sapiens
VIMQYFPAE

SEQ ID NO: 825568 - protein, 9 aa, Homo Sapiens
DSAGAPVDT

SEQ ID NO: 825569 - protein, 9 aa, Homo Sapiens
LKDMDIGGT

SEQ ID NO: 825570 - protein, 9 aa, Homo Sapiens
SINPLKTTP

SEQ ID NO: 825571 - protein, 9 aa, Homo Sapiens
IKDGSFNSR

SEQ ID NO: 825572 - protein, 9 aa, Homo Sapiens
YMVDPKKEA

SEQ ID NO: 825573 - protein, 9 aa, Homo Sapiens
ATDTQNVTF

SEQ ID NO: 825574 - protein, 9 aa, Homo Sapiens
HENIFLQPP

SEQ ID NO: 825575 - protein, 9 aa, Homo Sapiens
YKTEFDFSE

SEQ ID NO: 825576 - protein, 9 aa, Homo Sapiens
RVENIIWGM

SEQ ID NO: 825577 - protein, 9 aa, Homo Sapiens
SKENEEHKK

SEQ ID NO: 825578 - protein, 9 aa, Homo Sapiens
ELPLKLEAL

SEQ ID NO: 825579 - protein, 9 aa, Homo Sapiens
HSKKQAKLE

SEQ ID NO: 825580 - protein, 9 aa, Homo Sapiens
CYRQMLFCR

SEQ ID NO: 825581 - protein, 9 aa, Homo Sapiens
STPALHSAT

SEQ ID NO: 825582 - protein, 9 aa, Homo Sapiens
GHDNLQLKI

SEQ ID NO: 825583 - protein, 9 aa, Homo Sapiens
GVPGIGSGL

SEQ ID NO: 825584 - protein, 9 aa, Homo Sapiens
QDEAQTLIL

SEQ ID NO: 825585 - protein, 9 aa, Homo Sapiens
STPGVELTL

SEQ ID NO: 825586 - protein, 9 aa, Homo Sapiens
VWDSELAKL

SEQ ID NO: 825587 - protein, 9 aa, Homo Sapiens
HMRKHTGKK

SEQ ID NO: 825588 - protein, 9 aa, Homo Sapiens
CFRVDLVQA

SEQ ID NO: 825589 - protein, 9 aa, Homo Sapiens
GRIGISCIF

SEQ ID NO: 825590 - protein, 9 aa, Homo Sapiens
YQVTLHSIR

SEQ ID NO: 825591 - protein, 9 aa, Homo Sapiens
AKKHVMPFW

SEQ ID NO: 825592 - protein, 9 aa, Homo Sapiens
VILRFSVTW

SEQ ID NO: 825593 - protein, 9 aa, Homo Sapiens
MENKVSKRS

SEQ ID NO: 825594 - protein, 9 aa, Homo Sapiens
IYQRGLDIE

SEQ ID NO: 825595 - protein, 9 aa, Homo Sapiens
MSIGEGRFC

SEQ ID NO: 825596 - protein, 9 aa, Homo Sapiens
QFSRITYKM

SEQ ID NO: 825597 - protein, 9 aa, Homo Sapiens
GKVVQIIVW

SEQ ID NO: 825598 - protein, 9 aa, Homo Sapiens
DPKTGECLC

SEQ ID NO: 825599 - protein, 9 aa, Homo Sapiens
TRLFKPCCS

SEQ ID NO: 825600 - protein, 9 aa, Homo Sapiens
DYPGLFPSQ

SEQ ID NO: 825601 - protein, 9 aa, Homo Sapiens
DGVHADPEK

SEQ ID NO: 825602 - protein, 9 aa, Homo Sapiens
DTIRRQLEL

SEQ ID NO: 825603 - protein, 9 aa, Homo Sapiens
IIMRMLKLI

SEQ ID NO: 825604 - protein, 9 aa, Homo Sapiens
VMKKPSCGV

SEQ ID NO: 825605 - protein, 9 aa, Homo Sapiens
VENIKGPLF

SEQ ID NO: 825606 - protein, 9 aa, Homo Sapiens
TLLVEEIKG

SEQ ID NO: 825607 - protein, 9 aa, Homo Sapiens
VSSDDVNTF

SEQ ID NO: 825608 - protein, 9 aa, Homo Sapiens
KVLIQKHST

SEQ ID NO: 825609 - protein, 9 aa, Homo Sapiens
LPVHLQGFK

SEQ ID NO: 825610 - protein, 9 aa, Homo Sapiens
IQYIDRDPD

SEQ ID NO: 825611 - protein, 9 aa, Homo Sapiens
LSWEDIVRW

SEQ ID NO: 825612 - protein, 9 aa, Homo Sapiens
CHPQPLLHS

SEQ ID NO: 825613 - protein, 9 aa, Homo Sapiens
NQIISHFSQ

SEQ ID NO: 825614 - protein, 9 aa, Homo Sapiens
FIYSNSIRY

SEQ ID NO: 825615 - protein, 9 aa, Homo Sapiens
DVWSLSCTV

SEQ ID NO: 825616 - protein, 9 aa, Homo Sapiens
RYLGDCYKF

SEQ ID NO: 825617 - protein, 9 aa, Homo Sapiens
LTAFTALME

SEQ ID NO: 825618 - protein, 9 aa, Homo Sapiens
RKTLFLCSP

SEQ ID NO: 825619 - protein, 9 aa, Homo Sapiens
FHNTCFHCM

SEQ ID NO: 825620 - protein, 9 aa, Homo Sapiens
TGIIILTQN

SEQ ID NO: 825621 - protein, 9 aa, Homo Sapiens
MEREQKHPE

SEQ ID NO: 825622 - protein, 9 aa, Homo Sapiens
LSPPCPYEM

SEQ ID NO: 825623 - protein, 9 aa, Homo Sapiens
LLPDESIQR

SEQ ID NO: 825624 - protein, 9 aa, Homo Sapiens
TIHLALGGC

SEQ ID NO: 825625 - protein, 9 aa, Homo Sapiens
LVQAALIMG

SEQ ID NO: 825626 - protein, 9 aa, Homo Sapiens
VAHLEDYEG

SEQ ID NO: 825627 - protein, 9 aa, Homo Sapiens
DIQPEEKHE

SEQ ID NO: 825628 - protein, 9 aa, Homo Sapiens
EWQTSESGR

SEQ ID NO: 825629 - protein, 9 aa, Homo Sapiens
YYPRVSEDV

SEQ ID NO: 825630 - protein, 9 aa, Homo Sapiens
DAKGDKATV

SEQ ID NO: 825631 - protein, 9 aa, Homo Sapiens
TVPYDVVHC

SEQ ID NO: 825632 - protein, 9 aa, Homo Sapiens
LPVHGDILE

SEQ ID NO: 825633 - protein, 9 aa, Homo Sapiens
KKARSTTKK

SEQ ID NO: 825634 - protein, 9 aa, Homo Sapiens
FIEPFEEKV

SEQ ID NO: 825635 - protein, 9 aa, Homo Sapiens
IQRTEPSPA

SEQ ID NO: 825636 - protein, 9 aa, Homo Sapiens
VIYHDALQN

SEQ ID NO: 825637 - protein, 9 aa, Homo Sapiens
CNVCKSCCS

SEQ ID NO: 825638 - protein, 9 aa, Homo Sapiens
LEVKIIENA

SEQ ID NO: 825639 - protein, 9 aa, Homo Sapiens
QAIIMFPPD

SEQ ID NO: 825640 - protein, 9 aa, Homo Sapiens
GEDYLAALS

SEQ ID NO: 825641 - protein, 9 aa, Homo Sapiens
EPELLYPNI

SEQ ID NO: 825642 - protein, 9 aa, Homo Sapiens
NFQHMIELF

SEQ ID NO: 825643 - protein, 9 aa, Homo Sapiens
LRRVATLVL

SEQ ID NO: 825644 - protein, 9 aa, Homo Sapiens
NVQDKQGTS

SEQ ID NO: 825645 - protein, 9 aa, Homo Sapiens
KREKKPKNG

SEQ ID NO: 825646 - protein, 9 aa, Homo Sapiens
GSRGDLLKP

SEQ ID NO: 825647 - protein, 9 aa, Homo Sapiens
KQLLSTDAE

SEQ ID NO: 825648 - protein, 9 aa, Homo Sapiens
SQINRAYQC

SEQ ID NO: 825649 - protein, 9 aa, Homo Sapiens
TFMEKLGNG

SEQ ID NO: 825650 - protein, 9 aa, Homo Sapiens
SKIALHDCV

SEQ ID NO: 825651 - protein, 9 aa, Homo Sapiens
GDEEKYPPK

SEQ ID NO: 825652 - protein, 9 aa, Homo Sapiens
AEELEYTCA

SEQ ID NO: 825653 - protein, 9 aa, Homo Sapiens
GLSMARMEA

SEQ ID NO: 825654 - protein, 9 aa, Homo Sapiens
GHPLENNPS

SEQ ID NO: 825655 - protein, 9 aa, Homo Sapiens
KMNGRVSIR

SEQ ID NO: 825656 - protein, 9 aa, Homo Sapiens
ILNTHLSTQ

SEQ ID NO: 825657 - protein, 9 aa, Homo Sapiens
EPDTSDQTS

SEQ ID NO: 825658 - protein, 9 aa, Homo Sapiens
GSTEYLSSL

SEQ ID NO: 825659 - protein, 9 aa, Homo Sapiens
QGSYFTKKA

SEQ ID NO: 825660 - protein, 9 aa, Homo Sapiens
ALHNKRTEV

SEQ ID NO: 825661 - protein, 9 aa, Homo Sapiens
QELWRRMSV

SEQ ID NO: 825662 - protein, 9 aa, Homo Sapiens
DNSETIKNY

SEQ ID NO: 825663 - protein, 9 aa, Homo Sapiens
MRNGPDALI

SEQ ID NO: 825664 - protein, 9 aa, Homo Sapiens
KKIILPTTV

SEQ ID NO: 825665 - protein, 9 aa, Homo Sapiens
AMSTTTVTV

SEQ ID NO: 825666 - protein, 9 aa, Homo Sapiens
IQVIGKQNG

SEQ ID NO: 825667 - protein, 9 aa, Homo Sapiens
SHKQIYYSG

SEQ ID NO: 825668 - protein, 9 aa, Homo Sapiens
SFCHEQCEA

SEQ ID NO: 825669 - protein, 9 aa, Homo Sapiens
QWQKKTPEP

SEQ ID NO: 825670 - protein, 9 aa, Homo Sapiens
STEESVEVL

SEQ ID NO: 825671 - protein, 9 aa, Homo Sapiens
PQLINLKPS

SEQ ID NO: 825672 - protein, 9 aa, Homo Sapiens
KYFTEAGLN

SEQ ID NO: 825673 - protein, 9 aa, Homo Sapiens
EIGLAVILM

SEQ ID NO: 825674 - protein, 9 aa, Homo Sapiens
ASDSHQYDQ

SEQ ID NO: 825675 - protein, 9 aa, Homo Sapiens
FGRGNRGVI

SEQ ID NO: 825676 - protein, 9 aa, Homo Sapiens
SFSSDSFNF

SEQ ID NO: 825677 - protein, 9 aa, Homo Sapiens
SSCINHEKM

SEQ ID NO: 825678 - protein, 9 aa, Homo Sapiens
VSINSMLES

SEQ ID NO: 825679 - protein, 9 aa, Homo Sapiens
DDTNDGDDD

SEQ ID NO: 825680 - protein, 9 aa, Homo Sapiens
FICAGYETT

SEQ ID NO: 825681 - protein, 9 aa, Homo Sapiens
TQQDINEAK

SEQ ID NO: 825682 - protein, 9 aa, Homo Sapiens
DDDARTGAV

SEQ ID NO: 825683 - protein, 9 aa, Homo Sapiens
SRLLKEAML

SEQ ID NO: 825684 - protein, 9 aa, Homo Sapiens
KNMNRYSTF

SEQ ID NO: 825685 - protein, 9 aa, Homo Sapiens
YRHVDNIML

SEQ ID NO: 825686 - protein, 9 aa, Homo Sapiens
KWGREQLEV

SEQ ID NO: 825687 - protein, 9 aa, Homo Sapiens
LSTEAPGLI

SEQ ID NO: 825688 - protein, 9 aa, Homo Sapiens
SKSAKKKTR

SEQ ID NO: 825689 - protein, 9 aa, Homo Sapiens
RDYIKEYKF

SEQ ID NO: 825690 - protein, 9 aa, Homo Sapiens
SWFQDEEDD

SEQ ID NO: 825691 - protein, 9 aa, Homo Sapiens
ILVNWLHIY

SEQ ID NO: 825692 - protein, 9 aa, Homo Sapiens
VHEETTFEK

SEQ ID NO: 825693 - protein, 9 aa, Homo Sapiens
LPVTNTSSE

SEQ ID NO: 825694 - protein, 9 aa, Homo Sapiens
SQISDAHLA

SEQ ID NO: 825695 - protein, 9 aa, Homo Sapiens
VWKVNCYGQ

SEQ ID NO: 825696 - protein, 9 aa, Homo Sapiens
PPALARIAD

SEQ ID NO: 825697 - protein, 9 aa, Homo Sapiens
LACRDVEQG

SEQ ID NO: 825698 - protein, 9 aa, Homo Sapiens
YTNGAPLVV

SEQ ID NO: 825699 - protein, 9 aa, Homo Sapiens
TRGCSKLVD

SEQ ID NO: 825700 - protein, 9 aa, Homo Sapiens
YIIIAKPEM

SEQ ID NO: 825701 - protein, 9 aa, Homo Sapiens
QNKPYYDEA

SEQ ID NO: 825702 - protein, 9 aa, Homo Sapiens
RQEIIQHVD

SEQ ID NO: 825703 - protein, 9 aa, Homo Sapiens
TDCLTQICF

SEQ ID NO: 825704 - protein, 9 aa, Homo Sapiens
KIKFYFNRN

SEQ ID NO: 825705 - protein, 9 aa, Homo Sapiens
PAESVKILC

SEQ ID NO: 825706 - protein, 9 aa, Homo Sapiens
NGNPQQTQQ

SEQ ID NO: 825707 - protein, 9 aa, Homo Sapiens
LLLLSKATL

SEQ ID NO: 825708 - protein, 9 aa, Homo Sapiens
DELNAPQSP

SEQ ID NO: 825709 - protein, 9 aa, Homo Sapiens
KKQEKALWR

SEQ ID NO: 825710 - protein, 9 aa, Homo Sapiens
TFKMASRFP

SEQ ID NO: 825711 - protein, 9 aa, Homo Sapiens
ALLRPSIAG

SEQ ID NO: 825712 - protein, 9 aa, Homo Sapiens
PQTEEVSSK

SEQ ID NO: 825713 - protein, 9 aa, Homo Sapiens
VRVRVIILA

SEQ ID NO: 825714 - protein, 9 aa, Homo Sapiens
LTIIGRSFL

SEQ ID NO: 825715 - protein, 9 aa, Homo Sapiens
YLRKNSSAL

SEQ ID NO: 825716 - protein, 9 aa, Homo Sapiens
AETSKIKVL

SEQ ID NO: 825717 - protein, 9 aa, Homo Sapiens
TVVGPSGSR

SEQ ID NO: 825718 - protein, 9 aa, Homo Sapiens
LKHREQLIQ

SEQ ID NO: 825719 - protein, 9 aa, Homo Sapiens
PTVMSCDRY

SEQ ID NO: 825720 - protein, 9 aa, Homo Sapiens
GWNFPSMSK

SEQ ID NO: 825721 - protein, 9 aa, Homo Sapiens
LRTKVQKQQ

SEQ ID NO: 825722 - protein, 9 aa, Homo Sapiens
PMCDLYPNG

SEQ ID NO: 825723 - protein, 9 aa, Homo Sapiens
SLNGHKFDF

SEQ ID NO: 825724 - protein, 9 aa, Homo Sapiens
PPWDFLQVL

SEQ ID NO: 825725 - protein, 9 aa, Homo Sapiens
GQMDKPFLI

SEQ ID NO: 825726 - protein, 9 aa, Homo Sapiens
VFRQIANAN

SEQ ID NO: 825727 - protein, 9 aa, Homo Sapiens
EKITFQEEM

SEQ ID NO: 825728 - protein, 9 aa, Homo Sapiens
RHRNKLYVS

SEQ ID NO: 825729 - protein, 9 aa, Homo Sapiens
DRNMKNVFF

SEQ ID NO: 825730 - protein, 9 aa, Homo Sapiens
YNSEESHPY

SEQ ID NO: 825731 - protein, 9 aa, Homo Sapiens
ARCGPATQN

SEQ ID NO: 825732 - protein, 9 aa, Homo Sapiens
TLLVLGMVR

SEQ ID NO: 825733 - protein, 9 aa, Homo Sapiens
PPTPKTPPS

SEQ ID NO: 825734 - protein, 9 aa, Homo Sapiens
DKRLNATHC

SEQ ID NO: 825735 - protein, 9 aa, Homo Sapiens
KAKERDKSS

SEQ ID NO: 825736 - protein, 9 aa, Homo Sapiens
LNLCTKAIV

SEQ ID NO: 825737 - protein, 9 aa, Homo Sapiens
PELDPLHPD

SEQ ID NO: 825738 - protein, 9 aa, Homo Sapiens
RGELMHSLE

SEQ ID NO: 825739 - protein, 9 aa, Homo Sapiens
LDTEWNMFI

SEQ ID NO: 825740 - protein, 9 aa, Homo Sapiens
LLYRLWKGN

SEQ ID NO: 825741 - protein, 9 aa, Homo Sapiens
FKTRYCSML

SEQ ID NO: 825742 - protein, 9 aa, Homo Sapiens
QNLAEKTSY

SEQ ID NO: 825743 - protein, 9 aa, Homo Sapiens
CGDCKCNVC

SEQ ID NO: 825744 - protein, 9 aa, Homo Sapiens
LARHQTIHT

SEQ ID NO: 825745 - protein, 9 aa, Homo Sapiens
KNQTAEPLV

SEQ ID NO: 825746 - protein, 9 aa, Homo Sapiens
RSICMHTNK

SEQ ID NO: 825747 - protein, 9 aa, Homo Sapiens
IPLSAFNWV

SEQ ID NO: 825748 - protein, 9 aa, Homo Sapiens
ELMFSMLKT

SEQ ID NO: 825749 - protein, 9 aa, Homo Sapiens
ESCVEAQDG

SEQ ID NO: 825750 - protein, 9 aa, Homo Sapiens
WAGLSLAFS

SEQ ID NO: 825751 - protein, 9 aa, Homo Sapiens
EAKNKLSGS

SEQ ID NO: 825752 - protein, 9 aa, Homo Sapiens
YEQQQIIIR

SEQ ID NO: 825753 - protein, 9 aa, Homo Sapiens
EEFQLITSG

SEQ ID NO: 825754 - protein, 9 aa, Homo Sapiens
HLGEGSYAK

SEQ ID NO: 825755 - protein, 9 aa, Homo Sapiens
KALLEITGY

SEQ ID NO: 825756 - protein, 9 aa, Homo Sapiens
PALSQPSPP

SEQ ID NO: 825757 - protein, 9 aa, Homo Sapiens
VHCMHLHEK

SEQ ID NO: 825758 - protein, 9 aa, Homo Sapiens
LPVNYEHVT

SEQ ID NO: 825759 - protein, 9 aa, Homo Sapiens
KNQGFDSDS

SEQ ID NO: 825760 - protein, 9 aa, Homo Sapiens
VCCSLIKWL

SEQ ID NO: 825761 - protein, 9 aa, Homo Sapiens
QTDTSRGAS

SEQ ID NO: 825762 - protein, 9 aa, Homo Sapiens
LLDLGGQPV

SEQ ID NO: 825763 - protein, 9 aa, Homo Sapiens
FEIFELIHK

SEQ ID NO: 825764 - protein, 9 aa, Homo Sapiens
IESCQEDDN

SEQ ID NO: 825765 - protein, 9 aa, Homo Sapiens
TIDLRQDHP

SEQ ID NO: 825766 - protein, 9 aa, Homo Sapiens
RSEKDIGNQ

SEQ ID NO: 825767 - protein, 9 aa, Homo Sapiens
PSHVKISAS

SEQ ID NO: 825768 - protein, 9 aa, Homo Sapiens
CRYKIRLNN

SEQ ID NO: 825769 - protein, 9 aa, Homo Sapiens
FEGTSLCCG

SEQ ID NO: 825770 - protein, 9 aa, Homo Sapiens
QNLPSTGFF

SEQ ID NO: 825771 - protein, 9 aa, Homo Sapiens
YMEENNIEH

SEQ ID NO: 825772 - protein, 9 aa, Homo Sapiens
FSSKIISFK

SEQ ID NO: 825773 - protein, 9 aa, Homo Sapiens
DPLTYPTKC

SEQ ID NO: 825774 - protein, 9 aa, Homo Sapiens
FSPQLFHQD

SEQ ID NO: 825775 - protein, 9 aa, Homo Sapiens
FFVMEAIIM

SEQ ID NO: 825776 - protein, 9 aa, Homo Sapiens
QETRDGHYY

SEQ ID NO: 825777 - protein, 9 aa, Homo Sapiens
GQYPHLAPP

SEQ ID NO: 825778 - protein, 9 aa, Homo Sapiens
CFIKRVYVS

SEQ ID NO: 825779 - protein, 9 aa, Homo Sapiens
TQPVVVVVI

SEQ ID NO: 825780 - protein, 9 aa, Homo Sapiens
SNSHSMKKY

SEQ ID NO: 825781 - protein, 9 aa, Homo Sapiens
SKAGFTIIY

SEQ ID NO: 825782 - protein, 9 aa, Homo Sapiens
HFEKINSEG

SEQ ID NO: 825783 - protein, 9 aa, Homo Sapiens
NYSEAKSEN

SEQ ID NO: 825784 - protein, 9 aa, Homo Sapiens
ACTIFLFKF

SEQ ID NO: 825785 - protein, 9 aa, Homo Sapiens
GLDEAFLRL

SEQ ID NO: 825786 - protein, 9 aa, Homo Sapiens
PVIPPAALR

SEQ ID NO: 825787 - protein, 9 aa, Homo Sapiens
QNEKGQLGH

SEQ ID NO: 825788 - protein, 9 aa, Homo Sapiens
TEIGIAVQY

SEQ ID NO: 825789 - protein, 9 aa, Homo Sapiens
KDEQVRRQR

SEQ ID NO: 825790 - protein, 9 aa, Homo Sapiens
GASHFEHLC

SEQ ID NO: 825791 - protein, 9 aa, Homo Sapiens
VVSYGNIIS

SEQ ID NO: 825792 - protein, 9 aa, Homo Sapiens
ALQGEKQYY

SEQ ID NO: 825793 - protein, 9 aa, Homo Sapiens
LFECMNFLA

SEQ ID NO: 825794 - protein, 9 aa, Homo Sapiens
FNRSSHLVK

SEQ ID NO: 825795 - protein, 9 aa, Homo Sapiens
LLTLGMSLW

SEQ ID NO: 825796 - protein, 9 aa, Homo Sapiens
KPEAKATVE

SEQ ID NO: 825797 - protein, 9 aa, Homo Sapiens
TTPQNKLEC

SEQ ID NO: 825798 - protein, 9 aa, Homo Sapiens
FNTSVAPLL

SEQ ID NO: 825799 - protein, 9 aa, Homo Sapiens
AVKPAITTL

SEQ ID NO: 825800 - protein, 9 aa, Homo Sapiens
TNFHEEPQI

SEQ ID NO: 825801 - protein, 9 aa, Homo Sapiens
DKWEMEHTD

SEQ ID NO: 825802 - protein, 9 aa, Homo Sapiens
QPGKQSQEA

SEQ ID NO: 825803 - protein, 9 aa, Homo Sapiens
LQYLVEVEE

SEQ ID NO: 825804 - protein, 9 aa, Homo Sapiens
QREVEYLSK

SEQ ID NO: 825805 - protein, 9 aa, Homo Sapiens
EIDLNDWWN

SEQ ID NO: 825806 - protein, 9 aa, Homo Sapiens
ASHRNQLCY

SEQ ID NO: 825807 - protein, 9 aa, Homo Sapiens
LAKTACDEA

SEQ ID NO: 825808 - protein, 9 aa, Homo Sapiens
LGPEKNIPI

SEQ ID NO: 825809 - protein, 9 aa, Homo Sapiens
VGMSFQKAL

SEQ ID NO: 825810 - protein, 9 aa, Homo Sapiens
ESLKYAVPF

SEQ ID NO: 825811 - protein, 9 aa, Homo Sapiens
YTTCETART

SEQ ID NO: 825812 - protein, 9 aa, Homo Sapiens
KVDSHTPSL

SEQ ID NO: 825813 - protein, 9 aa, Homo Sapiens
DDYDKNKLV

SEQ ID NO: 825814 - protein, 9 aa, Homo Sapiens
KRSKQLLGE

SEQ ID NO: 825815 - protein, 9 aa, Homo Sapiens
FSTRYKFYL

SEQ ID NO: 825816 - protein, 9 aa, Homo Sapiens
LVGRVELGT

SEQ ID NO: 825817 - protein, 9 aa, Homo Sapiens
GTADVEKII

SEQ ID NO: 825818 - protein, 9 aa, Homo Sapiens
CSPQKAKII

SEQ ID NO: 825819 - protein, 9 aa, Homo Sapiens
ILCGKAFSK

SEQ ID NO: 825820 - protein, 9 aa, Homo Sapiens
KKVLLGVVG

SEQ ID NO: 825821 - protein, 9 aa, Homo Sapiens
AQLNKSLLK

SEQ ID NO: 825822 - protein, 9 aa, Homo Sapiens
IQVVPRMHE

SEQ ID NO: 825823 - protein, 9 aa, Homo Sapiens
DGIGNACDN

SEQ ID NO: 825824 - protein, 9 aa, Homo Sapiens
YLVMNDKGE

SEQ ID NO: 825825 - protein, 9 aa, Homo Sapiens
LQSRDILAG

SEQ ID NO: 825826 - protein, 9 aa, Homo Sapiens
HIEFSFHPV

SEQ ID NO: 825827 - protein, 9 aa, Homo Sapiens
HISLAYSEV

SEQ ID NO: 825828 - protein, 9 aa, Homo Sapiens
NIQQALVNR

SEQ ID NO: 825829 - protein, 9 aa, Homo Sapiens
LTQGQIHST

SEQ ID NO: 825830 - protein, 9 aa, Homo Sapiens
FQLNMYHLG

SEQ ID NO: 825831 - protein, 9 aa, Homo Sapiens
KLDIYCVQA

SEQ ID NO: 825832 - protein, 9 aa, Homo Sapiens
TLCSGSRLS

SEQ ID NO: 825833 - protein, 9 aa, Homo Sapiens
CVEHINLHP

SEQ ID NO: 825834 - protein, 9 aa, Homo Sapiens
TPTFIILGF

SEQ ID NO: 825835 - protein, 9 aa, Homo Sapiens
HGFSPRSYL

SEQ ID NO: 825836 - protein, 9 aa, Homo Sapiens
RLTRHSLGL

SEQ ID NO: 825837 - protein, 9 aa, Homo Sapiens
VSPSQIWNF

SEQ ID NO: 825838 - protein, 9 aa, Homo Sapiens
KFILRNANK

SEQ ID NO: 825839 - protein, 9 aa, Homo Sapiens
NIADNGDLR

SEQ ID NO: 825840 - protein, 9 aa, Homo Sapiens
EASKESKNG

SEQ ID NO: 825841 - protein, 9 aa, Homo Sapiens
NSIKRSRTI

SEQ ID NO: 825842 - protein, 9 aa, Homo Sapiens
SEPGEGLGG

SEQ ID NO: 825843 - protein, 9 aa, Homo Sapiens
WGTLSSLNL

SEQ ID NO: 825844 - protein, 9 aa, Homo Sapiens
CKENDFSPE

SEQ ID NO: 825845 - protein, 9 aa, Homo Sapiens
GFDLYFVLD

SEQ ID NO: 825846 - protein, 9 aa, Homo Sapiens
GVRKCCSNG

SEQ ID NO: 825847 - protein, 9 aa, Homo Sapiens
DKTCHQCIS

SEQ ID NO: 825848 - protein, 9 aa, Homo Sapiens
CDALVDDLT

SEQ ID NO: 825849 - protein, 9 aa, Homo Sapiens
NLHLIEHQK

SEQ ID NO: 825850 - protein, 9 aa, Homo Sapiens
TILIIFAVF

SEQ ID NO: 825851 - protein, 9 aa, Homo Sapiens
IKPSFVPGS

SEQ ID NO: 825852 - protein, 9 aa, Homo Sapiens
KRKAINLQT

SEQ ID NO: 825853 - protein, 9 aa, Homo Sapiens
YLSSIYESI

SEQ ID NO: 825854 - protein, 9 aa, Homo Sapiens
HKSTFSILN

SEQ ID NO: 825855 - protein, 9 aa, Homo Sapiens
NCRFEVSSY

SEQ ID NO: 825856 - protein, 9 aa, Homo Sapiens
HRILHSGEK

SEQ ID NO: 825857 - protein, 9 aa, Homo Sapiens
VDFRGKTVI

SEQ ID NO: 825858 - protein, 9 aa, Homo Sapiens
VHKLTIDNV

SEQ ID NO: 825859 - protein, 9 aa, Homo Sapiens
IMYGTNEKE

SEQ ID NO: 825860 - protein, 9 aa, Homo Sapiens
APSKLESPS

SEQ ID NO: 825861 - protein, 9 aa, Homo Sapiens
VVPKMLINF

SEQ ID NO: 825862 - protein, 9 aa, Homo Sapiens
TYTDYIFVL

SEQ ID NO: 825863 - protein, 9 aa, Homo Sapiens
FKLMRKIGK

SEQ ID NO: 825864 - protein, 9 aa, Homo Sapiens
YPGRAVPIK

SEQ ID NO: 825865 - protein, 9 aa, Homo Sapiens
SPSGYYLDA

SEQ ID NO: 825866 - protein, 9 aa, Homo Sapiens
ILLKWHVPP

SEQ ID NO: 825867 - protein, 9 aa, Homo Sapiens
AKMMGIPIQ

SEQ ID NO: 825868 - protein, 9 aa, Homo Sapiens
FFDLLSQFQ

SEQ ID NO: 825869 - protein, 9 aa, Homo Sapiens
EKSHRDKLT

SEQ ID NO: 825870 - protein, 9 aa, Homo Sapiens
LPESLPVLR

SEQ ID NO: 825871 - protein, 9 aa, Homo Sapiens
YVHVLTVTE

SEQ ID NO: 825872 - protein, 9 aa, Homo Sapiens
ALGTTVLGS

SEQ ID NO: 825873 - protein, 9 aa, Homo Sapiens
PIKGHEDYH

SEQ ID NO: 825874 - protein, 9 aa, Homo Sapiens
QMVLLPSYP

SEQ ID NO: 825875 - protein, 9 aa, Homo Sapiens
QINLHDNPW

SEQ ID NO: 825876 - protein, 9 aa, Homo Sapiens
NGDSGSLGS

SEQ ID NO: 825877 - protein, 9 aa, Homo Sapiens
IMGGDTELS

SEQ ID NO: 825878 - protein, 9 aa, Homo Sapiens
FCAGAINHI

SEQ ID NO: 825879 - protein, 9 aa, Homo Sapiens
YLFRAIQEL

SEQ ID NO: 825880 - protein, 9 aa, Homo Sapiens
FGPDGSQIP

SEQ ID NO: 825881 - protein, 9 aa, Homo Sapiens
FDFGSGINP

SEQ ID NO: 825882 - protein, 9 aa, Homo Sapiens
TTASTPMNV

SEQ ID NO: 825883 - protein, 9 aa, Homo Sapiens
VNTCRDHTS

SEQ ID NO: 825884 - protein, 9 aa, Homo Sapiens
MYLAHNYDI

SEQ ID NO: 825885 - protein, 9 aa, Homo Sapiens
CSYLSQPRN

SEQ ID NO: 825886 - protein, 9 aa, Homo Sapiens
GTLNKLSST

SEQ ID NO: 825887 - protein, 9 aa, Homo Sapiens
QDTENETMS

SEQ ID NO: 825888 - protein, 9 aa, Homo Sapiens
LYNPVNFAF

SEQ ID NO: 825889 - protein, 9 aa, Homo Sapiens
GKYSGSWNF

SEQ ID NO: 825890 - protein, 9 aa, Homo Sapiens
SLLLAPRNP

SEQ ID NO: 825891 - protein, 9 aa, Homo Sapiens
AKDDVEEDN

SEQ ID NO: 825892 - protein, 9 aa, Homo Sapiens
EWDALFDID

SEQ ID NO: 825893 - protein, 9 aa, Homo Sapiens
AEYFKGLTK

SEQ ID NO: 825894 - protein, 9 aa, Homo Sapiens
QHSAVLPGV

SEQ ID NO: 825895 - protein, 9 aa, Homo Sapiens
GNQAAGNDT

SEQ ID NO: 825896 - protein, 9 aa, Homo Sapiens
LLERLQIYR

SEQ ID NO: 825897 - protein, 9 aa, Homo Sapiens
AFVVYFDNT

SEQ ID NO: 825898 - protein, 9 aa, Homo Sapiens
MGTYNDGAT

SEQ ID NO: 825899 - protein, 9 aa, Homo Sapiens
LTANKRKLE

SEQ ID NO: 825900 - protein, 9 aa, Homo Sapiens
SALNTNIRA

SEQ ID NO: 825901 - protein, 9 aa, Homo Sapiens
NARVCISYP

SEQ ID NO: 825902 - protein, 9 aa, Homo Sapiens
KIKNTRRSI

SEQ ID NO: 825903 - protein, 9 aa, Homo Sapiens
ELDQFMKLT

SEQ ID NO: 825904 - protein, 9 aa, Homo Sapiens
IADRGHLKY

SEQ ID NO: 825905 - protein, 9 aa, Homo Sapiens
VQKSNKKMV

SEQ ID NO: 825906 - protein, 9 aa, Homo Sapiens
FQSLFQDVT

SEQ ID NO: 825907 - protein, 9 aa, Homo Sapiens
LNDGSPITY

SEQ ID NO: 825908 - protein, 9 aa, Homo Sapiens
ACIIIDRYV

SEQ ID NO: 825909 - protein, 9 aa, Homo Sapiens
LRREHDAHI

SEQ ID NO: 825910 - protein, 9 aa, Homo Sapiens
EACDLSNDA

SEQ ID NO: 825911 - protein, 9 aa, Homo Sapiens
EERSSFEIN

SEQ ID NO: 825912 - protein, 9 aa, Homo Sapiens
LFFFCLFVN

SEQ ID NO: 825913 - protein, 9 aa, Homo Sapiens
SYDDEQRTF

SEQ ID NO: 825914 - protein, 9 aa, Homo Sapiens
LAIVPQEPV

SEQ ID NO: 825915 - protein, 9 aa, Homo Sapiens
SQRYAWPLL

SEQ ID NO: 825916 - protein, 9 aa, Homo Sapiens
SHYPQLHAR

SEQ ID NO: 825917 - protein, 9 aa, Homo Sapiens
QTLKLHKSN

SEQ ID NO: 825918 - protein, 9 aa, Homo Sapiens
IIFVSYPSL

SEQ ID NO: 825919 - protein, 9 aa, Homo Sapiens
SQYMLWVTK

SEQ ID NO: 825920 - protein, 9 aa, Homo Sapiens
SEFVKKCSE

SEQ ID NO: 825921 - protein, 9 aa, Homo Sapiens
RVLFITAAW

SEQ ID NO: 825922 - protein, 9 aa, Homo Sapiens
NINAYLIAL

SEQ ID NO: 825923 - protein, 9 aa, Homo Sapiens
SHSGFSSVS

SEQ ID NO: 825924 - protein, 9 aa, Homo Sapiens
KTLLEIMDG

SEQ ID NO: 825925 - protein, 9 aa, Homo Sapiens
DKLFRRLST

SEQ ID NO: 825926 - protein, 9 aa, Homo Sapiens
AMCRRLNKH

SEQ ID NO: 825927 - protein, 9 aa, Homo Sapiens
RGRGCPPQK

SEQ ID NO: 825928 - protein, 9 aa, Homo Sapiens
FEGHFDGGP

SEQ ID NO: 825929 - protein, 9 aa, Homo Sapiens
DREGTPELH

SEQ ID NO: 825930 - protein, 9 aa, Homo Sapiens
FGPVMCKVI

SEQ ID NO: 825931 - protein, 9 aa, Homo Sapiens
QSVRKHPDC

SEQ ID NO: 825932 - protein, 9 aa, Homo Sapiens
VSPQPLQSS

SEQ ID NO: 825933 - protein, 9 aa, Homo Sapiens
QSLQKSLEA

SEQ ID NO: 825934 - protein, 9 aa, Homo Sapiens
NLRNNYFIT

SEQ ID NO: 825935 - protein, 9 aa, Homo Sapiens
ACLKMKMTF

SEQ ID NO: 825936 - protein, 9 aa, Homo Sapiens
VGFFQDIEE

SEQ ID NO: 825937 - protein, 9 aa, Homo Sapiens
IQRGVVAIP

SEQ ID NO: 825938 - protein, 9 aa, Homo Sapiens
TAWQDLYAW

SEQ ID NO: 825939 - protein, 9 aa, Homo Sapiens
KVPAPCPPC

SEQ ID NO: 825940 - protein, 9 aa, Homo Sapiens
RSRNEELGD

SEQ ID NO: 825941 - protein, 9 aa, Homo Sapiens
FLLHNPSNF

SEQ ID NO: 825942 - protein, 9 aa, Homo Sapiens
FCLLLNVQP

SEQ ID NO: 825943 - protein, 9 aa, Homo Sapiens
FDECQQNLM

SEQ ID NO: 825944 - protein, 9 aa, Homo Sapiens
PINDLSREK

SEQ ID NO: 825945 - protein, 9 aa, Homo Sapiens
VLIMDFHSV

SEQ ID NO: 825946 - protein, 9 aa, Homo Sapiens
TYIRADIDK

SEQ ID NO: 825947 - protein, 9 aa, Homo Sapiens
ATFPDNAVT

SEQ ID NO: 825948 - protein, 9 aa, Homo Sapiens
EVSESSLSA

SEQ ID NO: 825949 - protein, 9 aa, Homo Sapiens
EKMNYIGQL

SEQ ID NO: 825950 - protein, 9 aa, Homo Sapiens
KPDNLLLGS

SEQ ID NO: 825951 - protein, 9 aa, Homo Sapiens
SNPVGQMSL

SEQ ID NO: 825952 - protein, 9 aa, Homo Sapiens
GAHYWRFPN

SEQ ID NO: 825953 - protein, 9 aa, Homo Sapiens
DCKCNVCKS

SEQ ID NO: 825954 - protein, 9 aa, Homo Sapiens
CLVMAGAPN

SEQ ID NO: 825955 - protein, 9 aa, Homo Sapiens
KTLTYRGFI

SEQ ID NO: 825956 - protein, 9 aa, Homo Sapiens
CIKRPDVCG

SEQ ID NO: 825957 - protein, 9 aa, Homo Sapiens
EHQKDLKFL

SEQ ID NO: 825958 - protein, 9 aa, Homo Sapiens
ELLIYLSKG

SEQ ID NO: 825959 - protein, 9 aa, Homo Sapiens
RNKGAMVIY

SEQ ID NO: 825960 - protein, 9 aa, Homo Sapiens
ALHFQSLAG

SEQ ID NO: 825961 - protein, 9 aa, Homo Sapiens
QKFQQCYWL

SEQ ID NO: 825962 - protein, 9 aa, Homo Sapiens
DIKEANLFG

SEQ ID NO: 825963 - protein, 9 aa, Homo Sapiens
SLTESVRWI

SEQ ID NO: 825964 - protein, 9 aa, Homo Sapiens
NRDRHGHEY

SEQ ID NO: 825965 - protein, 9 aa, Homo Sapiens
EEHSEDMDT

SEQ ID NO: 825966 - protein, 9 aa, Homo Sapiens
LVRWLRRDI

SEQ ID NO: 825967 - protein, 9 aa, Homo Sapiens
HKKIYTGEK

SEQ ID NO: 825968 - protein, 9 aa, Homo Sapiens
LAEILLSHH

SEQ ID NO: 825969 - protein, 9 aa, Homo Sapiens
KDTESITGS

SEQ ID NO: 825970 - protein, 9 aa, Homo Sapiens
NYSVVEENG

SEQ ID NO: 825971 - protein, 9 aa, Homo Sapiens
EEDNGGRGG

SEQ ID NO: 825972 - protein, 9 aa, Homo Sapiens
KELFPDITR

SEQ ID NO: 825973 - protein, 9 aa, Homo Sapiens
HVLVDTLAS

SEQ ID NO: 825974 - protein, 9 aa, Homo Sapiens
LANKVMGYW

SEQ ID NO: 825975 - protein, 9 aa, Homo Sapiens
LLQPAQGCM

SEQ ID NO: 825976 - protein, 9 aa, Homo Sapiens
ASQPTNVSD

SEQ ID NO: 825977 - protein, 9 aa, Homo Sapiens
LLRKILLQK

SEQ ID NO: 825978 - protein, 9 aa, Homo Sapiens
DTYWEYTFK

SEQ ID NO: 825979 - protein, 9 aa, Homo Sapiens
FDLHLYVLV

SEQ ID NO: 825980 - protein, 9 aa, Homo Sapiens
NNATITQYQ

SEQ ID NO: 825981 - protein, 9 aa, Homo Sapiens
RDEDAVKTI

SEQ ID NO: 825982 - protein, 9 aa, Homo Sapiens
SSNTLQVSI

SEQ ID NO: 825983 - protein, 9 aa, Homo Sapiens
MKEKAKKQG

SEQ ID NO: 825984 - protein, 9 aa, Homo Sapiens
IGIEFIRKP

SEQ ID NO: 825985 - protein, 9 aa, Homo Sapiens
VQASGGRWV

SEQ ID NO: 825986 - protein, 9 aa, Homo Sapiens
DVPKKCFPE

SEQ ID NO: 825987 - protein, 9 aa, Homo Sapiens
NFENHKKLY

SEQ ID NO: 825988 - protein, 9 aa, Homo Sapiens
NDKAFSKPS

SEQ ID NO: 825989 - protein, 9 aa, Homo Sapiens
STFPHVSQM

SEQ ID NO: 825990 - protein, 9 aa, Homo Sapiens
RVTNEPTAA

SEQ ID NO: 825991 - protein, 9 aa, Homo Sapiens
FDNCQRNAS

SEQ ID NO: 825992 - protein, 9 aa, Homo Sapiens
SMFLIKCRD

SEQ ID NO: 825993 - protein, 9 aa, Homo Sapiens
GTYCEVDIY

SEQ ID NO: 825994 - protein, 9 aa, Homo Sapiens
INVRIGMQY

SEQ ID NO: 825995 - protein, 9 aa, Homo Sapiens
IDYGIKLLE

SEQ ID NO: 825996 - protein, 9 aa, Homo Sapiens
LNQLEPDPS

SEQ ID NO: 825997 - protein, 9 aa, Homo Sapiens
TNNNYSPTA

SEQ ID NO: 825998 - protein, 9 aa, Homo Sapiens
PKMSVPMRI

SEQ ID NO: 825999 - protein, 9 aa, Homo Sapiens
TEIGITFIK

SEQ ID NO: 826000 - protein, 9 aa, Homo Sapiens
KINHSRARS

SEQ ID NO: 826001 - protein, 9 aa, Homo Sapiens
LQEDYGLFR

SEQ ID NO: 826002 - protein, 9 aa, Homo Sapiens
IKLSPTYPV

SEQ ID NO: 826003 - protein, 9 aa, Homo Sapiens
TILVAVGLS

SEQ ID NO: 826004 - protein, 9 aa, Homo Sapiens
GTETVEEVA

SEQ ID NO: 826005 - protein, 9 aa, Homo Sapiens
NMFNNPATA

SEQ ID NO: 826006 - protein, 9 aa, Homo Sapiens
YRVLSPLSP

SEQ ID NO: 826007 - protein, 9 aa, Homo Sapiens
EFMVYKVPG

SEQ ID NO: 826008 - protein, 9 aa, Homo Sapiens
LHRASPHSS

SEQ ID NO: 826009 - protein, 9 aa, Homo Sapiens
FQNPNFPRR

SEQ ID NO: 826010 - protein, 9 aa, Homo Sapiens
FSSDGDLVS

SEQ ID NO: 826011 - protein, 9 aa, Homo Sapiens
LHYQPSAEL

SEQ ID NO: 826012 - protein, 9 aa, Homo Sapiens
RGIYSRHHS

SEQ ID NO: 826013 - protein, 9 aa, Homo Sapiens
VTVGEAHNL

SEQ ID NO: 826014 - protein, 9 aa, Homo Sapiens
YATSTTIAV

SEQ ID NO: 826015 - protein, 9 aa, Homo Sapiens
ATIDNAQPI

SEQ ID NO: 826016 - protein, 9 aa, Homo Sapiens
PSFVAIQAG

SEQ ID NO: 826017 - protein, 9 aa, Homo Sapiens
TSTKTRQRV

SEQ ID NO: 826018 - protein, 9 aa, Homo Sapiens
KGFVQKNGV

SEQ ID NO: 826019 - protein, 9 aa, Homo Sapiens
KRDSIGTHL

SEQ ID NO: 826020 - protein, 9 aa, Homo Sapiens
NLTRLNVPY

SEQ ID NO: 826021 - protein, 9 aa, Homo Sapiens
KDIRSCCLA

SEQ ID NO: 826022 - protein, 9 aa, Homo Sapiens
ELLEETTVV

SEQ ID NO: 826023 - protein, 9 aa, Homo Sapiens
RSNSGCVVL

SEQ ID NO: 826024 - protein, 9 aa, Homo Sapiens
AKSICCCLH

SEQ ID NO: 826025 - protein, 9 aa, Homo Sapiens
ALHLAAGGS

SEQ ID NO: 826026 - protein, 9 aa, Homo Sapiens
IYPIDVMNS

SEQ ID NO: 826027 - protein, 9 aa, Homo Sapiens
FWYHCFRPI

SEQ ID NO: 826028 - protein, 9 aa, Homo Sapiens
ESVFRQIAN

SEQ ID NO: 826029 - protein, 9 aa, Homo Sapiens
GSREIARFF

SEQ ID NO: 826030 - protein, 9 aa, Homo Sapiens
LYYKRNVNA

SEQ ID NO: 826031 - protein, 9 aa, Homo Sapiens
IPEQILSST

SEQ ID NO: 826032 - protein, 9 aa, Homo Sapiens
ASLSTAPSD

SEQ ID NO: 826033 - protein, 9 aa, Homo Sapiens
VGSFDDSFS

SEQ ID NO: 826034 - protein, 9 aa, Homo Sapiens
DLYDGFHIQ

SEQ ID NO: 826035 - protein, 9 aa, Homo Sapiens
LETTKMNIL

SEQ ID NO: 826036 - protein, 9 aa, Homo Sapiens
DPSDKRDGD

SEQ ID NO: 826037 - protein, 9 aa, Homo Sapiens
YGGFDLYFV

SEQ ID NO: 826038 - protein, 9 aa, Homo Sapiens
PYISIGKQE

SEQ ID NO: 826039 - protein, 9 aa, Homo Sapiens
YLRELSQKP

SEQ ID NO: 826040 - protein, 9 aa, Homo Sapiens
QYNSFPLLL

SEQ ID NO: 826041 - protein, 9 aa, Homo Sapiens
TATAHSALE

SEQ ID NO: 826042 - protein, 9 aa, Homo Sapiens
LHFLGKLLE

SEQ ID NO: 826043 - protein, 9 aa, Homo Sapiens
KQASIDGFD

SEQ ID NO: 826044 - protein, 9 aa, Homo Sapiens
LVLEGTIKQ

SEQ ID NO: 826045 - protein, 9 aa, Homo Sapiens
TNNADRLFR

SEQ ID NO: 826046 - protein, 9 aa, Homo Sapiens
AVLFYINMY

SEQ ID NO: 826047 - protein, 9 aa, Homo Sapiens
LDVLLADAV

SEQ ID NO: 826048 - protein, 9 aa, Homo Sapiens
AFAIERYIA

SEQ ID NO: 826049 - protein, 9 aa, Homo Sapiens
KLDISNVQS

SEQ ID NO: 826050 - protein, 9 aa, Homo Sapiens
KVIRCQVST

SEQ ID NO: 826051 - protein, 9 aa, Homo Sapiens
VITSSTINL

SEQ ID NO: 826052 - protein, 9 aa, Homo Sapiens
LPDESIQRG

SEQ ID NO: 826053 - protein, 9 aa, Homo Sapiens
TVELQFKRK

SEQ ID NO: 826054 - protein, 9 aa, Homo Sapiens
RYNMNNAIF

SEQ ID NO: 826055 - protein, 9 aa, Homo Sapiens
HSRFHEFHS

SEQ ID NO: 826056 - protein, 9 aa, Homo Sapiens
TVWDSNAHT

SEQ ID NO: 826057 - protein, 9 aa, Homo Sapiens
IHQCDVAGC

SEQ ID NO: 826058 - protein, 9 aa, Homo Sapiens
NVQFNILDP

SEQ ID NO: 826059 - protein, 9 aa, Homo Sapiens
LFPSQCQRD

SEQ ID NO: 826060 - protein, 9 aa, Homo Sapiens
ISYGIRQLI

SEQ ID NO: 826061 - protein, 9 aa, Homo Sapiens
RDSHKTIAS

SEQ ID NO: 826062 - protein, 9 aa, Homo Sapiens
AFYMPVTSM

SEQ ID NO: 826063 - protein, 9 aa, Homo Sapiens
EALRFLQNN

SEQ ID NO: 826064 - protein, 9 aa, Homo Sapiens
KFCKQERAA

SEQ ID NO: 826065 - protein, 9 aa, Homo Sapiens
YPPTTKPLT

SEQ ID NO: 826066 - protein, 9 aa, Homo Sapiens
ISPESLSCT

SEQ ID NO: 826067 - protein, 9 aa, Homo Sapiens
TLLAPKETN

SEQ ID NO: 826068 - protein, 9 aa, Homo Sapiens
GHISDHYNC

SEQ ID NO: 826069 - protein, 9 aa, Homo Sapiens
TQKKISHYM

SEQ ID NO: 826070 - protein, 9 aa, Homo Sapiens
VQALGIISQ

SEQ ID NO: 826071 - protein, 9 aa, Homo Sapiens
VCTSLTQSE

SEQ ID NO: 826072 - protein, 9 aa, Homo Sapiens
VETEHLEER

SEQ ID NO: 826073 - protein, 9 aa, Homo Sapiens
AYDNACQIK

SEQ ID NO: 826074 - protein, 9 aa, Homo Sapiens
VQDFGKVIS

SEQ ID NO: 826075 - protein, 9 aa, Homo Sapiens
GRVHFKSNN

SEQ ID NO: 826076 - protein, 9 aa, Homo Sapiens
FLATVIHTL

SEQ ID NO: 826077 - protein, 9 aa, Homo Sapiens
NLNYLDEQE

SEQ ID NO: 826078 - protein, 9 aa, Homo Sapiens
ILRVTNEPT

SEQ ID NO: 826079 - protein, 9 aa, Homo Sapiens
NNRYSHNEL

SEQ ID NO: 826080 - protein, 9 aa, Homo Sapiens
KFYIYYLCL

SEQ ID NO: 826081 - protein, 9 aa, Homo Sapiens
MQGNNKYGQ

SEQ ID NO: 826082 - protein, 9 aa, Homo Sapiens
KEKAILISY

SEQ ID NO: 826083 - protein, 9 aa, Homo Sapiens
HTRTHSGEK

SEQ ID NO: 826084 - protein, 9 aa, Homo Sapiens
EKCTLCLSM

SEQ ID NO: 826085 - protein, 9 aa, Homo Sapiens
KEEELRQKA

SEQ ID NO: 826086 - protein, 9 aa, Homo Sapiens
EPTNISTDR

SEQ ID NO: 826087 - protein, 9 aa, Homo Sapiens
ALGCRKAMT

SEQ ID NO: 826088 - protein, 9 aa, Homo Sapiens
AIRRTIGQT

SEQ ID NO: 826089 - protein, 9 aa, Homo Sapiens
AICFSIASP

SEQ ID NO: 826090 - protein, 9 aa, Homo Sapiens
GSRMLHVVQ

SEQ ID NO: 826091 - protein, 9 aa, Homo Sapiens
SGLLREKYF

SEQ ID NO: 826092 - protein, 9 aa, Homo Sapiens
PIINKTQNV

SEQ ID NO: 826093 - protein, 9 aa, Homo Sapiens
SSLFHPEKL

SEQ ID NO: 826094 - protein, 9 aa, Homo Sapiens
ESRYAFVVP

SEQ ID NO: 826095 - protein, 9 aa, Homo Sapiens
KTPIFQANQ

SEQ ID NO: 826096 - protein, 9 aa, Homo Sapiens
WPPKEHARA

SEQ ID NO: 826097 - protein, 9 aa, Homo Sapiens
NGRAQYTFQ

SEQ ID NO: 826098 - protein, 9 aa, Homo Sapiens
SAGDHAHGL

SEQ ID NO: 826099 - protein, 9 aa, Homo Sapiens
EEVSESSLS

SEQ ID NO: 826100 - protein, 9 aa, Homo Sapiens
KFVKNMNRY

SEQ ID NO: 826101 - protein, 9 aa, Homo Sapiens
SFAATVVVP

SEQ ID NO: 826102 - protein, 9 aa, Homo Sapiens
TQQAQDQQV

SEQ ID NO: 826103 - protein, 9 aa, Homo Sapiens
DLFLSLVAV

SEQ ID NO: 826104 - protein, 9 aa, Homo Sapiens
VENLYRRHC

SEQ ID NO: 826105 - protein, 9 aa, Homo Sapiens
ALSFMNVVD

SEQ ID NO: 826106 - protein, 9 aa, Homo Sapiens
NPDSEQDKN

SEQ ID NO: 826107 - protein, 9 aa, Homo Sapiens
TLNHVIYGV

SEQ ID NO: 826108 - protein, 9 aa, Homo Sapiens
TMFFQNISL

SEQ ID NO: 826109 - protein, 9 aa, Homo Sapiens
TEHLEERVA

SEQ ID NO: 826110 - protein, 9 aa, Homo Sapiens
KKFETQKYI

SEQ ID NO: 826111 - protein, 9 aa, Homo Sapiens
PDSVLKMEE

SEQ ID NO: 826112 - protein, 9 aa, Homo Sapiens
SRINYSGES

SEQ ID NO: 826113 - protein, 9 aa, Homo Sapiens
YADKELVQS

SEQ ID NO: 826114 - protein, 9 aa, Homo Sapiens
CLTRHILLP

SEQ ID NO: 826115 - protein, 9 aa, Homo Sapiens
QSGESKSSA

SEQ ID NO: 826116 - protein, 9 aa, Homo Sapiens
SNTPKELTV

SEQ ID NO: 826117 - protein, 9 aa, Homo Sapiens
YYLGCHQWV

SEQ ID NO: 826118 - protein, 9 aa, Homo Sapiens
GNSGEEVVP

SEQ ID NO: 826119 - protein, 9 aa, Homo Sapiens
VEAQDGELD

SEQ ID NO: 826120 - protein, 9 aa, Homo Sapiens
VQECVSELI

SEQ ID NO: 826121 - protein, 9 aa, Homo Sapiens
RGRHAVRVA

SEQ ID NO: 826122 - protein, 9 aa, Homo Sapiens
KPIFCLFAD

SEQ ID NO: 826123 - protein, 9 aa, Homo Sapiens
FERNPSDNS

SEQ ID NO: 826124 - protein, 9 aa, Homo Sapiens
DNKVTWGAR

SEQ ID NO: 826125 - protein, 9 aa, Homo Sapiens
YIKWTQIEK

SEQ ID NO: 826126 - protein, 9 aa, Homo Sapiens
TCQLKCQWL

SEQ ID NO: 826127 - protein, 9 aa, Homo Sapiens
MFYVVHQAQ

SEQ ID NO: 826128 - protein, 9 aa, Homo Sapiens
LMPFHHRPS

SEQ ID NO: 826129 - protein, 9 aa, Homo Sapiens
NQQSQSSDP

SEQ ID NO: 826130 - protein, 9 aa, Homo Sapiens
IAATIDNAQ

SEQ ID NO: 826131 - protein, 9 aa, Homo Sapiens
VSRYLGVSS

SEQ ID NO: 826132 - protein, 9 aa, Homo Sapiens
LNGKTMTKM

SEQ ID NO: 826133 - protein, 9 aa, Homo Sapiens
AIQSFQVAL

SEQ ID NO: 826134 - protein, 9 aa, Homo Sapiens
REHAGCIFR

SEQ ID NO: 826135 - protein, 9 aa, Homo Sapiens
LSQALRGTL

SEQ ID NO: 826136 - protein, 9 aa, Homo Sapiens
GMKRWIIPA

SEQ ID NO: 826137 - protein, 9 aa, Homo Sapiens
LPKYLIYGP

SEQ ID NO: 826138 - protein, 9 aa, Homo Sapiens
QTCGNVAHT

SEQ ID NO: 826139 - protein, 9 aa, Homo Sapiens
VKVKDTHKK

SEQ ID NO: 826140 - protein, 9 aa, Homo Sapiens
PMEPPMNKR

SEQ ID NO: 826141 - protein, 9 aa, Homo Sapiens
NLIKKLCRG

SEQ ID NO: 826142 - protein, 9 aa, Homo Sapiens
EYNGFWKIP

SEQ ID NO: 826143 - protein, 9 aa, Homo Sapiens
AEIHPNHPF

SEQ ID NO: 826144 - protein, 9 aa, Homo Sapiens
NRVCMFGPD

SEQ ID NO: 826145 - protein, 9 aa, Homo Sapiens
PTVKPRETR

SEQ ID NO: 826146 - protein, 9 aa, Homo Sapiens
KTDSIEILG

SEQ ID NO: 826147 - protein, 9 aa, Homo Sapiens
AKIKEEIIK

SEQ ID NO: 826148 - protein, 9 aa, Homo Sapiens
NDSDYAIDD

SEQ ID NO: 826149 - protein, 9 aa, Homo Sapiens
DLLGPNQTG

SEQ ID NO: 826150 - protein, 9 aa, Homo Sapiens
IIDKLTKEL

SEQ ID NO: 826151 - protein, 9 aa, Homo Sapiens
QRVGVPKGA

SEQ ID NO: 826152 - protein, 9 aa, Homo Sapiens
EYLDLNFNQ

SEQ ID NO: 826153 - protein, 9 aa, Homo Sapiens
DNNEAVILR

SEQ ID NO: 826154 - protein, 9 aa, Homo Sapiens
RSIQDIKAL

SEQ ID NO: 826155 - protein, 9 aa, Homo Sapiens
DKREGYERL

SEQ ID NO: 826156 - protein, 9 aa, Homo Sapiens
KDEVAKSTH

SEQ ID NO: 826157 - protein, 9 aa, Homo Sapiens
VDGRLSIHQ

SEQ ID NO: 826158 - protein, 9 aa, Homo Sapiens
QRHMVVKGG

SEQ ID NO: 826159 - protein, 9 aa, Homo Sapiens
DFVQKYLGE

SEQ ID NO: 826160 - protein, 9 aa, Homo Sapiens
LTVVAMHYS

SEQ ID NO: 826161 - protein, 9 aa, Homo Sapiens
FINDATNVN

SEQ ID NO: 826162 - protein, 9 aa, Homo Sapiens
REMLEAGPE

SEQ ID NO: 826163 - protein, 9 aa, Homo Sapiens
TRQIYGKRS

SEQ ID NO: 826164 - protein, 9 aa, Homo Sapiens
LSCAGRYSE

SEQ ID NO: 826165 - protein, 9 aa, Homo Sapiens
YDIDIDTET

SEQ ID NO: 826166 - protein, 9 aa, Homo Sapiens
HFDPDNFDK

SEQ ID NO: 826167 - protein, 9 aa, Homo Sapiens
LVVDGVKFM

SEQ ID NO: 826168 - protein, 9 aa, Homo Sapiens
TFYLVADTR

SEQ ID NO: 826169 - protein, 9 aa, Homo Sapiens
NSCIDCNPA

SEQ ID NO: 826170 - protein, 9 aa, Homo Sapiens
RLHFPIKPS

SEQ ID NO: 826171 - protein, 9 aa, Homo Sapiens
DRRCTKLDM

SEQ ID NO: 826172 - protein, 9 aa, Homo Sapiens
GQGSERKKW

SEQ ID NO: 826173 - protein, 9 aa, Homo Sapiens
DNINPPALV

SEQ ID NO: 826174 - protein, 9 aa, Homo Sapiens
LLLAVFNKA

SEQ ID NO: 826175 - protein, 9 aa, Homo Sapiens
SQNIIEINV

SEQ ID NO: 826176 - protein, 9 aa, Homo Sapiens
SRSSTLVQH

SEQ ID NO: 826177 - protein, 9 aa, Homo Sapiens
IVTGGKVAD

SEQ ID NO: 826178 - protein, 9 aa, Homo Sapiens
NCEKMLDNG

SEQ ID NO: 826179 - protein, 9 aa, Homo Sapiens
DPKPAIHFR

SEQ ID NO: 826180 - protein, 9 aa, Homo Sapiens
EHQLRHADI

SEQ ID NO: 826181 - protein, 9 aa, Homo Sapiens
RMLGAVQML

SEQ ID NO: 826182 - protein, 9 aa, Homo Sapiens
GALKLASQN

SEQ ID NO: 826183 - protein, 9 aa, Homo Sapiens
IHQIKRTAG

SEQ ID NO: 826184 - protein, 9 aa, Homo Sapiens
IQSSFVAPL

SEQ ID NO: 826185 - protein, 9 aa, Homo Sapiens
KCGYENVQL

SEQ ID NO: 826186 - protein, 9 aa, Homo Sapiens
HFSQWEMKD

SEQ ID NO: 826187 - protein, 9 aa, Homo Sapiens
HSSSLFKTS

SEQ ID NO: 826188 - protein, 9 aa, Homo Sapiens
FWSSILFNL

SEQ ID NO: 826189 - protein, 9 aa, Homo Sapiens
AKAEGRWNL

SEQ ID NO: 826190 - protein, 9 aa, Homo Sapiens
KKSCGRVQP

SEQ ID NO: 826191 - protein, 9 aa, Homo Sapiens
ARFVAKSGA

SEQ ID NO: 826192 - protein, 9 aa, Homo Sapiens
RNMDFGVFI

SEQ ID NO: 826193 - protein, 9 aa, Homo Sapiens
QFGFNNEKF

SEQ ID NO: 826194 - protein, 9 aa, Homo Sapiens
KLSMNNNII

SEQ ID NO: 826195 - protein, 9 aa, Homo Sapiens
DHTGNKPYA

SEQ ID NO: 826196 - protein, 9 aa, Homo Sapiens
TFSKNCNLR

SEQ ID NO: 826197 - protein, 9 aa, Homo Sapiens
SKTQTLPYR

SEQ ID NO: 826198 - protein, 9 aa, Homo Sapiens
AIYLLRDAI

SEQ ID NO: 826199 - protein, 9 aa, Homo Sapiens
VDPYLPYKY

SEQ ID NO: 826200 - protein, 9 aa, Homo Sapiens
RLGKHLQFP

SEQ ID NO: 826201 - protein, 9 aa, Homo Sapiens
TIIKARNVK

SEQ ID NO: 826202 - protein, 9 aa, Homo Sapiens
KYNGLLHCL

SEQ ID NO: 826203 - protein, 9 aa, Homo Sapiens
IELPEKLEE

SEQ ID NO: 826204 - protein, 9 aa, Homo Sapiens
FHMKGKENL

SEQ ID NO: 826205 - protein, 9 aa, Homo Sapiens
QTNVFAICF

SEQ ID NO: 826206 - protein, 9 aa, Homo Sapiens
AAALLASHT

SEQ ID NO: 826207 - protein, 9 aa, Homo Sapiens
DNVFLCLME

SEQ ID NO: 826208 - protein, 9 aa, Homo Sapiens
YCCYLYACG

SEQ ID NO: 826209 - protein, 9 aa, Homo Sapiens
STKISALCI

SEQ ID NO: 826210 - protein, 9 aa, Homo Sapiens
YTSYSDESE

SEQ ID NO: 826211 - protein, 9 aa, Homo Sapiens
NDQGLYSWL

SEQ ID NO: 826212 - protein, 9 aa, Homo Sapiens
QLCQFVMDN

SEQ ID NO: 826213 - protein, 9 aa, Homo Sapiens
QVDPYLPYK

SEQ ID NO: 826214 - protein, 9 aa, Homo Sapiens
KSGELRKDI

SEQ ID NO: 826215 - protein, 9 aa, Homo Sapiens
RYTQSPMYR

SEQ ID NO: 826216 - protein, 9 aa, Homo Sapiens
SKCEECGKV

SEQ ID NO: 826217 - protein, 9 aa, Homo Sapiens
NGSHFFFTL

SEQ ID NO: 826218 - protein, 9 aa, Homo Sapiens
FIRANPGKI

SEQ ID NO: 826219 - protein, 9 aa, Homo Sapiens
CIIIDRYVA

SEQ ID NO: 826220 - protein, 9 aa, Homo Sapiens
TFYFENLLS

SEQ ID NO: 826221 - protein, 9 aa, Homo Sapiens
QNPKEVFSE

SEQ ID NO: 826222 - protein, 9 aa, Homo Sapiens
TNFTINMVT

SEQ ID NO: 826223 - protein, 9 aa, Homo Sapiens
EIKRRYHFD

SEQ ID NO: 826224 - protein, 9 aa, Homo Sapiens
PPYISKAKG

SEQ ID NO: 826225 - protein, 9 aa, Homo Sapiens
DNLQSLTEG

SEQ ID NO: 826226 - protein, 9 aa, Homo Sapiens
NAPEISSNV

SEQ ID NO: 826227 - protein, 9 aa, Homo Sapiens
CDHQAAQLS

SEQ ID NO: 826228 - protein, 9 aa, Homo Sapiens
LTLRLPSYM

SEQ ID NO: 826229 - protein, 9 aa, Homo Sapiens
DMGGPLPAD

SEQ ID NO: 826230 - protein, 9 aa, Homo Sapiens
QAETMKKKL

SEQ ID NO: 826231 - protein, 9 aa, Homo Sapiens
NVFNLNEIK

SEQ ID NO: 826232 - protein, 9 aa, Homo Sapiens
TLLNIPRNA

SEQ ID NO: 826233 - protein, 9 aa, Homo Sapiens
QDKQRNRFF

SEQ ID NO: 826234 - protein, 9 aa, Homo Sapiens
NPREGKQTW

SEQ ID NO: 826235 - protein, 9 aa, Homo Sapiens
ESKEGACIV

SEQ ID NO: 826236 - protein, 9 aa, Homo Sapiens
YSVNMVTLQ

SEQ ID NO: 826237 - protein, 9 aa, Homo Sapiens
KMKERWEND

SEQ ID NO: 826238 - protein, 9 aa, Homo Sapiens
KMLKCDKFP

SEQ ID NO: 826239 - protein, 9 aa, Homo Sapiens
PVAVPHGKE

SEQ ID NO: 826240 - protein, 9 aa, Homo Sapiens
QVEKLAKYL

SEQ ID NO: 826241 - protein, 9 aa, Homo Sapiens
ERMSSTTVY

SEQ ID NO: 826242 - protein, 9 aa, Homo Sapiens
IITYLSDQI

SEQ ID NO: 826243 - protein, 9 aa, Homo Sapiens
TKGRGSPEE

SEQ ID NO: 826244 - protein, 9 aa, Homo Sapiens
LPAPPNIYF

SEQ ID NO: 826245 - protein, 9 aa, Homo Sapiens
VCDINKRLC

SEQ ID NO: 826246 - protein, 9 aa, Homo Sapiens
LIAMPQLFM

SEQ ID NO: 826247 - protein, 9 aa, Homo Sapiens
AQSINYTDC

SEQ ID NO: 826248 - protein, 9 aa, Homo Sapiens
RQAKRPAAP

SEQ ID NO: 826249 - protein, 9 aa, Homo Sapiens
NASKDESDS

SEQ ID NO: 826250 - protein, 9 aa, Homo Sapiens
EASYMTSDR

SEQ ID NO: 826251 - protein, 9 aa, Homo Sapiens
DRHGHEYYG

SEQ ID NO: 826252 - protein, 9 aa, Homo Sapiens
VFMTPEYFV

SEQ ID NO: 826253 - protein, 9 aa, Homo Sapiens
DITKEDLIQ

SEQ ID NO: 826254 - protein, 9 aa, Homo Sapiens
HKFDFIHDV

SEQ ID NO: 826255 - protein, 9 aa, Homo Sapiens
KELFGGVSG

SEQ ID NO: 826256 - protein, 9 aa, Homo Sapiens
RQSKINEGY

SEQ ID NO: 826257 - protein, 9 aa, Homo Sapiens
YTCDTEFRQ

SEQ ID NO: 826258 - protein, 9 aa, Homo Sapiens
LLAEGCLLN

SEQ ID NO: 826259 - protein, 9 aa, Homo Sapiens
MSKLKQQNE

SEQ ID NO: 826260 - protein, 9 aa, Homo Sapiens
ISSITKRIT

SEQ ID NO: 826261 - protein, 9 aa, Homo Sapiens
KKIVYSIVS

SEQ ID NO: 826262 - protein, 9 aa, Homo Sapiens
FSLILHQKT

SEQ ID NO: 826263 - protein, 9 aa, Homo Sapiens
GCNVCTFQK

SEQ ID NO: 826264 - protein, 9 aa, Homo Sapiens
NFLTGLGHI

SEQ ID NO: 826265 - protein, 9 aa, Homo Sapiens
PGRLKTVQG

SEQ ID NO: 826266 - protein, 9 aa, Homo Sapiens
ILDYHNQVW

SEQ ID NO: 826267 - protein, 9 aa, Homo Sapiens
AASRRRNAP

SEQ ID NO: 826268 - protein, 9 aa, Homo Sapiens
DSLSVPHRH

SEQ ID NO: 826269 - protein, 9 aa, Homo Sapiens
LYQENIEAQ

SEQ ID NO: 826270 - protein, 9 aa, Homo Sapiens
LELFAVVMG

SEQ ID NO: 826271 - protein, 9 aa, Homo Sapiens
NARQVVCDT

SEQ ID NO: 826272 - protein, 9 aa, Homo Sapiens
GATGLPHLD

SEQ ID NO: 826273 - protein, 9 aa, Homo Sapiens
TKKKSDPLA

SEQ ID NO: 826274 - protein, 9 aa, Homo Sapiens
SHLSRLPLG

SEQ ID NO: 826275 - protein, 9 aa, Homo Sapiens
CRYPVLIIE

SEQ ID NO: 826276 - protein, 9 aa, Homo Sapiens
LGLRKLVDV

SEQ ID NO: 826277 - protein, 9 aa, Homo Sapiens
QVDKLVELQ

SEQ ID NO: 826278 - protein, 9 aa, Homo Sapiens
KSTQIYLKR

SEQ ID NO: 826279 - protein, 9 aa, Homo Sapiens
AKVRYAMGA

SEQ ID NO: 826280 - protein, 9 aa, Homo Sapiens
KNNSYIKAF

SEQ ID NO: 826281 - protein, 9 aa, Homo Sapiens
PVTPCSSRP

SEQ ID NO: 826282 - protein, 9 aa, Homo Sapiens
AISGNETQH

SEQ ID NO: 826283 - protein, 9 aa, Homo Sapiens
KCDKLFRRL

SEQ ID NO: 826284 - protein, 9 aa, Homo Sapiens
SYQHEALRR

SEQ ID NO: 826285 - protein, 9 aa, Homo Sapiens
AVDLPVPSG

SEQ ID NO: 826286 - protein, 9 aa, Homo Sapiens
REITFPPAS

SEQ ID NO: 826287 - protein, 9 aa, Homo Sapiens
NFSNYIFLY

SEQ ID NO: 826288 - protein, 9 aa, Homo Sapiens
KDPAAIPKD

SEQ ID NO: 826289 - protein, 9 aa, Homo Sapiens
CFELLEETT

SEQ ID NO: 826290 - protein, 9 aa, Homo Sapiens
SKLLSYFMF

SEQ ID NO: 826291 - protein, 9 aa, Homo Sapiens
EDPDWRDFF

SEQ ID NO: 826292 - protein, 9 aa, Homo Sapiens
VKEELSNIA

SEQ ID NO: 826293 - protein, 9 aa, Homo Sapiens
LRDYIKEYK

SEQ ID NO: 826294 - protein, 9 aa, Homo Sapiens
RRIDTKENN

SEQ ID NO: 826295 - protein, 9 aa, Homo Sapiens
CGDTEAWTT

SEQ ID NO: 826296 - protein, 9 aa, Homo Sapiens
TLQSFGTEE

SEQ ID NO: 826297 - protein, 9 aa, Homo Sapiens
YRKCGYENV

SEQ ID NO: 826298 - protein, 9 aa, Homo Sapiens
PAKELMVKL

SEQ ID NO: 826299 - protein, 9 aa, Homo Sapiens
NLLHLVDQE

SEQ ID NO: 826300 - protein, 9 aa, Homo Sapiens
WRAHEALQT

SEQ ID NO: 826301 - protein, 9 aa, Homo Sapiens
YFEVTQCNC

SEQ ID NO: 826302 - protein, 9 aa, Homo Sapiens
DVSRPVATH

SEQ ID NO: 826303 - protein, 9 aa, Homo Sapiens
ISCLLNICQ

SEQ ID NO: 826304 - protein, 9 aa, Homo Sapiens
SDKTSKQMA

SEQ ID NO: 826305 - protein, 9 aa, Homo Sapiens
TLGMSLWNQ

SEQ ID NO: 826306 - protein, 9 aa, Homo Sapiens
WCLEHGEHG

SEQ ID NO: 826307 - protein, 9 aa, Homo Sapiens
GRRWHVLSR

SEQ ID NO: 826308 - protein, 9 aa, Homo Sapiens
TLSELNALM

SEQ ID NO: 826309 - protein, 9 aa, Homo Sapiens
DNECSGVRK

SEQ ID NO: 826310 - protein, 9 aa, Homo Sapiens
LIYYKSYMD

SEQ ID NO: 826311 - protein, 9 aa, Homo Sapiens
FSNVLTFYR

SEQ ID NO: 826312 - protein, 9 aa, Homo Sapiens
SASVPPLAL

SEQ ID NO: 826313 - protein, 9 aa, Homo Sapiens
VHRKASVIM

SEQ ID NO: 826314 - protein, 9 aa, Homo Sapiens
EDKGNCKED

SEQ ID NO: 826315 - protein, 9 aa, Homo Sapiens
LRNGEATGR

SEQ ID NO: 826316 - protein, 9 aa, Homo Sapiens
LLSSLGHTS

SEQ ID NO: 826317 - protein, 9 aa, Homo Sapiens
LVEIEQKCK

SEQ ID NO: 826318 - protein, 9 aa, Homo Sapiens
EFDKIIHRL

SEQ ID NO: 826319 - protein, 9 aa, Homo Sapiens
CLYQCYLIV

SEQ ID NO: 826320 - protein, 9 aa, Homo Sapiens
IISVPPQPP

SEQ ID NO: 826321 - protein, 9 aa, Homo Sapiens
GSPGHTVYA

SEQ ID NO: 826322 - protein, 9 aa, Homo Sapiens
DCDDMDSPQ

SEQ ID NO: 826323 - protein, 9 aa, Homo Sapiens
LMFMYLQPS

SEQ ID NO: 826324 - protein, 9 aa, Homo Sapiens
GKQEPGDNS

SEQ ID NO: 826325 - protein, 9 aa, Homo Sapiens
IVHQPWILP

SEQ ID NO: 826326 - protein, 9 aa, Homo Sapiens
FCKHEDYMQ

SEQ ID NO: 826327 - protein, 9 aa, Homo Sapiens
GKAFSDLYY

SEQ ID NO: 826328 - protein, 9 aa, Homo Sapiens
CSFTKDAHA

SEQ ID NO: 826329 - protein, 9 aa, Homo Sapiens
MVRPIISLY

SEQ ID NO: 826330 - protein, 9 aa, Homo Sapiens
LSLAKVRYA

SEQ ID NO: 826331 - protein, 9 aa, Homo Sapiens
QALCSIYGS

SEQ ID NO: 826332 - protein, 9 aa, Homo Sapiens
VDLDGELPS

SEQ ID NO: 826333 - protein, 9 aa, Homo Sapiens
LFEHHPIPQ

SEQ ID NO: 826334 - protein, 9 aa, Homo Sapiens
GLINHQIIH

SEQ ID NO: 826335 - protein, 9 aa, Homo Sapiens
KRTKLSPVA

SEQ ID NO: 826336 - protein, 9 aa, Homo Sapiens
DAKTTITVP

SEQ ID NO: 826337 - protein, 9 aa, Homo Sapiens
EAEVLQAAL

SEQ ID NO: 826338 - protein, 9 aa, Homo Sapiens
TAIVHMHRF

SEQ ID NO: 826339 - protein, 9 aa, Homo Sapiens
TLDVMKKPS

SEQ ID NO: 826340 - protein, 9 aa, Homo Sapiens
GAMVWGLDL

SEQ ID NO: 826341 - protein, 9 aa, Homo Sapiens
KGTQVWKNK

SEQ ID NO: 826342 - protein, 9 aa, Homo Sapiens
SVKHNPLPL

SEQ ID NO: 826343 - protein, 9 aa, Homo Sapiens
EKCIKHIAL

SEQ ID NO: 826344 - protein, 9 aa, Homo Sapiens
HAEQDKFLT

SEQ ID NO: 826345 - protein, 9 aa, Homo Sapiens
LVKRAKKEC

SEQ ID NO: 826346 - protein, 9 aa, Homo Sapiens
PAAEPSASA

SEQ ID NO: 826347 - protein, 9 aa, Homo Sapiens
LAKDSDKLK

SEQ ID NO: 826348 - protein, 9 aa, Homo Sapiens
VSDLTQTAN

SEQ ID NO: 826349 - protein, 9 aa, Homo Sapiens
TYDLSKSGC

SEQ ID NO: 826350 - protein, 9 aa, Homo Sapiens
YVWAQLNRY

SEQ ID NO: 826351 - protein, 9 aa, Homo Sapiens
LLSCLLRHR

SEQ ID NO: 826352 - protein, 9 aa, Homo Sapiens
YVPPSCCSG

SEQ ID NO: 826353 - protein, 9 aa, Homo Sapiens
LLFTSNSLS

SEQ ID NO: 826354 - protein, 9 aa, Homo Sapiens
LFVIAYPSH

SEQ ID NO: 826355 - protein, 9 aa, Homo Sapiens
DVLGKKSNN

SEQ ID NO: 826356 - protein, 9 aa, Homo Sapiens
RCLETKVGT

SEQ ID NO: 826357 - protein, 9 aa, Homo Sapiens
DEWERCQSF

SEQ ID NO: 826358 - protein, 9 aa, Homo Sapiens
LRKDLDELM

SEQ ID NO: 826359 - protein, 9 aa, Homo Sapiens
NLQKEKSKV

SEQ ID NO: 826360 - protein, 9 aa, Homo Sapiens
PLMPFHHRP

SEQ ID NO: 826361 - protein, 9 aa, Homo Sapiens
LVSDEPSTK

SEQ ID NO: 826362 - protein, 9 aa, Homo Sapiens
DMDTFSGLF

SEQ ID NO: 826363 - protein, 9 aa, Homo Sapiens
SGIFWSNYH

SEQ ID NO: 826364 - protein, 9 aa, Homo Sapiens
EARGTPQPS

SEQ ID NO: 826365 - protein, 9 aa, Homo Sapiens
YQPQSSYSV

SEQ ID NO: 826366 - protein, 9 aa, Homo Sapiens
VEKFLKRAD

SEQ ID NO: 826367 - protein, 9 aa, Homo Sapiens
GDIKLSIPV

SEQ ID NO: 826368 - protein, 9 aa, Homo Sapiens
LTYNLKKLP

SEQ ID NO: 826369 - protein, 9 aa, Homo Sapiens
SNFIGRLQS

SEQ ID NO: 826370 - protein, 9 aa, Homo Sapiens
NRDPQQAFQ

SEQ ID NO: 826371 - protein, 9 aa, Homo Sapiens
KSEYFIKQM

SEQ ID NO: 826372 - protein, 9 aa, Homo Sapiens
QAKTHMMSA

SEQ ID NO: 826373 - protein, 9 aa, Homo Sapiens
LNDLKITGE

SEQ ID NO: 826374 - protein, 9 aa, Homo Sapiens
EGLWAWGVE

SEQ ID NO: 826375 - protein, 9 aa, Homo Sapiens
VDSDLLGWW

SEQ ID NO: 826376 - protein, 9 aa, Homo Sapiens
VHGNLELVV

SEQ ID NO: 826377 - protein, 9 aa, Homo Sapiens
NYTDCLTQI

SEQ ID NO: 826378 - protein, 9 aa, Homo Sapiens
PKKSGILLD

SEQ ID NO: 826379 - protein, 9 aa, Homo Sapiens
VIITAYNVW

SEQ ID NO: 826380 - protein, 9 aa, Homo Sapiens
GACIVRDSR

SEQ ID NO: 826381 - protein, 9 aa, Homo Sapiens
LLPVRGFGW

SEQ ID NO: 826382 - protein, 9 aa, Homo Sapiens
NTKEVAHRI

SEQ ID NO: 826383 - protein, 9 aa, Homo Sapiens
HPGIQRTAY

SEQ ID NO: 826384 - protein, 9 aa, Homo Sapiens
DALFNESSA

SEQ ID NO: 826385 - protein, 9 aa, Homo Sapiens
SKMKAPVLP

SEQ ID NO: 826386 - protein, 9 aa, Homo Sapiens
PPIVESLGF

SEQ ID NO: 826387 - protein, 9 aa, Homo Sapiens
VGVHGIQIE

SEQ ID NO: 826388 - protein, 9 aa, Homo Sapiens
LFEYTSNKE

SEQ ID NO: 826389 - protein, 9 aa, Homo Sapiens
LQPERYELC

SEQ ID NO: 826390 - protein, 9 aa, Homo Sapiens
EPIIDDNML

SEQ ID NO: 826391 - protein, 9 aa, Homo Sapiens
FENHKKLYC

SEQ ID NO: 826392 - protein, 9 aa, Homo Sapiens
DTYDSSSSS

SEQ ID NO: 826393 - protein, 9 aa, Homo Sapiens
LTTVYGLRK

SEQ ID NO: 826394 - protein, 9 aa, Homo Sapiens
EGRWNLFLP

SEQ ID NO: 826395 - protein, 9 aa, Homo Sapiens
TTDFSKSLQ

SEQ ID NO: 826396 - protein, 9 aa, Homo Sapiens
FSSSSTRSS

SEQ ID NO: 826397 - protein, 9 aa, Homo Sapiens
GIPIQKFIC

SEQ ID NO: 826398 - protein, 9 aa, Homo Sapiens
TRAVLCCQK

SEQ ID NO: 826399 - protein, 9 aa, Homo Sapiens
NQKRSKRRD

SEQ ID NO: 826400 - protein, 9 aa, Homo Sapiens
FAHYTVITI

SEQ ID NO: 826401 - protein, 9 aa, Homo Sapiens
RTIFRKSRI

SEQ ID NO: 826402 - protein, 9 aa, Homo Sapiens
CIAVNIKDP

SEQ ID NO: 826403 - protein, 9 aa, Homo Sapiens
GVDKLLLFT

SEQ ID NO: 826404 - protein, 9 aa, Homo Sapiens
QCGKAFIYS

SEQ ID NO: 826405 - protein, 9 aa, Homo Sapiens
YIIPPYMIA

SEQ ID NO: 826406 - protein, 9 aa, Homo Sapiens
AGPGAQTPL

SEQ ID NO: 826407 - protein, 9 aa, Homo Sapiens
VFLATYYKI

SEQ ID NO: 826408 - protein, 9 aa, Homo Sapiens
SGNAQNGVA

SEQ ID NO: 826409 - protein, 9 aa, Homo Sapiens
NVPAEQKDE

SEQ ID NO: 826410 - protein, 9 aa, Homo Sapiens
SDFFPRPSR

SEQ ID NO: 826411 - protein, 9 aa, Homo Sapiens
RAVLCIPYG

SEQ ID NO: 826412 - protein, 9 aa, Homo Sapiens
PPRSATVTL

SEQ ID NO: 826413 - protein, 9 aa, Homo Sapiens
PNNYLSKEG

SEQ ID NO: 826414 - protein, 9 aa, Homo Sapiens
ECRYRENVC

SEQ ID NO: 826415 - protein, 9 aa, Homo Sapiens
DWIMEAVRG

SEQ ID NO: 826416 - protein, 9 aa, Homo Sapiens
SCPSTFQNK

SEQ ID NO: 826417 - protein, 9 aa, Homo Sapiens
SKDIEFGGM

SEQ ID NO: 826418 - protein, 9 aa, Homo Sapiens
GEIVSANLV

SEQ ID NO: 826419 - protein, 9 aa, Homo Sapiens
PDNLGLLVS

SEQ ID NO: 826420 - protein, 9 aa, Homo Sapiens
TLQEQLNED

SEQ ID NO: 826421 - protein, 9 aa, Homo Sapiens
VCEAIQNEM

SEQ ID NO: 826422 - protein, 9 aa, Homo Sapiens
KGLGADGLW

SEQ ID NO: 826423 - protein, 9 aa, Homo Sapiens
KFSPPLIGK

SEQ ID NO: 826424 - protein, 9 aa, Homo Sapiens
LPLSTQVNF

SEQ ID NO: 826425 - protein, 9 aa, Homo Sapiens
TGQLHSEAA

SEQ ID NO: 826426 - protein, 9 aa, Homo Sapiens
LSSDHVKVI

SEQ ID NO: 826427 - protein, 9 aa, Homo Sapiens
MYGSCIFLL

SEQ ID NO: 826428 - protein, 9 aa, Homo Sapiens
DKDTKNVNL

SEQ ID NO: 826429 - protein, 9 aa, Homo Sapiens
VVQRQIHNQ

SEQ ID NO: 826430 - protein, 9 aa, Homo Sapiens
QLYGPEPAL

SEQ ID NO: 826431 - protein, 9 aa, Homo Sapiens
VGLHWMEGD

SEQ ID NO: 826432 - protein, 9 aa, Homo Sapiens
KHYKGPGVS

SEQ ID NO: 826433 - protein, 9 aa, Homo Sapiens
NTASRDELM

SEQ ID NO: 826434 - protein, 9 aa, Homo Sapiens
DKLKLARDV

SEQ ID NO: 826435 - protein, 9 aa, Homo Sapiens
EWCLEHGEH

SEQ ID NO: 826436 - protein, 9 aa, Homo Sapiens
PTQPQIYPW

SEQ ID NO: 826437 - protein, 9 aa, Homo Sapiens
HSLTIHGII

SEQ ID NO: 826438 - protein, 9 aa, Homo Sapiens
YLKVIIFFD

SEQ ID NO: 826439 - protein, 9 aa, Homo Sapiens
LDILKEDTF

SEQ ID NO: 826440 - protein, 9 aa, Homo Sapiens
DGVLLCCQA

SEQ ID NO: 826441 - protein, 9 aa, Homo Sapiens
KQPNRTTSF

SEQ ID NO: 826442 - protein, 9 aa, Homo Sapiens
ISRKKQTQK

SEQ ID NO: 826443 - protein, 9 aa, Homo Sapiens
VFEKYYVTY

SEQ ID NO: 826444 - protein, 9 aa, Homo Sapiens
HAHRQLGER

SEQ ID NO: 826445 - protein, 9 aa, Homo Sapiens
KQEPIERKY

SEQ ID NO: 826446 - protein, 9 aa, Homo Sapiens
PDPNILAHY

SEQ ID NO: 826447 - protein, 9 aa, Homo Sapiens
DKFLSLASE

SEQ ID NO: 826448 - protein, 9 aa, Homo Sapiens
KKINHKRYR

SEQ ID NO: 826449 - protein, 9 aa, Homo Sapiens
KKCIAVNIK

SEQ ID NO: 826450 - protein, 9 aa, Homo Sapiens
AQQYVLQSD

SEQ ID NO: 826451 - protein, 9 aa, Homo Sapiens
ALEKDEQVR

SEQ ID NO: 826452 - protein, 9 aa, Homo Sapiens
AKEITVGQL

SEQ ID NO: 826453 - protein, 9 aa, Homo Sapiens
IVFMILLGS

SEQ ID NO: 826454 - protein, 9 aa, Homo Sapiens
ANHVNTTLY

SEQ ID NO: 826455 - protein, 9 aa, Homo Sapiens
STIRITGSG

SEQ ID NO: 826456 - protein, 9 aa, Homo Sapiens
LGPFPPLRC

SEQ ID NO: 826457 - protein, 9 aa, Homo Sapiens
PGKNVVTPL

SEQ ID NO: 826458 - protein, 9 aa, Homo Sapiens
NEKLVKAER

SEQ ID NO: 826459 - protein, 9 aa, Homo Sapiens
NVRGIRGRW

SEQ ID NO: 826460 - protein, 9 aa, Homo Sapiens
QTLHRASPH

SEQ ID NO: 826461 - protein, 9 aa, Homo Sapiens
LIIVRWCDI

SEQ ID NO: 826462 - protein, 9 aa, Homo Sapiens
TLMSQSVGS

SEQ ID NO: 826463 - protein, 9 aa, Homo Sapiens
NPEGQKTMY

SEQ ID NO: 826464 - protein, 9 aa, Homo Sapiens
TSEIFDSPA

SEQ ID NO: 826465 - protein, 9 aa, Homo Sapiens
INSHSHEDD

SEQ ID NO: 826466 - protein, 9 aa, Homo Sapiens
VETNWIVDR

SEQ ID NO: 826467 - protein, 9 aa, Homo Sapiens
SYPSAMNEE

SEQ ID NO: 826468 - protein, 9 aa, Homo Sapiens
KTLVLIGNV

SEQ ID NO: 826469 - protein, 9 aa, Homo Sapiens
PEPEAKTDT

SEQ ID NO: 826470 - protein, 9 aa, Homo Sapiens
GNVWLTHKE

SEQ ID NO: 826471 - protein, 9 aa, Homo Sapiens
ASHFEHLCS

SEQ ID NO: 826472 - protein, 9 aa, Homo Sapiens
IYHDVTSLL

SEQ ID NO: 826473 - protein, 9 aa, Homo Sapiens
RITGRDVVL

SEQ ID NO: 826474 - protein, 9 aa, Homo Sapiens
TLEHKLRRE

SEQ ID NO: 826475 - protein, 9 aa, Homo Sapiens
HYIKSQTGE

SEQ ID NO: 826476 - protein, 9 aa, Homo Sapiens
CSGVRKCCS

SEQ ID NO: 826477 - protein, 9 aa, Homo Sapiens
SNHQSSYQT

SEQ ID NO: 826478 - protein, 9 aa, Homo Sapiens
AAEFINNYM

SEQ ID NO: 826479 - protein, 9 aa, Homo Sapiens
EEIKDILPE

SEQ ID NO: 826480 - protein, 9 aa, Homo Sapiens
REHIKHVNV

SEQ ID NO: 826481 - protein, 9 aa, Homo Sapiens
GIVKHLRLS

SEQ ID NO: 826482 - protein, 9 aa, Homo Sapiens
SEGKFDKLL

SEQ ID NO: 826483 - protein, 9 aa, Homo Sapiens
EKMNKEAVW

SEQ ID NO: 826484 - protein, 9 aa, Homo Sapiens
LFGMGKEVG

SEQ ID NO: 826485 - protein, 9 aa, Homo Sapiens
PLLLVVGCV

SEQ ID NO: 826486 - protein, 9 aa, Homo Sapiens
ESPKFVRVR

SEQ ID NO: 826487 - protein, 9 aa, Homo Sapiens
TELQNHEKQ

SEQ ID NO: 826488 - protein, 9 aa, Homo Sapiens
KVSGKNKEL

SEQ ID NO: 826489 - protein, 9 aa, Homo Sapiens
GPYSSPSLC

SEQ ID NO: 826490 - protein, 9 aa, Homo Sapiens
IKTLSNVKY

SEQ ID NO: 826491 - protein, 9 aa, Homo Sapiens
VKCGRDGRC

SEQ ID NO: 826492 - protein, 9 aa, Homo Sapiens
LGMMAFMDI

SEQ ID NO: 826493 - protein, 9 aa, Homo Sapiens
LEDCKDIEH

SEQ ID NO: 826494 - protein, 9 aa, Homo Sapiens
MSIKLCPAL

SEQ ID NO: 826495 - protein, 9 aa, Homo Sapiens
NLQVKQRPT

SEQ ID NO: 826496 - protein, 9 aa, Homo Sapiens
ISDVKLLYT

SEQ ID NO: 826497 - protein, 9 aa, Homo Sapiens
FTTEEEIIL

SEQ ID NO: 826498 - protein, 9 aa, Homo Sapiens
WRCHVAVRK

SEQ ID NO: 826499 - protein, 9 aa, Homo Sapiens
WLHSHVQGI

SEQ ID NO: 826500 - protein, 9 aa, Homo Sapiens
AKDLDVGQN

SEQ ID NO: 826501 - protein, 9 aa, Homo Sapiens
GENIADNGD

SEQ ID NO: 826502 - protein, 9 aa, Homo Sapiens
VPFASVANV

SEQ ID NO: 826503 - protein, 9 aa, Homo Sapiens
GQTPYAGIK

SEQ ID NO: 826504 - protein, 9 aa, Homo Sapiens
IEPWPEDRD

SEQ ID NO: 826505 - protein, 9 aa, Homo Sapiens
IWNNIFSLN

SEQ ID NO: 826506 - protein, 9 aa, Homo Sapiens
DFPNHWEYY

SEQ ID NO: 826507 - protein, 9 aa, Homo Sapiens
EEVWKVNCY

SEQ ID NO: 826508 - protein, 9 aa, Homo Sapiens
LPPIDRRLG

SEQ ID NO: 826509 - protein, 9 aa, Homo Sapiens
ITEYCFYGY

SEQ ID NO: 826510 - protein, 9 aa, Homo Sapiens
QDLRWTSEN

SEQ ID NO: 826511 - protein, 9 aa, Homo Sapiens
ISDSISKFQ

SEQ ID NO: 826512 - protein, 9 aa, Homo Sapiens
KLFESLFAC

SEQ ID NO: 826513 - protein, 9 aa, Homo Sapiens
LRGISDLRT

SEQ ID NO: 826514 - protein, 9 aa, Homo Sapiens
GPAYLRDID

SEQ ID NO: 826515 - protein, 9 aa, Homo Sapiens
EQDRGEWDS

SEQ ID NO: 826516 - protein, 9 aa, Homo Sapiens
KEEREGLAK

SEQ ID NO: 826517 - protein, 9 aa, Homo Sapiens
HLKKKSGVC

SEQ ID NO: 826518 - protein, 9 aa, Homo Sapiens
LGASDKELH

SEQ ID NO: 826519 - protein, 9 aa, Homo Sapiens
SGGTRGCHP

SEQ ID NO: 826520 - protein, 9 aa, Homo Sapiens
LGKSNRNGP

SEQ ID NO: 826521 - protein, 9 aa, Homo Sapiens
LQSAKNSLK

SEQ ID NO: 826522 - protein, 9 aa, Homo Sapiens
NVTRLLSQS

SEQ ID NO: 826523 - protein, 9 aa, Homo Sapiens
LECIAHDAE

SEQ ID NO: 826524 - protein, 9 aa, Homo Sapiens
YLCLDKKKV

SEQ ID NO: 826525 - protein, 9 aa, Homo Sapiens
ETTKCVVVG

SEQ ID NO: 826526 - protein, 9 aa, Homo Sapiens
ICELVSEEP

SEQ ID NO: 826527 - protein, 9 aa, Homo Sapiens
NSERCKELT

SEQ ID NO: 826528 - protein, 9 aa, Homo Sapiens
PKEGTVEIK

SEQ ID NO: 826529 - protein, 9 aa, Homo Sapiens
SEELQINIS

SEQ ID NO: 826530 - protein, 9 aa, Homo Sapiens
LLPSEAVFG

SEQ ID NO: 826531 - protein, 9 aa, Homo Sapiens
FHEVQRQIR

SEQ ID NO: 826532 - protein, 9 aa, Homo Sapiens
LGCSTVSLI

SEQ ID NO: 826533 - protein, 9 aa, Homo Sapiens
EDEDWHYMQ

SEQ ID NO: 826534 - protein, 9 aa, Homo Sapiens
LEAWNNEVK

SEQ ID NO: 826535 - protein, 9 aa, Homo Sapiens
FTRELFSEC

SEQ ID NO: 826536 - protein, 9 aa, Homo Sapiens
PKVTSMFEP

SEQ ID NO: 826537 - protein, 9 aa, Homo Sapiens
IITHFNGNY

SEQ ID NO: 826538 - protein, 9 aa, Homo Sapiens
TTPTSLQVP

SEQ ID NO: 826539 - protein, 9 aa, Homo Sapiens
DQECLGKQL

SEQ ID NO: 826540 - protein, 9 aa, Homo Sapiens
ESHLKDTPS

SEQ ID NO: 826541 - protein, 9 aa, Homo Sapiens
EYCDNTLLN

SEQ ID NO: 826542 - protein, 9 aa, Homo Sapiens
RNNITEYCR

SEQ ID NO: 826543 - protein, 9 aa, Homo Sapiens
YCNSILREM

SEQ ID NO: 826544 - protein, 9 aa, Homo Sapiens
ERTDIAQLL

SEQ ID NO: 826545 - protein, 9 aa, Homo Sapiens
CDDSQRVKS

SEQ ID NO: 826546 - protein, 9 aa, Homo Sapiens
LDPLKHVRF

SEQ ID NO: 826547 - protein, 9 aa, Homo Sapiens
RLQSLTFNG

SEQ ID NO: 826548 - protein, 9 aa, Homo Sapiens
VAYSLLKTD

SEQ ID NO: 826549 - protein, 9 aa, Homo Sapiens
AVFGNSWQV

SEQ ID NO: 826550 - protein, 9 aa, Homo Sapiens
TTKESLRNY

SEQ ID NO: 826551 - protein, 9 aa, Homo Sapiens
ALTISKVIL

SEQ ID NO: 826552 - protein, 9 aa, Homo Sapiens
PEGMGVIPR

SEQ ID NO: 826553 - protein, 9 aa, Homo Sapiens
INCPGIKGP

SEQ ID NO: 826554 - protein, 9 aa, Homo Sapiens
RMLTKDLQN

SEQ ID NO: 826555 - protein, 9 aa, Homo Sapiens
ERYMTFNVQ

SEQ ID NO: 826556 - protein, 9 aa, Homo Sapiens
SWGFNVRGI

SEQ ID NO: 826557 - protein, 9 aa, Homo Sapiens
QSQGRVPCV

SEQ ID NO: 826558 - protein, 9 aa, Homo Sapiens
RPNPPTFVQ

SEQ ID NO: 826559 - protein, 9 aa, Homo Sapiens
VRFDPGTSM

SEQ ID NO: 826560 - protein, 9 aa, Homo Sapiens
SQVTVSSFS

SEQ ID NO: 826561 - protein, 9 aa, Homo Sapiens
FNILYWVIY

SEQ ID NO: 826562 - protein, 9 aa, Homo Sapiens
FLVSIILLT

SEQ ID NO: 826563 - protein, 9 aa, Homo Sapiens
EMQEVIDFI

SEQ ID NO: 826564 - protein, 9 aa, Homo Sapiens
LDVLGKKSN

SEQ ID NO: 826565 - protein, 9 aa, Homo Sapiens
DNLQCGQGS

SEQ ID NO: 826566 - protein, 9 aa, Homo Sapiens
LKRFSCLSF

SEQ ID NO: 826567 - protein, 9 aa, Homo Sapiens
WGDLLGEDY

SEQ ID NO: 826568 - protein, 9 aa, Homo Sapiens
RTPCYACPQ

SEQ ID NO: 826569 - protein, 9 aa, Homo Sapiens
HLESFTDVL

SEQ ID NO: 826570 - protein, 9 aa, Homo Sapiens
LNTINEVIT

SEQ ID NO: 826571 - protein, 9 aa, Homo Sapiens
AFVNCAENS

SEQ ID NO: 826572 - protein, 9 aa, Homo Sapiens
PAFIQHQII

SEQ ID NO: 826573 - protein, 9 aa, Homo Sapiens
QPFAGKEDA

SEQ ID NO: 826574 - protein, 9 aa, Homo Sapiens
AECSIQLPK

SEQ ID NO: 826575 - protein, 9 aa, Homo Sapiens
GGESECSNV

SEQ ID NO: 826576 - protein, 9 aa, Homo Sapiens
QYGNEEMGG

SEQ ID NO: 826577 - protein, 9 aa, Homo Sapiens
AYFHKEERE

SEQ ID NO: 826578 - protein, 9 aa, Homo Sapiens
LKKVALRWL

SEQ ID NO: 826579 - protein, 9 aa, Homo Sapiens
KSWSGDPFI

SEQ ID NO: 826580 - protein, 9 aa, Homo Sapiens
ISDNTSQER

SEQ ID NO: 826581 - protein, 9 aa, Homo Sapiens
PASYSVSLP

SEQ ID NO: 826582 - protein, 9 aa, Homo Sapiens
AVRRFKDLR

SEQ ID NO: 826583 - protein, 9 aa, Homo Sapiens
ENMSLFDEY

SEQ ID NO: 826584 - protein, 9 aa, Homo Sapiens
PNNRYSHNE

SEQ ID NO: 826585 - protein, 9 aa, Homo Sapiens
CFHKTRSRM

SEQ ID NO: 826586 - protein, 9 aa, Homo Sapiens
EEMELIIET

SEQ ID NO: 826587 - protein, 9 aa, Homo Sapiens
RRNSDIFVP

SEQ ID NO: 826588 - protein, 9 aa, Homo Sapiens
IPDTLEEDQ

SEQ ID NO: 826589 - protein, 9 aa, Homo Sapiens
KRMIYNHAF

SEQ ID NO: 826590 - protein, 9 aa, Homo Sapiens
LLHYQPSAE

SEQ ID NO: 826591 - protein, 9 aa, Homo Sapiens
KYAIGISLL

SEQ ID NO: 826592 - protein, 9 aa, Homo Sapiens
YNQIFSSQP

SEQ ID NO: 826593 - protein, 9 aa, Homo Sapiens
VNQVKVEGS

SEQ ID NO: 826594 - protein, 9 aa, Homo Sapiens
IYADKELVQ

SEQ ID NO: 826595 - protein, 9 aa, Homo Sapiens
DGLDEAFLR

SEQ ID NO: 826596 - protein, 9 aa, Homo Sapiens
HPGDTQDFD

SEQ ID NO: 826597 - protein, 9 aa, Homo Sapiens
HKGDLEEPI

SEQ ID NO: 826598 - protein, 9 aa, Homo Sapiens
TPQTFSNYE

SEQ ID NO: 826599 - protein, 9 aa, Homo Sapiens
LSHDADPEV

SEQ ID NO: 826600 - protein, 9 aa, Homo Sapiens
RRNRQMTRK

SEQ ID NO: 826601 - protein, 9 aa, Homo Sapiens
GQKPVLHRA

SEQ ID NO: 826602 - protein, 9 aa, Homo Sapiens
KALYREGMR

SEQ ID NO: 826603 - protein, 9 aa, Homo Sapiens
PSILILMVS

SEQ ID NO: 826604 - protein, 9 aa, Homo Sapiens
EGGESECSN

SEQ ID NO: 826605 - protein, 9 aa, Homo Sapiens
YLFSHCSTP

SEQ ID NO: 826606 - protein, 9 aa, Homo Sapiens
SDHPHMKIF

SEQ ID NO: 826607 - protein, 9 aa, Homo Sapiens
AVTKMAAVT

SEQ ID NO: 826608 - protein, 9 aa, Homo Sapiens
FPRTDEFKN

SEQ ID NO: 826609 - protein, 9 aa, Homo Sapiens
NFRRNSDLG

SEQ ID NO: 826610 - protein, 9 aa, Homo Sapiens
GQKVDKPEA

SEQ ID NO: 826611 - protein, 9 aa, Homo Sapiens
SQILNLEEL

SEQ ID NO: 826612 - protein, 9 aa, Homo Sapiens
YQKQESLEI

SEQ ID NO: 826613 - protein, 9 aa, Homo Sapiens
EGVPVVVHK

SEQ ID NO: 826614 - protein, 9 aa, Homo Sapiens
LFKMTGESE

SEQ ID NO: 826615 - protein, 9 aa, Homo Sapiens
NRCPFGVVD

SEQ ID NO: 826616 - protein, 9 aa, Homo Sapiens
HFLGKLLEA

SEQ ID NO: 826617 - protein, 9 aa, Homo Sapiens
SSSWPQSRS

SEQ ID NO: 826618 - protein, 9 aa, Homo Sapiens
WLLGTTHAE

SEQ ID NO: 826619 - protein, 9 aa, Homo Sapiens
NKPLSAMGR

SEQ ID NO: 826620 - protein, 9 aa, Homo Sapiens
VIIYLSTVM

SEQ ID NO: 826621 - protein, 9 aa, Homo Sapiens
QDEPSSRPQ

SEQ ID NO: 826622 - protein, 9 aa, Homo Sapiens
KCKAVGKFT

SEQ ID NO: 826623 - protein, 9 aa, Homo Sapiens
CWVPQVLRS

SEQ ID NO: 826624 - protein, 9 aa, Homo Sapiens
LCVVFSLVI

SEQ ID NO: 826625 - protein, 9 aa, Homo Sapiens
LYCRLKVHM

SEQ ID NO: 826626 - protein, 9 aa, Homo Sapiens
GNQKDSIKA

SEQ ID NO: 826627 - protein, 9 aa, Homo Sapiens
TGDTLRTLS

SEQ ID NO: 826628 - protein, 9 aa, Homo Sapiens
INATATINS

SEQ ID NO: 826629 - protein, 9 aa, Homo Sapiens
YLYREGVIR

SEQ ID NO: 826630 - protein, 9 aa, Homo Sapiens
HDFRAPAEP

SEQ ID NO: 826631 - protein, 9 aa, Homo Sapiens
IMVQDVSFK

SEQ ID NO: 826632 - protein, 9 aa, Homo Sapiens
CSENKIPFK

SEQ ID NO: 826633 - protein, 9 aa, Homo Sapiens
CMFSNMTNC

SEQ ID NO: 826634 - protein, 9 aa, Homo Sapiens
LVFQFFSWW

SEQ ID NO: 826635 - protein, 9 aa, Homo Sapiens
STDFDCKEY

SEQ ID NO: 826636 - protein, 9 aa, Homo Sapiens
TMYLQQYVE

SEQ ID NO: 826637 - protein, 9 aa, Homo Sapiens
KIFGPFDLA

SEQ ID NO: 826638 - protein, 9 aa, Homo Sapiens
ASEEAAITM

SEQ ID NO: 826639 - protein, 9 aa, Homo Sapiens
TVNYRQAKT

SEQ ID NO: 826640 - protein, 9 aa, Homo Sapiens
QYFENFYTR

SEQ ID NO: 826641 - protein, 9 aa, Homo Sapiens
SVHIQHQIV

SEQ ID NO: 826642 - protein, 9 aa, Homo Sapiens
LTSRLMIFS

SEQ ID NO: 826643 - protein, 9 aa, Homo Sapiens
DADEWQASE

SEQ ID NO: 826644 - protein, 9 aa, Homo Sapiens
EDEWQCTAC

SEQ ID NO: 826645 - protein, 9 aa, Homo Sapiens
FEILTKQQA

SEQ ID NO: 826646 - protein, 9 aa, Homo Sapiens
ISYLTIALN

SEQ ID NO: 826647 - protein, 9 aa, Homo Sapiens
IKDGFFYFF

SEQ ID NO: 826648 - protein, 9 aa, Homo Sapiens
RGRELFDSN

SEQ ID NO: 826649 - protein, 9 aa, Homo Sapiens
VSPSLKWPT

SEQ ID NO: 826650 - protein, 9 aa, Homo Sapiens
IVNINISEV

SEQ ID NO: 826651 - protein, 9 aa, Homo Sapiens
RAIKNTSKK

SEQ ID NO: 826652 - protein, 9 aa, Homo Sapiens
SLILPHIST

SEQ ID NO: 826653 - protein, 9 aa, Homo Sapiens
QYSLEEEAR

SEQ ID NO: 826654 - protein, 9 aa, Homo Sapiens
HSESSSNQS

SEQ ID NO: 826655 - protein, 9 aa, Homo Sapiens
NLSEIKCNS

SEQ ID NO: 826656 - protein, 9 aa, Homo Sapiens
ARLTREKEH

SEQ ID NO: 826657 - protein, 9 aa, Homo Sapiens
ATLGVSLSS

SEQ ID NO: 826658 - protein, 9 aa, Homo Sapiens
KKKEINKRK

SEQ ID NO: 826659 - protein, 9 aa, Homo Sapiens
VSKQVKEYQ

SEQ ID NO: 826660 - protein, 9 aa, Homo Sapiens
FLSFTNSDL

SEQ ID NO: 826661 - protein, 9 aa, Homo Sapiens
NNEGGGSAN

SEQ ID NO: 826662 - protein, 9 aa, Homo Sapiens
LESVTILVA

SEQ ID NO: 826663 - protein, 9 aa, Homo Sapiens
QREEERYAA

SEQ ID NO: 826664 - protein, 9 aa, Homo Sapiens
NQMDALLEF

SEQ ID NO: 826665 - protein, 9 aa, Homo Sapiens
EKFSYGYSL

SEQ ID NO: 826666 - protein, 9 aa, Homo Sapiens
PGIMKDMLY

SEQ ID NO: 826667 - protein, 9 aa, Homo Sapiens
YIRANYLQD

SEQ ID NO: 826668 - protein, 9 aa, Homo Sapiens
MQLPCKLRE

SEQ ID NO: 826669 - protein, 9 aa, Homo Sapiens
IYNASKNII

SEQ ID NO: 826670 - protein, 9 aa, Homo Sapiens
SMSQWEEKD

SEQ ID NO: 826671 - protein, 9 aa, Homo Sapiens
RELLDPSHQ

SEQ ID NO: 826672 - protein, 9 aa, Homo Sapiens
RKPEIHGAP

SEQ ID NO: 826673 - protein, 9 aa, Homo Sapiens
LSAMGRKPY

SEQ ID NO: 826674 - protein, 9 aa, Homo Sapiens
FLPRRTPPA

SEQ ID NO: 826675 - protein, 9 aa, Homo Sapiens
KRTCQLKCQ

SEQ ID NO: 826676 - protein, 9 aa, Homo Sapiens
GKPSTKKVK

SEQ ID NO: 826677 - protein, 9 aa, Homo Sapiens
DTTNEYNSN

SEQ ID NO: 826678 - protein, 9 aa, Homo Sapiens
QMWDLQFAS

SEQ ID NO: 826679 - protein, 9 aa, Homo Sapiens
VGIFFGFIT

SEQ ID NO: 826680 - protein, 9 aa, Homo Sapiens
AFHRDQRSL

SEQ ID NO: 826681 - protein, 9 aa, Homo Sapiens
PVYPKCLFD

SEQ ID NO: 826682 - protein, 9 aa, Homo Sapiens
CQAMKKICD

SEQ ID NO: 826683 - protein, 9 aa, Homo Sapiens
TLAKTACDE

SEQ ID NO: 826684 - protein, 9 aa, Homo Sapiens
VKLICLSIW

SEQ ID NO: 826685 - protein, 9 aa, Homo Sapiens
PEPFEYIDE

SEQ ID NO: 826686 - protein, 9 aa, Homo Sapiens
RGAFIGISL

SEQ ID NO: 826687 - protein, 9 aa, Homo Sapiens
MDEYNLFLR

SEQ ID NO: 826688 - protein, 9 aa, Homo Sapiens
SRRRSHQDA

SEQ ID NO: 826689 - protein, 9 aa, Homo Sapiens
KSEGNYLIC

SEQ ID NO: 826690 - protein, 9 aa, Homo Sapiens
QQLPKYILL

SEQ ID NO: 826691 - protein, 9 aa, Homo Sapiens
QDPWNWLDS

SEQ ID NO: 826692 - protein, 9 aa, Homo Sapiens
AYVTPIIQP

SEQ ID NO: 826693 - protein, 9 aa, Homo Sapiens
KEYDYETRI

SEQ ID NO: 826694 - protein, 9 aa, Homo Sapiens
TLKNEQSLP

SEQ ID NO: 826695 - protein, 9 aa, Homo Sapiens
QVASQNVGQ

SEQ ID NO: 826696 - protein, 9 aa, Homo Sapiens
TKRCMLQAD

SEQ ID NO: 826697 - protein, 9 aa, Homo Sapiens
LGPGPHHQP

SEQ ID NO: 826698 - protein, 9 aa, Homo Sapiens
LYDGSYDDP

SEQ ID NO: 826699 - protein, 9 aa, Homo Sapiens
RLTKLAEVK

SEQ ID NO: 826700 - protein, 9 aa, Homo Sapiens
QIVIHRGST

SEQ ID NO: 826701 - protein, 9 aa, Homo Sapiens
RDFQRESQI

SEQ ID NO: 826702 - protein, 9 aa, Homo Sapiens
NETALEKNI

SEQ ID NO: 826703 - protein, 9 aa, Homo Sapiens
YTIDYSHFH

SEQ ID NO: 826704 - protein, 9 aa, Homo Sapiens
GVLSSYGIG

SEQ ID NO: 826705 - protein, 9 aa, Homo Sapiens
QLFSLVTTV

SEQ ID NO: 826706 - protein, 9 aa, Homo Sapiens
AKKARSTTK

SEQ ID NO: 826707 - protein, 9 aa, Homo Sapiens
RLHWFPYCQ

SEQ ID NO: 826708 - protein, 9 aa, Homo Sapiens
WLDLSRILF

SEQ ID NO: 826709 - protein, 9 aa, Homo Sapiens
GKQLAVGKH

SEQ ID NO: 826710 - protein, 9 aa, Homo Sapiens
HLENITTGT

SEQ ID NO: 826711 - protein, 9 aa, Homo Sapiens
PVATVPPTP

SEQ ID NO: 826712 - protein, 9 aa, Homo Sapiens
TCLDNLKIK

SEQ ID NO: 826713 - protein, 9 aa, Homo Sapiens
IIWGMSHSP

SEQ ID NO: 826714 - protein, 9 aa, Homo Sapiens
RCSANVQSN

SEQ ID NO: 826715 - protein, 9 aa, Homo Sapiens
LIHKYIDSK

SEQ ID NO: 826716 - protein, 9 aa, Homo Sapiens
QLLADHAPG

SEQ ID NO: 826717 - protein, 9 aa, Homo Sapiens
RQKPYGCNK

SEQ ID NO: 826718 - protein, 9 aa, Homo Sapiens
LKMWQFMGQ

SEQ ID NO: 826719 - protein, 9 aa, Homo Sapiens
GEELLVEVL

SEQ ID NO: 826720 - protein, 9 aa, Homo Sapiens
RLLLFHLLE

SEQ ID NO: 826721 - protein, 9 aa, Homo Sapiens
NKKVGVKRR

SEQ ID NO: 826722 - protein, 9 aa, Homo Sapiens
VQAAVAPNI

SEQ ID NO: 826723 - protein, 9 aa, Homo Sapiens
LLPFSSPSL

SEQ ID NO: 826724 - protein, 9 aa, Homo Sapiens
NEEHACHCS

SEQ ID NO: 826725 - protein, 9 aa, Homo Sapiens
ASCCSLKKY

SEQ ID NO: 826726 - protein, 9 aa, Homo Sapiens
CGKTFIFKR

SEQ ID NO: 826727 - protein, 9 aa, Homo Sapiens
SELEPMTDK

SEQ ID NO: 826728 - protein, 9 aa, Homo Sapiens
TGQSRVTVV

SEQ ID NO: 826729 - protein, 9 aa, Homo Sapiens
KTDGSPNQA

SEQ ID NO: 826730 - protein, 9 aa, Homo Sapiens
WYRQYYGKS

SEQ ID NO: 826731 - protein, 9 aa, Homo Sapiens
ELYEQGDEE

SEQ ID NO: 826732 - protein, 9 aa, Homo Sapiens
SSTSIKGTS

SEQ ID NO: 826733 - protein, 9 aa, Homo Sapiens
KPQKSSPKS

SEQ ID NO: 826734 - protein, 9 aa, Homo Sapiens
PLMLDFNFG

SEQ ID NO: 826735 - protein, 9 aa, Homo Sapiens
AESHGLCSS

SEQ ID NO: 826736 - protein, 9 aa, Homo Sapiens
PFSDRVPSD

SEQ ID NO: 826737 - protein, 9 aa, Homo Sapiens
AKDKVLKYF

SEQ ID NO: 826738 - protein, 9 aa, Homo Sapiens
SSSPATNYS

SEQ ID NO: 826739 - protein, 9 aa, Homo Sapiens
VHNYPTQLQ

SEQ ID NO: 826740 - protein, 9 aa, Homo Sapiens
ILLQKFCQM

SEQ ID NO: 826741 - protein, 9 aa, Homo Sapiens
ALLLAKKVD

SEQ ID NO: 826742 - protein, 9 aa, Homo Sapiens
PVSNSCIDC

SEQ ID NO: 826743 - protein, 9 aa, Homo Sapiens
VRPTNVLEI

SEQ ID NO: 826744 - protein, 9 aa, Homo Sapiens
CLDDPVLSQ

SEQ ID NO: 826745 - protein, 9 aa, Homo Sapiens
GFCLYRGLI

SEQ ID NO: 826746 - protein, 9 aa, Homo Sapiens
EEAEPQGQP

SEQ ID NO: 826747 - protein, 9 aa, Homo Sapiens
VTSYIKIKE

SEQ ID NO: 826748 - protein, 9 aa, Homo Sapiens
VLGKKSNNS

SEQ ID NO: 826749 - protein, 9 aa, Homo Sapiens
LMKAAMQGQ

SEQ ID NO: 826750 - protein, 9 aa, Homo Sapiens
KFWRAMLAM

SEQ ID NO: 826751 - protein, 9 aa, Homo Sapiens
EASHRNQLC

SEQ ID NO: 826752 - protein, 9 aa, Homo Sapiens
QFIEPAPAP

SEQ ID NO: 826753 - protein, 9 aa, Homo Sapiens
YVFTGELER

SEQ ID NO: 826754 - protein, 9 aa, Homo Sapiens
LLLQIPSCL

SEQ ID NO: 826755 - protein, 9 aa, Homo Sapiens
TIIGNALVI

SEQ ID NO: 826756 - protein, 9 aa, Homo Sapiens
GEKNQQIIG

SEQ ID NO: 826757 - protein, 9 aa, Homo Sapiens
CLAQKMMIG

SEQ ID NO: 826758 - protein, 9 aa, Homo Sapiens
LYLCGLSDA

SEQ ID NO: 826759 - protein, 9 aa, Homo Sapiens
TLFEVGGSP

SEQ ID NO: 826760 - protein, 9 aa, Homo Sapiens
SYRCSANVQ

SEQ ID NO: 826761 - protein, 9 aa, Homo Sapiens
LLTLDNLIL

SEQ ID NO: 826762 - protein, 9 aa, Homo Sapiens
RFSLENNLL

SEQ ID NO: 826763 - protein, 9 aa, Homo Sapiens
TSALHKLEQ

SEQ ID NO: 826764 - protein, 9 aa, Homo Sapiens
EHFSPFCVQ

SEQ ID NO: 826765 - protein, 9 aa, Homo Sapiens
QMISVQPDT

SEQ ID NO: 826766 - protein, 9 aa, Homo Sapiens
SDQSEIISK

SEQ ID NO: 826767 - protein, 9 aa, Homo Sapiens
KHCPVVTVN

SEQ ID NO: 826768 - protein, 9 aa, Homo Sapiens
TASTLAHLD

SEQ ID NO: 826769 - protein, 9 aa, Homo Sapiens
QQQPPPATR

SEQ ID NO: 826770 - protein, 9 aa, Homo Sapiens
GTHRMAKKN

SEQ ID NO: 826771 - protein, 9 aa, Homo Sapiens
PSRTQRAKR

SEQ ID NO: 826772 - protein, 9 aa, Homo Sapiens
EEQRKKEEH

SEQ ID NO: 826773 - protein, 9 aa, Homo Sapiens
RGEYFLYKS

SEQ ID NO: 826774 - protein, 9 aa, Homo Sapiens
KEDLDALTE

SEQ ID NO: 826775 - protein, 9 aa, Homo Sapiens
PQRDSTKSQ

SEQ ID NO: 826776 - protein, 9 aa, Homo Sapiens
CALGRLGLV

SEQ ID NO: 826777 - protein, 9 aa, Homo Sapiens
NECTTQSNV

SEQ ID NO: 826778 - protein, 9 aa, Homo Sapiens
MKDSRYQHL

SEQ ID NO: 826779 - protein, 9 aa, Homo Sapiens
AECASHLKK

SEQ ID NO: 826780 - protein, 9 aa, Homo Sapiens
SKLMTPYIA

SEQ ID NO: 826781 - protein, 9 aa, Homo Sapiens
ARYNMNNAI

SEQ ID NO: 826782 - protein, 9 aa, Homo Sapiens
FSGTQIATI

SEQ ID NO: 826783 - protein, 9 aa, Homo Sapiens
TLKYGLLLL

SEQ ID NO: 826784 - protein, 9 aa, Homo Sapiens
KIINTNKLS

SEQ ID NO: 826785 - protein, 9 aa, Homo Sapiens
VHQAILGSV

SEQ ID NO: 826786 - protein, 9 aa, Homo Sapiens
HSHGWPEVG

SEQ ID NO: 826787 - protein, 9 aa, Homo Sapiens
YHAHMASQP

SEQ ID NO: 826788 - protein, 9 aa, Homo Sapiens
DMVTTAGIS

SEQ ID NO: 826789 - protein, 9 aa, Homo Sapiens
GHLIYTCGG

SEQ ID NO: 826790 - protein, 9 aa, Homo Sapiens
ILAGREDIA

SEQ ID NO: 826791 - protein, 9 aa, Homo Sapiens
QKRSKRRDA

SEQ ID NO: 826792 - protein, 9 aa, Homo Sapiens
VKIINYIIV

SEQ ID NO: 826793 - protein, 9 aa, Homo Sapiens
MTSMSLEVC

SEQ ID NO: 826794 - protein, 9 aa, Homo Sapiens
GQITFHAVK

SEQ ID NO: 826795 - protein, 9 aa, Homo Sapiens
TPMYLFLRN

SEQ ID NO: 826796 - protein, 9 aa, Homo Sapiens
FKYFKKAVK

SEQ ID NO: 826797 - protein, 9 aa, Homo Sapiens
SSEASFISA

SEQ ID NO: 826798 - protein, 9 aa, Homo Sapiens
STWNLALPL

SEQ ID NO: 826799 - protein, 9 aa, Homo Sapiens
DKWTTKMNE

SEQ ID NO: 826800 - protein, 9 aa, Homo Sapiens
LILQGLRSQ

SEQ ID NO: 826801 - protein, 9 aa, Homo Sapiens
LCHKVQCFV

SEQ ID NO: 826802 - protein, 9 aa, Homo Sapiens
TGTSLGGVT

SEQ ID NO: 826803 - protein, 9 aa, Homo Sapiens
YRGEKLTLT

SEQ ID NO: 826804 - protein, 9 aa, Homo Sapiens
NILTADNQT

SEQ ID NO: 826805 - protein, 9 aa, Homo Sapiens
TGVLCTVEY

SEQ ID NO: 826806 - protein, 9 aa, Homo Sapiens
VAYYVAREL

SEQ ID NO: 826807 - protein, 9 aa, Homo Sapiens
YEAAHMFFE

SEQ ID NO: 826808 - protein, 9 aa, Homo Sapiens
DVEQGELVA

SEQ ID NO: 826809 - protein, 9 aa, Homo Sapiens
AAAKKYNLR

SEQ ID NO: 826810 - protein, 9 aa, Homo Sapiens
NNGVLEEAI

SEQ ID NO: 826811 - protein, 9 aa, Homo Sapiens
VGLPHNLSS

SEQ ID NO: 826812 - protein, 9 aa, Homo Sapiens
NNLETFTMG

SEQ ID NO: 826813 - protein, 9 aa, Homo Sapiens
LLGLSDHPH

SEQ ID NO: 826814 - protein, 9 aa, Homo Sapiens
RNVKITSPE

SEQ ID NO: 826815 - protein, 9 aa, Homo Sapiens
SSQAESSIF

SEQ ID NO: 826816 - protein, 9 aa, Homo Sapiens
RRDSLSHLE

SEQ ID NO: 826817 - protein, 9 aa, Homo Sapiens
SNMISYAIS

SEQ ID NO: 826818 - protein, 9 aa, Homo Sapiens
EERGIISGT

SEQ ID NO: 826819 - protein, 9 aa, Homo Sapiens
FVLTIVISG

SEQ ID NO: 826820 - protein, 9 aa, Homo Sapiens
SMECYNIYS

SEQ ID NO: 826821 - protein, 9 aa, Homo Sapiens
PEQILSSTL

SEQ ID NO: 826822 - protein, 9 aa, Homo Sapiens
FETQKYISP

SEQ ID NO: 826823 - protein, 9 aa, Homo Sapiens
AKYILYRLR

SEQ ID NO: 826824 - protein, 9 aa, Homo Sapiens
QMYSSRDLE

SEQ ID NO: 826825 - protein, 9 aa, Homo Sapiens
TKGNDFFIN

SEQ ID NO: 826826 - protein, 9 aa, Homo Sapiens
EPWLTQRYR

SEQ ID NO: 826827 - protein, 9 aa, Homo Sapiens
DIAANEDNR

SEQ ID NO: 826828 - protein, 9 aa, Homo Sapiens
NIKLQQFSP

SEQ ID NO: 826829 - protein, 9 aa, Homo Sapiens
DAQPPGLKV

SEQ ID NO: 826830 - protein, 9 aa, Homo Sapiens
EYISYFGYP

SEQ ID NO: 826831 - protein, 9 aa, Homo Sapiens
ATLVPSERE

SEQ ID NO: 826832 - protein, 9 aa, Homo Sapiens
THHNMKPHE

SEQ ID NO: 826833 - protein, 9 aa, Homo Sapiens
RKIIHTGEK

SEQ ID NO: 826834 - protein, 9 aa, Homo Sapiens
CGAGVRTHS

SEQ ID NO: 826835 - protein, 9 aa, Homo Sapiens
LRKLINRNI

SEQ ID NO: 826836 - protein, 9 aa, Homo Sapiens
LDNGNFRRK

SEQ ID NO: 826837 - protein, 9 aa, Homo Sapiens
QLWSESFDE

SEQ ID NO: 826838 - protein, 9 aa, Homo Sapiens
VYSIVSSFA

SEQ ID NO: 826839 - protein, 9 aa, Homo Sapiens
ALIIYMLIP

SEQ ID NO: 826840 - protein, 9 aa, Homo Sapiens
SAARVTLGI

SEQ ID NO: 826841 - protein, 9 aa, Homo Sapiens
LQVTDSAYV

SEQ ID NO: 826842 - protein, 9 aa, Homo Sapiens
DKLLPGLDL

SEQ ID NO: 826843 - protein, 9 aa, Homo Sapiens
QHFYNLVLL

SEQ ID NO: 826844 - protein, 9 aa, Homo Sapiens
QFFDLSICC

SEQ ID NO: 826845 - protein, 9 aa, Homo Sapiens
SEPSNLPLY

SEQ ID NO: 826846 - protein, 9 aa, Homo Sapiens
DYLSDSEFN

SEQ ID NO: 826847 - protein, 9 aa, Homo Sapiens
SVTTDFSKS

SEQ ID NO: 826848 - protein, 9 aa, Homo Sapiens
DTGIFTIRL

SEQ ID NO: 826849 - protein, 9 aa, Homo Sapiens
TYNVAQYIK

SEQ ID NO: 826850 - protein, 9 aa, Homo Sapiens
CNVQFNILD

SEQ ID NO: 826851 - protein, 9 aa, Homo Sapiens
ANSQRPFNA

SEQ ID NO: 826852 - protein, 9 aa, Homo Sapiens
AHTINSSAF

SEQ ID NO: 826853 - protein, 9 aa, Homo Sapiens
NYGFGVLVQ

SEQ ID NO: 826854 - protein, 9 aa, Homo Sapiens
RIEDSVLSG

SEQ ID NO: 826855 - protein, 9 aa, Homo Sapiens
EDILERDIN

SEQ ID NO: 826856 - protein, 9 aa, Homo Sapiens
PGTERFQHV

SEQ ID NO: 826857 - protein, 9 aa, Homo Sapiens
LFLLFLAYS

SEQ ID NO: 826858 - protein, 9 aa, Homo Sapiens
LLVLMAYDR

SEQ ID NO: 826859 - protein, 9 aa, Homo Sapiens
FLLLSAATA

SEQ ID NO: 826860 - protein, 9 aa, Homo Sapiens
DSVCGLEHL

SEQ ID NO: 826861 - protein, 9 aa, Homo Sapiens
ITYKMPLGN

SEQ ID NO: 826862 - protein, 9 aa, Homo Sapiens
FRTFLSSLK

SEQ ID NO: 826863 - protein, 9 aa, Homo Sapiens
NMNNAIFSV

SEQ ID NO: 826864 - protein, 9 aa, Homo Sapiens
LQTLLNETP

SEQ ID NO: 826865 - protein, 9 aa, Homo Sapiens
KISLTNVCG

SEQ ID NO: 826866 - protein, 9 aa, Homo Sapiens
SGNALLQLP

SEQ ID NO: 826867 - protein, 9 aa, Homo Sapiens
RWINLDNNQ

SEQ ID NO: 826868 - protein, 9 aa, Homo Sapiens
ESKNDRKED

SEQ ID NO: 826869 - protein, 9 aa, Homo Sapiens
VKKKSKEEG

SEQ ID NO: 826870 - protein, 9 aa, Homo Sapiens
RLTTSFFRD

SEQ ID NO: 826871 - protein, 9 aa, Homo Sapiens
PVRDQVLQV

SEQ ID NO: 826872 - protein, 9 aa, Homo Sapiens
CLFFQNQLL

SEQ ID NO: 826873 - protein, 9 aa, Homo Sapiens
QAFKQLCLL

SEQ ID NO: 826874 - protein, 9 aa, Homo Sapiens
ISVRFVQLQ

SEQ ID NO: 826875 - protein, 9 aa, Homo Sapiens
ALHKLEQHG

SEQ ID NO: 826876 - protein, 9 aa, Homo Sapiens
LLEITGYTL

SEQ ID NO: 826877 - protein, 9 aa, Homo Sapiens
SALPRKYII

SEQ ID NO: 826878 - protein, 9 aa, Homo Sapiens
HQLEKMNVN

SEQ ID NO: 826879 - protein, 9 aa, Homo Sapiens
QFGWSPNFQ

SEQ ID NO: 826880 - protein, 9 aa, Homo Sapiens
KKLITAQQI

SEQ ID NO: 826881 - protein, 9 aa, Homo Sapiens
AQLAPGSWV

SEQ ID NO: 826882 - protein, 9 aa, Homo Sapiens
DQNAPPICL

SEQ ID NO: 826883 - protein, 9 aa, Homo Sapiens
NINGQWEGK

SEQ ID NO: 826884 - protein, 9 aa, Homo Sapiens
PIVQPLHFL

SEQ ID NO: 826885 - protein, 9 aa, Homo Sapiens
HPEFIILWW

SEQ ID NO: 826886 - protein, 9 aa, Homo Sapiens
ASISSQMHH

SEQ ID NO: 826887 - protein, 9 aa, Homo Sapiens
GDDKLIGNC

SEQ ID NO: 826888 - protein, 9 aa, Homo Sapiens
YGEFLNKYH

SEQ ID NO: 826889 - protein, 9 aa, Homo Sapiens
LNERKVFVG

SEQ ID NO: 826890 - protein, 9 aa, Homo Sapiens
SHQSKMEKA

SEQ ID NO: 826891 - protein, 9 aa, Homo Sapiens
GINPQIESS

SEQ ID NO: 826892 - protein, 9 aa, Homo Sapiens
RAGSPVSPP

SEQ ID NO: 826893 - protein, 9 aa, Homo Sapiens
QTCLKLIRL

SEQ ID NO: 826894 - protein, 9 aa, Homo Sapiens
LMWYKHKGD

SEQ ID NO: 826895 - protein, 9 aa, Homo Sapiens
EFVEEYGLV

SEQ ID NO: 826896 - protein, 9 aa, Homo Sapiens
RAQMEMKPF

SEQ ID NO: 826897 - protein, 9 aa, Homo Sapiens
GSVRCSHFP

SEQ ID NO: 826898 - protein, 9 aa, Homo Sapiens
LSFSRYSSK

SEQ ID NO: 826899 - protein, 9 aa, Homo Sapiens
ELDKLTGYK

SEQ ID NO: 826900 - protein, 9 aa, Homo Sapiens
GKTVIELGA

SEQ ID NO: 826901 - protein, 9 aa, Homo Sapiens
ELDKYEQAC

SEQ ID NO: 826902 - protein, 9 aa, Homo Sapiens
LRSQHRDLK

SEQ ID NO: 826903 - protein, 9 aa, Homo Sapiens
VIVKCVQDT

SEQ ID NO: 826904 - protein, 9 aa, Homo Sapiens
ISPFHDHAE

SEQ ID NO: 826905 - protein, 9 aa, Homo Sapiens
QLRPNKMDG

SEQ ID NO: 826906 - protein, 9 aa, Homo Sapiens
AEEKSIKHE

SEQ ID NO: 826907 - protein, 9 aa, Homo Sapiens
QKAIIFKCL

SEQ ID NO: 826908 - protein, 9 aa, Homo Sapiens
VALQTSINT

SEQ ID NO: 826909 - protein, 9 aa, Homo Sapiens
VWSLGCISY

SEQ ID NO: 826910 - protein, 9 aa, Homo Sapiens
EGKAAASVC

SEQ ID NO: 826911 - protein, 9 aa, Homo Sapiens
RSKDLEKQI

SEQ ID NO: 826912 - protein, 9 aa, Homo Sapiens
LRMIKDNSS

SEQ ID NO: 826913 - protein, 9 aa, Homo Sapiens
ALGEVSSDD

SEQ ID NO: 826914 - protein, 9 aa, Homo Sapiens
EIARLMEYL

SEQ ID NO: 826915 - protein, 9 aa, Homo Sapiens
INQTLSFNE

SEQ ID NO: 826916 - protein, 9 aa, Homo Sapiens
VTSMFEPSG

SEQ ID NO: 826917 - protein, 9 aa, Homo Sapiens
ALEQFIKEI

SEQ ID NO: 826918 - protein, 9 aa, Homo Sapiens
SPATIIDFH

SEQ ID NO: 826919 - protein, 9 aa, Homo Sapiens
EEGSFSQVT

SEQ ID NO: 826920 - protein, 9 aa, Homo Sapiens
SPNNYLLGT

SEQ ID NO: 826921 - protein, 9 aa, Homo Sapiens
WMHYNQAVD

SEQ ID NO: 826922 - protein, 9 aa, Homo Sapiens
DDAHLRHDK

SEQ ID NO: 826923 - protein, 9 aa, Homo Sapiens
DLAVYEMIQ

SEQ ID NO: 826924 - protein, 9 aa, Homo Sapiens
LSFTESLTR

SEQ ID NO: 826925 - protein, 9 aa, Homo Sapiens
SFRAQYGTE

SEQ ID NO: 826926 - protein, 9 aa, Homo Sapiens
LGLRAEDNP

SEQ ID NO: 826927 - protein, 9 aa, Homo Sapiens
SVRPERALW

SEQ ID NO: 826928 - protein, 9 aa, Homo Sapiens
YFFRTIPSD

SEQ ID NO: 826929 - protein, 9 aa, Homo Sapiens
QSQYLIVHC

SEQ ID NO: 826930 - protein, 9 aa, Homo Sapiens
DIAEIDDLS

SEQ ID NO: 826931 - protein, 9 aa, Homo Sapiens
AWIYTSEND

SEQ ID NO: 826932 - protein, 9 aa, Homo Sapiens
SVSRLKTVI

SEQ ID NO: 826933 - protein, 9 aa, Homo Sapiens
AMAIFKLLD

SEQ ID NO: 826934 - protein, 9 aa, Homo Sapiens
ENGNLENSC

SEQ ID NO: 826935 - protein, 9 aa, Homo Sapiens
EYLVGDGPH

SEQ ID NO: 826936 - protein, 9 aa, Homo Sapiens
RSRINDEEL

SEQ ID NO: 826937 - protein, 9 aa, Homo Sapiens
HERGLTLHQ

SEQ ID NO: 826938 - protein, 9 aa, Homo Sapiens
DTIRLPYEE

SEQ ID NO: 826939 - protein, 9 aa, Homo Sapiens
TLTCHRKLH

SEQ ID NO: 826940 - protein, 9 aa, Homo Sapiens
YPGVVEVWE

SEQ ID NO: 826941 - protein, 9 aa, Homo Sapiens
QAAVAPNIS

SEQ ID NO: 826942 - protein, 9 aa, Homo Sapiens
VQTPPALES

SEQ ID NO: 826943 - protein, 9 aa, Homo Sapiens
KKVALRWLE

SEQ ID NO: 826944 - protein, 9 aa, Homo Sapiens
TITTTGIMN

SEQ ID NO: 826945 - protein, 9 aa, Homo Sapiens
TVLHIAALY

SEQ ID NO: 826946 - protein, 9 aa, Homo Sapiens
TQRAYTSED

SEQ ID NO: 826947 - protein, 9 aa, Homo Sapiens
KDTWPGVTQ

SEQ ID NO: 826948 - protein, 9 aa, Homo Sapiens
HLKVLKSLP

SEQ ID NO: 826949 - protein, 9 aa, Homo Sapiens
YHGHSQKKN

SEQ ID NO: 826950 - protein, 9 aa, Homo Sapiens
LQLFKNTGS

SEQ ID NO: 826951 - protein, 9 aa, Homo Sapiens
ALKQILSLS

SEQ ID NO: 826952 - protein, 9 aa, Homo Sapiens
LPSVTKLFP

SEQ ID NO: 826953 - protein, 9 aa, Homo Sapiens
MPSSVSLRA

SEQ ID NO: 826954 - protein, 9 aa, Homo Sapiens
GFLFLRLFA

SEQ ID NO: 826955 - protein, 9 aa, Homo Sapiens
SVPMILQLG

SEQ ID NO: 826956 - protein, 9 aa, Homo Sapiens
NQWWRVGAD

SEQ ID NO: 826957 - protein, 9 aa, Homo Sapiens
NRFGPDCQP

SEQ ID NO: 826958 - protein, 9 aa, Homo Sapiens
PIPTPNPLA

SEQ ID NO: 826959 - protein, 9 aa, Homo Sapiens
EDENREEEK

SEQ ID NO: 826960 - protein, 9 aa, Homo Sapiens
RTVAGYGRF

SEQ ID NO: 826961 - protein, 9 aa, Homo Sapiens
KNNNKFVPY

SEQ ID NO: 826962 - protein, 9 aa, Homo Sapiens
ALLLDGISV

SEQ ID NO: 826963 - protein, 9 aa, Homo Sapiens
LINNFQEEQ

SEQ ID NO: 826964 - protein, 9 aa, Homo Sapiens
TENAFEPAT

SEQ ID NO: 826965 - protein, 9 aa, Homo Sapiens
SLLRDPDRT

SEQ ID NO: 826966 - protein, 9 aa, Homo Sapiens
HMFCKEAKL

SEQ ID NO: 826967 - protein, 9 aa, Homo Sapiens
ELKERLNMA

SEQ ID NO: 826968 - protein, 9 aa, Homo Sapiens
ISDAIYRPM

SEQ ID NO: 826969 - protein, 9 aa, Homo Sapiens
TASFDSYYS

SEQ ID NO: 826970 - protein, 9 aa, Homo Sapiens
EIETEVKTR

SEQ ID NO: 826971 - protein, 9 aa, Homo Sapiens
KVSGQVGYR

SEQ ID NO: 826972 - protein, 9 aa, Homo Sapiens
YLRFTWSMK

SEQ ID NO: 826973 - protein, 9 aa, Homo Sapiens
ASQEVMGLF

SEQ ID NO: 826974 - protein, 9 aa, Homo Sapiens
RLTISELDD

SEQ ID NO: 826975 - protein, 9 aa, Homo Sapiens
IPKSTRQKK

SEQ ID NO: 826976 - protein, 9 aa, Homo Sapiens
AFMDISVTM

SEQ ID NO: 826977 - protein, 9 aa, Homo Sapiens
YCGDSPPAL

SEQ ID NO: 826978 - protein, 9 aa, Homo Sapiens
AEEEDARKI

SEQ ID NO: 826979 - protein, 9 aa, Homo Sapiens
PVERGAFIG

SEQ ID NO: 826980 - protein, 9 aa, Homo Sapiens
PYECKDCRT

SEQ ID NO: 826981 - protein, 9 aa, Homo Sapiens
RDKHPEKFN

SEQ ID NO: 826982 - protein, 9 aa, Homo Sapiens
LNTIAWPLC

SEQ ID NO: 826983 - protein, 9 aa, Homo Sapiens
KEVQDLFET

SEQ ID NO: 826984 - protein, 9 aa, Homo Sapiens
EDNCVNSGS

SEQ ID NO: 826985 - protein, 9 aa, Homo Sapiens
RSSSKIALH

SEQ ID NO: 826986 - protein, 9 aa, Homo Sapiens
NYIKRYFEL

SEQ ID NO: 826987 - protein, 9 aa, Homo Sapiens
ILRRPASYW

SEQ ID NO: 826988 - protein, 9 aa, Homo Sapiens
INNVDGKSL

SEQ ID NO: 826989 - protein, 9 aa, Homo Sapiens
MPHELGHVL

SEQ ID NO: 826990 - protein, 9 aa, Homo Sapiens
ENSPGQLSI

SEQ ID NO: 826991 - protein, 9 aa, Homo Sapiens
PRIGCGLDC

SEQ ID NO: 826992 - protein, 9 aa, Homo Sapiens
LIDSITVSV

SEQ ID NO: 826993 - protein, 9 aa, Homo Sapiens
LQYAAPGSL

SEQ ID NO: 826994 - protein, 9 aa, Homo Sapiens
TLPPSDINE

SEQ ID NO: 826995 - protein, 9 aa, Homo Sapiens
TVEYVRQLL

SEQ ID NO: 826996 - protein, 9 aa, Homo Sapiens
EPNTFRDSL

SEQ ID NO: 826997 - protein, 9 aa, Homo Sapiens
WSNYHQVTE

SEQ ID NO: 826998 - protein, 9 aa, Homo Sapiens
AACDQRVII

SEQ ID NO: 826999 - protein, 9 aa, Homo Sapiens
DATNVNDAL

SEQ ID NO: 827000 - protein, 9 aa, Homo Sapiens
HTERLQIVG

SEQ ID NO: 827001 - protein, 9 aa, Homo Sapiens
CSPYLFDIF

SEQ ID NO: 827002 - protein, 9 aa, Homo Sapiens
TYVVLRGVE

SEQ ID NO: 827003 - protein, 9 aa, Homo Sapiens
EEKVAPYNI

SEQ ID NO: 827004 - protein, 9 aa, Homo Sapiens
GPPRYLGDC

SEQ ID NO: 827005 - protein, 9 aa, Homo Sapiens
EEAKRKSPT

SEQ ID NO: 827006 - protein, 9 aa, Homo Sapiens
NECHEYGDK

SEQ ID NO: 827007 - protein, 9 aa, Homo Sapiens
SPQALKQIL

SEQ ID NO: 827008 - protein, 9 aa, Homo Sapiens
PVGGNVTIN

SEQ ID NO: 827009 - protein, 9 aa, Homo Sapiens
DEDDPRLKC

SEQ ID NO: 827010 - protein, 9 aa, Homo Sapiens
HLEIENKVL

SEQ ID NO: 827011 - protein, 9 aa, Homo Sapiens
GLKRFSCLS

SEQ ID NO: 827012 - protein, 9 aa, Homo Sapiens
FDTNGDGDI

SEQ ID NO: 827013 - protein, 9 aa, Homo Sapiens
DPSAPFQSE

SEQ ID NO: 827014 - protein, 9 aa, Homo Sapiens
KWIIGVCSE

SEQ ID NO: 827015 - protein, 9 aa, Homo Sapiens
DFKRPFSTP

SEQ ID NO: 827016 - protein, 9 aa, Homo Sapiens
FSPDLGKNL

SEQ ID NO: 827017 - protein, 9 aa, Homo Sapiens
ESITGSPLQ

SEQ ID NO: 827018 - protein, 9 aa, Homo Sapiens
RINTNLTLI

SEQ ID NO: 827019 - protein, 9 aa, Homo Sapiens
KRIQRTFAA

SEQ ID NO: 827020 - protein, 9 aa, Homo Sapiens
HKELFSLFS

SEQ ID NO: 827021 - protein, 9 aa, Homo Sapiens
RLDECIYAI

SEQ ID NO: 827022 - protein, 9 aa, Homo Sapiens
SIDSSRKNE

SEQ ID NO: 827023 - protein, 9 aa, Homo Sapiens
EMQVALFIF

SEQ ID NO: 827024 - protein, 9 aa, Homo Sapiens
RKLCRYLVH

SEQ ID NO: 827025 - protein, 9 aa, Homo Sapiens
HQIIYIGES

SEQ ID NO: 827026 - protein, 9 aa, Homo Sapiens
EVWYLQSTQ

SEQ ID NO: 827027 - protein, 9 aa, Homo Sapiens
SVANVACGE

SEQ ID NO: 827028 - protein, 9 aa, Homo Sapiens
LILKRASAE

SEQ ID NO: 827029 - protein, 9 aa, Homo Sapiens
HTPCYRTTG

SEQ ID NO: 827030 - protein, 9 aa, Homo Sapiens
LNKHSYPNV

SEQ ID NO: 827031 - protein, 9 aa, Homo Sapiens
LEVPFIWPG

SEQ ID NO: 827032 - protein, 9 aa, Homo Sapiens
VEQVLLIWD

SEQ ID NO: 827033 - protein, 9 aa, Homo Sapiens
IFLCSSCGR

SEQ ID NO: 827034 - protein, 9 aa, Homo Sapiens
FGLQVPFFL

SEQ ID NO: 827035 - protein, 9 aa, Homo Sapiens
EGYHSVTQN

SEQ ID NO: 827036 - protein, 9 aa, Homo Sapiens
CSENTSSRA

SEQ ID NO: 827037 - protein, 9 aa, Homo Sapiens
VHAEQVLSD

SEQ ID NO: 827038 - protein, 9 aa, Homo Sapiens
PAAVLSSAD

SEQ ID NO: 827039 - protein, 9 aa, Homo Sapiens
NTFKIDLFR

SEQ ID NO: 827040 - protein, 9 aa, Homo Sapiens
TYDTQNINL

SEQ ID NO: 827041 - protein, 9 aa, Homo Sapiens
LGKKPSKLK

SEQ ID NO: 827042 - protein, 9 aa, Homo Sapiens
GHRSIDPMG

SEQ ID NO: 827043 - protein, 9 aa, Homo Sapiens
TEDSYTAEV

SEQ ID NO: 827044 - protein, 9 aa, Homo Sapiens
LLIGPKLYE

SEQ ID NO: 827045 - protein, 9 aa, Homo Sapiens
CEKFGPGPA

SEQ ID NO: 827046 - protein, 9 aa, Homo Sapiens
VKNNTTVLE

SEQ ID NO: 827047 - protein, 9 aa, Homo Sapiens
SGDKNRLAG

SEQ ID NO: 827048 - protein, 9 aa, Homo Sapiens
FVCVAHEIY

SEQ ID NO: 827049 - protein, 9 aa, Homo Sapiens
GLFNENFRR

SEQ ID NO: 827050 - protein, 9 aa, Homo Sapiens
ETFISASKI

SEQ ID NO: 827051 - protein, 9 aa, Homo Sapiens
RMLYDLHSE

SEQ ID NO: 827052 - protein, 9 aa, Homo Sapiens
YGNYYWLLT

SEQ ID NO: 827053 - protein, 9 aa, Homo Sapiens
LLLLKLSTD

SEQ ID NO: 827054 - protein, 9 aa, Homo Sapiens
EHVIENNNT

SEQ ID NO: 827055 - protein, 9 aa, Homo Sapiens
LFTHKEELE

SEQ ID NO: 827056 - protein, 9 aa, Homo Sapiens
GKKPSKLKS

SEQ ID NO: 827057 - protein, 9 aa, Homo Sapiens
AIIVGVELP

SEQ ID NO: 827058 - protein, 9 aa, Homo Sapiens
KCGKSFCVK

SEQ ID NO: 827059 - protein, 9 aa, Homo Sapiens
IESQQCEPA

SEQ ID NO: 827060 - protein, 9 aa, Homo Sapiens
CLSYLHVLL

SEQ ID NO: 827061 - protein, 9 aa, Homo Sapiens
AHGPDTLPQ

SEQ ID NO: 827062 - protein, 9 aa, Homo Sapiens
SQVLLSICS

SEQ ID NO: 827063 - protein, 9 aa, Homo Sapiens
KRSFLENKR

SEQ ID NO: 827064 - protein, 9 aa, Homo Sapiens
KQLLVAMPL

SEQ ID NO: 827065 - protein, 9 aa, Homo Sapiens
IFKYFKKAV

SEQ ID NO: 827066 - protein, 9 aa, Homo Sapiens
DGEGAASAW

SEQ ID NO: 827067 - protein, 9 aa, Homo Sapiens
TANKNNDAL

SEQ ID NO: 827068 - protein, 9 aa, Homo Sapiens
ISFGCASCP

SEQ ID NO: 827069 - protein, 9 aa, Homo Sapiens
EQEHIHRER

SEQ ID NO: 827070 - protein, 9 aa, Homo Sapiens
TVMAYDHYI

SEQ ID NO: 827071 - protein, 9 aa, Homo Sapiens
KGINLIQTI

SEQ ID NO: 827072 - protein, 9 aa, Homo Sapiens
VQLCRATDE

SEQ ID NO: 827073 - protein, 9 aa, Homo Sapiens
GLALIKTYY

SEQ ID NO: 827074 - protein, 9 aa, Homo Sapiens
EMERGLSKK

SEQ ID NO: 827075 - protein, 9 aa, Homo Sapiens
AVQVNLTAH

SEQ ID NO: 827076 - protein, 9 aa, Homo Sapiens
VGLITLAFP

SEQ ID NO: 827077 - protein, 9 aa, Homo Sapiens
RYAMVLFMI

SEQ ID NO: 827078 - protein, 9 aa, Homo Sapiens
PHHGLHTAG

SEQ ID NO: 827079 - protein, 9 aa, Homo Sapiens
QKLVHRDIK

SEQ ID NO: 827080 - protein, 9 aa, Homo Sapiens
HPESGDLLV

SEQ ID NO: 827081 - protein, 9 aa, Homo Sapiens
QEDVFQKFG

SEQ ID NO: 827082 - protein, 9 aa, Homo Sapiens
ALSCDTGLE

SEQ ID NO: 827083 - protein, 9 aa, Homo Sapiens
TSDRSQESL

SEQ ID NO: 827084 - protein, 9 aa, Homo Sapiens
HFLRLNHNK

SEQ ID NO: 827085 - protein, 9 aa, Homo Sapiens
TPHKLQEPM

SEQ ID NO: 827086 - protein, 9 aa, Homo Sapiens
AKEKYIVYP

SEQ ID NO: 827087 - protein, 9 aa, Homo Sapiens
PSPAPPTQP

SEQ ID NO: 827088 - protein, 9 aa, Homo Sapiens
ADFDDRRGV

SEQ ID NO: 827089 - protein, 9 aa, Homo Sapiens
YPSHIGSII

SEQ ID NO: 827090 - protein, 9 aa, Homo Sapiens
HILLDQKDK

SEQ ID NO: 827091 - protein, 9 aa, Homo Sapiens
EASERDTHK

SEQ ID NO: 827092 - protein, 9 aa, Homo Sapiens
WKQWHEDIT

SEQ ID NO: 827093 - protein, 9 aa, Homo Sapiens
GMLLNDHKV

SEQ ID NO: 827094 - protein, 9 aa, Homo Sapiens
NNSENQTYQ

SEQ ID NO: 827095 - protein, 9 aa, Homo Sapiens
PSSVSLRAP

SEQ ID NO: 827096 - protein, 9 aa, Homo Sapiens
GSVPAVTEE

SEQ ID NO: 827097 - protein, 9 aa, Homo Sapiens
LKIKNTRRS

SEQ ID NO: 827098 - protein, 9 aa, Homo Sapiens
AYMLLQPIR

SEQ ID NO: 827099 - protein, 9 aa, Homo Sapiens
QEQTTETAS

SEQ ID NO: 827100 - protein, 9 aa, Homo Sapiens
SQRGRCHVA

SEQ ID NO: 827101 - protein, 9 aa, Homo Sapiens
AAPGRATEG

SEQ ID NO: 827102 - protein, 9 aa, Homo Sapiens
AYQRTYYMK

SEQ ID NO: 827103 - protein, 9 aa, Homo Sapiens
AGLRGLPEL

SEQ ID NO: 827104 - protein, 9 aa, Homo Sapiens
SADIFRQIA

SEQ ID NO: 827105 - protein, 9 aa, Homo Sapiens
PPPRDFLLY

SEQ ID NO: 827106 - protein, 9 aa, Homo Sapiens
EITAYNRCT

SEQ ID NO: 827107 - protein, 9 aa, Homo Sapiens
GTIDFIVNE

SEQ ID NO: 827108 - protein, 9 aa, Homo Sapiens
RCNTLITFI

SEQ ID NO: 827109 - protein, 9 aa, Homo Sapiens
HYSTVKDNQ

SEQ ID NO: 827110 - protein, 9 aa, Homo Sapiens
PTINMPNTL

SEQ ID NO: 827111 - protein, 9 aa, Homo Sapiens
GEGFGKTTA

SEQ ID NO: 827112 - protein, 9 aa, Homo Sapiens
MVIYLMGAI

SEQ ID NO: 827113 - protein, 9 aa, Homo Sapiens
YVYGSGKTY

SEQ ID NO: 827114 - protein, 9 aa, Homo Sapiens
IRSISFPAC

SEQ ID NO: 827115 - protein, 9 aa, Homo Sapiens
VDECQPSQC

SEQ ID NO: 827116 - protein, 9 aa, Homo Sapiens
MALVRYIKE

SEQ ID NO: 827117 - protein, 9 aa, Homo Sapiens
HNYPTQLQA

SEQ ID NO: 827118 - protein, 9 aa, Homo Sapiens
IFGAFFSGI

SEQ ID NO: 827119 - protein, 9 aa, Homo Sapiens
LAVLEGDIL

SEQ ID NO: 827120 - protein, 9 aa, Homo Sapiens
ETGMEVSQT

SEQ ID NO: 827121 - protein, 9 aa, Homo Sapiens
QFWTLLFTS

SEQ ID NO: 827122 - protein, 9 aa, Homo Sapiens
TPRPTWKPW

SEQ ID NO: 827123 - protein, 9 aa, Homo Sapiens
VLLVRIICG

SEQ ID NO: 827124 - protein, 9 aa, Homo Sapiens
MDCNEFDQY

SEQ ID NO: 827125 - protein, 9 aa, Homo Sapiens
EEKPRAQEL

SEQ ID NO: 827126 - protein, 9 aa, Homo Sapiens
WSHESPPCL

SEQ ID NO: 827127 - protein, 9 aa, Homo Sapiens
IEQLRKKRR

SEQ ID NO: 827128 - protein, 9 aa, Homo Sapiens
HEEVNSDIF

SEQ ID NO: 827129 - protein, 9 aa, Homo Sapiens
DSKGQKAYA

SEQ ID NO: 827130 - protein, 9 aa, Homo Sapiens
YWRFPNNSI

SEQ ID NO: 827131 - protein, 9 aa, Homo Sapiens
ATAADQDKN

SEQ ID NO: 827132 - protein, 9 aa, Homo Sapiens
FSRLDPNFS

SEQ ID NO: 827133 - protein, 9 aa, Homo Sapiens
KLVDVLVDY

SEQ ID NO: 827134 - protein, 9 aa, Homo Sapiens
ATGNITIIP

SEQ ID NO: 827135 - protein, 9 aa, Homo Sapiens
PEGNLTLRY

SEQ ID NO: 827136 - protein, 9 aa, Homo Sapiens
TSLLQVPLK

SEQ ID NO: 827137 - protein, 9 aa, Homo Sapiens
VCIMKARKV

SEQ ID NO: 827138 - protein, 9 aa, Homo Sapiens
DREPLSLIE

SEQ ID NO: 827139 - protein, 9 aa, Homo Sapiens
PPRPETGIL

SEQ ID NO: 827140 - protein, 9 aa, Homo Sapiens
LRNQREFSM

SEQ ID NO: 827141 - protein, 9 aa, Homo Sapiens
VEAEKLFWD

SEQ ID NO: 827142 - protein, 9 aa, Homo Sapiens
DAESLESSD

SEQ ID NO: 827143 - protein, 9 aa, Homo Sapiens
VLAPAWHLL

SEQ ID NO: 827144 - protein, 9 aa, Homo Sapiens
RATFKSGKR

SEQ ID NO: 827145 - protein, 9 aa, Homo Sapiens
LYVQIDFSR

SEQ ID NO: 827146 - protein, 9 aa, Homo Sapiens
FNELPETFP

SEQ ID NO: 827147 - protein, 9 aa, Homo Sapiens
HCGMILQEA

SEQ ID NO: 827148 - protein, 9 aa, Homo Sapiens
LVFKMCFYR

SEQ ID NO: 827149 - protein, 9 aa, Homo Sapiens
AGDITELNI

SEQ ID NO: 827150 - protein, 9 aa, Homo Sapiens
DNCSLEKFY

SEQ ID NO: 827151 - protein, 9 aa, Homo Sapiens
TVIKAPRDK

SEQ ID NO: 827152 - protein, 9 aa, Homo Sapiens
VFNPIVGKW

SEQ ID NO: 827153 - protein, 9 aa, Homo Sapiens
VLFSTWRIK

SEQ ID NO: 827154 - protein, 9 aa, Homo Sapiens
EQVLSDKEN

SEQ ID NO: 827155 - protein, 9 aa, Homo Sapiens
KNLCSLKTP

SEQ ID NO: 827156 - protein, 9 aa, Homo Sapiens
QAQVKQESV

SEQ ID NO: 827157 - protein, 9 aa, Homo Sapiens
DRRHHPKTY

SEQ ID NO: 827158 - protein, 9 aa, Homo Sapiens
DKCLRPDVC

SEQ ID NO: 827159 - protein, 9 aa, Homo Sapiens
PGEPICVVW

SEQ ID NO: 827160 - protein, 9 aa, Homo Sapiens
GTHKRYFSE

SEQ ID NO: 827161 - protein, 9 aa, Homo Sapiens
DADISDDEP

SEQ ID NO: 827162 - protein, 9 aa, Homo Sapiens
HDEFGYNAD

SEQ ID NO: 827163 - protein, 9 aa, Homo Sapiens
VKHLRLSLT

SEQ ID NO: 827164 - protein, 9 aa, Homo Sapiens
LCMFFEPLL

SEQ ID NO: 827165 - protein, 9 aa, Homo Sapiens
SSSSTYHTI

SEQ ID NO: 827166 - protein, 9 aa, Homo Sapiens
FGKIIRQRF

SEQ ID NO: 827167 - protein, 9 aa, Homo Sapiens
GKAFGQSSG

SEQ ID NO: 827168 - protein, 9 aa, Homo Sapiens
YQGQSRGCV

SEQ ID NO: 827169 - protein, 9 aa, Homo Sapiens
QTSILRDAL

SEQ ID NO: 827170 - protein, 9 aa, Homo Sapiens
EAVTIDNAK

SEQ ID NO: 827171 - protein, 9 aa, Homo Sapiens
KYSGSWNFG

SEQ ID NO: 827172 - protein, 9 aa, Homo Sapiens
NPGQITFHA

SEQ ID NO: 827173 - protein, 9 aa, Homo Sapiens
NFVVKPRDQ

SEQ ID NO: 827174 - protein, 9 aa, Homo Sapiens
DKQVMEQGS

SEQ ID NO: 827175 - protein, 9 aa, Homo Sapiens
IANINRTLE

SEQ ID NO: 827176 - protein, 9 aa, Homo Sapiens
TVAGYGRFS

SEQ ID NO: 827177 - protein, 9 aa, Homo Sapiens
ILMKRLTYS

SEQ ID NO: 827178 - protein, 9 aa, Homo Sapiens
GVANVDMSR

SEQ ID NO: 827179 - protein, 9 aa, Homo Sapiens
QGADRVSEA

SEQ ID NO: 827180 - protein, 9 aa, Homo Sapiens
YLFASFSSD

SEQ ID NO: 827181 - protein, 9 aa, Homo Sapiens
CDDFADCMD

SEQ ID NO: 827182 - protein, 9 aa, Homo Sapiens
QAKRRYFIL

SEQ ID NO: 827183 - protein, 9 aa, Homo Sapiens
ASPVSRTPR

SEQ ID NO: 827184 - protein, 9 aa, Homo Sapiens
YCRSAHIHY

SEQ ID NO: 827185 - protein, 9 aa, Homo Sapiens
TTGITPVLR

SEQ ID NO: 827186 - protein, 9 aa, Homo Sapiens
YQTLQEERY

SEQ ID NO: 827187 - protein, 9 aa, Homo Sapiens
MKSLKYCNV

SEQ ID NO: 827188 - protein, 9 aa, Homo Sapiens
TLPTKVAKA

SEQ ID NO: 827189 - protein, 9 aa, Homo Sapiens
TELSTFLLL

SEQ ID NO: 827190 - protein, 9 aa, Homo Sapiens
RPRLFHQRR

SEQ ID NO: 827191 - protein, 9 aa, Homo Sapiens
DKITRKPVT

SEQ ID NO: 827192 - protein, 9 aa, Homo Sapiens
FILRNQKRS

SEQ ID NO: 827193 - protein, 9 aa, Homo Sapiens
QQSMHGRPN

SEQ ID NO: 827194 - protein, 9 aa, Homo Sapiens
VKHDLILNT

SEQ ID NO: 827195 - protein, 9 aa, Homo Sapiens
RRVHTGKKP

SEQ ID NO: 827196 - protein, 9 aa, Homo Sapiens
ISNPTELQN

SEQ ID NO: 827197 - protein, 9 aa, Homo Sapiens
NPKLKQARL

SEQ ID NO: 827198 - protein, 9 aa, Homo Sapiens
PATIIDFHV

SEQ ID NO: 827199 - protein, 9 aa, Homo Sapiens
PKRNLFSRH

SEQ ID NO: 827200 - protein, 9 aa, Homo Sapiens
ADTREDMNE

SEQ ID NO: 827201 - protein, 9 aa, Homo Sapiens
HLSYLKHHE

SEQ ID NO: 827202 - protein, 9 aa, Homo Sapiens
ENLFNKLVE

SEQ ID NO: 827203 - protein, 9 aa, Homo Sapiens
IMEFSGGGL

SEQ ID NO: 827204 - protein, 9 aa, Homo Sapiens
EDATVEVSP

SEQ ID NO: 827205 - protein, 9 aa, Homo Sapiens
MEQLHTYQE

SEQ ID NO: 827206 - protein, 9 aa, Homo Sapiens
PNFVAQGAD

SEQ ID NO: 827207 - protein, 9 aa, Homo Sapiens
CYWLCQQNM

SEQ ID NO: 827208 - protein, 9 aa, Homo Sapiens
IMSYKRRIS

SEQ ID NO: 827209 - protein, 9 aa, Homo Sapiens
VLLTNVVMG

SEQ ID NO: 827210 - protein, 9 aa, Homo Sapiens
KLEIAREKH

SEQ ID NO: 827211 - protein, 9 aa, Homo Sapiens
IGHIEAILL

SEQ ID NO: 827212 - protein, 9 aa, Homo Sapiens
EMAVNTELL

SEQ ID NO: 827213 - protein, 9 aa, Homo Sapiens
LSVTTDFSK

SEQ ID NO: 827214 - protein, 9 aa, Homo Sapiens
APMLTHATT

SEQ ID NO: 827215 - protein, 9 aa, Homo Sapiens
VEYLKESYF

SEQ ID NO: 827216 - protein, 9 aa, Homo Sapiens
SGSDYSGRS

SEQ ID NO: 827217 - protein, 9 aa, Homo Sapiens
VVWGRYGEY

SEQ ID NO: 827218 - protein, 9 aa, Homo Sapiens
PLRASTASP

SEQ ID NO: 827219 - protein, 9 aa, Homo Sapiens
SGHINIFVD

SEQ ID NO: 827220 - protein, 9 aa, Homo Sapiens
RLEWRGEGK

SEQ ID NO: 827221 - protein, 9 aa, Homo Sapiens
VGKRCDTPA

SEQ ID NO: 827222 - protein, 9 aa, Homo Sapiens
IFVLTCMSV

SEQ ID NO: 827223 - protein, 9 aa, Homo Sapiens
KQRKHLNMK

SEQ ID NO: 827224 - protein, 9 aa, Homo Sapiens
TVSAVKPAI

SEQ ID NO: 827225 - protein, 9 aa, Homo Sapiens
LHGSLVCTQ

SEQ ID NO: 827226 - protein, 9 aa, Homo Sapiens
EKISATWKR

SEQ ID NO: 827227 - protein, 9 aa, Homo Sapiens
PKKPFFLGP

SEQ ID NO: 827228 - protein, 9 aa, Homo Sapiens
PEVKRLMFQ

SEQ ID NO: 827229 - protein, 9 aa, Homo Sapiens
KNLPSYSGP

SEQ ID NO: 827230 - protein, 9 aa, Homo Sapiens
VEEEEVLNH

SEQ ID NO: 827231 - protein, 9 aa, Homo Sapiens
LDPNNYFTL

SEQ ID NO: 827232 - protein, 9 aa, Homo Sapiens
LDTMLRGDN

SEQ ID NO: 827233 - protein, 9 aa, Homo Sapiens
SEDTRSRGV

SEQ ID NO: 827234 - protein, 9 aa, Homo Sapiens
NVDMSRDSC

SEQ ID NO: 827235 - protein, 9 aa, Homo Sapiens
ARVNKKTIP

SEQ ID NO: 827236 - protein, 9 aa, Homo Sapiens
VHEEAAVYR

SEQ ID NO: 827237 - protein, 9 aa, Homo Sapiens
RSSPYATDV

SEQ ID NO: 827238 - protein, 9 aa, Homo Sapiens
TFNEFLERG

SEQ ID NO: 827239 - protein, 9 aa, Homo Sapiens
EIISYDVKY

SEQ ID NO: 827240 - protein, 9 aa, Homo Sapiens
MQTMAQKNE

SEQ ID NO: 827241 - protein, 9 aa, Homo Sapiens
ADPAKEYAR

SEQ ID NO: 827242 - protein, 9 aa, Homo Sapiens
QPGQRGKTL

SEQ ID NO: 827243 - protein, 9 aa, Homo Sapiens
TTMRTLGMG

SEQ ID NO: 827244 - protein, 9 aa, Homo Sapiens
LLMTYFDPD

SEQ ID NO: 827245 - protein, 9 aa, Homo Sapiens
ASHTIQGTL

SEQ ID NO: 827246 - protein, 9 aa, Homo Sapiens
LGQMLGGFL

SEQ ID NO: 827247 - protein, 9 aa, Homo Sapiens
KNPYAASNK

SEQ ID NO: 827248 - protein, 9 aa, Homo Sapiens
HSKRFLLVC

SEQ ID NO: 827249 - protein, 9 aa, Homo Sapiens
VVRLVALQR

SEQ ID NO: 827250 - protein, 9 aa, Homo Sapiens
MGFLVGNAF

SEQ ID NO: 827251 - protein, 9 aa, Homo Sapiens
INEEIDKFD

SEQ ID NO: 827252 - protein, 9 aa, Homo Sapiens
LMTYLDKAP

SEQ ID NO: 827253 - protein, 9 aa, Homo Sapiens
LDKVCKFDV

SEQ ID NO: 827254 - protein, 9 aa, Homo Sapiens
LRSVLTEHK

SEQ ID NO: 827255 - protein, 9 aa, Homo Sapiens
KIEQIKCDK

SEQ ID NO: 827256 - protein, 9 aa, Homo Sapiens
LKILNLHFL

SEQ ID NO: 827257 - protein, 9 aa, Homo Sapiens
CINANFLTR

SEQ ID NO: 827258 - protein, 9 aa, Homo Sapiens
RNRMAPVLP

SEQ ID NO: 827259 - protein, 9 aa, Homo Sapiens
TVYLCDTNH

SEQ ID NO: 827260 - protein, 9 aa, Homo Sapiens
LEQFWTLLF

SEQ ID NO: 827261 - protein, 9 aa, Homo Sapiens
IKQSSPPLS

SEQ ID NO: 827262 - protein, 9 aa, Homo Sapiens
YNKILATKK

SEQ ID NO: 827263 - protein, 9 aa, Homo Sapiens
LFARCILTA

SEQ ID NO: 827264 - protein, 9 aa, Homo Sapiens
DIPFNKNNT

SEQ ID NO: 827265 - protein, 9 aa, Homo Sapiens
CDTAVGTPV

SEQ ID NO: 827266 - protein, 9 aa, Homo Sapiens
FRAQYGTEM

SEQ ID NO: 827267 - protein, 9 aa, Homo Sapiens
RLSIKGHLC

SEQ ID NO: 827268 - protein, 9 aa, Homo Sapiens
VITNGPEKT

SEQ ID NO: 827269 - protein, 9 aa, Homo Sapiens
HSKVPYIVR

SEQ ID NO: 827270 - protein, 9 aa, Homo Sapiens
KGLTLGRSP

SEQ ID NO: 827271 - protein, 9 aa, Homo Sapiens
KIMSIKLCP

SEQ ID NO: 827272 - protein, 9 aa, Homo Sapiens
ACSSQPEHY

SEQ ID NO: 827273 - protein, 9 aa, Homo Sapiens
AVADIYCGN

SEQ ID NO: 827274 - protein, 9 aa, Homo Sapiens
ECINYYKLS

SEQ ID NO: 827275 - protein, 9 aa, Homo Sapiens
TTLTYDTQN

SEQ ID NO: 827276 - protein, 9 aa, Homo Sapiens
VATGTHECS

SEQ ID NO: 827277 - protein, 9 aa, Homo Sapiens
QPGAYQPCL

SEQ ID NO: 827278 - protein, 9 aa, Homo Sapiens
LIRKNGRMV

SEQ ID NO: 827279 - protein, 9 aa, Homo Sapiens
EGQDKQRNR

SEQ ID NO: 827280 - protein, 9 aa, Homo Sapiens
QAAGNDTLQ

SEQ ID NO: 827281 - protein, 9 aa, Homo Sapiens
PQLMINLCG

SEQ ID NO: 827282 - protein, 9 aa, Homo Sapiens
ASNYSMELQ

SEQ ID NO: 827283 - protein, 9 aa, Homo Sapiens
TKSEFTKLS

SEQ ID NO: 827284 - protein, 9 aa, Homo Sapiens
LIVLLGTVG

SEQ ID NO: 827285 - protein, 9 aa, Homo Sapiens
IWVNNTIID

SEQ ID NO: 827286 - protein, 9 aa, Homo Sapiens
LVTRLVNIV

SEQ ID NO: 827287 - protein, 9 aa, Homo Sapiens
LTQRYREYL

SEQ ID NO: 827288 - protein, 9 aa, Homo Sapiens
FSKLSGDYA

SEQ ID NO: 827289 - protein, 9 aa, Homo Sapiens
NTPAVSAAH

SEQ ID NO: 827290 - protein, 9 aa, Homo Sapiens
GRILALAQN

SEQ ID NO: 827291 - protein, 9 aa, Homo Sapiens
SFENVMATK

SEQ ID NO: 827292 - protein, 9 aa, Homo Sapiens
HPEAVCQLH

SEQ ID NO: 827293 - protein, 9 aa, Homo Sapiens
ETGLGTPPQ

SEQ ID NO: 827294 - protein, 9 aa, Homo Sapiens
VAGDKLTGV

SEQ ID NO: 827295 - protein, 9 aa, Homo Sapiens
QLNLKNMEI

SEQ ID NO: 827296 - protein, 9 aa, Homo Sapiens
DPLPSEVTS

SEQ ID NO: 827297 - protein, 9 aa, Homo Sapiens
TVKNRMGRQ

SEQ ID NO: 827298 - protein, 9 aa, Homo Sapiens
VYCALDKEP

SEQ ID NO: 827299 - protein, 9 aa, Homo Sapiens
AQKEVHNLN

SEQ ID NO: 827300 - protein, 9 aa, Homo Sapiens
TLPYVCFHI

SEQ ID NO: 827301 - protein, 9 aa, Homo Sapiens
PTPGLYMGR

SEQ ID NO: 827302 - protein, 9 aa, Homo Sapiens
KKDYLRELS

SEQ ID NO: 827303 - protein, 9 aa, Homo Sapiens
VWYRTCMME

SEQ ID NO: 827304 - protein, 9 aa, Homo Sapiens
NNKLSTIPA

SEQ ID NO: 827305 - protein, 9 aa, Homo Sapiens
RTVPGEQTS

SEQ ID NO: 827306 - protein, 9 aa, Homo Sapiens
KYVIDQIQI

SEQ ID NO: 827307 - protein, 9 aa, Homo Sapiens
LEQEAEKPQ

SEQ ID NO: 827308 - protein, 9 aa, Homo Sapiens
SFPRVELLK

SEQ ID NO: 827309 - protein, 9 aa, Homo Sapiens
EYSQVFCGL

SEQ ID NO: 827310 - protein, 9 aa, Homo Sapiens
IKSWVDTMQ

SEQ ID NO: 827311 - protein, 9 aa, Homo Sapiens
EMEMDAIQA

SEQ ID NO: 827312 - protein, 9 aa, Homo Sapiens
RRQFSTSGG

SEQ ID NO: 827313 - protein, 9 aa, Homo Sapiens
YSIVSSFAF

SEQ ID NO: 827314 - protein, 9 aa, Homo Sapiens
DGTSERRKI

SEQ ID NO: 827315 - protein, 9 aa, Homo Sapiens
EYFLFTFHL

SEQ ID NO: 827316 - protein, 9 aa, Homo Sapiens
AVGLSLSAP

SEQ ID NO: 827317 - protein, 9 aa, Homo Sapiens
PAMALPFFN

SEQ ID NO: 827318 - protein, 9 aa, Homo Sapiens
LCDGNGNSF

SEQ ID NO: 827319 - protein, 9 aa, Homo Sapiens
LGICAELTA

SEQ ID NO: 827320 - protein, 9 aa, Homo Sapiens
CHQTLFIFN

SEQ ID NO: 827321 - protein, 9 aa, Homo Sapiens
WGLHWVMEV

SEQ ID NO: 827322 - protein, 9 aa, Homo Sapiens
SKPNNLREE

SEQ ID NO: 827323 - protein, 9 aa, Homo Sapiens
GDALNHMGQ

SEQ ID NO: 827324 - protein, 9 aa, Homo Sapiens
KCVKAFHTF

SEQ ID NO: 827325 - protein, 9 aa, Homo Sapiens
PESFRAQYG

SEQ ID NO: 827326 - protein, 9 aa, Homo Sapiens
YTLINEEVK

SEQ ID NO: 827327 - protein, 9 aa, Homo Sapiens
NINDSKDNQ

SEQ ID NO: 827328 - protein, 9 aa, Homo Sapiens
AALLASHTI

SEQ ID NO: 827329 - protein, 9 aa, Homo Sapiens
PLKFLVETF

SEQ ID NO: 827330 - protein, 9 aa, Homo Sapiens
ILNVEDSNR

SEQ ID NO: 827331 - protein, 9 aa, Homo Sapiens
SRTQRAKRD

SEQ ID NO: 827332 - protein, 9 aa, Homo Sapiens
FNQNLAEKT

SEQ ID NO: 827333 - protein, 9 aa, Homo Sapiens
RGSRGDLLK

SEQ ID NO: 827334 - protein, 9 aa, Homo Sapiens
WSVGCTMAE

SEQ ID NO: 827335 - protein, 9 aa, Homo Sapiens
TYGFSSLFK

SEQ ID NO: 827336 - protein, 9 aa, Homo Sapiens
LFIDDKGVL

SEQ ID NO: 827337 - protein, 9 aa, Homo Sapiens
LHQRQEIIQ

SEQ ID NO: 827338 - protein, 9 aa, Homo Sapiens
HWQFFQGGP

SEQ ID NO: 827339 - protein, 9 aa, Homo Sapiens
QEPNTDQQL

SEQ ID NO: 827340 - protein, 9 aa, Homo Sapiens
WWVMARVIF

SEQ ID NO: 827341 - protein, 9 aa, Homo Sapiens
TPTLKQRKD

SEQ ID NO: 827342 - protein, 9 aa, Homo Sapiens
ENEKLVKAE

SEQ ID NO: 827343 - protein, 9 aa, Homo Sapiens
ISDLQKYAL

SEQ ID NO: 827344 - protein, 9 aa, Homo Sapiens
QKGTAFLSI

SEQ ID NO: 827345 - protein, 9 aa, Homo Sapiens
ENETMSKIV

SEQ ID NO: 827346 - protein, 9 aa, Homo Sapiens
VLQDYCNAI

SEQ ID NO: 827347 - protein, 9 aa, Homo Sapiens
QIWRLICGI

SEQ ID NO: 827348 - protein, 9 aa, Homo Sapiens
LLLQIEKEE

SEQ ID NO: 827349 - protein, 9 aa, Homo Sapiens
AQEMYDCVS

SEQ ID NO: 827350 - protein, 9 aa, Homo Sapiens
NKHSYPNVY

SEQ ID NO: 827351 - protein, 9 aa, Homo Sapiens
NVSDCRSMS

SEQ ID NO: 827352 - protein, 9 aa, Homo Sapiens
FRHKARENT

SEQ ID NO: 827353 - protein, 9 aa, Homo Sapiens
LTRHSLGLQ

SEQ ID NO: 827354 - protein, 9 aa, Homo Sapiens
RYVVKHHLS

SEQ ID NO: 827355 - protein, 9 aa, Homo Sapiens
GHDFVLQCS

SEQ ID NO: 827356 - protein, 9 aa, Homo Sapiens
FLLCGVIYV

SEQ ID NO: 827357 - protein, 9 aa, Homo Sapiens
NTVLNSEVL

SEQ ID NO: 827358 - protein, 9 aa, Homo Sapiens
SITCQKVIR

SEQ ID NO: 827359 - protein, 9 aa, Homo Sapiens
IAGYLFPAT

SEQ ID NO: 827360 - protein, 9 aa, Homo Sapiens
DWLESLNVG

SEQ ID NO: 827361 - protein, 9 aa, Homo Sapiens
ELFTKTPIF

SEQ ID NO: 827362 - protein, 9 aa, Homo Sapiens
GSEGPGSPL

SEQ ID NO: 827363 - protein, 9 aa, Homo Sapiens
SGEHSLKCM

SEQ ID NO: 827364 - protein, 9 aa, Homo Sapiens
DQLSHMCLH

SEQ ID NO: 827365 - protein, 9 aa, Homo Sapiens
HVRFAGCLH

SEQ ID NO: 827366 - protein, 9 aa, Homo Sapiens
RKTNYVDNL

SEQ ID NO: 827367 - protein, 9 aa, Homo Sapiens
SARRHTNST

SEQ ID NO: 827368 - protein, 9 aa, Homo Sapiens
LKGLFNNNP

SEQ ID NO: 827369 - protein, 9 aa, Homo Sapiens
VVPTLSTTN

SEQ ID NO: 827370 - protein, 9 aa, Homo Sapiens
KHKNKGKNN

SEQ ID NO: 827371 - protein, 9 aa, Homo Sapiens
MTYLDKAPP

SEQ ID NO: 827372 - protein, 9 aa, Homo Sapiens
RKHRTYVHV

SEQ ID NO: 827373 - protein, 9 aa, Homo Sapiens
KKKKGKKLP

SEQ ID NO: 827374 - protein, 9 aa, Homo Sapiens
KHFESKFKG

SEQ ID NO: 827375 - protein, 9 aa, Homo Sapiens
LQSMLKSEW

SEQ ID NO: 827376 - protein, 9 aa, Homo Sapiens
EDTRSRGVL

SEQ ID NO: 827377 - protein, 9 aa, Homo Sapiens
EPPEKLTQT

SEQ ID NO: 827378 - protein, 9 aa, Homo Sapiens
ENILFGVFL

SEQ ID NO: 827379 - protein, 9 aa, Homo Sapiens
LCVFFVKGT

SEQ ID NO: 827380 - protein, 9 aa, Homo Sapiens
SPRTLKTNL

SEQ ID NO: 827381 - protein, 9 aa, Homo Sapiens
INWQRARRF

SEQ ID NO: 827382 - protein, 9 aa, Homo Sapiens
VTTTQSHTT

SEQ ID NO: 827383 - protein, 9 aa, Homo Sapiens
KRMIMAAVP

SEQ ID NO: 827384 - protein, 9 aa, Homo Sapiens
RDTYIHCCV

SEQ ID NO: 827385 - protein, 9 aa, Homo Sapiens
IVELDNTPN

SEQ ID NO: 827386 - protein, 9 aa, Homo Sapiens
SSEAFQKRN

SEQ ID NO: 827387 - protein, 9 aa, Homo Sapiens
NSDIFVPYG

SEQ ID NO: 827388 - protein, 9 aa, Homo Sapiens
KRRCGQKVD

SEQ ID NO: 827389 - protein, 9 aa, Homo Sapiens
ETSKIKRLY

SEQ ID NO: 827390 - protein, 9 aa, Homo Sapiens
KDLCVELEA

SEQ ID NO: 827391 - protein, 9 aa, Homo Sapiens
PMYLFLRNF

SEQ ID NO: 827392 - protein, 9 aa, Homo Sapiens
VHVLTVTEL

SEQ ID NO: 827393 - protein, 9 aa, Homo Sapiens
QLEESCVEA

SEQ ID NO: 827394 - protein, 9 aa, Homo Sapiens
HFSISTITR

SEQ ID NO: 827395 - protein, 9 aa, Homo Sapiens
PVGQMSLSR

SEQ ID NO: 827396 - protein, 9 aa, Homo Sapiens
DSSGQTKVL

SEQ ID NO: 827397 - protein, 9 aa, Homo Sapiens
ILNIQSGEG

SEQ ID NO: 827398 - protein, 9 aa, Homo Sapiens
GDPSDKRDG

SEQ ID NO: 827399 - protein, 9 aa, Homo Sapiens
GLKSALDAK

SEQ ID NO: 827400 - protein, 9 aa, Homo Sapiens
VNLTAHEVW

SEQ ID NO: 827401 - protein, 9 aa, Homo Sapiens
CPDNGWDES

SEQ ID NO: 827402 - protein, 9 aa, Homo Sapiens
APLDGEELL

SEQ ID NO: 827403 - protein, 9 aa, Homo Sapiens
QNVACSNVS

SEQ ID NO: 827404 - protein, 9 aa, Homo Sapiens
PITPTPFKN

SEQ ID NO: 827405 - protein, 9 aa, Homo Sapiens
TEEEIILND

SEQ ID NO: 827406 - protein, 9 aa, Homo Sapiens
FSLENNLLL

SEQ ID NO: 827407 - protein, 9 aa, Homo Sapiens
VRPNVLLGR

SEQ ID NO: 827408 - protein, 9 aa, Homo Sapiens
YEAIMCIIH

SEQ ID NO: 827409 - protein, 9 aa, Homo Sapiens
NIGPACWDL

SEQ ID NO: 827410 - protein, 9 aa, Homo Sapiens
LKEAGGNTT

SEQ ID NO: 827411 - protein, 9 aa, Homo Sapiens
NPFQCPQCD

SEQ ID NO: 827412 - protein, 9 aa, Homo Sapiens
NKRIKNQLG

SEQ ID NO: 827413 - protein, 9 aa, Homo Sapiens
AKKYLQTDD

SEQ ID NO: 827414 - protein, 9 aa, Homo Sapiens
PDFKIQRTE

SEQ ID NO: 827415 - protein, 9 aa, Homo Sapiens
IYQTLQEER

SEQ ID NO: 827416 - protein, 9 aa, Homo Sapiens
QKGAKGESG

SEQ ID NO: 827417 - protein, 9 aa, Homo Sapiens
PAHTRHYQS

SEQ ID NO: 827418 - protein, 9 aa, Homo Sapiens
KQDTITNLN

SEQ ID NO: 827419 - protein, 9 aa, Homo Sapiens
LNINFLLRM

SEQ ID NO: 827420 - protein, 9 aa, Homo Sapiens
DHSPVFWHK

SEQ ID NO: 827421 - protein, 9 aa, Homo Sapiens
KAATPIKDG

SEQ ID NO: 827422 - protein, 9 aa, Homo Sapiens
PISQRDNLR

SEQ ID NO: 827423 - protein, 9 aa, Homo Sapiens
KIKHLRVLF

SEQ ID NO: 827424 - protein, 9 aa, Homo Sapiens
HDFEKGMAA

SEQ ID NO: 827425 - protein, 9 aa, Homo Sapiens
TSSGRSGRS

SEQ ID NO: 827426 - protein, 9 aa, Homo Sapiens
DNNENIQET

SEQ ID NO: 827427 - protein, 9 aa, Homo Sapiens
VLRGFEEKG

SEQ ID NO: 827428 - protein, 9 aa, Homo Sapiens
SLDSTMRIL

SEQ ID NO: 827429 - protein, 9 aa, Homo Sapiens
QTRSTSPIY

SEQ ID NO: 827430 - protein, 9 aa, Homo Sapiens
RRQIGELKK

SEQ ID NO: 827431 - protein, 9 aa, Homo Sapiens
VVQLPANIL

SEQ ID NO: 827432 - protein, 9 aa, Homo Sapiens
SRSDPHHCS

SEQ ID NO: 827433 - protein, 9 aa, Homo Sapiens
KSTKHPEKT

SEQ ID NO: 827434 - protein, 9 aa, Homo Sapiens
RIHIRENYY

SEQ ID NO: 827435 - protein, 9 aa, Homo Sapiens
DHLSCDASP

SEQ ID NO: 827436 - protein, 9 aa, Homo Sapiens
DINYHAPEF

SEQ ID NO: 827437 - protein, 9 aa, Homo Sapiens
EIVTKPIKG

SEQ ID NO: 827438 - protein, 9 aa, Homo Sapiens
YHNSRDRWR

SEQ ID NO: 827439 - protein, 9 aa, Homo Sapiens
KRDERLGMK

SEQ ID NO: 827440 - protein, 9 aa, Homo Sapiens
LWCGEEVAV

SEQ ID NO: 827441 - protein, 9 aa, Homo Sapiens
VTLPQMSQC

SEQ ID NO: 827442 - protein, 9 aa, Homo Sapiens
TIRVPVATL

SEQ ID NO: 827443 - protein, 9 aa, Homo Sapiens
LIIETQKQT

SEQ ID NO: 827444 - protein, 9 aa, Homo Sapiens
QSLAGEEDV

SEQ ID NO: 827445 - protein, 9 aa, Homo Sapiens
EDTLFCQDL

SEQ ID NO: 827446 - protein, 9 aa, Homo Sapiens
SLYVQIDFS

SEQ ID NO: 827447 - protein, 9 aa, Homo Sapiens
VPNIIITPP

SEQ ID NO: 827448 - protein, 9 aa, Homo Sapiens
KGVLFVSSR

SEQ ID NO: 827449 - protein, 9 aa, Homo Sapiens
PSKQEPENN

SEQ ID NO: 827450 - protein, 9 aa, Homo Sapiens
PICTDPMSK

SEQ ID NO: 827451 - protein, 9 aa, Homo Sapiens
EENEKLVKA

SEQ ID NO: 827452 - protein, 9 aa, Homo Sapiens
CFTATGQSR

SEQ ID NO: 827453 - protein, 9 aa, Homo Sapiens
VQQSQLVVD

SEQ ID NO: 827454 - protein, 9 aa, Homo Sapiens
CLPCCRSTC

SEQ ID NO: 827455 - protein, 9 aa, Homo Sapiens
SDQQYQAIE

SEQ ID NO: 827456 - protein, 9 aa, Homo Sapiens
PTPLCCDSR

SEQ ID NO: 827457 - protein, 9 aa, Homo Sapiens
LLLAHIILV

SEQ ID NO: 827458 - protein, 9 aa, Homo Sapiens
IKDQCLKSW

SEQ ID NO: 827459 - protein, 9 aa, Homo Sapiens
KLEPHKGLL

SEQ ID NO: 827460 - protein, 9 aa, Homo Sapiens
AALQWESWA

SEQ ID NO: 827461 - protein, 9 aa, Homo Sapiens
LFEQENKLQ

SEQ ID NO: 827462 - protein, 9 aa, Homo Sapiens
LSNGQGSRM

SEQ ID NO: 827463 - protein, 9 aa, Homo Sapiens
QQPSDKSTE

SEQ ID NO: 827464 - protein, 9 aa, Homo Sapiens
FIYQTLQEE

SEQ ID NO: 827465 - protein, 9 aa, Homo Sapiens
TWKTLLHMC

SEQ ID NO: 827466 - protein, 9 aa, Homo Sapiens
LIISCLLNI

SEQ ID NO: 827467 - protein, 9 aa, Homo Sapiens
EELKLMEEQ

SEQ ID NO: 827468 - protein, 9 aa, Homo Sapiens
GPGLVCMVT

SEQ ID NO: 827469 - protein, 9 aa, Homo Sapiens
ASRQTLFED

SEQ ID NO: 827470 - protein, 9 aa, Homo Sapiens
IPTLFGPQL

SEQ ID NO: 827471 - protein, 9 aa, Homo Sapiens
DLFTAFLPF

SEQ ID NO: 827472 - protein, 9 aa, Homo Sapiens
LKKCGISAN

SEQ ID NO: 827473 - protein, 9 aa, Homo Sapiens
CSPGFVLEG

SEQ ID NO: 827474 - protein, 9 aa, Homo Sapiens
HLIESSKVK

SEQ ID NO: 827475 - protein, 9 aa, Homo Sapiens
RRAAFSEDQ

SEQ ID NO: 827476 - protein, 9 aa, Homo Sapiens
KKLEDALSL

SEQ ID NO: 827477 - protein, 9 aa, Homo Sapiens
RWFSQKASL

SEQ ID NO: 827478 - protein, 9 aa, Homo Sapiens
RARKKPQSR

SEQ ID NO: 827479 - protein, 9 aa, Homo Sapiens
VVKSRSNSG

SEQ ID NO: 827480 - protein, 9 aa, Homo Sapiens
KTFENFYIG

SEQ ID NO: 827481 - protein, 9 aa, Homo Sapiens
SKEIKRLTG

SEQ ID NO: 827482 - protein, 9 aa, Homo Sapiens
ILEIISKSP

SEQ ID NO: 827483 - protein, 9 aa, Homo Sapiens
GFILLGLTE

SEQ ID NO: 827484 - protein, 9 aa, Homo Sapiens
TLEDDSNYV

SEQ ID NO: 827485 - protein, 9 aa, Homo Sapiens
NKQLEEKKT

SEQ ID NO: 827486 - protein, 9 aa, Homo Sapiens
GKAGTTEKT

SEQ ID NO: 827487 - protein, 9 aa, Homo Sapiens
LKTKGELLL

SEQ ID NO: 827488 - protein, 9 aa, Homo Sapiens
GRIISGNFF

SEQ ID NO: 827489 - protein, 9 aa, Homo Sapiens
EAKQVPRAA

SEQ ID NO: 827490 - protein, 9 aa, Homo Sapiens
CLPGFVFQF

SEQ ID NO: 827491 - protein, 9 aa, Homo Sapiens
LTCLAFELF

SEQ ID NO: 827492 - protein, 9 aa, Homo Sapiens
VHVVLNQQG

SEQ ID NO: 827493 - protein, 9 aa, Homo Sapiens
NNAPKEASR

SEQ ID NO: 827494 - protein, 9 aa, Homo Sapiens
AALQLFKNT

SEQ ID NO: 827495 - protein, 9 aa, Homo Sapiens
INYQPQSSY

SEQ ID NO: 827496 - protein, 9 aa, Homo Sapiens
FLQINPIPQ

SEQ ID NO: 827497 - protein, 9 aa, Homo Sapiens
HLQNELRET

SEQ ID NO: 827498 - protein, 9 aa, Homo Sapiens
CPPIINLKR

SEQ ID NO: 827499 - protein, 9 aa, Homo Sapiens
LSREMLEAG

SEQ ID NO: 827500 - protein, 9 aa, Homo Sapiens
TGSSTNKIS

SEQ ID NO: 827501 - protein, 9 aa, Homo Sapiens
YDSHVLWAP

SEQ ID NO: 827502 - protein, 9 aa, Homo Sapiens
KDVLDIEQL

SEQ ID NO: 827503 - protein, 9 aa, Homo Sapiens
SQVEIGDFK

SEQ ID NO: 827504 - protein, 9 aa, Homo Sapiens
ATGLPHLDH

SEQ ID NO: 827505 - protein, 9 aa, Homo Sapiens
KQKKGAKEK

SEQ ID NO: 827506 - protein, 9 aa, Homo Sapiens
IRWGHRFND

SEQ ID NO: 827507 - protein, 9 aa, Homo Sapiens
YVFNPIVGK

SEQ ID NO: 827508 - protein, 9 aa, Homo Sapiens
SGKDEIKAA

SEQ ID NO: 827509 - protein, 9 aa, Homo Sapiens
DSTSEQRTP

SEQ ID NO: 827510 - protein, 9 aa, Homo Sapiens
INQSQGSRK

SEQ ID NO: 827511 - protein, 9 aa, Homo Sapiens
QAIIVNNHT

SEQ ID NO: 827512 - protein, 9 aa, Homo Sapiens
LSFMNVVDV

SEQ ID NO: 827513 - protein, 9 aa, Homo Sapiens
EELTCLAFE

SEQ ID NO: 827514 - protein, 9 aa, Homo Sapiens
INPDVDHCC

SEQ ID NO: 827515 - protein, 9 aa, Homo Sapiens
SDCGKCFTQ

SEQ ID NO: 827516 - protein, 9 aa, Homo Sapiens
LNFCKVFLI

SEQ ID NO: 827517 - protein, 9 aa, Homo Sapiens
AVRNIRAGY

SEQ ID NO: 827518 - protein, 9 aa, Homo Sapiens
TSGGDGLGQ

SEQ ID NO: 827519 - protein, 9 aa, Homo Sapiens
SGQKKELHF

SEQ ID NO: 827520 - protein, 9 aa, Homo Sapiens
AFSLMGLSL

SEQ ID NO: 827521 - protein, 9 aa, Homo Sapiens
AETTELMTG

SEQ ID NO: 827522 - protein, 9 aa, Homo Sapiens
NNKHSKRFL

SEQ ID NO: 827523 - protein, 9 aa, Homo Sapiens
RIHQCDVAG

SEQ ID NO: 827524 - protein, 9 aa, Homo Sapiens
FSVLYTVPS

SEQ ID NO: 827525 - protein, 9 aa, Homo Sapiens
NELFNDVRL

SEQ ID NO: 827526 - protein, 9 aa, Homo Sapiens
CEMAVNTEL

SEQ ID NO: 827527 - protein, 9 aa, Homo Sapiens
PEMNVRSAF

SEQ ID NO: 827528 - protein, 9 aa, Homo Sapiens
KSAVVYMLH

SEQ ID NO: 827529 - protein, 9 aa, Homo Sapiens
ICDEGHRLN

SEQ ID NO: 827530 - protein, 9 aa, Homo Sapiens
TKKSKKADC

SEQ ID NO: 827531 - protein, 9 aa, Homo Sapiens
LSQGILFPD

SEQ ID NO: 827532 - protein, 9 aa, Homo Sapiens
QQDINEAKL

SEQ ID NO: 827533 - protein, 9 aa, Homo Sapiens
HLVFEYCDN

SEQ ID NO: 827534 - protein, 9 aa, Homo Sapiens
YEGFLYPSC

SEQ ID NO: 827535 - protein, 9 aa, Homo Sapiens
ESELPHKRY

SEQ ID NO: 827536 - protein, 9 aa, Homo Sapiens
FSISTITRI

SEQ ID NO: 827537 - protein, 9 aa, Homo Sapiens
NIRFCLEGM

SEQ ID NO: 827538 - protein, 9 aa, Homo Sapiens
LIDLMQLRR

SEQ ID NO: 827539 - protein, 9 aa, Homo Sapiens
AFNQNLAEK

SEQ ID NO: 827540 - protein, 9 aa, Homo Sapiens
IWVDYSITK

SEQ ID NO: 827541 - protein, 9 aa, Homo Sapiens
FGLLTVLSW

SEQ ID NO: 827542 - protein, 9 aa, Homo Sapiens
NLASLIQAG

SEQ ID NO: 827543 - protein, 9 aa, Homo Sapiens
QGRDISTKH

SEQ ID NO: 827544 - protein, 9 aa, Homo Sapiens
SRKKYYYIA

SEQ ID NO: 827545 - protein, 9 aa, Homo Sapiens
NHFFKESWP

SEQ ID NO: 827546 - protein, 9 aa, Homo Sapiens
PFIYGHKYY

SEQ ID NO: 827547 - protein, 9 aa, Homo Sapiens
CIMKARKVL

SEQ ID NO: 827548 - protein, 9 aa, Homo Sapiens
SYKPQKSSP

SEQ ID NO: 827549 - protein, 9 aa, Homo Sapiens
EYVRFNSDV

SEQ ID NO: 827550 - protein, 9 aa, Homo Sapiens
EAGKPTFGI

SEQ ID NO: 827551 - protein, 9 aa, Homo Sapiens
GQYENDFLE

SEQ ID NO: 827552 - protein, 9 aa, Homo Sapiens
FLPVKHKIQ

SEQ ID NO: 827553 - protein, 9 aa, Homo Sapiens
VPVNSSSSP

SEQ ID NO: 827554 - protein, 9 aa, Homo Sapiens
KAFQLHIQF

SEQ ID NO: 827555 - protein, 9 aa, Homo Sapiens
NGVTRSWKS

SEQ ID NO: 827556 - protein, 9 aa, Homo Sapiens
TLLSDIGRQ

SEQ ID NO: 827557 - protein, 9 aa, Homo Sapiens
IMNAEAATN

SEQ ID NO: 827558 - protein, 9 aa, Homo Sapiens
AQNGVALTA

SEQ ID NO: 827559 - protein, 9 aa, Homo Sapiens
AQREPLSSN

SEQ ID NO: 827560 - protein, 9 aa, Homo Sapiens
RYIIPIGSD

SEQ ID NO: 827561 - protein, 9 aa, Homo Sapiens
NPKYFDWNL

SEQ ID NO: 827562 - protein, 9 aa, Homo Sapiens
GCHLLTVHG

SEQ ID NO: 827563 - protein, 9 aa, Homo Sapiens
FGQGSYFTK

SEQ ID NO: 827564 - protein, 9 aa, Homo Sapiens
SRAEHLASV

SEQ ID NO: 827565 - protein, 9 aa, Homo Sapiens
ESLTRGASL

SEQ ID NO: 827566 - protein, 9 aa, Homo Sapiens
AGSSTIRIT

SEQ ID NO: 827567 - protein, 9 aa, Homo Sapiens
CSTPGVELT

SEQ ID NO: 827568 - protein, 9 aa, Homo Sapiens
LFTVAFAGF

SEQ ID NO: 827569 - protein, 9 aa, Homo Sapiens
LISLAAQTF

SEQ ID NO: 827570 - protein, 9 aa, Homo Sapiens
LGQHQIIHT

SEQ ID NO: 827571 - protein, 9 aa, Homo Sapiens
MIALLGGHA

SEQ ID NO: 827572 - protein, 9 aa, Homo Sapiens
SDEDNLPEK

SEQ ID NO: 827573 - protein, 9 aa, Homo Sapiens
FHLKSYLRK

SEQ ID NO: 827574 - protein, 9 aa, Homo Sapiens
AEIFTTEIL

SEQ ID NO: 827575 - protein, 9 aa, Homo Sapiens
GDLSGLHSG

SEQ ID NO: 827576 - protein, 9 aa, Homo Sapiens
CATDTQNVT

SEQ ID NO: 827577 - protein, 9 aa, Homo Sapiens
AKRKSPTKK

SEQ ID NO: 827578 - protein, 9 aa, Homo Sapiens
VGVLEGKQF

SEQ ID NO: 827579 - protein, 9 aa, Homo Sapiens
LQRRIIQWL

SEQ ID NO: 827580 - protein, 9 aa, Homo Sapiens
FGEVLIDTR

SEQ ID NO: 827581 - protein, 9 aa, Homo Sapiens
LNYLGFSFG

SEQ ID NO: 827582 - protein, 9 aa, Homo Sapiens
NPFAKGFWD

SEQ ID NO: 827583 - protein, 9 aa, Homo Sapiens
TPVRPVTFP

SEQ ID NO: 827584 - protein, 9 aa, Homo Sapiens
LTVDRNCLW

SEQ ID NO: 827585 - protein, 9 aa, Homo Sapiens
ADLKHQFTR

SEQ ID NO: 827586 - protein, 9 aa, Homo Sapiens
ERQPCFIVY

SEQ ID NO: 827587 - protein, 9 aa, Homo Sapiens
SSSFLTGVM

SEQ ID NO: 827588 - protein, 9 aa, Homo Sapiens
RSESSSEKD

SEQ ID NO: 827589 - protein, 9 aa, Homo Sapiens
QVGRFAPQL

SEQ ID NO: 827590 - protein, 9 aa, Homo Sapiens
DKRFPTCPQ

SEQ ID NO: 827591 - protein, 9 aa, Homo Sapiens
TPTNKAPHP

SEQ ID NO: 827592 - protein, 9 aa, Homo Sapiens
LGLLVSDEP

SEQ ID NO: 827593 - protein, 9 aa, Homo Sapiens
KAGQAQVKQ

SEQ ID NO: 827594 - protein, 9 aa, Homo Sapiens
VCTCTSQKA

SEQ ID NO: 827595 - protein, 9 aa, Homo Sapiens
VVISQGKII

SEQ ID NO: 827596 - protein, 9 aa, Homo Sapiens
FSLPDIQLE

SEQ ID NO: 827597 - protein, 9 aa, Homo Sapiens
IDDKGVLFV

SEQ ID NO: 827598 - protein, 9 aa, Homo Sapiens
RLFELFDRT

SEQ ID NO: 827599 - protein, 9 aa, Homo Sapiens
KLHVLCKQY

SEQ ID NO: 827600 - protein, 9 aa, Homo Sapiens
YRLGVHTNG

SEQ ID NO: 827601 - protein, 9 aa, Homo Sapiens
QLLKFITEK

SEQ ID NO: 827602 - protein, 9 aa, Homo Sapiens
IKKVYASQQ

SEQ ID NO: 827603 - protein, 9 aa, Homo Sapiens
LFEGTSLCC

SEQ ID NO: 827604 - protein, 9 aa, Homo Sapiens
SCSITAFAI

SEQ ID NO: 827605 - protein, 9 aa, Homo Sapiens
TTAGVLLGI

SEQ ID NO: 827606 - protein, 9 aa, Homo Sapiens
RDVMLDNLA

SEQ ID NO: 827607 - protein, 9 aa, Homo Sapiens
ARFHKNLEA

SEQ ID NO: 827608 - protein, 9 aa, Homo Sapiens
GIIILTQND

SEQ ID NO: 827609 - protein, 9 aa, Homo Sapiens
VYAITAQST

SEQ ID NO: 827610 - protein, 9 aa, Homo Sapiens
DSFSKHYKF

SEQ ID NO: 827611 - protein, 9 aa, Homo Sapiens
TERLFGKIC

SEQ ID NO: 827612 - protein, 9 aa, Homo Sapiens
RGACNNLPG

SEQ ID NO: 827613 - protein, 9 aa, Homo Sapiens
ACDEAIAEL

SEQ ID NO: 827614 - protein, 9 aa, Homo Sapiens
ESFMTSRKM

SEQ ID NO: 827615 - protein, 9 aa, Homo Sapiens
VGSECLFSV

SEQ ID NO: 827616 - protein, 9 aa, Homo Sapiens
GEKGANGEA

SEQ ID NO: 827617 - protein, 9 aa, Homo Sapiens
WSEGKGRVK

SEQ ID NO: 827618 - protein, 9 aa, Homo Sapiens
ILLGSGALA

SEQ ID NO: 827619 - protein, 9 aa, Homo Sapiens
TQLITVDDK

SEQ ID NO: 827620 - protein, 9 aa, Homo Sapiens
IQVLRVVKY

SEQ ID NO: 827621 - protein, 9 aa, Homo Sapiens
VERSRRERQ

SEQ ID NO: 827622 - protein, 9 aa, Homo Sapiens
STAVQFKIP

SEQ ID NO: 827623 - protein, 9 aa, Homo Sapiens
EVLDQGDLY

SEQ ID NO: 827624 - protein, 9 aa, Homo Sapiens
TQVAAPGTA

SEQ ID NO: 827625 - protein, 9 aa, Homo Sapiens
SPSAAYTTS

SEQ ID NO: 827626 - protein, 9 aa, Homo Sapiens
QCDALVDDL

SEQ ID NO: 827627 - protein, 9 aa, Homo Sapiens
NKKFWRAML

SEQ ID NO: 827628 - protein, 9 aa, Homo Sapiens
YIAAISVRF

SEQ ID NO: 827629 - protein, 9 aa, Homo Sapiens
YFTKKASYS

SEQ ID NO: 827630 - protein, 9 aa, Homo Sapiens
RPPLSRVVH

SEQ ID NO: 827631 - protein, 9 aa, Homo Sapiens
ECKVIAEKY

SEQ ID NO: 827632 - protein, 9 aa, Homo Sapiens
PPSEPVSSL

SEQ ID NO: 827633 - protein, 9 aa, Homo Sapiens
KHSSPRRKM

SEQ ID NO: 827634 - protein, 9 aa, Homo Sapiens
VCLCMCVCV

SEQ ID NO: 827635 - protein, 9 aa, Homo Sapiens
EAMPTHKNL

SEQ ID NO: 827636 - protein, 9 aa, Homo Sapiens
KIKKIVYSI

SEQ ID NO: 827637 - protein, 9 aa, Homo Sapiens
DHNQMLQYF

SEQ ID NO: 827638 - protein, 9 aa, Homo Sapiens
VAKSTHYAD

SEQ ID NO: 827639 - protein, 9 aa, Homo Sapiens
AVLTTLKEY

SEQ ID NO: 827640 - protein, 9 aa, Homo Sapiens
NYVVIMNNR

SEQ ID NO: 827641 - protein, 9 aa, Homo Sapiens
QKNAVAHRN

SEQ ID NO: 827642 - protein, 9 aa, Homo Sapiens
TVPLVNSEG

SEQ ID NO: 827643 - protein, 9 aa, Homo Sapiens
FLHANHEQL

SEQ ID NO: 827644 - protein, 9 aa, Homo Sapiens
IVRAQKYYD

SEQ ID NO: 827645 - protein, 9 aa, Homo Sapiens
VFRRPHDPK

SEQ ID NO: 827646 - protein, 9 aa, Homo Sapiens
ESYAIQSLQ

SEQ ID NO: 827647 - protein, 9 aa, Homo Sapiens
HTAEQPYKC

SEQ ID NO: 827648 - protein, 9 aa, Homo Sapiens
ACTCWMAGI

SEQ ID NO: 827649 - protein, 9 aa, Homo Sapiens
LKSLLEHYL

SEQ ID NO: 827650 - protein, 9 aa, Homo Sapiens
KADRDYHIF

SEQ ID NO: 827651 - protein, 9 aa, Homo Sapiens
CNLLRAALL

SEQ ID NO: 827652 - protein, 9 aa, Homo Sapiens
FNQLRLQGC

SEQ ID NO: 827653 - protein, 9 aa, Homo Sapiens
ELVEAWLEI

SEQ ID NO: 827654 - protein, 9 aa, Homo Sapiens
EVDCCGEHD

SEQ ID NO: 827655 - protein, 9 aa, Homo Sapiens
SYVCSSDNL

SEQ ID NO: 827656 - protein, 9 aa, Homo Sapiens
EERKEDQYI

SEQ ID NO: 827657 - protein, 9 aa, Homo Sapiens
YTVVQDQVW

SEQ ID NO: 827658 - protein, 9 aa, Homo Sapiens
DTFPNTWLL

SEQ ID NO: 827659 - protein, 9 aa, Homo Sapiens
APEKLDQIG

SEQ ID NO: 827660 - protein, 9 aa, Homo Sapiens
AVNKSLEGI

SEQ ID NO: 827661 - protein, 9 aa, Homo Sapiens
NGTKGLSVD

SEQ ID NO: 827662 - protein, 9 aa, Homo Sapiens
LLKKRSKQL

SEQ ID NO: 827663 - protein, 9 aa, Homo Sapiens
SQSKVMGEP

SEQ ID NO: 827664 - protein, 9 aa, Homo Sapiens
IENHICKLE

SEQ ID NO: 827665 - protein, 9 aa, Homo Sapiens
TPPDIAKLH

SEQ ID NO: 827666 - protein, 9 aa, Homo Sapiens
GAVVDVPFD

SEQ ID NO: 827667 - protein, 9 aa, Homo Sapiens
RKLKVFLGT

SEQ ID NO: 827668 - protein, 9 aa, Homo Sapiens
HYTFSKPVL

SEQ ID NO: 827669 - protein, 9 aa, Homo Sapiens
KMNECVMKK

SEQ ID NO: 827670 - protein, 9 aa, Homo Sapiens
KDNKVTWGA

SEQ ID NO: 827671 - protein, 9 aa, Homo Sapiens
TTIFLAATN

SEQ ID NO: 827672 - protein, 9 aa, Homo Sapiens
QQTRTEVVA

SEQ ID NO: 827673 - protein, 9 aa, Homo Sapiens
KILRKYKPY

SEQ ID NO: 827674 - protein, 9 aa, Homo Sapiens
EANISCYLN

SEQ ID NO: 827675 - protein, 9 aa, Homo Sapiens
CHILLHLFK

SEQ ID NO: 827676 - protein, 9 aa, Homo Sapiens
AENSRLVSL

SEQ ID NO: 827677 - protein, 9 aa, Homo Sapiens
SCCEYKHRT

SEQ ID NO: 827678 - protein, 9 aa, Homo Sapiens
LDLLKQCLE

SEQ ID NO: 827679 - protein, 9 aa, Homo Sapiens
LVKLGSCKR

SEQ ID NO: 827680 - protein, 9 aa, Homo Sapiens
MLENMGVGI

SEQ ID NO: 827681 - protein, 9 aa, Homo Sapiens
VSHLTVVAM

SEQ ID NO: 827682 - protein, 9 aa, Homo Sapiens
QQQQHQEYQ

SEQ ID NO: 827683 - protein, 9 aa, Homo Sapiens
FERFCVVYY

SEQ ID NO: 827684 - protein, 9 aa, Homo Sapiens
KHHTDMSSL

SEQ ID NO: 827685 - protein, 9 aa, Homo Sapiens
ETYGEDNDE

SEQ ID NO: 827686 - protein, 9 aa, Homo Sapiens
VTYAAVKHS

SEQ ID NO: 827687 - protein, 9 aa, Homo Sapiens
TIKTLQITD

SEQ ID NO: 827688 - protein, 9 aa, Homo Sapiens
DGEELLVEV

SEQ ID NO: 827689 - protein, 9 aa, Homo Sapiens
EKALGKHTE

SEQ ID NO: 827690 - protein, 9 aa, Homo Sapiens
NSYGQERCC

SEQ ID NO: 827691 - protein, 9 aa, Homo Sapiens
TIQASEASE

SEQ ID NO: 827692 - protein, 9 aa, Homo Sapiens
NLAARMTMY

SEQ ID NO: 827693 - protein, 9 aa, Homo Sapiens
FSTKGKALE

SEQ ID NO: 827694 - protein, 9 aa, Homo Sapiens
PAPMQAMWL

SEQ ID NO: 827695 - protein, 9 aa, Homo Sapiens
NGDGAIDFR

SEQ ID NO: 827696 - protein, 9 aa, Homo Sapiens
EVMGLFTKW

SEQ ID NO: 827697 - protein, 9 aa, Homo Sapiens
FYFTVTAVD

SEQ ID NO: 827698 - protein, 9 aa, Homo Sapiens
PKQASIDGF

SEQ ID NO: 827699 - protein, 9 aa, Homo Sapiens
HWRIHTGER

SEQ ID NO: 827700 - protein, 9 aa, Homo Sapiens
ALLRALLGT

SEQ ID NO: 827701 - protein, 9 aa, Homo Sapiens
YGNVGYRLP

SEQ ID NO: 827702 - protein, 9 aa, Homo Sapiens
EAPDDIQDL

SEQ ID NO: 827703 - protein, 9 aa, Homo Sapiens
LCKQGKDLT

SEQ ID NO: 827704 - protein, 9 aa, Homo Sapiens
PPWGIPAHT

SEQ ID NO: 827705 - protein, 9 aa, Homo Sapiens
LHLEIRDLE

SEQ ID NO: 827706 - protein, 9 aa, Homo Sapiens
SALYSLIQI

SEQ ID NO: 827707 - protein, 9 aa, Homo Sapiens
CRLYYEGLQ

SEQ ID NO: 827708 - protein, 9 aa, Homo Sapiens
VKGVTFYGP

SEQ ID NO: 827709 - protein, 9 aa, Homo Sapiens
LSCLGSSSL

SEQ ID NO: 827710 - protein, 9 aa, Homo Sapiens
SNSLSVIED

SEQ ID NO: 827711 - protein, 9 aa, Homo Sapiens
QFENTEMFG

SEQ ID NO: 827712 - protein, 9 aa, Homo Sapiens
DNNTPSPFI

SEQ ID NO: 827713 - protein, 9 aa, Homo Sapiens
QLLWGPAFM

SEQ ID NO: 827714 - protein, 9 aa, Homo Sapiens
DLQLLDLAQ

SEQ ID NO: 827715 - protein, 9 aa, Homo Sapiens
SGLKQNVLD

SEQ ID NO: 827716 - protein, 9 aa, Homo Sapiens
VGGNVTINF

SEQ ID NO: 827717 - protein, 9 aa, Homo Sapiens
FKCKQFLIQ

SEQ ID NO: 827718 - protein, 9 aa, Homo Sapiens
TYKRRAISL

SEQ ID NO: 827719 - protein, 9 aa, Homo Sapiens
CYFKVRQLF

SEQ ID NO: 827720 - protein, 9 aa, Homo Sapiens
VCDTKCNTL

SEQ ID NO: 827721 - protein, 9 aa, Homo Sapiens
GQSSHYIKS

SEQ ID NO: 827722 - protein, 9 aa, Homo Sapiens
VSQAFKQLC

SEQ ID NO: 827723 - protein, 9 aa, Homo Sapiens
IALTQKNQL

SEQ ID NO: 827724 - protein, 9 aa, Homo Sapiens
RMNRFKDKE

SEQ ID NO: 827725 - protein, 9 aa, Homo Sapiens
LDSLGRFRS

SEQ ID NO: 827726 - protein, 9 aa, Homo Sapiens
DTFSLLNNL

SEQ ID NO: 827727 - protein, 9 aa, Homo Sapiens
STSPQRVPQ

SEQ ID NO: 827728 - protein, 9 aa, Homo Sapiens
IRWCLLQLA

SEQ ID NO: 827729 - protein, 9 aa, Homo Sapiens
WTKQFFLLF

SEQ ID NO: 827730 - protein, 9 aa, Homo Sapiens
LAENNLHLP

SEQ ID NO: 827731 - protein, 9 aa, Homo Sapiens
LVEMNTGKA

SEQ ID NO: 827732 - protein, 9 aa, Homo Sapiens
ADLITTLTF

SEQ ID NO: 827733 - protein, 9 aa, Homo Sapiens
GICTFISGR

SEQ ID NO: 827734 - protein, 9 aa, Homo Sapiens
SAPFLLFFL

SEQ ID NO: 827735 - protein, 9 aa, Homo Sapiens
QIVETLSNA

SEQ ID NO: 827736 - protein, 9 aa, Homo Sapiens
KVTITLTNV

SEQ ID NO: 827737 - protein, 9 aa, Homo Sapiens
AAINPILYD

SEQ ID NO: 827738 - protein, 9 aa, Homo Sapiens
SVSEAMVDI

SEQ ID NO: 827739 - protein, 9 aa, Homo Sapiens
ETTWKIKFI

SEQ ID NO: 827740 - protein, 9 aa, Homo Sapiens
VESRTDKEM

SEQ ID NO: 827741 - protein, 9 aa, Homo Sapiens
TQQEYQEKG

SEQ ID NO: 827742 - protein, 9 aa, Homo Sapiens
CFYRLLQIR

SEQ ID NO: 827743 - protein, 9 aa, Homo Sapiens
LYQALARMR

SEQ ID NO: 827744 - protein, 9 aa, Homo Sapiens
SDCYVFFNY

SEQ ID NO: 827745 - protein, 9 aa, Homo Sapiens
IGQISPDGP

SEQ ID NO: 827746 - protein, 9 aa, Homo Sapiens
IPKAPGFNQ

SEQ ID NO: 827747 - protein, 9 aa, Homo Sapiens
NIYIIIYFI

SEQ ID NO: 827748 - protein, 9 aa, Homo Sapiens
LIEENNDMN

SEQ ID NO: 827749 - protein, 9 aa, Homo Sapiens
LQAPGRYFK

SEQ ID NO: 827750 - protein, 9 aa, Homo Sapiens
LYVHRIIHT

SEQ ID NO: 827751 - protein, 9 aa, Homo Sapiens
SDYAIDDQD

SEQ ID NO: 827752 - protein, 9 aa, Homo Sapiens
ALERNIVSR

SEQ ID NO: 827753 - protein, 9 aa, Homo Sapiens
NLGLLVSDE

SEQ ID NO: 827754 - protein, 9 aa, Homo Sapiens
PETTHKSSA

SEQ ID NO: 827755 - protein, 9 aa, Homo Sapiens
AAFQRASYA

SEQ ID NO: 827756 - protein, 9 aa, Homo Sapiens
QNLEEVREL

SEQ ID NO: 827757 - protein, 9 aa, Homo Sapiens
DERTCIQFY

SEQ ID NO: 827758 - protein, 9 aa, Homo Sapiens
GLRKLVDVL

SEQ ID NO: 827759 - protein, 9 aa, Homo Sapiens
DHKKKKKKI

SEQ ID NO: 827760 - protein, 9 aa, Homo Sapiens
GPFAPGITD

SEQ ID NO: 827761 - protein, 9 aa, Homo Sapiens
DYISKRPKS

SEQ ID NO: 827762 - protein, 9 aa, Homo Sapiens
LAGWHRITI

SEQ ID NO: 827763 - protein, 9 aa, Homo Sapiens
KKIKCFLER

SEQ ID NO: 827764 - protein, 9 aa, Homo Sapiens
QAADPAAMV

SEQ ID NO: 827765 - protein, 9 aa, Homo Sapiens
TYFDFRLYC

SEQ ID NO: 827766 - protein, 9 aa, Homo Sapiens
FWQQVLAPA

SEQ ID NO: 827767 - protein, 9 aa, Homo Sapiens
FERNNITEY

SEQ ID NO: 827768 - protein, 9 aa, Homo Sapiens
LGAIPQAHF

SEQ ID NO: 827769 - protein, 9 aa, Homo Sapiens
QCEEIATQF

SEQ ID NO: 827770 - protein, 9 aa, Homo Sapiens
KNTWEQMLQ

SEQ ID NO: 827771 - protein, 9 aa, Homo Sapiens
SRGLYYNFW

SEQ ID NO: 827772 - protein, 9 aa, Homo Sapiens
ELSKEERDP

SEQ ID NO: 827773 - protein, 9 aa, Homo Sapiens
LDEAHDDDL

SEQ ID NO: 827774 - protein, 9 aa, Homo Sapiens
PEIETEVKT

SEQ ID NO: 827775 - protein, 9 aa, Homo Sapiens
FYILVGGIG

SEQ ID NO: 827776 - protein, 9 aa, Homo Sapiens
NVAEHFFCD

SEQ ID NO: 827777 - protein, 9 aa, Homo Sapiens
KKVAKTPTN

SEQ ID NO: 827778 - protein, 9 aa, Homo Sapiens
TAASDTKKN

SEQ ID NO: 827779 - protein, 9 aa, Homo Sapiens
ALLLQIPSC

SEQ ID NO: 827780 - protein, 9 aa, Homo Sapiens
QIPLPCCTQ

SEQ ID NO: 827781 - protein, 9 aa, Homo Sapiens
YMTSDRTYQ

SEQ ID NO: 827782 - protein, 9 aa, Homo Sapiens
VISYRSGIT

SEQ ID NO: 827783 - protein, 9 aa, Homo Sapiens
LINEEVKNA

SEQ ID NO: 827784 - protein, 9 aa, Homo Sapiens
DDPVLENIL

SEQ ID NO: 827785 - protein, 9 aa, Homo Sapiens
INEITFDKI

SEQ ID NO: 827786 - protein, 9 aa, Homo Sapiens
ELSNPIPIK

SEQ ID NO: 827787 - protein, 9 aa, Homo Sapiens
QMGKPVPFS

SEQ ID NO: 827788 - protein, 9 aa, Homo Sapiens
SLSVSEAMV

SEQ ID NO: 827789 - protein, 9 aa, Homo Sapiens
DKENSECAF

SEQ ID NO: 827790 - protein, 9 aa, Homo Sapiens
IILTFTCYY

SEQ ID NO: 827791 - protein, 9 aa, Homo Sapiens
RDFLLYIAR

SEQ ID NO: 827792 - protein, 9 aa, Homo Sapiens
QLCEITEKT

SEQ ID NO: 827793 - protein, 9 aa, Homo Sapiens
VTELLMGEL

SEQ ID NO: 827794 - protein, 9 aa, Homo Sapiens
LMVHQITHT

SEQ ID NO: 827795 - protein, 9 aa, Homo Sapiens
KGQSPKSLR

SEQ ID NO: 827796 - protein, 9 aa, Homo Sapiens
VLDIEQLSV

SEQ ID NO: 827797 - protein, 9 aa, Homo Sapiens
GRCLGNKCV

SEQ ID NO: 827798 - protein, 9 aa, Homo Sapiens
ITSPMSIGH

SEQ ID NO: 827799 - protein, 9 aa, Homo Sapiens
RLFAPAILT

SEQ ID NO: 827800 - protein, 9 aa, Homo Sapiens
QTIHFSPDI

SEQ ID NO: 827801 - protein, 9 aa, Homo Sapiens
DFLLYIARQ

SEQ ID NO: 827802 - protein, 9 aa, Homo Sapiens
RYKYMVDPK

SEQ ID NO: 827803 - protein, 9 aa, Homo Sapiens
LTYDNQIHI

SEQ ID NO: 827804 - protein, 9 aa, Homo Sapiens
NNLWVDPCY

SEQ ID NO: 827805 - protein, 9 aa, Homo Sapiens
WYFHNHEEM

SEQ ID NO: 827806 - protein, 9 aa, Homo Sapiens
FHLNCLTCM

SEQ ID NO: 827807 - protein, 9 aa, Homo Sapiens
NPNGSWGKK

SEQ ID NO: 827808 - protein, 9 aa, Homo Sapiens
FIDKNFWSG

SEQ ID NO: 827809 - protein, 9 aa, Homo Sapiens
YSVTSFTTP

SEQ ID NO: 827810 - protein, 9 aa, Homo Sapiens
YGNVDGFKT

SEQ ID NO: 827811 - protein, 9 aa, Homo Sapiens
LYPDPGLLS

SEQ ID NO: 827812 - protein, 9 aa, Homo Sapiens
NLLLQHNIR

SEQ ID NO: 827813 - protein, 9 aa, Homo Sapiens
APTFWQMQC

SEQ ID NO: 827814 - protein, 9 aa, Homo Sapiens
FAQLIIGIP

SEQ ID NO: 827815 - protein, 9 aa, Homo Sapiens
YTGNLAMNY

SEQ ID NO: 827816 - protein, 9 aa, Homo Sapiens
ALLHPLESL

SEQ ID NO: 827817 - protein, 9 aa, Homo Sapiens
IIRQRFPQL

SEQ ID NO: 827818 - protein, 9 aa, Homo Sapiens
KMNRLFSGK

SEQ ID NO: 827819 - protein, 9 aa, Homo Sapiens
FLSETCTYL

SEQ ID NO: 827820 - protein, 9 aa, Homo Sapiens
WWRGLRLQK

SEQ ID NO: 827821 - protein, 9 aa, Homo Sapiens
MWKEGNIIH

SEQ ID NO: 827822 - protein, 9 aa, Homo Sapiens
DVLDIEQLS

SEQ ID NO: 827823 - protein, 9 aa, Homo Sapiens
MERGLSKKT

SEQ ID NO: 827824 - protein, 9 aa, Homo Sapiens
KMNVNIPEN

SEQ ID NO: 827825 - protein, 9 aa, Homo Sapiens
PVQHILLDQ

SEQ ID NO: 827826 - protein, 9 aa, Homo Sapiens
MYGRNELIG

SEQ ID NO: 827827 - protein, 9 aa, Homo Sapiens
AALKGEEQN

SEQ ID NO: 827828 - protein, 9 aa, Homo Sapiens
ARAQGPSRK

SEQ ID NO: 827829 - protein, 9 aa, Homo Sapiens
SEKLPEVLS

SEQ ID NO: 827830 - protein, 9 aa, Homo Sapiens
TIKYMTALH

SEQ ID NO: 827831 - protein, 9 aa, Homo Sapiens
VAHRITAEL

SEQ ID NO: 827832 - protein, 9 aa, Homo Sapiens
PICQVESLN

SEQ ID NO: 827833 - protein, 9 aa, Homo Sapiens
YIKNVPILR

SEQ ID NO: 827834 - protein, 9 aa, Homo Sapiens
RLKYYQILI

SEQ ID NO: 827835 - protein, 9 aa, Homo Sapiens
SSTNKISTA

SEQ ID NO: 827836 - protein, 9 aa, Homo Sapiens
GLEISHKSS

SEQ ID NO: 827837 - protein, 9 aa, Homo Sapiens
EFIILWWNI

SEQ ID NO: 827838 - protein, 9 aa, Homo Sapiens
KRDTKTMYA

SEQ ID NO: 827839 - protein, 9 aa, Homo Sapiens
SHPHTQKFT

SEQ ID NO: 827840 - protein, 9 aa, Homo Sapiens
SPVLISGNC

SEQ ID NO: 827841 - protein, 9 aa, Homo Sapiens
LNFDIDRGR

SEQ ID NO: 827842 - protein, 9 aa, Homo Sapiens
GSAPTPLCC

SEQ ID NO: 827843 - protein, 9 aa, Homo Sapiens
EAPMLTHAT

SEQ ID NO: 827844 - protein, 9 aa, Homo Sapiens
IQPPSTTPC

SEQ ID NO: 827845 - protein, 9 aa, Homo Sapiens
RTKQLFECM

SEQ ID NO: 827846 - protein, 9 aa, Homo Sapiens
SCLNTIAWP

SEQ ID NO: 827847 - protein, 9 aa, Homo Sapiens
NLSEREVEI

SEQ ID NO: 827848 - protein, 9 aa, Homo Sapiens
LRTFKLTLQ

SEQ ID NO: 827849 - protein, 9 aa, Homo Sapiens
IFGSSLSGL

SEQ ID NO: 827850 - protein, 9 aa, Homo Sapiens
STLTCHRKL

SEQ ID NO: 827851 - protein, 9 aa, Homo Sapiens
CHSAWPPTL

SEQ ID NO: 827852 - protein, 9 aa, Homo Sapiens
MPLTHFFKL

SEQ ID NO: 827853 - protein, 9 aa, Homo Sapiens
QDITKCLFL

SEQ ID NO: 827854 - protein, 9 aa, Homo Sapiens
ADIYEFIWT

SEQ ID NO: 827855 - protein, 9 aa, Homo Sapiens
HHRLHTQEG

SEQ ID NO: 827856 - protein, 9 aa, Homo Sapiens
INHISIRQL

SEQ ID NO: 827857 - protein, 9 aa, Homo Sapiens
HLDRIMDFR

SEQ ID NO: 827858 - protein, 9 aa, Homo Sapiens
VQRGRELFD

SEQ ID NO: 827859 - protein, 9 aa, Homo Sapiens
SDALSLDVA

SEQ ID NO: 827860 - protein, 9 aa, Homo Sapiens
SAQRAFDHE

SEQ ID NO: 827861 - protein, 9 aa, Homo Sapiens
ITVKQVYFH

SEQ ID NO: 827862 - protein, 9 aa, Homo Sapiens
EPGKRFMFQ

SEQ ID NO: 827863 - protein, 9 aa, Homo Sapiens
LSYRRNSDI

SEQ ID NO: 827864 - protein, 9 aa, Homo Sapiens
SMNNNIINT

SEQ ID NO: 827865 - protein, 9 aa, Homo Sapiens
EFDFSEYVK

SEQ ID NO: 827866 - protein, 9 aa, Homo Sapiens
MVDIYLLLP

SEQ ID NO: 827867 - protein, 9 aa, Homo Sapiens
KEHIARKFV

SEQ ID NO: 827868 - protein, 9 aa, Homo Sapiens
NMDKVLLKY

SEQ ID NO: 827869 - protein, 9 aa, Homo Sapiens
QTFRKIIHS

SEQ ID NO: 827870 - protein, 9 aa, Homo Sapiens
DTRSRGVLL

SEQ ID NO: 827871 - protein, 9 aa, Homo Sapiens
VTKVMNLFE

SEQ ID NO: 827872 - protein, 9 aa, Homo Sapiens
EGQLIIRPS

SEQ ID NO: 827873 - protein, 9 aa, Homo Sapiens
VQHVRRMFH

SEQ ID NO: 827874 - protein, 9 aa, Homo Sapiens
VYWYCTRLK

SEQ ID NO: 827875 - protein, 9 aa, Homo Sapiens
VEVLWPGTI

SEQ ID NO: 827876 - protein, 9 aa, Homo Sapiens
LPKEAGPSQ

SEQ ID NO: 827877 - protein, 9 aa, Homo Sapiens
SIDIWIGAI

SEQ ID NO: 827878 - protein, 9 aa, Homo Sapiens
LSMHSSDYP

SEQ ID NO: 827879 - protein, 9 aa, Homo Sapiens
VGEKKDQQI

SEQ ID NO: 827880 - protein, 9 aa, Homo Sapiens
YWPKMLKCD

SEQ ID NO: 827881 - protein, 9 aa, Homo Sapiens
FDWIRKEIN

SEQ ID NO: 827882 - protein, 9 aa, Homo Sapiens
VLSMESLPT

SEQ ID NO: 827883 - protein, 9 aa, Homo Sapiens
AVVLLFYIT

SEQ ID NO: 827884 - protein, 9 aa, Homo Sapiens
KYLAGQDAK

SEQ ID NO: 827885 - protein, 9 aa, Homo Sapiens
RINYSGESG

SEQ ID NO: 827886 - protein, 9 aa, Homo Sapiens
RDSLSVPHR

SEQ ID NO: 827887 - protein, 9 aa, Homo Sapiens
AFRESDTNG

SEQ ID NO: 827888 - protein, 9 aa, Homo Sapiens
KQLLWGPAF

SEQ ID NO: 827889 - protein, 9 aa, Homo Sapiens
SFGRKVMDI

SEQ ID NO: 827890 - protein, 9 aa, Homo Sapiens
RGKTCRRIL

SEQ ID NO: 827891 - protein, 9 aa, Homo Sapiens
QIDLIKVDD

SEQ ID NO: 827892 - protein, 9 aa, Homo Sapiens
EVAYGPEGI

SEQ ID NO: 827893 - protein, 9 aa, Homo Sapiens
IIANINRTL

SEQ ID NO: 827894 - protein, 9 aa, Homo Sapiens
NKASILLIR

SEQ ID NO: 827895 - protein, 9 aa, Homo Sapiens
EKDIRSCCL

SEQ ID NO: 827896 - protein, 9 aa, Homo Sapiens
VPNTPQIFP

SEQ ID NO: 827897 - protein, 9 aa, Homo Sapiens
IPGVPNLPE

SEQ ID NO: 827898 - protein, 9 aa, Homo Sapiens
NSQIQPIIA

SEQ ID NO: 827899 - protein, 9 aa, Homo Sapiens
GAKNVNMKP

SEQ ID NO: 827900 - protein, 9 aa, Homo Sapiens
LMEQHNIKG

SEQ ID NO: 827901 - protein, 9 aa, Homo Sapiens
SGGSEIKEI

SEQ ID NO: 827902 - protein, 9 aa, Homo Sapiens
GSSDEDISD

SEQ ID NO: 827903 - protein, 9 aa, Homo Sapiens
CGHTSVIRN

SEQ ID NO: 827904 - protein, 9 aa, Homo Sapiens
SGLYHSPSM

SEQ ID NO: 827905 - protein, 9 aa, Homo Sapiens
YKYHVKPLQ

SEQ ID NO: 827906 - protein, 9 aa, Homo Sapiens
ALGLQRAMS

SEQ ID NO: 827907 - protein, 9 aa, Homo Sapiens
FSEISNPFY

SEQ ID NO: 827908 - protein, 9 aa, Homo Sapiens
DAILALMPL

SEQ ID NO: 827909 - protein, 9 aa, Homo Sapiens
EKRAKLHEI

SEQ ID NO: 827910 - protein, 9 aa, Homo Sapiens
TEIVNVLLE

SEQ ID NO: 827911 - protein, 9 aa, Homo Sapiens
MNKNTWEQM

SEQ ID NO: 827912 - protein, 9 aa, Homo Sapiens
YANVFHQCS

SEQ ID NO: 827913 - protein, 9 aa, Homo Sapiens
GITMVLTMS

SEQ ID NO: 827914 - protein, 9 aa, Homo Sapiens
SFLRHEEQS

SEQ ID NO: 827915 - protein, 9 aa, Homo Sapiens
ASFLLCGVI

SEQ ID NO: 827916 - protein, 9 aa, Homo Sapiens
SHLPVTEAE

SEQ ID NO: 827917 - protein, 9 aa, Homo Sapiens
ARKKPQSRG

SEQ ID NO: 827918 - protein, 9 aa, Homo Sapiens
AATVAHQRK

SEQ ID NO: 827919 - protein, 9 aa, Homo Sapiens
LNWMHYNQA

SEQ ID NO: 827920 - protein, 9 aa, Homo Sapiens
CQSRPNAII

SEQ ID NO: 827921 - protein, 9 aa, Homo Sapiens
SQAFKQLCL

SEQ ID NO: 827922 - protein, 9 aa, Homo Sapiens
IRITQSGNF

SEQ ID NO: 827923 - protein, 9 aa, Homo Sapiens
GCQHVKYGQ

SEQ ID NO: 827924 - protein, 9 aa, Homo Sapiens
HIVQIPLPC

SEQ ID NO: 827925 - protein, 9 aa, Homo Sapiens
IKYCLGCIS

SEQ ID NO: 827926 - protein, 9 aa, Homo Sapiens
SYVYFPRIG

SEQ ID NO: 827927 - protein, 9 aa, Homo Sapiens
AWSDALSLD

SEQ ID NO: 827928 - protein, 9 aa, Homo Sapiens
TRAGALLLL

SEQ ID NO: 827929 - protein, 9 aa, Homo Sapiens
GVHGIQIEF

SEQ ID NO: 827930 - protein, 9 aa, Homo Sapiens
QERKLCRYL

SEQ ID NO: 827931 - protein, 9 aa, Homo Sapiens
VEKQLMEDK

SEQ ID NO: 827932 - protein, 9 aa, Homo Sapiens
LKVPQIHWD

SEQ ID NO: 827933 - protein, 9 aa, Homo Sapiens
KISTEIELP

SEQ ID NO: 827934 - protein, 9 aa, Homo Sapiens
MYLFLMFGD

SEQ ID NO: 827935 - protein, 9 aa, Homo Sapiens
KRYLVKLIC

SEQ ID NO: 827936 - protein, 9 aa, Homo Sapiens
AAEIILALM

SEQ ID NO: 827937 - protein, 9 aa, Homo Sapiens
PVHSKLFTV

SEQ ID NO: 827938 - protein, 9 aa, Homo Sapiens
YLYQLLQGI

SEQ ID NO: 827939 - protein, 9 aa, Homo Sapiens
LVAHKPLND

SEQ ID NO: 827940 - protein, 9 aa, Homo Sapiens
DTNDGDDDE

SEQ ID NO: 827941 - protein, 9 aa, Homo Sapiens
QERRYKCAA

SEQ ID NO: 827942 - protein, 9 aa, Homo Sapiens
LNISFVDCS

SEQ ID NO: 827943 - protein, 9 aa, Homo Sapiens
FKCLSKDAV

SEQ ID NO: 827944 - protein, 9 aa, Homo Sapiens
DVKDKFDYG

SEQ ID NO: 827945 - protein, 9 aa, Homo Sapiens
DKLYPCNQC

SEQ ID NO: 827946 - protein, 9 aa, Homo Sapiens
WLFLNILQP

SEQ ID NO: 827947 - protein, 9 aa, Homo Sapiens
KAPLYGQMM

SEQ ID NO: 827948 - protein, 9 aa, Homo Sapiens
VSESSLSAD

SEQ ID NO: 827949 - protein, 9 aa, Homo Sapiens
LRVNALLAG

SEQ ID NO: 827950 - protein, 9 aa, Homo Sapiens
HIILVNVRH

SEQ ID NO: 827951 - protein, 9 aa, Homo Sapiens
ENAEEYEGR

SEQ ID NO: 827952 - protein, 9 aa, Homo Sapiens
TECFSFWYH

SEQ ID NO: 827953 - protein, 9 aa, Homo Sapiens
GIGCSLVCG

SEQ ID NO: 827954 - protein, 9 aa, Homo Sapiens
VHRECDEGR

SEQ ID NO: 827955 - protein, 9 aa, Homo Sapiens
TYKQVAGSD

SEQ ID NO: 827956 - protein, 9 aa, Homo Sapiens
SEQVWYEHR

SEQ ID NO: 827957 - protein, 9 aa, Homo Sapiens
ERYKYMVDP

SEQ ID NO: 827958 - protein, 9 aa, Homo Sapiens
DDIFSILKD

SEQ ID NO: 827959 - protein, 9 aa, Homo Sapiens
TCTAIRTDI

SEQ ID NO: 827960 - protein, 9 aa, Homo Sapiens
LKLHWEDFN

SEQ ID NO: 827961 - protein, 9 aa, Homo Sapiens
TLKVQDVKS

SEQ ID NO: 827962 - protein, 9 aa, Homo Sapiens
PGDTYGPVT

SEQ ID NO: 827963 - protein, 9 aa, Homo Sapiens
EEEIIILEP

SEQ ID NO: 827964 - protein, 9 aa, Homo Sapiens
SDIKSECRK

SEQ ID NO: 827965 - protein, 9 aa, Homo Sapiens
YVTVKEHAH

SEQ ID NO: 827966 - protein, 9 aa, Homo Sapiens
AAIMGDHNR

SEQ ID NO: 827967 - protein, 9 aa, Homo Sapiens
EKEVNEVSH

SEQ ID NO: 827968 - protein, 9 aa, Homo Sapiens
IQGFEVLVE

SEQ ID NO: 827969 - protein, 9 aa, Homo Sapiens
DQKYLFANS

SEQ ID NO: 827970 - protein, 9 aa, Homo Sapiens
LNVFSLNYL

SEQ ID NO: 827971 - protein, 9 aa, Homo Sapiens
LRERVKTSV

SEQ ID NO: 827972 - protein, 9 aa, Homo Sapiens
KLQKQETSL

SEQ ID NO: 827973 - protein, 9 aa, Homo Sapiens
IGHEVTVLA

SEQ ID NO: 827974 - protein, 9 aa, Homo Sapiens
GLKGVLINS

SEQ ID NO: 827975 - protein, 9 aa, Homo Sapiens
CNVTIIRIG

SEQ ID NO: 827976 - protein, 9 aa, Homo Sapiens
PTFRVVDTE

SEQ ID NO: 827977 - protein, 9 aa, Homo Sapiens
LLYCIALSL

SEQ ID NO: 827978 - protein, 9 aa, Homo Sapiens
IIYRYLKPE

SEQ ID NO: 827979 - protein, 9 aa, Homo Sapiens
KRQCGDCKC

SEQ ID NO: 827980 - protein, 9 aa, Homo Sapiens
TGNSRSSIG

SEQ ID NO: 827981 - protein, 9 aa, Homo Sapiens
FKLQSMIPC

SEQ ID NO: 827982 - protein, 9 aa, Homo Sapiens
ISGLFSEAK

SEQ ID NO: 827983 - protein, 9 aa, Homo Sapiens
TESADSIDI

SEQ ID NO: 827984 - protein, 9 aa, Homo Sapiens
IIVLMLACL

SEQ ID NO: 827985 - protein, 9 aa, Homo Sapiens
TRVSQIICS

SEQ ID NO: 827986 - protein, 9 aa, Homo Sapiens
VITCFDSLK

SEQ ID NO: 827987 - protein, 9 aa, Homo Sapiens
IGQAFTMAE

SEQ ID NO: 827988 - protein, 9 aa, Homo Sapiens
SDSHQYDQI

SEQ ID NO: 827989 - protein, 9 aa, Homo Sapiens
SSQRTALSD

SEQ ID NO: 827990 - protein, 9 aa, Homo Sapiens
HFEEDTLEI

SEQ ID NO: 827991 - protein, 9 aa, Homo Sapiens
DSVTFDNVA

SEQ ID NO: 827992 - protein, 9 aa, Homo Sapiens
KVHPAVVIQ

SEQ ID NO: 827993 - protein, 9 aa, Homo Sapiens
GEEKFSYGY

SEQ ID NO: 827994 - protein, 9 aa, Homo Sapiens
RGVSVQYHY

SEQ ID NO: 827995 - protein, 9 aa, Homo Sapiens
YEHHLEAHM

SEQ ID NO: 827996 - protein, 9 aa, Homo Sapiens
WACVHNYPT

SEQ ID NO: 827997 - protein, 9 aa, Homo Sapiens
VWRGVNVNM

SEQ ID NO: 827998 - protein, 9 aa, Homo Sapiens
VAELENSEL

SEQ ID NO: 827999 - protein, 9 aa, Homo Sapiens
SQILKALHS

SEQ ID NO: 828000 - protein, 9 aa, Homo Sapiens
HKALKMILT

SEQ ID NO: 828001 - protein, 9 aa, Homo Sapiens
PPLGLGNKC

SEQ ID NO: 828002 - protein, 9 aa, Homo Sapiens
NARKRNRMH

SEQ ID NO: 828003 - protein, 9 aa, Homo Sapiens
VVSGNAQNG

SEQ ID NO: 828004 - protein, 9 aa, Homo Sapiens
GKGRTENRR

SEQ ID NO: 828005 - protein, 9 aa, Homo Sapiens
QSSPERNHS

SEQ ID NO: 828006 - protein, 9 aa, Homo Sapiens
YRTIQGFEV

SEQ ID NO: 828007 - protein, 9 aa, Homo Sapiens
RIYLIQHQK

SEQ ID NO: 828008 - protein, 9 aa, Homo Sapiens
VDNSACRMT

SEQ ID NO: 828009 - protein, 9 aa, Homo Sapiens
LQLRETVRN

SEQ ID NO: 828010 - protein, 9 aa, Homo Sapiens
LKIKFNTIA

SEQ ID NO: 828011 - protein, 9 aa, Homo Sapiens
IKFNTIAAE

SEQ ID NO: 828012 - protein, 9 aa, Homo Sapiens
PQPQQSLAT

SEQ ID NO: 828013 - protein, 9 aa, Homo Sapiens
SIGEKLERY

SEQ ID NO: 828014 - protein, 9 aa, Homo Sapiens
PNAAQYLHQ

SEQ ID NO: 828015 - protein, 9 aa, Homo Sapiens
LFRAWVWAG

SEQ ID NO: 828016 - protein, 9 aa, Homo Sapiens
EKLKQDEQR

SEQ ID NO: 828017 - protein, 9 aa, Homo Sapiens
SNIYKIRHT

SEQ ID NO: 828018 - protein, 9 aa, Homo Sapiens
MQGAVAVTM

SEQ ID NO: 828019 - protein, 9 aa, Homo Sapiens
DMNRLIINY

SEQ ID NO: 828020 - protein, 9 aa, Homo Sapiens
IWIFIPQLC

SEQ ID NO: 828021 - protein, 9 aa, Homo Sapiens
TGGTHKRYF

SEQ ID NO: 828022 - protein, 9 aa, Homo Sapiens
LPPSRNWRE

SEQ ID NO: 828023 - protein, 9 aa, Homo Sapiens
MATYDLPAT

SEQ ID NO: 828024 - protein, 9 aa, Homo Sapiens
GIEPWPEDR

SEQ ID NO: 828025 - protein, 9 aa, Homo Sapiens
VVVELFGVW

SEQ ID NO: 828026 - protein, 9 aa, Homo Sapiens
GLGSVTALR

SEQ ID NO: 828027 - protein, 9 aa, Homo Sapiens
HLSGKEADK

SEQ ID NO: 828028 - protein, 9 aa, Homo Sapiens
NSELRAFSS

SEQ ID NO: 828029 - protein, 9 aa, Homo Sapiens
FTATAKFRE

SEQ ID NO: 828030 - protein, 9 aa, Homo Sapiens
HKYSNSNIY

SEQ ID NO: 828031 - protein, 9 aa, Homo Sapiens
YAIYRESDL

SEQ ID NO: 828032 - protein, 9 aa, Homo Sapiens
KDSFGSGDC

SEQ ID NO: 828033 - protein, 9 aa, Homo Sapiens
LWKEMSAKK

SEQ ID NO: 828034 - protein, 9 aa, Homo Sapiens
VTSMTILYW

SEQ ID NO: 828035 - protein, 9 aa, Homo Sapiens
ARSINGIII

SEQ ID NO: 828036 - protein, 9 aa, Homo Sapiens
LDMATHPAG

SEQ ID NO: 828037 - protein, 9 aa, Homo Sapiens
SAVLFYINM

SEQ ID NO: 828038 - protein, 9 aa, Homo Sapiens
ILKTVLRSK

SEQ ID NO: 828039 - protein, 9 aa, Homo Sapiens
LFSTKGKAL

SEQ ID NO: 828040 - protein, 9 aa, Homo Sapiens
QKTLEEMEL

SEQ ID NO: 828041 - protein, 9 aa, Homo Sapiens
FKIEIIQPI

SEQ ID NO: 828042 - protein, 9 aa, Homo Sapiens
HMLLQEYRL

SEQ ID NO: 828043 - protein, 9 aa, Homo Sapiens
AKEEGAELE

SEQ ID NO: 828044 - protein, 9 aa, Homo Sapiens
YSLIQILMV

SEQ ID NO: 828045 - protein, 9 aa, Homo Sapiens
AKGESGFRG

SEQ ID NO: 828046 - protein, 9 aa, Homo Sapiens
GNCKTTLGW

SEQ ID NO: 828047 - protein, 9 aa, Homo Sapiens
DGIIKLNVR

SEQ ID NO: 828048 - protein, 9 aa, Homo Sapiens
EKGSYEILQ

SEQ ID NO: 828049 - protein, 9 aa, Homo Sapiens
SVVSEFLLL

SEQ ID NO: 828050 - protein, 9 aa, Homo Sapiens
HIRKILGTN

SEQ ID NO: 828051 - protein, 9 aa, Homo Sapiens
KMLPYTFPH

SEQ ID NO: 828052 - protein, 9 aa, Homo Sapiens
ITMDKTPSY

SEQ ID NO: 828053 - protein, 9 aa, Homo Sapiens
TLSSKSAKE

SEQ ID NO: 828054 - protein, 9 aa, Homo Sapiens
GNANILVAA

SEQ ID NO: 828055 - protein, 9 aa, Homo Sapiens
LEMKMSLFE

SEQ ID NO: 828056 - protein, 9 aa, Homo Sapiens
PGPPGPQGS

SEQ ID NO: 828057 - protein, 9 aa, Homo Sapiens
DNRTATPQT

SEQ ID NO: 828058 - protein, 9 aa, Homo Sapiens
HSPVFWHKE

SEQ ID NO: 828059 - protein, 9 aa, Homo Sapiens
KKRKQSEYI

SEQ ID NO: 828060 - protein, 9 aa, Homo Sapiens
PSLKWPTLV

SEQ ID NO: 828061 - protein, 9 aa, Homo Sapiens
LEAAHFDKK

SEQ ID NO: 828062 - protein, 9 aa, Homo Sapiens
AEHQIDLIK

SEQ ID NO: 828063 - protein, 9 aa, Homo Sapiens
FYGYLVNYL

SEQ ID NO: 828064 - protein, 9 aa, Homo Sapiens
GLSDHPHMK

SEQ ID NO: 828065 - protein, 9 aa, Homo Sapiens
YTCGGIDKR

SEQ ID NO: 828066 - protein, 9 aa, Homo Sapiens
PFFLGPQRL

SEQ ID NO: 828067 - protein, 9 aa, Homo Sapiens
SYPSLVYMG

SEQ ID NO: 828068 - protein, 9 aa, Homo Sapiens
DPAKEYARL

SEQ ID NO: 828069 - protein, 9 aa, Homo Sapiens
RKYRVVDLN

SEQ ID NO: 828070 - protein, 9 aa, Homo Sapiens
VYHEQHLFY

SEQ ID NO: 828071 - protein, 9 aa, Homo Sapiens
TKQLFECMN

SEQ ID NO: 828072 - protein, 9 aa, Homo Sapiens
ELFNVRPPW

SEQ ID NO: 828073 - protein, 9 aa, Homo Sapiens
GQDKETVIF

SEQ ID NO: 828074 - protein, 9 aa, Homo Sapiens
LDLRQQLCE

SEQ ID NO: 828075 - protein, 9 aa, Homo Sapiens
SKVFHLNCL

SEQ ID NO: 828076 - protein, 9 aa, Homo Sapiens
AFTMAEMKV

SEQ ID NO: 828077 - protein, 9 aa, Homo Sapiens
PGHVVVELF

SEQ ID NO: 828078 - protein, 9 aa, Homo Sapiens
SELQVLWVD

SEQ ID NO: 828079 - protein, 9 aa, Homo Sapiens
FMISKLLSY

SEQ ID NO: 828080 - protein, 9 aa, Homo Sapiens
VILYQILRG

SEQ ID NO: 828081 - protein, 9 aa, Homo Sapiens
LFYISGFIL

SEQ ID NO: 828082 - protein, 9 aa, Homo Sapiens
VHSLVQICL

SEQ ID NO: 828083 - protein, 9 aa, Homo Sapiens
ALRSEEYEQ

SEQ ID NO: 828084 - protein, 9 aa, Homo Sapiens
QGTSRGHSI

SEQ ID NO: 828085 - protein, 9 aa, Homo Sapiens
LHANHEQLH

SEQ ID NO: 828086 - protein, 9 aa, Homo Sapiens
CSTVSLIIH

SEQ ID NO: 828087 - protein, 9 aa, Homo Sapiens
NSTTWKVIS

SEQ ID NO: 828088 - protein, 9 aa, Homo Sapiens
DPDWRDFFW

SEQ ID NO: 828089 - protein, 9 aa, Homo Sapiens
MLINFLSEK

SEQ ID NO: 828090 - protein, 9 aa, Homo Sapiens
FIKQMLLNL

SEQ ID NO: 828091 - protein, 9 aa, Homo Sapiens
NQTAEPLVP

SEQ ID NO: 828092 - protein, 9 aa, Homo Sapiens
FPVLQTNND

SEQ ID NO: 828093 - protein, 9 aa, Homo Sapiens
YVPREIRWG

SEQ ID NO: 828094 - protein, 9 aa, Homo Sapiens
QSTSPQRVP

SEQ ID NO: 828095 - protein, 9 aa, Homo Sapiens
DLVTDSDED

SEQ ID NO: 828096 - protein, 9 aa, Homo Sapiens
ARDKDKRGK

SEQ ID NO: 828097 - protein, 9 aa, Homo Sapiens
DIYCVQAIT

SEQ ID NO: 828098 - protein, 9 aa, Homo Sapiens
DLFPFPRHG

SEQ ID NO: 828099 - protein, 9 aa, Homo Sapiens
AMKQNKLLE

SEQ ID NO: 828100 - protein, 9 aa, Homo Sapiens
FGLGGAGLA

SEQ ID NO: 828101 - protein, 9 aa, Homo Sapiens
KLPIIELSH

SEQ ID NO: 828102 - protein, 9 aa, Homo Sapiens
VTIWAANTG

SEQ ID NO: 828103 - protein, 9 aa, Homo Sapiens
PFLFGSGTS

SEQ ID NO: 828104 - protein, 9 aa, Homo Sapiens
ARGTNDERA

SEQ ID NO: 828105 - protein, 9 aa, Homo Sapiens
SVLDYFSEI

SEQ ID NO: 828106 - protein, 9 aa, Homo Sapiens
KNYEIKKYS

SEQ ID NO: 828107 - protein, 9 aa, Homo Sapiens
LFPAPIPRA

SEQ ID NO: 828108 - protein, 9 aa, Homo Sapiens
TCQIATRRF

SEQ ID NO: 828109 - protein, 9 aa, Homo Sapiens
KNNWQRIQE

SEQ ID NO: 828110 - protein, 9 aa, Homo Sapiens
VCYVPYVAF

SEQ ID NO: 828111 - protein, 9 aa, Homo Sapiens
GNASKDESD

SEQ ID NO: 828112 - protein, 9 aa, Homo Sapiens
LFIDVVQRQ

SEQ ID NO: 828113 - protein, 9 aa, Homo Sapiens
IDVAHVTST

SEQ ID NO: 828114 - protein, 9 aa, Homo Sapiens
TCLIQLLNS

SEQ ID NO: 828115 - protein, 9 aa, Homo Sapiens
RLQNIPFNL

SEQ ID NO: 828116 - protein, 9 aa, Homo Sapiens
VAHQIIHAV

SEQ ID NO: 828117 - protein, 9 aa, Homo Sapiens
RTPLMIALL

SEQ ID NO: 828118 - protein, 9 aa, Homo Sapiens
RRHMRIHKE

SEQ ID NO: 828119 - protein, 9 aa, Homo Sapiens
GAHWQELTC

SEQ ID NO: 828120 - protein, 9 aa, Homo Sapiens
DSKLSLDEL

SEQ ID NO: 828121 - protein, 9 aa, Homo Sapiens
TAIANAVVQ

SEQ ID NO: 828122 - protein, 9 aa, Homo Sapiens
KMCFYRLLQ

SEQ ID NO: 828123 - protein, 9 aa, Homo Sapiens
AGYPRDIHT

SEQ ID NO: 828124 - protein, 9 aa, Homo Sapiens
VAHTVIRSL

SEQ ID NO: 828125 - protein, 9 aa, Homo Sapiens
MKAQEIEIT

SEQ ID NO: 828126 - protein, 9 aa, Homo Sapiens
QESVCQRYN

SEQ ID NO: 828127 - protein, 9 aa, Homo Sapiens
LPVKHKIQC

SEQ ID NO: 828128 - protein, 9 aa, Homo Sapiens
GGEPKHPGG

SEQ ID NO: 828129 - protein, 9 aa, Homo Sapiens
RSSYCIEGF

SEQ ID NO: 828130 - protein, 9 aa, Homo Sapiens
HEFNLLDVR

SEQ ID NO: 828131 - protein, 9 aa, Homo Sapiens
AQQHHVGKK

SEQ ID NO: 828132 - protein, 9 aa, Homo Sapiens
NYSTVEQLY

SEQ ID NO: 828133 - protein, 9 aa, Homo Sapiens
NMISYAISA

SEQ ID NO: 828134 - protein, 9 aa, Homo Sapiens
LSDKENHIK

SEQ ID NO: 828135 - protein, 9 aa, Homo Sapiens
VALAKYHLK

SEQ ID NO: 828136 - protein, 9 aa, Homo Sapiens
LEISHKSSK

SEQ ID NO: 828137 - protein, 9 aa, Homo Sapiens
QFQICYGLS

SEQ ID NO: 828138 - protein, 9 aa, Homo Sapiens
LTQEERYKM

SEQ ID NO: 828139 - protein, 9 aa, Homo Sapiens
SKMVCKAPI

SEQ ID NO: 828140 - protein, 9 aa, Homo Sapiens
LNNSENQTY

SEQ ID NO: 828141 - protein, 9 aa, Homo Sapiens
EPQALLTAE

SEQ ID NO: 828142 - protein, 9 aa, Homo Sapiens
MRAEKRKNN

SEQ ID NO: 828143 - protein, 9 aa, Homo Sapiens
PYFCQNIAR

SEQ ID NO: 828144 - protein, 9 aa, Homo Sapiens
ISDHYNCVS

SEQ ID NO: 828145 - protein, 9 aa, Homo Sapiens
CPPQKLRAQ

SEQ ID NO: 828146 - protein, 9 aa, Homo Sapiens
IRNTNFCHG

SEQ ID NO: 828147 - protein, 9 aa, Homo Sapiens
EKVKDATQK

SEQ ID NO: 828148 - protein, 9 aa, Homo Sapiens
CKPLNYVVI

SEQ ID NO: 828149 - protein, 9 aa, Homo Sapiens
SGKTSVKGV

SEQ ID NO: 828150 - protein, 9 aa, Homo Sapiens
TYHLPPYKL

SEQ ID NO: 828151 - protein, 9 aa, Homo Sapiens
QSFYSRVLD

SEQ ID NO: 828152 - protein, 9 aa, Homo Sapiens
RGDGDGLII

SEQ ID NO: 828153 - protein, 9 aa, Homo Sapiens
VKETFDAMN

SEQ ID NO: 828154 - protein, 9 aa, Homo Sapiens
WTISMKVAY

SEQ ID NO: 828155 - protein, 9 aa, Homo Sapiens
ECQPSQCHP

SEQ ID NO: 828156 - protein, 9 aa, Homo Sapiens
GQLYAMELH

SEQ ID NO: 828157 - protein, 9 aa, Homo Sapiens
HIGSVSTTD

SEQ ID NO: 828158 - protein, 9 aa, Homo Sapiens
NLSLEYLDI

SEQ ID NO: 828159 - protein, 9 aa, Homo Sapiens
VIDKAQNFR

SEQ ID NO: 828160 - protein, 9 aa, Homo Sapiens
SGSNPNRVC

SEQ ID NO: 828161 - protein, 9 aa, Homo Sapiens
ERIALSRET

SEQ ID NO: 828162 - protein, 9 aa, Homo Sapiens
AKHVESRTD

SEQ ID NO: 828163 - protein, 9 aa, Homo Sapiens
QVFISDIKS

SEQ ID NO: 828164 - protein, 9 aa, Homo Sapiens
AVLSSADNI

SEQ ID NO: 828165 - protein, 9 aa, Homo Sapiens
DQHMVQNGY

SEQ ID NO: 828166 - protein, 9 aa, Homo Sapiens
VVDSADAGQ

SEQ ID NO: 828167 - protein, 9 aa, Homo Sapiens
QKLERDSLR

SEQ ID NO: 828168 - protein, 9 aa, Homo Sapiens
LGYQVKESK

SEQ ID NO: 828169 - protein, 9 aa, Homo Sapiens
NRDGLIDKE

SEQ ID NO: 828170 - protein, 9 aa, Homo Sapiens
MLHYIQDKT

SEQ ID NO: 828171 - protein, 9 aa, Homo Sapiens
SFHQLSHLQ

SEQ ID NO: 828172 - protein, 9 aa, Homo Sapiens
ERHVGRPWL

SEQ ID NO: 828173 - protein, 9 aa, Homo Sapiens
GDGDYMEIF

SEQ ID NO: 828174 - protein, 9 aa, Homo Sapiens
ALLFRSACQ

SEQ ID NO: 828175 - protein, 9 aa, Homo Sapiens
SDRTDGDRE

SEQ ID NO: 828176 - protein, 9 aa, Homo Sapiens
AEAQAELQW

SEQ ID NO: 828177 - protein, 9 aa, Homo Sapiens
FSGAAQASP

SEQ ID NO: 828178 - protein, 9 aa, Homo Sapiens
YLQGLSGDL

SEQ ID NO: 828179 - protein, 9 aa, Homo Sapiens
DKLPSSSSL

SEQ ID NO: 828180 - protein, 9 aa, Homo Sapiens
MKTTEHTRK

SEQ ID NO: 828181 - protein, 9 aa, Homo Sapiens
SHDVTERKL

SEQ ID NO: 828182 - protein, 9 aa, Homo Sapiens
NAKHMETKG

SEQ ID NO: 828183 - protein, 9 aa, Homo Sapiens
EALKLARRI

SEQ ID NO: 828184 - protein, 9 aa, Homo Sapiens
LYAMCDVFT

SEQ ID NO: 828185 - protein, 9 aa, Homo Sapiens
NNMSQLFAT

SEQ ID NO: 828186 - protein, 9 aa, Homo Sapiens
RFPHLYKIT

SEQ ID NO: 828187 - protein, 9 aa, Homo Sapiens
WYNVNVLTF

SEQ ID NO: 828188 - protein, 9 aa, Homo Sapiens
GLDDSKKIA

SEQ ID NO: 828189 - protein, 9 aa, Homo Sapiens
TYDLASDVV

SEQ ID NO: 828190 - protein, 9 aa, Homo Sapiens
MQKRSTTKL

SEQ ID NO: 828191 - protein, 9 aa, Homo Sapiens
KQRPNLRAN

SEQ ID NO: 828192 - protein, 9 aa, Homo Sapiens
DLGGQPVVE

SEQ ID NO: 828193 - protein, 9 aa, Homo Sapiens
ANECPKPEL

SEQ ID NO: 828194 - protein, 9 aa, Homo Sapiens
YMKKLTRKQ

SEQ ID NO: 828195 - protein, 9 aa, Homo Sapiens
MAAYDKRFP

SEQ ID NO: 828196 - protein, 9 aa, Homo Sapiens
ANYQKQESL

SEQ ID NO: 828197 - protein, 9 aa, Homo Sapiens
LKGEHLSKK

SEQ ID NO: 828198 - protein, 9 aa, Homo Sapiens
ELYNPDSEQ

SEQ ID NO: 828199 - protein, 9 aa, Homo Sapiens
RINEEIDKF

SEQ ID NO: 828200 - protein, 9 aa, Homo Sapiens
DTKNVNLNT

SEQ ID NO: 828201 - protein, 9 aa, Homo Sapiens
ATSEDYTLL

SEQ ID NO: 828202 - protein, 9 aa, Homo Sapiens
ITECFELLE

SEQ ID NO: 828203 - protein, 9 aa, Homo Sapiens
DYVPKEHTL

SEQ ID NO: 828204 - protein, 9 aa, Homo Sapiens
GTGNSGEEV

SEQ ID NO: 828205 - protein, 9 aa, Homo Sapiens
PIRRVGPFG

SEQ ID NO: 828206 - protein, 9 aa, Homo Sapiens
TVNQSILTP

SEQ ID NO: 828207 - protein, 9 aa, Homo Sapiens
TQPPSHFSI

SEQ ID NO: 828208 - protein, 9 aa, Homo Sapiens
AQEYERIVL

SEQ ID NO: 828209 - protein, 9 aa, Homo Sapiens
MMGTFIELS

SEQ ID NO: 828210 - protein, 9 aa, Homo Sapiens
KLIRLDLPI

SEQ ID NO: 828211 - protein, 9 aa, Homo Sapiens
IYDMTNVLE

SEQ ID NO: 828212 - protein, 9 aa, Homo Sapiens
YSPNNYLLG

SEQ ID NO: 828213 - protein, 9 aa, Homo Sapiens
LSGICTFIS

SEQ ID NO: 828214 - protein, 9 aa, Homo Sapiens
QNNEENVDL

SEQ ID NO: 828215 - protein, 9 aa, Homo Sapiens
RKMASPPSS

SEQ ID NO: 828216 - protein, 9 aa, Homo Sapiens
TAQQNNFSY

SEQ ID NO: 828217 - protein, 9 aa, Homo Sapiens
KCLEPTLRL

SEQ ID NO: 828218 - protein, 9 aa, Homo Sapiens
MKIPDTLEE

SEQ ID NO: 828219 - protein, 9 aa, Homo Sapiens
SFSVLGLEL

SEQ ID NO: 828220 - protein, 9 aa, Homo Sapiens
TLEEHNLAK

SEQ ID NO: 828221 - protein, 9 aa, Homo Sapiens
KKPPRFLQI

SEQ ID NO: 828222 - protein, 9 aa, Homo Sapiens
LLKKTQVST

SEQ ID NO: 828223 - protein, 9 aa, Homo Sapiens
LSKSAKEEL

SEQ ID NO: 828224 - protein, 9 aa, Homo Sapiens
GMHLSQETQ

SEQ ID NO: 828225 - protein, 9 aa, Homo Sapiens
ERLNMALGL

SEQ ID NO: 828226 - protein, 9 aa, Homo Sapiens
WDACAETPT

SEQ ID NO: 828227 - protein, 9 aa, Homo Sapiens
GLTTFEEDQ

SEQ ID NO: 828228 - protein, 9 aa, Homo Sapiens
EIPEGNDKA

SEQ ID NO: 828229 - protein, 9 aa, Homo Sapiens
PGLVGITFT

SEQ ID NO: 828230 - protein, 9 aa, Homo Sapiens
FTGLDVYGH

SEQ ID NO: 828231 - protein, 9 aa, Homo Sapiens
ECIEEEDQE

SEQ ID NO: 828232 - protein, 9 aa, Homo Sapiens
FALSRGQAY

SEQ ID NO: 828233 - protein, 9 aa, Homo Sapiens
EDQVFPINP

SEQ ID NO: 828234 - protein, 9 aa, Homo Sapiens
LLPESEEVK

SEQ ID NO: 828235 - protein, 9 aa, Homo Sapiens
VTTVDASGS

SEQ ID NO: 828236 - protein, 9 aa, Homo Sapiens
LETLEIIPA

SEQ ID NO: 828237 - protein, 9 aa, Homo Sapiens
LTIWQIDNF

SEQ ID NO: 828238 - protein, 9 aa, Homo Sapiens
DSLSHLEAR

SEQ ID NO: 828239 - protein, 9 aa, Homo Sapiens
DIFSILKDV

SEQ ID NO: 828240 - protein, 9 aa, Homo Sapiens
TLSSLNLQS

SEQ ID NO: 828241 - protein, 9 aa, Homo Sapiens
LEETILQHT

SEQ ID NO: 828242 - protein, 9 aa, Homo Sapiens
YSMELQVWT

SEQ ID NO: 828243 - protein, 9 aa, Homo Sapiens
KTNHHMQCL

SEQ ID NO: 828244 - protein, 9 aa, Homo Sapiens
AGALAYRNL

SEQ ID NO: 828245 - protein, 9 aa, Homo Sapiens
IENLKKFLK

SEQ ID NO: 828246 - protein, 9 aa, Homo Sapiens
CLAQSSLNS

SEQ ID NO: 828247 - protein, 9 aa, Homo Sapiens
TVIELGAGT

SEQ ID NO: 828248 - protein, 9 aa, Homo Sapiens
WEGIPGLAY

SEQ ID NO: 828249 - protein, 9 aa, Homo Sapiens
LVGGIGLAM

SEQ ID NO: 828250 - protein, 9 aa, Homo Sapiens
RALLYRLWK

SEQ ID NO: 828251 - protein, 9 aa, Homo Sapiens
ERKKQDKKQ

SEQ ID NO: 828252 - protein, 9 aa, Homo Sapiens
IPFTRLGQS

SEQ ID NO: 828253 - protein, 9 aa, Homo Sapiens
SSWSSLGRV

SEQ ID NO: 828254 - protein, 9 aa, Homo Sapiens
VIEGVDEDA

SEQ ID NO: 828255 - protein, 9 aa, Homo Sapiens
DHFQIHTGI

SEQ ID NO: 828256 - protein, 9 aa, Homo Sapiens
TKISALCIF

SEQ ID NO: 828257 - protein, 9 aa, Homo Sapiens
RKAPNNRYS

SEQ ID NO: 828258 - protein, 9 aa, Homo Sapiens
LKSLPGQNE

SEQ ID NO: 828259 - protein, 9 aa, Homo Sapiens
IEITAYNRC

SEQ ID NO: 828260 - protein, 9 aa, Homo Sapiens
PGRILALAQ

SEQ ID NO: 828261 - protein, 9 aa, Homo Sapiens
EMEHTDITM

SEQ ID NO: 828262 - protein, 9 aa, Homo Sapiens
CGQAFYFLN

SEQ ID NO: 828263 - protein, 9 aa, Homo Sapiens
HQEGKAPQC

SEQ ID NO: 828264 - protein, 9 aa, Homo Sapiens
SKNELEKFP

SEQ ID NO: 828265 - protein, 9 aa, Homo Sapiens
YLAEPQWAG

SEQ ID NO: 828266 - protein, 9 aa, Homo Sapiens
LSMSKPNMI

SEQ ID NO: 828267 - protein, 9 aa, Homo Sapiens
VEGDCFKHT

SEQ ID NO: 828268 - protein, 9 aa, Homo Sapiens
QAFGYLFDE

SEQ ID NO: 828269 - protein, 9 aa, Homo Sapiens
SLVPPSTAV

SEQ ID NO: 828270 - protein, 9 aa, Homo Sapiens
DPMGGNTTE

SEQ ID NO: 828271 - protein, 9 aa, Homo Sapiens
DVQITLPRA

SEQ ID NO: 828272 - protein, 9 aa, Homo Sapiens
LSVTSEENN

SEQ ID NO: 828273 - protein, 9 aa, Homo Sapiens
QASVLQGYN

SEQ ID NO: 828274 - protein, 9 aa, Homo Sapiens
QMAVLISNK

SEQ ID NO: 828275 - protein, 9 aa, Homo Sapiens
PKQIDTPSL

SEQ ID NO: 828276 - protein, 9 aa, Homo Sapiens
CQPSQCHPD

SEQ ID NO: 828277 - protein, 9 aa, Homo Sapiens
NGTKNRYKT

SEQ ID NO: 828278 - protein, 9 aa, Homo Sapiens
FFSEAFYDI

SEQ ID NO: 828279 - protein, 9 aa, Homo Sapiens
FRVKYYSSK

SEQ ID NO: 828280 - protein, 9 aa, Homo Sapiens
ATIPEDRIQ

SEQ ID NO: 828281 - protein, 9 aa, Homo Sapiens
YWTKQFFLL

SEQ ID NO: 828282 - protein, 9 aa, Homo Sapiens
NYNYKQVNK

SEQ ID NO: 828283 - protein, 9 aa, Homo Sapiens
KQLVNSGYD

SEQ ID NO: 828284 - protein, 9 aa, Homo Sapiens
KSSGMYKES

SEQ ID NO: 828285 - protein, 9 aa, Homo Sapiens
NPVPASPIH

SEQ ID NO: 828286 - protein, 9 aa, Homo Sapiens
VYILAVVGL

SEQ ID NO: 828287 - protein, 9 aa, Homo Sapiens
IGVSSVTDA

SEQ ID NO: 828288 - protein, 9 aa, Homo Sapiens
SSRLFSRQA

SEQ ID NO: 828289 - protein, 9 aa, Homo Sapiens
VFAFGPFAT

SEQ ID NO: 828290 - protein, 9 aa, Homo Sapiens
QIDAVCSKL

SEQ ID NO: 828291 - protein, 9 aa, Homo Sapiens
CTKAIVETI

SEQ ID NO: 828292 - protein, 9 aa, Homo Sapiens
SGLRVALED

SEQ ID NO: 828293 - protein, 9 aa, Homo Sapiens
LQEDRGVVS

SEQ ID NO: 828294 - protein, 9 aa, Homo Sapiens
CNVRHILRI

SEQ ID NO: 828295 - protein, 9 aa, Homo Sapiens
KWENCMAID

SEQ ID NO: 828296 - protein, 9 aa, Homo Sapiens
LLMVLTHII

SEQ ID NO: 828297 - protein, 9 aa, Homo Sapiens
NNKKRKALY

SEQ ID NO: 828298 - protein, 9 aa, Homo Sapiens
VTKERYQLL

SEQ ID NO: 828299 - protein, 9 aa, Homo Sapiens
SSKMVCKAP

SEQ ID NO: 828300 - protein, 9 aa, Homo Sapiens
SDITLLHNL

SEQ ID NO: 828301 - protein, 9 aa, Homo Sapiens
FINMAGNVA

SEQ ID NO: 828302 - protein, 9 aa, Homo Sapiens
YDYGKSFKN

SEQ ID NO: 828303 - protein, 9 aa, Homo Sapiens
NSGFMEQLH

SEQ ID NO: 828304 - protein, 9 aa, Homo Sapiens
NSDTFSLLN

SEQ ID NO: 828305 - protein, 9 aa, Homo Sapiens
LALGGFYPF

SEQ ID NO: 828306 - protein, 9 aa, Homo Sapiens
AEGHIKVVK

SEQ ID NO: 828307 - protein, 9 aa, Homo Sapiens
SDNESDIKD

SEQ ID NO: 828308 - protein, 9 aa, Homo Sapiens
KLETLPDEM

SEQ ID NO: 828309 - protein, 9 aa, Homo Sapiens
QDGLKPRCI

SEQ ID NO: 828310 - protein, 9 aa, Homo Sapiens
QWCDCCLWE

SEQ ID NO: 828311 - protein, 9 aa, Homo Sapiens
SSGLIRHQI

SEQ ID NO: 828312 - protein, 9 aa, Homo Sapiens
FHFTSWPGH

SEQ ID NO: 828313 - protein, 9 aa, Homo Sapiens
SPPPVQRGA

SEQ ID NO: 828314 - protein, 9 aa, Homo Sapiens
FNQRLLLYQ

SEQ ID NO: 828315 - protein, 9 aa, Homo Sapiens
IYPQLILAL

SEQ ID NO: 828316 - protein, 9 aa, Homo Sapiens
GPSRVCQNF

SEQ ID NO: 828317 - protein, 9 aa, Homo Sapiens
IIYKWNGNG

SEQ ID NO: 828318 - protein, 9 aa, Homo Sapiens
EIEAQLIGE

SEQ ID NO: 828319 - protein, 9 aa, Homo Sapiens
KERNHRPKL

SEQ ID NO: 828320 - protein, 9 aa, Homo Sapiens
LNANSGGRS

SEQ ID NO: 828321 - protein, 9 aa, Homo Sapiens
SVSMPSEYT

SEQ ID NO: 828322 - protein, 9 aa, Homo Sapiens
PIPLELFAV

SEQ ID NO: 828323 - protein, 9 aa, Homo Sapiens
YSNSNIYKI

SEQ ID NO: 828324 - protein, 9 aa, Homo Sapiens
NPLRPFVTR

SEQ ID NO: 828325 - protein, 9 aa, Homo Sapiens
TKRYEDRYA

SEQ ID NO: 828326 - protein, 9 aa, Homo Sapiens
LEARIHKEE

SEQ ID NO: 828327 - protein, 9 aa, Homo Sapiens
YYMKYFKNS

SEQ ID NO: 828328 - protein, 9 aa, Homo Sapiens
LPVCCVKSI

SEQ ID NO: 828329 - protein, 9 aa, Homo Sapiens
STFCGRPCH

SEQ ID NO: 828330 - protein, 9 aa, Homo Sapiens
YVLLCRQAQ

SEQ ID NO: 828331 - protein, 9 aa, Homo Sapiens
ITIATRNTK

SEQ ID NO: 828332 - protein, 9 aa, Homo Sapiens
WQKYYLDGV

SEQ ID NO: 828333 - protein, 9 aa, Homo Sapiens
TWGNESYVR

SEQ ID NO: 828334 - protein, 9 aa, Homo Sapiens
THFHSTMFA

SEQ ID NO: 828335 - protein, 9 aa, Homo Sapiens
TDNQNSQNS

SEQ ID NO: 828336 - protein, 9 aa, Homo Sapiens
NQKGCYALV

SEQ ID NO: 828337 - protein, 9 aa, Homo Sapiens
LYPNINVIT

SEQ ID NO: 828338 - protein, 9 aa, Homo Sapiens
IICMAIPAM

SEQ ID NO: 828339 - protein, 9 aa, Homo Sapiens
RRKFMERNR

SEQ ID NO: 828340 - protein, 9 aa, Homo Sapiens
CGESQEKQP

SEQ ID NO: 828341 - protein, 9 aa, Homo Sapiens
TADVEKIIT

SEQ ID NO: 828342 - protein, 9 aa, Homo Sapiens
ALAEIHPNH

SEQ ID NO: 828343 - protein, 9 aa, Homo Sapiens
LAWGENHLC

SEQ ID NO: 828344 - protein, 9 aa, Homo Sapiens
IDCNPAEKK

SEQ ID NO: 828345 - protein, 9 aa, Homo Sapiens
KSHSQIKHQ

SEQ ID NO: 828346 - protein, 9 aa, Homo Sapiens
ECMVQLFSL

SEQ ID NO: 828347 - protein, 9 aa, Homo Sapiens
PGHFDYIGH

SEQ ID NO: 828348 - protein, 9 aa, Homo Sapiens
SEESHPYTN

SEQ ID NO: 828349 - protein, 9 aa, Homo Sapiens
EIRICRPCE

SEQ ID NO: 828350 - protein, 9 aa, Homo Sapiens
LSDHFQIHT

SEQ ID NO: 828351 - protein, 9 aa, Homo Sapiens
VLISMQLMF

SEQ ID NO: 828352 - protein, 9 aa, Homo Sapiens
IVKCVQDTS

SEQ ID NO: 828353 - protein, 9 aa, Homo Sapiens
EMCNFSATD

SEQ ID NO: 828354 - protein, 9 aa, Homo Sapiens
HNLIPMDPN

SEQ ID NO: 828355 - protein, 9 aa, Homo Sapiens
VFISDIKSE

SEQ ID NO: 828356 - protein, 9 aa, Homo Sapiens
SDSNVYALL

SEQ ID NO: 828357 - protein, 9 aa, Homo Sapiens
VEVSPPFAF

SEQ ID NO: 828358 - protein, 9 aa, Homo Sapiens
DLAACIKLI

SEQ ID NO: 828359 - protein, 9 aa, Homo Sapiens
SPIQRQSDT

SEQ ID NO: 828360 - protein, 9 aa, Homo Sapiens
GQKAYAPSF

SEQ ID NO: 828361 - protein, 9 aa, Homo Sapiens
DIPFTRLGQ

SEQ ID NO: 828362 - protein, 9 aa, Homo Sapiens
KMNLSEREV

SEQ ID NO: 828363 - protein, 9 aa, Homo Sapiens
FEEDEVWYL

SEQ ID NO: 828364 - protein, 9 aa, Homo Sapiens
TSFPCTVLL

SEQ ID NO: 828365 - protein, 9 aa, Homo Sapiens
ATNMYDNAA

SEQ ID NO: 828366 - protein, 9 aa, Homo Sapiens
DSIKAQDLS

SEQ ID NO: 828367 - protein, 9 aa, Homo Sapiens
TKHDRNVEC

SEQ ID NO: 828368 - protein, 9 aa, Homo Sapiens
MTWLANKLR

SEQ ID NO: 828369 - protein, 9 aa, Homo Sapiens
NKDVQKRRQ

SEQ ID NO: 828370 - protein, 9 aa, Homo Sapiens
DQLKTEPFE

SEQ ID NO: 828371 - protein, 9 aa, Homo Sapiens
ITLNIGDYN

SEQ ID NO: 828372 - protein, 9 aa, Homo Sapiens
NKKKLEDAL

SEQ ID NO: 828373 - protein, 9 aa, Homo Sapiens
EYLELLFTL

SEQ ID NO: 828374 - protein, 9 aa, Homo Sapiens
EKERYAEKD

SEQ ID NO: 828375 - protein, 9 aa, Homo Sapiens
LMINLCGVD

SEQ ID NO: 828376 - protein, 9 aa, Homo Sapiens
NSFSPLESN

SEQ ID NO: 828377 - protein, 9 aa, Homo Sapiens
SEISDCYVF

SEQ ID NO: 828378 - protein, 9 aa, Homo Sapiens
LFGEPTTGL

SEQ ID NO: 828379 - protein, 9 aa, Homo Sapiens
SAKKHEDER

SEQ ID NO: 828380 - protein, 9 aa, Homo Sapiens
RINTDDKPY

SEQ ID NO: 828381 - protein, 9 aa, Homo Sapiens
CMHTNKRVS

SEQ ID NO: 828382 - protein, 9 aa, Homo Sapiens
YKTIKSPSK

SEQ ID NO: 828383 - protein, 9 aa, Homo Sapiens
LWRQQKERI

SEQ ID NO: 828384 - protein, 9 aa, Homo Sapiens
PTHFEEDTL

SEQ ID NO: 828385 - protein, 9 aa, Homo Sapiens
PYTEESYMK

SEQ ID NO: 828386 - protein, 9 aa, Homo Sapiens
ELCNEGQIA

SEQ ID NO: 828387 - protein, 9 aa, Homo Sapiens
KLGENLQEL

SEQ ID NO: 828388 - protein, 9 aa, Homo Sapiens
QRADTPRIN

SEQ ID NO: 828389 - protein, 9 aa, Homo Sapiens
CLVLRQSFE

SEQ ID NO: 828390 - protein, 9 aa, Homo Sapiens
LEVNETPVV

SEQ ID NO: 828391 - protein, 9 aa, Homo Sapiens
GTQIATIAE

SEQ ID NO: 828392 - protein, 9 aa, Homo Sapiens
CTKLNDLKI

SEQ ID NO: 828393 - protein, 9 aa, Homo Sapiens
NLFQYETQQ

SEQ ID NO: 828394 - protein, 9 aa, Homo Sapiens
EAESLTNFH

SEQ ID NO: 828395 - protein, 9 aa, Homo Sapiens
FPDKFKPEV

SEQ ID NO: 828396 - protein, 9 aa, Homo Sapiens
WFTDLECKY

SEQ ID NO: 828397 - protein, 9 aa, Homo Sapiens
CILSQAPDQ

SEQ ID NO: 828398 - protein, 9 aa, Homo Sapiens
HPQLKITAG

SEQ ID NO: 828399 - protein, 9 aa, Homo Sapiens
GLANLNTLA

SEQ ID NO: 828400 - protein, 9 aa, Homo Sapiens
EGKPTAPSK

SEQ ID NO: 828401 - protein, 9 aa, Homo Sapiens
SSILTNHKI

SEQ ID NO: 828402 - protein, 9 aa, Homo Sapiens
RNSDLGVGS

SEQ ID NO: 828403 - protein, 9 aa, Homo Sapiens
EGAPIKPDP

SEQ ID NO: 828404 - protein, 9 aa, Homo Sapiens
ILFTHKEEL

SEQ ID NO: 828405 - protein, 9 aa, Homo Sapiens
DITTKLCDV

SEQ ID NO: 828406 - protein, 9 aa, Homo Sapiens
SDNLREVNI

SEQ ID NO: 828407 - protein, 9 aa, Homo Sapiens
RRALQQPDD

SEQ ID NO: 828408 - protein, 9 aa, Homo Sapiens
YFGADSVPA

SEQ ID NO: 828409 - protein, 9 aa, Homo Sapiens
KKQFFNRAL

SEQ ID NO: 828410 - protein, 9 aa, Homo Sapiens
TNPAYEDVN

SEQ ID NO: 828411 - protein, 9 aa, Homo Sapiens
NLWKEFCSY

SEQ ID NO: 828412 - protein, 9 aa, Homo Sapiens
EAASFQINQ

SEQ ID NO: 828413 - protein, 9 aa, Homo Sapiens
DDFFNELPE

SEQ ID NO: 828414 - protein, 9 aa, Homo Sapiens
VTNTSSEST

SEQ ID NO: 828415 - protein, 9 aa, Homo Sapiens
GVVAIPKSF

SEQ ID NO: 828416 - protein, 9 aa, Homo Sapiens
KHFMQNVAC

SEQ ID NO: 828417 - protein, 9 aa, Homo Sapiens
LWRDSKEKN

SEQ ID NO: 828418 - protein, 9 aa, Homo Sapiens
AHLRHDKIM

SEQ ID NO: 828419 - protein, 9 aa, Homo Sapiens
TDHLRLHTG

SEQ ID NO: 828420 - protein, 9 aa, Homo Sapiens
IGCGLDCLQ

SEQ ID NO: 828421 - protein, 9 aa, Homo Sapiens
KSSIHFYLK

SEQ ID NO: 828422 - protein, 9 aa, Homo Sapiens
QGHATKEES

SEQ ID NO: 828423 - protein, 9 aa, Homo Sapiens
NMLAELTAQ

SEQ ID NO: 828424 - protein, 9 aa, Homo Sapiens
ELRGHRYLH

SEQ ID NO: 828425 - protein, 9 aa, Homo Sapiens
LQIYWLNYE

SEQ ID NO: 828426 - protein, 9 aa, Homo Sapiens
MPFHHRPSV

SEQ ID NO: 828427 - protein, 9 aa, Homo Sapiens
SGENPFQCP

SEQ ID NO: 828428 - protein, 9 aa, Homo Sapiens
DPSGLDKNK

SEQ ID NO: 828429 - protein, 9 aa, Homo Sapiens
ENHKKLYCS

SEQ ID NO: 828430 - protein, 9 aa, Homo Sapiens
ILFRGFFPV

SEQ ID NO: 828431 - protein, 9 aa, Homo Sapiens
LPSLNKLQK

SEQ ID NO: 828432 - protein, 9 aa, Homo Sapiens
AITGVKPYL

SEQ ID NO: 828433 - protein, 9 aa, Homo Sapiens
LMQLVLSCF

SEQ ID NO: 828434 - protein, 9 aa, Homo Sapiens
HQRRHQSPD

SEQ ID NO: 828435 - protein, 9 aa, Homo Sapiens
SVFRQIANA

SEQ ID NO: 828436 - protein, 9 aa, Homo Sapiens
VPGADGCNQ

SEQ ID NO: 828437 - protein, 9 aa, Homo Sapiens
DDIDQFQTQ

SEQ ID NO: 828438 - protein, 9 aa, Homo Sapiens
APTECFSFW

SEQ ID NO: 828439 - protein, 9 aa, Homo Sapiens
LEYLDLNFN

SEQ ID NO: 828440 - protein, 9 aa, Homo Sapiens
HLQIFYMFV

SEQ ID NO: 828441 - protein, 9 aa, Homo Sapiens
VNPRSLETL

SEQ ID NO: 828442 - protein, 9 aa, Homo Sapiens
IGSIGPPGP

SEQ ID NO: 828443 - protein, 9 aa, Homo Sapiens
ISSLKIFYK

SEQ ID NO: 828444 - protein, 9 aa, Homo Sapiens
LDPNCEKML

SEQ ID NO: 828445 - protein, 9 aa, Homo Sapiens
SVFDQQIGD

SEQ ID NO: 828446 - protein, 9 aa, Homo Sapiens
QAPPKPGHR

SEQ ID NO: 828447 - protein, 9 aa, Homo Sapiens
DYIFVLVLI

SEQ ID NO: 828448 - protein, 9 aa, Homo Sapiens
ITLRNLNGR

SEQ ID NO: 828449 - protein, 9 aa, Homo Sapiens
NRDKVILFS

SEQ ID NO: 828450 - protein, 9 aa, Homo Sapiens
PEPIPLTED

SEQ ID NO: 828451 - protein, 9 aa, Homo Sapiens
ETVRNKSTH

SEQ ID NO: 828452 - protein, 9 aa, Homo Sapiens
CHLPLMQVE

SEQ ID NO: 828453 - protein, 9 aa, Homo Sapiens
LTTLPILSR

SEQ ID NO: 828454 - protein, 9 aa, Homo Sapiens
PSVVDLVSI

SEQ ID NO: 828455 - protein, 9 aa, Homo Sapiens
SAQLAPGSW

SEQ ID NO: 828456 - protein, 9 aa, Homo Sapiens
QLQTQQAQD

SEQ ID NO: 828457 - protein, 9 aa, Homo Sapiens
IDSLNRRIF

SEQ ID NO: 828458 - protein, 9 aa, Homo Sapiens
TDFYKDLTY

SEQ ID NO: 828459 - protein, 9 aa, Homo Sapiens
YSGDLNQNE

SEQ ID NO: 828460 - protein, 9 aa, Homo Sapiens
IIVSSKYTL

SEQ ID NO: 828461 - protein, 9 aa, Homo Sapiens
AHAFTKNSG

SEQ ID NO: 828462 - protein, 9 aa, Homo Sapiens
TLNIQSVNR

SEQ ID NO: 828463 - protein, 9 aa, Homo Sapiens
VDGFKTCIK

SEQ ID NO: 828464 - protein, 9 aa, Homo Sapiens
WTMISRPYS

SEQ ID NO: 828465 - protein, 9 aa, Homo Sapiens
SSSLMVHQI

SEQ ID NO: 828466 - protein, 9 aa, Homo Sapiens
KLIYNFIED

SEQ ID NO: 828467 - protein, 9 aa, Homo Sapiens
EVIMGTYKT

SEQ ID NO: 828468 - protein, 9 aa, Homo Sapiens
EMQLQAIQI

SEQ ID NO: 828469 - protein, 9 aa, Homo Sapiens
IGDVFNGRC

SEQ ID NO: 828470 - protein, 9 aa, Homo Sapiens
MRKLITDLQ

SEQ ID NO: 828471 - protein, 9 aa, Homo Sapiens
FLETYGFSS

SEQ ID NO: 828472 - protein, 9 aa, Homo Sapiens
AAARRSKSQ

SEQ ID NO: 828473 - protein, 9 aa, Homo Sapiens
DSLSLLKTM

SEQ ID NO: 828474 - protein, 9 aa, Homo Sapiens
RLFYGNVGY

SEQ ID NO: 828475 - protein, 9 aa, Homo Sapiens
GDCKRSNID

SEQ ID NO: 828476 - protein, 9 aa, Homo Sapiens
VDERRYWKV

SEQ ID NO: 828477 - protein, 9 aa, Homo Sapiens
IGRYIKLRT

SEQ ID NO: 828478 - protein, 9 aa, Homo Sapiens
TDEEDNLHI

SEQ ID NO: 828479 - protein, 9 aa, Homo Sapiens
QQRIQRQLA

SEQ ID NO: 828480 - protein, 9 aa, Homo Sapiens
RGFVSISSP

SEQ ID NO: 828481 - protein, 9 aa, Homo Sapiens
LPDSSPSNN

SEQ ID NO: 828482 - protein, 9 aa, Homo Sapiens
TPMYFSLSN

SEQ ID NO: 828483 - protein, 9 aa, Homo Sapiens
NQNVIIIQP

SEQ ID NO: 828484 - protein, 9 aa, Homo Sapiens
PLETLTLTY

SEQ ID NO: 828485 - protein, 9 aa, Homo Sapiens
QGSSQWDGP

SEQ ID NO: 828486 - protein, 9 aa, Homo Sapiens
VCALQCAVF

SEQ ID NO: 828487 - protein, 9 aa, Homo Sapiens
FVSYPSLVY

SEQ ID NO: 828488 - protein, 9 aa, Homo Sapiens
GGPKGKDYC

SEQ ID NO: 828489 - protein, 9 aa, Homo Sapiens
RSGITQLFF

SEQ ID NO: 828490 - protein, 9 aa, Homo Sapiens
YLTDARKLI

SEQ ID NO: 828491 - protein, 9 aa, Homo Sapiens
TNFCHGLVI

SEQ ID NO: 828492 - protein, 9 aa, Homo Sapiens
PPRSVKASP

SEQ ID NO: 828493 - protein, 9 aa, Homo Sapiens
TGKDGYVPL

SEQ ID NO: 828494 - protein, 9 aa, Homo Sapiens
YRQVEVSWE

SEQ ID NO: 828495 - protein, 9 aa, Homo Sapiens
DLCEVYNAK

SEQ ID NO: 828496 - protein, 9 aa, Homo Sapiens
PLISAKPLD

SEQ ID NO: 828497 - protein, 9 aa, Homo Sapiens
CSLVCGEYG

SEQ ID NO: 828498 - protein, 9 aa, Homo Sapiens
WWCTYVVLR

SEQ ID NO: 828499 - protein, 9 aa, Homo Sapiens
DIGRQIYHH

SEQ ID NO: 828500 - protein, 9 aa, Homo Sapiens
YQQQQEEMH

SEQ ID NO: 828501 - protein, 9 aa, Homo Sapiens
NDPSVNYQA

SEQ ID NO: 828502 - protein, 9 aa, Homo Sapiens
DMPHVVACS

SEQ ID NO: 828503 - protein, 9 aa, Homo Sapiens
CGYENVQLR

SEQ ID NO: 828504 - protein, 9 aa, Homo Sapiens
SEKKREISK

SEQ ID NO: 828505 - protein, 9 aa, Homo Sapiens
DGRRIWVDY

SEQ ID NO: 828506 - protein, 9 aa, Homo Sapiens
LEALCRDEP

SEQ ID NO: 828507 - protein, 9 aa, Homo Sapiens
IRVPVATLV

SEQ ID NO: 828508 - protein, 9 aa, Homo Sapiens
KTVLRSKGE

SEQ ID NO: 828509 - protein, 9 aa, Homo Sapiens
IPSTSNVSG

SEQ ID NO: 828510 - protein, 9 aa, Homo Sapiens
PAPFYYKNT

SEQ ID NO: 828511 - protein, 9 aa, Homo Sapiens
VVLFSTWRI

SEQ ID NO: 828512 - protein, 9 aa, Homo Sapiens
ERGLIPSTA

SEQ ID NO: 828513 - protein, 9 aa, Homo Sapiens
SYMISLTSG

SEQ ID NO: 828514 - protein, 9 aa, Homo Sapiens
YCGIHLSSG

SEQ ID NO: 828515 - protein, 9 aa, Homo Sapiens
NNSPQLSTC

SEQ ID NO: 828516 - protein, 9 aa, Homo Sapiens
TIDNVTLAD

SEQ ID NO: 828517 - protein, 9 aa, Homo Sapiens
EDFEKALNA

SEQ ID NO: 828518 - protein, 9 aa, Homo Sapiens
TCDVFCKHE

SEQ ID NO: 828519 - protein, 9 aa, Homo Sapiens
IGNCLPTVL

SEQ ID NO: 828520 - protein, 9 aa, Homo Sapiens
NTVLVFPYT

SEQ ID NO: 828521 - protein, 9 aa, Homo Sapiens
SQSPEIDKV

SEQ ID NO: 828522 - protein, 9 aa, Homo Sapiens
HFYYPRVSE

SEQ ID NO: 828523 - protein, 9 aa, Homo Sapiens
DFNVFTKGE

SEQ ID NO: 828524 - protein, 9 aa, Homo Sapiens
CYPGFYGEA

SEQ ID NO: 828525 - protein, 9 aa, Homo Sapiens
EIVKEAEVL

SEQ ID NO: 828526 - protein, 9 aa, Homo Sapiens
GLRNKIIGH

SEQ ID NO: 828527 - protein, 9 aa, Homo Sapiens
IHNSFSPNS

SEQ ID NO: 828528 - protein, 9 aa, Homo Sapiens
WQCTACKKF

SEQ ID NO: 828529 - protein, 9 aa, Homo Sapiens
FSEYVKRKD

SEQ ID NO: 828530 - protein, 9 aa, Homo Sapiens
KRLGRNKKR

SEQ ID NO: 828531 - protein, 9 aa, Homo Sapiens
EKLASQKLR

SEQ ID NO: 828532 - protein, 9 aa, Homo Sapiens
TSVTWTRPT

SEQ ID NO: 828533 - protein, 9 aa, Homo Sapiens
EPFPESMDN

SEQ ID NO: 828534 - protein, 9 aa, Homo Sapiens
DIYCGNCKT

SEQ ID NO: 828535 - protein, 9 aa, Homo Sapiens
GKSGNSKLS

SEQ ID NO: 828536 - protein, 9 aa, Homo Sapiens
SETRDLSEL

SEQ ID NO: 828537 - protein, 9 aa, Homo Sapiens
TKSQRKQVL

SEQ ID NO: 828538 - protein, 9 aa, Homo Sapiens
SLTYHQTIH

SEQ ID NO: 828539 - protein, 9 aa, Homo Sapiens
YSWFQDEED

SEQ ID NO: 828540 - protein, 9 aa, Homo Sapiens
KIIDENTVN

SEQ ID NO: 828541 - protein, 9 aa, Homo Sapiens
PIQIFTIQA

SEQ ID NO: 828542 - protein, 9 aa, Homo Sapiens
LLLAAEQLL

SEQ ID NO: 828543 - protein, 9 aa, Homo Sapiens
RKQILKLLD

SEQ ID NO: 828544 - protein, 9 aa, Homo Sapiens
FSQQYSSCL

SEQ ID NO: 828545 - protein, 9 aa, Homo Sapiens
YMDVYLIHW

SEQ ID NO: 828546 - protein, 9 aa, Homo Sapiens
GSTLAGVDF

SEQ ID NO: 828547 - protein, 9 aa, Homo Sapiens
SALKAIHAI

SEQ ID NO: 828548 - protein, 9 aa, Homo Sapiens
YTSENDLNG

SEQ ID NO: 828549 - protein, 9 aa, Homo Sapiens
RPAPMQAMW

SEQ ID NO: 828550 - protein, 9 aa, Homo Sapiens
LGNTFEKLG

SEQ ID NO: 828551 - protein, 9 aa, Homo Sapiens
RIIVQPMID

SEQ ID NO: 828552 - protein, 9 aa, Homo Sapiens
LLKRLDSER

SEQ ID NO: 828553 - protein, 9 aa, Homo Sapiens
NIIKKIINL

SEQ ID NO: 828554 - protein, 9 aa, Homo Sapiens
TYGKLWTIS

SEQ ID NO: 828555 - protein, 9 aa, Homo Sapiens
LKRVKKETF

SEQ ID NO: 828556 - protein, 9 aa, Homo Sapiens
EYSGDLNQN

SEQ ID NO: 828557 - protein, 9 aa, Homo Sapiens
LPWFPSDLY

SEQ ID NO: 828558 - protein, 9 aa, Homo Sapiens
LSACSAYKF

SEQ ID NO: 828559 - protein, 9 aa, Homo Sapiens
VPLSKKVEC

SEQ ID NO: 828560 - protein, 9 aa, Homo Sapiens
CFTQCSSLM

SEQ ID NO: 828561 - protein, 9 aa, Homo Sapiens
LGNYTVIAP

SEQ ID NO: 828562 - protein, 9 aa, Homo Sapiens
KYLIKVAIK

SEQ ID NO: 828563 - protein, 9 aa, Homo Sapiens
GFKTCIKST

SEQ ID NO: 828564 - protein, 9 aa, Homo Sapiens
NVHTGDPNK

SEQ ID NO: 828565 - protein, 9 aa, Homo Sapiens
FENIQKDLE

SEQ ID NO: 828566 - protein, 9 aa, Homo Sapiens
SFFLSKCQN

SEQ ID NO: 828567 - protein, 9 aa, Homo Sapiens
AFCCALGRL

SEQ ID NO: 828568 - protein, 9 aa, Homo Sapiens
KAFFEQMLK

SEQ ID NO: 828569 - protein, 9 aa, Homo Sapiens
KRADEELLL

SEQ ID NO: 828570 - protein, 9 aa, Homo Sapiens
IIQAKLDQE

SEQ ID NO: 828571 - protein, 9 aa, Homo Sapiens
DNGGRGGGP

SEQ ID NO: 828572 - protein, 9 aa, Homo Sapiens
LRDDHALVT

SEQ ID NO: 828573 - protein, 9 aa, Homo Sapiens
GPEKTSSSS

SEQ ID NO: 828574 - protein, 9 aa, Homo Sapiens
LLFCLFIFV

SEQ ID NO: 828575 - protein, 9 aa, Homo Sapiens
GELYPPLIH

SEQ ID NO: 828576 - protein, 9 aa, Homo Sapiens
NLAHEEVRK

SEQ ID NO: 828577 - protein, 9 aa, Homo Sapiens
TQIPSYTKL

SEQ ID NO: 828578 - protein, 9 aa, Homo Sapiens
DNNQIRKID

SEQ ID NO: 828579 - protein, 9 aa, Homo Sapiens
KNLRHPKFI

SEQ ID NO: 828580 - protein, 9 aa, Homo Sapiens
ECRPKFANT

SEQ ID NO: 828581 - protein, 9 aa, Homo Sapiens
KETETSKIK

SEQ ID NO: 828582 - protein, 9 aa, Homo Sapiens
AEKPQRNGD

SEQ ID NO: 828583 - protein, 9 aa, Homo Sapiens
PWRQSSSQD

SEQ ID NO: 828584 - protein, 9 aa, Homo Sapiens
TPTPPPGRV

SEQ ID NO: 828585 - protein, 9 aa, Homo Sapiens
NNSPKKGGA

SEQ ID NO: 828586 - protein, 9 aa, Homo Sapiens
QAWVLQEAR

SEQ ID NO: 828587 - protein, 9 aa, Homo Sapiens
MAMQMAAFA

SEQ ID NO: 828588 - protein, 9 aa, Homo Sapiens
TISHLENAI

SEQ ID NO: 828589 - protein, 9 aa, Homo Sapiens
NTIEDNFPL

SEQ ID NO: 828590 - protein, 9 aa, Homo Sapiens
IAANEDNRK

SEQ ID NO: 828591 - protein, 9 aa, Homo Sapiens
LLAEITKEQ

SEQ ID NO: 828592 - protein, 9 aa, Homo Sapiens
AAYLSVQRD

SEQ ID NO: 828593 - protein, 9 aa, Homo Sapiens
KKFWRAMLA

SEQ ID NO: 828594 - protein, 9 aa, Homo Sapiens
SDHVTFSQR

SEQ ID NO: 828595 - protein, 9 aa, Homo Sapiens
NAKKYLQTD

SEQ ID NO: 828596 - protein, 9 aa, Homo Sapiens
TGVSKGYGL

SEQ ID NO: 828597 - protein, 9 aa, Homo Sapiens
TTKETRETY

SEQ ID NO: 828598 - protein, 9 aa, Homo Sapiens
DLRNKRFEQ

SEQ ID NO: 828599 - protein, 9 aa, Homo Sapiens
QHFCKLRKI

SEQ ID NO: 828600 - protein, 9 aa, Homo Sapiens
TELMSKMRD

SEQ ID NO: 828601 - protein, 9 aa, Homo Sapiens
CQQFLVIED

SEQ ID NO: 828602 - protein, 9 aa, Homo Sapiens
PLFSPASYS

SEQ ID NO: 828603 - protein, 9 aa, Homo Sapiens
EQMKARPDK

SEQ ID NO: 828604 - protein, 9 aa, Homo Sapiens
RKCPFNSEN

SEQ ID NO: 828605 - protein, 9 aa, Homo Sapiens
EEHEEELRL

SEQ ID NO: 828606 - protein, 9 aa, Homo Sapiens
DEFGYNADT

SEQ ID NO: 828607 - protein, 9 aa, Homo Sapiens
EEQNNEENV

SEQ ID NO: 828608 - protein, 9 aa, Homo Sapiens
RNIQMMTRG

SEQ ID NO: 828609 - protein, 9 aa, Homo Sapiens
RTVLFEWER

SEQ ID NO: 828610 - protein, 9 aa, Homo Sapiens
IKHKAKPQN

SEQ ID NO: 828611 - protein, 9 aa, Homo Sapiens
SGQDIEIWK

SEQ ID NO: 828612 - protein, 9 aa, Homo Sapiens
AKKECPFPD

SEQ ID NO: 828613 - protein, 9 aa, Homo Sapiens
NPFTRAHEE

SEQ ID NO: 828614 - protein, 9 aa, Homo Sapiens
AIEAWINLN

SEQ ID NO: 828615 - protein, 9 aa, Homo Sapiens
GDVIDCCVN

SEQ ID NO: 828616 - protein, 9 aa, Homo Sapiens
NSGEIVSAN

SEQ ID NO: 828617 - protein, 9 aa, Homo Sapiens
DGSQVWGGQ

SEQ ID NO: 828618 - protein, 9 aa, Homo Sapiens
QYSEESMGS

SEQ ID NO: 828619 - protein, 9 aa, Homo Sapiens
YISPGKESL

SEQ ID NO: 828620 - protein, 9 aa, Homo Sapiens
SPSLKWPTL

SEQ ID NO: 828621 - protein, 9 aa, Homo Sapiens
SKKKAAARY

SEQ ID NO: 828622 - protein, 9 aa, Homo Sapiens
DKDASIVGS

SEQ ID NO: 828623 - protein, 9 aa, Homo Sapiens
LVQSWYIRS

SEQ ID NO: 828624 - protein, 9 aa, Homo Sapiens
GGLTTFEED

SEQ ID NO: 828625 - protein, 9 aa, Homo Sapiens
PEEFQLITS

SEQ ID NO: 828626 - protein, 9 aa, Homo Sapiens
CWDTAETNV

SEQ ID NO: 828627 - protein, 9 aa, Homo Sapiens
HFLRLHLED

SEQ ID NO: 828628 - protein, 9 aa, Homo Sapiens
CFNVEEDMT

SEQ ID NO: 828629 - protein, 9 aa, Homo Sapiens
FIDNRPGKL

SEQ ID NO: 828630 - protein, 9 aa, Homo Sapiens
IMKPDEKAK

SEQ ID NO: 828631 - protein, 9 aa, Homo Sapiens
QKNNKKRKA

SEQ ID NO: 828632 - protein, 9 aa, Homo Sapiens
IQGGVEDEA

SEQ ID NO: 828633 - protein, 9 aa, Homo Sapiens
YVSAEIFLK

SEQ ID NO: 828634 - protein, 9 aa, Homo Sapiens
KNCLLILII

SEQ ID NO: 828635 - protein, 9 aa, Homo Sapiens
KFCAGAINH

SEQ ID NO: 828636 - protein, 9 aa, Homo Sapiens
FSQPTGANR

SEQ ID NO: 828637 - protein, 9 aa, Homo Sapiens
DNDSDYAID

SEQ ID NO: 828638 - protein, 9 aa, Homo Sapiens
LPTFSVATV

SEQ ID NO: 828639 - protein, 9 aa, Homo Sapiens
VPLNCVCFL

SEQ ID NO: 828640 - protein, 9 aa, Homo Sapiens
KSVKKDDTE

SEQ ID NO: 828641 - protein, 9 aa, Homo Sapiens
ENEMQPHGK

SEQ ID NO: 828642 - protein, 9 aa, Homo Sapiens
TFLDIPESP

SEQ ID NO: 828643 - protein, 9 aa, Homo Sapiens
LLPLAVLPI

SEQ ID NO: 828644 - protein, 9 aa, Homo Sapiens
NKHQVPKLQ

SEQ ID NO: 828645 - protein, 9 aa, Homo Sapiens
YCNVDSVSA

SEQ ID NO: 828646 - protein, 9 aa, Homo Sapiens
AVSPGSSSP

SEQ ID NO: 828647 - protein, 9 aa, Homo Sapiens
GVADKKIHL

SEQ ID NO: 828648 - protein, 9 aa, Homo Sapiens
VNMKPRLKS

SEQ ID NO: 828649 - protein, 9 aa, Homo Sapiens
VHQIIHTVV

SEQ ID NO: 828650 - protein, 9 aa, Homo Sapiens
EENIKLQQF

SEQ ID NO: 828651 - protein, 9 aa, Homo Sapiens
INNYNPKYF

SEQ ID NO: 828652 - protein, 9 aa, Homo Sapiens
LFGGVSGLT

SEQ ID NO: 828653 - protein, 9 aa, Homo Sapiens
EAMARFHKN

SEQ ID NO: 828654 - protein, 9 aa, Homo Sapiens
TYNSGIHSG

SEQ ID NO: 828655 - protein, 9 aa, Homo Sapiens
EANGACNVL

SEQ ID NO: 828656 - protein, 9 aa, Homo Sapiens
LIPVKYWHY

SEQ ID NO: 828657 - protein, 9 aa, Homo Sapiens
TAEQPYKCN

SEQ ID NO: 828658 - protein, 9 aa, Homo Sapiens
MFSNMTNCE

SEQ ID NO: 828659 - protein, 9 aa, Homo Sapiens
QGLTCSRAS

SEQ ID NO: 828660 - protein, 9 aa, Homo Sapiens
QPCFIVYSY

SEQ ID NO: 828661 - protein, 9 aa, Homo Sapiens
HMMPNILLA

SEQ ID NO: 828662 - protein, 9 aa, Homo Sapiens
VASVLAKKE

SEQ ID NO: 828663 - protein, 9 aa, Homo Sapiens
YCKAENSLG

SEQ ID NO: 828664 - protein, 9 aa, Homo Sapiens
YIQAMEENL

SEQ ID NO: 828665 - protein, 9 aa, Homo Sapiens
PVYSMDYFP

SEQ ID NO: 828666 - protein, 9 aa, Homo Sapiens
EDKEEDKEK

SEQ ID NO: 828667 - protein, 9 aa, Homo Sapiens
GSLILPHIS

SEQ ID NO: 828668 - protein, 9 aa, Homo Sapiens
NPNFPRRSK

SEQ ID NO: 828669 - protein, 9 aa, Homo Sapiens
LIHSFQVIE

SEQ ID NO: 828670 - protein, 9 aa, Homo Sapiens
STYHTIIGG

SEQ ID NO: 828671 - protein, 9 aa, Homo Sapiens
RKSKHFESK

SEQ ID NO: 828672 - protein, 9 aa, Homo Sapiens
LQKLELSDN

SEQ ID NO: 828673 - protein, 9 aa, Homo Sapiens
LRKVGAPSH

SEQ ID NO: 828674 - protein, 9 aa, Homo Sapiens
YIILSVIYP

SEQ ID NO: 828675 - protein, 9 aa, Homo Sapiens
FGVVDEINQ

SEQ ID NO: 828676 - protein, 9 aa, Homo Sapiens
NAQKAVEFE

SEQ ID NO: 828677 - protein, 9 aa, Homo Sapiens
KKGAKEKNK

SEQ ID NO: 828678 - protein, 9 aa, Homo Sapiens
YGNNKFSTC

SEQ ID NO: 828679 - protein, 9 aa, Homo Sapiens
FSFKWWIMV

SEQ ID NO: 828680 - protein, 9 aa, Homo Sapiens
SSKKEVSGD

SEQ ID NO: 828681 - protein, 9 aa, Homo Sapiens
NNTWSNTHD

SEQ ID NO: 828682 - protein, 9 aa, Homo Sapiens
NPINAVTTK

SEQ ID NO: 828683 - protein, 9 aa, Homo Sapiens
EEQGTRLAA

SEQ ID NO: 828684 - protein, 9 aa, Homo Sapiens
DSDYAIDDQ

SEQ ID NO: 828685 - protein, 9 aa, Homo Sapiens
ESLNVGEHK

SEQ ID NO: 828686 - protein, 9 aa, Homo Sapiens
IAATVAHQR

SEQ ID NO: 828687 - protein, 9 aa, Homo Sapiens
FFHSANGVI

SEQ ID NO: 828688 - protein, 9 aa, Homo Sapiens
DKYEQFFRE

SEQ ID NO: 828689 - protein, 9 aa, Homo Sapiens
EPQKQALFK

SEQ ID NO: 828690 - protein, 9 aa, Homo Sapiens
ERTCIQFYM

SEQ ID NO: 828691 - protein, 9 aa, Homo Sapiens
DYRLPQVIA

SEQ ID NO: 828692 - protein, 9 aa, Homo Sapiens
RTGVLCTVE

SEQ ID NO: 828693 - protein, 9 aa, Homo Sapiens
EIILAIQSF

SEQ ID NO: 828694 - protein, 9 aa, Homo Sapiens
IKTKRNTLF

SEQ ID NO: 828695 - protein, 9 aa, Homo Sapiens
VIDKELEEN

SEQ ID NO: 828696 - protein, 9 aa, Homo Sapiens
INEGLLKVA

SEQ ID NO: 828697 - protein, 9 aa, Homo Sapiens
LRPLFSPAS

SEQ ID NO: 828698 - protein, 9 aa, Homo Sapiens
LYGTPDSID

SEQ ID NO: 828699 - protein, 9 aa, Homo Sapiens
LKIELQAQH

SEQ ID NO: 828700 - protein, 9 aa, Homo Sapiens
LFYIHVDKR

SEQ ID NO: 828701 - protein, 9 aa, Homo Sapiens
GVVFKAKNK

SEQ ID NO: 828702 - protein, 9 aa, Homo Sapiens
VLEILTRGV

SEQ ID NO: 828703 - protein, 9 aa, Homo Sapiens
SLLARLGCS

SEQ ID NO: 828704 - protein, 9 aa, Homo Sapiens
THWPEYFIV

SEQ ID NO: 828705 - protein, 9 aa, Homo Sapiens
TDFDTIHST

SEQ ID NO: 828706 - protein, 9 aa, Homo Sapiens
QDSHGCCSQ

SEQ ID NO: 828707 - protein, 9 aa, Homo Sapiens
NPSGPSLGA

SEQ ID NO: 828708 - protein, 9 aa, Homo Sapiens
VLKRYAGTD

SEQ ID NO: 828709 - protein, 9 aa, Homo Sapiens
AKAAKLEKP

SEQ ID NO: 828710 - protein, 9 aa, Homo Sapiens
FAWSHESPP

SEQ ID NO: 828711 - protein, 9 aa, Homo Sapiens
ESLRQRDAF

SEQ ID NO: 828712 - protein, 9 aa, Homo Sapiens
ELHNSSGRD

SEQ ID NO: 828713 - protein, 9 aa, Homo Sapiens
KLIFLGSRV

SEQ ID NO: 828714 - protein, 9 aa, Homo Sapiens
KGGNIQVEI

SEQ ID NO: 828715 - protein, 9 aa, Homo Sapiens
RYLVMQKLF

SEQ ID NO: 828716 - protein, 9 aa, Homo Sapiens
LYGSTAFMY

SEQ ID NO: 828717 - protein, 9 aa, Homo Sapiens
RAEEHQETQ

SEQ ID NO: 828718 - protein, 9 aa, Homo Sapiens
MLPKEAGPS

SEQ ID NO: 828719 - protein, 9 aa, Homo Sapiens
LQCRRCCPG

SEQ ID NO: 828720 - protein, 9 aa, Homo Sapiens
MTELERAFG

SEQ ID NO: 828721 - protein, 9 aa, Homo Sapiens
CLTVHCMDP

SEQ ID NO: 828722 - protein, 9 aa, Homo Sapiens
LSGCFLQFY

SEQ ID NO: 828723 - protein, 9 aa, Homo Sapiens
NYIKTPPGV

SEQ ID NO: 828724 - protein, 9 aa, Homo Sapiens
SLSECMVQL

SEQ ID NO: 828725 - protein, 9 aa, Homo Sapiens
KGPRNLEHK

SEQ ID NO: 828726 - protein, 9 aa, Homo Sapiens
SINKTLTDK

SEQ ID NO: 828727 - protein, 9 aa, Homo Sapiens
INMKKLFPK

SEQ ID NO: 828728 - protein, 9 aa, Homo Sapiens
VLAEYKILE

SEQ ID NO: 828729 - protein, 9 aa, Homo Sapiens
TFGIEPNAE

SEQ ID NO: 828730 - protein, 9 aa, Homo Sapiens
GPHHQPSGT

SEQ ID NO: 828731 - protein, 9 aa, Homo Sapiens
LPDSRDYPA

SEQ ID NO: 828732 - protein, 9 aa, Homo Sapiens
VDNFFCDVS

SEQ ID NO: 828733 - protein, 9 aa, Homo Sapiens
NILDTLSKL

SEQ ID NO: 828734 - protein, 9 aa, Homo Sapiens
QIKRTAGDH

SEQ ID NO: 828735 - protein, 9 aa, Homo Sapiens
NFEIHWKIH

SEQ ID NO: 828736 - protein, 9 aa, Homo Sapiens
GGKTEQVQH

SEQ ID NO: 828737 - protein, 9 aa, Homo Sapiens
KQCVGETQS

SEQ ID NO: 828738 - protein, 9 aa, Homo Sapiens
GEFLCLWEQ

SEQ ID NO: 828739 - protein, 9 aa, Homo Sapiens
ANQFFSSPI

SEQ ID NO: 828740 - protein, 9 aa, Homo Sapiens
LMSQSVGSP

SEQ ID NO: 828741 - protein, 9 aa, Homo Sapiens
KRKNRQKNK

SEQ ID NO: 828742 - protein, 9 aa, Homo Sapiens
INWFMFFGP

SEQ ID NO: 828743 - protein, 9 aa, Homo Sapiens
LVQGVSDSL

SEQ ID NO: 828744 - protein, 9 aa, Homo Sapiens
VIDCCVNLI

SEQ ID NO: 828745 - protein, 9 aa, Homo Sapiens
YPGCGSLAQ

SEQ ID NO: 828746 - protein, 9 aa, Homo Sapiens
DIFKANDLF

SEQ ID NO: 828747 - protein, 9 aa, Homo Sapiens
HSLSVSEAM

SEQ ID NO: 828748 - protein, 9 aa, Homo Sapiens
HNLADVVQI

SEQ ID NO: 828749 - protein, 9 aa, Homo Sapiens
CLCSHCSGT

SEQ ID NO: 828750 - protein, 9 aa, Homo Sapiens
NAPAKLQGI

SEQ ID NO: 828751 - protein, 9 aa, Homo Sapiens
SKDHNKRLK

SEQ ID NO: 828752 - protein, 9 aa, Homo Sapiens
SHVRLWVLQ

SEQ ID NO: 828753 - protein, 9 aa, Homo Sapiens
GFGEAGKPT

SEQ ID NO: 828754 - protein, 9 aa, Homo Sapiens
GAALGQMLG

SEQ ID NO: 828755 - protein, 9 aa, Homo Sapiens
SRRDPSEEI

SEQ ID NO: 828756 - protein, 9 aa, Homo Sapiens
FLRDTCTYA

SEQ ID NO: 828757 - protein, 9 aa, Homo Sapiens
TTNIVLTGT

SEQ ID NO: 828758 - protein, 9 aa, Homo Sapiens
QSIFENQQA

SEQ ID NO: 828759 - protein, 9 aa, Homo Sapiens
PSAPFQSEL

SEQ ID NO: 828760 - protein, 9 aa, Homo Sapiens
PEPLNTSDL

SEQ ID NO: 828761 - protein, 9 aa, Homo Sapiens
RLMLSERLI

SEQ ID NO: 828762 - protein, 9 aa, Homo Sapiens
GRVFQGKWE

SEQ ID NO: 828763 - protein, 9 aa, Homo Sapiens
QEYRLVVLH

SEQ ID NO: 828764 - protein, 9 aa, Homo Sapiens
KIIKVTVNT

SEQ ID NO: 828765 - protein, 9 aa, Homo Sapiens
TCAFHLTAI

SEQ ID NO: 828766 - protein, 9 aa, Homo Sapiens
QVLGYKDPA

SEQ ID NO: 828767 - protein, 9 aa, Homo Sapiens
YLLQPAQGC

SEQ ID NO: 828768 - protein, 9 aa, Homo Sapiens
QNLVKDLCV

SEQ ID NO: 828769 - protein, 9 aa, Homo Sapiens
CQCRRNNYG

SEQ ID NO: 828770 - protein, 9 aa, Homo Sapiens
KEYQIQEPN

SEQ ID NO: 828771 - protein, 9 aa, Homo Sapiens
YEIKKYSDP

SEQ ID NO: 828772 - protein, 9 aa, Homo Sapiens
QRLLGSVQQ

SEQ ID NO: 828773 - protein, 9 aa, Homo Sapiens
ISRIRAEYF

SEQ ID NO: 828774 - protein, 9 aa, Homo Sapiens
RGFIHEDEL

SEQ ID NO: 828775 - protein, 9 aa, Homo Sapiens
QQGGWRCSC

SEQ ID NO: 828776 - protein, 9 aa, Homo Sapiens
AALLPSDEW

SEQ ID NO: 828777 - protein, 9 aa, Homo Sapiens
VVQKLFESL

SEQ ID NO: 828778 - protein, 9 aa, Homo Sapiens
GKWERAFFF

SEQ ID NO: 828779 - protein, 9 aa, Homo Sapiens
SLLETLYQN

SEQ ID NO: 828780 - protein, 9 aa, Homo Sapiens
LNRRAIHDK

SEQ ID NO: 828781 - protein, 9 aa, Homo Sapiens
SESSSFLTG

SEQ ID NO: 828782 - protein, 9 aa, Homo Sapiens
NQDNKLLKQ

SEQ ID NO: 828783 - protein, 9 aa, Homo Sapiens
DFSLPDIQL

SEQ ID NO: 828784 - protein, 9 aa, Homo Sapiens
KEEEIQYII

SEQ ID NO: 828785 - protein, 9 aa, Homo Sapiens
NFHADAILS

SEQ ID NO: 828786 - protein, 9 aa, Homo Sapiens
KQSLHESLF

SEQ ID NO: 828787 - protein, 9 aa, Homo Sapiens
PRKDTGSRY

SEQ ID NO: 828788 - protein, 9 aa, Homo Sapiens
AHKIMKYLI

SEQ ID NO: 828789 - protein, 9 aa, Homo Sapiens
IVIGNGTAC

SEQ ID NO: 828790 - protein, 9 aa, Homo Sapiens
KVPWYPSDL

SEQ ID NO: 828791 - protein, 9 aa, Homo Sapiens
IELSHIWEL

SEQ ID NO: 828792 - protein, 9 aa, Homo Sapiens
LSPMKPLPL

SEQ ID NO: 828793 - protein, 9 aa, Homo Sapiens
PVMSKSSPR

SEQ ID NO: 828794 - protein, 9 aa, Homo Sapiens
INGKTHTAT

SEQ ID NO: 828795 - protein, 9 aa, Homo Sapiens
LTDLSHLIR

SEQ ID NO: 828796 - protein, 9 aa, Homo Sapiens
KRLSPDWCK

SEQ ID NO: 828797 - protein, 9 aa, Homo Sapiens
LNARFPGCM

SEQ ID NO: 828798 - protein, 9 aa, Homo Sapiens
TFWQMQCSE

SEQ ID NO: 828799 - protein, 9 aa, Homo Sapiens
IHLKKKSGV

SEQ ID NO: 828800 - protein, 9 aa, Homo Sapiens
GMGHCLFVP

SEQ ID NO: 828801 - protein, 9 aa, Homo Sapiens
DKRDGDKKN

SEQ ID NO: 828802 - protein, 9 aa, Homo Sapiens
KAIHHLIEG

SEQ ID NO: 828803 - protein, 9 aa, Homo Sapiens
VQPAAAPNF

SEQ ID NO: 828804 - protein, 9 aa, Homo Sapiens
SSKKNLLEG

SEQ ID NO: 828805 - protein, 9 aa, Homo Sapiens
NLHDNPWDC

SEQ ID NO: 828806 - protein, 9 aa, Homo Sapiens
MVRRHRASD

SEQ ID NO: 828807 - protein, 9 aa, Homo Sapiens
TQRLQPEWG

SEQ ID NO: 828808 - protein, 9 aa, Homo Sapiens
GMGNFNSIS

SEQ ID NO: 828809 - protein, 9 aa, Homo Sapiens
LLQGIVFCH

SEQ ID NO: 828810 - protein, 9 aa, Homo Sapiens
GTTGIQSEL

SEQ ID NO: 828811 - protein, 9 aa, Homo Sapiens
ELDNSYLPI

SEQ ID NO: 828812 - protein, 9 aa, Homo Sapiens
FYYLGCHQW

SEQ ID NO: 828813 - protein, 9 aa, Homo Sapiens
YLQVQKDIF

SEQ ID NO: 828814 - protein, 9 aa, Homo Sapiens
PKEYDYETR

SEQ ID NO: 828815 - protein, 9 aa, Homo Sapiens
VKKDDTEKE

SEQ ID NO: 828816 - protein, 9 aa, Homo Sapiens
CPFASAYEH

SEQ ID NO: 828817 - protein, 9 aa, Homo Sapiens
ENTFKIDLF

SEQ ID NO: 828818 - protein, 9 aa, Homo Sapiens
VQNRFTTNL

SEQ ID NO: 828819 - protein, 9 aa, Homo Sapiens
RKYWALPSL

SEQ ID NO: 828820 - protein, 9 aa, Homo Sapiens
LKNASDLLR

SEQ ID NO: 828821 - protein, 9 aa, Homo Sapiens
SAATDGTSE

SEQ ID NO: 828822 - protein, 9 aa, Homo Sapiens
EKQIKEEIK

SEQ ID NO: 828823 - protein, 9 aa, Homo Sapiens
WFDGKELSG

SEQ ID NO: 828824 - protein, 9 aa, Homo Sapiens
GDRPYECSV

SEQ ID NO: 828825 - protein, 9 aa, Homo Sapiens
ISPDGPVLS

SEQ ID NO: 828826 - protein, 9 aa, Homo Sapiens
SQVTRLLDI

SEQ ID NO: 828827 - protein, 9 aa, Homo Sapiens
EGDCFKHTN

SEQ ID NO: 828828 - protein, 9 aa, Homo Sapiens
VECSKTSDI

SEQ ID NO: 828829 - protein, 9 aa, Homo Sapiens
SAIRRSDLY

SEQ ID NO: 828830 - protein, 9 aa, Homo Sapiens
LKVTEPLAR

SEQ ID NO: 828831 - protein, 9 aa, Homo Sapiens
KQVLSTEKT

SEQ ID NO: 828832 - protein, 9 aa, Homo Sapiens
LVTRRRVRT

SEQ ID NO: 828833 - protein, 9 aa, Homo Sapiens
VFCKHEDYM

SEQ ID NO: 828834 - protein, 9 aa, Homo Sapiens
SIPENLEYK

SEQ ID NO: 828835 - protein, 9 aa, Homo Sapiens
KFEQLSKSA

SEQ ID NO: 828836 - protein, 9 aa, Homo Sapiens
RREINKIAA

SEQ ID NO: 828837 - protein, 9 aa, Homo Sapiens
MLERYQNNN

SEQ ID NO: 828838 - protein, 9 aa, Homo Sapiens
CSISDNKSE

SEQ ID NO: 828839 - protein, 9 aa, Homo Sapiens
NSYLPIIVL

SEQ ID NO: 828840 - protein, 9 aa, Homo Sapiens
AFPEERYDS

SEQ ID NO: 828841 - protein, 9 aa, Homo Sapiens
VCSSEAFQK

SEQ ID NO: 828842 - protein, 9 aa, Homo Sapiens
REKKPKNGE

SEQ ID NO: 828843 - protein, 9 aa, Homo Sapiens
NNTTVLECA

SEQ ID NO: 828844 - protein, 9 aa, Homo Sapiens
KENRTTVER

SEQ ID NO: 828845 - protein, 9 aa, Homo Sapiens
NTVQGPAYL

SEQ ID NO: 828846 - protein, 9 aa, Homo Sapiens
RRTWRFGVA

SEQ ID NO: 828847 - protein, 9 aa, Homo Sapiens
SPFSITSNT

SEQ ID NO: 828848 - protein, 9 aa, Homo Sapiens
YSKIKHLRK

SEQ ID NO: 828849 - protein, 9 aa, Homo Sapiens
STSIDRLDD

SEQ ID NO: 828850 - protein, 9 aa, Homo Sapiens
KLLSPRQTA

SEQ ID NO: 828851 - protein, 9 aa, Homo Sapiens
ITLTNVNDN

SEQ ID NO: 828852 - protein, 9 aa, Homo Sapiens
RGLVHMINW

SEQ ID NO: 828853 - protein, 9 aa, Homo Sapiens
EHDRIAKFS

SEQ ID NO: 828854 - protein, 9 aa, Homo Sapiens
GNNWIEGEE

SEQ ID NO: 828855 - protein, 9 aa, Homo Sapiens
RVNYLTHMV

SEQ ID NO: 828856 - protein, 9 aa, Homo Sapiens
TVRGPCSVS

SEQ ID NO: 828857 - protein, 9 aa, Homo Sapiens
SWEKLENNL

SEQ ID NO: 828858 - protein, 9 aa, Homo Sapiens
IQNYHSGND

SEQ ID NO: 828859 - protein, 9 aa, Homo Sapiens
VAQIYHAVA

SEQ ID NO: 828860 - protein, 9 aa, Homo Sapiens
SVKTLRKRA

SEQ ID NO: 828861 - protein, 9 aa, Homo Sapiens
YVATRVPKE

SEQ ID NO: 828862 - protein, 9 aa, Homo Sapiens
PSSSSTYHT

SEQ ID NO: 828863 - protein, 9 aa, Homo Sapiens
ALLRDFPNH

SEQ ID NO: 828864 - protein, 9 aa, Homo Sapiens
KGYKGVTSH

SEQ ID NO: 828865 - protein, 9 aa, Homo Sapiens
MEIANVSYP

SEQ ID NO: 828866 - protein, 9 aa, Homo Sapiens
KYDATRQKR

SEQ ID NO: 828867 - protein, 9 aa, Homo Sapiens
RIILEPYKY

SEQ ID NO: 828868 - protein, 9 aa, Homo Sapiens
NRTINPDVD

SEQ ID NO: 828869 - protein, 9 aa, Homo Sapiens
QRRSVFPQQ

SEQ ID NO: 828870 - protein, 9 aa, Homo Sapiens
DEWWENQPA

SEQ ID NO: 828871 - protein, 9 aa, Homo Sapiens
EVVQEYQEK

SEQ ID NO: 828872 - protein, 9 aa, Homo Sapiens
EFFKSALQT

SEQ ID NO: 828873 - protein, 9 aa, Homo Sapiens
VSSLGPVAT

SEQ ID NO: 828874 - protein, 9 aa, Homo Sapiens
NPTSWEKRR

SEQ ID NO: 828875 - protein, 9 aa, Homo Sapiens
GNWYIQATC

SEQ ID NO: 828876 - protein, 9 aa, Homo Sapiens
AGTTEKTDE

SEQ ID NO: 828877 - protein, 9 aa, Homo Sapiens
PHNPWLQEA

SEQ ID NO: 828878 - protein, 9 aa, Homo Sapiens
VYICFQNGE

SEQ ID NO: 828879 - protein, 9 aa, Homo Sapiens
IIVTGSVIR

SEQ ID NO: 828880 - protein, 9 aa, Homo Sapiens
ENGGAHREK

SEQ ID NO: 828881 - protein, 9 aa, Homo Sapiens
FCKVCGVML

SEQ ID NO: 828882 - protein, 9 aa, Homo Sapiens
VQMYSSRDL

SEQ ID NO: 828883 - protein, 9 aa, Homo Sapiens
NFLTRIADL

SEQ ID NO: 828884 - protein, 9 aa, Homo Sapiens
DECQQNLMK

SEQ ID NO: 828885 - protein, 9 aa, Homo Sapiens
CTKGIEAPL

SEQ ID NO: 828886 - protein, 9 aa, Homo Sapiens
PHHVGQSGA

SEQ ID NO: 828887 - protein, 9 aa, Homo Sapiens
PPPDPHLLV

SEQ ID NO: 828888 - protein, 9 aa, Homo Sapiens
VSSSAASPY

SEQ ID NO: 828889 - protein, 9 aa, Homo Sapiens
EAVNKSLEG

SEQ ID NO: 828890 - protein, 9 aa, Homo Sapiens
VKFQMKQIS

SEQ ID NO: 828891 - protein, 9 aa, Homo Sapiens
TLPQSSLSA

SEQ ID NO: 828892 - protein, 9 aa, Homo Sapiens
FYRDALLLQ

SEQ ID NO: 828893 - protein, 9 aa, Homo Sapiens
QQQQAQQQL

SEQ ID NO: 828894 - protein, 9 aa, Homo Sapiens
NLYSFQKQC

SEQ ID NO: 828895 - protein, 9 aa, Homo Sapiens
RVYFNKCPF

SEQ ID NO: 828896 - protein, 9 aa, Homo Sapiens
VQIWEVLKT

SEQ ID NO: 828897 - protein, 9 aa, Homo Sapiens
PNIIITPPT

SEQ ID NO: 828898 - protein, 9 aa, Homo Sapiens
GIRNTFQGG

SEQ ID NO: 828899 - protein, 9 aa, Homo Sapiens
SSGLCREGD

SEQ ID NO: 828900 - protein, 9 aa, Homo Sapiens
MKEMLRQFS

SEQ ID NO: 828901 - protein, 9 aa, Homo Sapiens
PSLCIARFR

SEQ ID NO: 828902 - protein, 9 aa, Homo Sapiens
VFMALSAQL

SEQ ID NO: 828903 - protein, 9 aa, Homo Sapiens
TIADLILYA

SEQ ID NO: 828904 - protein, 9 aa, Homo Sapiens
WAVQDVARV

SEQ ID NO: 828905 - protein, 9 aa, Homo Sapiens
SPEAERVLQ

SEQ ID NO: 828906 - protein, 9 aa, Homo Sapiens
VKLNDGSPI

SEQ ID NO: 828907 - protein, 9 aa, Homo Sapiens
ITDMKLSMN

SEQ ID NO: 828908 - protein, 9 aa, Homo Sapiens
ALEERWSQQ

SEQ ID NO: 828909 - protein, 9 aa, Homo Sapiens
EPRQIVIHR

SEQ ID NO: 828910 - protein, 9 aa, Homo Sapiens
ERCSGNIKT

SEQ ID NO: 828911 - protein, 9 aa, Homo Sapiens
MLFRYVEKI

SEQ ID NO: 828912 - protein, 9 aa, Homo Sapiens
FPNPLRPFV

SEQ ID NO: 828913 - protein, 9 aa, Homo Sapiens
CAIFFCCFE

SEQ ID NO: 828914 - protein, 9 aa, Homo Sapiens
RTVASQAYN

SEQ ID NO: 828915 - protein, 9 aa, Homo Sapiens
PLVAATLLN

SEQ ID NO: 828916 - protein, 9 aa, Homo Sapiens
KMTIRDDMI

SEQ ID NO: 828917 - protein, 9 aa, Homo Sapiens
IPAKTPPTP

SEQ ID NO: 828918 - protein, 9 aa, Homo Sapiens
TVSSSYNIE

SEQ ID NO: 828919 - protein, 9 aa, Homo Sapiens
HLDHPGYLR

SEQ ID NO: 828920 - protein, 9 aa, Homo Sapiens
RTTTTAGVL

SEQ ID NO: 828921 - protein, 9 aa, Homo Sapiens
ETSALPRKY

SEQ ID NO: 828922 - protein, 9 aa, Homo Sapiens
EPSGPFRQQ

SEQ ID NO: 828923 - protein, 9 aa, Homo Sapiens
RRYKCAACG

SEQ ID NO: 828924 - protein, 9 aa, Homo Sapiens
SPEEKDLLK

SEQ ID NO: 828925 - protein, 9 aa, Homo Sapiens
DKLRKVIYC

SEQ ID NO: 828926 - protein, 9 aa, Homo Sapiens
VPPIMFENH

SEQ ID NO: 828927 - protein, 9 aa, Homo Sapiens
NQNVHEETT

SEQ ID NO: 828928 - protein, 9 aa, Homo Sapiens
GGNPKSVIL

SEQ ID NO: 828929 - protein, 9 aa, Homo Sapiens
ILETSEIKF

SEQ ID NO: 828930 - protein, 9 aa, Homo Sapiens
QGEMIDRIK

SEQ ID NO: 828931 - protein, 9 aa, Homo Sapiens
SAASPYFCQ

SEQ ID NO: 828932 - protein, 9 aa, Homo Sapiens
ALQIHLRLH

SEQ ID NO: 828933 - protein, 9 aa, Homo Sapiens
EKETMPFLN

SEQ ID NO: 828934 - protein, 9 aa, Homo Sapiens
QLSHMCLHD

SEQ ID NO: 828935 - protein, 9 aa, Homo Sapiens
LKFWAFLRI

SEQ ID NO: 828936 - protein, 9 aa, Homo Sapiens
LTLHQTIYN

SEQ ID NO: 828937 - protein, 9 aa, Homo Sapiens
YQRAQMEMK

SEQ ID NO: 828938 - protein, 9 aa, Homo Sapiens
VEPYPTSRY

SEQ ID NO: 828939 - protein, 9 aa, Homo Sapiens
ELSLNLDAK

SEQ ID NO: 828940 - protein, 9 aa, Homo Sapiens
PSPPSSPLP

SEQ ID NO: 828941 - protein, 9 aa, Homo Sapiens
KGIKKEVNV

SEQ ID NO: 828942 - protein, 9 aa, Homo Sapiens
SSWTPESNT

SEQ ID NO: 828943 - protein, 9 aa, Homo Sapiens
VVTKREHSK

SEQ ID NO: 828944 - protein, 9 aa, Homo Sapiens
AVFYLKRVK

SEQ ID NO: 828945 - protein, 9 aa, Homo Sapiens
EGPVRLYED

SEQ ID NO: 828946 - protein, 9 aa, Homo Sapiens
VLIENKAFK

SEQ ID NO: 828947 - protein, 9 aa, Homo Sapiens
KPPNRYLVK

SEQ ID NO: 828948 - protein, 9 aa, Homo Sapiens
PLPLPACLQ

SEQ ID NO: 828949 - protein, 9 aa, Homo Sapiens
YDFWYQPQH

SEQ ID NO: 828950 - protein, 9 aa, Homo Sapiens
FSIRKGYRR

SEQ ID NO: 828951 - protein, 9 aa, Homo Sapiens
MPEKEMLCL

SEQ ID NO: 828952 - protein, 9 aa, Homo Sapiens
QSHMITHTG

SEQ ID NO: 828953 - protein, 9 aa, Homo Sapiens
NQLFEYTSN

SEQ ID NO: 828954 - protein, 9 aa, Homo Sapiens
VQRWIRGFI

SEQ ID NO: 828955 - protein, 9 aa, Homo Sapiens
SILGPEKNI

SEQ ID NO: 828956 - protein, 9 aa, Homo Sapiens
LAVILMTTK

SEQ ID NO: 828957 - protein, 9 aa, Homo Sapiens
IYTRDNSYK

SEQ ID NO: 828958 - protein, 9 aa, Homo Sapiens
SVEVLNNNK

SEQ ID NO: 828959 - protein, 9 aa, Homo Sapiens
SNAVHDSFR

SEQ ID NO: 828960 - protein, 9 aa, Homo Sapiens
TLPQGSAPP

SEQ ID NO: 828961 - protein, 9 aa, Homo Sapiens
FRKLSNSSL

SEQ ID NO: 828962 - protein, 9 aa, Homo Sapiens
MPFQTHYRF

SEQ ID NO: 828963 - protein, 9 aa, Homo Sapiens
EEKTLDCGQ

SEQ ID NO: 828964 - protein, 9 aa, Homo Sapiens
SPARPRDSL

SEQ ID NO: 828965 - protein, 9 aa, Homo Sapiens
WEGKVNGRK

SEQ ID NO: 828966 - protein, 9 aa, Homo Sapiens
LVNDNKWKK

SEQ ID NO: 828967 - protein, 9 aa, Homo Sapiens
NPQQTQQEL

SEQ ID NO: 828968 - protein, 9 aa, Homo Sapiens
RAPPPDEDD

SEQ ID NO: 828969 - protein, 9 aa, Homo Sapiens
VCQLHREFL

SEQ ID NO: 828970 - protein, 9 aa, Homo Sapiens
YSTNTKTTS

SEQ ID NO: 828971 - protein, 9 aa, Homo Sapiens
RHWVHRECD

SEQ ID NO: 828972 - protein, 9 aa, Homo Sapiens
KRTKKRLRK

SEQ ID NO: 828973 - protein, 9 aa, Homo Sapiens
QPQEAFQGK

SEQ ID NO: 828974 - protein, 9 aa, Homo Sapiens
AHCGMILQE

SEQ ID NO: 828975 - protein, 9 aa, Homo Sapiens
NEGRKYPEL

SEQ ID NO: 828976 - protein, 9 aa, Homo Sapiens
LALGTHRMA

SEQ ID NO: 828977 - protein, 9 aa, Homo Sapiens
GLRLMWYKH

SEQ ID NO: 828978 - protein, 9 aa, Homo Sapiens
STSIPQKSR

SEQ ID NO: 828979 - protein, 9 aa, Homo Sapiens
NREPLKQAA

SEQ ID NO: 828980 - protein, 9 aa, Homo Sapiens
LQTSIDAYD

SEQ ID NO: 828981 - protein, 9 aa, Homo Sapiens
KMTMREINQ

SEQ ID NO: 828982 - protein, 9 aa, Homo Sapiens
ICGEIENIT

SEQ ID NO: 828983 - protein, 9 aa, Homo Sapiens
CLWEQFSDM

SEQ ID NO: 828984 - protein, 9 aa, Homo Sapiens
LINFLKLLK

SEQ ID NO: 828985 - protein, 9 aa, Homo Sapiens
DRYKKLQEK

SEQ ID NO: 828986 - protein, 9 aa, Homo Sapiens
LARKMHADM

SEQ ID NO: 828987 - protein, 9 aa, Homo Sapiens
YNGFWKIPH

SEQ ID NO: 828988 - protein, 9 aa, Homo Sapiens
DEKHLQSSQ

SEQ ID NO: 828989 - protein, 9 aa, Homo Sapiens
EYCNKCEFL

SEQ ID NO: 828990 - protein, 9 aa, Homo Sapiens
AYFLRYKNC

SEQ ID NO: 828991 - protein, 9 aa, Homo Sapiens
PTNSYGVLE

SEQ ID NO: 828992 - protein, 9 aa, Homo Sapiens
KAAKLEKPS

SEQ ID NO: 828993 - protein, 9 aa, Homo Sapiens
GYFPMPELK

SEQ ID NO: 828994 - protein, 9 aa, Homo Sapiens
LICLVLRQS

SEQ ID NO: 828995 - protein, 9 aa, Homo Sapiens
FLTIVCEGS

SEQ ID NO: 828996 - protein, 9 aa, Homo Sapiens
TMIRANCLA

SEQ ID NO: 828997 - protein, 9 aa, Homo Sapiens
YLPSRYHSL

SEQ ID NO: 828998 - protein, 9 aa, Homo Sapiens
TNIQHLKGL

SEQ ID NO: 828999 - protein, 9 aa, Homo Sapiens
MDNFCSDTE

SEQ ID NO: 829000 - protein, 9 aa, Homo Sapiens
MLYQTYMTH

SEQ ID NO: 829001 - protein, 9 aa, Homo Sapiens
ILPEMRAYW

SEQ ID NO: 829002 - protein, 9 aa, Homo Sapiens
GATYVIYHD

SEQ ID NO: 829003 - protein, 9 aa, Homo Sapiens
SQISWPLWT

SEQ ID NO: 829004 - protein, 9 aa, Homo Sapiens
ASDEDCQLS

SEQ ID NO: 829005 - protein, 9 aa, Homo Sapiens
VVLLIYADI

SEQ ID NO: 829006 - protein, 9 aa, Homo Sapiens
IKDTKEKRT

SEQ ID NO: 829007 - protein, 9 aa, Homo Sapiens
QKMKKIDKI

SEQ ID NO: 829008 - protein, 9 aa, Homo Sapiens
FTDKFCKVC

SEQ ID NO: 829009 - protein, 9 aa, Homo Sapiens
EDYEGDDDE

SEQ ID NO: 829010 - protein, 9 aa, Homo Sapiens
SSDNLFKKV

SEQ ID NO: 829011 - protein, 9 aa, Homo Sapiens
LAATTLRKV

SEQ ID NO: 829012 - protein, 9 aa, Homo Sapiens
SHDSYNRAR

SEQ ID NO: 829013 - protein, 9 aa, Homo Sapiens
EKNQGFDSD

SEQ ID NO: 829014 - protein, 9 aa, Homo Sapiens
QLFGYMQMT

SEQ ID NO: 829015 - protein, 9 aa, Homo Sapiens
LAPEQSFKK

SEQ ID NO: 829016 - protein, 9 aa, Homo Sapiens
FKPPGYERT

SEQ ID NO: 829017 - protein, 9 aa, Homo Sapiens
PGQFGRPVA

SEQ ID NO: 829018 - protein, 9 aa, Homo Sapiens
SKEDCRVIP

SEQ ID NO: 829019 - protein, 9 aa, Homo Sapiens
VIFSDYRLI

SEQ ID NO: 829020 - protein, 9 aa, Homo Sapiens
LFQEAVPPN

SEQ ID NO: 829021 - protein, 9 aa, Homo Sapiens
KDAENPTES

SEQ ID NO: 829022 - protein, 9 aa, Homo Sapiens
LNVPLSVNA

SEQ ID NO: 829023 - protein, 9 aa, Homo Sapiens
ETVEEVAAR

SEQ ID NO: 829024 - protein, 9 aa, Homo Sapiens
NVFSLNYLF

SEQ ID NO: 829025 - protein, 9 aa, Homo Sapiens
IHGNAPVET

SEQ ID NO: 829026 - protein, 9 aa, Homo Sapiens
YGVEGTLAK

SEQ ID NO: 829027 - protein, 9 aa, Homo Sapiens
LVGNAFIPH

SEQ ID NO: 829028 - protein, 9 aa, Homo Sapiens
EGNKETSPE

SEQ ID NO: 829029 - protein, 9 aa, Homo Sapiens
PRDSLLRQT

SEQ ID NO: 829030 - protein, 9 aa, Homo Sapiens
LSLIILDIL

SEQ ID NO: 829031 - protein, 9 aa, Homo Sapiens
EEKKYLSNK

SEQ ID NO: 829032 - protein, 9 aa, Homo Sapiens
RHERTRTGD

SEQ ID NO: 829033 - protein, 9 aa, Homo Sapiens
LSEADLQAE

SEQ ID NO: 829034 - protein, 9 aa, Homo Sapiens
CGWHHCPHL

SEQ ID NO: 829035 - protein, 9 aa, Homo Sapiens
SCDTGLESL

SEQ ID NO: 829036 - protein, 9 aa, Homo Sapiens
PAFEEIGKI

SEQ ID NO: 829037 - protein, 9 aa, Homo Sapiens
MLKYTSVFE

SEQ ID NO: 829038 - protein, 9 aa, Homo Sapiens
TVDNFFCDV

SEQ ID NO: 829039 - protein, 9 aa, Homo Sapiens
PGLRELSER

SEQ ID NO: 829040 - protein, 9 aa, Homo Sapiens
LHFALKSLL

SEQ ID NO: 829041 - protein, 9 aa, Homo Sapiens
DCHQPGTLG

SEQ ID NO: 829042 - protein, 9 aa, Homo Sapiens
KRMKICMNE

SEQ ID NO: 829043 - protein, 9 aa, Homo Sapiens
QDWLDRGDK

SEQ ID NO: 829044 - protein, 9 aa, Homo Sapiens
PYVAFAMYM

SEQ ID NO: 829045 - protein, 9 aa, Homo Sapiens
IGNSSVDKT

SEQ ID NO: 829046 - protein, 9 aa, Homo Sapiens
FVTEVCRFL

SEQ ID NO: 829047 - protein, 9 aa, Homo Sapiens
HATKEESTV

SEQ ID NO: 829048 - protein, 9 aa, Homo Sapiens
KIQGKDLQL

SEQ ID NO: 829049 - protein, 9 aa, Homo Sapiens
IIPAFSNQT

SEQ ID NO: 829050 - protein, 9 aa, Homo Sapiens
LINLKPSVF

SEQ ID NO: 829051 - protein, 9 aa, Homo Sapiens
NFANLIMEV

SEQ ID NO: 829052 - protein, 9 aa, Homo Sapiens
EEARKKMNS

SEQ ID NO: 829053 - protein, 9 aa, Homo Sapiens
NNDFEIVLP

SEQ ID NO: 829054 - protein, 9 aa, Homo Sapiens
HEAFLLALQ

SEQ ID NO: 829055 - protein, 9 aa, Homo Sapiens
SSEQNWANY

SEQ ID NO: 829056 - protein, 9 aa, Homo Sapiens
ALKAIDSSK

SEQ ID NO: 829057 - protein, 9 aa, Homo Sapiens
ILYTKTEAC

SEQ ID NO: 829058 - protein, 9 aa, Homo Sapiens
HHVGKKHRK

SEQ ID NO: 829059 - protein, 9 aa, Homo Sapiens
EGVLAGLRG

SEQ ID NO: 829060 - protein, 9 aa, Homo Sapiens
NVIQKKYDD

SEQ ID NO: 829061 - protein, 9 aa, Homo Sapiens
PLDTVRALS

SEQ ID NO: 829062 - protein, 9 aa, Homo Sapiens
SSELITHQI

SEQ ID NO: 829063 - protein, 9 aa, Homo Sapiens
DMDIGGTSD

SEQ ID NO: 829064 - protein, 9 aa, Homo Sapiens
LLKCVNHTN

SEQ ID NO: 829065 - protein, 9 aa, Homo Sapiens
HVGKKHRKQ

SEQ ID NO: 829066 - protein, 9 aa, Homo Sapiens
VRVAASYAL

SEQ ID NO: 829067 - protein, 9 aa, Homo Sapiens
RYVCENCKP

SEQ ID NO: 829068 - protein, 9 aa, Homo Sapiens
GYGPGDGPS

SEQ ID NO: 829069 - protein, 9 aa, Homo Sapiens
PWGWNLRWT

SEQ ID NO: 829070 - protein, 9 aa, Homo Sapiens
VAKNSVGSL

SEQ ID NO: 829071 - protein, 9 aa, Homo Sapiens
AHSAPPFPA

SEQ ID NO: 829072 - protein, 9 aa, Homo Sapiens
TCLIQHQLF

SEQ ID NO: 829073 - protein, 9 aa, Homo Sapiens
RKKQRSRIN

SEQ ID NO: 829074 - protein, 9 aa, Homo Sapiens
TKEGEQVEF

SEQ ID NO: 829075 - protein, 9 aa, Homo Sapiens
SLGRFRSMS

SEQ ID NO: 829076 - protein, 9 aa, Homo Sapiens
RSNQQRLGK

SEQ ID NO: 829077 - protein, 9 aa, Homo Sapiens
LTEINKILN

SEQ ID NO: 829078 - protein, 9 aa, Homo Sapiens
TPPRWAEYQ

SEQ ID NO: 829079 - protein, 9 aa, Homo Sapiens
VTLSNQIIS

SEQ ID NO: 829080 - protein, 9 aa, Homo Sapiens
GALNRVLKN

SEQ ID NO: 829081 - protein, 9 aa, Homo Sapiens
ELPHKRYVL

SEQ ID NO: 829082 - protein, 9 aa, Homo Sapiens
CGIIICLDL

SEQ ID NO: 829083 - protein, 9 aa, Homo Sapiens
KKLCRGNPS

SEQ ID NO: 829084 - protein, 9 aa, Homo Sapiens
SADIYEFIW

SEQ ID NO: 829085 - protein, 9 aa, Homo Sapiens
RIVGAQLRT

SEQ ID NO: 829086 - protein, 9 aa, Homo Sapiens
IPLALWSIL

SEQ ID NO: 829087 - protein, 9 aa, Homo Sapiens
MFAQGHPEV

SEQ ID NO: 829088 - protein, 9 aa, Homo Sapiens
RDPLQQVLS

SEQ ID NO: 829089 - protein, 9 aa, Homo Sapiens
SPVGVQPVL

SEQ ID NO: 829090 - protein, 9 aa, Homo Sapiens
PKRMIMAAV

SEQ ID NO: 829091 - protein, 9 aa, Homo Sapiens
CMDPTMDNT

SEQ ID NO: 829092 - protein, 9 aa, Homo Sapiens
CGLDCLQWE

SEQ ID NO: 829093 - protein, 9 aa, Homo Sapiens
TLNGVDKLL

SEQ ID NO: 829094 - protein, 9 aa, Homo Sapiens
QHHVGKKHR

SEQ ID NO: 829095 - protein, 9 aa, Homo Sapiens
PFGSEGKNC

SEQ ID NO: 829096 - protein, 9 aa, Homo Sapiens
NDPNFTEAI

SEQ ID NO: 829097 - protein, 9 aa, Homo Sapiens
YVITTTTLE

SEQ ID NO: 829098 - protein, 9 aa, Homo Sapiens
ILIISMIFI

SEQ ID NO: 829099 - protein, 9 aa, Homo Sapiens
PALKANSQR

SEQ ID NO: 829100 - protein, 9 aa, Homo Sapiens
ESSSEKDSQ

SEQ ID NO: 829101 - protein, 9 aa, Homo Sapiens
HVQRIVTMP

SEQ ID NO: 829102 - protein, 9 aa, Homo Sapiens
LIDKFCDPQ

SEQ ID NO: 829103 - protein, 9 aa, Homo Sapiens
IRQQIYYKT

SEQ ID NO: 829104 - protein, 9 aa, Homo Sapiens
PFSLHFLAQ

SEQ ID NO: 829105 - protein, 9 aa, Homo Sapiens
PYRLESQEE

SEQ ID NO: 829106 - protein, 9 aa, Homo Sapiens
FNEQAFPLP

SEQ ID NO: 829107 - protein, 9 aa, Homo Sapiens
HSLEPQKQA

SEQ ID NO: 829108 - protein, 9 aa, Homo Sapiens
NTGVTASPP

SEQ ID NO: 829109 - protein, 9 aa, Homo Sapiens
CGECGKFFQ

SEQ ID NO: 829110 - protein, 9 aa, Homo Sapiens
GITALAQAS

SEQ ID NO: 829111 - protein, 9 aa, Homo Sapiens
YILPYKELF

SEQ ID NO: 829112 - protein, 9 aa, Homo Sapiens
RNRVILARI

SEQ ID NO: 829113 - protein, 9 aa, Homo Sapiens
LALVSRDLT

SEQ ID NO: 829114 - protein, 9 aa, Homo Sapiens
KKKGKKLPE

SEQ ID NO: 829115 - protein, 9 aa, Homo Sapiens
VCFEMTDDI

SEQ ID NO: 829116 - protein, 9 aa, Homo Sapiens
QEYEEQKKY

SEQ ID NO: 829117 - protein, 9 aa, Homo Sapiens
DNQKRYYLR

SEQ ID NO: 829118 - protein, 9 aa, Homo Sapiens
HVRLWVLQI

SEQ ID NO: 829119 - protein, 9 aa, Homo Sapiens
GDLSPTKDG

SEQ ID NO: 829120 - protein, 9 aa, Homo Sapiens
LSLERTNKF

SEQ ID NO: 829121 - protein, 9 aa, Homo Sapiens
QGITHLKLI

SEQ ID NO: 829122 - protein, 9 aa, Homo Sapiens
QKFEQLSKS

SEQ ID NO: 829123 - protein, 9 aa, Homo Sapiens
SLENEKYEQ

SEQ ID NO: 829124 - protein, 9 aa, Homo Sapiens
FPRPSRSNT

SEQ ID NO: 829125 - protein, 9 aa, Homo Sapiens
TGCLTQMYL

SEQ ID NO: 829126 - protein, 9 aa, Homo Sapiens
HHLEAHMRS

SEQ ID NO: 829127 - protein, 9 aa, Homo Sapiens
DIQKRLKTY

SEQ ID NO: 829128 - protein, 9 aa, Homo Sapiens
KQRLHFALK

SEQ ID NO: 829129 - protein, 9 aa, Homo Sapiens
FIPQITPKQ

SEQ ID NO: 829130 - protein, 9 aa, Homo Sapiens
VLTCMSVDR

SEQ ID NO: 829131 - protein, 9 aa, Homo Sapiens
KAESNLFLA

SEQ ID NO: 829132 - protein, 9 aa, Homo Sapiens
HLEDYEGDD

SEQ ID NO: 829133 - protein, 9 aa, Homo Sapiens
HYAEYQVCL

SEQ ID NO: 829134 - protein, 9 aa, Homo Sapiens
GTLENYNSP

SEQ ID NO: 829135 - protein, 9 aa, Homo Sapiens
YVQPFWIVF

SEQ ID NO: 829136 - protein, 9 aa, Homo Sapiens
EITPGLEPH

SEQ ID NO: 829137 - protein, 9 aa, Homo Sapiens
GEHEPPSRS

SEQ ID NO: 829138 - protein, 9 aa, Homo Sapiens
NRSKQHLWL

SEQ ID NO: 829139 - protein, 9 aa, Homo Sapiens
RLNGCHLPF

SEQ ID NO: 829140 - protein, 9 aa, Homo Sapiens
SHAHRLIGA

SEQ ID NO: 829141 - protein, 9 aa, Homo Sapiens
ELCTLENVQ

SEQ ID NO: 829142 - protein, 9 aa, Homo Sapiens
IKNAEIYNY

SEQ ID NO: 829143 - protein, 9 aa, Homo Sapiens
RVALLLGGG

SEQ ID NO: 829144 - protein, 9 aa, Homo Sapiens
KAIPGFTNL

SEQ ID NO: 829145 - protein, 9 aa, Homo Sapiens
GKNNNKFVP

SEQ ID NO: 829146 - protein, 9 aa, Homo Sapiens
PSLGIIANI

SEQ ID NO: 829147 - protein, 9 aa, Homo Sapiens
HANGRAQYT

SEQ ID NO: 829148 - protein, 9 aa, Homo Sapiens
QILNLEELK

SEQ ID NO: 829149 - protein, 9 aa, Homo Sapiens
IAMNRGITD

SEQ ID NO: 829150 - protein, 9 aa, Homo Sapiens
CGVCFGAGC

SEQ ID NO: 829151 - protein, 9 aa, Homo Sapiens
IQQIEQDRG

SEQ ID NO: 829152 - protein, 9 aa, Homo Sapiens
LYGHTSTVH

SEQ ID NO: 829153 - protein, 9 aa, Homo Sapiens
GYLGCYCQD

SEQ ID NO: 829154 - protein, 9 aa, Homo Sapiens
DTQLDVESL

SEQ ID NO: 829155 - protein, 9 aa, Homo Sapiens
EELSEAQDM

SEQ ID NO: 829156 - protein, 9 aa, Homo Sapiens
PESNTSRKS

SEQ ID NO: 829157 - protein, 9 aa, Homo Sapiens
YKDILAWKV

SEQ ID NO: 829158 - protein, 9 aa, Homo Sapiens
FVENDMFVE

SEQ ID NO: 829159 - protein, 9 aa, Homo Sapiens
MVIAACSLQ

SEQ ID NO: 829160 - protein, 9 aa, Homo Sapiens
FTAQFNMFA

SEQ ID NO: 829161 - protein, 9 aa, Homo Sapiens
MRTLADVLH

SEQ ID NO: 829162 - protein, 9 aa, Homo Sapiens
RHHPKTYPN

SEQ ID NO: 829163 - protein, 9 aa, Homo Sapiens
IILEPYKYL

SEQ ID NO: 829164 - protein, 9 aa, Homo Sapiens
SVARQVCKQ

SEQ ID NO: 829165 - protein, 9 aa, Homo Sapiens
ARRIIVQPM

SEQ ID NO: 829166 - protein, 9 aa, Homo Sapiens
EGQEAEGDK

SEQ ID NO: 829167 - protein, 9 aa, Homo Sapiens
WLFGAWHVY

SEQ ID NO: 829168 - protein, 9 aa, Homo Sapiens
TASGTMFTE

SEQ ID NO: 829169 - protein, 9 aa, Homo Sapiens
KIAKEITVG

SEQ ID NO: 829170 - protein, 9 aa, Homo Sapiens
NEAKLSVFS

SEQ ID NO: 829171 - protein, 9 aa, Homo Sapiens
DLPSAKDDV

SEQ ID NO: 829172 - protein, 9 aa, Homo Sapiens
GKQLSEHQI

SEQ ID NO: 829173 - protein, 9 aa, Homo Sapiens
EGQPLCEYS

SEQ ID NO: 829174 - protein, 9 aa, Homo Sapiens
DSHEVEKSG

SEQ ID NO: 829175 - protein, 9 aa, Homo Sapiens
SLAIYFRCL

SEQ ID NO: 829176 - protein, 9 aa, Homo Sapiens
PPALIVSER

SEQ ID NO: 829177 - protein, 9 aa, Homo Sapiens
RQIVDHVDW

SEQ ID NO: 829178 - protein, 9 aa, Homo Sapiens
ALDHFQVDN

SEQ ID NO: 829179 - protein, 9 aa, Homo Sapiens
SVKKIISYR

SEQ ID NO: 829180 - protein, 9 aa, Homo Sapiens
SPLLEEEAA

SEQ ID NO: 829181 - protein, 9 aa, Homo Sapiens
DSKLQLPII

SEQ ID NO: 829182 - protein, 9 aa, Homo Sapiens
DKLDITTLT

SEQ ID NO: 829183 - protein, 9 aa, Homo Sapiens
PVANINSRF

SEQ ID NO: 829184 - protein, 9 aa, Homo Sapiens
GANEKDKRQ

SEQ ID NO: 829185 - protein, 9 aa, Homo Sapiens
SQIKHQNLA

SEQ ID NO: 829186 - protein, 9 aa, Homo Sapiens
VSAPEKLDQ

SEQ ID NO: 829187 - protein, 9 aa, Homo Sapiens
GISDLRTFR

SEQ ID NO: 829188 - protein, 9 aa, Homo Sapiens
KDKKWNYCV

SEQ ID NO: 829189 - protein, 9 aa, Homo Sapiens
SLDILKEDT

SEQ ID NO: 829190 - protein, 9 aa, Homo Sapiens
TGRAAATSM

SEQ ID NO: 829191 - protein, 9 aa, Homo Sapiens
VMKKVLVAP

SEQ ID NO: 829192 - protein, 9 aa, Homo Sapiens
EGVIRTASE

SEQ ID NO: 829193 - protein, 9 aa, Homo Sapiens
VTRLLDILE

SEQ ID NO: 829194 - protein, 9 aa, Homo Sapiens
CRRIDITTK

SEQ ID NO: 829195 - protein, 9 aa, Homo Sapiens
QQKVSQAFK

SEQ ID NO: 829196 - protein, 9 aa, Homo Sapiens
LENMGVGIR

SEQ ID NO: 829197 - protein, 9 aa, Homo Sapiens
AQRFCDNII

SEQ ID NO: 829198 - protein, 9 aa, Homo Sapiens
KYGELFPVP

SEQ ID NO: 829199 - protein, 9 aa, Homo Sapiens
FYLNHNLGA

SEQ ID NO: 829200 - protein, 9 aa, Homo Sapiens
ELFSLFSHI

SEQ ID NO: 829201 - protein, 9 aa, Homo Sapiens
GQEIEAILA

SEQ ID NO: 829202 - protein, 9 aa, Homo Sapiens
LLRILCFVL

SEQ ID NO: 829203 - protein, 9 aa, Homo Sapiens
DNHHLSAAY

SEQ ID NO: 829204 - protein, 9 aa, Homo Sapiens
EFLCLWEQF

SEQ ID NO: 829205 - protein, 9 aa, Homo Sapiens
NCWSPVLSG

SEQ ID NO: 829206 - protein, 9 aa, Homo Sapiens
KKLYCSELH

SEQ ID NO: 829207 - protein, 9 aa, Homo Sapiens
HIHYFPSVL

SEQ ID NO: 829208 - protein, 9 aa, Homo Sapiens
SKMNRLFSG

SEQ ID NO: 829209 - protein, 9 aa, Homo Sapiens
FRAWVWAGL

SEQ ID NO: 829210 - protein, 9 aa, Homo Sapiens
GYPRDIHTL

SEQ ID NO: 829211 - protein, 9 aa, Homo Sapiens
ELWLERGAG

SEQ ID NO: 829212 - protein, 9 aa, Homo Sapiens
FNSIFSNMG

SEQ ID NO: 829213 - protein, 9 aa, Homo Sapiens
NAICSMIWG

SEQ ID NO: 829214 - protein, 9 aa, Homo Sapiens
SIILIFAAI

SEQ ID NO: 829215 - protein, 9 aa, Homo Sapiens
DPNKPTYCL

SEQ ID NO: 829216 - protein, 9 aa, Homo Sapiens
YVLSAGFMP

SEQ ID NO: 829217 - protein, 9 aa, Homo Sapiens
RFPNNSIKT

SEQ ID NO: 829218 - protein, 9 aa, Homo Sapiens
RIKNFAEEE

SEQ ID NO: 829219 - protein, 9 aa, Homo Sapiens
QHSYVGSFS

SEQ ID NO: 829220 - protein, 9 aa, Homo Sapiens
VDRPQELKL

SEQ ID NO: 829221 - protein, 9 aa, Homo Sapiens
NGSWGKKVQ

SEQ ID NO: 829222 - protein, 9 aa, Homo Sapiens
QIYGKRSSP

SEQ ID NO: 829223 - protein, 9 aa, Homo Sapiens
YFDFVRLQN

SEQ ID NO: 829224 - protein, 9 aa, Homo Sapiens
FLSAHHDKR

SEQ ID NO: 829225 - protein, 9 aa, Homo Sapiens
LYPNIAERV

SEQ ID NO: 829226 - protein, 9 aa, Homo Sapiens
NENGHFEIS

SEQ ID NO: 829227 - protein, 9 aa, Homo Sapiens
ELINYTDPI

SEQ ID NO: 829228 - protein, 9 aa, Homo Sapiens
YLIILVANV

SEQ ID NO: 829229 - protein, 9 aa, Homo Sapiens
RKFNKRKEQ

SEQ ID NO: 829230 - protein, 9 aa, Homo Sapiens
GSLAGLSAY

SEQ ID NO: 829231 - protein, 9 aa, Homo Sapiens
LPKGACTCW

SEQ ID NO: 829232 - protein, 9 aa, Homo Sapiens
PHAIIRLDL

SEQ ID NO: 829233 - protein, 9 aa, Homo Sapiens
DIEEFENIQ

SEQ ID NO: 829234 - protein, 9 aa, Homo Sapiens
GKQPTSADK

SEQ ID NO: 829235 - protein, 9 aa, Homo Sapiens
FLGRESPEP

SEQ ID NO: 829236 - protein, 9 aa, Homo Sapiens
GKQCNLSDR

SEQ ID NO: 829237 - protein, 9 aa, Homo Sapiens
LWAGPCPPR

SEQ ID NO: 829238 - protein, 9 aa, Homo Sapiens
RACFVWFMN

SEQ ID NO: 829239 - protein, 9 aa, Homo Sapiens
TVAGFIPLL

SEQ ID NO: 829240 - protein, 9 aa, Homo Sapiens
RALEERWSQ

SEQ ID NO: 829241 - protein, 9 aa, Homo Sapiens
PEEQQKVIS

SEQ ID NO: 829242 - protein, 9 aa, Homo Sapiens
NNTKPGQPP

SEQ ID NO: 829243 - protein, 9 aa, Homo Sapiens
IFQEHRGLP

SEQ ID NO: 829244 - protein, 9 aa, Homo Sapiens
DPEHRAGLL

SEQ ID NO: 829245 - protein, 9 aa, Homo Sapiens
VREMLASRI

SEQ ID NO: 829246 - protein, 9 aa, Homo Sapiens
KPACQFEEG

SEQ ID NO: 829247 - protein, 9 aa, Homo Sapiens
GKSFKNISD

SEQ ID NO: 829248 - protein, 9 aa, Homo Sapiens
FKKHNMTAV

SEQ ID NO: 829249 - protein, 9 aa, Homo Sapiens
GIFVDWKYN

SEQ ID NO: 829250 - protein, 9 aa, Homo Sapiens
PPQCLLSGP

SEQ ID NO: 829251 - protein, 9 aa, Homo Sapiens
MTLNYLGFS

SEQ ID NO: 829252 - protein, 9 aa, Homo Sapiens
AIRAAVEQH

SEQ ID NO: 829253 - protein, 9 aa, Homo Sapiens
TYLIRYQWK

SEQ ID NO: 829254 - protein, 9 aa, Homo Sapiens
FPAMAKKIN

SEQ ID NO: 829255 - protein, 9 aa, Homo Sapiens
WVITMMATD

SEQ ID NO: 829256 - protein, 9 aa, Homo Sapiens
FVGVEEVQT

SEQ ID NO: 829257 - protein, 9 aa, Homo Sapiens
LFDIFNSDS

SEQ ID NO: 829258 - protein, 9 aa, Homo Sapiens
MGGPLPADP

SEQ ID NO: 829259 - protein, 9 aa, Homo Sapiens
PQPCRCPAH

SEQ ID NO: 829260 - protein, 9 aa, Homo Sapiens
GQTGHNYLR

SEQ ID NO: 829261 - protein, 9 aa, Homo Sapiens
QAEQKVHRA

SEQ ID NO: 829262 - protein, 9 aa, Homo Sapiens
QGTTIGCIA

SEQ ID NO: 829263 - protein, 9 aa, Homo Sapiens
ETKSTQEGE

SEQ ID NO: 829264 - protein, 9 aa, Homo Sapiens
QYLQQDAKE

SEQ ID NO: 829265 - protein, 9 aa, Homo Sapiens
LGGFQAMDG

SEQ ID NO: 829266 - protein, 9 aa, Homo Sapiens
DRVDSEIER

SEQ ID NO: 829267 - protein, 9 aa, Homo Sapiens
KGHLNAGYN

SEQ ID NO: 829268 - protein, 9 aa, Homo Sapiens
GNNGNMTEL

SEQ ID NO: 829269 - protein, 9 aa, Homo Sapiens
DHLRLHTGE

SEQ ID NO: 829270 - protein, 9 aa, Homo Sapiens
RFPGKSGNS

SEQ ID NO: 829271 - protein, 9 aa, Homo Sapiens
DECIYAIKR

SEQ ID NO: 829272 - protein, 9 aa, Homo Sapiens
TYTSKENCN

SEQ ID NO: 829273 - protein, 9 aa, Homo Sapiens
FILFRPFGP

SEQ ID NO: 829274 - protein, 9 aa, Homo Sapiens
QEDAQPPGL

SEQ ID NO: 829275 - protein, 9 aa, Homo Sapiens
KVDFRTFLS

SEQ ID NO: 829276 - protein, 9 aa, Homo Sapiens
WKMEASYYD

SEQ ID NO: 829277 - protein, 9 aa, Homo Sapiens
VLAGLYNSG

SEQ ID NO: 829278 - protein, 9 aa, Homo Sapiens
KAELPLGAR

SEQ ID NO: 829279 - protein, 9 aa, Homo Sapiens
EEHSRFHEF

SEQ ID NO: 829280 - protein, 9 aa, Homo Sapiens
NTPKELTVE

SEQ ID NO: 829281 - protein, 9 aa, Homo Sapiens
KELCVYHSS

SEQ ID NO: 829282 - protein, 9 aa, Homo Sapiens
KNNTTVLEC

SEQ ID NO: 829283 - protein, 9 aa, Homo Sapiens
EVLGRCVIY

SEQ ID NO: 829284 - protein, 9 aa, Homo Sapiens
DQRRIDTKE

SEQ ID NO: 829285 - protein, 9 aa, Homo Sapiens
EEGAELESV

SEQ ID NO: 829286 - protein, 9 aa, Homo Sapiens
LETGVWCWD

SEQ ID NO: 829287 - protein, 9 aa, Homo Sapiens
YDDVTETVN

SEQ ID NO: 829288 - protein, 9 aa, Homo Sapiens
AKKENSKLT

SEQ ID NO: 829289 - protein, 9 aa, Homo Sapiens
LTINTAIVH

SEQ ID NO: 829290 - protein, 9 aa, Homo Sapiens
GLYLVMNDK

SEQ ID NO: 829291 - protein, 9 aa, Homo Sapiens
DDLSPRNQF

SEQ ID NO: 829292 - protein, 9 aa, Homo Sapiens
KLIMHQRIH

SEQ ID NO: 829293 - protein, 9 aa, Homo Sapiens
KDNSSGYKD

SEQ ID NO: 829294 - protein, 9 aa, Homo Sapiens
RILYVMRLT

SEQ ID NO: 829295 - protein, 9 aa, Homo Sapiens
AIQIIDKSQ

SEQ ID NO: 829296 - protein, 9 aa, Homo Sapiens
YQPQHNVMI

SEQ ID NO: 829297 - protein, 9 aa, Homo Sapiens
GNYEQQQII

SEQ ID NO: 829298 - protein, 9 aa, Homo Sapiens
DKLKEEIGK

SEQ ID NO: 829299 - protein, 9 aa, Homo Sapiens
EVGPVMSKS

SEQ ID NO: 829300 - protein, 9 aa, Homo Sapiens
KLYCQDIRA

SEQ ID NO: 829301 - protein, 9 aa, Homo Sapiens
LSVKKIISY

SEQ ID NO: 829302 - protein, 9 aa, Homo Sapiens
WQQVDKASP

SEQ ID NO: 829303 - protein, 9 aa, Homo Sapiens
TSGEICQLL

SEQ ID NO: 829304 - protein, 9 aa, Homo Sapiens
HYKYNSQIQ

SEQ ID NO: 829305 - protein, 9 aa, Homo Sapiens
KKLRARLTY

SEQ ID NO: 829306 - protein, 9 aa, Homo Sapiens
YQILIDKLS

SEQ ID NO: 829307 - protein, 9 aa, Homo Sapiens
GVVSAQRAF

SEQ ID NO: 829308 - protein, 9 aa, Homo Sapiens
QVKESKVEQ

SEQ ID NO: 829309 - protein, 9 aa, Homo Sapiens
YILEPLILK

SEQ ID NO: 829310 - protein, 9 aa, Homo Sapiens
SRWKCISQA

SEQ ID NO: 829311 - protein, 9 aa, Homo Sapiens
VPTLSTTNM

SEQ ID NO: 829312 - protein, 9 aa, Homo Sapiens
RDALDHFVL

SEQ ID NO: 829313 - protein, 9 aa, Homo Sapiens
LYQTYMTHT

SEQ ID NO: 829314 - protein, 9 aa, Homo Sapiens
EIIHTGEEP

SEQ ID NO: 829315 - protein, 9 aa, Homo Sapiens
PTHTTITAG

SEQ ID NO: 829316 - protein, 9 aa, Homo Sapiens
KNYYLKYTK

SEQ ID NO: 829317 - protein, 9 aa, Homo Sapiens
GRETLYSNA

SEQ ID NO: 829318 - protein, 9 aa, Homo Sapiens
VTDSAYVMC

SEQ ID NO: 829319 - protein, 9 aa, Homo Sapiens
DSATGNWLS

SEQ ID NO: 829320 - protein, 9 aa, Homo Sapiens
SCGNIRITG

SEQ ID NO: 829321 - protein, 9 aa, Homo Sapiens
SEEIEEYVP

SEQ ID NO: 829322 - protein, 9 aa, Homo Sapiens
SPAGKIYLL

SEQ ID NO: 829323 - protein, 9 aa, Homo Sapiens
GSKSDGEEN

SEQ ID NO: 829324 - protein, 9 aa, Homo Sapiens
LDKNTFEFL

SEQ ID NO: 829325 - protein, 9 aa, Homo Sapiens
PEPPIVQPL

SEQ ID NO: 829326 - protein, 9 aa, Homo Sapiens
AIQIIQERN

SEQ ID NO: 829327 - protein, 9 aa, Homo Sapiens
KLICLSIWG

SEQ ID NO: 829328 - protein, 9 aa, Homo Sapiens
ILMTIGGNI

SEQ ID NO: 829329 - protein, 9 aa, Homo Sapiens
GRIYVTGGY

SEQ ID NO: 829330 - protein, 9 aa, Homo Sapiens
AGKYLAELM

SEQ ID NO: 829331 - protein, 9 aa, Homo Sapiens
YSVLFGSLR

SEQ ID NO: 829332 - protein, 9 aa, Homo Sapiens
MLQEICTLK

SEQ ID NO: 829333 - protein, 9 aa, Homo Sapiens
VYAKVKRVG

SEQ ID NO: 829334 - protein, 9 aa, Homo Sapiens
GNFDFTELD

SEQ ID NO: 829335 - protein, 9 aa, Homo Sapiens
YPGLFPSQC

SEQ ID NO: 829336 - protein, 9 aa, Homo Sapiens
KFYFPQCGS

SEQ ID NO: 829337 - protein, 9 aa, Homo Sapiens
CPSCCETTC

SEQ ID NO: 829338 - protein, 9 aa, Homo Sapiens
TNQTGMSHP

SEQ ID NO: 829339 - protein, 9 aa, Homo Sapiens
ALWLQYRYL

SEQ ID NO: 829340 - protein, 9 aa, Homo Sapiens
GAAPGRATE

SEQ ID NO: 829341 - protein, 9 aa, Homo Sapiens
SDTDEKCTL

SEQ ID NO: 829342 - protein, 9 aa, Homo Sapiens
HSDMPEEMC

SEQ ID NO: 829343 - protein, 9 aa, Homo Sapiens
NDPRSKHKF

SEQ ID NO: 829344 - protein, 9 aa, Homo Sapiens
PVLNEHTFC

SEQ ID NO: 829345 - protein, 9 aa, Homo Sapiens
LIQQMESGY

SEQ ID NO: 829346 - protein, 9 aa, Homo Sapiens
VTDTFPNTW

SEQ ID NO: 829347 - protein, 9 aa, Homo Sapiens
INTAIVHMH

SEQ ID NO: 829348 - protein, 9 aa, Homo Sapiens
RHDIQNQLR

SEQ ID NO: 829349 - protein, 9 aa, Homo Sapiens
NFPIDELSF

SEQ ID NO: 829350 - protein, 9 aa, Homo Sapiens
DINEAKLSV

SEQ ID NO: 829351 - protein, 9 aa, Homo Sapiens
TAETVKNRM

SEQ ID NO: 829352 - protein, 9 aa, Homo Sapiens
DITWFQILL

SEQ ID NO: 829353 - protein, 9 aa, Homo Sapiens
YRSSRSPRA

SEQ ID NO: 829354 - protein, 9 aa, Homo Sapiens
NRQMTRKQA

SEQ ID NO: 829355 - protein, 9 aa, Homo Sapiens
LSHPNIIKR

SEQ ID NO: 829356 - protein, 9 aa, Homo Sapiens
DDSQEANGN

SEQ ID NO: 829357 - protein, 9 aa, Homo Sapiens
SLIDYFVFW

SEQ ID NO: 829358 - protein, 9 aa, Homo Sapiens
MGPRMVGMS

SEQ ID NO: 829359 - protein, 9 aa, Homo Sapiens
AKEKNKEED

SEQ ID NO: 829360 - protein, 9 aa, Homo Sapiens
EADVEFTTH

SEQ ID NO: 829361 - protein, 9 aa, Homo Sapiens
QGSAQRLLQ

SEQ ID NO: 829362 - protein, 9 aa, Homo Sapiens
HREQLIQNL

SEQ ID NO: 829363 - protein, 9 aa, Homo Sapiens
LALRLQTLQ

SEQ ID NO: 829364 - protein, 9 aa, Homo Sapiens
AIWNNIFSL

SEQ ID NO: 829365 - protein, 9 aa, Homo Sapiens
DRALALNLL

SEQ ID NO: 829366 - protein, 9 aa, Homo Sapiens
DAQPNPGLL

SEQ ID NO: 829367 - protein, 9 aa, Homo Sapiens
GLGGAMVWG

SEQ ID NO: 829368 - protein, 9 aa, Homo Sapiens
GQLVRNDYL

SEQ ID NO: 829369 - protein, 9 aa, Homo Sapiens
DEAVTIDNA

SEQ ID NO: 829370 - protein, 9 aa, Homo Sapiens
FNSISTSTK

SEQ ID NO: 829371 - protein, 9 aa, Homo Sapiens
FNDNESWYL

SEQ ID NO: 829372 - protein, 9 aa, Homo Sapiens
TKANLNALD

SEQ ID NO: 829373 - protein, 9 aa, Homo Sapiens
KITRYTTEG

SEQ ID NO: 829374 - protein, 9 aa, Homo Sapiens
PKRNKKSTF

SEQ ID NO: 829375 - protein, 9 aa, Homo Sapiens
LASKQSMIN

SEQ ID NO: 829376 - protein, 9 aa, Homo Sapiens
NYPDRARRL

SEQ ID NO: 829377 - protein, 9 aa, Homo Sapiens
RCQCEMVLA

SEQ ID NO: 829378 - protein, 9 aa, Homo Sapiens
VFRSSQEKR

SEQ ID NO: 829379 - protein, 9 aa, Homo Sapiens
FNVQSKKRS

SEQ ID NO: 829380 - protein, 9 aa, Homo Sapiens
LAPSGGEGL

SEQ ID NO: 829381 - protein, 9 aa, Homo Sapiens
TSLQVPEIT

SEQ ID NO: 829382 - protein, 9 aa, Homo Sapiens
GNNSHGQLG

SEQ ID NO: 829383 - protein, 9 aa, Homo Sapiens
QLLRCSDDT

SEQ ID NO: 829384 - protein, 9 aa, Homo Sapiens
EKSTDAVLA

SEQ ID NO: 829385 - protein, 9 aa, Homo Sapiens
RIFMQGNNK

SEQ ID NO: 829386 - protein, 9 aa, Homo Sapiens
YAMELHGFW

SEQ ID NO: 829387 - protein, 9 aa, Homo Sapiens
ETLEDDSNY

SEQ ID NO: 829388 - protein, 9 aa, Homo Sapiens
HSQSELQVL

SEQ ID NO: 829389 - protein, 9 aa, Homo Sapiens
SGNKKDGRF

SEQ ID NO: 829390 - protein, 9 aa, Homo Sapiens
LFHEVQRQI

SEQ ID NO: 829391 - protein, 9 aa, Homo Sapiens
LRAAAYVGD

SEQ ID NO: 829392 - protein, 9 aa, Homo Sapiens
LPDRPTKAP

SEQ ID NO: 829393 - protein, 9 aa, Homo Sapiens
ARCILTAGW

SEQ ID NO: 829394 - protein, 9 aa, Homo Sapiens
KAKGTGVPV

SEQ ID NO: 829395 - protein, 9 aa, Homo Sapiens
PSEKLEQII

SEQ ID NO: 829396 - protein, 9 aa, Homo Sapiens
TANTAFSAS

SEQ ID NO: 829397 - protein, 9 aa, Homo Sapiens
PPLDSRPRS

SEQ ID NO: 829398 - protein, 9 aa, Homo Sapiens
LFSRHQSFT

SEQ ID NO: 829399 - protein, 9 aa, Homo Sapiens
AQVTSHDTS

SEQ ID NO: 829400 - protein, 9 aa, Homo Sapiens
DDSFSAFQE

SEQ ID NO: 829401 - protein, 9 aa, Homo Sapiens
SPEVLSFSR

SEQ ID NO: 829402 - protein, 9 aa, Homo Sapiens
MEDPGQGLS

SEQ ID NO: 829403 - protein, 9 aa, Homo Sapiens
VTAMGVVYA

SEQ ID NO: 829404 - protein, 9 aa, Homo Sapiens
ERYSLTLCQ

SEQ ID NO: 829405 - protein, 9 aa, Homo Sapiens
CTRYTIKTD

SEQ ID NO: 829406 - protein, 9 aa, Homo Sapiens
CYKKCVTQQ

SEQ ID NO: 829407 - protein, 9 aa, Homo Sapiens
KKKKKIKHS

SEQ ID NO: 829408 - protein, 9 aa, Homo Sapiens
ENTQSSLIY

SEQ ID NO: 829409 - protein, 9 aa, Homo Sapiens
PALRESSAP

SEQ ID NO: 829410 - protein, 9 aa, Homo Sapiens
HKCRLCAKV

SEQ ID NO: 829411 - protein, 9 aa, Homo Sapiens
KSERIKNFA

SEQ ID NO: 829412 - protein, 9 aa, Homo Sapiens
LSSIAYSPK

SEQ ID NO: 829413 - protein, 9 aa, Homo Sapiens
TLQITDVRL

SEQ ID NO: 829414 - protein, 9 aa, Homo Sapiens
RHGISSQIS

SEQ ID NO: 829415 - protein, 9 aa, Homo Sapiens
NIFLKRIIP

SEQ ID NO: 829416 - protein, 9 aa, Homo Sapiens
EKYIVYPGI

SEQ ID NO: 829417 - protein, 9 aa, Homo Sapiens
AHLAIHTEN

SEQ ID NO: 829418 - protein, 9 aa, Homo Sapiens
KTQTTSWLQ

SEQ ID NO: 829419 - protein, 9 aa, Homo Sapiens
RASAEESNF

SEQ ID NO: 829420 - protein, 9 aa, Homo Sapiens
LNSECKSET

SEQ ID NO: 829421 - protein, 9 aa, Homo Sapiens
LSAKTWWRG

SEQ ID NO: 829422 - protein, 9 aa, Homo Sapiens
NEEHKKQVS

SEQ ID NO: 829423 - protein, 9 aa, Homo Sapiens
DNFVRGHLR

SEQ ID NO: 829424 - protein, 9 aa, Homo Sapiens
TAETLLQQD

SEQ ID NO: 829425 - protein, 9 aa, Homo Sapiens
KPVKSHLVG

SEQ ID NO: 829426 - protein, 9 aa, Homo Sapiens
KHPALAEIH

SEQ ID NO: 829427 - protein, 9 aa, Homo Sapiens
YKYTSWIPP

SEQ ID NO: 829428 - protein, 9 aa, Homo Sapiens
HEALQTQLE

SEQ ID NO: 829429 - protein, 9 aa, Homo Sapiens
EEMIQTGIY

SEQ ID NO: 829430 - protein, 9 aa, Homo Sapiens
CAGYETTSS

SEQ ID NO: 829431 - protein, 9 aa, Homo Sapiens
SFGKIIRQR

SEQ ID NO: 829432 - protein, 9 aa, Homo Sapiens
QLEFSETDF

SEQ ID NO: 829433 - protein, 9 aa, Homo Sapiens
RDFLRKQMW

SEQ ID NO: 829434 - protein, 9 aa, Homo Sapiens
LNPLIYTLI

SEQ ID NO: 829435 - protein, 9 aa, Homo Sapiens
AVFLSVDDD

SEQ ID NO: 829436 - protein, 9 aa, Homo Sapiens
AIPVANINS

SEQ ID NO: 829437 - protein, 9 aa, Homo Sapiens
MDAELIMFI

SEQ ID NO: 829438 - protein, 9 aa, Homo Sapiens
VPLDPTRSV

SEQ ID NO: 829439 - protein, 9 aa, Homo Sapiens
EPQKQPPWD

SEQ ID NO: 829440 - protein, 9 aa, Homo Sapiens
MPAYRGSYH

SEQ ID NO: 829441 - protein, 9 aa, Homo Sapiens
IHVVYDLSQ

SEQ ID NO: 829442 - protein, 9 aa, Homo Sapiens
VNVTLRQIA

SEQ ID NO: 829443 - protein, 9 aa, Homo Sapiens
MDLAACIKL

SEQ ID NO: 829444 - protein, 9 aa, Homo Sapiens
NTSQLTQCY

SEQ ID NO: 829445 - protein, 9 aa, Homo Sapiens
FLTVKEDRE

SEQ ID NO: 829446 - protein, 9 aa, Homo Sapiens
EDISVIVNN

SEQ ID NO: 829447 - protein, 9 aa, Homo Sapiens
QTLTGYNYY

SEQ ID NO: 829448 - protein, 9 aa, Homo Sapiens
IYNLCNGYT

SEQ ID NO: 829449 - protein, 9 aa, Homo Sapiens
SHCSENCIE

SEQ ID NO: 829450 - protein, 9 aa, Homo Sapiens
YLVTIMGNI

SEQ ID NO: 829451 - protein, 9 aa, Homo Sapiens
WPNITPVPL

SEQ ID NO: 829452 - protein, 9 aa, Homo Sapiens
LSSPAKNLF

SEQ ID NO: 829453 - protein, 9 aa, Homo Sapiens
NVQNNTRVI

SEQ ID NO: 829454 - protein, 9 aa, Homo Sapiens
PVPSHPYGF

SEQ ID NO: 829455 - protein, 9 aa, Homo Sapiens
EAVFGNSWQ

SEQ ID NO: 829456 - protein, 9 aa, Homo Sapiens
SDEFIEKRQ

SEQ ID NO: 829457 - protein, 9 aa, Homo Sapiens
TLDDDDMFF

SEQ ID NO: 829458 - protein, 9 aa, Homo Sapiens
VGVQPVLNE

SEQ ID NO: 829459 - protein, 9 aa, Homo Sapiens
LGRAEYGWL

SEQ ID NO: 829460 - protein, 9 aa, Homo Sapiens
VHKSTQIYL

SEQ ID NO: 829461 - protein, 9 aa, Homo Sapiens
ADQIPLGSV

SEQ ID NO: 829462 - protein, 9 aa, Homo Sapiens
KQFKQWRIK

SEQ ID NO: 829463 - protein, 9 aa, Homo Sapiens
VGEELEMTP

SEQ ID NO: 829464 - protein, 9 aa, Homo Sapiens
LQLYFRDLP

SEQ ID NO: 829465 - protein, 9 aa, Homo Sapiens
LLRPGTPMT

SEQ ID NO: 829466 - protein, 9 aa, Homo Sapiens
LAQGRGSQE

SEQ ID NO: 829467 - protein, 9 aa, Homo Sapiens
KLCFDIEGS

SEQ ID NO: 829468 - protein, 9 aa, Homo Sapiens
NLPINPSMA

SEQ ID NO: 829469 - protein, 9 aa, Homo Sapiens
FSNMGAWTL

SEQ ID NO: 829470 - protein, 9 aa, Homo Sapiens
VRKIDQSEC

SEQ ID NO: 829471 - protein, 9 aa, Homo Sapiens
TYPVGTGRD

SEQ ID NO: 829472 - protein, 9 aa, Homo Sapiens
GFIPLKPTM

SEQ ID NO: 829473 - protein, 9 aa, Homo Sapiens
LTIHLALGG

SEQ ID NO: 829474 - protein, 9 aa, Homo Sapiens
VQLEGDNKM

SEQ ID NO: 829475 - protein, 9 aa, Homo Sapiens
ELVKRDERL

SEQ ID NO: 829476 - protein, 9 aa, Homo Sapiens
CLALSLPFC

SEQ ID NO: 829477 - protein, 9 aa, Homo Sapiens
QEQRMNIDR

SEQ ID NO: 829478 - protein, 9 aa, Homo Sapiens
VLTPMLNTF

SEQ ID NO: 829479 - protein, 9 aa, Homo Sapiens
YTEDIPGDT

SEQ ID NO: 829480 - protein, 9 aa, Homo Sapiens
QDKISLHFQ

SEQ ID NO: 829481 - protein, 9 aa, Homo Sapiens
NTGFLIIVL

SEQ ID NO: 829482 - protein, 9 aa, Homo Sapiens
IKSERIKNF

SEQ ID NO: 829483 - protein, 9 aa, Homo Sapiens
VRSRASIKH

SEQ ID NO: 829484 - protein, 9 aa, Homo Sapiens
SGSLDSLGR

SEQ ID NO: 829485 - protein, 9 aa, Homo Sapiens
WYCRRQNGY

SEQ ID NO: 829486 - protein, 9 aa, Homo Sapiens
ADNFIQHNL

SEQ ID NO: 829487 - protein, 9 aa, Homo Sapiens
SVNKAPLEK

SEQ ID NO: 829488 - protein, 9 aa, Homo Sapiens
YSFAATVVV

SEQ ID NO: 829489 - protein, 9 aa, Homo Sapiens
INEAKLSVF

SEQ ID NO: 829490 - protein, 9 aa, Homo Sapiens
ACVVCGTYF

SEQ ID NO: 829491 - protein, 9 aa, Homo Sapiens
LTDNYQLQI

SEQ ID NO: 829492 - protein, 9 aa, Homo Sapiens
PGDSARDVL

SEQ ID NO: 829493 - protein, 9 aa, Homo Sapiens
IAYMFLLVP

SEQ ID NO: 829494 - protein, 9 aa, Homo Sapiens
YFSQLQKLC

SEQ ID NO: 829495 - protein, 9 aa, Homo Sapiens
HQLLQGLFA

SEQ ID NO: 829496 - protein, 9 aa, Homo Sapiens
LCCDSRAST

SEQ ID NO: 829497 - protein, 9 aa, Homo Sapiens
KKENTKEDK

SEQ ID NO: 829498 - protein, 9 aa, Homo Sapiens
VKTFIDKNF

SEQ ID NO: 829499 - protein, 9 aa, Homo Sapiens
ALGLLEDKL

SEQ ID NO: 829500 - protein, 9 aa, Homo Sapiens
PTSADKSVA

SEQ ID NO: 829501 - protein, 9 aa, Homo Sapiens
KATTAFPFL

SEQ ID NO: 829502 - protein, 9 aa, Homo Sapiens
RQNSWTQKI

SEQ ID NO: 829503 - protein, 9 aa, Homo Sapiens
KFIKIDQAW

SEQ ID NO: 829504 - protein, 9 aa, Homo Sapiens
MKMRYKHID

SEQ ID NO: 829505 - protein, 9 aa, Homo Sapiens
EVINGKTHT

SEQ ID NO: 829506 - protein, 9 aa, Homo Sapiens
SKSKEEEEE

SEQ ID NO: 829507 - protein, 9 aa, Homo Sapiens
EAQVQTIQI

SEQ ID NO: 829508 - protein, 9 aa, Homo Sapiens
RIKKKSRMT

SEQ ID NO: 829509 - protein, 9 aa, Homo Sapiens
SYLRKNSSA

SEQ ID NO: 829510 - protein, 9 aa, Homo Sapiens
DSPGTPLLD

SEQ ID NO: 829511 - protein, 9 aa, Homo Sapiens
QNDEYENLF

SEQ ID NO: 829512 - protein, 9 aa, Homo Sapiens
ALTQVVSKL

SEQ ID NO: 829513 - protein, 9 aa, Homo Sapiens
ETVQRIILE

SEQ ID NO: 829514 - protein, 9 aa, Homo Sapiens
VTKEKTSAI

SEQ ID NO: 829515 - protein, 9 aa, Homo Sapiens
SYLILRNNS

SEQ ID NO: 829516 - protein, 9 aa, Homo Sapiens
LTLSILLTP

SEQ ID NO: 829517 - protein, 9 aa, Homo Sapiens
FSSTINTHK

SEQ ID NO: 829518 - protein, 9 aa, Homo Sapiens
FGLNISFVD

SEQ ID NO: 829519 - protein, 9 aa, Homo Sapiens
AQIGSYAPA

SEQ ID NO: 829520 - protein, 9 aa, Homo Sapiens
HVLVHDVAL

SEQ ID NO: 829521 - protein, 9 aa, Homo Sapiens
IFWRDQGKV

SEQ ID NO: 829522 - protein, 9 aa, Homo Sapiens
DMSSLSYLA

SEQ ID NO: 829523 - protein, 9 aa, Homo Sapiens
HRLRRTLWA

SEQ ID NO: 829524 - protein, 9 aa, Homo Sapiens
KVDAQSLAG

SEQ ID NO: 829525 - protein, 9 aa, Homo Sapiens
CIGETRFSL

SEQ ID NO: 829526 - protein, 9 aa, Homo Sapiens
WGGCSKDIE

SEQ ID NO: 829527 - protein, 9 aa, Homo Sapiens
VRLDLLSCL

SEQ ID NO: 829528 - protein, 9 aa, Homo Sapiens
ILTSLVAAP

SEQ ID NO: 829529 - protein, 9 aa, Homo Sapiens
QIIQYDKCY

SEQ ID NO: 829530 - protein, 9 aa, Homo Sapiens
YFINYVQYE

SEQ ID NO: 829531 - protein, 9 aa, Homo Sapiens
GKWLNTWKK

SEQ ID NO: 829532 - protein, 9 aa, Homo Sapiens
RTVERIEEP

SEQ ID NO: 829533 - protein, 9 aa, Homo Sapiens
QSVSSQSSS

SEQ ID NO: 829534 - protein, 9 aa, Homo Sapiens
VARPKLWKS

SEQ ID NO: 829535 - protein, 9 aa, Homo Sapiens
RVESGWIRY

SEQ ID NO: 829536 - protein, 9 aa, Homo Sapiens
VRNIRAGYE

SEQ ID NO: 829537 - protein, 9 aa, Homo Sapiens
IACDNVEGL

SEQ ID NO: 829538 - protein, 9 aa, Homo Sapiens
IRRRSKNKI

SEQ ID NO: 829539 - protein, 9 aa, Homo Sapiens
KDKRDPLQQ

SEQ ID NO: 829540 - protein, 9 aa, Homo Sapiens
LLKILRKYK

SEQ ID NO: 829541 - protein, 9 aa, Homo Sapiens
TVPPTPQPL

SEQ ID NO: 829542 - protein, 9 aa, Homo Sapiens
EDPNDEGAV

SEQ ID NO: 829543 - protein, 9 aa, Homo Sapiens
KEKERLANT

SEQ ID NO: 829544 - protein, 9 aa, Homo Sapiens
DDPESTKIS

SEQ ID NO: 829545 - protein, 9 aa, Homo Sapiens
GKHNGTVVQ

SEQ ID NO: 829546 - protein, 9 aa, Homo Sapiens
LTTSFFRDS

SEQ ID NO: 829547 - protein, 9 aa, Homo Sapiens
AAATSMFET

SEQ ID NO: 829548 - protein, 9 aa, Homo Sapiens
AKVYKSHKR

SEQ ID NO: 829549 - protein, 9 aa, Homo Sapiens
KQEERPLIP

SEQ ID NO: 829550 - protein, 9 aa, Homo Sapiens
SLLLRVEPY

SEQ ID NO: 829551 - protein, 9 aa, Homo Sapiens
IHTQNKIAI

SEQ ID NO: 829552 - protein, 9 aa, Homo Sapiens
SYAPWLNLH

SEQ ID NO: 829553 - protein, 9 aa, Homo Sapiens
DRDYHIFYQ

SEQ ID NO: 829554 - protein, 9 aa, Homo Sapiens
FAAGERTLQ

SEQ ID NO: 829555 - protein, 9 aa, Homo Sapiens
EHSHFYLKK

SEQ ID NO: 829556 - protein, 9 aa, Homo Sapiens
FIKEIVKSH

SEQ ID NO: 829557 - protein, 9 aa, Homo Sapiens
HPNIIKRKE

SEQ ID NO: 829558 - protein, 9 aa, Homo Sapiens
RMKLHWQFF

SEQ ID NO: 829559 - protein, 9 aa, Homo Sapiens
TLPPGLPQN

SEQ ID NO: 829560 - protein, 9 aa, Homo Sapiens
FLIGILYIA

SEQ ID NO: 829561 - protein, 9 aa, Homo Sapiens
YGGCGFPPL

SEQ ID NO: 829562 - protein, 9 aa, Homo Sapiens
GDIDTKPSN

SEQ ID NO: 829563 - protein, 9 aa, Homo Sapiens
TIEELSWLQ

SEQ ID NO: 829564 - protein, 9 aa, Homo Sapiens
AKWSYFPSE

SEQ ID NO: 829565 - protein, 9 aa, Homo Sapiens
KGKALLHPL

SEQ ID NO: 829566 - protein, 9 aa, Homo Sapiens
TCYLAPQNL

SEQ ID NO: 829567 - protein, 9 aa, Homo Sapiens
VVSAQRAFD

SEQ ID NO: 829568 - protein, 9 aa, Homo Sapiens
KDHSVFLLT

SEQ ID NO: 829569 - protein, 9 aa, Homo Sapiens
STDFDTIHS

SEQ ID NO: 829570 - protein, 9 aa, Homo Sapiens
ESNTSRKSL

SEQ ID NO: 829571 - protein, 9 aa, Homo Sapiens
NIQHLKGLN

SEQ ID NO: 829572 - protein, 9 aa, Homo Sapiens
LMKMPVAYQ

SEQ ID NO: 829573 - protein, 9 aa, Homo Sapiens
MLSTTPNHA

SEQ ID NO: 829574 - protein, 9 aa, Homo Sapiens
TLTSFGGQN

SEQ ID NO: 829575 - protein, 9 aa, Homo Sapiens
GLVGFGIGI

SEQ ID NO: 829576 - protein, 9 aa, Homo Sapiens
TGDKLYPCN

SEQ ID NO: 829577 - protein, 9 aa, Homo Sapiens
MEYLGRPIP

SEQ ID NO: 829578 - protein, 9 aa, Homo Sapiens
GVVMVSLFM

SEQ ID NO: 829579 - protein, 9 aa, Homo Sapiens
IEMQLQAIQ

SEQ ID NO: 829580 - protein, 9 aa, Homo Sapiens
AIVETIRVS

SEQ ID NO: 829581 - protein, 9 aa, Homo Sapiens
RHKTVIQAC

SEQ ID NO: 829582 - protein, 9 aa, Homo Sapiens
ALSPFLWKK

SEQ ID NO: 829583 - protein, 9 aa, Homo Sapiens
LRGDNNPLR

SEQ ID NO: 829584 - protein, 9 aa, Homo Sapiens
TTCALWDIK

SEQ ID NO: 829585 - protein, 9 aa, Homo Sapiens
YMGENLPVE

SEQ ID NO: 829586 - protein, 9 aa, Homo Sapiens
ATSMVSGFS

SEQ ID NO: 829587 - protein, 9 aa, Homo Sapiens
ATLGEEELT

SEQ ID NO: 829588 - protein, 9 aa, Homo Sapiens
CAPSPQGLS

SEQ ID NO: 829589 - protein, 9 aa, Homo Sapiens
TALEVRHFS

SEQ ID NO: 829590 - protein, 9 aa, Homo Sapiens
LTRVSQIIC

SEQ ID NO: 829591 - protein, 9 aa, Homo Sapiens
KGPEMEMDA

SEQ ID NO: 829592 - protein, 9 aa, Homo Sapiens
SAEIFLKLI

SEQ ID NO: 829593 - protein, 9 aa, Homo Sapiens
IPPDWVEAA

SEQ ID NO: 829594 - protein, 9 aa, Homo Sapiens
KAPRDKYWL

SEQ ID NO: 829595 - protein, 9 aa, Homo Sapiens
VQAIIVNNH

SEQ ID NO: 829596 - protein, 9 aa, Homo Sapiens
ESMSASLNS

SEQ ID NO: 829597 - protein, 9 aa, Homo Sapiens
DWEFGRETN

SEQ ID NO: 829598 - protein, 9 aa, Homo Sapiens
RVICTCCSR

SEQ ID NO: 829599 - protein, 9 aa, Homo Sapiens
INLKEYADN

SEQ ID NO: 829600 - protein, 9 aa, Homo Sapiens
QALLSETRD

SEQ ID NO: 829601 - protein, 9 aa, Homo Sapiens
QAFQLWLKK

SEQ ID NO: 829602 - protein, 9 aa, Homo Sapiens
RKEINQYGE

SEQ ID NO: 829603 - protein, 9 aa, Homo Sapiens
EKVKHEIIN

SEQ ID NO: 829604 - protein, 9 aa, Homo Sapiens
ILMTTKNYC

SEQ ID NO: 829605 - protein, 9 aa, Homo Sapiens
YLRTSTGRT

SEQ ID NO: 829606 - protein, 9 aa, Homo Sapiens
AACLQYLKM

SEQ ID NO: 829607 - protein, 9 aa, Homo Sapiens
IELALTSLF

SEQ ID NO: 829608 - protein, 9 aa, Homo Sapiens
IKSHLYWLD

SEQ ID NO: 829609 - protein, 9 aa, Homo Sapiens
LQVWLQLFK

SEQ ID NO: 829610 - protein, 9 aa, Homo Sapiens
AEDENREEE

SEQ ID NO: 829611 - protein, 9 aa, Homo Sapiens
KKMKGGERR

SEQ ID NO: 829612 - protein, 9 aa, Homo Sapiens
KPIHLTLKV

SEQ ID NO: 829613 - protein, 9 aa, Homo Sapiens
AESLFYKGV

SEQ ID NO: 829614 - protein, 9 aa, Homo Sapiens
AHSSGSEDI

SEQ ID NO: 829615 - protein, 9 aa, Homo Sapiens
FSMVCLSPL

SEQ ID NO: 829616 - protein, 9 aa, Homo Sapiens
HNSSGRDGK

SEQ ID NO: 829617 - protein, 9 aa, Homo Sapiens
TIDYSHFHK

SEQ ID NO: 829618 - protein, 9 aa, Homo Sapiens
DEGEHRMTT

SEQ ID NO: 829619 - protein, 9 aa, Homo Sapiens
PEKGSHMPE

SEQ ID NO: 829620 - protein, 9 aa, Homo Sapiens
SPLTFLSAP

SEQ ID NO: 829621 - protein, 9 aa, Homo Sapiens
TEEQRPNKS

SEQ ID NO: 829622 - protein, 9 aa, Homo Sapiens
AHQIIHAVE

SEQ ID NO: 829623 - protein, 9 aa, Homo Sapiens
ASPYFCQNI

SEQ ID NO: 829624 - protein, 9 aa, Homo Sapiens
AYFRWDFKK

SEQ ID NO: 829625 - protein, 9 aa, Homo Sapiens
EMAIYIIPP

SEQ ID NO: 829626 - protein, 9 aa, Homo Sapiens
ETALEKNIL

SEQ ID NO: 829627 - protein, 9 aa, Homo Sapiens
VTSTDFAYS

SEQ ID NO: 829628 - protein, 9 aa, Homo Sapiens
VEYSDLEDD

SEQ ID NO: 829629 - protein, 9 aa, Homo Sapiens
EQNLRENKI

SEQ ID NO: 829630 - protein, 9 aa, Homo Sapiens
ANRTVLDNL

SEQ ID NO: 829631 - protein, 9 aa, Homo Sapiens
RSKQLLGEV

SEQ ID NO: 829632 - protein, 9 aa, Homo Sapiens
GALQGCDCD

SEQ ID NO: 829633 - protein, 9 aa, Homo Sapiens
YLICLRKKD

SEQ ID NO: 829634 - protein, 9 aa, Homo Sapiens
EIIMRMLKL

SEQ ID NO: 829635 - protein, 9 aa, Homo Sapiens
LLCRKPALI

SEQ ID NO: 829636 - protein, 9 aa, Homo Sapiens
PQSLDLLGL

SEQ ID NO: 829637 - protein, 9 aa, Homo Sapiens
RIIRTYWDA

SEQ ID NO: 829638 - protein, 9 aa, Homo Sapiens
LDKITRKPV

SEQ ID NO: 829639 - protein, 9 aa, Homo Sapiens
GVTGSGLAG

SEQ ID NO: 829640 - protein, 9 aa, Homo Sapiens
AFISFTNVQ

SEQ ID NO: 829641 - protein, 9 aa, Homo Sapiens
EKCKQRRIR

SEQ ID NO: 829642 - protein, 9 aa, Homo Sapiens
KMTAVIFSD

SEQ ID NO: 829643 - protein, 9 aa, Homo Sapiens
TCSLVRPKV

SEQ ID NO: 829644 - protein, 9 aa, Homo Sapiens
NPQIESSSL

SEQ ID NO: 829645 - protein, 9 aa, Homo Sapiens
NNSKDIQKL

SEQ ID NO: 829646 - protein, 9 aa, Homo Sapiens
TALRVSSQA

SEQ ID NO: 829647 - protein, 9 aa, Homo Sapiens
SFGVCRLIG

SEQ ID NO: 829648 - protein, 9 aa, Homo Sapiens
VESSQDGDN

SEQ ID NO: 829649 - protein, 9 aa, Homo Sapiens
AVALASAHH

SEQ ID NO: 829650 - protein, 9 aa, Homo Sapiens
LQTQLEGAQ

SEQ ID NO: 829651 - protein, 9 aa, Homo Sapiens
SRPDDGFPS

SEQ ID NO: 829652 - protein, 9 aa, Homo Sapiens
SEENEMQPH

SEQ ID NO: 829653 - protein, 9 aa, Homo Sapiens
LFQRLIHRE

SEQ ID NO: 829654 - protein, 9 aa, Homo Sapiens
HLRRYTYNY

SEQ ID NO: 829655 - protein, 9 aa, Homo Sapiens
EDDNILPLN

SEQ ID NO: 829656 - protein, 9 aa, Homo Sapiens
HTDMSSLSY

SEQ ID NO: 829657 - protein, 9 aa, Homo Sapiens
TEKSTKHPE

SEQ ID NO: 829658 - protein, 9 aa, Homo Sapiens
YADIFAGAI

SEQ ID NO: 829659 - protein, 9 aa, Homo Sapiens
EVYGLLTLG

SEQ ID NO: 829660 - protein, 9 aa, Homo Sapiens
QALYQNNGL

SEQ ID NO: 829661 - protein, 9 aa, Homo Sapiens
ACMSACQHM

SEQ ID NO: 829662 - protein, 9 aa, Homo Sapiens
FSMYDQRPS

SEQ ID NO: 829663 - protein, 9 aa, Homo Sapiens
DRRFNDELD

SEQ ID NO: 829664 - protein, 9 aa, Homo Sapiens
EEEVWEVLT

SEQ ID NO: 829665 - protein, 9 aa, Homo Sapiens
AMLIERSSN

SEQ ID NO: 829666 - protein, 9 aa, Homo Sapiens
WALHILASL

SEQ ID NO: 829667 - protein, 9 aa, Homo Sapiens
LVMAGAPNS

SEQ ID NO: 829668 - protein, 9 aa, Homo Sapiens
SYVPREIRW

SEQ ID NO: 829669 - protein, 9 aa, Homo Sapiens
GEAFRTKEN

SEQ ID NO: 829670 - protein, 9 aa, Homo Sapiens
SQNSLKHRR

SEQ ID NO: 829671 - protein, 9 aa, Homo Sapiens
TGPAPVIPP

SEQ ID NO: 829672 - protein, 9 aa, Homo Sapiens
TAFSASEIG

SEQ ID NO: 829673 - protein, 9 aa, Homo Sapiens
IREEECSPV

SEQ ID NO: 829674 - protein, 9 aa, Homo Sapiens
KQLQIVHQP

SEQ ID NO: 829675 - protein, 9 aa, Homo Sapiens
IPAEKVCLA

SEQ ID NO: 829676 - protein, 9 aa, Homo Sapiens
LDSEDSELE

SEQ ID NO: 829677 - protein, 9 aa, Homo Sapiens
PELCNHSES

SEQ ID NO: 829678 - protein, 9 aa, Homo Sapiens
CHTIYECLT

SEQ ID NO: 829679 - protein, 9 aa, Homo Sapiens
KDDCDKTGI

SEQ ID NO: 829680 - protein, 9 aa, Homo Sapiens
DPVSNTPAL

SEQ ID NO: 829681 - protein, 9 aa, Homo Sapiens
NFDIDRGRQ

SEQ ID NO: 829682 - protein, 9 aa, Homo Sapiens
EHTEFVLVR

SEQ ID NO: 829683 - protein, 9 aa, Homo Sapiens
NKKCIAVNI

SEQ ID NO: 829684 - protein, 9 aa, Homo Sapiens
KSIDLGYAK

SEQ ID NO: 829685 - protein, 9 aa, Homo Sapiens
TKGEFILLG

SEQ ID NO: 829686 - protein, 9 aa, Homo Sapiens
NIAGRKAVK

SEQ ID NO: 829687 - protein, 9 aa, Homo Sapiens
VTTAGISSS

SEQ ID NO: 829688 - protein, 9 aa, Homo Sapiens
RFLQNNSSK

SEQ ID NO: 829689 - protein, 9 aa, Homo Sapiens
YWDAGFKEG

SEQ ID NO: 829690 - protein, 9 aa, Homo Sapiens
DILIKATYN

SEQ ID NO: 829691 - protein, 9 aa, Homo Sapiens
FTCGIGNDY

SEQ ID NO: 829692 - protein, 9 aa, Homo Sapiens
ENDFLEADA

SEQ ID NO: 829693 - protein, 9 aa, Homo Sapiens
IQGKDLQLL

SEQ ID NO: 829694 - protein, 9 aa, Homo Sapiens
DNLKIKNTR

SEQ ID NO: 829695 - protein, 9 aa, Homo Sapiens
VSSIGYRAL

SEQ ID NO: 829696 - protein, 9 aa, Homo Sapiens
KEFGFIKLE

SEQ ID NO: 829697 - protein, 9 aa, Homo Sapiens
PFLNQLEPD

SEQ ID NO: 829698 - protein, 9 aa, Homo Sapiens
QTQQAQDQQ

SEQ ID NO: 829699 - protein, 9 aa, Homo Sapiens
DGHGRLLRR

SEQ ID NO: 829700 - protein, 9 aa, Homo Sapiens
ETKLEAIAR

SEQ ID NO: 829701 - protein, 9 aa, Homo Sapiens
AHREKKEST

SEQ ID NO: 829702 - protein, 9 aa, Homo Sapiens
KIIRQRFPQ

SEQ ID NO: 829703 - protein, 9 aa, Homo Sapiens
SFSKYDSVI

SEQ ID NO: 829704 - protein, 9 aa, Homo Sapiens
YRKLKVFLG

SEQ ID NO: 829705 - protein, 9 aa, Homo Sapiens
LMQTGDNLQ

SEQ ID NO: 829706 - protein, 9 aa, Homo Sapiens
SEYVKRKDP

SEQ ID NO: 829707 - protein, 9 aa, Homo Sapiens
FNYFGAENL

SEQ ID NO: 829708 - protein, 9 aa, Homo Sapiens
LLLCPPIIN

SEQ ID NO: 829709 - protein, 9 aa, Homo Sapiens
EQGSYDADT

SEQ ID NO: 829710 - protein, 9 aa, Homo Sapiens
GRKRGICGC

SEQ ID NO: 829711 - protein, 9 aa, Homo Sapiens
HKRVNTGEK

SEQ ID NO: 829712 - protein, 9 aa, Homo Sapiens
TKDNRWVPV

SEQ ID NO: 829713 - protein, 9 aa, Homo Sapiens
KILQKDIWD

SEQ ID NO: 829714 - protein, 9 aa, Homo Sapiens
LNKLQKLEL

SEQ ID NO: 829715 - protein, 9 aa, Homo Sapiens
VQEREVPIS

SEQ ID NO: 829716 - protein, 9 aa, Homo Sapiens
ERHMGTAVG

SEQ ID NO: 829717 - protein, 9 aa, Homo Sapiens
SADVDKLAD

SEQ ID NO: 829718 - protein, 9 aa, Homo Sapiens
ALSKYDATR

SEQ ID NO: 829719 - protein, 9 aa, Homo Sapiens
NMDCSWKIT

SEQ ID NO: 829720 - protein, 9 aa, Homo Sapiens
ERVGTHSEK

SEQ ID NO: 829721 - protein, 9 aa, Homo Sapiens
LDSMKAKIT

SEQ ID NO: 829722 - protein, 9 aa, Homo Sapiens
RYGNLHSHD

SEQ ID NO: 829723 - protein, 9 aa, Homo Sapiens
GQRGYVVLL

SEQ ID NO: 829724 - protein, 9 aa, Homo Sapiens
RNQLRYINN

SEQ ID NO: 829725 - protein, 9 aa, Homo Sapiens
GYRGSSEAG

SEQ ID NO: 829726 - protein, 9 aa, Homo Sapiens
YVGREKTLG

SEQ ID NO: 829727 - protein, 9 aa, Homo Sapiens
DMIGPENTL

SEQ ID NO: 829728 - protein, 9 aa, Homo Sapiens
KTYIGPCGG

SEQ ID NO: 829729 - protein, 9 aa, Homo Sapiens
RSRPQERVI

SEQ ID NO: 829730 - protein, 9 aa, Homo Sapiens
DSVINHQRV

SEQ ID NO: 829731 - protein, 9 aa, Homo Sapiens
PKRKKRKYI

SEQ ID NO: 829732 - protein, 9 aa, Homo Sapiens
VVKKPKSMQ

SEQ ID NO: 829733 - protein, 9 aa, Homo Sapiens
PDHKETATT

SEQ ID NO: 829734 - protein, 9 aa, Homo Sapiens
SPLHYAACF

SEQ ID NO: 829735 - protein, 9 aa, Homo Sapiens
LERLALKLQ

SEQ ID NO: 829736 - protein, 9 aa, Homo Sapiens
DWPPPWGIP

SEQ ID NO: 829737 - protein, 9 aa, Homo Sapiens
EINNMWAAF

SEQ ID NO: 829738 - protein, 9 aa, Homo Sapiens
AWLSYCLLK

SEQ ID NO: 829739 - protein, 9 aa, Homo Sapiens
TAVEFHQEQ

SEQ ID NO: 829740 - protein, 9 aa, Homo Sapiens
DKSFQLPAF

SEQ ID NO: 829741 - protein, 9 aa, Homo Sapiens
PNNSPKKGG

SEQ ID NO: 829742 - protein, 9 aa, Homo Sapiens
CSQRKPQAG

SEQ ID NO: 829743 - protein, 9 aa, Homo Sapiens
QAFVVYFDN

SEQ ID NO: 829744 - protein, 9 aa, Homo Sapiens
HEKCKQRRI

SEQ ID NO: 829745 - protein, 9 aa, Homo Sapiens
TNKLSARDH

SEQ ID NO: 829746 - protein, 9 aa, Homo Sapiens
PRPNVCLPA

SEQ ID NO: 829747 - protein, 9 aa, Homo Sapiens
YKHKGDLEE

SEQ ID NO: 829748 - protein, 9 aa, Homo Sapiens
EGFENESKI

SEQ ID NO: 829749 - protein, 9 aa, Homo Sapiens
VVILLFVPC

SEQ ID NO: 829750 - protein, 9 aa, Homo Sapiens
ALKTIDIRE

SEQ ID NO: 829751 - protein, 9 aa, Homo Sapiens
LVNDLSKLA

SEQ ID NO: 829752 - protein, 9 aa, Homo Sapiens
DKCVKAFHT

SEQ ID NO: 829753 - protein, 9 aa, Homo Sapiens
TYEVLSLLE

SEQ ID NO: 829754 - protein, 9 aa, Homo Sapiens
VALVGVMPH

SEQ ID NO: 829755 - protein, 9 aa, Homo Sapiens
QLATKDTPI

SEQ ID NO: 829756 - protein, 9 aa, Homo Sapiens
NAIFDEDHD

SEQ ID NO: 829757 - protein, 9 aa, Homo Sapiens
AVFGLGGAG

SEQ ID NO: 829758 - protein, 9 aa, Homo Sapiens
LLEHYLPWP

SEQ ID NO: 829759 - protein, 9 aa, Homo Sapiens
TYGEDNDEQ

SEQ ID NO: 829760 - protein, 9 aa, Homo Sapiens
LYSCKYCNF

SEQ ID NO: 829761 - protein, 9 aa, Homo Sapiens
LLLPLIDSF

SEQ ID NO: 829762 - protein, 9 aa, Homo Sapiens
PHQKEKCIK

SEQ ID NO: 829763 - protein, 9 aa, Homo Sapiens
NGLLHCLTT

SEQ ID NO: 829764 - protein, 9 aa, Homo Sapiens
LCEQDKLPG

SEQ ID NO: 829765 - protein, 9 aa, Homo Sapiens
KLMTPYIAH

SEQ ID NO: 829766 - protein, 9 aa, Homo Sapiens
QQAHQIIRD

SEQ ID NO: 829767 - protein, 9 aa, Homo Sapiens
KKLDRNYLN

SEQ ID NO: 829768 - protein, 9 aa, Homo Sapiens
TVGMSTVPE

SEQ ID NO: 829769 - protein, 9 aa, Homo Sapiens
VILGITDNL

SEQ ID NO: 829770 - protein, 9 aa, Homo Sapiens
LINHQIIHT

SEQ ID NO: 829771 - protein, 9 aa, Homo Sapiens
NGRGLALLR

SEQ ID NO: 829772 - protein, 9 aa, Homo Sapiens
KHPGGKHKV

SEQ ID NO: 829773 - protein, 9 aa, Homo Sapiens
AGVLLGISS

SEQ ID NO: 829774 - protein, 9 aa, Homo Sapiens
LINNLTIED

SEQ ID NO: 829775 - protein, 9 aa, Homo Sapiens
EGAEKIKTK

SEQ ID NO: 829776 - protein, 9 aa, Homo Sapiens
GLTLAKLEQ

SEQ ID NO: 829777 - protein, 9 aa, Homo Sapiens
EGIELHSFE

SEQ ID NO: 829778 - protein, 9 aa, Homo Sapiens
DSKKGDVWN

SEQ ID NO: 829779 - protein, 9 aa, Homo Sapiens
PRAKIFWRD

SEQ ID NO: 829780 - protein, 9 aa, Homo Sapiens
PDVLLGAKL

SEQ ID NO: 829781 - protein, 9 aa, Homo Sapiens
QELRISRGF

SEQ ID NO: 829782 - protein, 9 aa, Homo Sapiens
NGILPAWCH

SEQ ID NO: 829783 - protein, 9 aa, Homo Sapiens
GAIDFREFI

SEQ ID NO: 829784 - protein, 9 aa, Homo Sapiens
ETAGDSEDK

SEQ ID NO: 829785 - protein, 9 aa, Homo Sapiens
PKMLINFLS

SEQ ID NO: 829786 - protein, 9 aa, Homo Sapiens
YFTVTAVDG

SEQ ID NO: 829787 - protein, 9 aa, Homo Sapiens
YLMKLSAAN

SEQ ID NO: 829788 - protein, 9 aa, Homo Sapiens
ILGGNKESF

SEQ ID NO: 829789 - protein, 9 aa, Homo Sapiens
NCVDFANVQ

SEQ ID NO: 829790 - protein, 9 aa, Homo Sapiens
GKYITNKLY

SEQ ID NO: 829791 - protein, 9 aa, Homo Sapiens
PTQMSFIFR

SEQ ID NO: 829792 - protein, 9 aa, Homo Sapiens
LNSRKLFLG

SEQ ID NO: 829793 - protein, 9 aa, Homo Sapiens
QSLLLLPAL

SEQ ID NO: 829794 - protein, 9 aa, Homo Sapiens
EFVAPDFLD

SEQ ID NO: 829795 - protein, 9 aa, Homo Sapiens
VTSYSSVQH

SEQ ID NO: 829796 - protein, 9 aa, Homo Sapiens
IKAGDTEDN

SEQ ID NO: 829797 - protein, 9 aa, Homo Sapiens
TELQQKFID

SEQ ID NO: 829798 - protein, 9 aa, Homo Sapiens
ANSFTAQFN

SEQ ID NO: 829799 - protein, 9 aa, Homo Sapiens
HHCSFSKHH

SEQ ID NO: 829800 - protein, 9 aa, Homo Sapiens
MVMFKKIKY

SEQ ID NO: 829801 - protein, 9 aa, Homo Sapiens
FLTHFLRKE

SEQ ID NO: 829802 - protein, 9 aa, Homo Sapiens
IRKYSHLSD

SEQ ID NO: 829803 - protein, 9 aa, Homo Sapiens
SKYHGYPYR

SEQ ID NO: 829804 - protein, 9 aa, Homo Sapiens
QSLPKKVYL

SEQ ID NO: 829805 - protein, 9 aa, Homo Sapiens
DNSYQCKDC

SEQ ID NO: 829806 - protein, 9 aa, Homo Sapiens
MEEAKDNFK

SEQ ID NO: 829807 - protein, 9 aa, Homo Sapiens
IPQTEEKPF

SEQ ID NO: 829808 - protein, 9 aa, Homo Sapiens
HCGVCFGAG

SEQ ID NO: 829809 - protein, 9 aa, Homo Sapiens
WNNIFSLNL

SEQ ID NO: 829810 - protein, 9 aa, Homo Sapiens
AADFDDRRG

SEQ ID NO: 829811 - protein, 9 aa, Homo Sapiens
QKRINSAVK

SEQ ID NO: 829812 - protein, 9 aa, Homo Sapiens
FSQRGRCHV

SEQ ID NO: 829813 - protein, 9 aa, Homo Sapiens
LSMSQGAVV

SEQ ID NO: 829814 - protein, 9 aa, Homo Sapiens
VDDGIDLNQ

SEQ ID NO: 829815 - protein, 9 aa, Homo Sapiens
VLTLLTNTG

SEQ ID NO: 829816 - protein, 9 aa, Homo Sapiens
CKSSPPESA

SEQ ID NO: 829817 - protein, 9 aa, Homo Sapiens
NVAHNRIQS

SEQ ID NO: 829818 - protein, 9 aa, Homo Sapiens
RQAEYVIRH

SEQ ID NO: 829819 - protein, 9 aa, Homo Sapiens
HDLIKAALD

SEQ ID NO: 829820 - protein, 9 aa, Homo Sapiens
NQVWGKVFP

SEQ ID NO: 829821 - protein, 9 aa, Homo Sapiens
KCKPNRTPS

SEQ ID NO: 829822 - protein, 9 aa, Homo Sapiens
ATITNIGIQ

SEQ ID NO: 829823 - protein, 9 aa, Homo Sapiens
NMILMTNHL

SEQ ID NO: 829824 - protein, 9 aa, Homo Sapiens
WINVFLLSA

SEQ ID NO: 829825 - protein, 9 aa, Homo Sapiens
QVQKDIFIL

SEQ ID NO: 829826 - protein, 9 aa, Homo Sapiens
GPTVVSHHL

SEQ ID NO: 829827 - protein, 9 aa, Homo Sapiens
NYWRGLFAA

SEQ ID NO: 829828 - protein, 9 aa, Homo Sapiens
IQKHSTSNH

SEQ ID NO: 829829 - protein, 9 aa, Homo Sapiens
ATIAWMVYF

SEQ ID NO: 829830 - protein, 9 aa, Homo Sapiens
QIAHGADAV

SEQ ID NO: 829831 - protein, 9 aa, Homo Sapiens
QHLFYIHVD

SEQ ID NO: 829832 - protein, 9 aa, Homo Sapiens
IKNGSKTVI

SEQ ID NO: 829833 - protein, 9 aa, Homo Sapiens
NSPLVPQLT

SEQ ID NO: 829834 - protein, 9 aa, Homo Sapiens
PIIQPKTCQ

SEQ ID NO: 829835 - protein, 9 aa, Homo Sapiens
PDETIQSKK

SEQ ID NO: 829836 - protein, 9 aa, Homo Sapiens
VSCWAKGLG

SEQ ID NO: 829837 - protein, 9 aa, Homo Sapiens
QINRIFHER

SEQ ID NO: 829838 - protein, 9 aa, Homo Sapiens
CDDPLFLDL

SEQ ID NO: 829839 - protein, 9 aa, Homo Sapiens
VRYELPHFF

SEQ ID NO: 829840 - protein, 9 aa, Homo Sapiens
PVGTAAIAH

SEQ ID NO: 829841 - protein, 9 aa, Homo Sapiens
RKFPAIQNL

SEQ ID NO: 829842 - protein, 9 aa, Homo Sapiens
AYKKAKERD

SEQ ID NO: 829843 - protein, 9 aa, Homo Sapiens
FAYVLIMDF

SEQ ID NO: 829844 - protein, 9 aa, Homo Sapiens
DAFGSLSNS

SEQ ID NO: 829845 - protein, 9 aa, Homo Sapiens
NPWRCSYHK

SEQ ID NO: 829846 - protein, 9 aa, Homo Sapiens
KRDARNKRI

SEQ ID NO: 829847 - protein, 9 aa, Homo Sapiens
PRLQTNFDP

SEQ ID NO: 829848 - protein, 9 aa, Homo Sapiens
NKLFMADLQ

SEQ ID NO: 829849 - protein, 9 aa, Homo Sapiens
YSTLTNHKI

SEQ ID NO: 829850 - protein, 9 aa, Homo Sapiens
LRQREVEYL

SEQ ID NO: 829851 - protein, 9 aa, Homo Sapiens
QRCLRDPDW

SEQ ID NO: 829852 - protein, 9 aa, Homo Sapiens
LKQNVLDYY

SEQ ID NO: 829853 - protein, 9 aa, Homo Sapiens
LYALERATV

SEQ ID NO: 829854 - protein, 9 aa, Homo Sapiens
WNYYEGFLY

SEQ ID NO: 829855 - protein, 9 aa, Homo Sapiens
TEEMPGPGC

SEQ ID NO: 829856 - protein, 9 aa, Homo Sapiens
PYTCGECGH

SEQ ID NO: 829857 - protein, 9 aa, Homo Sapiens
YQRTFNEFL

SEQ ID NO: 829858 - protein, 9 aa, Homo Sapiens
TIQARTPFS

SEQ ID NO: 829859 - protein, 9 aa, Homo Sapiens
HGTQQQNLN

SEQ ID NO: 829860 - protein, 9 aa, Homo Sapiens
ITSSWGGTP

SEQ ID NO: 829861 - protein, 9 aa, Homo Sapiens
EGWKETDKF

SEQ ID NO: 829862 - protein, 9 aa, Homo Sapiens
YVKVKVNCS

SEQ ID NO: 829863 - protein, 9 aa, Homo Sapiens
KKQTQVLIN

SEQ ID NO: 829864 - protein, 9 aa, Homo Sapiens
EDKADEGPE

SEQ ID NO: 829865 - protein, 9 aa, Homo Sapiens
YAELAGLEF

SEQ ID NO: 829866 - protein, 9 aa, Homo Sapiens
EGKLSKRLT

SEQ ID NO: 829867 - protein, 9 aa, Homo Sapiens
NDDNEYLFQ

SEQ ID NO: 829868 - protein, 9 aa, Homo Sapiens
KERLGMCFG

SEQ ID NO: 829869 - protein, 9 aa, Homo Sapiens
ARGRQTQWG

SEQ ID NO: 829870 - protein, 9 aa, Homo Sapiens
SVTKLFPEF

SEQ ID NO: 829871 - protein, 9 aa, Homo Sapiens
HYHALASFD

SEQ ID NO: 829872 - protein, 9 aa, Homo Sapiens
EAIYQRGLD

SEQ ID NO: 829873 - protein, 9 aa, Homo Sapiens
PGLQTPLLT

SEQ ID NO: 829874 - protein, 9 aa, Homo Sapiens
RSKAKYLTD

SEQ ID NO: 829875 - protein, 9 aa, Homo Sapiens
KDKTHQTIP

SEQ ID NO: 829876 - protein, 9 aa, Homo Sapiens
LNFNQIARL

SEQ ID NO: 829877 - protein, 9 aa, Homo Sapiens
TFKRKDWSL

SEQ ID NO: 829878 - protein, 9 aa, Homo Sapiens
LGILASVPS

SEQ ID NO: 829879 - protein, 9 aa, Homo Sapiens
VVLIEVVDK

SEQ ID NO: 829880 - protein, 9 aa, Homo Sapiens
QTSANSSFK

SEQ ID NO: 829881 - protein, 9 aa, Homo Sapiens
ENIFSSTGD

SEQ ID NO: 829882 - protein, 9 aa, Homo Sapiens
PRLECSDTI

SEQ ID NO: 829883 - protein, 9 aa, Homo Sapiens
NLPTHLPNA

SEQ ID NO: 829884 - protein, 9 aa, Homo Sapiens
ANARKRNRM

SEQ ID NO: 829885 - protein, 9 aa, Homo Sapiens
IEAILLKWH

SEQ ID NO: 829886 - protein, 9 aa, Homo Sapiens
YLRAQMLIS

SEQ ID NO: 829887 - protein, 9 aa, Homo Sapiens
GRKTIVVNL

SEQ ID NO: 829888 - protein, 9 aa, Homo Sapiens
KKYQAVLSQ

SEQ ID NO: 829889 - protein, 9 aa, Homo Sapiens
SSPTENYFT

SEQ ID NO: 829890 - protein, 9 aa, Homo Sapiens
IDHLSCDAS

SEQ ID NO: 829891 - protein, 9 aa, Homo Sapiens
VENQVSGNL

SEQ ID NO: 829892 - protein, 9 aa, Homo Sapiens
MPEVRQSYF

SEQ ID NO: 829893 - protein, 9 aa, Homo Sapiens
TWGLTLTLE

SEQ ID NO: 829894 - protein, 9 aa, Homo Sapiens
GDGGPFSGG

SEQ ID NO: 829895 - protein, 9 aa, Homo Sapiens
GVELTLLAF

SEQ ID NO: 829896 - protein, 9 aa, Homo Sapiens
IGNACDNCP

SEQ ID NO: 829897 - protein, 9 aa, Homo Sapiens
AVLISNKAC

SEQ ID NO: 829898 - protein, 9 aa, Homo Sapiens
CLDASENRL

SEQ ID NO: 829899 - protein, 9 aa, Homo Sapiens
GFDEPSTSK

SEQ ID NO: 829900 - protein, 9 aa, Homo Sapiens
PLHLGYIED

SEQ ID NO: 829901 - protein, 9 aa, Homo Sapiens
RNNYGQLDI

SEQ ID NO: 829902 - protein, 9 aa, Homo Sapiens
QSEDFGVNE

SEQ ID NO: 829903 - protein, 9 aa, Homo Sapiens
DRIAKFSKV

SEQ ID NO: 829904 - protein, 9 aa, Homo Sapiens
KQALLSETR

SEQ ID NO: 829905 - protein, 9 aa, Homo Sapiens
TMDSIQSSK

SEQ ID NO: 829906 - protein, 9 aa, Homo Sapiens
PVSYFIWNM

SEQ ID NO: 829907 - protein, 9 aa, Homo Sapiens
HSIKYCLGC

SEQ ID NO: 829908 - protein, 9 aa, Homo Sapiens
DSLLRQTIA

SEQ ID NO: 829909 - protein, 9 aa, Homo Sapiens
VISFGCASC

SEQ ID NO: 829910 - protein, 9 aa, Homo Sapiens
TIENKNYVL

SEQ ID NO: 829911 - protein, 9 aa, Homo Sapiens
LEAMMHILQ

SEQ ID NO: 829912 - protein, 9 aa, Homo Sapiens
GIKKEVNVY

SEQ ID NO: 829913 - protein, 9 aa, Homo Sapiens
KSLEYLDLN

SEQ ID NO: 829914 - protein, 9 aa, Homo Sapiens
PTYHLPPYK

SEQ ID NO: 829915 - protein, 9 aa, Homo Sapiens
LMFPATLPP

SEQ ID NO: 829916 - protein, 9 aa, Homo Sapiens
VMTDFKLHV

SEQ ID NO: 829917 - protein, 9 aa, Homo Sapiens
IQNEMNVML

SEQ ID NO: 829918 - protein, 9 aa, Homo Sapiens
NVNDALGYV

SEQ ID NO: 829919 - protein, 9 aa, Homo Sapiens
DGKAYDNAC

SEQ ID NO: 829920 - protein, 9 aa, Homo Sapiens
GMSFQKALL

SEQ ID NO: 829921 - protein, 9 aa, Homo Sapiens
NILGLETIR

SEQ ID NO: 829922 - protein, 9 aa, Homo Sapiens
QSVIKLNYF

SEQ ID NO: 829923 - protein, 9 aa, Homo Sapiens
KVKISSSWG

SEQ ID NO: 829924 - protein, 9 aa, Homo Sapiens
MMPNILLAL

SEQ ID NO: 829925 - protein, 9 aa, Homo Sapiens
AEEWLFTKT

SEQ ID NO: 829926 - protein, 9 aa, Homo Sapiens
QHPGHFSTA

SEQ ID NO: 829927 - protein, 9 aa, Homo Sapiens
LKAIHAIME

SEQ ID NO: 829928 - protein, 9 aa, Homo Sapiens
SPASSPSVS

SEQ ID NO: 829929 - protein, 9 aa, Homo Sapiens
FFMKDAINK

SEQ ID NO: 829930 - protein, 9 aa, Homo Sapiens
ECPHKGRNF

SEQ ID NO: 829931 - protein, 9 aa, Homo Sapiens
AHDLQQNSA

SEQ ID NO: 829932 - protein, 9 aa, Homo Sapiens
EIYAGVCEE

SEQ ID NO: 829933 - protein, 9 aa, Homo Sapiens
NYPTQLQAI

SEQ ID NO: 829934 - protein, 9 aa, Homo Sapiens
EFRTTTTAG

SEQ ID NO: 829935 - protein, 9 aa, Homo Sapiens
SETDPGAKE

SEQ ID NO: 829936 - protein, 9 aa, Homo Sapiens
RGRIRLAED

SEQ ID NO: 829937 - protein, 9 aa, Homo Sapiens
KVGYKTVTY

SEQ ID NO: 829938 - protein, 9 aa, Homo Sapiens
TGPLFTFPS

SEQ ID NO: 829939 - protein, 9 aa, Homo Sapiens
GGATSQLLV

SEQ ID NO: 829940 - protein, 9 aa, Homo Sapiens
TDHLGIELM

SEQ ID NO: 829941 - protein, 9 aa, Homo Sapiens
CLAQQQLKE

SEQ ID NO: 829942 - protein, 9 aa, Homo Sapiens
GITDKAPEE

SEQ ID NO: 829943 - protein, 9 aa, Homo Sapiens
SPISIASAL

SEQ ID NO: 829944 - protein, 9 aa, Homo Sapiens
RTHSVVCMT

SEQ ID NO: 829945 - protein, 9 aa, Homo Sapiens
VDNLFRSCH

SEQ ID NO: 829946 - protein, 9 aa, Homo Sapiens
QISELPIRP

SEQ ID NO: 829947 - protein, 9 aa, Homo Sapiens
VDIYECQSS

SEQ ID NO: 829948 - protein, 9 aa, Homo Sapiens
EVFTPVCER

SEQ ID NO: 829949 - protein, 9 aa, Homo Sapiens
GSEKKLRQN

SEQ ID NO: 829950 - protein, 9 aa, Homo Sapiens
PLTFLSAPV

SEQ ID NO: 829951 - protein, 9 aa, Homo Sapiens
TFGATYLQQ

SEQ ID NO: 829952 - protein, 9 aa, Homo Sapiens
KRLDECIYA

SEQ ID NO: 829953 - protein, 9 aa, Homo Sapiens
YCDTQPLLK

SEQ ID NO: 829954 - protein, 9 aa, Homo Sapiens
PTNVSDAFG

SEQ ID NO: 829955 - protein, 9 aa, Homo Sapiens
YVGRDKKLA

SEQ ID NO: 829956 - protein, 9 aa, Homo Sapiens
ERSARLTRG

SEQ ID NO: 829957 - protein, 9 aa, Homo Sapiens
TIEDHLHPY

SEQ ID NO: 829958 - protein, 9 aa, Homo Sapiens
QLHPKLLHC

SEQ ID NO: 829959 - protein, 9 aa, Homo Sapiens
GENHLCVGC

SEQ ID NO: 829960 - protein, 9 aa, Homo Sapiens
EAKAAKLEK

SEQ ID NO: 829961 - protein, 9 aa, Homo Sapiens
AYLNRHWVH

SEQ ID NO: 829962 - protein, 9 aa, Homo Sapiens
IFLQPPKLS

SEQ ID NO: 829963 - protein, 9 aa, Homo Sapiens
SSADIFRQI

SEQ ID NO: 829964 - protein, 9 aa, Homo Sapiens
DAERRYLTI

SEQ ID NO: 829965 - protein, 9 aa, Homo Sapiens
TATINSLSY

SEQ ID NO: 829966 - protein, 9 aa, Homo Sapiens
SMSRALLYR

SEQ ID NO: 829967 - protein, 9 aa, Homo Sapiens
TTGQSVYMH

SEQ ID NO: 829968 - protein, 9 aa, Homo Sapiens
STNLVLIGA

SEQ ID NO: 829969 - protein, 9 aa, Homo Sapiens
EYRGNSLAL

SEQ ID NO: 829970 - protein, 9 aa, Homo Sapiens
IENMVNPRA

SEQ ID NO: 829971 - protein, 9 aa, Homo Sapiens
ITYHGSITH

SEQ ID NO: 829972 - protein, 9 aa, Homo Sapiens
MYMTWMKNG

SEQ ID NO: 829973 - protein, 9 aa, Homo Sapiens
AGREDIAHS

SEQ ID NO: 829974 - protein, 9 aa, Homo Sapiens
SNGVVDAIG

SEQ ID NO: 829975 - protein, 9 aa, Homo Sapiens
SILIILRLP

SEQ ID NO: 829976 - protein, 9 aa, Homo Sapiens
LVMSEVDCC

SEQ ID NO: 829977 - protein, 9 aa, Homo Sapiens
LLNIRCEHF

SEQ ID NO: 829978 - protein, 9 aa, Homo Sapiens
IRRDLACFL

SEQ ID NO: 829979 - protein, 9 aa, Homo Sapiens
WTQIEKGIF

SEQ ID NO: 829980 - protein, 9 aa, Homo Sapiens
IISNSCSNN

SEQ ID NO: 829981 - protein, 9 aa, Homo Sapiens
ATFIDNKSM

SEQ ID NO: 829982 - protein, 9 aa, Homo Sapiens
QEGPRCELW

SEQ ID NO: 829983 - protein, 9 aa, Homo Sapiens
GYSTVTVTL

SEQ ID NO: 829984 - protein, 9 aa, Homo Sapiens
HFYCDTQPL

SEQ ID NO: 829985 - protein, 9 aa, Homo Sapiens
DPKVMLFGE

SEQ ID NO: 829986 - protein, 9 aa, Homo Sapiens
GHSLPPIDR

SEQ ID NO: 829987 - protein, 9 aa, Homo Sapiens
TLTKQLSDV

SEQ ID NO: 829988 - protein, 9 aa, Homo Sapiens
YDKFKKMNR

SEQ ID NO: 829989 - protein, 9 aa, Homo Sapiens
AADGIPFFH

SEQ ID NO: 829990 - protein, 9 aa, Homo Sapiens
VPVVQMYSS

SEQ ID NO: 829991 - protein, 9 aa, Homo Sapiens
RQAKTHMMS

SEQ ID NO: 829992 - protein, 9 aa, Homo Sapiens
SLRSEATPQ

SEQ ID NO: 829993 - protein, 9 aa, Homo Sapiens
HLLQVCCCH

SEQ ID NO: 829994 - protein, 9 aa, Homo Sapiens
LSTAPSDKG

SEQ ID NO: 829995 - protein, 9 aa, Homo Sapiens
FEEFYEDHG

SEQ ID NO: 829996 - protein, 9 aa, Homo Sapiens
ASIVGSFDD

SEQ ID NO: 829997 - protein, 9 aa, Homo Sapiens
DHGFMLYQT

SEQ ID NO: 829998 - protein, 9 aa, Homo Sapiens
DEITAEIFT

SEQ ID NO: 829999 - protein, 9 aa, Homo Sapiens
VVPINNQVF

SEQ ID NO: 830000 - protein, 9 aa, Homo Sapiens
DAQCEAYLQ

SEQ ID NO: 830001 - protein, 9 aa, Homo Sapiens
QDMHITQML

SEQ ID NO: 830002 - protein, 9 aa, Homo Sapiens
DYLSSIYES

SEQ ID NO: 830003 - protein, 9 aa, Homo Sapiens
VMAAYDKRF

SEQ ID NO: 830004 - protein, 9 aa, Homo Sapiens
ISGQSRWSN

SEQ ID NO: 830005 - protein, 9 aa, Homo Sapiens
QDEERYMTF

SEQ ID NO: 830006 - protein, 9 aa, Homo Sapiens
SLLTLDNLI

SEQ ID NO: 830007 - protein, 9 aa, Homo Sapiens
GVIPRIVQD

SEQ ID NO: 830008 - protein, 9 aa, Homo Sapiens
TTEEEIILN

SEQ ID NO: 830009 - protein, 9 aa, Homo Sapiens
SSLFKNMIQ

SEQ ID NO: 830010 - protein, 9 aa, Homo Sapiens
HLENAIETM

SEQ ID NO: 830011 - protein, 9 aa, Homo Sapiens
TVHCMHLHE

SEQ ID NO: 830012 - protein, 9 aa, Homo Sapiens
TYSFILRRL

SEQ ID NO: 830013 - protein, 9 aa, Homo Sapiens
GTKVLEVPE

SEQ ID NO: 830014 - protein, 9 aa, Homo Sapiens
NWYEHNNYK

SEQ ID NO: 830015 - protein, 9 aa, Homo Sapiens
GDKKKVVDP

SEQ ID NO: 830016 - protein, 9 aa, Homo Sapiens
KRSRTIIFV

SEQ ID NO: 830017 - protein, 9 aa, Homo Sapiens
LERYSSSEP

SEQ ID NO: 830018 - protein, 9 aa, Homo Sapiens
VNDEIEANL

SEQ ID NO: 830019 - protein, 9 aa, Homo Sapiens
KQTNLNESH

SEQ ID NO: 830020 - protein, 9 aa, Homo Sapiens
TPSVFEDNF

SEQ ID NO: 830021 - protein, 9 aa, Homo Sapiens
AETRERKGL

SEQ ID NO: 830022 - protein, 9 aa, Homo Sapiens
RKPALISTV

SEQ ID NO: 830023 - protein, 9 aa, Homo Sapiens
HKRKYWALP

SEQ ID NO: 830024 - protein, 9 aa, Homo Sapiens
LGHVSFKLF

SEQ ID NO: 830025 - protein, 9 aa, Homo Sapiens
HGDDTNRWF

SEQ ID NO: 830026 - protein, 9 aa, Homo Sapiens
VQWLRSQLA

SEQ ID NO: 830027 - protein, 9 aa, Homo Sapiens
EPQGEGGIR

SEQ ID NO: 830028 - protein, 9 aa, Homo Sapiens
LLAVLKVRT

SEQ ID NO: 830029 - protein, 9 aa, Homo Sapiens
KNKTFKCHR

SEQ ID NO: 830030 - protein, 9 aa, Homo Sapiens
QESKEGACI

SEQ ID NO: 830031 - protein, 9 aa, Homo Sapiens
IENVPLLVP

SEQ ID NO: 830032 - protein, 9 aa, Homo Sapiens
ESKTRLELS

SEQ ID NO: 830033 - protein, 9 aa, Homo Sapiens
NEWQTSESG

SEQ ID NO: 830034 - protein, 9 aa, Homo Sapiens
AQMEMKPFE

SEQ ID NO: 830035 - protein, 9 aa, Homo Sapiens
LSKLSHDAD

SEQ ID NO: 830036 - protein, 9 aa, Homo Sapiens
AAKLRKCIG

SEQ ID NO: 830037 - protein, 9 aa, Homo Sapiens
SDSELEPMT

SEQ ID NO: 830038 - protein, 9 aa, Homo Sapiens
WADIKEDKD

SEQ ID NO: 830039 - protein, 9 aa, Homo Sapiens
VYHNGDPFY

SEQ ID NO: 830040 - protein, 9 aa, Homo Sapiens
STLSSKSAK

SEQ ID NO: 830041 - protein, 9 aa, Homo Sapiens
MEVLKRYAG

SEQ ID NO: 830042 - protein, 9 aa, Homo Sapiens
VNHLKIPVS

SEQ ID NO: 830043 - protein, 9 aa, Homo Sapiens
PSRSFKDEL

SEQ ID NO: 830044 - protein, 9 aa, Homo Sapiens
NKIIAYNAC

SEQ ID NO: 830045 - protein, 9 aa, Homo Sapiens
ENSENRIST

SEQ ID NO: 830046 - protein, 9 aa, Homo Sapiens
YTLVVLDYI

SEQ ID NO: 830047 - protein, 9 aa, Homo Sapiens
DEDCQLSIS

SEQ ID NO: 830048 - protein, 9 aa, Homo Sapiens
SSLAKRKII

SEQ ID NO: 830049 - protein, 9 aa, Homo Sapiens
KESLDSIAH

SEQ ID NO: 830050 - protein, 9 aa, Homo Sapiens
GLLPWTNCL

SEQ ID NO: 830051 - protein, 9 aa, Homo Sapiens
TTNNNYSPT

SEQ ID NO: 830052 - protein, 9 aa, Homo Sapiens
LPWSSDPFS

SEQ ID NO: 830053 - protein, 9 aa, Homo Sapiens
RKNVQKTWQ

SEQ ID NO: 830054 - protein, 9 aa, Homo Sapiens
DVNTSLQSA

SEQ ID NO: 830055 - protein, 9 aa, Homo Sapiens
QPCVLNNKK

SEQ ID NO: 830056 - protein, 9 aa, Homo Sapiens
GALSAVTAT

SEQ ID NO: 830057 - protein, 9 aa, Homo Sapiens
PKKKQALVE

SEQ ID NO: 830058 - protein, 9 aa, Homo Sapiens
SPGLQSCQK

SEQ ID NO: 830059 - protein, 9 aa, Homo Sapiens
LRNANKTSY

SEQ ID NO: 830060 - protein, 9 aa, Homo Sapiens
FVPINSVNL

SEQ ID NO: 830061 - protein, 9 aa, Homo Sapiens
KELLEYYQN

SEQ ID NO: 830062 - protein, 9 aa, Homo Sapiens
IEKGSSYRE

SEQ ID NO: 830063 - protein, 9 aa, Homo Sapiens
IYTGEKPYT

SEQ ID NO: 830064 - protein, 9 aa, Homo Sapiens
EVYSVLFGS

SEQ ID NO: 830065 - protein, 9 aa, Homo Sapiens
SPRTPPPTY

SEQ ID NO: 830066 - protein, 9 aa, Homo Sapiens
KGCRLSPRN

SEQ ID NO: 830067 - protein, 9 aa, Homo Sapiens
KTGDIVDIK

SEQ ID NO: 830068 - protein, 9 aa, Homo Sapiens
SGLEDCAVA

SEQ ID NO: 830069 - protein, 9 aa, Homo Sapiens
DSFLPGLEE

SEQ ID NO: 830070 - protein, 9 aa, Homo Sapiens
GDHNRNLLN

SEQ ID NO: 830071 - protein, 9 aa, Homo Sapiens
PEVPIIYHD

SEQ ID NO: 830072 - protein, 9 aa, Homo Sapiens
GKTYFFCGN

SEQ ID NO: 830073 - protein, 9 aa, Homo Sapiens
LFPVEPVSL

SEQ ID NO: 830074 - protein, 9 aa, Homo Sapiens
RGKLLLKLS

SEQ ID NO: 830075 - protein, 9 aa, Homo Sapiens
TAAKLRKCI

SEQ ID NO: 830076 - protein, 9 aa, Homo Sapiens
LEKKLSKAQ

SEQ ID NO: 830077 - protein, 9 aa, Homo Sapiens
LAGLRGLPE

SEQ ID NO: 830078 - protein, 9 aa, Homo Sapiens
AANYLLACE

SEQ ID NO: 830079 - protein, 9 aa, Homo Sapiens
YVNDLQGRN

SEQ ID NO: 830080 - protein, 9 aa, Homo Sapiens
LDQIGSYLA

SEQ ID NO: 830081 - protein, 9 aa, Homo Sapiens
RMIMKISNA

SEQ ID NO: 830082 - protein, 9 aa, Homo Sapiens
REVDMYTGY

SEQ ID NO: 830083 - protein, 9 aa, Homo Sapiens
VSKHDFLGQ

SEQ ID NO: 830084 - protein, 9 aa, Homo Sapiens
VVHQAQVEL

SEQ ID NO: 830085 - protein, 9 aa, Homo Sapiens
NDPSQSKVM

SEQ ID NO: 830086 - protein, 9 aa, Homo Sapiens
LFAVVMGTG

SEQ ID NO: 830087 - protein, 9 aa, Homo Sapiens
TVSTFEGCP

SEQ ID NO: 830088 - protein, 9 aa, Homo Sapiens
KHNGTVVQY

SEQ ID NO: 830089 - protein, 9 aa, Homo Sapiens
DPGPSVVDL

SEQ ID NO: 830090 - protein, 9 aa, Homo Sapiens
KERSRINYS

SEQ ID NO: 830091 - protein, 9 aa, Homo Sapiens
TILDKGHAK

SEQ ID NO: 830092 - protein, 9 aa, Homo Sapiens
GPVEHGKFI

SEQ ID NO: 830093 - protein, 9 aa, Homo Sapiens
PSRPKAQQK

SEQ ID NO: 830094 - protein, 9 aa, Homo Sapiens
SNKRTPSAP

SEQ ID NO: 830095 - protein, 9 aa, Homo Sapiens
TRMELFRNI

SEQ ID NO: 830096 - protein, 9 aa, Homo Sapiens
SVHPASLNG

SEQ ID NO: 830097 - protein, 9 aa, Homo Sapiens
LLRQHHKLC

SEQ ID NO: 830098 - protein, 9 aa, Homo Sapiens
SDKGATWNV

SEQ ID NO: 830099 - protein, 9 aa, Homo Sapiens
RFVTDFLDN

SEQ ID NO: 830100 - protein, 9 aa, Homo Sapiens
QCAGRSKKE

SEQ ID NO: 830101 - protein, 9 aa, Homo Sapiens
HVCLCMCVC

SEQ ID NO: 830102 - protein, 9 aa, Homo Sapiens
ELQLEESCV

SEQ ID NO: 830103 - protein, 9 aa, Homo Sapiens
AKKIKCFLE

SEQ ID NO: 830104 - protein, 9 aa, Homo Sapiens
SNPFQGLME

SEQ ID NO: 830105 - protein, 9 aa, Homo Sapiens
NIPLSAPRK

SEQ ID NO: 830106 - protein, 9 aa, Homo Sapiens
HLERTGHYS

SEQ ID NO: 830107 - protein, 9 aa, Homo Sapiens
RMTMYYPGI

SEQ ID NO: 830108 - protein, 9 aa, Homo Sapiens
AAIQSGRMT

SEQ ID NO: 830109 - protein, 9 aa, Homo Sapiens
QEAANDIES

SEQ ID NO: 830110 - protein, 9 aa, Homo Sapiens
EDIHFNDAC

SEQ ID NO: 830111 - protein, 9 aa, Homo Sapiens
QDNALAIVN

SEQ ID NO: 830112 - protein, 9 aa, Homo Sapiens
EPMPFQTHY

SEQ ID NO: 830113 - protein, 9 aa, Homo Sapiens
RYKKLQEKH

SEQ ID NO: 830114 - protein, 9 aa, Homo Sapiens
RLGCFDHAH

SEQ ID NO: 830115 - protein, 9 aa, Homo Sapiens
RRYWKVFED

SEQ ID NO: 830116 - protein, 9 aa, Homo Sapiens
TDVDTSWKE

SEQ ID NO: 830117 - protein, 9 aa, Homo Sapiens
PRVICTCCS

SEQ ID NO: 830118 - protein, 9 aa, Homo Sapiens
TFLSAPVTP

SEQ ID NO: 830119 - protein, 9 aa, Homo Sapiens
AGLLEDNNK

SEQ ID NO: 830120 - protein, 9 aa, Homo Sapiens
EDYLENVES

SEQ ID NO: 830121 - protein, 9 aa, Homo Sapiens
DTLEALSSL

SEQ ID NO: 830122 - protein, 9 aa, Homo Sapiens
QEIPVNIRF

SEQ ID NO: 830123 - protein, 9 aa, Homo Sapiens
KILQGKLSQ

SEQ ID NO: 830124 - protein, 9 aa, Homo Sapiens
IFQLNMYHL

SEQ ID NO: 830125 - protein, 9 aa, Homo Sapiens
TYIFNSLDD

SEQ ID NO: 830126 - protein, 9 aa, Homo Sapiens
MSRALLYRL

SEQ ID NO: 830127 - protein, 9 aa, Homo Sapiens
APPEPIIDD

SEQ ID NO: 830128 - protein, 9 aa, Homo Sapiens
VINVRIGMQ

SEQ ID NO: 830129 - protein, 9 aa, Homo Sapiens
IDVESLVRL

SEQ ID NO: 830130 - protein, 9 aa, Homo Sapiens
DGRLSIHQI

SEQ ID NO: 830131 - protein, 9 aa, Homo Sapiens
CAEHQIDLI

SEQ ID NO: 830132 - protein, 9 aa, Homo Sapiens
PLALNAVTG

SEQ ID NO: 830133 - protein, 9 aa, Homo Sapiens
SHFVLANGH

SEQ ID NO: 830134 - protein, 9 aa, Homo Sapiens
TMSALYSLI

SEQ ID NO: 830135 - protein, 9 aa, Homo Sapiens
RASIKHKDE

SEQ ID NO: 830136 - protein, 9 aa, Homo Sapiens
HGLLQPHLP

SEQ ID NO: 830137 - protein, 9 aa, Homo Sapiens
HIQHQIVHT

SEQ ID NO: 830138 - protein, 9 aa, Homo Sapiens
EIIIAINSE

SEQ ID NO: 830139 - protein, 9 aa, Homo Sapiens
HPRYLERQR

SEQ ID NO: 830140 - protein, 9 aa, Homo Sapiens
LQNHEKQES

SEQ ID NO: 830141 - protein, 9 aa, Homo Sapiens
YLKLLKCRL

SEQ ID NO: 830142 - protein, 9 aa, Homo Sapiens
LLKRSGKLL

SEQ ID NO: 830143 - protein, 9 aa, Homo Sapiens
EMDADNPLH

SEQ ID NO: 830144 - protein, 9 aa, Homo Sapiens
QILPVLNFC

SEQ ID NO: 830145 - protein, 9 aa, Homo Sapiens
FIKKRDEKK

SEQ ID NO: 830146 - protein, 9 aa, Homo Sapiens
SAPLEAARW

SEQ ID NO: 830147 - protein, 9 aa, Homo Sapiens
VMEKIEDSK

SEQ ID NO: 830148 - protein, 9 aa, Homo Sapiens
IELIQAGGT

SEQ ID NO: 830149 - protein, 9 aa, Homo Sapiens
SLLRQTIAA

SEQ ID NO: 830150 - protein, 9 aa, Homo Sapiens
IYVIPGLKT

SEQ ID NO: 830151 - protein, 9 aa, Homo Sapiens
GQLDISIVR

SEQ ID NO: 830152 - protein, 9 aa, Homo Sapiens
SSKESSWIS

SEQ ID NO: 830153 - protein, 9 aa, Homo Sapiens
NLKKLRARL

SEQ ID NO: 830154 - protein, 9 aa, Homo Sapiens
RSMTFQSRV

SEQ ID NO: 830155 - protein, 9 aa, Homo Sapiens
GSAQRLLQN

SEQ ID NO: 830156 - protein, 9 aa, Homo Sapiens
KCLSKDAVK

SEQ ID NO: 830157 - protein, 9 aa, Homo Sapiens
YIVFLVVYK

SEQ ID NO: 830158 - protein, 9 aa, Homo Sapiens
CKRMKICMN

SEQ ID NO: 830159 - protein, 9 aa, Homo Sapiens
AIGEEHFQL

SEQ ID NO: 830160 - protein, 9 aa, Homo Sapiens
SGKWLHSHV

SEQ ID NO: 830161 - protein, 9 aa, Homo Sapiens
GKKIDLDTI

SEQ ID NO: 830162 - protein, 9 aa, Homo Sapiens
SPRATVSTE

SEQ ID NO: 830163 - protein, 9 aa, Homo Sapiens
KESVFEKYY

SEQ ID NO: 830164 - protein, 9 aa, Homo Sapiens
ASLQYELRE

SEQ ID NO: 830165 - protein, 9 aa, Homo Sapiens
TFKSTRNYA

SEQ ID NO: 830166 - protein, 9 aa, Homo Sapiens
FEQLEDKLC

SEQ ID NO: 830167 - protein, 9 aa, Homo Sapiens
DGFKTCIKS

SEQ ID NO: 830168 - protein, 9 aa, Homo Sapiens
KHFPLEEVW

SEQ ID NO: 830169 - protein, 9 aa, Homo Sapiens
LDTMLITVS

SEQ ID NO: 830170 - protein, 9 aa, Homo Sapiens
NSMLCPAHI

SEQ ID NO: 830171 - protein, 9 aa, Homo Sapiens
NDMFVEHRC

SEQ ID NO: 830172 - protein, 9 aa, Homo Sapiens
ILIAYMFLL

SEQ ID NO: 830173 - protein, 9 aa, Homo Sapiens
SHFLEEIEE

SEQ ID NO: 830174 - protein, 9 aa, Homo Sapiens
LIGILYIAT

SEQ ID NO: 830175 - protein, 9 aa, Homo Sapiens
WLDRGDKSA

SEQ ID NO: 830176 - protein, 9 aa, Homo Sapiens
IVRKNLSPV

SEQ ID NO: 830177 - protein, 9 aa, Homo Sapiens
LEPFLQRLG

SEQ ID NO: 830178 - protein, 9 aa, Homo Sapiens
SSCGSGSFN

SEQ ID NO: 830179 - protein, 9 aa, Homo Sapiens
NGTKLEPPA

SEQ ID NO: 830180 - protein, 9 aa, Homo Sapiens
MKINTYKQV

SEQ ID NO: 830181 - protein, 9 aa, Homo Sapiens
VFAICFSIA

SEQ ID NO: 830182 - protein, 9 aa, Homo Sapiens
EDAGEDEEK

SEQ ID NO: 830183 - protein, 9 aa, Homo Sapiens
FLKTSPVRE

SEQ ID NO: 830184 - protein, 9 aa, Homo Sapiens
ESPQQTFPA

SEQ ID NO: 830185 - protein, 9 aa, Homo Sapiens
MDEEELHPE

SEQ ID NO: 830186 - protein, 9 aa, Homo Sapiens
HIKKASDVL

SEQ ID NO: 830187 - protein, 9 aa, Homo Sapiens
CYVFFNYSQ

SEQ ID NO: 830188 - protein, 9 aa, Homo Sapiens
ACVKDISAA

SEQ ID NO: 830189 - protein, 9 aa, Homo Sapiens
GGPSNMISY

SEQ ID NO: 830190 - protein, 9 aa, Homo Sapiens
SIMGSMVPP

SEQ ID NO: 830191 - protein, 9 aa, Homo Sapiens
ALWSILVNI

SEQ ID NO: 830192 - protein, 9 aa, Homo Sapiens
MEYLGPPNH

SEQ ID NO: 830193 - protein, 9 aa, Homo Sapiens
ETQKYISPP

SEQ ID NO: 830194 - protein, 9 aa, Homo Sapiens
YEMVRRHRA

SEQ ID NO: 830195 - protein, 9 aa, Homo Sapiens
GVIIAGYGV

SEQ ID NO: 830196 - protein, 9 aa, Homo Sapiens
SSLSADPLP

SEQ ID NO: 830197 - protein, 9 aa, Homo Sapiens
RNIRDGSEG

SEQ ID NO: 830198 - protein, 9 aa, Homo Sapiens
KTPLAPFFQ

SEQ ID NO: 830199 - protein, 9 aa, Homo Sapiens
NRSKCLEKV

SEQ ID NO: 830200 - protein, 9 aa, Homo Sapiens
YNTCYSSKR

SEQ ID NO: 830201 - protein, 9 aa, Homo Sapiens
LPFQNPNFP

SEQ ID NO: 830202 - protein, 9 aa, Homo Sapiens
RFVIGGSQG

SEQ ID NO: 830203 - protein, 9 aa, Homo Sapiens
AATNILTEL

SEQ ID NO: 830204 - protein, 9 aa, Homo Sapiens
NPIWKIYHN

SEQ ID NO: 830205 - protein, 9 aa, Homo Sapiens
ITSQNNLQE

SEQ ID NO: 830206 - protein, 9 aa, Homo Sapiens
IFKRNLFRH

SEQ ID NO: 830207 - protein, 9 aa, Homo Sapiens
KNSVGSLPP

SEQ ID NO: 830208 - protein, 9 aa, Homo Sapiens
NGRGFAHQK

SEQ ID NO: 830209 - protein, 9 aa, Homo Sapiens
ARDVEVSLP

SEQ ID NO: 830210 - protein, 9 aa, Homo Sapiens
AETGMEVSQ

SEQ ID NO: 830211 - protein, 9 aa, Homo Sapiens
TFIERENME

SEQ ID NO: 830212 - protein, 9 aa, Homo Sapiens
NFSSKIISF

SEQ ID NO: 830213 - protein, 9 aa, Homo Sapiens
GISVNKAPL

SEQ ID NO: 830214 - protein, 9 aa, Homo Sapiens
KETDKFGQG

SEQ ID NO: 830215 - protein, 9 aa, Homo Sapiens
KGKQALEIQ

SEQ ID NO: 830216 - protein, 9 aa, Homo Sapiens
EDFNVFTKG

SEQ ID NO: 830217 - protein, 9 aa, Homo Sapiens
SAKTLYGIY

SEQ ID NO: 830218 - protein, 9 aa, Homo Sapiens
ASEYPIFDK

SEQ ID NO: 830219 - protein, 9 aa, Homo Sapiens
SEEHDQTFS

SEQ ID NO: 830220 - protein, 9 aa, Homo Sapiens
ASVPPLALA

SEQ ID NO: 830221 - protein, 9 aa, Homo Sapiens
SQINDIQEK

SEQ ID NO: 830222 - protein, 9 aa, Homo Sapiens
VRAQKYYDD

SEQ ID NO: 830223 - protein, 9 aa, Homo Sapiens
IIYGLFNEN

SEQ ID NO: 830224 - protein, 9 aa, Homo Sapiens
AVINQSCCV

SEQ ID NO: 830225 - protein, 9 aa, Homo Sapiens
RKYNHMRAA

SEQ ID NO: 830226 - protein, 9 aa, Homo Sapiens
HSFIGSTSN

SEQ ID NO: 830227 - protein, 9 aa, Homo Sapiens
QRSSPLHYA

SEQ ID NO: 830228 - protein, 9 aa, Homo Sapiens
CLCFSFIIG

SEQ ID NO: 830229 - protein, 9 aa, Homo Sapiens
RINSAVKTS

SEQ ID NO: 830230 - protein, 9 aa, Homo Sapiens
SPTQYSLSA

SEQ ID NO: 830231 - protein, 9 aa, Homo Sapiens
SLAGHSISK

SEQ ID NO: 830232 - protein, 9 aa, Homo Sapiens
IIGNSSVDK

SEQ ID NO: 830233 - protein, 9 aa, Homo Sapiens
TWVPYPGCG

SEQ ID NO: 830234 - protein, 9 aa, Homo Sapiens
SFCRERSTF

SEQ ID NO: 830235 - protein, 9 aa, Homo Sapiens
STQKPLVLG

SEQ ID NO: 830236 - protein, 9 aa, Homo Sapiens
KDPVKIVQC

SEQ ID NO: 830237 - protein, 9 aa, Homo Sapiens
GKEIFAFKD

SEQ ID NO: 830238 - protein, 9 aa, Homo Sapiens
GAQGLGQSL

SEQ ID NO: 830239 - protein, 9 aa, Homo Sapiens
LFLFVGLHW

SEQ ID NO: 830240 - protein, 9 aa, Homo Sapiens
TASMSLMAP

SEQ ID NO: 830241 - protein, 9 aa, Homo Sapiens
TGRSQKVNK

SEQ ID NO: 830242 - protein, 9 aa, Homo Sapiens
FNVIKAYSL

SEQ ID NO: 830243 - protein, 9 aa, Homo Sapiens
SREQRCTDH

SEQ ID NO: 830244 - protein, 9 aa, Homo Sapiens
LRLWRVARS

SEQ ID NO: 830245 - protein, 9 aa, Homo Sapiens
GQRTLEYRD

SEQ ID NO: 830246 - protein, 9 aa, Homo Sapiens
REPLTNAVQ

SEQ ID NO: 830247 - protein, 9 aa, Homo Sapiens
ESLLFEQSF

SEQ ID NO: 830248 - protein, 9 aa, Homo Sapiens
LKKANVHRK

SEQ ID NO: 830249 - protein, 9 aa, Homo Sapiens
EPPEPKKSH

SEQ ID NO: 830250 - protein, 9 aa, Homo Sapiens
VYKDILAWK

SEQ ID NO: 830251 - protein, 9 aa, Homo Sapiens
MGNATVGRQ

SEQ ID NO: 830252 - protein, 9 aa, Homo Sapiens
RNKRLQLKQ

SEQ ID NO: 830253 - protein, 9 aa, Homo Sapiens
NAGYNVVLL

SEQ ID NO: 830254 - protein, 9 aa, Homo Sapiens
IPLGSVVIN

SEQ ID NO: 830255 - protein, 9 aa, Homo Sapiens
RDDREPQDG

SEQ ID NO: 830256 - protein, 9 aa, Homo Sapiens
LWVTKSEPS

SEQ ID NO: 830257 - protein, 9 aa, Homo Sapiens
KEEKPTDDT

SEQ ID NO: 830258 - protein, 9 aa, Homo Sapiens
WYLDKGICE

SEQ ID NO: 830259 - protein, 9 aa, Homo Sapiens
PPDWVEAAC

SEQ ID NO: 830260 - protein, 9 aa, Homo Sapiens
DTMQSALAA

SEQ ID NO: 830261 - protein, 9 aa, Homo Sapiens
NIIWGMSHS

SEQ ID NO: 830262 - protein, 9 aa, Homo Sapiens
RLFRSHSSP

SEQ ID NO: 830263 - protein, 9 aa, Homo Sapiens
NKNIIEDKA

SEQ ID NO: 830264 - protein, 9 aa, Homo Sapiens
TREKKTIRI

SEQ ID NO: 830265 - protein, 9 aa, Homo Sapiens
AFLLALQMN

SEQ ID NO: 830266 - protein, 9 aa, Homo Sapiens
QRINTGEKP

SEQ ID NO: 830267 - protein, 9 aa, Homo Sapiens
FIQPEIMDG

SEQ ID NO: 830268 - protein, 9 aa, Homo Sapiens
ASYPSAMNE

SEQ ID NO: 830269 - protein, 9 aa, Homo Sapiens
TFEWEKGYS

SEQ ID NO: 830270 - protein, 9 aa, Homo Sapiens
YKKSSKMVC

SEQ ID NO: 830271 - protein, 9 aa, Homo Sapiens
GSDSEERSL

SEQ ID NO: 830272 - protein, 9 aa, Homo Sapiens
LIGLEFILK

SEQ ID NO: 830273 - protein, 9 aa, Homo Sapiens
GGRKPQGLA

SEQ ID NO: 830274 - protein, 9 aa, Homo Sapiens
DVDKYLAGQ

SEQ ID NO: 830275 - protein, 9 aa, Homo Sapiens
SDSFNFNSQ

SEQ ID NO: 830276 - protein, 9 aa, Homo Sapiens
GTLSSLNLQ

SEQ ID NO: 830277 - protein, 9 aa, Homo Sapiens
NSNCKGGFN

SEQ ID NO: 830278 - protein, 9 aa, Homo Sapiens
RGLKIIDPN

SEQ ID NO: 830279 - protein, 9 aa, Homo Sapiens
PVKNIFVGG

SEQ ID NO: 830280 - protein, 9 aa, Homo Sapiens
SYFSQLQKL

SEQ ID NO: 830281 - protein, 9 aa, Homo Sapiens
LFTLYNNNI

SEQ ID NO: 830282 - protein, 9 aa, Homo Sapiens
AQRACPNNC

SEQ ID NO: 830283 - protein, 9 aa, Homo Sapiens
ELVQQLREN

SEQ ID NO: 830284 - protein, 9 aa, Homo Sapiens
SPLNNADSQ

SEQ ID NO: 830285 - protein, 9 aa, Homo Sapiens
ASVLNPTSW

SEQ ID NO: 830286 - protein, 9 aa, Homo Sapiens
LRSFKVTKY

SEQ ID NO: 830287 - protein, 9 aa, Homo Sapiens
RKDGKTTQE

SEQ ID NO: 830288 - protein, 9 aa, Homo Sapiens
HYPVAGYRP

SEQ ID NO: 830289 - protein, 9 aa, Homo Sapiens
EEEEYNEVE

SEQ ID NO: 830290 - protein, 9 aa, Homo Sapiens
TINEMYASL

SEQ ID NO: 830291 - protein, 9 aa, Homo Sapiens
RGHLKYYLA

SEQ ID NO: 830292 - protein, 9 aa, Homo Sapiens
CAFFKALQE

SEQ ID NO: 830293 - protein, 9 aa, Homo Sapiens
SDNGNVCQR

SEQ ID NO: 830294 - protein, 9 aa, Homo Sapiens
PDSASEANA

SEQ ID NO: 830295 - protein, 9 aa, Homo Sapiens
PYDGIPCVN

SEQ ID NO: 830296 - protein, 9 aa, Homo Sapiens
PKDVLVQFK

SEQ ID NO: 830297 - protein, 9 aa, Homo Sapiens
ILRNANKTS

SEQ ID NO: 830298 - protein, 9 aa, Homo Sapiens
IRQQREADA

SEQ ID NO: 830299 - protein, 9 aa, Homo Sapiens
PHMASQLGK

SEQ ID NO: 830300 - protein, 9 aa, Homo Sapiens
TMRTRLAQV

SEQ ID NO: 830301 - protein, 9 aa, Homo Sapiens
YTPETLLEE

SEQ ID NO: 830302 - protein, 9 aa, Homo Sapiens
IYLAKQNIK

SEQ ID NO: 830303 - protein, 9 aa, Homo Sapiens
LRFLATTSN

SEQ ID NO: 830304 - protein, 9 aa, Homo Sapiens
FLYLQGLSG

SEQ ID NO: 830305 - protein, 9 aa, Homo Sapiens
TNTRVYKKV

SEQ ID NO: 830306 - protein, 9 aa, Homo Sapiens
KKYGELFPV

SEQ ID NO: 830307 - protein, 9 aa, Homo Sapiens
IFYGIFYSQ

SEQ ID NO: 830308 - protein, 9 aa, Homo Sapiens
CWYTAHRTL

SEQ ID NO: 830309 - protein, 9 aa, Homo Sapiens
LNQSQDGAF

SEQ ID NO: 830310 - protein, 9 aa, Homo Sapiens
DIIQTLVLM

SEQ ID NO: 830311 - protein, 9 aa, Homo Sapiens
GNTGDNFRK

SEQ ID NO: 830312 - protein, 9 aa, Homo Sapiens
AEFVEEYGL

SEQ ID NO: 830313 - protein, 9 aa, Homo Sapiens
DRVATSQIS

SEQ ID NO: 830314 - protein, 9 aa, Homo Sapiens
KLRINENRI

SEQ ID NO: 830315 - protein, 9 aa, Homo Sapiens
IKTTMPESD

SEQ ID NO: 830316 - protein, 9 aa, Homo Sapiens
TSRHKELFS

SEQ ID NO: 830317 - protein, 9 aa, Homo Sapiens
PRVEGVPVV

SEQ ID NO: 830318 - protein, 9 aa, Homo Sapiens
TDLLGRQQR

SEQ ID NO: 830319 - protein, 9 aa, Homo Sapiens
REKQARIKA

SEQ ID NO: 830320 - protein, 9 aa, Homo Sapiens
RDHTGNKPY

SEQ ID NO: 830321 - protein, 9 aa, Homo Sapiens
VTVKEHAHQ

SEQ ID NO: 830322 - protein, 9 aa, Homo Sapiens
GYLFDEAIK

SEQ ID NO: 830323 - protein, 9 aa, Homo Sapiens
GLSKRWPKY

SEQ ID NO: 830324 - protein, 9 aa, Homo Sapiens
PQTNVFAIC

SEQ ID NO: 830325 - protein, 9 aa, Homo Sapiens
RVIFQLKAD

SEQ ID NO: 830326 - protein, 9 aa, Homo Sapiens
QRVPVEVRP

SEQ ID NO: 830327 - protein, 9 aa, Homo Sapiens
KCVQDTSKF

SEQ ID NO: 830328 - protein, 9 aa, Homo Sapiens
YKEGTYIIE

SEQ ID NO: 830329 - protein, 9 aa, Homo Sapiens
KKPLETGVW

SEQ ID NO: 830330 - protein, 9 aa, Homo Sapiens
IGFGDIVLE

SEQ ID NO: 830331 - protein, 9 aa, Homo Sapiens
ITSQRYAWP

SEQ ID NO: 830332 - protein, 9 aa, Homo Sapiens
SVYKQVIEA

SEQ ID NO: 830333 - protein, 9 aa, Homo Sapiens
RPNAIIVIG

SEQ ID NO: 830334 - protein, 9 aa, Homo Sapiens
GSVAWRVAQ

SEQ ID NO: 830335 - protein, 9 aa, Homo Sapiens
TPDYDVFQY

SEQ ID NO: 830336 - protein, 9 aa, Homo Sapiens
EGCPALLYK

SEQ ID NO: 830337 - protein, 9 aa, Homo Sapiens
LPHLIQTTW

SEQ ID NO: 830338 - protein, 9 aa, Homo Sapiens
GVGDGGPFS

SEQ ID NO: 830339 - protein, 9 aa, Homo Sapiens
FKDLQRDEL

SEQ ID NO: 830340 - protein, 9 aa, Homo Sapiens
GWPRAKLPN

SEQ ID NO: 830341 - protein, 9 aa, Homo Sapiens
ANNRLESQG

SEQ ID NO: 830342 - protein, 9 aa, Homo Sapiens
QPVQKKYKN

SEQ ID NO: 830343 - protein, 9 aa, Homo Sapiens
TSSVAVDLP

SEQ ID NO: 830344 - protein, 9 aa, Homo Sapiens
RCWLVFRES

SEQ ID NO: 830345 - protein, 9 aa, Homo Sapiens
FQGLMELGT

SEQ ID NO: 830346 - protein, 9 aa, Homo Sapiens
CRPCEIKKT

SEQ ID NO: 830347 - protein, 9 aa, Homo Sapiens
VKKKRKFPG

SEQ ID NO: 830348 - protein, 9 aa, Homo Sapiens
YVCSSDNLF

SEQ ID NO: 830349 - protein, 9 aa, Homo Sapiens
PLSSNTLQV

SEQ ID NO: 830350 - protein, 9 aa, Homo Sapiens
DVKLEDEDG

SEQ ID NO: 830351 - protein, 9 aa, Homo Sapiens
GNDLYDGSY

SEQ ID NO: 830352 - protein, 9 aa, Homo Sapiens
KEYFINYVQ

SEQ ID NO: 830353 - protein, 9 aa, Homo Sapiens
YSRVLDNCE

SEQ ID NO: 830354 - protein, 9 aa, Homo Sapiens
LCCGGVLID

SEQ ID NO: 830355 - protein, 9 aa, Homo Sapiens
CWLLNEFPV

SEQ ID NO: 830356 - protein, 9 aa, Homo Sapiens
PNTDQQLIE

SEQ ID NO: 830357 - protein, 9 aa, Homo Sapiens
QPPPDPHLL

SEQ ID NO: 830358 - protein, 9 aa, Homo Sapiens
EDFKGLINV

SEQ ID NO: 830359 - protein, 9 aa, Homo Sapiens
GELLLNELP

SEQ ID NO: 830360 - protein, 9 aa, Homo Sapiens
QKAFDWDVW

SEQ ID NO: 830361 - protein, 9 aa, Homo Sapiens
NNNVVDCNQ

SEQ ID NO: 830362 - protein, 9 aa, Homo Sapiens
TTIPNMIAD

SEQ ID NO: 830363 - protein, 9 aa, Homo Sapiens
SSTSCMSEQ

SEQ ID NO: 830364 - protein, 9 aa, Homo Sapiens
FIIRWCLLQ

SEQ ID NO: 830365 - protein, 9 aa, Homo Sapiens
SSFSSDSFN

SEQ ID NO: 830366 - protein, 9 aa, Homo Sapiens
LLSPRQTAP

SEQ ID NO: 830367 - protein, 9 aa, Homo Sapiens
LCEITEKTS

SEQ ID NO: 830368 - protein, 9 aa, Homo Sapiens
TIGKYLDFE

SEQ ID NO: 830369 - protein, 9 aa, Homo Sapiens
GEALLGNEA

SEQ ID NO: 830370 - protein, 9 aa, Homo Sapiens
FCGLSNMYH

SEQ ID NO: 830371 - protein, 9 aa, Homo Sapiens
TSQQPKLKR

SEQ ID NO: 830372 - protein, 9 aa, Homo Sapiens
IHLLVHKLP

SEQ ID NO: 830373 - protein, 9 aa, Homo Sapiens
QSFLMNKHQ

SEQ ID NO: 830374 - protein, 9 aa, Homo Sapiens
SACACSLDT

SEQ ID NO: 830375 - protein, 9 aa, Homo Sapiens
VNKLTPSNI

SEQ ID NO: 830376 - protein, 9 aa, Homo Sapiens
DCQPVCSCV

SEQ ID NO: 830377 - protein, 9 aa, Homo Sapiens
ERNPSDNSL

SEQ ID NO: 830378 - protein, 9 aa, Homo Sapiens
NEELQNLSL

SEQ ID NO: 830379 - protein, 9 aa, Homo Sapiens
VIEDNKVRQ

SEQ ID NO: 830380 - protein, 9 aa, Homo Sapiens
CNTNCCQES

SEQ ID NO: 830381 - protein, 9 aa, Homo Sapiens
VSVCAILVF

SEQ ID NO: 830382 - protein, 9 aa, Homo Sapiens
VLKMEEEQK

SEQ ID NO: 830383 - protein, 9 aa, Homo Sapiens
MRMGPGRKW

SEQ ID NO: 830384 - protein, 9 aa, Homo Sapiens
LAKVTADVV

SEQ ID NO: 830385 - protein, 9 aa, Homo Sapiens
EERYDSHVL

SEQ ID NO: 830386 - protein, 9 aa, Homo Sapiens
GMRMNYETV

SEQ ID NO: 830387 - protein, 9 aa, Homo Sapiens
GNGCGRSNK

SEQ ID NO: 830388 - protein, 9 aa, Homo Sapiens
MNNKLEELQ

SEQ ID NO: 830389 - protein, 9 aa, Homo Sapiens
KRSSCELEV

SEQ ID NO: 830390 - protein, 9 aa, Homo Sapiens
QTLGIAYAI

SEQ ID NO: 830391 - protein, 9 aa, Homo Sapiens
GSYVYFPRI

SEQ ID NO: 830392 - protein, 9 aa, Homo Sapiens
CDTLMSQSV

SEQ ID NO: 830393 - protein, 9 aa, Homo Sapiens
QTGLKLIAK

SEQ ID NO: 830394 - protein, 9 aa, Homo Sapiens
NQFNLIVFS

SEQ ID NO: 830395 - protein, 9 aa, Homo Sapiens
SPNFQTCKG

SEQ ID NO: 830396 - protein, 9 aa, Homo Sapiens
LFERQMQEK

SEQ ID NO: 830397 - protein, 9 aa, Homo Sapiens
GNYLICLRK

SEQ ID NO: 830398 - protein, 9 aa, Homo Sapiens
WWMLAWEVL

SEQ ID NO: 830399 - protein, 9 aa, Homo Sapiens
DAVKTISPS

SEQ ID NO: 830400 - protein, 9 aa, Homo Sapiens
YRRNSDIFV

SEQ ID NO: 830401 - protein, 9 aa, Homo Sapiens
EHTLFIDLS

SEQ ID NO: 830402 - protein, 9 aa, Homo Sapiens
TVHITDLYP

SEQ ID NO: 830403 - protein, 9 aa, Homo Sapiens
LEKAGCHLL

SEQ ID NO: 830404 - protein, 9 aa, Homo Sapiens
DNMLVIFIL

SEQ ID NO: 830405 - protein, 9 aa, Homo Sapiens
ILDRLIGIY

SEQ ID NO: 830406 - protein, 9 aa, Homo Sapiens
SSRRPQNDR

SEQ ID NO: 830407 - protein, 9 aa, Homo Sapiens
VVCDTKCNT

SEQ ID NO: 830408 - protein, 9 aa, Homo Sapiens
IRNFCKYVV

SEQ ID NO: 830409 - protein, 9 aa, Homo Sapiens
KLPEASDRC

SEQ ID NO: 830410 - protein, 9 aa, Homo Sapiens
AVNSYMPVI

SEQ ID NO: 830411 - protein, 9 aa, Homo Sapiens
DQEFLKGCA

SEQ ID NO: 830412 - protein, 9 aa, Homo Sapiens
PQAGLKEVS

SEQ ID NO: 830413 - protein, 9 aa, Homo Sapiens
PPMDSAGAP

SEQ ID NO: 830414 - protein, 9 aa, Homo Sapiens
VQKFIKIDQ

SEQ ID NO: 830415 - protein, 9 aa, Homo Sapiens
NEDNRKWMR

SEQ ID NO: 830416 - protein, 9 aa, Homo Sapiens
RKLGGLPSI

SEQ ID NO: 830417 - protein, 9 aa, Homo Sapiens
NTNFCHGLV

SEQ ID NO: 830418 - protein, 9 aa, Homo Sapiens
KMFLITREP

SEQ ID NO: 830419 - protein, 9 aa, Homo Sapiens
LTAVNVQNI

SEQ ID NO: 830420 - protein, 9 aa, Homo Sapiens
HLASAHFSQ

SEQ ID NO: 830421 - protein, 9 aa, Homo Sapiens
AATRAVLCC

SEQ ID NO: 830422 - protein, 9 aa, Homo Sapiens
WEVGVHGIQ

SEQ ID NO: 830423 - protein, 9 aa, Homo Sapiens
KVAEAALQL

SEQ ID NO: 830424 - protein, 9 aa, Homo Sapiens
VTENIFSST

SEQ ID NO: 830425 - protein, 9 aa, Homo Sapiens
GQSRVTVVG

SEQ ID NO: 830426 - protein, 9 aa, Homo Sapiens
AEALTAFTA

SEQ ID NO: 830427 - protein, 9 aa, Homo Sapiens
CKAQNALGV

SEQ ID NO: 830428 - protein, 9 aa, Homo Sapiens
GVIRTASEP

SEQ ID NO: 830429 - protein, 9 aa, Homo Sapiens
GAENLFNKL

SEQ ID NO: 830430 - protein, 9 aa, Homo Sapiens
STTGIWKQW

SEQ ID NO: 830431 - protein, 9 aa, Homo Sapiens
RLMIFSVGK

SEQ ID NO: 830432 - protein, 9 aa, Homo Sapiens
SLYREPLAS

SEQ ID NO: 830433 - protein, 9 aa, Homo Sapiens
TSRGHSIKT

SEQ ID NO: 830434 - protein, 9 aa, Homo Sapiens
MSKQEDSMC

SEQ ID NO: 830435 - protein, 9 aa, Homo Sapiens
EEERRVASV

SEQ ID NO: 830436 - protein, 9 aa, Homo Sapiens
EAGYTKEFF

SEQ ID NO: 830437 - protein, 9 aa, Homo Sapiens
EDEIEHLQN

SEQ ID NO: 830438 - protein, 9 aa, Homo Sapiens
LHIGSVSTT

SEQ ID NO: 830439 - protein, 9 aa, Homo Sapiens
SSNYRASAS

SEQ ID NO: 830440 - protein, 9 aa, Homo Sapiens
TLANHKIIH

SEQ ID NO: 830441 - protein, 9 aa, Homo Sapiens
FHPILSYFF

SEQ ID NO: 830442 - protein, 9 aa, Homo Sapiens
VVDVLAILP

SEQ ID NO: 830443 - protein, 9 aa, Homo Sapiens
WKENHATFI

SEQ ID NO: 830444 - protein, 9 aa, Homo Sapiens
IGTNLVKTA

SEQ ID NO: 830445 - protein, 9 aa, Homo Sapiens
CIRQNVADS

SEQ ID NO: 830446 - protein, 9 aa, Homo Sapiens
PPPVATVPP

SEQ ID NO: 830447 - protein, 9 aa, Homo Sapiens
RQTALKVIK

SEQ ID NO: 830448 - protein, 9 aa, Homo Sapiens
NHHSRVYLM

SEQ ID NO: 830449 - protein, 9 aa, Homo Sapiens
YRNLIKVLK

SEQ ID NO: 830450 - protein, 9 aa, Homo Sapiens
STCINLLKL

SEQ ID NO: 830451 - protein, 9 aa, Homo Sapiens
GYYVVFGSR

SEQ ID NO: 830452 - protein, 9 aa, Homo Sapiens
LLEPIPCEV

SEQ ID NO: 830453 - protein, 9 aa, Homo Sapiens
SYVASEESQ

SEQ ID NO: 830454 - protein, 9 aa, Homo Sapiens
IYFLQLLKY

SEQ ID NO: 830455 - protein, 9 aa, Homo Sapiens
VLFVGEALL

SEQ ID NO: 830456 - protein, 9 aa, Homo Sapiens
GGKNFSRPK

SEQ ID NO: 830457 - protein, 9 aa, Homo Sapiens
LHFTILSFY

SEQ ID NO: 830458 - protein, 9 aa, Homo Sapiens
PEMQVALFI

SEQ ID NO: 830459 - protein, 9 aa, Homo Sapiens
IYGLFNENF

SEQ ID NO: 830460 - protein, 9 aa, Homo Sapiens
SGSSHFVLA

SEQ ID NO: 830461 - protein, 9 aa, Homo Sapiens
TEDRGNGIK

SEQ ID NO: 830462 - protein, 9 aa, Homo Sapiens
RDLACFLLL

SEQ ID NO: 830463 - protein, 9 aa, Homo Sapiens
IEDLATEPT

SEQ ID NO: 830464 - protein, 9 aa, Homo Sapiens
MDNAKHMET

SEQ ID NO: 830465 - protein, 9 aa, Homo Sapiens
ALQAFKFRV

SEQ ID NO: 830466 - protein, 9 aa, Homo Sapiens
KYTHLVDED

SEQ ID NO: 830467 - protein, 9 aa, Homo Sapiens
PNKCYVHND

SEQ ID NO: 830468 - protein, 9 aa, Homo Sapiens
FVQETDHDQ

SEQ ID NO: 830469 - protein, 9 aa, Homo Sapiens
YYNLVVRMI

SEQ ID NO: 830470 - protein, 9 aa, Homo Sapiens
ILIIEQSRR

SEQ ID NO: 830471 - protein, 9 aa, Homo Sapiens
PGNLLLTTC

SEQ ID NO: 830472 - protein, 9 aa, Homo Sapiens
EEQEVVDKV

SEQ ID NO: 830473 - protein, 9 aa, Homo Sapiens
SMLKSEWDA

SEQ ID NO: 830474 - protein, 9 aa, Homo Sapiens
SHPYTNKVI

SEQ ID NO: 830475 - protein, 9 aa, Homo Sapiens
VYFNVPMKK

SEQ ID NO: 830476 - protein, 9 aa, Homo Sapiens
EPDVLHDYT

SEQ ID NO: 830477 - protein, 9 aa, Homo Sapiens
VTVSYLYDV

SEQ ID NO: 830478 - protein, 9 aa, Homo Sapiens
TLYSNASLL

SEQ ID NO: 830479 - protein, 9 aa, Homo Sapiens
KSYLYQLLQ

SEQ ID NO: 830480 - protein, 9 aa, Homo Sapiens
TAVMGINLC

SEQ ID NO: 830481 - protein, 9 aa, Homo Sapiens
GHGVPDTTD

SEQ ID NO: 830482 - protein, 9 aa, Homo Sapiens
LTVWPDSQN

SEQ ID NO: 830483 - protein, 9 aa, Homo Sapiens
KLADQLKQA

SEQ ID NO: 830484 - protein, 9 aa, Homo Sapiens
YECWCPFGS

SEQ ID NO: 830485 - protein, 9 aa, Homo Sapiens
NSKEQRVKS

SEQ ID NO: 830486 - protein, 9 aa, Homo Sapiens
HKTEPYWSP

SEQ ID NO: 830487 - protein, 9 aa, Homo Sapiens
MFETIDRKP

SEQ ID NO: 830488 - protein, 9 aa, Homo Sapiens
IISKSPDSY

SEQ ID NO: 830489 - protein, 9 aa, Homo Sapiens
KSENTKDLS

SEQ ID NO: 830490 - protein, 9 aa, Homo Sapiens
LRKKAFEEK

SEQ ID NO: 830491 - protein, 9 aa, Homo Sapiens
CLDVSSNKL

SEQ ID NO: 830492 - protein, 9 aa, Homo Sapiens
SSGHRSSSE

SEQ ID NO: 830493 - protein, 9 aa, Homo Sapiens
DGYVDTDSK

SEQ ID NO: 830494 - protein, 9 aa, Homo Sapiens
SKLIYNFIE

SEQ ID NO: 830495 - protein, 9 aa, Homo Sapiens
ILHKIIHSG

SEQ ID NO: 830496 - protein, 9 aa, Homo Sapiens
NQSMRGNGK

SEQ ID NO: 830497 - protein, 9 aa, Homo Sapiens
VMATKYGPV

SEQ ID NO: 830498 - protein, 9 aa, Homo Sapiens
SGMDYTIMT

SEQ ID NO: 830499 - protein, 9 aa, Homo Sapiens
DDEQQILNK

SEQ ID NO: 830500 - protein, 9 aa, Homo Sapiens
CYSESMKIL

SEQ ID NO: 830501 - protein, 9 aa, Homo Sapiens
ILREIVINE

SEQ ID NO: 830502 - protein, 9 aa, Homo Sapiens
LIGEPPING

SEQ ID NO: 830503 - protein, 9 aa, Homo Sapiens
VLLGRWAIL

SEQ ID NO: 830504 - protein, 9 aa, Homo Sapiens
KLFHPFNQK

SEQ ID NO: 830505 - protein, 9 aa, Homo Sapiens
EPEEDVHAE

SEQ ID NO: 830506 - protein, 9 aa, Homo Sapiens
IQNLEEVRE

SEQ ID NO: 830507 - protein, 9 aa, Homo Sapiens
KGTTPSYLT

SEQ ID NO: 830508 - protein, 9 aa, Homo Sapiens
AELVCLTRH

SEQ ID NO: 830509 - protein, 9 aa, Homo Sapiens
FQTAHLFLS

SEQ ID NO: 830510 - protein, 9 aa, Homo Sapiens
AQASLQSII

SEQ ID NO: 830511 - protein, 9 aa, Homo Sapiens
GLGHISDHY

SEQ ID NO: 830512 - protein, 9 aa, Homo Sapiens
PVHLQGFKP

SEQ ID NO: 830513 - protein, 9 aa, Homo Sapiens
LPESFICKD

SEQ ID NO: 830514 - protein, 9 aa, Homo Sapiens
PPEMYMTWM

SEQ ID NO: 830515 - protein, 9 aa, Homo Sapiens
CWCVDDKGG

SEQ ID NO: 830516 - protein, 9 aa, Homo Sapiens
KQYYSDPRF

SEQ ID NO: 830517 - protein, 9 aa, Homo Sapiens
AGNAKNNWQ

SEQ ID NO: 830518 - protein, 9 aa, Homo Sapiens
NLQSRKDSD

SEQ ID NO: 830519 - protein, 9 aa, Homo Sapiens
LIALWSEGK

SEQ ID NO: 830520 - protein, 9 aa, Homo Sapiens
DQQVLQQQE

SEQ ID NO: 830521 - protein, 9 aa, Homo Sapiens
SFGGNPGYV

SEQ ID NO: 830522 - protein, 9 aa, Homo Sapiens
PYPGCGSLA

SEQ ID NO: 830523 - protein, 9 aa, Homo Sapiens
ASRINTNLT

SEQ ID NO: 830524 - protein, 9 aa, Homo Sapiens
ESFDELLAS

SEQ ID NO: 830525 - protein, 9 aa, Homo Sapiens
EKSIKHETL

SEQ ID NO: 830526 - protein, 9 aa, Homo Sapiens
QKIAKEITV

SEQ ID NO: 830527 - protein, 9 aa, Homo Sapiens
THKRIHAGD

SEQ ID NO: 830528 - protein, 9 aa, Homo Sapiens
EEASNKPVT

SEQ ID NO: 830529 - protein, 9 aa, Homo Sapiens
LIRKALESM

SEQ ID NO: 830530 - protein, 9 aa, Homo Sapiens
RQKRINSAV

SEQ ID NO: 830531 - protein, 9 aa, Homo Sapiens
QSPQSVGST

SEQ ID NO: 830532 - protein, 9 aa, Homo Sapiens
KEKEPGKLD

SEQ ID NO: 830533 - protein, 9 aa, Homo Sapiens
TVRGLKIID

SEQ ID NO: 830534 - protein, 9 aa, Homo Sapiens
ETQMKKLDI

SEQ ID NO: 830535 - protein, 9 aa, Homo Sapiens
PSAAAQGTW

SEQ ID NO: 830536 - protein, 9 aa, Homo Sapiens
MGHRRASPG

SEQ ID NO: 830537 - protein, 9 aa, Homo Sapiens
LCTDNCPDH

SEQ ID NO: 830538 - protein, 9 aa, Homo Sapiens
GLYQPICST

SEQ ID NO: 830539 - protein, 9 aa, Homo Sapiens
ATVKDEPQR

SEQ ID NO: 830540 - protein, 9 aa, Homo Sapiens
ILNDNDLAV

SEQ ID NO: 830541 - protein, 9 aa, Homo Sapiens
NFTEAIDES

SEQ ID NO: 830542 - protein, 9 aa, Homo Sapiens
FKSTRNECT

SEQ ID NO: 830543 - protein, 9 aa, Homo Sapiens
PAPSLGALC

SEQ ID NO: 830544 - protein, 9 aa, Homo Sapiens
VFPIMNLLI

SEQ ID NO: 830545 - protein, 9 aa, Homo Sapiens
PQSVGSTAA

SEQ ID NO: 830546 - protein, 9 aa, Homo Sapiens
FAKQFKQWR

SEQ ID NO: 830547 - protein, 9 aa, Homo Sapiens
SPIFSKKGY

SEQ ID NO: 830548 - protein, 9 aa, Homo Sapiens
PRHLFQIKH

SEQ ID NO: 830549 - protein, 9 aa, Homo Sapiens
GEIGVSSVT

SEQ ID NO: 830550 - protein, 9 aa, Homo Sapiens
QRRSDLNRF

SEQ ID NO: 830551 - protein, 9 aa, Homo Sapiens
NAEHLEDAA

SEQ ID NO: 830552 - protein, 9 aa, Homo Sapiens
IMDGPNQYF

SEQ ID NO: 830553 - protein, 9 aa, Homo Sapiens
PAEIYRQKA

SEQ ID NO: 830554 - protein, 9 aa, Homo Sapiens
EPIKGHEDY

SEQ ID NO: 830555 - protein, 9 aa, Homo Sapiens
YSFTTFFSE

SEQ ID NO: 830556 - protein, 9 aa, Homo Sapiens
CTLTATMRY

SEQ ID NO: 830557 - protein, 9 aa, Homo Sapiens
QGFDSDSFI

SEQ ID NO: 830558 - protein, 9 aa, Homo Sapiens
SKHLSWEDI

SEQ ID NO: 830559 - protein, 9 aa, Homo Sapiens
HAEPPEKHI

SEQ ID NO: 830560 - protein, 9 aa, Homo Sapiens
GFHTLSFQG

SEQ ID NO: 830561 - protein, 9 aa, Homo Sapiens
SVIKLNYFF

SEQ ID NO: 830562 - protein, 9 aa, Homo Sapiens
TTTAEHQLR

SEQ ID NO: 830563 - protein, 9 aa, Homo Sapiens
LCLAQEAAQ

SEQ ID NO: 830564 - protein, 9 aa, Homo Sapiens
YSWLLVIRV

SEQ ID NO: 830565 - protein, 9 aa, Homo Sapiens
LTSDSTVYY

SEQ ID NO: 830566 - protein, 9 aa, Homo Sapiens
QYQLLGIKN

SEQ ID NO: 830567 - protein, 9 aa, Homo Sapiens
FTPVCERNS

SEQ ID NO: 830568 - protein, 9 aa, Homo Sapiens
TRGLNPTDA

SEQ ID NO: 830569 - protein, 9 aa, Homo Sapiens
AVHDSFRPK

SEQ ID NO: 830570 - protein, 9 aa, Homo Sapiens
LLLVNNKIS

SEQ ID NO: 830571 - protein, 9 aa, Homo Sapiens
KTCLIQHQL

SEQ ID NO: 830572 - protein, 9 aa, Homo Sapiens
HSIYFLLDS

SEQ ID NO: 830573 - protein, 9 aa, Homo Sapiens
QSQSSDPEE

SEQ ID NO: 830574 - protein, 9 aa, Homo Sapiens
NTTWVPYPG

SEQ ID NO: 830575 - protein, 9 aa, Homo Sapiens
TFKANSSSA

SEQ ID NO: 830576 - protein, 9 aa, Homo Sapiens
IDLDTFICH

SEQ ID NO: 830577 - protein, 9 aa, Homo Sapiens
SSRAIIKAG

SEQ ID NO: 830578 - protein, 9 aa, Homo Sapiens
GSVASMNSA

SEQ ID NO: 830579 - protein, 9 aa, Homo Sapiens
QFYMYEILK

SEQ ID NO: 830580 - protein, 9 aa, Homo Sapiens
GDPKINVRV

SEQ ID NO: 830581 - protein, 9 aa, Homo Sapiens
SYTLILSIH

SEQ ID NO: 830582 - protein, 9 aa, Homo Sapiens
NKCMRNGPD

SEQ ID NO: 830583 - protein, 9 aa, Homo Sapiens
VPLCYVKFQ

SEQ ID NO: 830584 - protein, 9 aa, Homo Sapiens
NTSFYGFTV

SEQ ID NO: 830585 - protein, 9 aa, Homo Sapiens
IEASKESKN

SEQ ID NO: 830586 - protein, 9 aa, Homo Sapiens
TDNIFAIKY

SEQ ID NO: 830587 - protein, 9 aa, Homo Sapiens
KPDGENRAH

SEQ ID NO: 830588 - protein, 9 aa, Homo Sapiens
EHLYHWMHI

SEQ ID NO: 830589 - protein, 9 aa, Homo Sapiens
NPTDAPHAG

SEQ ID NO: 830590 - protein, 9 aa, Homo Sapiens
ERKREEKLC

SEQ ID NO: 830591 - protein, 9 aa, Homo Sapiens
PILAEVIPD

SEQ ID NO: 830592 - protein, 9 aa, Homo Sapiens
YSSMSRALL

SEQ ID NO: 830593 - protein, 9 aa, Homo Sapiens
QEQVRVNYL

SEQ ID NO: 830594 - protein, 9 aa, Homo Sapiens
EIQSARRHT

SEQ ID NO: 830595 - protein, 9 aa, Homo Sapiens
QKNGVNEAK

SEQ ID NO: 830596 - protein, 9 aa, Homo Sapiens
ALLIQALST

SEQ ID NO: 830597 - protein, 9 aa, Homo Sapiens
SITLNILGK

SEQ ID NO: 830598 - protein, 9 aa, Homo Sapiens
QLSCLGSSS

SEQ ID NO: 830599 - protein, 9 aa, Homo Sapiens
LVCLTRHIL

SEQ ID NO: 830600 - protein, 9 aa, Homo Sapiens
DYWWCTYVV

SEQ ID NO: 830601 - protein, 9 aa, Homo Sapiens
FFSMVCLSP

SEQ ID NO: 830602 - protein, 9 aa, Homo Sapiens
ALPDSSPSN

SEQ ID NO: 830603 - protein, 9 aa, Homo Sapiens
GYGRFSGKM

SEQ ID NO: 830604 - protein, 9 aa, Homo Sapiens
LLLSSEKSS

SEQ ID NO: 830605 - protein, 9 aa, Homo Sapiens
KLAGLEFPP

SEQ ID NO: 830606 - protein, 9 aa, Homo Sapiens
DAVLAADSA

SEQ ID NO: 830607 - protein, 9 aa, Homo Sapiens
KSGRINVYG

SEQ ID NO: 830608 - protein, 9 aa, Homo Sapiens
EKKREISKR

SEQ ID NO: 830609 - protein, 9 aa, Homo Sapiens
VDLNTNFKK

SEQ ID NO: 830610 - protein, 9 aa, Homo Sapiens
EHMFCKEAK

SEQ ID NO: 830611 - protein, 9 aa, Homo Sapiens
SVILFGESA

SEQ ID NO: 830612 - protein, 9 aa, Homo Sapiens
NTGQHNAII

SEQ ID NO: 830613 - protein, 9 aa, Homo Sapiens
NYLLGTYSV

SEQ ID NO: 830614 - protein, 9 aa, Homo Sapiens
FYMKLLYFL

SEQ ID NO: 830615 - protein, 9 aa, Homo Sapiens
LSRVLTELM

SEQ ID NO: 830616 - protein, 9 aa, Homo Sapiens
MLDFNFGAA

SEQ ID NO: 830617 - protein, 9 aa, Homo Sapiens
LSNALNQNL

SEQ ID NO: 830618 - protein, 9 aa, Homo Sapiens
ENLYRRHCP

SEQ ID NO: 830619 - protein, 9 aa, Homo Sapiens
LAYIVFLVV

SEQ ID NO: 830620 - protein, 9 aa, Homo Sapiens
QASYNQIFS

SEQ ID NO: 830621 - protein, 9 aa, Homo Sapiens
WLQHQKKHL

SEQ ID NO: 830622 - protein, 9 aa, Homo Sapiens
KNFHADAIL

SEQ ID NO: 830623 - protein, 9 aa, Homo Sapiens
CYGYRDFGS

SEQ ID NO: 830624 - protein, 9 aa, Homo Sapiens
SHRNQLCYS

SEQ ID NO: 830625 - protein, 9 aa, Homo Sapiens
DGDLRNKRF

SEQ ID NO: 830626 - protein, 9 aa, Homo Sapiens
PLEEDIHFN

SEQ ID NO: 830627 - protein, 9 aa, Homo Sapiens
HLARMKIPD

SEQ ID NO: 830628 - protein, 9 aa, Homo Sapiens
WWSQYTGIP

SEQ ID NO: 830629 - protein, 9 aa, Homo Sapiens
TAIEMNINK

SEQ ID NO: 830630 - protein, 9 aa, Homo Sapiens
TVGCCSLCV

SEQ ID NO: 830631 - protein, 9 aa, Homo Sapiens
HDCSQCIDS

SEQ ID NO: 830632 - protein, 9 aa, Homo Sapiens
TLRYLMAHI

SEQ ID NO: 830633 - protein, 9 aa, Homo Sapiens
MAEPDGSNQ

SEQ ID NO: 830634 - protein, 9 aa, Homo Sapiens
ELCLLIPPD

SEQ ID NO: 830635 - protein, 9 aa, Homo Sapiens
DPNNYFTLD

SEQ ID NO: 830636 - protein, 9 aa, Homo Sapiens
ANILTADNQ

SEQ ID NO: 830637 - protein, 9 aa, Homo Sapiens
QYPIGLITS

SEQ ID NO: 830638 - protein, 9 aa, Homo Sapiens
AYLKVIIFF

SEQ ID NO: 830639 - protein, 9 aa, Homo Sapiens
ENKRFPLVN

SEQ ID NO: 830640 - protein, 9 aa, Homo Sapiens
TTPKRQTAV

SEQ ID NO: 830641 - protein, 9 aa, Homo Sapiens
MPAGTKVLE

SEQ ID NO: 830642 - protein, 9 aa, Homo Sapiens
GVSHSGFSS

SEQ ID NO: 830643 - protein, 9 aa, Homo Sapiens
VKRLDECIY

SEQ ID NO: 830644 - protein, 9 aa, Homo Sapiens
LSETRDLSE

SEQ ID NO: 830645 - protein, 9 aa, Homo Sapiens
VWAGLGGRH

SEQ ID NO: 830646 - protein, 9 aa, Homo Sapiens
MVPLNCVCF

SEQ ID NO: 830647 - protein, 9 aa, Homo Sapiens
SSSPIINIH

SEQ ID NO: 830648 - protein, 9 aa, Homo Sapiens
LLLAPRNPD

SEQ ID NO: 830649 - protein, 9 aa, Homo Sapiens
GNGSLSPPC

SEQ ID NO: 830650 - protein, 9 aa, Homo Sapiens
EVLFKMTGE

SEQ ID NO: 830651 - protein, 9 aa, Homo Sapiens
TQSHERTGP

SEQ ID NO: 830652 - protein, 9 aa, Homo Sapiens
YLRKLKRQL

SEQ ID NO: 830653 - protein, 9 aa, Homo Sapiens
SLAYSEVSQ

SEQ ID NO: 830654 - protein, 9 aa, Homo Sapiens
INFLSEKKT

SEQ ID NO: 830655 - protein, 9 aa, Homo Sapiens
PHLSCLPAS

SEQ ID NO: 830656 - protein, 9 aa, Homo Sapiens
SCGSGSFNW

SEQ ID NO: 830657 - protein, 9 aa, Homo Sapiens
TALTKVVQC

SEQ ID NO: 830658 - protein, 9 aa, Homo Sapiens
EDQETSLPP

SEQ ID NO: 830659 - protein, 9 aa, Homo Sapiens
TTWYHRHYR

SEQ ID NO: 830660 - protein, 9 aa, Homo Sapiens
LMKALEYLE

SEQ ID NO: 830661 - protein, 9 aa, Homo Sapiens
IKGYIIRYC

SEQ ID NO: 830662 - protein, 9 aa, Homo Sapiens
GPGHIHLPY

SEQ ID NO: 830663 - protein, 9 aa, Homo Sapiens
SVHGSDGHG

SEQ ID NO: 830664 - protein, 9 aa, Homo Sapiens
SRRLRDSHK

SEQ ID NO: 830665 - protein, 9 aa, Homo Sapiens
NVGFLEVLK

SEQ ID NO: 830666 - protein, 9 aa, Homo Sapiens
NLTVHHIIH

SEQ ID NO: 830667 - protein, 9 aa, Homo Sapiens
AWLCLALMQ

SEQ ID NO: 830668 - protein, 9 aa, Homo Sapiens
DDHECCKRV

SEQ ID NO: 830669 - protein, 9 aa, Homo Sapiens
MDVVSVTNG

SEQ ID NO: 830670 - protein, 9 aa, Homo Sapiens
MKAPKRMIM

SEQ ID NO: 830671 - protein, 9 aa, Homo Sapiens
IPFNKNNTF

SEQ ID NO: 830672 - protein, 9 aa, Homo Sapiens
ELEILQICQ

SEQ ID NO: 830673 - protein, 9 aa, Homo Sapiens
DDLNKPLKL

SEQ ID NO: 830674 - protein, 9 aa, Homo Sapiens
AALSRIWQE

SEQ ID NO: 830675 - protein, 9 aa, Homo Sapiens
ENYNSPVPE

SEQ ID NO: 830676 - protein, 9 aa, Homo Sapiens
WYHRHYRGE

SEQ ID NO: 830677 - protein, 9 aa, Homo Sapiens
VIVFNNDDW

SEQ ID NO: 830678 - protein, 9 aa, Homo Sapiens
KLEPGDYFS

SEQ ID NO: 830679 - protein, 9 aa, Homo Sapiens
FLGSSDLKF

SEQ ID NO: 830680 - protein, 9 aa, Homo Sapiens
RGLNPTDAP

SEQ ID NO: 830681 - protein, 9 aa, Homo Sapiens
FQIHTGIKP

SEQ ID NO: 830682 - protein, 9 aa, Homo Sapiens
ILDMAAGTS

SEQ ID NO: 830683 - protein, 9 aa, Homo Sapiens
LFDNPRRYD

SEQ ID NO: 830684 - protein, 9 aa, Homo Sapiens
GRDANRRDV

SEQ ID NO: 830685 - protein, 9 aa, Homo Sapiens
EQKCKAVGK

SEQ ID NO: 830686 - protein, 9 aa, Homo Sapiens
DIYECQSSP

SEQ ID NO: 830687 - protein, 9 aa, Homo Sapiens
SPLRVSKRK

SEQ ID NO: 830688 - protein, 9 aa, Homo Sapiens
NNKLNILDS

SEQ ID NO: 830689 - protein, 9 aa, Homo Sapiens
DSGLYLVMN

SEQ ID NO: 830690 - protein, 9 aa, Homo Sapiens
FSKEEKTVV

SEQ ID NO: 830691 - protein, 9 aa, Homo Sapiens
PLDEAHDDD

SEQ ID NO: 830692 - protein, 9 aa, Homo Sapiens
EEQQKVISL

SEQ ID NO: 830693 - protein, 9 aa, Homo Sapiens
LPDEQKEVK

SEQ ID NO: 830694 - protein, 9 aa, Homo Sapiens
ETGGTHKRY

SEQ ID NO: 830695 - protein, 9 aa, Homo Sapiens
PMDEKSLEK

SEQ ID NO: 830696 - protein, 9 aa, Homo Sapiens
ADRCTLPKH

SEQ ID NO: 830697 - protein, 9 aa, Homo Sapiens
SEKGSYEIL

SEQ ID NO: 830698 - protein, 9 aa, Homo Sapiens
EKNILKELT

SEQ ID NO: 830699 - protein, 9 aa, Homo Sapiens
LELMFSMLK

SEQ ID NO: 830700 - protein, 9 aa, Homo Sapiens
QGLTSLCKL

SEQ ID NO: 830701 - protein, 9 aa, Homo Sapiens
SGNKQRLHF

SEQ ID NO: 830702 - protein, 9 aa, Homo Sapiens
YFLYKSSGA

SEQ ID NO: 830703 - protein, 9 aa, Homo Sapiens
AILVFQFFS

SEQ ID NO: 830704 - protein, 9 aa, Homo Sapiens
LFPPGQITN

SEQ ID NO: 830705 - protein, 9 aa, Homo Sapiens
VFVASVRSG

SEQ ID NO: 830706 - protein, 9 aa, Homo Sapiens
FNPAKELMV

SEQ ID NO: 830707 - protein, 9 aa, Homo Sapiens
QSAGKNNNK

SEQ ID NO: 830708 - protein, 9 aa, Homo Sapiens
EKFPSKHLS

SEQ ID NO: 830709 - protein, 9 aa, Homo Sapiens
CFYIEETLW

SEQ ID NO: 830710 - protein, 9 aa, Homo Sapiens
FCITCQKSY

SEQ ID NO: 830711 - protein, 9 aa, Homo Sapiens
VDYYPNRTY

SEQ ID NO: 830712 - protein, 9 aa, Homo Sapiens
LSWESLKYA

SEQ ID NO: 830713 - protein, 9 aa, Homo Sapiens
VPVHQRRSV

SEQ ID NO: 830714 - protein, 9 aa, Homo Sapiens
AIVYPFRSC

SEQ ID NO: 830715 - protein, 9 aa, Homo Sapiens
TTKIFIYNI

SEQ ID NO: 830716 - protein, 9 aa, Homo Sapiens
RGSSSPQKR

SEQ ID NO: 830717 - protein, 9 aa, Homo Sapiens
IKINDVEIE

SEQ ID NO: 830718 - protein, 9 aa, Homo Sapiens
SSRKNEQSV

SEQ ID NO: 830719 - protein, 9 aa, Homo Sapiens
TKLEAIARP

SEQ ID NO: 830720 - protein, 9 aa, Homo Sapiens
YIKMTVCLE

SEQ ID NO: 830721 - protein, 9 aa, Homo Sapiens
GHHIEGVHV

SEQ ID NO: 830722 - protein, 9 aa, Homo Sapiens
RLSRTPGNI

SEQ ID NO: 830723 - protein, 9 aa, Homo Sapiens
LSSVLQTSL

SEQ ID NO: 830724 - protein, 9 aa, Homo Sapiens
EVLKEDAAY

SEQ ID NO: 830725 - protein, 9 aa, Homo Sapiens
FVESNLRKK

SEQ ID NO: 830726 - protein, 9 aa, Homo Sapiens
LMQIFRDSA

SEQ ID NO: 830727 - protein, 9 aa, Homo Sapiens
LPDHMSLWR

SEQ ID NO: 830728 - protein, 9 aa, Homo Sapiens
SLFYKGVYY

SEQ ID NO: 830729 - protein, 9 aa, Homo Sapiens
GDKPYVCRY

SEQ ID NO: 830730 - protein, 9 aa, Homo Sapiens
DKGVLFVSS

SEQ ID NO: 830731 - protein, 9 aa, Homo Sapiens
YMLWYRQDL

SEQ ID NO: 830732 - protein, 9 aa, Homo Sapiens
NMVHRIDLD

SEQ ID NO: 830733 - protein, 9 aa, Homo Sapiens
SDRVPSDGV

SEQ ID NO: 830734 - protein, 9 aa, Homo Sapiens
YLDFEKAKP

SEQ ID NO: 830735 - protein, 9 aa, Homo Sapiens
NRKDAEEWL

SEQ ID NO: 830736 - protein, 9 aa, Homo Sapiens
GPNTPGYLV

SEQ ID NO: 830737 - protein, 9 aa, Homo Sapiens
RGCHPSHEG

SEQ ID NO: 830738 - protein, 9 aa, Homo Sapiens
MGDEDKIIT

SEQ ID NO: 830739 - protein, 9 aa, Homo Sapiens
DVIMQYFPA

SEQ ID NO: 830740 - protein, 9 aa, Homo Sapiens
PVFWHKEMV

SEQ ID NO: 830741 - protein, 9 aa, Homo Sapiens
KANVKELTK

SEQ ID NO: 830742 - protein, 9 aa, Homo Sapiens
FLPVVLKDV

SEQ ID NO: 830743 - protein, 9 aa, Homo Sapiens
FRNNYLKPV

SEQ ID NO: 830744 - protein, 9 aa, Homo Sapiens
IHKKRLIEH

SEQ ID NO: 830745 - protein, 9 aa, Homo Sapiens
SEQMKIVDV

SEQ ID NO: 830746 - protein, 9 aa, Homo Sapiens
ALLTVGSEC

SEQ ID NO: 830747 - protein, 9 aa, Homo Sapiens
HISIVKHLC

SEQ ID NO: 830748 - protein, 9 aa, Homo Sapiens
GVGTLQLLD

SEQ ID NO: 830749 - protein, 9 aa, Homo Sapiens
TPVYAKVKR

SEQ ID NO: 830750 - protein, 9 aa, Homo Sapiens
YFSCHVEKL

SEQ ID NO: 830751 - protein, 9 aa, Homo Sapiens
NLLNFDIDR

SEQ ID NO: 830752 - protein, 9 aa, Homo Sapiens
VCVTALIGW

SEQ ID NO: 830753 - protein, 9 aa, Homo Sapiens
IENEGKLKR

SEQ ID NO: 830754 - protein, 9 aa, Homo Sapiens
IIWKGSCPL

SEQ ID NO: 830755 - protein, 9 aa, Homo Sapiens
PLCASDGKA

SEQ ID NO: 830756 - protein, 9 aa, Homo Sapiens
LEHYKDPSL

SEQ ID NO: 830757 - protein, 9 aa, Homo Sapiens
KRIEEVMIG

SEQ ID NO: 830758 - protein, 9 aa, Homo Sapiens
LIRCPFVET

SEQ ID NO: 830759 - protein, 9 aa, Homo Sapiens
IAPTGEPLH

SEQ ID NO: 830760 - protein, 9 aa, Homo Sapiens
CLLILIISM

SEQ ID NO: 830761 - protein, 9 aa, Homo Sapiens
PKCNVQFNI

SEQ ID NO: 830762 - protein, 9 aa, Homo Sapiens
SLALAFLAY

SEQ ID NO: 830763 - protein, 9 aa, Homo Sapiens
LKEAMEERK

SEQ ID NO: 830764 - protein, 9 aa, Homo Sapiens
SILNYKCRN

SEQ ID NO: 830765 - protein, 9 aa, Homo Sapiens
KVNGRKGLF

SEQ ID NO: 830766 - protein, 9 aa, Homo Sapiens
FTIQARTPF

SEQ ID NO: 830767 - protein, 9 aa, Homo Sapiens
KQNFDAYVS

SEQ ID NO: 830768 - protein, 9 aa, Homo Sapiens
LHQESPTQY

SEQ ID NO: 830769 - protein, 9 aa, Homo Sapiens
LAGREDIAH

SEQ ID NO: 830770 - protein, 9 aa, Homo Sapiens
PKLKQARLI

SEQ ID NO: 830771 - protein, 9 aa, Homo Sapiens
RNANKTSYL

SEQ ID NO: 830772 - protein, 9 aa, Homo Sapiens
RNTFESEDY

SEQ ID NO: 830773 - protein, 9 aa, Homo Sapiens
LTAPFSLHF

SEQ ID NO: 830774 - protein, 9 aa, Homo Sapiens
AHDAELVDK

SEQ ID NO: 830775 - protein, 9 aa, Homo Sapiens
PSSHLRFHK

SEQ ID NO: 830776 - protein, 9 aa, Homo Sapiens
LQLKPQTVA

SEQ ID NO: 830777 - protein, 9 aa, Homo Sapiens
KGKYFNFIG

SEQ ID NO: 830778 - protein, 9 aa, Homo Sapiens
PPLRPAHGR

SEQ ID NO: 830779 - protein, 9 aa, Homo Sapiens
VMLDGATFH

SEQ ID NO: 830780 - protein, 9 aa, Homo Sapiens
QITRNKEFA

SEQ ID NO: 830781 - protein, 9 aa, Homo Sapiens
ECGSSFQKH

SEQ ID NO: 830782 - protein, 9 aa, Homo Sapiens
MNGRVSIRD

SEQ ID NO: 830783 - protein, 9 aa, Homo Sapiens
APEFPCPTG

SEQ ID NO: 830784 - protein, 9 aa, Homo Sapiens
KYLKIHARG

SEQ ID NO: 830785 - protein, 9 aa, Homo Sapiens
SCIPICGEI

SEQ ID NO: 830786 - protein, 9 aa, Homo Sapiens
KENLPSHFK

SEQ ID NO: 830787 - protein, 9 aa, Homo Sapiens
GRVSQEVTS

SEQ ID NO: 830788 - protein, 9 aa, Homo Sapiens
AGVNPSDHV

SEQ ID NO: 830789 - protein, 9 aa, Homo Sapiens
LNLLIGPKL

SEQ ID NO: 830790 - protein, 9 aa, Homo Sapiens
AAAEGHIKV

SEQ ID NO: 830791 - protein, 9 aa, Homo Sapiens
SVNYQAQET

SEQ ID NO: 830792 - protein, 9 aa, Homo Sapiens
ITTSDTAGK

SEQ ID NO: 830793 - protein, 9 aa, Homo Sapiens
LGSPTLLSR

SEQ ID NO: 830794 - protein, 9 aa, Homo Sapiens
QHNMKCCIH

SEQ ID NO: 830795 - protein, 9 aa, Homo Sapiens
ETGYFFIHG

SEQ ID NO: 830796 - protein, 9 aa, Homo Sapiens
IALLGGHAA

SEQ ID NO: 830797 - protein, 9 aa, Homo Sapiens
IKYFEVVFN

SEQ ID NO: 830798 - protein, 9 aa, Homo Sapiens
DNFFLGLIC

SEQ ID NO: 830799 - protein, 9 aa, Homo Sapiens
GLRIQQMKS

SEQ ID NO: 830800 - protein, 9 aa, Homo Sapiens
LFIKKTGQA

SEQ ID NO: 830801 - protein, 9 aa, Homo Sapiens
TATAPTGQV

SEQ ID NO: 830802 - protein, 9 aa, Homo Sapiens
RRVATLVLA

SEQ ID NO: 830803 - protein, 9 aa, Homo Sapiens
KRLTGLLTQ

SEQ ID NO: 830804 - protein, 9 aa, Homo Sapiens
SNQTVFVSI

SEQ ID NO: 830805 - protein, 9 aa, Homo Sapiens
AVGLCCPAY

SEQ ID NO: 830806 - protein, 9 aa, Homo Sapiens
RKKRKYINT

SEQ ID NO: 830807 - protein, 9 aa, Homo Sapiens
ENLIKGRNI

SEQ ID NO: 830808 - protein, 9 aa, Homo Sapiens
VTTGITPVL

SEQ ID NO: 830809 - protein, 9 aa, Homo Sapiens
LTETASQEV

SEQ ID NO: 830810 - protein, 9 aa, Homo Sapiens
VVGPSGSRP

SEQ ID NO: 830811 - protein, 9 aa, Homo Sapiens
GCNKCGKSF

SEQ ID NO: 830812 - protein, 9 aa, Homo Sapiens
NVLSPIAAP

SEQ ID NO: 830813 - protein, 9 aa, Homo Sapiens
NSPEIIITY

SEQ ID NO: 830814 - protein, 9 aa, Homo Sapiens
CTGFLFGVA

SEQ ID NO: 830815 - protein, 9 aa, Homo Sapiens
ELGMTSMSL

SEQ ID NO: 830816 - protein, 9 aa, Homo Sapiens
TLRIYIQGV

SEQ ID NO: 830817 - protein, 9 aa, Homo Sapiens
ARIRRLLKH

SEQ ID NO: 830818 - protein, 9 aa, Homo Sapiens
REKTLGETL

SEQ ID NO: 830819 - protein, 9 aa, Homo Sapiens
QYQASYNQI

SEQ ID NO: 830820 - protein, 9 aa, Homo Sapiens
YKKMKEKQP

SEQ ID NO: 830821 - protein, 9 aa, Homo Sapiens
FARHRIIHT

SEQ ID NO: 830822 - protein, 9 aa, Homo Sapiens
YQAGEGRRK

SEQ ID NO: 830823 - protein, 9 aa, Homo Sapiens
FLGKKFKIY

SEQ ID NO: 830824 - protein, 9 aa, Homo Sapiens
VDNLKEKSE

SEQ ID NO: 830825 - protein, 9 aa, Homo Sapiens
LNSAFQRSA

SEQ ID NO: 830826 - protein, 9 aa, Homo Sapiens
KAKKPACQF

SEQ ID NO: 830827 - protein, 9 aa, Homo Sapiens
PPAVCNMQN

SEQ ID NO: 830828 - protein, 9 aa, Homo Sapiens
PFQTHYRFT

SEQ ID NO: 830829 - protein, 9 aa, Homo Sapiens
RTDIAQLLD

SEQ ID NO: 830830 - protein, 9 aa, Homo Sapiens
LEGTSFIMD

SEQ ID NO: 830831 - protein, 9 aa, Homo Sapiens
REQLATENN

SEQ ID NO: 830832 - protein, 9 aa, Homo Sapiens
MSSPTENYF

SEQ ID NO: 830833 - protein, 9 aa, Homo Sapiens
LKEVIQREG

SEQ ID NO: 830834 - protein, 9 aa, Homo Sapiens
YERIVLVDN

SEQ ID NO: 830835 - protein, 9 aa, Homo Sapiens
SVNNLESFP

SEQ ID NO: 830836 - protein, 9 aa, Homo Sapiens
RGEARALCL

SEQ ID NO: 830837 - protein, 9 aa, Homo Sapiens
QTHYRFTAY

SEQ ID NO: 830838 - protein, 9 aa, Homo Sapiens
FVAGPRLRN

SEQ ID NO: 830839 - protein, 9 aa, Homo Sapiens
SLALLVLPD

SEQ ID NO: 830840 - protein, 9 aa, Homo Sapiens
YETNSNAYM

SEQ ID NO: 830841 - protein, 9 aa, Homo Sapiens
VHGRNVTSK

SEQ ID NO: 830842 - protein, 9 aa, Homo Sapiens
MVRVASAIV

SEQ ID NO: 830843 - protein, 9 aa, Homo Sapiens
ENEEHKKQV

SEQ ID NO: 830844 - protein, 9 aa, Homo Sapiens
FRYLIGKYI

SEQ ID NO: 830845 - protein, 9 aa, Homo Sapiens
CRLVYKDIL

SEQ ID NO: 830846 - protein, 9 aa, Homo Sapiens
LEAASNGVV

SEQ ID NO: 830847 - protein, 9 aa, Homo Sapiens
VQLFSLVTT

SEQ ID NO: 830848 - protein, 9 aa, Homo Sapiens
FHTLSFQGL

SEQ ID NO: 830849 - protein, 9 aa, Homo Sapiens
IKRLTGLLT

SEQ ID NO: 830850 - protein, 9 aa, Homo Sapiens
KAKLGQEPV

SEQ ID NO: 830851 - protein, 9 aa, Homo Sapiens
YLVGASKII

SEQ ID NO: 830852 - protein, 9 aa, Homo Sapiens
AGNTTVLYR

SEQ ID NO: 830853 - protein, 9 aa, Homo Sapiens
IHRFSYQEK

SEQ ID NO: 830854 - protein, 9 aa, Homo Sapiens
VFQELEYYD

SEQ ID NO: 830855 - protein, 9 aa, Homo Sapiens
LVGVPEDMR

SEQ ID NO: 830856 - protein, 9 aa, Homo Sapiens
KKQIKHTMA

SEQ ID NO: 830857 - protein, 9 aa, Homo Sapiens
NIVVADLIT

SEQ ID NO: 830858 - protein, 9 aa, Homo Sapiens
GKKNTILYY

SEQ ID NO: 830859 - protein, 9 aa, Homo Sapiens
NRNPYFQNK

SEQ ID NO: 830860 - protein, 9 aa, Homo Sapiens
NLLIGPKLY

SEQ ID NO: 830861 - protein, 9 aa, Homo Sapiens
LDGQITMDK

SEQ ID NO: 830862 - protein, 9 aa, Homo Sapiens
PSDKRDGDK

SEQ ID NO: 830863 - protein, 9 aa, Homo Sapiens
SKKLDFHLH

SEQ ID NO: 830864 - protein, 9 aa, Homo Sapiens
GGYLVANYP

SEQ ID NO: 830865 - protein, 9 aa, Homo Sapiens
QEAEGDKYI

SEQ ID NO: 830866 - protein, 9 aa, Homo Sapiens
WKSILSTML

SEQ ID NO: 830867 - protein, 9 aa, Homo Sapiens
GQPPHLEEL

SEQ ID NO: 830868 - protein, 9 aa, Homo Sapiens
HNRFKNIDE

SEQ ID NO: 830869 - protein, 9 aa, Homo Sapiens
EDAAFTIYE

SEQ ID NO: 830870 - protein, 9 aa, Homo Sapiens
IGITFIKKR

SEQ ID NO: 830871 - protein, 9 aa, Homo Sapiens
EQPQSPKAP

SEQ ID NO: 830872 - protein, 9 aa, Homo Sapiens
MASRINTNL

SEQ ID NO: 830873 - protein, 9 aa, Homo Sapiens
ELIHKYIDS

SEQ ID NO: 830874 - protein, 9 aa, Homo Sapiens
AALQQANDD

SEQ ID NO: 830875 - protein, 9 aa, Homo Sapiens
DEKELEILQ

SEQ ID NO: 830876 - protein, 9 aa, Homo Sapiens
KARIELPWG

SEQ ID NO: 830877 - protein, 9 aa, Homo Sapiens
IDESWIQKY

SEQ ID NO: 830878 - protein, 9 aa, Homo Sapiens
ALCRDEPVV

SEQ ID NO: 830879 - protein, 9 aa, Homo Sapiens
THTPILRDL

SEQ ID NO: 830880 - protein, 9 aa, Homo Sapiens
VLDYFSEIS

SEQ ID NO: 830881 - protein, 9 aa, Homo Sapiens
DVAPSRLDL

SEQ ID NO: 830882 - protein, 9 aa, Homo Sapiens
TESWSLRMV

SEQ ID NO: 830883 - protein, 9 aa, Homo Sapiens
HNFVRVHVD

SEQ ID NO: 830884 - protein, 9 aa, Homo Sapiens
AYGTLEAGY

SEQ ID NO: 830885 - protein, 9 aa, Homo Sapiens
ANPKELYHE

SEQ ID NO: 830886 - protein, 9 aa, Homo Sapiens
GFPTSCETS

SEQ ID NO: 830887 - protein, 9 aa, Homo Sapiens
IAPKPKFLK

SEQ ID NO: 830888 - protein, 9 aa, Homo Sapiens
KLENIQSIF

SEQ ID NO: 830889 - protein, 9 aa, Homo Sapiens
NKNKFVSLI

SEQ ID NO: 830890 - protein, 9 aa, Homo Sapiens
PKDDANLLP

SEQ ID NO: 830891 - protein, 9 aa, Homo Sapiens
LCQEISTFY

SEQ ID NO: 830892 - protein, 9 aa, Homo Sapiens
MRESFTAYE

SEQ ID NO: 830893 - protein, 9 aa, Homo Sapiens
TSESSAADF

SEQ ID NO: 830894 - protein, 9 aa, Homo Sapiens
LIGNLAFVD

SEQ ID NO: 830895 - protein, 9 aa, Homo Sapiens
HFAFMYITI

SEQ ID NO: 830896 - protein, 9 aa, Homo Sapiens
RGRKRKMCS

SEQ ID NO: 830897 - protein, 9 aa, Homo Sapiens
RCNPCPKMC

SEQ ID NO: 830898 - protein, 9 aa, Homo Sapiens
GNYLRTSTG

SEQ ID NO: 830899 - protein, 9 aa, Homo Sapiens
LRLQEDRGV

SEQ ID NO: 830900 - protein, 9 aa, Homo Sapiens
AKRKTKANV

SEQ ID NO: 830901 - protein, 9 aa, Homo Sapiens
GPRGPSVPT

SEQ ID NO: 830902 - protein, 9 aa, Homo Sapiens
GNRNTFESE

SEQ ID NO: 830903 - protein, 9 aa, Homo Sapiens
LPVKLLLGA

SEQ ID NO: 830904 - protein, 9 aa, Homo Sapiens
KCKKEELLD

SEQ ID NO: 830905 - protein, 9 aa, Homo Sapiens
AATSMFETI

SEQ ID NO: 830906 - protein, 9 aa, Homo Sapiens
YPSGDAFVS

SEQ ID NO: 830907 - protein, 9 aa, Homo Sapiens
GHNNEKYCI

SEQ ID NO: 830908 - protein, 9 aa, Homo Sapiens
SGQYENDFL

SEQ ID NO: 830909 - protein, 9 aa, Homo Sapiens
QYFYSTFQA

SEQ ID NO: 830910 - protein, 9 aa, Homo Sapiens
YEEAQKEVH

SEQ ID NO: 830911 - protein, 9 aa, Homo Sapiens
RQHELLYTF

SEQ ID NO: 830912 - protein, 9 aa, Homo Sapiens
METEVKPMW

SEQ ID NO: 830913 - protein, 9 aa, Homo Sapiens
AANNVPRQN

SEQ ID NO: 830914 - protein, 9 aa, Homo Sapiens
WSPDNWLQP

SEQ ID NO: 830915 - protein, 9 aa, Homo Sapiens
DLMSEKLPQ

SEQ ID NO: 830916 - protein, 9 aa, Homo Sapiens
PPFSSLRED

SEQ ID NO: 830917 - protein, 9 aa, Homo Sapiens
LFKTVIQTI

SEQ ID NO: 830918 - protein, 9 aa, Homo Sapiens
MAIAVNKCD

SEQ ID NO: 830919 - protein, 9 aa, Homo Sapiens
HWVHRECDE

SEQ ID NO: 830920 - protein, 9 aa, Homo Sapiens
FRDVLNRCL

SEQ ID NO: 830921 - protein, 9 aa, Homo Sapiens
TVSQVLLSI

SEQ ID NO: 830922 - protein, 9 aa, Homo Sapiens
KSMSQWEEK

SEQ ID NO: 830923 - protein, 9 aa, Homo Sapiens
VVILAGTNQ

SEQ ID NO: 830924 - protein, 9 aa, Homo Sapiens
TEPYWSPAM

SEQ ID NO: 830925 - protein, 9 aa, Homo Sapiens
FDAKSSVDD

SEQ ID NO: 830926 - protein, 9 aa, Homo Sapiens
EGSVPAVTE

SEQ ID NO: 830927 - protein, 9 aa, Homo Sapiens
EQMKIVDVI

SEQ ID NO: 830928 - protein, 9 aa, Homo Sapiens
FCGRPCHLI

SEQ ID NO: 830929 - protein, 9 aa, Homo Sapiens
LAPKFAKRN

SEQ ID NO: 830930 - protein, 9 aa, Homo Sapiens
IQLAINQNG

SEQ ID NO: 830931 - protein, 9 aa, Homo Sapiens
LFGDVAVGF

SEQ ID NO: 830932 - protein, 9 aa, Homo Sapiens
SLQKQEAIC

SEQ ID NO: 830933 - protein, 9 aa, Homo Sapiens
QLLDTCFTL

SEQ ID NO: 830934 - protein, 9 aa, Homo Sapiens
WNFDVDGDG

SEQ ID NO: 830935 - protein, 9 aa, Homo Sapiens
IITTRPDLP

SEQ ID NO: 830936 - protein, 9 aa, Homo Sapiens
IEDILERDI

SEQ ID NO: 830937 - protein, 9 aa, Homo Sapiens
CYTFGQLIL

SEQ ID NO: 830938 - protein, 9 aa, Homo Sapiens
IHAGDKFYK

SEQ ID NO: 830939 - protein, 9 aa, Homo Sapiens
STKTRQRVE

SEQ ID NO: 830940 - protein, 9 aa, Homo Sapiens
DDEELLLAN

SEQ ID NO: 830941 - protein, 9 aa, Homo Sapiens
SNRLYDNIE

SEQ ID NO: 830942 - protein, 9 aa, Homo Sapiens
NKDEIEKIK

SEQ ID NO: 830943 - protein, 9 aa, Homo Sapiens
LPILAPFLE

SEQ ID NO: 830944 - protein, 9 aa, Homo Sapiens
HIHREREEL

SEQ ID NO: 830945 - protein, 9 aa, Homo Sapiens
FPRLDLKLV

SEQ ID NO: 830946 - protein, 9 aa, Homo Sapiens
IKETKKVYE

SEQ ID NO: 830947 - protein, 9 aa, Homo Sapiens
PYFRDKELS

SEQ ID NO: 830948 - protein, 9 aa, Homo Sapiens
TLCQAASDP

SEQ ID NO: 830949 - protein, 9 aa, Homo Sapiens
KTSSSSPSS

SEQ ID NO: 830950 - protein, 9 aa, Homo Sapiens
INRCKKIIL

SEQ ID NO: 830951 - protein, 9 aa, Homo Sapiens
CILCGKAFS

SEQ ID NO: 830952 - protein, 9 aa, Homo Sapiens
ADINGLQQV

SEQ ID NO: 830953 - protein, 9 aa, Homo Sapiens
FRTVERIEE

SEQ ID NO: 830954 - protein, 9 aa, Homo Sapiens
IKLESFEES

SEQ ID NO: 830955 - protein, 9 aa, Homo Sapiens
PAVDSLHTG

SEQ ID NO: 830956 - protein, 9 aa, Homo Sapiens
ELQCLDDPV

SEQ ID NO: 830957 - protein, 9 aa, Homo Sapiens
PFSSSSTRS

SEQ ID NO: 830958 - protein, 9 aa, Homo Sapiens
GEMAGASVA

SEQ ID NO: 830959 - protein, 9 aa, Homo Sapiens
INLHDNPWD

SEQ ID NO: 830960 - protein, 9 aa, Homo Sapiens
MKCCIHGSG

SEQ ID NO: 830961 - protein, 9 aa, Homo Sapiens
SFILRRLPL

SEQ ID NO: 830962 - protein, 9 aa, Homo Sapiens
SVTFDNVAV

SEQ ID NO: 830963 - protein, 9 aa, Homo Sapiens
FTVAFAGFN

SEQ ID NO: 830964 - protein, 9 aa, Homo Sapiens
CYLGCDLPQ

SEQ ID NO: 830965 - protein, 9 aa, Homo Sapiens
DVFRHRNPP

SEQ ID NO: 830966 - protein, 9 aa, Homo Sapiens
GGKMAGQLF

SEQ ID NO: 830967 - protein, 9 aa, Homo Sapiens
EVPNVAYSL

SEQ ID NO: 830968 - protein, 9 aa, Homo Sapiens
NGSLSPPCP

SEQ ID NO: 830969 - protein, 9 aa, Homo Sapiens
LMDKELLRL

SEQ ID NO: 830970 - protein, 9 aa, Homo Sapiens
TEESYMKLG

SEQ ID NO: 830971 - protein, 9 aa, Homo Sapiens
TCSLHFPHK

SEQ ID NO: 830972 - protein, 9 aa, Homo Sapiens
PDRARRAQN

SEQ ID NO: 830973 - protein, 9 aa, Homo Sapiens
QLVRNDYLW

SEQ ID NO: 830974 - protein, 9 aa, Homo Sapiens
ISKTSTELA

SEQ ID NO: 830975 - protein, 9 aa, Homo Sapiens
CQDLEVFYP

SEQ ID NO: 830976 - protein, 9 aa, Homo Sapiens
YKTKEIARA

SEQ ID NO: 830977 - protein, 9 aa, Homo Sapiens
NRCKKIILP

SEQ ID NO: 830978 - protein, 9 aa, Homo Sapiens
EMQQRADQL

SEQ ID NO: 830979 - protein, 9 aa, Homo Sapiens
KSYLVGCSV

SEQ ID NO: 830980 - protein, 9 aa, Homo Sapiens
RASLQYELR

SEQ ID NO: 830981 - protein, 9 aa, Homo Sapiens
TIVVNLIGL

SEQ ID NO: 830982 - protein, 9 aa, Homo Sapiens
FLSADYNKI

SEQ ID NO: 830983 - protein, 9 aa, Homo Sapiens
AKSLEAPIK

SEQ ID NO: 830984 - protein, 9 aa, Homo Sapiens
RMRPYTCKT

SEQ ID NO: 830985 - protein, 9 aa, Homo Sapiens
RNDKVFVAS

SEQ ID NO: 830986 - protein, 9 aa, Homo Sapiens
KTDFDEEPQ

SEQ ID NO: 830987 - protein, 9 aa, Homo Sapiens
LQHVVKVDF

SEQ ID NO: 830988 - protein, 9 aa, Homo Sapiens
SLEPPEKLT

SEQ ID NO: 830989 - protein, 9 aa, Homo Sapiens
DPEGMGVIP

SEQ ID NO: 830990 - protein, 9 aa, Homo Sapiens
LENYNSPVP

SEQ ID NO: 830991 - protein, 9 aa, Homo Sapiens
RNLYSALKN

SEQ ID NO: 830992 - protein, 9 aa, Homo Sapiens
TTIKMWEVQ

SEQ ID NO: 830993 - protein, 9 aa, Homo Sapiens
QRTHMKDKL

SEQ ID NO: 830994 - protein, 9 aa, Homo Sapiens
ILKQRPNLR

SEQ ID NO: 830995 - protein, 9 aa, Homo Sapiens
YGSILQEHP

SEQ ID NO: 830996 - protein, 9 aa, Homo Sapiens
QNMACIIYS

SEQ ID NO: 830997 - protein, 9 aa, Homo Sapiens
RFAMYGEEC

SEQ ID NO: 830998 - protein, 9 aa, Homo Sapiens
DPQGNIGSY

SEQ ID NO: 830999 - protein, 9 aa, Homo Sapiens
CRVLSHKGM

SEQ ID NO: 831000 - protein, 9 aa, Homo Sapiens
TTEILGLTI

SEQ ID NO: 831001 - protein, 9 aa, Homo Sapiens
MTIIGIIYI

SEQ ID NO: 831002 - protein, 9 aa, Homo Sapiens
LFQVDIQPE

SEQ ID NO: 831003 - protein, 9 aa, Homo Sapiens
PRLPAVDTS

SEQ ID NO: 831004 - protein, 9 aa, Homo Sapiens
GTGRDMAST

SEQ ID NO: 831005 - protein, 9 aa, Homo Sapiens
HSGSRDLSR

SEQ ID NO: 831006 - protein, 9 aa, Homo Sapiens
SCGNVRGNA

SEQ ID NO: 831007 - protein, 9 aa, Homo Sapiens
VVMPKKKQA

SEQ ID NO: 831008 - protein, 9 aa, Homo Sapiens
NNSYIKAFF

SEQ ID NO: 831009 - protein, 9 aa, Homo Sapiens
NRPRRVLNT

SEQ ID NO: 831010 - protein, 9 aa, Homo Sapiens
TEAVNYHDK

SEQ ID NO: 831011 - protein, 9 aa, Homo Sapiens
CNMQNNTFP

SEQ ID NO: 831012 - protein, 9 aa, Homo Sapiens
VSAAHVIKR

SEQ ID NO: 831013 - protein, 9 aa, Homo Sapiens
YSSHSGRSV

SEQ ID NO: 831014 - protein, 9 aa, Homo Sapiens
NEFAHYTVI

SEQ ID NO: 831015 - protein, 9 aa, Homo Sapiens
DEDKIITYE

SEQ ID NO: 831016 - protein, 9 aa, Homo Sapiens
NHALYAMCD

SEQ ID NO: 831017 - protein, 9 aa, Homo Sapiens
QRKQNVLRS

SEQ ID NO: 831018 - protein, 9 aa, Homo Sapiens
SHRPSLRQN

SEQ ID NO: 831019 - protein, 9 aa, Homo Sapiens
AHGLLDPYS

SEQ ID NO: 831020 - protein, 9 aa, Homo Sapiens
CLCLCVCTC

SEQ ID NO: 831021 - protein, 9 aa, Homo Sapiens
DNRLKALQL

SEQ ID NO: 831022 - protein, 9 aa, Homo Sapiens
CFYDIDIDT

SEQ ID NO: 831023 - protein, 9 aa, Homo Sapiens
SKNEAPVVH

SEQ ID NO: 831024 - protein, 9 aa, Homo Sapiens
EIQKRGVSK

SEQ ID NO: 831025 - protein, 9 aa, Homo Sapiens
GMDYTIMTG

SEQ ID NO: 831026 - protein, 9 aa, Homo Sapiens
IIFISPDLH

SEQ ID NO: 831027 - protein, 9 aa, Homo Sapiens
LPGVSHSGF

SEQ ID NO: 831028 - protein, 9 aa, Homo Sapiens
GLCVHVCLC

SEQ ID NO: 831029 - protein, 9 aa, Homo Sapiens
GDNEKQKKK

SEQ ID NO: 831030 - protein, 9 aa, Homo Sapiens
NWHQSAMAK

SEQ ID NO: 831031 - protein, 9 aa, Homo Sapiens
AHCPSPTMS

SEQ ID NO: 831032 - protein, 9 aa, Homo Sapiens
VADLITTLT

SEQ ID NO: 831033 - protein, 9 aa, Homo Sapiens
TLTYMSHQN

SEQ ID NO: 831034 - protein, 9 aa, Homo Sapiens
TKGSAGKMN

SEQ ID NO: 831035 - protein, 9 aa, Homo Sapiens
LNKLQDKIE

SEQ ID NO: 831036 - protein, 9 aa, Homo Sapiens
IPNMIADTF

SEQ ID NO: 831037 - protein, 9 aa, Homo Sapiens
HSISKPDLI

SEQ ID NO: 831038 - protein, 9 aa, Homo Sapiens
FEENIKLQQ

SEQ ID NO: 831039 - protein, 9 aa, Homo Sapiens
YFPKKLLRM

SEQ ID NO: 831040 - protein, 9 aa, Homo Sapiens
DNKDYGSTR

SEQ ID NO: 831041 - protein, 9 aa, Homo Sapiens
SIEILGKSV

SEQ ID NO: 831042 - protein, 9 aa, Homo Sapiens
VDQDNTENP

SEQ ID NO: 831043 - protein, 9 aa, Homo Sapiens
QQQQQQTQM

SEQ ID NO: 831044 - protein, 9 aa, Homo Sapiens
AWGMPSPST

SEQ ID NO: 831045 - protein, 9 aa, Homo Sapiens
VERERALQE

SEQ ID NO: 831046 - protein, 9 aa, Homo Sapiens
KRALNDVFH

SEQ ID NO: 831047 - protein, 9 aa, Homo Sapiens
SPTFRSSYW

SEQ ID NO: 831048 - protein, 9 aa, Homo Sapiens
VAHNRIQSF

SEQ ID NO: 831049 - protein, 9 aa, Homo Sapiens
QQISDAIYR

SEQ ID NO: 831050 - protein, 9 aa, Homo Sapiens
SFVPGSTRK

SEQ ID NO: 831051 - protein, 9 aa, Homo Sapiens
GDEDEDDLN

SEQ ID NO: 831052 - protein, 9 aa, Homo Sapiens
IKMPYSPGL

SEQ ID NO: 831053 - protein, 9 aa, Homo Sapiens
CHFGFEVYP

SEQ ID NO: 831054 - protein, 9 aa, Homo Sapiens
DVFQKFGKV

SEQ ID NO: 831055 - protein, 9 aa, Homo Sapiens
SRTRNIRDG

SEQ ID NO: 831056 - protein, 9 aa, Homo Sapiens
HITYNNLSD

SEQ ID NO: 831057 - protein, 9 aa, Homo Sapiens
QKIAFEDSK

SEQ ID NO: 831058 - protein, 9 aa, Homo Sapiens
GAKKHVMPF

SEQ ID NO: 831059 - protein, 9 aa, Homo Sapiens
GKAFIYSNS

SEQ ID NO: 831060 - protein, 9 aa, Homo Sapiens
GLYCNETCY

SEQ ID NO: 831061 - protein, 9 aa, Homo Sapiens
LSGPGLVCM

SEQ ID NO: 831062 - protein, 9 aa, Homo Sapiens
DSAITYHGS

SEQ ID NO: 831063 - protein, 9 aa, Homo Sapiens
VQWLINNLT

SEQ ID NO: 831064 - protein, 9 aa, Homo Sapiens
FWTDKEELN

SEQ ID NO: 831065 - protein, 9 aa, Homo Sapiens
KTITEFVLL

SEQ ID NO: 831066 - protein, 9 aa, Homo Sapiens
KDKIYLSAP

SEQ ID NO: 831067 - protein, 9 aa, Homo Sapiens
QQVDKASPG

SEQ ID NO: 831068 - protein, 9 aa, Homo Sapiens
LEKLASQKL

SEQ ID NO: 831069 - protein, 9 aa, Homo Sapiens
DLIRPLRIH

SEQ ID NO: 831070 - protein, 9 aa, Homo Sapiens
VMLGAWGVG

SEQ ID NO: 831071 - protein, 9 aa, Homo Sapiens
MDCFEMCAS

SEQ ID NO: 831072 - protein, 9 aa, Homo Sapiens
GRCVIYKKS

SEQ ID NO: 831073 - protein, 9 aa, Homo Sapiens
LFGGEPKHP

SEQ ID NO: 831074 - protein, 9 aa, Homo Sapiens
YGFSSLFKG

SEQ ID NO: 831075 - protein, 9 aa, Homo Sapiens
ASGQFTHES

SEQ ID NO: 831076 - protein, 9 aa, Homo Sapiens
ISGFILQCT

SEQ ID NO: 831077 - protein, 9 aa, Homo Sapiens
GGDSHILEL

SEQ ID NO: 831078 - protein, 9 aa, Homo Sapiens
HSIKKMSLR

SEQ ID NO: 831079 - protein, 9 aa, Homo Sapiens
MFIDAMLLV

SEQ ID NO: 831080 - protein, 9 aa, Homo Sapiens
QRLIHREPG

SEQ ID NO: 831081 - protein, 9 aa, Homo Sapiens
MQKYVPNKA

SEQ ID NO: 831082 - protein, 9 aa, Homo Sapiens
EVAKHYLST

SEQ ID NO: 831083 - protein, 9 aa, Homo Sapiens
GPKGKDYCI

SEQ ID NO: 831084 - protein, 9 aa, Homo Sapiens
SASMHNHIE

SEQ ID NO: 831085 - protein, 9 aa, Homo Sapiens
AETERLFGK

SEQ ID NO: 831086 - protein, 9 aa, Homo Sapiens
KWNKKLLYK

SEQ ID NO: 831087 - protein, 9 aa, Homo Sapiens
VIDSQTVSE

SEQ ID NO: 831088 - protein, 9 aa, Homo Sapiens
YLDLNFNQI

SEQ ID NO: 831089 - protein, 9 aa, Homo Sapiens
DILLPSPLT

SEQ ID NO: 831090 - protein, 9 aa, Homo Sapiens
GSFVENDMF

SEQ ID NO: 831091 - protein, 9 aa, Homo Sapiens
SVGSPNKKH

SEQ ID NO: 831092 - protein, 9 aa, Homo Sapiens
CGIVCSSEA

SEQ ID NO: 831093 - protein, 9 aa, Homo Sapiens
NGEATGRDR

SEQ ID NO: 831094 - protein, 9 aa, Homo Sapiens
IHRLLETSN

SEQ ID NO: 831095 - protein, 9 aa, Homo Sapiens
RATALAGTP

SEQ ID NO: 831096 - protein, 9 aa, Homo Sapiens
AAVSCVPIS

SEQ ID NO: 831097 - protein, 9 aa, Homo Sapiens
GVHTNGADI

SEQ ID NO: 831098 - protein, 9 aa, Homo Sapiens
KSTQEGEAV

SEQ ID NO: 831099 - protein, 9 aa, Homo Sapiens
LMNLHNNIA

SEQ ID NO: 831100 - protein, 9 aa, Homo Sapiens
MKASLCSPT

SEQ ID NO: 831101 - protein, 9 aa, Homo Sapiens
INSHKRTCQ

SEQ ID NO: 831102 - protein, 9 aa, Homo Sapiens
KEGAEKIKT

SEQ ID NO: 831103 - protein, 9 aa, Homo Sapiens
QLILPGLAY

SEQ ID NO: 831104 - protein, 9 aa, Homo Sapiens
TYFQEFSLT

SEQ ID NO: 831105 - protein, 9 aa, Homo Sapiens
SGAAQASPS

SEQ ID NO: 831106 - protein, 9 aa, Homo Sapiens
DNFISRAFA

SEQ ID NO: 831107 - protein, 9 aa, Homo Sapiens
IKRSIQDIK

SEQ ID NO: 831108 - protein, 9 aa, Homo Sapiens
PQHNVMIST

SEQ ID NO: 831109 - protein, 9 aa, Homo Sapiens
EPTSFKHGE

SEQ ID NO: 831110 - protein, 9 aa, Homo Sapiens
EGMYNIIED

SEQ ID NO: 831111 - protein, 9 aa, Homo Sapiens
KLKQKEANQ

SEQ ID NO: 831112 - protein, 9 aa, Homo Sapiens
ASYNISYFT

SEQ ID NO: 831113 - protein, 9 aa, Homo Sapiens
SEAKIAHKI

SEQ ID NO: 831114 - protein, 9 aa, Homo Sapiens
KQIDDAMCN

SEQ ID NO: 831115 - protein, 9 aa, Homo Sapiens
MGKPVPFST

SEQ ID NO: 831116 - protein, 9 aa, Homo Sapiens
QDLSYGVLS

SEQ ID NO: 831117 - protein, 9 aa, Homo Sapiens
RLDDNFVRG

SEQ ID NO: 831118 - protein, 9 aa, Homo Sapiens
AVEFILIKS

SEQ ID NO: 831119 - protein, 9 aa, Homo Sapiens
GKNVVTPLL

SEQ ID NO: 831120 - protein, 9 aa, Homo Sapiens
AETLWKAMK

SEQ ID NO: 831121 - protein, 9 aa, Homo Sapiens
GRGCTDYVS

SEQ ID NO: 831122 - protein, 9 aa, Homo Sapiens
NQIEIIDQL

SEQ ID NO: 831123 - protein, 9 aa, Homo Sapiens
NRAHFLPGK

SEQ ID NO: 831124 - protein, 9 aa, Homo Sapiens
EEAHKICEG

SEQ ID NO: 831125 - protein, 9 aa, Homo Sapiens
SSSVHGSDG

SEQ ID NO: 831126 - protein, 9 aa, Homo Sapiens
QEVIDVESL

SEQ ID NO: 831127 - protein, 9 aa, Homo Sapiens
RTKEINQGI

SEQ ID NO: 831128 - protein, 9 aa, Homo Sapiens
YSPISIASA

SEQ ID NO: 831129 - protein, 9 aa, Homo Sapiens
IEFSPGGEP

SEQ ID NO: 831130 - protein, 9 aa, Homo Sapiens
YTILQKSQK

SEQ ID NO: 831131 - protein, 9 aa, Homo Sapiens
SSVLHHCCD

SEQ ID NO: 831132 - protein, 9 aa, Homo Sapiens
MDDSKNNFQ

SEQ ID NO: 831133 - protein, 9 aa, Homo Sapiens
FTTGDVIDC

SEQ ID NO: 831134 - protein, 9 aa, Homo Sapiens
NVTQTVHCF

SEQ ID NO: 831135 - protein, 9 aa, Homo Sapiens
DSNFKDLQT

SEQ ID NO: 831136 - protein, 9 aa, Homo Sapiens
VQKTWQESG

SEQ ID NO: 831137 - protein, 9 aa, Homo Sapiens
TTIVTSGTR

SEQ ID NO: 831138 - protein, 9 aa, Homo Sapiens
FGRLERTLD

SEQ ID NO: 831139 - protein, 9 aa, Homo Sapiens
MGVIPRIVQ

SEQ ID NO: 831140 - protein, 9 aa, Homo Sapiens
GRDAERKSL

SEQ ID NO: 831141 - protein, 9 aa, Homo Sapiens
LIVSILYLK

SEQ ID NO: 831142 - protein, 9 aa, Homo Sapiens
HSSGSILFL

SEQ ID NO: 831143 - protein, 9 aa, Homo Sapiens
ANTVDNFFC

SEQ ID NO: 831144 - protein, 9 aa, Homo Sapiens
RVLTELMSK

SEQ ID NO: 831145 - protein, 9 aa, Homo Sapiens
LMDQNRDGL

SEQ ID NO: 831146 - protein, 9 aa, Homo Sapiens
TAQTFDWMK

SEQ ID NO: 831147 - protein, 9 aa, Homo Sapiens
AVDIWSVGC

SEQ ID NO: 831148 - protein, 9 aa, Homo Sapiens
NKWAAQTTD

SEQ ID NO: 831149 - protein, 9 aa, Homo Sapiens
RQVCKQLIQ

SEQ ID NO: 831150 - protein, 9 aa, Homo Sapiens
SPSLNVLQN

SEQ ID NO: 831151 - protein, 9 aa, Homo Sapiens
TCWMAGIPG

SEQ ID NO: 831152 - protein, 9 aa, Homo Sapiens
TGIMNKPEE

SEQ ID NO: 831153 - protein, 9 aa, Homo Sapiens
QGLFALSRG

SEQ ID NO: 831154 - protein, 9 aa, Homo Sapiens
CFEMCASLI

SEQ ID NO: 831155 - protein, 9 aa, Homo Sapiens
TDDPTRRAG

SEQ ID NO: 831156 - protein, 9 aa, Homo Sapiens
EVLTAAVAQ

SEQ ID NO: 831157 - protein, 9 aa, Homo Sapiens
HLYKITQNG

SEQ ID NO: 831158 - protein, 9 aa, Homo Sapiens
LEEDIHFND

SEQ ID NO: 831159 - protein, 9 aa, Homo Sapiens
NGSKTVIQH

SEQ ID NO: 831160 - protein, 9 aa, Homo Sapiens
NKLENGGAH

SEQ ID NO: 831161 - protein, 9 aa, Homo Sapiens
KTFSQSSIL

SEQ ID NO: 831162 - protein, 9 aa, Homo Sapiens
GFFQDIEEE

SEQ ID NO: 831163 - protein, 9 aa, Homo Sapiens
MSCGASDCL

SEQ ID NO: 831164 - protein, 9 aa, Homo Sapiens
PPNRYLVKA

SEQ ID NO: 831165 - protein, 9 aa, Homo Sapiens
TTCLALGTH

SEQ ID NO: 831166 - protein, 9 aa, Homo Sapiens
SSKMKAPVL

SEQ ID NO: 831167 - protein, 9 aa, Homo Sapiens
LQPRSLLIQ

SEQ ID NO: 831168 - protein, 9 aa, Homo Sapiens
IQGYAEGVE

SEQ ID NO: 831169 - protein, 9 aa, Homo Sapiens
NVRIGMQYF

SEQ ID NO: 831170 - protein, 9 aa, Homo Sapiens
CTNTRVYKK

SEQ ID NO: 831171 - protein, 9 aa, Homo Sapiens
ETKIISVFI

SEQ ID NO: 831172 - protein, 9 aa, Homo Sapiens
TINRQIVDH

SEQ ID NO: 831173 - protein, 9 aa, Homo Sapiens
AAFHLDRIM

SEQ ID NO: 831174 - protein, 9 aa, Homo Sapiens
KSRIRSTFQ

SEQ ID NO: 831175 - protein, 9 aa, Homo Sapiens
AEELCNEGQ

SEQ ID NO: 831176 - protein, 9 aa, Homo Sapiens
CTVIFSNQT

SEQ ID NO: 831177 - protein, 9 aa, Homo Sapiens
FARTGVCIR

SEQ ID NO: 831178 - protein, 9 aa, Homo Sapiens
ECHKCGKTF

SEQ ID NO: 831179 - protein, 9 aa, Homo Sapiens
NLLDVRFHE

SEQ ID NO: 831180 - protein, 9 aa, Homo Sapiens
KEGNIIHFQ

SEQ ID NO: 831181 - protein, 9 aa, Homo Sapiens
FPAPFYYKN

SEQ ID NO: 831182 - protein, 9 aa, Homo Sapiens
WNKFYAVLK

SEQ ID NO: 831183 - protein, 9 aa, Homo Sapiens
KEQIQNAGG

SEQ ID NO: 831184 - protein, 9 aa, Homo Sapiens
DLHRSPHQA

SEQ ID NO: 831185 - protein, 9 aa, Homo Sapiens
WIDQQIQKR

SEQ ID NO: 831186 - protein, 9 aa, Homo Sapiens
ASDGKAYDN

SEQ ID NO: 831187 - protein, 9 aa, Homo Sapiens
GNKETSPES

SEQ ID NO: 831188 - protein, 9 aa, Homo Sapiens
YSTNKAKKR

SEQ ID NO: 831189 - protein, 9 aa, Homo Sapiens
HHIEGVHVH

SEQ ID NO: 831190 - protein, 9 aa, Homo Sapiens
GAQTLHRAS

SEQ ID NO: 831191 - protein, 9 aa, Homo Sapiens
LDLGKCILD

SEQ ID NO: 831192 - protein, 9 aa, Homo Sapiens
AGNAATVCK

SEQ ID NO: 831193 - protein, 9 aa, Homo Sapiens
QLPKAAKTP

SEQ ID NO: 831194 - protein, 9 aa, Homo Sapiens
AVCQQRIQR

SEQ ID NO: 831195 - protein, 9 aa, Homo Sapiens
KQVPRAAPA

SEQ ID NO: 831196 - protein, 9 aa, Homo Sapiens
LNRICRISH

SEQ ID NO: 831197 - protein, 9 aa, Homo Sapiens
VRTHSVVCM

SEQ ID NO: 831198 - protein, 9 aa, Homo Sapiens
VFLRDFVSI

SEQ ID NO: 831199 - protein, 9 aa, Homo Sapiens
EESYMKLGR

SEQ ID NO: 831200 - protein, 9 aa, Homo Sapiens
TVKEHAHQI

SEQ ID NO: 831201 - protein, 9 aa, Homo Sapiens
DASYLDNML

SEQ ID NO: 831202 - protein, 9 aa, Homo Sapiens
RDGLIDKED

SEQ ID NO: 831203 - protein, 9 aa, Homo Sapiens
YFPPPPPHT

SEQ ID NO: 831204 - protein, 9 aa, Homo Sapiens
PATREKKTI

SEQ ID NO: 831205 - protein, 9 aa, Homo Sapiens
NIKHKAKPQ

SEQ ID NO: 831206 - protein, 9 aa, Homo Sapiens
EPPVLTKVS

SEQ ID NO: 831207 - protein, 9 aa, Homo Sapiens
QIILEQAFY

SEQ ID NO: 831208 - protein, 9 aa, Homo Sapiens
IQQGLQTLS

SEQ ID NO: 831209 - protein, 9 aa, Homo Sapiens
IGFVLKISL

SEQ ID NO: 831210 - protein, 9 aa, Homo Sapiens
QPHQDANPE

SEQ ID NO: 831211 - protein, 9 aa, Homo Sapiens
VQDAQPNPG

SEQ ID NO: 831212 - protein, 9 aa, Homo Sapiens
TGSVQTPPA

SEQ ID NO: 831213 - protein, 9 aa, Homo Sapiens
LELSGGAQI

SEQ ID NO: 831214 - protein, 9 aa, Homo Sapiens
SDGDGIGNA

SEQ ID NO: 831215 - protein, 9 aa, Homo Sapiens
TVTHSIKKM

SEQ ID NO: 831216 - protein, 9 aa, Homo Sapiens
RLGMKKEQL

SEQ ID NO: 831217 - protein, 9 aa, Homo Sapiens
KDTKEKRTI

SEQ ID NO: 831218 - protein, 9 aa, Homo Sapiens
GVEGGHSIE

SEQ ID NO: 831219 - protein, 9 aa, Homo Sapiens
QIPLSAFNW

SEQ ID NO: 831220 - protein, 9 aa, Homo Sapiens
PGVPNLPEI

SEQ ID NO: 831221 - protein, 9 aa, Homo Sapiens
SLRQRDAFG

SEQ ID NO: 831222 - protein, 9 aa, Homo Sapiens
PGLVCMVTV

SEQ ID NO: 831223 - protein, 9 aa, Homo Sapiens
HGISSQISW

SEQ ID NO: 831224 - protein, 9 aa, Homo Sapiens
QSSKFQEGV

SEQ ID NO: 831225 - protein, 9 aa, Homo Sapiens
KTKWKDLKL

SEQ ID NO: 831226 - protein, 9 aa, Homo Sapiens
CLQSGIDFA

SEQ ID NO: 831227 - protein, 9 aa, Homo Sapiens
VSAVLFYIN

SEQ ID NO: 831228 - protein, 9 aa, Homo Sapiens
RRSQSNYMA

SEQ ID NO: 831229 - protein, 9 aa, Homo Sapiens
TELTTAIHT

SEQ ID NO: 831230 - protein, 9 aa, Homo Sapiens
QVIEICSCP

SEQ ID NO: 831231 - protein, 9 aa, Homo Sapiens
RGICGCVDK

SEQ ID NO: 831232 - protein, 9 aa, Homo Sapiens
SPTSPDYSP

SEQ ID NO: 831233 - protein, 9 aa, Homo Sapiens
RTHSHGTRA

SEQ ID NO: 831234 - protein, 9 aa, Homo Sapiens
RRPQNDRRN

SEQ ID NO: 831235 - protein, 9 aa, Homo Sapiens
VQFSWNVWP

SEQ ID NO: 831236 - protein, 9 aa, Homo Sapiens
YPQLNVSQL

SEQ ID NO: 831237 - protein, 9 aa, Homo Sapiens
DIMIDSRIV

SEQ ID NO: 831238 - protein, 9 aa, Homo Sapiens
KDEANQEDK

SEQ ID NO: 831239 - protein, 9 aa, Homo Sapiens
FNPSWKTSA

SEQ ID NO: 831240 - protein, 9 aa, Homo Sapiens
AFLRSYQRT

SEQ ID NO: 831241 - protein, 9 aa, Homo Sapiens
QRPNKSTGG

SEQ ID NO: 831242 - protein, 9 aa, Homo Sapiens
EKLENNLSD

SEQ ID NO: 831243 - protein, 9 aa, Homo Sapiens
CLMGRHDFG

SEQ ID NO: 831244 - protein, 9 aa, Homo Sapiens
RNLIRKISD

SEQ ID NO: 831245 - protein, 9 aa, Homo Sapiens
ADNIAVGLA

SEQ ID NO: 831246 - protein, 9 aa, Homo Sapiens
GIPVMALII

SEQ ID NO: 831247 - protein, 9 aa, Homo Sapiens
VELKDDRTE

SEQ ID NO: 831248 - protein, 9 aa, Homo Sapiens
LYGTSIWKA

SEQ ID NO: 831249 - protein, 9 aa, Homo Sapiens
YIQALREGD

SEQ ID NO: 831250 - protein, 9 aa, Homo Sapiens
KIKLAVLEG

SEQ ID NO: 831251 - protein, 9 aa, Homo Sapiens
SVTALRFTM

SEQ ID NO: 831252 - protein, 9 aa, Homo Sapiens
SHCSATPTP

SEQ ID NO: 831253 - protein, 9 aa, Homo Sapiens
FEVSSYLIL

SEQ ID NO: 831254 - protein, 9 aa, Homo Sapiens
SAFTFGIDS

SEQ ID NO: 831255 - protein, 9 aa, Homo Sapiens
LFIFNEAEK

SEQ ID NO: 831256 - protein, 9 aa, Homo Sapiens
VNINFSLSY

SEQ ID NO: 831257 - protein, 9 aa, Homo Sapiens
GHVSGIGGL

SEQ ID NO: 831258 - protein, 9 aa, Homo Sapiens
HTPTLASTP

SEQ ID NO: 831259 - protein, 9 aa, Homo Sapiens
FCDSHKKYS

SEQ ID NO: 831260 - protein, 9 aa, Homo Sapiens
IRKDLIQHF

SEQ ID NO: 831261 - protein, 9 aa, Homo Sapiens
TFQSRVMNV

SEQ ID NO: 831262 - protein, 9 aa, Homo Sapiens
ERKYYIVEN

SEQ ID NO: 831263 - protein, 9 aa, Homo Sapiens
VLRSKCKIN

SEQ ID NO: 831264 - protein, 9 aa, Homo Sapiens
FDLQNPSQM

SEQ ID NO: 831265 - protein, 9 aa, Homo Sapiens
DVEKEVKQL

SEQ ID NO: 831266 - protein, 9 aa, Homo Sapiens
ALNARFPGC

SEQ ID NO: 831267 - protein, 9 aa, Homo Sapiens
RRYDELHNS

SEQ ID NO: 831268 - protein, 9 aa, Homo Sapiens
RQMKINTYK

SEQ ID NO: 831269 - protein, 9 aa, Homo Sapiens
QHKSEGNYL

SEQ ID NO: 831270 - protein, 9 aa, Homo Sapiens
FRSSYWRVF

SEQ ID NO: 831271 - protein, 9 aa, Homo Sapiens
PSFSQRGRC

SEQ ID NO: 831272 - protein, 9 aa, Homo Sapiens
GKPVINVRI

SEQ ID NO: 831273 - protein, 9 aa, Homo Sapiens
KKHVMPFWR

SEQ ID NO: 831274 - protein, 9 aa, Homo Sapiens
ETKKVYEGE

SEQ ID NO: 831275 - protein, 9 aa, Homo Sapiens
AKFCKQERA

SEQ ID NO: 831276 - protein, 9 aa, Homo Sapiens
GKAAASVCS

SEQ ID NO: 831277 - protein, 9 aa, Homo Sapiens
DLMTLFEVG

SEQ ID NO: 831278 - protein, 9 aa, Homo Sapiens
HIISIHASP

SEQ ID NO: 831279 - protein, 9 aa, Homo Sapiens
MVADTSKVK

SEQ ID NO: 831280 - protein, 9 aa, Homo Sapiens
GLVNLCIFL

SEQ ID NO: 831281 - protein, 9 aa, Homo Sapiens
YWRGLFAAT

SEQ ID NO: 831282 - protein, 9 aa, Homo Sapiens
TFLRQLCTY

SEQ ID NO: 831283 - protein, 9 aa, Homo Sapiens
MAGAPNSRP

SEQ ID NO: 831284 - protein, 9 aa, Homo Sapiens
SVFKNAMYI

SEQ ID NO: 831285 - protein, 9 aa, Homo Sapiens
NVVTPLLNA

SEQ ID NO: 831286 - protein, 9 aa, Homo Sapiens
SLALVATLH

SEQ ID NO: 831287 - protein, 9 aa, Homo Sapiens
LESADKLYG

SEQ ID NO: 831288 - protein, 9 aa, Homo Sapiens
NTGNRTIIG

SEQ ID NO: 831289 - protein, 9 aa, Homo Sapiens
VLFEWERTG

SEQ ID NO: 831290 - protein, 9 aa, Homo Sapiens
ARILYLNEK

SEQ ID NO: 831291 - protein, 9 aa, Homo Sapiens
KGTSLAEIL

SEQ ID NO: 831292 - protein, 9 aa, Homo Sapiens
AYHMSYTMK

SEQ ID NO: 831293 - protein, 9 aa, Homo Sapiens
AMQGQTDCI

SEQ ID NO: 831294 - protein, 9 aa, Homo Sapiens
VAYQVYSGG

SEQ ID NO: 831295 - protein, 9 aa, Homo Sapiens
RDITIATRN

SEQ ID NO: 831296 - protein, 9 aa, Homo Sapiens
VCCKGINIS

SEQ ID NO: 831297 - protein, 9 aa, Homo Sapiens
LQSSHRAVE

SEQ ID NO: 831298 - protein, 9 aa, Homo Sapiens
YIEIYRVAG

SEQ ID NO: 831299 - protein, 9 aa, Homo Sapiens
HLEERVAVV

SEQ ID NO: 831300 - protein, 9 aa, Homo Sapiens
PLKNAKDLD

SEQ ID NO: 831301 - protein, 9 aa, Homo Sapiens
NCPHKFLQV

SEQ ID NO: 831302 - protein, 9 aa, Homo Sapiens
HAGCIFRFG

SEQ ID NO: 831303 - protein, 9 aa, Homo Sapiens
VLNSRKLFL

SEQ ID NO: 831304 - protein, 9 aa, Homo Sapiens
NCLWYVPRH

SEQ ID NO: 831305 - protein, 9 aa, Homo Sapiens
EHEAFLLAL

SEQ ID NO: 831306 - protein, 9 aa, Homo Sapiens
YIAGYLFPA

SEQ ID NO: 831307 - protein, 9 aa, Homo Sapiens
FGRPLNIVC

SEQ ID NO: 831308 - protein, 9 aa, Homo Sapiens
TGDKFYKCE

SEQ ID NO: 831309 - protein, 9 aa, Homo Sapiens
EKVSGQVGY

SEQ ID NO: 831310 - protein, 9 aa, Homo Sapiens
KSSKMVCKA

SEQ ID NO: 831311 - protein, 9 aa, Homo Sapiens
LISDLQKYA

SEQ ID NO: 831312 - protein, 9 aa, Homo Sapiens
GADYVSSRA

SEQ ID NO: 831313 - protein, 9 aa, Homo Sapiens
QHLFEACRL

SEQ ID NO: 831314 - protein, 9 aa, Homo Sapiens
LITVTLSNQ

SEQ ID NO: 831315 - protein, 9 aa, Homo Sapiens
IIHTGEEPY

SEQ ID NO: 831316 - protein, 9 aa, Homo Sapiens
SSSTRDYQT

SEQ ID NO: 831317 - protein, 9 aa, Homo Sapiens
GFNNEKFAD

SEQ ID NO: 831318 - protein, 9 aa, Homo Sapiens
SFDSYYSLL

SEQ ID NO: 831319 - protein, 9 aa, Homo Sapiens
SFEILTKQQ

SEQ ID NO: 831320 - protein, 9 aa, Homo Sapiens
NTVIDQMKK

SEQ ID NO: 831321 - protein, 9 aa, Homo Sapiens
TENYFTLDA

SEQ ID NO: 831322 - protein, 9 aa, Homo Sapiens
IYRYLKPEN

SEQ ID NO: 831323 - protein, 9 aa, Homo Sapiens
TKLENKTIR

SEQ ID NO: 831324 - protein, 9 aa, Homo Sapiens
SGSTGFGNV

SEQ ID NO: 831325 - protein, 9 aa, Homo Sapiens
ILYQNRVPL

SEQ ID NO: 831326 - protein, 9 aa, Homo Sapiens
FILDHHCWV

SEQ ID NO: 831327 - protein, 9 aa, Homo Sapiens
IGEKAAKWK

SEQ ID NO: 831328 - protein, 9 aa, Homo Sapiens
NNYFITHSL

SEQ ID NO: 831329 - protein, 9 aa, Homo Sapiens
QGEEGAYAR

SEQ ID NO: 831330 - protein, 9 aa, Homo Sapiens
CLTCMMCNK

SEQ ID NO: 831331 - protein, 9 aa, Homo Sapiens
KKGDVWNMG

SEQ ID NO: 831332 - protein, 9 aa, Homo Sapiens
FTLQCEEFI

SEQ ID NO: 831333 - protein, 9 aa, Homo Sapiens
RGYQRCCET

SEQ ID NO: 831334 - protein, 9 aa, Homo Sapiens
KFLGKNENG

SEQ ID NO: 831335 - protein, 9 aa, Homo Sapiens
HKEEREGLA

SEQ ID NO: 831336 - protein, 9 aa, Homo Sapiens
KLTPSNIAI

SEQ ID NO: 831337 - protein, 9 aa, Homo Sapiens
QKKEEKTKW

SEQ ID NO: 831338 - protein, 9 aa, Homo Sapiens
GNPSERLGN

SEQ ID NO: 831339 - protein, 9 aa, Homo Sapiens
HMASQLGKR

SEQ ID NO: 831340 - protein, 9 aa, Homo Sapiens
TKAIASHRA

SEQ ID NO: 831341 - protein, 9 aa, Homo Sapiens
DSLRTSTIR

SEQ ID NO: 831342 - protein, 9 aa, Homo Sapiens
IMLRECIQH

SEQ ID NO: 831343 - protein, 9 aa, Homo Sapiens
KKNKINNGT

SEQ ID NO: 831344 - protein, 9 aa, Homo Sapiens
VKLESKGLE

SEQ ID NO: 831345 - protein, 9 aa, Homo Sapiens
YCLWKSRQH

SEQ ID NO: 831346 - protein, 9 aa, Homo Sapiens
ACEAINQMF

SEQ ID NO: 831347 - protein, 9 aa, Homo Sapiens
INARRIIVQ

SEQ ID NO: 831348 - protein, 9 aa, Homo Sapiens
MLGYQVKES

SEQ ID NO: 831349 - protein, 9 aa, Homo Sapiens
WGPSSYMWR

SEQ ID NO: 831350 - protein, 9 aa, Homo Sapiens
YFNKCPFTV

SEQ ID NO: 831351 - protein, 9 aa, Homo Sapiens
DAIYRPMGF

SEQ ID NO: 831352 - protein, 9 aa, Homo Sapiens
RLAHRTCLE

SEQ ID NO: 831353 - protein, 9 aa, Homo Sapiens
QEYHVRIST

SEQ ID NO: 831354 - protein, 9 aa, Homo Sapiens
NYLSRTPPD

SEQ ID NO: 831355 - protein, 9 aa, Homo Sapiens
RQQKERIAL

SEQ ID NO: 831356 - protein, 9 aa, Homo Sapiens
HLAAGGSHP

SEQ ID NO: 831357 - protein, 9 aa, Homo Sapiens
KCGGAYPIG

SEQ ID NO: 831358 - protein, 9 aa, Homo Sapiens
QPAAAPNFS

SEQ ID NO: 831359 - protein, 9 aa, Homo Sapiens
EGHDYDPLQ

SEQ ID NO: 831360 - protein, 9 aa, Homo Sapiens
QWLQKIKAI

SEQ ID NO: 831361 - protein, 9 aa, Homo Sapiens
QQNGDSGSL

SEQ ID NO: 831362 - protein, 9 aa, Homo Sapiens
YLIKNGSKT

SEQ ID NO: 831363 - protein, 9 aa, Homo Sapiens
VISSLKIFY

SEQ ID NO: 831364 - protein, 9 aa, Homo Sapiens
RDCNDFWEG

SEQ ID NO: 831365 - protein, 9 aa, Homo Sapiens
GHGMDRVDS

SEQ ID NO: 831366 - protein, 9 aa, Homo Sapiens
VEVTQVQVP

SEQ ID NO: 831367 - protein, 9 aa, Homo Sapiens
MKSLLILVL

SEQ ID NO: 831368 - protein, 9 aa, Homo Sapiens
ENLIMQETS

SEQ ID NO: 831369 - protein, 9 aa, Homo Sapiens
SFMNVVDVL

SEQ ID NO: 831370 - protein, 9 aa, Homo Sapiens
EMVRRHRAS

SEQ ID NO: 831371 - protein, 9 aa, Homo Sapiens
LMQLRRQEM

SEQ ID NO: 831372 - protein, 9 aa, Homo Sapiens
PKCCNLLRA

SEQ ID NO: 831373 - protein, 9 aa, Homo Sapiens
NLHGGYLVA

SEQ ID NO: 831374 - protein, 9 aa, Homo Sapiens
GPEMLAKVI

SEQ ID NO: 831375 - protein, 9 aa, Homo Sapiens
TSQLTQCYL

SEQ ID NO: 831376 - protein, 9 aa, Homo Sapiens
QEGRHIEVM

SEQ ID NO: 831377 - protein, 9 aa, Homo Sapiens
SSLLSCVYH

SEQ ID NO: 831378 - protein, 9 aa, Homo Sapiens
QIMPNTGFL

SEQ ID NO: 831379 - protein, 9 aa, Homo Sapiens
QTGILCALL

SEQ ID NO: 831380 - protein, 9 aa, Homo Sapiens
RTLILCADN

SEQ ID NO: 831381 - protein, 9 aa, Homo Sapiens
EMYKIILND

SEQ ID NO: 831382 - protein, 9 aa, Homo Sapiens
TRVLVRKLC

SEQ ID NO: 831383 - protein, 9 aa, Homo Sapiens
AASSFVAGA

SEQ ID NO: 831384 - protein, 9 aa, Homo Sapiens
GTLRIYIQG

SEQ ID NO: 831385 - protein, 9 aa, Homo Sapiens
FGSGTSGME

SEQ ID NO: 831386 - protein, 9 aa, Homo Sapiens
ITTEDLGNV

SEQ ID NO: 831387 - protein, 9 aa, Homo Sapiens
EFVKEKEKV

SEQ ID NO: 831388 - protein, 9 aa, Homo Sapiens
NGCFISIMA

SEQ ID NO: 831389 - protein, 9 aa, Homo Sapiens
LVAFVNMFT

SEQ ID NO: 831390 - protein, 9 aa, Homo Sapiens
LRTSTIRKV

SEQ ID NO: 831391 - protein, 9 aa, Homo Sapiens
LMKRLTYSN

SEQ ID NO: 831392 - protein, 9 aa, Homo Sapiens
NPAKAFKRC

SEQ ID NO: 831393 - protein, 9 aa, Homo Sapiens
ITVSALCSS

SEQ ID NO: 831394 - protein, 9 aa, Homo Sapiens
NGKTHTATV

SEQ ID NO: 831395 - protein, 9 aa, Homo Sapiens
HQKDLKFLS

SEQ ID NO: 831396 - protein, 9 aa, Homo Sapiens
GTYKTAAEM

SEQ ID NO: 831397 - protein, 9 aa, Homo Sapiens
LYGVKFRNK

SEQ ID NO: 831398 - protein, 9 aa, Homo Sapiens
GECCAVCPH

SEQ ID NO: 831399 - protein, 9 aa, Homo Sapiens
KQCNLSDRQ

SEQ ID NO: 831400 - protein, 9 aa, Homo Sapiens
GKNYLNSGQ

SEQ ID NO: 831401 - protein, 9 aa, Homo Sapiens
PKCRNVFEP

SEQ ID NO: 831402 - protein, 9 aa, Homo Sapiens
SQGNIMSYK

SEQ ID NO: 831403 - protein, 9 aa, Homo Sapiens
AIIVSSILK

SEQ ID NO: 831404 - protein, 9 aa, Homo Sapiens
LRNQKRSKR

SEQ ID NO: 831405 - protein, 9 aa, Homo Sapiens
YWRSKSKEE

SEQ ID NO: 831406 - protein, 9 aa, Homo Sapiens
HWPQKEHFI

SEQ ID NO: 831407 - protein, 9 aa, Homo Sapiens
VLLIYADIF

SEQ ID NO: 831408 - protein, 9 aa, Homo Sapiens
FMDISVTMM

SEQ ID NO: 831409 - protein, 9 aa, Homo Sapiens
HGSLENEKY

SEQ ID NO: 831410 - protein, 9 aa, Homo Sapiens
VQPFWIVFL

SEQ ID NO: 831411 - protein, 9 aa, Homo Sapiens
LKKLRARLT

SEQ ID NO: 831412 - protein, 9 aa, Homo Sapiens
YMDAACFGE

SEQ ID NO: 831413 - protein, 9 aa, Homo Sapiens
VLCCAIQNS

SEQ ID NO: 831414 - protein, 9 aa, Homo Sapiens
SKAMSIINS

SEQ ID NO: 831415 - protein, 9 aa, Homo Sapiens
SGITEIVTK

SEQ ID NO: 831416 - protein, 9 aa, Homo Sapiens
APEEKQLTE

SEQ ID NO: 831417 - protein, 9 aa, Homo Sapiens
WPGHGVPDT

SEQ ID NO: 831418 - protein, 9 aa, Homo Sapiens
LQLEESCVE

SEQ ID NO: 831419 - protein, 9 aa, Homo Sapiens
SPIKPNIPL

SEQ ID NO: 831420 - protein, 9 aa, Homo Sapiens
NLTCAHTIN

SEQ ID NO: 831421 - protein, 9 aa, Homo Sapiens
KRMRNHIAA

SEQ ID NO: 831422 - protein, 9 aa, Homo Sapiens
YTSWSLLDT

SEQ ID NO: 831423 - protein, 9 aa, Homo Sapiens
QWLLEEKVC

SEQ ID NO: 831424 - protein, 9 aa, Homo Sapiens
IPPFLAVLT

SEQ ID NO: 831425 - protein, 9 aa, Homo Sapiens
KYAYVTVCN

SEQ ID NO: 831426 - protein, 9 aa, Homo Sapiens
HSSPVTPCS

SEQ ID NO: 831427 - protein, 9 aa, Homo Sapiens
MDNNRIEER

SEQ ID NO: 831428 - protein, 9 aa, Homo Sapiens
KEITAKQKH

SEQ ID NO: 831429 - protein, 9 aa, Homo Sapiens
EAVCYVLPR

SEQ ID NO: 831430 - protein, 9 aa, Homo Sapiens
INPIPQPRL

SEQ ID NO: 831431 - protein, 9 aa, Homo Sapiens
PAKLQGIPR

SEQ ID NO: 831432 - protein, 9 aa, Homo Sapiens
MPQGSYMLV

SEQ ID NO: 831433 - protein, 9 aa, Homo Sapiens
LVQELWRRM

SEQ ID NO: 831434 - protein, 9 aa, Homo Sapiens
SQGHLQIFY

SEQ ID NO: 831435 - protein, 9 aa, Homo Sapiens
ERQQANLLK

SEQ ID NO: 831436 - protein, 9 aa, Homo Sapiens
NFQMWDFPG

SEQ ID NO: 831437 - protein, 9 aa, Homo Sapiens
PTKENLCSF

SEQ ID NO: 831438 - protein, 9 aa, Homo Sapiens
RRINTGEKP

SEQ ID NO: 831439 - protein, 9 aa, Homo Sapiens
VKINAPKEY

SEQ ID NO: 831440 - protein, 9 aa, Homo Sapiens
IGRRYDELH

SEQ ID NO: 831441 - protein, 9 aa, Homo Sapiens
GLQTLSTEA

SEQ ID NO: 831442 - protein, 9 aa, Homo Sapiens
SGKWLNTWK

SEQ ID NO: 831443 - protein, 9 aa, Homo Sapiens
LYPKRDIYE

SEQ ID NO: 831444 - protein, 9 aa, Homo Sapiens
TFPDNAVTK

SEQ ID NO: 831445 - protein, 9 aa, Homo Sapiens
RPTNVLEIM

SEQ ID NO: 831446 - protein, 9 aa, Homo Sapiens
ENGNPQQTQ

SEQ ID NO: 831447 - protein, 9 aa, Homo Sapiens
PAAGPSRVC

SEQ ID NO: 831448 - protein, 9 aa, Homo Sapiens
DGDGIGNAC

SEQ ID NO: 831449 - protein, 9 aa, Homo Sapiens
NEERKLQEN

SEQ ID NO: 831450 - protein, 9 aa, Homo Sapiens
KNSKSKPMT

SEQ ID NO: 831451 - protein, 9 aa, Homo Sapiens
YNVAQYIKF

SEQ ID NO: 831452 - protein, 9 aa, Homo Sapiens
LEPMTDKML

SEQ ID NO: 831453 - protein, 9 aa, Homo Sapiens
PAVFYLKRV

SEQ ID NO: 831454 - protein, 9 aa, Homo Sapiens
KKMQMLSEA

SEQ ID NO: 831455 - protein, 9 aa, Homo Sapiens
AILANMETS

SEQ ID NO: 831456 - protein, 9 aa, Homo Sapiens
LPSKINTLL

SEQ ID NO: 831457 - protein, 9 aa, Homo Sapiens
NPLTASTLA

SEQ ID NO: 831458 - protein, 9 aa, Homo Sapiens
FLRLEREKQ

SEQ ID NO: 831459 - protein, 9 aa, Homo Sapiens
AEGPLPLPA

SEQ ID NO: 831460 - protein, 9 aa, Homo Sapiens
PPSRSCGLL

SEQ ID NO: 831461 - protein, 9 aa, Homo Sapiens
NKIAAQRCR

SEQ ID NO: 831462 - protein, 9 aa, Homo Sapiens
DSVSASQGA

SEQ ID NO: 831463 - protein, 9 aa, Homo Sapiens
QQQIAPCHL

SEQ ID NO: 831464 - protein, 9 aa, Homo Sapiens
ELARQISCK

SEQ ID NO: 831465 - protein, 9 aa, Homo Sapiens
FIRVVGSDF

SEQ ID NO: 831466 - protein, 9 aa, Homo Sapiens
TDVNDNPPT

SEQ ID NO: 831467 - protein, 9 aa, Homo Sapiens
VERWKQATK

SEQ ID NO: 831468 - protein, 9 aa, Homo Sapiens
SSFEINAFK

SEQ ID NO: 831469 - protein, 9 aa, Homo Sapiens
DEKCTLCLS

SEQ ID NO: 831470 - protein, 9 aa, Homo Sapiens
DLVKGLKSA

SEQ ID NO: 831471 - protein, 9 aa, Homo Sapiens
ANTNNNVVD

SEQ ID NO: 831472 - protein, 9 aa, Homo Sapiens
QEERPLIPI

SEQ ID NO: 831473 - protein, 9 aa, Homo Sapiens
QLQRKSITC

SEQ ID NO: 831474 - protein, 9 aa, Homo Sapiens
NLCDSTQAA

SEQ ID NO: 831475 - protein, 9 aa, Homo Sapiens
FHKAPVGQH

SEQ ID NO: 831476 - protein, 9 aa, Homo Sapiens
LSHLPTSSS

SEQ ID NO: 831477 - protein, 9 aa, Homo Sapiens
IFLKRIIPL

SEQ ID NO: 831478 - protein, 9 aa, Homo Sapiens
TLILCADNR

SEQ ID NO: 831479 - protein, 9 aa, Homo Sapiens
LDRITLISW

SEQ ID NO: 831480 - protein, 9 aa, Homo Sapiens
LLYTIQENM

SEQ ID NO: 831481 - protein, 9 aa, Homo Sapiens
SQFNKLKIK

SEQ ID NO: 831482 - protein, 9 aa, Homo Sapiens
GPGPHHQPS

SEQ ID NO: 831483 - protein, 9 aa, Homo Sapiens
RVPQVRIPK

SEQ ID NO: 831484 - protein, 9 aa, Homo Sapiens
FSNYKLFLL

SEQ ID NO: 831485 - protein, 9 aa, Homo Sapiens
SDKHPEYGD

SEQ ID NO: 831486 - protein, 9 aa, Homo Sapiens
KAGTTEKTD

SEQ ID NO: 831487 - protein, 9 aa, Homo Sapiens
KAAIECLAQ

SEQ ID NO: 831488 - protein, 9 aa, Homo Sapiens
CPALKIFNS

SEQ ID NO: 831489 - protein, 9 aa, Homo Sapiens
NPSNFLKTA

SEQ ID NO: 831490 - protein, 9 aa, Homo Sapiens
KQANRKKIT

SEQ ID NO: 831491 - protein, 9 aa, Homo Sapiens
EFIEKRQQG

SEQ ID NO: 831492 - protein, 9 aa, Homo Sapiens
RTVENIKGP

SEQ ID NO: 831493 - protein, 9 aa, Homo Sapiens
EYTPGNPPA

SEQ ID NO: 831494 - protein, 9 aa, Homo Sapiens
PEGNDKALK

SEQ ID NO: 831495 - protein, 9 aa, Homo Sapiens
KHQRINTDD

SEQ ID NO: 831496 - protein, 9 aa, Homo Sapiens
VNISVRFGK

SEQ ID NO: 831497 - protein, 9 aa, Homo Sapiens
CDEAIAELD

SEQ ID NO: 831498 - protein, 9 aa, Homo Sapiens
LQSAFLHCI

SEQ ID NO: 831499 - protein, 9 aa, Homo Sapiens
SEPGKRFMF

SEQ ID NO: 831500 - protein, 9 aa, Homo Sapiens
QKFQTEGNI

SEQ ID NO: 831501 - protein, 9 aa, Homo Sapiens
DQYPKGRSV

SEQ ID NO: 831502 - protein, 9 aa, Homo Sapiens
ISFKCKQFL

SEQ ID NO: 831503 - protein, 9 aa, Homo Sapiens
PVFIMPQIP

SEQ ID NO: 831504 - protein, 9 aa, Homo Sapiens
LDQASRLDL

SEQ ID NO: 831505 - protein, 9 aa, Homo Sapiens
LLVRIICGS

SEQ ID NO: 831506 - protein, 9 aa, Homo Sapiens
LGGDHTLTY

SEQ ID NO: 831507 - protein, 9 aa, Homo Sapiens
AIQAGTTLY

SEQ ID NO: 831508 - protein, 9 aa, Homo Sapiens
FGRETNNLS

SEQ ID NO: 831509 - protein, 9 aa, Homo Sapiens
SQPCVLNNK

SEQ ID NO: 831510 - protein, 9 aa, Homo Sapiens
RRDLACFLL

SEQ ID NO: 831511 - protein, 9 aa, Homo Sapiens
VTTVGGLPC

SEQ ID NO: 831512 - protein, 9 aa, Homo Sapiens
NFPLKTKGE

SEQ ID NO: 831513 - protein, 9 aa, Homo Sapiens
EYKHRTGSR

SEQ ID NO: 831514 - protein, 9 aa, Homo Sapiens
NMVDGYRYT

SEQ ID NO: 831515 - protein, 9 aa, Homo Sapiens
HCSENCIEI

SEQ ID NO: 831516 - protein, 9 aa, Homo Sapiens
KMDMEESIQ

SEQ ID NO: 831517 - protein, 9 aa, Homo Sapiens
FVSYAKWSY

SEQ ID NO: 831518 - protein, 9 aa, Homo Sapiens
IRTDIMDDW

SEQ ID NO: 831519 - protein, 9 aa, Homo Sapiens
QASMPDKEP

SEQ ID NO: 831520 - protein, 9 aa, Homo Sapiens
IPKAPDETI

SEQ ID NO: 831521 - protein, 9 aa, Homo Sapiens
AGFMPGIMP

SEQ ID NO: 831522 - protein, 9 aa, Homo Sapiens
YYWALAYQG

SEQ ID NO: 831523 - protein, 9 aa, Homo Sapiens
KSCLDILVN

SEQ ID NO: 831524 - protein, 9 aa, Homo Sapiens
GPLPLPACL

SEQ ID NO: 831525 - protein, 9 aa, Homo Sapiens
GLLKVAQEA

SEQ ID NO: 831526 - protein, 9 aa, Homo Sapiens
ARVTLGITT

SEQ ID NO: 831527 - protein, 9 aa, Homo Sapiens
RLQQLPKYI

SEQ ID NO: 831528 - protein, 9 aa, Homo Sapiens
TTRGEYFLY

SEQ ID NO: 831529 - protein, 9 aa, Homo Sapiens
DLSNPVGQM

SEQ ID NO: 831530 - protein, 9 aa, Homo Sapiens
PKVAFPGPQ

SEQ ID NO: 831531 - protein, 9 aa, Homo Sapiens
MEASVLNPT

SEQ ID NO: 831532 - protein, 9 aa, Homo Sapiens
EMILKIKKN

SEQ ID NO: 831533 - protein, 9 aa, Homo Sapiens
NHLKIPVSG

SEQ ID NO: 831534 - protein, 9 aa, Homo Sapiens
LFLHYLVSA

SEQ ID NO: 831535 - protein, 9 aa, Homo Sapiens
QSTPKQIDT

SEQ ID NO: 831536 - protein, 9 aa, Homo Sapiens
LRKLFHPFN

SEQ ID NO: 831537 - protein, 9 aa, Homo Sapiens
RDGHYYLTY

SEQ ID NO: 831538 - protein, 9 aa, Homo Sapiens
SQCEPITLK

SEQ ID NO: 831539 - protein, 9 aa, Homo Sapiens
CSRGLQSGS

SEQ ID NO: 831540 - protein, 9 aa, Homo Sapiens
TSGNALLQL

SEQ ID NO: 831541 - protein, 9 aa, Homo Sapiens
DKTKDNVEK

SEQ ID NO: 831542 - protein, 9 aa, Homo Sapiens
NSIFTHFHS

SEQ ID NO: 831543 - protein, 9 aa, Homo Sapiens
CPEKDIRSC

SEQ ID NO: 831544 - protein, 9 aa, Homo Sapiens
RYKFYLYAQ

SEQ ID NO: 831545 - protein, 9 aa, Homo Sapiens
FCSCQTLKL

SEQ ID NO: 831546 - protein, 9 aa, Homo Sapiens
RTYYMKYFK

SEQ ID NO: 831547 - protein, 9 aa, Homo Sapiens
RCTTNEHTY

SEQ ID NO: 831548 - protein, 9 aa, Homo Sapiens
TDEKCTLCL

SEQ ID NO: 831549 - protein, 9 aa, Homo Sapiens
EQFQSDAAM

SEQ ID NO: 831550 - protein, 9 aa, Homo Sapiens
NILKMPMYR

SEQ ID NO: 831551 - protein, 9 aa, Homo Sapiens
EINCKEAFQ

SEQ ID NO: 831552 - protein, 9 aa, Homo Sapiens
YLWGPGAGS

SEQ ID NO: 831553 - protein, 9 aa, Homo Sapiens
VSAEEAGET

SEQ ID NO: 831554 - protein, 9 aa, Homo Sapiens
CKAEVNSSG

SEQ ID NO: 831555 - protein, 9 aa, Homo Sapiens
LSGSSNFGE

SEQ ID NO: 831556 - protein, 9 aa, Homo Sapiens
LFSTWRIKK

SEQ ID NO: 831557 - protein, 9 aa, Homo Sapiens
EKDKRDPLQ

SEQ ID NO: 831558 - protein, 9 aa, Homo Sapiens
QRLLQNVND

SEQ ID NO: 831559 - protein, 9 aa, Homo Sapiens
DLVCSNSNS

SEQ ID NO: 831560 - protein, 9 aa, Homo Sapiens
LIDRIQILP

SEQ ID NO: 831561 - protein, 9 aa, Homo Sapiens
HSQVGACIV

SEQ ID NO: 831562 - protein, 9 aa, Homo Sapiens
RARLTYNLK

SEQ ID NO: 831563 - protein, 9 aa, Homo Sapiens
GGKLRFRAS

SEQ ID NO: 831564 - protein, 9 aa, Homo Sapiens
YRNKYVIYI

SEQ ID NO: 831565 - protein, 9 aa, Homo Sapiens
ILMNKMGIK

SEQ ID NO: 831566 - protein, 9 aa, Homo Sapiens
AVLLVVAII

SEQ ID NO: 831567 - protein, 9 aa, Homo Sapiens
KSDPLAWGE

SEQ ID NO: 831568 - protein, 9 aa, Homo Sapiens
IISCLLNIC

SEQ ID NO: 831569 - protein, 9 aa, Homo Sapiens
YKNEIQPID

SEQ ID NO: 831570 - protein, 9 aa, Homo Sapiens
LNPRSSSKI

SEQ ID NO: 831571 - protein, 9 aa, Homo Sapiens
LEYLDNTVF

SEQ ID NO: 831572 - protein, 9 aa, Homo Sapiens
QKANKETLD

SEQ ID NO: 831573 - protein, 9 aa, Homo Sapiens
FKKTKTSEY

SEQ ID NO: 831574 - protein, 9 aa, Homo Sapiens
VPSHPYGFS

SEQ ID NO: 831575 - protein, 9 aa, Homo Sapiens
VTFVFDAVT

SEQ ID NO: 831576 - protein, 9 aa, Homo Sapiens
GMYLAHNYD

SEQ ID NO: 831577 - protein, 9 aa, Homo Sapiens
ESHPYTNKV

SEQ ID NO: 831578 - protein, 9 aa, Homo Sapiens
LETLLTYPM

SEQ ID NO: 831579 - protein, 9 aa, Homo Sapiens
LPLGPILGS

SEQ ID NO: 831580 - protein, 9 aa, Homo Sapiens
HDFFMYSQS

SEQ ID NO: 831581 - protein, 9 aa, Homo Sapiens
VWMSSNLHQ

SEQ ID NO: 831582 - protein, 9 aa, Homo Sapiens
NGLICLKHN

SEQ ID NO: 831583 - protein, 9 aa, Homo Sapiens
PLGPILGSE

SEQ ID NO: 831584 - protein, 9 aa, Homo Sapiens
VHGSKVQEQ

SEQ ID NO: 831585 - protein, 9 aa, Homo Sapiens
TNMSSMNER

SEQ ID NO: 831586 - protein, 9 aa, Homo Sapiens
QFSTSGGGH

SEQ ID NO: 831587 - protein, 9 aa, Homo Sapiens
CTMAPEARN

SEQ ID NO: 831588 - protein, 9 aa, Homo Sapiens
CARNILVEN

SEQ ID NO: 831589 - protein, 9 aa, Homo Sapiens
QRTLEYRDS

SEQ ID NO: 831590 - protein, 9 aa, Homo Sapiens
YYYAGKNKV

SEQ ID NO: 831591 - protein, 9 aa, Homo Sapiens
LSGLVLSPV

SEQ ID NO: 831592 - protein, 9 aa, Homo Sapiens
QNLAHEEVR

SEQ ID NO: 831593 - protein, 9 aa, Homo Sapiens
VTIFYGTLT

SEQ ID NO: 831594 - protein, 9 aa, Homo Sapiens
GATLIRDQL

SEQ ID NO: 831595 - protein, 9 aa, Homo Sapiens
FLEKKHIIL

SEQ ID NO: 831596 - protein, 9 aa, Homo Sapiens
GETVLHIAA

SEQ ID NO: 831597 - protein, 9 aa, Homo Sapiens
DALLEFNVN

SEQ ID NO: 831598 - protein, 9 aa, Homo Sapiens
VTIFYGTLM

SEQ ID NO: 831599 - protein, 9 aa, Homo Sapiens
NKLTYLPYY

SEQ ID NO: 831600 - protein, 9 aa, Homo Sapiens
QSSFVAPLE

SEQ ID NO: 831601 - protein, 9 aa, Homo Sapiens
SVTEAGPGS

SEQ ID NO: 831602 - protein, 9 aa, Homo Sapiens
KVIRAVVPA

SEQ ID NO: 831603 - protein, 9 aa, Homo Sapiens
DRLPKARFV

SEQ ID NO: 831604 - protein, 9 aa, Homo Sapiens
LNNSVLTDE

SEQ ID NO: 831605 - protein, 9 aa, Homo Sapiens
WISKNIYWT

SEQ ID NO: 831606 - protein, 9 aa, Homo Sapiens
YTELTTAIH

SEQ ID NO: 831607 - protein, 9 aa, Homo Sapiens
TKKASYSHN

SEQ ID NO: 831608 - protein, 9 aa, Homo Sapiens
NNIAGRKAV

SEQ ID NO: 831609 - protein, 9 aa, Homo Sapiens
RYCNSILRE

SEQ ID NO: 831610 - protein, 9 aa, Homo Sapiens
QKCGGAYPI

SEQ ID NO: 831611 - protein, 9 aa, Homo Sapiens
ELENSELRA

SEQ ID NO: 831612 - protein, 9 aa, Homo Sapiens
VNFAFEVTQ

SEQ ID NO: 831613 - protein, 9 aa, Homo Sapiens
QRTYYMKYF

SEQ ID NO: 831614 - protein, 9 aa, Homo Sapiens
SIIPNYRTK

SEQ ID NO: 831615 - protein, 9 aa, Homo Sapiens
GSEGTTYSP

SEQ ID NO: 831616 - protein, 9 aa, Homo Sapiens
FVKDSQSPP

SEQ ID NO: 831617 - protein, 9 aa, Homo Sapiens
GHTSIRRGF

SEQ ID NO: 831618 - protein, 9 aa, Homo Sapiens
WLIGGGRKP

SEQ ID NO: 831619 - protein, 9 aa, Homo Sapiens
AKETTIFLA

SEQ ID NO: 831620 - protein, 9 aa, Homo Sapiens
GIISGTCPD

SEQ ID NO: 831621 - protein, 9 aa, Homo Sapiens
FDCGLEANN

SEQ ID NO: 831622 - protein, 9 aa, Homo Sapiens
IYFLGNYLG

SEQ ID NO: 831623 - protein, 9 aa, Homo Sapiens
HGLIDEQLL

SEQ ID NO: 831624 - protein, 9 aa, Homo Sapiens
ILYYECMVQ

SEQ ID NO: 831625 - protein, 9 aa, Homo Sapiens
LLSETRDLS

SEQ ID NO: 831626 - protein, 9 aa, Homo Sapiens
SNKKYPDYY

SEQ ID NO: 831627 - protein, 9 aa, Homo Sapiens
RSLDYVKIT

SEQ ID NO: 831628 - protein, 9 aa, Homo Sapiens
EDGDTGGIN

SEQ ID NO: 831629 - protein, 9 aa, Homo Sapiens
TTDCSFIVL

SEQ ID NO: 831630 - protein, 9 aa, Homo Sapiens
PPFLFGSGT

SEQ ID NO: 831631 - protein, 9 aa, Homo Sapiens
KKREISKRQ

SEQ ID NO: 831632 - protein, 9 aa, Homo Sapiens
NHENGNLEN

SEQ ID NO: 831633 - protein, 9 aa, Homo Sapiens
SPTFRLSSQ

SEQ ID NO: 831634 - protein, 9 aa, Homo Sapiens
SHEVEKSGL

SEQ ID NO: 831635 - protein, 9 aa, Homo Sapiens
INLLKLPEF

SEQ ID NO: 831636 - protein, 9 aa, Homo Sapiens
IGEAHQDFS

SEQ ID NO: 831637 - protein, 9 aa, Homo Sapiens
ELKTTRFCL

SEQ ID NO: 831638 - protein, 9 aa, Homo Sapiens
PPDISDEVT

SEQ ID NO: 831639 - protein, 9 aa, Homo Sapiens
KMPCKSSPP

SEQ ID NO: 831640 - protein, 9 aa, Homo Sapiens
SRHQIIHTS

SEQ ID NO: 831641 - protein, 9 aa, Homo Sapiens
PKGKAGTTE

SEQ ID NO: 831642 - protein, 9 aa, Homo Sapiens
IIHKNLNLV

SEQ ID NO: 831643 - protein, 9 aa, Homo Sapiens
KTKGELLLN

SEQ ID NO: 831644 - protein, 9 aa, Homo Sapiens
GSNGYSVTS

SEQ ID NO: 831645 - protein, 9 aa, Homo Sapiens
HLSTKKPMD

SEQ ID NO: 831646 - protein, 9 aa, Homo Sapiens
CQIATRRFN

SEQ ID NO: 831647 - protein, 9 aa, Homo Sapiens
KINSEGTCI

SEQ ID NO: 831648 - protein, 9 aa, Homo Sapiens
KARNLKDMD

SEQ ID NO: 831649 - protein, 9 aa, Homo Sapiens
NGSYVYFPR

SEQ ID NO: 831650 - protein, 9 aa, Homo Sapiens
PHQSYDNLD

SEQ ID NO: 831651 - protein, 9 aa, Homo Sapiens
TNLHKILRR

SEQ ID NO: 831652 - protein, 9 aa, Homo Sapiens
AKSLQQKLE

SEQ ID NO: 831653 - protein, 9 aa, Homo Sapiens
NRALKVMKM

SEQ ID NO: 831654 - protein, 9 aa, Homo Sapiens
KKNTWRQHL

SEQ ID NO: 831655 - protein, 9 aa, Homo Sapiens
WKLQKQETS

SEQ ID NO: 831656 - protein, 9 aa, Homo Sapiens
DGHYYLTYL

SEQ ID NO: 831657 - protein, 9 aa, Homo Sapiens
PSDCPHSSS

SEQ ID NO: 831658 - protein, 9 aa, Homo Sapiens
LPSWPTCLE

SEQ ID NO: 831659 - protein, 9 aa, Homo Sapiens
LTNNKGVSN

SEQ ID NO: 831660 - protein, 9 aa, Homo Sapiens
QESVVQWCD

SEQ ID NO: 831661 - protein, 9 aa, Homo Sapiens
LCRYLVHSN

SEQ ID NO: 831662 - protein, 9 aa, Homo Sapiens
NTVASLHVR

SEQ ID NO: 831663 - protein, 9 aa, Homo Sapiens
FYVVHQAQV

SEQ ID NO: 831664 - protein, 9 aa, Homo Sapiens
GFDSDSFIA

SEQ ID NO: 831665 - protein, 9 aa, Homo Sapiens
PDIKVATQI

SEQ ID NO: 831666 - protein, 9 aa, Homo Sapiens
RNSLRCISK

SEQ ID NO: 831667 - protein, 9 aa, Homo Sapiens
IFPSTFPHV

SEQ ID NO: 831668 - protein, 9 aa, Homo Sapiens
HSLVQICLA

SEQ ID NO: 831669 - protein, 9 aa, Homo Sapiens
TAVGTPVYI

SEQ ID NO: 831670 - protein, 9 aa, Homo Sapiens
ERNAICSMI

SEQ ID NO: 831671 - protein, 9 aa, Homo Sapiens
SHVIYPCHF

SEQ ID NO: 831672 - protein, 9 aa, Homo Sapiens
TDNGLMCPA

SEQ ID NO: 831673 - protein, 9 aa, Homo Sapiens
FSLSNLSLV

SEQ ID NO: 831674 - protein, 9 aa, Homo Sapiens
AHQRCDDFA

SEQ ID NO: 831675 - protein, 9 aa, Homo Sapiens
TCIKSTVGF

SEQ ID NO: 831676 - protein, 9 aa, Homo Sapiens
QQLRIKGDY

SEQ ID NO: 831677 - protein, 9 aa, Homo Sapiens
GGNRNTFES

SEQ ID NO: 831678 - protein, 9 aa, Homo Sapiens
RTLPGPRGS

SEQ ID NO: 831679 - protein, 9 aa, Homo Sapiens
KKSVEVLNN

SEQ ID NO: 831680 - protein, 9 aa, Homo Sapiens
SCGSGLIRH

SEQ ID NO: 831681 - protein, 9 aa, Homo Sapiens
EKVRRSTSI

SEQ ID NO: 831682 - protein, 9 aa, Homo Sapiens
ARKARVEDH

SEQ ID NO: 831683 - protein, 9 aa, Homo Sapiens
YNNGYEIYE

SEQ ID NO: 831684 - protein, 9 aa, Homo Sapiens
DNDEQGNYS

SEQ ID NO: 831685 - protein, 9 aa, Homo Sapiens
GYRGTMVTT

SEQ ID NO: 831686 - protein, 9 aa, Homo Sapiens
ILLTEVSQH

SEQ ID NO: 831687 - protein, 9 aa, Homo Sapiens
LGFTNYIQA

SEQ ID NO: 831688 - protein, 9 aa, Homo Sapiens
QLSCSSTYI

SEQ ID NO: 831689 - protein, 9 aa, Homo Sapiens
FLKGCACAQ

SEQ ID NO: 831690 - protein, 9 aa, Homo Sapiens
SEHVYDLFE

SEQ ID NO: 831691 - protein, 9 aa, Homo Sapiens
YLEVAARSI

SEQ ID NO: 831692 - protein, 9 aa, Homo Sapiens
GFIVRKNLS

SEQ ID NO: 831693 - protein, 9 aa, Homo Sapiens
QKHPERRME

SEQ ID NO: 831694 - protein, 9 aa, Homo Sapiens
EGIYAIAVV

SEQ ID NO: 831695 - protein, 9 aa, Homo Sapiens
YNCPGQYTI

SEQ ID NO: 831696 - protein, 9 aa, Homo Sapiens
PCILIIEQS

SEQ ID NO: 831697 - protein, 9 aa, Homo Sapiens
GQNAWLSYC

SEQ ID NO: 831698 - protein, 9 aa, Homo Sapiens
FQYQNCIAA

SEQ ID NO: 831699 - protein, 9 aa, Homo Sapiens
DTLSKLSHD

SEQ ID NO: 831700 - protein, 9 aa, Homo Sapiens
MFLGGLAFA

SEQ ID NO: 831701 - protein, 9 aa, Homo Sapiens
SESGPSSRG

SEQ ID NO: 831702 - protein, 9 aa, Homo Sapiens
LTVLLNTKD

SEQ ID NO: 831703 - protein, 9 aa, Homo Sapiens
VILAIITDS

SEQ ID NO: 831704 - protein, 9 aa, Homo Sapiens
WELMMKTTE

SEQ ID NO: 831705 - protein, 9 aa, Homo Sapiens
HQFIEPAPA

SEQ ID NO: 831706 - protein, 9 aa, Homo Sapiens
VDKPEAFTA

SEQ ID NO: 831707 - protein, 9 aa, Homo Sapiens
SMDNFILFD

SEQ ID NO: 831708 - protein, 9 aa, Homo Sapiens
MLCPAHILN

SEQ ID NO: 831709 - protein, 9 aa, Homo Sapiens
NTIKYMTAL

SEQ ID NO: 831710 - protein, 9 aa, Homo Sapiens
NSVYEGDDD

SEQ ID NO: 831711 - protein, 9 aa, Homo Sapiens
SSVLSTSTG

SEQ ID NO: 831712 - protein, 9 aa, Homo Sapiens
MVLCCAIQN

SEQ ID NO: 831713 - protein, 9 aa, Homo Sapiens
FYGTLMFMY

SEQ ID NO: 831714 - protein, 9 aa, Homo Sapiens
NISLGDCKM

SEQ ID NO: 831715 - protein, 9 aa, Homo Sapiens
DPHNRKQHI

SEQ ID NO: 831716 - protein, 9 aa, Homo Sapiens
MSGQKKELH

SEQ ID NO: 831717 - protein, 9 aa, Homo Sapiens
QQNVLKVLT

SEQ ID NO: 831718 - protein, 9 aa, Homo Sapiens
LEAPYTKEE

SEQ ID NO: 831719 - protein, 9 aa, Homo Sapiens
RNVNMSRVD

SEQ ID NO: 831720 - protein, 9 aa, Homo Sapiens
EGVYGFLID

SEQ ID NO: 831721 - protein, 9 aa, Homo Sapiens
LNRVLKNLT

SEQ ID NO: 831722 - protein, 9 aa, Homo Sapiens
EKEPGKLDK

SEQ ID NO: 831723 - protein, 9 aa, Homo Sapiens
GSSPGSLDI

SEQ ID NO: 831724 - protein, 9 aa, Homo Sapiens
ASAWGMPSP

SEQ ID NO: 831725 - protein, 9 aa, Homo Sapiens
DLLFLLQQK

SEQ ID NO: 831726 - protein, 9 aa, Homo Sapiens
QRTALSDKE

SEQ ID NO: 831727 - protein, 9 aa, Homo Sapiens
YLITMLENV

SEQ ID NO: 831728 - protein, 9 aa, Homo Sapiens
SRPYSFIEC

SEQ ID NO: 831729 - protein, 9 aa, Homo Sapiens
GIVCSSEAF

SEQ ID NO: 831730 - protein, 9 aa, Homo Sapiens
LEKIFQEYH

SEQ ID NO: 831731 - protein, 9 aa, Homo Sapiens
TALEKNILK

SEQ ID NO: 831732 - protein, 9 aa, Homo Sapiens
LDPRFKNSL

SEQ ID NO: 831733 - protein, 9 aa, Homo Sapiens
CKAKQQLEY

SEQ ID NO: 831734 - protein, 9 aa, Homo Sapiens
LEEQFQSDA

SEQ ID NO: 831735 - protein, 9 aa, Homo Sapiens
PWGIPAHTA

SEQ ID NO: 831736 - protein, 9 aa, Homo Sapiens
HLSGTVGVA

SEQ ID NO: 831737 - protein, 9 aa, Homo Sapiens
VQDLSYGVL

SEQ ID NO: 831738 - protein, 9 aa, Homo Sapiens
NSWTQKILK

SEQ ID NO: 831739 - protein, 9 aa, Homo Sapiens
KKEANKREK

SEQ ID NO: 831740 - protein, 9 aa, Homo Sapiens
GTQVAAPGT

SEQ ID NO: 831741 - protein, 9 aa, Homo Sapiens
LGACLGPQI

SEQ ID NO: 831742 - protein, 9 aa, Homo Sapiens
KNIIEATNM

SEQ ID NO: 831743 - protein, 9 aa, Homo Sapiens
RLMFQIAMR

SEQ ID NO: 831744 - protein, 9 aa, Homo Sapiens
ILLGYLAMV

SEQ ID NO: 831745 - protein, 9 aa, Homo Sapiens
FQNHERTHS

SEQ ID NO: 831746 - protein, 9 aa, Homo Sapiens
EENEMQPHG

SEQ ID NO: 831747 - protein, 9 aa, Homo Sapiens
GMRLICEGK

SEQ ID NO: 831748 - protein, 9 aa, Homo Sapiens
WACGYRGSS

SEQ ID NO: 831749 - protein, 9 aa, Homo Sapiens
TWTKGPDKS

SEQ ID NO: 831750 - protein, 9 aa, Homo Sapiens
DHYIAISQP

SEQ ID NO: 831751 - protein, 9 aa, Homo Sapiens
GFVQKNGVN

SEQ ID NO: 831752 - protein, 9 aa, Homo Sapiens
ILISPHNPL

SEQ ID NO: 831753 - protein, 9 aa, Homo Sapiens
ETVIIHPHL

SEQ ID NO: 831754 - protein, 9 aa, Homo Sapiens
EKVYLGSQI

SEQ ID NO: 831755 - protein, 9 aa, Homo Sapiens
MLWYRQDLG

SEQ ID NO: 831756 - protein, 9 aa, Homo Sapiens
SRNDTKDDI

SEQ ID NO: 831757 - protein, 9 aa, Homo Sapiens
ILVAANGTK

SEQ ID NO: 831758 - protein, 9 aa, Homo Sapiens
QVTEKSTKH

SEQ ID NO: 831759 - protein, 9 aa, Homo Sapiens
ISPLTFLSA

SEQ ID NO: 831760 - protein, 9 aa, Homo Sapiens
NFPSMSKLL

SEQ ID NO: 831761 - protein, 9 aa, Homo Sapiens
VGLFRIVAI

SEQ ID NO: 831762 - protein, 9 aa, Homo Sapiens
SRTDKEMEK

SEQ ID NO: 831763 - protein, 9 aa, Homo Sapiens
DYVNDLQGR

SEQ ID NO: 831764 - protein, 9 aa, Homo Sapiens
SWFAGLSLL

SEQ ID NO: 831765 - protein, 9 aa, Homo Sapiens
IAEFLGFIL

SEQ ID NO: 831766 - protein, 9 aa, Homo Sapiens
RLNNSENQT

SEQ ID NO: 831767 - protein, 9 aa, Homo Sapiens
CGNRRHDIQ

SEQ ID NO: 831768 - protein, 9 aa, Homo Sapiens
EMPEFSLDS

SEQ ID NO: 831769 - protein, 9 aa, Homo Sapiens
SVERQIHTL

SEQ ID NO: 831770 - protein, 9 aa, Homo Sapiens
SLDSDRDLV

SEQ ID NO: 831771 - protein, 9 aa, Homo Sapiens
SLHGDVWLW

SEQ ID NO: 831772 - protein, 9 aa, Homo Sapiens
LFGSIFVLT

SEQ ID NO: 831773 - protein, 9 aa, Homo Sapiens
RYLVKAVNY

SEQ ID NO: 831774 - protein, 9 aa, Homo Sapiens
NPLLSTFKS

SEQ ID NO: 831775 - protein, 9 aa, Homo Sapiens
SFQLAYLLR

SEQ ID NO: 831776 - protein, 9 aa, Homo Sapiens
YELPHFFSV

SEQ ID NO: 831777 - protein, 9 aa, Homo Sapiens
RDLADVDCV

SEQ ID NO: 831778 - protein, 9 aa, Homo Sapiens
LKQRPNLRA

SEQ ID NO: 831779 - protein, 9 aa, Homo Sapiens
AVSDKPLDG

SEQ ID NO: 831780 - protein, 9 aa, Homo Sapiens
LAALSCDTG

SEQ ID NO: 831781 - protein, 9 aa, Homo Sapiens
FSCYHDHRS

SEQ ID NO: 831782 - protein, 9 aa, Homo Sapiens
DKEEAIIPC

SEQ ID NO: 831783 - protein, 9 aa, Homo Sapiens
KDKRQQGKN

SEQ ID NO: 831784 - protein, 9 aa, Homo Sapiens
FSYQEKPRL

SEQ ID NO: 831785 - protein, 9 aa, Homo Sapiens
FAQGHPEVN

SEQ ID NO: 831786 - protein, 9 aa, Homo Sapiens
KVVVVCCKG

SEQ ID NO: 831787 - protein, 9 aa, Homo Sapiens
TKQHLTPKL

SEQ ID NO: 831788 - protein, 9 aa, Homo Sapiens
LRTRVHKEN

SEQ ID NO: 831789 - protein, 9 aa, Homo Sapiens
LPVRTFKLP

SEQ ID NO: 831790 - protein, 9 aa, Homo Sapiens
KLRLNDDNE

SEQ ID NO: 831791 - protein, 9 aa, Homo Sapiens
SRRRRQQRS

SEQ ID NO: 831792 - protein, 9 aa, Homo Sapiens
HKNRDKKTK

SEQ ID NO: 831793 - protein, 9 aa, Homo Sapiens
TILDRYYTA

SEQ ID NO: 831794 - protein, 9 aa, Homo Sapiens
KPWLLEVNR

SEQ ID NO: 831795 - protein, 9 aa, Homo Sapiens
TKSTQEGEA

SEQ ID NO: 831796 - protein, 9 aa, Homo Sapiens
QALKDFTTK

SEQ ID NO: 831797 - protein, 9 aa, Homo Sapiens
HTVLKPRKV

SEQ ID NO: 831798 - protein, 9 aa, Homo Sapiens
FCDNIIVSS

SEQ ID NO: 831799 - protein, 9 aa, Homo Sapiens
ACKVFIPDD

SEQ ID NO: 831800 - protein, 9 aa, Homo Sapiens
IVGIDYNCR

SEQ ID NO: 831801 - protein, 9 aa, Homo Sapiens
LRVEPYPTS

SEQ ID NO: 831802 - protein, 9 aa, Homo Sapiens
PVKNYQVHQ

SEQ ID NO: 831803 - protein, 9 aa, Homo Sapiens
DMQPFKDRC

SEQ ID NO: 831804 - protein, 9 aa, Homo Sapiens
PLSAFNWVK

SEQ ID NO: 831805 - protein, 9 aa, Homo Sapiens
LQANHEKLQ

SEQ ID NO: 831806 - protein, 9 aa, Homo Sapiens
QEDDEQQIL

SEQ ID NO: 831807 - protein, 9 aa, Homo Sapiens
LSVVCRFAH

SEQ ID NO: 831808 - protein, 9 aa, Homo Sapiens
TNGSVAYYV

SEQ ID NO: 831809 - protein, 9 aa, Homo Sapiens
EIETQGDDL

SEQ ID NO: 831810 - protein, 9 aa, Homo Sapiens
NDMNNKLEE

SEQ ID NO: 831811 - protein, 9 aa, Homo Sapiens
IDTRLFKPC

SEQ ID NO: 831812 - protein, 9 aa, Homo Sapiens
FTPNNYSTS

SEQ ID NO: 831813 - protein, 9 aa, Homo Sapiens
RNSDIFVPY

SEQ ID NO: 831814 - protein, 9 aa, Homo Sapiens
SHPLHNDPH

SEQ ID NO: 831815 - protein, 9 aa, Homo Sapiens
DHRFDNTPE

SEQ ID NO: 831816 - protein, 9 aa, Homo Sapiens
SPRAGSPVS

SEQ ID NO: 831817 - protein, 9 aa, Homo Sapiens
TDDQIIVSY

SEQ ID NO: 831818 - protein, 9 aa, Homo Sapiens
VRTTGVLSS

SEQ ID NO: 831819 - protein, 9 aa, Homo Sapiens
SMRIGKYFI

SEQ ID NO: 831820 - protein, 9 aa, Homo Sapiens
VQLISNKGT

SEQ ID NO: 831821 - protein, 9 aa, Homo Sapiens
PPRPPETAQ

SEQ ID NO: 831822 - protein, 9 aa, Homo Sapiens
PEKEDCVQI

SEQ ID NO: 831823 - protein, 9 aa, Homo Sapiens
ILPTTVPPA

SEQ ID NO: 831824 - protein, 9 aa, Homo Sapiens
STLHLVLHL

SEQ ID NO: 831825 - protein, 9 aa, Homo Sapiens
SEDESGINF

SEQ ID NO: 831826 - protein, 9 aa, Homo Sapiens
WTLQTLQEQ

SEQ ID NO: 831827 - protein, 9 aa, Homo Sapiens
PAHTAEEVD

SEQ ID NO: 831828 - protein, 9 aa, Homo Sapiens
DKETVIFIP

SEQ ID NO: 831829 - protein, 9 aa, Homo Sapiens
LVGFGIGIA

SEQ ID NO: 831830 - protein, 9 aa, Homo Sapiens
IQYGEYLEF

SEQ ID NO: 831831 - protein, 9 aa, Homo Sapiens
QMDRNVEMF

SEQ ID NO: 831832 - protein, 9 aa, Homo Sapiens
HESPRAANN

SEQ ID NO: 831833 - protein, 9 aa, Homo Sapiens
VGRPWLLNW

SEQ ID NO: 831834 - protein, 9 aa, Homo Sapiens
QAGLKEVSP

SEQ ID NO: 831835 - protein, 9 aa, Homo Sapiens
GGTLSLTLH

SEQ ID NO: 831836 - protein, 9 aa, Homo Sapiens
GTQGPPGSV

SEQ ID NO: 831837 - protein, 9 aa, Homo Sapiens
GPRTTEPPT

SEQ ID NO: 831838 - protein, 9 aa, Homo Sapiens
HPEILENNS

SEQ ID NO: 831839 - protein, 9 aa, Homo Sapiens
QGKRKTVTD

SEQ ID NO: 831840 - protein, 9 aa, Homo Sapiens
TLPVGFGAH

SEQ ID NO: 831841 - protein, 9 aa, Homo Sapiens
HREESYPRK

SEQ ID NO: 831842 - protein, 9 aa, Homo Sapiens
VYTGVKPCE

SEQ ID NO: 831843 - protein, 9 aa, Homo Sapiens
RTLQSFGTE

SEQ ID NO: 831844 - protein, 9 aa, Homo Sapiens
PKECILLGF

SEQ ID NO: 831845 - protein, 9 aa, Homo Sapiens
TKGMGKFSS

SEQ ID NO: 831846 - protein, 9 aa, Homo Sapiens
NISEVVIKQ

SEQ ID NO: 831847 - protein, 9 aa, Homo Sapiens
LYISDLWKV

SEQ ID NO: 831848 - protein, 9 aa, Homo Sapiens
ADVVLAHLG

SEQ ID NO: 831849 - protein, 9 aa, Homo Sapiens
LHLEDRVED

SEQ ID NO: 831850 - protein, 9 aa, Homo Sapiens
VQHSKLEEN

SEQ ID NO: 831851 - protein, 9 aa, Homo Sapiens
IFHMVPVSQ

SEQ ID NO: 831852 - protein, 9 aa, Homo Sapiens
SEITFFSPI

SEQ ID NO: 831853 - protein, 9 aa, Homo Sapiens
SVQHPLGMR

SEQ ID NO: 831854 - protein, 9 aa, Homo Sapiens
SLVQICLAL

SEQ ID NO: 831855 - protein, 9 aa, Homo Sapiens
SLHPMKQPA

SEQ ID NO: 831856 - protein, 9 aa, Homo Sapiens
GSNQTVFVS

SEQ ID NO: 831857 - protein, 9 aa, Homo Sapiens
EPQDGRDRR

SEQ ID NO: 831858 - protein, 9 aa, Homo Sapiens
QTLDLIRPL

SEQ ID NO: 831859 - protein, 9 aa, Homo Sapiens
SFKWWIMVP

SEQ ID NO: 831860 - protein, 9 aa, Homo Sapiens
AMELHGFWM

SEQ ID NO: 831861 - protein, 9 aa, Homo Sapiens
MDASSSKMK

SEQ ID NO: 831862 - protein, 9 aa, Homo Sapiens
TFTMGSGAE

SEQ ID NO: 831863 - protein, 9 aa, Homo Sapiens
PNLFADEDL

SEQ ID NO: 831864 - protein, 9 aa, Homo Sapiens
DPVRVDITL

SEQ ID NO: 831865 - protein, 9 aa, Homo Sapiens
SDGDQSVSS

SEQ ID NO: 831866 - protein, 9 aa, Homo Sapiens
YGADGDVFN

SEQ ID NO: 831867 - protein, 9 aa, Homo Sapiens
WKTLLHMCD

SEQ ID NO: 831868 - protein, 9 aa, Homo Sapiens
KELFNVRPP

SEQ ID NO: 831869 - protein, 9 aa, Homo Sapiens
NYNSPVPEF

SEQ ID NO: 831870 - protein, 9 aa, Homo Sapiens
SGLTSQPQA

SEQ ID NO: 831871 - protein, 9 aa, Homo Sapiens
KHESPSQDI

SEQ ID NO: 831872 - protein, 9 aa, Homo Sapiens
KSNKKMVAS

SEQ ID NO: 831873 - protein, 9 aa, Homo Sapiens
AELTAIQKA

SEQ ID NO: 831874 - protein, 9 aa, Homo Sapiens
IANTTNGRG

SEQ ID NO: 831875 - protein, 9 aa, Homo Sapiens
VYFSLLLMQ

SEQ ID NO: 831876 - protein, 9 aa, Homo Sapiens
PYSSPSLCI

SEQ ID NO: 831877 - protein, 9 aa, Homo Sapiens
VLQASFLNN

SEQ ID NO: 831878 - protein, 9 aa, Homo Sapiens
LYFEEDEVW

SEQ ID NO: 831879 - protein, 9 aa, Homo Sapiens
HTPVEEKIN

SEQ ID NO: 831880 - protein, 9 aa, Homo Sapiens
VIILAFSLH

SEQ ID NO: 831881 - protein, 9 aa, Homo Sapiens
NFYIRANYL

SEQ ID NO: 831882 - protein, 9 aa, Homo Sapiens
LVVLHTFML

SEQ ID NO: 831883 - protein, 9 aa, Homo Sapiens
KQHILISRK

SEQ ID NO: 831884 - protein, 9 aa, Homo Sapiens
RSKRKDEVS

SEQ ID NO: 831885 - protein, 9 aa, Homo Sapiens
SYSQIVTSA

SEQ ID NO: 831886 - protein, 9 aa, Homo Sapiens
VRRIYPQLI

SEQ ID NO: 831887 - protein, 9 aa, Homo Sapiens
SFKKKPISK

SEQ ID NO: 831888 - protein, 9 aa, Homo Sapiens
LLIGNLAFV

SEQ ID NO: 831889 - protein, 9 aa, Homo Sapiens
GYFETFISA

SEQ ID NO: 831890 - protein, 9 aa, Homo Sapiens
LRLQMRLKR

SEQ ID NO: 831891 - protein, 9 aa, Homo Sapiens
ILKVLEDEF

SEQ ID NO: 831892 - protein, 9 aa, Homo Sapiens
SHIAVVILL

SEQ ID NO: 831893 - protein, 9 aa, Homo Sapiens
KYGQCWVFT

SEQ ID NO: 831894 - protein, 9 aa, Homo Sapiens
ILTQNDFGH

SEQ ID NO: 831895 - protein, 9 aa, Homo Sapiens
GGDTELSAC

SEQ ID NO: 831896 - protein, 9 aa, Homo Sapiens
RMLSLTTIL

SEQ ID NO: 831897 - protein, 9 aa, Homo Sapiens
LEAKKIKCF

SEQ ID NO: 831898 - protein, 9 aa, Homo Sapiens
SLDDSFSAF

SEQ ID NO: 831899 - protein, 9 aa, Homo Sapiens
FSGININAY

SEQ ID NO: 831900 - protein, 9 aa, Homo Sapiens
KEFETAGLN

SEQ ID NO: 831901 - protein, 9 aa, Homo Sapiens
LEHYLPWPE

SEQ ID NO: 831902 - protein, 9 aa, Homo Sapiens
KQVLCYAAR

SEQ ID NO: 831903 - protein, 9 aa, Homo Sapiens
NGADGTQGP

SEQ ID NO: 831904 - protein, 9 aa, Homo Sapiens
TGSIFVVFD

SEQ ID NO: 831905 - protein, 9 aa, Homo Sapiens
TVDASGSPK

SEQ ID NO: 831906 - protein, 9 aa, Homo Sapiens
HDRTILHRD

SEQ ID NO: 831907 - protein, 9 aa, Homo Sapiens
ALIHLDDMH

SEQ ID NO: 831908 - protein, 9 aa, Homo Sapiens
LAKQTGRSE

SEQ ID NO: 831909 - protein, 9 aa, Homo Sapiens
LAEPQWAGR

SEQ ID NO: 831910 - protein, 9 aa, Homo Sapiens
PSPQQTEYC

SEQ ID NO: 831911 - protein, 9 aa, Homo Sapiens
MSPFCQIRN

SEQ ID NO: 831912 - protein, 9 aa, Homo Sapiens
ITAGRHGDA

SEQ ID NO: 831913 - protein, 9 aa, Homo Sapiens
PGPGCYNVL

SEQ ID NO: 831914 - protein, 9 aa, Homo Sapiens
ISERKKWIH

SEQ ID NO: 831915 - protein, 9 aa, Homo Sapiens
VKKKNDNRL

SEQ ID NO: 831916 - protein, 9 aa, Homo Sapiens
QAAQNMVLQ

SEQ ID NO: 831917 - protein, 9 aa, Homo Sapiens
EFNVNSNEL

SEQ ID NO: 831918 - protein, 9 aa, Homo Sapiens
NTCFHCMAC

SEQ ID NO: 831919 - protein, 9 aa, Homo Sapiens
YCYTFGQLI

SEQ ID NO: 831920 - protein, 9 aa, Homo Sapiens
WWGRLSIKG

SEQ ID NO: 831921 - protein, 9 aa, Homo Sapiens
LKVAQEAIE

SEQ ID NO: 831922 - protein, 9 aa, Homo Sapiens
VNTTLYTVR

SEQ ID NO: 831923 - protein, 9 aa, Homo Sapiens
YLGVEWDYN

SEQ ID NO: 831924 - protein, 9 aa, Homo Sapiens
VGQYICKDL

SEQ ID NO: 831925 - protein, 9 aa, Homo Sapiens
YDVMYLSWN

SEQ ID NO: 831926 - protein, 9 aa, Homo Sapiens
LANQSILLL

SEQ ID NO: 831927 - protein, 9 aa, Homo Sapiens
YVLLILLFC

SEQ ID NO: 831928 - protein, 9 aa, Homo Sapiens
CVAQVGPEI

SEQ ID NO: 831929 - protein, 9 aa, Homo Sapiens
YAFVVPASI

SEQ ID NO: 831930 - protein, 9 aa, Homo Sapiens
QPKEVWCER

SEQ ID NO: 831931 - protein, 9 aa, Homo Sapiens
PFDEGLPPI

SEQ ID NO: 831932 - protein, 9 aa, Homo Sapiens
DEQGLNSEC

SEQ ID NO: 831933 - protein, 9 aa, Homo Sapiens
PAKTSAVNN

SEQ ID NO: 831934 - protein, 9 aa, Homo Sapiens
DQGDLYSLL

SEQ ID NO: 831935 - protein, 9 aa, Homo Sapiens
IAMAVLGHW

SEQ ID NO: 831936 - protein, 9 aa, Homo Sapiens
SDVSDAGTY

SEQ ID NO: 831937 - protein, 9 aa, Homo Sapiens
RKLCGLDNG

SEQ ID NO: 831938 - protein, 9 aa, Homo Sapiens
VMPFWRISS

SEQ ID NO: 831939 - protein, 9 aa, Homo Sapiens
YSHLSDTKE

SEQ ID NO: 831940 - protein, 9 aa, Homo Sapiens
AYGDQYRTT

SEQ ID NO: 831941 - protein, 9 aa, Homo Sapiens
YFYRTLITL

SEQ ID NO: 831942 - protein, 9 aa, Homo Sapiens
FCGGLIKYI

SEQ ID NO: 831943 - protein, 9 aa, Homo Sapiens
RFYWNVSRF

SEQ ID NO: 831944 - protein, 9 aa, Homo Sapiens
VKGNYLRTS

SEQ ID NO: 831945 - protein, 9 aa, Homo Sapiens
LGGLLAAAY

SEQ ID NO: 831946 - protein, 9 aa, Homo Sapiens
IQTVMKKVL

SEQ ID NO: 831947 - protein, 9 aa, Homo Sapiens
VAKNNTLQF

SEQ ID NO: 831948 - protein, 9 aa, Homo Sapiens
FLGMIGIFG

SEQ ID NO: 831949 - protein, 9 aa, Homo Sapiens
PATNYSHTD

SEQ ID NO: 831950 - protein, 9 aa, Homo Sapiens
AAEAQRGLC

SEQ ID NO: 831951 - protein, 9 aa, Homo Sapiens
FTRPEEIVF

SEQ ID NO: 831952 - protein, 9 aa, Homo Sapiens
CPECGRWFS

SEQ ID NO: 831953 - protein, 9 aa, Homo Sapiens
SMTFQSRVM

SEQ ID NO: 831954 - protein, 9 aa, Homo Sapiens
LFMGVIQCN

SEQ ID NO: 831955 - protein, 9 aa, Homo Sapiens
LLKKAQKDG

SEQ ID NO: 831956 - protein, 9 aa, Homo Sapiens
KRIEKGSSY

SEQ ID NO: 831957 - protein, 9 aa, Homo Sapiens
KASWEEREI

SEQ ID NO: 831958 - protein, 9 aa, Homo Sapiens
IFNNNTNSK

SEQ ID NO: 831959 - protein, 9 aa, Homo Sapiens
TVAKLTLDN

SEQ ID NO: 831960 - protein, 9 aa, Homo Sapiens
RYGSSCLKS

SEQ ID NO: 831961 - protein, 9 aa, Homo Sapiens
HTESWSLRM

SEQ ID NO: 831962 - protein, 9 aa, Homo Sapiens
TGLTLLHQA

SEQ ID NO: 831963 - protein, 9 aa, Homo Sapiens
SKQEPENNQ

SEQ ID NO: 831964 - protein, 9 aa, Homo Sapiens
VEIPDFSNS

SEQ ID NO: 831965 - protein, 9 aa, Homo Sapiens
FINARRIIV

SEQ ID NO: 831966 - protein, 9 aa, Homo Sapiens
VRDYYHCYS

SEQ ID NO: 831967 - protein, 9 aa, Homo Sapiens
KNDFEQGKL

SEQ ID NO: 831968 - protein, 9 aa, Homo Sapiens
HIEKLNSVG

SEQ ID NO: 831969 - protein, 9 aa, Homo Sapiens
ETFDAMNNS

SEQ ID NO: 831970 - protein, 9 aa, Homo Sapiens
LPQLLDDSH

SEQ ID NO: 831971 - protein, 9 aa, Homo Sapiens
ELINQSQGS

SEQ ID NO: 831972 - protein, 9 aa, Homo Sapiens
RVIQSKGIT

SEQ ID NO: 831973 - protein, 9 aa, Homo Sapiens
QREPNAVDP

SEQ ID NO: 831974 - protein, 9 aa, Homo Sapiens
QCYLIVYYT

SEQ ID NO: 831975 - protein, 9 aa, Homo Sapiens
CPKLPKANM

SEQ ID NO: 831976 - protein, 9 aa, Homo Sapiens
PNDLFSTNP

SEQ ID NO: 831977 - protein, 9 aa, Homo Sapiens
DSDEDILEV

SEQ ID NO: 831978 - protein, 9 aa, Homo Sapiens
LFKCNECGK

SEQ ID NO: 831979 - protein, 9 aa, Homo Sapiens
IIGHFLFWF

SEQ ID NO: 831980 - protein, 9 aa, Homo Sapiens
SSARAQGPS

SEQ ID NO: 831981 - protein, 9 aa, Homo Sapiens
ILRRLPLFY

SEQ ID NO: 831982 - protein, 9 aa, Homo Sapiens
DKGICELVS

SEQ ID NO: 831983 - protein, 9 aa, Homo Sapiens
LAEQLAQLY

SEQ ID NO: 831984 - protein, 9 aa, Homo Sapiens
KEAVCYVLP

SEQ ID NO: 831985 - protein, 9 aa, Homo Sapiens
AQAQSLRER

SEQ ID NO: 831986 - protein, 9 aa, Homo Sapiens
SDACSARMY

SEQ ID NO: 831987 - protein, 9 aa, Homo Sapiens
EPSNLQSAV

SEQ ID NO: 831988 - protein, 9 aa, Homo Sapiens
GEGLGGESA

SEQ ID NO: 831989 - protein, 9 aa, Homo Sapiens
KLSYMDVYL

SEQ ID NO: 831990 - protein, 9 aa, Homo Sapiens
IGLPGPQGS

SEQ ID NO: 831991 - protein, 9 aa, Homo Sapiens
TATKSPIIF

SEQ ID NO: 831992 - protein, 9 aa, Homo Sapiens
PNLPYRYQN

SEQ ID NO: 831993 - protein, 9 aa, Homo Sapiens
TFSNYESMK

SEQ ID NO: 831994 - protein, 9 aa, Homo Sapiens
AFPGPQGKK

SEQ ID NO: 831995 - protein, 9 aa, Homo Sapiens
DGKKRKGSR

SEQ ID NO: 831996 - protein, 9 aa, Homo Sapiens
MQTQPFRDE

SEQ ID NO: 831997 - protein, 9 aa, Homo Sapiens
SESFDELLA

SEQ ID NO: 831998 - protein, 9 aa, Homo Sapiens
NYRQAKTHM

SEQ ID NO: 831999 - protein, 9 aa, Homo Sapiens
ALHFLRLNH

SEQ ID NO: 832000 - protein, 9 aa, Homo Sapiens
RCVTNPAYE

SEQ ID NO: 832001 - protein, 9 aa, Homo Sapiens
KRKEIFETP

SEQ ID NO: 832002 - protein, 9 aa, Homo Sapiens
GCGKGTQCN

SEQ ID NO: 832003 - protein, 9 aa, Homo Sapiens
LNMTTPNKT

SEQ ID NO: 832004 - protein, 9 aa, Homo Sapiens
LNRARKLHL

SEQ ID NO: 832005 - protein, 9 aa, Homo Sapiens
RSVTSVRDL

SEQ ID NO: 832006 - protein, 9 aa, Homo Sapiens
YIPHNSATE

SEQ ID NO: 832007 - protein, 9 aa, Homo Sapiens
VVPPPNPGD

SEQ ID NO: 832008 - protein, 9 aa, Homo Sapiens
LVAILISYI

SEQ ID NO: 832009 - protein, 9 aa, Homo Sapiens
GLRAEDNPM

SEQ ID NO: 832010 - protein, 9 aa, Homo Sapiens
ETDKFGQGV

SEQ ID NO: 832011 - protein, 9 aa, Homo Sapiens
SSWGNPGFT

SEQ ID NO: 832012 - protein, 9 aa, Homo Sapiens
VKDLMPKAE

SEQ ID NO: 832013 - protein, 9 aa, Homo Sapiens
VQASYQHEA

SEQ ID NO: 832014 - protein, 9 aa, Homo Sapiens
TLGLQCRRC

SEQ ID NO: 832015 - protein, 9 aa, Homo Sapiens
IYRPMGFGD

SEQ ID NO: 832016 - protein, 9 aa, Homo Sapiens
VGWYRPPLS

SEQ ID NO: 832017 - protein, 9 aa, Homo Sapiens
QLRTFKLTL

SEQ ID NO: 832018 - protein, 9 aa, Homo Sapiens
PSLYWWLCW

SEQ ID NO: 832019 - protein, 9 aa, Homo Sapiens
IIVIDSIDH

SEQ ID NO: 832020 - protein, 9 aa, Homo Sapiens
PIIYSLWNC

SEQ ID NO: 832021 - protein, 9 aa, Homo Sapiens
LSNPIPIKV

SEQ ID NO: 832022 - protein, 9 aa, Homo Sapiens
DEIEHLQNE

SEQ ID NO: 832023 - protein, 9 aa, Homo Sapiens
QPRAHFQRR

SEQ ID NO: 832024 - protein, 9 aa, Homo Sapiens
QKIQIVTTV

SEQ ID NO: 832025 - protein, 9 aa, Homo Sapiens
QSLSADEEH

SEQ ID NO: 832026 - protein, 9 aa, Homo Sapiens
VGIFTPNNY

SEQ ID NO: 832027 - protein, 9 aa, Homo Sapiens
HTADKPYKC

SEQ ID NO: 832028 - protein, 9 aa, Homo Sapiens
NYWLEMFDN

SEQ ID NO: 832029 - protein, 9 aa, Homo Sapiens
REQINSSSC

SEQ ID NO: 832030 - protein, 9 aa, Homo Sapiens
GSFDDSFSE

SEQ ID NO: 832031 - protein, 9 aa, Homo Sapiens
LGGFYPFPQ

SEQ ID NO: 832032 - protein, 9 aa, Homo Sapiens
LPKPMEPPM

SEQ ID NO: 832033 - protein, 9 aa, Homo Sapiens
FVFQFIPYM

SEQ ID NO: 832034 - protein, 9 aa, Homo Sapiens
YLWHRSDSA

SEQ ID NO: 832035 - protein, 9 aa, Homo Sapiens
TLLLQIEKE

SEQ ID NO: 832036 - protein, 9 aa, Homo Sapiens
TSFSNLVHL

SEQ ID NO: 832037 - protein, 9 aa, Homo Sapiens
AERKRMRNH

SEQ ID NO: 832038 - protein, 9 aa, Homo Sapiens
QMKKLDIKL

SEQ ID NO: 832039 - protein, 9 aa, Homo Sapiens
LTAHQRRHT

SEQ ID NO: 832040 - protein, 9 aa, Homo Sapiens
RTETYVRTI

SEQ ID NO: 832041 - protein, 9 aa, Homo Sapiens
NTKFMIFKS

SEQ ID NO: 832042 - protein, 9 aa, Homo Sapiens
HLMEQHNIK

SEQ ID NO: 832043 - protein, 9 aa, Homo Sapiens
ECTDRNYTL

SEQ ID NO: 832044 - protein, 9 aa, Homo Sapiens
IISQEERCT

SEQ ID NO: 832045 - protein, 9 aa, Homo Sapiens
QPDDRIPFL

SEQ ID NO: 832046 - protein, 9 aa, Homo Sapiens
TDDEGAPQI

SEQ ID NO: 832047 - protein, 9 aa, Homo Sapiens
EYIEEHVEQ

SEQ ID NO: 832048 - protein, 9 aa, Homo Sapiens
ILIIFAVFI

SEQ ID NO: 832049 - protein, 9 aa, Homo Sapiens
LTLTRRPTL

SEQ ID NO: 832050 - protein, 9 aa, Homo Sapiens
FYQWICDNF

SEQ ID NO: 832051 - protein, 9 aa, Homo Sapiens
NLATQPKGP

SEQ ID NO: 832052 - protein, 9 aa, Homo Sapiens
EDHVQIWEV

SEQ ID NO: 832053 - protein, 9 aa, Homo Sapiens
DKVANNLAI

SEQ ID NO: 832054 - protein, 9 aa, Homo Sapiens
ACKVLIEFY

SEQ ID NO: 832055 - protein, 9 aa, Homo Sapiens
LNISINDYA

SEQ ID NO: 832056 - protein, 9 aa, Homo Sapiens
VHGIQIEFI

SEQ ID NO: 832057 - protein, 9 aa, Homo Sapiens
SEDMDTHVK

SEQ ID NO: 832058 - protein, 9 aa, Homo Sapiens
LVMNDKGEL

SEQ ID NO: 832059 - protein, 9 aa, Homo Sapiens
FELAHYHAP

SEQ ID NO: 832060 - protein, 9 aa, Homo Sapiens
WKRTAPEDF

SEQ ID NO: 832061 - protein, 9 aa, Homo Sapiens
GKKIYLPGQ

SEQ ID NO: 832062 - protein, 9 aa, Homo Sapiens
YLPFQNPNF

SEQ ID NO: 832063 - protein, 9 aa, Homo Sapiens
LKAWLNGHR

SEQ ID NO: 832064 - protein, 9 aa, Homo Sapiens
RPLSYPDLD

SEQ ID NO: 832065 - protein, 9 aa, Homo Sapiens
GHRPHKGPG

SEQ ID NO: 832066 - protein, 9 aa, Homo Sapiens
LGSVVINED

SEQ ID NO: 832067 - protein, 9 aa, Homo Sapiens
GKSGELLKP

SEQ ID NO: 832068 - protein, 9 aa, Homo Sapiens
YCPKKNKLT

SEQ ID NO: 832069 - protein, 9 aa, Homo Sapiens
GKIFGPFDL

SEQ ID NO: 832070 - protein, 9 aa, Homo Sapiens
LQKIKAIKL

SEQ ID NO: 832071 - protein, 9 aa, Homo Sapiens
HEASTAMLP

SEQ ID NO: 832072 - protein, 9 aa, Homo Sapiens
LPPAASCPD

SEQ ID NO: 832073 - protein, 9 aa, Homo Sapiens
KKASPKAAS

SEQ ID NO: 832074 - protein, 9 aa, Homo Sapiens
EDSNRGKYH

SEQ ID NO: 832075 - protein, 9 aa, Homo Sapiens
FCCEAPAKN

SEQ ID NO: 832076 - protein, 9 aa, Homo Sapiens
GLANQFFSS

SEQ ID NO: 832077 - protein, 9 aa, Homo Sapiens
LEFNMLCYT

SEQ ID NO: 832078 - protein, 9 aa, Homo Sapiens
RAKAGQAQV

SEQ ID NO: 832079 - protein, 9 aa, Homo Sapiens
RFSGSLCAG

SEQ ID NO: 832080 - protein, 9 aa, Homo Sapiens
YGLTKAIAS

SEQ ID NO: 832081 - protein, 9 aa, Homo Sapiens
FCCEFDSQA

SEQ ID NO: 832082 - protein, 9 aa, Homo Sapiens
YWNVSRFIN

SEQ ID NO: 832083 - protein, 9 aa, Homo Sapiens
EIIILEPDK

SEQ ID NO: 832084 - protein, 9 aa, Homo Sapiens
IAFPRTDEF

SEQ ID NO: 832085 - protein, 9 aa, Homo Sapiens
MRVYFNVPM

SEQ ID NO: 832086 - protein, 9 aa, Homo Sapiens
IYGTPHNNQ

SEQ ID NO: 832087 - protein, 9 aa, Homo Sapiens
PQLCVGTMA

SEQ ID NO: 832088 - protein, 9 aa, Homo Sapiens
RHGNWYIQA

SEQ ID NO: 832089 - protein, 9 aa, Homo Sapiens
HQRIHTGET

SEQ ID NO: 832090 - protein, 9 aa, Homo Sapiens
GTVCSLIHV

SEQ ID NO: 832091 - protein, 9 aa, Homo Sapiens
ILQPDDSLQ

SEQ ID NO: 832092 - protein, 9 aa, Homo Sapiens
SVLLFPLIP

SEQ ID NO: 832093 - protein, 9 aa, Homo Sapiens
TGIPLPDQL

SEQ ID NO: 832094 - protein, 9 aa, Homo Sapiens
QLKHEDTNL

SEQ ID NO: 832095 - protein, 9 aa, Homo Sapiens
DYQVPLDPT

SEQ ID NO: 832096 - protein, 9 aa, Homo Sapiens
TWSDNGNVC

SEQ ID NO: 832097 - protein, 9 aa, Homo Sapiens
LTMNPLLYS

SEQ ID NO: 832098 - protein, 9 aa, Homo Sapiens
IISLSGCFL

SEQ ID NO: 832099 - protein, 9 aa, Homo Sapiens
LKRYSFSNA

SEQ ID NO: 832100 - protein, 9 aa, Homo Sapiens
NVPIFKDNN

SEQ ID NO: 832101 - protein, 9 aa, Homo Sapiens
ARLEPLYFP

SEQ ID NO: 832102 - protein, 9 aa, Homo Sapiens
DGLKNQKLF

SEQ ID NO: 832103 - protein, 9 aa, Homo Sapiens
TKLCDVAQQ

SEQ ID NO: 832104 - protein, 9 aa, Homo Sapiens
IDEDCTLMS

SEQ ID NO: 832105 - protein, 9 aa, Homo Sapiens
ANLYVHRII

SEQ ID NO: 832106 - protein, 9 aa, Homo Sapiens
MDAKINVDS

SEQ ID NO: 832107 - protein, 9 aa, Homo Sapiens
STVSLIIHQ

SEQ ID NO: 832108 - protein, 9 aa, Homo Sapiens
AGLFIDVVQ

SEQ ID NO: 832109 - protein, 9 aa, Homo Sapiens
PYLTDVLLQ

SEQ ID NO: 832110 - protein, 9 aa, Homo Sapiens
AGTLMTFFL

SEQ ID NO: 832111 - protein, 9 aa, Homo Sapiens
EARNVSVSP

SEQ ID NO: 832112 - protein, 9 aa, Homo Sapiens
EDISGQTGH

SEQ ID NO: 832113 - protein, 9 aa, Homo Sapiens
SSHCSATPT

SEQ ID NO: 832114 - protein, 9 aa, Homo Sapiens
CHSHFHNIF

SEQ ID NO: 832115 - protein, 9 aa, Homo Sapiens
PPTQHFPMR

SEQ ID NO: 832116 - protein, 9 aa, Homo Sapiens
ELFEENIKL

SEQ ID NO: 832117 - protein, 9 aa, Homo Sapiens
KLCDIILRV

SEQ ID NO: 832118 - protein, 9 aa, Homo Sapiens
PQLNPATTS

SEQ ID NO: 832119 - protein, 9 aa, Homo Sapiens
MSRALAENM

SEQ ID NO: 832120 - protein, 9 aa, Homo Sapiens
FEPSGPFRQ

SEQ ID NO: 832121 - protein, 9 aa, Homo Sapiens
VGTGEALIH

SEQ ID NO: 832122 - protein, 9 aa, Homo Sapiens
KVPTPITKM

SEQ ID NO: 832123 - protein, 9 aa, Homo Sapiens
AEAVRDYYH

SEQ ID NO: 832124 - protein, 9 aa, Homo Sapiens
SGDLNQNEE

SEQ ID NO: 832125 - protein, 9 aa, Homo Sapiens
GDQSVSSQS

SEQ ID NO: 832126 - protein, 9 aa, Homo Sapiens
LEEVCTSLT

SEQ ID NO: 832127 - protein, 9 aa, Homo Sapiens
EREASKIMK

SEQ ID NO: 832128 - protein, 9 aa, Homo Sapiens
GSLNAYLHS

SEQ ID NO: 832129 - protein, 9 aa, Homo Sapiens
NGYSVTSFT

SEQ ID NO: 832130 - protein, 9 aa, Homo Sapiens
RLGPWRVGA

SEQ ID NO: 832131 - protein, 9 aa, Homo Sapiens
VFLDTMPEY

SEQ ID NO: 832132 - protein, 9 aa, Homo Sapiens
ITHTQEKPY

SEQ ID NO: 832133 - protein, 9 aa, Homo Sapiens
CIFPASWHF

SEQ ID NO: 832134 - protein, 9 aa, Homo Sapiens
STRHDMGTL

SEQ ID NO: 832135 - protein, 9 aa, Homo Sapiens
SFQGSVMAY

SEQ ID NO: 832136 - protein, 9 aa, Homo Sapiens
VAFAMYMVN

SEQ ID NO: 832137 - protein, 9 aa, Homo Sapiens
NKHFPLEEV

SEQ ID NO: 832138 - protein, 9 aa, Homo Sapiens
IAFRNNYLK

SEQ ID NO: 832139 - protein, 9 aa, Homo Sapiens
GVGIRNILV

SEQ ID NO: 832140 - protein, 9 aa, Homo Sapiens
LSGGALKLA

SEQ ID NO: 832141 - protein, 9 aa, Homo Sapiens
KDLAGCIHS

SEQ ID NO: 832142 - protein, 9 aa, Homo Sapiens
MPRLLLFHL

SEQ ID NO: 832143 - protein, 9 aa, Homo Sapiens
IVTTCSLVR

SEQ ID NO: 832144 - protein, 9 aa, Homo Sapiens
DQLQTHTVY

SEQ ID NO: 832145 - protein, 9 aa, Homo Sapiens
FCVCYVPYV

SEQ ID NO: 832146 - protein, 9 aa, Homo Sapiens
YSMTRPASR

SEQ ID NO: 832147 - protein, 9 aa, Homo Sapiens
ICYQNKYTH

SEQ ID NO: 832148 - protein, 9 aa, Homo Sapiens
LYKFLVGCV

SEQ ID NO: 832149 - protein, 9 aa, Homo Sapiens
YIFVYSAKR

SEQ ID NO: 832150 - protein, 9 aa, Homo Sapiens
SLTIHGIIH

SEQ ID NO: 832151 - protein, 9 aa, Homo Sapiens
FWVHAGGDP

SEQ ID NO: 832152 - protein, 9 aa, Homo Sapiens
KINTYKQVA

SEQ ID NO: 832153 - protein, 9 aa, Homo Sapiens
KIKYFEVVF

SEQ ID NO: 832154 - protein, 9 aa, Homo Sapiens
AIDESKKEW

SEQ ID NO: 832155 - protein, 9 aa, Homo Sapiens
TYCLLLFYK

SEQ ID NO: 832156 - protein, 9 aa, Homo Sapiens
HRLEHHAKL

SEQ ID NO: 832157 - protein, 9 aa, Homo Sapiens
YDWPPQIQG

SEQ ID NO: 832158 - protein, 9 aa, Homo Sapiens
FRRALQQPD

SEQ ID NO: 832159 - protein, 9 aa, Homo Sapiens
SKKPTMLAL

SEQ ID NO: 832160 - protein, 9 aa, Homo Sapiens
GQGLPSSGH

SEQ ID NO: 832161 - protein, 9 aa, Homo Sapiens
MKKTIDMLH

SEQ ID NO: 832162 - protein, 9 aa, Homo Sapiens
NVLDYYKRE

SEQ ID NO: 832163 - protein, 9 aa, Homo Sapiens
GQRKKYAPK

SEQ ID NO: 832164 - protein, 9 aa, Homo Sapiens
DCTNARRNR

SEQ ID NO: 832165 - protein, 9 aa, Homo Sapiens
AYQFMLADR

SEQ ID NO: 832166 - protein, 9 aa, Homo Sapiens
VSIVALVVL

SEQ ID NO: 832167 - protein, 9 aa, Homo Sapiens
LGLCSLFVV

SEQ ID NO: 832168 - protein, 9 aa, Homo Sapiens
TLRKVLSLK

SEQ ID NO: 832169 - protein, 9 aa, Homo Sapiens
GVEEVQTFL

SEQ ID NO: 832170 - protein, 9 aa, Homo Sapiens
TLSLKQIHL

SEQ ID NO: 832171 - protein, 9 aa, Homo Sapiens
RPGETLNIN

SEQ ID NO: 832172 - protein, 9 aa, Homo Sapiens
VSKKENLRS

SEQ ID NO: 832173 - protein, 9 aa, Homo Sapiens
KSLLILVLI

SEQ ID NO: 832174 - protein, 9 aa, Homo Sapiens
QLTVHQIIH

SEQ ID NO: 832175 - protein, 9 aa, Homo Sapiens
VIRGQSSVC

SEQ ID NO: 832176 - protein, 9 aa, Homo Sapiens
TIVHNCLIS

SEQ ID NO: 832177 - protein, 9 aa, Homo Sapiens
RPPRAGNTG

SEQ ID NO: 832178 - protein, 9 aa, Homo Sapiens
CYVSKKPAN

SEQ ID NO: 832179 - protein, 9 aa, Homo Sapiens
LKEKVIRAV

SEQ ID NO: 832180 - protein, 9 aa, Homo Sapiens
CGERFSQSF

SEQ ID NO: 832181 - protein, 9 aa, Homo Sapiens
EAVCTTIQV

SEQ ID NO: 832182 - protein, 9 aa, Homo Sapiens
PGVKNKTFK

SEQ ID NO: 832183 - protein, 9 aa, Homo Sapiens
PEAKATVEE

SEQ ID NO: 832184 - protein, 9 aa, Homo Sapiens
PKFANTSMA

SEQ ID NO: 832185 - protein, 9 aa, Homo Sapiens
EHNLADVVQ

SEQ ID NO: 832186 - protein, 9 aa, Homo Sapiens
FLSVDDDND

SEQ ID NO: 832187 - protein, 9 aa, Homo Sapiens
HMEYLVKWK

SEQ ID NO: 832188 - protein, 9 aa, Homo Sapiens
RKSEAKQVP

SEQ ID NO: 832189 - protein, 9 aa, Homo Sapiens
NSFTAQFNM

SEQ ID NO: 832190 - protein, 9 aa, Homo Sapiens
AADPAAMVS

SEQ ID NO: 832191 - protein, 9 aa, Homo Sapiens
MDGPNQYFC

SEQ ID NO: 832192 - protein, 9 aa, Homo Sapiens
GRRYDELHN

SEQ ID NO: 832193 - protein, 9 aa, Homo Sapiens
KKCTYAIKC

SEQ ID NO: 832194 - protein, 9 aa, Homo Sapiens
TYRPHVYVG

SEQ ID NO: 832195 - protein, 9 aa, Homo Sapiens
RIGDKNKVT

SEQ ID NO: 832196 - protein, 9 aa, Homo Sapiens
LKSLELHDE

SEQ ID NO: 832197 - protein, 9 aa, Homo Sapiens
FSQPIRLQN

SEQ ID NO: 832198 - protein, 9 aa, Homo Sapiens
LHSNLYRRD

SEQ ID NO: 832199 - protein, 9 aa, Homo Sapiens
STKNYPSTR

SEQ ID NO: 832200 - protein, 9 aa, Homo Sapiens
LRHKRKHDE

SEQ ID NO: 832201 - protein, 9 aa, Homo Sapiens
EPLARERIA

SEQ ID NO: 832202 - protein, 9 aa, Homo Sapiens
VANINSRFG

SEQ ID NO: 832203 - protein, 9 aa, Homo Sapiens
RRHFNSNCK

SEQ ID NO: 832204 - protein, 9 aa, Homo Sapiens
LESFPRVEL

SEQ ID NO: 832205 - protein, 9 aa, Homo Sapiens
KEITSEDMA

SEQ ID NO: 832206 - protein, 9 aa, Homo Sapiens
EKFLTDYVN

SEQ ID NO: 832207 - protein, 9 aa, Homo Sapiens
SPKFVRVRS

SEQ ID NO: 832208 - protein, 9 aa, Homo Sapiens
TNKLLTVYL

SEQ ID NO: 832209 - protein, 9 aa, Homo Sapiens
ELPKDDANL

SEQ ID NO: 832210 - protein, 9 aa, Homo Sapiens
ALCPRKFPA

SEQ ID NO: 832211 - protein, 9 aa, Homo Sapiens
MDQANRPHC

SEQ ID NO: 832212 - protein, 9 aa, Homo Sapiens
PVSPKFSTQ

SEQ ID NO: 832213 - protein, 9 aa, Homo Sapiens
CDRNLCNVF

SEQ ID NO: 832214 - protein, 9 aa, Homo Sapiens
MLFSWQEDP

SEQ ID NO: 832215 - protein, 9 aa, Homo Sapiens
FKASYPSAM

SEQ ID NO: 832216 - protein, 9 aa, Homo Sapiens
KSQWMLSQT

SEQ ID NO: 832217 - protein, 9 aa, Homo Sapiens
HNLKSWNGE

SEQ ID NO: 832218 - protein, 9 aa, Homo Sapiens
RAMEGKLGE

SEQ ID NO: 832219 - protein, 9 aa, Homo Sapiens
KQISSGSSK

SEQ ID NO: 832220 - protein, 9 aa, Homo Sapiens
NLQSAVSIL

SEQ ID NO: 832221 - protein, 9 aa, Homo Sapiens
LAEDKENYN

SEQ ID NO: 832222 - protein, 9 aa, Homo Sapiens
PKTYPNCFV

SEQ ID NO: 832223 - protein, 9 aa, Homo Sapiens
SDLQHSQVP

SEQ ID NO: 832224 - protein, 9 aa, Homo Sapiens
KESINKTLT

SEQ ID NO: 832225 - protein, 9 aa, Homo Sapiens
QRDSTKSQR

SEQ ID NO: 832226 - protein, 9 aa, Homo Sapiens
RGLYYNFWC

SEQ ID NO: 832227 - protein, 9 aa, Homo Sapiens
GRRFIIRWC

SEQ ID NO: 832228 - protein, 9 aa, Homo Sapiens
ASKSVSSTN

SEQ ID NO: 832229 - protein, 9 aa, Homo Sapiens
PIACDNVEG

SEQ ID NO: 832230 - protein, 9 aa, Homo Sapiens
LQAVSPSQI

SEQ ID NO: 832231 - protein, 9 aa, Homo Sapiens
HYNKQSLHE

SEQ ID NO: 832232 - protein, 9 aa, Homo Sapiens
ETQQIISLN

SEQ ID NO: 832233 - protein, 9 aa, Homo Sapiens
NVMTAIISL

SEQ ID NO: 832234 - protein, 9 aa, Homo Sapiens
LHEIELKVM

SEQ ID NO: 832235 - protein, 9 aa, Homo Sapiens
MYDVNLNNN

SEQ ID NO: 832236 - protein, 9 aa, Homo Sapiens
KANVHRKAS

SEQ ID NO: 832237 - protein, 9 aa, Homo Sapiens
DIGIIHEKK

SEQ ID NO: 832238 - protein, 9 aa, Homo Sapiens
ANEFSKCDQ

SEQ ID NO: 832239 - protein, 9 aa, Homo Sapiens
QNTIKYMTA

SEQ ID NO: 832240 - protein, 9 aa, Homo Sapiens
SDNLKDMIF

SEQ ID NO: 832241 - protein, 9 aa, Homo Sapiens
PPSVPMCDL

SEQ ID NO: 832242 - protein, 9 aa, Homo Sapiens
RRGILRRAA

SEQ ID NO: 832243 - protein, 9 aa, Homo Sapiens
CKSCCSSSG

SEQ ID NO: 832244 - protein, 9 aa, Homo Sapiens
FFLGPQRLS

SEQ ID NO: 832245 - protein, 9 aa, Homo Sapiens
RLHQLFRDM

SEQ ID NO: 832246 - protein, 9 aa, Homo Sapiens
GKMELCAKT

SEQ ID NO: 832247 - protein, 9 aa, Homo Sapiens
RDLLEKKLS

SEQ ID NO: 832248 - protein, 9 aa, Homo Sapiens
ECYHKLDYL

SEQ ID NO: 832249 - protein, 9 aa, Homo Sapiens
FILKKVNDL

SEQ ID NO: 832250 - protein, 9 aa, Homo Sapiens
KKPYTCEEC

SEQ ID NO: 832251 - protein, 9 aa, Homo Sapiens
NLIDSITVS

SEQ ID NO: 832252 - protein, 9 aa, Homo Sapiens
LTNYYVGSN

SEQ ID NO: 832253 - protein, 9 aa, Homo Sapiens
INYTVDKDI

SEQ ID NO: 832254 - protein, 9 aa, Homo Sapiens
DNAVLKSLS

SEQ ID NO: 832255 - protein, 9 aa, Homo Sapiens
VVWKKSCGR

SEQ ID NO: 832256 - protein, 9 aa, Homo Sapiens
IQVIVYILA

SEQ ID NO: 832257 - protein, 9 aa, Homo Sapiens
YTHRRMTIT

SEQ ID NO: 832258 - protein, 9 aa, Homo Sapiens
GKYLAELMV

SEQ ID NO: 832259 - protein, 9 aa, Homo Sapiens
VQQARKMVL

SEQ ID NO: 832260 - protein, 9 aa, Homo Sapiens
QQYQAIETS

SEQ ID NO: 832261 - protein, 9 aa, Homo Sapiens
TITGDDVSL

SEQ ID NO: 832262 - protein, 9 aa, Homo Sapiens
FYLLRLENP

SEQ ID NO: 832263 - protein, 9 aa, Homo Sapiens
WRGEGKAPQ

SEQ ID NO: 832264 - protein, 9 aa, Homo Sapiens
NSLSYYQVK

SEQ ID NO: 832265 - protein, 9 aa, Homo Sapiens
SSKGTNNEG

SEQ ID NO: 832266 - protein, 9 aa, Homo Sapiens
STSCMSEQS

SEQ ID NO: 832267 - protein, 9 aa, Homo Sapiens
RMRVRNSLI

SEQ ID NO: 832268 - protein, 9 aa, Homo Sapiens
AKYTTCETA

SEQ ID NO: 832269 - protein, 9 aa, Homo Sapiens
REVCKADAK

SEQ ID NO: 832270 - protein, 9 aa, Homo Sapiens
LNPIIYSLI

SEQ ID NO: 832271 - protein, 9 aa, Homo Sapiens
ILLTLMLVF

SEQ ID NO: 832272 - protein, 9 aa, Homo Sapiens
IIKARNLKD

SEQ ID NO: 832273 - protein, 9 aa, Homo Sapiens
RMDVVSVTN

SEQ ID NO: 832274 - protein, 9 aa, Homo Sapiens
QYFPAEIFL

SEQ ID NO: 832275 - protein, 9 aa, Homo Sapiens
PTVGIPLFF

SEQ ID NO: 832276 - protein, 9 aa, Homo Sapiens
TRNKEFAYE

SEQ ID NO: 832277 - protein, 9 aa, Homo Sapiens
TYIHCCVIG

SEQ ID NO: 832278 - protein, 9 aa, Homo Sapiens
YFEEDEVWY

SEQ ID NO: 832279 - protein, 9 aa, Homo Sapiens
HLTLHQESP

SEQ ID NO: 832280 - protein, 9 aa, Homo Sapiens
PLPTSGDLY

SEQ ID NO: 832281 - protein, 9 aa, Homo Sapiens
SMQKVGQVI

SEQ ID NO: 832282 - protein, 9 aa, Homo Sapiens
FREIIIAIN

SEQ ID NO: 832283 - protein, 9 aa, Homo Sapiens
ALSLDVASG

SEQ ID NO: 832284 - protein, 9 aa, Homo Sapiens
PHYMFLFQL

SEQ ID NO: 832285 - protein, 9 aa, Homo Sapiens
MQKEGLYEK

SEQ ID NO: 832286 - protein, 9 aa, Homo Sapiens
THTTITAGM

SEQ ID NO: 832287 - protein, 9 aa, Homo Sapiens
NDATNVNDA

SEQ ID NO: 832288 - protein, 9 aa, Homo Sapiens
FSPRSYLFD

SEQ ID NO: 832289 - protein, 9 aa, Homo Sapiens
VVVPPTLNH

SEQ ID NO: 832290 - protein, 9 aa, Homo Sapiens
RERTKGDIM

SEQ ID NO: 832291 - protein, 9 aa, Homo Sapiens
IGKYITNKL

SEQ ID NO: 832292 - protein, 9 aa, Homo Sapiens
CLFVNSECY

SEQ ID NO: 832293 - protein, 9 aa, Homo Sapiens
FINELKNLQ

SEQ ID NO: 832294 - protein, 9 aa, Homo Sapiens
QTEEVSSKE

SEQ ID NO: 832295 - protein, 9 aa, Homo Sapiens
KMWQFMGQS

SEQ ID NO: 832296 - protein, 9 aa, Homo Sapiens
QAAINNLWV

SEQ ID NO: 832297 - protein, 9 aa, Homo Sapiens
AAAFQRASY

SEQ ID NO: 832298 - protein, 9 aa, Homo Sapiens
MSIQDKSKE

SEQ ID NO: 832299 - protein, 9 aa, Homo Sapiens
EGPRCELWA

SEQ ID NO: 832300 - protein, 9 aa, Homo Sapiens
QNLRENKIN

SEQ ID NO: 832301 - protein, 9 aa, Homo Sapiens
YLIALLYSL

SEQ ID NO: 832302 - protein, 9 aa, Homo Sapiens
AHSSPVTPC

SEQ ID NO: 832303 - protein, 9 aa, Homo Sapiens
FFCSDELRR

SEQ ID NO: 832304 - protein, 9 aa, Homo Sapiens
SYPRKTSLV

SEQ ID NO: 832305 - protein, 9 aa, Homo Sapiens
TINYSVVEE

SEQ ID NO: 832306 - protein, 9 aa, Homo Sapiens
QMKINTYKQ

SEQ ID NO: 832307 - protein, 9 aa, Homo Sapiens
RPEEIVFLR

SEQ ID NO: 832308 - protein, 9 aa, Homo Sapiens
KKEINNSKD

SEQ ID NO: 832309 - protein, 9 aa, Homo Sapiens
NRKVQSLKE

SEQ ID NO: 832310 - protein, 9 aa, Homo Sapiens
INFSGDDLE

SEQ ID NO: 832311 - protein, 9 aa, Homo Sapiens
SSSSSSNSD

SEQ ID NO: 832312 - protein, 9 aa, Homo Sapiens
QCYLETLSE

SEQ ID NO: 832313 - protein, 9 aa, Homo Sapiens
DFWYQPQHN

SEQ ID NO: 832314 - protein, 9 aa, Homo Sapiens
EEIDYSTQK

SEQ ID NO: 832315 - protein, 9 aa, Homo Sapiens
LFTSVLRVK

SEQ ID NO: 832316 - protein, 9 aa, Homo Sapiens
WVELKDDRT

SEQ ID NO: 832317 - protein, 9 aa, Homo Sapiens
MLDNGNFRR

SEQ ID NO: 832318 - protein, 9 aa, Homo Sapiens
KQEPENNQG

SEQ ID NO: 832319 - protein, 9 aa, Homo Sapiens
KLENNLSDR

SEQ ID NO: 832320 - protein, 9 aa, Homo Sapiens
EQPHPHLVL

SEQ ID NO: 832321 - protein, 9 aa, Homo Sapiens
LERQVVDQI

SEQ ID NO: 832322 - protein, 9 aa, Homo Sapiens
EPPKYEFFW

SEQ ID NO: 832323 - protein, 9 aa, Homo Sapiens
ENQIITREE

SEQ ID NO: 832324 - protein, 9 aa, Homo Sapiens
AATHRQNYE

SEQ ID NO: 832325 - protein, 9 aa, Homo Sapiens
VWKGINLIQ

SEQ ID NO: 832326 - protein, 9 aa, Homo Sapiens
VINILIQSL

SEQ ID NO: 832327 - protein, 9 aa, Homo Sapiens
KDIEELKLM

SEQ ID NO: 832328 - protein, 9 aa, Homo Sapiens
REWGENLKD

SEQ ID NO: 832329 - protein, 9 aa, Homo Sapiens
HPLILKVHG

SEQ ID NO: 832330 - protein, 9 aa, Homo Sapiens
QERVIGSTS

SEQ ID NO: 832331 - protein, 9 aa, Homo Sapiens
NQGIQNLLK

SEQ ID NO: 832332 - protein, 9 aa, Homo Sapiens
LHNLQARYE

SEQ ID NO: 832333 - protein, 9 aa, Homo Sapiens
MMSVQENIN

SEQ ID NO: 832334 - protein, 9 aa, Homo Sapiens
LVEDHVQIW

SEQ ID NO: 832335 - protein, 9 aa, Homo Sapiens
GTYVLQYNS

SEQ ID NO: 832336 - protein, 9 aa, Homo Sapiens
QYPGVAQSL

SEQ ID NO: 832337 - protein, 9 aa, Homo Sapiens
VTPSISKED

SEQ ID NO: 832338 - protein, 9 aa, Homo Sapiens
LIDDIRKEV

SEQ ID NO: 832339 - protein, 9 aa, Homo Sapiens
KGKEGSLKD

SEQ ID NO: 832340 - protein, 9 aa, Homo Sapiens
ALELMFSML

SEQ ID NO: 832341 - protein, 9 aa, Homo Sapiens
VDKTSFLFR

SEQ ID NO: 832342 - protein, 9 aa, Homo Sapiens
EGMPGSHHD

SEQ ID NO: 832343 - protein, 9 aa, Homo Sapiens
GGLKLNAFA

SEQ ID NO: 832344 - protein, 9 aa, Homo Sapiens
ETYRDYVHR

SEQ ID NO: 832345 - protein, 9 aa, Homo Sapiens
LLAPKETNS

SEQ ID NO: 832346 - protein, 9 aa, Homo Sapiens
AQSLAGEED

SEQ ID NO: 832347 - protein, 9 aa, Homo Sapiens
YYFVPEPSN

SEQ ID NO: 832348 - protein, 9 aa, Homo Sapiens
MNPPKFFKV

SEQ ID NO: 832349 - protein, 9 aa, Homo Sapiens
KKTQVSTDQ

SEQ ID NO: 832350 - protein, 9 aa, Homo Sapiens
CVPVCCQCN

SEQ ID NO: 832351 - protein, 9 aa, Homo Sapiens
RTPEFEECN

SEQ ID NO: 832352 - protein, 9 aa, Homo Sapiens
SCLYYWALA

SEQ ID NO: 832353 - protein, 9 aa, Homo Sapiens
RMLVGGVRS

SEQ ID NO: 832354 - protein, 9 aa, Homo Sapiens
AFNCRIYLI

SEQ ID NO: 832355 - protein, 9 aa, Homo Sapiens
HVFKDNVVL

SEQ ID NO: 832356 - protein, 9 aa, Homo Sapiens
DILLERLQI

SEQ ID NO: 832357 - protein, 9 aa, Homo Sapiens
AKHNSYYVH

SEQ ID NO: 832358 - protein, 9 aa, Homo Sapiens
MILLGSGAL

SEQ ID NO: 832359 - protein, 9 aa, Homo Sapiens
ICSMIWGAS

SEQ ID NO: 832360 - protein, 9 aa, Homo Sapiens
PVSGAETVN

SEQ ID NO: 832361 - protein, 9 aa, Homo Sapiens
KISATWKRE

SEQ ID NO: 832362 - protein, 9 aa, Homo Sapiens
QPCLIAPGT

SEQ ID NO: 832363 - protein, 9 aa, Homo Sapiens
IRANCLAQT

SEQ ID NO: 832364 - protein, 9 aa, Homo Sapiens
EAEGDKYIE

SEQ ID NO: 832365 - protein, 9 aa, Homo Sapiens
EKPYKCNEG

SEQ ID NO: 832366 - protein, 9 aa, Homo Sapiens
YPNHRHRAI

SEQ ID NO: 832367 - protein, 9 aa, Homo Sapiens
DKLTGVCYV

SEQ ID NO: 832368 - protein, 9 aa, Homo Sapiens
CASNVEDNC

SEQ ID NO: 832369 - protein, 9 aa, Homo Sapiens
VYLIHSVIV

SEQ ID NO: 832370 - protein, 9 aa, Homo Sapiens
HAKIEENQK

SEQ ID NO: 832371 - protein, 9 aa, Homo Sapiens
LGELFTKTP

SEQ ID NO: 832372 - protein, 9 aa, Homo Sapiens
SPQGNLCHV

SEQ ID NO: 832373 - protein, 9 aa, Homo Sapiens
CKVLIEFYL

SEQ ID NO: 832374 - protein, 9 aa, Homo Sapiens
QVEGKTNAL

SEQ ID NO: 832375 - protein, 9 aa, Homo Sapiens
LLCNQLLRC

SEQ ID NO: 832376 - protein, 9 aa, Homo Sapiens
YRHASSLLN

SEQ ID NO: 832377 - protein, 9 aa, Homo Sapiens
SAMGRKPYV

SEQ ID NO: 832378 - protein, 9 aa, Homo Sapiens
SPVFWHKEM

SEQ ID NO: 832379 - protein, 9 aa, Homo Sapiens
QDKIQPLWR

SEQ ID NO: 832380 - protein, 9 aa, Homo Sapiens
LSQVKGFVQ

SEQ ID NO: 832381 - protein, 9 aa, Homo Sapiens
NNLAIQLAA

SEQ ID NO: 832382 - protein, 9 aa, Homo Sapiens
SFYFTVTAV

SEQ ID NO: 832383 - protein, 9 aa, Homo Sapiens
QQRFTQVSN

SEQ ID NO: 832384 - protein, 9 aa, Homo Sapiens
LGPPKHCPV

SEQ ID NO: 832385 - protein, 9 aa, Homo Sapiens
DVDRAQQYV

SEQ ID NO: 832386 - protein, 9 aa, Homo Sapiens
KLDVLLADA

SEQ ID NO: 832387 - protein, 9 aa, Homo Sapiens
DLSEVRGVE

SEQ ID NO: 832388 - protein, 9 aa, Homo Sapiens
ITQPVVVVV

SEQ ID NO: 832389 - protein, 9 aa, Homo Sapiens
ERSANGGSK

SEQ ID NO: 832390 - protein, 9 aa, Homo Sapiens
NQSYRDSGI

SEQ ID NO: 832391 - protein, 9 aa, Homo Sapiens
DEPLLKITD

SEQ ID NO: 832392 - protein, 9 aa, Homo Sapiens
DEDTFFSQE

SEQ ID NO: 832393 - protein, 9 aa, Homo Sapiens
KLARRIALA

SEQ ID NO: 832394 - protein, 9 aa, Homo Sapiens
MLFGEPTTG

SEQ ID NO: 832395 - protein, 9 aa, Homo Sapiens
LTPLMLDFN

SEQ ID NO: 832396 - protein, 9 aa, Homo Sapiens
YKKRYEDEI

SEQ ID NO: 832397 - protein, 9 aa, Homo Sapiens
CLLIPPDTL

SEQ ID NO: 832398 - protein, 9 aa, Homo Sapiens
PYFGLEESG

SEQ ID NO: 832399 - protein, 9 aa, Homo Sapiens
LEQLATKDT

SEQ ID NO: 832400 - protein, 9 aa, Homo Sapiens
STTCQAGGR

SEQ ID NO: 832401 - protein, 9 aa, Homo Sapiens
PEVPEMFTK

SEQ ID NO: 832402 - protein, 9 aa, Homo Sapiens
YAETAVLKW

SEQ ID NO: 832403 - protein, 9 aa, Homo Sapiens
KAVIQSKDT

SEQ ID NO: 832404 - protein, 9 aa, Homo Sapiens
LYQKIAKEI

SEQ ID NO: 832405 - protein, 9 aa, Homo Sapiens
LTRHRIIHT

SEQ ID NO: 832406 - protein, 9 aa, Homo Sapiens
CKKEELLDM

SEQ ID NO: 832407 - protein, 9 aa, Homo Sapiens
VPAYFNESQ

SEQ ID NO: 832408 - protein, 9 aa, Homo Sapiens
DTQCVWLDS

SEQ ID NO: 832409 - protein, 9 aa, Homo Sapiens
GKNFSQSQY

SEQ ID NO: 832410 - protein, 9 aa, Homo Sapiens
RLQNYFKKE

SEQ ID NO: 832411 - protein, 9 aa, Homo Sapiens
MQGQTDCIR

SEQ ID NO: 832412 - protein, 9 aa, Homo Sapiens
KFLKTSPVR

SEQ ID NO: 832413 - protein, 9 aa, Homo Sapiens
ITILDKGHA

SEQ ID NO: 832414 - protein, 9 aa, Homo Sapiens
VKDLKTELG

SEQ ID NO: 832415 - protein, 9 aa, Homo Sapiens
RGSPEEKTL

SEQ ID NO: 832416 - protein, 9 aa, Homo Sapiens
RKNNAPKEA

SEQ ID NO: 832417 - protein, 9 aa, Homo Sapiens
STFLTSYSP

SEQ ID NO: 832418 - protein, 9 aa, Homo Sapiens
REFICLDDP

SEQ ID NO: 832419 - protein, 9 aa, Homo Sapiens
PAFGKDTKD

SEQ ID NO: 832420 - protein, 9 aa, Homo Sapiens
HRVKNSPPE

SEQ ID NO: 832421 - protein, 9 aa, Homo Sapiens
HPEEFQLIT

SEQ ID NO: 832422 - protein, 9 aa, Homo Sapiens
NQIITREEF

SEQ ID NO: 832423 - protein, 9 aa, Homo Sapiens
KHEDEREKQ

SEQ ID NO: 832424 - protein, 9 aa, Homo Sapiens
NNCRASWSM

SEQ ID NO: 832425 - protein, 9 aa, Homo Sapiens
VLEAASNGV

SEQ ID NO: 832426 - protein, 9 aa, Homo Sapiens
KEHTLFIDL

SEQ ID NO: 832427 - protein, 9 aa, Homo Sapiens
LLDQKDKEL

SEQ ID NO: 832428 - protein, 9 aa, Homo Sapiens
LFKQRRLIE

SEQ ID NO: 832429 - protein, 9 aa, Homo Sapiens
QQQTQMAVA

SEQ ID NO: 832430 - protein, 9 aa, Homo Sapiens
VLHHCCDLL

SEQ ID NO: 832431 - protein, 9 aa, Homo Sapiens
GGLLAAAYS

SEQ ID NO: 832432 - protein, 9 aa, Homo Sapiens
YFFCGNKYY

SEQ ID NO: 832433 - protein, 9 aa, Homo Sapiens
KETDLEYVK

SEQ ID NO: 832434 - protein, 9 aa, Homo Sapiens
DCGIPLCHL

SEQ ID NO: 832435 - protein, 9 aa, Homo Sapiens
SQKFQQCYW

SEQ ID NO: 832436 - protein, 9 aa, Homo Sapiens
GKRTKLSPV

SEQ ID NO: 832437 - protein, 9 aa, Homo Sapiens
WDKSALGYD

SEQ ID NO: 832438 - protein, 9 aa, Homo Sapiens
VKLFQNDQN

SEQ ID NO: 832439 - protein, 9 aa, Homo Sapiens
YRGNAGVVL

SEQ ID NO: 832440 - protein, 9 aa, Homo Sapiens
SSEGRCKAL

SEQ ID NO: 832441 - protein, 9 aa, Homo Sapiens
SSNPFTRAH

SEQ ID NO: 832442 - protein, 9 aa, Homo Sapiens
YGFSHQSKM

SEQ ID NO: 832443 - protein, 9 aa, Homo Sapiens
SGDCDDMDS

SEQ ID NO: 832444 - protein, 9 aa, Homo Sapiens
DARPLIQTK

SEQ ID NO: 832445 - protein, 9 aa, Homo Sapiens
SKFKSTRNE

SEQ ID NO: 832446 - protein, 9 aa, Homo Sapiens
KNIFIGEKA

SEQ ID NO: 832447 - protein, 9 aa, Homo Sapiens
VKEILTSLV

SEQ ID NO: 832448 - protein, 9 aa, Homo Sapiens
KTEEIVQNF

SEQ ID NO: 832449 - protein, 9 aa, Homo Sapiens
RSEILFGTP

SEQ ID NO: 832450 - protein, 9 aa, Homo Sapiens
AVQDVARVL

SEQ ID NO: 832451 - protein, 9 aa, Homo Sapiens
INNNVCKQC

SEQ ID NO: 832452 - protein, 9 aa, Homo Sapiens
REQARLRLY

SEQ ID NO: 832453 - protein, 9 aa, Homo Sapiens
PNVETTKCV

SEQ ID NO: 832454 - protein, 9 aa, Homo Sapiens
NAAICTTEY

SEQ ID NO: 832455 - protein, 9 aa, Homo Sapiens
IADVVREKL

SEQ ID NO: 832456 - protein, 9 aa, Homo Sapiens
ADYQAVNDE

SEQ ID NO: 832457 - protein, 9 aa, Homo Sapiens
VGGQISERK

SEQ ID NO: 832458 - protein, 9 aa, Homo Sapiens
AKDDVEEAL

SEQ ID NO: 832459 - protein, 9 aa, Homo Sapiens
TDILERAIR

SEQ ID NO: 832460 - protein, 9 aa, Homo Sapiens
SALILLRAG

SEQ ID NO: 832461 - protein, 9 aa, Homo Sapiens
NALGKYVLV

SEQ ID NO: 832462 - protein, 9 aa, Homo Sapiens
LSWIWKMEA

SEQ ID NO: 832463 - protein, 9 aa, Homo Sapiens
ASTCINLLK

SEQ ID NO: 832464 - protein, 9 aa, Homo Sapiens
DDISVGKEG

SEQ ID NO: 832465 - protein, 9 aa, Homo Sapiens
VRGFGWHLL

SEQ ID NO: 832466 - protein, 9 aa, Homo Sapiens
PYECHKCGK

SEQ ID NO: 832467 - protein, 9 aa, Homo Sapiens
YVPKGTSES

SEQ ID NO: 832468 - protein, 9 aa, Homo Sapiens
RPLDTVRAL

SEQ ID NO: 832469 - protein, 9 aa, Homo Sapiens
YVHRELLRR

SEQ ID NO: 832470 - protein, 9 aa, Homo Sapiens
VLKIFFESL

SEQ ID NO: 832471 - protein, 9 aa, Homo Sapiens
STDFISNPY

SEQ ID NO: 832472 - protein, 9 aa, Homo Sapiens
QTFISDIAN

SEQ ID NO: 832473 - protein, 9 aa, Homo Sapiens
TPYFDVGAS

SEQ ID NO: 832474 - protein, 9 aa, Homo Sapiens
KRRCLRIIN

SEQ ID NO: 832475 - protein, 9 aa, Homo Sapiens
RSKIAKYMN

SEQ ID NO: 832476 - protein, 9 aa, Homo Sapiens
KIIRNEDIK

SEQ ID NO: 832477 - protein, 9 aa, Homo Sapiens
RSHPHTQKF

SEQ ID NO: 832478 - protein, 9 aa, Homo Sapiens
VPQHKLFSM

SEQ ID NO: 832479 - protein, 9 aa, Homo Sapiens
APVGGNVTI

SEQ ID NO: 832480 - protein, 9 aa, Homo Sapiens
QVIVYILAV

SEQ ID NO: 832481 - protein, 9 aa, Homo Sapiens
KGLINVTLL

SEQ ID NO: 832482 - protein, 9 aa, Homo Sapiens
LFQQNKDHS

SEQ ID NO: 832483 - protein, 9 aa, Homo Sapiens
SLKKYSNPM

SEQ ID NO: 832484 - protein, 9 aa, Homo Sapiens
FHRKRKQLL

SEQ ID NO: 832485 - protein, 9 aa, Homo Sapiens
CRRILFMKE

SEQ ID NO: 832486 - protein, 9 aa, Homo Sapiens
EFLGFILTG

SEQ ID NO: 832487 - protein, 9 aa, Homo Sapiens
ATSQLLVNY

SEQ ID NO: 832488 - protein, 9 aa, Homo Sapiens
IARFFCELP

SEQ ID NO: 832489 - protein, 9 aa, Homo Sapiens
EAHKICEGL

SEQ ID NO: 832490 - protein, 9 aa, Homo Sapiens
DKSALGYDY

SEQ ID NO: 832491 - protein, 9 aa, Homo Sapiens
QHRDLKIIT

SEQ ID NO: 832492 - protein, 9 aa, Homo Sapiens
KEEIPRQNI

SEQ ID NO: 832493 - protein, 9 aa, Homo Sapiens
IQRLNISIN

SEQ ID NO: 832494 - protein, 9 aa, Homo Sapiens
CGRPCHLIK

SEQ ID NO: 832495 - protein, 9 aa, Homo Sapiens
VRPIISLYF

SEQ ID NO: 832496 - protein, 9 aa, Homo Sapiens
NGQLVRNDY

SEQ ID NO: 832497 - protein, 9 aa, Homo Sapiens
PTDCSIVSL

SEQ ID NO: 832498 - protein, 9 aa, Homo Sapiens
DYYIWNYKA

SEQ ID NO: 832499 - protein, 9 aa, Homo Sapiens
SHVDQRSMP

SEQ ID NO: 832500 - protein, 9 aa, Homo Sapiens
SRTLGKSNR

SEQ ID NO: 832501 - protein, 9 aa, Homo Sapiens
PGEMLKKAA

SEQ ID NO: 832502 - protein, 9 aa, Homo Sapiens
INVDVESTD

SEQ ID NO: 832503 - protein, 9 aa, Homo Sapiens
CAPDDQEFL

SEQ ID NO: 832504 - protein, 9 aa, Homo Sapiens
LDAQKSAVA

SEQ ID NO: 832505 - protein, 9 aa, Homo Sapiens
AARRIKTEL

SEQ ID NO: 832506 - protein, 9 aa, Homo Sapiens
VLKSLLEHY

SEQ ID NO: 832507 - protein, 9 aa, Homo Sapiens
PALGEVSSD

SEQ ID NO: 832508 - protein, 9 aa, Homo Sapiens
QLLANFSCN

SEQ ID NO: 832509 - protein, 9 aa, Homo Sapiens
VSAVKPAIT

SEQ ID NO: 832510 - protein, 9 aa, Homo Sapiens
VLSFSRYSS

SEQ ID NO: 832511 - protein, 9 aa, Homo Sapiens
ATSNAEHLE

SEQ ID NO: 832512 - protein, 9 aa, Homo Sapiens
KDYFGNDYI

SEQ ID NO: 832513 - protein, 9 aa, Homo Sapiens
CHVVRKLGW

SEQ ID NO: 832514 - protein, 9 aa, Homo Sapiens
EAVSFCRER

SEQ ID NO: 832515 - protein, 9 aa, Homo Sapiens
QLGPAERAT

SEQ ID NO: 832516 - protein, 9 aa, Homo Sapiens
LIPASQPPG

SEQ ID NO: 832517 - protein, 9 aa, Homo Sapiens
RTTYFCRDL

SEQ ID NO: 832518 - protein, 9 aa, Homo Sapiens
LSLSVWHRK

SEQ ID NO: 832519 - protein, 9 aa, Homo Sapiens
ERKSSALKA

SEQ ID NO: 832520 - protein, 9 aa, Homo Sapiens
SHSHCFQTH

SEQ ID NO: 832521 - protein, 9 aa, Homo Sapiens
SRGREGAKR

SEQ ID NO: 832522 - protein, 9 aa, Homo Sapiens
AEDAGFVVI

SEQ ID NO: 832523 - protein, 9 aa, Homo Sapiens
KIVKDLMPK

SEQ ID NO: 832524 - protein, 9 aa, Homo Sapiens
KKVETFTSD

SEQ ID NO: 832525 - protein, 9 aa, Homo Sapiens
YTMVILMLN

SEQ ID NO: 832526 - protein, 9 aa, Homo Sapiens
DKGHLNAGY

SEQ ID NO: 832527 - protein, 9 aa, Homo Sapiens
IIILTQNDF

SEQ ID NO: 832528 - protein, 9 aa, Homo Sapiens
GTLGEIWSI

SEQ ID NO: 832529 - protein, 9 aa, Homo Sapiens
AISVRFVQL

SEQ ID NO: 832530 - protein, 9 aa, Homo Sapiens
VLISYLYII

SEQ ID NO: 832531 - protein, 9 aa, Homo Sapiens
RLQTDNLQS

SEQ ID NO: 832532 - protein, 9 aa, Homo Sapiens
LWKKAQILE

SEQ ID NO: 832533 - protein, 9 aa, Homo Sapiens
QKFECANVN

SEQ ID NO: 832534 - protein, 9 aa, Homo Sapiens
RTTDFVVPG

SEQ ID NO: 832535 - protein, 9 aa, Homo Sapiens
ISVNDSDYP

SEQ ID NO: 832536 - protein, 9 aa, Homo Sapiens
RVPLGITMV

SEQ ID NO: 832537 - protein, 9 aa, Homo Sapiens
VVYDLSQKP

SEQ ID NO: 832538 - protein, 9 aa, Homo Sapiens
RVDLVQAAL

SEQ ID NO: 832539 - protein, 9 aa, Homo Sapiens
HCSIIHPVL

SEQ ID NO: 832540 - protein, 9 aa, Homo Sapiens
FDHAHRQLG

SEQ ID NO: 832541 - protein, 9 aa, Homo Sapiens
RCQVSTFEQ

SEQ ID NO: 832542 - protein, 9 aa, Homo Sapiens
ERLIIWAVM

SEQ ID NO: 832543 - protein, 9 aa, Homo Sapiens
LYCSELHGP

SEQ ID NO: 832544 - protein, 9 aa, Homo Sapiens
WLLTHRTLD

SEQ ID NO: 832545 - protein, 9 aa, Homo Sapiens
TSTDKEITS

SEQ ID NO: 832546 - protein, 9 aa, Homo Sapiens
INAITGEIW

SEQ ID NO: 832547 - protein, 9 aa, Homo Sapiens
TLCLSMLED

SEQ ID NO: 832548 - protein, 9 aa, Homo Sapiens
ELVHLLCCC

SEQ ID NO: 832549 - protein, 9 aa, Homo Sapiens
SLEEEEGLV

SEQ ID NO: 832550 - protein, 9 aa, Homo Sapiens
EGIDSDNLK

SEQ ID NO: 832551 - protein, 9 aa, Homo Sapiens
KLEKECQYS

SEQ ID NO: 832552 - protein, 9 aa, Homo Sapiens
LLKKYQAVL

SEQ ID NO: 832553 - protein, 9 aa, Homo Sapiens
QLLEHPSRT

SEQ ID NO: 832554 - protein, 9 aa, Homo Sapiens
LISFITSEA

SEQ ID NO: 832555 - protein, 9 aa, Homo Sapiens
REENMDNFC

SEQ ID NO: 832556 - protein, 9 aa, Homo Sapiens
TACKKFNSP

SEQ ID NO: 832557 - protein, 9 aa, Homo Sapiens
LLYIARQRN

SEQ ID NO: 832558 - protein, 9 aa, Homo Sapiens
LYRCSIGGG

SEQ ID NO: 832559 - protein, 9 aa, Homo Sapiens
IIMLLNIAY

SEQ ID NO: 832560 - protein, 9 aa, Homo Sapiens
SSLGGRTVE

SEQ ID NO: 832561 - protein, 9 aa, Homo Sapiens
KMAGQLFSN

SEQ ID NO: 832562 - protein, 9 aa, Homo Sapiens
DCKDIEHLE

SEQ ID NO: 832563 - protein, 9 aa, Homo Sapiens
PGQEYHVRI

SEQ ID NO: 832564 - protein, 9 aa, Homo Sapiens
AQVVKLTEE

SEQ ID NO: 832565 - protein, 9 aa, Homo Sapiens
NDSKLASAD

SEQ ID NO: 832566 - protein, 9 aa, Homo Sapiens
QEERIMEIS

SEQ ID NO: 832567 - protein, 9 aa, Homo Sapiens
LPLIDSFQR

SEQ ID NO: 832568 - protein, 9 aa, Homo Sapiens
YRPPLSRVV

SEQ ID NO: 832569 - protein, 9 aa, Homo Sapiens
NNYLSKEGD

SEQ ID NO: 832570 - protein, 9 aa, Homo Sapiens
GTKYLGNEK

SEQ ID NO: 832571 - protein, 9 aa, Homo Sapiens
GRFLGDKSL

SEQ ID NO: 832572 - protein, 9 aa, Homo Sapiens
GCIKRPDVC

SEQ ID NO: 832573 - protein, 9 aa, Homo Sapiens
PEGQKTMYL

SEQ ID NO: 832574 - protein, 9 aa, Homo Sapiens
DRIILQPDD

SEQ ID NO: 832575 - protein, 9 aa, Homo Sapiens
TTDIIITEH

SEQ ID NO: 832576 - protein, 9 aa, Homo Sapiens
VVDAIGLAT

SEQ ID NO: 832577 - protein, 9 aa, Homo Sapiens
QEVLFKMTG

SEQ ID NO: 832578 - protein, 9 aa, Homo Sapiens
IRVAKTGSL

SEQ ID NO: 832579 - protein, 9 aa, Homo Sapiens
VFMILLGSG

SEQ ID NO: 832580 - protein, 9 aa, Homo Sapiens
RGQRSSPLH

SEQ ID NO: 832581 - protein, 9 aa, Homo Sapiens
FEFVSALCQ

SEQ ID NO: 832582 - protein, 9 aa, Homo Sapiens
VALRWLEDG

SEQ ID NO: 832583 - protein, 9 aa, Homo Sapiens
CAYRVRIGC

SEQ ID NO: 832584 - protein, 9 aa, Homo Sapiens
FWQDQEHLV

SEQ ID NO: 832585 - protein, 9 aa, Homo Sapiens
EWLFTKTEE

SEQ ID NO: 832586 - protein, 9 aa, Homo Sapiens
RCIPMQVPS

SEQ ID NO: 832587 - protein, 9 aa, Homo Sapiens
VQAGAWGFP

SEQ ID NO: 832588 - protein, 9 aa, Homo Sapiens
ELHWRLMAL

SEQ ID NO: 832589 - protein, 9 aa, Homo Sapiens
LLIFSHLHK

SEQ ID NO: 832590 - protein, 9 aa, Homo Sapiens
KVSNRKIQE

SEQ ID NO: 832591 - protein, 9 aa, Homo Sapiens
ERLGMCFGD

SEQ ID NO: 832592 - protein, 9 aa, Homo Sapiens
GSLIIVIVS

SEQ ID NO: 832593 - protein, 9 aa, Homo Sapiens
AAKLLSPRQ

SEQ ID NO: 832594 - protein, 9 aa, Homo Sapiens
VMNVMWMIT

SEQ ID NO: 832595 - protein, 9 aa, Homo Sapiens
KNRYYVSNK

SEQ ID NO: 832596 - protein, 9 aa, Homo Sapiens
VKEIRDQIQ

SEQ ID NO: 832597 - protein, 9 aa, Homo Sapiens
ANIMKTLTY

SEQ ID NO: 832598 - protein, 9 aa, Homo Sapiens
LSLPKYQAG

SEQ ID NO: 832599 - protein, 9 aa, Homo Sapiens
SLNKEFLNL

SEQ ID NO: 832600 - protein, 9 aa, Homo Sapiens
LKHYAEYQV

SEQ ID NO: 832601 - protein, 9 aa, Homo Sapiens
SVSTTDRDS

SEQ ID NO: 832602 - protein, 9 aa, Homo Sapiens
KMDNLLRGD

SEQ ID NO: 832603 - protein, 9 aa, Homo Sapiens
NYKQVNKAI

SEQ ID NO: 832604 - protein, 9 aa, Homo Sapiens
FPPRIRKTQ

SEQ ID NO: 832605 - protein, 9 aa, Homo Sapiens
QIHWDLSTE

SEQ ID NO: 832606 - protein, 9 aa, Homo Sapiens
NKDSGIVTN

SEQ ID NO: 832607 - protein, 9 aa, Homo Sapiens
QFEEGQDKQ

SEQ ID NO: 832608 - protein, 9 aa, Homo Sapiens
EPIQIVITM

SEQ ID NO: 832609 - protein, 9 aa, Homo Sapiens
RTRLPQYYI

SEQ ID NO: 832610 - protein, 9 aa, Homo Sapiens
RGPRSSLAA

SEQ ID NO: 832611 - protein, 9 aa, Homo Sapiens
VGEHKEAFM

SEQ ID NO: 832612 - protein, 9 aa, Homo Sapiens
MVKLQKLQA

SEQ ID NO: 832613 - protein, 9 aa, Homo Sapiens
TSSFSCYHD

SEQ ID NO: 832614 - protein, 9 aa, Homo Sapiens
KLEKRRARE

SEQ ID NO: 832615 - protein, 9 aa, Homo Sapiens
NTLQVSIDT

SEQ ID NO: 832616 - protein, 9 aa, Homo Sapiens
PQLLEAWNN

SEQ ID NO: 832617 - protein, 9 aa, Homo Sapiens
SFNSKLACE

SEQ ID NO: 832618 - protein, 9 aa, Homo Sapiens
CAILVFQFF

SEQ ID NO: 832619 - protein, 9 aa, Homo Sapiens
CPITECFEL

SEQ ID NO: 832620 - protein, 9 aa, Homo Sapiens
PNKRKRHFQ

SEQ ID NO: 832621 - protein, 9 aa, Homo Sapiens
NIRQCISGD

SEQ ID NO: 832622 - protein, 9 aa, Homo Sapiens
YEVARALNL

SEQ ID NO: 832623 - protein, 9 aa, Homo Sapiens
HYTNGAPLV

SEQ ID NO: 832624 - protein, 9 aa, Homo Sapiens
EIPSTSNVS

SEQ ID NO: 832625 - protein, 9 aa, Homo Sapiens
KKYVIDQIQ

SEQ ID NO: 832626 - protein, 9 aa, Homo Sapiens
YVRSKIAKY

SEQ ID NO: 832627 - protein, 9 aa, Homo Sapiens
YTAEVVGPP

SEQ ID NO: 832628 - protein, 9 aa, Homo Sapiens
ANIPAHTRH

SEQ ID NO: 832629 - protein, 9 aa, Homo Sapiens
LCGGSIIGS

SEQ ID NO: 832630 - protein, 9 aa, Homo Sapiens
LLILLALCT

SEQ ID NO: 832631 - protein, 9 aa, Homo Sapiens
FGDIVLEHP

SEQ ID NO: 832632 - protein, 9 aa, Homo Sapiens
TILFYDRVC

SEQ ID NO: 832633 - protein, 9 aa, Homo Sapiens
QTAEPLVPE

SEQ ID NO: 832634 - protein, 9 aa, Homo Sapiens
VLSVPLNTA

SEQ ID NO: 832635 - protein, 9 aa, Homo Sapiens
IPPDTLPLR

SEQ ID NO: 832636 - protein, 9 aa, Homo Sapiens
MYLTDARKL

SEQ ID NO: 832637 - protein, 9 aa, Homo Sapiens
LNEKYGEAL

SEQ ID NO: 832638 - protein, 9 aa, Homo Sapiens
KLRREVEDL

SEQ ID NO: 832639 - protein, 9 aa, Homo Sapiens
SMFEPSGPF

SEQ ID NO: 832640 - protein, 9 aa, Homo Sapiens
SSSSSNSDV

SEQ ID NO: 832641 - protein, 9 aa, Homo Sapiens
YDIRSISFP

SEQ ID NO: 832642 - protein, 9 aa, Homo Sapiens
RSFGDDRHL

SEQ ID NO: 832643 - protein, 9 aa, Homo Sapiens
GMKKTSFKR

SEQ ID NO: 832644 - protein, 9 aa, Homo Sapiens
QSHSEKKAR

SEQ ID NO: 832645 - protein, 9 aa, Homo Sapiens
GLTSLCKLW

SEQ ID NO: 832646 - protein, 9 aa, Homo Sapiens
TTSDTAGKN

SEQ ID NO: 832647 - protein, 9 aa, Homo Sapiens
CHVFCCEAP

SEQ ID NO: 832648 - protein, 9 aa, Homo Sapiens
QSHRRQSCS

SEQ ID NO: 832649 - protein, 9 aa, Homo Sapiens
EVIKDTKEK

SEQ ID NO: 832650 - protein, 9 aa, Homo Sapiens
PAQDDRVLL

SEQ ID NO: 832651 - protein, 9 aa, Homo Sapiens
GNIGSYATY

SEQ ID NO: 832652 - protein, 9 aa, Homo Sapiens
PDYDVFQYL

SEQ ID NO: 832653 - protein, 9 aa, Homo Sapiens
SLKCMIYEL

SEQ ID NO: 832654 - protein, 9 aa, Homo Sapiens
NSPQLSTCG

SEQ ID NO: 832655 - protein, 9 aa, Homo Sapiens
AHKGEIEDL

SEQ ID NO: 832656 - protein, 9 aa, Homo Sapiens
TENLEAAKK

SEQ ID NO: 832657 - protein, 9 aa, Homo Sapiens
QLEKTAAKL

SEQ ID NO: 832658 - protein, 9 aa, Homo Sapiens
RCYLFSHCS

SEQ ID NO: 832659 - protein, 9 aa, Homo Sapiens
VVADLITTL

SEQ ID NO: 832660 - protein, 9 aa, Homo Sapiens
FETVHQIHT

SEQ ID NO: 832661 - protein, 9 aa, Homo Sapiens
QNSALPATK

SEQ ID NO: 832662 - protein, 9 aa, Homo Sapiens
AEVAKHYLS

SEQ ID NO: 832663 - protein, 9 aa, Homo Sapiens
SMTEDYAGI

SEQ ID NO: 832664 - protein, 9 aa, Homo Sapiens
RTIEKIIDK

SEQ ID NO: 832665 - protein, 9 aa, Homo Sapiens
HEQLHTAIK

SEQ ID NO: 832666 - protein, 9 aa, Homo Sapiens
SREHGSGVT

SEQ ID NO: 832667 - protein, 9 aa, Homo Sapiens
NSFLNLNNA

SEQ ID NO: 832668 - protein, 9 aa, Homo Sapiens
LPRLQQLPK

SEQ ID NO: 832669 - protein, 9 aa, Homo Sapiens
GFDQGINGE

SEQ ID NO: 832670 - protein, 9 aa, Homo Sapiens
VLCCQKQCA

SEQ ID NO: 832671 - protein, 9 aa, Homo Sapiens
NVNLNTGMQ

SEQ ID NO: 832672 - protein, 9 aa, Homo Sapiens
SELNKQKIA

SEQ ID NO: 832673 - protein, 9 aa, Homo Sapiens
NCQKTSIVW

SEQ ID NO: 832674 - protein, 9 aa, Homo Sapiens
LFDGLLTLR

SEQ ID NO: 832675 - protein, 9 aa, Homo Sapiens
KYRVVDLNL

SEQ ID NO: 832676 - protein, 9 aa, Homo Sapiens
NTPQIFPAM

SEQ ID NO: 832677 - protein, 9 aa, Homo Sapiens
LYTDMRLTK

SEQ ID NO: 832678 - protein, 9 aa, Homo Sapiens
KKHSGSDYS

SEQ ID NO: 832679 - protein, 9 aa, Homo Sapiens
ADDLSNPVG

SEQ ID NO: 832680 - protein, 9 aa, Homo Sapiens
KSADHQTLD

SEQ ID NO: 832681 - protein, 9 aa, Homo Sapiens
GFWDNYDTI

SEQ ID NO: 832682 - protein, 9 aa, Homo Sapiens
QRIEDSVLS

SEQ ID NO: 832683 - protein, 9 aa, Homo Sapiens
SKHFESKFK

SEQ ID NO: 832684 - protein, 9 aa, Homo Sapiens
CSKHSHRLY

SEQ ID NO: 832685 - protein, 9 aa, Homo Sapiens
AEYQNSLLK

SEQ ID NO: 832686 - protein, 9 aa, Homo Sapiens
EVTKERYQL

SEQ ID NO: 832687 - protein, 9 aa, Homo Sapiens
QVENLRLDL

SEQ ID NO: 832688 - protein, 9 aa, Homo Sapiens
HQDLKPRNI

SEQ ID NO: 832689 - protein, 9 aa, Homo Sapiens
KPFKTIILL

SEQ ID NO: 832690 - protein, 9 aa, Homo Sapiens
VLDNHHLSA

SEQ ID NO: 832691 - protein, 9 aa, Homo Sapiens
NDDRIQGVL

SEQ ID NO: 832692 - protein, 9 aa, Homo Sapiens
DKAAEEQGY

SEQ ID NO: 832693 - protein, 9 aa, Homo Sapiens
IQVPVRRRL

SEQ ID NO: 832694 - protein, 9 aa, Homo Sapiens
GNATDSPKS

SEQ ID NO: 832695 - protein, 9 aa, Homo Sapiens
LPLRLQMRL

SEQ ID NO: 832696 - protein, 9 aa, Homo Sapiens
PGLQTHCYR

SEQ ID NO: 832697 - protein, 9 aa, Homo Sapiens
YVHRKFRLM

SEQ ID NO: 832698 - protein, 9 aa, Homo Sapiens
ELGFTNYIQ

SEQ ID NO: 832699 - protein, 9 aa, Homo Sapiens
PGGTLSLTL

SEQ ID NO: 832700 - protein, 9 aa, Homo Sapiens
LNILDSKIL

SEQ ID NO: 832701 - protein, 9 aa, Homo Sapiens
EKNWNRDKV

SEQ ID NO: 832702 - protein, 9 aa, Homo Sapiens
TAEELDNED

SEQ ID NO: 832703 - protein, 9 aa, Homo Sapiens
RLTHKDDSV

SEQ ID NO: 832704 - protein, 9 aa, Homo Sapiens
FHSSNVIGG

SEQ ID NO: 832705 - protein, 9 aa, Homo Sapiens
SSSSPIINI

SEQ ID NO: 832706 - protein, 9 aa, Homo Sapiens
ELQINISLQ

SEQ ID NO: 832707 - protein, 9 aa, Homo Sapiens
CYIHEVQEL

SEQ ID NO: 832708 - protein, 9 aa, Homo Sapiens
KDKENIFQE

SEQ ID NO: 832709 - protein, 9 aa, Homo Sapiens
GKGVDIYSK

SEQ ID NO: 832710 - protein, 9 aa, Homo Sapiens
LEAQVQTIQ

SEQ ID NO: 832711 - protein, 9 aa, Homo Sapiens
MTRPASRHT

SEQ ID NO: 832712 - protein, 9 aa, Homo Sapiens
FLVGTQSLT

SEQ ID NO: 832713 - protein, 9 aa, Homo Sapiens
NRIKRVQLI

SEQ ID NO: 832714 - protein, 9 aa, Homo Sapiens
ASWEEREIM

SEQ ID NO: 832715 - protein, 9 aa, Homo Sapiens
HARIQAAAP

SEQ ID NO: 832716 - protein, 9 aa, Homo Sapiens
IQPIDRQAF

SEQ ID NO: 832717 - protein, 9 aa, Homo Sapiens
SDLEDDSEF

SEQ ID NO: 832718 - protein, 9 aa, Homo Sapiens
DDPLFLDLL

SEQ ID NO: 832719 - protein, 9 aa, Homo Sapiens
YKDYDMPHV

SEQ ID NO: 832720 - protein, 9 aa, Homo Sapiens
ATPIKDGPK

SEQ ID NO: 832721 - protein, 9 aa, Homo Sapiens
QTFSNYESM

SEQ ID NO: 832722 - protein, 9 aa, Homo Sapiens
VQHPLGMRL

SEQ ID NO: 832723 - protein, 9 aa, Homo Sapiens
NKKDGRFTA

SEQ ID NO: 832724 - protein, 9 aa, Homo Sapiens
EIYGFFILF

SEQ ID NO: 832725 - protein, 9 aa, Homo Sapiens
DVGGYYYDK

SEQ ID NO: 832726 - protein, 9 aa, Homo Sapiens
ENESSPKEC

SEQ ID NO: 832727 - protein, 9 aa, Homo Sapiens
GASKIIMLL

SEQ ID NO: 832728 - protein, 9 aa, Homo Sapiens
WTMSDVVEK

SEQ ID NO: 832729 - protein, 9 aa, Homo Sapiens
NDDYSFTTF

SEQ ID NO: 832730 - protein, 9 aa, Homo Sapiens
EQEQVRVNY

SEQ ID NO: 832731 - protein, 9 aa, Homo Sapiens
EACQQNNPA

SEQ ID NO: 832732 - protein, 9 aa, Homo Sapiens
PCCVSQYLE

SEQ ID NO: 832733 - protein, 9 aa, Homo Sapiens
AIQDLKRTG

SEQ ID NO: 832734 - protein, 9 aa, Homo Sapiens
PSTLCSGSR

SEQ ID NO: 832735 - protein, 9 aa, Homo Sapiens
CDIVPLIQL

SEQ ID NO: 832736 - protein, 9 aa, Homo Sapiens
YHNRQGIFV

SEQ ID NO: 832737 - protein, 9 aa, Homo Sapiens
NLRFLATTS

SEQ ID NO: 832738 - protein, 9 aa, Homo Sapiens
YSCPSCGQT

SEQ ID NO: 832739 - protein, 9 aa, Homo Sapiens
SAPEKLDQI

SEQ ID NO: 832740 - protein, 9 aa, Homo Sapiens
KRTEAPEFP

SEQ ID NO: 832741 - protein, 9 aa, Homo Sapiens
VQFNSVQEM

SEQ ID NO: 832742 - protein, 9 aa, Homo Sapiens
RLNKKQQHK

SEQ ID NO: 832743 - protein, 9 aa, Homo Sapiens
ISYRSGITQ

SEQ ID NO: 832744 - protein, 9 aa, Homo Sapiens
VASCFPACS

SEQ ID NO: 832745 - protein, 9 aa, Homo Sapiens
VMGLFTKWS

SEQ ID NO: 832746 - protein, 9 aa, Homo Sapiens
SCKRIEEVM

SEQ ID NO: 832747 - protein, 9 aa, Homo Sapiens
DVHAERVQA

SEQ ID NO: 832748 - protein, 9 aa, Homo Sapiens
ISDEVTCVI

SEQ ID NO: 832749 - protein, 9 aa, Homo Sapiens
YQQKFIKEP

SEQ ID NO: 832750 - protein, 9 aa, Homo Sapiens
VEKDKWDKS

SEQ ID NO: 832751 - protein, 9 aa, Homo Sapiens
QDGLDSEHV

SEQ ID NO: 832752 - protein, 9 aa, Homo Sapiens
FDGGNFDFT

SEQ ID NO: 832753 - protein, 9 aa, Homo Sapiens
GSSQWDGPE

SEQ ID NO: 832754 - protein, 9 aa, Homo Sapiens
YPGVAQSLN

SEQ ID NO: 832755 - protein, 9 aa, Homo Sapiens
LDGLLVFNK

SEQ ID NO: 832756 - protein, 9 aa, Homo Sapiens
EALKTTRIR

SEQ ID NO: 832757 - protein, 9 aa, Homo Sapiens
RQKINLGDR

SEQ ID NO: 832758 - protein, 9 aa, Homo Sapiens
SEFGWINVF

SEQ ID NO: 832759 - protein, 9 aa, Homo Sapiens
ISLPPGDIY

SEQ ID NO: 832760 - protein, 9 aa, Homo Sapiens
EDYKKRYED

SEQ ID NO: 832761 - protein, 9 aa, Homo Sapiens
VNVNMKTNN

SEQ ID NO: 832762 - protein, 9 aa, Homo Sapiens
FYHTGLYSK

SEQ ID NO: 832763 - protein, 9 aa, Homo Sapiens
LGNKCPARV

SEQ ID NO: 832764 - protein, 9 aa, Homo Sapiens
FQVQVKRYD

SEQ ID NO: 832765 - protein, 9 aa, Homo Sapiens
YSRILFTVA

SEQ ID NO: 832766 - protein, 9 aa, Homo Sapiens
MIYNHAFFF

SEQ ID NO: 832767 - protein, 9 aa, Homo Sapiens
RGRCHVASL

SEQ ID NO: 832768 - protein, 9 aa, Homo Sapiens
QKRRIYDMT

SEQ ID NO: 832769 - protein, 9 aa, Homo Sapiens
GYYYDKIER

SEQ ID NO: 832770 - protein, 9 aa, Homo Sapiens
GKTFENFYI

SEQ ID NO: 832771 - protein, 9 aa, Homo Sapiens
KNNTFNALP

SEQ ID NO: 832772 - protein, 9 aa, Homo Sapiens
LYSGNKQRL

SEQ ID NO: 832773 - protein, 9 aa, Homo Sapiens
LTLTYGSLD

SEQ ID NO: 832774 - protein, 9 aa, Homo Sapiens
SAANYTNGN

SEQ ID NO: 832775 - protein, 9 aa, Homo Sapiens
LSEHQIIHT

SEQ ID NO: 832776 - protein, 9 aa, Homo Sapiens
VFKLENFQG

SEQ ID NO: 832777 - protein, 9 aa, Homo Sapiens
SHSQAPDKV

SEQ ID NO: 832778 - protein, 9 aa, Homo Sapiens
LTREKEHEM

SEQ ID NO: 832779 - protein, 9 aa, Homo Sapiens
PESLPVLRN

SEQ ID NO: 832780 - protein, 9 aa, Homo Sapiens
PQSGVVSAQ

SEQ ID NO: 832781 - protein, 9 aa, Homo Sapiens
DFQPSPDII

SEQ ID NO: 832782 - protein, 9 aa, Homo Sapiens
SLAFISLAF

SEQ ID NO: 832783 - protein, 9 aa, Homo Sapiens
KHRKKRSSS

SEQ ID NO: 832784 - protein, 9 aa, Homo Sapiens
MKAAMQGQT

SEQ ID NO: 832785 - protein, 9 aa, Homo Sapiens
PVQLLLDFM

SEQ ID NO: 832786 - protein, 9 aa, Homo Sapiens
NESDIKDED

SEQ ID NO: 832787 - protein, 9 aa, Homo Sapiens
VTGSNPNKA

SEQ ID NO: 832788 - protein, 9 aa, Homo Sapiens
PSSSNAAVP

SEQ ID NO: 832789 - protein, 9 aa, Homo Sapiens
LGYNSLEII

SEQ ID NO: 832790 - protein, 9 aa, Homo Sapiens
SFLMNKHQV

SEQ ID NO: 832791 - protein, 9 aa, Homo Sapiens
NDIESPDRE

SEQ ID NO: 832792 - protein, 9 aa, Homo Sapiens
LHNGTKAFF

SEQ ID NO: 832793 - protein, 9 aa, Homo Sapiens
YLGKVTVVA

SEQ ID NO: 832794 - protein, 9 aa, Homo Sapiens
GPGVSCCIK

SEQ ID NO: 832795 - protein, 9 aa, Homo Sapiens
TSNLAAHIT

SEQ ID NO: 832796 - protein, 9 aa, Homo Sapiens
NVIKAYSLV

SEQ ID NO: 832797 - protein, 9 aa, Homo Sapiens
YRPHVYVGM

SEQ ID NO: 832798 - protein, 9 aa, Homo Sapiens
FMAIRNPQE

SEQ ID NO: 832799 - protein, 9 aa, Homo Sapiens
IKCINRQEK

SEQ ID NO: 832800 - protein, 9 aa, Homo Sapiens
SNPKREPAQ

SEQ ID NO: 832801 - protein, 9 aa, Homo Sapiens
VDWIMEAVR

SEQ ID NO: 832802 - protein, 9 aa, Homo Sapiens
HILLHLFKT

SEQ ID NO: 832803 - protein, 9 aa, Homo Sapiens
LCIVLGYLG

SEQ ID NO: 832804 - protein, 9 aa, Homo Sapiens
ELRYEESSK

SEQ ID NO: 832805 - protein, 9 aa, Homo Sapiens
EMLEAGPEA

SEQ ID NO: 832806 - protein, 9 aa, Homo Sapiens
EEDLVSAIR

SEQ ID NO: 832807 - protein, 9 aa, Homo Sapiens
YKDLTYLGH

SEQ ID NO: 832808 - protein, 9 aa, Homo Sapiens
EEAEKSHRD

SEQ ID NO: 832809 - protein, 9 aa, Homo Sapiens
KREVSSWTA

SEQ ID NO: 832810 - protein, 9 aa, Homo Sapiens
QYSVALSTP

SEQ ID NO: 832811 - protein, 9 aa, Homo Sapiens
LYILKLYDK

SEQ ID NO: 832812 - protein, 9 aa, Homo Sapiens
REASKIMKS

SEQ ID NO: 832813 - protein, 9 aa, Homo Sapiens
DDNDDREES

SEQ ID NO: 832814 - protein, 9 aa, Homo Sapiens
KYGWKKEAI

SEQ ID NO: 832815 - protein, 9 aa, Homo Sapiens
RKPTTTKQT

SEQ ID NO: 832816 - protein, 9 aa, Homo Sapiens
SSNAAVPEA

SEQ ID NO: 832817 - protein, 9 aa, Homo Sapiens
QIISLNKEF

SEQ ID NO: 832818 - protein, 9 aa, Homo Sapiens
GEMVLLVLM

SEQ ID NO: 832819 - protein, 9 aa, Homo Sapiens
TENIFSSTG

SEQ ID NO: 832820 - protein, 9 aa, Homo Sapiens
LSGYQQQDC

SEQ ID NO: 832821 - protein, 9 aa, Homo Sapiens
VRAKKPLFS

SEQ ID NO: 832822 - protein, 9 aa, Homo Sapiens
VVVSIVALV

SEQ ID NO: 832823 - protein, 9 aa, Homo Sapiens
YDKTKDNVE

SEQ ID NO: 832824 - protein, 9 aa, Homo Sapiens
NLKSVKKDD

SEQ ID NO: 832825 - protein, 9 aa, Homo Sapiens
TLTLRLPSY

SEQ ID NO: 832826 - protein, 9 aa, Homo Sapiens
PLVLGAMVH

SEQ ID NO: 832827 - protein, 9 aa, Homo Sapiens
RHSWRSWQS

SEQ ID NO: 832828 - protein, 9 aa, Homo Sapiens
RLTCAPPPP

SEQ ID NO: 832829 - protein, 9 aa, Homo Sapiens
RSNKRSSCE

SEQ ID NO: 832830 - protein, 9 aa, Homo Sapiens
VFNKIVEVT

SEQ ID NO: 832831 - protein, 9 aa, Homo Sapiens
GLWAWGVEV

SEQ ID NO: 832832 - protein, 9 aa, Homo Sapiens
WLYGLLPWT

SEQ ID NO: 832833 - protein, 9 aa, Homo Sapiens
SKKHSGSDY

SEQ ID NO: 832834 - protein, 9 aa, Homo Sapiens
CGQKVDKPE

SEQ ID NO: 832835 - protein, 9 aa, Homo Sapiens
TQCYLETLS

SEQ ID NO: 832836 - protein, 9 aa, Homo Sapiens
IDINNVDGK

SEQ ID NO: 832837 - protein, 9 aa, Homo Sapiens
VHFYAKCRA

SEQ ID NO: 832838 - protein, 9 aa, Homo Sapiens
ERAIRAAVE

SEQ ID NO: 832839 - protein, 9 aa, Homo Sapiens
IMFIFCSFI

SEQ ID NO: 832840 - protein, 9 aa, Homo Sapiens
FVENDIPFE

SEQ ID NO: 832841 - protein, 9 aa, Homo Sapiens
SKVSDLTQT

SEQ ID NO: 832842 - protein, 9 aa, Homo Sapiens
RIWKEPPVY

SEQ ID NO: 832843 - protein, 9 aa, Homo Sapiens
PGNQESDQS

SEQ ID NO: 832844 - protein, 9 aa, Homo Sapiens
KQKIAFEDS

SEQ ID NO: 832845 - protein, 9 aa, Homo Sapiens
QYDSSEPAD

SEQ ID NO: 832846 - protein, 9 aa, Homo Sapiens
GDDDEDSNP

SEQ ID NO: 832847 - protein, 9 aa, Homo Sapiens
GSQGKALQK

SEQ ID NO: 832848 - protein, 9 aa, Homo Sapiens
ANVKELTKE

SEQ ID NO: 832849 - protein, 9 aa, Homo Sapiens
IQDRVLYIL

SEQ ID NO: 832850 - protein, 9 aa, Homo Sapiens
LGLRERVKT

SEQ ID NO: 832851 - protein, 9 aa, Homo Sapiens
PTPSVFEDN

SEQ ID NO: 832852 - protein, 9 aa, Homo Sapiens
QFSWNVWPS

SEQ ID NO: 832853 - protein, 9 aa, Homo Sapiens
GAGLGFKQA

SEQ ID NO: 832854 - protein, 9 aa, Homo Sapiens
FDEGTIDFI

SEQ ID NO: 832855 - protein, 9 aa, Homo Sapiens
LISSNRSNH

SEQ ID NO: 832856 - protein, 9 aa, Homo Sapiens
ALPFFNISA

SEQ ID NO: 832857 - protein, 9 aa, Homo Sapiens
ELHPNTDPF

SEQ ID NO: 832858 - protein, 9 aa, Homo Sapiens
TYMAKQFAV

SEQ ID NO: 832859 - protein, 9 aa, Homo Sapiens
LHLAAGGSH

SEQ ID NO: 832860 - protein, 9 aa, Homo Sapiens
FTNLFQYET

SEQ ID NO: 832861 - protein, 9 aa, Homo Sapiens
FFILFRGFF

SEQ ID NO: 832862 - protein, 9 aa, Homo Sapiens
LDNHHLSAA

SEQ ID NO: 832863 - protein, 9 aa, Homo Sapiens
IKELFPDIT

SEQ ID NO: 832864 - protein, 9 aa, Homo Sapiens
KRKIIHTGE

SEQ ID NO: 832865 - protein, 9 aa, Homo Sapiens
VHILMVDIY

SEQ ID NO: 832866 - protein, 9 aa, Homo Sapiens
LAEINEITF

SEQ ID NO: 832867 - protein, 9 aa, Homo Sapiens
EYTVADVIS

SEQ ID NO: 832868 - protein, 9 aa, Homo Sapiens
KTMIYFVGC

SEQ ID NO: 832869 - protein, 9 aa, Homo Sapiens
LDLHSVVRL

SEQ ID NO: 832870 - protein, 9 aa, Homo Sapiens
NYLLACEFL

SEQ ID NO: 832871 - protein, 9 aa, Homo Sapiens
TPKQIDTPS

SEQ ID NO: 832872 - protein, 9 aa, Homo Sapiens
DGGNFDFTE

SEQ ID NO: 832873 - protein, 9 aa, Homo Sapiens
AATDGTSEL

SEQ ID NO: 832874 - protein, 9 aa, Homo Sapiens
TPPVKKKPT

SEQ ID NO: 832875 - protein, 9 aa, Homo Sapiens
ETPQMLFHS

SEQ ID NO: 832876 - protein, 9 aa, Homo Sapiens
NKLFIKRTR

SEQ ID NO: 832877 - protein, 9 aa, Homo Sapiens
ESGGSEIKE

SEQ ID NO: 832878 - protein, 9 aa, Homo Sapiens
HQNLANTNQ

SEQ ID NO: 832879 - protein, 9 aa, Homo Sapiens
VVDLLAATS

SEQ ID NO: 832880 - protein, 9 aa, Homo Sapiens
LETTFPKTT

SEQ ID NO: 832881 - protein, 9 aa, Homo Sapiens
VSYKPQKSS

SEQ ID NO: 832882 - protein, 9 aa, Homo Sapiens
TYLGHNENQ

SEQ ID NO: 832883 - protein, 9 aa, Homo Sapiens
MFQNLAHEE

SEQ ID NO: 832884 - protein, 9 aa, Homo Sapiens
SLAMQWPFC

SEQ ID NO: 832885 - protein, 9 aa, Homo Sapiens
DIKTLHGSV

SEQ ID NO: 832886 - protein, 9 aa, Homo Sapiens
GGNFDFTEL

SEQ ID NO: 832887 - protein, 9 aa, Homo Sapiens
PTHSADVLH

SEQ ID NO: 832888 - protein, 9 aa, Homo Sapiens
MEHTDITMK

SEQ ID NO: 832889 - protein, 9 aa, Homo Sapiens
EKIIKESIN

SEQ ID NO: 832890 - protein, 9 aa, Homo Sapiens
IHAMNFSNE

SEQ ID NO: 832891 - protein, 9 aa, Homo Sapiens
ISTNPRLAK

SEQ ID NO: 832892 - protein, 9 aa, Homo Sapiens
FFRDPLDWS

SEQ ID NO: 832893 - protein, 9 aa, Homo Sapiens
GTIKQSSPP

SEQ ID NO: 832894 - protein, 9 aa, Homo Sapiens
LAIHTENKS

SEQ ID NO: 832895 - protein, 9 aa, Homo Sapiens
DVLFRSVIS

SEQ ID NO: 832896 - protein, 9 aa, Homo Sapiens
YDIQFYMYE

SEQ ID NO: 832897 - protein, 9 aa, Homo Sapiens
LSWALRIKS

SEQ ID NO: 832898 - protein, 9 aa, Homo Sapiens
VILLIETSI

SEQ ID NO: 832899 - protein, 9 aa, Homo Sapiens
FSDLNPLVI

SEQ ID NO: 832900 - protein, 9 aa, Homo Sapiens
EDADISDDE

SEQ ID NO: 832901 - protein, 9 aa, Homo Sapiens
LIFRHLSMR

SEQ ID NO: 832902 - protein, 9 aa, Homo Sapiens
QERPRQQKE

SEQ ID NO: 832903 - protein, 9 aa, Homo Sapiens
VKILAHFYN

SEQ ID NO: 832904 - protein, 9 aa, Homo Sapiens
LQAHTPTLA

SEQ ID NO: 832905 - protein, 9 aa, Homo Sapiens
PEDLKANVE

SEQ ID NO: 832906 - protein, 9 aa, Homo Sapiens
ERRYKCAAC

SEQ ID NO: 832907 - protein, 9 aa, Homo Sapiens
LIQHFNIHT

SEQ ID NO: 832908 - protein, 9 aa, Homo Sapiens
FCLPGFVFQ

SEQ ID NO: 832909 - protein, 9 aa, Homo Sapiens
RVIGSTSGK

SEQ ID NO: 832910 - protein, 9 aa, Homo Sapiens
RSQESLAVL

SEQ ID NO: 832911 - protein, 9 aa, Homo Sapiens
RLESQEEEK

SEQ ID NO: 832912 - protein, 9 aa, Homo Sapiens
LSCVYHAKP

SEQ ID NO: 832913 - protein, 9 aa, Homo Sapiens
LNEKSVQKS

SEQ ID NO: 832914 - protein, 9 aa, Homo Sapiens
RWRKKIIEE

SEQ ID NO: 832915 - protein, 9 aa, Homo Sapiens
VLKSLPGQN

SEQ ID NO: 832916 - protein, 9 aa, Homo Sapiens
FHPVCKAEM

SEQ ID NO: 832917 - protein, 9 aa, Homo Sapiens
LENILFGVF

SEQ ID NO: 832918 - protein, 9 aa, Homo Sapiens
PINGSCQCF

SEQ ID NO: 832919 - protein, 9 aa, Homo Sapiens
AINMKKLFP

SEQ ID NO: 832920 - protein, 9 aa, Homo Sapiens
ADTSVFKNA

SEQ ID NO: 832921 - protein, 9 aa, Homo Sapiens
SCLEDRHDF

SEQ ID NO: 832922 - protein, 9 aa, Homo Sapiens
CAATDDPTR

SEQ ID NO: 832923 - protein, 9 aa, Homo Sapiens
NCFNVEEDM

SEQ ID NO: 832924 - protein, 9 aa, Homo Sapiens
FRMLSSLPV

SEQ ID NO: 832925 - protein, 9 aa, Homo Sapiens
ADVWSLSCT

SEQ ID NO: 832926 - protein, 9 aa, Homo Sapiens
TVLKHLRAY

SEQ ID NO: 832927 - protein, 9 aa, Homo Sapiens
RTPGNIIVY

SEQ ID NO: 832928 - protein, 9 aa, Homo Sapiens
GVWGQYGNE

SEQ ID NO: 832929 - protein, 9 aa, Homo Sapiens
VGASCTEQE

SEQ ID NO: 832930 - protein, 9 aa, Homo Sapiens
VPLETVSCC

SEQ ID NO: 832931 - protein, 9 aa, Homo Sapiens
HYMQKEGLY

SEQ ID NO: 832932 - protein, 9 aa, Homo Sapiens
FLGATLSST

SEQ ID NO: 832933 - protein, 9 aa, Homo Sapiens
ILERAIRAA

SEQ ID NO: 832934 - protein, 9 aa, Homo Sapiens
GQAVVITVG

SEQ ID NO: 832935 - protein, 9 aa, Homo Sapiens
LNYPPSPGV

SEQ ID NO: 832936 - protein, 9 aa, Homo Sapiens
QLNRYMIVS

SEQ ID NO: 832937 - protein, 9 aa, Homo Sapiens
LPCGCLCGM

SEQ ID NO: 832938 - protein, 9 aa, Homo Sapiens
GLIIGEAPA

SEQ ID NO: 832939 - protein, 9 aa, Homo Sapiens
SYPDEELSC

SEQ ID NO: 832940 - protein, 9 aa, Homo Sapiens
GLNSECKSE

SEQ ID NO: 832941 - protein, 9 aa, Homo Sapiens
EYLLCLAAA

SEQ ID NO: 832942 - protein, 9 aa, Homo Sapiens
LSPFLWKKA

SEQ ID NO: 832943 - protein, 9 aa, Homo Sapiens
NTNQHIKIS

SEQ ID NO: 832944 - protein, 9 aa, Homo Sapiens
RIWQEARLQ

SEQ ID NO: 832945 - protein, 9 aa, Homo Sapiens
GLQQVLDNL

SEQ ID NO: 832946 - protein, 9 aa, Homo Sapiens
LNLYPKEWT

SEQ ID NO: 832947 - protein, 9 aa, Homo Sapiens
VFCTLTATM

SEQ ID NO: 832948 - protein, 9 aa, Homo Sapiens
YGRRYGFSH

SEQ ID NO: 832949 - protein, 9 aa, Homo Sapiens
DKSYECPQC

SEQ ID NO: 832950 - protein, 9 aa, Homo Sapiens
HATFINELK

SEQ ID NO: 832951 - protein, 9 aa, Homo Sapiens
RVISPESLS

SEQ ID NO: 832952 - protein, 9 aa, Homo Sapiens
NPAFGKDTK

SEQ ID NO: 832953 - protein, 9 aa, Homo Sapiens
SQWILTAAH

SEQ ID NO: 832954 - protein, 9 aa, Homo Sapiens
AIMCIIHQA

SEQ ID NO: 832955 - protein, 9 aa, Homo Sapiens
SRVLTELMS

SEQ ID NO: 832956 - protein, 9 aa, Homo Sapiens
PCSFNVSQG

SEQ ID NO: 832957 - protein, 9 aa, Homo Sapiens
GCSKDIEFG

SEQ ID NO: 832958 - protein, 9 aa, Homo Sapiens
TKDMDLYSI

SEQ ID NO: 832959 - protein, 9 aa, Homo Sapiens
GQVFVEYAH

SEQ ID NO: 832960 - protein, 9 aa, Homo Sapiens
SNYHQVTES

SEQ ID NO: 832961 - protein, 9 aa, Homo Sapiens
GLGILASVP

SEQ ID NO: 832962 - protein, 9 aa, Homo Sapiens
WIKQPLMDN

SEQ ID NO: 832963 - protein, 9 aa, Homo Sapiens
LCSKLRHLD

SEQ ID NO: 832964 - protein, 9 aa, Homo Sapiens
ATPHKLQEP

SEQ ID NO: 832965 - protein, 9 aa, Homo Sapiens
KNTNRKADF

SEQ ID NO: 832966 - protein, 9 aa, Homo Sapiens
MARSSPYAT

SEQ ID NO: 832967 - protein, 9 aa, Homo Sapiens
STFNNYYSL

SEQ ID NO: 832968 - protein, 9 aa, Homo Sapiens
RGVVAIPKS

SEQ ID NO: 832969 - protein, 9 aa, Homo Sapiens
HKTGDHVQS

SEQ ID NO: 832970 - protein, 9 aa, Homo Sapiens
FLETLKAVD

SEQ ID NO: 832971 - protein, 9 aa, Homo Sapiens
WTPPTDGEG

SEQ ID NO: 832972 - protein, 9 aa, Homo Sapiens
VEFILLGFY

SEQ ID NO: 832973 - protein, 9 aa, Homo Sapiens
FLRNKPIVP

SEQ ID NO: 832974 - protein, 9 aa, Homo Sapiens
PEMLAKVIR

SEQ ID NO: 832975 - protein, 9 aa, Homo Sapiens
EVTQVQVPT

SEQ ID NO: 832976 - protein, 9 aa, Homo Sapiens
EIVKSHSPE

SEQ ID NO: 832977 - protein, 9 aa, Homo Sapiens
PVKLLLGAT

SEQ ID NO: 832978 - protein, 9 aa, Homo Sapiens
QYFGRLSLQ

SEQ ID NO: 832979 - protein, 9 aa, Homo Sapiens
IDQMKKFGR

SEQ ID NO: 832980 - protein, 9 aa, Homo Sapiens
QLLFSDNAV

SEQ ID NO: 832981 - protein, 9 aa, Homo Sapiens
LKLTNNKGV

SEQ ID NO: 832982 - protein, 9 aa, Homo Sapiens
THPAGQNLQ

SEQ ID NO: 832983 - protein, 9 aa, Homo Sapiens
TVEAGGVTG

SEQ ID NO: 832984 - protein, 9 aa, Homo Sapiens
AERRYLTIN

SEQ ID NO: 832985 - protein, 9 aa, Homo Sapiens
EHMAENKEL

SEQ ID NO: 832986 - protein, 9 aa, Homo Sapiens
FGGMCQPCE

SEQ ID NO: 832987 - protein, 9 aa, Homo Sapiens
NNPRHSSSE

SEQ ID NO: 832988 - protein, 9 aa, Homo Sapiens
VPYDVVHCW

SEQ ID NO: 832989 - protein, 9 aa, Homo Sapiens
EVQTFLQTY

SEQ ID NO: 832990 - protein, 9 aa, Homo Sapiens
EQFIKEIVK

SEQ ID NO: 832991 - protein, 9 aa, Homo Sapiens
TRDNSYKCE

SEQ ID NO: 832992 - protein, 9 aa, Homo Sapiens
QQLLHNGKS

SEQ ID NO: 832993 - protein, 9 aa, Homo Sapiens
LGPFGMMGT

SEQ ID NO: 832994 - protein, 9 aa, Homo Sapiens
WRKKIIEEQ

SEQ ID NO: 832995 - protein, 9 aa, Homo Sapiens
EAVYTCICS

SEQ ID NO: 832996 - protein, 9 aa, Homo Sapiens
FSGALLYGG

SEQ ID NO: 832997 - protein, 9 aa, Homo Sapiens
NFSATDFQV

SEQ ID NO: 832998 - protein, 9 aa, Homo Sapiens
HQLVHEGYT

SEQ ID NO: 832999 - protein, 9 aa, Homo Sapiens
KLCSVPCTA

SEQ ID NO: 833000 - protein, 9 aa, Homo Sapiens
WPYGRQTVP

SEQ ID NO: 833001 - protein, 9 aa, Homo Sapiens
NIQETCKAE

SEQ ID NO: 833002 - protein, 9 aa, Homo Sapiens
VWLWLEFFL

SEQ ID NO: 833003 - protein, 9 aa, Homo Sapiens
ETDSHVNPK

SEQ ID NO: 833004 - protein, 9 aa, Homo Sapiens
RWENDKDMT

SEQ ID NO: 833005 - protein, 9 aa, Homo Sapiens
FTSPIPDNA

SEQ ID NO: 833006 - protein, 9 aa, Homo Sapiens
CKKVVLIEV

SEQ ID NO: 833007 - protein, 9 aa, Homo Sapiens
DQIIVSYLW

SEQ ID NO: 833008 - protein, 9 aa, Homo Sapiens
ACFLLLQSI

SEQ ID NO: 833009 - protein, 9 aa, Homo Sapiens
KHHDGQNNG

SEQ ID NO: 833010 - protein, 9 aa, Homo Sapiens
AKGDQSEDF

SEQ ID NO: 833011 - protein, 9 aa, Homo Sapiens
PFWIVHCET

SEQ ID NO: 833012 - protein, 9 aa, Homo Sapiens
DMRGYQRCC

SEQ ID NO: 833013 - protein, 9 aa, Homo Sapiens
RTPRLPAVD

SEQ ID NO: 833014 - protein, 9 aa, Homo Sapiens
LWNSRLLPD

SEQ ID NO: 833015 - protein, 9 aa, Homo Sapiens
NMSRSMTFQ

SEQ ID NO: 833016 - protein, 9 aa, Homo Sapiens
SYAIQSLQK

SEQ ID NO: 833017 - protein, 9 aa, Homo Sapiens
HRRVHTGKK

SEQ ID NO: 833018 - protein, 9 aa, Homo Sapiens
PAFNKDSGI

SEQ ID NO: 833019 - protein, 9 aa, Homo Sapiens
TSESGRVFP

SEQ ID NO: 833020 - protein, 9 aa, Homo Sapiens
LKTNLPVQL

SEQ ID NO: 833021 - protein, 9 aa, Homo Sapiens
QYEMPEFSL

SEQ ID NO: 833022 - protein, 9 aa, Homo Sapiens
KTPPRWAEY

SEQ ID NO: 833023 - protein, 9 aa, Homo Sapiens
HVIYGVRTK

SEQ ID NO: 833024 - protein, 9 aa, Homo Sapiens
SQILVLTEL

SEQ ID NO: 833025 - protein, 9 aa, Homo Sapiens
KINTFIVLN

SEQ ID NO: 833026 - protein, 9 aa, Homo Sapiens
WKNHGCQHV

SEQ ID NO: 833027 - protein, 9 aa, Homo Sapiens
PITSALHKL

SEQ ID NO: 833028 - protein, 9 aa, Homo Sapiens
AICKPLNYV

SEQ ID NO: 833029 - protein, 9 aa, Homo Sapiens
ALKEEEASK

SEQ ID NO: 833030 - protein, 9 aa, Homo Sapiens
NASSQRTAL

SEQ ID NO: 833031 - protein, 9 aa, Homo Sapiens
VGFNVEHLK

SEQ ID NO: 833032 - protein, 9 aa, Homo Sapiens
TALHLAAGG

SEQ ID NO: 833033 - protein, 9 aa, Homo Sapiens
ICRRIDITT

SEQ ID NO: 833034 - protein, 9 aa, Homo Sapiens
NTFIYSLRN

SEQ ID NO: 833035 - protein, 9 aa, Homo Sapiens
TPPTPKTPP

SEQ ID NO: 833036 - protein, 9 aa, Homo Sapiens
HYHAPSTIF

SEQ ID NO: 833037 - protein, 9 aa, Homo Sapiens
FPPLRCQEL

SEQ ID NO: 833038 - protein, 9 aa, Homo Sapiens
VFESRKDIL

SEQ ID NO: 833039 - protein, 9 aa, Homo Sapiens
EEHTEFVLV

SEQ ID NO: 833040 - protein, 9 aa, Homo Sapiens
ALESMDLSQ

SEQ ID NO: 833041 - protein, 9 aa, Homo Sapiens
EMYDCVSQT

SEQ ID NO: 833042 - protein, 9 aa, Homo Sapiens
TTGDVIDCC

SEQ ID NO: 833043 - protein, 9 aa, Homo Sapiens
PPETFDFNI

SEQ ID NO: 833044 - protein, 9 aa, Homo Sapiens
PGGRHKCRL

SEQ ID NO: 833045 - protein, 9 aa, Homo Sapiens
CQAGGRDAE

SEQ ID NO: 833046 - protein, 9 aa, Homo Sapiens
VAPNISQRL

SEQ ID NO: 833047 - protein, 9 aa, Homo Sapiens
PVPETESNV

SEQ ID NO: 833048 - protein, 9 aa, Homo Sapiens
AFELLDKNT

SEQ ID NO: 833049 - protein, 9 aa, Homo Sapiens
LLMGLMFAS

SEQ ID NO: 833050 - protein, 9 aa, Homo Sapiens
IELEEGITH

SEQ ID NO: 833051 - protein, 9 aa, Homo Sapiens
EKGVVEEWW

SEQ ID NO: 833052 - protein, 9 aa, Homo Sapiens
YSYFLGLSD

SEQ ID NO: 833053 - protein, 9 aa, Homo Sapiens
VNGRVYLIM

SEQ ID NO: 833054 - protein, 9 aa, Homo Sapiens
TISCDQLST

SEQ ID NO: 833055 - protein, 9 aa, Homo Sapiens
LCLCSHCSG

SEQ ID NO: 833056 - protein, 9 aa, Homo Sapiens
LMRERNKNV

SEQ ID NO: 833057 - protein, 9 aa, Homo Sapiens
FQIVCTFKM

SEQ ID NO: 833058 - protein, 9 aa, Homo Sapiens
DGVSNEMYT

SEQ ID NO: 833059 - protein, 9 aa, Homo Sapiens
IHDLVSAYL

SEQ ID NO: 833060 - protein, 9 aa, Homo Sapiens
LWIPLLLVV

SEQ ID NO: 833061 - protein, 9 aa, Homo Sapiens
AVVFGLLTV

SEQ ID NO: 833062 - protein, 9 aa, Homo Sapiens
LQLPQAQSC

SEQ ID NO: 833063 - protein, 9 aa, Homo Sapiens
WDYMEKIWH

SEQ ID NO: 833064 - protein, 9 aa, Homo Sapiens
QSLLLPLAV

SEQ ID NO: 833065 - protein, 9 aa, Homo Sapiens
KIMTSQDCL

SEQ ID NO: 833066 - protein, 9 aa, Homo Sapiens
PRGRIRLAE

SEQ ID NO: 833067 - protein, 9 aa, Homo Sapiens
DTQPLLKLS

SEQ ID NO: 833068 - protein, 9 aa, Homo Sapiens
CQPFYQVCH

SEQ ID NO: 833069 - protein, 9 aa, Homo Sapiens
QAPTDGVLL

SEQ ID NO: 833070 - protein, 9 aa, Homo Sapiens
KTEAPGGVK

SEQ ID NO: 833071 - protein, 9 aa, Homo Sapiens
KLNLQKYLE

SEQ ID NO: 833072 - protein, 9 aa, Homo Sapiens
KKELIRQQR

SEQ ID NO: 833073 - protein, 9 aa, Homo Sapiens
TEAPGGVKT

SEQ ID NO: 833074 - protein, 9 aa, Homo Sapiens
KLLPESEEV

SEQ ID NO: 833075 - protein, 9 aa, Homo Sapiens
ASYQHEALR

SEQ ID NO: 833076 - protein, 9 aa, Homo Sapiens
LRYFCGRCI

SEQ ID NO: 833077 - protein, 9 aa, Homo Sapiens
DIKELFPDI

SEQ ID NO: 833078 - protein, 9 aa, Homo Sapiens
LYLRQTSPV

SEQ ID NO: 833079 - protein, 9 aa, Homo Sapiens
EISSNVCFA

SEQ ID NO: 833080 - protein, 9 aa, Homo Sapiens
KHLQFPGCF

SEQ ID NO: 833081 - protein, 9 aa, Homo Sapiens
VSTFWNKPS

SEQ ID NO: 833082 - protein, 9 aa, Homo Sapiens
QHHRQNSWT

SEQ ID NO: 833083 - protein, 9 aa, Homo Sapiens
APFSNVLTF

SEQ ID NO: 833084 - protein, 9 aa, Homo Sapiens
AIENDPLFA

SEQ ID NO: 833085 - protein, 9 aa, Homo Sapiens
NEVITENLE

SEQ ID NO: 833086 - protein, 9 aa, Homo Sapiens
VGYRKTLNC

SEQ ID NO: 833087 - protein, 9 aa, Homo Sapiens
MLPSPVTSI

SEQ ID NO: 833088 - protein, 9 aa, Homo Sapiens
PSSYMWRDG

SEQ ID NO: 833089 - protein, 9 aa, Homo Sapiens
TGCPAIIQA

SEQ ID NO: 833090 - protein, 9 aa, Homo Sapiens
EVPICTDPM

SEQ ID NO: 833091 - protein, 9 aa, Homo Sapiens
SRSPLKVVK

SEQ ID NO: 833092 - protein, 9 aa, Homo Sapiens
QAKRPAAPN

SEQ ID NO: 833093 - protein, 9 aa, Homo Sapiens
SDEEKVICL

SEQ ID NO: 833094 - protein, 9 aa, Homo Sapiens
INVFLLSAA

SEQ ID NO: 833095 - protein, 9 aa, Homo Sapiens
VRNTVQGPA

SEQ ID NO: 833096 - protein, 9 aa, Homo Sapiens
HTERIGHRY

SEQ ID NO: 833097 - protein, 9 aa, Homo Sapiens
RKFPGVAAA

SEQ ID NO: 833098 - protein, 9 aa, Homo Sapiens
LLGGGSGHE

SEQ ID NO: 833099 - protein, 9 aa, Homo Sapiens
HDPEGMGVI

SEQ ID NO: 833100 - protein, 9 aa, Homo Sapiens
ENDLNGSSH

SEQ ID NO: 833101 - protein, 9 aa, Homo Sapiens
TLSLLHRAR

SEQ ID NO: 833102 - protein, 9 aa, Homo Sapiens
GNLGNNGNM

SEQ ID NO: 833103 - protein, 9 aa, Homo Sapiens
GGALNRVLK

SEQ ID NO: 833104 - protein, 9 aa, Homo Sapiens
LLMFKDLKL

SEQ ID NO: 833105 - protein, 9 aa, Homo Sapiens
NLCSFTKDA

SEQ ID NO: 833106 - protein, 9 aa, Homo Sapiens
IKFMKIGVS

SEQ ID NO: 833107 - protein, 9 aa, Homo Sapiens
IRANRQLCY

SEQ ID NO: 833108 - protein, 9 aa, Homo Sapiens
QEQDIKTLH

SEQ ID NO: 833109 - protein, 9 aa, Homo Sapiens
IREQEDKIR

SEQ ID NO: 833110 - protein, 9 aa, Homo Sapiens
QNKKKTGSQ

SEQ ID NO: 833111 - protein, 9 aa, Homo Sapiens
FIHKKRLIE

SEQ ID NO: 833112 - protein, 9 aa, Homo Sapiens
DKPFKCQEC

SEQ ID NO: 833113 - protein, 9 aa, Homo Sapiens
QVPAYLIDL

SEQ ID NO: 833114 - protein, 9 aa, Homo Sapiens
WSSPSDSVH

SEQ ID NO: 833115 - protein, 9 aa, Homo Sapiens
LGITMVLTM

SEQ ID NO: 833116 - protein, 9 aa, Homo Sapiens
LETFTMGSG

SEQ ID NO: 833117 - protein, 9 aa, Homo Sapiens
QTAMSSRQP

SEQ ID NO: 833118 - protein, 9 aa, Homo Sapiens
KSNNLKSGD

SEQ ID NO: 833119 - protein, 9 aa, Homo Sapiens
VHPASLNGH

SEQ ID NO: 833120 - protein, 9 aa, Homo Sapiens
KPAITTLVV

SEQ ID NO: 833121 - protein, 9 aa, Homo Sapiens
CRISHHHPE

SEQ ID NO: 833122 - protein, 9 aa, Homo Sapiens
PQYLALFRV

SEQ ID NO: 833123 - protein, 9 aa, Homo Sapiens
GCLLDAPAA

SEQ ID NO: 833124 - protein, 9 aa, Homo Sapiens
TLHNLQARY

SEQ ID NO: 833125 - protein, 9 aa, Homo Sapiens
SHWHTKKLP

SEQ ID NO: 833126 - protein, 9 aa, Homo Sapiens
VIPPAALRT

SEQ ID NO: 833127 - protein, 9 aa, Homo Sapiens
EAALQLFKN

SEQ ID NO: 833128 - protein, 9 aa, Homo Sapiens
YKGVTSHWH

SEQ ID NO: 833129 - protein, 9 aa, Homo Sapiens
YIKVNLIKQ

SEQ ID NO: 833130 - protein, 9 aa, Homo Sapiens
DNAKDTTKN

SEQ ID NO: 833131 - protein, 9 aa, Homo Sapiens
YVTHYCQGP

SEQ ID NO: 833132 - protein, 9 aa, Homo Sapiens
QQVLAPAWH

SEQ ID NO: 833133 - protein, 9 aa, Homo Sapiens
VKIIIDELS

SEQ ID NO: 833134 - protein, 9 aa, Homo Sapiens
EVSAVQLQE

SEQ ID NO: 833135 - protein, 9 aa, Homo Sapiens
NEVNNEAVM

SEQ ID NO: 833136 - protein, 9 aa, Homo Sapiens
KCLRPDVCG

SEQ ID NO: 833137 - protein, 9 aa, Homo Sapiens
KHNMTAVVR

SEQ ID NO: 833138 - protein, 9 aa, Homo Sapiens
DVVRGRIIS

SEQ ID NO: 833139 - protein, 9 aa, Homo Sapiens
VHPLFKDLN

SEQ ID NO: 833140 - protein, 9 aa, Homo Sapiens
YFVPEPSNL

SEQ ID NO: 833141 - protein, 9 aa, Homo Sapiens
FGSLSNAYS

SEQ ID NO: 833142 - protein, 9 aa, Homo Sapiens
FEGVPVFIH

SEQ ID NO: 833143 - protein, 9 aa, Homo Sapiens
DKIVDLNLL

SEQ ID NO: 833144 - protein, 9 aa, Homo Sapiens
DTGACVCPP

SEQ ID NO: 833145 - protein, 9 aa, Homo Sapiens
LSHFLEEIE

SEQ ID NO: 833146 - protein, 9 aa, Homo Sapiens
HECSLWGSW

SEQ ID NO: 833147 - protein, 9 aa, Homo Sapiens
KSFETNTYF

SEQ ID NO: 833148 - protein, 9 aa, Homo Sapiens
TPNATLGSL

SEQ ID NO: 833149 - protein, 9 aa, Homo Sapiens
VQFSDRIIL

SEQ ID NO: 833150 - protein, 9 aa, Homo Sapiens
APFWLEDPA

SEQ ID NO: 833151 - protein, 9 aa, Homo Sapiens
VHQRRSVFP

SEQ ID NO: 833152 - protein, 9 aa, Homo Sapiens
IDKFLSLAS

SEQ ID NO: 833153 - protein, 9 aa, Homo Sapiens
KSFINYRFM

SEQ ID NO: 833154 - protein, 9 aa, Homo Sapiens
DVVPPPNPG

SEQ ID NO: 833155 - protein, 9 aa, Homo Sapiens
HDIPEDISD

SEQ ID NO: 833156 - protein, 9 aa, Homo Sapiens
PSAMNEEES

SEQ ID NO: 833157 - protein, 9 aa, Homo Sapiens
AFIVHKRVN

SEQ ID NO: 833158 - protein, 9 aa, Homo Sapiens
IENAAPSSR

SEQ ID NO: 833159 - protein, 9 aa, Homo Sapiens
TPKELTVET

SEQ ID NO: 833160 - protein, 9 aa, Homo Sapiens
PYWALILQG

SEQ ID NO: 833161 - protein, 9 aa, Homo Sapiens
INYTDCLTQ

SEQ ID NO: 833162 - protein, 9 aa, Homo Sapiens
YVTLKVQDV

SEQ ID NO: 833163 - protein, 9 aa, Homo Sapiens
AYSSFCSVR

SEQ ID NO: 833164 - protein, 9 aa, Homo Sapiens
EDDEQQILN

SEQ ID NO: 833165 - protein, 9 aa, Homo Sapiens
RVNKQCVGE

SEQ ID NO: 833166 - protein, 9 aa, Homo Sapiens
PFRKMNEKS

SEQ ID NO: 833167 - protein, 9 aa, Homo Sapiens
NNGLNDRDK

SEQ ID NO: 833168 - protein, 9 aa, Homo Sapiens
CIQFYMKLL

SEQ ID NO: 833169 - protein, 9 aa, Homo Sapiens
NVFAICFSI

SEQ ID NO: 833170 - protein, 9 aa, Homo Sapiens
FILRRLPLF

SEQ ID NO: 833171 - protein, 9 aa, Homo Sapiens
QDPKVMLFG

SEQ ID NO: 833172 - protein, 9 aa, Homo Sapiens
KRCDTPANL

SEQ ID NO: 833173 - protein, 9 aa, Homo Sapiens
STPKQIDTP

SEQ ID NO: 833174 - protein, 9 aa, Homo Sapiens
QHFCGQRKK

SEQ ID NO: 833175 - protein, 9 aa, Homo Sapiens
EPSSSSTSQ

SEQ ID NO: 833176 - protein, 9 aa, Homo Sapiens
DKKRKKLEE

SEQ ID NO: 833177 - protein, 9 aa, Homo Sapiens
TWQGITHLK

SEQ ID NO: 833178 - protein, 9 aa, Homo Sapiens
YIVYPGIAV

SEQ ID NO: 833179 - protein, 9 aa, Homo Sapiens
VRPVTFPSL

SEQ ID NO: 833180 - protein, 9 aa, Homo Sapiens
NGCAYFHKE

SEQ ID NO: 833181 - protein, 9 aa, Homo Sapiens
LPFKDMDTF

SEQ ID NO: 833182 - protein, 9 aa, Homo Sapiens
HPCILSQAP

SEQ ID NO: 833183 - protein, 9 aa, Homo Sapiens
AKIKGYQCL

SEQ ID NO: 833184 - protein, 9 aa, Homo Sapiens
LRETVRNKS

SEQ ID NO: 833185 - protein, 9 aa, Homo Sapiens
ASKISRNYV

SEQ ID NO: 833186 - protein, 9 aa, Homo Sapiens
HKGPGGGMG

SEQ ID NO: 833187 - protein, 9 aa, Homo Sapiens
DTVGMSTVP

SEQ ID NO: 833188 - protein, 9 aa, Homo Sapiens
LGEIILAIQ

SEQ ID NO: 833189 - protein, 9 aa, Homo Sapiens
HLHNKENQH

SEQ ID NO: 833190 - protein, 9 aa, Homo Sapiens
KSSPKSTGS

SEQ ID NO: 833191 - protein, 9 aa, Homo Sapiens
DIRNKRLQL

SEQ ID NO: 833192 - protein, 9 aa, Homo Sapiens
QATQAAEIW

SEQ ID NO: 833193 - protein, 9 aa, Homo Sapiens
AFVAGPRLR

SEQ ID NO: 833194 - protein, 9 aa, Homo Sapiens
EEHLAALQC

SEQ ID NO: 833195 - protein, 9 aa, Homo Sapiens
YNNRNQDMS

SEQ ID NO: 833196 - protein, 9 aa, Homo Sapiens
RFNREVDMY

SEQ ID NO: 833197 - protein, 9 aa, Homo Sapiens
MKCTFGRGY

SEQ ID NO: 833198 - protein, 9 aa, Homo Sapiens
EMFDNFAAS

SEQ ID NO: 833199 - protein, 9 aa, Homo Sapiens
RCTDHGSDH

SEQ ID NO: 833200 - protein, 9 aa, Homo Sapiens
EKNSSKCEE

SEQ ID NO: 833201 - protein, 9 aa, Homo Sapiens
KEAVLYVKE

SEQ ID NO: 833202 - protein, 9 aa, Homo Sapiens
TDGQDSPAS

SEQ ID NO: 833203 - protein, 9 aa, Homo Sapiens
DNLSNIDVL

SEQ ID NO: 833204 - protein, 9 aa, Homo Sapiens
AMVWGLDLD

SEQ ID NO: 833205 - protein, 9 aa, Homo Sapiens
EGSYTCDTE

SEQ ID NO: 833206 - protein, 9 aa, Homo Sapiens
GEVQTNIFE

SEQ ID NO: 833207 - protein, 9 aa, Homo Sapiens
FNGRCHVVR

SEQ ID NO: 833208 - protein, 9 aa, Homo Sapiens
AEKLFWDLI

SEQ ID NO: 833209 - protein, 9 aa, Homo Sapiens
EINEITFDK

SEQ ID NO: 833210 - protein, 9 aa, Homo Sapiens
RKNTNIDNF

SEQ ID NO: 833211 - protein, 9 aa, Homo Sapiens
KCLAEGGKL

SEQ ID NO: 833212 - protein, 9 aa, Homo Sapiens
GEPPINGSS

SEQ ID NO: 833213 - protein, 9 aa, Homo Sapiens
TSMQGAVAV

SEQ ID NO: 833214 - protein, 9 aa, Homo Sapiens
AFPGLIFAI

SEQ ID NO: 833215 - protein, 9 aa, Homo Sapiens
QCHHKQKHC

SEQ ID NO: 833216 - protein, 9 aa, Homo Sapiens
RSFHNTCFH

SEQ ID NO: 833217 - protein, 9 aa, Homo Sapiens
NLVHGRNVT

SEQ ID NO: 833218 - protein, 9 aa, Homo Sapiens
RKKSITNTV

SEQ ID NO: 833219 - protein, 9 aa, Homo Sapiens
DDSKNNFQN

SEQ ID NO: 833220 - protein, 9 aa, Homo Sapiens
QRLHSGVQP

SEQ ID NO: 833221 - protein, 9 aa, Homo Sapiens
LLKSEIRRS

SEQ ID NO: 833222 - protein, 9 aa, Homo Sapiens
KELEILQIC

SEQ ID NO: 833223 - protein, 9 aa, Homo Sapiens
CSCGWHHCP

SEQ ID NO: 833224 - protein, 9 aa, Homo Sapiens
YPTTMRTLG

SEQ ID NO: 833225 - protein, 9 aa, Homo Sapiens
PKYSTNKAK

SEQ ID NO: 833226 - protein, 9 aa, Homo Sapiens
LAEAVRDYY

SEQ ID NO: 833227 - protein, 9 aa, Homo Sapiens
LLQGLFALS

SEQ ID NO: 833228 - protein, 9 aa, Homo Sapiens
AFPGLIFAV

SEQ ID NO: 833229 - protein, 9 aa, Homo Sapiens
PGILKNASD

SEQ ID NO: 833230 - protein, 9 aa, Homo Sapiens
DRTIEKIID

SEQ ID NO: 833231 - protein, 9 aa, Homo Sapiens
HFQVDNLDE

SEQ ID NO: 833232 - protein, 9 aa, Homo Sapiens
IQGVDANDN

SEQ ID NO: 833233 - protein, 9 aa, Homo Sapiens
FEQLWKVNP

SEQ ID NO: 833234 - protein, 9 aa, Homo Sapiens
CKVKTIVMI

SEQ ID NO: 833235 - protein, 9 aa, Homo Sapiens
CAQRNLYTD

SEQ ID NO: 833236 - protein, 9 aa, Homo Sapiens
KSGKQSRTS

SEQ ID NO: 833237 - protein, 9 aa, Homo Sapiens
VIHTILLGY

SEQ ID NO: 833238 - protein, 9 aa, Homo Sapiens
MANRNNVTG

SEQ ID NO: 833239 - protein, 9 aa, Homo Sapiens
TGIALFIII

SEQ ID NO: 833240 - protein, 9 aa, Homo Sapiens
IVQDILHFE

SEQ ID NO: 833241 - protein, 9 aa, Homo Sapiens
NIVSRNPSI

SEQ ID NO: 833242 - protein, 9 aa, Homo Sapiens
NLEEAKIIG

SEQ ID NO: 833243 - protein, 9 aa, Homo Sapiens
AASTMSVCF

SEQ ID NO: 833244 - protein, 9 aa, Homo Sapiens
FEEIDYSTQ

SEQ ID NO: 833245 - protein, 9 aa, Homo Sapiens
VKHEIINED

SEQ ID NO: 833246 - protein, 9 aa, Homo Sapiens
ALKIYKYHV

SEQ ID NO: 833247 - protein, 9 aa, Homo Sapiens
TDPFDTPSF

SEQ ID NO: 833248 - protein, 9 aa, Homo Sapiens
EPTSALSNV

SEQ ID NO: 833249 - protein, 9 aa, Homo Sapiens
PILTQNTHP

SEQ ID NO: 833250 - protein, 9 aa, Homo Sapiens
AKQFKQWRI

SEQ ID NO: 833251 - protein, 9 aa, Homo Sapiens
FLANLFVFL

SEQ ID NO: 833252 - protein, 9 aa, Homo Sapiens
LLQKQHALY

SEQ ID NO: 833253 - protein, 9 aa, Homo Sapiens
SLFPPGYQV

SEQ ID NO: 833254 - protein, 9 aa, Homo Sapiens
TSAGRYVCE

SEQ ID NO: 833255 - protein, 9 aa, Homo Sapiens
QQLCEITEK

SEQ ID NO: 833256 - protein, 9 aa, Homo Sapiens
RCFIKRVYV

SEQ ID NO: 833257 - protein, 9 aa, Homo Sapiens
NCNREAFNV

SEQ ID NO: 833258 - protein, 9 aa, Homo Sapiens
FAPQLSGYQ

SEQ ID NO: 833259 - protein, 9 aa, Homo Sapiens
VQYFGETGL

SEQ ID NO: 833260 - protein, 9 aa, Homo Sapiens
GKCSRHKVC

SEQ ID NO: 833261 - protein, 9 aa, Homo Sapiens
LEPDPSLDM

SEQ ID NO: 833262 - protein, 9 aa, Homo Sapiens
SVSLLMFKD

SEQ ID NO: 833263 - protein, 9 aa, Homo Sapiens
KESLRNYYE

SEQ ID NO: 833264 - protein, 9 aa, Homo Sapiens
AAHCGMILQ

SEQ ID NO: 833265 - protein, 9 aa, Homo Sapiens
VLARLQQQA

SEQ ID NO: 833266 - protein, 9 aa, Homo Sapiens
LLDKVANNL

SEQ ID NO: 833267 - protein, 9 aa, Homo Sapiens
MLRFPHLYK

SEQ ID NO: 833268 - protein, 9 aa, Homo Sapiens
PTLNEQQRS

SEQ ID NO: 833269 - protein, 9 aa, Homo Sapiens
DEEANIGLP

SEQ ID NO: 833270 - protein, 9 aa, Homo Sapiens
AKHEIKAAK

SEQ ID NO: 833271 - protein, 9 aa, Homo Sapiens
FNMSPGFPK

SEQ ID NO: 833272 - protein, 9 aa, Homo Sapiens
LSACFDNFT

SEQ ID NO: 833273 - protein, 9 aa, Homo Sapiens
PNKSSVRLL

SEQ ID NO: 833274 - protein, 9 aa, Homo Sapiens
TRSWKSILS

SEQ ID NO: 833275 - protein, 9 aa, Homo Sapiens
NAGGQSDEN

SEQ ID NO: 833276 - protein, 9 aa, Homo Sapiens
IQIIQERNG

SEQ ID NO: 833277 - protein, 9 aa, Homo Sapiens
ILNYKCRNV

SEQ ID NO: 833278 - protein, 9 aa, Homo Sapiens
MLENHTVAD

SEQ ID NO: 833279 - protein, 9 aa, Homo Sapiens
NFVAQGADR

SEQ ID NO: 833280 - protein, 9 aa, Homo Sapiens
LPTCYNYSE

SEQ ID NO: 833281 - protein, 9 aa, Homo Sapiens
VLRVFTQQD

SEQ ID NO: 833282 - protein, 9 aa, Homo Sapiens
IALFIIILT

SEQ ID NO: 833283 - protein, 9 aa, Homo Sapiens
SYFTKGEFI

SEQ ID NO: 833284 - protein, 9 aa, Homo Sapiens
EEDHGSLEN

SEQ ID NO: 833285 - protein, 9 aa, Homo Sapiens
YLLKNDTSD

SEQ ID NO: 833286 - protein, 9 aa, Homo Sapiens
FKRKAINLQ

SEQ ID NO: 833287 - protein, 9 aa, Homo Sapiens
ACCQPTCCC

SEQ ID NO: 833288 - protein, 9 aa, Homo Sapiens
SPRPDNYFH

SEQ ID NO: 833289 - protein, 9 aa, Homo Sapiens
QVVHGKERS

SEQ ID NO: 833290 - protein, 9 aa, Homo Sapiens
NILQPGHSH

SEQ ID NO: 833291 - protein, 9 aa, Homo Sapiens
QQIVRAQKY

SEQ ID NO: 833292 - protein, 9 aa, Homo Sapiens
NVSKKENLR

SEQ ID NO: 833293 - protein, 9 aa, Homo Sapiens
FPDNAVTKR

SEQ ID NO: 833294 - protein, 9 aa, Homo Sapiens
KLAGWHRIT

SEQ ID NO: 833295 - protein, 9 aa, Homo Sapiens
NLVQNNVSP

SEQ ID NO: 833296 - protein, 9 aa, Homo Sapiens
AQNMVLQED

SEQ ID NO: 833297 - protein, 9 aa, Homo Sapiens
VHGSDGHGR

SEQ ID NO: 833298 - protein, 9 aa, Homo Sapiens
VNRSPSFST

SEQ ID NO: 833299 - protein, 9 aa, Homo Sapiens
DPDFFIGKQ

SEQ ID NO: 833300 - protein, 9 aa, Homo Sapiens
TLTVQEPPN

SEQ ID NO: 833301 - protein, 9 aa, Homo Sapiens
IMEAVRGSL

SEQ ID NO: 833302 - protein, 9 aa, Homo Sapiens
EIEQKCKAV

SEQ ID NO: 833303 - protein, 9 aa, Homo Sapiens
MINSLPTFP

SEQ ID NO: 833304 - protein, 9 aa, Homo Sapiens
GAVAVTMLL

SEQ ID NO: 833305 - protein, 9 aa, Homo Sapiens
TSTDFAYSS

SEQ ID NO: 833306 - protein, 9 aa, Homo Sapiens
QLLGIKNIG

SEQ ID NO: 833307 - protein, 9 aa, Homo Sapiens
GIPPFLAVL

SEQ ID NO: 833308 - protein, 9 aa, Homo Sapiens
LRPAHGRRP

SEQ ID NO: 833309 - protein, 9 aa, Homo Sapiens
RSCTIRTRR

SEQ ID NO: 833310 - protein, 9 aa, Homo Sapiens
EALQGEKQY

SEQ ID NO: 833311 - protein, 9 aa, Homo Sapiens
ICGFLKGRC

SEQ ID NO: 833312 - protein, 9 aa, Homo Sapiens
ITGDTLRTL

SEQ ID NO: 833313 - protein, 9 aa, Homo Sapiens
KRYDLELIV

SEQ ID NO: 833314 - protein, 9 aa, Homo Sapiens
KYSHLSDTK

SEQ ID NO: 833315 - protein, 9 aa, Homo Sapiens
IISVFIQTD

SEQ ID NO: 833316 - protein, 9 aa, Homo Sapiens
QKKINRLGK

SEQ ID NO: 833317 - protein, 9 aa, Homo Sapiens
EYFLPLPTG

SEQ ID NO: 833318 - protein, 9 aa, Homo Sapiens
LQTIGVEAH

SEQ ID NO: 833319 - protein, 9 aa, Homo Sapiens
LHNPSNFLK

SEQ ID NO: 833320 - protein, 9 aa, Homo Sapiens
SSSQMVLLP

SEQ ID NO: 833321 - protein, 9 aa, Homo Sapiens
QWAGRYRII

SEQ ID NO: 833322 - protein, 9 aa, Homo Sapiens
NMGIVHQDL

SEQ ID NO: 833323 - protein, 9 aa, Homo Sapiens
QGMTFIAGY

SEQ ID NO: 833324 - protein, 9 aa, Homo Sapiens
LNNEDNDIA

SEQ ID NO: 833325 - protein, 9 aa, Homo Sapiens
LISSGNLLP

SEQ ID NO: 833326 - protein, 9 aa, Homo Sapiens
KNNKKRKAL

SEQ ID NO: 833327 - protein, 9 aa, Homo Sapiens
VSQIICSGK

SEQ ID NO: 833328 - protein, 9 aa, Homo Sapiens
RISTEDDGL

SEQ ID NO: 833329 - protein, 9 aa, Homo Sapiens
PICSTNFIT

SEQ ID NO: 833330 - protein, 9 aa, Homo Sapiens
ESLMAALRR

SEQ ID NO: 833331 - protein, 9 aa, Homo Sapiens
HVVLNQQGR

SEQ ID NO: 833332 - protein, 9 aa, Homo Sapiens
LFQDYEIRQ

SEQ ID NO: 833333 - protein, 9 aa, Homo Sapiens
YPQLILALL

SEQ ID NO: 833334 - protein, 9 aa, Homo Sapiens
IHLGEGSYA

SEQ ID NO: 833335 - protein, 9 aa, Homo Sapiens
ERTKGDIMI

SEQ ID NO: 833336 - protein, 9 aa, Homo Sapiens
TKRITPDSY

SEQ ID NO: 833337 - protein, 9 aa, Homo Sapiens
GYNVVLLYP

SEQ ID NO: 833338 - protein, 9 aa, Homo Sapiens
NPDRRCTKL

SEQ ID NO: 833339 - protein, 9 aa, Homo Sapiens
CSSQPEHYS

SEQ ID NO: 833340 - protein, 9 aa, Homo Sapiens
YHMSYTMKP

SEQ ID NO: 833341 - protein, 9 aa, Homo Sapiens
ATTENLLHL

SEQ ID NO: 833342 - protein, 9 aa, Homo Sapiens
PMYLLIGNL

SEQ ID NO: 833343 - protein, 9 aa, Homo Sapiens
VKKTVEAGG

SEQ ID NO: 833344 - protein, 9 aa, Homo Sapiens
NAVVQELAE

SEQ ID NO: 833345 - protein, 9 aa, Homo Sapiens
EYIEIYRVA

SEQ ID NO: 833346 - protein, 9 aa, Homo Sapiens
LVALQRQAL

SEQ ID NO: 833347 - protein, 9 aa, Homo Sapiens
GGDGGPSLR

SEQ ID NO: 833348 - protein, 9 aa, Homo Sapiens
GRQIYHHVT

SEQ ID NO: 833349 - protein, 9 aa, Homo Sapiens
LTYRLDPNN

SEQ ID NO: 833350 - protein, 9 aa, Homo Sapiens
DMVPQAADP

SEQ ID NO: 833351 - protein, 9 aa, Homo Sapiens
TALLDKVAN

SEQ ID NO: 833352 - protein, 9 aa, Homo Sapiens
AGTAKDKKE

SEQ ID NO: 833353 - protein, 9 aa, Homo Sapiens
VRKQTCHFS

SEQ ID NO: 833354 - protein, 9 aa, Homo Sapiens
FISFTNVQS

SEQ ID NO: 833355 - protein, 9 aa, Homo Sapiens
KRKKSRYRS

SEQ ID NO: 833356 - protein, 9 aa, Homo Sapiens
ILLTPLFEE

SEQ ID NO: 833357 - protein, 9 aa, Homo Sapiens
RENNRTSSI

SEQ ID NO: 833358 - protein, 9 aa, Homo Sapiens
VRFVQLQHN

SEQ ID NO: 833359 - protein, 9 aa, Homo Sapiens
GNETFAGGV

SEQ ID NO: 833360 - protein, 9 aa, Homo Sapiens
DLDAVLICF

SEQ ID NO: 833361 - protein, 9 aa, Homo Sapiens
AASDTKKNK

SEQ ID NO: 833362 - protein, 9 aa, Homo Sapiens
FIGKQTVSP

SEQ ID NO: 833363 - protein, 9 aa, Homo Sapiens
KILCDWMYK

SEQ ID NO: 833364 - protein, 9 aa, Homo Sapiens
DDAMCNFAE

SEQ ID NO: 833365 - protein, 9 aa, Homo Sapiens
KVPTGVIIG

SEQ ID NO: 833366 - protein, 9 aa, Homo Sapiens
TSTVNTGLM

SEQ ID NO: 833367 - protein, 9 aa, Homo Sapiens
AEEGHIIPQ

SEQ ID NO: 833368 - protein, 9 aa, Homo Sapiens
PFHHRNPGI

SEQ ID NO: 833369 - protein, 9 aa, Homo Sapiens
VSAQVITLT

SEQ ID NO: 833370 - protein, 9 aa, Homo Sapiens
NIFLTIRMI

SEQ ID NO: 833371 - protein, 9 aa, Homo Sapiens
VWIGGSIPA

SEQ ID NO: 833372 - protein, 9 aa, Homo Sapiens
VGPSSDTCE

SEQ ID NO: 833373 - protein, 9 aa, Homo Sapiens
NYRLVVFKL

SEQ ID NO: 833374 - protein, 9 aa, Homo Sapiens
ALRREHDAH

SEQ ID NO: 833375 - protein, 9 aa, Homo Sapiens
SVKKKNDNR

SEQ ID NO: 833376 - protein, 9 aa, Homo Sapiens
LGDPRLQTN

SEQ ID NO: 833377 - protein, 9 aa, Homo Sapiens
CHQTGLDRI

SEQ ID NO: 833378 - protein, 9 aa, Homo Sapiens
KCSLFEYHD

SEQ ID NO: 833379 - protein, 9 aa, Homo Sapiens
IRGGCSEFC

SEQ ID NO: 833380 - protein, 9 aa, Homo Sapiens
CKSETAAIP

SEQ ID NO: 833381 - protein, 9 aa, Homo Sapiens
VQKKYKNRT

SEQ ID NO: 833382 - protein, 9 aa, Homo Sapiens
LKAVKLFQN

SEQ ID NO: 833383 - protein, 9 aa, Homo Sapiens
DHTLTYPIL

SEQ ID NO: 833384 - protein, 9 aa, Homo Sapiens
KMLINFLSE

SEQ ID NO: 833385 - protein, 9 aa, Homo Sapiens
TNRKLYCQD

SEQ ID NO: 833386 - protein, 9 aa, Homo Sapiens
EYFRKFNKR

SEQ ID NO: 833387 - protein, 9 aa, Homo Sapiens
SNDAEYECQ

SEQ ID NO: 833388 - protein, 9 aa, Homo Sapiens
TIQFYFVHS

SEQ ID NO: 833389 - protein, 9 aa, Homo Sapiens
IFNILYWVI

SEQ ID NO: 833390 - protein, 9 aa, Homo Sapiens
KAINMRYPV

SEQ ID NO: 833391 - protein, 9 aa, Homo Sapiens
NDHSPVFWH

SEQ ID NO: 833392 - protein, 9 aa, Homo Sapiens
QADKKVSLM

SEQ ID NO: 833393 - protein, 9 aa, Homo Sapiens
EFNLLDVRF

SEQ ID NO: 833394 - protein, 9 aa, Homo Sapiens
DVAVNIVNS

SEQ ID NO: 833395 - protein, 9 aa, Homo Sapiens
SKMNLNNFI

SEQ ID NO: 833396 - protein, 9 aa, Homo Sapiens
SDEEQLFSV

SEQ ID NO: 833397 - protein, 9 aa, Homo Sapiens
APWLNLHEL

SEQ ID NO: 833398 - protein, 9 aa, Homo Sapiens
FKTCIKSTV

SEQ ID NO: 833399 - protein, 9 aa, Homo Sapiens
NRQGIFVDW

SEQ ID NO: 833400 - protein, 9 aa, Homo Sapiens
KVKKTVEAG

SEQ ID NO: 833401 - protein, 9 aa, Homo Sapiens
PPLIGKGLA

SEQ ID NO: 833402 - protein, 9 aa, Homo Sapiens
TFRLSATSG

SEQ ID NO: 833403 - protein, 9 aa, Homo Sapiens
QTEYCNKCE

SEQ ID NO: 833404 - protein, 9 aa, Homo Sapiens
YHSHEAIIN

SEQ ID NO: 833405 - protein, 9 aa, Homo Sapiens
RYDRVIFWG

SEQ ID NO: 833406 - protein, 9 aa, Homo Sapiens
LASHSEKTK

SEQ ID NO: 833407 - protein, 9 aa, Homo Sapiens
LSGGAQINR

SEQ ID NO: 833408 - protein, 9 aa, Homo Sapiens
KLVIVKCVQ

SEQ ID NO: 833409 - protein, 9 aa, Homo Sapiens
FARCILTAG

SEQ ID NO: 833410 - protein, 9 aa, Homo Sapiens
FKSKATNDD

SEQ ID NO: 833411 - protein, 9 aa, Homo Sapiens
SESSLSADP

SEQ ID NO: 833412 - protein, 9 aa, Homo Sapiens
EALGHVSFK

SEQ ID NO: 833413 - protein, 9 aa, Homo Sapiens
DAAIILSTY

SEQ ID NO: 833414 - protein, 9 aa, Homo Sapiens
SIPSPQTSS

SEQ ID NO: 833415 - protein, 9 aa, Homo Sapiens
SGCSWITVS

SEQ ID NO: 833416 - protein, 9 aa, Homo Sapiens
SMKIKDNDI

SEQ ID NO: 833417 - protein, 9 aa, Homo Sapiens
EAEAEDGEE

SEQ ID NO: 833418 - protein, 9 aa, Homo Sapiens
ADPKVCCNY

SEQ ID NO: 833419 - protein, 9 aa, Homo Sapiens
NLYMRLEDE

SEQ ID NO: 833420 - protein, 9 aa, Homo Sapiens
KNQKLFDEL

SEQ ID NO: 833421 - protein, 9 aa, Homo Sapiens
ASVSCWAKG

SEQ ID NO: 833422 - protein, 9 aa, Homo Sapiens
YIMEAVREG

SEQ ID NO: 833423 - protein, 9 aa, Homo Sapiens
AVWDSELAK

SEQ ID NO: 833424 - protein, 9 aa, Homo Sapiens
HVLYKLNNE

SEQ ID NO: 833425 - protein, 9 aa, Homo Sapiens
PMTDKMLVR

SEQ ID NO: 833426 - protein, 9 aa, Homo Sapiens
KLSRRRSHQ

SEQ ID NO: 833427 - protein, 9 aa, Homo Sapiens
RITENASET

SEQ ID NO: 833428 - protein, 9 aa, Homo Sapiens
IWDLLLNVD

SEQ ID NO: 833429 - protein, 9 aa, Homo Sapiens
SLSNNSTSK

SEQ ID NO: 833430 - protein, 9 aa, Homo Sapiens
RGTTRPNGP

SEQ ID NO: 833431 - protein, 9 aa, Homo Sapiens
PKVMLFGEP

SEQ ID NO: 833432 - protein, 9 aa, Homo Sapiens
GQEVLFNVI

SEQ ID NO: 833433 - protein, 9 aa, Homo Sapiens
HATLHAENL

SEQ ID NO: 833434 - protein, 9 aa, Homo Sapiens
MFGDPCFKT

SEQ ID NO: 833435 - protein, 9 aa, Homo Sapiens
SKETDVINF

SEQ ID NO: 833436 - protein, 9 aa, Homo Sapiens
FDLEEFKGN

SEQ ID NO: 833437 - protein, 9 aa, Homo Sapiens
SSTRSSHIP

SEQ ID NO: 833438 - protein, 9 aa, Homo Sapiens
AKGDPLIAE

SEQ ID NO: 833439 - protein, 9 aa, Homo Sapiens
HHQQIHTGE

SEQ ID NO: 833440 - protein, 9 aa, Homo Sapiens
PCSLECWDE

SEQ ID NO: 833441 - protein, 9 aa, Homo Sapiens
DMQAVRQDP

SEQ ID NO: 833442 - protein, 9 aa, Homo Sapiens
LLMKKIQGK

SEQ ID NO: 833443 - protein, 9 aa, Homo Sapiens
DPFIKDGSF

SEQ ID NO: 833444 - protein, 9 aa, Homo Sapiens
NIMKTLTYR

SEQ ID NO: 833445 - protein, 9 aa, Homo Sapiens
YTLSLERTN

SEQ ID NO: 833446 - protein, 9 aa, Homo Sapiens
TLKSFSNLA

SEQ ID NO: 833447 - protein, 9 aa, Homo Sapiens
IKATYNRTL

SEQ ID NO: 833448 - protein, 9 aa, Homo Sapiens
PAFSLMGLS

SEQ ID NO: 833449 - protein, 9 aa, Homo Sapiens
EKARKGYGM

SEQ ID NO: 833450 - protein, 9 aa, Homo Sapiens
YKSHKREAV

SEQ ID NO: 833451 - protein, 9 aa, Homo Sapiens
EEEDPPAKS

SEQ ID NO: 833452 - protein, 9 aa, Homo Sapiens
LSAHQNTPL

SEQ ID NO: 833453 - protein, 9 aa, Homo Sapiens
IIKSQERET

SEQ ID NO: 833454 - protein, 9 aa, Homo Sapiens
ALLGNEAVD

SEQ ID NO: 833455 - protein, 9 aa, Homo Sapiens
SQLQEHQII

SEQ ID NO: 833456 - protein, 9 aa, Homo Sapiens
PLNLCTKAI

SEQ ID NO: 833457 - protein, 9 aa, Homo Sapiens
GPVWPAKED

SEQ ID NO: 833458 - protein, 9 aa, Homo Sapiens
NIGDYNMDG

SEQ ID NO: 833459 - protein, 9 aa, Homo Sapiens
TLDVSSKSR

SEQ ID NO: 833460 - protein, 9 aa, Homo Sapiens
YCNKCEFLV

SEQ ID NO: 833461 - protein, 9 aa, Homo Sapiens
SSISICTGI

SEQ ID NO: 833462 - protein, 9 aa, Homo Sapiens
PRPSPSAAY

SEQ ID NO: 833463 - protein, 9 aa, Homo Sapiens
INCSISDNK

SEQ ID NO: 833464 - protein, 9 aa, Homo Sapiens
SNSFYGSSY

SEQ ID NO: 833465 - protein, 9 aa, Homo Sapiens
SDAPKMHTL

SEQ ID NO: 833466 - protein, 9 aa, Homo Sapiens
MNRADEVEA

SEQ ID NO: 833467 - protein, 9 aa, Homo Sapiens
SSTGISYLI

SEQ ID NO: 833468 - protein, 9 aa, Homo Sapiens
TGDNFRKNL

SEQ ID NO: 833469 - protein, 9 aa, Homo Sapiens
KSKSSQLST

SEQ ID NO: 833470 - protein, 9 aa, Homo Sapiens
SAITYHGSI

SEQ ID NO: 833471 - protein, 9 aa, Homo Sapiens
GRGRAWLCL
